United States Patent 11,492,591 (UNIVERSAL DONOR STEM CELLS AND RELATED METHODS) - sequence listing, part 5

SEQ ID NO: 130139 - DNA, 20 bp, Artificial
  CRISPR gRNA sequence
ggggtggggagggcaggcgg

SEQ ID NO: 130140 - DNA, 20 bp, Artificial
  CRISPR gRNA sequence
ggaagaataacagaaattct

SEQ ID NO: 130141 - DNA, 20 bp, Artificial
  CRISPR gRNA sequence
tttcctgaatgagtgtttac

SEQ ID NO: 130142 - DNA, 20 bp, Artificial
  CRISPR gRNA sequence
tcctgaatgagtgtttacat

SEQ ID NO: 130143 - DNA, 20 bp, Artificial
  CRISPR gRNA sequence
cctgaatgagtgtttacatg

SEQ ID NO: 130144 - DNA, 20 bp, Artificial
  CRISPR gRNA sequence
ctgaatgagtgtttacatga

SEQ ID NO: 130145 - DNA, 20 bp, Artificial
  CRISPR gRNA sequence
aatgagtgtttacatgatac

SEQ ID NO: 130146 - DNA, 20 bp, Artificial
  CRISPR gRNA sequence
acatgataccattaagtctt

SEQ ID NO: 130147 - DNA, 20 bp, Artificial
  CRISPR gRNA sequence
catgataccattaagtcttt

SEQ ID NO: 130148 - DNA, 20 bp, Artificial
  CRISPR gRNA sequence
agtcttttaaaattggctat

SEQ ID NO: 130149 - DNA, 20 bp, Artificial
  CRISPR gRNA sequence
ttaaaattggctatgagcaa

SEQ ID NO: 130150 - DNA, 20 bp, Artificial
  CRISPR gRNA sequence
taaaattggctatgagcaag

SEQ ID NO: 130151 - DNA, 20 bp, Artificial
  CRISPR gRNA sequence
aaaattggctatgagcaaga

SEQ ID NO: 130152 - DNA, 20 bp, Artificial
  CRISPR gRNA sequence
aaattggctatgagcaagac

SEQ ID NO: 130153 - DNA, 20 bp, Artificial
  CRISPR gRNA sequence
gctatgagcaagacactgtt

SEQ ID NO: 130154 - DNA, 20 bp, Artificial
  CRISPR gRNA sequence
tgagcaagacactgttcaaa

SEQ ID NO: 130155 - DNA, 20 bp, Artificial
  CRISPR gRNA sequence
ttcaaataaccaggcggatc

SEQ ID NO: 130156 - DNA, 20 bp, Artificial
  CRISPR gRNA sequence
aaataaccaggcggatctgg

SEQ ID NO: 130157 - DNA, 20 bp, Artificial
  CRISPR gRNA sequence
ggagatgaattaatttagaa

SEQ ID NO: 130158 - DNA, 20 bp, Artificial
  CRISPR gRNA sequence
atttagaaatataacacaaa

SEQ ID NO: 130159 - DNA, 20 bp, Artificial
  CRISPR gRNA sequence
agaaatataacacaaacaaa

SEQ ID NO: 130160 - DNA, 20 bp, Artificial
  CRISPR gRNA sequence
gaaatataacacaaacaaaa

SEQ ID NO: 130161 - DNA, 20 bp, Artificial
  CRISPR gRNA sequence
aaggaaaaaagtttaaatca

SEQ ID NO: 130162 - DNA, 20 bp, Artificial
  CRISPR gRNA sequence
aaatcatattatcttgtcat

SEQ ID NO: 130163 - DNA, 20 bp, Artificial
  CRISPR gRNA sequence
aatcatattatcttgtcatg

SEQ ID NO: 130164 - DNA, 20 bp, Artificial
  CRISPR gRNA sequence
tcttgtcatgcactggaatt

SEQ ID NO: 130165 - DNA, 20 bp, Artificial
  CRISPR gRNA sequence
gtcatgcactggaattagca

SEQ ID NO: 130166 - DNA, 20 bp, Artificial
  CRISPR gRNA sequence
tcatgcactggaattagcaa

SEQ ID NO: 130167 - DNA, 20 bp, Artificial
  CRISPR gRNA sequence
gaattagcaacatgattatc

SEQ ID NO: 130168 - DNA, 20 bp, Artificial
  CRISPR gRNA sequence
gcaacatgattatcatttgg

SEQ ID NO: 130169 - DNA, 20 bp, Artificial
  CRISPR gRNA sequence
tcatttggactaacagcatt

SEQ ID NO: 130170 - DNA, 20 bp, Artificial
  CRISPR gRNA sequence
ggactaacagcattagcctc

SEQ ID NO: 130171 - DNA, 20 bp, Artificial
  CRISPR gRNA sequence
gactaacagcattagcctcg

SEQ ID NO: 130172 - DNA, 20 bp, Artificial
  CRISPR gRNA sequence
acagcattagcctcgctaaa

SEQ ID NO: 130173 - DNA, 20 bp, Artificial
  CRISPR gRNA sequence
gcctcgctaaacctcagtct

SEQ ID NO: 130174 - DNA, 20 bp, Artificial
  CRISPR gRNA sequence
gctaaacctcagtcttctaa

SEQ ID NO: 130175 - DNA, 20 bp, Artificial
  CRISPR gRNA sequence
aacctcagtcttctaaaagt

SEQ ID NO: 130176 - DNA, 20 bp, Artificial
  CRISPR gRNA sequence
agtcttctaaaagtgaagat

SEQ ID NO: 130177 - DNA, 20 bp, Artificial
  CRISPR gRNA sequence
ctaaaagtgaagataaaagt

SEQ ID NO: 130178 - DNA, 20 bp, Artificial
  CRISPR gRNA sequence
taaaagtgaagataaaagta

SEQ ID NO: 130179 - DNA, 20 bp, Artificial
  CRISPR gRNA sequence
aaagtgaagataaaagtatt

SEQ ID NO: 130180 - DNA, 20 bp, Artificial
  CRISPR gRNA sequence
cctagagttgtcagaattaa

SEQ ID NO: 130181 - DNA, 20 bp, Artificial
  CRISPR gRNA sequence
ctagagttgtcagaattaaa

SEQ ID NO: 130182 - DNA, 20 bp, Artificial
  CRISPR gRNA sequence
gagttgtcagaattaaataa

SEQ ID NO: 130183 - DNA, 20 bp, Artificial
  CRISPR gRNA sequence
tcagaattaaataaagacta

SEQ ID NO: 130184 - DNA, 20 bp, Artificial
  CRISPR gRNA sequence
aataaagactagaaagctgc

SEQ ID NO: 130185 - DNA, 20 bp, Artificial
  CRISPR gRNA sequence
gaaagctgctaaagacagtg

SEQ ID NO: 130186 - DNA, 20 bp, Artificial
  CRISPR gRNA sequence
ctaaagacagtgtttggcac

SEQ ID NO: 130187 - DNA, 20 bp, Artificial
  CRISPR gRNA sequence
aagacagtgtttggcacgta

SEQ ID NO: 130188 - DNA, 20 bp, Artificial
  CRISPR gRNA sequence
ggcacgtagtgtaccccaca

SEQ ID NO: 130189 - DNA, 20 bp, Artificial
  CRISPR gRNA sequence
gcacgtagtgtaccccacag

SEQ ID NO: 130190 - DNA, 20 bp, Artificial
  CRISPR gRNA sequence
gatctcatcctccctccttt

SEQ ID NO: 130191 - DNA, 20 bp, Artificial
  CRISPR gRNA sequence
atcctccctcctttgaagag

SEQ ID NO: 130192 - DNA, 20 bp, Artificial
  CRISPR gRNA sequence
cctcctttgaagagaagccg

SEQ ID NO: 130193 - DNA, 20 bp, Artificial
  CRISPR gRNA sequence
ctttgaagagaagccgcaca

SEQ ID NO: 130194 - DNA, 20 bp, Artificial
  CRISPR gRNA sequence
tgaagagaagccgcacatca

SEQ ID NO: 130195 - DNA, 20 bp, Artificial
  CRISPR gRNA sequence
gaagagaagccgcacatcat

SEQ ID NO: 130196 - DNA, 20 bp, Artificial
  CRISPR gRNA sequence
aagagaagccgcacatcatc

SEQ ID NO: 130197 - DNA, 20 bp, Artificial
  CRISPR gRNA sequence
cttaactgtatgtgtcttca

SEQ ID NO: 130198 - DNA, 20 bp, Artificial
  CRISPR gRNA sequence
aactgtatgtgtcttcagtt

SEQ ID NO: 130199 - DNA, 20 bp, Artificial
  CRISPR gRNA sequence
actgtatgtgtcttcagttc

SEQ ID NO: 130200 - DNA, 20 bp, Artificial
  CRISPR gRNA sequence
tatgtgtcttcagttctgca

SEQ ID NO: 130201 - DNA, 20 bp, Artificial
  CRISPR gRNA sequence
cagttctgcaagttttagct

SEQ ID NO: 130202 - DNA, 20 bp, Artificial
  CRISPR gRNA sequence
agttctgcaagttttagctt

SEQ ID NO: 130203 - DNA, 20 bp, Artificial
  CRISPR gRNA sequence
tgcaagttttagctttctat

SEQ ID NO: 130204 - DNA, 20 bp, Artificial
  CRISPR gRNA sequence
caagttttagctttctatca

SEQ ID NO: 130205 - DNA, 20 bp, Artificial
  CRISPR gRNA sequence
tagctttctatcatttcacg

SEQ ID NO: 130206 - DNA, 20 bp, Artificial
  CRISPR gRNA sequence
agctttctatcatttcacgc

SEQ ID NO: 130207 - DNA, 20 bp, Artificial
  CRISPR gRNA sequence
gctttctatcatttcacgcc

SEQ ID NO: 130208 - DNA, 20 bp, Artificial
  CRISPR gRNA sequence
tctatcatttcacgccttct

SEQ ID NO: 130209 - DNA, 20 bp, Artificial
  CRISPR gRNA sequence
ctatcatttcacgccttctg

SEQ ID NO: 130210 - DNA, 20 bp, Artificial
  CRISPR gRNA sequence
tatcatttcacgccttctgt

SEQ ID NO: 130211 - DNA, 20 bp, Artificial
  CRISPR gRNA sequence
tcatttcacgccttctgtct

SEQ ID NO: 130212 - DNA, 20 bp, Artificial
  CRISPR gRNA sequence
cacgccttctgtcttccttt

SEQ ID NO: 130213 - DNA, 20 bp, Artificial
  CRISPR gRNA sequence
acgccttctgtcttcctttc

SEQ ID NO: 130214 - DNA, 20 bp, Artificial
  CRISPR gRNA sequence
ctgtcttcctttcctctgtc

SEQ ID NO: 130215 - DNA, 20 bp, Artificial
  CRISPR gRNA sequence
tgtcttcctttcctctgtct

SEQ ID NO: 130216 - DNA, 20 bp, Artificial
  CRISPR gRNA sequence
tcttcctttcctctgtcttt

SEQ ID NO: 130217 - DNA, 20 bp, Artificial
  CRISPR gRNA sequence
cctttcctctgtctttctac

SEQ ID NO: 130218 - DNA, 20 bp, Artificial
  CRISPR gRNA sequence
ctttcctctgtctttctacc

SEQ ID NO: 130219 - DNA, 20 bp, Artificial
  CRISPR gRNA sequence
tcctctgtctttctaccatt

SEQ ID NO: 130220 - DNA, 20 bp, Artificial
  CRISPR gRNA sequence
cctctgtctttctaccatta

SEQ ID NO: 130221 - DNA, 20 bp, Artificial
  CRISPR gRNA sequence
ctctgtctttctaccattaa

SEQ ID NO: 130222 - DNA, 20 bp, Artificial
  CRISPR gRNA sequence
tgtctttctaccattaaaat

SEQ ID NO: 130223 - DNA, 20 bp, Artificial
  CRISPR gRNA sequence
tctttctaccattaaaatcc

SEQ ID NO: 130224 - DNA, 20 bp, Artificial
  CRISPR gRNA sequence
tctaccattaaaatcctgcc

SEQ ID NO: 130225 - DNA, 20 bp, Artificial
  CRISPR gRNA sequence
ctaccattaaaatcctgccc

SEQ ID NO: 130226 - DNA, 20 bp, Artificial
  CRISPR gRNA sequence
taccattaaaatcctgcccc

SEQ ID NO: 130227 - DNA, 20 bp, Artificial
  CRISPR gRNA sequence
ccattaaaatcctgccccag

SEQ ID NO: 130228 - DNA, 20 bp, Artificial
  CRISPR gRNA sequence
aaatcctgccccagacttta

SEQ ID NO: 130229 - DNA, 20 bp, Artificial
  CRISPR gRNA sequence
ccccagactttaatcccagt

SEQ ID NO: 130230 - DNA, 20 bp, Artificial
  CRISPR gRNA sequence
taatcccagtgttctctatc

SEQ ID NO: 130231 - DNA, 20 bp, Artificial
  CRISPR gRNA sequence
aatcccagtgttctctatcc

SEQ ID NO: 130232 - DNA, 20 bp, Artificial
  CRISPR gRNA sequence
atcccagtgttctctatcct

SEQ ID NO: 130233 - DNA, 20 bp, Artificial
  CRISPR gRNA sequence
tctatcctcctttaatcttt

SEQ ID NO: 130234 - DNA, 20 bp, Artificial
  CRISPR gRNA sequence
tatcctcctttaatctttct

SEQ ID NO: 130235 - DNA, 20 bp, Artificial
  CRISPR gRNA sequence
tcctcctttaatctttctga

SEQ ID NO: 130236 - DNA, 20 bp, Artificial
  CRISPR gRNA sequence
ctttaatctttctgatttat

SEQ ID NO: 130237 - DNA, 20 bp, Artificial
  CRISPR gRNA sequence
taatctttctgatttatcct

SEQ ID NO: 130238 - DNA, 20 bp, Artificial
  CRISPR gRNA sequence
aatctttctgatttatcctt

SEQ ID NO: 130239 - DNA, 20 bp, Artificial
  CRISPR gRNA sequence
atctttctgatttatccttt

SEQ ID NO: 130240 - DNA, 20 bp, Artificial
  CRISPR gRNA sequence
tctgatttatcctttctgca

SEQ ID NO: 130241 - DNA, 20 bp, Artificial
  CRISPR gRNA sequence
ctgatttatcctttctgcaa

SEQ ID NO: 130242 - DNA, 20 bp, Artificial
  CRISPR gRNA sequence
tgatttatcctttctgcaat

SEQ ID NO: 130243 - DNA, 20 bp, Artificial
  CRISPR gRNA sequence
atttatcctttctgcaattc

SEQ ID NO: 130244 - DNA, 20 bp, Artificial
  CRISPR gRNA sequence
atcctttctgcaattcaaaa

SEQ ID NO: 130245 - DNA, 20 bp, Artificial
  CRISPR gRNA sequence
tcctttctgcaattcaaaaa

SEQ ID NO: 130246 - DNA, 20 bp, Artificial
  CRISPR gRNA sequence
tctgcaattcaaaaacaaat

SEQ ID NO: 130247 - DNA, 20 bp, Artificial
  CRISPR gRNA sequence
ctgcaattcaaaaacaaatg

SEQ ID NO: 130248 - DNA, 20 bp, Artificial
  CRISPR gRNA sequence
tgcaattcaaaaacaaatgt

SEQ ID NO: 130249 - DNA, 20 bp, Artificial
  CRISPR gRNA sequence
caattcaaaaacaaatgttc

SEQ ID NO: 130250 - DNA, 20 bp, Artificial
  CRISPR gRNA sequence
aaaaacaaatgttctgttct

SEQ ID NO: 130251 - DNA, 20 bp, Artificial
  CRISPR gRNA sequence
tgttctttaaagctctatgg

SEQ ID NO: 130252 - DNA, 20 bp, Artificial
  CRISPR gRNA sequence
ttctttaaagctctatggca

SEQ ID NO: 130253 - DNA, 20 bp, Artificial
  CRISPR gRNA sequence
tttaaagctctatggcactt

SEQ ID NO: 130254 - DNA, 20 bp, Artificial
  CRISPR gRNA sequence
taaagctctatggcacttag

SEQ ID NO: 130255 - DNA, 20 bp, Artificial
  CRISPR gRNA sequence
aaagctctatggcacttagt

SEQ ID NO: 130256 - DNA, 20 bp, Artificial
  CRISPR gRNA sequence
aagctctatggcacttagta

SEQ ID NO: 130257 - DNA, 20 bp, Artificial
  CRISPR gRNA sequence
tatggcacttagtacctttc

SEQ ID NO: 130258 - DNA, 20 bp, Artificial
  CRISPR gRNA sequence
tggcacttagtacctttcac

SEQ ID NO: 130259 - DNA, 20 bp, Artificial
  CRISPR gRNA sequence
agtacctttcactcaataag

SEQ ID NO: 130260 - DNA, 20 bp, Artificial
  CRISPR gRNA sequence
gtacctttcactcaataagt

SEQ ID NO: 130261 - DNA, 20 bp, Artificial
  CRISPR gRNA sequence
tcactcaataagtcaaccta

SEQ ID NO: 130262 - DNA, 20 bp, Artificial
  CRISPR gRNA sequence
cactcaataagtcaacctaa

SEQ ID NO: 130263 - DNA, 20 bp, Artificial
  CRISPR gRNA sequence
actcaataagtcaacctaat

SEQ ID NO: 130264 - DNA, 20 bp, Artificial
  CRISPR gRNA sequence
aataagtcaacctaatcttt

SEQ ID NO: 130265 - DNA, 20 bp, Artificial
  CRISPR gRNA sequence
atctttgatgcttagaatat

SEQ ID NO: 130266 - DNA, 20 bp, Artificial
  CRISPR gRNA sequence
tgatgcttagaatatgccag

SEQ ID NO: 130267 - DNA, 20 bp, Artificial
  CRISPR gRNA sequence
gatgcttagaatatgccagc

SEQ ID NO: 130268 - DNA, 20 bp, Artificial
  CRISPR gRNA sequence
atgcttagaatatgccagcc

SEQ ID NO: 130269 - DNA, 20 bp, Artificial
  CRISPR gRNA sequence
agaatatgccagccattcgc

SEQ ID NO: 130270 - DNA, 20 bp, Artificial
  CRISPR gRNA sequence
gaatatgccagccattcgcc

SEQ ID NO: 130271 - DNA, 20 bp, Artificial
  CRISPR gRNA sequence
gcctatatataagaatgatg

SEQ ID NO: 130272 - DNA, 20 bp, Artificial
  CRISPR gRNA sequence
tatataagaatgatggaaaa

SEQ ID NO: 130273 - DNA, 20 bp, Artificial
  CRISPR gRNA sequence
gctagatgcatcccaaaggt

SEQ ID NO: 130274 - DNA, 20 bp, Artificial
  CRISPR gRNA sequence
ctagatgcatcccaaaggtt

SEQ ID NO: 130275 - DNA, 20 bp, Artificial
  CRISPR gRNA sequence
gatgcatcccaaaggttttt

SEQ ID NO: 130276 - DNA, 20 bp, Artificial
  CRISPR gRNA sequence
tttctaggtctaaaacatcc

SEQ ID NO: 130277 - DNA, 20 bp, Artificial
  CRISPR gRNA sequence
ttctaggtctaaaacatcct

SEQ ID NO: 130278 - DNA, 20 bp, Artificial
  CRISPR gRNA sequence
tctaggtctaaaacatccta

SEQ ID NO: 130279 - DNA, 20 bp, Artificial
  CRISPR gRNA sequence
ctaggtctaaaacatcctat

SEQ ID NO: 130280 - DNA, 20 bp, Artificial
  CRISPR gRNA sequence
taggtctaaaacatcctata

SEQ ID NO: 130281 - DNA, 20 bp, Artificial
  CRISPR gRNA sequence
ggtctaaaacatcctataaa

SEQ ID NO: 130282 - DNA, 20 bp, Artificial
  CRISPR gRNA sequence
aaacatcctataaaaactta

SEQ ID NO: 130283 - DNA, 20 bp, Artificial
  CRISPR gRNA sequence
taaaaacttataaaacagac

SEQ ID NO: 130284 - DNA, 20 bp, Artificial
  CRISPR gRNA sequence
ataaaacagactgtagattg

SEQ ID NO: 130285 - DNA, 20 bp, Artificial
  CRISPR gRNA sequence
taaaacagactgtagattgt

SEQ ID NO: 130286 - DNA, 20 bp, Artificial
  CRISPR gRNA sequence
tagattgtcagtaagccagc

SEQ ID NO: 130287 - DNA, 20 bp, Artificial
  CRISPR gRNA sequence
tcagtaagccagccaacaaa

SEQ ID NO: 130288 - DNA, 20 bp, Artificial
  CRISPR gRNA sequence
actgagtgagcgcttagtat

SEQ ID NO: 130289 - DNA, 20 bp, Artificial
  CRISPR gRNA sequence
ctgagtgagcgcttagtatt

SEQ ID NO: 130290 - DNA, 20 bp, Artificial
  CRISPR gRNA sequence
agtgagcgcttagtatttac

SEQ ID NO: 130291 - DNA, 20 bp, Artificial
  CRISPR gRNA sequence
agtatttaccaggttcatgc

SEQ ID NO: 130292 - DNA, 20 bp, Artificial
  CRISPR gRNA sequence
gtatttaccaggttcatgct

SEQ ID NO: 130293 - DNA, 20 bp, Artificial
  CRISPR gRNA sequence
accaggttcatgctatgtgc

SEQ ID NO: 130294 - DNA, 20 bp, Artificial
  CRISPR gRNA sequence
ccaggttcatgctatgtgct

SEQ ID NO: 130295 - DNA, 20 bp, Artificial
  CRISPR gRNA sequence
atgctatgtgctggtcacgt

SEQ ID NO: 130296 - DNA, 20 bp, Artificial
  CRISPR gRNA sequence
tgtgctggtcacgtagctgt

SEQ ID NO: 130297 - DNA, 20 bp, Artificial
  CRISPR gRNA sequence
gtcacgtagctgtcaacaac

SEQ ID NO: 130298 - DNA, 20 bp, Artificial
  CRISPR gRNA sequence
tcaacaacagacaaggtctc

SEQ ID NO: 130299 - DNA, 20 bp, Artificial
  CRISPR gRNA sequence
tgtcctcagcttgcaggaca

SEQ ID NO: 130300 - DNA, 20 bp, Artificial
  CRISPR gRNA sequence
tcctcagcttgcaggacaaa

SEQ ID NO: 130301 - DNA, 20 bp, Artificial
  CRISPR gRNA sequence
agcttgcaggacaaatgtta

SEQ ID NO: 130302 - DNA, 20 bp, Artificial
  CRISPR gRNA sequence
gcaggacaaatgttacataa

SEQ ID NO: 130303 - DNA, 20 bp, Artificial
  CRISPR gRNA sequence
caggacaaatgttacataac

SEQ ID NO: 130304 - DNA, 20 bp, Artificial
  CRISPR gRNA sequence
cataacctgggaggcagggt

SEQ ID NO: 130305 - DNA, 20 bp, Artificial
  CRISPR gRNA sequence
ggaggcagggtgaaggggta

SEQ ID NO: 130306 - DNA, 20 bp, Artificial
  CRISPR gRNA sequence
ttagtccttccaggacacag

SEQ ID NO: 130307 - DNA, 20 bp, Artificial
  CRISPR gRNA sequence
gtccttccaggacacaggct

SEQ ID NO: 130308 - DNA, 20 bp, Artificial
  CRISPR gRNA sequence
ccaggacacaggctctggaa

SEQ ID NO: 130309 - DNA, 20 bp, Artificial
  CRISPR gRNA sequence
caggacacaggctctggaat

SEQ ID NO: 130310 - DNA, 20 bp, Artificial
  CRISPR gRNA sequence
tggaatcgaatcacctagtt

SEQ ID NO: 130311 - DNA, 20 bp, Artificial
  CRISPR gRNA sequence
gaatcgaatcacctagtttg

SEQ ID NO: 130312 - DNA, 20 bp, Artificial
  CRISPR gRNA sequence
gtttgaattccctgccactt

SEQ ID NO: 130313 - DNA, 20 bp, Artificial
  CRISPR gRNA sequence
gaattccctgccacttacca

SEQ ID NO: 130314 - DNA, 20 bp, Artificial
  CRISPR gRNA sequence
aattccctgccacttaccat

SEQ ID NO: 130315 - DNA, 20 bp, Artificial
  CRISPR gRNA sequence
cctgccacttaccatgagac

SEQ ID NO: 130316 - DNA, 20 bp, Artificial
  CRISPR gRNA sequence
ccacttaccatgagaccgtg

SEQ ID NO: 130317 - DNA, 20 bp, Artificial
  CRISPR gRNA sequence
accatgagaccgtgaacaaa

SEQ ID NO: 130318 - DNA, 20 bp, Artificial
  CRISPR gRNA sequence
ccatgagaccgtgaacaaac

SEQ ID NO: 130319 - DNA, 20 bp, Artificial
  CRISPR gRNA sequence
gatgagaacaagacttaacc

SEQ ID NO: 130320 - DNA, 20 bp, Artificial
  CRISPR gRNA sequence
aacctcccaggctcctgtac

SEQ ID NO: 130321 - DNA, 20 bp, Artificial
  CRISPR gRNA sequence
acctcccaggctcctgtaca

SEQ ID NO: 130322 - DNA, 20 bp, Artificial
  CRISPR gRNA sequence
ccaggctcctgtacaggtta

SEQ ID NO: 130323 - DNA, 20 bp, Artificial
  CRISPR gRNA sequence
ctgtacaggttaggagctaa

SEQ ID NO: 130324 - DNA, 20 bp, Artificial
  CRISPR gRNA sequence
tacaggttaggagctaatcc

SEQ ID NO: 130325 - DNA, 20 bp, Artificial
  CRISPR gRNA sequence
ggagctaatccatgtaaaga

SEQ ID NO: 130326 - DNA, 20 bp, Artificial
  CRISPR gRNA sequence
atccatgtaaagacagcata

SEQ ID NO: 130327 - DNA, 20 bp, Artificial
  CRISPR gRNA sequence
agtaagtggtatatatagct

SEQ ID NO: 130328 - DNA, 20 bp, Artificial
  CRISPR gRNA sequence
ttaaaataattacaaataat

SEQ ID NO: 130329 - DNA, 20 bp, Artificial
  CRISPR gRNA sequence
aaataattacaaataattaa

SEQ ID NO: 130330 - DNA, 20 bp, Artificial
  CRISPR gRNA sequence
caaataattaagtaattgct

SEQ ID NO: 130331 - DNA, 20 bp, Artificial
  CRISPR gRNA sequence
agtaattgctagtgccaagt

SEQ ID NO: 130332 - DNA, 20 bp, Artificial
  CRISPR gRNA sequence
ctagtgccaagtacgaagaa

SEQ ID NO: 130333 - DNA, 20 bp, Artificial
  CRISPR gRNA sequence
gtgccaagtacgaagaaaaa

SEQ ID NO: 130334 - DNA, 20 bp, Artificial
  CRISPR gRNA sequence
tgttatgtgctatgtgagtt

SEQ ID NO: 130335 - DNA, 20 bp, Artificial
  CRISPR gRNA sequence
gttatgtgctatgtgagttt

SEQ ID NO: 130336 - DNA, 20 bp, Artificial
  CRISPR gRNA sequence
ttatgtgctatgtgagttta

SEQ ID NO: 130337 - DNA, 20 bp, Artificial
  CRISPR gRNA sequence
tgtgctatgtgagtttactc

SEQ ID NO: 130338 - DNA, 20 bp, Artificial
  CRISPR gRNA sequence
tgtgagtttactccaaaagg

SEQ ID NO: 130339 - DNA, 20 bp, Artificial
  CRISPR gRNA sequence
actccaaaagggacctcact

SEQ ID NO: 130340 - DNA, 20 bp, Artificial
  CRISPR gRNA sequence
ctccaaaagggacctcacta

SEQ ID NO: 130341 - DNA, 20 bp, Artificial
  CRISPR gRNA sequence
caaaagggacctcactagtc

SEQ ID NO: 130342 - DNA, 20 bp, Artificial
  CRISPR gRNA sequence
actagtctgaggggtcaaga

SEQ ID NO: 130343 - DNA, 20 bp, Artificial
  CRISPR gRNA sequence
gtctgaggggtcaagaaagg

SEQ ID NO: 130344 - DNA, 20 bp, Artificial
  CRISPR gRNA sequence
aggggtcaagaaaggctatc

SEQ ID NO: 130345 - DNA, 20 bp, Artificial
  CRISPR gRNA sequence
tcttaggaaatgacattgaa

SEQ ID NO: 130346 - DNA, 20 bp, Artificial
  CRISPR gRNA sequence
aggaaatgacattgaaaatg

SEQ ID NO: 130347 - DNA, 20 bp, Artificial
  CRISPR gRNA sequence
ggaaatgacattgaaaatga

SEQ ID NO: 130348 - DNA, 20 bp, Artificial
  CRISPR gRNA sequence
aaaatgagactgacagataa

SEQ ID NO: 130349 - DNA, 20 bp, Artificial
  CRISPR gRNA sequence
acagataaacagaaatcagt

SEQ ID NO: 130350 - DNA, 20 bp, Artificial
  CRISPR gRNA sequence
taggcagagaaaaccaagaa

SEQ ID NO: 130351 - DNA, 20 bp, Artificial
  CRISPR gRNA sequence
ggcagagaaaaccaagaaat

SEQ ID NO: 130352 - DNA, 20 bp, Artificial
  CRISPR gRNA sequence
gtggattggaaggcgctaag

SEQ ID NO: 130353 - DNA, 20 bp, Artificial
  CRISPR gRNA sequence
gaaggcgctaaggaggggct

SEQ ID NO: 130354 - DNA, 20 bp, Artificial
  CRISPR gRNA sequence
aggaggggctagatcaagca

SEQ ID NO: 130355 - DNA, 20 bp, Artificial
  CRISPR gRNA sequence
gatcaagcagtgtccggtgg

SEQ ID NO: 130356 - DNA, 20 bp, Artificial
  CRISPR gRNA sequence
taagcagaagagcacaaatc

SEQ ID NO: 130357 - DNA, 20 bp, Artificial
  CRISPR gRNA sequence
aagcagaagagcacaaatca

SEQ ID NO: 130358 - DNA, 20 bp, Artificial
  CRISPR gRNA sequence
agcagaagagcacaaatcac

SEQ ID NO: 130359 - DNA, 20 bp, Artificial
  CRISPR gRNA sequence
aaaaaaaaaatccctctggc

SEQ ID NO: 130360 - DNA, 20 bp, Artificial
  CRISPR gRNA sequence
tggctacagttcagtacaga

SEQ ID NO: 130361 - DNA, 20 bp, Artificial
  CRISPR gRNA sequence
gctacagttcagtacagaaa

SEQ ID NO: 130362 - DNA, 20 bp, Artificial
  CRISPR gRNA sequence
cagttcagtacagaaaccga

SEQ ID NO: 130363 - DNA, 20 bp, Artificial
  CRISPR gRNA sequence
agtacagaaaccgacctgga

SEQ ID NO: 130364 - DNA, 20 bp, Artificial
  CRISPR gRNA sequence
gaggggagcacaaataggca

SEQ ID NO: 130365 - DNA, 20 bp, Artificial
  CRISPR gRNA sequence
caatgctgcagtcagggcat

SEQ ID NO: 130366 - DNA, 20 bp, Artificial
  CRISPR gRNA sequence
cagtcagggcatgacttcaa

SEQ ID NO: 130367 - DNA, 20 bp, Artificial
  CRISPR gRNA sequence
caagcaagataatgatcatt

SEQ ID NO: 130368 - DNA, 20 bp, Artificial
  CRISPR gRNA sequence
aagcaagataatgatcattt

SEQ ID NO: 130369 - DNA, 20 bp, Artificial
  CRISPR gRNA sequence
tagcatcaggtctgggtgag

SEQ ID NO: 130370 - DNA, 20 bp, Artificial
  CRISPR gRNA sequence
agcatcaggtctgggtgaga

SEQ ID NO: 130371 - DNA, 20 bp, Artificial
  CRISPR gRNA sequence
gcatcaggtctgggtgagag

SEQ ID NO: 130372 - DNA, 20 bp, Artificial
  CRISPR gRNA sequence
ggtgagagcgctggagatca

SEQ ID NO: 130373 - DNA, 20 bp, Artificial
  CRISPR gRNA sequence
gagatcaagagaagcagaac

SEQ ID NO: 130374 - DNA, 20 bp, Artificial
  CRISPR gRNA sequence
gacagctttttagtaggtga

SEQ ID NO: 130375 - DNA, 20 bp, Artificial
  CRISPR gRNA sequence
tttagtaggtgacttggtga

SEQ ID NO: 130376 - DNA, 20 bp, Artificial
  CRISPR gRNA sequence
ttagtaggtgacttggtgac

SEQ ID NO: 130377 - DNA, 20 bp, Artificial
  CRISPR gRNA sequence
tagtaggtgacttggtgact

SEQ ID NO: 130378 - DNA, 20 bp, Artificial
  CRISPR gRNA sequence
agtaggtgacttggtgactg

SEQ ID NO: 130379 - DNA, 20 bp, Artificial
  CRISPR gRNA sequence
gtaggtgacttggtgactga

SEQ ID NO: 130380 - DNA, 20 bp, Artificial
  CRISPR gRNA sequence
ggtgactgactgatagagat

SEQ ID NO: 130381 - DNA, 20 bp, Artificial
  CRISPR gRNA sequence
gtgactgactgatagagata

SEQ ID NO: 130382 - DNA, 20 bp, Artificial
  CRISPR gRNA sequence
actgatagagatacaggaag

SEQ ID NO: 130383 - DNA, 20 bp, Artificial
  CRISPR gRNA sequence
atagagatacaggaagacca

SEQ ID NO: 130384 - DNA, 20 bp, Artificial
  CRISPR gRNA sequence
ggattcttgcagctggagag

SEQ ID NO: 130385 - DNA, 20 bp, Artificial
  CRISPR gRNA sequence
ttgcagctggagagacagac

SEQ ID NO: 130386 - DNA, 20 bp, Artificial
  CRISPR gRNA sequence
gcagctggagagacagacag

SEQ ID NO: 130387 - DNA, 20 bp, Artificial
  CRISPR gRNA sequence
cagctggagagacagacagc

SEQ ID NO: 130388 - DNA, 20 bp, Artificial
  CRISPR gRNA sequence
gagagacagacagctgtcac

SEQ ID NO: 130389 - DNA, 20 bp, Artificial
  CRISPR gRNA sequence
tcaccgcagagaatgggaaa

SEQ ID NO: 130390 - DNA, 20 bp, Artificial
  CRISPR gRNA sequence
gacagtgtaagcctagctga

SEQ ID NO: 130391 - DNA, 20 bp, Artificial
  CRISPR gRNA sequence
gctgaagctaatgaccgtga

SEQ ID NO: 130392 - DNA, 20 bp, Artificial
  CRISPR gRNA sequence
aagctaatgaccgtgagttt

SEQ ID NO: 130393 - DNA, 20 bp, Artificial
  CRISPR gRNA sequence
atgaccgtgagtttacagtg

SEQ ID NO: 130394 - DNA, 20 bp, Artificial
  CRISPR gRNA sequence
acagtggtgccagtatgtcc

SEQ ID NO: 130395 - DNA, 20 bp, Artificial
  CRISPR gRNA sequence
cagtggtgccagtatgtcca

SEQ ID NO: 130396 - DNA, 20 bp, Artificial
  CRISPR gRNA sequence
gaaaggcctgatatgagact

SEQ ID NO: 130397 - DNA, 20 bp, Artificial
  CRISPR gRNA sequence
aaaggcctgatatgagacta

SEQ ID NO: 130398 - DNA, 20 bp, Artificial
  CRISPR gRNA sequence
atatgagactacaaaagcca

SEQ ID NO: 130399 - DNA, 20 bp, Artificial
  CRISPR gRNA sequence
caaaagccaaagtgttggat

SEQ ID NO: 130400 - DNA, 20 bp, Artificial
  CRISPR gRNA sequence
gatttcatccaggtaatgag

SEQ ID NO: 130401 - DNA, 20 bp, Artificial
  CRISPR gRNA sequence
catccaggtaatgaggctgg

SEQ ID NO: 130402 - DNA, 20 bp, Artificial
  CRISPR gRNA sequence
atccaggtaatgaggctgga

SEQ ID NO: 130403 - DNA, 20 bp, Artificial
  CRISPR gRNA sequence
gaagagcacagcatgtagga

SEQ ID NO: 130404 - DNA, 20 bp, Artificial
  CRISPR gRNA sequence
gactcaaggaactgataaat

SEQ ID NO: 130405 - DNA, 20 bp, Artificial
  CRISPR gRNA sequence
aaggaactgataaatatgga

SEQ ID NO: 130406 - DNA, 20 bp, Artificial
  CRISPR gRNA sequence
ataaatatggacaaagagtg

SEQ ID NO: 130407 - DNA, 20 bp, Artificial
  CRISPR gRNA sequence
aatcccaataaattcatttt

SEQ ID NO: 130408 - DNA, 20 bp, Artificial
  CRISPR gRNA sequence
attttaatgactattctcat

SEQ ID NO: 130409 - DNA, 20 bp, Artificial
  CRISPR gRNA sequence
taatgactattctcattatt

SEQ ID NO: 130410 - DNA, 20 bp, Artificial
  CRISPR gRNA sequence
aatgactattctcattattt

SEQ ID NO: 130411 - DNA, 20 bp, Artificial
  CRISPR gRNA sequence
atgactattctcattattta

SEQ ID NO: 130412 - DNA, 20 bp, Artificial
  CRISPR gRNA sequence
ttctcattatttagttgaat

SEQ ID NO: 130413 - DNA, 20 bp, Artificial
  CRISPR gRNA sequence
tcattatttagttgaattga

SEQ ID NO: 130414 - DNA, 20 bp, Artificial
  CRISPR gRNA sequence
attatttagttgaattgaca

SEQ ID NO: 130415 - DNA, 20 bp, Artificial
  CRISPR gRNA sequence
tttagttgaattgacagaat

SEQ ID NO: 130416 - DNA, 20 bp, Artificial
  CRISPR gRNA sequence
agttgaattgacagaattat

SEQ ID NO: 130417 - DNA, 20 bp, Artificial
  CRISPR gRNA sequence
gttgaattgacagaattatt

SEQ ID NO: 130418 - DNA, 20 bp, Artificial
  CRISPR gRNA sequence
aattgacagaattattcttg

SEQ ID NO: 130419 - DNA, 20 bp, Artificial
  CRISPR gRNA sequence
acagaattattcttgaaaat

SEQ ID NO: 130420 - DNA, 20 bp, Artificial
  CRISPR gRNA sequence
ttcttgaaaatattatttga

SEQ ID NO: 130421 - DNA, 20 bp, Artificial
  CRISPR gRNA sequence
ttgaaaatattatttgaaat

SEQ ID NO: 130422 - DNA, 20 bp, Artificial
  CRISPR gRNA sequence
gaaaatattatttgaaataa

SEQ ID NO: 130423 - DNA, 20 bp, Artificial
  CRISPR gRNA sequence
aaaatattatttgaaataaa

SEQ ID NO: 130424 - DNA, 20 bp, Artificial
  CRISPR gRNA sequence
tttgaaataaacaggtagtg

SEQ ID NO: 130425 - DNA, 20 bp, Artificial
  CRISPR gRNA sequence
gaaataaacaggtagtgggc

SEQ ID NO: 130426 - DNA, 20 bp, Artificial
  CRISPR gRNA sequence
aaataaacaggtagtgggct

SEQ ID NO: 130427 - DNA, 20 bp, Artificial
  CRISPR gRNA sequence
ataaatctttatttttttga

SEQ ID NO: 130428 - DNA, 20 bp, Artificial
  CRISPR gRNA sequence
tatttttttgatgtagccgt

SEQ ID NO: 130429 - DNA, 20 bp, Artificial
  CRISPR gRNA sequence
atttttttgatgtagccgta

SEQ ID NO: 130430 - DNA, 20 bp, Artificial
  CRISPR gRNA sequence
tttttttgatgtagccgtat

SEQ ID NO: 130431 - DNA, 20 bp, Artificial
  CRISPR gRNA sequence
ttttgatgtagccgtattta

SEQ ID NO: 130432 - DNA, 20 bp, Artificial
  CRISPR gRNA sequence
tttgatgtagccgtatttaa

SEQ ID NO: 130433 - DNA, 20 bp, Artificial
  CRISPR gRNA sequence
ttgatgtagccgtatttaaa

SEQ ID NO: 130434 - DNA, 20 bp, Artificial
  CRISPR gRNA sequence
tgatgtagccgtatttaaac

SEQ ID NO: 130435 - DNA, 20 bp, Artificial
  CRISPR gRNA sequence
gatgtagccgtatttaaact

SEQ ID NO: 130436 - DNA, 20 bp, Artificial
  CRISPR gRNA sequence
atgtagccgtatttaaacta

SEQ ID NO: 130437 - DNA, 20 bp, Artificial
  CRISPR gRNA sequence
aaactatgctaataatttgt

SEQ ID NO: 130438 - DNA, 20 bp, Artificial
  CRISPR gRNA sequence
aactatgctaataatttgtt

SEQ ID NO: 130439 - DNA, 20 bp, Artificial
  CRISPR gRNA sequence
tgctaataatttgttccaca

SEQ ID NO: 130440 - DNA, 20 bp, Artificial
  CRISPR gRNA sequence
ataatttgttccacaaacaa

SEQ ID NO: 130441 - DNA, 20 bp, Artificial
  CRISPR gRNA sequence
gttccacaaacaaatactgc

SEQ ID NO: 130442 - DNA, 20 bp, Artificial
  CRISPR gRNA sequence
ttccacaaacaaatactgcc

SEQ ID NO: 130443 - DNA, 20 bp, Artificial
  CRISPR gRNA sequence
cacaaacaaatactgccctc

SEQ ID NO: 130444 - DNA, 20 bp, Artificial
  CRISPR gRNA sequence
ccctctttaatgtttacatt

SEQ ID NO: 130445 - DNA, 20 bp, Artificial
  CRISPR gRNA sequence
tttaatgtttacatttattg

SEQ ID NO: 130446 - DNA, 20 bp, Artificial
  CRISPR gRNA sequence
taatgtttacatttattgaa

SEQ ID NO: 130447 - DNA, 20 bp, Artificial
  CRISPR gRNA sequence
aatgtttacatttattgaac

SEQ ID NO: 130448 - DNA, 20 bp, Artificial
  CRISPR gRNA sequence
atgtttacatttattgaaca

SEQ ID NO: 130449 - DNA, 20 bp, Artificial
  CRISPR gRNA sequence
acatttattgaacactttct

SEQ ID NO: 130450 - DNA, 20 bp, Artificial
  CRISPR gRNA sequence
catttattgaacactttcta

SEQ ID NO: 130451 - DNA, 20 bp, Artificial
  CRISPR gRNA sequence
attgaacactttctaaatat

SEQ ID NO: 130452 - DNA, 20 bp, Artificial
  CRISPR gRNA sequence
ttgaacactttctaaatatc

SEQ ID NO: 130453 - DNA, 20 bp, Artificial
  CRISPR gRNA sequence
aacactttctaaatatctca

SEQ ID NO: 130454 - DNA, 20 bp, Artificial
  CRISPR gRNA sequence
tctaaatatctcatgcaatg

SEQ ID NO: 130455 - DNA, 20 bp, Artificial
  CRISPR gRNA sequence
ctaaatatctcatgcaatgt

SEQ ID NO: 130456 - DNA, 20 bp, Artificial
  CRISPR gRNA sequence
taaatatctcatgcaatgtt

SEQ ID NO: 130457 - DNA, 20 bp, Artificial
  CRISPR gRNA sequence
aatatctcatgcaatgttca

SEQ ID NO: 130458 - DNA, 20 bp, Artificial
  CRISPR gRNA sequence
atgcaatgttcacaagcctg

SEQ ID NO: 130459 - DNA, 20 bp, Artificial
  CRISPR gRNA sequence
acaagcctgtgacgcaggtg

SEQ ID NO: 130460 - DNA, 20 bp, Artificial
  CRISPR gRNA sequence
tgacgcaggtgagaaaactg

SEQ ID NO: 130461 - DNA, 20 bp, Artificial
  CRISPR gRNA sequence
aggtacatgaggctaatgat

SEQ ID NO: 130462 - DNA, 20 bp, Artificial
  CRISPR gRNA sequence
atgatttgcctgaggtgaca

SEQ ID NO: 130463 - DNA, 20 bp, Artificial
  CRISPR gRNA sequence
gcctgaggtgacacagtaaa

SEQ ID NO: 130464 - DNA, 20 bp, Artificial
  CRISPR gRNA sequence
cctgaggtgacacagtaaat

SEQ ID NO: 130465 - DNA, 20 bp, Artificial
  CRISPR gRNA sequence
aggtgacacagtaaatggga

SEQ ID NO: 130466 - DNA, 20 bp, Artificial
  CRISPR gRNA sequence
aaatccagggcctcagatgc

SEQ ID NO: 130467 - DNA, 20 bp, Artificial
  CRISPR gRNA sequence
agatgccaactactctctac

SEQ ID NO: 130468 - DNA, 20 bp, Artificial
  CRISPR gRNA sequence
ctctctacagcattcctgcc

SEQ ID NO: 130469 - DNA, 20 bp, Artificial
  CRISPR gRNA sequence
tctacagcattcctgcctgg

SEQ ID NO: 130470 - DNA, 20 bp, Artificial
  CRISPR gRNA sequence
tacagcattcctgcctggta

SEQ ID NO: 130471 - DNA, 20 bp, Artificial
  CRISPR gRNA sequence
cagcattcctgcctggtagt

SEQ ID NO: 130472 - DNA, 20 bp, Artificial
  CRISPR gRNA sequence
ctgcctggtagtttttcata

SEQ ID NO: 130473 - DNA, 20 bp, Artificial
  CRISPR gRNA sequence
cctggtagtttttcatacag

SEQ ID NO: 130474 - DNA, 20 bp, Artificial
  CRISPR gRNA sequence
gtagtttttcatacagtctt

SEQ ID NO: 130475 - DNA, 20 bp, Artificial
  CRISPR gRNA sequence
ttcatacagtctttacacct

SEQ ID NO: 130476 - DNA, 20 bp, Artificial
  CRISPR gRNA sequence
tcatacagtctttacaccta

SEQ ID NO: 130477 - DNA, 20 bp, Artificial
  CRISPR gRNA sequence
catacagtctttacacctac

SEQ ID NO: 130478 - DNA, 20 bp, Artificial
  CRISPR gRNA sequence
atacagtctttacacctact

SEQ ID NO: 130479 - DNA, 20 bp, Artificial
  CRISPR gRNA sequence
tacacctacttctttaattt

SEQ ID NO: 130480 - DNA, 20 bp, Artificial
  CRISPR gRNA sequence
acacctacttctttaatttg

SEQ ID NO: 130481 - DNA, 20 bp, Artificial
  CRISPR gRNA sequence
cacctacttctttaatttgt

SEQ ID NO: 130482 - DNA, 20 bp, Artificial
  CRISPR gRNA sequence
cttctttaatttgtcccttt

SEQ ID NO: 130483 - DNA, 20 bp, Artificial
  CRISPR gRNA sequence
ctttaatttgtcccttttac

SEQ ID NO: 130484 - DNA, 20 bp, Artificial
  CRISPR gRNA sequence
tttaatttgtcccttttaca

SEQ ID NO: 130485 - DNA, 20 bp, Artificial
  CRISPR gRNA sequence
taatttgtcccttttacatt

SEQ ID NO: 130486 - DNA, 20 bp, Artificial
  CRISPR gRNA sequence
aatttgtcccttttacattc

SEQ ID NO: 130487 - DNA, 20 bp, Artificial
  CRISPR gRNA sequence
atttgtcccttttacattct

SEQ ID NO: 130488 - DNA, 20 bp, Artificial
  CRISPR gRNA sequence
gtcccttttacattctaagg

SEQ ID NO: 130489 - DNA, 20 bp, Artificial
  CRISPR gRNA sequence
tcccttttacattctaaggc

SEQ ID NO: 130490 - DNA, 20 bp, Artificial
  CRISPR gRNA sequence
ttacattctaaggctactga

SEQ ID NO: 130491 - DNA, 20 bp, Artificial
  CRISPR gRNA sequence
tacattctaaggctactgat

SEQ ID NO: 130492 - DNA, 20 bp, Artificial
  CRISPR gRNA sequence
acattctaaggctactgatt

SEQ ID NO: 130493 - DNA, 20 bp, Artificial
  CRISPR gRNA sequence
cattctaaggctactgatta

SEQ ID NO: 130494 - DNA, 20 bp, Artificial
  CRISPR gRNA sequence
taaggctactgattatacac

SEQ ID NO: 130495 - DNA, 20 bp, Artificial
  CRISPR gRNA sequence
aggctactgattatacactg

SEQ ID NO: 130496 - DNA, 20 bp, Artificial
  CRISPR gRNA sequence
ctgattatacactgaaaaca

SEQ ID NO: 130497 - DNA, 20 bp, Artificial
  CRISPR gRNA sequence
attatacactgaaaacactg

SEQ ID NO: 130498 - DNA, 20 bp, Artificial
  CRISPR gRNA sequence
tacactgaaaacactgaaat

SEQ ID NO: 130499 - DNA, 20 bp, Artificial
  CRISPR gRNA sequence
aaaacactgaaattagcttc

SEQ ID NO: 130500 - DNA, 20 bp, Artificial
  CRISPR gRNA sequence
aaattagcttctcaaaccag

SEQ ID NO: 130501 - DNA, 20 bp, Artificial
  CRISPR gRNA sequence
gcttctcaaaccaggatggt

SEQ ID NO: 130502 - DNA, 20 bp, Artificial
  CRISPR gRNA sequence
ctcaaaccaggatggtgttt

SEQ ID NO: 130503 - DNA, 20 bp, Artificial
  CRISPR gRNA sequence
tcaaaccaggatggtgtttg

SEQ ID NO: 130504 - DNA, 20 bp, Artificial
  CRISPR gRNA sequence
aaaccaggatggtgtttgtg

SEQ ID NO: 130505 - DNA, 20 bp, Artificial
  CRISPR gRNA sequence
gtgagatggttaagaagtgc

SEQ ID NO: 130506 - DNA, 20 bp, Artificial
  CRISPR gRNA sequence
tgagatggttaagaagtgca

SEQ ID NO: 130507 - DNA, 20 bp, Artificial
  CRISPR gRNA sequence
agaagtgcaccctggacgac

SEQ ID NO: 130508 - DNA, 20 bp, Artificial
  CRISPR gRNA sequence
gacgacggtgaggagcactg

SEQ ID NO: 130509 - DNA, 20 bp, Artificial
  CRISPR gRNA sequence
gctcttaggaccgatttcgt

SEQ ID NO: 130510 - DNA, 20 bp, Artificial
  CRISPR gRNA sequence
ttaggaccgatttcgtgggt

SEQ ID NO: 130511 - DNA, 20 bp, Artificial
  CRISPR gRNA sequence
aggaccgatttcgtgggttt

SEQ ID NO: 130512 - DNA, 20 bp, Artificial
  CRISPR gRNA sequence
ggaccgatttcgtgggtttg

SEQ ID NO: 130513 - DNA, 20 bp, Artificial
  CRISPR gRNA sequence
cgtgggtttgaagcttggct

SEQ ID NO: 130514 - DNA, 20 bp, Artificial
  CRISPR gRNA sequence
gtgggtttgaagcttggctc

SEQ ID NO: 130515 - DNA, 20 bp, Artificial
  CRISPR gRNA sequence
gaagcttggctccccattta

SEQ ID NO: 130516 - DNA, 20 bp, Artificial
  CRISPR gRNA sequence
aagcttggctccccatttat

SEQ ID NO: 130517 - DNA, 20 bp, Artificial
  CRISPR gRNA sequence
ggctccccatttatgagctc

SEQ ID NO: 130518 - DNA, 20 bp, Artificial
  CRISPR gRNA sequence
gctccccatttatgagctct

SEQ ID NO: 130519 - DNA, 20 bp, Artificial
  CRISPR gRNA sequence
cccatttatgagctctcttt

SEQ ID NO: 130520 - DNA, 20 bp, Artificial
  CRISPR gRNA sequence
atgagctctctttgtgtttt

SEQ ID NO: 130521 - DNA, 20 bp, Artificial
  CRISPR gRNA sequence
tgagctctctttgtgttttc

SEQ ID NO: 130522 - DNA, 20 bp, Artificial
  CRISPR gRNA sequence
tctttgtgttttcagcttcc

SEQ ID NO: 130523 - DNA, 20 bp, Artificial
  CRISPR gRNA sequence
tttgtgttttcagcttcccc

SEQ ID NO: 130524 - DNA, 20 bp, Artificial
  CRISPR gRNA sequence
tgtgttttcagcttccccat

SEQ ID NO: 130525 - DNA, 20 bp, Artificial
  CRISPR gRNA sequence
gtgttttcagcttccccatt

SEQ ID NO: 130526 - DNA, 20 bp, Artificial
  CRISPR gRNA sequence
tgttttcagcttccccattt

SEQ ID NO: 130527 - DNA, 20 bp, Artificial
  CRISPR gRNA sequence
tcagcttccccatttttaaa

SEQ ID NO: 130528 - DNA, 20 bp, Artificial
  CRISPR gRNA sequence
cagcttccccatttttaaag

SEQ ID NO: 130529 - DNA, 20 bp, Artificial
  CRISPR gRNA sequence
agcttccccatttttaaagt

SEQ ID NO: 130530 - DNA, 20 bp, Artificial
  CRISPR gRNA sequence
ccccatttttaaagtgatgt

SEQ ID NO: 130531 - DNA, 20 bp, Artificial
  CRISPR gRNA sequence
cccatttttaaagtgatgtt

SEQ ID NO: 130532 - DNA, 20 bp, Artificial
  CRISPR gRNA sequence
ttaaagtgatgttgctatga

SEQ ID NO: 130533 - DNA, 20 bp, Artificial
  CRISPR gRNA sequence
taaagtgatgttgctatgag

SEQ ID NO: 130534 - DNA, 20 bp, Artificial
  CRISPR gRNA sequence
aaagtgatgttgctatgagg

SEQ ID NO: 130535 - DNA, 20 bp, Artificial
  CRISPR gRNA sequence
aagtgatgttgctatgagga

SEQ ID NO: 130536 - DNA, 20 bp, Artificial
  CRISPR gRNA sequence
ctatgaggaagctattgtat

SEQ ID NO: 130537 - DNA, 20 bp, Artificial
  CRISPR gRNA sequence
tgaggaagctattgtataaa

SEQ ID NO: 130538 - DNA, 20 bp, Artificial
  CRISPR gRNA sequence
ttgtataaaaagcacctagc

SEQ ID NO: 130539 - DNA, 20 bp, Artificial
  CRISPR gRNA sequence
tataaaaagcacctagcaaa

SEQ ID NO: 130540 - DNA, 20 bp, Artificial
  CRISPR gRNA sequence
gcaaagtgcaagatacatag

SEQ ID NO: 130541 - DNA, 20 bp, Artificial
  CRISPR gRNA sequence
aacaaatgtaatcttagtat

SEQ ID NO: 130542 - DNA, 20 bp, Artificial
  CRISPR gRNA sequence
acaaatgtaatcttagtatt

SEQ ID NO: 130543 - DNA, 20 bp, Artificial
  CRISPR gRNA sequence
agtattgccccctcaaatac

SEQ ID NO: 130544 - DNA, 20 bp, Artificial
  CRISPR gRNA sequence
gtattgccccctcaaatacg

SEQ ID NO: 130545 - DNA, 20 bp, Artificial
  CRISPR gRNA sequence
ccccctcaaatacggttctc

SEQ ID NO: 130546 - DNA, 20 bp, Artificial
  CRISPR gRNA sequence
aaatacggttctcattattc

SEQ ID NO: 130547 - DNA, 20 bp, Artificial
  CRISPR gRNA sequence
tcattattcttccaggcaga

SEQ ID NO: 130548 - DNA, 20 bp, Artificial
  CRISPR gRNA sequence
attattcttccaggcagaga

SEQ ID NO: 130549 - DNA, 20 bp, Artificial
  CRISPR gRNA sequence
ttcttccaggcagagattct

SEQ ID NO: 130550 - DNA, 20 bp, Artificial
  CRISPR gRNA sequence
ttccaggcagagattcttct

SEQ ID NO: 130551 - DNA, 20 bp, Artificial
  CRISPR gRNA sequence
ccaggcagagattcttctct

SEQ ID NO: 130552 - DNA, 20 bp, Artificial
  CRISPR gRNA sequence
caggcagagattcttctctc

SEQ ID NO: 130553 - DNA, 20 bp, Artificial
  CRISPR gRNA sequence
ttctctctcttaatttaccc

SEQ ID NO: 130554 - DNA, 20 bp, Artificial
  CRISPR gRNA sequence
ctctctcttaatttaccctt

SEQ ID NO: 130555 - DNA, 20 bp, Artificial
  CRISPR gRNA sequence
tctctcttaatttacccttt

SEQ ID NO: 130556 - DNA, 20 bp, Artificial
  CRISPR gRNA sequence
tctcttaatttaccctttta

SEQ ID NO: 130557 - DNA, 20 bp, Artificial
  CRISPR gRNA sequence
tcttaatttacccttttacc

SEQ ID NO: 130558 - DNA, 20 bp, Artificial
  CRISPR gRNA sequence
ttaatttacccttttacctg

SEQ ID NO: 130559 - DNA, 20 bp, Artificial
  CRISPR gRNA sequence
aatttacccttttacctgtt

SEQ ID NO: 130560 - DNA, 20 bp, Artificial
  CRISPR gRNA sequence
atttacccttttacctgttt

SEQ ID NO: 130561 - DNA, 20 bp, Artificial
  CRISPR gRNA sequence
acccttttacctgttttctg

SEQ ID NO: 130562 - DNA, 20 bp, Artificial
  CRISPR gRNA sequence
cccttttacctgttttctgg

SEQ ID NO: 130563 - DNA, 20 bp, Artificial
  CRISPR gRNA sequence
ttacctgttttctgggttac

SEQ ID NO: 130564 - DNA, 20 bp, Artificial
  CRISPR gRNA sequence
tacctgttttctgggttaca

SEQ ID NO: 130565 - DNA, 20 bp, Artificial
  CRISPR gRNA sequence
acctgttttctgggttacat

SEQ ID NO: 130566 - DNA, 20 bp, Artificial
  CRISPR gRNA sequence
cctgttttctgggttacatt

SEQ ID NO: 130567 - DNA, 20 bp, Artificial
  CRISPR gRNA sequence
ttttctgggttacattcctt

SEQ ID NO: 130568 - DNA, 20 bp, Artificial
  CRISPR gRNA sequence
tctgggttacattcctttta

SEQ ID NO: 130569 - DNA, 20 bp, Artificial
  CRISPR gRNA sequence
ctgggttacattccttttat

SEQ ID NO: 130570 - DNA, 20 bp, Artificial
  CRISPR gRNA sequence
tgggttacattccttttatc

SEQ ID NO: 130571 - DNA, 20 bp, Artificial
  CRISPR gRNA sequence
ggttacattccttttatcta

SEQ ID NO: 130572 - DNA, 20 bp, Artificial
  CRISPR gRNA sequence
cattccttttatctatctga

SEQ ID NO: 130573 - DNA, 20 bp, Artificial
  CRISPR gRNA sequence
cttttatctatctgaggata

SEQ ID NO: 130574 - DNA, 20 bp, Artificial
  CRISPR gRNA sequence
ttatctatctgaggataaga

SEQ ID NO: 130575 - DNA, 20 bp, Artificial
  CRISPR gRNA sequence
tatctatctgaggataagaa

SEQ ID NO: 130576 - DNA, 20 bp, Artificial
  CRISPR gRNA sequence
atctatctgaggataagaaa

SEQ ID NO: 130577 - DNA, 20 bp, Artificial
  CRISPR gRNA sequence
tctatctgaggataagaaat

SEQ ID NO: 130578 - DNA, 20 bp, Artificial
  CRISPR gRNA sequence
tctgaggataagaaataata

SEQ ID NO: 130579 - DNA, 20 bp, Artificial
  CRISPR gRNA sequence
aggataagaaataatacaaa

SEQ ID NO: 130580 - DNA, 20 bp, Artificial
  CRISPR gRNA sequence
ctcttctataatgtatcttc

SEQ ID NO: 130581 - DNA, 20 bp, Artificial
  CRISPR gRNA sequence
ttctataatgtatcttcaat

SEQ ID NO: 130582 - DNA, 20 bp, Artificial
  CRISPR gRNA sequence
ctataatgtatcttcaatcc

SEQ ID NO: 130583 - DNA, 20 bp, Artificial
  CRISPR gRNA sequence
tataatgtatcttcaatcct

SEQ ID NO: 130584 - DNA, 20 bp, Artificial
  CRISPR gRNA sequence
taatgtatcttcaatcctcc

SEQ ID NO: 130585 - DNA, 20 bp, Artificial
  CRISPR gRNA sequence
caatcctccttaccagctcc

SEQ ID NO: 130586 - DNA, 20 bp, Artificial
  CRISPR gRNA sequence
aatcctccttaccagctcct

SEQ ID NO: 130587 - DNA, 20 bp, Artificial
  CRISPR gRNA sequence
cttaccagctccttcactct

SEQ ID NO: 130588 - DNA, 20 bp, Artificial
  CRISPR gRNA sequence
accagctccttcactcttcc

SEQ ID NO: 130589 - DNA, 20 bp, Artificial
  CRISPR gRNA sequence
ccagctccttcactcttcct

SEQ ID NO: 130590 - DNA, 20 bp, Artificial
  CRISPR gRNA sequence
cttcactcttccttaaacat

SEQ ID NO: 130591 - DNA, 20 bp, Artificial
  CRISPR gRNA sequence
cactcttccttaaacatgct

SEQ ID NO: 130592 - DNA, 20 bp, Artificial
  CRISPR gRNA sequence
actcttccttaaacatgctt

SEQ ID NO: 130593 - DNA, 20 bp, Artificial
  CRISPR gRNA sequence
ttccttaaacatgcttagtc

SEQ ID NO: 130594 - DNA, 20 bp, Artificial
  CRISPR gRNA sequence
ccttaaacatgcttagtctc

SEQ ID NO: 130595 - DNA, 20 bp, Artificial
  CRISPR gRNA sequence
cttaaacatgcttagtctcc

SEQ ID NO: 130596 - DNA, 20 bp, Artificial
  CRISPR gRNA sequence
aaacatgcttagtctccctc

SEQ ID NO: 130597 - DNA, 20 bp, Artificial
  CRISPR gRNA sequence
aacatgcttagtctccctca

SEQ ID NO: 130598 - DNA, 20 bp, Artificial
  CRISPR gRNA sequence
agtctccctcattaagcata

SEQ ID NO: 130599 - DNA, 20 bp, Artificial
  CRISPR gRNA sequence
gtctccctcattaagcatac

SEQ ID NO: 130600 - DNA, 20 bp, Artificial
  CRISPR gRNA sequence
cctcattaagcatacagaag

SEQ ID NO: 130601 - DNA, 20 bp, Artificial
  CRISPR gRNA sequence
attaagcatacagaagtaca

SEQ ID NO: 130602 - DNA, 20 bp, Artificial
  CRISPR gRNA sequence
agcatacagaagtacacaga

SEQ ID NO: 130603 - DNA, 20 bp, Artificial
  CRISPR gRNA sequence
aattctgccccatacccttg

SEQ ID NO: 130604 - DNA, 20 bp, Artificial
  CRISPR gRNA sequence
attctgccccatacccttgc

SEQ ID NO: 130605 - DNA, 20 bp, Artificial
  CRISPR gRNA sequence
tgccccatacccttgcctag

SEQ ID NO: 130606 - DNA, 20 bp, Artificial
  CRISPR gRNA sequence
ccccatacccttgcctagct

SEQ ID NO: 130607 - DNA, 20 bp, Artificial
  CRISPR gRNA sequence
gcctagctaccattcttgcc

SEQ ID NO: 130608 - DNA, 20 bp, Artificial
  CRISPR gRNA sequence
cctagctaccattcttgccc

SEQ ID NO: 130609 - DNA, 20 bp, Artificial
  CRISPR gRNA sequence
gctaccattcttgccctgac

SEQ ID NO: 130610 - DNA, 20 bp, Artificial
  CRISPR gRNA sequence
ccattcttgccctgacagtt

SEQ ID NO: 130611 - DNA, 20 bp, Artificial
  CRISPR gRNA sequence
ttgccctgacagttgttaag

SEQ ID NO: 130612 - DNA, 20 bp, Artificial
  CRISPR gRNA sequence
gccctgacagttgttaagac

SEQ ID NO: 130613 - DNA, 20 bp, Artificial
  CRISPR gRNA sequence
ccctgacagttgttaagaca

SEQ ID NO: 130614 - DNA, 20 bp, Artificial
  CRISPR gRNA sequence
acagttgttaagacacctct

SEQ ID NO: 130615 - DNA, 20 bp, Artificial
  CRISPR gRNA sequence
ttaagacacctcttcattcc

SEQ ID NO: 130616 - DNA, 20 bp, Artificial
  CRISPR gRNA sequence
agacacctcttcattcctat

SEQ ID NO: 130617 - DNA, 20 bp, Artificial
  CRISPR gRNA sequence
ttcattcctatttaaactcc

SEQ ID NO: 130618 - DNA, 20 bp, Artificial
  CRISPR gRNA sequence
cattcctatttaaactcctg

SEQ ID NO: 130619 - DNA, 20 bp, Artificial
  CRISPR gRNA sequence
attcctatttaaactcctga

SEQ ID NO: 130620 - DNA, 20 bp, Artificial
  CRISPR gRNA sequence
ctatttaaactcctgaacat

SEQ ID NO: 130621 - DNA, 20 bp, Artificial
  CRISPR gRNA sequence
tttaaactcctgaacatgta

SEQ ID NO: 130622 - DNA, 20 bp, Artificial
  CRISPR gRNA sequence
aaactcctgaacatgtactt

SEQ ID NO: 130623 - DNA, 20 bp, Artificial
  CRISPR gRNA sequence
aactcctgaacatgtacttt

SEQ ID NO: 130624 - DNA, 20 bp, Artificial
  CRISPR gRNA sequence
ctgaacatgtactttttaac

SEQ ID NO: 130625 - DNA, 20 bp, Artificial
  CRISPR gRNA sequence
aacatgtactttttaacccc

SEQ ID NO: 130626 - DNA, 20 bp, Artificial
  CRISPR gRNA sequence
tttaaccccaacccagaatg

SEQ ID NO: 130627 - DNA, 20 bp, Artificial
  CRISPR gRNA sequence
ttaaccccaacccagaatga

SEQ ID NO: 130628 - DNA, 20 bp, Artificial
  CRISPR gRNA sequence
taaccccaacccagaatgaa

SEQ ID NO: 130629 - DNA, 20 bp, Artificial
  CRISPR gRNA sequence
aaccccaacccagaatgaaa

SEQ ID NO: 130630 - DNA, 20 bp, Artificial
  CRISPR gRNA sequence
accccaacccagaatgaaac

SEQ ID NO: 130631 - DNA, 20 bp, Artificial
  CRISPR gRNA sequence
ttaaaagctgccagtgatct

SEQ ID NO: 130632 - DNA, 20 bp, Artificial
  CRISPR gRNA sequence
aaaagctgccagtgatcttg

SEQ ID NO: 130633 - DNA, 20 bp, Artificial
  CRISPR gRNA sequence
aaagctgccagtgatcttgt

SEQ ID NO: 130634 - DNA, 20 bp, Artificial
  CRISPR gRNA sequence
ccagtgatcttgtcctcatc

SEQ ID NO: 130635 - DNA, 20 bp, Artificial
  CRISPR gRNA sequence
gtcctcatcctacttgactg

SEQ ID NO: 130636 - DNA, 20 bp, Artificial
  CRISPR gRNA sequence
tcctcatcctacttgactgt

SEQ ID NO: 130637 - DNA, 20 bp, Artificial
  CRISPR gRNA sequence
atcctacttgactgttcttt

SEQ ID NO: 130638 - DNA, 20 bp, Artificial
  CRISPR gRNA sequence
cttgactgttctttgtagtg

SEQ ID NO: 130639 - DNA, 20 bp, Artificial
  CRISPR gRNA sequence
gactgttctttgtagtgctg

SEQ ID NO: 130640 - DNA, 20 bp, Artificial
  CRISPR gRNA sequence
actgttctttgtagtgctgg

SEQ ID NO: 130641 - DNA, 20 bp, Artificial
  CRISPR gRNA sequence
ttctttgtagtgctggctac

SEQ ID NO: 130642 - DNA, 20 bp, Artificial
  CRISPR gRNA sequence
tttgtagtgctggctactac

SEQ ID NO: 130643 - DNA, 20 bp, Artificial
  CRISPR gRNA sequence
tgtagtgctggctactactc

SEQ ID NO: 130644 - DNA, 20 bp, Artificial
  CRISPR gRNA sequence
gtagtgctggctactactcg

SEQ ID NO: 130645 - DNA, 20 bp, Artificial
  CRISPR gRNA sequence
tagtgctggctactactcgc

SEQ ID NO: 130646 - DNA, 20 bp, Artificial
  CRISPR gRNA sequence
gctactactcgccacacatt

SEQ ID NO: 130647 - DNA, 20 bp, Artificial
  CRISPR gRNA sequence
ctactcgccacacatttatg

SEQ ID NO: 130648 - DNA, 20 bp, Artificial
  CRISPR gRNA sequence
ctcgccacacatttatgctt

SEQ ID NO: 130649 - DNA, 20 bp, Artificial
  CRISPR gRNA sequence
gccacacatttatgcttgga

SEQ ID NO: 130650 - DNA, 20 bp, Artificial
  CRISPR gRNA sequence
atgcttggaattctctccta

SEQ ID NO: 130651 - DNA, 20 bp, Artificial
  CRISPR gRNA sequence
tgcttggaattctctcctac

SEQ ID NO: 130652 - DNA, 20 bp, Artificial
  CRISPR gRNA sequence
ggaattctctcctactctga

SEQ ID NO: 130653 - DNA, 20 bp, Artificial
  CRISPR gRNA sequence
gaattctctcctactctgat

SEQ ID NO: 130654 - DNA, 20 bp, Artificial
  CRISPR gRNA sequence
tctcctactctgatttccaa

SEQ ID NO: 130655 - DNA, 20 bp, Artificial
  CRISPR gRNA sequence
tcctactctgatttccaaag

SEQ ID NO: 130656 - DNA, 20 bp, Artificial
  CRISPR gRNA sequence
ctactctgatttccaaagca

SEQ ID NO: 130657 - DNA, 20 bp, Artificial
  CRISPR gRNA sequence
ctctgatttccaaagcaata

SEQ ID NO: 130658 - DNA, 20 bp, Artificial
  CRISPR gRNA sequence
tgatttccaaagcaatatcc

SEQ ID NO: 130659 - DNA, 20 bp, Artificial
  CRISPR gRNA sequence
atttccaaagcaatatcctt

SEQ ID NO: 130660 - DNA, 20 bp, Artificial
  CRISPR gRNA sequence
ccaaagcaatatcctttcct

SEQ ID NO: 130661 - DNA, 20 bp, Artificial
  CRISPR gRNA sequence
caaagcaatatcctttcctc

SEQ ID NO: 130662 - DNA, 20 bp, Artificial
  CRISPR gRNA sequence
tcctccccaccccctaattg

SEQ ID NO: 130663 - DNA, 20 bp, Artificial
  CRISPR gRNA sequence
cctccccaccccctaattgt

SEQ ID NO: 130664 - DNA, 20 bp, Artificial
  CRISPR gRNA sequence
ctccccaccccctaattgtt

SEQ ID NO: 130665 - DNA, 20 bp, Artificial
  CRISPR gRNA sequence
cccaccccctaattgtttca

SEQ ID NO: 130666 - DNA, 20 bp, Artificial
  CRISPR gRNA sequence
attgtttcacccaaggttat

SEQ ID NO: 130667 - DNA, 20 bp, Artificial
  CRISPR gRNA sequence
tttcacccaaggttatcctt

SEQ ID NO: 130668 - DNA, 20 bp, Artificial
  CRISPR gRNA sequence
cacccaaggttatccttctc

SEQ ID NO: 130669 - DNA, 20 bp, Artificial
  CRISPR gRNA sequence
acccaaggttatccttctct

SEQ ID NO: 130670 - DNA, 20 bp, Artificial
  CRISPR gRNA sequence
tccttctctttcttccctta

SEQ ID NO: 130671 - DNA, 20 bp, Artificial
  CRISPR gRNA sequence
ctctttcttcccttattttc

SEQ ID NO: 130672 - DNA, 20 bp, Artificial
  CRISPR gRNA sequence
tctttcttcccttattttct

SEQ ID NO: 130673 - DNA, 20 bp, Artificial
  CRISPR gRNA sequence
tttcttcccttattttctta

SEQ ID NO: 130674 - DNA, 20 bp, Artificial
  CRISPR gRNA sequence
tcttcccttattttcttaat

SEQ ID NO: 130675 - DNA, 20 bp, Artificial
  CRISPR gRNA sequence
cttcccttattttcttaatg

SEQ ID NO: 130676 - DNA, 20 bp, Artificial
  CRISPR gRNA sequence
ttcccttattttcttaatga

SEQ ID NO: 130677 - DNA, 20 bp, Artificial
  CRISPR gRNA sequence
cccttattttcttaatgaac

SEQ ID NO: 130678 - DNA, 20 bp, Artificial
  CRISPR gRNA sequence
ccttattttcttaatgaact

SEQ ID NO: 130679 - DNA, 20 bp, Artificial
  CRISPR gRNA sequence
attttcttaatgaactcact

SEQ ID NO: 130680 - DNA, 20 bp, Artificial
  CRISPR gRNA sequence
ttttcttaatgaactcacta

SEQ ID NO: 130681 - DNA, 20 bp, Artificial
  CRISPR gRNA sequence
tcttaatgaactcactaaat

SEQ ID NO: 130682 - DNA, 20 bp, Artificial
  CRISPR gRNA sequence
cttaatgaactcactaaata

SEQ ID NO: 130683 - DNA, 20 bp, Artificial
  CRISPR gRNA sequence
ttaatgaactcactaaatat

SEQ ID NO: 130684 - DNA, 20 bp, Artificial
  CRISPR gRNA sequence
aatgaactcactaaatatca

SEQ ID NO: 130685 - DNA, 20 bp, Artificial
  CRISPR gRNA sequence
atgaactcactaaatatcac

SEQ ID NO: 130686 - DNA, 20 bp, Artificial
  CRISPR gRNA sequence
actaaatatcacttctatgc

SEQ ID NO: 130687 - DNA, 20 bp, Artificial
  CRISPR gRNA sequence
aatatcacttctatgcttat

SEQ ID NO: 130688 - DNA, 20 bp, Artificial
  CRISPR gRNA sequence
ctatgcttataaatgccaaa

SEQ ID NO: 130689 - DNA, 20 bp, Artificial
  CRISPR gRNA sequence
tatgcttataaatgccaaat

SEQ ID NO: 130690 - DNA, 20 bp, Artificial
  CRISPR gRNA sequence
tgcttataaatgccaaatct

SEQ ID NO: 130691 - DNA, 20 bp, Artificial
  CRISPR gRNA sequence
ataaatgccaaatctacaac

SEQ ID NO: 130692 - DNA, 20 bp, Artificial
  CRISPR gRNA sequence
taaatgccaaatctacaacc

SEQ ID NO: 130693 - DNA, 20 bp, Artificial
  CRISPR gRNA sequence
caaccaatattctgcttgcc

SEQ ID NO: 130694 - DNA, 20 bp, Artificial
  CRISPR gRNA sequence
tgcttgccactcaagcaacc

SEQ ID NO: 130695 - DNA, 20 bp, Artificial
  CRISPR gRNA sequence
cttgccactcaagcaaccca

SEQ ID NO: 130696 - DNA, 20 bp, Artificial
  CRISPR gRNA sequence
gccactcaagcaacccatgc

SEQ ID NO: 130697 - DNA, 20 bp, Artificial
  CRISPR gRNA sequence
ccactcaagcaacccatgcc

SEQ ID NO: 130698 - DNA, 20 bp, Artificial
  CRISPR gRNA sequence
aagcaacccatgcctgtagg

SEQ ID NO: 130699 - DNA, 20 bp, Artificial
  CRISPR gRNA sequence
tagggcatgtctaatatctc

SEQ ID NO: 130700 - DNA, 20 bp, Artificial
  CRISPR gRNA sequence
atatctcatcacggcaaatt

SEQ ID NO: 130701 - DNA, 20 bp, Artificial
  CRISPR gRNA sequence
atcacggcaaatttaagata

SEQ ID NO: 130702 - DNA, 20 bp, Artificial
  CRISPR gRNA sequence
aagatattgggaaatgaaat

SEQ ID NO: 130703 - DNA, 20 bp, Artificial
  CRISPR gRNA sequence
agatattgggaaatgaaatt

SEQ ID NO: 130704 - DNA, 20 bp, Artificial
  CRISPR gRNA sequence
ggaaatgaaattcaccttgc

SEQ ID NO: 130705 - DNA, 20 bp, Artificial
  CRISPR gRNA sequence
accttgccccattccctgca

SEQ ID NO: 130706 - DNA, 20 bp, Artificial
  CRISPR gRNA sequence
gccccattccctgcaacggg

SEQ ID NO: 130707 - DNA, 20 bp, Artificial
  CRISPR gRNA sequence
ccccattccctgcaacgggg

SEQ ID NO: 130708 - DNA, 20 bp, Artificial
  CRISPR gRNA sequence
cctgcaacggggaaaggagg

SEQ ID NO: 130709 - DNA, 20 bp, Artificial
  CRISPR gRNA sequence
caacggggaaaggagggaga

SEQ ID NO: 130710 - DNA, 20 bp, Artificial
  CRISPR gRNA sequence
ccctttccactactgtaatt

SEQ ID NO: 130711 - DNA, 20 bp, Artificial
  CRISPR gRNA sequence
cctttccactactgtaattc

SEQ ID NO: 130712 - DNA, 20 bp, Artificial
  CRISPR gRNA sequence
tccactactgtaattctact

SEQ ID NO: 130713 - DNA, 20 bp, Artificial
  CRISPR gRNA sequence
ccactactgtaattctacta

SEQ ID NO: 130714 - DNA, 20 bp, Artificial
  CRISPR gRNA sequence
cactactgtaattctactaa

SEQ ID NO: 130715 - DNA, 20 bp, Artificial
  CRISPR gRNA sequence
ctgtaattctactaagaaga

SEQ ID NO: 130716 - DNA, 20 bp, Artificial
  CRISPR gRNA sequence
taattctactaagaagaata

SEQ ID NO: 130717 - DNA, 20 bp, Artificial
  CRISPR gRNA sequence
tactaagaagaataccagcc

SEQ ID NO: 130718 - DNA, 20 bp, Artificial
  CRISPR gRNA sequence
ctaagaagaataccagccct

SEQ ID NO: 130719 - DNA, 20 bp, Artificial
  CRISPR gRNA sequence
agaagaataccagcccttca

SEQ ID NO: 130720 - DNA, 20 bp, Artificial
  CRISPR gRNA sequence
cactctgcccagccaaatat

SEQ ID NO: 130721 - DNA, 20 bp, Artificial
  CRISPR gRNA sequence
actctgcccagccaaatata

SEQ ID NO: 130722 - DNA, 20 bp, Artificial
  CRISPR gRNA sequence
tgcccagccaaatataccag

SEQ ID NO: 130723 - DNA, 20 bp, Artificial
  CRISPR gRNA sequence
cccagccaaatataccagca

SEQ ID NO: 130724 - DNA, 20 bp, Artificial
  CRISPR gRNA sequence
aggttcttccatctccttca

SEQ ID NO: 130725 - DNA, 20 bp, Artificial
  CRISPR gRNA sequence
ggttcttccatctccttcaa

SEQ ID NO: 130726 - DNA, 20 bp, Artificial
  CRISPR gRNA sequence
ttccatctccttcaagctct

SEQ ID NO: 130727 - DNA, 20 bp, Artificial
  CRISPR gRNA sequence
ccatctccttcaagctctac

SEQ ID NO: 130728 - DNA, 20 bp, Artificial
  CRISPR gRNA sequence
catctccttcaagctctacc

SEQ ID NO: 130729 - DNA, 20 bp, Artificial
  CRISPR gRNA sequence
cttcaagctctacctcatct

SEQ ID NO: 130730 - DNA, 20 bp, Artificial
  CRISPR gRNA sequence
caagctctacctcatctatt

SEQ ID NO: 130731 - DNA, 20 bp, Artificial
  CRISPR gRNA sequence
aagctctacctcatctatta

SEQ ID NO: 130732 - DNA, 20 bp, Artificial
  CRISPR gRNA sequence
tacctcatctattacctctt

SEQ ID NO: 130733 - DNA, 20 bp, Artificial
  CRISPR gRNA sequence
cctcatctattacctcttta

SEQ ID NO: 130734 - DNA, 20 bp, Artificial
  CRISPR gRNA sequence
atctattacctctttaaaaa

SEQ ID NO: 130735 - DNA, 20 bp, Artificial
  CRISPR gRNA sequence
ttacctctttaaaaatgtct

SEQ ID NO: 130736 - DNA, 20 bp, Artificial
  CRISPR gRNA sequence
cctctttaaaaatgtctcct

SEQ ID NO: 130737 - DNA, 20 bp, Artificial
  CRISPR gRNA sequence
tttaaaaatgtctcctagat

SEQ ID NO: 130738 - DNA, 20 bp, Artificial
  CRISPR gRNA sequence
taaaaatgtctcctagatat

SEQ ID NO: 130739 - DNA, 20 bp, Artificial
  CRISPR gRNA sequence
aaaaatgtctcctagatatg

SEQ ID NO: 130740 - DNA, 20 bp, Artificial
  CRISPR gRNA sequence
aaaatgtctcctagatatgc

SEQ ID NO: 130741 - DNA, 20 bp, Artificial
  CRISPR gRNA sequence
ctagatatgctttccctttc

SEQ ID NO: 130742 - DNA, 20 bp, Artificial
  CRISPR gRNA sequence
gatatgctttccctttccta

SEQ ID NO: 130743 - DNA, 20 bp, Artificial
  CRISPR gRNA sequence
tccctttcctatttccactg

SEQ ID NO: 130744 - DNA, 20 bp, Artificial
  CRISPR gRNA sequence
ccctttcctatttccactgg

SEQ ID NO: 130745 - DNA, 20 bp, Artificial
  CRISPR gRNA sequence
cctttcctatttccactgga

SEQ ID NO: 130746 - DNA, 20 bp, Artificial
  CRISPR gRNA sequence
tcctatttccactggattac

SEQ ID NO: 130747 - DNA, 20 bp, Artificial
  CRISPR gRNA sequence
cctatttccactggattacc

SEQ ID NO: 130748 - DNA, 20 bp, Artificial
  CRISPR gRNA sequence
ctatttccactggattacca

SEQ ID NO: 130749 - DNA, 20 bp, Artificial
  CRISPR gRNA sequence
tttccactggattaccaccc

SEQ ID NO: 130750 - DNA, 20 bp, Artificial
  CRISPR gRNA sequence
ccactggattaccacccagc

SEQ ID NO: 130751 - DNA, 20 bp, Artificial
  CRISPR gRNA sequence
cactggattaccacccagcc

SEQ ID NO: 130752 - DNA, 20 bp, Artificial
  CRISPR gRNA sequence
gattaccacccagcccatct

SEQ ID NO: 130753 - DNA, 20 bp, Artificial
  CRISPR gRNA sequence
ccacccagcccatcttaaca

SEQ ID NO: 130754 - DNA, 20 bp, Artificial
  CRISPR gRNA sequence
aacatattgttataagacta

SEQ ID NO: 130755 - DNA, 20 bp, Artificial
  CRISPR gRNA sequence
acatattgttataagactaa

SEQ ID NO: 130756 - DNA, 20 bp, Artificial
  CRISPR gRNA sequence
ttataagactaatctcacca

SEQ ID NO: 130757 - DNA, 20 bp, Artificial
  CRISPR gRNA sequence
taagactaatctcaccacaa

SEQ ID NO: 130758 - DNA, 20 bp, Artificial
  CRISPR gRNA sequence
atctcaccacaacaccagtt

SEQ ID NO: 130759 - DNA, 20 bp, Artificial
  CRISPR gRNA sequence
accacaacaccagttctata

SEQ ID NO: 130760 - DNA, 20 bp, Artificial
  CRISPR gRNA sequence
tatactcttgaacctattct

SEQ ID NO: 130761 - DNA, 20 bp, Artificial
  CRISPR gRNA sequence
tactcttgaacctattctca

SEQ ID NO: 130762 - DNA, 20 bp, Artificial
  CRISPR gRNA sequence
ttgaacctattctcaaaggt

SEQ ID NO: 130763 - DNA, 20 bp, Artificial
  CRISPR gRNA sequence
gaacctattctcaaaggttc

SEQ ID NO: 130764 - DNA, 20 bp, Artificial
  CRISPR gRNA sequence
aacctattctcaaaggttcc

SEQ ID NO: 130765 - DNA, 20 bp, Artificial
  CRISPR gRNA sequence
ttctcaaaggttcctaaagg

SEQ ID NO: 130766 - DNA, 20 bp, Artificial
  CRISPR gRNA sequence
tcaaaggttcctaaaggctt

SEQ ID NO: 130767 - DNA, 20 bp, Artificial
  CRISPR gRNA sequence
aaaggttcctaaaggcttcc

SEQ ID NO: 130768 - DNA, 20 bp, Artificial
  CRISPR gRNA sequence
ctaaaggcttcctgtgtcaa

SEQ ID NO: 130769 - DNA, 20 bp, Artificial
  CRISPR gRNA sequence
aaggcttcctgtgtcaaatc

SEQ ID NO: 130770 - DNA, 20 bp, Artificial
  CRISPR gRNA sequence
cctgtgtcaaatccaaacct

SEQ ID NO: 130771 - DNA, 20 bp, Artificial
  CRISPR gRNA sequence
ctgtgtcaaatccaaacctc

SEQ ID NO: 130772 - DNA, 20 bp, Artificial
  CRISPR gRNA sequence
tgtcaaatccaaacctcatt

SEQ ID NO: 130773 - DNA, 20 bp, Artificial
  CRISPR gRNA sequence
attttcatgacttcacatga

SEQ ID NO: 130774 - DNA, 20 bp, Artificial
  CRISPR gRNA sequence
tcatgacttcacatgagcag

SEQ ID NO: 130775 - DNA, 20 bp, Artificial
  CRISPR gRNA sequence
catgacttcacatgagcaga

SEQ ID NO: 130776 - DNA, 20 bp, Artificial
  CRISPR gRNA sequence
atgacttcacatgagcagat

SEQ ID NO: 130777 - DNA, 20 bp, Artificial
  CRISPR gRNA sequence
cacatgagcagatcgcacat

SEQ ID NO: 130778 - DNA, 20 bp, Artificial
  CRISPR gRNA sequence
acatgagcagatcgcacatt

SEQ ID NO: 130779 - DNA, 20 bp, Artificial
  CRISPR gRNA sequence
aacctaaccaaacttgtttc

SEQ ID NO: 130780 - DNA, 20 bp, Artificial
  CRISPR gRNA sequence
acctaaccaaacttgtttcc

SEQ ID NO: 130781 - DNA, 20 bp, Artificial
  CRISPR gRNA sequence
accaaacttgtttcctactt

SEQ ID NO: 130782 - DNA, 20 bp, Artificial
  CRISPR gRNA sequence
gtttcctacttttctctatc

SEQ ID NO: 130783 - DNA, 20 bp, Artificial
  CRISPR gRNA sequence
tttcctacttttctctatct

SEQ ID NO: 130784 - DNA, 20 bp, Artificial
  CRISPR gRNA sequence
cctacttttctctatcttca

SEQ ID NO: 130785 - DNA, 20 bp, Artificial
  CRISPR gRNA sequence
ctacttttctctatcttcat

SEQ ID NO: 130786 - DNA, 20 bp, Artificial
  CRISPR gRNA sequence
cttttctctatcttcatggt

SEQ ID NO: 130787 - DNA, 20 bp, Artificial
  CRISPR gRNA sequence
ttctctatcttcatggttaa

SEQ ID NO: 130788 - DNA, 20 bp, Artificial
  CRISPR gRNA sequence
tctctatcttcatggttaat

SEQ ID NO: 130789 - DNA, 20 bp, Artificial
  CRISPR gRNA sequence
ctctatcttcatggttaata

SEQ ID NO: 130790 - DNA, 20 bp, Artificial
  CRISPR gRNA sequence
tctatcttcatggttaataa

SEQ ID NO: 130791 - DNA, 20 bp, Artificial
  CRISPR gRNA sequence
tatcttcatggttaataaaa

SEQ ID NO: 130792 - DNA, 20 bp, Artificial
  CRISPR gRNA sequence
tcttcatggttaataaaaat

SEQ ID NO: 130793 - DNA, 20 bp, Artificial
  CRISPR gRNA sequence
catggttaataaaaatcttt

SEQ ID NO: 130794 - DNA, 20 bp, Artificial
  CRISPR gRNA sequence
atggttaataaaaatctttg

SEQ ID NO: 130795 - DNA, 20 bp, Artificial
  CRISPR gRNA sequence
ataaaaatctttgtgctaga

SEQ ID NO: 130796 - DNA, 20 bp, Artificial
  CRISPR gRNA sequence
tgtgctagaatgtgctttat

SEQ ID NO: 130797 - DNA, 20 bp, Artificial
  CRISPR gRNA sequence
gtgctagaatgtgctttatt

SEQ ID NO: 130798 - DNA, 20 bp, Artificial
  CRISPR gRNA sequence
tgctagaatgtgctttattt

SEQ ID NO: 130799 - DNA, 20 bp, Artificial
  CRISPR gRNA sequence
gaatgtgctttatttaggga

SEQ ID NO: 130800 - DNA, 20 bp, Artificial
  CRISPR gRNA sequence
tatttagggatcactgagtg

SEQ ID NO: 130801 - DNA, 20 bp, Artificial
  CRISPR gRNA sequence
atttagggatcactgagtgc

SEQ ID NO: 130802 - DNA, 20 bp, Artificial
  CRISPR gRNA sequence
tttagggatcactgagtgca

SEQ ID NO: 130803 - DNA, 20 bp, Artificial
  CRISPR gRNA sequence
agggatcactgagtgcactt

SEQ ID NO: 130804 - DNA, 20 bp, Artificial
  CRISPR gRNA sequence
gggatcactgagtgcacttc

SEQ ID NO: 130805 - DNA, 20 bp, Artificial
  CRISPR gRNA sequence
agtgcacttctttcatttta

SEQ ID NO: 130806 - DNA, 20 bp, Artificial
  CRISPR gRNA sequence
ctttcattttaggagtgaag

SEQ ID NO: 130807 - DNA, 20 bp, Artificial
  CRISPR gRNA sequence
tttcattttaggagtgaagc

SEQ ID NO: 130808 - DNA, 20 bp, Artificial
  CRISPR gRNA sequence
tcattttaggagtgaagcga

SEQ ID NO: 130809 - DNA, 20 bp, Artificial
  CRISPR gRNA sequence
cattttaggagtgaagcgac

SEQ ID NO: 130810 - DNA, 20 bp, Artificial
  CRISPR gRNA sequence
attttaggagtgaagcgacc

SEQ ID NO: 130811 - DNA, 20 bp, Artificial
  CRISPR gRNA sequence
taggagtgaagcgaccacag

SEQ ID NO: 130812 - DNA, 20 bp, Artificial
  CRISPR gRNA sequence
aggagtgaagcgaccacagc

SEQ ID NO: 130813 - DNA, 20 bp, Artificial
  CRISPR gRNA sequence
ggagtgaagcgaccacagct

SEQ ID NO: 130814 - DNA, 20 bp, Artificial
  CRISPR gRNA sequence
aaagaagctgtaacacaccc

SEQ ID NO: 130815 - DNA, 20 bp, Artificial
  CRISPR gRNA sequence
taacacacccgaggttacag

SEQ ID NO: 130816 - DNA, 20 bp, Artificial
  CRISPR gRNA sequence
cagatatagtagcacatcca

SEQ ID NO: 130817 - DNA, 20 bp, Artificial
  CRISPR gRNA sequence
aatatccagaggggacaagt

SEQ ID NO: 130818 - DNA, 20 bp, Artificial
  CRISPR gRNA sequence
tctctttcctacattatcct

SEQ ID NO: 130819 - DNA, 20 bp, Artificial
  CRISPR gRNA sequence
ctctttcctacattatcctt

SEQ ID NO: 130820 - DNA, 20 bp, Artificial
  CRISPR gRNA sequence
tctttcctacattatccttt

SEQ ID NO: 130821 - DNA, 20 bp, Artificial
  CRISPR gRNA sequence
tttcctacattatcctttga

SEQ ID NO: 130822 - DNA, 20 bp, Artificial
  CRISPR gRNA sequence
tcctacattatcctttgaga

SEQ ID NO: 130823 - DNA, 20 bp, Artificial
  CRISPR gRNA sequence
cctacattatcctttgagat

SEQ ID NO: 130824 - DNA, 20 bp, Artificial
  CRISPR gRNA sequence
ctacattatcctttgagatc

SEQ ID NO: 130825 - DNA, 20 bp, Artificial
  CRISPR gRNA sequence
cattatcctttgagatctac

SEQ ID NO: 130826 - DNA, 20 bp, Artificial
  CRISPR gRNA sequence
tcctttgagatctaccctgg

SEQ ID NO: 130827 - DNA, 20 bp, Artificial
  CRISPR gRNA sequence
tgagatctaccctggaccat

SEQ ID NO: 130828 - DNA, 20 bp, Artificial
  CRISPR gRNA sequence
gagatctaccctggaccatg

SEQ ID NO: 130829 - DNA, 20 bp, Artificial
  CRISPR gRNA sequence
agatctaccctggaccatgc

SEQ ID NO: 130830 - DNA, 20 bp, Artificial
  CRISPR gRNA sequence
ccctggaccatgcacctcta

SEQ ID NO: 130831 - DNA, 20 bp, Artificial
  CRISPR gRNA sequence
gaccatgcacctctactccc

SEQ ID NO: 130832 - DNA, 20 bp, Artificial
  CRISPR gRNA sequence
tactcccgatcccctaaact

SEQ ID NO: 130833 - DNA, 20 bp, Artificial
  CRISPR gRNA sequence
ctcccgatcccctaaactta

SEQ ID NO: 130834 - DNA, 20 bp, Artificial
  CRISPR gRNA sequence
ccgatcccctaaacttaagt

SEQ ID NO: 130835 - DNA, 20 bp, Artificial
  CRISPR gRNA sequence
aacttaagttgcccatcctg

SEQ ID NO: 130836 - DNA, 20 bp, Artificial
  CRISPR gRNA sequence
aagttgcccatcctgccatc

SEQ ID NO: 130837 - DNA, 20 bp, Artificial
  CRISPR gRNA sequence
agttgcccatcctgccatca

SEQ ID NO: 130838 - DNA, 20 bp, Artificial
  CRISPR gRNA sequence
cccatcctgccatcaggctt

SEQ ID NO: 130839 - DNA, 20 bp, Artificial
  CRISPR gRNA sequence
ccatcaggcttttgcttttg

SEQ ID NO: 130840 - DNA, 20 bp, Artificial
  CRISPR gRNA sequence
ttgcttttggtgacaccctt

SEQ ID NO: 130841 - DNA, 20 bp, Artificial
  CRISPR gRNA sequence
tgcttttggtgacacccttc

SEQ ID NO: 130842 - DNA, 20 bp, Artificial
  CRISPR gRNA sequence
gcttttggtgacacccttca

SEQ ID NO: 130843 - DNA, 20 bp, Artificial
  CRISPR gRNA sequence
cttttggtgacacccttcac

SEQ ID NO: 130844 - DNA, 20 bp, Artificial
  CRISPR gRNA sequence
ttggtgacacccttcaccaa

SEQ ID NO: 130845 - DNA, 20 bp, Artificial
  CRISPR gRNA sequence
tggtgacacccttcaccaat

SEQ ID NO: 130846 - DNA, 20 bp, Artificial
  CRISPR gRNA sequence
ggtgacacccttcaccaatc

SEQ ID NO: 130847 - DNA, 20 bp, Artificial
  CRISPR gRNA sequence
gtgacacccttcaccaatcc

SEQ ID NO: 130848 - DNA, 20 bp, Artificial
  CRISPR gRNA sequence
caccaatccactcccaccct

SEQ ID NO: 130849 - DNA, 20 bp, Artificial
  CRISPR gRNA sequence
accaatccactcccaccctc

SEQ ID NO: 130850 - DNA, 20 bp, Artificial
  CRISPR gRNA sequence
ccaccctctatttcaaggct

SEQ ID NO: 130851 - DNA, 20 bp, Artificial
  CRISPR gRNA sequence
tatttcaaggctcagttcaa

SEQ ID NO: 130852 - DNA, 20 bp, Artificial
  CRISPR gRNA sequence
tttcaaggctcagttcaagg

SEQ ID NO: 130853 - DNA, 20 bp, Artificial
  CRISPR gRNA sequence
caaggctcagttcaaggtct

SEQ ID NO: 130854 - DNA, 20 bp, Artificial
  CRISPR gRNA sequence
aaggctcagttcaaggtctg

SEQ ID NO: 130855 - DNA, 20 bp, Artificial
  CRISPR gRNA sequence
agttcaaggtctgcaggatc

SEQ ID NO: 130856 - DNA, 20 bp, Artificial
  CRISPR gRNA sequence
aaggtctgcaggatccctct

SEQ ID NO: 130857 - DNA, 20 bp, Artificial
  CRISPR gRNA sequence
caggatccctctgtgacatt

SEQ ID NO: 130858 - DNA, 20 bp, Artificial
  CRISPR gRNA sequence
tgtgacattcccaagtaccc

SEQ ID NO: 130859 - DNA, 20 bp, Artificial
  CRISPR gRNA sequence
tgacattcccaagtacccag

SEQ ID NO: 130860 - DNA, 20 bp, Artificial
  CRISPR gRNA sequence
ccaagtacccaggctcacca

SEQ ID NO: 130861 - DNA, 20 bp, Artificial
  CRISPR gRNA sequence
accatgcctctcttcttccc

SEQ ID NO: 130862 - DNA, 20 bp, Artificial
  CRISPR gRNA sequence
tcttcttcccatatctactg

SEQ ID NO: 130863 - DNA, 20 bp, Artificial
  CRISPR gRNA sequence
ttcttcccatatctactgca

SEQ ID NO: 130864 - DNA, 20 bp, Artificial
  CRISPR gRNA sequence
cttcccatatctactgcact

SEQ ID NO: 130865 - DNA, 20 bp, Artificial
  CRISPR gRNA sequence
ttcccatatctactgcactt

SEQ ID NO: 130866 - DNA, 20 bp, Artificial
  CRISPR gRNA sequence
cccatatctactgcacttaa

SEQ ID NO: 130867 - DNA, 20 bp, Artificial
  CRISPR gRNA sequence
ccatatctactgcacttaag

SEQ ID NO: 130868 - DNA, 20 bp, Artificial
  CRISPR gRNA sequence
ctgcacttaagagttagcat

SEQ ID NO: 130869 - DNA, 20 bp, Artificial
  CRISPR gRNA sequence
cacttaagagttagcatttt

SEQ ID NO: 130870 - DNA, 20 bp, Artificial
  CRISPR gRNA sequence
aagagttagcattttccatt

SEQ ID NO: 130871 - DNA, 20 bp, Artificial
  CRISPR gRNA sequence
agagttagcattttccattc

SEQ ID NO: 130872 - DNA, 20 bp, Artificial
  CRISPR gRNA sequence
gcattttccattctgggcat

SEQ ID NO: 130873 - DNA, 20 bp, Artificial
  CRISPR gRNA sequence
tccattctgggcataactgt

SEQ ID NO: 130874 - DNA, 20 bp, Artificial
  CRISPR gRNA sequence
ccattctgggcataactgtc

SEQ ID NO: 130875 - DNA, 20 bp, Artificial
  CRISPR gRNA sequence
cattctgggcataactgtcc

SEQ ID NO: 130876 - DNA, 20 bp, Artificial
  CRISPR gRNA sequence
tgggcataactgtcccctaa

SEQ ID NO: 130877 - DNA, 20 bp, Artificial
  CRISPR gRNA sequence
ggcataactgtcccctaagt

SEQ ID NO: 130878 - DNA, 20 bp, Artificial
  CRISPR gRNA sequence
tcccctaagtattcaattaa

SEQ ID NO: 130879 - DNA, 20 bp, Artificial
  CRISPR gRNA sequence
agtattcaattaattggcta

SEQ ID NO: 130880 - DNA, 20 bp, Artificial
  CRISPR gRNA sequence
aattaattggctaaacagac

SEQ ID NO: 130881 - DNA, 20 bp, Artificial
  CRISPR gRNA sequence
attggctaaacagacagccc

SEQ ID NO: 130882 - DNA, 20 bp, Artificial
  CRISPR gRNA sequence
gctaaacagacagccccttt

SEQ ID NO: 130883 - DNA, 20 bp, Artificial
  CRISPR gRNA sequence
aacagacagcccctttacag

SEQ ID NO: 130884 - DNA, 20 bp, Artificial
  CRISPR gRNA sequence
tacagctgggacaggctacc

SEQ ID NO: 130885 - DNA, 20 bp, Artificial
  CRISPR gRNA sequence
acagctgggacaggctaccc

SEQ ID NO: 130886 - DNA, 20 bp, Artificial
  CRISPR gRNA sequence
cagctgggacaggctaccct

SEQ ID NO: 130887 - DNA, 20 bp, Artificial
  CRISPR gRNA sequence
ggacaggctaccctgtagcc

SEQ ID NO: 130888 - DNA, 20 bp, Artificial
  CRISPR gRNA sequence
ccctgtagcctcaacagcac

SEQ ID NO: 130889 - DNA, 20 bp, Artificial
  CRISPR gRNA sequence
tagcctcaacagcacttagg

SEQ ID NO: 130890 - DNA, 20 bp, Artificial
  CRISPR gRNA sequence
aacagcacttagggacccat

SEQ ID NO: 130891 - DNA, 20 bp, Artificial
  CRISPR gRNA sequence
agggacccatgggaaataat

SEQ ID NO: 130892 - DNA, 20 bp, Artificial
  CRISPR gRNA sequence
gggacccatgggaaataata

SEQ ID NO: 130893 - DNA, 20 bp, Artificial
  CRISPR gRNA sequence
aaaataaggaagcaacagga

SEQ ID NO: 130894 - DNA, 20 bp, Artificial
  CRISPR gRNA sequence
tctgtctagacttgaaatgc

SEQ ID NO: 130895 - DNA, 20 bp, Artificial
  CRISPR gRNA sequence
tctagacttgaaatgcattc

SEQ ID NO: 130896 - DNA, 20 bp, Artificial
  CRISPR gRNA sequence
gacttgaaatgcattcattc

SEQ ID NO: 130897 - DNA, 20 bp, Artificial
  CRISPR gRNA sequence
gaaatgcattcattctacca

SEQ ID NO: 130898 - DNA, 20 bp, Artificial
  CRISPR gRNA sequence
aaatgcattcattctaccag

SEQ ID NO: 130899 - DNA, 20 bp, Artificial
  CRISPR gRNA sequence
attctaccaggcacctccag

SEQ ID NO: 130900 - DNA, 20 bp, Artificial
  CRISPR gRNA sequence
taccaggcacctccagtata

SEQ ID NO: 130901 - DNA, 20 bp, Artificial
  CRISPR gRNA sequence
ccaggcacctccagtataaa

SEQ ID NO: 130902 - DNA, 20 bp, Artificial
  CRISPR gRNA sequence
cagtataaattggttacaat

SEQ ID NO: 130903 - DNA, 20 bp, Artificial
  CRISPR gRNA sequence
gttacaattttatttccagc

SEQ ID NO: 130904 - DNA, 20 bp, Artificial
  CRISPR gRNA sequence
caattttatttccagccaat

SEQ ID NO: 130905 - DNA, 20 bp, Artificial
  CRISPR gRNA sequence
tatttccagccaattactat

SEQ ID NO: 130906 - DNA, 20 bp, Artificial
  CRISPR gRNA sequence
atttccagccaattactatt

SEQ ID NO: 130907 - DNA, 20 bp, Artificial
  CRISPR gRNA sequence
tttccagccaattactattc

SEQ ID NO: 130908 - DNA, 20 bp, Artificial
  CRISPR gRNA sequence
ccagccaattactattcaaa

SEQ ID NO: 130909 - DNA, 20 bp, Artificial
  CRISPR gRNA sequence
cagccaattactattcaaat

SEQ ID NO: 130910 - DNA, 20 bp, Artificial
  CRISPR gRNA sequence
ctattcaaatctaattaaca

SEQ ID NO: 130911 - DNA, 20 bp, Artificial
  CRISPR gRNA sequence
ttcaaatctaattaacaacc

SEQ ID NO: 130912 - DNA, 20 bp, Artificial
  CRISPR gRNA sequence
aaatctaattaacaaccaaa

SEQ ID NO: 130913 - DNA, 20 bp, Artificial
  CRISPR gRNA sequence
attaacaaccaaaatggtaa

SEQ ID NO: 130914 - DNA, 20 bp, Artificial
  CRISPR gRNA sequence
acaaccaaaatggtaaaata

SEQ ID NO: 130915 - DNA, 20 bp, Artificial
  CRISPR gRNA sequence
actgtcatgaaatactgtca

SEQ ID NO: 130916 - DNA, 20 bp, Artificial
  CRISPR gRNA sequence
ctgtcatgaaatactgtcag

SEQ ID NO: 130917 - DNA, 20 bp, Artificial
  CRISPR gRNA sequence
tcatgaaatactgtcagaac

SEQ ID NO: 130918 - DNA, 20 bp, Artificial
  CRISPR gRNA sequence
tcagaaccgtgttgtcagtg

SEQ ID NO: 130919 - DNA, 20 bp, Artificial
  CRISPR gRNA sequence
tcagtggtgctgaagaacac

SEQ ID NO: 130920 - DNA, 20 bp, Artificial
  CRISPR gRNA sequence
aagaacacctatctaaaaag

SEQ ID NO: 130921 - DNA, 20 bp, Artificial
  CRISPR gRNA sequence
tctaaaaaggtgtctaatct

SEQ ID NO: 130922 - DNA, 20 bp, Artificial
  CRISPR gRNA sequence
aaaaggtgtctaatctttgt

SEQ ID NO: 130923 - DNA, 20 bp, Artificial
  CRISPR gRNA sequence
atctttgtgatttcaaccta

SEQ ID NO: 130924 - DNA, 20 bp, Artificial
  CRISPR gRNA sequence
tgtgatttcaacctaaaaga

SEQ ID NO: 130925 - DNA, 20 bp, Artificial
  CRISPR gRNA sequence
gtgatttcaacctaaaagat

SEQ ID NO: 130926 - DNA, 20 bp, Artificial
  CRISPR gRNA sequence
tgatttcaacctaaaagata

SEQ ID NO: 130927 - DNA, 20 bp, Artificial
  CRISPR gRNA sequence
caacctaaaagataaacatc

SEQ ID NO: 130928 - DNA, 20 bp, Artificial
  CRISPR gRNA sequence
aacctaaaagataaacatct

SEQ ID NO: 130929 - DNA, 20 bp, Artificial
  CRISPR gRNA sequence
aaagataaacatctattagg

SEQ ID NO: 130930 - DNA, 20 bp, Artificial
  CRISPR gRNA sequence
ttaggacctaacatctatca

SEQ ID NO: 130931 - DNA, 20 bp, Artificial
  CRISPR gRNA sequence
ggacctaacatctatcaata

SEQ ID NO: 130932 - DNA, 20 bp, Artificial
  CRISPR gRNA sequence
acatctatcaatagtaaaaa

SEQ ID NO: 130933 - DNA, 20 bp, Artificial
  CRISPR gRNA sequence
tcaatagtaaaaatacatca

SEQ ID NO: 130934 - DNA, 20 bp, Artificial
  CRISPR gRNA sequence
ataggctttttttctcataa

SEQ ID NO: 130935 - DNA, 20 bp, Artificial
  CRISPR gRNA sequence
taggctttttttctcataaa

SEQ ID NO: 130936 - DNA, 20 bp, Artificial
  CRISPR gRNA sequence
tttttctcataaaattaaag

SEQ ID NO: 130937 - DNA, 20 bp, Artificial
  CRISPR gRNA sequence
ttttctcataaaattaaaga

SEQ ID NO: 130938 - DNA, 20 bp, Artificial
  CRISPR gRNA sequence
tttctcataaaattaaagag

SEQ ID NO: 130939 - DNA, 20 bp, Artificial
  CRISPR gRNA sequence
ttctcataaaattaaagagg

SEQ ID NO: 130940 - DNA, 20 bp, Artificial
  CRISPR gRNA sequence
tctcataaaattaaagaggg

SEQ ID NO: 130941 - DNA, 20 bp, Artificial
  CRISPR gRNA sequence
ctcataaaattaaagagggc

SEQ ID NO: 130942 - DNA, 20 bp, Artificial
  CRISPR gRNA sequence
tcataaaattaaagagggct

SEQ ID NO: 130943 - DNA, 20 bp, Artificial
  CRISPR gRNA sequence
ataaaattaaagagggcttg

SEQ ID NO: 130944 - DNA, 20 bp, Artificial
  CRISPR gRNA sequence
aagagggcttgtataatttt

SEQ ID NO: 130945 - DNA, 20 bp, Artificial
  CRISPR gRNA sequence
gtataattttgactactatt

SEQ ID NO: 130946 - DNA, 20 bp, Artificial
  CRISPR gRNA sequence
tataattttgactactattc

SEQ ID NO: 130947 - DNA, 20 bp, Artificial
  CRISPR gRNA sequence
tgactactattcttaatcaa

SEQ ID NO: 130948 - DNA, 20 bp, Artificial
  CRISPR gRNA sequence
gactactattcttaatcaat

SEQ ID NO: 130949 - DNA, 20 bp, Artificial
  CRISPR gRNA sequence
actactattcttaatcaatg

SEQ ID NO: 130950 - DNA, 20 bp, Artificial
  CRISPR gRNA sequence
ctattcttaatcaatggagt

SEQ ID NO: 130951 - DNA, 20 bp, Artificial
  CRISPR gRNA sequence
ttcttaatcaatggagtaca

SEQ ID NO: 130952 - DNA, 20 bp, Artificial
  CRISPR gRNA sequence
ttaatcaatggagtacatgg

SEQ ID NO: 130953 - DNA, 20 bp, Artificial
  CRISPR gRNA sequence
aatcaatggagtacatggta

SEQ ID NO: 130954 - DNA, 20 bp, Artificial
  CRISPR gRNA sequence
atcaatggagtacatggtat

SEQ ID NO: 130955 - DNA, 20 bp, Artificial
  CRISPR gRNA sequence
gttgacttgaaagatttatt

SEQ ID NO: 130956 - DNA, 20 bp, Artificial
  CRISPR gRNA sequence
ttgacttgaaagatttattt

SEQ ID NO: 130957 - DNA, 20 bp, Artificial
  CRISPR gRNA sequence
acttgaaagatttattttgg

SEQ ID NO: 130958 - DNA, 20 bp, Artificial
  CRISPR gRNA sequence
gaaagatttattttggagaa

SEQ ID NO: 130959 - DNA, 20 bp, Artificial
  CRISPR gRNA sequence
aaagatttattttggagaac

SEQ ID NO: 130960 - DNA, 20 bp, Artificial
  CRISPR gRNA sequence
attttggagaacttaaaaac

SEQ ID NO: 130961 - DNA, 20 bp, Artificial
  CRISPR gRNA sequence
ttttggagaacttaaaaaca

SEQ ID NO: 130962 - DNA, 20 bp, Artificial
  CRISPR gRNA sequence
tggagaacttaaaaacaagt

SEQ ID NO: 130963 - DNA, 20 bp, Artificial
  CRISPR gRNA sequence
ggagaacttaaaaacaagtt

SEQ ID NO: 130964 - DNA, 20 bp, Artificial
  CRISPR gRNA sequence
gagaacttaaaaacaagtta

SEQ ID NO: 130965 - DNA, 20 bp, Artificial
  CRISPR gRNA sequence
aaaaacaagttaattccatg

SEQ ID NO: 130966 - DNA, 20 bp, Artificial
  CRISPR gRNA sequence
aaaacaagttaattccatgg

SEQ ID NO: 130967 - DNA, 20 bp, Artificial
  CRISPR gRNA sequence
attccatggggaaaggagaa

SEQ ID NO: 130968 - DNA, 20 bp, Artificial
  CRISPR gRNA sequence
catggggaaaggagaaaatg

SEQ ID NO: 130969 - DNA, 20 bp, Artificial
  CRISPR gRNA sequence
tccaacataaccctgaattt

SEQ ID NO: 130970 - DNA, 20 bp, Artificial
  CRISPR gRNA sequence
ccaacataaccctgaattta

SEQ ID NO: 130971 - DNA, 20 bp, Artificial
  CRISPR gRNA sequence
caacataaccctgaatttag

SEQ ID NO: 130972 - DNA, 20 bp, Artificial
  CRISPR gRNA sequence
aatttagccatattcatcat

SEQ ID NO: 130973 - DNA, 20 bp, Artificial
  CRISPR gRNA sequence
agccatattcatcataaaca

SEQ ID NO: 130974 - DNA, 20 bp, Artificial
  CRISPR gRNA sequence
gccatattcatcataaacat

SEQ ID NO: 130975 - DNA, 20 bp, Artificial
  CRISPR gRNA sequence
atcataaacattcattacaa

SEQ ID NO: 130976 - DNA, 20 bp, Artificial
  CRISPR gRNA sequence
attacaatacaccaaaaagg

SEQ ID NO: 130977 - DNA, 20 bp, Artificial
  CRISPR gRNA sequence
caatacaccaaaaagggacc

SEQ ID NO: 130978 - DNA, 20 bp, Artificial
  CRISPR gRNA sequence
tataatatgcaagagaccaa

SEQ ID NO: 130979 - DNA, 20 bp, Artificial
  CRISPR gRNA sequence
tacatctaaattacttaaaa

SEQ ID NO: 130980 - DNA, 20 bp, Artificial
  CRISPR gRNA sequence
aattacttaaaacattaaca

SEQ ID NO: 130981 - DNA, 20 bp, Artificial
  CRISPR gRNA sequence
cttaaaacattaacactcaa

SEQ ID NO: 130982 - DNA, 20 bp, Artificial
  CRISPR gRNA sequence
aaaacattaacactcaagat

SEQ ID NO: 130983 - DNA, 20 bp, Artificial
  CRISPR gRNA sequence
aaacattaacactcaagatg

SEQ ID NO: 130984 - DNA, 20 bp, Artificial
  CRISPR gRNA sequence
acactcaagatgcaaacaca

SEQ ID NO: 130985 - DNA, 20 bp, Artificial
  CRISPR gRNA sequence
aagatgcaaacacacccctt

SEQ ID NO: 130986 - DNA, 20 bp, Artificial
  CRISPR gRNA sequence
atcatcttaattttttggtg

SEQ ID NO: 130987 - DNA, 20 bp, Artificial
  CRISPR gRNA sequence
tcatcttaattttttggtga

SEQ ID NO: 130988 - DNA, 20 bp, Artificial
  CRISPR gRNA sequence
aattttttggtgatggtttt

SEQ ID NO: 130989 - DNA, 20 bp, Artificial
  CRISPR gRNA sequence
attttttggtgatggttttc

SEQ ID NO: 130990 - DNA, 20 bp, Artificial
  CRISPR gRNA sequence
tttggtgatggttttcttaa

SEQ ID NO: 130991 - DNA, 20 bp, Artificial
  CRISPR gRNA sequence
ttggtgatggttttcttaaa

SEQ ID NO: 130992 - DNA, 20 bp, Artificial
  CRISPR gRNA sequence
tggtgatggttttcttaaat

SEQ ID NO: 130993 - DNA, 20 bp, Artificial
  CRISPR gRNA sequence
ggtgatggttttcttaaatg

SEQ ID NO: 130994 - DNA, 20 bp, Artificial
  CRISPR gRNA sequence
gtgatggttttcttaaatgt

SEQ ID NO: 130995 - DNA, 20 bp, Artificial
  CRISPR gRNA sequence
tcttaaatgtttcagagtaa

SEQ ID NO: 130996 - DNA, 20 bp, Artificial
  CRISPR gRNA sequence
cttaaatgtttcagagtaac

SEQ ID NO: 130997 - DNA, 20 bp, Artificial
  CRISPR gRNA sequence
ttaaatgtttcagagtaaca

SEQ ID NO: 130998 - DNA, 20 bp, Artificial
  CRISPR gRNA sequence
aaatgtttcagagtaacatt

SEQ ID NO: 130999 - DNA, 20 bp, Artificial
  CRISPR gRNA sequence
aatgtttcagagtaacattt

SEQ ID NO: 131000 - DNA, 20 bp, Artificial
  CRISPR gRNA sequence
cagagtaacatttagacatt

SEQ ID NO: 131001 - DNA, 20 bp, Artificial
  CRISPR gRNA sequence
agagtaacatttagacattc

SEQ ID NO: 131002 - DNA, 20 bp, Artificial
  CRISPR gRNA sequence
agacattctatagctcaaga

SEQ ID NO: 131003 - DNA, 20 bp, Artificial
  CRISPR gRNA sequence
gacattctatagctcaagag

SEQ ID NO: 131004 - DNA, 20 bp, Artificial
  CRISPR gRNA sequence
tatagctcaagaggaggaaa

SEQ ID NO: 131005 - DNA, 20 bp, Artificial
  CRISPR gRNA sequence
tagctcaagaggaggaaaaa

SEQ ID NO: 131006 - DNA, 20 bp, Artificial
  CRISPR gRNA sequence
aagaggaggaaaaaattatc

SEQ ID NO: 131007 - DNA, 20 bp, Artificial
  CRISPR gRNA sequence
tctgagaatataatgctttt

SEQ ID NO: 131008 - DNA, 20 bp, Artificial
  CRISPR gRNA sequence
agaatataatgcttttcaat

SEQ ID NO: 131009 - DNA, 20 bp, Artificial
  CRISPR gRNA sequence
ttcaattaagaatctcagat

SEQ ID NO: 131010 - DNA, 20 bp, Artificial
  CRISPR gRNA sequence
tcaattaagaatctcagatt

SEQ ID NO: 131011 - DNA, 20 bp, Artificial
  CRISPR gRNA sequence
caattaagaatctcagatta

SEQ ID NO: 131012 - DNA, 20 bp, Artificial
  CRISPR gRNA sequence
aattaagaatctcagattat

SEQ ID NO: 131013 - DNA, 20 bp, Artificial
  CRISPR gRNA sequence
agaatctcagattatactgt

SEQ ID NO: 131014 - DNA, 20 bp, Artificial
  CRISPR gRNA sequence
agattatactgtaatgaaga

SEQ ID NO: 131015 - DNA, 20 bp, Artificial
  CRISPR gRNA sequence
tactgtaatgaagatacatt

SEQ ID NO: 131016 - DNA, 20 bp, Artificial
  CRISPR gRNA sequence
taatgaagatacattctgca

SEQ ID NO: 131017 - DNA, 20 bp, Artificial
  CRISPR gRNA sequence
tgcactgagaagatatcaaa

SEQ ID NO: 131018 - DNA, 20 bp, Artificial
  CRISPR gRNA sequence
cactgagaagatatcaaaaa

SEQ ID NO: 131019 - DNA, 20 bp, Artificial
  CRISPR gRNA sequence
agaagatatcaaaaaagcaa

SEQ ID NO: 131020 - DNA, 20 bp, Artificial
  CRISPR gRNA sequence
atttataattttgaagcacc

SEQ ID NO: 131021 - DNA, 20 bp, Artificial
  CRISPR gRNA sequence
tttataattttgaagcacca

SEQ ID NO: 131022 - DNA, 20 bp, Artificial
  CRISPR gRNA sequence
ataattttgaagcaccacca

SEQ ID NO: 131023 - DNA, 20 bp, Artificial
  CRISPR gRNA sequence
taattttgaagcaccaccat

SEQ ID NO: 131024 - DNA, 20 bp, Artificial
  CRISPR gRNA sequence
tgaagcaccaccatttttga

SEQ ID NO: 131025 - DNA, 20 bp, Artificial
  CRISPR gRNA sequence
gaagcaccaccatttttgac

SEQ ID NO: 131026 - DNA, 20 bp, Artificial
  CRISPR gRNA sequence
aagcaccaccatttttgact

SEQ ID NO: 131027 - DNA, 20 bp, Artificial
  CRISPR gRNA sequence
ttgactaaaattgcatcgaa

SEQ ID NO: 131028 - DNA, 20 bp, Artificial
  CRISPR gRNA sequence
tgactaaaattgcatcgaaa

SEQ ID NO: 131029 - DNA, 20 bp, Artificial
  CRISPR gRNA sequence
gactaaaattgcatcgaaat

SEQ ID NO: 131030 - DNA, 20 bp, Artificial
  CRISPR gRNA sequence
actaaaattgcatcgaaata

SEQ ID NO: 131031 - DNA, 20 bp, Artificial
  CRISPR gRNA sequence
aaattgcatcgaaatagcac

SEQ ID NO: 131032 - DNA, 20 bp, Artificial
  CRISPR gRNA sequence
catcgaaatagcacttcagt

SEQ ID NO: 131033 - DNA, 20 bp, Artificial
  CRISPR gRNA sequence
cagtctcactgtaaggcata

SEQ ID NO: 131034 - DNA, 20 bp, Artificial
  CRISPR gRNA sequence
agtctcactgtaaggcataa

SEQ ID NO: 131035 - DNA, 20 bp, Artificial
  CRISPR gRNA sequence
actgtaaggcataaatagct

SEQ ID NO: 131036 - DNA, 20 bp, Artificial
  CRISPR gRNA sequence
taaggcataaatagctgaac

SEQ ID NO: 131037 - DNA, 20 bp, Artificial
  CRISPR gRNA sequence
aacaaattagtaccaattgc

SEQ ID NO: 131038 - DNA, 20 bp, Artificial
  CRISPR gRNA sequence
gtaccaattgctgtgttaca

SEQ ID NO: 131039 - DNA, 20 bp, Artificial
  CRISPR gRNA sequence
ctgtgttacaagtttcattt

SEQ ID NO: 131040 - DNA, 20 bp, Artificial
  CRISPR gRNA sequence
tgttacaagtttcatttctc

SEQ ID NO: 131041 - DNA, 20 bp, Artificial
  CRISPR gRNA sequence
caagtttcatttctcatttg

SEQ ID NO: 131042 - DNA, 20 bp, Artificial
  CRISPR gRNA sequence
catttctcatttgctccatt

SEQ ID NO: 131043 - DNA, 20 bp, Artificial
  CRISPR gRNA sequence
atttctcatttgctccattc

SEQ ID NO: 131044 - DNA, 20 bp, Artificial
  CRISPR gRNA sequence
ctcatttgctccattctttc

SEQ ID NO: 131045 - DNA, 20 bp, Artificial
  CRISPR gRNA sequence
tcatttgctccattctttct

SEQ ID NO: 131046 - DNA, 20 bp, Artificial
  CRISPR gRNA sequence
atttgctccattctttctca

SEQ ID NO: 131047 - DNA, 20 bp, Artificial
  CRISPR gRNA sequence
gctccattctttctcaaagg

SEQ ID NO: 131048 - DNA, 20 bp, Artificial
  CRISPR gRNA sequence
ctccattctttctcaaagga

SEQ ID NO: 131049 - DNA, 20 bp, Artificial
  CRISPR gRNA sequence
cattctttctcaaaggaaac

SEQ ID NO: 131050 - DNA, 20 bp, Artificial
  CRISPR gRNA sequence
tttctcaaaggaaacaatta

SEQ ID NO: 131051 - DNA, 20 bp, Artificial
  CRISPR gRNA sequence
tctcaaaggaaacaattaaa

SEQ ID NO: 131052 - DNA, 20 bp, Artificial
  CRISPR gRNA sequence
ctcaaaggaaacaattaaat

SEQ ID NO: 131053 - DNA, 20 bp, Artificial
  CRISPR gRNA sequence
tcaaaggaaacaattaaatg

SEQ ID NO: 131054 - DNA, 20 bp, Artificial
  CRISPR gRNA sequence
aaaggaaacaattaaatggg

SEQ ID NO: 131055 - DNA, 20 bp, Artificial
  CRISPR gRNA sequence
aatgggggaggggtaggatg

SEQ ID NO: 131056 - DNA, 20 bp, Artificial
  CRISPR gRNA sequence
tcagtgttaattttaaaggg

SEQ ID NO: 131057 - DNA, 20 bp, Artificial
  CRISPR gRNA sequence
cagtgttaattttaaaggga

SEQ ID NO: 131058 - DNA, 20 bp, Artificial
  CRISPR gRNA sequence
agtgttaattttaaagggag

SEQ ID NO: 131059 - DNA, 20 bp, Artificial
  CRISPR gRNA sequence
attttaaagggagaagatat

SEQ ID NO: 131060 - DNA, 20 bp, Artificial
  CRISPR gRNA sequence
taaagggagaagatatactg

SEQ ID NO: 131061 - DNA, 20 bp, Artificial
  CRISPR gRNA sequence
aaagggagaagatatactga

SEQ ID NO: 131062 - DNA, 20 bp, Artificial
  CRISPR gRNA sequence
aagggagaagatatactgat

SEQ ID NO: 131063 - DNA, 20 bp, Artificial
  CRISPR gRNA sequence
atacgcatccaagcatgaaa

SEQ ID NO: 131064 - DNA, 20 bp, Artificial
  CRISPR gRNA sequence
gcaaatagcagaaaaaattg

SEQ ID NO: 131065 - DNA, 20 bp, Artificial
  CRISPR gRNA sequence
tagccactgaattgaaagtt

SEQ ID NO: 131066 - DNA, 20 bp, Artificial
  CRISPR gRNA sequence
aattgaaagtttttaatgcc

SEQ ID NO: 131067 - DNA, 20 bp, Artificial
  CRISPR gRNA sequence
aaagtttttaatgccactaa

SEQ ID NO: 131068 - DNA, 20 bp, Artificial
  CRISPR gRNA sequence
ttaatgccactaaaaaggtc

SEQ ID NO: 131069 - DNA, 20 bp, Artificial
  CRISPR gRNA sequence
taatgccactaaaaaggtcc

SEQ ID NO: 131070 - DNA, 20 bp, Artificial
  CRISPR gRNA sequence
aatgccactaaaaaggtcca

SEQ ID NO: 131071 - DNA, 20 bp, Artificial
  CRISPR gRNA sequence
atgccactaaaaaggtccag

SEQ ID NO: 131072 - DNA, 20 bp, Artificial
  CRISPR gRNA sequence
aaaaggtccaggtagcaaaa

SEQ ID NO: 131073 - DNA, 20 bp, Artificial
  CRISPR gRNA sequence
cttgacgtttgctataatat

SEQ ID NO: 131074 - DNA, 20 bp, Artificial
  CRISPR gRNA sequence
gacgtttgctataatattaa

SEQ ID NO: 131075 - DNA, 20 bp, Artificial
  CRISPR gRNA sequence
acgtttgctataatattaaa

SEQ ID NO: 131076 - DNA, 20 bp, Artificial
  CRISPR gRNA sequence
gctataatattaaaagtaat

SEQ ID NO: 131077 - DNA, 20 bp, Artificial
  CRISPR gRNA sequence
ctataatattaaaagtaatt

SEQ ID NO: 131078 - DNA, 20 bp, Artificial
  CRISPR gRNA sequence
taatattaaaagtaatttat

SEQ ID NO: 131079 - DNA, 20 bp, Artificial
  CRISPR gRNA sequence
aaagtaatttataatttctt

SEQ ID NO: 131080 - DNA, 20 bp, Artificial
  CRISPR gRNA sequence
ataatttcttttcaaatatt

SEQ ID NO: 131081 - DNA, 20 bp, Artificial
  CRISPR gRNA sequence
taatttcttttcaaatatta

SEQ ID NO: 131082 - DNA, 20 bp, Artificial
  CRISPR gRNA sequence
cttttcaaatattaatagta

SEQ ID NO: 131083 - DNA, 20 bp, Artificial
  CRISPR gRNA sequence
ttttcaaatattaatagtat

SEQ ID NO: 131084 - DNA, 20 bp, Artificial
  CRISPR gRNA sequence
ttcaaatattaatagtatcc

SEQ ID NO: 131085 - DNA, 20 bp, Artificial
  CRISPR gRNA sequence
tcaaatattaatagtatcct

SEQ ID NO: 131086 - DNA, 20 bp, Artificial
  CRISPR gRNA sequence
caaatattaatagtatcctc

SEQ ID NO: 131087 - DNA, 20 bp, Artificial
  CRISPR gRNA sequence
aaatattaatagtatcctct

SEQ ID NO: 131088 - DNA, 20 bp, Artificial
  CRISPR gRNA sequence
atagtatcctctaaccccaa

SEQ ID NO: 131089 - DNA, 20 bp, Artificial
  CRISPR gRNA sequence
taaccccaaaactgctcaga

SEQ ID NO: 131090 - DNA, 20 bp, Artificial
  CRISPR gRNA sequence
accccaaaactgctcagaaa

SEQ ID NO: 131091 - DNA, 20 bp, Artificial
  CRISPR gRNA sequence
ctcagaaaagtccttccttg

SEQ ID NO: 131092 - DNA, 20 bp, Artificial
  CRISPR gRNA sequence
agaaaagtccttccttgtaa

SEQ ID NO: 131093 - DNA, 20 bp, Artificial
  CRISPR gRNA sequence
ccttgtaacgagaaatgtta

SEQ ID NO: 131094 - DNA, 20 bp, Artificial
  CRISPR gRNA sequence
cttgtaacgagaaatgttat

SEQ ID NO: 131095 - DNA, 20 bp, Artificial
  CRISPR gRNA sequence
gtaacgagaaatgttatttt

SEQ ID NO: 131096 - DNA, 20 bp, Artificial
  CRISPR gRNA sequence
taacgagaaatgttattttt

SEQ ID NO: 131097 - DNA, 20 bp, Artificial
  CRISPR gRNA sequence
ttttttaaagagtgtctttg

SEQ ID NO: 131098 - DNA, 20 bp, Artificial
  CRISPR gRNA sequence
tttaaagagtgtctttgaaa

SEQ ID NO: 131099 - DNA, 20 bp, Artificial
  CRISPR gRNA sequence
ttaaagagtgtctttgaaaa

SEQ ID NO: 131100 - DNA, 20 bp, Artificial
  CRISPR gRNA sequence
taaagagtgtctttgaaaaa

SEQ ID NO: 131101 - DNA, 20 bp, Artificial
  CRISPR gRNA sequence
aaagagtgtctttgaaaaaa

SEQ ID NO: 131102 - DNA, 20 bp, Artificial
  CRISPR gRNA sequence
aagagtgtctttgaaaaaat

SEQ ID NO: 131103 - DNA, 20 bp, Artificial
  CRISPR gRNA sequence
tgaaaaaataagccctcaga

SEQ ID NO: 131104 - DNA, 20 bp, Artificial
  CRISPR gRNA sequence
gaaaaaataagccctcagaa

SEQ ID NO: 131105 - DNA, 20 bp, Artificial
  CRISPR gRNA sequence
aaaaaataagccctcagaac

SEQ ID NO: 131106 - DNA, 20 bp, Artificial
  CRISPR gRNA sequence
agaacacttaaaacatggga

SEQ ID NO: 131107 - DNA, 20 bp, Artificial
  CRISPR gRNA sequence
aaaacatgggagctatattt

SEQ ID NO: 131108 - DNA, 20 bp, Artificial
  CRISPR gRNA sequence
aaacatgggagctatattta

SEQ ID NO: 131109 - DNA, 20 bp, Artificial
  CRISPR gRNA sequence
tatttatgtattttgcttgg

SEQ ID NO: 131110 - DNA, 20 bp, Artificial
  CRISPR gRNA sequence
atgtattttgcttggaatgg

SEQ ID NO: 131111 - DNA, 20 bp, Artificial
  CRISPR gRNA sequence
tgtattttgcttggaatggg

SEQ ID NO: 131112 - DNA, 20 bp, Artificial
  CRISPR gRNA sequence
tgcttggaatgggagagggg

SEQ ID NO: 131113 - DNA, 20 bp, Artificial
  CRISPR gRNA sequence
gcttggaatgggagaggggg

SEQ ID NO: 131114 - DNA, 20 bp, Artificial
  CRISPR gRNA sequence
cttggaatgggagagggggg

SEQ ID NO: 131115 - DNA, 20 bp, Artificial
  CRISPR gRNA sequence
ggaatgggagaggggggtgt

SEQ ID NO: 131116 - DNA, 20 bp, Artificial
  CRISPR gRNA sequence
gaatgggagaggggggtgtg

SEQ ID NO: 131117 - DNA, 20 bp, Artificial
  CRISPR gRNA sequence
actcacccaaatagttgatt

SEQ ID NO: 131118 - DNA, 20 bp, Artificial
  CRISPR gRNA sequence
acccaaatagttgattcagt

SEQ ID NO: 131119 - DNA, 20 bp, Artificial
  CRISPR gRNA sequence
attcagtatatatttagact

SEQ ID NO: 131120 - DNA, 20 bp, Artificial
  CRISPR gRNA sequence
agtatatatttagactcagt

SEQ ID NO: 131121 - DNA, 20 bp, Artificial
  CRISPR gRNA sequence
agactcagtacattaaagaa

SEQ ID NO: 131122 - DNA, 20 bp, Artificial
  CRISPR gRNA sequence
gactcagtacattaaagaaa

SEQ ID NO: 131123 - DNA, 20 bp, Artificial
  CRISPR gRNA sequence
agtacattaaagaaaaacac

SEQ ID NO: 131124 - DNA, 20 bp, Artificial
  CRISPR gRNA sequence
aagaaaaacactgtcacctc

SEQ ID NO: 131125 - DNA, 20 bp, Artificial
  CRISPR gRNA sequence
tcacctcatatggtgtatat

SEQ ID NO: 131126 - DNA, 20 bp, Artificial
  CRISPR gRNA sequence
atatggtgtatattttctta

SEQ ID NO: 131127 - DNA, 20 bp, Artificial
  CRISPR gRNA sequence
tcttaagggcaggttgatat

SEQ ID NO: 131128 - DNA, 20 bp, Artificial
  CRISPR gRNA sequence
cttaagggcaggttgatata

SEQ ID NO: 131129 - DNA, 20 bp, Artificial
  CRISPR gRNA sequence
ttaagggcaggttgatatat

SEQ ID NO: 131130 - DNA, 20 bp, Artificial
  CRISPR gRNA sequence
aagggcaggttgatatatgt

SEQ ID NO: 131131 - DNA, 20 bp, Artificial
  CRISPR gRNA sequence
agggcaggttgatatatgta

SEQ ID NO: 131132 - DNA, 20 bp, Artificial
  CRISPR gRNA sequence
atatatgtaaaagctcaagg

SEQ ID NO: 131133 - DNA, 20 bp, Artificial
  CRISPR gRNA sequence
aagggaatgcatacatctgt

SEQ ID NO: 131134 - DNA, 20 bp, Artificial
  CRISPR gRNA sequence
tttaatgttttaagaaatgc

SEQ ID NO: 131135 - DNA, 20 bp, Artificial
  CRISPR gRNA sequence
aatgttttaagaaatgcaaa

SEQ ID NO: 131136 - DNA, 20 bp, Artificial
  CRISPR gRNA sequence
atgttttaagaaatgcaaat

SEQ ID NO: 131137 - DNA, 20 bp, Artificial
  CRISPR gRNA sequence
taagaaatgcaaatttgtat

SEQ ID NO: 131138 - DNA, 20 bp, Artificial
  CRISPR gRNA sequence
aagaaatgcaaatttgtatc

SEQ ID NO: 131139 - DNA, 20 bp, Artificial
  CRISPR gRNA sequence
agaaatgcaaatttgtatcc

SEQ ID NO: 131140 - DNA, 20 bp, Artificial
  CRISPR gRNA sequence
gtatccaagaaaagcagtag

SEQ ID NO: 131141 - DNA, 20 bp, Artificial
  CRISPR gRNA sequence
tatccaagaaaagcagtagt

SEQ ID NO: 131142 - DNA, 20 bp, Artificial
  CRISPR gRNA sequence
cctccaccctccattctttg

SEQ ID NO: 131143 - DNA, 20 bp, Artificial
  CRISPR gRNA sequence
ctccaccctccattctttgg

SEQ ID NO: 131144 - DNA, 20 bp, Artificial
  CRISPR gRNA sequence
caccctccattctttggcat

SEQ ID NO: 131145 - DNA, 20 bp, Artificial
  CRISPR gRNA sequence
cattctttggcatcaacaac

SEQ ID NO: 131146 - DNA, 20 bp, Artificial
  CRISPR gRNA sequence
tttggcatcaacaaccagag

SEQ ID NO: 131147 - DNA, 20 bp, Artificial
  CRISPR gRNA sequence
tggcatcaacaaccagagtt

SEQ ID NO: 131148 - DNA, 20 bp, Artificial
  CRISPR gRNA sequence
ggcatcaacaaccagagttt

SEQ ID NO: 131149 - DNA, 20 bp, Artificial
  CRISPR gRNA sequence
gcatcaacaaccagagtttt

SEQ ID NO: 131150 - DNA, 20 bp, Artificial
  CRISPR gRNA sequence
tgcatcaatatacagtaatc

SEQ ID NO: 131151 - DNA, 20 bp, Artificial
  CRISPR gRNA sequence
gcatcaatatacagtaatcc

SEQ ID NO: 131152 - DNA, 20 bp, Artificial
  CRISPR gRNA sequence
catcaatatacagtaatcct

SEQ ID NO: 131153 - DNA, 20 bp, Artificial
  CRISPR gRNA sequence
aaattaagatacaagagcaa

SEQ ID NO: 131154 - DNA, 20 bp, Artificial
  CRISPR gRNA sequence
aattaagatacaagagcaat

SEQ ID NO: 131155 - DNA, 20 bp, Artificial
  CRISPR gRNA sequence
agatacaagagcaatgcagg

SEQ ID NO: 131156 - DNA, 20 bp, Artificial
  CRISPR gRNA sequence
gccttttaaggaattttggt

SEQ ID NO: 131157 - DNA, 20 bp, Artificial
  CRISPR gRNA sequence
ccttttaaggaattttggtt

SEQ ID NO: 131158 - DNA, 20 bp, Artificial
  CRISPR gRNA sequence
ttaaggaattttggttaaac

SEQ ID NO: 131159 - DNA, 20 bp, Artificial
  CRISPR gRNA sequence
taaggaattttggttaaact

SEQ ID NO: 131160 - DNA, 20 bp, Artificial
  CRISPR gRNA sequence
aaggaattttggttaaactt

SEQ ID NO: 131161 - DNA, 20 bp, Artificial
  CRISPR gRNA sequence
aggaattttggttaaacttt

SEQ ID NO: 131162 - DNA, 20 bp, Artificial
  CRISPR gRNA sequence
tggttaaactttcaatactt

SEQ ID NO: 131163 - DNA, 20 bp, Artificial
  CRISPR gRNA sequence
ggttaaactttcaatacttt

SEQ ID NO: 131164 - DNA, 20 bp, Artificial
  CRISPR gRNA sequence
gttaaactttcaatacttta

SEQ ID NO: 131165 - DNA, 20 bp, Artificial
  CRISPR gRNA sequence
aactttcaatactttacaaa

SEQ ID NO: 131166 - DNA, 20 bp, Artificial
  CRISPR gRNA sequence
tcaatactttacaaataaac

SEQ ID NO: 131167 - DNA, 20 bp, Artificial
  CRISPR gRNA sequence
caatactttacaaataaacc

SEQ ID NO: 131168 - DNA, 20 bp, Artificial
  CRISPR gRNA sequence
aatactttacaaataaaccc

SEQ ID NO: 131169 - DNA, 20 bp, Artificial
  CRISPR gRNA sequence
tacaaataaaccccccactg

SEQ ID NO: 131170 - DNA, 20 bp, Artificial
  CRISPR gRNA sequence
acaaataaaccccccactga

SEQ ID NO: 131171 - DNA, 20 bp, Artificial
  CRISPR gRNA sequence
caaataaaccccccactgat

SEQ ID NO: 131172 - DNA, 20 bp, Artificial
  CRISPR gRNA sequence
attagtgccactgatattga

SEQ ID NO: 131173 - DNA, 20 bp, Artificial
  CRISPR gRNA sequence
gtgccactgatattgatccg

SEQ ID NO: 131174 - DNA, 20 bp, Artificial
  CRISPR gRNA sequence
atattgatccgtttgctttc

SEQ ID NO: 131175 - DNA, 20 bp, Artificial
  CRISPR gRNA sequence
atccgtttgctttcatcact

SEQ ID NO: 131176 - DNA, 20 bp, Artificial
  CRISPR gRNA sequence
gctttcatcactttatgttg

SEQ ID NO: 131177 - DNA, 20 bp, Artificial
  CRISPR gRNA sequence
ctttcatcactttatgttgc

SEQ ID NO: 131178 - DNA, 20 bp, Artificial
  CRISPR gRNA sequence
tcatcactttatgttgctga

SEQ ID NO: 131179 - DNA, 20 bp, Artificial
  CRISPR gRNA sequence
catcactttatgttgctgat

SEQ ID NO: 131180 - DNA, 20 bp, Artificial
  CRISPR gRNA sequence
atcactttatgttgctgatt

SEQ ID NO: 131181 - DNA, 20 bp, Artificial
  CRISPR gRNA sequence
tatgttgctgattagtttcc

SEQ ID NO: 131182 - DNA, 20 bp, Artificial
  CRISPR gRNA sequence
atgttgctgattagtttcca

SEQ ID NO: 131183 - DNA, 20 bp, Artificial
  CRISPR gRNA sequence
tgttgctgattagtttccat

SEQ ID NO: 131184 - DNA, 20 bp, Artificial
  CRISPR gRNA sequence
ctgattagtttccatactaa

SEQ ID NO: 131185 - DNA, 20 bp, Artificial
  CRISPR gRNA sequence
attagtttccatactaagag

SEQ ID NO: 131186 - DNA, 20 bp, Artificial
  CRISPR gRNA sequence
gtttccatactaagagagat

SEQ ID NO: 131187 - DNA, 20 bp, Artificial
  CRISPR gRNA sequence
ccatactaagagagatgaaa

SEQ ID NO: 131188 - DNA, 20 bp, Artificial
  CRISPR gRNA sequence
catactaagagagatgaaac

SEQ ID NO: 131189 - DNA, 20 bp, Artificial
  CRISPR gRNA sequence
agagagatgaaaccacccca

SEQ ID NO: 131190 - DNA, 20 bp, Artificial
  CRISPR gRNA sequence
gtagcacgaaccacgcaact

SEQ ID NO: 131191 - DNA, 20 bp, Artificial
  CRISPR gRNA sequence
tagcacgaaccacgcaacta

SEQ ID NO: 131192 - DNA, 20 bp, Artificial
  CRISPR gRNA sequence
tggggtccatgcgggttagt

SEQ ID NO: 131193 - DNA, 20 bp, Artificial
  CRISPR gRNA sequence
gtgggatgccatttttttaa

SEQ ID NO: 131194 - DNA, 20 bp, Artificial
  CRISPR gRNA sequence
ttttaaaggtcgcaggctac

SEQ ID NO: 131195 - DNA, 20 bp, Artificial
  CRISPR gRNA sequence
tttaaaggtcgcaggctacc

SEQ ID NO: 131196 - DNA, 20 bp, Artificial
  CRISPR gRNA sequence
ttaaaggtcgcaggctacct

SEQ ID NO: 131197 - DNA, 20 bp, Artificial
  CRISPR gRNA sequence
taaaggtcgcaggctaccta

SEQ ID NO: 131198 - DNA, 20 bp, Artificial
  CRISPR gRNA sequence
aaaggtcgcaggctacctaa

SEQ ID NO: 131199 - DNA, 20 bp, Artificial
  CRISPR gRNA sequence
aaggtcgcaggctacctaac

SEQ ID NO: 131200 - DNA, 20 bp, Artificial
  CRISPR gRNA sequence
cctaaccttgtttaaattat

SEQ ID NO: 131201 - DNA, 20 bp, Artificial
  CRISPR gRNA sequence
accttgtttaaattatcctg

SEQ ID NO: 131202 - DNA, 20 bp, Artificial
  CRISPR gRNA sequence
gtttaaattatcctgttaga

SEQ ID NO: 131203 - DNA, 20 bp, Artificial
  CRISPR gRNA sequence
tttaaattatcctgttagag

SEQ ID NO: 131204 - DNA, 20 bp, Artificial
  CRISPR gRNA sequence
aaattatcctgttagagtgc

SEQ ID NO: 131205 - DNA, 20 bp, Artificial
  CRISPR gRNA sequence
aattatcctgttagagtgct

SEQ ID NO: 131206 - DNA, 20 bp, Artificial
  CRISPR gRNA sequence
tcctgttagagtgctttggg

SEQ ID NO: 131207 - DNA, 20 bp, Artificial
  CRISPR gRNA sequence
ttagagtgctttgggcgaga

SEQ ID NO: 131208 - DNA, 20 bp, Artificial
  CRISPR gRNA sequence
gagtgctttgggcgagatta

SEQ ID NO: 131209 - DNA, 20 bp, Artificial
  CRISPR gRNA sequence
tgggcgagattacgatttgt

SEQ ID NO: 131210 - DNA, 20 bp, Artificial
  CRISPR gRNA sequence
gggcgagattacgatttgtg

SEQ ID NO: 131211 - DNA, 20 bp, Artificial
  CRISPR gRNA sequence
ggcgagattacgatttgtgg

SEQ ID NO: 131212 - DNA, 20 bp, Artificial
  CRISPR gRNA sequence
cgatttgtgggtgctctgta

SEQ ID NO: 131213 - DNA, 20 bp, Artificial
  CRISPR gRNA sequence
gtgggtgctctgtaattctt

SEQ ID NO: 131214 - DNA, 20 bp, Artificial
  CRISPR gRNA sequence
tgggtgctctgtaattcttt

SEQ ID NO: 131215 - DNA, 20 bp, Artificial
  CRISPR gRNA sequence
tgtaattctttgttctctaa

SEQ ID NO: 131216 - DNA, 20 bp, Artificial
  CRISPR gRNA sequence
taattctttgttctctaaga

SEQ ID NO: 131217 - DNA, 20 bp, Artificial
  CRISPR gRNA sequence
tttgttctctaagactaccg

SEQ ID NO: 131218 - DNA, 20 bp, Artificial
  CRISPR gRNA sequence
tgttctctaagactaccgtt

SEQ ID NO: 131219 - DNA, 20 bp, Artificial
  CRISPR gRNA sequence
gttctctaagactaccgttc

SEQ ID NO: 131220 - DNA, 20 bp, Artificial
  CRISPR gRNA sequence
ttctctaagactaccgttct

SEQ ID NO: 131221 - DNA, 20 bp, Artificial
  CRISPR gRNA sequence
tctaagactaccgttcttta

SEQ ID NO: 131222 - DNA, 20 bp, Artificial
  CRISPR gRNA sequence
taagactaccgttctttaag

SEQ ID NO: 131223 - DNA, 20 bp, Artificial
  CRISPR gRNA sequence
agactaccgttctttaaggc

SEQ ID NO: 131224 - DNA, 20 bp, Artificial
  CRISPR gRNA sequence
ccgttctttaaggccctgca

SEQ ID NO: 131225 - DNA, 20 bp, Artificial
  CRISPR gRNA sequence
tttaaggccctgcatatcct

SEQ ID NO: 131226 - DNA, 20 bp, Artificial
  CRISPR gRNA sequence
taaggccctgcatatcctcc

SEQ ID NO: 131227 - DNA, 20 bp, Artificial
  CRISPR gRNA sequence
aaggccctgcatatcctccc

SEQ ID NO: 131228 - DNA, 20 bp, Artificial
  CRISPR gRNA sequence
aggccctgcatatcctcccg

SEQ ID NO: 131229 - DNA, 20 bp, Artificial
  CRISPR gRNA sequence
catatcctcccgcctcccac

SEQ ID NO: 131230 - DNA, 20 bp, Artificial
  CRISPR gRNA sequence
ccgcctcccaccactaatga

SEQ ID NO: 131231 - DNA, 20 bp, Artificial
  CRISPR gRNA sequence
ccaccactaatgattaaaac

SEQ ID NO: 131232 - DNA, 20 bp, Artificial
  CRISPR gRNA sequence
atgattaaaaccttagtcca

SEQ ID NO: 131233 - DNA, 20 bp, Artificial
  CRISPR gRNA sequence
aaaccttagtccaatccgaa

SEQ ID NO: 131234 - DNA, 20 bp, Artificial
  CRISPR gRNA sequence
agtccaatccgaagggcttc

SEQ ID NO: 131235 - DNA, 20 bp, Artificial
  CRISPR gRNA sequence
gtccaatccgaagggcttcc

SEQ ID NO: 131236 - DNA, 20 bp, Artificial
  CRISPR gRNA sequence
ccttcccaccttcggggcaa

SEQ ID NO: 131237 - DNA, 20 bp, Artificial
  CRISPR gRNA sequence
cttcccaccttcggggcaag

SEQ ID NO: 131238 - DNA, 20 bp, Artificial
  CRISPR gRNA sequence
cccaccttcggggcaagtac

SEQ ID NO: 131239 - DNA, 20 bp, Artificial
  CRISPR gRNA sequence
ccaccttcggggcaagtaca

SEQ ID NO: 131240 - DNA, 20 bp, Artificial
  CRISPR gRNA sequence
cggggcaagtacagggaccg

SEQ ID NO: 131241 - DNA, 20 bp, Artificial
  CRISPR gRNA sequence
ggggcaagtacagggaccgc

SEQ ID NO: 131242 - DNA, 20 bp, Artificial
  CRISPR gRNA sequence
cattctttacgcgcaaacca

SEQ ID NO: 131243 - DNA, 20 bp, Artificial
  CRISPR gRNA sequence
tttacgcgcaaaccaggctg

SEQ ID NO: 131244 - DNA, 20 bp, Artificial
  CRISPR gRNA sequence
tacgcgcaaaccaggctgcg

SEQ ID NO: 131245 - DNA, 20 bp, Artificial
  CRISPR gRNA sequence
acgcgcaaaccaggctgcgg

SEQ ID NO: 131246 - DNA, 20 bp, Artificial
  CRISPR gRNA sequence
cgcgcaaaccaggctgcggg

SEQ ID NO: 131247 - DNA, 20 bp, Artificial
  CRISPR gRNA sequence
cggggaagctaaagccatgc

SEQ ID NO: 131248 - DNA, 20 bp, Artificial
  CRISPR gRNA sequence
aagccatgccttcctcccca

SEQ ID NO: 131249 - DNA, 20 bp, Artificial
  CRISPR gRNA sequence
cctccccacgcaggtgcctg

SEQ ID NO: 131250 - DNA, 20 bp, Artificial
  CRISPR gRNA sequence
ctccccacgcaggtgcctgg

SEQ ID NO: 131251 - DNA, 20 bp, Artificial
  CRISPR gRNA sequence
cccacgcaggtgcctgggtg

SEQ ID NO: 131252 - DNA, 20 bp, Artificial
  CRISPR gRNA sequence
ggtggccccggccccacggc

SEQ ID NO: 131253 - DNA, 20 bp, Artificial
  CRISPR gRNA sequence
gtcccggcgacctgtcagcc

SEQ ID NO: 131254 - DNA, 20 bp, Artificial
  CRISPR gRNA sequence
tcagccctgcgagtgccagg

SEQ ID NO: 131255 - DNA, 20 bp, Artificial
  CRISPR gRNA sequence
cgagtgccaggaggccgccc

SEQ ID NO: 131256 - DNA, 20 bp, Artificial
  CRISPR gRNA sequence
actcgcccggccgccccggc

SEQ ID NO: 131257 - DNA, 20 bp, Artificial
  CRISPR gRNA sequence
gcccggccgccccggccccg

SEQ ID NO: 131258 - DNA, 20 bp, Artificial
  CRISPR gRNA sequence
cctcccacccgccgcgcggc

SEQ ID NO: 131259 - DNA, 20 bp, Artificial
  CRISPR gRNA sequence
ccacccgccgcgcggccccc

SEQ ID NO: 131260 - DNA, 20 bp, Artificial
  CRISPR gRNA sequence
gcgccgccgccggggctacg

SEQ ID NO: 131261 - DNA, 20 bp, Artificial
  CRISPR gRNA sequence
cggggccagggcccgggccg

SEQ ID NO: 131262 - DNA, 20 bp, Artificial
  CRISPR gRNA sequence
ccgcccctcggccggctccc

SEQ ID NO: 131263 - DNA, 20 bp, Artificial
  CRISPR gRNA sequence
ggccggctccccgcacaaaa

SEQ ID NO: 131264 - DNA, 20 bp, Artificial
  CRISPR gRNA sequence
cccgcacaaaatggagccgg

SEQ ID NO: 131265 - DNA, 20 bp, Artificial
  CRISPR gRNA sequence
ctcggccccgggcccggagc

SEQ ID NO: 131266 - DNA, 20 bp, Artificial
  CRISPR gRNA sequence
ggccccgggcccggagctca

SEQ ID NO: 131267 - DNA, 20 bp, Artificial
  CRISPR gRNA sequence
aacggcggcgagggtgaggt

SEQ ID NO: 131268 - DNA, 20 bp, Artificial
  CRISPR gRNA sequence
gcccgcgtcccgccgctcct

SEQ ID NO: 131269 - DNA, 20 bp, Artificial
  CRISPR gRNA sequence
ctcagcccggcgcacaaaga

SEQ ID NO: 131270 - DNA, 20 bp, Artificial
  CRISPR gRNA sequence
agcccggcgcacaaagagcc

SEQ ID NO: 131271 - DNA, 20 bp, Artificial
  CRISPR gRNA sequence
cccggcccggcccgctgcgg

SEQ ID NO: 131272 - DNA, 20 bp, Artificial
  CRISPR gRNA sequence
cgggagcggcctcgcaggcg

SEQ ID NO: 131273 - DNA, 20 bp, Artificial
  CRISPR gRNA sequence
gcaggcgcggggcccggcct

SEQ ID NO: 131274 - DNA, 20 bp, Artificial
  CRISPR gRNA sequence
ggcccgcgcgggagggcggg

SEQ ID NO: 131275 - DNA, 20 bp, Artificial
  CRISPR gRNA sequence
gtgcccccggccgcggcggc

SEQ ID NO: 131276 - DNA, 20 bp, Artificial
  CRISPR gRNA sequence
gcggcggggacggcgccggg

SEQ ID NO: 131277 - DNA, 20 bp, Artificial
  CRISPR gRNA sequence
cattcgagctaaagtggagt

SEQ ID NO: 131278 - DNA, 20 bp, Artificial
  CRISPR gRNA sequence
attcgagctaaagtggagtc

SEQ ID NO: 131279 - DNA, 20 bp, Artificial
  CRISPR gRNA sequence
gagctaaagtggagtcggtt

SEQ ID NO: 131280 - DNA, 20 bp, Artificial
  CRISPR gRNA sequence
aagtggagtcggtttaggag

SEQ ID NO: 131281 - DNA, 20 bp, Artificial
  CRISPR gRNA sequence
aggagcgatcattggccgaa

SEQ ID NO: 131282 - DNA, 20 bp, Artificial
  CRISPR gRNA sequence
ggagcgatcattggccgaag

SEQ ID NO: 131283 - DNA, 20 bp, Artificial
  CRISPR gRNA sequence
gccgaagcgagacacaaacc

SEQ ID NO: 131284 - DNA, 20 bp, Artificial
  CRISPR gRNA sequence
caatgcagccctggttggct

SEQ ID NO: 131285 - DNA, 20 bp, Artificial
  CRISPR gRNA sequence
gttggctcccgtctccaatc

SEQ ID NO: 131286 - DNA, 20 bp, Artificial
  CRISPR gRNA sequence
gctcccgtctccaatcggct

SEQ ID NO: 131287 - DNA, 20 bp, Artificial
  CRISPR gRNA sequence
ccgtctccaatcggctgttt

SEQ ID NO: 131288 - DNA, 20 bp, Artificial
  CRISPR gRNA sequence
caatcggctgtttggttgga

SEQ ID NO: 131289 - DNA, 20 bp, Artificial
  CRISPR gRNA sequence
tttggttggacagaaaatgg

SEQ ID NO: 131290 - DNA, 20 bp, Artificial
  CRISPR gRNA sequence
ggttggacagaaaatggctg

SEQ ID NO: 131291 - DNA, 20 bp, Artificial
  CRISPR gRNA sequence
gttggacagaaaatggctgc

SEQ ID NO: 131292 - DNA, 20 bp, Artificial
  CRISPR gRNA sequence
gacagaaaatggctgcgaag

SEQ ID NO: 131293 - DNA, 20 bp, Artificial
  CRISPR gRNA sequence
cgaaggaaccagtcccagcg

SEQ ID NO: 131294 - DNA, 20 bp, Artificial
  CRISPR gRNA sequence
cgcttccaggactcggcctc

SEQ ID NO: 131295 - DNA, 20 bp, Artificial
  CRISPR gRNA sequence
ccaggactcggcctcccctc

SEQ ID NO: 131296 - DNA, 20 bp, Artificial
  CRISPR gRNA sequence
caggactcggcctcccctcc

SEQ ID NO: 131297 - DNA, 20 bp, Artificial
  CRISPR gRNA sequence
ggcctcccctccctccgccg

SEQ ID NO: 131298 - DNA, 20 bp, Artificial
  CRISPR gRNA sequence
ccctccctccgccgcgggcc

SEQ ID NO: 131299 - DNA, 20 bp, Artificial
  CRISPR gRNA sequence
cctccgccgcgggccgcttc

SEQ ID NO: 131300 - DNA, 20 bp, Artificial
  CRISPR gRNA sequence
cgccgcgggccgcttccctc

SEQ ID NO: 131301 - DNA, 20 bp, Artificial
  CRISPR gRNA sequence
ccctcggcgcgacaccctcc

SEQ ID NO: 131302 - DNA, 20 bp, Artificial
  CRISPR gRNA sequence
cctcggcgcgacaccctccc

SEQ ID NO: 131303 - DNA, 20 bp, Artificial
  CRISPR gRNA sequence
ggcgcgacaccctccctccg

SEQ ID NO: 131304 - DNA, 20 bp, Artificial
  CRISPR gRNA sequence
cctccgcgccgcccgcgcgc

SEQ ID NO: 131305 - DNA, 20 bp, Artificial
  CRISPR gRNA sequence
cgcgccgcccgcgcgcccgc

SEQ ID NO: 131306 - DNA, 20 bp, Artificial
  CRISPR gRNA sequence
gaagcggagctccgcgctgg

SEQ ID NO: 131307 - DNA, 20 bp, Artificial
  CRISPR gRNA sequence
cgcgctgggactggttcctt

SEQ ID NO: 131308 - DNA, 20 bp, Artificial
  CRISPR gRNA sequence
ggactggttccttcgcagcc

SEQ ID NO: 131309 - DNA, 20 bp, Artificial
  CRISPR gRNA sequence
gttccttcgcagccattttc

SEQ ID NO: 131310 - DNA, 20 bp, Artificial
  CRISPR gRNA sequence
cttcgcagccattttctgtc

SEQ ID NO: 131311 - DNA, 20 bp, Artificial
  CRISPR gRNA sequence
cgcagccattttctgtccaa

SEQ ID NO: 131312 - DNA, 20 bp, Artificial
  CRISPR gRNA sequence
gcagccattttctgtccaac

SEQ ID NO: 131313 - DNA, 20 bp, Artificial
  CRISPR gRNA sequence
tctgtccaaccaaacagccg

SEQ ID NO: 131314 - DNA, 20 bp, Artificial
  CRISPR gRNA sequence
ctgtccaaccaaacagccga

SEQ ID NO: 131315 - DNA, 20 bp, Artificial
  CRISPR gRNA sequence
tgtccaaccaaacagccgat

SEQ ID NO: 131316 - DNA, 20 bp, Artificial
  CRISPR gRNA sequence
tccaaccaaacagccgattg

SEQ ID NO: 131317 - DNA, 20 bp, Artificial
  CRISPR gRNA sequence
gagacgggagccaaccaggg

SEQ ID NO: 131318 - DNA, 20 bp, Artificial
  CRISPR gRNA sequence
cattggaggtttgtgtctcg

SEQ ID NO: 131319 - DNA, 20 bp, Artificial
  CRISPR gRNA sequence
gaggtttgtgtctcgcttcg

SEQ ID NO: 131320 - DNA, 20 bp, Artificial
  CRISPR gRNA sequence
gtgtctcgcttcggccaatg

SEQ ID NO: 131321 - DNA, 20 bp, Artificial
  CRISPR gRNA sequence
tgtctcgcttcggccaatga

SEQ ID NO: 131322 - DNA, 20 bp, Artificial
  CRISPR gRNA sequence
gcttcggccaatgatcgctc

SEQ ID NO: 131323 - DNA, 20 bp, Artificial
  CRISPR gRNA sequence
cggccaatgatcgctcctaa

SEQ ID NO: 131324 - DNA, 20 bp, Artificial
  CRISPR gRNA sequence
ggccaatgatcgctcctaaa

SEQ ID NO: 131325 - DNA, 20 bp, Artificial
  CRISPR gRNA sequence
ctaaaccgactccactttag

SEQ ID NO: 131326 - DNA, 20 bp, Artificial
  CRISPR gRNA sequence
aaccgactccactttagctc

SEQ ID NO: 131327 - DNA, 20 bp, Artificial
  CRISPR gRNA sequence
cactttagctcgaatgaaat

SEQ ID NO: 131328 - DNA, 20 bp, Artificial
  CRISPR gRNA sequence
tagctcgaatgaaatgtccg

SEQ ID NO: 131329 - DNA, 20 bp, Artificial
  CRISPR gRNA sequence
agctcgaatgaaatgtccgt

SEQ ID NO: 131330 - DNA, 20 bp, Artificial
  CRISPR gRNA sequence
gctcgaatgaaatgtccgtc

SEQ ID NO: 131331 - DNA, 20 bp, Artificial
  CRISPR gRNA sequence
gaatgaaatgtccgtctcct

SEQ ID NO: 131332 - DNA, 20 bp, Artificial
  CRISPR gRNA sequence
ctcccggcgccgtccccgcc

SEQ ID NO: 131333 - DNA, 20 bp, Artificial
  CRISPR gRNA sequence
ccggcgccgtccccgccgcc

SEQ ID NO: 131334 - DNA, 20 bp, Artificial
  CRISPR gRNA sequence
gcctcccgccctcccgcgcg

SEQ ID NO: 131335 - DNA, 20 bp, Artificial
  CRISPR gRNA sequence
ccgccctcccgcgcgggccg

SEQ ID NO: 131336 - DNA, 20 bp, Artificial
  CRISPR gRNA sequence
ccgcgcgggccgaggccggg

SEQ ID NO: 131337 - DNA, 20 bp, Artificial
  CRISPR gRNA sequence
cgaggccgctcccgcagcgg

SEQ ID NO: 131338 - DNA, 20 bp, Artificial
  CRISPR gRNA sequence
ccgcagcgggccgggccggg

SEQ ID NO: 131339 - DNA, 20 bp, Artificial
  CRISPR gRNA sequence
tttgtgcgccgggctgagga

SEQ ID NO: 131340 - DNA, 20 bp, Artificial
  CRISPR gRNA sequence
tgtgcgccgggctgaggagc

SEQ ID NO: 131341 - DNA, 20 bp, Artificial
  CRISPR gRNA sequence
gtgcgccgggctgaggagcg

SEQ ID NO: 131342 - DNA, 20 bp, Artificial
  CRISPR gRNA sequence
tgcgccgggctgaggagcgg

SEQ ID NO: 131343 - DNA, 20 bp, Artificial
  CRISPR gRNA sequence
aggagcggcgggacgcgggc

SEQ ID NO: 131344 - DNA, 20 bp, Artificial
  CRISPR gRNA sequence
accctcgccgccgttgagct

SEQ ID NO: 131345 - DNA, 20 bp, Artificial
  CRISPR gRNA sequence
gccgccgttgagctccgggc

SEQ ID NO: 131346 - DNA, 20 bp, Artificial
  CRISPR gRNA sequence
agctccgggcccggggccga

SEQ ID NO: 131347 - DNA, 20 bp, Artificial
  CRISPR gRNA sequence
cgggcccggggccgaggagg

SEQ ID NO: 131348 - DNA, 20 bp, Artificial
  CRISPR gRNA sequence
cgtcggggccccgctctcga

SEQ ID NO: 131349 - DNA, 20 bp, Artificial
  CRISPR gRNA sequence
tcgacggcgtcccgggccgg

SEQ ID NO: 131350 - DNA, 20 bp, Artificial
  CRISPR gRNA sequence
gacggcgtcccgggccggct

SEQ ID NO: 131351 - DNA, 20 bp, Artificial
  CRISPR gRNA sequence
cattttgtgcggggagccgg

SEQ ID NO: 131352 - DNA, 20 bp, Artificial
  CRISPR gRNA sequence
tgtgcggggagccggccgag

SEQ ID NO: 131353 - DNA, 20 bp, Artificial
  CRISPR gRNA sequence
gtgcggggagccggccgagg

SEQ ID NO: 131354 - DNA, 20 bp, Artificial
  CRISPR gRNA sequence
tgcggggagccggccgaggg

SEQ ID NO: 131355 - DNA, 20 bp, Artificial
  CRISPR gRNA sequence
gccccgtagccccggcggcg

SEQ ID NO: 131356 - DNA, 20 bp, Artificial
  CRISPR gRNA sequence
ctcccgcccgcggggctgtg

SEQ ID NO: 131357 - DNA, 20 bp, Artificial
  CRISPR gRNA sequence
ccgcccgcggggctgtggcg

SEQ ID NO: 131358 - DNA, 20 bp, Artificial
  CRISPR gRNA sequence
tggcggggcccggcgctttg

SEQ ID NO: 131359 - DNA, 20 bp, Artificial
  CRISPR gRNA sequence
tgtctgcccgcacatcccgg

SEQ ID NO: 131360 - DNA, 20 bp, Artificial
  CRISPR gRNA sequence
gtctgcccgcacatcccggg

SEQ ID NO: 131361 - DNA, 20 bp, Artificial
  CRISPR gRNA sequence
tctgcccgcacatcccgggg

SEQ ID NO: 131362 - DNA, 20 bp, Artificial
  CRISPR gRNA sequence
cccgcacatcccgggggccg

SEQ ID NO: 131363 - DNA, 20 bp, Artificial
  CRISPR gRNA sequence
ggcgcggggccggggcggcc

SEQ ID NO: 131364 - DNA, 20 bp, Artificial
  CRISPR gRNA sequence
tgggggcggcctcctggcac

SEQ ID NO: 131365 - DNA, 20 bp, Artificial
  CRISPR gRNA sequence
ggggcggcctcctggcactc

SEQ ID NO: 131366 - DNA, 20 bp, Artificial
  CRISPR gRNA sequence
ctggcactcgcagggctgac

SEQ ID NO: 131367 - DNA, 20 bp, Artificial
  CRISPR gRNA sequence
gcactcgcagggctgacagg

SEQ ID NO: 131368 - DNA, 20 bp, Artificial
  CRISPR gRNA sequence
gcagggctgacaggtcgccg

SEQ ID NO: 131369 - DNA, 20 bp, Artificial
  CRISPR gRNA sequence
acaggtcgccgggaccaggc

SEQ ID NO: 131370 - DNA, 20 bp, Artificial
  CRISPR gRNA sequence
cgtggggaggaaggcatggc

SEQ ID NO: 131371 - DNA, 20 bp, Artificial
  CRISPR gRNA sequence
tagcttccccgcagcctggt

SEQ ID NO: 131372 - DNA, 20 bp, Artificial
  CRISPR gRNA sequence
agcttccccgcagcctggtt

SEQ ID NO: 131373 - DNA, 20 bp, Artificial
  CRISPR gRNA sequence
gcttccccgcagcctggttt

SEQ ID NO: 131374 - DNA, 20 bp, Artificial
  CRISPR gRNA sequence
ccccgcagcctggtttgcgc

SEQ ID NO: 131375 - DNA, 20 bp, Artificial
  CRISPR gRNA sequence
cccgcagcctggtttgcgcg

SEQ ID NO: 131376 - DNA, 20 bp, Artificial
  CRISPR gRNA sequence
gtttgcgcgtaaagaatgca

SEQ ID NO: 131377 - DNA, 20 bp, Artificial
  CRISPR gRNA sequence
gcgcgtaaagaatgcagcca

SEQ ID NO: 131378 - DNA, 20 bp, Artificial
  CRISPR gRNA sequence
cgcgtaaagaatgcagccat

SEQ ID NO: 131379 - DNA, 20 bp, Artificial
  CRISPR gRNA sequence
gcggtttgcggtccctgtac

SEQ ID NO: 131380 - DNA, 20 bp, Artificial
  CRISPR gRNA sequence
gcggtccctgtacttgcccc

SEQ ID NO: 131381 - DNA, 20 bp, Artificial
  CRISPR gRNA sequence
cggtccctgtacttgccccg

SEQ ID NO: 131382 - DNA, 20 bp, Artificial
  CRISPR gRNA sequence
tacttgccccgaaggtggga

SEQ ID NO: 131383 - DNA, 20 bp, Artificial
  CRISPR gRNA sequence
gccccgaaggtgggaaggaa

SEQ ID NO: 131384 - DNA, 20 bp, Artificial
  CRISPR gRNA sequence
ccccgaaggtgggaaggaag

SEQ ID NO: 131385 - DNA, 20 bp, Artificial
  CRISPR gRNA sequence
cggattggactaaggtttta

SEQ ID NO: 131386 - DNA, 20 bp, Artificial
  CRISPR gRNA sequence
ggattggactaaggttttaa

SEQ ID NO: 131387 - DNA, 20 bp, Artificial
  CRISPR gRNA sequence
gactaaggttttaatcatta

SEQ ID NO: 131388 - DNA, 20 bp, Artificial
  CRISPR gRNA sequence
aggttttaatcattagtggt

SEQ ID NO: 131389 - DNA, 20 bp, Artificial
  CRISPR gRNA sequence
taatcattagtggtgggagg

SEQ ID NO: 131390 - DNA, 20 bp, Artificial
  CRISPR gRNA sequence
aatcattagtggtgggaggc

SEQ ID NO: 131391 - DNA, 20 bp, Artificial
  CRISPR gRNA sequence
atcattagtggtgggaggcg

SEQ ID NO: 131392 - DNA, 20 bp, Artificial
  CRISPR gRNA sequence
gtggtgggaggcgggaggat

SEQ ID NO: 131393 - DNA, 20 bp, Artificial
  CRISPR gRNA sequence
aaagaacggtagtcttagag

SEQ ID NO: 131394 - DNA, 20 bp, Artificial
  CRISPR gRNA sequence
aagaacggtagtcttagaga

SEQ ID NO: 131395 - DNA, 20 bp, Artificial
  CRISPR gRNA sequence
agagaacaaagaattacaga

SEQ ID NO: 131396 - DNA, 20 bp, Artificial
  CRISPR gRNA sequence
gagaacaaagaattacagag

SEQ ID NO: 131397 - DNA, 20 bp, Artificial
  CRISPR gRNA sequence
cagagcacccacaaatcgta

SEQ ID NO: 131398 - DNA, 20 bp, Artificial
  CRISPR gRNA sequence
gcccaaagcactctaacagg

SEQ ID NO: 131399 - DNA, 20 bp, Artificial
  CRISPR gRNA sequence
taacaggataatttaaacaa

SEQ ID NO: 131400 - DNA, 20 bp, Artificial
  CRISPR gRNA sequence
acaggataatttaaacaagg

SEQ ID NO: 131401 - DNA, 20 bp, Artificial
  CRISPR gRNA sequence
aaacaaggttaggtagcctg

SEQ ID NO: 131402 - DNA, 20 bp, Artificial
  CRISPR gRNA sequence
aacaaggttaggtagcctgc

SEQ ID NO: 131403 - DNA, 20 bp, Artificial
  CRISPR gRNA sequence
ggtagcctgcgacctttaaa

SEQ ID NO: 131404 - DNA, 20 bp, Artificial
  CRISPR gRNA sequence
cgacctttaaaaaaatggca

SEQ ID NO: 131405 - DNA, 20 bp, Artificial
  CRISPR gRNA sequence
taaaaaaatggcatcccact

SEQ ID NO: 131406 - DNA, 20 bp, Artificial
  CRISPR gRNA sequence
aaaaaaatggcatcccacta

SEQ ID NO: 131407 - DNA, 20 bp, Artificial
  CRISPR gRNA sequence
aaaaaatggcatcccactaa

SEQ ID NO: 131408 - DNA, 20 bp, Artificial
  CRISPR gRNA sequence
acccgcatggaccccatagt

SEQ ID NO: 131409 - DNA, 20 bp, Artificial
  CRISPR gRNA sequence
cgtggttcgtgctacaaatc

SEQ ID NO: 131410 - DNA, 20 bp, Artificial
  CRISPR gRNA sequence
gtgctacaaatcactggggt

SEQ ID NO: 131411 - DNA, 20 bp, Artificial
  CRISPR gRNA sequence
caaatcactggggtggtttc

SEQ ID NO: 131412 - DNA, 20 bp, Artificial
  CRISPR gRNA sequence
gggtggtttcatctctctta

SEQ ID NO: 131413 - DNA, 20 bp, Artificial
  CRISPR gRNA sequence
catctctcttagtatggaaa

SEQ ID NO: 131414 - DNA, 20 bp, Artificial
  CRISPR gRNA sequence
atctctcttagtatggaaac

SEQ ID NO: 131415 - DNA, 20 bp, Artificial
  CRISPR gRNA sequence
tcttagtatggaaactaatc

SEQ ID NO: 131416 - DNA, 20 bp, Artificial
  CRISPR gRNA sequence
ttagtatggaaactaatcag

SEQ ID NO: 131417 - DNA, 20 bp, Artificial
  CRISPR gRNA sequence
agtatggaaactaatcagca

SEQ ID NO: 131418 - DNA, 20 bp, Artificial
  CRISPR gRNA sequence
gtatggaaactaatcagcaa

SEQ ID NO: 131419 - DNA, 20 bp, Artificial
  CRISPR gRNA sequence
atcagcaacataaagtgatg

SEQ ID NO: 131420 - DNA, 20 bp, Artificial
  CRISPR gRNA sequence
atcagtggggggtttatttg

SEQ ID NO: 131421 - DNA, 20 bp, Artificial
  CRISPR gRNA sequence
atttgtaaagtattgaaagt

SEQ ID NO: 131422 - DNA, 20 bp, Artificial
  CRISPR gRNA sequence
tttgtaaagtattgaaagtt

SEQ ID NO: 131423 - DNA, 20 bp, Artificial
  CRISPR gRNA sequence
gtaaagtattgaaagtttaa

SEQ ID NO: 131424 - DNA, 20 bp, Artificial
  CRISPR gRNA sequence
taaagtattgaaagtttaac

SEQ ID NO: 131425 - DNA, 20 bp, Artificial
  CRISPR gRNA sequence
aaagtttaaccaaaattcct

SEQ ID NO: 131426 - DNA, 20 bp, Artificial
  CRISPR gRNA sequence
aaccaaaattccttaaaagg

SEQ ID NO: 131427 - DNA, 20 bp, Artificial
  CRISPR gRNA sequence
accaaaattccttaaaaggc

SEQ ID NO: 131428 - DNA, 20 bp, Artificial
  CRISPR gRNA sequence
cttaaaaggcaaattattcc

SEQ ID NO: 131429 - DNA, 20 bp, Artificial
  CRISPR gRNA sequence
aaaaggcaaattattccttc

SEQ ID NO: 131430 - DNA, 20 bp, Artificial
  CRISPR gRNA sequence
aaaggcaaattattccttcc

SEQ ID NO: 131431 - DNA, 20 bp, Artificial
  CRISPR gRNA sequence
ttccttccctgcattgctct

SEQ ID NO: 131432 - DNA, 20 bp, Artificial
  CRISPR gRNA sequence
cttccctgcattgctcttgt

SEQ ID NO: 131433 - DNA, 20 bp, Artificial
  CRISPR gRNA sequence
ccctgcattgctcttgtatc

SEQ ID NO: 131434 - DNA, 20 bp, Artificial
  CRISPR gRNA sequence
cctgcattgctcttgtatct

SEQ ID NO: 131435 - DNA, 20 bp, Artificial
  CRISPR gRNA sequence
cattgctcttgtatcttaat

SEQ ID NO: 131436 - DNA, 20 bp, Artificial
  CRISPR gRNA sequence
ctcttgtatcttaatttaag

SEQ ID NO: 131437 - DNA, 20 bp, Artificial
  CRISPR gRNA sequence
ttgtatcttaatttaaggat

SEQ ID NO: 131438 - DNA, 20 bp, Artificial
  CRISPR gRNA sequence
gtatcttaatttaaggatta

SEQ ID NO: 131439 - DNA, 20 bp, Artificial
  CRISPR gRNA sequence
tatcttaatttaaggattac

SEQ ID NO: 131440 - DNA, 20 bp, Artificial
  CRISPR gRNA sequence
aatttaaggattactgtata

SEQ ID NO: 131441 - DNA, 20 bp, Artificial
  CRISPR gRNA sequence
atttaaggattactgtatat

SEQ ID NO: 131442 - DNA, 20 bp, Artificial
  CRISPR gRNA sequence
aaggattactgtatattgat

SEQ ID NO: 131443 - DNA, 20 bp, Artificial
  CRISPR gRNA sequence
aggattactgtatattgatg

SEQ ID NO: 131444 - DNA, 20 bp, Artificial
  CRISPR gRNA sequence
ctgtatattgatgcaaaact

SEQ ID NO: 131445 - DNA, 20 bp, Artificial
  CRISPR gRNA sequence
tatattgatgcaaaactctg

SEQ ID NO: 131446 - DNA, 20 bp, Artificial
  CRISPR gRNA sequence
atgcaaaactctggttgttg

SEQ ID NO: 131447 - DNA, 20 bp, Artificial
  CRISPR gRNA sequence
tggttgttgatgccaaagaa

SEQ ID NO: 131448 - DNA, 20 bp, Artificial
  CRISPR gRNA sequence
gttgttgatgccaaagaatg

SEQ ID NO: 131449 - DNA, 20 bp, Artificial
  CRISPR gRNA sequence
ttgatgccaaagaatggagg

SEQ ID NO: 131450 - DNA, 20 bp, Artificial
  CRISPR gRNA sequence
atgccaaagaatggagggtg

SEQ ID NO: 131451 - DNA, 20 bp, Artificial
  CRISPR gRNA sequence
ctgcttttcttggatacaaa

SEQ ID NO: 131452 - DNA, 20 bp, Artificial
  CRISPR gRNA sequence
cttttcttggatacaaattt

SEQ ID NO: 131453 - DNA, 20 bp, Artificial
  CRISPR gRNA sequence
ttcttggatacaaatttgca

SEQ ID NO: 131454 - DNA, 20 bp, Artificial
  CRISPR gRNA sequence
tcttggatacaaatttgcat

SEQ ID NO: 131455 - DNA, 20 bp, Artificial
  CRISPR gRNA sequence
cttggatacaaatttgcatt

SEQ ID NO: 131456 - DNA, 20 bp, Artificial
  CRISPR gRNA sequence
ttggatacaaatttgcattt

SEQ ID NO: 131457 - DNA, 20 bp, Artificial
  CRISPR gRNA sequence
ggatacaaatttgcatttct

SEQ ID NO: 131458 - DNA, 20 bp, Artificial
  CRISPR gRNA sequence
gatacaaatttgcatttctt

SEQ ID NO: 131459 - DNA, 20 bp, Artificial
  CRISPR gRNA sequence
gcatttcttaaaacattaaa

SEQ ID NO: 131460 - DNA, 20 bp, Artificial
  CRISPR gRNA sequence
catttcttaaaacattaaac

SEQ ID NO: 131461 - DNA, 20 bp, Artificial
  CRISPR gRNA sequence
cttaaaacattaaacagatg

SEQ ID NO: 131462 - DNA, 20 bp, Artificial
  CRISPR gRNA sequence
ttaaaacattaaacagatgt

SEQ ID NO: 131463 - DNA, 20 bp, Artificial
  CRISPR gRNA sequence
aaaacattaaacagatgtat

SEQ ID NO: 131464 - DNA, 20 bp, Artificial
  CRISPR gRNA sequence
aaacattaaacagatgtatg

SEQ ID NO: 131465 - DNA, 20 bp, Artificial
  CRISPR gRNA sequence
aacagatgtatgcattccct

SEQ ID NO: 131466 - DNA, 20 bp, Artificial
  CRISPR gRNA sequence
ccttgagcttttacatatat

SEQ ID NO: 131467 - DNA, 20 bp, Artificial
  CRISPR gRNA sequence
gagcttttacatatatcaac

SEQ ID NO: 131468 - DNA, 20 bp, Artificial
  CRISPR gRNA sequence
agcttttacatatatcaacc

SEQ ID NO: 131469 - DNA, 20 bp, Artificial
  CRISPR gRNA sequence
ttacatatatcaacctgccc

SEQ ID NO: 131470 - DNA, 20 bp, Artificial
  CRISPR gRNA sequence
tacatatatcaacctgccct

SEQ ID NO: 131471 - DNA, 20 bp, Artificial
  CRISPR gRNA sequence
acatatatcaacctgccctt

SEQ ID NO: 131472 - DNA, 20 bp, Artificial
  CRISPR gRNA sequence
catatatcaacctgccctta

SEQ ID NO: 131473 - DNA, 20 bp, Artificial
  CRISPR gRNA sequence
cccttaagaaaatatacacc

SEQ ID NO: 131474 - DNA, 20 bp, Artificial
  CRISPR gRNA sequence
aagaaaatatacaccatatg

SEQ ID NO: 131475 - DNA, 20 bp, Artificial
  CRISPR gRNA sequence
agaaaatatacaccatatga

SEQ ID NO: 131476 - DNA, 20 bp, Artificial
  CRISPR gRNA sequence
ttctttaatgtactgagtct

SEQ ID NO: 131477 - DNA, 20 bp, Artificial
  CRISPR gRNA sequence
tctttaatgtactgagtcta

SEQ ID NO: 131478 - DNA, 20 bp, Artificial
  CRISPR gRNA sequence
ctttaatgtactgagtctaa

SEQ ID NO: 131479 - DNA, 20 bp, Artificial
  CRISPR gRNA sequence
tttaatgtactgagtctaaa

SEQ ID NO: 131480 - DNA, 20 bp, Artificial
  CRISPR gRNA sequence
taatgtactgagtctaaata

SEQ ID NO: 131481 - DNA, 20 bp, Artificial
  CRISPR gRNA sequence
aatgtactgagtctaaatat

SEQ ID NO: 131482 - DNA, 20 bp, Artificial
  CRISPR gRNA sequence
atgtactgagtctaaatata

SEQ ID NO: 131483 - DNA, 20 bp, Artificial
  CRISPR gRNA sequence
agtctaaatatatactgaat

SEQ ID NO: 131484 - DNA, 20 bp, Artificial
  CRISPR gRNA sequence
aatatatactgaatcaacta

SEQ ID NO: 131485 - DNA, 20 bp, Artificial
  CRISPR gRNA sequence
aatcaactatttgggtgagt

SEQ ID NO: 131486 - DNA, 20 bp, Artificial
  CRISPR gRNA sequence
tttgggtgagtgagtgtggt

SEQ ID NO: 131487 - DNA, 20 bp, Artificial
  CRISPR gRNA sequence
gggtgagtgagtgtggtgtg

SEQ ID NO: 131488 - DNA, 20 bp, Artificial
  CRISPR gRNA sequence
ggtgagtgagtgtggtgtgg

SEQ ID NO: 131489 - DNA, 20 bp, Artificial
  CRISPR gRNA sequence
cctgcccacacccccctctc

SEQ ID NO: 131490 - DNA, 20 bp, Artificial
  CRISPR gRNA sequence
cccacacccccctctcccat

SEQ ID NO: 131491 - DNA, 20 bp, Artificial
  CRISPR gRNA sequence
tcccattccaagcaaaatac

SEQ ID NO: 131492 - DNA, 20 bp, Artificial
  CRISPR gRNA sequence
ccattccaagcaaaatacat

SEQ ID NO: 131493 - DNA, 20 bp, Artificial
  CRISPR gRNA sequence
caagcaaaatacataaatat

SEQ ID NO: 131494 - DNA, 20 bp, Artificial
  CRISPR gRNA sequence
ccatgttttaagtgttctga

SEQ ID NO: 131495 - DNA, 20 bp, Artificial
  CRISPR gRNA sequence
taagtgttctgagggcttat

SEQ ID NO: 131496 - DNA, 20 bp, Artificial
  CRISPR gRNA sequence
aagtgttctgagggcttatt

SEQ ID NO: 131497 - DNA, 20 bp, Artificial
  CRISPR gRNA sequence
agtgttctgagggcttattt

SEQ ID NO: 131498 - DNA, 20 bp, Artificial
  CRISPR gRNA sequence
tgagggcttattttttcaaa

SEQ ID NO: 131499 - DNA, 20 bp, Artificial
  CRISPR gRNA sequence
agggcttattttttcaaaga

SEQ ID NO: 131500 - DNA, 20 bp, Artificial
  CRISPR gRNA sequence
attttttcaaagacactctt

SEQ ID NO: 131501 - DNA, 20 bp, Artificial
  CRISPR gRNA sequence
ttttttcaaagacactcttt

SEQ ID NO: 131502 - DNA, 20 bp, Artificial
  CRISPR gRNA sequence
tttcaaagacactctttaaa

SEQ ID NO: 131503 - DNA, 20 bp, Artificial
  CRISPR gRNA sequence
ttcaaagacactctttaaaa

SEQ ID NO: 131504 - DNA, 20 bp, Artificial
  CRISPR gRNA sequence
tcaaagacactctttaaaaa

SEQ ID NO: 131505 - DNA, 20 bp, Artificial
  CRISPR gRNA sequence
caaagacactctttaaaaaa

SEQ ID NO: 131506 - DNA, 20 bp, Artificial
  CRISPR gRNA sequence
aaagacactctttaaaaaat

SEQ ID NO: 131507 - DNA, 20 bp, Artificial
  CRISPR gRNA sequence
tttaaaaaataacatttctc

SEQ ID NO: 131508 - DNA, 20 bp, Artificial
  CRISPR gRNA sequence
taaaaaataacatttctcgt

SEQ ID NO: 131509 - DNA, 20 bp, Artificial
  CRISPR gRNA sequence
aaaaaataacatttctcgtt

SEQ ID NO: 131510 - DNA, 20 bp, Artificial
  CRISPR gRNA sequence
aaaaataacatttctcgtta

SEQ ID NO: 131511 - DNA, 20 bp, Artificial
  CRISPR gRNA sequence
ctcgttacaaggaaggactt

SEQ ID NO: 131512 - DNA, 20 bp, Artificial
  CRISPR gRNA sequence
tcgttacaaggaaggacttt

SEQ ID NO: 131513 - DNA, 20 bp, Artificial
  CRISPR gRNA sequence
gttacaaggaaggacttttc

SEQ ID NO: 131514 - DNA, 20 bp, Artificial
  CRISPR gRNA sequence
caaggaaggacttttctgag

SEQ ID NO: 131515 - DNA, 20 bp, Artificial
  CRISPR gRNA sequence
ttctgagcagttttggggtt

SEQ ID NO: 131516 - DNA, 20 bp, Artificial
  CRISPR gRNA sequence
tctgagcagttttggggtta

SEQ ID NO: 131517 - DNA, 20 bp, Artificial
  CRISPR gRNA sequence
ctgagcagttttggggttag

SEQ ID NO: 131518 - DNA, 20 bp, Artificial
  CRISPR gRNA sequence
tgagcagttttggggttaga

SEQ ID NO: 131519 - DNA, 20 bp, Artificial
  CRISPR gRNA sequence
agcagttttggggttagagg

SEQ ID NO: 131520 - DNA, 20 bp, Artificial
  CRISPR gRNA sequence
tggggttagaggatactatt

SEQ ID NO: 131521 - DNA, 20 bp, Artificial
  CRISPR gRNA sequence
ggggttagaggatactatta

SEQ ID NO: 131522 - DNA, 20 bp, Artificial
  CRISPR gRNA sequence
gggttagaggatactattaa

SEQ ID NO: 131523 - DNA, 20 bp, Artificial
  CRISPR gRNA sequence
gaggatactattaatatttg

SEQ ID NO: 131524 - DNA, 20 bp, Artificial
  CRISPR gRNA sequence
ttaatatttgaaaagaaatt

SEQ ID NO: 131525 - DNA, 20 bp, Artificial
  CRISPR gRNA sequence
atatttgaaaagaaattata

SEQ ID NO: 131526 - DNA, 20 bp, Artificial
  CRISPR gRNA sequence
gaaaagaaattataaattac

SEQ ID NO: 131527 - DNA, 20 bp, Artificial
  CRISPR gRNA sequence
aaaagaaattataaattact

SEQ ID NO: 131528 - DNA, 20 bp, Artificial
  CRISPR gRNA sequence
taaattacttttaatattat

SEQ ID NO: 131529 - DNA, 20 bp, Artificial
  CRISPR gRNA sequence
cttttaatattatagcaaac

SEQ ID NO: 131530 - DNA, 20 bp, Artificial
  CRISPR gRNA sequence
ttaatattatagcaaacgtc

SEQ ID NO: 131531 - DNA, 20 bp, Artificial
  CRISPR gRNA sequence
taatattatagcaaacgtca

SEQ ID NO: 131532 - DNA, 20 bp, Artificial
  CRISPR gRNA sequence
aatattatagcaaacgtcaa

SEQ ID NO: 131533 - DNA, 20 bp, Artificial
  CRISPR gRNA sequence
atattatagcaaacgtcaag

SEQ ID NO: 131534 - DNA, 20 bp, Artificial
  CRISPR gRNA sequence
tagcaaacgtcaagcagttt

SEQ ID NO: 131535 - DNA, 20 bp, Artificial
  CRISPR gRNA sequence
ttgctacctggaccttttta

SEQ ID NO: 131536 - DNA, 20 bp, Artificial
  CRISPR gRNA sequence
tgctacctggacctttttag

SEQ ID NO: 131537 - DNA, 20 bp, Artificial
  CRISPR gRNA sequence
gctacctggacctttttagt

SEQ ID NO: 131538 - DNA, 20 bp, Artificial
  CRISPR gRNA sequence
ctacctggacctttttagtg

SEQ ID NO: 131539 - DNA, 20 bp, Artificial
  CRISPR gRNA sequence
cctggacctttttagtggca

SEQ ID NO: 131540 - DNA, 20 bp, Artificial
  CRISPR gRNA sequence
gacctttttagtggcattaa

SEQ ID NO: 131541 - DNA, 20 bp, Artificial
  CRISPR gRNA sequence
tttagtggcattaaaaactt

SEQ ID NO: 131542 - DNA, 20 bp, Artificial
  CRISPR gRNA sequence
ttagtggcattaaaaacttt

SEQ ID NO: 131543 - DNA, 20 bp, Artificial
  CRISPR gRNA sequence
tagtggcattaaaaactttc

SEQ ID NO: 131544 - DNA, 20 bp, Artificial
  CRISPR gRNA sequence
agtggcattaaaaactttca

SEQ ID NO: 131545 - DNA, 20 bp, Artificial
  CRISPR gRNA sequence
gtggcattaaaaactttcaa

SEQ ID NO: 131546 - DNA, 20 bp, Artificial
  CRISPR gRNA sequence
aaaactttcaattcagtggc

SEQ ID NO: 131547 - DNA, 20 bp, Artificial
  CRISPR gRNA sequence
tcaattcagtggctacaatt

SEQ ID NO: 131548 - DNA, 20 bp, Artificial
  CRISPR gRNA sequence
caattcagtggctacaattt

SEQ ID NO: 131549 - DNA, 20 bp, Artificial
  CRISPR gRNA sequence
aattcagtggctacaatttt

SEQ ID NO: 131550 - DNA, 20 bp, Artificial
  CRISPR gRNA sequence
agtggctacaattttttctg

SEQ ID NO: 131551 - DNA, 20 bp, Artificial
  CRISPR gRNA sequence
caattttttctgctatttgc

SEQ ID NO: 131552 - DNA, 20 bp, Artificial
  CRISPR gRNA sequence
tttctgctatttgctagatt

SEQ ID NO: 131553 - DNA, 20 bp, Artificial
  CRISPR gRNA sequence
ttctgctatttgctagattt

SEQ ID NO: 131554 - DNA, 20 bp, Artificial
  CRISPR gRNA sequence
tctgctatttgctagatttc

SEQ ID NO: 131555 - DNA, 20 bp, Artificial
  CRISPR gRNA sequence
ctgctatttgctagatttca

SEQ ID NO: 131556 - DNA, 20 bp, Artificial
  CRISPR gRNA sequence
tgctatttgctagatttcat

SEQ ID NO: 131557 - DNA, 20 bp, Artificial
  CRISPR gRNA sequence
ctatttgctagatttcatgc

SEQ ID NO: 131558 - DNA, 20 bp, Artificial
  CRISPR gRNA sequence
tttgctagatttcatgcttg

SEQ ID NO: 131559 - DNA, 20 bp, Artificial
  CRISPR gRNA sequence
gctagatttcatgcttggat

SEQ ID NO: 131560 - DNA, 20 bp, Artificial
  CRISPR gRNA sequence
ctagatttcatgcttggatg

SEQ ID NO: 131561 - DNA, 20 bp, Artificial
  CRISPR gRNA sequence
gatttcatgcttggatgcgt

SEQ ID NO: 131562 - DNA, 20 bp, Artificial
  CRISPR gRNA sequence
catgcttggatgcgtatcag

SEQ ID NO: 131563 - DNA, 20 bp, Artificial
  CRISPR gRNA sequence
atgcttggatgcgtatcagt

SEQ ID NO: 131564 - DNA, 20 bp, Artificial
  CRISPR gRNA sequence
ggatgcgtatcagtatatct

SEQ ID NO: 131565 - DNA, 20 bp, Artificial
  CRISPR gRNA sequence
gatgcgtatcagtatatctt

SEQ ID NO: 131566 - DNA, 20 bp, Artificial
  CRISPR gRNA sequence
ctccctttaaaattaacact

SEQ ID NO: 131567 - DNA, 20 bp, Artificial
  CRISPR gRNA sequence
tccctttaaaattaacactg

SEQ ID NO: 131568 - DNA, 20 bp, Artificial
  CRISPR gRNA sequence
cctttaaaattaacactgaa

SEQ ID NO: 131569 - DNA, 20 bp, Artificial
  CRISPR gRNA sequence
taaaattaacactgaaagga

SEQ ID NO: 131570 - DNA, 20 bp, Artificial
  CRISPR gRNA sequence
aaaattaacactgaaaggat

SEQ ID NO: 131571 - DNA, 20 bp, Artificial
  CRISPR gRNA sequence
aaattaacactgaaaggatg

SEQ ID NO: 131572 - DNA, 20 bp, Artificial
  CRISPR gRNA sequence
acactgaaaggatgtgtttt

SEQ ID NO: 131573 - DNA, 20 bp, Artificial
  CRISPR gRNA sequence
aaaggatgtgtttttgtttt

SEQ ID NO: 131574 - DNA, 20 bp, Artificial
  CRISPR gRNA sequence
ttgttttggcatcctacccc

SEQ ID NO: 131575 - DNA, 20 bp, Artificial
  CRISPR gRNA sequence
tgttttggcatcctacccct

SEQ ID NO: 131576 - DNA, 20 bp, Artificial
  CRISPR gRNA sequence
gttttggcatcctacccctc

SEQ ID NO: 131577 - DNA, 20 bp, Artificial
  CRISPR gRNA sequence
ttttggcatcctacccctcc

SEQ ID NO: 131578 - DNA, 20 bp, Artificial
  CRISPR gRNA sequence
tggcatcctacccctccccc

SEQ ID NO: 131579 - DNA, 20 bp, Artificial
  CRISPR gRNA sequence
ggcatcctacccctccccca

SEQ ID NO: 131580 - DNA, 20 bp, Artificial
  CRISPR gRNA sequence
gcatcctacccctcccccat

SEQ ID NO: 131581 - DNA, 20 bp, Artificial
  CRISPR gRNA sequence
cccctcccccatttaattgt

SEQ ID NO: 131582 - DNA, 20 bp, Artificial
  CRISPR gRNA sequence
ccccatttaattgtttcctt

SEQ ID NO: 131583 - DNA, 20 bp, Artificial
  CRISPR gRNA sequence
aattgtttcctttgagaaag

SEQ ID NO: 131584 - DNA, 20 bp, Artificial
  CRISPR gRNA sequence
attgtttcctttgagaaaga

SEQ ID NO: 131585 - DNA, 20 bp, Artificial
  CRISPR gRNA sequence
tttcctttgagaaagaatgg

SEQ ID NO: 131586 - DNA, 20 bp, Artificial
  CRISPR gRNA sequence
cctttgagaaagaatggagc

SEQ ID NO: 131587 - DNA, 20 bp, Artificial
  CRISPR gRNA sequence
ctttgagaaagaatggagca

SEQ ID NO: 131588 - DNA, 20 bp, Artificial
  CRISPR gRNA sequence
tgagaaagaatggagcaaat

SEQ ID NO: 131589 - DNA, 20 bp, Artificial
  CRISPR gRNA sequence
gagaaagaatggagcaaatg

SEQ ID NO: 131590 - DNA, 20 bp, Artificial
  CRISPR gRNA sequence
agaaagaatggagcaaatga

SEQ ID NO: 131591 - DNA, 20 bp, Artificial
  CRISPR gRNA sequence
gtaacacagcaattggtact

SEQ ID NO: 131592 - DNA, 20 bp, Artificial
  CRISPR gRNA sequence
taacacagcaattggtacta

SEQ ID NO: 131593 - DNA, 20 bp, Artificial
  CRISPR gRNA sequence
gtactaatttgttcagctat

SEQ ID NO: 131594 - DNA, 20 bp, Artificial
  CRISPR gRNA sequence
atttgttcagctatttatgc

SEQ ID NO: 131595 - DNA, 20 bp, Artificial
  CRISPR gRNA sequence
gttcagctatttatgcctta

SEQ ID NO: 131596 - DNA, 20 bp, Artificial
  CRISPR gRNA sequence
ttcagctatttatgccttac

SEQ ID NO: 131597 - DNA, 20 bp, Artificial
  CRISPR gRNA sequence
agctatttatgccttacagt

SEQ ID NO: 131598 - DNA, 20 bp, Artificial
  CRISPR gRNA sequence
tttatgccttacagtgagac

SEQ ID NO: 131599 - DNA, 20 bp, Artificial
  CRISPR gRNA sequence
atgccttacagtgagactga

SEQ ID NO: 131600 - DNA, 20 bp, Artificial
  CRISPR gRNA sequence
tgccttacagtgagactgaa

SEQ ID NO: 131601 - DNA, 20 bp, Artificial
  CRISPR gRNA sequence
acagtgagactgaagtgcta

SEQ ID NO: 131602 - DNA, 20 bp, Artificial
  CRISPR gRNA sequence
cagtgagactgaagtgctat

SEQ ID NO: 131603 - DNA, 20 bp, Artificial
  CRISPR gRNA sequence
aagtgctatttcgatgcaat

SEQ ID NO: 131604 - DNA, 20 bp, Artificial
  CRISPR gRNA sequence
tttcgatgcaattttagtca

SEQ ID NO: 131605 - DNA, 20 bp, Artificial
  CRISPR gRNA sequence
cgatgcaattttagtcaaaa

SEQ ID NO: 131606 - DNA, 20 bp, Artificial
  CRISPR gRNA sequence
gatgcaattttagtcaaaaa

SEQ ID NO: 131607 - DNA, 20 bp, Artificial
  CRISPR gRNA sequence
tagtcaaaaatggtggtgct

SEQ ID NO: 131608 - DNA, 20 bp, Artificial
  CRISPR gRNA sequence
agtcaaaaatggtggtgctt

SEQ ID NO: 131609 - DNA, 20 bp, Artificial
  CRISPR gRNA sequence
gtcaaaaatggtggtgcttc

SEQ ID NO: 131610 - DNA, 20 bp, Artificial
  CRISPR gRNA sequence
caaaattataaataagggtc

SEQ ID NO: 131611 - DNA, 20 bp, Artificial
  CRISPR gRNA sequence
aaaattataaataagggtct

SEQ ID NO: 131612 - DNA, 20 bp, Artificial
  CRISPR gRNA sequence
taaataagggtcttgattgt

SEQ ID NO: 131613 - DNA, 20 bp, Artificial
  CRISPR gRNA sequence
gattgtgttgcttttttgat

SEQ ID NO: 131614 - DNA, 20 bp, Artificial
  CRISPR gRNA sequence
attgtgttgcttttttgata

SEQ ID NO: 131615 - DNA, 20 bp, Artificial
  CRISPR gRNA sequence
tgttgcttttttgatatctt

SEQ ID NO: 131616 - DNA, 20 bp, Artificial
  CRISPR gRNA sequence
cttttttgatatcttctcag

SEQ ID NO: 131617 - DNA, 20 bp, Artificial
  CRISPR gRNA sequence
ttttgatatcttctcagtgc

SEQ ID NO: 131618 - DNA, 20 bp, Artificial
  CRISPR gRNA sequence
tttgatatcttctcagtgca

SEQ ID NO: 131619 - DNA, 20 bp, Artificial
  CRISPR gRNA sequence
ttgatatcttctcagtgcag

SEQ ID NO: 131620 - DNA, 20 bp, Artificial
  CRISPR gRNA sequence
tgatatcttctcagtgcaga

SEQ ID NO: 131621 - DNA, 20 bp, Artificial
  CRISPR gRNA sequence
gatatcttctcagtgcagaa

SEQ ID NO: 131622 - DNA, 20 bp, Artificial
  CRISPR gRNA sequence
atatcttctcagtgcagaat

SEQ ID NO: 131623 - DNA, 20 bp, Artificial
  CRISPR gRNA sequence
ctcagtgcagaatgtatctt

SEQ ID NO: 131624 - DNA, 20 bp, Artificial
  CRISPR gRNA sequence
tcagtgcagaatgtatcttc

SEQ ID NO: 131625 - DNA, 20 bp, Artificial
  CRISPR gRNA sequence
agtgcagaatgtatcttcat

SEQ ID NO: 131626 - DNA, 20 bp, Artificial
  CRISPR gRNA sequence
cattacagtataatctgaga

SEQ ID NO: 131627 - DNA, 20 bp, Artificial
  CRISPR gRNA sequence
attacagtataatctgagat

SEQ ID NO: 131628 - DNA, 20 bp, Artificial
  CRISPR gRNA sequence
cagtataatctgagattctt

SEQ ID NO: 131629 - DNA, 20 bp, Artificial
  CRISPR gRNA sequence
agattcttaattgaaaagca

SEQ ID NO: 131630 - DNA, 20 bp, Artificial
  CRISPR gRNA sequence
ttaattgaaaagcattatat

SEQ ID NO: 131631 - DNA, 20 bp, Artificial
  CRISPR gRNA sequence
aattgaaaagcattatattc

SEQ ID NO: 131632 - DNA, 20 bp, Artificial
  CRISPR gRNA sequence
attgaaaagcattatattct

SEQ ID NO: 131633 - DNA, 20 bp, Artificial
  CRISPR gRNA sequence
aaaagcattatattctcaga

SEQ ID NO: 131634 - DNA, 20 bp, Artificial
  CRISPR gRNA sequence
tattctcagataattttttc

SEQ ID NO: 131635 - DNA, 20 bp, Artificial
  CRISPR gRNA sequence
tcagataattttttcctcct

SEQ ID NO: 131636 - DNA, 20 bp, Artificial
  CRISPR gRNA sequence
agataattttttcctcctct

SEQ ID NO: 131637 - DNA, 20 bp, Artificial
  CRISPR gRNA sequence
tttcctcctcttgagctata

SEQ ID NO: 131638 - DNA, 20 bp, Artificial
  CRISPR gRNA sequence
ttcctcctcttgagctatag

SEQ ID NO: 131639 - DNA, 20 bp, Artificial
  CRISPR gRNA sequence
tcctcctcttgagctataga

SEQ ID NO: 131640 - DNA, 20 bp, Artificial
  CRISPR gRNA sequence
cctcctcttgagctatagaa

SEQ ID NO: 131641 - DNA, 20 bp, Artificial
  CRISPR gRNA sequence
ctcctcttgagctatagaat

SEQ ID NO: 131642 - DNA, 20 bp, Artificial
  CRISPR gRNA sequence
ctcttgagctatagaatgtc

SEQ ID NO: 131643 - DNA, 20 bp, Artificial
  CRISPR gRNA sequence
ttgagctatagaatgtctaa

SEQ ID NO: 131644 - DNA, 20 bp, Artificial
  CRISPR gRNA sequence
gagctatagaatgtctaaat

SEQ ID NO: 131645 - DNA, 20 bp, Artificial
  CRISPR gRNA sequence
agctatagaatgtctaaatg

SEQ ID NO: 131646 - DNA, 20 bp, Artificial
  CRISPR gRNA sequence
tagaatgtctaaatgttact

SEQ ID NO: 131647 - DNA, 20 bp, Artificial
  CRISPR gRNA sequence
aatgttactctgaaacattt

SEQ ID NO: 131648 - DNA, 20 bp, Artificial
  CRISPR gRNA sequence
ctctgaaacatttaagaaaa

SEQ ID NO: 131649 - DNA, 20 bp, Artificial
  CRISPR gRNA sequence
tgaaacatttaagaaaacca

SEQ ID NO: 131650 - DNA, 20 bp, Artificial
  CRISPR gRNA sequence
aaacatttaagaaaaccatc

SEQ ID NO: 131651 - DNA, 20 bp, Artificial
  CRISPR gRNA sequence
aagaaaaccatcaccaaaaa

SEQ ID NO: 131652 - DNA, 20 bp, Artificial
  CRISPR gRNA sequence
agaaaaccatcaccaaaaaa

SEQ ID NO: 131653 - DNA, 20 bp, Artificial
  CRISPR gRNA sequence
agatgataaggggtgtgttt

SEQ ID NO: 131654 - DNA, 20 bp, Artificial
  CRISPR gRNA sequence
gcatcttgagtgttaatgtt

SEQ ID NO: 131655 - DNA, 20 bp, Artificial
  CRISPR gRNA sequence
catcttgagtgttaatgttt

SEQ ID NO: 131656 - DNA, 20 bp, Artificial
  CRISPR gRNA sequence
gagtgttaatgttttaagta

SEQ ID NO: 131657 - DNA, 20 bp, Artificial
  CRISPR gRNA sequence
agtgttaatgttttaagtaa

SEQ ID NO: 131658 - DNA, 20 bp, Artificial
  CRISPR gRNA sequence
atgttttaagtaatttagat

SEQ ID NO: 131659 - DNA, 20 bp, Artificial
  CRISPR gRNA sequence
taagtaatttagatgtataa

SEQ ID NO: 131660 - DNA, 20 bp, Artificial
  CRISPR gRNA sequence
aagtaatttagatgtataat

SEQ ID NO: 131661 - DNA, 20 bp, Artificial
  CRISPR gRNA sequence
agtaatttagatgtataatt

SEQ ID NO: 131662 - DNA, 20 bp, Artificial
  CRISPR gRNA sequence
agatgtataatttttggtct

SEQ ID NO: 131663 - DNA, 20 bp, Artificial
  CRISPR gRNA sequence
gatgtataatttttggtctc

SEQ ID NO: 131664 - DNA, 20 bp, Artificial
  CRISPR gRNA sequence
ttggtctcttgcatattata

SEQ ID NO: 131665 - DNA, 20 bp, Artificial
  CRISPR gRNA sequence
tggtctcttgcatattatat

SEQ ID NO: 131666 - DNA, 20 bp, Artificial
  CRISPR gRNA sequence
ggtctcttgcatattatata

SEQ ID NO: 131667 - DNA, 20 bp, Artificial
  CRISPR gRNA sequence
gtctcttgcatattatataa

SEQ ID NO: 131668 - DNA, 20 bp, Artificial
  CRISPR gRNA sequence
ttgcatattatataatttgg

SEQ ID NO: 131669 - DNA, 20 bp, Artificial
  CRISPR gRNA sequence
gcatattatataatttggtc

SEQ ID NO: 131670 - DNA, 20 bp, Artificial
  CRISPR gRNA sequence
catattatataatttggtcc

SEQ ID NO: 131671 - DNA, 20 bp, Artificial
  CRISPR gRNA sequence
tataatttggtccctttttg

SEQ ID NO: 131672 - DNA, 20 bp, Artificial
  CRISPR gRNA sequence
ggtccctttttggtgtattg

SEQ ID NO: 131673 - DNA, 20 bp, Artificial
  CRISPR gRNA sequence
gtccctttttggtgtattgt

SEQ ID NO: 131674 - DNA, 20 bp, Artificial
  CRISPR gRNA sequence
tttggtgtattgtaatgaat

SEQ ID NO: 131675 - DNA, 20 bp, Artificial
  CRISPR gRNA sequence
ttggtgtattgtaatgaatg

SEQ ID NO: 131676 - DNA, 20 bp, Artificial
  CRISPR gRNA sequence
tggtgtattgtaatgaatgt

SEQ ID NO: 131677 - DNA, 20 bp, Artificial
  CRISPR gRNA sequence
ggtgtattgtaatgaatgtt

SEQ ID NO: 131678 - DNA, 20 bp, Artificial
  CRISPR gRNA sequence
gtgtattgtaatgaatgttt

SEQ ID NO: 131679 - DNA, 20 bp, Artificial
  CRISPR gRNA sequence
taatgaatgtttatgatgaa

SEQ ID NO: 131680 - DNA, 20 bp, Artificial
  CRISPR gRNA sequence
atgatgaatatggctaaatt

SEQ ID NO: 131681 - DNA, 20 bp, Artificial
  CRISPR gRNA sequence
tgatgaatatggctaaattc

SEQ ID NO: 131682 - DNA, 20 bp, Artificial
  CRISPR gRNA sequence
aattcagggttatgttggaa

SEQ ID NO: 131683 - DNA, 20 bp, Artificial
  CRISPR gRNA sequence
agggttatgttggaaaatcc

SEQ ID NO: 131684 - DNA, 20 bp, Artificial
  CRISPR gRNA sequence
tgttggaaaatccattttct

SEQ ID NO: 131685 - DNA, 20 bp, Artificial
  CRISPR gRNA sequence
gaaaatccattttctccttt

SEQ ID NO: 131686 - DNA, 20 bp, Artificial
  CRISPR gRNA sequence
tctcctttccccatggaatt

SEQ ID NO: 131687 - DNA, 20 bp, Artificial
  CRISPR gRNA sequence
ctcctttccccatggaatta

SEQ ID NO: 131688 - DNA, 20 bp, Artificial
  CRISPR gRNA sequence
tcctttccccatggaattaa

SEQ ID NO: 131689 - DNA, 20 bp, Artificial
  CRISPR gRNA sequence
ctttccccatggaattaact

SEQ ID NO: 131690 - DNA, 20 bp, Artificial
  CRISPR gRNA sequence
tccccatggaattaacttgt

SEQ ID NO: 131691 - DNA, 20 bp, Artificial
  CRISPR gRNA sequence
ccccatggaattaacttgtt

SEQ ID NO: 131692 - DNA, 20 bp, Artificial
  CRISPR gRNA sequence
cccatggaattaacttgttt

SEQ ID NO: 131693 - DNA, 20 bp, Artificial
  CRISPR gRNA sequence
acttgtttttaagttctcca

SEQ ID NO: 131694 - DNA, 20 bp, Artificial
  CRISPR gRNA sequence
gtttttaagttctccaaaat

SEQ ID NO: 131695 - DNA, 20 bp, Artificial
  CRISPR gRNA sequence
tttttaagttctccaaaata

SEQ ID NO: 131696 - DNA, 20 bp, Artificial
  CRISPR gRNA sequence
ttaagttctccaaaataaat

SEQ ID NO: 131697 - DNA, 20 bp, Artificial
  CRISPR gRNA sequence
taagttctccaaaataaatc

SEQ ID NO: 131698 - DNA, 20 bp, Artificial
  CRISPR gRNA sequence
aagttctccaaaataaatct

SEQ ID NO: 131699 - DNA, 20 bp, Artificial
  CRISPR gRNA sequence
agttctccaaaataaatctt

SEQ ID NO: 131700 - DNA, 20 bp, Artificial
  CRISPR gRNA sequence
tccaaaataaatctttcaag

SEQ ID NO: 131701 - DNA, 20 bp, Artificial
  CRISPR gRNA sequence
caaaataaatctttcaagtc

SEQ ID NO: 131702 - DNA, 20 bp, Artificial
  CRISPR gRNA sequence
tcaagtcaacaaacatttat

SEQ ID NO: 131703 - DNA, 20 bp, Artificial
  CRISPR gRNA sequence
caagtcaacaaacatttatt

SEQ ID NO: 131704 - DNA, 20 bp, Artificial
  CRISPR gRNA sequence
aagtcaacaaacatttattg

SEQ ID NO: 131705 - DNA, 20 bp, Artificial
  CRISPR gRNA sequence
attgggtgcctttttatact

SEQ ID NO: 131706 - DNA, 20 bp, Artificial
  CRISPR gRNA sequence
ttgggtgcctttttatacta

SEQ ID NO: 131707 - DNA, 20 bp, Artificial
  CRISPR gRNA sequence
ggtgcctttttatactattt

SEQ ID NO: 131708 - DNA, 20 bp, Artificial
  CRISPR gRNA sequence
tttatactattttataccat

SEQ ID NO: 131709 - DNA, 20 bp, Artificial
  CRISPR gRNA sequence
ttatactattttataccatg

SEQ ID NO: 131710 - DNA, 20 bp, Artificial
  CRISPR gRNA sequence
tatactattttataccatgt

SEQ ID NO: 131711 - DNA, 20 bp, Artificial
  CRISPR gRNA sequence
atactattttataccatgta

SEQ ID NO: 131712 - DNA, 20 bp, Artificial
  CRISPR gRNA sequence
tactattttataccatgtac

SEQ ID NO: 131713 - DNA, 20 bp, Artificial
  CRISPR gRNA sequence
ttttataccatgtactccat

SEQ ID NO: 131714 - DNA, 20 bp, Artificial
  CRISPR gRNA sequence
tataccatgtactccattga

SEQ ID NO: 131715 - DNA, 20 bp, Artificial
  CRISPR gRNA sequence
ataccatgtactccattgat

SEQ ID NO: 131716 - DNA, 20 bp, Artificial
  CRISPR gRNA sequence
taccatgtactccattgatt

SEQ ID NO: 131717 - DNA, 20 bp, Artificial
  CRISPR gRNA sequence
cattgattaagaatagtagt

SEQ ID NO: 131718 - DNA, 20 bp, Artificial
  CRISPR gRNA sequence
attaagaatagtagtcaaaa

SEQ ID NO: 131719 - DNA, 20 bp, Artificial
  CRISPR gRNA sequence
agaatagtagtcaaaattat

SEQ ID NO: 131720 - DNA, 20 bp, Artificial
  CRISPR gRNA sequence
tacaagccctctttaatttt

SEQ ID NO: 131721 - DNA, 20 bp, Artificial
  CRISPR gRNA sequence
tttaattttatgagaaaaaa

SEQ ID NO: 131722 - DNA, 20 bp, Artificial
  CRISPR gRNA sequence
taattttatgagaaaaaaag

SEQ ID NO: 131723 - DNA, 20 bp, Artificial
  CRISPR gRNA sequence
aattttatgagaaaaaaagc

SEQ ID NO: 131724 - DNA, 20 bp, Artificial
  CRISPR gRNA sequence
attttatgagaaaaaaagcc

SEQ ID NO: 131725 - DNA, 20 bp, Artificial
  CRISPR gRNA sequence
tatgagaaaaaaagcctata

SEQ ID NO: 131726 - DNA, 20 bp, Artificial
  CRISPR gRNA sequence
atgagaaaaaaagcctataa

SEQ ID NO: 131727 - DNA, 20 bp, Artificial
  CRISPR gRNA sequence
tgagaaaaaaagcctataag

SEQ ID NO: 131728 - DNA, 20 bp, Artificial
  CRISPR gRNA sequence
taagtgatacatttgatgta

SEQ ID NO: 131729 - DNA, 20 bp, Artificial
  CRISPR gRNA sequence
gatgtatttttactattgat

SEQ ID NO: 131730 - DNA, 20 bp, Artificial
  CRISPR gRNA sequence
atgtatttttactattgata

SEQ ID NO: 131731 - DNA, 20 bp, Artificial
  CRISPR gRNA sequence
ttactattgatagatgttag

SEQ ID NO: 131732 - DNA, 20 bp, Artificial
  CRISPR gRNA sequence
tactattgatagatgttagg

SEQ ID NO: 131733 - DNA, 20 bp, Artificial
  CRISPR gRNA sequence
actattgatagatgttaggt

SEQ ID NO: 131734 - DNA, 20 bp, Artificial
  CRISPR gRNA sequence
ctattgatagatgttaggtc

SEQ ID NO: 131735 - DNA, 20 bp, Artificial
  CRISPR gRNA sequence
ttgatagatgttaggtccta

SEQ ID NO: 131736 - DNA, 20 bp, Artificial
  CRISPR gRNA sequence
atagatgttaggtcctaata

SEQ ID NO: 131737 - DNA, 20 bp, Artificial
  CRISPR gRNA sequence
ggtcctaatagatgtttatc

SEQ ID NO: 131738 - DNA, 20 bp, Artificial
  CRISPR gRNA sequence
atagatgtttatcttttagg

SEQ ID NO: 131739 - DNA, 20 bp, Artificial
  CRISPR gRNA sequence
atcttttaggttgaaatcac

SEQ ID NO: 131740 - DNA, 20 bp, Artificial
  CRISPR gRNA sequence
tcttttaggttgaaatcaca

SEQ ID NO: 131741 - DNA, 20 bp, Artificial
  CRISPR gRNA sequence
ttaggttgaaatcacaaaga

SEQ ID NO: 131742 - DNA, 20 bp, Artificial
  CRISPR gRNA sequence
taggttgaaatcacaaagat

SEQ ID NO: 131743 - DNA, 20 bp, Artificial
  CRISPR gRNA sequence
aggttgaaatcacaaagatt

SEQ ID NO: 131744 - DNA, 20 bp, Artificial
  CRISPR gRNA sequence
ggttgaaatcacaaagatta

SEQ ID NO: 131745 - DNA, 20 bp, Artificial
  CRISPR gRNA sequence
aaatcacaaagattagacac

SEQ ID NO: 131746 - DNA, 20 bp, Artificial
  CRISPR gRNA sequence
gacacctttttagataggtg

SEQ ID NO: 131747 - DNA, 20 bp, Artificial
  CRISPR gRNA sequence
tttagataggtgttcttcag

SEQ ID NO: 131748 - DNA, 20 bp, Artificial
  CRISPR gRNA sequence
ttagataggtgttcttcagc

SEQ ID NO: 131749 - DNA, 20 bp, Artificial
  CRISPR gRNA sequence
tagataggtgttcttcagca

SEQ ID NO: 131750 - DNA, 20 bp, Artificial
  CRISPR gRNA sequence
agataggtgttcttcagcac

SEQ ID NO: 131751 - DNA, 20 bp, Artificial
  CRISPR gRNA sequence
gataggtgttcttcagcacc

SEQ ID NO: 131752 - DNA, 20 bp, Artificial
  CRISPR gRNA sequence
ttcagcaccactgacaacac

SEQ ID NO: 131753 - DNA, 20 bp, Artificial
  CRISPR gRNA sequence
cagcaccactgacaacacgg

SEQ ID NO: 131754 - DNA, 20 bp, Artificial
  CRISPR gRNA sequence
agcaccactgacaacacggt

SEQ ID NO: 131755 - DNA, 20 bp, Artificial
  CRISPR gRNA sequence
acaacacggttctgacagta

SEQ ID NO: 131756 - DNA, 20 bp, Artificial
  CRISPR gRNA sequence
tgacagtatttcatgacagt

SEQ ID NO: 131757 - DNA, 20 bp, Artificial
  CRISPR gRNA sequence
acagtatttcatgacagtaa

SEQ ID NO: 131758 - DNA, 20 bp, Artificial
  CRISPR gRNA sequence
catgacagtaagtatatttt

SEQ ID NO: 131759 - DNA, 20 bp, Artificial
  CRISPR gRNA sequence
atgacagtaagtatatttta

SEQ ID NO: 131760 - DNA, 20 bp, Artificial
  CRISPR gRNA sequence
taccattttggttgttaatt

SEQ ID NO: 131761 - DNA, 20 bp, Artificial
  CRISPR gRNA sequence
accattttggttgttaatta

SEQ ID NO: 131762 - DNA, 20 bp, Artificial
  CRISPR gRNA sequence
ccattttggttgttaattag

SEQ ID NO: 131763 - DNA, 20 bp, Artificial
  CRISPR gRNA sequence
tggttgttaattagatttga

SEQ ID NO: 131764 - DNA, 20 bp, Artificial
  CRISPR gRNA sequence
ggttgttaattagatttgaa

SEQ ID NO: 131765 - DNA, 20 bp, Artificial
  CRISPR gRNA sequence
gttgttaattagatttgaat

SEQ ID NO: 131766 - DNA, 20 bp, Artificial
  CRISPR gRNA sequence
ttaattagatttgaatagta

SEQ ID NO: 131767 - DNA, 20 bp, Artificial
  CRISPR gRNA sequence
attagatttgaatagtaatt

SEQ ID NO: 131768 - DNA, 20 bp, Artificial
  CRISPR gRNA sequence
gatttgaatagtaattggct

SEQ ID NO: 131769 - DNA, 20 bp, Artificial
  CRISPR gRNA sequence
gaatagtaattggctggaaa

SEQ ID NO: 131770 - DNA, 20 bp, Artificial
  CRISPR gRNA sequence
aatagtaattggctggaaat

SEQ ID NO: 131771 - DNA, 20 bp, Artificial
  CRISPR gRNA sequence
gctggaaataaaattgtaac

SEQ ID NO: 131772 - DNA, 20 bp, Artificial
  CRISPR gRNA sequence
gaaataaaattgtaaccaat

SEQ ID NO: 131773 - DNA, 20 bp, Artificial
  CRISPR gRNA sequence
taaccaatttatactggagg

SEQ ID NO: 131774 - DNA, 20 bp, Artificial
  CRISPR gRNA sequence
atactggaggtgcctggtag

SEQ ID NO: 131775 - DNA, 20 bp, Artificial
  CRISPR gRNA sequence
tactggaggtgcctggtaga

SEQ ID NO: 131776 - DNA, 20 bp, Artificial
  CRISPR gRNA sequence
gaggtgcctggtagaatgaa

SEQ ID NO: 131777 - DNA, 20 bp, Artificial
  CRISPR gRNA sequence
gtagaatgaatgcatttcaa

SEQ ID NO: 131778 - DNA, 20 bp, Artificial
  CRISPR gRNA sequence
caagtctagacagacagtac

SEQ ID NO: 131779 - DNA, 20 bp, Artificial
  CRISPR gRNA sequence
aagtctagacagacagtacc

SEQ ID NO: 131780 - DNA, 20 bp, Artificial
  CRISPR gRNA sequence
gacagacagtacctctgctc

SEQ ID NO: 131781 - DNA, 20 bp, Artificial
  CRISPR gRNA sequence
tgctcattcctgttgcttcc

SEQ ID NO: 131782 - DNA, 20 bp, Artificial
  CRISPR gRNA sequence
ctcattcctgttgcttcctt

SEQ ID NO: 131783 - DNA, 20 bp, Artificial
  CRISPR gRNA sequence
attcctgttgcttccttatt

SEQ ID NO: 131784 - DNA, 20 bp, Artificial
  CRISPR gRNA sequence
ctgttgcttccttattttca

SEQ ID NO: 131785 - DNA, 20 bp, Artificial
  CRISPR gRNA sequence
ttgcttccttattttcagct

SEQ ID NO: 131786 - DNA, 20 bp, Artificial
  CRISPR gRNA sequence
cttccttattttcagcttct

SEQ ID NO: 131787 - DNA, 20 bp, Artificial
  CRISPR gRNA sequence
ccttattttcagcttcttgc

SEQ ID NO: 131788 - DNA, 20 bp, Artificial
  CRISPR gRNA sequence
cttattttcagcttcttgca

SEQ ID NO: 131789 - DNA, 20 bp, Artificial
  CRISPR gRNA sequence
attttcagcttcttgcatat

SEQ ID NO: 131790 - DNA, 20 bp, Artificial
  CRISPR gRNA sequence
ttttcagcttcttgcatata

SEQ ID NO: 131791 - DNA, 20 bp, Artificial
  CRISPR gRNA sequence
tcagcttcttgcatatatta

SEQ ID NO: 131792 - DNA, 20 bp, Artificial
  CRISPR gRNA sequence
cagcttcttgcatatattat

SEQ ID NO: 131793 - DNA, 20 bp, Artificial
  CRISPR gRNA sequence
agcttcttgcatatattatt

SEQ ID NO: 131794 - DNA, 20 bp, Artificial
  CRISPR gRNA sequence
cttgcatatattatttccca

SEQ ID NO: 131795 - DNA, 20 bp, Artificial
  CRISPR gRNA sequence
ttgcatatattatttcccat

SEQ ID NO: 131796 - DNA, 20 bp, Artificial
  CRISPR gRNA sequence
gcatatattatttcccatgg

SEQ ID NO: 131797 - DNA, 20 bp, Artificial
  CRISPR gRNA sequence
catatattatttcccatggg

SEQ ID NO: 131798 - DNA, 20 bp, Artificial
  CRISPR gRNA sequence
tttcccatgggtccctaagt

SEQ ID NO: 131799 - DNA, 20 bp, Artificial
  CRISPR gRNA sequence
cccatgggtccctaagtgct

SEQ ID NO: 131800 - DNA, 20 bp, Artificial
  CRISPR gRNA sequence
ccatgggtccctaagtgctg

SEQ ID NO: 131801 - DNA, 20 bp, Artificial
  CRISPR gRNA sequence
agtgctgttgaggctacagg

SEQ ID NO: 131802 - DNA, 20 bp, Artificial
  CRISPR gRNA sequence
ttgaggctacagggtagcct

SEQ ID NO: 131803 - DNA, 20 bp, Artificial
  CRISPR gRNA sequence
aggctacagggtagcctgtc

SEQ ID NO: 131804 - DNA, 20 bp, Artificial
  CRISPR gRNA sequence
cagggtagcctgtcccagct

SEQ ID NO: 131805 - DNA, 20 bp, Artificial
  CRISPR gRNA sequence
tcccagctgtaaaggggctg

SEQ ID NO: 131806 - DNA, 20 bp, Artificial
  CRISPR gRNA sequence
taaaggggctgtctgtttag

SEQ ID NO: 131807 - DNA, 20 bp, Artificial
  CRISPR gRNA sequence
tctgtttagccaattaattg

SEQ ID NO: 131808 - DNA, 20 bp, Artificial
  CRISPR gRNA sequence
tttagccaattaattgaata

SEQ ID NO: 131809 - DNA, 20 bp, Artificial
  CRISPR gRNA sequence
agccaattaattgaatactt

SEQ ID NO: 131810 - DNA, 20 bp, Artificial
  CRISPR gRNA sequence
gccaattaattgaatactta

SEQ ID NO: 131811 - DNA, 20 bp, Artificial
  CRISPR gRNA sequence
attgaatacttaggggacag

SEQ ID NO: 131812 - DNA, 20 bp, Artificial
  CRISPR gRNA sequence
aatacttaggggacagttat

SEQ ID NO: 131813 - DNA, 20 bp, Artificial
  CRISPR gRNA sequence
aggggacagttatgcccaga

SEQ ID NO: 131814 - DNA, 20 bp, Artificial
  CRISPR gRNA sequence
ggggacagttatgcccagaa

SEQ ID NO: 131815 - DNA, 20 bp, Artificial
  CRISPR gRNA sequence
tgcccagaatggaaaatgct

SEQ ID NO: 131816 - DNA, 20 bp, Artificial
  CRISPR gRNA sequence
actcttaagtgcagtagata

SEQ ID NO: 131817 - DNA, 20 bp, Artificial
  CRISPR gRNA sequence
ttaagtgcagtagatatggg

SEQ ID NO: 131818 - DNA, 20 bp, Artificial
  CRISPR gRNA sequence
aagtgcagtagatatgggaa

SEQ ID NO: 131819 - DNA, 20 bp, Artificial
  CRISPR gRNA sequence
agtgcagtagatatgggaag

SEQ ID NO: 131820 - DNA, 20 bp, Artificial
  CRISPR gRNA sequence
ggtacttgggaatgtcacag

SEQ ID NO: 131821 - DNA, 20 bp, Artificial
  CRISPR gRNA sequence
gggaatgtcacagagggatc

SEQ ID NO: 131822 - DNA, 20 bp, Artificial
  CRISPR gRNA sequence
ggaatgtcacagagggatcc

SEQ ID NO: 131823 - DNA, 20 bp, Artificial
  CRISPR gRNA sequence
cagaccttgaactgagcctt

SEQ ID NO: 131824 - DNA, 20 bp, Artificial
  CRISPR gRNA sequence
gaactgagccttgaaataga

SEQ ID NO: 131825 - DNA, 20 bp, Artificial
  CRISPR gRNA sequence
aactgagccttgaaatagag

SEQ ID NO: 131826 - DNA, 20 bp, Artificial
  CRISPR gRNA sequence
agccttgaaatagagggtgg

SEQ ID NO: 131827 - DNA, 20 bp, Artificial
  CRISPR gRNA sequence
gaaatagagggtgggagtgg

SEQ ID NO: 131828 - DNA, 20 bp, Artificial
  CRISPR gRNA sequence
aaatagagggtgggagtgga

SEQ ID NO: 131829 - DNA, 20 bp, Artificial
  CRISPR gRNA sequence
gtgaagggtgtcaccaaaag

SEQ ID NO: 131830 - DNA, 20 bp, Artificial
  CRISPR gRNA sequence
atggcaggatgggcaactta

SEQ ID NO: 131831 - DNA, 20 bp, Artificial
  CRISPR gRNA sequence
aagtttaggggatcgggagt

SEQ ID NO: 131832 - DNA, 20 bp, Artificial
  CRISPR gRNA sequence
agtttaggggatcgggagta

SEQ ID NO: 131833 - DNA, 20 bp, Artificial
  CRISPR gRNA sequence
aggggatcgggagtagaggt

SEQ ID NO: 131834 - DNA, 20 bp, Artificial
  CRISPR gRNA sequence
ggggatcgggagtagaggtg

SEQ ID NO: 131835 - DNA, 20 bp, Artificial
  CRISPR gRNA sequence
aaaggataatgtaggaaaga

SEQ ID NO: 131836 - DNA, 20 bp, Artificial
  CRISPR gRNA sequence
gtcccctctggatatttaat

SEQ ID NO: 131837 - DNA, 20 bp, Artificial
  CRISPR gRNA sequence
tcccctctggatatttaatt

SEQ ID NO: 131838 - DNA, 20 bp, Artificial
  CRISPR gRNA sequence
tggatatttaattctggatg

SEQ ID NO: 131839 - DNA, 20 bp, Artificial
  CRISPR gRNA sequence
gatatttaattctggatgtg

SEQ ID NO: 131840 - DNA, 20 bp, Artificial
  CRISPR gRNA sequence
aattctggatgtgctactat

SEQ ID NO: 131841 - DNA, 20 bp, Artificial
  CRISPR gRNA sequence
attctggatgtgctactata

SEQ ID NO: 131842 - DNA, 20 bp, Artificial
  CRISPR gRNA sequence
tggatgtgctactatatctg

SEQ ID NO: 131843 - DNA, 20 bp, Artificial
  CRISPR gRNA sequence
gatgtgctactatatctgta

SEQ ID NO: 131844 - DNA, 20 bp, Artificial
  CRISPR gRNA sequence
ctatatctgtaacctcgggt

SEQ ID NO: 131845 - DNA, 20 bp, Artificial
  CRISPR gRNA sequence
tatctgtaacctcgggtgtg

SEQ ID NO: 131846 - DNA, 20 bp, Artificial
  CRISPR gRNA sequence
taacctcgggtgtgttacag

SEQ ID NO: 131847 - DNA, 20 bp, Artificial
  CRISPR gRNA sequence
gggtgtgttacagcttcttt

SEQ ID NO: 131848 - DNA, 20 bp, Artificial
  CRISPR gRNA sequence
cagcttctttgagctgtggt

SEQ ID NO: 131849 - DNA, 20 bp, Artificial
  CRISPR gRNA sequence
ctttgagctgtggtcgcttc

SEQ ID NO: 131850 - DNA, 20 bp, Artificial
  CRISPR gRNA sequence
tttgagctgtggtcgcttca

SEQ ID NO: 131851 - DNA, 20 bp, Artificial
  CRISPR gRNA sequence
tgagctgtggtcgcttcact

SEQ ID NO: 131852 - DNA, 20 bp, Artificial
  CRISPR gRNA sequence
gagctgtggtcgcttcactc

SEQ ID NO: 131853 - DNA, 20 bp, Artificial
  CRISPR gRNA sequence
agctgtggtcgcttcactcc

SEQ ID NO: 131854 - DNA, 20 bp, Artificial
  CRISPR gRNA sequence
tggtcgcttcactcctaaaa

SEQ ID NO: 131855 - DNA, 20 bp, Artificial
  CRISPR gRNA sequence
cactcctaaaatgaaagaag

SEQ ID NO: 131856 - DNA, 20 bp, Artificial
  CRISPR gRNA sequence
actcctaaaatgaaagaagt

SEQ ID NO: 131857 - DNA, 20 bp, Artificial
  CRISPR gRNA sequence
ctaaaatgaaagaagtgcac

SEQ ID NO: 131858 - DNA, 20 bp, Artificial
  CRISPR gRNA sequence
aaatgaaagaagtgcactca

SEQ ID NO: 131859 - DNA, 20 bp, Artificial
  CRISPR gRNA sequence
agtgatccctaaataaagca

SEQ ID NO: 131860 - DNA, 20 bp, Artificial
  CRISPR gRNA sequence
aataaagcacattctagcac

SEQ ID NO: 131861 - DNA, 20 bp, Artificial
  CRISPR gRNA sequence
tagcacaaagatttttatta

SEQ ID NO: 131862 - DNA, 20 bp, Artificial
  CRISPR gRNA sequence
gcacaaagatttttattaac

SEQ ID NO: 131863 - DNA, 20 bp, Artificial
  CRISPR gRNA sequence
ttattaaccatgaagataga

SEQ ID NO: 131864 - DNA, 20 bp, Artificial
  CRISPR gRNA sequence
tattaaccatgaagatagag

SEQ ID NO: 131865 - DNA, 20 bp, Artificial
  CRISPR gRNA sequence
attaaccatgaagatagaga

SEQ ID NO: 131866 - DNA, 20 bp, Artificial
  CRISPR gRNA sequence
ttaaccatgaagatagagaa

SEQ ID NO: 131867 - DNA, 20 bp, Artificial
  CRISPR gRNA sequence
accatgaagatagagaaaag

SEQ ID NO: 131868 - DNA, 20 bp, Artificial
  CRISPR gRNA sequence
ggttaggttaaatgtgcgat

SEQ ID NO: 131869 - DNA, 20 bp, Artificial
  CRISPR gRNA sequence
gttaggttaaatgtgcgatc

SEQ ID NO: 131870 - DNA, 20 bp, Artificial
  CRISPR gRNA sequence
ggttaaatgtgcgatctgct

SEQ ID NO: 131871 - DNA, 20 bp, Artificial
  CRISPR gRNA sequence
aatgtgcgatctgctcatgt

SEQ ID NO: 131872 - DNA, 20 bp, Artificial
  CRISPR gRNA sequence
ctcatgtgaagtcatgaaaa

SEQ ID NO: 131873 - DNA, 20 bp, Artificial
  CRISPR gRNA sequence
atgtgaagtcatgaaaatga

SEQ ID NO: 131874 - DNA, 20 bp, Artificial
  CRISPR gRNA sequence
ggatttgacacaggaagcct

SEQ ID NO: 131875 - DNA, 20 bp, Artificial
  CRISPR gRNA sequence
gatttgacacaggaagcctt

SEQ ID NO: 131876 - DNA, 20 bp, Artificial
  CRISPR gRNA sequence
gacacaggaagcctttagga

SEQ ID NO: 131877 - DNA, 20 bp, Artificial
  CRISPR gRNA sequence
acacaggaagcctttaggaa

SEQ ID NO: 131878 - DNA, 20 bp, Artificial
  CRISPR gRNA sequence
taggaacctttgagaatagg

SEQ ID NO: 131879 - DNA, 20 bp, Artificial
  CRISPR gRNA sequence
aggaacctttgagaataggt

SEQ ID NO: 131880 - DNA, 20 bp, Artificial
  CRISPR gRNA sequence
ggaacctttgagaataggtt

SEQ ID NO: 131881 - DNA, 20 bp, Artificial
  CRISPR gRNA sequence
tgagaataggttcaagagta

SEQ ID NO: 131882 - DNA, 20 bp, Artificial
  CRISPR gRNA sequence
gagaataggttcaagagtat

SEQ ID NO: 131883 - DNA, 20 bp, Artificial
  CRISPR gRNA sequence
agaataggttcaagagtata

SEQ ID NO: 131884 - DNA, 20 bp, Artificial
  CRISPR gRNA sequence
aagagtatagaactggtgtt

SEQ ID NO: 131885 - DNA, 20 bp, Artificial
  CRISPR gRNA sequence
gtgttgtggtgagattagtc

SEQ ID NO: 131886 - DNA, 20 bp, Artificial
  CRISPR gRNA sequence
tggtgagattagtcttataa

SEQ ID NO: 131887 - DNA, 20 bp, Artificial
  CRISPR gRNA sequence
gtcttataacaatatgttaa

SEQ ID NO: 131888 - DNA, 20 bp, Artificial
  CRISPR gRNA sequence
ataacaatatgttaagatgg

SEQ ID NO: 131889 - DNA, 20 bp, Artificial
  CRISPR gRNA sequence
taacaatatgttaagatggg

SEQ ID NO: 131890 - DNA, 20 bp, Artificial
  CRISPR gRNA sequence
agatgggctgggtggtaatc

SEQ ID NO: 131891 - DNA, 20 bp, Artificial
  CRISPR gRNA sequence
ggtggtaatccagtggaaat

SEQ ID NO: 131892 - DNA, 20 bp, Artificial
  CRISPR gRNA sequence
ggagacatttttaaagaggt

SEQ ID NO: 131893 - DNA, 20 bp, Artificial
  CRISPR gRNA sequence
ttaaagaggtaatagatgag

SEQ ID NO: 131894 - DNA, 20 bp, Artificial
  CRISPR gRNA sequence
taaagaggtaatagatgagg

SEQ ID NO: 131895 - DNA, 20 bp, Artificial
  CRISPR gRNA sequence
aaagaggtaatagatgaggt

SEQ ID NO: 131896 - DNA, 20 bp, Artificial
  CRISPR gRNA sequence
aagaggtaatagatgaggta

SEQ ID NO: 131897 - DNA, 20 bp, Artificial
  CRISPR gRNA sequence
gaaggagatggaagaaccta

SEQ ID NO: 131898 - DNA, 20 bp, Artificial
  CRISPR gRNA sequence
aaggagatggaagaacctaa

SEQ ID NO: 131899 - DNA, 20 bp, Artificial
  CRISPR gRNA sequence
agatgatgctggtatatttg

SEQ ID NO: 131900 - DNA, 20 bp, Artificial
  CRISPR gRNA sequence
gtatatttggctgggcagag

SEQ ID NO: 131901 - DNA, 20 bp, Artificial
  CRISPR gRNA sequence
ggctgggcagagtgaagggc

SEQ ID NO: 131902 - DNA, 20 bp, Artificial
  CRISPR gRNA sequence
gctgggcagagtgaagggct

SEQ ID NO: 131903 - DNA, 20 bp, Artificial
  CRISPR gRNA sequence
ggcagagtgaagggctggta

SEQ ID NO: 131904 - DNA, 20 bp, Artificial
  CRISPR gRNA sequence
gtattcttcttagtagaatt

SEQ ID NO: 131905 - DNA, 20 bp, Artificial
  CRISPR gRNA sequence
ttcttagtagaattacagta

SEQ ID NO: 131906 - DNA, 20 bp, Artificial
  CRISPR gRNA sequence
cttagtagaattacagtagt

SEQ ID NO: 131907 - DNA, 20 bp, Artificial
  CRISPR gRNA sequence
ttagtagaattacagtagtg

SEQ ID NO: 131908 - DNA, 20 bp, Artificial
  CRISPR gRNA sequence
agtagaattacagtagtgga

SEQ ID NO: 131909 - DNA, 20 bp, Artificial
  CRISPR gRNA sequence
gtagaattacagtagtggaa

SEQ ID NO: 131910 - DNA, 20 bp, Artificial
  CRISPR gRNA sequence
cagtagtggaaagggaaatc

SEQ ID NO: 131911 - DNA, 20 bp, Artificial
  CRISPR gRNA sequence
cctcctttccccgttgcagg

SEQ ID NO: 131912 - DNA, 20 bp, Artificial
  CRISPR gRNA sequence
ctttccccgttgcagggaat

SEQ ID NO: 131913 - DNA, 20 bp, Artificial
  CRISPR gRNA sequence
tccccgttgcagggaatggg

SEQ ID NO: 131914 - DNA, 20 bp, Artificial
  CRISPR gRNA sequence
ccccgttgcagggaatgggg

SEQ ID NO: 131915 - DNA, 20 bp, Artificial
  CRISPR gRNA sequence
cccgttgcagggaatggggc

SEQ ID NO: 131916 - DNA, 20 bp, Artificial
  CRISPR gRNA sequence
cagggaatggggcaaggtga

SEQ ID NO: 131917 - DNA, 20 bp, Artificial
  CRISPR gRNA sequence
catttcccaatatcttaaat

SEQ ID NO: 131918 - DNA, 20 bp, Artificial
  CRISPR gRNA sequence
atttcccaatatcttaaatt

SEQ ID NO: 131919 - DNA, 20 bp, Artificial
  CRISPR gRNA sequence
cccaatatcttaaatttgcc

SEQ ID NO: 131920 - DNA, 20 bp, Artificial
  CRISPR gRNA sequence
ccaatatcttaaatttgccg

SEQ ID NO: 131921 - DNA, 20 bp, Artificial
  CRISPR gRNA sequence
aaatttgccgtgatgagata

SEQ ID NO: 131922 - DNA, 20 bp, Artificial
  CRISPR gRNA sequence
aatttgccgtgatgagatat

SEQ ID NO: 131923 - DNA, 20 bp, Artificial
  CRISPR gRNA sequence
gccgtgatgagatattagac

SEQ ID NO: 131924 - DNA, 20 bp, Artificial
  CRISPR gRNA sequence
ccgtgatgagatattagaca

SEQ ID NO: 131925 - DNA, 20 bp, Artificial
  CRISPR gRNA sequence
gacatgccctacaggcatgg

SEQ ID NO: 131926 - DNA, 20 bp, Artificial
  CRISPR gRNA sequence
caggcatgggttgcttgagt

SEQ ID NO: 131927 - DNA, 20 bp, Artificial
  CRISPR gRNA sequence
cttgagtggcaagcagaata

SEQ ID NO: 131928 - DNA, 20 bp, Artificial
  CRISPR gRNA sequence
gagtggcaagcagaatattg

SEQ ID NO: 131929 - DNA, 20 bp, Artificial
  CRISPR gRNA sequence
agtggcaagcagaatattgg

SEQ ID NO: 131930 - DNA, 20 bp, Artificial
  CRISPR gRNA sequence
gttgtagatttggcatttat

SEQ ID NO: 131931 - DNA, 20 bp, Artificial
  CRISPR gRNA sequence
tagatttggcatttataagc

SEQ ID NO: 131932 - DNA, 20 bp, Artificial
  CRISPR gRNA sequence
ggcatttataagcatagaag

SEQ ID NO: 131933 - DNA, 20 bp, Artificial
  CRISPR gRNA sequence
gcatttataagcatagaagt

SEQ ID NO: 131934 - DNA, 20 bp, Artificial
  CRISPR gRNA sequence
ataagcatagaagtgatatt

SEQ ID NO: 131935 - DNA, 20 bp, Artificial
  CRISPR gRNA sequence
taagcatagaagtgatattt

SEQ ID NO: 131936 - DNA, 20 bp, Artificial
  CRISPR gRNA sequence
agtgagttcattaagaaaat

SEQ ID NO: 131937 - DNA, 20 bp, Artificial
  CRISPR gRNA sequence
gtgagttcattaagaaaata

SEQ ID NO: 131938 - DNA, 20 bp, Artificial
  CRISPR gRNA sequence
attaagaaaataagggaaga

SEQ ID NO: 131939 - DNA, 20 bp, Artificial
  CRISPR gRNA sequence
agaaaataagggaagaaaga

SEQ ID NO: 131940 - DNA, 20 bp, Artificial
  CRISPR gRNA sequence
gggtgaaacaattagggggt

SEQ ID NO: 131941 - DNA, 20 bp, Artificial
  CRISPR gRNA sequence
ggtgaaacaattagggggtg

SEQ ID NO: 131942 - DNA, 20 bp, Artificial
  CRISPR gRNA sequence
gggggtggggaggaaaggat

SEQ ID NO: 131943 - DNA, 20 bp, Artificial
  CRISPR gRNA sequence
ctttggaaatcagagtagga

SEQ ID NO: 131944 - DNA, 20 bp, Artificial
  CRISPR gRNA sequence
tggaaatcagagtaggagag

SEQ ID NO: 131945 - DNA, 20 bp, Artificial
  CRISPR gRNA sequence
ggaaatcagagtaggagaga

SEQ ID NO: 131946 - DNA, 20 bp, Artificial
  CRISPR gRNA sequence
gaaatcagagtaggagagaa

SEQ ID NO: 131947 - DNA, 20 bp, Artificial
  CRISPR gRNA sequence
caagcataaatgtgtggcga

SEQ ID NO: 131948 - DNA, 20 bp, Artificial
  CRISPR gRNA sequence
caaagaacagtcaagtagga

SEQ ID NO: 131949 - DNA, 20 bp, Artificial
  CRISPR gRNA sequence
gcagcttttaagagtggttt

SEQ ID NO: 131950 - DNA, 20 bp, Artificial
  CRISPR gRNA sequence
ttaagagtggtttcattctg

SEQ ID NO: 131951 - DNA, 20 bp, Artificial
  CRISPR gRNA sequence
taagagtggtttcattctgg

SEQ ID NO: 131952 - DNA, 20 bp, Artificial
  CRISPR gRNA sequence
aagagtggtttcattctggg

SEQ ID NO: 131953 - DNA, 20 bp, Artificial
  CRISPR gRNA sequence
agagtggtttcattctgggt

SEQ ID NO: 131954 - DNA, 20 bp, Artificial
  CRISPR gRNA sequence
cattctgggttggggttaaa

SEQ ID NO: 131955 - DNA, 20 bp, Artificial
  CRISPR gRNA sequence
attctgggttggggttaaaa

SEQ ID NO: 131956 - DNA, 20 bp, Artificial
  CRISPR gRNA sequence
tgggttggggttaaaaagta

SEQ ID NO: 131957 - DNA, 20 bp, Artificial
  CRISPR gRNA sequence
ggttggggttaaaaagtaca

SEQ ID NO: 131958 - DNA, 20 bp, Artificial
  CRISPR gRNA sequence
gggttaaaaagtacatgttc

SEQ ID NO: 131959 - DNA, 20 bp, Artificial
  CRISPR gRNA sequence
aaaagtacatgttcaggagt

SEQ ID NO: 131960 - DNA, 20 bp, Artificial
  CRISPR gRNA sequence
aggagtttaaataggaatga

SEQ ID NO: 131961 - DNA, 20 bp, Artificial
  CRISPR gRNA sequence
aaataggaatgaagaggtgt

SEQ ID NO: 131962 - DNA, 20 bp, Artificial
  CRISPR gRNA sequence
aataggaatgaagaggtgtc

SEQ ID NO: 131963 - DNA, 20 bp, Artificial
  CRISPR gRNA sequence
aacaactgtcagggcaagaa

SEQ ID NO: 131964 - DNA, 20 bp, Artificial
  CRISPR gRNA sequence
acaactgtcagggcaagaat

SEQ ID NO: 131965 - DNA, 20 bp, Artificial
  CRISPR gRNA sequence
tcagggcaagaatggtagct

SEQ ID NO: 131966 - DNA, 20 bp, Artificial
  CRISPR gRNA sequence
ggcaagggtatggggcagaa

SEQ ID NO: 131967 - DNA, 20 bp, Artificial
  CRISPR gRNA sequence
agattttatatatctctgtg

SEQ ID NO: 131968 - DNA, 20 bp, Artificial
  CRISPR gRNA sequence
tatatatctctgtgtacttc

SEQ ID NO: 131969 - DNA, 20 bp, Artificial
  CRISPR gRNA sequence
atatatctctgtgtacttct

SEQ ID NO: 131970 - DNA, 20 bp, Artificial
  CRISPR gRNA sequence
tatatctctgtgtacttctg

SEQ ID NO: 131971 - DNA, 20 bp, Artificial
  CRISPR gRNA sequence
tgtgtacttctgtatgctta

SEQ ID NO: 131972 - DNA, 20 bp, Artificial
  CRISPR gRNA sequence
tgtacttctgtatgcttaat

SEQ ID NO: 131973 - DNA, 20 bp, Artificial
  CRISPR gRNA sequence
ctgtatgcttaatgagggag

SEQ ID NO: 131974 - DNA, 20 bp, Artificial
  CRISPR gRNA sequence
tgtatgcttaatgagggaga

SEQ ID NO: 131975 - DNA, 20 bp, Artificial
  CRISPR gRNA sequence
tatgcttaatgagggagact

SEQ ID NO: 131976 - DNA, 20 bp, Artificial
  CRISPR gRNA sequence
aatgagggagactaagcatg

SEQ ID NO: 131977 - DNA, 20 bp, Artificial
  CRISPR gRNA sequence
atgagggagactaagcatgt

SEQ ID NO: 131978 - DNA, 20 bp, Artificial
  CRISPR gRNA sequence
agcatgtttaaggaagagtg

SEQ ID NO: 131979 - DNA, 20 bp, Artificial
  CRISPR gRNA sequence
aaggaagagtgaaggagctg

SEQ ID NO: 131980 - DNA, 20 bp, Artificial
  CRISPR gRNA sequence
aggaagagtgaaggagctgg

SEQ ID NO: 131981 - DNA, 20 bp, Artificial
  CRISPR gRNA sequence
gtaaggaggattgaagatac

SEQ ID NO: 131982 - DNA, 20 bp, Artificial
  CRISPR gRNA sequence
aagatacattatagaagagg

SEQ ID NO: 131983 - DNA, 20 bp, Artificial
  CRISPR gRNA sequence
tagaagaggaatctttgtat

SEQ ID NO: 131984 - DNA, 20 bp, Artificial
  CRISPR gRNA sequence
tgtattatttcttatcctca

SEQ ID NO: 131985 - DNA, 20 bp, Artificial
  CRISPR gRNA sequence
gtattatttcttatcctcag

SEQ ID NO: 131986 - DNA, 20 bp, Artificial
  CRISPR gRNA sequence
tattatttcttatcctcaga

SEQ ID NO: 131987 - DNA, 20 bp, Artificial
  CRISPR gRNA sequence
tttcttatcctcagatagat

SEQ ID NO: 131988 - DNA, 20 bp, Artificial
  CRISPR gRNA sequence
cttatcctcagatagataaa

SEQ ID NO: 131989 - DNA, 20 bp, Artificial
  CRISPR gRNA sequence
ttatcctcagatagataaaa

SEQ ID NO: 131990 - DNA, 20 bp, Artificial
  CRISPR gRNA sequence
atcctcagatagataaaagg

SEQ ID NO: 131991 - DNA, 20 bp, Artificial
  CRISPR gRNA sequence
tcctcagatagataaaagga

SEQ ID NO: 131992 - DNA, 20 bp, Artificial
  CRISPR gRNA sequence
agatagataaaaggaatgta

SEQ ID NO: 131993 - DNA, 20 bp, Artificial
  CRISPR gRNA sequence
agagagagaagaatctctgc

SEQ ID NO: 131994 - DNA, 20 bp, Artificial
  CRISPR gRNA sequence
tgcctggaagaataatgaga

SEQ ID NO: 131995 - DNA, 20 bp, Artificial
  CRISPR gRNA sequence
cctggaagaataatgagaac

SEQ ID NO: 131996 - DNA, 20 bp, Artificial
  CRISPR gRNA sequence
gaagaataatgagaaccgta

SEQ ID NO: 131997 - DNA, 20 bp, Artificial
  CRISPR gRNA sequence
gagggggcaatactaagatt

SEQ ID NO: 131998 - DNA, 20 bp, Artificial
  CRISPR gRNA sequence
agggggcaatactaagatta

SEQ ID NO: 131999 - DNA, 20 bp, Artificial
  CRISPR gRNA sequence
agattacatttgttaagttc

SEQ ID NO: 132000 - DNA, 20 bp, Artificial
  CRISPR gRNA sequence
catttgttaagttcttacta

SEQ ID NO: 132001 - DNA, 20 bp, Artificial
  CRISPR gRNA sequence
gttaagttcttactatgtat

SEQ ID NO: 132002 - DNA, 20 bp, Artificial
  CRISPR gRNA sequence
ttaagttcttactatgtatc

SEQ ID NO: 132003 - DNA, 20 bp, Artificial
  CRISPR gRNA sequence
agttcttactatgtatcttg

SEQ ID NO: 132004 - DNA, 20 bp, Artificial
  CRISPR gRNA sequence
ttactatgtatcttgcactt

SEQ ID NO: 132005 - DNA, 20 bp, Artificial
  CRISPR gRNA sequence
actatgtatcttgcactttg

SEQ ID NO: 132006 - DNA, 20 bp, Artificial
  CRISPR gRNA sequence
ctatgtatcttgcactttgc

SEQ ID NO: 132007 - DNA, 20 bp, Artificial
  CRISPR gRNA sequence
tgtatcttgcactttgctag

SEQ ID NO: 132008 - DNA, 20 bp, Artificial
  CRISPR gRNA sequence
gcactttgctaggtgctttt

SEQ ID NO: 132009 - DNA, 20 bp, Artificial
  CRISPR gRNA sequence
cactttgctaggtgcttttt

SEQ ID NO: 132010 - DNA, 20 bp, Artificial
  CRISPR gRNA sequence
tgctaggtgctttttataca

SEQ ID NO: 132011 - DNA, 20 bp, Artificial
  CRISPR gRNA sequence
gctaggtgctttttatacaa

SEQ ID NO: 132012 - DNA, 20 bp, Artificial
  CRISPR gRNA sequence
ctaggtgctttttatacaat

SEQ ID NO: 132013 - DNA, 20 bp, Artificial
  CRISPR gRNA sequence
ggtgctttttatacaatagc

SEQ ID NO: 132014 - DNA, 20 bp, Artificial
  CRISPR gRNA sequence
tttatacaatagcttcctca

SEQ ID NO: 132015 - DNA, 20 bp, Artificial
  CRISPR gRNA sequence
ttatacaatagcttcctcat

SEQ ID NO: 132016 - DNA, 20 bp, Artificial
  CRISPR gRNA sequence
tatacaatagcttcctcata

SEQ ID NO: 132017 - DNA, 20 bp, Artificial
  CRISPR gRNA sequence
atacaatagcttcctcatag

SEQ ID NO: 132018 - DNA, 20 bp, Artificial
  CRISPR gRNA sequence
tacaatagcttcctcatagc

SEQ ID NO: 132019 - DNA, 20 bp, Artificial
  CRISPR gRNA sequence
cctcatagcaacatcacttt

SEQ ID NO: 132020 - DNA, 20 bp, Artificial
  CRISPR gRNA sequence
ctcatagcaacatcacttta

SEQ ID NO: 132021 - DNA, 20 bp, Artificial
  CRISPR gRNA sequence
atagcaacatcactttaaaa

SEQ ID NO: 132022 - DNA, 20 bp, Artificial
  CRISPR gRNA sequence
taaaaatggggaagctgaaa

SEQ ID NO: 132023 - DNA, 20 bp, Artificial
  CRISPR gRNA sequence
aaaaatggggaagctgaaaa

SEQ ID NO: 132024 - DNA, 20 bp, Artificial
  CRISPR gRNA sequence
aaaatggggaagctgaaaac

SEQ ID NO: 132025 - DNA, 20 bp, Artificial
  CRISPR gRNA sequence
aaaacacaaagagagctcat

SEQ ID NO: 132026 - DNA, 20 bp, Artificial
  CRISPR gRNA sequence
ataaatggggagccaagctt

SEQ ID NO: 132027 - DNA, 20 bp, Artificial
  CRISPR gRNA sequence
caaacccacgaaatcggtcc

SEQ ID NO: 132028 - DNA, 20 bp, Artificial
  CRISPR gRNA sequence
aaacccacgaaatcggtcct

SEQ ID NO: 132029 - DNA, 20 bp, Artificial
  CRISPR gRNA sequence
agagccagtgctcctcaccg

SEQ ID NO: 132030 - DNA, 20 bp, Artificial
  CRISPR gRNA sequence
ctcaccgtcgtccagggtgc

SEQ ID NO: 132031 - DNA, 20 bp, Artificial
  CRISPR gRNA sequence
accgtcgtccagggtgcact

SEQ ID NO: 132032 - DNA, 20 bp, Artificial
  CRISPR gRNA sequence
cttaaccatctcacaaacac

SEQ ID NO: 132033 - DNA, 20 bp, Artificial
  CRISPR gRNA sequence
ttaaccatctcacaaacacc

SEQ ID NO: 132034 - DNA, 20 bp, Artificial
  CRISPR gRNA sequence
aaccatctcacaaacaccat

SEQ ID NO: 132035 - DNA, 20 bp, Artificial
  CRISPR gRNA sequence
accatctcacaaacaccatc

SEQ ID NO: 132036 - DNA, 20 bp, Artificial
  CRISPR gRNA sequence
acaaacaccatcctggtttg

SEQ ID NO: 132037 - DNA, 20 bp, Artificial
  CRISPR gRNA sequence
gtttgagaagctaatttcag

SEQ ID NO: 132038 - DNA, 20 bp, Artificial
  CRISPR gRNA sequence
gagaagctaatttcagtgtt

SEQ ID NO: 132039 - DNA, 20 bp, Artificial
  CRISPR gRNA sequence
agaagctaatttcagtgttt

SEQ ID NO: 132040 - DNA, 20 bp, Artificial
  CRISPR gRNA sequence
atttcagtgttttcagtgta

SEQ ID NO: 132041 - DNA, 20 bp, Artificial
  CRISPR gRNA sequence
cagtgttttcagtgtataat

SEQ ID NO: 132042 - DNA, 20 bp, Artificial
  CRISPR gRNA sequence
agtgttttcagtgtataatc

SEQ ID NO: 132043 - DNA, 20 bp, Artificial
  CRISPR gRNA sequence
tcagtgtataatcagtagcc

SEQ ID NO: 132044 - DNA, 20 bp, Artificial
  CRISPR gRNA sequence
cagtgtataatcagtagcct

SEQ ID NO: 132045 - DNA, 20 bp, Artificial
  CRISPR gRNA sequence
agtgtataatcagtagcctt

SEQ ID NO: 132046 - DNA, 20 bp, Artificial
  CRISPR gRNA sequence
agaatgtaaaagggacaaat

SEQ ID NO: 132047 - DNA, 20 bp, Artificial
  CRISPR gRNA sequence
gaatgtaaaagggacaaatt

SEQ ID NO: 132048 - DNA, 20 bp, Artificial
  CRISPR gRNA sequence
aagaagtaggtgtaaagact

SEQ ID NO: 132049 - DNA, 20 bp, Artificial
  CRISPR gRNA sequence
tatgaaaaactaccaggcag

SEQ ID NO: 132050 - DNA, 20 bp, Artificial
  CRISPR gRNA sequence
ccaggcaggaatgctgtaga

SEQ ID NO: 132051 - DNA, 20 bp, Artificial
  CRISPR gRNA sequence
tagagagtagttggcatctg

SEQ ID NO: 132052 - DNA, 20 bp, Artificial
  CRISPR gRNA sequence
gcatctgaggccctggattt

SEQ ID NO: 132053 - DNA, 20 bp, Artificial
  CRISPR gRNA sequence
aggccctggatttcagtccc

SEQ ID NO: 132054 - DNA, 20 bp, Artificial
  CRISPR gRNA sequence
gatttcagtcccatttactg

SEQ ID NO: 132055 - DNA, 20 bp, Artificial
  CRISPR gRNA sequence
cagtcccatttactgtgtca

SEQ ID NO: 132056 - DNA, 20 bp, Artificial
  CRISPR gRNA sequence
agtcccatttactgtgtcac

SEQ ID NO: 132057 - DNA, 20 bp, Artificial
  CRISPR gRNA sequence
actgtgtcacctcaggcaaa

SEQ ID NO: 132058 - DNA, 20 bp, Artificial
  CRISPR gRNA sequence
ctgtgtcacctcaggcaaat

SEQ ID NO: 132059 - DNA, 20 bp, Artificial
  CRISPR gRNA sequence
tgtcacctcaggcaaatcat

SEQ ID NO: 132060 - DNA, 20 bp, Artificial
  CRISPR gRNA sequence
aggcaaatcattagcctcat

SEQ ID NO: 132061 - DNA, 20 bp, Artificial
  CRISPR gRNA sequence
gcctcatgtacctcagtttt

SEQ ID NO: 132062 - DNA, 20 bp, Artificial
  CRISPR gRNA sequence
atgtacctcagttttctcac

SEQ ID NO: 132063 - DNA, 20 bp, Artificial
  CRISPR gRNA sequence
agttttctcacctgcgtcac

SEQ ID NO: 132064 - DNA, 20 bp, Artificial
  CRISPR gRNA sequence
tctcacctgcgtcacaggct

SEQ ID NO: 132065 - DNA, 20 bp, Artificial
  CRISPR gRNA sequence
ctcacctgcgtcacaggctt

SEQ ID NO: 132066 - DNA, 20 bp, Artificial
  CRISPR gRNA sequence
tcacctgcgtcacaggcttg

SEQ ID NO: 132067 - DNA, 20 bp, Artificial
  CRISPR gRNA sequence
acctgcgtcacaggcttgtg

SEQ ID NO: 132068 - DNA, 20 bp, Artificial
  CRISPR gRNA sequence
cgtcacaggcttgtgaacat

SEQ ID NO: 132069 - DNA, 20 bp, Artificial
  CRISPR gRNA sequence
gtgaacattgcatgagatat

SEQ ID NO: 132070 - DNA, 20 bp, Artificial
  CRISPR gRNA sequence
tgaacattgcatgagatatt

SEQ ID NO: 132071 - DNA, 20 bp, Artificial
  CRISPR gRNA sequence
catgagatatttagaaagtg

SEQ ID NO: 132072 - DNA, 20 bp, Artificial
  CRISPR gRNA sequence
agaaagtgttcaataaatgt

SEQ ID NO: 132073 - DNA, 20 bp, Artificial
  CRISPR gRNA sequence
gaaagtgttcaataaatgta

SEQ ID NO: 132074 - DNA, 20 bp, Artificial
  CRISPR gRNA sequence
aataaatgtaaacattaaag

SEQ ID NO: 132075 - DNA, 20 bp, Artificial
  CRISPR gRNA sequence
aagagggcagtatttgtttg

SEQ ID NO: 132076 - DNA, 20 bp, Artificial
  CRISPR gRNA sequence
gtttgtggaacaaattatta

SEQ ID NO: 132077 - DNA, 20 bp, Artificial
  CRISPR gRNA sequence
tttgtggaacaaattattag

SEQ ID NO: 132078 - DNA, 20 bp, Artificial
  CRISPR gRNA sequence
gtggaacaaattattagcat

SEQ ID NO: 132079 - DNA, 20 bp, Artificial
  CRISPR gRNA sequence
tggaacaaattattagcata

SEQ ID NO: 132080 - DNA, 20 bp, Artificial
  CRISPR gRNA sequence
ttagcatagtttaaatacgg

SEQ ID NO: 132081 - DNA, 20 bp, Artificial
  CRISPR gRNA sequence
gcatagtttaaatacggcta

SEQ ID NO: 132082 - DNA, 20 bp, Artificial
  CRISPR gRNA sequence
aaatacggctacatcaaaaa

SEQ ID NO: 132083 - DNA, 20 bp, Artificial
  CRISPR gRNA sequence
aatacggctacatcaaaaaa

SEQ ID NO: 132084 - DNA, 20 bp, Artificial
  CRISPR gRNA sequence
catcaaaaaaataaagattt

SEQ ID NO: 132085 - DNA, 20 bp, Artificial
  CRISPR gRNA sequence
attagcccactacctgttta

SEQ ID NO: 132086 - DNA, 20 bp, Artificial
  CRISPR gRNA sequence
ttagcccactacctgtttat

SEQ ID NO: 132087 - DNA, 20 bp, Artificial
  CRISPR gRNA sequence
gcccactacctgtttatttc

SEQ ID NO: 132088 - DNA, 20 bp, Artificial
  CRISPR gRNA sequence
cctgtttatttcaaataata

SEQ ID NO: 132089 - DNA, 20 bp, Artificial
  CRISPR gRNA sequence
tttatttcaaataatatttt

SEQ ID NO: 132090 - DNA, 20 bp, Artificial
  CRISPR gRNA sequence
atttcaaataatattttcaa

SEQ ID NO: 132091 - DNA, 20 bp, Artificial
  CRISPR gRNA sequence
tttcaaataatattttcaag

SEQ ID NO: 132092 - DNA, 20 bp, Artificial
  CRISPR gRNA sequence
caaataatattttcaagaat

SEQ ID NO: 132093 - DNA, 20 bp, Artificial
  CRISPR gRNA sequence
aaataatattttcaagaata

SEQ ID NO: 132094 - DNA, 20 bp, Artificial
  CRISPR gRNA sequence
tcaagaataattctgtcaat

SEQ ID NO: 132095 - DNA, 20 bp, Artificial
  CRISPR gRNA sequence
caagaataattctgtcaatt

SEQ ID NO: 132096 - DNA, 20 bp, Artificial
  CRISPR gRNA sequence
aagaataattctgtcaattc

SEQ ID NO: 132097 - DNA, 20 bp, Artificial
  CRISPR gRNA sequence
tgtcaattcaactaaataat

SEQ ID NO: 132098 - DNA, 20 bp, Artificial
  CRISPR gRNA sequence
tcaattcaactaaataatga

SEQ ID NO: 132099 - DNA, 20 bp, Artificial
  CRISPR gRNA sequence
aactaaataatgagaatagt

SEQ ID NO: 132100 - DNA, 20 bp, Artificial
  CRISPR gRNA sequence
aataatgagaatagtcatta

SEQ ID NO: 132101 - DNA, 20 bp, Artificial
  CRISPR gRNA sequence
aaatgaatttattgggattt

SEQ ID NO: 132102 - DNA, 20 bp, Artificial
  CRISPR gRNA sequence
attgggatttaaccactctt

SEQ ID NO: 132103 - DNA, 20 bp, Artificial
  CRISPR gRNA sequence
ttgggatttaaccactcttt

SEQ ID NO: 132104 - DNA, 20 bp, Artificial
  CRISPR gRNA sequence
ggatttaaccactctttgtc

SEQ ID NO: 132105 - DNA, 20 bp, Artificial
  CRISPR gRNA sequence
aaccactctttgtccatatt

SEQ ID NO: 132106 - DNA, 20 bp, Artificial
  CRISPR gRNA sequence
accactctttgtccatattt

SEQ ID NO: 132107 - DNA, 20 bp, Artificial
  CRISPR gRNA sequence
tttgtccatatttatcagtt

SEQ ID NO: 132108 - DNA, 20 bp, Artificial
  CRISPR gRNA sequence
tgtccatatttatcagttcc

SEQ ID NO: 132109 - DNA, 20 bp, Artificial
  CRISPR gRNA sequence
gtccatatttatcagttcct

SEQ ID NO: 132110 - DNA, 20 bp, Artificial
  CRISPR gRNA sequence
tccatatttatcagttcctt

SEQ ID NO: 132111 - DNA, 20 bp, Artificial
  CRISPR gRNA sequence
atcagttccttgagtctaac

SEQ ID NO: 132112 - DNA, 20 bp, Artificial
  CRISPR gRNA sequence
tcagttccttgagtctaacg

SEQ ID NO: 132113 - DNA, 20 bp, Artificial
  CRISPR gRNA sequence
cttgagtctaacgattcatc

SEQ ID NO: 132114 - DNA, 20 bp, Artificial
  CRISPR gRNA sequence
gagtctaacgattcatcact

SEQ ID NO: 132115 - DNA, 20 bp, Artificial
  CRISPR gRNA sequence
agtctaacgattcatcactg

SEQ ID NO: 132116 - DNA, 20 bp, Artificial
  CRISPR gRNA sequence
acgattcatcactgtccgtg

SEQ ID NO: 132117 - DNA, 20 bp, Artificial
  CRISPR gRNA sequence
atcactgtccgtgtcccctt

SEQ ID NO: 132118 - DNA, 20 bp, Artificial
  CRISPR gRNA sequence
tccgtgtccccttgtcatta

SEQ ID NO: 132119 - DNA, 20 bp, Artificial
  CRISPR gRNA sequence
gtcattatcctacatgctgt

SEQ ID NO: 132120 - DNA, 20 bp, Artificial
  CRISPR gRNA sequence
tcattatcctacatgctgtg

SEQ ID NO: 132121 - DNA, 20 bp, Artificial
  CRISPR gRNA sequence
tcctacatgctgtgctcttc

SEQ ID NO: 132122 - DNA, 20 bp, Artificial
  CRISPR gRNA sequence
catgctgtgctcttccagcc

SEQ ID NO: 132123 - DNA, 20 bp, Artificial
  CRISPR gRNA sequence
tgctcttccagcctcattac

SEQ ID NO: 132124 - DNA, 20 bp, Artificial
  CRISPR gRNA sequence
ttccagcctcattacctgga

SEQ ID NO: 132125 - DNA, 20 bp, Artificial
  CRISPR gRNA sequence
ccagcctcattacctggatg

SEQ ID NO: 132126 - DNA, 20 bp, Artificial
  CRISPR gRNA sequence
cagcctcattacctggatga

SEQ ID NO: 132127 - DNA, 20 bp, Artificial
  CRISPR gRNA sequence
attacctggatgaaatccaa

SEQ ID NO: 132128 - DNA, 20 bp, Artificial
  CRISPR gRNA sequence
cctggatgaaatccaacact

SEQ ID NO: 132129 - DNA, 20 bp, Artificial
  CRISPR gRNA sequence
gatgaaatccaacactttgg

SEQ ID NO: 132130 - DNA, 20 bp, Artificial
  CRISPR gRNA sequence
tggcttttgtagtctcatat

SEQ ID NO: 132131 - DNA, 20 bp, Artificial
  CRISPR gRNA sequence
ggcttttgtagtctcatatc

SEQ ID NO: 132132 - DNA, 20 bp, Artificial
  CRISPR gRNA sequence
gcttttgtagtctcatatca

SEQ ID NO: 132133 - DNA, 20 bp, Artificial
  CRISPR gRNA sequence
ttgtagtctcatatcaggcc

SEQ ID NO: 132134 - DNA, 20 bp, Artificial
  CRISPR gRNA sequence
tgtagtctcatatcaggcct

SEQ ID NO: 132135 - DNA, 20 bp, Artificial
  CRISPR gRNA sequence
gtagtctcatatcaggcctt

SEQ ID NO: 132136 - DNA, 20 bp, Artificial
  CRISPR gRNA sequence
tagtctcatatcaggccttt

SEQ ID NO: 132137 - DNA, 20 bp, Artificial
  CRISPR gRNA sequence
atatcaggcctttcaagtgt

SEQ ID NO: 132138 - DNA, 20 bp, Artificial
  CRISPR gRNA sequence
tcaagtgtcacactggacat

SEQ ID NO: 132139 - DNA, 20 bp, Artificial
  CRISPR gRNA sequence
caagtgtcacactggacata

SEQ ID NO: 132140 - DNA, 20 bp, Artificial
  CRISPR gRNA sequence
aagtgtcacactggacatac

SEQ ID NO: 132141 - DNA, 20 bp, Artificial
  CRISPR gRNA sequence
gacatactggcaccactgta

SEQ ID NO: 132142 - DNA, 20 bp, Artificial
  CRISPR gRNA sequence
gcaccactgtaaactcacgg

SEQ ID NO: 132143 - DNA, 20 bp, Artificial
  CRISPR gRNA sequence
taaactcacggtcattagct

SEQ ID NO: 132144 - DNA, 20 bp, Artificial
  CRISPR gRNA sequence
acggtcattagcttcagcta

SEQ ID NO: 132145 - DNA, 20 bp, Artificial
  CRISPR gRNA sequence
gcttcagctaggcttacact

SEQ ID NO: 132146 - DNA, 20 bp, Artificial
  CRISPR gRNA sequence
cagctaggcttacactgtcc

SEQ ID NO: 132147 - DNA, 20 bp, Artificial
  CRISPR gRNA sequence
agctaggcttacactgtcca

SEQ ID NO: 132148 - DNA, 20 bp, Artificial
  CRISPR gRNA sequence
ggcttacactgtccagcact

SEQ ID NO: 132149 - DNA, 20 bp, Artificial
  CRISPR gRNA sequence
acactgtccagcactcccct

SEQ ID NO: 132150 - DNA, 20 bp, Artificial
  CRISPR gRNA sequence
cactgtccagcactcccctc

SEQ ID NO: 132151 - DNA, 20 bp, Artificial
  CRISPR gRNA sequence
tccagcactcccctcccttt

SEQ ID NO: 132152 - DNA, 20 bp, Artificial
  CRISPR gRNA sequence
ccctccctttcctttcccat

SEQ ID NO: 132153 - DNA, 20 bp, Artificial
  CRISPR gRNA sequence
cctttcctttcccattctct

SEQ ID NO: 132154 - DNA, 20 bp, Artificial
  CRISPR gRNA sequence
tcctttcccattctctgcgg

SEQ ID NO: 132155 - DNA, 20 bp, Artificial
  CRISPR gRNA sequence
cctttcccattctctgcggt

SEQ ID NO: 132156 - DNA, 20 bp, Artificial
  CRISPR gRNA sequence
ctttcccattctctgcggtg

SEQ ID NO: 132157 - DNA, 20 bp, Artificial
  CRISPR gRNA sequence
tcccattctctgcggtgaca

SEQ ID NO: 132158 - DNA, 20 bp, Artificial
  CRISPR gRNA sequence
cccattctctgcggtgacag

SEQ ID NO: 132159 - DNA, 20 bp, Artificial
  CRISPR gRNA sequence
ccattctctgcggtgacagc

SEQ ID NO: 132160 - DNA, 20 bp, Artificial
  CRISPR gRNA sequence
tctgcggtgacagctgtctg

SEQ ID NO: 132161 - DNA, 20 bp, Artificial
  CRISPR gRNA sequence
tgcggtgacagctgtctgtc

SEQ ID NO: 132162 - DNA, 20 bp, Artificial
  CRISPR gRNA sequence
cggtgacagctgtctgtctc

SEQ ID NO: 132163 - DNA, 20 bp, Artificial
  CRISPR gRNA sequence
tctgtctctccagctgcaag

SEQ ID NO: 132164 - DNA, 20 bp, Artificial
  CRISPR gRNA sequence
tctctccagctgcaagaatc

SEQ ID NO: 132165 - DNA, 20 bp, Artificial
  CRISPR gRNA sequence
tccagctgcaagaatcccag

SEQ ID NO: 132166 - DNA, 20 bp, Artificial
  CRISPR gRNA sequence
cagctgcaagaatcccagca

SEQ ID NO: 132167 - DNA, 20 bp, Artificial
  CRISPR gRNA sequence
caagaatcccagcattatcc

SEQ ID NO: 132168 - DNA, 20 bp, Artificial
  CRISPR gRNA sequence
tccttggtcttcctgtatct

SEQ ID NO: 132169 - DNA, 20 bp, Artificial
  CRISPR gRNA sequence
ggtcttcctgtatctctatc

SEQ ID NO: 132170 - DNA, 20 bp, Artificial
  CRISPR gRNA sequence
gtcttcctgtatctctatca

SEQ ID NO: 132171 - DNA, 20 bp, Artificial
  CRISPR gRNA sequence
cctgtatctctatcagtcag

SEQ ID NO: 132172 - DNA, 20 bp, Artificial
  CRISPR gRNA sequence
ctgtatctctatcagtcagt

SEQ ID NO: 132173 - DNA, 20 bp, Artificial
  CRISPR gRNA sequence
tatctctatcagtcagtcac

SEQ ID NO: 132174 - DNA, 20 bp, Artificial
  CRISPR gRNA sequence
tatcagtcagtcaccaagtc

SEQ ID NO: 132175 - DNA, 20 bp, Artificial
  CRISPR gRNA sequence
tcagtcagtcaccaagtcac

SEQ ID NO: 132176 - DNA, 20 bp, Artificial
  CRISPR gRNA sequence
ctaaaaagctgtctagttgt

SEQ ID NO: 132177 - DNA, 20 bp, Artificial
  CRISPR gRNA sequence
aaaagctgtctagttgttct

SEQ ID NO: 132178 - DNA, 20 bp, Artificial
  CRISPR gRNA sequence
tctagttgttctgcttctct

SEQ ID NO: 132179 - DNA, 20 bp, Artificial
  CRISPR gRNA sequence
gttgttctgcttctcttgat

SEQ ID NO: 132180 - DNA, 20 bp, Artificial
  CRISPR gRNA sequence
ttctgcttctcttgatctcc

SEQ ID NO: 132181 - DNA, 20 bp, Artificial
  CRISPR gRNA sequence
tgcttctcttgatctccagc

SEQ ID NO: 132182 - DNA, 20 bp, Artificial
  CRISPR gRNA sequence
cttctcttgatctccagcgc

SEQ ID NO: 132183 - DNA, 20 bp, Artificial
  CRISPR gRNA sequence
ctcttgatctccagcgctct

SEQ ID NO: 132184 - DNA, 20 bp, Artificial
  CRISPR gRNA sequence
tcttgatctccagcgctctc

SEQ ID NO: 132185 - DNA, 20 bp, Artificial
  CRISPR gRNA sequence
ttgatctccagcgctctcac

SEQ ID NO: 132186 - DNA, 20 bp, Artificial
  CRISPR gRNA sequence
gatctccagcgctctcaccc

SEQ ID NO: 132187 - DNA, 20 bp, Artificial
  CRISPR gRNA sequence
atctccagcgctctcaccca

SEQ ID NO: 132188 - DNA, 20 bp, Artificial
  CRISPR gRNA sequence
cagcgctctcacccagacct

SEQ ID NO: 132189 - DNA, 20 bp, Artificial
  CRISPR gRNA sequence
tcacccagacctgatgctaa

SEQ ID NO: 132190 - DNA, 20 bp, Artificial
  CRISPR gRNA sequence
acccagacctgatgctaaaa

SEQ ID NO: 132191 - DNA, 20 bp, Artificial
  CRISPR gRNA sequence
atgctaaaatgatcattatc

SEQ ID NO: 132192 - DNA, 20 bp, Artificial
  CRISPR gRNA sequence
aaatgatcattatcttgctt

SEQ ID NO: 132193 - DNA, 20 bp, Artificial
  CRISPR gRNA sequence
tcttgcttgaagtcatgccc

SEQ ID NO: 132194 - DNA, 20 bp, Artificial
  CRISPR gRNA sequence
gcttgaagtcatgccctgac

SEQ ID NO: 132195 - DNA, 20 bp, Artificial
  CRISPR gRNA sequence
cttgaagtcatgccctgact

SEQ ID NO: 132196 - DNA, 20 bp, Artificial
  CRISPR gRNA sequence
gaagtcatgccctgactgca

SEQ ID NO: 132197 - DNA, 20 bp, Artificial
  CRISPR gRNA sequence
aagtcatgccctgactgcag

SEQ ID NO: 132198 - DNA, 20 bp, Artificial
  CRISPR gRNA sequence
actgcagcattgcagtcctc

SEQ ID NO: 132199 - DNA, 20 bp, Artificial
  CRISPR gRNA sequence
cagcattgcagtcctcactg

SEQ ID NO: 132200 - DNA, 20 bp, Artificial
  CRISPR gRNA sequence
cagtcctcactggtcttctg

SEQ ID NO: 132201 - DNA, 20 bp, Artificial
  CRISPR gRNA sequence
actggtcttctgtgcctatt

SEQ ID NO: 132202 - DNA, 20 bp, Artificial
  CRISPR gRNA sequence
gtcttctgtgcctatttgtg

SEQ ID NO: 132203 - DNA, 20 bp, Artificial
  CRISPR gRNA sequence
ctgtgcctatttgtgctccc

SEQ ID NO: 132204 - DNA, 20 bp, Artificial
  CRISPR gRNA sequence
tgtgcctatttgtgctcccc

SEQ ID NO: 132205 - DNA, 20 bp, Artificial
  CRISPR gRNA sequence
tgcctatttgtgctcccctc

SEQ ID NO: 132206 - DNA, 20 bp, Artificial
  CRISPR gRNA sequence
tttgtgctcccctccaggtc

SEQ ID NO: 132207 - DNA, 20 bp, Artificial
  CRISPR gRNA sequence
gtgctcccctccaggtcggt

SEQ ID NO: 132208 - DNA, 20 bp, Artificial
  CRISPR gRNA sequence
tgctcccctccaggtcggtt

SEQ ID NO: 132209 - DNA, 20 bp, Artificial
  CRISPR gRNA sequence
ccctccaggtcggtttctgt

SEQ ID NO: 132210 - DNA, 20 bp, Artificial
  CRISPR gRNA sequence
caggtcggtttctgtactga

SEQ ID NO: 132211 - DNA, 20 bp, Artificial
  CRISPR gRNA sequence
ctgtactgaactgtagccag

SEQ ID NO: 132212 - DNA, 20 bp, Artificial
  CRISPR gRNA sequence
tgtactgaactgtagccaga

SEQ ID NO: 132213 - DNA, 20 bp, Artificial
  CRISPR gRNA sequence
tactgaactgtagccagagg

SEQ ID NO: 132214 - DNA, 20 bp, Artificial
  CRISPR gRNA sequence
aactgtagccagagggattt

SEQ ID NO: 132215 - DNA, 20 bp, Artificial
  CRISPR gRNA sequence
tagccagagggatttttttt

SEQ ID NO: 132216 - DNA, 20 bp, Artificial
  CRISPR gRNA sequence
ttttttttaatgtgatttgt

SEQ ID NO: 132217 - DNA, 20 bp, Artificial
  CRISPR gRNA sequence
tttttttaatgtgatttgtg

SEQ ID NO: 132218 - DNA, 20 bp, Artificial
  CRISPR gRNA sequence
ttttttaatgtgatttgtgc

SEQ ID NO: 132219 - DNA, 20 bp, Artificial
  CRISPR gRNA sequence
tttttaatgtgatttgtgct

SEQ ID NO: 132220 - DNA, 20 bp, Artificial
  CRISPR gRNA sequence
ttttaatgtgatttgtgctc

SEQ ID NO: 132221 - DNA, 20 bp, Artificial
  CRISPR gRNA sequence
tttaatgtgatttgtgctct

SEQ ID NO: 132222 - DNA, 20 bp, Artificial
  CRISPR gRNA sequence
ttaatgtgatttgtgctctt

SEQ ID NO: 132223 - DNA, 20 bp, Artificial
  CRISPR gRNA sequence
taatgtgatttgtgctcttc

SEQ ID NO: 132224 - DNA, 20 bp, Artificial
  CRISPR gRNA sequence
aatgtgatttgtgctcttct

SEQ ID NO: 132225 - DNA, 20 bp, Artificial
  CRISPR gRNA sequence
atgtgatttgtgctcttctg

SEQ ID NO: 132226 - DNA, 20 bp, Artificial
  CRISPR gRNA sequence
gtgctcttctgcttaaaact

SEQ ID NO: 132227 - DNA, 20 bp, Artificial
  CRISPR gRNA sequence
tgctcttctgcttaaaactc

SEQ ID NO: 132228 - DNA, 20 bp, Artificial
  CRISPR gRNA sequence
ttctgcttaaaactctttga

SEQ ID NO: 132229 - DNA, 20 bp, Artificial
  CRISPR gRNA sequence
ctgcttaaaactctttgatt

SEQ ID NO: 132230 - DNA, 20 bp, Artificial
  CRISPR gRNA sequence
tgcttaaaactctttgattt

SEQ ID NO: 132231 - DNA, 20 bp, Artificial
  CRISPR gRNA sequence
cttaaaactctttgatttcc

SEQ ID NO: 132232 - DNA, 20 bp, Artificial
  CRISPR gRNA sequence
aaaactctttgatttcctct

SEQ ID NO: 132233 - DNA, 20 bp, Artificial
  CRISPR gRNA sequence
aaactctttgatttcctctt

SEQ ID NO: 132234 - DNA, 20 bp, Artificial
  CRISPR gRNA sequence
tttgatttcctcttgtccac

SEQ ID NO: 132235 - DNA, 20 bp, Artificial
  CRISPR gRNA sequence
tgatttcctcttgtccaccg

SEQ ID NO: 132236 - DNA, 20 bp, Artificial
  CRISPR gRNA sequence
gatttcctcttgtccaccgg

SEQ ID NO: 132237 - DNA, 20 bp, Artificial
  CRISPR gRNA sequence
atttcctcttgtccaccgga

SEQ ID NO: 132238 - DNA, 20 bp, Artificial
  CRISPR gRNA sequence
cctcttgtccaccggacact

SEQ ID NO: 132239 - DNA, 20 bp, Artificial
  CRISPR gRNA sequence
ctcttgtccaccggacactg

SEQ ID NO: 132240 - DNA, 20 bp, Artificial
  CRISPR gRNA sequence
ttgtccaccggacactgctt

SEQ ID NO: 132241 - DNA, 20 bp, Artificial
  CRISPR gRNA sequence
gtccaccggacactgcttga

SEQ ID NO: 132242 - DNA, 20 bp, Artificial
  CRISPR gRNA sequence
tccaccggacactgcttgat

SEQ ID NO: 132243 - DNA, 20 bp, Artificial
  CRISPR gRNA sequence
cttgatctagcccctcctta

SEQ ID NO: 132244 - DNA, 20 bp, Artificial
  CRISPR gRNA sequence
gatctagcccctccttagcg

SEQ ID NO: 132245 - DNA, 20 bp, Artificial
  CRISPR gRNA sequence
atctagcccctccttagcgc

SEQ ID NO: 132246 - DNA, 20 bp, Artificial
  CRISPR gRNA sequence
gcccctccttagcgccttcc

SEQ ID NO: 132247 - DNA, 20 bp, Artificial
  CRISPR gRNA sequence
cttagcgccttccaatccac

SEQ ID NO: 132248 - DNA, 20 bp, Artificial
  CRISPR gRNA sequence
agcgccttccaatccaccag

SEQ ID NO: 132249 - DNA, 20 bp, Artificial
  CRISPR gRNA sequence
gcgccttccaatccaccagt

SEQ ID NO: 132250 - DNA, 20 bp, Artificial
  CRISPR gRNA sequence
ccaatccaccagtactgtat

SEQ ID NO: 132251 - DNA, 20 bp, Artificial
  CRISPR gRNA sequence
caatccaccagtactgtatt

SEQ ID NO: 132252 - DNA, 20 bp, Artificial
  CRISPR gRNA sequence
tatttcttggttttctctgc

SEQ ID NO: 132253 - DNA, 20 bp, Artificial
  CRISPR gRNA sequence
cttggttttctctgcctaga

SEQ ID NO: 132254 - DNA, 20 bp, Artificial
  CRISPR gRNA sequence
ttggttttctctgcctagaa

SEQ ID NO: 132255 - DNA, 20 bp, Artificial
  CRISPR gRNA sequence
ggttttctctgcctagaaca

SEQ ID NO: 132256 - DNA, 20 bp, Artificial
  CRISPR gRNA sequence
gttttctctgcctagaacat

SEQ ID NO: 132257 - DNA, 20 bp, Artificial
  CRISPR gRNA sequence
tctctgcctagaacattcgt

SEQ ID NO: 132258 - DNA, 20 bp, Artificial
  CRISPR gRNA sequence
ctctgcctagaacattcgtt

SEQ ID NO: 132259 - DNA, 20 bp, Artificial
  CRISPR gRNA sequence
tctgcctagaacattcgttt

SEQ ID NO: 132260 - DNA, 20 bp, Artificial
  CRISPR gRNA sequence
tgcctagaacattcgtttcc

SEQ ID NO: 132261 - DNA, 20 bp, Artificial
  CRISPR gRNA sequence
cctagaacattcgtttccca

SEQ ID NO: 132262 - DNA, 20 bp, Artificial
  CRISPR gRNA sequence
gaacattcgtttcccacctt

SEQ ID NO: 132263 - DNA, 20 bp, Artificial
  CRISPR gRNA sequence
gtttcccacctttctttttg

SEQ ID NO: 132264 - DNA, 20 bp, Artificial
  CRISPR gRNA sequence
cccacctttctttttgcctg

SEQ ID NO: 132265 - DNA, 20 bp, Artificial
  CRISPR gRNA sequence
ccacctttctttttgcctga

SEQ ID NO: 132266 - DNA, 20 bp, Artificial
  CRISPR gRNA sequence
tctttttgcctgactgattt

SEQ ID NO: 132267 - DNA, 20 bp, Artificial
  CRISPR gRNA sequence
ctttttgcctgactgatttc

SEQ ID NO: 132268 - DNA, 20 bp, Artificial
  CRISPR gRNA sequence
tttttgcctgactgatttct

SEQ ID NO: 132269 - DNA, 20 bp, Artificial
  CRISPR gRNA sequence
tttgcctgactgatttctgt

SEQ ID NO: 132270 - DNA, 20 bp, Artificial
  CRISPR gRNA sequence
ttgcctgactgatttctgtt

SEQ ID NO: 132271 - DNA, 20 bp, Artificial
  CRISPR gRNA sequence
tgcctgactgatttctgttt

SEQ ID NO: 132272 - DNA, 20 bp, Artificial
  CRISPR gRNA sequence
gcctgactgatttctgttta

SEQ ID NO: 132273 - DNA, 20 bp, Artificial
  CRISPR gRNA sequence
cctgactgatttctgtttat

SEQ ID NO: 132274 - DNA, 20 bp, Artificial
  CRISPR gRNA sequence
actgatttctgtttatctgt

SEQ ID NO: 132275 - DNA, 20 bp, Artificial
  CRISPR gRNA sequence
atttctgtttatctgtcagt

SEQ ID NO: 132276 - DNA, 20 bp, Artificial
  CRISPR gRNA sequence
ctgtttatctgtcagtctca

SEQ ID NO: 132277 - DNA, 20 bp, Artificial
  CRISPR gRNA sequence
tgtttatctgtcagtctcat

SEQ ID NO: 132278 - DNA, 20 bp, Artificial
  CRISPR gRNA sequence
tttatctgtcagtctcattt

SEQ ID NO: 132279 - DNA, 20 bp, Artificial
  CRISPR gRNA sequence
atctgtcagtctcattttca

SEQ ID NO: 132280 - DNA, 20 bp, Artificial
  CRISPR gRNA sequence
tctgtcagtctcattttcaa

SEQ ID NO: 132281 - DNA, 20 bp, Artificial
  CRISPR gRNA sequence
tcagtctcattttcaatgtc

SEQ ID NO: 132282 - DNA, 20 bp, Artificial
  CRISPR gRNA sequence
attttcaatgtcatttccta

SEQ ID NO: 132283 - DNA, 20 bp, Artificial
  CRISPR gRNA sequence
tcaatgtcatttcctaagat

SEQ ID NO: 132284 - DNA, 20 bp, Artificial
  CRISPR gRNA sequence
caatgtcatttcctaagata

SEQ ID NO: 132285 - DNA, 20 bp, Artificial
  CRISPR gRNA sequence
aatgtcatttcctaagatag

SEQ ID NO: 132286 - DNA, 20 bp, Artificial
  CRISPR gRNA sequence
cctaagatagcctttcttga

SEQ ID NO: 132287 - DNA, 20 bp, Artificial
  CRISPR gRNA sequence
ctaagatagcctttcttgac

SEQ ID NO: 132288 - DNA, 20 bp, Artificial
  CRISPR gRNA sequence
agatagcctttcttgacccc

SEQ ID NO: 132289 - DNA, 20 bp, Artificial
  CRISPR gRNA sequence
tcttgacccctcagactagt

SEQ ID NO: 132290 - DNA, 20 bp, Artificial
  CRISPR gRNA sequence
cttgacccctcagactagtg

SEQ ID NO: 132291 - DNA, 20 bp, Artificial
  CRISPR gRNA sequence
ttgacccctcagactagtga

SEQ ID NO: 132292 - DNA, 20 bp, Artificial
  CRISPR gRNA sequence
gacccctcagactagtgagg

SEQ ID NO: 132293 - DNA, 20 bp, Artificial
  CRISPR gRNA sequence
acccctcagactagtgaggt

SEQ ID NO: 132294 - DNA, 20 bp, Artificial
  CRISPR gRNA sequence
agactagtgaggtccctttt

SEQ ID NO: 132295 - DNA, 20 bp, Artificial
  CRISPR gRNA sequence
gtgaggtcccttttggagta

SEQ ID NO: 132296 - DNA, 20 bp, Artificial
  CRISPR gRNA sequence
ttggagtaaactcacatagc

SEQ ID NO: 132297 - DNA, 20 bp, Artificial
  CRISPR gRNA sequence
tggagtaaactcacatagca

SEQ ID NO: 132298 - DNA, 20 bp, Artificial
  CRISPR gRNA sequence
ggagtaaactcacatagcac

SEQ ID NO: 132299 - DNA, 20 bp, Artificial
  CRISPR gRNA sequence
gagtaaactcacatagcaca

SEQ ID NO: 132300 - DNA, 20 bp, Artificial
  CRISPR gRNA sequence
acatagcacataacaaaaca

SEQ ID NO: 132301 - DNA, 20 bp, Artificial
  CRISPR gRNA sequence
tgtttttcttcgtacttggc

SEQ ID NO: 132302 - DNA, 20 bp, Artificial
  CRISPR gRNA sequence
gtttttcttcgtacttggca

SEQ ID NO: 132303 - DNA, 20 bp, Artificial
  CRISPR gRNA sequence
tttttcttcgtacttggcac

SEQ ID NO: 132304 - DNA, 20 bp, Artificial
  CRISPR gRNA sequence
ttcttcgtacttggcactag

SEQ ID NO: 132305 - DNA, 20 bp, Artificial
  CRISPR gRNA sequence
tcttcgtacttggcactagc

SEQ ID NO: 132306 - DNA, 20 bp, Artificial
  CRISPR gRNA sequence
cttcgtacttggcactagca

SEQ ID NO: 132307 - DNA, 20 bp, Artificial
  CRISPR gRNA sequence
ttcgtacttggcactagcaa

SEQ ID NO: 132308 - DNA, 20 bp, Artificial
  CRISPR gRNA sequence
cgtacttggcactagcaatt

SEQ ID NO: 132309 - DNA, 20 bp, Artificial
  CRISPR gRNA sequence
gtacttggcactagcaatta

SEQ ID NO: 132310 - DNA, 20 bp, Artificial
  CRISPR gRNA sequence
ggcactagcaattacttaat

SEQ ID NO: 132311 - DNA, 20 bp, Artificial
  CRISPR gRNA sequence
gcactagcaattacttaatt

SEQ ID NO: 132312 - DNA, 20 bp, Artificial
  CRISPR gRNA sequence
gcaattacttaattatttgt

SEQ ID NO: 132313 - DNA, 20 bp, Artificial
  CRISPR gRNA sequence
cttaattatttgtaattatt

SEQ ID NO: 132314 - DNA, 20 bp, Artificial
  CRISPR gRNA sequence
aattatttgtaattatttta

SEQ ID NO: 132315 - DNA, 20 bp, Artificial
  CRISPR gRNA sequence
attatttgtaattattttaa

SEQ ID NO: 132316 - DNA, 20 bp, Artificial
  CRISPR gRNA sequence
tttgtaattattttaatagc

SEQ ID NO: 132317 - DNA, 20 bp, Artificial
  CRISPR gRNA sequence
gtaattattttaatagctat

SEQ ID NO: 132318 - DNA, 20 bp, Artificial
  CRISPR gRNA sequence
taattattttaatagctata

SEQ ID NO: 132319 - DNA, 20 bp, Artificial
  CRISPR gRNA sequence
ttttaatagctatatatacc

SEQ ID NO: 132320 - DNA, 20 bp, Artificial
  CRISPR gRNA sequence
taatagctatatataccact

SEQ ID NO: 132321 - DNA, 20 bp, Artificial
  CRISPR gRNA sequence
aatagctatatataccactt

SEQ ID NO: 132322 - DNA, 20 bp, Artificial
  CRISPR gRNA sequence
atagctatatataccactta

SEQ ID NO: 132323 - DNA, 20 bp, Artificial
  CRISPR gRNA sequence
tatataccacttactgagta

SEQ ID NO: 132324 - DNA, 20 bp, Artificial
  CRISPR gRNA sequence
actgagtatgcccattgtac

SEQ ID NO: 132325 - DNA, 20 bp, Artificial
  CRISPR gRNA sequence
ctgagtatgcccattgtact

SEQ ID NO: 132326 - DNA, 20 bp, Artificial
  CRISPR gRNA sequence
agtatgcccattgtactatg

SEQ ID NO: 132327 - DNA, 20 bp, Artificial
  CRISPR gRNA sequence
tactatgctgtctttacatg

SEQ ID NO: 132328 - DNA, 20 bp, Artificial
  CRISPR gRNA sequence
tgctgtctttacatggatta

SEQ ID NO: 132329 - DNA, 20 bp, Artificial
  CRISPR gRNA sequence
tctttacatggattagctcc

SEQ ID NO: 132330 - DNA, 20 bp, Artificial
  CRISPR gRNA sequence
tacatggattagctcctaac

SEQ ID NO: 132331 - DNA, 20 bp, Artificial
  CRISPR gRNA sequence
acatggattagctcctaacc

SEQ ID NO: 132332 - DNA, 20 bp, Artificial
  CRISPR gRNA sequence
catggattagctcctaacct

SEQ ID NO: 132333 - DNA, 20 bp, Artificial
  CRISPR gRNA sequence
gctcctaacctgtacaggag

SEQ ID NO: 132334 - DNA, 20 bp, Artificial
  CRISPR gRNA sequence
ctaacctgtacaggagcctg

SEQ ID NO: 132335 - DNA, 20 bp, Artificial
  CRISPR gRNA sequence
acctgtacaggagcctggga

SEQ ID NO: 132336 - DNA, 20 bp, Artificial
  CRISPR gRNA sequence
tacaggagcctgggaggtta

SEQ ID NO: 132337 - DNA, 20 bp, Artificial
  CRISPR gRNA sequence
ggaggttaagtcttgttctc

SEQ ID NO: 132338 - DNA, 20 bp, Artificial
  CRISPR gRNA sequence
agtcttgttctcatccagtt

SEQ ID NO: 132339 - DNA, 20 bp, Artificial
  CRISPR gRNA sequence
gttctcatccagtttgttca

SEQ ID NO: 132340 - DNA, 20 bp, Artificial
  CRISPR gRNA sequence
ttctcatccagtttgttcac

SEQ ID NO: 132341 - DNA, 20 bp, Artificial
  CRISPR gRNA sequence
tcatccagtttgttcacggt

SEQ ID NO: 132342 - DNA, 20 bp, Artificial
  CRISPR gRNA sequence
atccagtttgttcacggtct

SEQ ID NO: 132343 - DNA, 20 bp, Artificial
  CRISPR gRNA sequence
gttcacggtctcatggtaag

SEQ ID NO: 132344 - DNA, 20 bp, Artificial
  CRISPR gRNA sequence
ttcacggtctcatggtaagt

SEQ ID NO: 132345 - DNA, 20 bp, Artificial
  CRISPR gRNA sequence
acggtctcatggtaagtggc

SEQ ID NO: 132346 - DNA, 20 bp, Artificial
  CRISPR gRNA sequence
atggtaagtggcagggaatt

SEQ ID NO: 132347 - DNA, 20 bp, Artificial
  CRISPR gRNA sequence
aaactaggtgattcgattcc

SEQ ID NO: 132348 - DNA, 20 bp, Artificial
  CRISPR gRNA sequence
ggtgattcgattccagagcc

SEQ ID NO: 132349 - DNA, 20 bp, Artificial
  CRISPR gRNA sequence
gattccagagcctgtgtcct

SEQ ID NO: 132350 - DNA, 20 bp, Artificial
  CRISPR gRNA sequence
cagagcctgtgtcctggaag

SEQ ID NO: 132351 - DNA, 20 bp, Artificial
  CRISPR gRNA sequence
tgtcctggaaggactaatag

SEQ ID NO: 132352 - DNA, 20 bp, Artificial
  CRISPR gRNA sequence
gaaggactaataggctctgt

SEQ ID NO: 132353 - DNA, 20 bp, Artificial
  CRISPR gRNA sequence
ataggctctgttctctaccc

SEQ ID NO: 132354 - DNA, 20 bp, Artificial
  CRISPR gRNA sequence
tgttctctaccccttcaccc

SEQ ID NO: 132355 - DNA, 20 bp, Artificial
  CRISPR gRNA sequence
ttctctaccccttcaccctg

SEQ ID NO: 132356 - DNA, 20 bp, Artificial
  CRISPR gRNA sequence
tctaccccttcaccctgcct

SEQ ID NO: 132357 - DNA, 20 bp, Artificial
  CRISPR gRNA sequence
taccccttcaccctgcctcc

SEQ ID NO: 132358 - DNA, 20 bp, Artificial
  CRISPR gRNA sequence
ccccttcaccctgcctccca

SEQ ID NO: 132359 - DNA, 20 bp, Artificial
  CRISPR gRNA sequence
caccctgcctcccaggttat

SEQ ID NO: 132360 - DNA, 20 bp, Artificial
  CRISPR gRNA sequence
accctgcctcccaggttatg

SEQ ID NO: 132361 - DNA, 20 bp, Artificial
  CRISPR gRNA sequence
cctcccaggttatgtaacat

SEQ ID NO: 132362 - DNA, 20 bp, Artificial
  CRISPR gRNA sequence
ccaggttatgtaacatttgt

SEQ ID NO: 132363 - DNA, 20 bp, Artificial
  CRISPR gRNA sequence
tgtaacatttgtcctgcaag

SEQ ID NO: 132364 - DNA, 20 bp, Artificial
  CRISPR gRNA sequence
gtcctgcaagctgaggacag

SEQ ID NO: 132365 - DNA, 20 bp, Artificial
  CRISPR gRNA sequence
tcctgcaagctgaggacaga

SEQ ID NO: 132366 - DNA, 20 bp, Artificial
  CRISPR gRNA sequence
caagctgaggacagagacct

SEQ ID NO: 132367 - DNA, 20 bp, Artificial
  CRISPR gRNA sequence
aggacagagaccttgtctgt

SEQ ID NO: 132368 - DNA, 20 bp, Artificial
  CRISPR gRNA sequence
gtctgttgttgacagctacg

SEQ ID NO: 132369 - DNA, 20 bp, Artificial
  CRISPR gRNA sequence
tctgttgttgacagctacgt

SEQ ID NO: 132370 - DNA, 20 bp, Artificial
  CRISPR gRNA sequence
ttgttgacagctacgtgacc

SEQ ID NO: 132371 - DNA, 20 bp, Artificial
  CRISPR gRNA sequence
ttgacagctacgtgaccagc

SEQ ID NO: 132372 - DNA, 20 bp, Artificial
  CRISPR gRNA sequence
acagctacgtgaccagcaca

SEQ ID NO: 132373 - DNA, 20 bp, Artificial
  CRISPR gRNA sequence
cgtgaccagcacatagcatg

SEQ ID NO: 132374 - DNA, 20 bp, Artificial
  CRISPR gRNA sequence
gtaaatactaagcgctcact

SEQ ID NO: 132375 - DNA, 20 bp, Artificial
  CRISPR gRNA sequence
agcgctcactcagtaaatat

SEQ ID NO: 132376 - DNA, 20 bp, Artificial
  CRISPR gRNA sequence
actcagtaaatatttgttgg

SEQ ID NO: 132377 - DNA, 20 bp, Artificial
  CRISPR gRNA sequence
agtaaatatttgttggctgg

SEQ ID NO: 132378 - DNA, 20 bp, Artificial
  CRISPR gRNA sequence
gttggctggcttactgacaa

SEQ ID NO: 132379 - DNA, 20 bp, Artificial
  CRISPR gRNA sequence
ttggctggcttactgacaat

SEQ ID NO: 132380 - DNA, 20 bp, Artificial
  CRISPR gRNA sequence
gctggcttactgacaatcta

SEQ ID NO: 132381 - DNA, 20 bp, Artificial
  CRISPR gRNA sequence
gcttactgacaatctacagt

SEQ ID NO: 132382 - DNA, 20 bp, Artificial
  CRISPR gRNA sequence
actgacaatctacagtctgt

SEQ ID NO: 132383 - DNA, 20 bp, Artificial
  CRISPR gRNA sequence
ctgacaatctacagtctgtt

SEQ ID NO: 132384 - DNA, 20 bp, Artificial
  CRISPR gRNA sequence
acaatctacagtctgtttta

SEQ ID NO: 132385 - DNA, 20 bp, Artificial
  CRISPR gRNA sequence
cagtctgttttataagtttt

SEQ ID NO: 132386 - DNA, 20 bp, Artificial
  CRISPR gRNA sequence
ttttataagtttttatagga

SEQ ID NO: 132387 - DNA, 20 bp, Artificial
  CRISPR gRNA sequence
tataagtttttataggatgt

SEQ ID NO: 132388 - DNA, 20 bp, Artificial
  CRISPR gRNA sequence
ataagtttttataggatgtt

SEQ ID NO: 132389 - DNA, 20 bp, Artificial
  CRISPR gRNA sequence
taagtttttataggatgttt

SEQ ID NO: 132390 - DNA, 20 bp, Artificial
  CRISPR gRNA sequence
ttataggatgttttagacct

SEQ ID NO: 132391 - DNA, 20 bp, Artificial
  CRISPR gRNA sequence
tataggatgttttagaccta

SEQ ID NO: 132392 - DNA, 20 bp, Artificial
  CRISPR gRNA sequence
ataggatgttttagacctag

SEQ ID NO: 132393 - DNA, 20 bp, Artificial
  CRISPR gRNA sequence
taggatgttttagacctaga

SEQ ID NO: 132394 - DNA, 20 bp, Artificial
  CRISPR gRNA sequence
tagacctagaaaaaaccttt

SEQ ID NO: 132395 - DNA, 20 bp, Artificial
  CRISPR gRNA sequence
agacctagaaaaaacctttg

SEQ ID NO: 132396 - DNA, 20 bp, Artificial
  CRISPR gRNA sequence
gacctagaaaaaacctttgg

SEQ ID NO: 132397 - DNA, 20 bp, Artificial
  CRISPR gRNA sequence
gaaaaaacctttgggatgca

SEQ ID NO: 132398 - DNA, 20 bp, Artificial
  CRISPR gRNA sequence
tgggatgcatctagcaagtt

SEQ ID NO: 132399 - DNA, 20 bp, Artificial
  CRISPR gRNA sequence
gggatgcatctagcaagttt

SEQ ID NO: 132400 - DNA, 20 bp, Artificial
  CRISPR gRNA sequence
ggatgcatctagcaagtttt

SEQ ID NO: 132401 - DNA, 20 bp, Artificial
  CRISPR gRNA sequence
gcaagtttttttccatcatt

SEQ ID NO: 132402 - DNA, 20 bp, Artificial
  CRISPR gRNA sequence
ttttccatcattcttatata

SEQ ID NO: 132403 - DNA, 20 bp, Artificial
  CRISPR gRNA sequence
tttccatcattcttatatat

SEQ ID NO: 132404 - DNA, 20 bp, Artificial
  CRISPR gRNA sequence
ttccatcattcttatatata

SEQ ID NO: 132405 - DNA, 20 bp, Artificial
  CRISPR gRNA sequence
tccatcattcttatatatag

SEQ ID NO: 132406 - DNA, 20 bp, Artificial
  CRISPR gRNA sequence
ccatcattcttatatatagg

SEQ ID NO: 132407 - DNA, 20 bp, Artificial
  CRISPR gRNA sequence
catcattcttatatataggc

SEQ ID NO: 132408 - DNA, 20 bp, Artificial
  CRISPR gRNA sequence
ttatatataggcgaatggct

SEQ ID NO: 132409 - DNA, 20 bp, Artificial
  CRISPR gRNA sequence
atatataggcgaatggctgg

SEQ ID NO: 132410 - DNA, 20 bp, Artificial
  CRISPR gRNA sequence
tatataggcgaatggctggc

SEQ ID NO: 132411 - DNA, 20 bp, Artificial
  CRISPR gRNA sequence
gcatattctaagcatcaaag

SEQ ID NO: 132412 - DNA, 20 bp, Artificial
  CRISPR gRNA sequence
taagcatcaaagattaggtt

SEQ ID NO: 132413 - DNA, 20 bp, Artificial
  CRISPR gRNA sequence
agcatcaaagattaggttga

SEQ ID NO: 132414 - DNA, 20 bp, Artificial
  CRISPR gRNA sequence
ggttgacttattgagtgaaa

SEQ ID NO: 132415 - DNA, 20 bp, Artificial
  CRISPR gRNA sequence
acttattgagtgaaaggtac

SEQ ID NO: 132416 - DNA, 20 bp, Artificial
  CRISPR gRNA sequence
attgagtgaaaggtactaag

SEQ ID NO: 132417 - DNA, 20 bp, Artificial
  CRISPR gRNA sequence
ttgagtgaaaggtactaagt

SEQ ID NO: 132418 - DNA, 20 bp, Artificial
  CRISPR gRNA sequence
agtgaaaggtactaagtgcc

SEQ ID NO: 132419 - DNA, 20 bp, Artificial
  CRISPR gRNA sequence
agtgccatagagctttaaag

SEQ ID NO: 132420 - DNA, 20 bp, Artificial
  CRISPR gRNA sequence
taaagaacagaacatttgtt

SEQ ID NO: 132421 - DNA, 20 bp, Artificial
  CRISPR gRNA sequence
aaagaacagaacatttgttt

SEQ ID NO: 132422 - DNA, 20 bp, Artificial
  CRISPR gRNA sequence
aagaacagaacatttgtttt

SEQ ID NO: 132423 - DNA, 20 bp, Artificial
  CRISPR gRNA sequence
gtttttgaattgcagaaagg

SEQ ID NO: 132424 - DNA, 20 bp, Artificial
  CRISPR gRNA sequence
tttttgaattgcagaaagga

SEQ ID NO: 132425 - DNA, 20 bp, Artificial
  CRISPR gRNA sequence
ttgaattgcagaaaggataa

SEQ ID NO: 132426 - DNA, 20 bp, Artificial
  CRISPR gRNA sequence
tgaattgcagaaaggataaa

SEQ ID NO: 132427 - DNA, 20 bp, Artificial
  CRISPR gRNA sequence
gaattgcagaaaggataaat

SEQ ID NO: 132428 - DNA, 20 bp, Artificial
  CRISPR gRNA sequence
aattgcagaaaggataaatc

SEQ ID NO: 132429 - DNA, 20 bp, Artificial
  CRISPR gRNA sequence
cagaaaggataaatcagaaa

SEQ ID NO: 132430 - DNA, 20 bp, Artificial
  CRISPR gRNA sequence
aaggaggatagagaacactg

SEQ ID NO: 132431 - DNA, 20 bp, Artificial
  CRISPR gRNA sequence
ggattaaagtctggggcagg

SEQ ID NO: 132432 - DNA, 20 bp, Artificial
  CRISPR gRNA sequence
aagtctggggcaggatttta

SEQ ID NO: 132433 - DNA, 20 bp, Artificial
  CRISPR gRNA sequence
gggcaggattttaatggtag

SEQ ID NO: 132434 - DNA, 20 bp, Artificial
  CRISPR gRNA sequence
taatggtagaaagacagagg

SEQ ID NO: 132435 - DNA, 20 bp, Artificial
  CRISPR gRNA sequence
aatggtagaaagacagagga

SEQ ID NO: 132436 - DNA, 20 bp, Artificial
  CRISPR gRNA sequence
atggtagaaagacagaggaa

SEQ ID NO: 132437 - DNA, 20 bp, Artificial
  CRISPR gRNA sequence
aaacttgcagaactgaagac

SEQ ID NO: 132438 - DNA, 20 bp, Artificial
  CRISPR gRNA sequence
gcagaactgaagacacatac

SEQ ID NO: 132439 - DNA, 20 bp, Artificial
  CRISPR gRNA sequence
cagaactgaagacacataca

SEQ ID NO: 132440 - DNA, 20 bp, Artificial
  CRISPR gRNA sequence
aagacacatacagttaagca

SEQ ID NO: 132441 - DNA, 20 bp, Artificial
  CRISPR gRNA sequence
agcagatgatgtgcggcttc

SEQ ID NO: 132442 - DNA, 20 bp, Artificial
  CRISPR gRNA sequence
ctcttcaaaggagggaggat

SEQ ID NO: 132443 - DNA, 20 bp, Artificial
  CRISPR gRNA sequence
tcttcaaaggagggaggatg

SEQ ID NO: 132444 - DNA, 20 bp, Artificial
  CRISPR gRNA sequence
ttcaaaggagggaggatgag

SEQ ID NO: 132445 - DNA, 20 bp, Artificial
  CRISPR gRNA sequence
caaaggagggaggatgagat

SEQ ID NO: 132446 - DNA, 20 bp, Artificial
  CRISPR gRNA sequence
aaaggagggaggatgagatc

SEQ ID NO: 132447 - DNA, 20 bp, Artificial
  CRISPR gRNA sequence
tggggtacactacgtgccaa

SEQ ID NO: 132448 - DNA, 20 bp, Artificial
  CRISPR gRNA sequence
cgtgccaaacactgtcttta

SEQ ID NO: 132449 - DNA, 20 bp, Artificial
  CRISPR gRNA sequence
tctttagcagctttctagtc

SEQ ID NO: 132450 - DNA, 20 bp, Artificial
  CRISPR gRNA sequence
tagcagctttctagtcttta

SEQ ID NO: 132451 - DNA, 20 bp, Artificial
  CRISPR gRNA sequence
agcagctttctagtctttat

SEQ ID NO: 132452 - DNA, 20 bp, Artificial
  CRISPR gRNA sequence
gcagctttctagtctttatt

SEQ ID NO: 132453 - DNA, 20 bp, Artificial
  CRISPR gRNA sequence
tctagtctttatttaattct

SEQ ID NO: 132454 - DNA, 20 bp, Artificial
  CRISPR gRNA sequence
ctagtctttatttaattctg

SEQ ID NO: 132455 - DNA, 20 bp, Artificial
  CRISPR gRNA sequence
tagtctttatttaattctga

SEQ ID NO: 132456 - DNA, 20 bp, Artificial
  CRISPR gRNA sequence
gtctttatttaattctgaca

SEQ ID NO: 132457 - DNA, 20 bp, Artificial
  CRISPR gRNA sequence
tatttaattctgacaactct

SEQ ID NO: 132458 - DNA, 20 bp, Artificial
  CRISPR gRNA sequence
atttaattctgacaactcta

SEQ ID NO: 132459 - DNA, 20 bp, Artificial
  CRISPR gRNA sequence
tttaattctgacaactctag

SEQ ID NO: 132460 - DNA, 20 bp, Artificial
  CRISPR gRNA sequence
aattctgacaactctaggaa

SEQ ID NO: 132461 - DNA, 20 bp, Artificial
  CRISPR gRNA sequence
attctgacaactctaggaaa

SEQ ID NO: 132462 - DNA, 20 bp, Artificial
  CRISPR gRNA sequence
tgacaactctaggaaatact

SEQ ID NO: 132463 - DNA, 20 bp, Artificial
  CRISPR gRNA sequence
acaactctaggaaatacttt

SEQ ID NO: 132464 - DNA, 20 bp, Artificial
  CRISPR gRNA sequence
taggaaatacttttatcttc

SEQ ID NO: 132465 - DNA, 20 bp, Artificial
  CRISPR gRNA sequence
ggaaatacttttatcttcac

SEQ ID NO: 132466 - DNA, 20 bp, Artificial
  CRISPR gRNA sequence
ttatcttcacttttagaaga

SEQ ID NO: 132467 - DNA, 20 bp, Artificial
  CRISPR gRNA sequence
tatcttcacttttagaagac

SEQ ID NO: 132468 - DNA, 20 bp, Artificial
  CRISPR gRNA sequence
atcttcacttttagaagact

SEQ ID NO: 132469 - DNA, 20 bp, Artificial
  CRISPR gRNA sequence
tcttcacttttagaagactg

SEQ ID NO: 132470 - DNA, 20 bp, Artificial
  CRISPR gRNA sequence
cacttttagaagactgaggt

SEQ ID NO: 132471 - DNA, 20 bp, Artificial
  CRISPR gRNA sequence
acttttagaagactgaggtt

SEQ ID NO: 132472 - DNA, 20 bp, Artificial
  CRISPR gRNA sequence
ttagaagactgaggtttagc

SEQ ID NO: 132473 - DNA, 20 bp, Artificial
  CRISPR gRNA sequence
tagaagactgaggtttagcg

SEQ ID NO: 132474 - DNA, 20 bp, Artificial
  CRISPR gRNA sequence
agaagactgaggtttagcga

SEQ ID NO: 132475 - DNA, 20 bp, Artificial
  CRISPR gRNA sequence
gaagactgaggtttagcgag

SEQ ID NO: 132476 - DNA, 20 bp, Artificial
  CRISPR gRNA sequence
aggtttagcgaggctaatgc

SEQ ID NO: 132477 - DNA, 20 bp, Artificial
  CRISPR gRNA sequence
agcgaggctaatgctgttag

SEQ ID NO: 132478 - DNA, 20 bp, Artificial
  CRISPR gRNA sequence
gcgaggctaatgctgttagt

SEQ ID NO: 132479 - DNA, 20 bp, Artificial
  CRISPR gRNA sequence
atgctgttagtccaaatgat

SEQ ID NO: 132480 - DNA, 20 bp, Artificial
  CRISPR gRNA sequence
ttagtccaaatgataatcat

SEQ ID NO: 132481 - DNA, 20 bp, Artificial
  CRISPR gRNA sequence
gtccaaatgataatcatgtt

SEQ ID NO: 132482 - DNA, 20 bp, Artificial
  CRISPR gRNA sequence
ctaattccagtgcatgacaa

SEQ ID NO: 132483 - DNA, 20 bp, Artificial
  CRISPR gRNA sequence
attccagtgcatgacaagat

SEQ ID NO: 132484 - DNA, 20 bp, Artificial
  CRISPR gRNA sequence
cagtgcatgacaagataata

SEQ ID NO: 132485 - DNA, 20 bp, Artificial
  CRISPR gRNA sequence
aaacttttttcctttaatac

SEQ ID NO: 132486 - DNA, 20 bp, Artificial
  CRISPR gRNA sequence
aacttttttcctttaatact

SEQ ID NO: 132487 - DNA, 20 bp, Artificial
  CRISPR gRNA sequence
ttttcctttaatacttttgt

SEQ ID NO: 132488 - DNA, 20 bp, Artificial
  CRISPR gRNA sequence
tttcctttaatacttttgtt

SEQ ID NO: 132489 - DNA, 20 bp, Artificial
  CRISPR gRNA sequence
ttcctttaatacttttgttt

SEQ ID NO: 132490 - DNA, 20 bp, Artificial
  CRISPR gRNA sequence
tcctttaatacttttgtttg

SEQ ID NO: 132491 - DNA, 20 bp, Artificial
  CRISPR gRNA sequence
cctttaatacttttgtttgt

SEQ ID NO: 132492 - DNA, 20 bp, Artificial
  CRISPR gRNA sequence
ctttaatacttttgtttgtg

SEQ ID NO: 132493 - DNA, 20 bp, Artificial
  CRISPR gRNA sequence
taatacttttgtttgtgtta

SEQ ID NO: 132494 - DNA, 20 bp, Artificial
  CRISPR gRNA sequence
aatacttttgtttgtgttat

SEQ ID NO: 132495 - DNA, 20 bp, Artificial
  CRISPR gRNA sequence
atacttttgtttgtgttata

SEQ ID NO: 132496 - DNA, 20 bp, Artificial
  CRISPR gRNA sequence
ttgtttgtgttatatttcta

SEQ ID NO: 132497 - DNA, 20 bp, Artificial
  CRISPR gRNA sequence
tgtttgtgttatatttctaa

SEQ ID NO: 132498 - DNA, 20 bp, Artificial
  CRISPR gRNA sequence
gtttgtgttatatttctaaa

SEQ ID NO: 132499 - DNA, 20 bp, Artificial
  CRISPR gRNA sequence
tttgtgttatatttctaaat

SEQ ID NO: 132500 - DNA, 20 bp, Artificial
  CRISPR gRNA sequence
gtgttatatttctaaattaa

SEQ ID NO: 132501 - DNA, 20 bp, Artificial
  CRISPR gRNA sequence
tgttatatttctaaattaat

SEQ ID NO: 132502 - DNA, 20 bp, Artificial
  CRISPR gRNA sequence
tatttctaaattaattcatc

SEQ ID NO: 132503 - DNA, 20 bp, Artificial
  CRISPR gRNA sequence
ctaaattaattcatctccca

SEQ ID NO: 132504 - DNA, 20 bp, Artificial
  CRISPR gRNA sequence
taaattaattcatctcccag

SEQ ID NO: 132505 - DNA, 20 bp, Artificial
  CRISPR gRNA sequence
aattaattcatctcccagat

SEQ ID NO: 132506 - DNA, 20 bp, Artificial
  CRISPR gRNA sequence
attcatctcccagatccgcc

SEQ ID NO: 132507 - DNA, 20 bp, Artificial
  CRISPR gRNA sequence
atctcccagatccgcctggt

SEQ ID NO: 132508 - DNA, 20 bp, Artificial
  CRISPR gRNA sequence
ccagatccgcctggttattt

SEQ ID NO: 132509 - DNA, 20 bp, Artificial
  CRISPR gRNA sequence
gttatttgaacagtgtcttg

SEQ ID NO: 132510 - DNA, 20 bp, Artificial
  CRISPR gRNA sequence
tttgaacagtgtcttgctca

SEQ ID NO: 132511 - DNA, 20 bp, Artificial
  CRISPR gRNA sequence
gaacagtgtcttgctcatag

SEQ ID NO: 132512 - DNA, 20 bp, Artificial
  CRISPR gRNA sequence
aacagtgtcttgctcatagc

SEQ ID NO: 132513 - DNA, 20 bp, Artificial
  CRISPR gRNA sequence
gctcatagccaattttaaaa

SEQ ID NO: 132514 - DNA, 20 bp, Artificial
  CRISPR gRNA sequence
ctcatagccaattttaaaag

SEQ ID NO: 132515 - DNA, 20 bp, Artificial
  CRISPR gRNA sequence
atagccaattttaaaagact

SEQ ID NO: 132516 - DNA, 20 bp, Artificial
  CRISPR gRNA sequence
taaaagacttaatggtatca

SEQ ID NO: 132517 - DNA, 20 bp, Artificial
  CRISPR gRNA sequence
aaaagacttaatggtatcat

SEQ ID NO: 132518 - DNA, 20 bp, Artificial
  CRISPR gRNA sequence
aaagacttaatggtatcatg

SEQ ID NO: 132519 - DNA, 20 bp, Artificial
  CRISPR gRNA sequence
aatggtatcatgtaaacact

SEQ ID NO: 132520 - DNA, 20 bp, Artificial
  CRISPR gRNA sequence
atggtatcatgtaaacactc

SEQ ID NO: 132521 - DNA, 20 bp, Artificial
  CRISPR gRNA sequence
attcaggaaagaatttctgt

SEQ ID NO: 132522 - DNA, 20 bp, Artificial
  CRISPR gRNA sequence
aggaaagaatttctgttatt

SEQ ID NO: 132523 - DNA, 20 bp, Artificial
  CRISPR gRNA sequence
ctgttattcttcccaaccca

SEQ ID NO: 132524 - DNA, 20 bp, Artificial
  CRISPR gRNA sequence
tgttattcttcccaacccac

SEQ ID NO: 132525 - DNA, 20 bp, Artificial
  CRISPR gRNA sequence
ttattcttcccaacccaccg

SEQ ID NO: 132526 - DNA, 20 bp, Artificial
  CRISPR gRNA sequence
ttcttcccaacccaccgcct

SEQ ID NO: 132527 - DNA, 20 bp, Artificial
  CRISPR gRNA sequence
ttcccaacccaccgcctgcc

SEQ ID NO: 132528 - DNA, 20 bp, Artificial
  CRISPR gRNA sequence
cccaacccaccgcctgccct

SEQ ID NO: 132529 - DNA, 20 bp, Artificial
  CRISPR gRNA sequence
ccaacccaccgcctgccctc

SEQ ID NO: 132530 - DNA, 20 bp, Artificial
  CRISPR gRNA sequence
ccctccccacccccaaccaa

SEQ ID NO: 132531 - DNA, 20 bp, Artificial
  CRISPR gRNA sequence
cccacccccaaccaaagttt

SEQ ID NO: 132532 - DNA, 20 bp, Artificial
  CRISPR gRNA sequence
gtttccaattgtaggctctg

SEQ ID NO: 132533 - DNA, 20 bp, Artificial
  CRISPR gRNA sequence
tttccaattgtaggctctga

SEQ ID NO: 132534 - DNA, 20 bp, Artificial
  CRISPR gRNA sequence
ccaattgtaggctctgaaac

SEQ ID NO: 132535 - DNA, 20 bp, Artificial
  CRISPR gRNA sequence
caattgtaggctctgaaaca

SEQ ID NO: 132536 - DNA, 20 bp, Artificial
  CRISPR gRNA sequence
taggctctgaaacaaccact

SEQ ID NO: 132537 - DNA, 20 bp, Artificial
  CRISPR gRNA sequence
tgaaacaaccactttggtcc

SEQ ID NO: 132538 - DNA, 20 bp, Artificial
  CRISPR gRNA sequence
aaacaaccactttggtcctg

SEQ ID NO: 132539 - DNA, 20 bp, Artificial
  CRISPR gRNA sequence
tggtcctgtctcctgcacct

SEQ ID NO: 132540 - DNA, 20 bp, Artificial
  CRISPR gRNA sequence
ggtcctgtctcctgcacctt

SEQ ID NO: 132541 - DNA, 20 bp, Artificial
  CRISPR gRNA sequence
gtcctgtctcctgcaccttg

SEQ ID NO: 132542 - DNA, 20 bp, Artificial
  CRISPR gRNA sequence
tctcctgcaccttgatcttc

SEQ ID NO: 132543 - DNA, 20 bp, Artificial
  CRISPR gRNA sequence
ctgcaccttgatcttcctta

SEQ ID NO: 132544 - DNA, 20 bp, Artificial
  CRISPR gRNA sequence
caccttgatcttccttaggt

SEQ ID NO: 132545 - DNA, 20 bp, Artificial
  CRISPR gRNA sequence
gatcttccttaggttattgt

SEQ ID NO: 132546 - DNA, 20 bp, Artificial
  CRISPR gRNA sequence
atcttccttaggttattgta

SEQ ID NO: 132547 - DNA, 20 bp, Artificial
  CRISPR gRNA sequence
ccttaggttattgtaaaagc

SEQ ID NO: 132548 - DNA, 20 bp, Artificial
  CRISPR gRNA sequence
cttaggttattgtaaaagct

SEQ ID NO: 132549 - DNA, 20 bp, Artificial
  CRISPR gRNA sequence
aggttattgtaaaagctagt

SEQ ID NO: 132550 - DNA, 20 bp, Artificial
  CRISPR gRNA sequence
ggttattgtaaaagctagtc

SEQ ID NO: 132551 - DNA, 20 bp, Artificial
  CRISPR gRNA sequence
ttgtaaaagctagtcaactc

SEQ ID NO: 132552 - DNA, 20 bp, Artificial
  CRISPR gRNA sequence
taaaagctagtcaactcaca

SEQ ID NO: 132553 - DNA, 20 bp, Artificial
  CRISPR gRNA sequence
gtcaactcacaggtatcata

SEQ ID NO: 132554 - DNA, 20 bp, Artificial
  CRISPR gRNA sequence
acaggtatcataattgatca

SEQ ID NO: 132555 - DNA, 20 bp, Artificial
  CRISPR gRNA sequence
atcattcttttatggctgta

SEQ ID NO: 132556 - DNA, 20 bp, Artificial
  CRISPR gRNA sequence
ttttatggctgtaaaaaaaa

SEQ ID NO: 132557 - DNA, 20 bp, Artificial
  CRISPR gRNA sequence
ttatggctgtaaaaaaaaat

SEQ ID NO: 132558 - DNA, 20 bp, Artificial
  CRISPR gRNA sequence
tatggctgtaaaaaaaaatc

SEQ ID NO: 132559 - DNA, 20 bp, Artificial
  CRISPR gRNA sequence
atggctgtaaaaaaaaatcc

SEQ ID NO: 132560 - DNA, 20 bp, Artificial
  CRISPR gRNA sequence
tggctgtaaaaaaaaatcca

SEQ ID NO: 132561 - DNA, 20 bp, Artificial
  CRISPR gRNA sequence
taaaaaaaaatccatcatgt

SEQ ID NO: 132562 - DNA, 20 bp, Artificial
  CRISPR gRNA sequence
ttaaaggatactctcctagt

SEQ ID NO: 132563 - DNA, 20 bp, Artificial
  CRISPR gRNA sequence
aaggatactctcctagtatg

SEQ ID NO: 132564 - DNA, 20 bp, Artificial
  CRISPR gRNA sequence
tcctagtatgttagcatttt

SEQ ID NO: 132565 - DNA, 20 bp, Artificial
  CRISPR gRNA sequence
ctagtatgttagcattttaa

SEQ ID NO: 132566 - DNA, 20 bp, Artificial
  CRISPR gRNA sequence
gtatgttagcattttaagat

SEQ ID NO: 132567 - DNA, 20 bp, Artificial
  CRISPR gRNA sequence
gcattttaagatcaaaatag

SEQ ID NO: 132568 - DNA, 20 bp, Artificial
  CRISPR gRNA sequence
taagatcaaaatagcatttg

SEQ ID NO: 132569 - DNA, 20 bp, Artificial
  CRISPR gRNA sequence
aagatcaaaatagcatttga

SEQ ID NO: 132570 - DNA, 20 bp, Artificial
  CRISPR gRNA sequence
agatcaaaatagcatttgat

SEQ ID NO: 132571 - DNA, 20 bp, Artificial
  CRISPR gRNA sequence
gatttttgggcactgtttca

SEQ ID NO: 132572 - DNA, 20 bp, Artificial
  CRISPR gRNA sequence
atttttgggcactgtttcac

SEQ ID NO: 132573 - DNA, 20 bp, Artificial
  CRISPR gRNA sequence
ttgggcactgtttcacattt

SEQ ID NO: 132574 - DNA, 20 bp, Artificial
  CRISPR gRNA sequence
tgggcactgtttcacattta

SEQ ID NO: 132575 - DNA, 20 bp, Artificial
  CRISPR gRNA sequence
gggcactgtttcacatttat

SEQ ID NO: 132576 - DNA, 20 bp, Artificial
  CRISPR gRNA sequence
ggcactgtttcacatttatt

SEQ ID NO: 132577 - DNA, 20 bp, Artificial
  CRISPR gRNA sequence
tttcacatttatttgtgtta

SEQ ID NO: 132578 - DNA, 20 bp, Artificial
  CRISPR gRNA sequence
cacatttatttgtgttagtt

SEQ ID NO: 132579 - DNA, 20 bp, Artificial
  CRISPR gRNA sequence
acatttatttgtgttagttt

SEQ ID NO: 132580 - DNA, 20 bp, Artificial
  CRISPR gRNA sequence
atttgtgttagtttaagatg

SEQ ID NO: 132581 - DNA, 20 bp, Artificial
  CRISPR gRNA sequence
tttgtgttagtttaagatgg

SEQ ID NO: 132582 - DNA, 20 bp, Artificial
  CRISPR gRNA sequence
gtgttagtttaagatgggga

SEQ ID NO: 132583 - DNA, 20 bp, Artificial
  CRISPR gRNA sequence
tgttagtttaagatggggag

SEQ ID NO: 132584 - DNA, 20 bp, Artificial
  CRISPR gRNA sequence
gtttaagatggggagggtgg

SEQ ID NO: 132585 - DNA, 20 bp, Artificial
  CRISPR gRNA sequence
aagatggggagggtggtatt

SEQ ID NO: 132586 - DNA, 20 bp, Artificial
  CRISPR gRNA sequence
agatggggagggtggtattg

SEQ ID NO: 132587 - DNA, 20 bp, Artificial
  CRISPR gRNA sequence
ttatttacattttatatgga

SEQ ID NO: 132588 - DNA, 20 bp, Artificial
  CRISPR gRNA sequence
tttacattttatatggaaat

SEQ ID NO: 132589 - DNA, 20 bp, Artificial
  CRISPR gRNA sequence
acattttatatggaaataca

SEQ ID NO: 132590 - DNA, 20 bp, Artificial
  CRISPR gRNA sequence
cattttatatggaaatacat

SEQ ID NO: 132591 - DNA, 20 bp, Artificial
  CRISPR gRNA sequence
tatatggaaatacatttaat

SEQ ID NO: 132592 - DNA, 20 bp, Artificial
  CRISPR gRNA sequence
atatggaaatacatttaatt

SEQ ID NO: 132593 - DNA, 20 bp, Artificial
  CRISPR gRNA sequence
tatggaaatacatttaattg

SEQ ID NO: 132594 - DNA, 20 bp, Artificial
  CRISPR gRNA sequence
aattggcagggatgcttatt

SEQ ID NO: 132595 - DNA, 20 bp, Artificial
  CRISPR gRNA sequence
attggcagggatgcttattt

SEQ ID NO: 132596 - DNA, 20 bp, Artificial
  CRISPR gRNA sequence
gcagggatgcttattttcag

SEQ ID NO: 132597 - DNA, 20 bp, Artificial
  CRISPR gRNA sequence
attttcaggggatcagtagg

SEQ ID NO: 132598 - DNA, 20 bp, Artificial
  CRISPR gRNA sequence
ttttcaggggatcagtagga

SEQ ID NO: 132599 - DNA, 20 bp, Artificial
  CRISPR gRNA sequence
tcaggggatcagtaggagag

SEQ ID NO: 132600 - DNA, 20 bp, Artificial
  CRISPR gRNA sequence
caggggatcagtaggagagt

SEQ ID NO: 132601 - DNA, 20 bp, Artificial
  CRISPR gRNA sequence
aggggatcagtaggagagtc

SEQ ID NO: 132602 - DNA, 20 bp, Artificial
  CRISPR gRNA sequence
actttgttgtttacttctta

SEQ ID NO: 132603 - DNA, 20 bp, Artificial
  CRISPR gRNA sequence
tgttgtttacttcttagagg

SEQ ID NO: 132604 - DNA, 20 bp, Artificial
  CRISPR gRNA sequence
gttgtttacttcttagaggc

SEQ ID NO: 132605 - DNA, 20 bp, Artificial
  CRISPR gRNA sequence
ttgtttacttcttagaggct

SEQ ID NO: 132606 - DNA, 20 bp, Artificial
  CRISPR gRNA sequence
tttacttcttagaggctact

SEQ ID NO: 132607 - DNA, 20 bp, Artificial
  CRISPR gRNA sequence
acttcttagaggctactaaa

SEQ ID NO: 132608 - DNA, 20 bp, Artificial
  CRISPR gRNA sequence
cttcttagaggctactaaaa

SEQ ID NO: 132609 - DNA, 20 bp, Artificial
  CRISPR gRNA sequence
cttagaggctactaaaagta

SEQ ID NO: 132610 - DNA, 20 bp, Artificial
  CRISPR gRNA sequence
ttagaggctactaaaagtat

SEQ ID NO: 132611 - DNA, 20 bp, Artificial
  CRISPR gRNA sequence
agaggctactaaaagtatca

SEQ ID NO: 132612 - DNA, 20 bp, Artificial
  CRISPR gRNA sequence
gaggctactaaaagtatcaa

SEQ ID NO: 132613 - DNA, 20 bp, Artificial
  CRISPR gRNA sequence
ctaaaagtatcaaataggta

SEQ ID NO: 132614 - DNA, 20 bp, Artificial
  CRISPR gRNA sequence
aaagtatcaaataggtaccc

SEQ ID NO: 132615 - DNA, 20 bp, Artificial
  CRISPR gRNA sequence
tgttcacagattattaaagg

SEQ ID NO: 132616 - DNA, 20 bp, Artificial
  CRISPR gRNA sequence
acagattattaaaggtctgt

SEQ ID NO: 132617 - DNA, 20 bp, Artificial
  CRISPR gRNA sequence
ttaaaggtctgtaaattcta

SEQ ID NO: 132618 - DNA, 20 bp, Artificial
  CRISPR gRNA sequence
aaggtctgtaaattctattt

SEQ ID NO: 132619 - DNA, 20 bp, Artificial
  CRISPR gRNA sequence
taaattctattttctacccc

SEQ ID NO: 132620 - DNA, 20 bp, Artificial
  CRISPR gRNA sequence
tattttctacccccttacaa

SEQ ID NO: 132621 - DNA, 20 bp, Artificial
  CRISPR gRNA sequence
ttttctacccccttacaaca

SEQ ID NO: 132622 - DNA, 20 bp, Artificial
  CRISPR gRNA sequence
tctacccccttacaacaact

SEQ ID NO: 132623 - DNA, 20 bp, Artificial
  CRISPR gRNA sequence
ctacccccttacaacaacta

SEQ ID NO: 132624 - DNA, 20 bp, Artificial
  CRISPR gRNA sequence
tacccccttacaacaactat

SEQ ID NO: 132625 - DNA, 20 bp, Artificial
  CRISPR gRNA sequence
cccccttacaacaactatat

SEQ ID NO: 132626 - DNA, 20 bp, Artificial
  CRISPR gRNA sequence
acaacaactatataaattat

SEQ ID NO: 132627 - DNA, 20 bp, Artificial
  CRISPR gRNA sequence
caacaactatataaattata

SEQ ID NO: 132628 - DNA, 20 bp, Artificial
  CRISPR gRNA sequence
tataaattatagaaatgtgt

SEQ ID NO: 132629 - DNA, 20 bp, Artificial
  CRISPR gRNA sequence
tagaaatgtgtctctatcta

SEQ ID NO: 132630 - DNA, 20 bp, Artificial
  CRISPR gRNA sequence
tatctacagttatattaggc

SEQ ID NO: 132631 - DNA, 20 bp, Artificial
  CRISPR gRNA sequence
tctacagttatattaggcat

SEQ ID NO: 132632 - DNA, 20 bp, Artificial
  CRISPR gRNA sequence
cagttatattaggcatcaca

SEQ ID NO: 132633 - DNA, 20 bp, Artificial
  CRISPR gRNA sequence
tattaggcatcacagtcaac

SEQ ID NO: 132634 - DNA, 20 bp, Artificial
  CRISPR gRNA sequence
ggcatcacagtcaacagatg

SEQ ID NO: 132635 - DNA, 20 bp, Artificial
  CRISPR gRNA sequence
ttgaagacctggaaactagc

SEQ ID NO: 132636 - DNA, 20 bp, Artificial
  CRISPR gRNA sequence
aagacctggaaactagccca

SEQ ID NO: 132637 - DNA, 20 bp, Artificial
  CRISPR gRNA sequence
gaaactagcccagtatttta

SEQ ID NO: 132638 - DNA, 20 bp, Artificial
  CRISPR gRNA sequence
gcccagtattttaatattaa

SEQ ID NO: 132639 - DNA, 20 bp, Artificial
  CRISPR gRNA sequence
taatattaaataaaaattca

SEQ ID NO: 132640 - DNA, 20 bp, Artificial
  CRISPR gRNA sequence
aatattaaataaaaattcaa

SEQ ID NO: 132641 - DNA, 20 bp, Artificial
  CRISPR gRNA sequence
atattaaataaaaattcaac

SEQ ID NO: 132642 - DNA, 20 bp, Artificial
  CRISPR gRNA sequence
aataaaaattcaacagagat

SEQ ID NO: 132643 - DNA, 20 bp, Artificial
  CRISPR gRNA sequence
aacagagatggagaagacat

SEQ ID NO: 132644 - DNA, 20 bp, Artificial
  CRISPR gRNA sequence
tacaaggactaaaattttgc

SEQ ID NO: 132645 - DNA, 20 bp, Artificial
  CRISPR gRNA sequence
aaattttgcaattaataaca

SEQ ID NO: 132646 - DNA, 20 bp, Artificial
  CRISPR gRNA sequence
tgcaattaataacattaagt

SEQ ID NO: 132647 - DNA, 20 bp, Artificial
  CRISPR gRNA sequence
gcaattaataacattaagtt

SEQ ID NO: 132648 - DNA, 20 bp, Artificial
  CRISPR gRNA sequence
caattaataacattaagttt

SEQ ID NO: 132649 - DNA, 20 bp, Artificial
  CRISPR gRNA sequence
ataacattaagtttatactg

SEQ ID NO: 132650 - DNA, 20 bp, Artificial
  CRISPR gRNA sequence
agtttatactgggtcctggg

SEQ ID NO: 132651 - DNA, 20 bp, Artificial
  CRISPR gRNA sequence
atactgggtcctgggcctta

SEQ ID NO: 132652 - DNA, 20 bp, Artificial
  CRISPR gRNA sequence
tactgggtcctgggccttaa

SEQ ID NO: 132653 - DNA, 20 bp, Artificial
  CRISPR gRNA sequence
ggtcctgggccttaatgaag

SEQ ID NO: 132654 - DNA, 20 bp, Artificial
  CRISPR gRNA sequence
ggccttaatgaagggtcaaa

SEQ ID NO: 132655 - DNA, 20 bp, Artificial
  CRISPR gRNA sequence
aatgaagggtcaaatttctt

SEQ ID NO: 132656 - DNA, 20 bp, Artificial
  CRISPR gRNA sequence
atgaagggtcaaatttcttt

SEQ ID NO: 132657 - DNA, 20 bp, Artificial
  CRISPR gRNA sequence
ctttgttcagcctgaaagta

SEQ ID NO: 132658 - DNA, 20 bp, Artificial
  CRISPR gRNA sequence
tttgttcagcctgaaagtat

SEQ ID NO: 132659 - DNA, 20 bp, Artificial
  CRISPR gRNA sequence
tgttcagcctgaaagtatgt

SEQ ID NO: 132660 - DNA, 20 bp, Artificial
  CRISPR gRNA sequence
gttcagcctgaaagtatgta

SEQ ID NO: 132661 - DNA, 20 bp, Artificial
  CRISPR gRNA sequence
ttcagcctgaaagtatgtat

SEQ ID NO: 132662 - DNA, 20 bp, Artificial
  CRISPR gRNA sequence
agcctgaaagtatgtatgaa

SEQ ID NO: 132663 - DNA, 20 bp, Artificial
  CRISPR gRNA sequence
aaagtatgtatgaattacac

SEQ ID NO: 132664 - DNA, 20 bp, Artificial
  CRISPR gRNA sequence
cacttgatttttgctatact

SEQ ID NO: 132665 - DNA, 20 bp, Artificial
  CRISPR gRNA sequence
gatttttgctatacttttta

SEQ ID NO: 132666 - DNA, 20 bp, Artificial
  CRISPR gRNA sequence
atttttgctatactttttat

SEQ ID NO: 132667 - DNA, 20 bp, Artificial
  CRISPR gRNA sequence
ttgctatactttttattcag

SEQ ID NO: 132668 - DNA, 20 bp, Artificial
  CRISPR gRNA sequence
tgctatactttttattcaga

SEQ ID NO: 132669 - DNA, 20 bp, Artificial
  CRISPR gRNA sequence
gctatactttttattcagat

SEQ ID NO: 132670 - DNA, 20 bp, Artificial
  CRISPR gRNA sequence
ctatactttttattcagata

SEQ ID NO: 132671 - DNA, 20 bp, Artificial
  CRISPR gRNA sequence
tactttttattcagataatg

SEQ ID NO: 132672 - DNA, 20 bp, Artificial
  CRISPR gRNA sequence
tttattcagataatgcattt

SEQ ID NO: 132673 - DNA, 20 bp, Artificial
  CRISPR gRNA sequence
ttattcagataatgcattta

SEQ ID NO: 132674 - DNA, 20 bp, Artificial
  CRISPR gRNA sequence
tattcagataatgcatttaa

SEQ ID NO: 132675 - DNA, 20 bp, Artificial
  CRISPR gRNA sequence
attcagataatgcatttaac

SEQ ID NO: 132676 - DNA, 20 bp, Artificial
  CRISPR gRNA sequence
ttcagataatgcatttaaca

SEQ ID NO: 132677 - DNA, 20 bp, Artificial
  CRISPR gRNA sequence
agataatgcatttaacattt

SEQ ID NO: 132678 - DNA, 20 bp, Artificial
  CRISPR gRNA sequence
aacattttttcactcacaga

SEQ ID NO: 132679 - DNA, 20 bp, Artificial
  CRISPR gRNA sequence
acattttttcactcacagat

SEQ ID NO: 132680 - DNA, 20 bp, Artificial
  CRISPR gRNA sequence
tttcactcacagatatctta

SEQ ID NO: 132681 - DNA, 20 bp, Artificial
  CRISPR gRNA sequence
ttcactcacagatatcttat

SEQ ID NO: 132682 - DNA, 20 bp, Artificial
  CRISPR gRNA sequence
tcactcacagatatcttatt

SEQ ID NO: 132683 - DNA, 20 bp, Artificial
  CRISPR gRNA sequence
cactcacagatatcttattt

SEQ ID NO: 132684 - DNA, 20 bp, Artificial
  CRISPR gRNA sequence
actcacagatatcttatttt

SEQ ID NO: 132685 - DNA, 20 bp, Artificial
  CRISPR gRNA sequence
acagatatcttattttgagt

SEQ ID NO: 132686 - DNA, 20 bp, Artificial
  CRISPR gRNA sequence
attttgagtagtagtatttg

SEQ ID NO: 132687 - DNA, 20 bp, Artificial
  CRISPR gRNA sequence
ttttgagtagtagtatttgc

SEQ ID NO: 132688 - DNA, 20 bp, Artificial
  CRISPR gRNA sequence
tgagtagtagtatttgcaaa

SEQ ID NO: 132689 - DNA, 20 bp, Artificial
  CRISPR gRNA sequence
gagtagtagtatttgcaaaa

SEQ ID NO: 132690 - DNA, 20 bp, Artificial
  CRISPR gRNA sequence
agtagtagtatttgcaaaac

SEQ ID NO: 132691 - DNA, 20 bp, Artificial
  CRISPR gRNA sequence
gcaaaacagaaagccttcta

SEQ ID NO: 132692 - DNA, 20 bp, Artificial
  CRISPR gRNA sequence
caaaacagaaagccttctag

SEQ ID NO: 132693 - DNA, 20 bp, Artificial
  CRISPR gRNA sequence
ctaggatctgccatgttggt

SEQ ID NO: 132694 - DNA, 20 bp, Artificial
  CRISPR gRNA sequence
taggatctgccatgttggtg

SEQ ID NO: 132695 - DNA, 20 bp, Artificial
  CRISPR gRNA sequence
ggatctgccatgttggtgaa

SEQ ID NO: 132696 - DNA, 20 bp, Artificial
  CRISPR gRNA sequence
ccatgttggtgaaattgaat

SEQ ID NO: 132697 - DNA, 20 bp, Artificial
  CRISPR gRNA sequence
gtgaaattgaatggagccag

SEQ ID NO: 132698 - DNA, 20 bp, Artificial
  CRISPR gRNA sequence
aatggagccagctcagggct

SEQ ID NO: 132699 - DNA, 20 bp, Artificial
  CRISPR gRNA sequence
agggcttatgatttactttt

SEQ ID NO: 132700 - DNA, 20 bp, Artificial
  CRISPR gRNA sequence
atgatttacttttttccaga

SEQ ID NO: 132701 - DNA, 20 bp, Artificial
  CRISPR gRNA sequence
tgatttacttttttccagac

SEQ ID NO: 132702 - DNA, 20 bp, Artificial
  CRISPR gRNA sequence
acttttttccagactttccc

SEQ ID NO: 132703 - DNA, 20 bp, Artificial
  CRISPR gRNA sequence
cttttttccagactttccct

SEQ ID NO: 132704 - DNA, 20 bp, Artificial
  CRISPR gRNA sequence
ttttccagactttccctctt

SEQ ID NO: 132705 - DNA, 20 bp, Artificial
  CRISPR gRNA sequence
tttccagactttccctcttg

SEQ ID NO: 132706 - DNA, 20 bp, Artificial
  CRISPR gRNA sequence
ttccagactttccctcttgg

SEQ ID NO: 132707 - DNA, 20 bp, Artificial
  CRISPR gRNA sequence
tccagactttccctcttgga

SEQ ID NO: 132708 - DNA, 20 bp, Artificial
  CRISPR gRNA sequence
ccagactttccctcttggaa

SEQ ID NO: 132709 - DNA, 20 bp, Artificial
  CRISPR gRNA sequence
cagactttccctcttggaat

SEQ ID NO: 132710 - DNA, 20 bp, Artificial
  CRISPR gRNA sequence
tccctcttggaattctttta

SEQ ID NO: 132711 - DNA, 20 bp, Artificial
  CRISPR gRNA sequence
ccctcttggaattcttttag

SEQ ID NO: 132712 - DNA, 20 bp, Artificial
  CRISPR gRNA sequence
cctcttggaattcttttagc

SEQ ID NO: 132713 - DNA, 20 bp, Artificial
  CRISPR gRNA sequence
ttggaattcttttagctctc

SEQ ID NO: 132714 - DNA, 20 bp, Artificial
  CRISPR gRNA sequence
ggaattcttttagctctcag

SEQ ID NO: 132715 - DNA, 20 bp, Artificial
  CRISPR gRNA sequence
gaattcttttagctctcagc

SEQ ID NO: 132716 - DNA, 20 bp, Artificial
  CRISPR gRNA sequence
ttttagctctcagcaaaatt

SEQ ID NO: 132717 - DNA, 20 bp, Artificial
  CRISPR gRNA sequence
ttagctctcagcaaaattaa

SEQ ID NO: 132718 - DNA, 20 bp, Artificial
  CRISPR gRNA sequence
tagctctcagcaaaattaat

SEQ ID NO: 132719 - DNA, 20 bp, Artificial
  CRISPR gRNA sequence
agctctcagcaaaattaatt

SEQ ID NO: 132720 - DNA, 20 bp, Artificial
  CRISPR gRNA sequence
gctctcagcaaaattaatta

SEQ ID NO: 132721 - DNA, 20 bp, Artificial
  CRISPR gRNA sequence
tcagcaaaattaattaagca

SEQ ID NO: 132722 - DNA, 20 bp, Artificial
  CRISPR gRNA sequence
agcaaaattaattaagcagg

SEQ ID NO: 132723 - DNA, 20 bp, Artificial
  CRISPR gRNA sequence
attaagcaggctttttttaa

SEQ ID NO: 132724 - DNA, 20 bp, Artificial
  CRISPR gRNA sequence
agcaggctttttttaaaata

SEQ ID NO: 132725 - DNA, 20 bp, Artificial
  CRISPR gRNA sequence
tttttaaaataggaatttta

SEQ ID NO: 132726 - DNA, 20 bp, Artificial
  CRISPR gRNA sequence
ttttaaaataggaattttaa

SEQ ID NO: 132727 - DNA, 20 bp, Artificial
  CRISPR gRNA sequence
tttaaaataggaattttaac

SEQ ID NO: 132728 - DNA, 20 bp, Artificial
  CRISPR gRNA sequence
ttaaaataggaattttaact

SEQ ID NO: 132729 - DNA, 20 bp, Artificial
  CRISPR gRNA sequence
taaaataggaattttaactc

SEQ ID NO: 132730 - DNA, 20 bp, Artificial
  CRISPR gRNA sequence
aaaataggaattttaactct

SEQ ID NO: 132731 - DNA, 20 bp, Artificial
  CRISPR gRNA sequence
aaataggaattttaactctt

SEQ ID NO: 132732 - DNA, 20 bp, Artificial
  CRISPR gRNA sequence
taactcttattcttgtctgt

SEQ ID NO: 132733 - DNA, 20 bp, Artificial
  CRISPR gRNA sequence
aactcttattcttgtctgtg

SEQ ID NO: 132734 - DNA, 20 bp, Artificial
  CRISPR gRNA sequence
actcttattcttgtctgtgc

SEQ ID NO: 132735 - DNA, 20 bp, Artificial
  CRISPR gRNA sequence
ttattcttgtctgtgcaggt

SEQ ID NO: 132736 - DNA, 20 bp, Artificial
  CRISPR gRNA sequence
attcttgtctgtgcaggtaa

SEQ ID NO: 132737 - DNA, 20 bp, Artificial
  CRISPR gRNA sequence
ttcttgtctgtgcaggtaat

SEQ ID NO: 132738 - DNA, 20 bp, Artificial
  CRISPR gRNA sequence
ttgtctgtgcaggtaatttt

SEQ ID NO: 132739 - DNA, 20 bp, Artificial
  CRISPR gRNA sequence
gtctgtgcaggtaattttcc

SEQ ID NO: 132740 - DNA, 20 bp, Artificial
  CRISPR gRNA sequence
tctgtgcaggtaattttcct

SEQ ID NO: 132741 - DNA, 20 bp, Artificial
  CRISPR gRNA sequence
tgcaggtaattttcctatct

SEQ ID NO: 132742 - DNA, 20 bp, Artificial
  CRISPR gRNA sequence
tcctatctttatacatagat

SEQ ID NO: 132743 - DNA, 20 bp, Artificial
  CRISPR gRNA sequence
cctatctttatacatagatc

SEQ ID NO: 132744 - DNA, 20 bp, Artificial
  CRISPR gRNA sequence
ctatctttatacatagatct

SEQ ID NO: 132745 - DNA, 20 bp, Artificial
  CRISPR gRNA sequence
tctttatacatagatcttcc

SEQ ID NO: 132746 - DNA, 20 bp, Artificial
  CRISPR gRNA sequence
tatacatagatcttcctgac

SEQ ID NO: 132747 - DNA, 20 bp, Artificial
  CRISPR gRNA sequence
atacatagatcttcctgacc

SEQ ID NO: 132748 - DNA, 20 bp, Artificial
  CRISPR gRNA sequence
tacatagatcttcctgaccc

SEQ ID NO: 132749 - DNA, 20 bp, Artificial
  CRISPR gRNA sequence
cctgacccctcctcctgacc

SEQ ID NO: 132750 - DNA, 20 bp, Artificial
  CRISPR gRNA sequence
ctgacccctcctcctgaccc

SEQ ID NO: 132751 - DNA, 20 bp, Artificial
  CRISPR gRNA sequence
acccctcctcctgaccccac

SEQ ID NO: 132752 - DNA, 20 bp, Artificial
  CRISPR gRNA sequence
ctcctgaccccactctgtca

SEQ ID NO: 132753 - DNA, 20 bp, Artificial
  CRISPR gRNA sequence
ctgaccccactctgtcactg

SEQ ID NO: 132754 - DNA, 20 bp, Artificial
  CRISPR gRNA sequence
accccactctgtcactgagg

SEQ ID NO: 132755 - DNA, 20 bp, Artificial
  CRISPR gRNA sequence
tgtcactgaggctggagtgc

SEQ ID NO: 132756 - DNA, 20 bp, Artificial
  CRISPR gRNA sequence
tcactgaggctggagtgcag

SEQ ID NO: 132757 - DNA, 20 bp, Artificial
  CRISPR gRNA sequence
aggctggagtgcagtggtgt

SEQ ID NO: 132758 - DNA, 20 bp, Artificial
  CRISPR gRNA sequence
gagtgcagtggtgtgatcac

SEQ ID NO: 132759 - DNA, 20 bp, Artificial
  CRISPR gRNA sequence
actgcagcctcaacctccta

SEQ ID NO: 132760 - DNA, 20 bp, Artificial
  CRISPR gRNA sequence
cagcctcaacctcctaggct

SEQ ID NO: 132761 - DNA, 20 bp, Artificial
  CRISPR gRNA sequence
aacctcctaggctcaagtga

SEQ ID NO: 132762 - DNA, 20 bp, Artificial
  CRISPR gRNA sequence
ctaggctcaagtgatcttcc

SEQ ID NO: 132763 - DNA, 20 bp, Artificial
  CRISPR gRNA sequence
ggctcaagtgatcttcccac

SEQ ID NO: 132764 - DNA, 20 bp, Artificial
  CRISPR gRNA sequence
aagtgatcttcccacctcag

SEQ ID NO: 132765 - DNA, 20 bp, Artificial
  CRISPR gRNA sequence
cccacctcagcctctcaagt

SEQ ID NO: 132766 - DNA, 20 bp, Artificial
  CRISPR gRNA sequence
ccacctcagcctctcaagta

SEQ ID NO: 132767 - DNA, 20 bp, Artificial
  CRISPR gRNA sequence
agcctctcaagtagttagga

SEQ ID NO: 132768 - DNA, 20 bp, Artificial
  CRISPR gRNA sequence
tcaagtagttaggactacag

SEQ ID NO: 132769 - DNA, 20 bp, Artificial
  CRISPR gRNA sequence
aagtagttaggactacaggc

SEQ ID NO: 132770 - DNA, 20 bp, Artificial
  CRISPR gRNA sequence
ggactacaggcacatgccac

SEQ ID NO: 132771 - DNA, 20 bp, Artificial
  CRISPR gRNA sequence
caggcacatgccacaacgcc

SEQ ID NO: 132772 - DNA, 20 bp, Artificial
  CRISPR gRNA sequence
gctaatttcttaatttttgt

SEQ ID NO: 132773 - DNA, 20 bp, Artificial
  CRISPR gRNA sequence
atttcttaatttttgttttt

SEQ ID NO: 132774 - DNA, 20 bp, Artificial
  CRISPR gRNA sequence
cttaatttttgttttttttt

SEQ ID NO: 132775 - DNA, 20 bp, Artificial
  CRISPR gRNA sequence
ttaatttttgttttttttta

SEQ ID NO: 132776 - DNA, 20 bp, Artificial
  CRISPR gRNA sequence
aatttttgtttttttttaga

SEQ ID NO: 132777 - DNA, 20 bp, Artificial
  CRISPR gRNA sequence
atttttgtttttttttagag

SEQ ID NO: 132778 - DNA, 20 bp, Artificial
  CRISPR gRNA sequence
ttgtttttttttagagacag

SEQ ID NO: 132779 - DNA, 20 bp, Artificial
  CRISPR gRNA sequence
tgtttttttttagagacagg

SEQ ID NO: 132780 - DNA, 20 bp, Artificial
  CRISPR gRNA sequence
gtttttttttagagacaggg

SEQ ID NO: 132781 - DNA, 20 bp, Artificial
  CRISPR gRNA sequence
tttttttttagagacagggt

SEQ ID NO: 132782 - DNA, 20 bp, Artificial
  CRISPR gRNA sequence
ttttttagagacagggtctc

SEQ ID NO: 132783 - DNA, 20 bp, Artificial
  CRISPR gRNA sequence
tttttagagacagggtctca

SEQ ID NO: 132784 - DNA, 20 bp, Artificial
  CRISPR gRNA sequence
ttttagagacagggtctcac

SEQ ID NO: 132785 - DNA, 20 bp, Artificial
  CRISPR gRNA sequence
tttagagacagggtctcact

SEQ ID NO: 132786 - DNA, 20 bp, Artificial
  CRISPR gRNA sequence
ttagagacagggtctcactg

SEQ ID NO: 132787 - DNA, 20 bp, Artificial
  CRISPR gRNA sequence
tagagacagggtctcactgt

SEQ ID NO: 132788 - DNA, 20 bp, Artificial
  CRISPR gRNA sequence
agagacagggtctcactgtg

SEQ ID NO: 132789 - DNA, 20 bp, Artificial
  CRISPR gRNA sequence
gagacagggtctcactgtgt

SEQ ID NO: 132790 - DNA, 20 bp, Artificial
  CRISPR gRNA sequence
actgtgttgcccaggctgat

SEQ ID NO: 132791 - DNA, 20 bp, Artificial
  CRISPR gRNA sequence
tgttgcccaggctgatcttg

SEQ ID NO: 132792 - DNA, 20 bp, Artificial
  CRISPR gRNA sequence
cccaggctgatcttgaactt

SEQ ID NO: 132793 - DNA, 20 bp, Artificial
  CRISPR gRNA sequence
atcttgaacttctgggccca

SEQ ID NO: 132794 - DNA, 20 bp, Artificial
  CRISPR gRNA sequence
gaacttctgggcccaagtga

SEQ ID NO: 132795 - DNA, 20 bp, Artificial
  CRISPR gRNA sequence
aacttctgggcccaagtgat

SEQ ID NO: 132796 - DNA, 20 bp, Artificial
  CRISPR gRNA sequence
ctgggcccaagtgatcctcc

SEQ ID NO: 132797 - DNA, 20 bp, Artificial
  CRISPR gRNA sequence
tgggcccaagtgatcctccc

SEQ ID NO: 132798 - DNA, 20 bp, Artificial
  CRISPR gRNA sequence
ggcccaagtgatcctcccac

SEQ ID NO: 132799 - DNA, 20 bp, Artificial
  CRISPR gRNA sequence
ccaccttggcttcccaaagt

SEQ ID NO: 132800 - DNA, 20 bp, Artificial
  CRISPR gRNA sequence
ggcttcccaaagttctggga

SEQ ID NO: 132801 - DNA, 20 bp, Artificial
  CRISPR gRNA sequence
gcttcccaaagttctgggat

SEQ ID NO: 132802 - DNA, 20 bp, Artificial
  CRISPR gRNA sequence
cccaaagttctgggattaca

SEQ ID NO: 132803 - DNA, 20 bp, Artificial
  CRISPR gRNA sequence
ccaaagttctgggattacag

SEQ ID NO: 132804 - DNA, 20 bp, Artificial
  CRISPR gRNA sequence
tgggattacaggcatgagcc

SEQ ID NO: 132805 - DNA, 20 bp, Artificial
  CRISPR gRNA sequence
ggattacaggcatgagccac

SEQ ID NO: 132806 - DNA, 20 bp, Artificial
  CRISPR gRNA sequence
caggcatgagccacacctgg

SEQ ID NO: 132807 - DNA, 20 bp, Artificial
  CRISPR gRNA sequence
gccctgatttggcaggggga

SEQ ID NO: 132808 - DNA, 20 bp, Artificial
  CRISPR gRNA sequence
atttggcagggggagagaaa

SEQ ID NO: 132809 - DNA, 20 bp, Artificial
  CRISPR gRNA sequence
ggcagggggagagaaaatta

SEQ ID NO: 132810 - DNA, 20 bp, Artificial
  CRISPR gRNA sequence
gcagggggagagaaaattaa

SEQ ID NO: 132811 - DNA, 20 bp, Artificial
  CRISPR gRNA sequence
acctttgactagaatcagga

SEQ ID NO: 132812 - DNA, 20 bp, Artificial
  CRISPR gRNA sequence
tgactagaatcaggagttta

SEQ ID NO: 132813 - DNA, 20 bp, Artificial
  CRISPR gRNA sequence
gactagaatcaggagtttat

SEQ ID NO: 132814 - DNA, 20 bp, Artificial
  CRISPR gRNA sequence
actagaatcaggagtttatg

SEQ ID NO: 132815 - DNA, 20 bp, Artificial
  CRISPR gRNA sequence
gaatcaggagtttatgggtt

SEQ ID NO: 132816 - DNA, 20 bp, Artificial
  CRISPR gRNA sequence
atgggttcattcaaaacatg

SEQ ID NO: 132817 - DNA, 20 bp, Artificial
  CRISPR gRNA sequence
tgggttcattcaaaacatgg

SEQ ID NO: 132818 - DNA, 20 bp, Artificial
  CRISPR gRNA sequence
attcaaaacatgggtgtact

SEQ ID NO: 132819 - DNA, 20 bp, Artificial
  CRISPR gRNA sequence
aaaacatgggtgtacttttg

SEQ ID NO: 132820 - DNA, 20 bp, Artificial
  CRISPR gRNA sequence
ttggcttgcctgggtacaga

SEQ ID NO: 132821 - DNA, 20 bp, Artificial
  CRISPR gRNA sequence
tggcttgcctgggtacagaa

SEQ ID NO: 132822 - DNA, 20 bp, Artificial
  CRISPR gRNA sequence
ggcttgcctgggtacagaat

SEQ ID NO: 132823 - DNA, 20 bp, Artificial
  CRISPR gRNA sequence
gcttgcctgggtacagaatt

SEQ ID NO: 132824 - DNA, 20 bp, Artificial
  CRISPR gRNA sequence
gcctgggtacagaattgtgc

SEQ ID NO: 132825 - DNA, 20 bp, Artificial
  CRISPR gRNA sequence
cctgggtacagaattgtgca

SEQ ID NO: 132826 - DNA, 20 bp, Artificial
  CRISPR gRNA sequence
ggtacagaattgtgcagaga

SEQ ID NO: 132827 - DNA, 20 bp, Artificial
  CRISPR gRNA sequence
tgcagagaatccgcatgctt

SEQ ID NO: 132828 - DNA, 20 bp, Artificial
  CRISPR gRNA sequence
cttataccaagtaacagttt

SEQ ID NO: 132829 - DNA, 20 bp, Artificial
  CRISPR gRNA sequence
ttataccaagtaacagtttg

SEQ ID NO: 132830 - DNA, 20 bp, Artificial
  CRISPR gRNA sequence
ataccaagtaacagtttgaa

SEQ ID NO: 132831 - DNA, 20 bp, Artificial
  CRISPR gRNA sequence
taccaagtaacagtttgaac

SEQ ID NO: 132832 - DNA, 20 bp, Artificial
  CRISPR gRNA sequence
gaacggagacattgtctatt

SEQ ID NO: 132833 - DNA, 20 bp, Artificial
  CRISPR gRNA sequence
aacggagacattgtctattt

SEQ ID NO: 132834 - DNA, 20 bp, Artificial
  CRISPR gRNA sequence
tctattttggaacttctatg

SEQ ID NO: 132835 - DNA, 20 bp, Artificial
  CRISPR gRNA sequence
ttttggaacttctatgagaa

SEQ ID NO: 132836 - DNA, 20 bp, Artificial
  CRISPR gRNA sequence
tggaacttctatgagaaagc

SEQ ID NO: 132837 - DNA, 20 bp, Artificial
  CRISPR gRNA sequence
ggaacttctatgagaaagca

SEQ ID NO: 132838 - DNA, 20 bp, Artificial
  CRISPR gRNA sequence
gaacttctatgagaaagcaa

SEQ ID NO: 132839 - DNA, 20 bp, Artificial
  CRISPR gRNA sequence
ctatgagaaagcaaagaaag

SEQ ID NO: 132840 - DNA, 20 bp, Artificial
  CRISPR gRNA sequence
tatgagaaagcaaagaaagt

SEQ ID NO: 132841 - DNA, 20 bp, Artificial
  CRISPR gRNA sequence
tgagaaagcaaagaaagttc

SEQ ID NO: 132842 - DNA, 20 bp, Artificial
  CRISPR gRNA sequence
gcaagcaggagcaaaaggaa

SEQ ID NO: 132843 - DNA, 20 bp, Artificial
  CRISPR gRNA sequence
agcaggagagctggaagtga

SEQ ID NO: 132844 - DNA, 20 bp, Artificial
  CRISPR gRNA sequence
gcaggagagctggaagtgat

SEQ ID NO: 132845 - DNA, 20 bp, Artificial
  CRISPR gRNA sequence
gaagtgatggatacaggtga

SEQ ID NO: 132846 - DNA, 20 bp, Artificial
  CRISPR gRNA sequence
cagttgatgacttaagctga

SEQ ID NO: 132847 - DNA, 20 bp, Artificial
  CRISPR gRNA sequence
atgacttaagctgatttttt

SEQ ID NO: 132848 - DNA, 20 bp, Artificial
  CRISPR gRNA sequence
aagctgatttttttttttaa

SEQ ID NO: 132849 - DNA, 20 bp, Artificial
  CRISPR gRNA sequence
agctgatttttttttttaag

SEQ ID NO: 132850 - DNA, 20 bp, Artificial
  CRISPR gRNA sequence
atttttttttttaagagaca

SEQ ID NO: 132851 - DNA, 20 bp, Artificial
  CRISPR gRNA sequence
ttttttttaagagacaggtt

SEQ ID NO: 132852 - DNA, 20 bp, Artificial
  CRISPR gRNA sequence
tttttttaagagacaggttc

SEQ ID NO: 132853 - DNA, 20 bp, Artificial
  CRISPR gRNA sequence
ttttttaagagacaggttct

SEQ ID NO: 132854 - DNA, 20 bp, Artificial
  CRISPR gRNA sequence
tttttaagagacaggttctc

SEQ ID NO: 132855 - DNA, 20 bp, Artificial
  CRISPR gRNA sequence
ttttaagagacaggttctca

SEQ ID NO: 132856 - DNA, 20 bp, Artificial
  CRISPR gRNA sequence
tttaagagacaggttctcac

SEQ ID NO: 132857 - DNA, 20 bp, Artificial
  CRISPR gRNA sequence
ttaagagacaggttctcact

SEQ ID NO: 132858 - DNA, 20 bp, Artificial
  CRISPR gRNA sequence
taagagacaggttctcacta

SEQ ID NO: 132859 - DNA, 20 bp, Artificial
  CRISPR gRNA sequence
aagagacaggttctcactac

SEQ ID NO: 132860 - DNA, 20 bp, Artificial
  CRISPR gRNA sequence
agagacaggttctcactaca

SEQ ID NO: 132861 - DNA, 20 bp, Artificial
  CRISPR gRNA sequence
tcactacattgaccaggctg

SEQ ID NO: 132862 - DNA, 20 bp, Artificial
  CRISPR gRNA sequence
actacattgaccaggctggt

SEQ ID NO: 132863 - DNA, 20 bp, Artificial
  CRISPR gRNA sequence
cattgaccaggctggtctgg

SEQ ID NO: 132864 - DNA, 20 bp, Artificial
  CRISPR gRNA sequence
accaggctggtctggaactc

SEQ ID NO: 132865 - DNA, 20 bp, Artificial
  CRISPR gRNA sequence
gtctggaactcttgagctca

SEQ ID NO: 132866 - DNA, 20 bp, Artificial
  CRISPR gRNA sequence
gaactcttgagctcaagcag

SEQ ID NO: 132867 - DNA, 20 bp, Artificial
  CRISPR gRNA sequence
ttgagctcaagcagtcctcc

SEQ ID NO: 132868 - DNA, 20 bp, Artificial
  CRISPR gRNA sequence
gagctcaagcagtcctcctg

SEQ ID NO: 132869 - DNA, 20 bp, Artificial
  CRISPR gRNA sequence
agctcaagcagtcctcctgc

SEQ ID NO: 132870 - DNA, 20 bp, Artificial
  CRISPR gRNA sequence
aagcagtcctcctgcttcag

SEQ ID NO: 132871 - DNA, 20 bp, Artificial
  CRISPR gRNA sequence
ctgcttcagcttctgagcag

SEQ ID NO: 132872 - DNA, 20 bp, Artificial
  CRISPR gRNA sequence
cttcagcttctgagcagttg

SEQ ID NO: 132873 - DNA, 20 bp, Artificial
  CRISPR gRNA sequence
cagcttctgagcagttgggg

SEQ ID NO: 132874 - DNA, 20 bp, Artificial
  CRISPR gRNA sequence
agcttctgagcagttggggc

SEQ ID NO: 132875 - DNA, 20 bp, Artificial
  CRISPR gRNA sequence
ctgagcagttggggctacag

SEQ ID NO: 132876 - DNA, 20 bp, Artificial
  CRISPR gRNA sequence
tgagcagttggggctacagg

SEQ ID NO: 132877 - DNA, 20 bp, Artificial
  CRISPR gRNA sequence
agcagttggggctacaggta

SEQ ID NO: 132878 - DNA, 20 bp, Artificial
  CRISPR gRNA sequence
gggctacaggtacatgacac

SEQ ID NO: 132879 - DNA, 20 bp, Artificial
  CRISPR gRNA sequence
caggtacatgacactgtgta

SEQ ID NO: 132880 - DNA, 20 bp, Artificial
  CRISPR gRNA sequence
tgtacagctttactaagctg

SEQ ID NO: 132881 - DNA, 20 bp, Artificial
  CRISPR gRNA sequence
tactaagctgatcatcattc

SEQ ID NO: 132882 - DNA, 20 bp, Artificial
  CRISPR gRNA sequence
actaagctgatcatcattcc

SEQ ID NO: 132883 - DNA, 20 bp, Artificial
  CRISPR gRNA sequence
ctaagctgatcatcattcca

SEQ ID NO: 132884 - DNA, 20 bp, Artificial
  CRISPR gRNA sequence
agctgatcatcattccaggg

SEQ ID NO: 132885 - DNA, 20 bp, Artificial
  CRISPR gRNA sequence
atcatcattccagggataaa

SEQ ID NO: 132886 - DNA, 20 bp, Artificial
  CRISPR gRNA sequence
cagggataaattaggttgta

SEQ ID NO: 132887 - DNA, 20 bp, Artificial
  CRISPR gRNA sequence
ggttgtaagtcagggttgcc

SEQ ID NO: 132888 - DNA, 20 bp, Artificial
  CRISPR gRNA sequence
taagtcagggttgcctgtgg

SEQ ID NO: 132889 - DNA, 20 bp, Artificial
  CRISPR gRNA sequence
cctgtggtactatatttgaa

SEQ ID NO: 132890 - DNA, 20 bp, Artificial
  CRISPR gRNA sequence
tggtactatatttgaagatt

SEQ ID NO: 132891 - DNA, 20 bp, Artificial
  CRISPR gRNA sequence
tatttgaagattatgcactt

SEQ ID NO: 132892 - DNA, 20 bp, Artificial
  CRISPR gRNA sequence
gaagattatgcacttaaaaa

SEQ ID NO: 132893 - DNA, 20 bp, Artificial
  CRISPR gRNA sequence
aagattatgcacttaaaaag

SEQ ID NO: 132894 - DNA, 20 bp, Artificial
  CRISPR gRNA sequence
tgcacttaaaaagaaagagg

SEQ ID NO: 132895 - DNA, 20 bp, Artificial
  CRISPR gRNA sequence
aaaaagaaagaggcatatgc

SEQ ID NO: 132896 - DNA, 20 bp, Artificial
  CRISPR gRNA sequence
aaaagaaagaggcatatgct

SEQ ID NO: 132897 - DNA, 20 bp, Artificial
  CRISPR gRNA sequence
tagattcatttccttgtcgc

SEQ ID NO: 132898 - DNA, 20 bp, Artificial
  CRISPR gRNA sequence
agattcatttccttgtcgct

SEQ ID NO: 132899 - DNA, 20 bp, Artificial
  CRISPR gRNA sequence
gattcatttccttgtcgcta

SEQ ID NO: 132900 - DNA, 20 bp, Artificial
  CRISPR gRNA sequence
atttccttgtcgctattggc

SEQ ID NO: 132901 - DNA, 20 bp, Artificial
  CRISPR gRNA sequence
ccttgtcgctattggcctta

SEQ ID NO: 132902 - DNA, 20 bp, Artificial
  CRISPR gRNA sequence
cttgtcgctattggccttat

SEQ ID NO: 132903 - DNA, 20 bp, Artificial
  CRISPR gRNA sequence
gtcgctattggccttatgct

SEQ ID NO: 132904 - DNA, 20 bp, Artificial
  CRISPR gRNA sequence
tcgctattggccttatgctt

SEQ ID NO: 132905 - DNA, 20 bp, Artificial
  CRISPR gRNA sequence
ttggccttatgcttatatca

SEQ ID NO: 132906 - DNA, 20 bp, Artificial
  CRISPR gRNA sequence
gccttatgcttatatcactt

SEQ ID NO: 132907 - DNA, 20 bp, Artificial
  CRISPR gRNA sequence
atgcttatatcacttatgga

SEQ ID NO: 132908 - DNA, 20 bp, Artificial
  CRISPR gRNA sequence
tgcttatatcacttatggaa

SEQ ID NO: 132909 - DNA, 20 bp, Artificial
  CRISPR gRNA sequence
atatcacttatggaagatgg

SEQ ID NO: 132910 - DNA, 20 bp, Artificial
  CRISPR gRNA sequence
tatcacttatggaagatgga

SEQ ID NO: 132911 - DNA, 20 bp, Artificial
  CRISPR gRNA sequence
atggaagatggatagggaaa

SEQ ID NO: 132912 - DNA, 20 bp, Artificial
  CRISPR gRNA sequence
tggaagatggatagggaaat

SEQ ID NO: 132913 - DNA, 20 bp, Artificial
  CRISPR gRNA sequence
gaatcgtggacaaattgtgg

SEQ ID NO: 132914 - DNA, 20 bp, Artificial
  CRISPR gRNA sequence
aatcgtggacaaattgtggg

SEQ ID NO: 132915 - DNA, 20 bp, Artificial
  CRISPR gRNA sequence
tgggaaagtttccaaatcaa

SEQ ID NO: 132916 - DNA, 20 bp, Artificial
  CRISPR gRNA sequence
ccaaatcaagaaatataggc

SEQ ID NO: 132917 - DNA, 20 bp, Artificial
  CRISPR gRNA sequence
caaatcaagaaatataggct

SEQ ID NO: 132918 - DNA, 20 bp, Artificial
  CRISPR gRNA sequence
gttgcggtggctgatgcctg

SEQ ID NO: 132919 - DNA, 20 bp, Artificial
  CRISPR gRNA sequence
cggtggctgatgcctgtaat

SEQ ID NO: 132920 - DNA, 20 bp, Artificial
  CRISPR gRNA sequence
atgcctgtaatctcagcatt

SEQ ID NO: 132921 - DNA, 20 bp, Artificial
  CRISPR gRNA sequence
taatctcagcattttgggag

SEQ ID NO: 132922 - DNA, 20 bp, Artificial
  CRISPR gRNA sequence
agcattttgggaggctgagg

SEQ ID NO: 132923 - DNA, 20 bp, Artificial
  CRISPR gRNA sequence
tgggaggctgaggtaggtgg

SEQ ID NO: 132924 - DNA, 20 bp, Artificial
  CRISPR gRNA sequence
gggaggctgaggtaggtggt

SEQ ID NO: 132925 - DNA, 20 bp, Artificial
  CRISPR gRNA sequence
ggaggctgaggtaggtggtt

SEQ ID NO: 132926 - DNA, 20 bp, Artificial
  CRISPR gRNA sequence
aggtaggtggtttgtttgag

SEQ ID NO: 132927 - DNA, 20 bp, Artificial
  CRISPR gRNA sequence
gtttgagcccaggagttcca

SEQ ID NO: 132928 - DNA, 20 bp, Artificial
  CRISPR gRNA sequence
tttgagcccaggagttccag

SEQ ID NO: 132929 - DNA, 20 bp, Artificial
  CRISPR gRNA sequence
gagcccaggagttccagacc

SEQ ID NO: 132930 - DNA, 20 bp, Artificial
  CRISPR gRNA sequence
agcccaggagttccagacca

SEQ ID NO: 132931 - DNA, 20 bp, Artificial
  CRISPR gRNA sequence
cagaccagcctgggcaacat

SEQ ID NO: 132932 - DNA, 20 bp, Artificial
  CRISPR gRNA sequence
ggcaacatagcaaaaccctg

SEQ ID NO: 132933 - DNA, 20 bp, Artificial
  CRISPR gRNA sequence
tctctgctaaaaatacaaaa

SEQ ID NO: 132934 - DNA, 20 bp, Artificial
  CRISPR gRNA sequence
tgctaaaaatacaaaaaaat

SEQ ID NO: 132935 - DNA, 20 bp, Artificial
  CRISPR gRNA sequence
ctaaaaatacaaaaaaattg

SEQ ID NO: 132936 - DNA, 20 bp, Artificial
  CRISPR gRNA sequence
aaaatacaaaaaaattggcc

SEQ ID NO: 132937 - DNA, 20 bp, Artificial
  CRISPR gRNA sequence
gccaggcatggtggtgcatg

SEQ ID NO: 132938 - DNA, 20 bp, Artificial
  CRISPR gRNA sequence
tagtccagctactcaggagg

SEQ ID NO: 132939 - DNA, 20 bp, Artificial
  CRISPR gRNA sequence
ctcaggaggctgaggtggga

SEQ ID NO: 132940 - DNA, 20 bp, Artificial
  CRISPR gRNA sequence
aggaggctgaggtgggagga

SEQ ID NO: 132941 - DNA, 20 bp, Artificial
  CRISPR gRNA sequence
aggtgggaggattgcttcag

SEQ ID NO: 132942 - DNA, 20 bp, Artificial
  CRISPR gRNA sequence
cttcagcctgggaggtggat

SEQ ID NO: 132943 - DNA, 20 bp, Artificial
  CRISPR gRNA sequence
cagcctgggaggtggattct

SEQ ID NO: 132944 - DNA, 20 bp, Artificial
  CRISPR gRNA sequence
agcctgggaggtggattctg

SEQ ID NO: 132945 - DNA, 20 bp, Artificial
  CRISPR gRNA sequence
ggaggtggattctgcagtga

SEQ ID NO: 132946 - DNA, 20 bp, Artificial
  CRISPR gRNA sequence
tgcagtgagctgtgatcacg

SEQ ID NO: 132947 - DNA, 20 bp, Artificial
  CRISPR gRNA sequence
cagtgagctgtgatcacgcc

SEQ ID NO: 132948 - DNA, 20 bp, Artificial
  CRISPR gRNA sequence
tgatcacgccactgcactcc

SEQ ID NO: 132949 - DNA, 20 bp, Artificial
  CRISPR gRNA sequence
cactccagcctgggccacag

SEQ ID NO: 132950 - DNA, 20 bp, Artificial
  CRISPR gRNA sequence
cagcctgggccacagagtaa

SEQ ID NO: 132951 - DNA, 20 bp, Artificial
  CRISPR gRNA sequence
ggccacagagtaagaccctg

SEQ ID NO: 132952 - DNA, 20 bp, Artificial
  CRISPR gRNA sequence
tctcaaaaaaataattaatt

SEQ ID NO: 132953 - DNA, 20 bp, Artificial
  CRISPR gRNA sequence
aaaaaaataattaatttttt

SEQ ID NO: 132954 - DNA, 20 bp, Artificial
  CRISPR gRNA sequence
attttttaaaaaagaaatat

SEQ ID NO: 132955 - DNA, 20 bp, Artificial
  CRISPR gRNA sequence
tttaaaaaagaaatataaat

SEQ ID NO: 132956 - DNA, 20 bp, Artificial
  CRISPR gRNA sequence
ttaaaaaagaaatataaatt

SEQ ID NO: 132957 - DNA, 20 bp, Artificial
  CRISPR gRNA sequence
taaaaaagaaatataaattc

SEQ ID NO: 132958 - DNA, 20 bp, Artificial
  CRISPR gRNA sequence
aaaaaagaaatataaattct

SEQ ID NO: 132959 - DNA, 20 bp, Artificial
  CRISPR gRNA sequence
aaaaagaaatataaattctc

SEQ ID NO: 132960 - DNA, 20 bp, Artificial
  CRISPR gRNA sequence
tcttttagtaagcttaaggc

SEQ ID NO: 132961 - DNA, 20 bp, Artificial
  CRISPR gRNA sequence
ttttagtaagcttaaggcta

SEQ ID NO: 132962 - DNA, 20 bp, Artificial
  CRISPR gRNA sequence
ttagtaagcttaaggctatg

SEQ ID NO: 132963 - DNA, 20 bp, Artificial
  CRISPR gRNA sequence
tagtaagcttaaggctatga

SEQ ID NO: 132964 - DNA, 20 bp, Artificial
  CRISPR gRNA sequence
agtaagcttaaggctatgaa

SEQ ID NO: 132965 - DNA, 20 bp, Artificial
  CRISPR gRNA sequence
gtaagcttaaggctatgaaa

SEQ ID NO: 132966 - DNA, 20 bp, Artificial
  CRISPR gRNA sequence
aaggctatgaaaagtataat

SEQ ID NO: 132967 - DNA, 20 bp, Artificial
  CRISPR gRNA sequence
aggctatgaaaagtataatt

SEQ ID NO: 132968 - DNA, 20 bp, Artificial
  CRISPR gRNA sequence
tgaaaagtataattgatgca

SEQ ID NO: 132969 - DNA, 20 bp, Artificial
  CRISPR gRNA sequence
atgcatcatcctgtgacagt

SEQ ID NO: 132970 - DNA, 20 bp, Artificial
  CRISPR gRNA sequence
tgacagtttataagtgttga

SEQ ID NO: 132971 - DNA, 20 bp, Artificial
  CRISPR gRNA sequence
ataagtgttgaatctgttac

SEQ ID NO: 132972 - DNA, 20 bp, Artificial
  CRISPR gRNA sequence
taagtgttgaatctgttacg

SEQ ID NO: 132973 - DNA, 20 bp, Artificial
  CRISPR gRNA sequence
aatctgttacgtttgttagt

SEQ ID NO: 132974 - DNA, 20 bp, Artificial
  CRISPR gRNA sequence
ttacgtttgttagtactttg

SEQ ID NO: 132975 - DNA, 20 bp, Artificial
  CRISPR gRNA sequence
cgtttgttagtactttgaaa

SEQ ID NO: 132976 - DNA, 20 bp, Artificial
  CRISPR gRNA sequence
gttagtactttgaaaagtat

SEQ ID NO: 132977 - DNA, 20 bp, Artificial
  CRISPR gRNA sequence
ttagtactttgaaaagtatt

SEQ ID NO: 132978 - DNA, 20 bp, Artificial
  CRISPR gRNA sequence
gtactttgaaaagtattgaa

SEQ ID NO: 132979 - DNA, 20 bp, Artificial
  CRISPR gRNA sequence
tgaaaagtattgaaaaactg

SEQ ID NO: 132980 - DNA, 20 bp, Artificial
  CRISPR gRNA sequence
gaaaagtattgaaaaactgt

SEQ ID NO: 132981 - DNA, 20 bp, Artificial
  CRISPR gRNA sequence
aaaagtattgaaaaactgtt

SEQ ID NO: 132982 - DNA, 20 bp, Artificial
  CRISPR gRNA sequence
aaaaactgtttttctcctca

SEQ ID NO: 132983 - DNA, 20 bp, Artificial
  CRISPR gRNA sequence
tttttctcctcatagatgga

SEQ ID NO: 132984 - DNA, 20 bp, Artificial
  CRISPR gRNA sequence
ttctcctcatagatggatgg

SEQ ID NO: 132985 - DNA, 20 bp, Artificial
  CRISPR gRNA sequence
tctcctcatagatggatggt

SEQ ID NO: 132986 - DNA, 20 bp, Artificial
  CRISPR gRNA sequence
ctcctcatagatggatggtg

SEQ ID NO: 132987 - DNA, 20 bp, Artificial
  CRISPR gRNA sequence
tcctcatagatggatggtga

SEQ ID NO: 132988 - DNA, 20 bp, Artificial
  CRISPR gRNA sequence
ctcatagatggatggtgaca

SEQ ID NO: 132989 - DNA, 20 bp, Artificial
  CRISPR gRNA sequence
atagatggatggtgacagtt

SEQ ID NO: 132990 - DNA, 20 bp, Artificial
  CRISPR gRNA sequence
tacaacagatgcttctcaac

SEQ ID NO: 132991 - DNA, 20 bp, Artificial
  CRISPR gRNA sequence
caacagatgcttctcaacta

SEQ ID NO: 132992 - DNA, 20 bp, Artificial
  CRISPR gRNA sequence
ctcaactaggaatctctgca

SEQ ID NO: 132993 - DNA, 20 bp, Artificial
  CRISPR gRNA sequence
tcaactaggaatctctgcag

SEQ ID NO: 132994 - DNA, 20 bp, Artificial
  CRISPR gRNA sequence
aactaggaatctctgcagac

SEQ ID NO: 132995 - DNA, 20 bp, Artificial
  CRISPR gRNA sequence
ggaatctctgcagactatat

SEQ ID NO: 132996 - DNA, 20 bp, Artificial
  CRISPR gRNA sequence
tgcagactatattggaggaa

SEQ ID NO: 132997 - DNA, 20 bp, Artificial
  CRISPR gRNA sequence
cagactatattggaggaagt

SEQ ID NO: 132998 - DNA, 20 bp, Artificial
  CRISPR gRNA sequence
tattggaggaagtcattatg

SEQ ID NO: 132999 - DNA, 20 bp, Artificial
  CRISPR gRNA sequence
gaggaagtcattatgttata

SEQ ID NO: 133000 - DNA, 20 bp, Artificial
  CRISPR gRNA sequence
tgttatacagcctcatgatg

SEQ ID NO: 133001 - DNA, 20 bp, Artificial
  CRISPR gRNA sequence
tacagcctcatgatggtaag

SEQ ID NO: 133002 - DNA, 20 bp, Artificial
  CRISPR gRNA sequence
atgatggtaagcaagccaca

SEQ ID NO: 133003 - DNA, 20 bp, Artificial
  CRISPR gRNA sequence
gaaccaaattctcaagttga

SEQ ID NO: 133004 - DNA, 20 bp, Artificial
  CRISPR gRNA sequence
tcaagttgaagcaagttaga

SEQ ID NO: 133005 - DNA, 20 bp, Artificial
  CRISPR gRNA sequence
aagttgaagcaagttagaaa

SEQ ID NO: 133006 - DNA, 20 bp, Artificial
  CRISPR gRNA sequence
aagcaagttagaaagtggac

SEQ ID NO: 133007 - DNA, 20 bp, Artificial
  CRISPR gRNA sequence
gaaagtggacatttcattaa

SEQ ID NO: 133008 - DNA, 20 bp, Artificial
  CRISPR gRNA sequence
cattaatatggtgttctagg

SEQ ID NO: 133009 - DNA, 20 bp, Artificial
  CRISPR gRNA sequence
attaatatggtgttctaggc

SEQ ID NO: 133010 - DNA, 20 bp, Artificial
  CRISPR gRNA sequence
atatggtgttctaggctact

SEQ ID NO: 133011 - DNA, 20 bp, Artificial
  CRISPR gRNA sequence
taggctacttgtgtctttat

SEQ ID NO: 133012 - DNA, 20 bp, Artificial
  CRISPR gRNA sequence
ggctacttgtgtctttatag

SEQ ID NO: 133013 - DNA, 20 bp, Artificial
  CRISPR gRNA sequence
cttgtgtctttataggaaaa

SEQ ID NO: 133014 - DNA, 20 bp, Artificial
  CRISPR gRNA sequence
gtgtctttataggaaaattt

SEQ ID NO: 133015 - DNA, 20 bp, Artificial
  CRISPR gRNA sequence
tgtctttataggaaaattta

SEQ ID NO: 133016 - DNA, 20 bp, Artificial
  CRISPR gRNA sequence
tataggaaaatttacaatct

SEQ ID NO: 133017 - DNA, 20 bp, Artificial
  CRISPR gRNA sequence
ataggaaaatttacaatctt

SEQ ID NO: 133018 - DNA, 20 bp, Artificial
  CRISPR gRNA sequence
taggaaaatttacaatcttg

SEQ ID NO: 133019 - DNA, 20 bp, Artificial
  CRISPR gRNA sequence
acaatcttgtgttacggttc

SEQ ID NO: 133020 - DNA, 20 bp, Artificial
  CRISPR gRNA sequence
caatcttgtgttacggttca

SEQ ID NO: 133021 - DNA, 20 bp, Artificial
  CRISPR gRNA sequence
gtgttacggttcaatgagaa

SEQ ID NO: 133022 - DNA, 20 bp, Artificial
  CRISPR gRNA sequence
tgttacggttcaatgagaaa

SEQ ID NO: 133023 - DNA, 20 bp, Artificial
  CRISPR gRNA sequence
cggttcaatgagaaagtcta

SEQ ID NO: 133024 - DNA, 20 bp, Artificial
  CRISPR gRNA sequence
aatgagaaagtctaaaaagg

SEQ ID NO: 133025 - DNA, 20 bp, Artificial
  CRISPR gRNA sequence
aaaaggcgtaccatgctatt

SEQ ID NO: 133026 - DNA, 20 bp, Artificial
  CRISPR gRNA sequence
tttttattagaaatagtctt

SEQ ID NO: 133027 - DNA, 20 bp, Artificial
  CRISPR gRNA sequence
ttattagaaatagtcttcaa

SEQ ID NO: 133028 - DNA, 20 bp, Artificial
  CRISPR gRNA sequence
tattagaaatagtcttcaaa

SEQ ID NO: 133029 - DNA, 20 bp, Artificial
  CRISPR gRNA sequence
attagaaatagtcttcaaaa

SEQ ID NO: 133030 - DNA, 20 bp, Artificial
  CRISPR gRNA sequence
ttagaaatagtcttcaaaag

SEQ ID NO: 133031 - DNA, 20 bp, Artificial
  CRISPR gRNA sequence
gaaatagtcttcaaaagaat

SEQ ID NO: 133032 - DNA, 20 bp, Artificial
  CRISPR gRNA sequence
caaaagaatgagtccttgaa

SEQ ID NO: 133033 - DNA, 20 bp, Artificial
  CRISPR gRNA sequence
aaaagaatgagtccttgaaa

SEQ ID NO: 133034 - DNA, 20 bp, Artificial
  CRISPR gRNA sequence
gaaaagacttttactataaa

SEQ ID NO: 133035 - DNA, 20 bp, Artificial
  CRISPR gRNA sequence
aaaagacttttactataaaa

SEQ ID NO: 133036 - DNA, 20 bp, Artificial
  CRISPR gRNA sequence
ttactataaaaatacacctt

SEQ ID NO: 133037 - DNA, 20 bp, Artificial
  CRISPR gRNA sequence
tactataaaaatacaccttg

SEQ ID NO: 133038 - DNA, 20 bp, Artificial
  CRISPR gRNA sequence
actataaaaatacaccttgt

SEQ ID NO: 133039 - DNA, 20 bp, Artificial
  CRISPR gRNA sequence
ctataaaaatacaccttgtc

SEQ ID NO: 133040 - DNA, 20 bp, Artificial
  CRISPR gRNA sequence
taaaaatacaccttgtctaa

SEQ ID NO: 133041 - DNA, 20 bp, Artificial
  CRISPR gRNA sequence
gtctaaaatctgtacagttt

SEQ ID NO: 133042 - DNA, 20 bp, Artificial
  CRISPR gRNA sequence
tctaaaatctgtacagtttc

SEQ ID NO: 133043 - DNA, 20 bp, Artificial
  CRISPR gRNA sequence
aaatctgtacagtttctttt

SEQ ID NO: 133044 - DNA, 20 bp, Artificial
  CRISPR gRNA sequence
tacagtttcttttaaaattt

SEQ ID NO: 133045 - DNA, 20 bp, Artificial
  CRISPR gRNA sequence
cttttaaaatttgttatcga

SEQ ID NO: 133046 - DNA, 20 bp, Artificial
  CRISPR gRNA sequence
ttttaaaatttgttatcgac

SEQ ID NO: 133047 - DNA, 20 bp, Artificial
  CRISPR gRNA sequence
ttaaaatttgttatcgactt

SEQ ID NO: 133048 - DNA, 20 bp, Artificial
  CRISPR gRNA sequence
taaaatttgttatcgacttc

SEQ ID NO: 133049 - DNA, 20 bp, Artificial
  CRISPR gRNA sequence
aaaatttgttatcgacttcc

SEQ ID NO: 133050 - DNA, 20 bp, Artificial
  CRISPR gRNA sequence
aaatttgttatcgacttcct

SEQ ID NO: 133051 - DNA, 20 bp, Artificial
  CRISPR gRNA sequence
gttatcgacttcctgtttaa

SEQ ID NO: 133052 - DNA, 20 bp, Artificial
  CRISPR gRNA sequence
ttatcgacttcctgtttaaa

SEQ ID NO: 133053 - DNA, 20 bp, Artificial
  CRISPR gRNA sequence
tcgacttcctgtttaaatgt

SEQ ID NO: 133054 - DNA, 20 bp, Artificial
  CRISPR gRNA sequence
cctgtttaaatgttaaataa

SEQ ID NO: 133055 - DNA, 20 bp, Artificial
  CRISPR gRNA sequence
ctgtttaaatgttaaataag

SEQ ID NO: 133056 - DNA, 20 bp, Artificial
  CRISPR gRNA sequence
tttaaatgttaaataagaaa

SEQ ID NO: 133057 - DNA, 20 bp, Artificial
  CRISPR gRNA sequence
aaatgttaaataagaaattt

SEQ ID NO: 133058 - DNA, 20 bp, Artificial
  CRISPR gRNA sequence
aatgttaaataagaaattta

SEQ ID NO: 133059 - DNA, 20 bp, Artificial
  CRISPR gRNA sequence
aataagaaatttataatcaa

SEQ ID NO: 133060 - DNA, 20 bp, Artificial
  CRISPR gRNA sequence
ataatcaattgatagggtaa

SEQ ID NO: 133061 - DNA, 20 bp, Artificial
  CRISPR gRNA sequence
taatcaattgatagggtaac

SEQ ID NO: 133062 - DNA, 20 bp, Artificial
  CRISPR gRNA sequence
atagggtaactaaaataatt

SEQ ID NO: 133063 - DNA, 20 bp, Artificial
  CRISPR gRNA sequence
aaataattatttagagggtg

SEQ ID NO: 133064 - DNA, 20 bp, Artificial
  CRISPR gRNA sequence
tttagagggtgagttaaatt

SEQ ID NO: 133065 - DNA, 20 bp, Artificial
  CRISPR gRNA sequence
agagggtgagttaaatttct

SEQ ID NO: 133066 - DNA, 20 bp, Artificial
  CRISPR gRNA sequence
gagggtgagttaaatttcta

SEQ ID NO: 133067 - DNA, 20 bp, Artificial
  CRISPR gRNA sequence
aatttctagctattatattt

SEQ ID NO: 133068 - DNA, 20 bp, Artificial
  CRISPR gRNA sequence
ctagctattatatttcttgc

SEQ ID NO: 133069 - DNA, 20 bp, Artificial
  CRISPR gRNA sequence
tagctattatatttcttgca

SEQ ID NO: 133070 - DNA, 20 bp, Artificial
  CRISPR gRNA sequence
gctattatatttcttgcact

SEQ ID NO: 133071 - DNA, 20 bp, Artificial
  CRISPR gRNA sequence
ttatatttcttgcacttatg

SEQ ID NO: 133072 - DNA, 20 bp, Artificial
  CRISPR gRNA sequence
tatttcttgcacttatgatt

SEQ ID NO: 133073 - DNA, 20 bp, Artificial
  CRISPR gRNA sequence
cttgcacttatgatttattt

SEQ ID NO: 133074 - DNA, 20 bp, Artificial
  CRISPR gRNA sequence
ttgcacttatgatttatttt

SEQ ID NO: 133075 - DNA, 20 bp, Artificial
  CRISPR gRNA sequence
gcacttatgatttatttttg

SEQ ID NO: 133076 - DNA, 20 bp, Artificial
  CRISPR gRNA sequence
cacttatgatttatttttgg

SEQ ID NO: 133077 - DNA, 20 bp, Artificial
  CRISPR gRNA sequence
atgatttatttttggttttc

SEQ ID NO: 133078 - DNA, 20 bp, Artificial
  CRISPR gRNA sequence
tgatttatttttggttttca

SEQ ID NO: 133079 - DNA, 20 bp, Artificial
  CRISPR gRNA sequence
atttttggttttcattcaat

SEQ ID NO: 133080 - DNA, 20 bp, Artificial
  CRISPR gRNA sequence
tttttggttttcattcaata

SEQ ID NO: 133081 - DNA, 20 bp, Artificial
  CRISPR gRNA sequence
ttggttttcattcaatatta

SEQ ID NO: 133082 - DNA, 20 bp, Artificial
  CRISPR gRNA sequence
tggttttcattcaatattaa

SEQ ID NO: 133083 - DNA, 20 bp, Artificial
  CRISPR gRNA sequence
ggttttcattcaatattaac

SEQ ID NO: 133084 - DNA, 20 bp, Artificial
  CRISPR gRNA sequence
gttttcattcaatattaact

SEQ ID NO: 133085 - DNA, 20 bp, Artificial
  CRISPR gRNA sequence
tcattcaatattaactttga

SEQ ID NO: 133086 - DNA, 20 bp, Artificial
  CRISPR gRNA sequence
cattcaatattaactttgaa

SEQ ID NO: 133087 - DNA, 20 bp, Artificial
  CRISPR gRNA sequence
attcaatattaactttgaac

SEQ ID NO: 133088 - DNA, 20 bp, Artificial
  CRISPR gRNA sequence
aatattaactttgaactatg

SEQ ID NO: 133089 - DNA, 20 bp, Artificial
  CRISPR gRNA sequence
actttgaactatgtcaggta

SEQ ID NO: 133090 - DNA, 20 bp, Artificial
  CRISPR gRNA sequence
tgaactatgtcaggtattag

SEQ ID NO: 133091 - DNA, 20 bp, Artificial
  CRISPR gRNA sequence
gaactatgtcaggtattaga

SEQ ID NO: 133092 - DNA, 20 bp, Artificial
  CRISPR gRNA sequence
aactatgtcaggtattagaa

SEQ ID NO: 133093 - DNA, 20 bp, Artificial
  CRISPR gRNA sequence
tgtcaggtattagaatggta

SEQ ID NO: 133094 - DNA, 20 bp, Artificial
  CRISPR gRNA sequence
gaatggtagtgttggctcag

SEQ ID NO: 133095 - DNA, 20 bp, Artificial
  CRISPR gRNA sequence
gctcagtgtggtgctcacac

SEQ ID NO: 133096 - DNA, 20 bp, Artificial
  CRISPR gRNA sequence
agtgtggtgctcacacctat

SEQ ID NO: 133097 - DNA, 20 bp, Artificial
  CRISPR gRNA sequence
acacctataatcccagcagt

SEQ ID NO: 133098 - DNA, 20 bp, Artificial
  CRISPR gRNA sequence
taatcccagcagtttgggag

SEQ ID NO: 133099 - DNA, 20 bp, Artificial
  CRISPR gRNA sequence
gggagggcaaggtgggcaga

SEQ ID NO: 133100 - DNA, 20 bp, Artificial
  CRISPR gRNA sequence
ggagggcaaggtgggcagat

SEQ ID NO: 133101 - DNA, 20 bp, Artificial
  CRISPR gRNA sequence
gagctcaggagttcgagacc

SEQ ID NO: 133102 - DNA, 20 bp, Artificial
  CRISPR gRNA sequence
agctcaggagttcgagacca

SEQ ID NO: 133103 - DNA, 20 bp, Artificial
  CRISPR gRNA sequence
aggagttcgagaccagcctg

SEQ ID NO: 133104 - DNA, 20 bp, Artificial
  CRISPR gRNA sequence
gagaccagcctgggcaacat

SEQ ID NO: 133105 - DNA, 20 bp, Artificial
  CRISPR gRNA sequence
ggcaacatggtgaaacccca

SEQ ID NO: 133106 - DNA, 20 bp, Artificial
  CRISPR gRNA sequence
tacaaaaaaattaaaaaatt

SEQ ID NO: 133107 - DNA, 20 bp, Artificial
  CRISPR gRNA sequence
caaaaaaattaaaaaattag

SEQ ID NO: 133108 - DNA, 20 bp, Artificial
  CRISPR gRNA sequence
aaaaattagctgtgcttggt

SEQ ID NO: 133109 - DNA, 20 bp, Artificial
  CRISPR gRNA sequence
gctgtgcttggtggcatgta

SEQ ID NO: 133110 - DNA, 20 bp, Artificial
  CRISPR gRNA sequence
tgcttggtggcatgtacctg

SEQ ID NO: 133111 - DNA, 20 bp, Artificial
  CRISPR gRNA sequence
ggtggcatgtacctgtagtc

SEQ ID NO: 133112 - DNA, 20 bp, Artificial
  CRISPR gRNA sequence
gtggcatgtacctgtagtcc

SEQ ID NO: 133113 - DNA, 20 bp, Artificial
  CRISPR gRNA sequence
tagtcccagctacttagggg

SEQ ID NO: 133114 - DNA, 20 bp, Artificial
  CRISPR gRNA sequence
cttagggggctgggggctga

SEQ ID NO: 133115 - DNA, 20 bp, Artificial
  CRISPR gRNA sequence
agggggctgggggctgaggt

SEQ ID NO: 133116 - DNA, 20 bp, Artificial
  CRISPR gRNA sequence
gggggctgggggctgaggtg

SEQ ID NO: 133117 - DNA, 20 bp, Artificial
  CRISPR gRNA sequence
ggggctgaggtgggaggatt

SEQ ID NO: 133118 - DNA, 20 bp, Artificial
  CRISPR gRNA sequence
aggtgggaggattgcttgaa

SEQ ID NO: 133119 - DNA, 20 bp, Artificial
  CRISPR gRNA sequence
cttgaatctgggaggtagag

SEQ ID NO: 133120 - DNA, 20 bp, Artificial
  CRISPR gRNA sequence
gaatctgggaggtagaggct

SEQ ID NO: 133121 - DNA, 20 bp, Artificial
  CRISPR gRNA sequence
aatctgggaggtagaggctt

SEQ ID NO: 133122 - DNA, 20 bp, Artificial
  CRISPR gRNA sequence
ggaggtagaggcttcagtga

SEQ ID NO: 133123 - DNA, 20 bp, Artificial
  CRISPR gRNA sequence
cagtgagccatgtttgcacc

SEQ ID NO: 133124 - DNA, 20 bp, Artificial
  CRISPR gRNA sequence
agtgagccatgtttgcacca

SEQ ID NO: 133125 - DNA, 20 bp, Artificial
  CRISPR gRNA sequence
gcaccactgcacactccagc

SEQ ID NO: 133126 - DNA, 20 bp, Artificial
  CRISPR gRNA sequence
caccactgcacactccagcc

SEQ ID NO: 133127 - DNA, 20 bp, Artificial
  CRISPR gRNA sequence
cacactccagcctgggtgac

SEQ ID NO: 133128 - DNA, 20 bp, Artificial
  CRISPR gRNA sequence
cagcctgggtgacaaagtgc

SEQ ID NO: 133129 - DNA, 20 bp, Artificial
  CRISPR gRNA sequence
ggtgacaaagtgcaaagtga

SEQ ID NO: 133130 - DNA, 20 bp, Artificial
  CRISPR gRNA sequence
tctccaaaaaaaaaaaaaaa

SEQ ID NO: 133131 - DNA, 20 bp, Artificial
  CRISPR gRNA sequence
caaaaaaaaaaaaaaaaaaa

SEQ ID NO: 133132 - DNA, 20 bp, Artificial
  CRISPR gRNA sequence
tgttggcctatcagaaataa

SEQ ID NO: 133133 - DNA, 20 bp, Artificial
  CRISPR gRNA sequence
gcctatcagaaataatttac

SEQ ID NO: 133134 - DNA, 20 bp, Artificial
  CRISPR gRNA sequence
tcagaaataatttacttttg

SEQ ID NO: 133135 - DNA, 20 bp, Artificial
  CRISPR gRNA sequence
acttttgtggcattttggtt

SEQ ID NO: 133136 - DNA, 20 bp, Artificial
  CRISPR gRNA sequence
cttttgtggcattttggttt

SEQ ID NO: 133137 - DNA, 20 bp, Artificial
  CRISPR gRNA sequence
ttgtggcattttggtttgta

SEQ ID NO: 133138 - DNA, 20 bp, Artificial
  CRISPR gRNA sequence
tgtggcattttggtttgtaa

SEQ ID NO: 133139 - DNA, 20 bp, Artificial
  CRISPR gRNA sequence
gtggcattttggtttgtaaa

SEQ ID NO: 133140 - DNA, 20 bp, Artificial
  CRISPR gRNA sequence
tggcattttggtttgtaaaa

SEQ ID NO: 133141 - DNA, 20 bp, Artificial
  CRISPR gRNA sequence
tggtttgtaaaaaaaatttt

SEQ ID NO: 133142 - DNA, 20 bp, Artificial
  CRISPR gRNA sequence
ggtttgtaaaaaaaattttt

SEQ ID NO: 133143 - DNA, 20 bp, Artificial
  CRISPR gRNA sequence
gtttgtaaaaaaaatttttt

SEQ ID NO: 133144 - DNA, 20 bp, Artificial
  CRISPR gRNA sequence
gtaaaaaaaatttttttttt

SEQ ID NO: 133145 - DNA, 20 bp, Artificial
  CRISPR gRNA sequence
taaaaaaaattttttttttt

SEQ ID NO: 133146 - DNA, 20 bp, Artificial
  CRISPR gRNA sequence
tttttttttttttatttttt

SEQ ID NO: 133147 - DNA, 20 bp, Artificial
  CRISPR gRNA sequence
ttttttttttttatttttta

SEQ ID NO: 133148 - DNA, 20 bp, Artificial
  CRISPR gRNA sequence
tttttttttttattttttat

SEQ ID NO: 133149 - DNA, 20 bp, Artificial
  CRISPR gRNA sequence
ttttttttttattttttatt

SEQ ID NO: 133150 - DNA, 20 bp, Artificial
  CRISPR gRNA sequence
tttttttttattttttattt

SEQ ID NO: 133151 - DNA, 20 bp, Artificial
  CRISPR gRNA sequence
ttttttttattttttatttt

SEQ ID NO: 133152 - DNA, 20 bp, Artificial
  CRISPR gRNA sequence
tttttttattttttattttt

SEQ ID NO: 133153 - DNA, 20 bp, Artificial
  CRISPR gRNA sequence
ttttttattttttatttttt

SEQ ID NO: 133154 - DNA, 20 bp, Artificial
  CRISPR gRNA sequence
tttttattttttattttttt

SEQ ID NO: 133155 - DNA, 20 bp, Artificial
  CRISPR gRNA sequence
ttttattttttatttttttt

SEQ ID NO: 133156 - DNA, 20 bp, Artificial
  CRISPR gRNA sequence
tttattttttattttttttg

SEQ ID NO: 133157 - DNA, 20 bp, Artificial
  CRISPR gRNA sequence
ttattttttattttttttga

SEQ ID NO: 133158 - DNA, 20 bp, Artificial
  CRISPR gRNA sequence
tattttttattttttttgag

SEQ ID NO: 133159 - DNA, 20 bp, Artificial
  CRISPR gRNA sequence
attttttattttttttgaga

SEQ ID NO: 133160 - DNA, 20 bp, Artificial
  CRISPR gRNA sequence
ttttttattttttttgagat

SEQ ID NO: 133161 - DNA, 20 bp, Artificial
  CRISPR gRNA sequence
tttattttttttgagatgga

SEQ ID NO: 133162 - DNA, 20 bp, Artificial
  CRISPR gRNA sequence
ttattttttttgagatggag

SEQ ID NO: 133163 - DNA, 20 bp, Artificial
  CRISPR gRNA sequence
tattttttttgagatggagt

SEQ ID NO: 133164 - DNA, 20 bp, Artificial
  CRISPR gRNA sequence
attttttttgagatggagtc

SEQ ID NO: 133165 - DNA, 20 bp, Artificial
  CRISPR gRNA sequence
ttttttttgagatggagtct

SEQ ID NO: 133166 - DNA, 20 bp, Artificial
  CRISPR gRNA sequence
tttttgagatggagtcttgc

SEQ ID NO: 133167 - DNA, 20 bp, Artificial
  CRISPR gRNA sequence
ttttgagatggagtcttgct

SEQ ID NO: 133168 - DNA, 20 bp, Artificial
  CRISPR gRNA sequence
tttgagatggagtcttgctc

SEQ ID NO: 133169 - DNA, 20 bp, Artificial
  CRISPR gRNA sequence
ttgagatggagtcttgctct

SEQ ID NO: 133170 - DNA, 20 bp, Artificial
  CRISPR gRNA sequence
tgagatggagtcttgctctg

SEQ ID NO: 133171 - DNA, 20 bp, Artificial
  CRISPR gRNA sequence
gagatggagtcttgctctgt

SEQ ID NO: 133172 - DNA, 20 bp, Artificial
  CRISPR gRNA sequence
agatggagtcttgctctgtc

SEQ ID NO: 133173 - DNA, 20 bp, Artificial
  CRISPR gRNA sequence
gctctgtcgcccaggctgga

SEQ ID NO: 133174 - DNA, 20 bp, Artificial
  CRISPR gRNA sequence
ctctgtcgcccaggctggag

SEQ ID NO: 133175 - DNA, 20 bp, Artificial
  CRISPR gRNA sequence
tgtcgcccaggctggagtgc

SEQ ID NO: 133176 - DNA, 20 bp, Artificial
  CRISPR gRNA sequence
tcgcccaggctggagtgcag

SEQ ID NO: 133177 - DNA, 20 bp, Artificial
  CRISPR gRNA sequence
gagtgcagtggcacaatctt

SEQ ID NO: 133178 - DNA, 20 bp, Artificial
  CRISPR gRNA sequence
ggctcactgcaacctccgcc

SEQ ID NO: 133179 - DNA, 20 bp, Artificial
  CRISPR gRNA sequence
gctcactgcaacctccgcct

SEQ ID NO: 133180 - DNA, 20 bp, Artificial
  CRISPR gRNA sequence
actgcaacctccgcctcctg

SEQ ID NO: 133181 - DNA, 20 bp, Artificial
  CRISPR gRNA sequence
caacctccgcctcctgggtt

SEQ ID NO: 133182 - DNA, 20 bp, Artificial
  CRISPR gRNA sequence
cgcctcctgggttcaagcaa

SEQ ID NO: 133183 - DNA, 20 bp, Artificial
  CRISPR gRNA sequence
ctgggttcaagcaattctcc

SEQ ID NO: 133184 - DNA, 20 bp, Artificial
  CRISPR gRNA sequence
ggttcaagcaattctcctgc

SEQ ID NO: 133185 - DNA, 20 bp, Artificial
  CRISPR gRNA sequence
aagcaattctcctgcctcag

SEQ ID NO: 133186 - DNA, 20 bp, Artificial
  CRISPR gRNA sequence
tcctgcctcagcctgcccgt

SEQ ID NO: 133187 - DNA, 20 bp, Artificial
  CRISPR gRNA sequence
ctgcctcagcctgcccgtta

SEQ ID NO: 133188 - DNA, 20 bp, Artificial
  CRISPR gRNA sequence
cctcagcctgcccgttagct

SEQ ID NO: 133189 - DNA, 20 bp, Artificial
  CRISPR gRNA sequence
agcctgcccgttagctgaga

SEQ ID NO: 133190 - DNA, 20 bp, Artificial
  CRISPR gRNA sequence
cccgttagctgagatcacag

SEQ ID NO: 133191 - DNA, 20 bp, Artificial
  CRISPR gRNA sequence
gctgagatcacaggcgccca

SEQ ID NO: 133192 - DNA, 20 bp, Artificial
  CRISPR gRNA sequence
agatcacaggcgcccagcac

SEQ ID NO: 133193 - DNA, 20 bp, Artificial
  CRISPR gRNA sequence
atttttttttagtagagaca

SEQ ID NO: 133194 - DNA, 20 bp, Artificial
  CRISPR gRNA sequence
ttttttagtagagacagggt

SEQ ID NO: 133195 - DNA, 20 bp, Artificial
  CRISPR gRNA sequence
tttttagtagagacagggtt

SEQ ID NO: 133196 - DNA, 20 bp, Artificial
  CRISPR gRNA sequence
ttttagtagagacagggttt

SEQ ID NO: 133197 - DNA, 20 bp, Artificial
  CRISPR gRNA sequence
tttagtagagacagggtttc

SEQ ID NO: 133198 - DNA, 20 bp, Artificial
  CRISPR gRNA sequence
ttagtagagacagggtttcg

SEQ ID NO: 133199 - DNA, 20 bp, Artificial
  CRISPR gRNA sequence
tagtagagacagggtttcgc

SEQ ID NO: 133200 - DNA, 20 bp, Artificial
  CRISPR gRNA sequence
agtagagacagggtttcgct

SEQ ID NO: 133201 - DNA, 20 bp, Artificial
  CRISPR gRNA sequence
gtagagacagggtttcgctg

SEQ ID NO: 133202 - DNA, 20 bp, Artificial
  CRISPR gRNA sequence
cgctgtgttggtcaggctgg

SEQ ID NO: 133203 - DNA, 20 bp, Artificial
  CRISPR gRNA sequence
gctgtgttggtcaggctggt

SEQ ID NO: 133204 - DNA, 20 bp, Artificial
  CRISPR gRNA sequence
tgttggtcaggctggtctca

SEQ ID NO: 133205 - DNA, 20 bp, Artificial
  CRISPR gRNA sequence
gtcaggctggtctcaaactc

SEQ ID NO: 133206 - DNA, 20 bp, Artificial
  CRISPR gRNA sequence
gtctcaaactcgtgacctca

SEQ ID NO: 133207 - DNA, 20 bp, Artificial
  CRISPR gRNA sequence
aaactcgtgacctcagatga

SEQ ID NO: 133208 - DNA, 20 bp, Artificial
  CRISPR gRNA sequence
gtgacctcagatgatctgcc

SEQ ID NO: 133209 - DNA, 20 bp, Artificial
  CRISPR gRNA sequence
agatgatctgcctgcttcag

SEQ ID NO: 133210 - DNA, 20 bp, Artificial
  CRISPR gRNA sequence
cctgcttcagcctcccaaag

SEQ ID NO: 133211 - DNA, 20 bp, Artificial
  CRISPR gRNA sequence
cttcagcctcccaaagtgct

SEQ ID NO: 133212 - DNA, 20 bp, Artificial
  CRISPR gRNA sequence
cagcctcccaaagtgctggg

SEQ ID NO: 133213 - DNA, 20 bp, Artificial
  CRISPR gRNA sequence
agcctcccaaagtgctggga

SEQ ID NO: 133214 - DNA, 20 bp, Artificial
  CRISPR gRNA sequence
ccaaagtgctgggattatag

SEQ ID NO: 133215 - DNA, 20 bp, Artificial
  CRISPR gRNA sequence
ggattatagtcatgagccac

SEQ ID NO: 133216 - DNA, 20 bp, Artificial
  CRISPR gRNA sequence
tagtcatgagccaccacgcc

SEQ ID NO: 133217 - DNA, 20 bp, Artificial
  CRISPR gRNA sequence
gcctgatttgtaaaattttt

SEQ ID NO: 133218 - DNA, 20 bp, Artificial
  CRISPR gRNA sequence
atttgtaaaatttttaaaaa

SEQ ID NO: 133219 - DNA, 20 bp, Artificial
  CRISPR gRNA sequence
gtaaaatttttaaaaattga

SEQ ID NO: 133220 - DNA, 20 bp, Artificial
  CRISPR gRNA sequence
taaaatttttaaaaattgag

SEQ ID NO: 133221 - DNA, 20 bp, Artificial
  CRISPR gRNA sequence
ttaaaaattgagatatattt

SEQ ID NO: 133222 - DNA, 20 bp, Artificial
  CRISPR gRNA sequence
taaaaattgagatatatttt

SEQ ID NO: 133223 - DNA, 20 bp, Artificial
  CRISPR gRNA sequence
aaaaattgagatatattttt

SEQ ID NO: 133224 - DNA, 20 bp, Artificial
  CRISPR gRNA sequence
aaaattgagatatattttta

SEQ ID NO: 133225 - DNA, 20 bp, Artificial
  CRISPR gRNA sequence
agatatatttttagaagaaa

SEQ ID NO: 133226 - DNA, 20 bp, Artificial
  CRISPR gRNA sequence
ttagaagaaacttgccagag

SEQ ID NO: 133227 - DNA, 20 bp, Artificial
  CRISPR gRNA sequence
tagaagaaacttgccagagg

SEQ ID NO: 133228 - DNA, 20 bp, Artificial
  CRISPR gRNA sequence
agaagaaacttgccagaggg

SEQ ID NO: 133229 - DNA, 20 bp, Artificial
  CRISPR gRNA sequence
gaagaaacttgccagaggga

SEQ ID NO: 133230 - DNA, 20 bp, Artificial
  CRISPR gRNA sequence
gccagagggattaatttcat

SEQ ID NO: 133231 - DNA, 20 bp, Artificial
  CRISPR gRNA sequence
ccagagggattaatttcatc

SEQ ID NO: 133232 - DNA, 20 bp, Artificial
  CRISPR gRNA sequence
atttcatcctgaaacggata

SEQ ID NO: 133233 - DNA, 20 bp, Artificial
  CRISPR gRNA sequence
catcctgaaacggatattca

SEQ ID NO: 133234 - DNA, 20 bp, Artificial
  CRISPR gRNA sequence
atcctgaaacggatattcaa

SEQ ID NO: 133235 - DNA, 20 bp, Artificial
  CRISPR gRNA sequence
aaacggatattcaaataaat

SEQ ID NO: 133236 - DNA, 20 bp, Artificial
  CRISPR gRNA sequence
aaataaattaattctgataa

SEQ ID NO: 133237 - DNA, 20 bp, Artificial
  CRISPR gRNA sequence
attctgataacatcatttta

SEQ ID NO: 133238 - DNA, 20 bp, Artificial
  CRISPR gRNA sequence
tgataacatcattttaaaca

SEQ ID NO: 133239 - DNA, 20 bp, Artificial
  CRISPR gRNA sequence
ataacatcattttaaacaca

SEQ ID NO: 133240 - DNA, 20 bp, Artificial
  CRISPR gRNA sequence
taaacacataaaaacgtaaa

SEQ ID NO: 133241 - DNA, 20 bp, Artificial
  CRISPR gRNA sequence
aaacacataaaaacgtaaat

SEQ ID NO: 133242 - DNA, 20 bp, Artificial
  CRISPR gRNA sequence
aacacataaaaacgtaaatt

SEQ ID NO: 133243 - DNA, 20 bp, Artificial
  CRISPR gRNA sequence
aatcaacttaagtgccttgc

SEQ ID NO: 133244 - DNA, 20 bp, Artificial
  CRISPR gRNA sequence
aagtgccttgcctccttact

SEQ ID NO: 133245 - DNA, 20 bp, Artificial
  CRISPR gRNA sequence
agtgccttgcctccttactt

SEQ ID NO: 133246 - DNA, 20 bp, Artificial
  CRISPR gRNA sequence
gcctccttacttagtacata

SEQ ID NO: 133247 - DNA, 20 bp, Artificial
  CRISPR gRNA sequence
cctccttacttagtacatat

SEQ ID NO: 133248 - DNA, 20 bp, Artificial
  CRISPR gRNA sequence
cttacttagtacatatgaag

SEQ ID NO: 133249 - DNA, 20 bp, Artificial
  CRISPR gRNA sequence
acttagtacatatgaagagt

SEQ ID NO: 133250 - DNA, 20 bp, Artificial
  CRISPR gRNA sequence
cttagtacatatgaagagtg

SEQ ID NO: 133251 - DNA, 20 bp, Artificial
  CRISPR gRNA sequence
agtacatatgaagagtgggc

SEQ ID NO: 133252 - DNA, 20 bp, Artificial
  CRISPR gRNA sequence
gtacatatgaagagtgggca

SEQ ID NO: 133253 - DNA, 20 bp, Artificial
  CRISPR gRNA sequence
acttacaggatactgcattt

SEQ ID NO: 133254 - DNA, 20 bp, Artificial
  CRISPR gRNA sequence
cttacaggatactgcattta

SEQ ID NO: 133255 - DNA, 20 bp, Artificial
  CRISPR gRNA sequence
acaggatactgcatttagtc

SEQ ID NO: 133256 - DNA, 20 bp, Artificial
  CRISPR gRNA sequence
caggatactgcatttagtca

SEQ ID NO: 133257 - DNA, 20 bp, Artificial
  CRISPR gRNA sequence
catttagtcataaaaggatg

SEQ ID NO: 133258 - DNA, 20 bp, Artificial
  CRISPR gRNA sequence
agtcataaaaggatgttatt

SEQ ID NO: 133259 - DNA, 20 bp, Artificial
  CRISPR gRNA sequence
gtcataaaaggatgttattg

SEQ ID NO: 133260 - DNA, 20 bp, Artificial
  CRISPR gRNA sequence
ttggtactgcgcaagcttca

SEQ ID NO: 133261 - DNA, 20 bp, Artificial
  CRISPR gRNA sequence
gtactgcgcaagcttcagtt

SEQ ID NO: 133262 - DNA, 20 bp, Artificial
  CRISPR gRNA sequence
cgcaagcttcagttatagct

SEQ ID NO: 133263 - DNA, 20 bp, Artificial
  CRISPR gRNA sequence
cagttatagctaaatttata

SEQ ID NO: 133264 - DNA, 20 bp, Artificial
  CRISPR gRNA sequence
agttatagctaaatttatat

SEQ ID NO: 133265 - DNA, 20 bp, Artificial
  CRISPR gRNA sequence
tagctaaatttatataattt

SEQ ID NO: 133266 - DNA, 20 bp, Artificial
  CRISPR gRNA sequence
aatttatataatttgaaaag

SEQ ID NO: 133267 - DNA, 20 bp, Artificial
  CRISPR gRNA sequence
atataatttgaaaagtccct

SEQ ID NO: 133268 - DNA, 20 bp, Artificial
  CRISPR gRNA sequence
tataatttgaaaagtccctt

SEQ ID NO: 133269 - DNA, 20 bp, Artificial
  CRISPR gRNA sequence
gaaaagtccctttttgtatg

SEQ ID NO: 133270 - DNA, 20 bp, Artificial
  CRISPR gRNA sequence
aaaagtccctttttgtatga

SEQ ID NO: 133271 - DNA, 20 bp, Artificial
  CRISPR gRNA sequence
tttgtatgaacagttggatc

SEQ ID NO: 133272 - DNA, 20 bp, Artificial
  CRISPR gRNA sequence
ttgtatgaacagttggatca

SEQ ID NO: 133273 - DNA, 20 bp, Artificial
  CRISPR gRNA sequence
tgtatgaacagttggatcac

SEQ ID NO: 133274 - DNA, 20 bp, Artificial
  CRISPR gRNA sequence
gtatgaacagttggatcact

SEQ ID NO: 133275 - DNA, 20 bp, Artificial
  CRISPR gRNA sequence
tatgaacagttggatcactg

SEQ ID NO: 133276 - DNA, 20 bp, Artificial
  CRISPR gRNA sequence
gatcactgctctagctttgt

SEQ ID NO: 133277 - DNA, 20 bp, Artificial
  CRISPR gRNA sequence
ctctagctttgttcaaaaac

SEQ ID NO: 133278 - DNA, 20 bp, Artificial
  CRISPR gRNA sequence
tagctttgttcaaaaactag

SEQ ID NO: 133279 - DNA, 20 bp, Artificial
  CRISPR gRNA sequence
gctttgttcaaaaactagtt

SEQ ID NO: 133280 - DNA, 20 bp, Artificial
  CRISPR gRNA sequence
tgttcaaaaactagttacat

SEQ ID NO: 133281 - DNA, 20 bp, Artificial
  CRISPR gRNA sequence
gttcaaaaactagttacatt

SEQ ID NO: 133282 - DNA, 20 bp, Artificial
  CRISPR gRNA sequence
ttcaaaaactagttacatta

SEQ ID NO: 133283 - DNA, 20 bp, Artificial
  CRISPR gRNA sequence
aaaaactagttacattagta

SEQ ID NO: 133284 - DNA, 20 bp, Artificial
  CRISPR gRNA sequence
gttacattagtaagccaact

SEQ ID NO: 133285 - DNA, 20 bp, Artificial
  CRISPR gRNA sequence
cattagtaagccaactggat

SEQ ID NO: 133286 - DNA, 20 bp, Artificial
  CRISPR gRNA sequence
gtaagccaactggatcagta

SEQ ID NO: 133287 - DNA, 20 bp, Artificial
  CRISPR gRNA sequence
gatcagtaataatcaagtcc

SEQ ID NO: 133288 - DNA, 20 bp, Artificial
  CRISPR gRNA sequence
ttccattctttaaagaattt

SEQ ID NO: 133289 - DNA, 20 bp, Artificial
  CRISPR gRNA sequence
tccattctttaaagaatttt

SEQ ID NO: 133290 - DNA, 20 bp, Artificial
  CRISPR gRNA sequence
ccattctttaaagaatttta

SEQ ID NO: 133291 - DNA, 20 bp, Artificial
  CRISPR gRNA sequence
cattctttaaagaattttat

SEQ ID NO: 133292 - DNA, 20 bp, Artificial
  CRISPR gRNA sequence
tttaaagaattttatataaa

SEQ ID NO: 133293 - DNA, 20 bp, Artificial
  CRISPR gRNA sequence
taaagaattttatataaact

SEQ ID NO: 133294 - DNA, 20 bp, Artificial
  CRISPR gRNA sequence
aaagaattttatataaactt

SEQ ID NO: 133295 - DNA, 20 bp, Artificial
  CRISPR gRNA sequence
aagaattttatataaacttt

SEQ ID NO: 133296 - DNA, 20 bp, Artificial
  CRISPR gRNA sequence
tatataaactttatacagac

SEQ ID NO: 133297 - DNA, 20 bp, Artificial
  CRISPR gRNA sequence
atataaactttatacagaca

SEQ ID NO: 133298 - DNA, 20 bp, Artificial
  CRISPR gRNA sequence
tataaactttatacagacaa

SEQ ID NO: 133299 - DNA, 20 bp, Artificial
  CRISPR gRNA sequence
tatacagacaagacaacttt

SEQ ID NO: 133300 - DNA, 20 bp, Artificial
  CRISPR gRNA sequence
atacagacaagacaacttta

SEQ ID NO: 133301 - DNA, 20 bp, Artificial
  CRISPR gRNA sequence
tacagacaagacaactttat

SEQ ID NO: 133302 - DNA, 20 bp, Artificial
  CRISPR gRNA sequence
tatatcaactttaaaagttt

SEQ ID NO: 133303 - DNA, 20 bp, Artificial
  CRISPR gRNA sequence
atatcaactttaaaagtttt

SEQ ID NO: 133304 - DNA, 20 bp, Artificial
  CRISPR gRNA sequence
tatcaactttaaaagtttta

SEQ ID NO: 133305 - DNA, 20 bp, Artificial
  CRISPR gRNA sequence
taaaagttttatatagactt

SEQ ID NO: 133306 - DNA, 20 bp, Artificial
  CRISPR gRNA sequence
aaaagttttatatagacttt

SEQ ID NO: 133307 - DNA, 20 bp, Artificial
  CRISPR gRNA sequence
aaagttttatatagactttt

SEQ ID NO: 133308 - DNA, 20 bp, Artificial
  CRISPR gRNA sequence
tatatagacttttacataaa

SEQ ID NO: 133309 - DNA, 20 bp, Artificial
  CRISPR gRNA sequence
atatagacttttacataaat

SEQ ID NO: 133310 - DNA, 20 bp, Artificial
  CRISPR gRNA sequence
tatagacttttacataaatg

SEQ ID NO: 133311 - DNA, 20 bp, Artificial
  CRISPR gRNA sequence
ttacataaatgagtttatat

SEQ ID NO: 133312 - DNA, 20 bp, Artificial
  CRISPR gRNA sequence
tacataaatgagtttatata

SEQ ID NO: 133313 - DNA, 20 bp, Artificial
  CRISPR gRNA sequence
acataaatgagtttatataa

SEQ ID NO: 133314 - DNA, 20 bp, Artificial
  CRISPR gRNA sequence
cataaatgagtttatataaa

SEQ ID NO: 133315 - DNA, 20 bp, Artificial
  CRISPR gRNA sequence
atataaacttgggtttggag

SEQ ID NO: 133316 - DNA, 20 bp, Artificial
  CRISPR gRNA sequence
tataaacttgggtttggaga

SEQ ID NO: 133317 - DNA, 20 bp, Artificial
  CRISPR gRNA sequence
gggtttggagaaacatacaa

SEQ ID NO: 133318 - DNA, 20 bp, Artificial
  CRISPR gRNA sequence
ggtttggagaaacatacaac

SEQ ID NO: 133319 - DNA, 20 bp, Artificial
  CRISPR gRNA sequence
ggagaaacatacaacctctt

SEQ ID NO: 133320 - DNA, 20 bp, Artificial
  CRISPR gRNA sequence
gagaaacatacaacctctta

SEQ ID NO: 133321 - DNA, 20 bp, Artificial
  CRISPR gRNA sequence
ttaatctagcagtattgaag

SEQ ID NO: 133322 - DNA, 20 bp, Artificial
  CRISPR gRNA sequence
aatctagcagtattgaagga

SEQ ID NO: 133323 - DNA, 20 bp, Artificial
  CRISPR gRNA sequence
atctagcagtattgaaggag

SEQ ID NO: 133324 - DNA, 20 bp, Artificial
  CRISPR gRNA sequence
gcagtattgaaggagccata

SEQ ID NO: 133325 - DNA, 20 bp, Artificial
  CRISPR gRNA sequence
aaggagccataggttacggt

SEQ ID NO: 133326 - DNA, 20 bp, Artificial
  CRISPR gRNA sequence
cggtctgtaagttttatagc

SEQ ID NO: 133327 - DNA, 20 bp, Artificial
  CRISPR gRNA sequence
taagttttatagctaagtcg

SEQ ID NO: 133328 - DNA, 20 bp, Artificial
  CRISPR gRNA sequence
tatagctaagtcgtataata

SEQ ID NO: 133329 - DNA, 20 bp, Artificial
  CRISPR gRNA sequence
atagctaagtcgtataataa

SEQ ID NO: 133330 - DNA, 20 bp, Artificial
  CRISPR gRNA sequence
tagctaagtcgtataataaa

SEQ ID NO: 133331 - DNA, 20 bp, Artificial
  CRISPR gRNA sequence
agtcgtataataaatattta

SEQ ID NO: 133332 - DNA, 20 bp, Artificial
  CRISPR gRNA sequence
atgagtacctactctgtgga

SEQ ID NO: 133333 - DNA, 20 bp, Artificial
  CRISPR gRNA sequence
tgagtacctactctgtggaa

SEQ ID NO: 133334 - DNA, 20 bp, Artificial
  CRISPR gRNA sequence
ctctgtggaaggtgctgtac

SEQ ID NO: 133335 - DNA, 20 bp, Artificial
  CRISPR gRNA sequence
tgtggaaggtgctgtaccaa

SEQ ID NO: 133336 - DNA, 20 bp, Artificial
  CRISPR gRNA sequence
tggaaggtgctgtaccaagc

SEQ ID NO: 133337 - DNA, 20 bp, Artificial
  CRISPR gRNA sequence
taccaagctgtaggaaacac

SEQ ID NO: 133338 - DNA, 20 bp, Artificial
  CRISPR gRNA sequence
taggaaacacaaagctgatt

SEQ ID NO: 133339 - DNA, 20 bp, Artificial
  CRISPR gRNA sequence
attcgtgacattaagtagca

SEQ ID NO: 133340 - DNA, 20 bp, Artificial
  CRISPR gRNA sequence
gtgacattaagtagcaaaaa

SEQ ID NO: 133341 - DNA, 20 bp, Artificial
  CRISPR gRNA sequence
agtagcaaaaatctaatagg

SEQ ID NO: 133342 - DNA, 20 bp, Artificial
  CRISPR gRNA sequence
ataggagaaatgaggaataa

SEQ ID NO: 133343 - DNA, 20 bp, Artificial
  CRISPR gRNA sequence
taaaaatgtgtaagagaaaa

SEQ ID NO: 133344 - DNA, 20 bp, Artificial
  CRISPR gRNA sequence
aaaatgtgtaagagaaaagg

SEQ ID NO: 133345 - DNA, 20 bp, Artificial
  CRISPR gRNA sequence
acattttatgaaagaaaaga

SEQ ID NO: 133346 - DNA, 20 bp, Artificial
  CRISPR gRNA sequence
cattttatgaaagaaaagat

SEQ ID NO: 133347 - DNA, 20 bp, Artificial
  CRISPR gRNA sequence
tatgaaagaaaagatcattt

SEQ ID NO: 133348 - DNA, 20 bp, Artificial
  CRISPR gRNA sequence
atgaaagaaaagatcatttt

SEQ ID NO: 133349 - DNA, 20 bp, Artificial
  CRISPR gRNA sequence
tgaaagaaaagatcattttt

SEQ ID NO: 133350 - DNA, 20 bp, Artificial
  CRISPR gRNA sequence
ttgaaggtggtatggagatg

SEQ ID NO: 133351 - DNA, 20 bp, Artificial
  CRISPR gRNA sequence
tgaaggtggtatggagatgt

SEQ ID NO: 133352 - DNA, 20 bp, Artificial
  CRISPR gRNA sequence
gaaggtggtatggagatgtt

SEQ ID NO: 133353 - DNA, 20 bp, Artificial
  CRISPR gRNA sequence
aaggtggtatggagatgtta

SEQ ID NO: 133354 - DNA, 20 bp, Artificial
  CRISPR gRNA sequence
tttgagatttttggagaatg

SEQ ID NO: 133355 - DNA, 20 bp, Artificial
  CRISPR gRNA sequence
gagatttttggagaatgggc

SEQ ID NO: 133356 - DNA, 20 bp, Artificial
  CRISPR gRNA sequence
agatttttggagaatgggca

SEQ ID NO: 133357 - DNA, 20 bp, Artificial
  CRISPR gRNA sequence
ttggagaatgggcaagtagg

SEQ ID NO: 133358 - DNA, 20 bp, Artificial
  CRISPR gRNA sequence
tggagaatgggcaagtagga

SEQ ID NO: 133359 - DNA, 20 bp, Artificial
  CRISPR gRNA sequence
ggagaatgggcaagtaggat

SEQ ID NO: 133360 - DNA, 20 bp, Artificial
  CRISPR gRNA sequence
gagaatgggcaagtaggatt

SEQ ID NO: 133361 - DNA, 20 bp, Artificial
  CRISPR gRNA sequence
tagcaggtatatttgaggat

SEQ ID NO: 133362 - DNA, 20 bp, Artificial
  CRISPR gRNA sequence
agcaggtatatttgaggata

SEQ ID NO: 133363 - DNA, 20 bp, Artificial
  CRISPR gRNA sequence
gcaggtatatttgaggataa

SEQ ID NO: 133364 - DNA, 20 bp, Artificial
  CRISPR gRNA sequence
gaggataaaaagtgttctag

SEQ ID NO: 133365 - DNA, 20 bp, Artificial
  CRISPR gRNA sequence
aggataaaaagtgttctagg

SEQ ID NO: 133366 - DNA, 20 bp, Artificial
  CRISPR gRNA sequence
taggcagtgagtctgaaatt

SEQ ID NO: 133367 - DNA, 20 bp, Artificial
  CRISPR gRNA sequence
ggcagtgagtctgaaattaa

SEQ ID NO: 133368 - DNA, 20 bp, Artificial
  CRISPR gRNA sequence
aaattaataaaaaaaaagtt

SEQ ID NO: 133369 - DNA, 20 bp, Artificial
  CRISPR gRNA sequence
ataaaaaaaaagttcagttc

SEQ ID NO: 133370 - DNA, 20 bp, Artificial
  CRISPR gRNA sequence
agttctggctctgtaaaaat

SEQ ID NO: 133371 - DNA, 20 bp, Artificial
  CRISPR gRNA sequence
tggctctgtaaaaattatga

SEQ ID NO: 133372 - DNA, 20 bp, Artificial
  CRISPR gRNA sequence
gctctgtaaaaattatgaag

SEQ ID NO: 133373 - DNA, 20 bp, Artificial
  CRISPR gRNA sequence
tgtaaaaattatgaagagac

SEQ ID NO: 133374 - DNA, 20 bp, Artificial
  CRISPR gRNA sequence
taaaaattatgaagagactt

SEQ ID NO: 133375 - DNA, 20 bp, Artificial
  CRISPR gRNA sequence
tgaagagacttgctatccta

SEQ ID NO: 133376 - DNA, 20 bp, Artificial
  CRISPR gRNA sequence
gctatcctaatccctaaata

SEQ ID NO: 133377 - DNA, 20 bp, Artificial
  CRISPR gRNA sequence
ctatcctaatccctaaataa

SEQ ID NO: 133378 - DNA, 20 bp, Artificial
  CRISPR gRNA sequence
tcctaatccctaaataatgg

SEQ ID NO: 133379 - DNA, 20 bp, Artificial
  CRISPR gRNA sequence
atccctaaataatggttaag

SEQ ID NO: 133380 - DNA, 20 bp, Artificial
  CRISPR gRNA sequence
aataatggttaagaggtgaa

SEQ ID NO: 133381 - DNA, 20 bp, Artificial
  CRISPR gRNA sequence
agaggtgaaccagaatgatt

SEQ ID NO: 133382 - DNA, 20 bp, Artificial
  CRISPR gRNA sequence
tattctggatcactttggta

SEQ ID NO: 133383 - DNA, 20 bp, Artificial
  CRISPR gRNA sequence
attctggatcactttggtag

SEQ ID NO: 133384 - DNA, 20 bp, Artificial
  CRISPR gRNA sequence
ttctggatcactttggtagt

SEQ ID NO: 133385 - DNA, 20 bp, Artificial
  CRISPR gRNA sequence
tggatcactttggtagtttt

SEQ ID NO: 133386 - DNA, 20 bp, Artificial
  CRISPR gRNA sequence
gatcactttggtagtttttt

SEQ ID NO: 133387 - DNA, 20 bp, Artificial
  CRISPR gRNA sequence
tggtagttttttctatcttg

SEQ ID NO: 133388 - DNA, 20 bp, Artificial
  CRISPR gRNA sequence
ggtagttttttctatcttga

SEQ ID NO: 133389 - DNA, 20 bp, Artificial
  CRISPR gRNA sequence
gtagttttttctatcttgaa

SEQ ID NO: 133390 - DNA, 20 bp, Artificial
  CRISPR gRNA sequence
tttctatcttgaaatagaaa

SEQ ID NO: 133391 - DNA, 20 bp, Artificial
  CRISPR gRNA sequence
ttctatcttgaaatagaaat

SEQ ID NO: 133392 - DNA, 20 bp, Artificial
  CRISPR gRNA sequence
tctatcttgaaatagaaata

SEQ ID NO: 133393 - DNA, 20 bp, Artificial
  CRISPR gRNA sequence
ctatcttgaaatagaaataa

SEQ ID NO: 133394 - DNA, 20 bp, Artificial
  CRISPR gRNA sequence
tatcttgaaatagaaataat

SEQ ID NO: 133395 - DNA, 20 bp, Artificial
  CRISPR gRNA sequence
tcttgaaatagaaataataa

SEQ ID NO: 133396 - DNA, 20 bp, Artificial
  CRISPR gRNA sequence
gaaatagaaataataagaag

SEQ ID NO: 133397 - DNA, 20 bp, Artificial
  CRISPR gRNA sequence
aaatagaaataataagaagc

SEQ ID NO: 133398 - DNA, 20 bp, Artificial
  CRISPR gRNA sequence
tacacctaaatatttttatt

SEQ ID NO: 133399 - DNA, 20 bp, Artificial
  CRISPR gRNA sequence
acacctaaatatttttattt

SEQ ID NO: 133400 - DNA, 20 bp, Artificial
  CRISPR gRNA sequence
cacctaaatatttttatttc

SEQ ID NO: 133401 - DNA, 20 bp, Artificial
  CRISPR gRNA sequence
aatatttttatttctttaga

SEQ ID NO: 133402 - DNA, 20 bp, Artificial
  CRISPR gRNA sequence
ttatttctttagatactgag

SEQ ID NO: 133403 - DNA, 20 bp, Artificial
  CRISPR gRNA sequence
tatttctttagatactgagg

SEQ ID NO: 133404 - DNA, 20 bp, Artificial
  CRISPR gRNA sequence
atttctttagatactgagga

SEQ ID NO: 133405 - DNA, 20 bp, Artificial
  CRISPR gRNA sequence
tttctttagatactgaggac

SEQ ID NO: 133406 - DNA, 20 bp, Artificial
  CRISPR gRNA sequence
ctttagatactgaggacagc

SEQ ID NO: 133407 - DNA, 20 bp, Artificial
  CRISPR gRNA sequence
tttagatactgaggacagca

SEQ ID NO: 133408 - DNA, 20 bp, Artificial
  CRISPR gRNA sequence
tagatactgaggacagcatg

SEQ ID NO: 133409 - DNA, 20 bp, Artificial
  CRISPR gRNA sequence
agatactgaggacagcatga

SEQ ID NO: 133410 - DNA, 20 bp, Artificial
  CRISPR gRNA sequence
gatactgaggacagcatgaa

SEQ ID NO: 133411 - DNA, 20 bp, Artificial
  CRISPR gRNA sequence
aggacagcatgaatgatcat

SEQ ID NO: 133412 - DNA, 20 bp, Artificial
  CRISPR gRNA sequence
aaaagaaagtttcagagaac

SEQ ID NO: 133413 - DNA, 20 bp, Artificial
  CRISPR gRNA sequence
cagagaacaagatatatatc

SEQ ID NO: 133414 - DNA, 20 bp, Artificial
  CRISPR gRNA sequence
agagaacaagatatatatct

SEQ ID NO: 133415 - DNA, 20 bp, Artificial
  CRISPR gRNA sequence
ccaatagcaaacgtggctag

SEQ ID NO: 133416 - DNA, 20 bp, Artificial
  CRISPR gRNA sequence
caatagcaaacgtggctagg

SEQ ID NO: 133417 - DNA, 20 bp, Artificial
  CRISPR gRNA sequence
ggataatgaaaaatgccata

SEQ ID NO: 133418 - DNA, 20 bp, Artificial
  CRISPR gRNA sequence
aaacgggaaaggtaacgtag

SEQ ID NO: 133419 - DNA, 20 bp, Artificial
  CRISPR gRNA sequence
aactaggttttttcaaggga

SEQ ID NO: 133420 - DNA, 20 bp, Artificial
  CRISPR gRNA sequence
actaggttttttcaagggaa

SEQ ID NO: 133421 - DNA, 20 bp, Artificial
  CRISPR gRNA sequence
ggttttttcaagggaaacac

SEQ ID NO: 133422 - DNA, 20 bp, Artificial
  CRISPR gRNA sequence
tttcaagggaaacacgaaac

SEQ ID NO: 133423 - DNA, 20 bp, Artificial
  CRISPR gRNA sequence
ttcaagggaaacacgaaact

SEQ ID NO: 133424 - DNA, 20 bp, Artificial
  CRISPR gRNA sequence
tcaagggaaacacgaaacta

SEQ ID NO: 133425 - DNA, 20 bp, Artificial
  CRISPR gRNA sequence
caagggaaacacgaaactac

SEQ ID NO: 133426 - DNA, 20 bp, Artificial
  CRISPR gRNA sequence
aagggaaacacgaaactaca

SEQ ID NO: 133427 - DNA, 20 bp, Artificial
  CRISPR gRNA sequence
catgaattcataggtcatgg

SEQ ID NO: 133428 - DNA, 20 bp, Artificial
  CRISPR gRNA sequence
ataggtcatgggtacagtta

SEQ ID NO: 133429 - DNA, 20 bp, Artificial
  CRISPR gRNA sequence
gctgttgatttcaatcattc

SEQ ID NO: 133430 - DNA, 20 bp, Artificial
  CRISPR gRNA sequence
ttgatttcaatcattcaggc

SEQ ID NO: 133431 - DNA, 20 bp, Artificial
  CRISPR gRNA sequence
atttcaatcattcaggcttt

SEQ ID NO: 133432 - DNA, 20 bp, Artificial
  CRISPR gRNA sequence
caatcattcaggctttcagc

SEQ ID NO: 133433 - DNA, 20 bp, Artificial
  CRISPR gRNA sequence
aatcattcaggctttcagca

SEQ ID NO: 133434 - DNA, 20 bp, Artificial
  CRISPR gRNA sequence
aggctttcagcaaatcaaat

SEQ ID NO: 133435 - DNA, 20 bp, Artificial
  CRISPR gRNA sequence
tcagcaaatcaaatatttct

SEQ ID NO: 133436 - DNA, 20 bp, Artificial
  CRISPR gRNA sequence
cagcaaatcaaatatttctt

SEQ ID NO: 133437 - DNA, 20 bp, Artificial
  CRISPR gRNA sequence
agcaaatcaaatatttcttt

SEQ ID NO: 133438 - DNA, 20 bp, Artificial
  CRISPR gRNA sequence
ctttcatgtctacatacaca

SEQ ID NO: 133439 - DNA, 20 bp, Artificial
  CRISPR gRNA sequence
tttcatgtctacatacacag

SEQ ID NO: 133440 - DNA, 20 bp, Artificial
  CRISPR gRNA sequence
tcatgtctacatacacagtt

SEQ ID NO: 133441 - DNA, 20 bp, Artificial
  CRISPR gRNA sequence
catgtctacatacacagtta

SEQ ID NO: 133442 - DNA, 20 bp, Artificial
  CRISPR gRNA sequence
atgtctacatacacagttac

SEQ ID NO: 133443 - DNA, 20 bp, Artificial
  CRISPR gRNA sequence
catacacagttactgaacag

SEQ ID NO: 133444 - DNA, 20 bp, Artificial
  CRISPR gRNA sequence
ctgaacagtgtcccattttc

SEQ ID NO: 133445 - DNA, 20 bp, Artificial
  CRISPR gRNA sequence
aacagtgtcccattttcaat

SEQ ID NO: 133446 - DNA, 20 bp, Artificial
  CRISPR gRNA sequence
tcaattctgtcatgtcccta

SEQ ID NO: 133447 - DNA, 20 bp, Artificial
  CRISPR gRNA sequence
caattctgtcatgtccctaa

SEQ ID NO: 133448 - DNA, 20 bp, Artificial
  CRISPR gRNA sequence
aattctgtcatgtccctaaa

SEQ ID NO: 133449 - DNA, 20 bp, Artificial
  CRISPR gRNA sequence
tgtcatgtccctaaatgttc

SEQ ID NO: 133450 - DNA, 20 bp, Artificial
  CRISPR gRNA sequence
tcatgtccctaaatgttctc

SEQ ID NO: 133451 - DNA, 20 bp, Artificial
  CRISPR gRNA sequence
aatgttctcctctctcccac

SEQ ID NO: 133452 - DNA, 20 bp, Artificial
  CRISPR gRNA sequence
tcctctctcccacttattgg

SEQ ID NO: 133453 - DNA, 20 bp, Artificial
  CRISPR gRNA sequence
ctctctcccacttattggag

SEQ ID NO: 133454 - DNA, 20 bp, Artificial
  CRISPR gRNA sequence
tctcccacttattggaggca

SEQ ID NO: 133455 - DNA, 20 bp, Artificial
  CRISPR gRNA sequence
tcccacttattggaggcaga

SEQ ID NO: 133456 - DNA, 20 bp, Artificial
  CRISPR gRNA sequence
ccacttattggaggcagata

SEQ ID NO: 133457 - DNA, 20 bp, Artificial
  CRISPR gRNA sequence
attggaggcagataaaatag

SEQ ID NO: 133458 - DNA, 20 bp, Artificial
  CRISPR gRNA sequence
ttggaggcagataaaataga

SEQ ID NO: 133459 - DNA, 20 bp, Artificial
  CRISPR gRNA sequence
gaggcagataaaatagaatt

SEQ ID NO: 133460 - DNA, 20 bp, Artificial
  CRISPR gRNA sequence
agactgtttttttttttttt

SEQ ID NO: 133461 - DNA, 20 bp, Artificial
  CRISPR gRNA sequence
gactgttttttttttttttt

SEQ ID NO: 133462 - DNA, 20 bp, Artificial
  CRISPR gRNA sequence
tttttttttttttttttttt

SEQ ID NO: 133463 - DNA, 20 bp, Artificial
  CRISPR gRNA sequence
tttttttttttttttttttt

SEQ ID NO: 133464 - DNA, 20 bp, Artificial
  CRISPR gRNA sequence
tttttttttttttttttttt

SEQ ID NO: 133465 - DNA, 20 bp, Artificial
  CRISPR gRNA sequence
tttttttttttttttttttg

SEQ ID NO: 133466 - DNA, 20 bp, Artificial
  CRISPR gRNA sequence
ttttttttttttttttttgg

SEQ ID NO: 133467 - DNA, 20 bp, Artificial
  CRISPR gRNA sequence
tttttttttttttttttggg

SEQ ID NO: 133468 - DNA, 20 bp, Artificial
  CRISPR gRNA sequence
ttttttttttttttttgggg

SEQ ID NO: 133469 - DNA, 20 bp, Artificial
  CRISPR gRNA sequence
tttttttttttttttgggga

SEQ ID NO: 133470 - DNA, 20 bp, Artificial
  CRISPR gRNA sequence
ttttttttttttttggggac

SEQ ID NO: 133471 - DNA, 20 bp, Artificial
  CRISPR gRNA sequence
tttttttttttttggggaca

SEQ ID NO: 133472 - DNA, 20 bp, Artificial
  CRISPR gRNA sequence
ttttttttttttggggacag

SEQ ID NO: 133473 - DNA, 20 bp, Artificial
  CRISPR gRNA sequence
tttttttttttggggacaga

SEQ ID NO: 133474 - DNA, 20 bp, Artificial
  CRISPR gRNA sequence
ttttttttttggggacagag

SEQ ID NO: 133475 - DNA, 20 bp, Artificial
  CRISPR gRNA sequence
tttttttttggggacagagt

SEQ ID NO: 133476 - DNA, 20 bp, Artificial
  CRISPR gRNA sequence
ttttttttggggacagagtt

SEQ ID NO: 133477 - DNA, 20 bp, Artificial
  CRISPR gRNA sequence
tttttttggggacagagttt

SEQ ID NO: 133478 - DNA, 20 bp, Artificial
  CRISPR gRNA sequence
ttttttggggacagagtttc

SEQ ID NO: 133479 - DNA, 20 bp, Artificial
  CRISPR gRNA sequence
tttttggggacagagtttca

SEQ ID NO: 133480 - DNA, 20 bp, Artificial
  CRISPR gRNA sequence
ttttggggacagagtttcac

SEQ ID NO: 133481 - DNA, 20 bp, Artificial
  CRISPR gRNA sequence
tttggggacagagtttcact

SEQ ID NO: 133482 - DNA, 20 bp, Artificial
  CRISPR gRNA sequence
ttggggacagagtttcactc

SEQ ID NO: 133483 - DNA, 20 bp, Artificial
  CRISPR gRNA sequence
tggggacagagtttcactct

SEQ ID NO: 133484 - DNA, 20 bp, Artificial
  CRISPR gRNA sequence
ggggacagagtttcactctt

SEQ ID NO: 133485 - DNA, 20 bp, Artificial
  CRISPR gRNA sequence
gggacagagtttcactctta

SEQ ID NO: 133486 - DNA, 20 bp, Artificial
  CRISPR gRNA sequence
cactcttattggccaggctg

SEQ ID NO: 133487 - DNA, 20 bp, Artificial
  CRISPR gRNA sequence
actcttattggccaggctgg

SEQ ID NO: 133488 - DNA, 20 bp, Artificial
  CRISPR gRNA sequence
ttattggccaggctggagtg

SEQ ID NO: 133489 - DNA, 20 bp, Artificial
  CRISPR gRNA sequence
attggccaggctggagtgca

SEQ ID NO: 133490 - DNA, 20 bp, Artificial
  CRISPR gRNA sequence
ttggccaggctggagtgcaa

SEQ ID NO: 133491 - DNA, 20 bp, Artificial
  CRISPR gRNA sequence
gccaggctggagtgcaatgg

SEQ ID NO: 133492 - DNA, 20 bp, Artificial
  CRISPR gRNA sequence
gagtgcaatggtacaatctc

SEQ ID NO: 133493 - DNA, 20 bp, Artificial
  CRISPR gRNA sequence
cgctcactgcaacctccgcc

SEQ ID NO: 133494 - DNA, 20 bp, Artificial
  CRISPR gRNA sequence
actgcaacctccgcctccca

SEQ ID NO: 133495 - DNA, 20 bp, Artificial
  CRISPR gRNA sequence
caacctccgcctcccaggtt

SEQ ID NO: 133496 - DNA, 20 bp, Artificial
  CRISPR gRNA sequence
cgcctcccaggttcaagcaa

SEQ ID NO: 133497 - DNA, 20 bp, Artificial
  CRISPR gRNA sequence
ccaggttcaagcaattctcc

SEQ ID NO: 133498 - DNA, 20 bp, Artificial
  CRISPR gRNA sequence
aagcaattctcctgcctcag

SEQ ID NO: 133499 - DNA, 20 bp, Artificial
  CRISPR gRNA sequence
tcctgcctcagcctcccgag

SEQ ID NO: 133500 - DNA, 20 bp, Artificial
  CRISPR gRNA sequence
ctgcctcagcctcccgagta

SEQ ID NO: 133501 - DNA, 20 bp, Artificial
  CRISPR gRNA sequence
cctcagcctcccgagtagct

SEQ ID NO: 133502 - DNA, 20 bp, Artificial
  CRISPR gRNA sequence
agcctcccgagtagctggga

SEQ ID NO: 133503 - DNA, 20 bp, Artificial
  CRISPR gRNA sequence
ccgagtagctgggattacag

SEQ ID NO: 133504 - DNA, 20 bp, Artificial
  CRISPR gRNA sequence
ggattacaggcgtgcaccac

SEQ ID NO: 133505 - DNA, 20 bp, Artificial
  CRISPR gRNA sequence
caggcgtgcaccaccatgcc

SEQ ID NO: 133506 - DNA, 20 bp, Artificial
  CRISPR gRNA sequence
attttgtatttttggtagaa

SEQ ID NO: 133507 - DNA, 20 bp, Artificial
  CRISPR gRNA sequence
tgtatttttggtagaaatgg

SEQ ID NO: 133508 - DNA, 20 bp, Artificial
  CRISPR gRNA sequence
gtatttttggtagaaatggg

SEQ ID NO: 133509 - DNA, 20 bp, Artificial
  CRISPR gRNA sequence
tatttttggtagaaatgggg

SEQ ID NO: 133510 - DNA, 20 bp, Artificial
  CRISPR gRNA sequence
ttggtagaaatggggtttct

SEQ ID NO: 133511 - DNA, 20 bp, Artificial
  CRISPR gRNA sequence
tggtagaaatggggtttctc

SEQ ID NO: 133512 - DNA, 20 bp, Artificial
  CRISPR gRNA sequence
ggtagaaatggggtttctcc

SEQ ID NO: 133513 - DNA, 20 bp, Artificial
  CRISPR gRNA sequence
gtagaaatggggtttctcca

SEQ ID NO: 133514 - DNA, 20 bp, Artificial
  CRISPR gRNA sequence
ctccatgttggtcaggctgg

SEQ ID NO: 133515 - DNA, 20 bp, Artificial
  CRISPR gRNA sequence
tccatgttggtcaggctggt

SEQ ID NO: 133516 - DNA, 20 bp, Artificial
  CRISPR gRNA sequence
catgttggtcaggctggtct

SEQ ID NO: 133517 - DNA, 20 bp, Artificial
  CRISPR gRNA sequence
gtcaggctggtcttgaactc

SEQ ID NO: 133518 - DNA, 20 bp, Artificial
  CRISPR gRNA sequence
gtcttgaactctcgacctca

SEQ ID NO: 133519 - DNA, 20 bp, Artificial
  CRISPR gRNA sequence
gaactctcgacctcaggtga

SEQ ID NO: 133520 - DNA, 20 bp, Artificial
  CRISPR gRNA sequence
aactctcgacctcaggtgat

SEQ ID NO: 133521 - DNA, 20 bp, Artificial
  CRISPR gRNA sequence
tcgacctcaggtgatccatc

SEQ ID NO: 133522 - DNA, 20 bp, Artificial
  CRISPR gRNA sequence
gacctcaggtgatccatccg

SEQ ID NO: 133523 - DNA, 20 bp, Artificial
  CRISPR gRNA sequence
aggtgatccatccgccttgg

SEQ ID NO: 133524 - DNA, 20 bp, Artificial
  CRISPR gRNA sequence
ggcctaccaaagtgctggga

SEQ ID NO: 133525 - DNA, 20 bp, Artificial
  CRISPR gRNA sequence
gcctaccaaagtgctgggat

SEQ ID NO: 133526 - DNA, 20 bp, Artificial
  CRISPR gRNA sequence
ccaaagtgctgggattatag

SEQ ID NO: 133527 - DNA, 20 bp, Artificial
  CRISPR gRNA sequence
ggattatagacatgagccac

SEQ ID NO: 133528 - DNA, 20 bp, Artificial
  CRISPR gRNA sequence
tagacatgagccactgtgcc

SEQ ID NO: 133529 - DNA, 20 bp, Artificial
  CRISPR gRNA sequence
tgcctggcccgactgtttta

SEQ ID NO: 133530 - DNA, 20 bp, Artificial
  CRISPR gRNA sequence
gcccgactgttttaaaaaat

SEQ ID NO: 133531 - DNA, 20 bp, Artificial
  CRISPR gRNA sequence
ttttaaaaaataggtacgtt

SEQ ID NO: 133532 - DNA, 20 bp, Artificial
  CRISPR gRNA sequence
taaaaaataggtacgttgtc

SEQ ID NO: 133533 - DNA, 20 bp, Artificial
  CRISPR gRNA sequence
aaaaaataggtacgttgtca

SEQ ID NO: 133534 - DNA, 20 bp, Artificial
  CRISPR gRNA sequence
aaaaataggtacgttgtcag

SEQ ID NO: 133535 - DNA, 20 bp, Artificial
  CRISPR gRNA sequence
tcagaactatcaggtttggg

SEQ ID NO: 133536 - DNA, 20 bp, Artificial
  CRISPR gRNA sequence
tcaggtttgggtgtatgaag

SEQ ID NO: 133537 - DNA, 20 bp, Artificial
  CRISPR gRNA sequence
gggtgtatgaagctgtaact

SEQ ID NO: 133538 - DNA, 20 bp, Artificial
  CRISPR gRNA sequence
ggtgtatgaagctgtaactt

SEQ ID NO: 133539 - DNA, 20 bp, Artificial
  CRISPR gRNA sequence
taactttttttttttttttt

SEQ ID NO: 133540 - DNA, 20 bp, Artificial
  CRISPR gRNA sequence
ttttttttttttttgagacg

SEQ ID NO: 133541 - DNA, 20 bp, Artificial
  CRISPR gRNA sequence
tttttttttttttgagacgg

SEQ ID NO: 133542 - DNA, 20 bp, Artificial
  CRISPR gRNA sequence
ttttttttttttgagacgga

SEQ ID NO: 133543 - DNA, 20 bp, Artificial
  CRISPR gRNA sequence
tttttttttttgagacggag

SEQ ID NO: 133544 - DNA, 20 bp, Artificial
  CRISPR gRNA sequence
ttttttttttgagacggagt

SEQ ID NO: 133545 - DNA, 20 bp, Artificial
  CRISPR gRNA sequence
tttttttttgagacggagtt

SEQ ID NO: 133546 - DNA, 20 bp, Artificial
  CRISPR gRNA sequence
ttttttttgagacggagttt

SEQ ID NO: 133547 - DNA, 20 bp, Artificial
  CRISPR gRNA sequence
tttttttgagacggagtttc

SEQ ID NO: 133548 - DNA, 20 bp, Artificial
  CRISPR gRNA sequence
ttttttgagacggagtttcg

SEQ ID NO: 133549 - DNA, 20 bp, Artificial
  CRISPR gRNA sequence
tttttgagacggagtttcgc

SEQ ID NO: 133550 - DNA, 20 bp, Artificial
  CRISPR gRNA sequence
ttttgagacggagtttcgct

SEQ ID NO: 133551 - DNA, 20 bp, Artificial
  CRISPR gRNA sequence
tttgagacggagtttcgctc

SEQ ID NO: 133552 - DNA, 20 bp, Artificial
  CRISPR gRNA sequence
ttgagacggagtttcgctct

SEQ ID NO: 133553 - DNA, 20 bp, Artificial
  CRISPR gRNA sequence
tgagacggagtttcgctctt

SEQ ID NO: 133554 - DNA, 20 bp, Artificial
  CRISPR gRNA sequence
gagacggagtttcgctcttg

SEQ ID NO: 133555 - DNA, 20 bp, Artificial
  CRISPR gRNA sequence
agacggagtttcgctcttgt

SEQ ID NO: 133556 - DNA, 20 bp, Artificial
  CRISPR gRNA sequence
cgctcttgttgcccaggctg

SEQ ID NO: 133557 - DNA, 20 bp, Artificial
  CRISPR gRNA sequence
gctcttgttgcccaggctgg

SEQ ID NO: 133558 - DNA, 20 bp, Artificial
  CRISPR gRNA sequence
ttgttgcccaggctggagtg

SEQ ID NO: 133559 - DNA, 20 bp, Artificial
  CRISPR gRNA sequence
gttgcccaggctggagtgca

SEQ ID NO: 133560 - DNA, 20 bp, Artificial
  CRISPR gRNA sequence
ttgcccaggctggagtgcag

SEQ ID NO: 133561 - DNA, 20 bp, Artificial
  CRISPR gRNA sequence
cccaggctggagtgcagtgg

SEQ ID NO: 133562 - DNA, 20 bp, Artificial
  CRISPR gRNA sequence
gagtgcagtggcgtgatctc

SEQ ID NO: 133563 - DNA, 20 bp, Artificial
  CRISPR gRNA sequence
ggctcattgcaacctccacc

SEQ ID NO: 133564 - DNA, 20 bp, Artificial
  CRISPR gRNA sequence
attgcaacctccacctccca

SEQ ID NO: 133565 - DNA, 20 bp, Artificial
  CRISPR gRNA sequence
caacctccacctcccaggtt

SEQ ID NO: 133566 - DNA, 20 bp, Artificial
  CRISPR gRNA sequence
cacctcccaggttcaagcga

SEQ ID NO: 133567 - DNA, 20 bp, Artificial
  CRISPR gRNA sequence
ccaggttcaagcgattctcc

SEQ ID NO: 133568 - DNA, 20 bp, Artificial
  CRISPR gRNA sequence
aagcgattctcctgcctcag

SEQ ID NO: 133569 - DNA, 20 bp, Artificial
  CRISPR gRNA sequence
tcctgcctcagcctcccctg

SEQ ID NO: 133570 - DNA, 20 bp, Artificial
  CRISPR gRNA sequence
ctgcctcagcctcccctggt

SEQ ID NO: 133571 - DNA, 20 bp, Artificial
  CRISPR gRNA sequence
cctcagcctcccctggtagc

SEQ ID NO: 133572 - DNA, 20 bp, Artificial
  CRISPR gRNA sequence
agcctcccctggtagctggg

SEQ ID NO: 133573 - DNA, 20 bp, Artificial
  CRISPR gRNA sequence
ccctggtagctgggattaca

SEQ ID NO: 133574 - DNA, 20 bp, Artificial
  CRISPR gRNA sequence
gtagctgggattacaggcac

SEQ ID NO: 133575 - DNA, 20 bp, Artificial
  CRISPR gRNA sequence
ggattacaggcacgagccac

SEQ ID NO: 133576 - DNA, 20 bp, Artificial
  CRISPR gRNA sequence
caggcacgagccactgtgcc

SEQ ID NO: 133577 - DNA, 20 bp, Artificial
  CRISPR gRNA sequence
tgcccggcctgaagctgtaa

SEQ ID NO: 133578 - DNA, 20 bp, Artificial
  CRISPR gRNA sequence
aagctgtaacttctcccatc

SEQ ID NO: 133579 - DNA, 20 bp, Artificial
  CRISPR gRNA sequence
taacttctcccatccaagta

SEQ ID NO: 133580 - DNA, 20 bp, Artificial
  CRISPR gRNA sequence
ctcccatccaagtactaacc

SEQ ID NO: 133581 - DNA, 20 bp, Artificial
  CRISPR gRNA sequence
tcccatccaagtactaacca

SEQ ID NO: 133582 - DNA, 20 bp, Artificial
  CRISPR gRNA sequence
ccatccaagtactaaccagg

SEQ ID NO: 133583 - DNA, 20 bp, Artificial
  CRISPR gRNA sequence
accaggcccgaccctgctta

SEQ ID NO: 133584 - DNA, 20 bp, Artificial
  CRISPR gRNA sequence
cttagcttccgagatcagac

SEQ ID NO: 133585 - DNA, 20 bp, Artificial
  CRISPR gRNA sequence
agcttccgagatcagacgag

SEQ ID NO: 133586 - DNA, 20 bp, Artificial
  CRISPR gRNA sequence
gcttccgagatcagacgaga

SEQ ID NO: 133587 - DNA, 20 bp, Artificial
  CRISPR gRNA sequence
ccgagatcagacgagatcgg

SEQ ID NO: 133588 - DNA, 20 bp, Artificial
  CRISPR gRNA sequence
cgagatcagacgagatcggg

SEQ ID NO: 133589 - DNA, 20 bp, Artificial
  CRISPR gRNA sequence
agggtggtatggccgtagac

SEQ ID NO: 133590 - DNA, 20 bp, Artificial
  CRISPR gRNA sequence
aagctgtaacttctataatg

SEQ ID NO: 133591 - DNA, 20 bp, Artificial
  CRISPR gRNA sequence
taacttctataatgttgcag

SEQ ID NO: 133592 - DNA, 20 bp, Artificial
  CRISPR gRNA sequence
ctataatgttgcagtaaatt

SEQ ID NO: 133593 - DNA, 20 bp, Artificial
  CRISPR gRNA sequence
tataatgttgcagtaaattt

SEQ ID NO: 133594 - DNA, 20 bp, Artificial
  CRISPR gRNA sequence
taatgttgcagtaaatttag

SEQ ID NO: 133595 - DNA, 20 bp, Artificial
  CRISPR gRNA sequence
cagtaaatttaggtcgtatt

SEQ ID NO: 133596 - DNA, 20 bp, Artificial
  CRISPR gRNA sequence
aggtcgtattggtctgatat

SEQ ID NO: 133597 - DNA, 20 bp, Artificial
  CRISPR gRNA sequence
ggtcgtattggtctgatata

SEQ ID NO: 133598 - DNA, 20 bp, Artificial
  CRISPR gRNA sequence
gtctgatataggtgtaataa

SEQ ID NO: 133599 - DNA, 20 bp, Artificial
  CRISPR gRNA sequence
atataggtgtaataagaatt

SEQ ID NO: 133600 - DNA, 20 bp, Artificial
  CRISPR gRNA sequence
tccaaaacaaatcctggtat

SEQ ID NO: 133601 - DNA, 20 bp, Artificial
  CRISPR gRNA sequence
ccaaaacaaatcctggtatt

SEQ ID NO: 133602 - DNA, 20 bp, Artificial
  CRISPR gRNA sequence
caaaacaaatcctggtattt

SEQ ID NO: 133603 - DNA, 20 bp, Artificial
  CRISPR gRNA sequence
gtatttggaaacagctattt

SEQ ID NO: 133604 - DNA, 20 bp, Artificial
  CRISPR gRNA sequence
ggaaacagctatttttacat

SEQ ID NO: 133605 - DNA, 20 bp, Artificial
  CRISPR gRNA sequence
gaaacagctatttttacata

SEQ ID NO: 133606 - DNA, 20 bp, Artificial
  CRISPR gRNA sequence
tttttacataattatagata

SEQ ID NO: 133607 - DNA, 20 bp, Artificial
  CRISPR gRNA sequence
ttacataattatagatacta

SEQ ID NO: 133608 - DNA, 20 bp, Artificial
  CRISPR gRNA sequence
tacataattatagatactaa

SEQ ID NO: 133609 - DNA, 20 bp, Artificial
  CRISPR gRNA sequence
acataattatagatactaag

SEQ ID NO: 133610 - DNA, 20 bp, Artificial
  CRISPR gRNA sequence
cataattatagatactaaga

SEQ ID NO: 133611 - DNA, 20 bp, Artificial
  CRISPR gRNA sequence
tagatactaagatacattta

SEQ ID NO: 133612 - DNA, 20 bp, Artificial
  CRISPR gRNA sequence
agatacatttaaattgatat

SEQ ID NO: 133613 - DNA, 20 bp, Artificial
  CRISPR gRNA sequence
aaattgatatttttttttct

SEQ ID NO: 133614 - DNA, 20 bp, Artificial
  CRISPR gRNA sequence
aattgatatttttttttctt

SEQ ID NO: 133615 - DNA, 20 bp, Artificial
  CRISPR gRNA sequence
atatttttttttcttaagta

SEQ ID NO: 133616 - DNA, 20 bp, Artificial
  CRISPR gRNA sequence
ttttttcttaagtagttttg

SEQ ID NO: 133617 - DNA, 20 bp, Artificial
  CRISPR gRNA sequence
tttttcttaagtagttttgt

SEQ ID NO: 133618 - DNA, 20 bp, Artificial
  CRISPR gRNA sequence
ttttcttaagtagttttgtc

SEQ ID NO: 133619 - DNA, 20 bp, Artificial
  CRISPR gRNA sequence
tttcttaagtagttttgtct

SEQ ID NO: 133620 - DNA, 20 bp, Artificial
  CRISPR gRNA sequence
ttcttaagtagttttgtctt

SEQ ID NO: 133621 - DNA, 20 bp, Artificial
  CRISPR gRNA sequence
tcttaagtagttttgtcttc

SEQ ID NO: 133622 - DNA, 20 bp, Artificial
  CRISPR gRNA sequence
cttaagtagttttgtcttct

SEQ ID NO: 133623 - DNA, 20 bp, Artificial
  CRISPR gRNA sequence
ttaagtagttttgtcttctt

SEQ ID NO: 133624 - DNA, 20 bp, Artificial
  CRISPR gRNA sequence
aagtagttttgtcttcttag

SEQ ID NO: 133625 - DNA, 20 bp, Artificial
  CRISPR gRNA sequence
agtagttttgtcttcttaga

SEQ ID NO: 133626 - DNA, 20 bp, Artificial
  CRISPR gRNA sequence
tgtcttcttagaacttttaa

SEQ ID NO: 133627 - DNA, 20 bp, Artificial
  CRISPR gRNA sequence
gtcttcttagaacttttaaa

SEQ ID NO: 133628 - DNA, 20 bp, Artificial
  CRISPR gRNA sequence
tcttcttagaacttttaaaa

SEQ ID NO: 133629 - DNA, 20 bp, Artificial
  CRISPR gRNA sequence
cttagaacttttaaaactca

SEQ ID NO: 133630 - DNA, 20 bp, Artificial
  CRISPR gRNA sequence
ttagaacttttaaaactcat

SEQ ID NO: 133631 - DNA, 20 bp, Artificial
  CRISPR gRNA sequence
agaacttttaaaactcattg

SEQ ID NO: 133632 - DNA, 20 bp, Artificial
  CRISPR gRNA sequence
gaacttttaaaactcattgt

SEQ ID NO: 133633 - DNA, 20 bp, Artificial
  CRISPR gRNA sequence
ttaaaactcattgtcattgc

SEQ ID NO: 133634 - DNA, 20 bp, Artificial
  CRISPR gRNA sequence
taaaactcattgtcattgct

SEQ ID NO: 133635 - DNA, 20 bp, Artificial
  CRISPR gRNA sequence
aaaactcattgtcattgctc

SEQ ID NO: 133636 - DNA, 20 bp, Artificial
  CRISPR gRNA sequence
aaactcattgtcattgctca

SEQ ID NO: 133637 - DNA, 20 bp, Artificial
  CRISPR gRNA sequence
attgtcattgctcatcactt

SEQ ID NO: 133638 - DNA, 20 bp, Artificial
  CRISPR gRNA sequence
tcattgctcatcacttggtc

SEQ ID NO: 133639 - DNA, 20 bp, Artificial
  CRISPR gRNA sequence
ctcatcacttggtctgaatt

SEQ ID NO: 133640 - DNA, 20 bp, Artificial
  CRISPR gRNA sequence
atcacttggtctgaattaaa

SEQ ID NO: 133641 - DNA, 20 bp, Artificial
  CRISPR gRNA sequence
ggtctgaattaaaattcaca

SEQ ID NO: 133642 - DNA, 20 bp, Artificial
  CRISPR gRNA sequence
gtctgaattaaaattcacac

SEQ ID NO: 133643 - DNA, 20 bp, Artificial
  CRISPR gRNA sequence
aattaaaattcacacgtttt

SEQ ID NO: 133644 - DNA, 20 bp, Artificial
  CRISPR gRNA sequence
aaattcacacgttttatatc

SEQ ID NO: 133645 - DNA, 20 bp, Artificial
  CRISPR gRNA sequence
acacgttttatatcattttc

SEQ ID NO: 133646 - DNA, 20 bp, Artificial
  CRISPR gRNA sequence
tatatcattttctattggta

SEQ ID NO: 133647 - DNA, 20 bp, Artificial
  CRISPR gRNA sequence
atatcattttctattggtaa

SEQ ID NO: 133648 - DNA, 20 bp, Artificial
  CRISPR gRNA sequence
tatcattttctattggtaat

SEQ ID NO: 133649 - DNA, 20 bp, Artificial
  CRISPR gRNA sequence
tctattggtaatttttctgt

SEQ ID NO: 133650 - DNA, 20 bp, Artificial
  CRISPR gRNA sequence
ctattggtaatttttctgtc

SEQ ID NO: 133651 - DNA, 20 bp, Artificial
  CRISPR gRNA sequence
tattggtaatttttctgtca

SEQ ID NO: 133652 - DNA, 20 bp, Artificial
  CRISPR gRNA sequence
ttggtaatttttctgtcatt

SEQ ID NO: 133653 - DNA, 20 bp, Artificial
  CRISPR gRNA sequence
gtaatttttctgtcatttta

SEQ ID NO: 133654 - DNA, 20 bp, Artificial
  CRISPR gRNA sequence
ttctgtcattttatagttta

SEQ ID NO: 133655 - DNA, 20 bp, Artificial
  CRISPR gRNA sequence
tctgtcattttatagtttaa

SEQ ID NO: 133656 - DNA, 20 bp, Artificial
  CRISPR gRNA sequence
ctgtcattttatagtttaaa

SEQ ID NO: 133657 - DNA, 20 bp, Artificial
  CRISPR gRNA sequence
tgtcattttatagtttaaaa

SEQ ID NO: 133658 - DNA, 20 bp, Artificial
  CRISPR gRNA sequence
tcattttatagtttaaaaag

SEQ ID NO: 133659 - DNA, 20 bp, Artificial
  CRISPR gRNA sequence
tatagtttaaaaagacttat

SEQ ID NO: 133660 - DNA, 20 bp, Artificial
  CRISPR gRNA sequence
atagtttaaaaagacttatg

SEQ ID NO: 133661 - DNA, 20 bp, Artificial
  CRISPR gRNA sequence
tagtttaaaaagacttatgg

SEQ ID NO: 133662 - DNA, 20 bp, Artificial
  CRISPR gRNA sequence
aaaaagacttatggaagtaa

SEQ ID NO: 133663 - DNA, 20 bp, Artificial
  CRISPR gRNA sequence
aaaagacttatggaagtaat

SEQ ID NO: 133664 - DNA, 20 bp, Artificial
  CRISPR gRNA sequence
atggaagtaataaagcttac

SEQ ID NO: 133665 - DNA, 20 bp, Artificial
  CRISPR gRNA sequence
tggaagtaataaagcttaca

SEQ ID NO: 133666 - DNA, 20 bp, Artificial
  CRISPR gRNA sequence
acaaataaatatgctattaa

SEQ ID NO: 133667 - DNA, 20 bp, Artificial
  CRISPR gRNA sequence
caaataaatatgctattaaa

SEQ ID NO: 133668 - DNA, 20 bp, Artificial
  CRISPR gRNA sequence
ttaaaatacatcactaagct

SEQ ID NO: 133669 - DNA, 20 bp, Artificial
  CRISPR gRNA sequence
aaatacatcactaagcttag

SEQ ID NO: 133670 - DNA, 20 bp, Artificial
  CRISPR gRNA sequence
agcttagaacttacagtttg

SEQ ID NO: 133671 - DNA, 20 bp, Artificial
  CRISPR gRNA sequence
agaacttacagtttgagaat

SEQ ID NO: 133672 - DNA, 20 bp, Artificial
  CRISPR gRNA sequence
gaacttacagtttgagaatt

SEQ ID NO: 133673 - DNA, 20 bp, Artificial
  CRISPR gRNA sequence
acagtttgagaattttgtcc

SEQ ID NO: 133674 - DNA, 20 bp, Artificial
  CRISPR gRNA sequence
cagtttgagaattttgtcct

SEQ ID NO: 133675 - DNA, 20 bp, Artificial
  CRISPR gRNA sequence
gagaattttgtccttatgtt

SEQ ID NO: 133676 - DNA, 20 bp, Artificial
  CRISPR gRNA sequence
agaattttgtccttatgttt

SEQ ID NO: 133677 - DNA, 20 bp, Artificial
  CRISPR gRNA sequence
tgtccttatgttttaaggaa

SEQ ID NO: 133678 - DNA, 20 bp, Artificial
  CRISPR gRNA sequence
gtccttatgttttaaggaaa

SEQ ID NO: 133679 - DNA, 20 bp, Artificial
  CRISPR gRNA sequence
tccttatgttttaaggaaaa

SEQ ID NO: 133680 - DNA, 20 bp, Artificial
  CRISPR gRNA sequence
atgttttaaggaaaaaaaag

SEQ ID NO: 133681 - DNA, 20 bp, Artificial
  CRISPR gRNA sequence
tgttttaaggaaaaaaaagc

SEQ ID NO: 133682 - DNA, 20 bp, Artificial
  CRISPR gRNA sequence
taaggaaaaaaaagcacaaa

SEQ ID NO: 133683 - DNA, 20 bp, Artificial
  CRISPR gRNA sequence
aaggaaaaaaaagcacaaat

SEQ ID NO: 133684 - DNA, 20 bp, Artificial
  CRISPR gRNA sequence
aggaaaaaaaagcacaaatg

SEQ ID NO: 133685 - DNA, 20 bp, Artificial
  CRISPR gRNA sequence
attattgcttacataggcta

SEQ ID NO: 133686 - DNA, 20 bp, Artificial
  CRISPR gRNA sequence
ttgcttacataggctatgta

SEQ ID NO: 133687 - DNA, 20 bp, Artificial
  CRISPR gRNA sequence
cttacataggctatgtatga

SEQ ID NO: 133688 - DNA, 20 bp, Artificial
  CRISPR gRNA sequence
acataggctatgtatgacca

SEQ ID NO: 133689 - DNA, 20 bp, Artificial
  CRISPR gRNA sequence
cataggctatgtatgaccag

SEQ ID NO: 133690 - DNA, 20 bp, Artificial
  CRISPR gRNA sequence
tgtatgaccagctatgccgc

SEQ ID NO: 133691 - DNA, 20 bp, Artificial
  CRISPR gRNA sequence
tgccgctggtcagtaccata

SEQ ID NO: 133692 - DNA, 20 bp, Artificial
  CRISPR gRNA sequence
gtcagtaccatagccacaag

SEQ ID NO: 133693 - DNA, 20 bp, Artificial
  CRISPR gRNA sequence
aggagcacctgaaatgtggc

SEQ ID NO: 133694 - DNA, 20 bp, Artificial
  CRISPR gRNA sequence
aaatgtggctggtctgaatg

SEQ ID NO: 133695 - DNA, 20 bp, Artificial
  CRISPR gRNA sequence
gtctgaatggagatgtgttg

SEQ ID NO: 133696 - DNA, 20 bp, Artificial
  CRISPR gRNA sequence
aatggagatgtgttgtaaat

SEQ ID NO: 133697 - DNA, 20 bp, Artificial
  CRISPR gRNA sequence
taaatttgaaacaccagatt

SEQ ID NO: 133698 - DNA, 20 bp, Artificial
  CRISPR gRNA sequence
gaaacaccagattttgaaga

SEQ ID NO: 133699 - DNA, 20 bp, Artificial
  CRISPR gRNA sequence
aaacaccagattttgaagac

SEQ ID NO: 133700 - DNA, 20 bp, Artificial
  CRISPR gRNA sequence
tgaagacttagtatgaagaa

SEQ ID NO: 133701 - DNA, 20 bp, Artificial
  CRISPR gRNA sequence
gaagacttagtatgaagaaa

SEQ ID NO: 133702 - DNA, 20 bp, Artificial
  CRISPR gRNA sequence
aagacttagtatgaagaaaa

SEQ ID NO: 133703 - DNA, 20 bp, Artificial
  CRISPR gRNA sequence
agtatgaagaaaagaattaa

SEQ ID NO: 133704 - DNA, 20 bp, Artificial
  CRISPR gRNA sequence
gtatgaagaaaagaattaaa

SEQ ID NO: 133705 - DNA, 20 bp, Artificial
  CRISPR gRNA sequence
aaatttctcatttaaaaatt

SEQ ID NO: 133706 - DNA, 20 bp, Artificial
  CRISPR gRNA sequence
ctcatttaaaaattgattct

SEQ ID NO: 133707 - DNA, 20 bp, Artificial
  CRISPR gRNA sequence
tcatttaaaaattgattcta

SEQ ID NO: 133708 - DNA, 20 bp, Artificial
  CRISPR gRNA sequence
atttaaaaattgattctatg

SEQ ID NO: 133709 - DNA, 20 bp, Artificial
  CRISPR gRNA sequence
aaaaattgattctatgttta

SEQ ID NO: 133710 - DNA, 20 bp, Artificial
  CRISPR gRNA sequence
aaaattgattctatgtttaa

SEQ ID NO: 133711 - DNA, 20 bp, Artificial
  CRISPR gRNA sequence
attctatgtttaaatggtaa

SEQ ID NO: 133712 - DNA, 20 bp, Artificial
  CRISPR gRNA sequence
tatgtttaaatggtaagaat

SEQ ID NO: 133713 - DNA, 20 bp, Artificial
  CRISPR gRNA sequence
tgtttaaatggtaagaattt

SEQ ID NO: 133714 - DNA, 20 bp, Artificial
  CRISPR gRNA sequence
aaatggtaagaatttggcta

SEQ ID NO: 133715 - DNA, 20 bp, Artificial
  CRISPR gRNA sequence
aatggtaagaatttggctat

SEQ ID NO: 133716 - DNA, 20 bp, Artificial
  CRISPR gRNA sequence
ggctatattgggttaaatta

SEQ ID NO: 133717 - DNA, 20 bp, Artificial
  CRISPR gRNA sequence
gctatattgggttaaattaa

SEQ ID NO: 133718 - DNA, 20 bp, Artificial
  CRISPR gRNA sequence
tattgggttaaattaaatat

SEQ ID NO: 133719 - DNA, 20 bp, Artificial
  CRISPR gRNA sequence
ggttaaattaaatatattaa

SEQ ID NO: 133720 - DNA, 20 bp, Artificial
  CRISPR gRNA sequence
aattaaatatattaaaatta

SEQ ID NO: 133721 - DNA, 20 bp, Artificial
  CRISPR gRNA sequence
aatatattaaaattaatttt

SEQ ID NO: 133722 - DNA, 20 bp, Artificial
  CRISPR gRNA sequence
aaattaattttattttattt

SEQ ID NO: 133723 - DNA, 20 bp, Artificial
  CRISPR gRNA sequence
attttattttattttatatg

SEQ ID NO: 133724 - DNA, 20 bp, Artificial
  CRISPR gRNA sequence
tattttattttatatggcta

SEQ ID NO: 133725 - DNA, 20 bp, Artificial
  CRISPR gRNA sequence
attttattttatatggctac

SEQ ID NO: 133726 - DNA, 20 bp, Artificial
  CRISPR gRNA sequence
ttttattttatatggctact

SEQ ID NO: 133727 - DNA, 20 bp, Artificial
  CRISPR gRNA sequence
tattttatatggctactaga

SEQ ID NO: 133728 - DNA, 20 bp, Artificial
  CRISPR gRNA sequence
attttatatggctactagag

SEQ ID NO: 133729 - DNA, 20 bp, Artificial
  CRISPR gRNA sequence
ttttatatggctactagaga

SEQ ID NO: 133730 - DNA, 20 bp, Artificial
  CRISPR gRNA sequence
tatatggctactagagaatc

SEQ ID NO: 133731 - DNA, 20 bp, Artificial
  CRISPR gRNA sequence
atatggctactagagaatct

SEQ ID NO: 133732 - DNA, 20 bp, Artificial
  CRISPR gRNA sequence
tatggctactagagaatcta

SEQ ID NO: 133733 - DNA, 20 bp, Artificial
  CRISPR gRNA sequence
ctagagaatctaaactgaca

SEQ ID NO: 133734 - DNA, 20 bp, Artificial
  CRISPR gRNA sequence
gagaatctaaactgacatat

SEQ ID NO: 133735 - DNA, 20 bp, Artificial
  CRISPR gRNA sequence
aactgacatatgtggctcac

SEQ ID NO: 133736 - DNA, 20 bp, Artificial
  CRISPR gRNA sequence
acatatgtggctcacattat

SEQ ID NO: 133737 - DNA, 20 bp, Artificial
  CRISPR gRNA sequence
acattatattatcttgcttg

SEQ ID NO: 133738 - DNA, 20 bp, Artificial
  CRISPR gRNA sequence
tattatcttgcttgactgca

SEQ ID NO: 133739 - DNA, 20 bp, Artificial
  CRISPR gRNA sequence
tcttgcttgactgcatttat

SEQ ID NO: 133740 - DNA, 20 bp, Artificial
  CRISPR gRNA sequence
gcttgactgcatttatgcag

SEQ ID NO: 133741 - DNA, 20 bp, Artificial
  CRISPR gRNA sequence
cttgactgcatttatgcagt

SEQ ID NO: 133742 - DNA, 20 bp, Artificial
  CRISPR gRNA sequence
gactgcatttatgcagttct

SEQ ID NO: 133743 - DNA, 20 bp, Artificial
  CRISPR gRNA sequence
actgcatttatgcagttctt

SEQ ID NO: 133744 - DNA, 20 bp, Artificial
  CRISPR gRNA sequence
catttatgcagttcttgttt

SEQ ID NO: 133745 - DNA, 20 bp, Artificial
  CRISPR gRNA sequence
atgcagttcttgtttacttt

SEQ ID NO: 133746 - DNA, 20 bp, Artificial
  CRISPR gRNA sequence
tgcagttcttgtttactttc

SEQ ID NO: 133747 - DNA, 20 bp, Artificial
  CRISPR gRNA sequence
ttgtttactttctccagtat

SEQ ID NO: 133748 - DNA, 20 bp, Artificial
  CRISPR gRNA sequence
gtttactttctccagtatgg

SEQ ID NO: 133749 - DNA, 20 bp, Artificial
  CRISPR gRNA sequence
tttactttctccagtatgga

SEQ ID NO: 133750 - DNA, 20 bp, Artificial
  CRISPR gRNA sequence
actttctccagtatggaaaa

SEQ ID NO: 133751 - DNA, 20 bp, Artificial
  CRISPR gRNA sequence
ctttctccagtatggaaaat

SEQ ID NO: 133752 - DNA, 20 bp, Artificial
  CRISPR gRNA sequence
tctccagtatggaaaatagg

SEQ ID NO: 133753 - DNA, 20 bp, Artificial
  CRISPR gRNA sequence
ctccagtatggaaaataggc

SEQ ID NO: 133754 - DNA, 20 bp, Artificial
  CRISPR gRNA sequence
tccagtatggaaaataggca

SEQ ID NO: 133755 - DNA, 20 bp, Artificial
  CRISPR gRNA sequence
cagtatggaaaataggcatg

SEQ ID NO: 133756 - DNA, 20 bp, Artificial
  CRISPR gRNA sequence
cggcagggagtttgagtggt

SEQ ID NO: 133757 - DNA, 20 bp, Artificial
  CRISPR gRNA sequence
ggcagggagtttgagtggta

SEQ ID NO: 133758 - DNA, 20 bp, Artificial
  CRISPR gRNA sequence
gagtggtattgctgttacaa

SEQ ID NO: 133759 - DNA, 20 bp, Artificial
  CRISPR gRNA sequence
agtggtattgctgttacaag

SEQ ID NO: 133760 - DNA, 20 bp, Artificial
  CRISPR gRNA sequence
ctgttacaagtggctttgca

SEQ ID NO: 133761 - DNA, 20 bp, Artificial
  CRISPR gRNA sequence
ttacaagtggctttgcaatt

SEQ ID NO: 133762 - DNA, 20 bp, Artificial
  CRISPR gRNA sequence
caagtggctttgcaattgct

SEQ ID NO: 133763 - DNA, 20 bp, Artificial
  CRISPR gRNA sequence
tgcaattgcttgattaatcc

SEQ ID NO: 133764 - DNA, 20 bp, Artificial
  CRISPR gRNA sequence
gcaattgcttgattaatcca

SEQ ID NO: 133765 - DNA, 20 bp, Artificial
  CRISPR gRNA sequence
caattgcttgattaatccat

SEQ ID NO: 133766 - DNA, 20 bp, Artificial
  CRISPR gRNA sequence
cttgattaatccattggagt

SEQ ID NO: 133767 - DNA, 20 bp, Artificial
  CRISPR gRNA sequence
gattaatccattggagtttc

SEQ ID NO: 133768 - DNA, 20 bp, Artificial
  CRISPR gRNA sequence
attaatccattggagtttca

SEQ ID NO: 133769 - DNA, 20 bp, Artificial
  CRISPR gRNA sequence
atccattggagtttcatttt

SEQ ID NO: 133770 - DNA, 20 bp, Artificial
  CRISPR gRNA sequence
gagtttcatttttagacccc

SEQ ID NO: 133771 - DNA, 20 bp, Artificial
  CRISPR gRNA sequence
catttttagaccccagaccc

SEQ ID NO: 133772 - DNA, 20 bp, Artificial
  CRISPR gRNA sequence
atttttagaccccagaccct

SEQ ID NO: 133773 - DNA, 20 bp, Artificial
  CRISPR gRNA sequence
ttagaccccagacccttaag

SEQ ID NO: 133774 - DNA, 20 bp, Artificial
  CRISPR gRNA sequence
tagaccccagacccttaagg

SEQ ID NO: 133775 - DNA, 20 bp, Artificial
  CRISPR gRNA sequence
agaccccagacccttaaggg

SEQ ID NO: 133776 - DNA, 20 bp, Artificial
  CRISPR gRNA sequence
gaccccagacccttaaggga

SEQ ID NO: 133777 - DNA, 20 bp, Artificial
  CRISPR gRNA sequence
aagggaaaaattgtttttat

SEQ ID NO: 133778 - DNA, 20 bp, Artificial
  CRISPR gRNA sequence
agggaaaaattgtttttata

SEQ ID NO: 133779 - DNA, 20 bp, Artificial
  CRISPR gRNA sequence
tttttataatgaagtggcag

SEQ ID NO: 133780 - DNA, 20 bp, Artificial
  CRISPR gRNA sequence
ttataatgaagtggcagatg

SEQ ID NO: 133781 - DNA, 20 bp, Artificial
  CRISPR gRNA sequence
tataatgaagtggcagatgt

SEQ ID NO: 133782 - DNA, 20 bp, Artificial
  CRISPR gRNA sequence
ataatgaagtggcagatgtg

SEQ ID NO: 133783 - DNA, 20 bp, Artificial
  CRISPR gRNA sequence
taatgaagtggcagatgtgt

SEQ ID NO: 133784 - DNA, 20 bp, Artificial
  CRISPR gRNA sequence
ctttaggcaggctttttagt

SEQ ID NO: 133785 - DNA, 20 bp, Artificial
  CRISPR gRNA sequence
tttaggcaggctttttagta

SEQ ID NO: 133786 - DNA, 20 bp, Artificial
  CRISPR gRNA sequence
taggcaggctttttagtaaa

SEQ ID NO: 133787 - DNA, 20 bp, Artificial
  CRISPR gRNA sequence
aggcaggctttttagtaaac

SEQ ID NO: 133788 - DNA, 20 bp, Artificial
  CRISPR gRNA sequence
ggcaggctttttagtaaact

SEQ ID NO: 133789 - DNA, 20 bp, Artificial
  CRISPR gRNA sequence
tttagtaaactcaaaacctg

SEQ ID NO: 133790 - DNA, 20 bp, Artificial
  CRISPR gRNA sequence
ttagtaaactcaaaacctgt

SEQ ID NO: 133791 - DNA, 20 bp, Artificial
  CRISPR gRNA sequence
tagtaaactcaaaacctgta

SEQ ID NO: 133792 - DNA, 20 bp, Artificial
  CRISPR gRNA sequence
agtaaactcaaaacctgtat

SEQ ID NO: 133793 - DNA, 20 bp, Artificial
  CRISPR gRNA sequence
gtaaactcaaaacctgtatc

SEQ ID NO: 133794 - DNA, 20 bp, Artificial
  CRISPR gRNA sequence
aaaacctgtatctgacactg

SEQ ID NO: 133795 - DNA, 20 bp, Artificial
  CRISPR gRNA sequence
tatctgacactgtgtatccc

SEQ ID NO: 133796 - DNA, 20 bp, Artificial
  CRISPR gRNA sequence
acactgtgtatcccaaataa

SEQ ID NO: 133797 - DNA, 20 bp, Artificial
  CRISPR gRNA sequence
tgtatcccaaataataaaaa

SEQ ID NO: 133798 - DNA, 20 bp, Artificial
  CRISPR gRNA sequence
tcatttctctcttttccaag

SEQ ID NO: 133799 - DNA, 20 bp, Artificial
  CRISPR gRNA sequence
ctctcttttccaagccttat

SEQ ID NO: 133800 - DNA, 20 bp, Artificial
  CRISPR gRNA sequence
tctcttttccaagccttatg

SEQ ID NO: 133801 - DNA, 20 bp, Artificial
  CRISPR gRNA sequence
tcttttccaagccttatgtg

SEQ ID NO: 133802 - DNA, 20 bp, Artificial
  CRISPR gRNA sequence
ttttccaagccttatgtgaa

SEQ ID NO: 133803 - DNA, 20 bp, Artificial
  CRISPR gRNA sequence
ttccaagccttatgtgaatt

SEQ ID NO: 133804 - DNA, 20 bp, Artificial
  CRISPR gRNA sequence
tccaagccttatgtgaattc

SEQ ID NO: 133805 - DNA, 20 bp, Artificial
  CRISPR gRNA sequence
ccaagccttatgtgaattca

SEQ ID NO: 133806 - DNA, 20 bp, Artificial
  CRISPR gRNA sequence
caagccttatgtgaattcag

SEQ ID NO: 133807 - DNA, 20 bp, Artificial
  CRISPR gRNA sequence
atgtgaattcagttttttag

SEQ ID NO: 133808 - DNA, 20 bp, Artificial
  CRISPR gRNA sequence
tgtgaattcagttttttagt

SEQ ID NO: 133809 - DNA, 20 bp, Artificial
  CRISPR gRNA sequence
agttttttagttcctgtttt

SEQ ID NO: 133810 - DNA, 20 bp, Artificial
  CRISPR gRNA sequence
tttagttcctgttttgcttt

SEQ ID NO: 133811 - DNA, 20 bp, Artificial
  CRISPR gRNA sequence
ttagttcctgttttgctttt

SEQ ID NO: 133812 - DNA, 20 bp, Artificial
  CRISPR gRNA sequence
tagttcctgttttgcttttt

SEQ ID NO: 133813 - DNA, 20 bp, Artificial
  CRISPR gRNA sequence
agttcctgttttgctttttg

SEQ ID NO: 133814 - DNA, 20 bp, Artificial
  CRISPR gRNA sequence
gttcctgttttgctttttgt

SEQ ID NO: 133815 - DNA, 20 bp, Artificial
  CRISPR gRNA sequence
ctgttttgctttttgttttc

SEQ ID NO: 133816 - DNA, 20 bp, Artificial
  CRISPR gRNA sequence
ttttgctttttgttttctgg

SEQ ID NO: 133817 - DNA, 20 bp, Artificial
  CRISPR gRNA sequence
tgctttttgttttctggtgt

SEQ ID NO: 133818 - DNA, 20 bp, Artificial
  CRISPR gRNA sequence
gctttttgttttctggtgtc

SEQ ID NO: 133819 - DNA, 20 bp, Artificial
  CRISPR gRNA sequence
ctttttgttttctggtgtct

SEQ ID NO: 133820 - DNA, 20 bp, Artificial
  CRISPR gRNA sequence
tttgttttctggtgtcttta

SEQ ID NO: 133821 - DNA, 20 bp, Artificial
  CRISPR gRNA sequence
ttgttttctggtgtctttat

SEQ ID NO: 133822 - DNA, 20 bp, Artificial
  CRISPR gRNA sequence
tgttttctggtgtctttatt

SEQ ID NO: 133823 - DNA, 20 bp, Artificial
  CRISPR gRNA sequence
gttttctggtgtctttattc

SEQ ID NO: 133824 - DNA, 20 bp, Artificial
  CRISPR gRNA sequence
ttttctggtgtctttattca

SEQ ID NO: 133825 - DNA, 20 bp, Artificial
  CRISPR gRNA sequence
tctggtgtctttattcatgg

SEQ ID NO: 133826 - DNA, 20 bp, Artificial
  CRISPR gRNA sequence
ctggtgtctttattcatgga

SEQ ID NO: 133827 - DNA, 20 bp, Artificial
  CRISPR gRNA sequence
tggtgtctttattcatggaa

SEQ ID NO: 133828 - DNA, 20 bp, Artificial
  CRISPR gRNA sequence
gtgtctttattcatggaaat

SEQ ID NO: 133829 - DNA, 20 bp, Artificial
  CRISPR gRNA sequence
tattcatggaaatgctaggg

SEQ ID NO: 133830 - DNA, 20 bp, Artificial
  CRISPR gRNA sequence
attcatggaaatgctagggc

SEQ ID NO: 133831 - DNA, 20 bp, Artificial
  CRISPR gRNA sequence
ttcatggaaatgctagggca

SEQ ID NO: 133832 - DNA, 20 bp, Artificial
  CRISPR gRNA sequence
atggaaatgctagggcagag

SEQ ID NO: 133833 - DNA, 20 bp, Artificial
  CRISPR gRNA sequence
gggcagagaagtggtactta

SEQ ID NO: 133834 - DNA, 20 bp, Artificial
  CRISPR gRNA sequence
atgtcgcccacaaaatatgc

SEQ ID NO: 133835 - DNA, 20 bp, Artificial
  CRISPR gRNA sequence
tgtcgcccacaaaatatgca

SEQ ID NO: 133836 - DNA, 20 bp, Artificial
  CRISPR gRNA sequence
tccaggggcactgggttatt

SEQ ID NO: 133837 - DNA, 20 bp, Artificial
  CRISPR gRNA sequence
ccaggggcactgggttatta

SEQ ID NO: 133838 - DNA, 20 bp, Artificial
  CRISPR gRNA sequence
caggggcactgggttattaa

SEQ ID NO: 133839 - DNA, 20 bp, Artificial
  CRISPR gRNA sequence
ggttattaagagttttcatc

SEQ ID NO: 133840 - DNA, 20 bp, Artificial
  CRISPR gRNA sequence
ttaagagttttcatcctctg

SEQ ID NO: 133841 - DNA, 20 bp, Artificial
  CRISPR gRNA sequence
agagttttcatcctctgtgg

SEQ ID NO: 133842 - DNA, 20 bp, Artificial
  CRISPR gRNA sequence
tcatcctctgtggggtggta

SEQ ID NO: 133843 - DNA, 20 bp, Artificial
  CRISPR gRNA sequence
catcctctgtggggtggtag

SEQ ID NO: 133844 - DNA, 20 bp, Artificial
  CRISPR gRNA sequence
atcctctgtggggtggtagg

SEQ ID NO: 133845 - DNA, 20 bp, Artificial
  CRISPR gRNA sequence
tgtggggtggtaggaacatc

SEQ ID NO: 133846 - DNA, 20 bp, Artificial
  CRISPR gRNA sequence
tggggtggtaggaacatcca

SEQ ID NO: 133847 - DNA, 20 bp, Artificial
  CRISPR gRNA sequence
ctgttttatatctttttaaa

SEQ ID NO: 133848 - DNA, 20 bp, Artificial
  CRISPR gRNA sequence
ttttatatctttttaaaatt

SEQ ID NO: 133849 - DNA, 20 bp, Artificial
  CRISPR gRNA sequence
tatatctttttaaaattttt

SEQ ID NO: 133850 - DNA, 20 bp, Artificial
  CRISPR gRNA sequence
atatctttttaaaatttttt

SEQ ID NO: 133851 - DNA, 20 bp, Artificial
  CRISPR gRNA sequence
tatctttttaaaattttttt

SEQ ID NO: 133852 - DNA, 20 bp, Artificial
  CRISPR gRNA sequence
tttaaaatttttttaatttt

SEQ ID NO: 133853 - DNA, 20 bp, Artificial
  CRISPR gRNA sequence
ttaaaatttttttaattttt

SEQ ID NO: 133854 - DNA, 20 bp, Artificial
  CRISPR gRNA sequence
taaaatttttttaatttttt

SEQ ID NO: 133855 - DNA, 20 bp, Artificial
  CRISPR gRNA sequence
aaaatttttttaattttttt

SEQ ID NO: 133856 - DNA, 20 bp, Artificial
  CRISPR gRNA sequence
aaatttttttaatttttttt

SEQ ID NO: 133857 - DNA, 20 bp, Artificial
  CRISPR gRNA sequence
ttttaattttttttttgaga

SEQ ID NO: 133858 - DNA, 20 bp, Artificial
  CRISPR gRNA sequence
tttaattttttttttgagac

SEQ ID NO: 133859 - DNA, 20 bp, Artificial
  CRISPR gRNA sequence
ttaattttttttttgagacg

SEQ ID NO: 133860 - DNA, 20 bp, Artificial
  CRISPR gRNA sequence
taattttttttttgagacgg

SEQ ID NO: 133861 - DNA, 20 bp, Artificial
  CRISPR gRNA sequence
aattttttttttgagacgga

SEQ ID NO: 133862 - DNA, 20 bp, Artificial
  CRISPR gRNA sequence
attttttttttgagacggag

SEQ ID NO: 133863 - DNA, 20 bp, Artificial
  CRISPR gRNA sequence
tttttttgagacggagtctc

SEQ ID NO: 133864 - DNA, 20 bp, Artificial
  CRISPR gRNA sequence
ttttttgagacggagtctcg

SEQ ID NO: 133865 - DNA, 20 bp, Artificial
  CRISPR gRNA sequence
tttttgagacggagtctcgc

SEQ ID NO: 133866 - DNA, 20 bp, Artificial
  CRISPR gRNA sequence
ttttgagacggagtctcgct

SEQ ID NO: 133867 - DNA, 20 bp, Artificial
  CRISPR gRNA sequence
tttgagacggagtctcgctc

SEQ ID NO: 133868 - DNA, 20 bp, Artificial
  CRISPR gRNA sequence
ttgagacggagtctcgctct

SEQ ID NO: 133869 - DNA, 20 bp, Artificial
  CRISPR gRNA sequence
tgagacggagtctcgctctt

SEQ ID NO: 133870 - DNA, 20 bp, Artificial
  CRISPR gRNA sequence
gagacggagtctcgctcttt

SEQ ID NO: 133871 - DNA, 20 bp, Artificial
  CRISPR gRNA sequence
agacggagtctcgctctttt

SEQ ID NO: 133872 - DNA, 20 bp, Artificial
  CRISPR gRNA sequence
gctctttttgcccaggcctg

SEQ ID NO: 133873 - DNA, 20 bp, Artificial
  CRISPR gRNA sequence
tttttgcccaggcctggagt

SEQ ID NO: 133874 - DNA, 20 bp, Artificial
  CRISPR gRNA sequence
tttgcccaggcctggagtac

SEQ ID NO: 133875 - DNA, 20 bp, Artificial
  CRISPR gRNA sequence
ttgcccaggcctggagtaca

SEQ ID NO: 133876 - DNA, 20 bp, Artificial
  CRISPR gRNA sequence
tgcccaggcctggagtacag

SEQ ID NO: 133877 - DNA, 20 bp, Artificial
  CRISPR gRNA sequence
gcccaggcctggagtacagt

SEQ ID NO: 133878 - DNA, 20 bp, Artificial
  CRISPR gRNA sequence
cccaggcctggagtacagtg

SEQ ID NO: 133879 - DNA, 20 bp, Artificial
  CRISPR gRNA sequence
gagtacagtggctcaatctc

SEQ ID NO: 133880 - DNA, 20 bp, Artificial
  CRISPR gRNA sequence
aatctcggctcactgcaacc

SEQ ID NO: 133881 - DNA, 20 bp, Artificial
  CRISPR gRNA sequence
ggctcactgcaacctccgcc

SEQ ID NO: 133882 - DNA, 20 bp, Artificial
  CRISPR gRNA sequence
actgcaacctccgcctcctg

SEQ ID NO: 133883 - DNA, 20 bp, Artificial
  CRISPR gRNA sequence
caacctccgcctcctgggtt

SEQ ID NO: 133884 - DNA, 20 bp, Artificial
  CRISPR gRNA sequence
cgcctcctgggttcaagcaa

SEQ ID NO: 133885 - DNA, 20 bp, Artificial
  CRISPR gRNA sequence
ctgggttcaagcaattctcc

SEQ ID NO: 133886 - DNA, 20 bp, Artificial
  CRISPR gRNA sequence
ggttcaagcaattctcctgc

SEQ ID NO: 133887 - DNA, 20 bp, Artificial
  CRISPR gRNA sequence
aagcaattctcctgcctcat

SEQ ID NO: 133888 - DNA, 20 bp, Artificial
  CRISPR gRNA sequence
tcctgcctcatcctcctgag

SEQ ID NO: 133889 - DNA, 20 bp, Artificial
  CRISPR gRNA sequence
ctgcctcatcctcctgagta

SEQ ID NO: 133890 - DNA, 20 bp, Artificial
  CRISPR gRNA sequence
cctcatcctcctgagtagca

SEQ ID NO: 133891 - DNA, 20 bp, Artificial
  CRISPR gRNA sequence
atcctcctgagtagcagcaa

SEQ ID NO: 133892 - DNA, 20 bp, Artificial
  CRISPR gRNA sequence
ctgagtagcagcaattacag

SEQ ID NO: 133893 - DNA, 20 bp, Artificial
  CRISPR gRNA sequence
agtagcagcaattacaggca

SEQ ID NO: 133894 - DNA, 20 bp, Artificial
  CRISPR gRNA sequence
caggcacctgccaccacgcc

SEQ ID NO: 133895 - DNA, 20 bp, Artificial
  CRISPR gRNA sequence
ccaccacgcccagctaattt

SEQ ID NO: 133896 - DNA, 20 bp, Artificial
  CRISPR gRNA sequence
attttttgtacttttagtag

SEQ ID NO: 133897 - DNA, 20 bp, Artificial
  CRISPR gRNA sequence
tttgtacttttagtagagat

SEQ ID NO: 133898 - DNA, 20 bp, Artificial
  CRISPR gRNA sequence
ttgtacttttagtagagatg

SEQ ID NO: 133899 - DNA, 20 bp, Artificial
  CRISPR gRNA sequence
tgtacttttagtagagatgg

SEQ ID NO: 133900 - DNA, 20 bp, Artificial
  CRISPR gRNA sequence
gtacttttagtagagatggg

SEQ ID NO: 133901 - DNA, 20 bp, Artificial
  CRISPR gRNA sequence
tacttttagtagagatgggg

SEQ ID NO: 133902 - DNA, 20 bp, Artificial
  CRISPR gRNA sequence
ttagtagagatggggtttcg

SEQ ID NO: 133903 - DNA, 20 bp, Artificial
  CRISPR gRNA sequence
tagtagagatggggtttcgc

SEQ ID NO: 133904 - DNA, 20 bp, Artificial
  CRISPR gRNA sequence
agtagagatggggtttcgcc

SEQ ID NO: 133905 - DNA, 20 bp, Artificial
  CRISPR gRNA sequence
gtagagatggggtttcgcca

SEQ ID NO: 133906 - DNA, 20 bp, Artificial
  CRISPR gRNA sequence
cgccatgttggccaggctgg

SEQ ID NO: 133907 - DNA, 20 bp, Artificial
  CRISPR gRNA sequence
gccatgttggccaggctggt

SEQ ID NO: 133908 - DNA, 20 bp, Artificial
  CRISPR gRNA sequence
gccaggctggtcttgaactc

SEQ ID NO: 133909 - DNA, 20 bp, Artificial
  CRISPR gRNA sequence
gtcttgaactcctgacctca

SEQ ID NO: 133910 - DNA, 20 bp, Artificial
  CRISPR gRNA sequence
gaactcctgacctcaggtca

SEQ ID NO: 133911 - DNA, 20 bp, Artificial
  CRISPR gRNA sequence
aactcctgacctcaggtcat

SEQ ID NO: 133912 - DNA, 20 bp, Artificial
  CRISPR gRNA sequence
ctgacctcaggtcatccgcc

SEQ ID NO: 133913 - DNA, 20 bp, Artificial
  CRISPR gRNA sequence
acctcaggtcatccgcccgc

SEQ ID NO: 133914 - DNA, 20 bp, Artificial
  CRISPR gRNA sequence
aggtcatccgcccgcctcgg

SEQ ID NO: 133915 - DNA, 20 bp, Artificial
  CRISPR gRNA sequence
ggcctcccaaagtgctggga

SEQ ID NO: 133916 - DNA, 20 bp, Artificial
  CRISPR gRNA sequence
ccaaagtgctgggattacag

SEQ ID NO: 133917 - DNA, 20 bp, Artificial
  CRISPR gRNA sequence
ggattacaggcatgagtcac

SEQ ID NO: 133918 - DNA, 20 bp, Artificial
  CRISPR gRNA sequence
caggcatgagtcaccctgcc

SEQ ID NO: 133919 - DNA, 20 bp, Artificial
  CRISPR gRNA sequence
ccaggcactcttttacatct

SEQ ID NO: 133920 - DNA, 20 bp, Artificial
  CRISPR gRNA sequence
ttttacatctaaattagatt

SEQ ID NO: 133921 - DNA, 20 bp, Artificial
  CRISPR gRNA sequence
ttacatctaaattagatttg

SEQ ID NO: 133922 - DNA, 20 bp, Artificial
  CRISPR gRNA sequence
tacatctaaattagatttgt

SEQ ID NO: 133923 - DNA, 20 bp, Artificial
  CRISPR gRNA sequence
acatctaaattagatttgtt

SEQ ID NO: 133924 - DNA, 20 bp, Artificial
  CRISPR gRNA sequence
catctaaattagatttgttt

SEQ ID NO: 133925 - DNA, 20 bp, Artificial
  CRISPR gRNA sequence
aattagatttgtttctgtaa

SEQ ID NO: 133926 - DNA, 20 bp, Artificial
  CRISPR gRNA sequence
gatttgtttctgtaaatagt

SEQ ID NO: 133927 - DNA, 20 bp, Artificial
  CRISPR gRNA sequence
gtttctgtaaatagttgtca

SEQ ID NO: 133928 - DNA, 20 bp, Artificial
  CRISPR gRNA sequence
tttctgtaaatagttgtcaa

SEQ ID NO: 133929 - DNA, 20 bp, Artificial
  CRISPR gRNA sequence
ctgtaaatagttgtcaaggc

SEQ ID NO: 133930 - DNA, 20 bp, Artificial
  CRISPR gRNA sequence
tgtaaatagttgtcaaggct

SEQ ID NO: 133931 - DNA, 20 bp, Artificial
  CRISPR gRNA sequence
taaatagttgtcaaggcttc

SEQ ID NO: 133932 - DNA, 20 bp, Artificial
  CRISPR gRNA sequence
tcaaggcttctctcacttgt

SEQ ID NO: 133933 - DNA, 20 bp, Artificial
  CRISPR gRNA sequence
ctctcacttgtatttgagct

SEQ ID NO: 133934 - DNA, 20 bp, Artificial
  CRISPR gRNA sequence
tctcacttgtatttgagctt

SEQ ID NO: 133935 - DNA, 20 bp, Artificial
  CRISPR gRNA sequence
tcacttgtatttgagctttt

SEQ ID NO: 133936 - DNA, 20 bp, Artificial
  CRISPR gRNA sequence
acttgtatttgagcttttat

SEQ ID NO: 133937 - DNA, 20 bp, Artificial
  CRISPR gRNA sequence
gtatttgagcttttattctg

SEQ ID NO: 133938 - DNA, 20 bp, Artificial
  CRISPR gRNA sequence
tatttgagcttttattctga

SEQ ID NO: 133939 - DNA, 20 bp, Artificial
  CRISPR gRNA sequence
gagcttttattctgactctg

SEQ ID NO: 133940 - DNA, 20 bp, Artificial
  CRISPR gRNA sequence
agcttttattctgactctga

SEQ ID NO: 133941 - DNA, 20 bp, Artificial
  CRISPR gRNA sequence
ttattctgactctgaggtgt

SEQ ID NO: 133942 - DNA, 20 bp, Artificial
  CRISPR gRNA sequence
tattctgactctgaggtgtg

SEQ ID NO: 133943 - DNA, 20 bp, Artificial
  CRISPR gRNA sequence
attctgactctgaggtgtgg

SEQ ID NO: 133944 - DNA, 20 bp, Artificial
  CRISPR gRNA sequence
ttctgactctgaggtgtgga

SEQ ID NO: 133945 - DNA, 20 bp, Artificial
  CRISPR gRNA sequence
tgactctgaggtgtggactt

SEQ ID NO: 133946 - DNA, 20 bp, Artificial
  CRISPR gRNA sequence
actctgaggtgtggactttt

SEQ ID NO: 133947 - DNA, 20 bp, Artificial
  CRISPR gRNA sequence
tgaggtgtggacttttgata

SEQ ID NO: 133948 - DNA, 20 bp, Artificial
  CRISPR gRNA sequence
aggtgtggacttttgatagc

SEQ ID NO: 133949 - DNA, 20 bp, Artificial
  CRISPR gRNA sequence
ttgatagcacacattgtgtt

SEQ ID NO: 133950 - DNA, 20 bp, Artificial
  CRISPR gRNA sequence
tgatagcacacattgtgtta

SEQ ID NO: 133951 - DNA, 20 bp, Artificial
  CRISPR gRNA sequence
gatagcacacattgtgttaa

SEQ ID NO: 133952 - DNA, 20 bp, Artificial
  CRISPR gRNA sequence
atagcacacattgtgttaat

SEQ ID NO: 133953 - DNA, 20 bp, Artificial
  CRISPR gRNA sequence
tgttaatgttataacatata

SEQ ID NO: 133954 - DNA, 20 bp, Artificial
  CRISPR gRNA sequence
atgttataacatatatttaa

SEQ ID NO: 133955 - DNA, 20 bp, Artificial
  CRISPR gRNA sequence
taacatatatttaagagatt

SEQ ID NO: 133956 - DNA, 20 bp, Artificial
  CRISPR gRNA sequence
aagagattaaatagtcataa

SEQ ID NO: 133957 - DNA, 20 bp, Artificial
  CRISPR gRNA sequence
agagattaaatagtcataaa

SEQ ID NO: 133958 - DNA, 20 bp, Artificial
  CRISPR gRNA sequence
aatagtcataaagtgaagat

SEQ ID NO: 133959 - DNA, 20 bp, Artificial
  CRISPR gRNA sequence
ttctgaataggctttcattt

SEQ ID NO: 133960 - DNA, 20 bp, Artificial
  CRISPR gRNA sequence
ctgaataggctttcattttt

SEQ ID NO: 133961 - DNA, 20 bp, Artificial
  CRISPR gRNA sequence
tgaataggctttcatttttg

SEQ ID NO: 133962 - DNA, 20 bp, Artificial
  CRISPR gRNA sequence
aataggctttcatttttgta

SEQ ID NO: 133963 - DNA, 20 bp, Artificial
  CRISPR gRNA sequence
tcatttttgtaggttgttag

SEQ ID NO: 133964 - DNA, 20 bp, Artificial
  CRISPR gRNA sequence
catttttgtaggttgttagg

SEQ ID NO: 133965 - DNA, 20 bp, Artificial
  CRISPR gRNA sequence
atttttgtaggttgttagga

SEQ ID NO: 133966 - DNA, 20 bp, Artificial
  CRISPR gRNA sequence
ttgtaggttgttaggaaggt

SEQ ID NO: 133967 - DNA, 20 bp, Artificial
  CRISPR gRNA sequence
tgtaggttgttaggaaggtg

SEQ ID NO: 133968 - DNA, 20 bp, Artificial
  CRISPR gRNA sequence
gtaggttgttaggaaggtga

SEQ ID NO: 133969 - DNA, 20 bp, Artificial
  CRISPR gRNA sequence
taggttgttaggaaggtgat

SEQ ID NO: 133970 - DNA, 20 bp, Artificial
  CRISPR gRNA sequence
ttaggaaggtgatggttata

SEQ ID NO: 133971 - DNA, 20 bp, Artificial
  CRISPR gRNA sequence
ggaaggtgatggttatagtt

SEQ ID NO: 133972 - DNA, 20 bp, Artificial
  CRISPR gRNA sequence
tagtttctgtaatttaccta

SEQ ID NO: 133973 - DNA, 20 bp, Artificial
  CRISPR gRNA sequence
ctgtaatttacctatgattt

SEQ ID NO: 133974 - DNA, 20 bp, Artificial
  CRISPR gRNA sequence
tgtaatttacctatgatttt

SEQ ID NO: 133975 - DNA, 20 bp, Artificial
  CRISPR gRNA sequence
taatttacctatgattttct

SEQ ID NO: 133976 - DNA, 20 bp, Artificial
  CRISPR gRNA sequence
acctatgattttctcttcag

SEQ ID NO: 133977 - DNA, 20 bp, Artificial
  CRISPR gRNA sequence
cctatgattttctcttcaga

SEQ ID NO: 133978 - DNA, 20 bp, Artificial
  CRISPR gRNA sequence
tgattttctcttcagattgc

SEQ ID NO: 133979 - DNA, 20 bp, Artificial
  CRISPR gRNA sequence
tctcttcagattgcaaaaga

SEQ ID NO: 133980 - DNA, 20 bp, Artificial
  CRISPR gRNA sequence
ctcttcagattgcaaaagat

SEQ ID NO: 133981 - DNA, 20 bp, Artificial
  CRISPR gRNA sequence
tcttcagattgcaaaagatg

SEQ ID NO: 133982 - DNA, 20 bp, Artificial
  CRISPR gRNA sequence
ttcagattgcaaaagatgcc

SEQ ID NO: 133983 - DNA, 20 bp, Artificial
  CRISPR gRNA sequence
cagattgcaaaagatgccaa

SEQ ID NO: 133984 - DNA, 20 bp, Artificial
  CRISPR gRNA sequence
agattgcaaaagatgccaaa

SEQ ID NO: 133985 - DNA, 20 bp, Artificial
  CRISPR gRNA sequence
caaaagatgccaaagaatgt

SEQ ID NO: 133986 - DNA, 20 bp, Artificial
  CRISPR gRNA sequence
aagaatgtgtaagtgagttc

SEQ ID NO: 133987 - DNA, 20 bp, Artificial
  CRISPR gRNA sequence
atcagttttataacatctga

SEQ ID NO: 133988 - DNA, 20 bp, Artificial
  CRISPR gRNA sequence
tataacatctgaagcaagtg

SEQ ID NO: 133989 - DNA, 20 bp, Artificial
  CRISPR gRNA sequence
ataacatctgaagcaagtga

SEQ ID NO: 133990 - DNA, 20 bp, Artificial
  CRISPR gRNA sequence
taacatctgaagcaagtgaa

SEQ ID NO: 133991 - DNA, 20 bp, Artificial
  CRISPR gRNA sequence
aagcaagtgaaaggtgccat

SEQ ID NO: 133992 - DNA, 20 bp, Artificial
  CRISPR gRNA sequence
tctttgctatgtctacttta

SEQ ID NO: 133993 - DNA, 20 bp, Artificial
  CRISPR gRNA sequence
tttgctatgtctactttagg

SEQ ID NO: 133994 - DNA, 20 bp, Artificial
  CRISPR gRNA sequence
tgctatgtctactttaggct

SEQ ID NO: 133995 - DNA, 20 bp, Artificial
  CRISPR gRNA sequence
gctatgtctactttaggctt

SEQ ID NO: 133996 - DNA, 20 bp, Artificial
  CRISPR gRNA sequence
ctatgtctactttaggcttt

SEQ ID NO: 133997 - DNA, 20 bp, Artificial
  CRISPR gRNA sequence
tgtctactttaggctttgac

SEQ ID NO: 133998 - DNA, 20 bp, Artificial
  CRISPR gRNA sequence
ctttaggctttgacagttat

SEQ ID NO: 133999 - DNA, 20 bp, Artificial
  CRISPR gRNA sequence
taggctttgacagttatgtg

SEQ ID NO: 134000 - DNA, 20 bp, Artificial
  CRISPR gRNA sequence
aggctttgacagttatgtgg

SEQ ID NO: 134001 - DNA, 20 bp, Artificial
  CRISPR gRNA sequence
ggctttgacagttatgtgga

SEQ ID NO: 134002 - DNA, 20 bp, Artificial
  CRISPR gRNA sequence
tgacagttatgtggaacctc

SEQ ID NO: 134003 - DNA, 20 bp, Artificial
  CRISPR gRNA sequence
gacagttatgtggaacctct

SEQ ID NO: 134004 - DNA, 20 bp, Artificial
  CRISPR gRNA sequence
acagttatgtggaacctctg

SEQ ID NO: 134005 - DNA, 20 bp, Artificial
  CRISPR gRNA sequence
tgtggaacctctgaaattat

SEQ ID NO: 134006 - DNA, 20 bp, Artificial
  CRISPR gRNA sequence
tgaaattataccttcagaaa

SEQ ID NO: 134007 - DNA, 20 bp, Artificial
  CRISPR gRNA sequence
aaattataccttcagaaatt

SEQ ID NO: 134008 - DNA, 20 bp, Artificial
  CRISPR gRNA sequence
taccttcagaaattcagaga

SEQ ID NO: 134009 - DNA, 20 bp, Artificial
  CRISPR gRNA sequence
cagaaattcagagaggtaaa

SEQ ID NO: 134010 - DNA, 20 bp, Artificial
  CRISPR gRNA sequence
agaaattcagagaggtaaat

SEQ ID NO: 134011 - DNA, 20 bp, Artificial
  CRISPR gRNA sequence
agagaggtaaataaaatatc

SEQ ID NO: 134012 - DNA, 20 bp, Artificial
  CRISPR gRNA sequence
ccattgtgcttttttttttc

SEQ ID NO: 134013 - DNA, 20 bp, Artificial
  CRISPR gRNA sequence
tgcttttttttttcttcttt

SEQ ID NO: 134014 - DNA, 20 bp, Artificial
  CRISPR gRNA sequence
ttttttttcttctttttttt

SEQ ID NO: 134015 - DNA, 20 bp, Artificial
  CRISPR gRNA sequence
tttttttcttcttttttttt

SEQ ID NO: 134016 - DNA, 20 bp, Artificial
  CRISPR gRNA sequence
ttttttcttctttttttttt

SEQ ID NO: 134017 - DNA, 20 bp, Artificial
  CRISPR gRNA sequence
tttttcttcttttttttttt

SEQ ID NO: 134018 - DNA, 20 bp, Artificial
  CRISPR gRNA sequence
ttttcttctttttttttttg

SEQ ID NO: 134019 - DNA, 20 bp, Artificial
  CRISPR gRNA sequence
tttcttctttttttttttga

SEQ ID NO: 134020 - DNA, 20 bp, Artificial
  CRISPR gRNA sequence
ttcttctttttttttttgag

SEQ ID NO: 134021 - DNA, 20 bp, Artificial
  CRISPR gRNA sequence
tcttctttttttttttgagg

SEQ ID NO: 134022 - DNA, 20 bp, Artificial
  CRISPR gRNA sequence
cttctttttttttttgaggt

SEQ ID NO: 134023 - DNA, 20 bp, Artificial
  CRISPR gRNA sequence
ttctttttttttttgaggtg

SEQ ID NO: 134024 - DNA, 20 bp, Artificial
  CRISPR gRNA sequence
ctttttttttttgaggtgga

SEQ ID NO: 134025 - DNA, 20 bp, Artificial
  CRISPR gRNA sequence
tttttttttttgaggtggag

SEQ ID NO: 134026 - DNA, 20 bp, Artificial
  CRISPR gRNA sequence
tttttttttgaggtggagta

SEQ ID NO: 134027 - DNA, 20 bp, Artificial
  CRISPR gRNA sequence
ttttttttgaggtggagtat

SEQ ID NO: 134028 - DNA, 20 bp, Artificial
  CRISPR gRNA sequence
tttttttgaggtggagtatc

SEQ ID NO: 134029 - DNA, 20 bp, Artificial
  CRISPR gRNA sequence
ttttttgaggtggagtatcg

SEQ ID NO: 134030 - DNA, 20 bp, Artificial
  CRISPR gRNA sequence
tttttgaggtggagtatcgc

SEQ ID NO: 134031 - DNA, 20 bp, Artificial
  CRISPR gRNA sequence
ttttgaggtggagtatcgct

SEQ ID NO: 134032 - DNA, 20 bp, Artificial
  CRISPR gRNA sequence
tttgaggtggagtatcgctc

SEQ ID NO: 134033 - DNA, 20 bp, Artificial
  CRISPR gRNA sequence
ttgaggtggagtatcgctct

SEQ ID NO: 134034 - DNA, 20 bp, Artificial
  CRISPR gRNA sequence
tgaggtggagtatcgctctg

SEQ ID NO: 134035 - DNA, 20 bp, Artificial
  CRISPR gRNA sequence
gaggtggagtatcgctctgt

SEQ ID NO: 134036 - DNA, 20 bp, Artificial
  CRISPR gRNA sequence
aggtggagtatcgctctgtt

SEQ ID NO: 134037 - DNA, 20 bp, Artificial
  CRISPR gRNA sequence
tgttgcccaggctggagtac

SEQ ID NO: 134038 - DNA, 20 bp, Artificial
  CRISPR gRNA sequence
ttgcccaggctggagtacag

SEQ ID NO: 134039 - DNA, 20 bp, Artificial
  CRISPR gRNA sequence
cccaggctggagtacagtgg

SEQ ID NO: 134040 - DNA, 20 bp, Artificial
  CRISPR gRNA sequence
gagtacagtggcaagatctc

SEQ ID NO: 134041 - DNA, 20 bp, Artificial
  CRISPR gRNA sequence
ggctcactgcaacctctgcc

SEQ ID NO: 134042 - DNA, 20 bp, Artificial
  CRISPR gRNA sequence
actgcaacctctgcctcctg

SEQ ID NO: 134043 - DNA, 20 bp, Artificial
  CRISPR gRNA sequence
caacctctgcctcctgggtt

SEQ ID NO: 134044 - DNA, 20 bp, Artificial
  CRISPR gRNA sequence
tgcctcctgggttcaagcaa

SEQ ID NO: 134045 - DNA, 20 bp, Artificial
  CRISPR gRNA sequence
cctcctgggttcaagcaact

SEQ ID NO: 134046 - DNA, 20 bp, Artificial
  CRISPR gRNA sequence
ctgggttcaagcaactctcc

SEQ ID NO: 134047 - DNA, 20 bp, Artificial
  CRISPR gRNA sequence
ggttcaagcaactctcctgc

SEQ ID NO: 134048 - DNA, 20 bp, Artificial
  CRISPR gRNA sequence
aagcaactctcctgcctcag

SEQ ID NO: 134049 - DNA, 20 bp, Artificial
  CRISPR gRNA sequence
tcctgcctcagcctcctgag

SEQ ID NO: 134050 - DNA, 20 bp, Artificial
  CRISPR gRNA sequence
ctgcctcagcctcctgagta

SEQ ID NO: 134051 - DNA, 20 bp, Artificial
  CRISPR gRNA sequence
cctcagcctcctgagtagct

SEQ ID NO: 134052 - DNA, 20 bp, Artificial
  CRISPR gRNA sequence
agcctcctgagtagctggga

SEQ ID NO: 134053 - DNA, 20 bp, Artificial
  CRISPR gRNA sequence
ctgagtagctgggattacag

SEQ ID NO: 134054 - DNA, 20 bp, Artificial
  CRISPR gRNA sequence
agtagctgggattacaggcg

SEQ ID NO: 134055 - DNA, 20 bp, Artificial
  CRISPR gRNA sequence
ggattacaggcgtgcaccac

SEQ ID NO: 134056 - DNA, 20 bp, Artificial
  CRISPR gRNA sequence
caggcgtgcaccaccatgcc

SEQ ID NO: 134057 - DNA, 20 bp, Artificial
  CRISPR gRNA sequence
gctaagttttgtatttttag

SEQ ID NO: 134058 - DNA, 20 bp, Artificial
  CRISPR gRNA sequence
agttttgtatttttagtaga

SEQ ID NO: 134059 - DNA, 20 bp, Artificial
  CRISPR gRNA sequence
tgtatttttagtagagacgg

SEQ ID NO: 134060 - DNA, 20 bp, Artificial
  CRISPR gRNA sequence
gtatttttagtagagacggg

SEQ ID NO: 134061 - DNA, 20 bp, Artificial
  CRISPR gRNA sequence
tatttttagtagagacgggg

SEQ ID NO: 134062 - DNA, 20 bp, Artificial
  CRISPR gRNA sequence
ttagtagagacgggggttac

SEQ ID NO: 134063 - DNA, 20 bp, Artificial
  CRISPR gRNA sequence
tagtagagacgggggttaca

SEQ ID NO: 134064 - DNA, 20 bp, Artificial
  CRISPR gRNA sequence
agtagagacgggggttacac

SEQ ID NO: 134065 - DNA, 20 bp, Artificial
  CRISPR gRNA sequence
gtagagacgggggttacacc

SEQ ID NO: 134066 - DNA, 20 bp, Artificial
  CRISPR gRNA sequence
caccatgttggccaggctgg

SEQ ID NO: 134067 - DNA, 20 bp, Artificial
  CRISPR gRNA sequence
gccaggctggtctcaaactc

SEQ ID NO: 134068 - DNA, 20 bp, Artificial
  CRISPR gRNA sequence
gtctcaaactcctgacctca

SEQ ID NO: 134069 - DNA, 20 bp, Artificial
  CRISPR gRNA sequence
aaactcctgacctcaggtga

SEQ ID NO: 134070 - DNA, 20 bp, Artificial
  CRISPR gRNA sequence
ctgacctcaggtgatccacc

SEQ ID NO: 134071 - DNA, 20 bp, Artificial
  CRISPR gRNA sequence
acctcaggtgatccacctgc

SEQ ID NO: 134072 - DNA, 20 bp, Artificial
  CRISPR gRNA sequence
aggtgatccacctgcctcgg

SEQ ID NO: 134073 - DNA, 20 bp, Artificial
  CRISPR gRNA sequence
cctcggcctcccaaagtgct

SEQ ID NO: 134074 - DNA, 20 bp, Artificial
  CRISPR gRNA sequence
ggcctcccaaagtgctggga

SEQ ID NO: 134075 - DNA, 20 bp, Artificial
  CRISPR gRNA sequence
ccaaagtgctgggattacag

SEQ ID NO: 134076 - DNA, 20 bp, Artificial
  CRISPR gRNA sequence
ggattacaggtgtgagccac

SEQ ID NO: 134077 - DNA, 20 bp, Artificial
  CRISPR gRNA sequence
caggtgtgagccaccatgcc

SEQ ID NO: 134078 - DNA, 20 bp, Artificial
  CRISPR gRNA sequence
tgcttttaagaaaataagag

SEQ ID NO: 134079 - DNA, 20 bp, Artificial
  CRISPR gRNA sequence
ttaagaaaataagagacatt

SEQ ID NO: 134080 - DNA, 20 bp, Artificial
  CRISPR gRNA sequence
taagaaaataagagacatta

SEQ ID NO: 134081 - DNA, 20 bp, Artificial
  CRISPR gRNA sequence
aagaaaataagagacattat

SEQ ID NO: 134082 - DNA, 20 bp, Artificial
  CRISPR gRNA sequence
agaaaataagagacattatt

SEQ ID NO: 134083 - DNA, 20 bp, Artificial
  CRISPR gRNA sequence
tttattttaactttgtaaat

SEQ ID NO: 134084 - DNA, 20 bp, Artificial
  CRISPR gRNA sequence
attttaactttgtaaatgta

SEQ ID NO: 134085 - DNA, 20 bp, Artificial
  CRISPR gRNA sequence
ttttaactttgtaaatgtat

SEQ ID NO: 134086 - DNA, 20 bp, Artificial
  CRISPR gRNA sequence
taactttgtaaatgtattac

SEQ ID NO: 134087 - DNA, 20 bp, Artificial
  CRISPR gRNA sequence
aactttgtaaatgtattact

SEQ ID NO: 134088 - DNA, 20 bp, Artificial
  CRISPR gRNA sequence
actttgtaaatgtattactt

SEQ ID NO: 134089 - DNA, 20 bp, Artificial
  CRISPR gRNA sequence
tgtaaatgtattacttgttt

SEQ ID NO: 134090 - DNA, 20 bp, Artificial
  CRISPR gRNA sequence
gtaaatgtattacttgtttt

SEQ ID NO: 134091 - DNA, 20 bp, Artificial
  CRISPR gRNA sequence
taaatgtattacttgtttta

SEQ ID NO: 134092 - DNA, 20 bp, Artificial
  CRISPR gRNA sequence
cttgttttaaaaattcattt

SEQ ID NO: 134093 - DNA, 20 bp, Artificial
  CRISPR gRNA sequence
gttttaaaaattcattttgt

SEQ ID NO: 134094 - DNA, 20 bp, Artificial
  CRISPR gRNA sequence
ttttaaaaattcattttgta

SEQ ID NO: 134095 - DNA, 20 bp, Artificial
  CRISPR gRNA sequence
taaaaattcattttgtagta

SEQ ID NO: 134096 - DNA, 20 bp, Artificial
  CRISPR gRNA sequence
aaaaattcattttgtagtaa

SEQ ID NO: 134097 - DNA, 20 bp, Artificial
  CRISPR gRNA sequence
aaaattcattttgtagtaaa

SEQ ID NO: 134098 - DNA, 20 bp, Artificial
  CRISPR gRNA sequence
attttgtagtaaattatgta

SEQ ID NO: 134099 - DNA, 20 bp, Artificial
  CRISPR gRNA sequence
tgtagtaaattatgtaacat

SEQ ID NO: 134100 - DNA, 20 bp, Artificial
  CRISPR gRNA sequence
gtagtaaattatgtaacatt

SEQ ID NO: 134101 - DNA, 20 bp, Artificial
  CRISPR gRNA sequence
tagtaaattatgtaacattt

SEQ ID NO: 134102 - DNA, 20 bp, Artificial
  CRISPR gRNA sequence
tgtaacatttctcagaagta

SEQ ID NO: 134103 - DNA, 20 bp, Artificial
  CRISPR gRNA sequence
ctcagaagtatttaattgct

SEQ ID NO: 134104 - DNA, 20 bp, Artificial
  CRISPR gRNA sequence
tcagaagtatttaattgctt

SEQ ID NO: 134105 - DNA, 20 bp, Artificial
  CRISPR gRNA sequence
agaagtatttaattgcttat

SEQ ID NO: 134106 - DNA, 20 bp, Artificial
  CRISPR gRNA sequence
aattgcttatatcagcagtc

SEQ ID NO: 134107 - DNA, 20 bp, Artificial
  CRISPR gRNA sequence
attgcttatatcagcagtcc

SEQ ID NO: 134108 - DNA, 20 bp, Artificial
  CRISPR gRNA sequence
cttatatcagcagtcctcaa

SEQ ID NO: 134109 - DNA, 20 bp, Artificial
  CRISPR gRNA sequence
atatcagcagtcctcaacat

SEQ ID NO: 134110 - DNA, 20 bp, Artificial
  CRISPR gRNA sequence
tatcagcagtcctcaacatt

SEQ ID NO: 134111 - DNA, 20 bp, Artificial
  CRISPR gRNA sequence
aacatttttggcaccaggga

SEQ ID NO: 134112 - DNA, 20 bp, Artificial
  CRISPR gRNA sequence
ttggcaccagggacctgttt

SEQ ID NO: 134113 - DNA, 20 bp, Artificial
  CRISPR gRNA sequence
tggcaccagggacctgtttt

SEQ ID NO: 134114 - DNA, 20 bp, Artificial
  CRISPR gRNA sequence
ggcaccagggacctgttttg

SEQ ID NO: 134115 - DNA, 20 bp, Artificial
  CRISPR gRNA sequence
gcaccagggacctgttttgt

SEQ ID NO: 134116 - DNA, 20 bp, Artificial
  CRISPR gRNA sequence
ttttgtggaaagcaattttt

SEQ ID NO: 134117 - DNA, 20 bp, Artificial
  CRISPR gRNA sequence
tgtggaaagcaatttttcca

SEQ ID NO: 134118 - DNA, 20 bp, Artificial
  CRISPR gRNA sequence
gtggaaagcaatttttccac

SEQ ID NO: 134119 - DNA, 20 bp, Artificial
  CRISPR gRNA sequence
tggaaagcaatttttccacg

SEQ ID NO: 134120 - DNA, 20 bp, Artificial
  CRISPR gRNA sequence
ttccacgctctggggtcagg

SEQ ID NO: 134121 - DNA, 20 bp, Artificial
  CRISPR gRNA sequence
tccacgctctggggtcaggg

SEQ ID NO: 134122 - DNA, 20 bp, Artificial
  CRISPR gRNA sequence
ccacgctctggggtcagggg

SEQ ID NO: 134123 - DNA, 20 bp, Artificial
  CRISPR gRNA sequence
cacgctctggggtcagggga

SEQ ID NO: 134124 - DNA, 20 bp, Artificial
  CRISPR gRNA sequence
tggggtcaggggaggggtgc

SEQ ID NO: 134125 - DNA, 20 bp, Artificial
  CRISPR gRNA sequence
gggtcaggggaggggtgcga

SEQ ID NO: 134126 - DNA, 20 bp, Artificial
  CRISPR gRNA sequence
caggatgaaactgttccacc

SEQ ID NO: 134127 - DNA, 20 bp, Artificial
  CRISPR gRNA sequence
aggatgaaactgttccacct

SEQ ID NO: 134128 - DNA, 20 bp, Artificial
  CRISPR gRNA sequence
ttccacctcagatcatcagg

SEQ ID NO: 134129 - DNA, 20 bp, Artificial
  CRISPR gRNA sequence
cacctcagatcatcaggcat

SEQ ID NO: 134130 - DNA, 20 bp, Artificial
  CRISPR gRNA sequence
agatcatcaggcattagtta

SEQ ID NO: 134131 - DNA, 20 bp, Artificial
  CRISPR gRNA sequence
gttagattctcataaggaac

SEQ ID NO: 134132 - DNA, 20 bp, Artificial
  CRISPR gRNA sequence
gattctcataaggaacgcac

SEQ ID NO: 134133 - DNA, 20 bp, Artificial
  CRISPR gRNA sequence
tcataaggaacgcacagcct

SEQ ID NO: 134134 - DNA, 20 bp, Artificial
  CRISPR gRNA sequence
ataaggaacgcacagcctag

SEQ ID NO: 134135 - DNA, 20 bp, Artificial
  CRISPR gRNA sequence
gatcccttgcatgcgcagtt

SEQ ID NO: 134136 - DNA, 20 bp, Artificial
  CRISPR gRNA sequence
gcatgcgcagttcacaatag

SEQ ID NO: 134137 - DNA, 20 bp, Artificial
  CRISPR gRNA sequence
catgcgcagttcacaatagg

SEQ ID NO: 134138 - DNA, 20 bp, Artificial
  CRISPR gRNA sequence
acaatagggttccagcgcct

SEQ ID NO: 134139 - DNA, 20 bp, Artificial
  CRISPR gRNA sequence
cagcgcctatgagaatctca

SEQ ID NO: 134140 - DNA, 20 bp, Artificial
  CRISPR gRNA sequence
tgagaatctcacgtggccgc

SEQ ID NO: 134141 - DNA, 20 bp, Artificial
  CRISPR gRNA sequence
acgtggccgctgatctgacc

SEQ ID NO: 134142 - DNA, 20 bp, Artificial
  CRISPR gRNA sequence
atctgaccgaaggcggagct

SEQ ID NO: 134143 - DNA, 20 bp, Artificial
  CRISPR gRNA sequence
accgaaggcggagctcaggt

SEQ ID NO: 134144 - DNA, 20 bp, Artificial
  CRISPR gRNA sequence
aggtggtaatgctggattac

SEQ ID NO: 134145 - DNA, 20 bp, Artificial
  CRISPR gRNA sequence
gattaccagaccctcacctc

SEQ ID NO: 134146 - DNA, 20 bp, Artificial
  CRISPR gRNA sequence
ccagaccctcacctcctgct

SEQ ID NO: 134147 - DNA, 20 bp, Artificial
  CRISPR gRNA sequence
acctcctgctgtgtggctgg

SEQ ID NO: 134148 - DNA, 20 bp, Artificial
  CRISPR gRNA sequence
ctgctgtgtggctgggttct

SEQ ID NO: 134149 - DNA, 20 bp, Artificial
  CRISPR gRNA sequence
ctgtgtggctgggttcttaa

SEQ ID NO: 134150 - DNA, 20 bp, Artificial
  CRISPR gRNA sequence
tgtggctgggttcttaacag

SEQ ID NO: 134151 - DNA, 20 bp, Artificial
  CRISPR gRNA sequence
ggttcttaacaggccacgga

SEQ ID NO: 134152 - DNA, 20 bp, Artificial
  CRISPR gRNA sequence
ttaacaggccacggacactc

SEQ ID NO: 134153 - DNA, 20 bp, Artificial
  CRISPR gRNA sequence
aacaggccacggacactcat

SEQ ID NO: 134154 - DNA, 20 bp, Artificial
  CRISPR gRNA sequence
acaggccacggacactcatc

SEQ ID NO: 134155 - DNA, 20 bp, Artificial
  CRISPR gRNA sequence
atcagtctgcagcctggggg

SEQ ID NO: 134156 - DNA, 20 bp, Artificial
  CRISPR gRNA sequence
cagcctgggggttggggatc

SEQ ID NO: 134157 - DNA, 20 bp, Artificial
  CRISPR gRNA sequence
ggggttggggatcactgact

SEQ ID NO: 134158 - DNA, 20 bp, Artificial
  CRISPR gRNA sequence
gggatcactgacttatatta

SEQ ID NO: 134159 - DNA, 20 bp, Artificial
  CRISPR gRNA sequence
acttatattacagtacttaa

SEQ ID NO: 134160 - DNA, 20 bp, Artificial
  CRISPR gRNA sequence
atattacagtacttaaatag

SEQ ID NO: 134161 - DNA, 20 bp, Artificial
  CRISPR gRNA sequence
tattacagtacttaaataga

SEQ ID NO: 134162 - DNA, 20 bp, Artificial
  CRISPR gRNA sequence
cagtacttaaatagaaagtc

SEQ ID NO: 134163 - DNA, 20 bp, Artificial
  CRISPR gRNA sequence
aaatagaaagtcctttcttt

SEQ ID NO: 134164 - DNA, 20 bp, Artificial
  CRISPR gRNA sequence
aatagaaagtcctttctttt

SEQ ID NO: 134165 - DNA, 20 bp, Artificial
  CRISPR gRNA sequence
tctttttccctttgtttatt

SEQ ID NO: 134166 - DNA, 20 bp, Artificial
  CRISPR gRNA sequence
ctttttccctttgtttatta

SEQ ID NO: 134167 - DNA, 20 bp, Artificial
  CRISPR gRNA sequence
tttttccctttgtttattac

SEQ ID NO: 134168 - DNA, 20 bp, Artificial
  CRISPR gRNA sequence
tttccctttgtttattacta

SEQ ID NO: 134169 - DNA, 20 bp, Artificial
  CRISPR gRNA sequence
ttccctttgtttattactaa

SEQ ID NO: 134170 - DNA, 20 bp, Artificial
  CRISPR gRNA sequence
tccctttgtttattactaac

SEQ ID NO: 134171 - DNA, 20 bp, Artificial
  CRISPR gRNA sequence
ccctttgtttattactaact

SEQ ID NO: 134172 - DNA, 20 bp, Artificial
  CRISPR gRNA sequence
cctttgtttattactaacta

SEQ ID NO: 134173 - DNA, 20 bp, Artificial
  CRISPR gRNA sequence
tgtttattactaactatagc

SEQ ID NO: 134174 - DNA, 20 bp, Artificial
  CRISPR gRNA sequence
gtttattactaactatagca

SEQ ID NO: 134175 - DNA, 20 bp, Artificial
  CRISPR gRNA sequence
tttattactaactatagcat

SEQ ID NO: 134176 - DNA, 20 bp, Artificial
  CRISPR gRNA sequence
attactaactatagcatagt

SEQ ID NO: 134177 - DNA, 20 bp, Artificial
  CRISPR gRNA sequence
ttactaactatagcatagtt

SEQ ID NO: 134178 - DNA, 20 bp, Artificial
  CRISPR gRNA sequence
ctaactatagcatagttata

SEQ ID NO: 134179 - DNA, 20 bp, Artificial
  CRISPR gRNA sequence
actatagcatagttatataa

SEQ ID NO: 134180 - DNA, 20 bp, Artificial
  CRISPR gRNA sequence
tagcatagttatataatgat

SEQ ID NO: 134181 - DNA, 20 bp, Artificial
  CRISPR gRNA sequence
tataatgatttaagggcaca

SEQ ID NO: 134182 - DNA, 20 bp, Artificial
  CRISPR gRNA sequence
aagggcacagactttgtatt

SEQ ID NO: 134183 - DNA, 20 bp, Artificial
  CRISPR gRNA sequence
agggcacagactttgtattc

SEQ ID NO: 134184 - DNA, 20 bp, Artificial
  CRISPR gRNA sequence
tgtattcagactaccaggag

SEQ ID NO: 134185 - DNA, 20 bp, Artificial
  CRISPR gRNA sequence
gtattcagactaccaggagg

SEQ ID NO: 134186 - DNA, 20 bp, Artificial
  CRISPR gRNA sequence
tattcagactaccaggaggc

SEQ ID NO: 134187 - DNA, 20 bp, Artificial
  CRISPR gRNA sequence
agactaccaggaggctgaat

SEQ ID NO: 134188 - DNA, 20 bp, Artificial
  CRISPR gRNA sequence
ccaggaggctgaatcccagc

SEQ ID NO: 134189 - DNA, 20 bp, Artificial
  CRISPR gRNA sequence
aatcccagctctgccacatg

SEQ ID NO: 134190 - DNA, 20 bp, Artificial
  CRISPR gRNA sequence
tgccacatgcaaattctgtg

SEQ ID NO: 134191 - DNA, 20 bp, Artificial
  CRISPR gRNA sequence
ccacatgcaaattctgtggc

SEQ ID NO: 134192 - DNA, 20 bp, Artificial
  CRISPR gRNA sequence
tgtggccttggacagattat

SEQ ID NO: 134193 - DNA, 20 bp, Artificial
  CRISPR gRNA sequence
tggccttggacagattattt

SEQ ID NO: 134194 - DNA, 20 bp, Artificial
  CRISPR gRNA sequence
ggacagattatttaattact

SEQ ID NO: 134195 - DNA, 20 bp, Artificial
  CRISPR gRNA sequence
gacagattatttaattactt

SEQ ID NO: 134196 - DNA, 20 bp, Artificial
  CRISPR gRNA sequence
tttaattactttaggccttg

SEQ ID NO: 134197 - DNA, 20 bp, Artificial
  CRISPR gRNA sequence
aattactttaggccttggtt

SEQ ID NO: 134198 - DNA, 20 bp, Artificial
  CRISPR gRNA sequence
attactttaggccttggttt

SEQ ID NO: 134199 - DNA, 20 bp, Artificial
  CRISPR gRNA sequence
ctttaggccttggtttcctc

SEQ ID NO: 134200 - DNA, 20 bp, Artificial
  CRISPR gRNA sequence
taggccttggtttcctcatc

SEQ ID NO: 134201 - DNA, 20 bp, Artificial
  CRISPR gRNA sequence
aggccttggtttcctcatct

SEQ ID NO: 134202 - DNA, 20 bp, Artificial
  CRISPR gRNA sequence
ggccttggtttcctcatctg

SEQ ID NO: 134203 - DNA, 20 bp, Artificial
  CRISPR gRNA sequence
ggtttcctcatctgtaaaat

SEQ ID NO: 134204 - DNA, 20 bp, Artificial
  CRISPR gRNA sequence
gtttcctcatctgtaaaatg

SEQ ID NO: 134205 - DNA, 20 bp, Artificial
  CRISPR gRNA sequence
cctcatctgtaaaatgaggc

SEQ ID NO: 134206 - DNA, 20 bp, Artificial
  CRISPR gRNA sequence
ctcatctgtaaaatgaggct

SEQ ID NO: 134207 - DNA, 20 bp, Artificial
  CRISPR gRNA sequence
atctgtaaaatgaggctaat

SEQ ID NO: 134208 - DNA, 20 bp, Artificial
  CRISPR gRNA sequence
taaaatgaggctaatagtac

SEQ ID NO: 134209 - DNA, 20 bp, Artificial
  CRISPR gRNA sequence
atagtacctatatcatagaa

SEQ ID NO: 134210 - DNA, 20 bp, Artificial
  CRISPR gRNA sequence
tatcatagaattatggatgg

SEQ ID NO: 134211 - DNA, 20 bp, Artificial
  CRISPR gRNA sequence
tggatggtactaaataatgt

SEQ ID NO: 134212 - DNA, 20 bp, Artificial
  CRISPR gRNA sequence
aataatgttcagtgctcatt

SEQ ID NO: 134213 - DNA, 20 bp, Artificial
  CRISPR gRNA sequence
agtgctcattaatgttactt

SEQ ID NO: 134214 - DNA, 20 bp, Artificial
  CRISPR gRNA sequence
attaatgttacttcttgctg

SEQ ID NO: 134215 - DNA, 20 bp, Artificial
  CRISPR gRNA sequence
atgttacttcttgctgctat

SEQ ID NO: 134216 - DNA, 20 bp, Artificial
  CRISPR gRNA sequence
cttcttgctgctattgttaa

SEQ ID NO: 134217 - DNA, 20 bp, Artificial
  CRISPR gRNA sequence
cttgctgctattgttaattt

SEQ ID NO: 134218 - DNA, 20 bp, Artificial
  CRISPR gRNA sequence
ttgctgctattgttaatttc

SEQ ID NO: 134219 - DNA, 20 bp, Artificial
  CRISPR gRNA sequence
gctgctattgttaatttcaa

SEQ ID NO: 134220 - DNA, 20 bp, Artificial
  CRISPR gRNA sequence
ctgctattgttaatttcaaa

SEQ ID NO: 134221 - DNA, 20 bp, Artificial
  CRISPR gRNA sequence
ctattgttaatttcaaagaa

SEQ ID NO: 134222 - DNA, 20 bp, Artificial
  CRISPR gRNA sequence
ttgttaatttcaaagaagta

SEQ ID NO: 134223 - DNA, 20 bp, Artificial
  CRISPR gRNA sequence
ttaatttcaaagaagtagca

SEQ ID NO: 134224 - DNA, 20 bp, Artificial
  CRISPR gRNA sequence
atttcaaagaagtagcatta

SEQ ID NO: 134225 - DNA, 20 bp, Artificial
  CRISPR gRNA sequence
caaagaagtagcattaaaag

SEQ ID NO: 134226 - DNA, 20 bp, Artificial
  CRISPR gRNA sequence
aaagaagtagcattaaaagt

SEQ ID NO: 134227 - DNA, 20 bp, Artificial
  CRISPR gRNA sequence
aaagtagtaaggttggagtc

SEQ ID NO: 134228 - DNA, 20 bp, Artificial
  CRISPR gRNA sequence
gagtcttttagataataaaa

SEQ ID NO: 134229 - DNA, 20 bp, Artificial
  CRISPR gRNA sequence
ttagataataaaaagaggaa

SEQ ID NO: 134230 - DNA, 20 bp, Artificial
  CRISPR gRNA sequence
tagataataaaaagaggaag

SEQ ID NO: 134231 - DNA, 20 bp, Artificial
  CRISPR gRNA sequence
agataataaaaagaggaagg

SEQ ID NO: 134232 - DNA, 20 bp, Artificial
  CRISPR gRNA sequence
gataataaaaagaggaaggt

SEQ ID NO: 134233 - DNA, 20 bp, Artificial
  CRISPR gRNA sequence
attattgattgaattcttct

SEQ ID NO: 134234 - DNA, 20 bp, Artificial
  CRISPR gRNA sequence
ttattgattgaattcttcta

SEQ ID NO: 134235 - DNA, 20 bp, Artificial
  CRISPR gRNA sequence
ttgattgaattcttctatat

SEQ ID NO: 134236 - DNA, 20 bp, Artificial
  CRISPR gRNA sequence
attgaattcttctatatttc

SEQ ID NO: 134237 - DNA, 20 bp, Artificial
  CRISPR gRNA sequence
aattcttctatatttcttag

SEQ ID NO: 134238 - DNA, 20 bp, Artificial
  CRISPR gRNA sequence
ttctatatttcttaggttta

SEQ ID NO: 134239 - DNA, 20 bp, Artificial
  CRISPR gRNA sequence
ctatatttcttaggtttatc

SEQ ID NO: 134240 - DNA, 20 bp, Artificial
  CRISPR gRNA sequence
tatatttcttaggtttatct

SEQ ID NO: 134241 - DNA, 20 bp, Artificial
  CRISPR gRNA sequence
tatttcttaggtttatcttt

SEQ ID NO: 134242 - DNA, 20 bp, Artificial
  CRISPR gRNA sequence
cttaggtttatctttgcctg

SEQ ID NO: 134243 - DNA, 20 bp, Artificial
  CRISPR gRNA sequence
ttaggtttatctttgcctgt

SEQ ID NO: 134244 - DNA, 20 bp, Artificial
  CRISPR gRNA sequence
aggtttatctttgcctgtag

SEQ ID NO: 134245 - DNA, 20 bp, Artificial
  CRISPR gRNA sequence
ggtttatctttgcctgtagg

SEQ ID NO: 134246 - DNA, 20 bp, Artificial
  CRISPR gRNA sequence
atctttgcctgtaggaatgg

SEQ ID NO: 134247 - DNA, 20 bp, Artificial
  CRISPR gRNA sequence
tctttgcctgtaggaatgga

SEQ ID NO: 134248 - DNA, 20 bp, Artificial
  CRISPR gRNA sequence
tgcctgtaggaatggatttt

SEQ ID NO: 134249 - DNA, 20 bp, Artificial
  CRISPR gRNA sequence
gcctgtaggaatggattttg

SEQ ID NO: 134250 - DNA, 20 bp, Artificial
  CRISPR gRNA sequence
cctgtaggaatggattttgt

SEQ ID NO: 134251 - DNA, 20 bp, Artificial
  CRISPR gRNA sequence
taggaatggattttgtgaaa

SEQ ID NO: 134252 - DNA, 20 bp, Artificial
  CRISPR gRNA sequence
tgtgaaaagcagttgagttc

SEQ ID NO: 134253 - DNA, 20 bp, Artificial
  CRISPR gRNA sequence
gtgaaaagcagttgagttca

SEQ ID NO: 134254 - DNA, 20 bp, Artificial
  CRISPR gRNA sequence
tgaaaagcagttgagttcag

SEQ ID NO: 134255 - DNA, 20 bp, Artificial
  CRISPR gRNA sequence
agttcagcatatttatttcc

SEQ ID NO: 134256 - DNA, 20 bp, Artificial
  CRISPR gRNA sequence
agcatatttatttccacatg

SEQ ID NO: 134257 - DNA, 20 bp, Artificial
  CRISPR gRNA sequence
atttccacatgccagcttag

SEQ ID NO: 134258 - DNA, 20 bp, Artificial
  CRISPR gRNA sequence
tttccacatgccagcttagg

SEQ ID NO: 134259 - DNA, 20 bp, Artificial
  CRISPR gRNA sequence
ccacatgccagcttaggtgt

SEQ ID NO: 134260 - DNA, 20 bp, Artificial
  CRISPR gRNA sequence
cacatgccagcttaggtgtc

SEQ ID NO: 134261 - DNA, 20 bp, Artificial
  CRISPR gRNA sequence
aggtgtcagattcacattac

SEQ ID NO: 134262 - DNA, 20 bp, Artificial
  CRISPR gRNA sequence
ggtgtcagattcacattact

SEQ ID NO: 134263 - DNA, 20 bp, Artificial
  CRISPR gRNA sequence
acattactttcaaaatatat

SEQ ID NO: 134264 - DNA, 20 bp, Artificial
  CRISPR gRNA sequence
ctttcaaaatatattcttaa

SEQ ID NO: 134265 - DNA, 20 bp, Artificial
  CRISPR gRNA sequence
tcaaaatatattcttaatat

SEQ ID NO: 134266 - DNA, 20 bp, Artificial
  CRISPR gRNA sequence
caaaatatattcttaatatc

SEQ ID NO: 134267 - DNA, 20 bp, Artificial
  CRISPR gRNA sequence
aaaatatattcttaatatct

SEQ ID NO: 134268 - DNA, 20 bp, Artificial
  CRISPR gRNA sequence
ttaatatctttagtgtttga

SEQ ID NO: 134269 - DNA, 20 bp, Artificial
  CRISPR gRNA sequence
aatatctttagtgtttgaat

SEQ ID NO: 134270 - DNA, 20 bp, Artificial
  CRISPR gRNA sequence
atatctttagtgtttgaatc

SEQ ID NO: 134271 - DNA, 20 bp, Artificial
  CRISPR gRNA sequence
tagtgtttgaatcccattaa

SEQ ID NO: 134272 - DNA, 20 bp, Artificial
  CRISPR gRNA sequence
agtgtttgaatcccattaaa

SEQ ID NO: 134273 - DNA, 20 bp, Artificial
  CRISPR gRNA sequence
gtgtttgaatcccattaaat

SEQ ID NO: 134274 - DNA, 20 bp, Artificial
  CRISPR gRNA sequence
gaatcccattaaattagtga

SEQ ID NO: 134275 - DNA, 20 bp, Artificial
  CRISPR gRNA sequence
aatcccattaaattagtgat

SEQ ID NO: 134276 - DNA, 20 bp, Artificial
  CRISPR gRNA sequence
aattagtgatatttgcatgg

SEQ ID NO: 134277 - DNA, 20 bp, Artificial
  CRISPR gRNA sequence
gtgatatttgcatggaataa

SEQ ID NO: 134278 - DNA, 20 bp, Artificial
  CRISPR gRNA sequence
gcatggaataattgaagtag

SEQ ID NO: 134279 - DNA, 20 bp, Artificial
  CRISPR gRNA sequence
catggaataattgaagtagg

SEQ ID NO: 134280 - DNA, 20 bp, Artificial
  CRISPR gRNA sequence
aagtaggaaaagaatgtgta

SEQ ID NO: 134281 - DNA, 20 bp, Artificial
  CRISPR gRNA sequence
ctgacattatttttacagat

SEQ ID NO: 134282 - DNA, 20 bp, Artificial
  CRISPR gRNA sequence
acattatttttacagatctt

SEQ ID NO: 134283 - DNA, 20 bp, Artificial
  CRISPR gRNA sequence
tttttacagatcttcagtat

SEQ ID NO: 134284 - DNA, 20 bp, Artificial
  CRISPR gRNA sequence
ttacagatcttcagtatcat

SEQ ID NO: 134285 - DNA, 20 bp, Artificial
  CRISPR gRNA sequence
tacagatcttcagtatcata

SEQ ID NO: 134286 - DNA, 20 bp, Artificial
  CRISPR gRNA sequence
acagatcttcagtatcatag

SEQ ID NO: 134287 - DNA, 20 bp, Artificial
  CRISPR gRNA sequence
cagatcttcagtatcatagg

SEQ ID NO: 134288 - DNA, 20 bp, Artificial
  CRISPR gRNA sequence
cagtatcataggaacctaga

SEQ ID NO: 134289 - DNA, 20 bp, Artificial
  CRISPR gRNA sequence
agtatcataggaacctagaa

SEQ ID NO: 134290 - DNA, 20 bp, Artificial
  CRISPR gRNA sequence
gaagtatttggccaaattaa

SEQ ID NO: 134291 - DNA, 20 bp, Artificial
  CRISPR gRNA sequence
ggccaaattaatttaggaat

SEQ ID NO: 134292 - DNA, 20 bp, Artificial
  CRISPR gRNA sequence
gccaaattaatttaggaatt

SEQ ID NO: 134293 - DNA, 20 bp, Artificial
  CRISPR gRNA sequence
atttaggaatttttaactct

SEQ ID NO: 134294 - DNA, 20 bp, Artificial
  CRISPR gRNA sequence
aggaatttttaactctcagc

SEQ ID NO: 134295 - DNA, 20 bp, Artificial
  CRISPR gRNA sequence
ggaatttttaactctcagct

SEQ ID NO: 134296 - DNA, 20 bp, Artificial
  CRISPR gRNA sequence
ttaactctcagcttgctaca

SEQ ID NO: 134297 - DNA, 20 bp, Artificial
  CRISPR gRNA sequence
taactctcagcttgctacag

SEQ ID NO: 134298 - DNA, 20 bp, Artificial
  CRISPR gRNA sequence
aactctcagcttgctacagt

SEQ ID NO: 134299 - DNA, 20 bp, Artificial
  CRISPR gRNA sequence
actctcagcttgctacagta

SEQ ID NO: 134300 - DNA, 20 bp, Artificial
  CRISPR gRNA sequence
tcagcttgctacagtactgc

SEQ ID NO: 134301 - DNA, 20 bp, Artificial
  CRISPR gRNA sequence
agcttgctacagtactgccc

SEQ ID NO: 134302 - DNA, 20 bp, Artificial
  CRISPR gRNA sequence
gctacagtactgcccagttg

SEQ ID NO: 134303 - DNA, 20 bp, Artificial
  CRISPR gRNA sequence
ctacagtactgcccagttgg

SEQ ID NO: 134304 - DNA, 20 bp, Artificial
  CRISPR gRNA sequence
cagtactgcccagttggctg

SEQ ID NO: 134305 - DNA, 20 bp, Artificial
  CRISPR gRNA sequence
cccagttggctgagagacat

SEQ ID NO: 134306 - DNA, 20 bp, Artificial
  CRISPR gRNA sequence
gctgagagacatatatatac

SEQ ID NO: 134307 - DNA, 20 bp, Artificial
  CRISPR gRNA sequence
agagacatatatatacttaa

SEQ ID NO: 134308 - DNA, 20 bp, Artificial
  CRISPR gRNA sequence
aagtgatcacttggatcatt

SEQ ID NO: 134309 - DNA, 20 bp, Artificial
  CRISPR gRNA sequence
agtgatcacttggatcattt

SEQ ID NO: 134310 - DNA, 20 bp, Artificial
  CRISPR gRNA sequence
ggatcatttgtagatttata

SEQ ID NO: 134311 - DNA, 20 bp, Artificial
  CRISPR gRNA sequence
gatcatttgtagatttataa

SEQ ID NO: 134312 - DNA, 20 bp, Artificial
  CRISPR gRNA sequence
gtagatttataagctcaata

SEQ ID NO: 134313 - DNA, 20 bp, Artificial
  CRISPR gRNA sequence
tagatttataagctcaatat

SEQ ID NO: 134314 - DNA, 20 bp, Artificial
  CRISPR gRNA sequence
ataagctcaatattggtggt

SEQ ID NO: 134315 - DNA, 20 bp, Artificial
  CRISPR gRNA sequence
taagctcaatattggtggtg

SEQ ID NO: 134316 - DNA, 20 bp, Artificial
  CRISPR gRNA sequence
aatattggtggtgttttgca

SEQ ID NO: 134317 - DNA, 20 bp, Artificial
  CRISPR gRNA sequence
gtggtgttttgcagacttct

SEQ ID NO: 134318 - DNA, 20 bp, Artificial
  CRISPR gRNA sequence
tgcagacttcttcatctgta

SEQ ID NO: 134319 - DNA, 20 bp, Artificial
  CRISPR gRNA sequence
gcagacttcttcatctgtaa

SEQ ID NO: 134320 - DNA, 20 bp, Artificial
  CRISPR gRNA sequence
cagacttcttcatctgtaag

SEQ ID NO: 134321 - DNA, 20 bp, Artificial
  CRISPR gRNA sequence
cttcatctgtaagtagagtt

SEQ ID NO: 134322 - DNA, 20 bp, Artificial
  CRISPR gRNA sequence
ttcatctgtaagtagagtta

SEQ ID NO: 134323 - DNA, 20 bp, Artificial
  CRISPR gRNA sequence
catctgtaagtagagttacc

SEQ ID NO: 134324 - DNA, 20 bp, Artificial
  CRISPR gRNA sequence
atctgtaagtagagttaccc

SEQ ID NO: 134325 - DNA, 20 bp, Artificial
  CRISPR gRNA sequence
taagtagagttacccctttg

SEQ ID NO: 134326 - DNA, 20 bp, Artificial
  CRISPR gRNA sequence
cccctttgatatgatgtgga

SEQ ID NO: 134327 - DNA, 20 bp, Artificial
  CRISPR gRNA sequence
tgatatgatgtggaattaga

SEQ ID NO: 134328 - DNA, 20 bp, Artificial
  CRISPR gRNA sequence
gatatgatgtggaattagaa

SEQ ID NO: 134329 - DNA, 20 bp, Artificial
  CRISPR gRNA sequence
atatgatgtggaattagaat

SEQ ID NO: 134330 - DNA, 20 bp, Artificial
  CRISPR gRNA sequence
gaataatttatttttatctg

SEQ ID NO: 134331 - DNA, 20 bp, Artificial
  CRISPR gRNA sequence
atttttatctgtaaatactt

SEQ ID NO: 134332 - DNA, 20 bp, Artificial
  CRISPR gRNA sequence
tttttatctgtaaatacttt

SEQ ID NO: 134333 - DNA, 20 bp, Artificial
  CRISPR gRNA sequence
ttatctgtaaatactttgct

SEQ ID NO: 134334 - DNA, 20 bp, Artificial
  CRISPR gRNA sequence
tatctgtaaatactttgctt

SEQ ID NO: 134335 - DNA, 20 bp, Artificial
  CRISPR gRNA sequence
atctgtaaatactttgcttt

SEQ ID NO: 134336 - DNA, 20 bp, Artificial
  CRISPR gRNA sequence
tctgtaaatactttgctttc

SEQ ID NO: 134337 - DNA, 20 bp, Artificial
  CRISPR gRNA sequence
taaatactttgctttctagg

SEQ ID NO: 134338 - DNA, 20 bp, Artificial
  CRISPR gRNA sequence
tgctttctaggtcattacta

SEQ ID NO: 134339 - DNA, 20 bp, Artificial
  CRISPR gRNA sequence
gctttctaggtcattactaa

SEQ ID NO: 134340 - DNA, 20 bp, Artificial
  CRISPR gRNA sequence
ctttctaggtcattactaac

SEQ ID NO: 134341 - DNA, 20 bp, Artificial
  CRISPR gRNA sequence
tctaggtcattactaactct

SEQ ID NO: 134342 - DNA, 20 bp, Artificial
  CRISPR gRNA sequence
ctaggtcattactaactctg

SEQ ID NO: 134343 - DNA, 20 bp, Artificial
  CRISPR gRNA sequence
taggtcattactaactctgt

SEQ ID NO: 134344 - DNA, 20 bp, Artificial
  CRISPR gRNA sequence
ggtcattactaactctgtct

SEQ ID NO: 134345 - DNA, 20 bp, Artificial
  CRISPR gRNA sequence
ctaactctgtcttgttaatg

SEQ ID NO: 134346 - DNA, 20 bp, Artificial
  CRISPR gRNA sequence
actctgtcttgttaatgatt

SEQ ID NO: 134347 - DNA, 20 bp, Artificial
  CRISPR gRNA sequence
tgtcttgttaatgattacag

SEQ ID NO: 134348 - DNA, 20 bp, Artificial
  CRISPR gRNA sequence
tcttgttaatgattacagct

SEQ ID NO: 134349 - DNA, 20 bp, Artificial
  CRISPR gRNA sequence
gttaatgattacagcttata

SEQ ID NO: 134350 - DNA, 20 bp, Artificial
  CRISPR gRNA sequence
ttaatgattacagcttatat

SEQ ID NO: 134351 - DNA, 20 bp, Artificial
  CRISPR gRNA sequence
atgattacagcttatattaa

SEQ ID NO: 134352 - DNA, 20 bp, Artificial
  CRISPR gRNA sequence
cagcttatattaaaagttag

SEQ ID NO: 134353 - DNA, 20 bp, Artificial
  CRISPR gRNA sequence
atattaaaagttagccttct

SEQ ID NO: 134354 - DNA, 20 bp, Artificial
  CRISPR gRNA sequence
tattaaaagttagccttctg

SEQ ID NO: 134355 - DNA, 20 bp, Artificial
  CRISPR gRNA sequence
aaagttagccttctgaaagc

SEQ ID NO: 134356 - DNA, 20 bp, Artificial
  CRISPR gRNA sequence
gccttctgaaagccttcttc

SEQ ID NO: 134357 - DNA, 20 bp, Artificial
  CRISPR gRNA sequence
ctgaaagccttcttcatatg

SEQ ID NO: 134358 - DNA, 20 bp, Artificial
  CRISPR gRNA sequence
tgaaagccttcttcatatgt

SEQ ID NO: 134359 - DNA, 20 bp, Artificial
  CRISPR gRNA sequence
aaagccttcttcatatgtaa

SEQ ID NO: 134360 - DNA, 20 bp, Artificial
  CRISPR gRNA sequence
cttcatatgtaattaaccag

SEQ ID NO: 134361 - DNA, 20 bp, Artificial
  CRISPR gRNA sequence
ttcatatgtaattaaccaga

SEQ ID NO: 134362 - DNA, 20 bp, Artificial
  CRISPR gRNA sequence
catatgtaattaaccagaag

SEQ ID NO: 134363 - DNA, 20 bp, Artificial
  CRISPR gRNA sequence
atatgtaattaaccagaagt

SEQ ID NO: 134364 - DNA, 20 bp, Artificial
  CRISPR gRNA sequence
accagaagtgttaataaata

SEQ ID NO: 134365 - DNA, 20 bp, Artificial
  CRISPR gRNA sequence
ataaatactctgcttagagt

SEQ ID NO: 134366 - DNA, 20 bp, Artificial
  CRISPR gRNA sequence
tgcttagagtttgtaataat

SEQ ID NO: 134367 - DNA, 20 bp, Artificial
  CRISPR gRNA sequence
cttagagtttgtaataatag

SEQ ID NO: 134368 - DNA, 20 bp, Artificial
  CRISPR gRNA sequence
agagtttgtaataatagaag

SEQ ID NO: 134369 - DNA, 20 bp, Artificial
  CRISPR gRNA sequence
gagtttgtaataatagaagc

SEQ ID NO: 134370 - DNA, 20 bp, Artificial
  CRISPR gRNA sequence
gtaataatagaagctcctaa

SEQ ID NO: 134371 - DNA, 20 bp, Artificial
  CRISPR gRNA sequence
taataatagaagctcctaat

SEQ ID NO: 134372 - DNA, 20 bp, Artificial
  CRISPR gRNA sequence
ctaattttaggcaataagta

SEQ ID NO: 134373 - DNA, 20 bp, Artificial
  CRISPR gRNA sequence
attttaggcaataagtaagc

SEQ ID NO: 134374 - DNA, 20 bp, Artificial
  CRISPR gRNA sequence
taggcaataagtaagcattt

SEQ ID NO: 134375 - DNA, 20 bp, Artificial
  CRISPR gRNA sequence
aggcaataagtaagcatttg

SEQ ID NO: 134376 - DNA, 20 bp, Artificial
  CRISPR gRNA sequence
ggcaataagtaagcatttgc

SEQ ID NO: 134377 - DNA, 20 bp, Artificial
  CRISPR gRNA sequence
gcatttggaagacaatttca

SEQ ID NO: 134378 - DNA, 20 bp, Artificial
  CRISPR gRNA sequence
catttggaagacaatttcat

SEQ ID NO: 134379 - DNA, 20 bp, Artificial
  CRISPR gRNA sequence
ggaagacaatttcatttgaa

SEQ ID NO: 134380 - DNA, 20 bp, Artificial
  CRISPR gRNA sequence
gaagacaatttcatttgaat

SEQ ID NO: 134381 - DNA, 20 bp, Artificial
  CRISPR gRNA sequence
catttgaatatcagtgactt

SEQ ID NO: 134382 - DNA, 20 bp, Artificial
  CRISPR gRNA sequence
atttgaatatcagtgacttt

SEQ ID NO: 134383 - DNA, 20 bp, Artificial
  CRISPR gRNA sequence
gaatatcagtgacttttttt

SEQ ID NO: 134384 - DNA, 20 bp, Artificial
  CRISPR gRNA sequence
aatatcagtgactttttttt

SEQ ID NO: 134385 - DNA, 20 bp, Artificial
  CRISPR gRNA sequence
tttttttttccttcctcagg

SEQ ID NO: 134386 - DNA, 20 bp, Artificial
  CRISPR gRNA sequence
ttttttttccttcctcaggc

SEQ ID NO: 134387 - DNA, 20 bp, Artificial
  CRISPR gRNA sequence
tttttttccttcctcaggct

SEQ ID NO: 134388 - DNA, 20 bp, Artificial
  CRISPR gRNA sequence
ttttttccttcctcaggcta

SEQ ID NO: 134389 - DNA, 20 bp, Artificial
  CRISPR gRNA sequence
tttttccttcctcaggctat

SEQ ID NO: 134390 - DNA, 20 bp, Artificial
  CRISPR gRNA sequence
ttttccttcctcaggctatg

SEQ ID NO: 134391 - DNA, 20 bp, Artificial
  CRISPR gRNA sequence
tttccttcctcaggctatga

SEQ ID NO: 134392 - DNA, 20 bp, Artificial
  CRISPR gRNA sequence
ttccttcctcaggctatgaa

SEQ ID NO: 134393 - DNA, 20 bp, Artificial
  CRISPR gRNA sequence
tccttcctcaggctatgaaa

SEQ ID NO: 134394 - DNA, 20 bp, Artificial
  CRISPR gRNA sequence
ccttcctcaggctatgaaag

SEQ ID NO: 134395 - DNA, 20 bp, Artificial
  CRISPR gRNA sequence
cttcctcaggctatgaaagg

SEQ ID NO: 134396 - DNA, 20 bp, Artificial
  CRISPR gRNA sequence
cctcaggctatgaaaggaga

SEQ ID NO: 134397 - DNA, 20 bp, Artificial
  CRISPR gRNA sequence
ctcaggctatgaaaggagaa

SEQ ID NO: 134398 - DNA, 20 bp, Artificial
  CRISPR gRNA sequence
aggctatgaaaggagaaaag

SEQ ID NO: 134399 - DNA, 20 bp, Artificial
  CRISPR gRNA sequence
tgaaaggagaaaagggaatt

SEQ ID NO: 134400 - DNA, 20 bp, Artificial
  CRISPR gRNA sequence
gtggagcagtcacagctaca

SEQ ID NO: 134401 - DNA, 20 bp, Artificial
  CRISPR gRNA sequence
cagatggactaagtgaagag

SEQ ID NO: 134402 - DNA, 20 bp, Artificial
  CRISPR gRNA sequence
agtgaagagcttacagagga

SEQ ID NO: 134403 - DNA, 20 bp, Artificial
  CRISPR gRNA sequence
acagaggaggcatttagtaa

SEQ ID NO: 134404 - DNA, 20 bp, Artificial
  CRISPR gRNA sequence
cagaggaggcatttagtaag

SEQ ID NO: 134405 - DNA, 20 bp, Artificial
  CRISPR gRNA sequence
agtaagcattgttataatac

SEQ ID NO: 134406 - DNA, 20 bp, Artificial
  CRISPR gRNA sequence
gtaagcattgttataataca

SEQ ID NO: 134407 - DNA, 20 bp, Artificial
  CRISPR gRNA sequence
ttataatacaagtcatgtag

SEQ ID NO: 134408 - DNA, 20 bp, Artificial
  CRISPR gRNA sequence
taatacaagtcatgtagatt

SEQ ID NO: 134409 - DNA, 20 bp, Artificial
  CRISPR gRNA sequence
ttagcaatgattcatactaa

SEQ ID NO: 134410 - DNA, 20 bp, Artificial
  CRISPR gRNA sequence
gcaatgattcatactaagta

SEQ ID NO: 134411 - DNA, 20 bp, Artificial
  CRISPR gRNA sequence
atactaagtatctaatggta

SEQ ID NO: 134412 - DNA, 20 bp, Artificial
  CRISPR gRNA sequence
agtatctaatggtatttttg

SEQ ID NO: 134413 - DNA, 20 bp, Artificial
  CRISPR gRNA sequence
atggtatttttggaatgtca

SEQ ID NO: 134414 - DNA, 20 bp, Artificial
  CRISPR gRNA sequence
ttggaatgtcagcagtgagt

SEQ ID NO: 134415 - DNA, 20 bp, Artificial
  CRISPR gRNA sequence
tggaatgtcagcagtgagta

SEQ ID NO: 134416 - DNA, 20 bp, Artificial
  CRISPR gRNA sequence
ggaatgtcagcagtgagtat

SEQ ID NO: 134417 - DNA, 20 bp, Artificial
  CRISPR gRNA sequence
gaatgtcagcagtgagtatt

SEQ ID NO: 134418 - DNA, 20 bp, Artificial
  CRISPR gRNA sequence
tgacaaagcactattttaaa

SEQ ID NO: 134419 - DNA, 20 bp, Artificial
  CRISPR gRNA sequence
gacaaagcactattttaaat

SEQ ID NO: 134420 - DNA, 20 bp, Artificial
  CRISPR gRNA sequence
acaaagcactattttaaata

SEQ ID NO: 134421 - DNA, 20 bp, Artificial
  CRISPR gRNA sequence
ttttaaatagttcttatcag

SEQ ID NO: 134422 - DNA, 20 bp, Artificial
  CRISPR gRNA sequence
taaatagttcttatcagttc

SEQ ID NO: 134423 - DNA, 20 bp, Artificial
  CRISPR gRNA sequence
aaatagttcttatcagttca

SEQ ID NO: 134424 - DNA, 20 bp, Artificial
  CRISPR gRNA sequence
aatagttcttatcagttcat

SEQ ID NO: 134425 - DNA, 20 bp, Artificial
  CRISPR gRNA sequence
ttatcagttcatgccctttt

SEQ ID NO: 134426 - DNA, 20 bp, Artificial
  CRISPR gRNA sequence
atcagttcatgcccttttat

SEQ ID NO: 134427 - DNA, 20 bp, Artificial
  CRISPR gRNA sequence
tcagttcatgcccttttatt

SEQ ID NO: 134428 - DNA, 20 bp, Artificial
  CRISPR gRNA sequence
atgcccttttatttgaagtc

SEQ ID NO: 134429 - DNA, 20 bp, Artificial
  CRISPR gRNA sequence
ttatttgaagtcagtgagtg

SEQ ID NO: 134430 - DNA, 20 bp, Artificial
  CRISPR gRNA sequence
tatttgaagtcagtgagtga

SEQ ID NO: 134431 - DNA, 20 bp, Artificial
  CRISPR gRNA sequence
atttgaagtcagtgagtgat

SEQ ID NO: 134432 - DNA, 20 bp, Artificial
  CRISPR gRNA sequence
tttgaagtcagtgagtgata

SEQ ID NO: 134433 - DNA, 20 bp, Artificial
  CRISPR gRNA sequence
gaagtcagtgagtgataagt

SEQ ID NO: 134434 - DNA, 20 bp, Artificial
  CRISPR gRNA sequence
aagtcagtgagtgataagtg

SEQ ID NO: 134435 - DNA, 20 bp, Artificial
  CRISPR gRNA sequence
aattctgtagacattataac

SEQ ID NO: 134436 - DNA, 20 bp, Artificial
  CRISPR gRNA sequence
attctgtagacattataacc

SEQ ID NO: 134437 - DNA, 20 bp, Artificial
  CRISPR gRNA sequence
tgtagacattataacctttc

SEQ ID NO: 134438 - DNA, 20 bp, Artificial
  CRISPR gRNA sequence
tagacattataacctttcac

SEQ ID NO: 134439 - DNA, 20 bp, Artificial
  CRISPR gRNA sequence
taacctttcactgatagttc

SEQ ID NO: 134440 - DNA, 20 bp, Artificial
  CRISPR gRNA sequence
tcactgatagttctgactga

SEQ ID NO: 134441 - DNA, 20 bp, Artificial
  CRISPR gRNA sequence
cactgatagttctgactgag

SEQ ID NO: 134442 - DNA, 20 bp, Artificial
  CRISPR gRNA sequence
actgatagttctgactgagt

SEQ ID NO: 134443 - DNA, 20 bp, Artificial
  CRISPR gRNA sequence
atagttctgactgagttctg

SEQ ID NO: 134444 - DNA, 20 bp, Artificial
  CRISPR gRNA sequence
tgactgagttctgtagcccc

SEQ ID NO: 134445 - DNA, 20 bp, Artificial
  CRISPR gRNA sequence
actgagttctgtagccccta

SEQ ID NO: 134446 - DNA, 20 bp, Artificial
  CRISPR gRNA sequence
agttctgtagcccctagttt

SEQ ID NO: 134447 - DNA, 20 bp, Artificial
  CRISPR gRNA sequence
tgtagcccctagtttttggt

SEQ ID NO: 134448 - DNA, 20 bp, Artificial
  CRISPR gRNA sequence
tagcccctagtttttggtga

SEQ ID NO: 134449 - DNA, 20 bp, Artificial
  CRISPR gRNA sequence
gtttttggtgaagattcata

SEQ ID NO: 134450 - DNA, 20 bp, Artificial
  CRISPR gRNA sequence
ttggtgaagattcatatgag

SEQ ID NO: 134451 - DNA, 20 bp, Artificial
  CRISPR gRNA sequence
tggtgaagattcatatgaga

SEQ ID NO: 134452 - DNA, 20 bp, Artificial
  CRISPR gRNA sequence
ggtgaagattcatatgagat

SEQ ID NO: 134453 - DNA, 20 bp, Artificial
  CRISPR gRNA sequence
gtgaagattcatatgagata

SEQ ID NO: 134454 - DNA, 20 bp, Artificial
  CRISPR gRNA sequence
atatgagataggaatattaa

SEQ ID NO: 134455 - DNA, 20 bp, Artificial
  CRISPR gRNA sequence
aggaaaagtttgtaatataa

SEQ ID NO: 134456 - DNA, 20 bp, Artificial
  CRISPR gRNA sequence
gtaatataaaatcttatgat

SEQ ID NO: 134457 - DNA, 20 bp, Artificial
  CRISPR gRNA sequence
taatataaaatcttatgatt

SEQ ID NO: 134458 - DNA, 20 bp, Artificial
  CRISPR gRNA sequence
atgatttaaataaatttcaa

SEQ ID NO: 134459 - DNA, 20 bp, Artificial
  CRISPR gRNA sequence
tgatttaaataaatttcaac

SEQ ID NO: 134460 - DNA, 20 bp, Artificial
  CRISPR gRNA sequence
aaataaatttcaactcagtt

SEQ ID NO: 134461 - DNA, 20 bp, Artificial
  CRISPR gRNA sequence
aataaatttcaactcagttt

SEQ ID NO: 134462 - DNA, 20 bp, Artificial
  CRISPR gRNA sequence
caactcagttttttttaaat

SEQ ID NO: 134463 - DNA, 20 bp, Artificial
  CRISPR gRNA sequence
aactcagttttttttaaatt

SEQ ID NO: 134464 - DNA, 20 bp, Artificial
  CRISPR gRNA sequence
agttttttttaaattgagta

SEQ ID NO: 134465 - DNA, 20 bp, Artificial
  CRISPR gRNA sequence
tttttaaattgagtatcatg

SEQ ID NO: 134466 - DNA, 20 bp, Artificial
  CRISPR gRNA sequence
ttttaaattgagtatcatgt

SEQ ID NO: 134467 - DNA, 20 bp, Artificial
  CRISPR gRNA sequence
tttaaattgagtatcatgtt

SEQ ID NO: 134468 - DNA, 20 bp, Artificial
  CRISPR gRNA sequence
ttaaattgagtatcatgttg

SEQ ID NO: 134469 - DNA, 20 bp, Artificial
  CRISPR gRNA sequence
taaattgagtatcatgttgt

SEQ ID NO: 134470 - DNA, 20 bp, Artificial
  CRISPR gRNA sequence
aaattgagtatcatgttgtc

SEQ ID NO: 134471 - DNA, 20 bp, Artificial
  CRISPR gRNA sequence
aattgagtatcatgttgtca

SEQ ID NO: 134472 - DNA, 20 bp, Artificial
  CRISPR gRNA sequence
agtatcatgttgtcatattg

SEQ ID NO: 134473 - DNA, 20 bp, Artificial
  CRISPR gRNA sequence
tcatattggtgaaataaaag

SEQ ID NO: 134474 - DNA, 20 bp, Artificial
  CRISPR gRNA sequence
gtgaaataaaagggctatgt

SEQ ID NO: 134475 - DNA, 20 bp, Artificial
  CRISPR gRNA sequence
tgttgagtaaatttctcatt

SEQ ID NO: 134476 - DNA, 20 bp, Artificial
  CRISPR gRNA sequence
agtaaatttctcattatata

SEQ ID NO: 134477 - DNA, 20 bp, Artificial
  CRISPR gRNA sequence
ctcattatatatatttctca

SEQ ID NO: 134478 - DNA, 20 bp, Artificial
  CRISPR gRNA sequence
tcattatatatatttctcat

SEQ ID NO: 134479 - DNA, 20 bp, Artificial
  CRISPR gRNA sequence
attatatatatttctcatat

SEQ ID NO: 134480 - DNA, 20 bp, Artificial
  CRISPR gRNA sequence
tatatatttctcatatgtaa

SEQ ID NO: 134481 - DNA, 20 bp, Artificial
  CRISPR gRNA sequence
ctcatatgtaaactatatgc

SEQ ID NO: 134482 - DNA, 20 bp, Artificial
  CRISPR gRNA sequence
tcatatgtaaactatatgct

SEQ ID NO: 134483 - DNA, 20 bp, Artificial
  CRISPR gRNA sequence
atatgtaaactatatgctgc

SEQ ID NO: 134484 - DNA, 20 bp, Artificial
  CRISPR gRNA sequence
tatgctgctcagttatatgt

SEQ ID NO: 134485 - DNA, 20 bp, Artificial
  CRISPR gRNA sequence
ctcagttatatgttgctcct

SEQ ID NO: 134486 - DNA, 20 bp, Artificial
  CRISPR gRNA sequence
agttatatgttgctcctagc

SEQ ID NO: 134487 - DNA, 20 bp, Artificial
  CRISPR gRNA sequence
tatgttgctcctagccaaac

SEQ ID NO: 134488 - DNA, 20 bp, Artificial
  CRISPR gRNA sequence
ctcctagccaaacctcatgg

SEQ ID NO: 134489 - DNA, 20 bp, Artificial
  CRISPR gRNA sequence
ctagccaaacctcatggtgt

SEQ ID NO: 134490 - DNA, 20 bp, Artificial
  CRISPR gRNA sequence
gccaaacctcatggtgtagt

SEQ ID NO: 134491 - DNA, 20 bp, Artificial
  CRISPR gRNA sequence
atggtgtagtgtagtttaat

SEQ ID NO: 134492 - DNA, 20 bp, Artificial
  CRISPR gRNA sequence
aatcatgaatcagaaacttc

SEQ ID NO: 134493 - DNA, 20 bp, Artificial
  CRISPR gRNA sequence
atcatgaatcagaaacttca

SEQ ID NO: 134494 - DNA, 20 bp, Artificial
  CRISPR gRNA sequence
catccagtctgtctacagat

SEQ ID NO: 134495 - DNA, 20 bp, Artificial
  CRISPR gRNA sequence
atccagtctgtctacagatt

SEQ ID NO: 134496 - DNA, 20 bp, Artificial
  CRISPR gRNA sequence
tctacagatttgtacacatg

SEQ ID NO: 134497 - DNA, 20 bp, Artificial
  CRISPR gRNA sequence
cagatttgtacacatgggca

SEQ ID NO: 134498 - DNA, 20 bp, Artificial
  CRISPR gRNA sequence
gtacacatgggcagttagct

SEQ ID NO: 134499 - DNA, 20 bp, Artificial
  CRISPR gRNA sequence
tacacatgggcagttagcta

SEQ ID NO: 134500 - DNA, 20 bp, Artificial
  CRISPR gRNA sequence
gctaaggtacatgttagaga

SEQ ID NO: 134501 - DNA, 20 bp, Artificial
  CRISPR gRNA sequence
aggtacatgttagagatagg

SEQ ID NO: 134502 - DNA, 20 bp, Artificial
  CRISPR gRNA sequence
gagataggaaaattgaaaaa

SEQ ID NO: 134503 - DNA, 20 bp, Artificial
  CRISPR gRNA sequence
aaaaacgcaatataaaataa

SEQ ID NO: 134504 - DNA, 20 bp, Artificial
  CRISPR gRNA sequence
ttagggaacattttttaaaa

SEQ ID NO: 134505 - DNA, 20 bp, Artificial
  CRISPR gRNA sequence
tagggaacattttttaaaat

SEQ ID NO: 134506 - DNA, 20 bp, Artificial
  CRISPR gRNA sequence
agggaacattttttaaaatg

SEQ ID NO: 134507 - DNA, 20 bp, Artificial
  CRISPR gRNA sequence
gggaacattttttaaaatgg

SEQ ID NO: 134508 - DNA, 20 bp, Artificial
  CRISPR gRNA sequence
tttaaaatggaaaattggag

SEQ ID NO: 134509 - DNA, 20 bp, Artificial
  CRISPR gRNA sequence
ttaaaatggaaaattggagg

SEQ ID NO: 134510 - DNA, 20 bp, Artificial
  CRISPR gRNA sequence
taaaatggaaaattggagga

SEQ ID NO: 134511 - DNA, 20 bp, Artificial
  CRISPR gRNA sequence
aaaatggaaaattggaggat

SEQ ID NO: 134512 - DNA, 20 bp, Artificial
  CRISPR gRNA sequence
aaatggaaaattggaggatt

SEQ ID NO: 134513 - DNA, 20 bp, Artificial
  CRISPR gRNA sequence
gaggatttattattttgtcc

SEQ ID NO: 134514 - DNA, 20 bp, Artificial
  CRISPR gRNA sequence
attattttgtccaagactac

SEQ ID NO: 134515 - DNA, 20 bp, Artificial
  CRISPR gRNA sequence
ttattttgtccaagactaca

SEQ ID NO: 134516 - DNA, 20 bp, Artificial
  CRISPR gRNA sequence
ttttgtccaagactacatca

SEQ ID NO: 134517 - DNA, 20 bp, Artificial
  CRISPR gRNA sequence
tgtccaagactacatcattg

SEQ ID NO: 134518 - DNA, 20 bp, Artificial
  CRISPR gRNA sequence
gtccaagactacatcattga

SEQ ID NO: 134519 - DNA, 20 bp, Artificial
  CRISPR gRNA sequence
tccaagactacatcattgat

SEQ ID NO: 134520 - DNA, 20 bp, Artificial
  CRISPR gRNA sequence
catcattgataccgggcaga

SEQ ID NO: 134521 - DNA, 20 bp, Artificial
  CRISPR gRNA sequence
ataccgggcagaattgtaat

SEQ ID NO: 134522 - DNA, 20 bp, Artificial
  CRISPR gRNA sequence
taatgagacattaatggtac

SEQ ID NO: 134523 - DNA, 20 bp, Artificial
  CRISPR gRNA sequence
atggtacaaccttaagatac

SEQ ID NO: 134524 - DNA, 20 bp, Artificial
  CRISPR gRNA sequence
aagatacaacccaagaaagt

SEQ ID NO: 134525 - DNA, 20 bp, Artificial
  CRISPR gRNA sequence
agatacaacccaagaaagta

SEQ ID NO: 134526 - DNA, 20 bp, Artificial
  CRISPR gRNA sequence
atttccctctttaactaatt

SEQ ID NO: 134527 - DNA, 20 bp, Artificial
  CRISPR gRNA sequence
ccctctttaactaatttttt

SEQ ID NO: 134528 - DNA, 20 bp, Artificial
  CRISPR gRNA sequence
cctctttaactaattttttt

SEQ ID NO: 134529 - DNA, 20 bp, Artificial
  CRISPR gRNA sequence
tttaactaattttttttctt

SEQ ID NO: 134530 - DNA, 20 bp, Artificial
  CRISPR gRNA sequence
taactaattttttttctttt

SEQ ID NO: 134531 - DNA, 20 bp, Artificial
  CRISPR gRNA sequence
aactaattttttttctttta

SEQ ID NO: 134532 - DNA, 20 bp, Artificial
  CRISPR gRNA sequence
actaattttttttcttttag

SEQ ID NO: 134533 - DNA, 20 bp, Artificial
  CRISPR gRNA sequence
attttttttcttttagctaa

SEQ ID NO: 134534 - DNA, 20 bp, Artificial
  CRISPR gRNA sequence
tttttcttttagctaaccag

SEQ ID NO: 134535 - DNA, 20 bp, Artificial
  CRISPR gRNA sequence
ttttcttttagctaaccagt

SEQ ID NO: 134536 - DNA, 20 bp, Artificial
  CRISPR gRNA sequence
tttcttttagctaaccagtt

SEQ ID NO: 134537 - DNA, 20 bp, Artificial
  CRISPR gRNA sequence
ttcttttagctaaccagtta

SEQ ID NO: 134538 - DNA, 20 bp, Artificial
  CRISPR gRNA sequence
tcttttagctaaccagttac

SEQ ID NO: 134539 - DNA, 20 bp, Artificial
  CRISPR gRNA sequence
cttttagctaaccagttacc

SEQ ID NO: 134540 - DNA, 20 bp, Artificial
  CRISPR gRNA sequence
ttttagctaaccagttacca

SEQ ID NO: 134541 - DNA, 20 bp, Artificial
  CRISPR gRNA sequence
ttagctaaccagttaccagc

SEQ ID NO: 134542 - DNA, 20 bp, Artificial
  CRISPR gRNA sequence
tagctaaccagttaccagct

SEQ ID NO: 134543 - DNA, 20 bp, Artificial
  CRISPR gRNA sequence
agctaaccagttaccagctg

SEQ ID NO: 134544 - DNA, 20 bp, Artificial
  CRISPR gRNA sequence
gctaaccagttaccagctgg

SEQ ID NO: 134545 - DNA, 20 bp, Artificial
  CRISPR gRNA sequence
accagttaccagctggctta

SEQ ID NO: 134546 - DNA, 20 bp, Artificial
  CRISPR gRNA sequence
ccagctggcttaataaccac

SEQ ID NO: 134547 - DNA, 20 bp, Artificial
  CRISPR gRNA sequence
gcttaataaccacagacggt

SEQ ID NO: 134548 - DNA, 20 bp, Artificial
  CRISPR gRNA sequence
aataaccacagacggtcaac

SEQ ID NO: 134549 - DNA, 20 bp, Artificial
  CRISPR gRNA sequence
ataaccacagacggtcaaca

SEQ ID NO: 134550 - DNA, 20 bp, Artificial
  CRISPR gRNA sequence
tggtttacacaacatcatat

SEQ ID NO: 134551 - DNA, 20 bp, Artificial
  CRISPR gRNA sequence
acacaacatcatatcaacag

SEQ ID NO: 134552 - DNA, 20 bp, Artificial
  CRISPR gRNA sequence
cacaacatcatatcaacagg

SEQ ID NO: 134553 - DNA, 20 bp, Artificial
  CRISPR gRNA sequence
tgtattttaaatgcttaaaa

SEQ ID NO: 134554 - DNA, 20 bp, Artificial
  CRISPR gRNA sequence
gtattttaaatgcttaaaaa

SEQ ID NO: 134555 - DNA, 20 bp, Artificial
  CRISPR gRNA sequence
tattttaaatgcttaaaaaa

SEQ ID NO: 134556 - DNA, 20 bp, Artificial
  CRISPR gRNA sequence
taaatgcttaaaaaatttga

SEQ ID NO: 134557 - DNA, 20 bp, Artificial
  CRISPR gRNA sequence
aaatgcttaaaaaatttgat

SEQ ID NO: 134558 - DNA, 20 bp, Artificial
  CRISPR gRNA sequence
aatgcttaaaaaatttgatt

SEQ ID NO: 134559 - DNA, 20 bp, Artificial
  CRISPR gRNA sequence
aaaaaatttgattgtatcga

SEQ ID NO: 134560 - DNA, 20 bp, Artificial
  CRISPR gRNA sequence
aaaaatttgattgtatcgac

SEQ ID NO: 134561 - DNA, 20 bp, Artificial
  CRISPR gRNA sequence
gattgtatcgacagggcccc

SEQ ID NO: 134562 - DNA, 20 bp, Artificial
  CRISPR gRNA sequence
attgtatcgacagggcccca

SEQ ID NO: 134563 - DNA, 20 bp, Artificial
  CRISPR gRNA sequence
tatcgacagggccccatggc

SEQ ID NO: 134564 - DNA, 20 bp, Artificial
  CRISPR gRNA sequence
atgcctgtaatcccagcacc

SEQ ID NO: 134565 - DNA, 20 bp, Artificial
  CRISPR gRNA sequence
taatcccagcaccttgggag

SEQ ID NO: 134566 - DNA, 20 bp, Artificial
  CRISPR gRNA sequence
gggaggccgaggtgggtgga

SEQ ID NO: 134567 - DNA, 20 bp, Artificial
  CRISPR gRNA sequence
ggaggccgaggtgggtggat

SEQ ID NO: 134568 - DNA, 20 bp, Artificial
  CRISPR gRNA sequence
aggtcaggagttcaagacca

SEQ ID NO: 134569 - DNA, 20 bp, Artificial
  CRISPR gRNA sequence
aagaccagcctggccaacat

SEQ ID NO: 134570 - DNA, 20 bp, Artificial
  CRISPR gRNA sequence
gccaacatggtgaaaccctg

SEQ ID NO: 134571 - DNA, 20 bp, Artificial
  CRISPR gRNA sequence
tctctactaaaaatacaaaa

SEQ ID NO: 134572 - DNA, 20 bp, Artificial
  CRISPR gRNA sequence
tactaaaaatacaaaaatta

SEQ ID NO: 134573 - DNA, 20 bp, Artificial
  CRISPR gRNA sequence
ctaaaaatacaaaaattagc

SEQ ID NO: 134574 - DNA, 20 bp, Artificial
  CRISPR gRNA sequence
aaaatacaaaaattagctgg

SEQ ID NO: 134575 - DNA, 20 bp, Artificial
  CRISPR gRNA sequence
gctgggcgtcatggcgtgta

SEQ ID NO: 134576 - DNA, 20 bp, Artificial
  CRISPR gRNA sequence
ggcgtcatggcgtgtacctg

SEQ ID NO: 134577 - DNA, 20 bp, Artificial
  CRISPR gRNA sequence
taatcccctctgcttggagg

SEQ ID NO: 134578 - DNA, 20 bp, Artificial
  CRISPR gRNA sequence
tgcttggaggctgaggcagg

SEQ ID NO: 134579 - DNA, 20 bp, Artificial
  CRISPR gRNA sequence
cttggaggctgaggcaggag

SEQ ID NO: 134580 - DNA, 20 bp, Artificial
  CRISPR gRNA sequence
ggaggctgaggcaggagaat

SEQ ID NO: 134581 - DNA, 20 bp, Artificial
  CRISPR gRNA sequence
gaggctgaggcaggagaatc

SEQ ID NO: 134582 - DNA, 20 bp, Artificial
  CRISPR gRNA sequence
aggcaggagaatcacttgaa

SEQ ID NO: 134583 - DNA, 20 bp, Artificial
  CRISPR gRNA sequence
gaaccctggaggtggaggtt

SEQ ID NO: 134584 - DNA, 20 bp, Artificial
  CRISPR gRNA sequence
aaccctggaggtggaggttg

SEQ ID NO: 134585 - DNA, 20 bp, Artificial
  CRISPR gRNA sequence
gaggtggaggttgcagtgag

SEQ ID NO: 134586 - DNA, 20 bp, Artificial
  CRISPR gRNA sequence
cagtgagctgagatcacacc

SEQ ID NO: 134587 - DNA, 20 bp, Artificial
  CRISPR gRNA sequence
agatcacaccactgcactcc

SEQ ID NO: 134588 - DNA, 20 bp, Artificial
  CRISPR gRNA sequence
cactccagcctgggcaatag

SEQ ID NO: 134589 - DNA, 20 bp, Artificial
  CRISPR gRNA sequence
cagcctgggcaatagagtga

SEQ ID NO: 134590 - DNA, 20 bp, Artificial
  CRISPR gRNA sequence
ggcaatagagtgagactctg

SEQ ID NO: 134591 - DNA, 20 bp, Artificial
  CRISPR gRNA sequence
tgtctcaaaaaaaaaatttt

SEQ ID NO: 134592 - DNA, 20 bp, Artificial
  CRISPR gRNA sequence
tctcaaaaaaaaaatttttt

SEQ ID NO: 134593 - DNA, 20 bp, Artificial
  CRISPR gRNA sequence
aaaaaaaaaatttttttttt

SEQ ID NO: 134594 - DNA, 20 bp, Artificial
  CRISPR gRNA sequence
tttttttattatatctattg

SEQ ID NO: 134595 - DNA, 20 bp, Artificial
  CRISPR gRNA sequence
ttttttattatatctattga

SEQ ID NO: 134596 - DNA, 20 bp, Artificial
  CRISPR gRNA sequence
tttttattatatctattgat

SEQ ID NO: 134597 - DNA, 20 bp, Artificial
  CRISPR gRNA sequence
ttttattatatctattgata

SEQ ID NO: 134598 - DNA, 20 bp, Artificial
  CRISPR gRNA sequence
tttattatatctattgatat

SEQ ID NO: 134599 - DNA, 20 bp, Artificial
  CRISPR gRNA sequence
ttattatatctattgatata

SEQ ID NO: 134600 - DNA, 20 bp, Artificial
  CRISPR gRNA sequence
tattatatctattgatatag

SEQ ID NO: 134601 - DNA, 20 bp, Artificial
  CRISPR gRNA sequence
attatatctattgatatagt

SEQ ID NO: 134602 - DNA, 20 bp, Artificial
  CRISPR gRNA sequence
ttatatctattgatatagtt

SEQ ID NO: 134603 - DNA, 20 bp, Artificial
  CRISPR gRNA sequence
tatctattgatatagttaat

SEQ ID NO: 134604 - DNA, 20 bp, Artificial
  CRISPR gRNA sequence
ttgatatagttaatttcaac

SEQ ID NO: 134605 - DNA, 20 bp, Artificial
  CRISPR gRNA sequence
atatagttaatttcaacatg

SEQ ID NO: 134606 - DNA, 20 bp, Artificial
  CRISPR gRNA sequence
atttcaacatgctattaagg

SEQ ID NO: 134607 - DNA, 20 bp, Artificial
  CRISPR gRNA sequence
caacatgctattaaggacct

SEQ ID NO: 134608 - DNA, 20 bp, Artificial
  CRISPR gRNA sequence
aacatgctattaaggacctg

SEQ ID NO: 134609 - DNA, 20 bp, Artificial
  CRISPR gRNA sequence
ttaaggacctgataaagaag

SEQ ID NO: 134610 - DNA, 20 bp, Artificial
  CRISPR gRNA sequence
aggacctgataaagaaggtt

SEQ ID NO: 134611 - DNA, 20 bp, Artificial
  CRISPR gRNA sequence
ataaagaaggttattaaaat

SEQ ID NO: 134612 - DNA, 20 bp, Artificial
  CRISPR gRNA sequence
ttaaaattgtgttttctcaa

SEQ ID NO: 134613 - DNA, 20 bp, Artificial
  CRISPR gRNA sequence
aaattgtgttttctcaatgt

SEQ ID NO: 134614 - DNA, 20 bp, Artificial
  CRISPR gRNA sequence
tgttttctcaatgtagataa

SEQ ID NO: 134615 - DNA, 20 bp, Artificial
  CRISPR gRNA sequence
tctcaatgtagataacagta

SEQ ID NO: 134616 - DNA, 20 bp, Artificial
  CRISPR gRNA sequence
ctcaatgtagataacagtat

SEQ ID NO: 134617 - DNA, 20 bp, Artificial
  CRISPR gRNA sequence
tcaatgtagataacagtata

SEQ ID NO: 134618 - DNA, 20 bp, Artificial
  CRISPR gRNA sequence
aatgtagataacagtatata

SEQ ID NO: 134619 - DNA, 20 bp, Artificial
  CRISPR gRNA sequence
tcttaatagttaaaaataag

SEQ ID NO: 134620 - DNA, 20 bp, Artificial
  CRISPR gRNA sequence
ttaatagttaaaaataagca

SEQ ID NO: 134621 - DNA, 20 bp, Artificial
  CRISPR gRNA sequence
aatagttaaaaataagcata

SEQ ID NO: 134622 - DNA, 20 bp, Artificial
  CRISPR gRNA sequence
atagttaaaaataagcatat

SEQ ID NO: 134623 - DNA, 20 bp, Artificial
  CRISPR gRNA sequence
aaaataagcatatgttcata

SEQ ID NO: 134624 - DNA, 20 bp, Artificial
  CRISPR gRNA sequence
atatttgcataggagatttc

SEQ ID NO: 134625 - DNA, 20 bp, Artificial
  CRISPR gRNA sequence
gcataggagatttctagaaa

SEQ ID NO: 134626 - DNA, 20 bp, Artificial
  CRISPR gRNA sequence
cataggagatttctagaaag

SEQ ID NO: 134627 - DNA, 20 bp, Artificial
  CRISPR gRNA sequence
ctagaaagatacacaagaaa

SEQ ID NO: 134628 - DNA, 20 bp, Artificial
  CRISPR gRNA sequence
tagaaagatacacaagaaat

SEQ ID NO: 134629 - DNA, 20 bp, Artificial
  CRISPR gRNA sequence
gaaagatacacaagaaatgg

SEQ ID NO: 134630 - DNA, 20 bp, Artificial
  CRISPR gRNA sequence
gacttgttattgtcttttta

SEQ ID NO: 134631 - DNA, 20 bp, Artificial
  CRISPR gRNA sequence
gttattgtctttttattcac

SEQ ID NO: 134632 - DNA, 20 bp, Artificial
  CRISPR gRNA sequence
ttattgtctttttattcact

SEQ ID NO: 134633 - DNA, 20 bp, Artificial
  CRISPR gRNA sequence
ttgtctttttattcactgaa

SEQ ID NO: 134634 - DNA, 20 bp, Artificial
  CRISPR gRNA sequence
tctttttattcactgaattt

SEQ ID NO: 134635 - DNA, 20 bp, Artificial
  CRISPR gRNA sequence
tttattcactgaatttttat

SEQ ID NO: 134636 - DNA, 20 bp, Artificial
  CRISPR gRNA sequence
ttattcactgaatttttata

SEQ ID NO: 134637 - DNA, 20 bp, Artificial
  CRISPR gRNA sequence
tattcactgaatttttataa

SEQ ID NO: 134638 - DNA, 20 bp, Artificial
  CRISPR gRNA sequence
attcactgaatttttataat

SEQ ID NO: 134639 - DNA, 20 bp, Artificial
  CRISPR gRNA sequence
ttcactgaatttttataata

SEQ ID NO: 134640 - DNA, 20 bp, Artificial
  CRISPR gRNA sequence
actgaatttttataatatgc

SEQ ID NO: 134641 - DNA, 20 bp, Artificial
  CRISPR gRNA sequence
aatttttataatatgcatat

SEQ ID NO: 134642 - DNA, 20 bp, Artificial
  CRISPR gRNA sequence
ttataatatgcatatggtac

SEQ ID NO: 134643 - DNA, 20 bp, Artificial
  CRISPR gRNA sequence
tataatatgcatatggtact

SEQ ID NO: 134644 - DNA, 20 bp, Artificial
  CRISPR gRNA sequence
ataatatgcatatggtactt

SEQ ID NO: 134645 - DNA, 20 bp, Artificial
  CRISPR gRNA sequence
taatatgcatatggtacttt

SEQ ID NO: 134646 - DNA, 20 bp, Artificial
  CRISPR gRNA sequence
ttaatctccttttctttaat

SEQ ID NO: 134647 - DNA, 20 bp, Artificial
  CRISPR gRNA sequence
taatctccttttctttaatt

SEQ ID NO: 134648 - DNA, 20 bp, Artificial
  CRISPR gRNA sequence
aatctccttttctttaattc

SEQ ID NO: 134649 - DNA, 20 bp, Artificial
  CRISPR gRNA sequence
atctccttttctttaattct

SEQ ID NO: 134650 - DNA, 20 bp, Artificial
  CRISPR gRNA sequence
cttttctttaattctgctca

SEQ ID NO: 134651 - DNA, 20 bp, Artificial
  CRISPR gRNA sequence
ttctttaattctgctcaatt

SEQ ID NO: 134652 - DNA, 20 bp, Artificial
  CRISPR gRNA sequence
tctttaattctgctcaattt

SEQ ID NO: 134653 - DNA, 20 bp, Artificial
  CRISPR gRNA sequence
ctttaattctgctcaattta

SEQ ID NO: 134654 - DNA, 20 bp, Artificial
  CRISPR gRNA sequence
tttaattctgctcaatttaa

SEQ ID NO: 134655 - DNA, 20 bp, Artificial
  CRISPR gRNA sequence
taattctgctcaatttaaat

SEQ ID NO: 134656 - DNA, 20 bp, Artificial
  CRISPR gRNA sequence
aattctgctcaatttaaatt

SEQ ID NO: 134657 - DNA, 20 bp, Artificial
  CRISPR gRNA sequence
attctgctcaatttaaattt

SEQ ID NO: 134658 - DNA, 20 bp, Artificial
  CRISPR gRNA sequence
tgctcaatttaaattttcta

SEQ ID NO: 134659 - DNA, 20 bp, Artificial
  CRISPR gRNA sequence
ctcaatttaaattttctaat

SEQ ID NO: 134660 - DNA, 20 bp, Artificial
  CRISPR gRNA sequence
aatttaaattttctaatctt

SEQ ID NO: 134661 - DNA, 20 bp, Artificial
  CRISPR gRNA sequence
aaattttctaatcttagatt

SEQ ID NO: 134662 - DNA, 20 bp, Artificial
  CRISPR gRNA sequence
aattttctaatcttagattt

SEQ ID NO: 134663 - DNA, 20 bp, Artificial
  CRISPR gRNA sequence
tctaatcttagatttctggt

SEQ ID NO: 134664 - DNA, 20 bp, Artificial
  CRISPR gRNA sequence
ctaatcttagatttctggtg

SEQ ID NO: 134665 - DNA, 20 bp, Artificial
  CRISPR gRNA sequence
taatcttagatttctggtgt

SEQ ID NO: 134666 - DNA, 20 bp, Artificial
  CRISPR gRNA sequence
atcttagatttctggtgttc

SEQ ID NO: 134667 - DNA, 20 bp, Artificial
  CRISPR gRNA sequence
agatttctggtgttcagcaa

SEQ ID NO: 134668 - DNA, 20 bp, Artificial
  CRISPR gRNA sequence
gatttctggtgttcagcaaa

SEQ ID NO: 134669 - DNA, 20 bp, Artificial
  CRISPR gRNA sequence
ctggtgttcagcaaattcag

SEQ ID NO: 134670 - DNA, 20 bp, Artificial
  CRISPR gRNA sequence
tggtgttcagcaaattcagt

SEQ ID NO: 134671 - DNA, 20 bp, Artificial
  CRISPR gRNA sequence
gtgttcagcaaattcagttt

SEQ ID NO: 134672 - DNA, 20 bp, Artificial
  CRISPR gRNA sequence
agcaaattcagttttcatga

SEQ ID NO: 134673 - DNA, 20 bp, Artificial
  CRISPR gRNA sequence
agttttcatgatctgaagaa

SEQ ID NO: 134674 - DNA, 20 bp, Artificial
  CRISPR gRNA sequence
tcatgatctgaagaaatgat

SEQ ID NO: 134675 - DNA, 20 bp, Artificial
  CRISPR gRNA sequence
catgatctgaagaaatgatg

SEQ ID NO: 134676 - DNA, 20 bp, Artificial
  CRISPR gRNA sequence
atgatctgaagaaatgatgg

SEQ ID NO: 134677 - DNA, 20 bp, Artificial
  CRISPR gRNA sequence
aagaaatgatggaatgggga

SEQ ID NO: 134678 - DNA, 20 bp, Artificial
  CRISPR gRNA sequence
tatgattctggaacagagac

SEQ ID NO: 134679 - DNA, 20 bp, Artificial
  CRISPR gRNA sequence
tggaacagagacatcagaag

SEQ ID NO: 134680 - DNA, 20 bp, Artificial
  CRISPR gRNA sequence
gaacagagacatcagaagga

SEQ ID NO: 134681 - DNA, 20 bp, Artificial
  CRISPR gRNA sequence
gtgaaaagatgtatctttgt

SEQ ID NO: 134682 - DNA, 20 bp, Artificial
  CRISPR gRNA sequence
tgtatattaatagctgtaat

SEQ ID NO: 134683 - DNA, 20 bp, Artificial
  CRISPR gRNA sequence
gtatattaatagctgtaatg

SEQ ID NO: 134684 - DNA, 20 bp, Artificial
  CRISPR gRNA sequence
tatattaatagctgtaatgt

SEQ ID NO: 134685 - DNA, 20 bp, Artificial
  CRISPR gRNA sequence
atagctgtaatgtagcttcc

SEQ ID NO: 134686 - DNA, 20 bp, Artificial
  CRISPR gRNA sequence
taatgtagcttcctgatgct

SEQ ID NO: 134687 - DNA, 20 bp, Artificial
  CRISPR gRNA sequence
cctgatgcttgactaattga

SEQ ID NO: 134688 - DNA, 20 bp, Artificial
  CRISPR gRNA sequence
ctgatgcttgactaattgag

SEQ ID NO: 134689 - DNA, 20 bp, Artificial
  CRISPR gRNA sequence
atgcttgactaattgaggtg

SEQ ID NO: 134690 - DNA, 20 bp, Artificial
  CRISPR gRNA sequence
gactaattgaggtgttaatt

SEQ ID NO: 134691 - DNA, 20 bp, Artificial
  CRISPR gRNA sequence
actaattgaggtgttaattc

SEQ ID NO: 134692 - DNA, 20 bp, Artificial
  CRISPR gRNA sequence
attgaggtgttaattctgac

SEQ ID NO: 134693 - DNA, 20 bp, Artificial
  CRISPR gRNA sequence
aggtgttaattctgacttga

SEQ ID NO: 134694 - DNA, 20 bp, Artificial
  CRISPR gRNA sequence
attctgacttgagaatcttt

SEQ ID NO: 134695 - DNA, 20 bp, Artificial
  CRISPR gRNA sequence
tgacttgagaatctttttca

SEQ ID NO: 134696 - DNA, 20 bp, Artificial
  CRISPR gRNA sequence
acttgagaatctttttcatg

SEQ ID NO: 134697 - DNA, 20 bp, Artificial
  CRISPR gRNA sequence
gagaatctttttcatgaatg

SEQ ID NO: 134698 - DNA, 20 bp, Artificial
  CRISPR gRNA sequence
agaatctttttcatgaatga

SEQ ID NO: 134699 - DNA, 20 bp, Artificial
  CRISPR gRNA sequence
tttcatgaatgattttaaag

SEQ ID NO: 134700 - DNA, 20 bp, Artificial
  CRISPR gRNA sequence
ttcatgaatgattttaaaga

SEQ ID NO: 134701 - DNA, 20 bp, Artificial
  CRISPR gRNA sequence
tcatgaatgattttaaagaa

SEQ ID NO: 134702 - DNA, 20 bp, Artificial
  CRISPR gRNA sequence
catgaatgattttaaagaaa

SEQ ID NO: 134703 - DNA, 20 bp, Artificial
  CRISPR gRNA sequence
atgaatgattttaaagaaaa

SEQ ID NO: 134704 - DNA, 20 bp, Artificial
  CRISPR gRNA sequence
taaagaaaaatttggatttt

SEQ ID NO: 134705 - DNA, 20 bp, Artificial
  CRISPR gRNA sequence
aaagaaaaatttggatttta

SEQ ID NO: 134706 - DNA, 20 bp, Artificial
  CRISPR gRNA sequence
aagaaaaatttggattttaa

SEQ ID NO: 134707 - DNA, 20 bp, Artificial
  CRISPR gRNA sequence
ggattttaaaggtattaaaa

SEQ ID NO: 134708 - DNA, 20 bp, Artificial
  CRISPR gRNA sequence
gattttaaaggtattaaaat

SEQ ID NO: 134709 - DNA, 20 bp, Artificial
  CRISPR gRNA sequence
taaaggtattaaaatatttt

SEQ ID NO: 134710 - DNA, 20 bp, Artificial
  CRISPR gRNA sequence
aaaggtattaaaatattttt

SEQ ID NO: 134711 - DNA, 20 bp, Artificial
  CRISPR gRNA sequence
aaggtattaaaatatttttg

SEQ ID NO: 134712 - DNA, 20 bp, Artificial
  CRISPR gRNA sequence
aaatatttttgttttgtacg

SEQ ID NO: 134713 - DNA, 20 bp, Artificial
  CRISPR gRNA sequence
ttgttttgtacgagagtttg

SEQ ID NO: 134714 - DNA, 20 bp, Artificial
  CRISPR gRNA sequence
tgttttgtacgagagtttgt

SEQ ID NO: 134715 - DNA, 20 bp, Artificial
  CRISPR gRNA sequence
gttttgtacgagagtttgtt

SEQ ID NO: 134716 - DNA, 20 bp, Artificial
  CRISPR gRNA sequence
ttttgtacgagagtttgttg

SEQ ID NO: 134717 - DNA, 20 bp, Artificial
  CRISPR gRNA sequence
tgtacgagagtttgttgctc

SEQ ID NO: 134718 - DNA, 20 bp, Artificial
  CRISPR gRNA sequence
gtacgagagtttgttgctct

SEQ ID NO: 134719 - DNA, 20 bp, Artificial
  CRISPR gRNA sequence
tacgagagtttgttgctctg

SEQ ID NO: 134720 - DNA, 20 bp, Artificial
  CRISPR gRNA sequence
gttgctctgtatgactcctg

SEQ ID NO: 134721 - DNA, 20 bp, Artificial
  CRISPR gRNA sequence
ttgctctgtatgactcctgt

SEQ ID NO: 134722 - DNA, 20 bp, Artificial
  CRISPR gRNA sequence
ctctgtatgactcctgtatg

SEQ ID NO: 134723 - DNA, 20 bp, Artificial
  CRISPR gRNA sequence
tgtatgactcctgtatgcat

SEQ ID NO: 134724 - DNA, 20 bp, Artificial
  CRISPR gRNA sequence
tatgactcctgtatgcattg

SEQ ID NO: 134725 - DNA, 20 bp, Artificial
  CRISPR gRNA sequence
ctgtatgcattgtatattgc

SEQ ID NO: 134726 - DNA, 20 bp, Artificial
  CRISPR gRNA sequence
tatgcattgtatattgcaat

SEQ ID NO: 134727 - DNA, 20 bp, Artificial
  CRISPR gRNA sequence
tatattgcaatttattactg

SEQ ID NO: 134728 - DNA, 20 bp, Artificial
  CRISPR gRNA sequence
caatttattactgtcagaga

SEQ ID NO: 134729 - DNA, 20 bp, Artificial
  CRISPR gRNA sequence
attactgtcagagatttgta

SEQ ID NO: 134730 - DNA, 20 bp, Artificial
  CRISPR gRNA sequence
ttactgtcagagatttgtag

SEQ ID NO: 134731 - DNA, 20 bp, Artificial
  CRISPR gRNA sequence
ctgtcagagatttgtagaca

SEQ ID NO: 134732 - DNA, 20 bp, Artificial
  CRISPR gRNA sequence
tcagagatttgtagacagtt

SEQ ID NO: 134733 - DNA, 20 bp, Artificial
  CRISPR gRNA sequence
gtagacagtttcttattttc

SEQ ID NO: 134734 - DNA, 20 bp, Artificial
  CRISPR gRNA sequence
tagacagtttcttattttca

SEQ ID NO: 134735 - DNA, 20 bp, Artificial
  CRISPR gRNA sequence
cttattttcatattgaatca

SEQ ID NO: 134736 - DNA, 20 bp, Artificial
  CRISPR gRNA sequence
ttattttcatattgaatcat

SEQ ID NO: 134737 - DNA, 20 bp, Artificial
  CRISPR gRNA sequence
attttcatattgaatcatgt

SEQ ID NO: 134738 - DNA, 20 bp, Artificial
  CRISPR gRNA sequence
ttttcatattgaatcatgtt

SEQ ID NO: 134739 - DNA, 20 bp, Artificial
  CRISPR gRNA sequence
tcatattgaatcatgttact

SEQ ID NO: 134740 - DNA, 20 bp, Artificial
  CRISPR gRNA sequence
catattgaatcatgttactt

SEQ ID NO: 134741 - DNA, 20 bp, Artificial
  CRISPR gRNA sequence
atattgaatcatgttacttt

SEQ ID NO: 134742 - DNA, 20 bp, Artificial
  CRISPR gRNA sequence
aatcatgttacttttgtaat

SEQ ID NO: 134743 - DNA, 20 bp, Artificial
  CRISPR gRNA sequence
cttttgtaattcaagtaagc

SEQ ID NO: 134744 - DNA, 20 bp, Artificial
  CRISPR gRNA sequence
ttgtaattcaagtaagcggc

SEQ ID NO: 134745 - DNA, 20 bp, Artificial
  CRISPR gRNA sequence
tgtaattcaagtaagcggct

SEQ ID NO: 134746 - DNA, 20 bp, Artificial
  CRISPR gRNA sequence
gtaattcaagtaagcggctg

SEQ ID NO: 134747 - DNA, 20 bp, Artificial
  CRISPR gRNA sequence
taattcaagtaagcggctgg

SEQ ID NO: 134748 - DNA, 20 bp, Artificial
  CRISPR gRNA sequence
aagtaagcggctgggttaat

SEQ ID NO: 134749 - DNA, 20 bp, Artificial
  CRISPR gRNA sequence
ggttaattcatgatgtttgc

SEQ ID NO: 134750 - DNA, 20 bp, Artificial
  CRISPR gRNA sequence
attcatgatgtttgcccttt

SEQ ID NO: 134751 - DNA, 20 bp, Artificial
  CRISPR gRNA sequence
atgatgtttgcccttttaat

SEQ ID NO: 134752 - DNA, 20 bp, Artificial
  CRISPR gRNA sequence
gcccttttaataaaatataa

SEQ ID NO: 134753 - DNA, 20 bp, Artificial
  CRISPR gRNA sequence
cccttttaataaaatataag

SEQ ID NO: 134754 - DNA, 20 bp, Artificial
  CRISPR gRNA sequence
ttaataaaatataagggtag

SEQ ID NO: 134755 - DNA, 20 bp, Artificial
  CRISPR gRNA sequence
taataaaatataagggtaga

SEQ ID NO: 134756 - DNA, 20 bp, Artificial
  CRISPR gRNA sequence
aataaaatataagggtagag

SEQ ID NO: 134757 - DNA, 20 bp, Artificial
  CRISPR gRNA sequence
ataaaatataagggtagagt

SEQ ID NO: 134758 - DNA, 20 bp, Artificial
  CRISPR gRNA sequence
attttgaatgcaagttgcct

SEQ ID NO: 134759 - DNA, 20 bp, Artificial
  CRISPR gRNA sequence
tgaatgcaagttgcctttat

SEQ ID NO: 134760 - DNA, 20 bp, Artificial
  CRISPR gRNA sequence
gaatgcaagttgcctttatt

SEQ ID NO: 134761 - DNA, 20 bp, Artificial
  CRISPR gRNA sequence
aatgcaagttgcctttatta

SEQ ID NO: 134762 - DNA, 20 bp, Artificial
  CRISPR gRNA sequence
cctttattataaatttgagt

SEQ ID NO: 134763 - DNA, 20 bp, Artificial
  CRISPR gRNA sequence
tattataaatttgagtttgt

SEQ ID NO: 134764 - DNA, 20 bp, Artificial
  CRISPR gRNA sequence
attataaatttgagtttgtc

SEQ ID NO: 134765 - DNA, 20 bp, Artificial
  CRISPR gRNA sequence
ttataaatttgagtttgtct

SEQ ID NO: 134766 - DNA, 20 bp, Artificial
  CRISPR gRNA sequence
taaatttgagtttgtcttgg

SEQ ID NO: 134767 - DNA, 20 bp, Artificial
  CRISPR gRNA sequence
gagtttgtcttggttatacc

SEQ ID NO: 134768 - DNA, 20 bp, Artificial
  CRISPR gRNA sequence
agtttgtcttggttatacct

SEQ ID NO: 134769 - DNA, 20 bp, Artificial
  CRISPR gRNA sequence
gtcttggttataccttgcat

SEQ ID NO: 134770 - DNA, 20 bp, Artificial
  CRISPR gRNA sequence
tcttggttataccttgcatg

SEQ ID NO: 134771 - DNA, 20 bp, Artificial
  CRISPR gRNA sequence
ggttataccttgcatgataa

SEQ ID NO: 134772 - DNA, 20 bp, Artificial
  CRISPR gRNA sequence
gttataccttgcatgataac

SEQ ID NO: 134773 - DNA, 20 bp, Artificial
  CRISPR gRNA sequence
taccttgcatgataacctag

SEQ ID NO: 134774 - DNA, 20 bp, Artificial
  CRISPR gRNA sequence
gcatgataacctagctagat

SEQ ID NO: 134775 - DNA, 20 bp, Artificial
  CRISPR gRNA sequence
catgataacctagctagatt

SEQ ID NO: 134776 - DNA, 20 bp, Artificial
  CRISPR gRNA sequence
gctagatttctagcatttgc

SEQ ID NO: 134777 - DNA, 20 bp, Artificial
  CRISPR gRNA sequence
gatttctagcatttgctgta

SEQ ID NO: 134778 - DNA, 20 bp, Artificial
  CRISPR gRNA sequence
ctagcatttgctgtatttat

SEQ ID NO: 134779 - DNA, 20 bp, Artificial
  CRISPR gRNA sequence
tagcatttgctgtatttatt

SEQ ID NO: 134780 - DNA, 20 bp, Artificial
  CRISPR gRNA sequence
gcatttgctgtatttattaa

SEQ ID NO: 134781 - DNA, 20 bp, Artificial
  CRISPR gRNA sequence
gctgtatttattaaaattat

SEQ ID NO: 134782 - DNA, 20 bp, Artificial
  CRISPR gRNA sequence
ctgtatttattaaaattatt

SEQ ID NO: 134783 - DNA, 20 bp, Artificial
  CRISPR gRNA sequence
tatttattaaaattattatt

SEQ ID NO: 134784 - DNA, 20 bp, Artificial
  CRISPR gRNA sequence
attaaaattattattttttt

SEQ ID NO: 134785 - DNA, 20 bp, Artificial
  CRISPR gRNA sequence
ttaaaattattatttttttg

SEQ ID NO: 134786 - DNA, 20 bp, Artificial
  CRISPR gRNA sequence
aaattattatttttttggta

SEQ ID NO: 134787 - DNA, 20 bp, Artificial
  CRISPR gRNA sequence
ttatttttttggtaaaacat

SEQ ID NO: 134788 - DNA, 20 bp, Artificial
  CRISPR gRNA sequence
tttttttggtaaaacattaa

SEQ ID NO: 134789 - DNA, 20 bp, Artificial
  CRISPR gRNA sequence
ttttggtaaaacattaatag

SEQ ID NO: 134790 - DNA, 20 bp, Artificial
  CRISPR gRNA sequence
tttggtaaaacattaatagt

SEQ ID NO: 134791 - DNA, 20 bp, Artificial
  CRISPR gRNA sequence
ttggtaaaacattaatagtt

SEQ ID NO: 134792 - DNA, 20 bp, Artificial
  CRISPR gRNA sequence
tggtaaaacattaatagttt

SEQ ID NO: 134793 - DNA, 20 bp, Artificial
  CRISPR gRNA sequence
ggtaaaacattaatagttta

SEQ ID NO: 134794 - DNA, 20 bp, Artificial
  CRISPR gRNA sequence
gtaaaacattaatagtttaa

SEQ ID NO: 134795 - DNA, 20 bp, Artificial
  CRISPR gRNA sequence
atagtttaagcagcatcatt

SEQ ID NO: 134796 - DNA, 20 bp, Artificial
  CRISPR gRNA sequence
aagcagcatcatttttttaa

SEQ ID NO: 134797 - DNA, 20 bp, Artificial
  CRISPR gRNA sequence
agcagcatcatttttttaaa

SEQ ID NO: 134798 - DNA, 20 bp, Artificial
  CRISPR gRNA sequence
ttttaaaaaatgtaattgaa

SEQ ID NO: 134799 - DNA, 20 bp, Artificial
  CRISPR gRNA sequence
tttaaaaaatgtaattgaat

SEQ ID NO: 134800 - DNA, 20 bp, Artificial
  CRISPR gRNA sequence
ttaaaaaatgtaattgaata

SEQ ID NO: 134801 - DNA, 20 bp, Artificial
  CRISPR gRNA sequence
taaaaaatgtaattgaataa

SEQ ID NO: 134802 - DNA, 20 bp, Artificial
  CRISPR gRNA sequence
aaaaaatgtaattgaataag

SEQ ID NO: 134803 - DNA, 20 bp, Artificial
  CRISPR gRNA sequence
aaaaatgtaattgaataagt

SEQ ID NO: 134804 - DNA, 20 bp, Artificial
  CRISPR gRNA sequence
aataagtgtgaatgcagaag

SEQ ID NO: 134805 - DNA, 20 bp, Artificial
  CRISPR gRNA sequence
tctgccctgttaaacttggt

SEQ ID NO: 134806 - DNA, 20 bp, Artificial
  CRISPR gRNA sequence
ccctgttaaacttggtgccc

SEQ ID NO: 134807 - DNA, 20 bp, Artificial
  CRISPR gRNA sequence
ttaaacttggtgcccattaa

SEQ ID NO: 134808 - DNA, 20 bp, Artificial
  CRISPR gRNA sequence
aacttggtgcccattaacag

SEQ ID NO: 134809 - DNA, 20 bp, Artificial
  CRISPR gRNA sequence
ggtgcccattaacagtgttt

SEQ ID NO: 134810 - DNA, 20 bp, Artificial
  CRISPR gRNA sequence
gtgcccattaacagtgttta

SEQ ID NO: 134811 - DNA, 20 bp, Artificial
  CRISPR gRNA sequence
acagtgtttacactgttcat

SEQ ID NO: 134812 - DNA, 20 bp, Artificial
  CRISPR gRNA sequence
acactgttcatcgtgcctgt

SEQ ID NO: 134813 - DNA, 20 bp, Artificial
  CRISPR gRNA sequence
cactgttcatcgtgcctgtt

SEQ ID NO: 134814 - DNA, 20 bp, Artificial
  CRISPR gRNA sequence
ttcatcgtgcctgttaatgt

SEQ ID NO: 134815 - DNA, 20 bp, Artificial
  CRISPR gRNA sequence
atcgtgcctgttaatgtagt

SEQ ID NO: 134816 - DNA, 20 bp, Artificial
  CRISPR gRNA sequence
ttaatgtagttttagttact

SEQ ID NO: 134817 - DNA, 20 bp, Artificial
  CRISPR gRNA sequence
atgtagttttagttactgga

SEQ ID NO: 134818 - DNA, 20 bp, Artificial
  CRISPR gRNA sequence
tagttactggagctttttta

SEQ ID NO: 134819 - DNA, 20 bp, Artificial
  CRISPR gRNA sequence
agttactggagcttttttaa

SEQ ID NO: 134820 - DNA, 20 bp, Artificial
  CRISPR gRNA sequence
gttactggagcttttttaag

SEQ ID NO: 134821 - DNA, 20 bp, Artificial
  CRISPR gRNA sequence
ctggagcttttttaagacta

SEQ ID NO: 134822 - DNA, 20 bp, Artificial
  CRISPR gRNA sequence
gagcttttttaagactagat

SEQ ID NO: 134823 - DNA, 20 bp, Artificial
  CRISPR gRNA sequence
ttttaagactagatttggtt

SEQ ID NO: 134824 - DNA, 20 bp, Artificial
  CRISPR gRNA sequence
tttaagactagatttggttt

SEQ ID NO: 134825 - DNA, 20 bp, Artificial
  CRISPR gRNA sequence
ttaagactagatttggtttt

SEQ ID NO: 134826 - DNA, 20 bp, Artificial
  CRISPR gRNA sequence
taagactagatttggttttg

SEQ ID NO: 134827 - DNA, 20 bp, Artificial
  CRISPR gRNA sequence
aagactagatttggttttga

SEQ ID NO: 134828 - DNA, 20 bp, Artificial
  CRISPR gRNA sequence
agactagatttggttttgag

SEQ ID NO: 134829 - DNA, 20 bp, Artificial
  CRISPR gRNA sequence
gatttggttttgagttacat

SEQ ID NO: 134830 - DNA, 20 bp, Artificial
  CRISPR gRNA sequence
ggttttgagttacattttta

SEQ ID NO: 134831 - DNA, 20 bp, Artificial
  CRISPR gRNA sequence
gttttgagttacatttttaa

SEQ ID NO: 134832 - DNA, 20 bp, Artificial
  CRISPR gRNA sequence
tgagttacatttttaagaat

SEQ ID NO: 134833 - DNA, 20 bp, Artificial
  CRISPR gRNA sequence
gagttacatttttaagaatg

SEQ ID NO: 134834 - DNA, 20 bp, Artificial
  CRISPR gRNA sequence
agttacatttttaagaatgt

SEQ ID NO: 134835 - DNA, 20 bp, Artificial
  CRISPR gRNA sequence
catttttaagaatgtgggaa

SEQ ID NO: 134836 - DNA, 20 bp, Artificial
  CRISPR gRNA sequence
ttaagaatgtgggaatatat

SEQ ID NO: 134837 - DNA, 20 bp, Artificial
  CRISPR gRNA sequence
taagaatgtgggaatatatt

SEQ ID NO: 134838 - DNA, 20 bp, Artificial
  CRISPR gRNA sequence
aagaatgtgggaatatattt

SEQ ID NO: 134839 - DNA, 20 bp, Artificial
  CRISPR gRNA sequence
agaatgtgggaatatattta

SEQ ID NO: 134840 - DNA, 20 bp, Artificial
  CRISPR gRNA sequence
aagtttaatgtagtcctagt

SEQ ID NO: 134841 - DNA, 20 bp, Artificial
  CRISPR gRNA sequence
agtttaatgtagtcctagtg

SEQ ID NO: 134842 - DNA, 20 bp, Artificial
  CRISPR gRNA sequence
aatgtagtcctagtgctctt

SEQ ID NO: 134843 - DNA, 20 bp, Artificial
  CRISPR gRNA sequence
atgtagtcctagtgctcttg

SEQ ID NO: 134844 - DNA, 20 bp, Artificial
  CRISPR gRNA sequence
gtgctcttgaaatggtgccc

SEQ ID NO: 134845 - DNA, 20 bp, Artificial
  CRISPR gRNA sequence
ttgaaatggtgcccctttca

SEQ ID NO: 134846 - DNA, 20 bp, Artificial
  CRISPR gRNA sequence
gaaatggtgcccctttcatt

SEQ ID NO: 134847 - DNA, 20 bp, Artificial
  CRISPR gRNA sequence
aaatggtgcccctttcattt

SEQ ID NO: 134848 - DNA, 20 bp, Artificial
  CRISPR gRNA sequence
tcatttggtacatgattttt

SEQ ID NO: 134849 - DNA, 20 bp, Artificial
  CRISPR gRNA sequence
catttggtacatgatttttt

SEQ ID NO: 134850 - DNA, 20 bp, Artificial
  CRISPR gRNA sequence
atttggtacatgattttttt

SEQ ID NO: 134851 - DNA, 20 bp, Artificial
  CRISPR gRNA sequence
ggtacatgattttttttcaa

SEQ ID NO: 134852 - DNA, 20 bp, Artificial
  CRISPR gRNA sequence
gtacatgattttttttcaaa

SEQ ID NO: 134853 - DNA, 20 bp, Artificial
  CRISPR gRNA sequence
tttttcaaatcatatcttca

SEQ ID NO: 134854 - DNA, 20 bp, Artificial
  CRISPR gRNA sequence
ttttcaaatcatatcttcaa

SEQ ID NO: 134855 - DNA, 20 bp, Artificial
  CRISPR gRNA sequence
tttcaaatcatatcttcaag

SEQ ID NO: 134856 - DNA, 20 bp, Artificial
  CRISPR gRNA sequence
ttcaaatcatatcttcaagt

SEQ ID NO: 134857 - DNA, 20 bp, Artificial
  CRISPR gRNA sequence
tcaaatcatatcttcaagta

SEQ ID NO: 134858 - DNA, 20 bp, Artificial
  CRISPR gRNA sequence
caaatcatatcttcaagtac

SEQ ID NO: 134859 - DNA, 20 bp, Artificial
  CRISPR gRNA sequence
aaatcatatcttcaagtact

SEQ ID NO: 134860 - DNA, 20 bp, Artificial
  CRISPR gRNA sequence
caagtactatagtattctct

SEQ ID NO: 134861 - DNA, 20 bp, Artificial
  CRISPR gRNA sequence
aagtactatagtattctctt

SEQ ID NO: 134862 - DNA, 20 bp, Artificial
  CRISPR gRNA sequence
tagtattctcttacagaaga

SEQ ID NO: 134863 - DNA, 20 bp, Artificial
  CRISPR gRNA sequence
tcttacagaagaggagtttt

SEQ ID NO: 134864 - DNA, 20 bp, Artificial
  CRISPR gRNA sequence
ttacagaagaggagttttat

SEQ ID NO: 134865 - DNA, 20 bp, Artificial
  CRISPR gRNA sequence
acagaagaggagttttatag

SEQ ID NO: 134866 - DNA, 20 bp, Artificial
  CRISPR gRNA sequence
cagaagaggagttttatagt

SEQ ID NO: 134867 - DNA, 20 bp, Artificial
  CRISPR gRNA sequence
tatagtctgatggtaaatgt

SEQ ID NO: 134868 - DNA, 20 bp, Artificial
  CRISPR gRNA sequence
atagtctgatggtaaatgtc

SEQ ID NO: 134869 - DNA, 20 bp, Artificial
  CRISPR gRNA sequence
tagtctgatggtaaatgtct

SEQ ID NO: 134870 - DNA, 20 bp, Artificial
  CRISPR gRNA sequence
atggtaaatgtcttcatttt

SEQ ID NO: 134871 - DNA, 20 bp, Artificial
  CRISPR gRNA sequence
cattttacctttttaattga

SEQ ID NO: 134872 - DNA, 20 bp, Artificial
  CRISPR gRNA sequence
attttacctttttaattgaa

SEQ ID NO: 134873 - DNA, 20 bp, Artificial
  CRISPR gRNA sequence
tacctttttaattgaaatgt

SEQ ID NO: 134874 - DNA, 20 bp, Artificial
  CRISPR gRNA sequence
acctttttaattgaaatgtc

SEQ ID NO: 134875 - DNA, 20 bp, Artificial
  CRISPR gRNA sequence
cctttttaattgaaatgtca

SEQ ID NO: 134876 - DNA, 20 bp, Artificial
  CRISPR gRNA sequence
tttaattgaaatgtcaagtt

SEQ ID NO: 134877 - DNA, 20 bp, Artificial
  CRISPR gRNA sequence
ttaattgaaatgtcaagttt

SEQ ID NO: 134878 - DNA, 20 bp, Artificial
  CRISPR gRNA sequence
taattgaaatgtcaagtttc

SEQ ID NO: 134879 - DNA, 20 bp, Artificial
  CRISPR gRNA sequence
aattgaaatgtcaagtttcc

SEQ ID NO: 134880 - DNA, 20 bp, Artificial
  CRISPR gRNA sequence
attgaaatgtcaagtttcct

SEQ ID NO: 134881 - DNA, 20 bp, Artificial
  CRISPR gRNA sequence
aaatgtcaagtttcctgtta

SEQ ID NO: 134882 - DNA, 20 bp, Artificial
  CRISPR gRNA sequence
cctgttacactatggaaacc

SEQ ID NO: 134883 - DNA, 20 bp, Artificial
  CRISPR gRNA sequence
ctgttacactatggaaacca

SEQ ID NO: 134884 - DNA, 20 bp, Artificial
  CRISPR gRNA sequence
ttacactatggaaaccaaga

SEQ ID NO: 134885 - DNA, 20 bp, Artificial
  CRISPR gRNA sequence
cactatggaaaccaagaaac

SEQ ID NO: 134886 - DNA, 20 bp, Artificial
  CRISPR gRNA sequence
tggaaaccaagaaacatcag

SEQ ID NO: 134887 - DNA, 20 bp, Artificial
  CRISPR gRNA sequence
cgtgtacagaccttttgcat

SEQ ID NO: 134888 - DNA, 20 bp, Artificial
  CRISPR gRNA sequence
ttgcatgggtgagtggatga

SEQ ID NO: 134889 - DNA, 20 bp, Artificial
  CRISPR gRNA sequence
tgcatgggtgagtggatgaa

SEQ ID NO: 134890 - DNA, 20 bp, Artificial
  CRISPR gRNA sequence
gcatgggtgagtggatgaaa

SEQ ID NO: 134891 - DNA, 20 bp, Artificial
  CRISPR gRNA sequence
catgggtgagtggatgaaat

SEQ ID NO: 134892 - DNA, 20 bp, Artificial
  CRISPR gRNA sequence
tgaacggtgtgaaatagaag

SEQ ID NO: 134893 - DNA, 20 bp, Artificial
  CRISPR gRNA sequence
ctagtatgctgtcttcatct

SEQ ID NO: 134894 - DNA, 20 bp, Artificial
  CRISPR gRNA sequence
tagtatgctgtcttcatctc

SEQ ID NO: 134895 - DNA, 20 bp, Artificial
  CRISPR gRNA sequence
gtatgctgtcttcatctctg

SEQ ID NO: 134896 - DNA, 20 bp, Artificial
  CRISPR gRNA sequence
tcttcatctctgcaataaac

SEQ ID NO: 134897 - DNA, 20 bp, Artificial
  CRISPR gRNA sequence
catctctgcaataaactaaa

SEQ ID NO: 134898 - DNA, 20 bp, Artificial
  CRISPR gRNA sequence
atctctgcaataaactaaac

SEQ ID NO: 134899 - DNA, 20 bp, Artificial
  CRISPR gRNA sequence
tgcaataaactaaacgtaaa

SEQ ID NO: 134900 - DNA, 20 bp, Artificial
  CRISPR gRNA sequence
caataaactaaacgtaaata

SEQ ID NO: 134901 - DNA, 20 bp, Artificial
  CRISPR gRNA sequence
aacgtaaataatgtaacttt

SEQ ID NO: 134902 - DNA, 20 bp, Artificial
  CRISPR gRNA sequence
tgtataatttagtagtatgt

SEQ ID NO: 134903 - DNA, 20 bp, Artificial
  CRISPR gRNA sequence
gtataatttagtagtatgta

SEQ ID NO: 134904 - DNA, 20 bp, Artificial
  CRISPR gRNA sequence
tataatttagtagtatgtac

SEQ ID NO: 134905 - DNA, 20 bp, Artificial
  CRISPR gRNA sequence
agtagtatgtacttggattg

SEQ ID NO: 134906 - DNA, 20 bp, Artificial
  CRISPR gRNA sequence
gtagtatgtacttggattgt

SEQ ID NO: 134907 - DNA, 20 bp, Artificial
  CRISPR gRNA sequence
ggattgtttctttttgaaaa

SEQ ID NO: 134908 - DNA, 20 bp, Artificial
  CRISPR gRNA sequence
gattgtttctttttgaaaag

SEQ ID NO: 134909 - DNA, 20 bp, Artificial
  CRISPR gRNA sequence
tttctttttgaaaagtgagg

SEQ ID NO: 134910 - DNA, 20 bp, Artificial
  CRISPR gRNA sequence
ctttttgaaaagtgaggatt

SEQ ID NO: 134911 - DNA, 20 bp, Artificial
  CRISPR gRNA sequence
tttttgaaaagtgaggattt

SEQ ID NO: 134912 - DNA, 20 bp, Artificial
  CRISPR gRNA sequence
tttgaaaagtgaggatttgt

SEQ ID NO: 134913 - DNA, 20 bp, Artificial
  CRISPR gRNA sequence
ttgaaaagtgaggatttgta

SEQ ID NO: 134914 - DNA, 20 bp, Artificial
  CRISPR gRNA sequence
tgaaaagtgaggatttgtat

SEQ ID NO: 134915 - DNA, 20 bp, Artificial
  CRISPR gRNA sequence
gaaaagtgaggatttgtatt

SEQ ID NO: 134916 - DNA, 20 bp, Artificial
  CRISPR gRNA sequence
aaaagtgaggatttgtattt

SEQ ID NO: 134917 - DNA, 20 bp, Artificial
  CRISPR gRNA sequence
gtattttctcatctattctt

SEQ ID NO: 134918 - DNA, 20 bp, Artificial
  CRISPR gRNA sequence
tattttctcatctattcttt

SEQ ID NO: 134919 - DNA, 20 bp, Artificial
  CRISPR gRNA sequence
tctcatctattctttttggt

SEQ ID NO: 134920 - DNA, 20 bp, Artificial
  CRISPR gRNA sequence
ctcatctattctttttggtg

SEQ ID NO: 134921 - DNA, 20 bp, Artificial
  CRISPR gRNA sequence
tcatctattctttttggtgt

SEQ ID NO: 134922 - DNA, 20 bp, Artificial
  CRISPR gRNA sequence
atctattctttttggtgtta

SEQ ID NO: 134923 - DNA, 20 bp, Artificial
  CRISPR gRNA sequence
ttctttttggtgttaattaa

SEQ ID NO: 134924 - DNA, 20 bp, Artificial
  CRISPR gRNA sequence
tttttggtgttaattaactt

SEQ ID NO: 134925 - DNA, 20 bp, Artificial
  CRISPR gRNA sequence
tttggtgttaattaacttga

SEQ ID NO: 134926 - DNA, 20 bp, Artificial
  CRISPR gRNA sequence
ttggtgttaattaacttgag

SEQ ID NO: 134927 - DNA, 20 bp, Artificial
  CRISPR gRNA sequence
tggtgttaattaacttgagg

SEQ ID NO: 134928 - DNA, 20 bp, Artificial
  CRISPR gRNA sequence
ggtgttaattaacttgaggg

SEQ ID NO: 134929 - DNA, 20 bp, Artificial
  CRISPR gRNA sequence
gtgttaattaacttgaggga

SEQ ID NO: 134930 - DNA, 20 bp, Artificial
  CRISPR gRNA sequence
attaacttgagggatttctt

SEQ ID NO: 134931 - DNA, 20 bp, Artificial
  CRISPR gRNA sequence
acttgagggatttctttttt

SEQ ID NO: 134932 - DNA, 20 bp, Artificial
  CRISPR gRNA sequence
gagggatttcttttttaagt

SEQ ID NO: 134933 - DNA, 20 bp, Artificial
  CRISPR gRNA sequence
agggatttcttttttaagtt

SEQ ID NO: 134934 - DNA, 20 bp, Artificial
  CRISPR gRNA sequence
cttttttaagtttttaatat

SEQ ID NO: 134935 - DNA, 20 bp, Artificial
  CRISPR gRNA sequence
ttttttaagtttttaatatc

SEQ ID NO: 134936 - DNA, 20 bp, Artificial
  CRISPR gRNA sequence
ttttaagtttttaatatcaa

SEQ ID NO: 134937 - DNA, 20 bp, Artificial
  CRISPR gRNA sequence
tttaagtttttaatatcaaa

SEQ ID NO: 134938 - DNA, 20 bp, Artificial
  CRISPR gRNA sequence
ttaagtttttaatatcaaaa

SEQ ID NO: 134939 - DNA, 20 bp, Artificial
  CRISPR gRNA sequence
taagtttttaatatcaaaaa

SEQ ID NO: 134940 - DNA, 20 bp, Artificial
  CRISPR gRNA sequence
aagtttttaatatcaaaaat

SEQ ID NO: 134941 - DNA, 20 bp, Artificial
  CRISPR gRNA sequence
agtttttaatatcaaaaatt

SEQ ID NO: 134942 - DNA, 20 bp, Artificial
  CRISPR gRNA sequence
ttaatatcaaaaattgctat

SEQ ID NO: 134943 - DNA, 20 bp, Artificial
  CRISPR gRNA sequence
taatatcaaaaattgctatt

SEQ ID NO: 134944 - DNA, 20 bp, Artificial
  CRISPR gRNA sequence
aatatcaaaaattgctattg

SEQ ID NO: 134945 - DNA, 20 bp, Artificial
  CRISPR gRNA sequence
atatcaaaaattgctattgt

SEQ ID NO: 134946 - DNA, 20 bp, Artificial
  CRISPR gRNA sequence
ctattgtatagtttgcctaa

SEQ ID NO: 134947 - DNA, 20 bp, Artificial
  CRISPR gRNA sequence
ttgtatagtttgcctaaaag

SEQ ID NO: 134948 - DNA, 20 bp, Artificial
  CRISPR gRNA sequence
tatagtttgcctaaaaggaa

SEQ ID NO: 134949 - DNA, 20 bp, Artificial
  CRISPR gRNA sequence
gcctaaaaggaagttggagt

SEQ ID NO: 134950 - DNA, 20 bp, Artificial
  CRISPR gRNA sequence
cctaaaaggaagttggagtg

SEQ ID NO: 134951 - DNA, 20 bp, Artificial
  CRISPR gRNA sequence
aaaggaagttggagtgaata

SEQ ID NO: 134952 - DNA, 20 bp, Artificial
  CRISPR gRNA sequence
gagtgaatatcatctttgaa

SEQ ID NO: 134953 - DNA, 20 bp, Artificial
  CRISPR gRNA sequence
tgaaggacactcaaatttat

SEQ ID NO: 134954 - DNA, 20 bp, Artificial
  CRISPR gRNA sequence
gaaggacactcaaatttata

SEQ ID NO: 134955 - DNA, 20 bp, Artificial
  CRISPR gRNA sequence
aaggacactcaaatttataa

SEQ ID NO: 134956 - DNA, 20 bp, Artificial
  CRISPR gRNA sequence
aaatttataaggtagaagca

SEQ ID NO: 134957 - DNA, 20 bp, Artificial
  CRISPR gRNA sequence
ataaggtagaagcaatttcc

SEQ ID NO: 134958 - DNA, 20 bp, Artificial
  CRISPR gRNA sequence
taaggtagaagcaatttccc

SEQ ID NO: 134959 - DNA, 20 bp, Artificial
  CRISPR gRNA sequence
cccagatataggctgaacag

SEQ ID NO: 134960 - DNA, 20 bp, Artificial
  CRISPR gRNA sequence
ccagatataggctgaacaga

SEQ ID NO: 134961 - DNA, 20 bp, Artificial
  CRISPR gRNA sequence
aacagaaacatttactttgc

SEQ ID NO: 134962 - DNA, 20 bp, Artificial
  CRISPR gRNA sequence
actttgccagaaggagcctt

SEQ ID NO: 134963 - DNA, 20 bp, Artificial
  CRISPR gRNA sequence
ctttgccagaaggagccttt

SEQ ID NO: 134964 - DNA, 20 bp, Artificial
  CRISPR gRNA sequence
tgccagaaggagcctttagg

SEQ ID NO: 134965 - DNA, 20 bp, Artificial
  CRISPR gRNA sequence
gccagaaggagcctttagga

SEQ ID NO: 134966 - DNA, 20 bp, Artificial
  CRISPR gRNA sequence
ccagaaggagcctttaggag

SEQ ID NO: 134967 - DNA, 20 bp, Artificial
  CRISPR gRNA sequence
taggagtatatgtgggctaa

SEQ ID NO: 134968 - DNA, 20 bp, Artificial
  CRISPR gRNA sequence
aggagtatatgtgggctaat

SEQ ID NO: 134969 - DNA, 20 bp, Artificial
  CRISPR gRNA sequence
ggagtatatgtgggctaatc

SEQ ID NO: 134970 - DNA, 20 bp, Artificial
  CRISPR gRNA sequence
atcagaggttaataatgtcc

SEQ ID NO: 134971 - DNA, 20 bp, Artificial
  CRISPR gRNA sequence
ataatgtcctcatctcctac

SEQ ID NO: 134972 - DNA, 20 bp, Artificial
  CRISPR gRNA sequence
atctcctactctccatttaa

SEQ ID NO: 134973 - DNA, 20 bp, Artificial
  CRISPR gRNA sequence
ctactctccatttaaaaaac

SEQ ID NO: 134974 - DNA, 20 bp, Artificial
  CRISPR gRNA sequence
ctctccatttaaaaaacaaa

SEQ ID NO: 134975 - DNA, 20 bp, Artificial
  CRISPR gRNA sequence
tccatttaaaaaacaaactt

SEQ ID NO: 134976 - DNA, 20 bp, Artificial
  CRISPR gRNA sequence
catttaaaaaacaaacttca

SEQ ID NO: 134977 - DNA, 20 bp, Artificial
  CRISPR gRNA sequence
aaaaaacaaacttcattgta

SEQ ID NO: 134978 - DNA, 20 bp, Artificial
  CRISPR gRNA sequence
aaaaacaaacttcattgtag

SEQ ID NO: 134979 - DNA, 20 bp, Artificial
  CRISPR gRNA sequence
cattgtagtaaattcaaata

SEQ ID NO: 134980 - DNA, 20 bp, Artificial
  CRISPR gRNA sequence
attgtagtaaattcaaatag

SEQ ID NO: 134981 - DNA, 20 bp, Artificial
  CRISPR gRNA sequence
tagtaaattcaaataggaaa

SEQ ID NO: 134982 - DNA, 20 bp, Artificial
  CRISPR gRNA sequence
aaataggaaaaaatggggga

SEQ ID NO: 134983 - DNA, 20 bp, Artificial
  CRISPR gRNA sequence
agcaaaatcaacagtcatcc

SEQ ID NO: 134984 - DNA, 20 bp, Artificial
  CRISPR gRNA sequence
ctatgttgaaagaaccaatg

SEQ ID NO: 134985 - DNA, 20 bp, Artificial
  CRISPR gRNA sequence
tgttgaaagaaccaatgtta

SEQ ID NO: 134986 - DNA, 20 bp, Artificial
  CRISPR gRNA sequence
aaagaaccaatgttaatatt

SEQ ID NO: 134987 - DNA, 20 bp, Artificial
  CRISPR gRNA sequence
atattttgataaatatcatt

SEQ ID NO: 134988 - DNA, 20 bp, Artificial
  CRISPR gRNA sequence
tgataaatatcatttgtcct

SEQ ID NO: 134989 - DNA, 20 bp, Artificial
  CRISPR gRNA sequence
gataaatatcatttgtcctt

SEQ ID NO: 134990 - DNA, 20 bp, Artificial
  CRISPR gRNA sequence
ataaatatcatttgtccttt

SEQ ID NO: 134991 - DNA, 20 bp, Artificial
  CRISPR gRNA sequence
gtccttttactttgctaaat

SEQ ID NO: 134992 - DNA, 20 bp, Artificial
  CRISPR gRNA sequence
tccttttactttgctaaata

SEQ ID NO: 134993 - DNA, 20 bp, Artificial
  CRISPR gRNA sequence
ttactttgctaaatatgtat

SEQ ID NO: 134994 - DNA, 20 bp, Artificial
  CRISPR gRNA sequence
tactttgctaaatatgtata

SEQ ID NO: 134995 - DNA, 20 bp, Artificial
  CRISPR gRNA sequence
actttgctaaatatgtatat

SEQ ID NO: 134996 - DNA, 20 bp, Artificial
  CRISPR gRNA sequence
ctttgctaaatatgtatatt

SEQ ID NO: 134997 - DNA, 20 bp, Artificial
  CRISPR gRNA sequence
tgctaaatatgtatattttt

SEQ ID NO: 134998 - DNA, 20 bp, Artificial
  CRISPR gRNA sequence
gctaaatatgtatattttta

SEQ ID NO: 134999 - DNA, 20 bp, Artificial
  CRISPR gRNA sequence
ctaaatatgtatatttttat

SEQ ID NO: 135000 - DNA, 20 bp, Artificial
  CRISPR gRNA sequence
aatatgtatatttttataaa

SEQ ID NO: 135001 - DNA, 20 bp, Artificial
  CRISPR gRNA sequence
ttataaaaatgggctcatat

SEQ ID NO: 135002 - DNA, 20 bp, Artificial
  CRISPR gRNA sequence
tataaaaatgggctcatatt

SEQ ID NO: 135003 - DNA, 20 bp, Artificial
  CRISPR gRNA sequence
ataaaaatgggctcatattg

SEQ ID NO: 135004 - DNA, 20 bp, Artificial
  CRISPR gRNA sequence
taaaaatgggctcatattgt

SEQ ID NO: 135005 - DNA, 20 bp, Artificial
  CRISPR gRNA sequence
atattgtgcataccattttg

SEQ ID NO: 135006 - DNA, 20 bp, Artificial
  CRISPR gRNA sequence
tgcataccattttgtaacct

SEQ ID NO: 135007 - DNA, 20 bp, Artificial
  CRISPR gRNA sequence
tgtaacctgcttttttcact

SEQ ID NO: 135008 - DNA, 20 bp, Artificial
  CRISPR gRNA sequence
gtaacctgcttttttcactt

SEQ ID NO: 135009 - DNA, 20 bp, Artificial
  CRISPR gRNA sequence
taacctgcttttttcactta

SEQ ID NO: 135010 - DNA, 20 bp, Artificial
  CRISPR gRNA sequence
cttttttcacttaacaatat

SEQ ID NO: 135011 - DNA, 20 bp, Artificial
  CRISPR gRNA sequence
ttttcacttaacaatatatt

SEQ ID NO: 135012 - DNA, 20 bp, Artificial
  CRISPR gRNA sequence
tttcacttaacaatatattg

SEQ ID NO: 135013 - DNA, 20 bp, Artificial
  CRISPR gRNA sequence
ttcacttaacaatatattgg

SEQ ID NO: 135014 - DNA, 20 bp, Artificial
  CRISPR gRNA sequence
tcacttaacaatatattggg

SEQ ID NO: 135015 - DNA, 20 bp, Artificial
  CRISPR gRNA sequence
cacttaacaatatattggga

SEQ ID NO: 135016 - DNA, 20 bp, Artificial
  CRISPR gRNA sequence
acttaacaatatattgggaa

SEQ ID NO: 135017 - DNA, 20 bp, Artificial
  CRISPR gRNA sequence
aacaatatattgggaacatc

SEQ ID NO: 135018 - DNA, 20 bp, Artificial
  CRISPR gRNA sequence
acaatatattgggaacatct

SEQ ID NO: 135019 - DNA, 20 bp, Artificial
  CRISPR gRNA sequence
ggaacatcttttccaggtca

SEQ ID NO: 135020 - DNA, 20 bp, Artificial
  CRISPR gRNA sequence
ttccaggtcatgcatagtct

SEQ ID NO: 135021 - DNA, 20 bp, Artificial
  CRISPR gRNA sequence
tccaggtcatgcatagtctt

SEQ ID NO: 135022 - DNA, 20 bp, Artificial
  CRISPR gRNA sequence
ccaggtcatgcatagtcttc

SEQ ID NO: 135023 - DNA, 20 bp, Artificial
  CRISPR gRNA sequence
caggtcatgcatagtcttct

SEQ ID NO: 135024 - DNA, 20 bp, Artificial
  CRISPR gRNA sequence
ctgcatcatttttattggtt

SEQ ID NO: 135025 - DNA, 20 bp, Artificial
  CRISPR gRNA sequence
tgcatcatttttattggttt

SEQ ID NO: 135026 - DNA, 20 bp, Artificial
  CRISPR gRNA sequence
catcatttttattggtttat

SEQ ID NO: 135027 - DNA, 20 bp, Artificial
  CRISPR gRNA sequence
ttattggtttattattctgc

SEQ ID NO: 135028 - DNA, 20 bp, Artificial
  CRISPR gRNA sequence
tattggtttattattctgct

SEQ ID NO: 135029 - DNA, 20 bp, Artificial
  CRISPR gRNA sequence
attggtttattattctgctg

SEQ ID NO: 135030 - DNA, 20 bp, Artificial
  CRISPR gRNA sequence
ttggtttattattctgctgt

SEQ ID NO: 135031 - DNA, 20 bp, Artificial
  CRISPR gRNA sequence
gtttattattctgctgtatg

SEQ ID NO: 135032 - DNA, 20 bp, Artificial
  CRISPR gRNA sequence
attattctgctgtatgactc

SEQ ID NO: 135033 - DNA, 20 bp, Artificial
  CRISPR gRNA sequence
ttattctgctgtatgactca

SEQ ID NO: 135034 - DNA, 20 bp, Artificial
  CRISPR gRNA sequence
ttctgctgtatgactcaatc

SEQ ID NO: 135035 - DNA, 20 bp, Artificial
  CRISPR gRNA sequence
tgctgtatgactcaatcata

SEQ ID NO: 135036 - DNA, 20 bp, Artificial
  CRISPR gRNA sequence
ctgtatgactcaatcataat

SEQ ID NO: 135037 - DNA, 20 bp, Artificial
  CRISPR gRNA sequence
tatgactcaatcataattca

SEQ ID NO: 135038 - DNA, 20 bp, Artificial
  CRISPR gRNA sequence
aatcataattcatttaatct

SEQ ID NO: 135039 - DNA, 20 bp, Artificial
  CRISPR gRNA sequence
atttaatcttctattggata

SEQ ID NO: 135040 - DNA, 20 bp, Artificial
  CRISPR gRNA sequence
aatcttctattggatatttt

SEQ ID NO: 135041 - DNA, 20 bp, Artificial
  CRISPR gRNA sequence
atcttctattggatattttg

SEQ ID NO: 135042 - DNA, 20 bp, Artificial
  CRISPR gRNA sequence
ctattggatattttgactat

SEQ ID NO: 135043 - DNA, 20 bp, Artificial
  CRISPR gRNA sequence
tattggatattttgactatt

SEQ ID NO: 135044 - DNA, 20 bp, Artificial
  CRISPR gRNA sequence
ttggatattttgactattta

SEQ ID NO: 135045 - DNA, 20 bp, Artificial
  CRISPR gRNA sequence
gatattttgactatttacat

SEQ ID NO: 135046 - DNA, 20 bp, Artificial
  CRISPR gRNA sequence
tgactatttacatcttttca

SEQ ID NO: 135047 - DNA, 20 bp, Artificial
  CRISPR gRNA sequence
gactatttacatcttttcac

SEQ ID NO: 135048 - DNA, 20 bp, Artificial
  CRISPR gRNA sequence
actatttacatcttttcaca

SEQ ID NO: 135049 - DNA, 20 bp, Artificial
  CRISPR gRNA sequence
tttacatcttttcacagtta

SEQ ID NO: 135050 - DNA, 20 bp, Artificial
  CRISPR gRNA sequence
acatcttttcacagttataa

SEQ ID NO: 135051 - DNA, 20 bp, Artificial
  CRISPR gRNA sequence
catcttttcacagttataaa

SEQ ID NO: 135052 - DNA, 20 bp, Artificial
  CRISPR gRNA sequence
ttcacagttataaacagcac

SEQ ID NO: 135053 - DNA, 20 bp, Artificial
  CRISPR gRNA sequence
tcacagttataaacagcact

SEQ ID NO: 135054 - DNA, 20 bp, Artificial
  CRISPR gRNA sequence
cacagttataaacagcactt

SEQ ID NO: 135055 - DNA, 20 bp, Artificial
  CRISPR gRNA sequence
acagttataaacagcacttc

SEQ ID NO: 135056 - DNA, 20 bp, Artificial
  CRISPR gRNA sequence
taaacagcacttcactgaat

SEQ ID NO: 135057 - DNA, 20 bp, Artificial
  CRISPR gRNA sequence
cactgaatcccatgtacatc

SEQ ID NO: 135058 - DNA, 20 bp, Artificial
  CRISPR gRNA sequence
actgaatcccatgtacatcc

SEQ ID NO: 135059 - DNA, 20 bp, Artificial
  CRISPR gRNA sequence
aatcccatgtacatccatga

SEQ ID NO: 135060 - DNA, 20 bp, Artificial
  CRISPR gRNA sequence
ttttcttaaattctttgaat

SEQ ID NO: 135061 - DNA, 20 bp, Artificial
  CRISPR gRNA sequence
tcttaaattctttgaattgc

SEQ ID NO: 135062 - DNA, 20 bp, Artificial
  CRISPR gRNA sequence
cttaaattctttgaattgct

SEQ ID NO: 135063 - DNA, 20 bp, Artificial
  CRISPR gRNA sequence
ttaaattctttgaattgctg

SEQ ID NO: 135064 - DNA, 20 bp, Artificial
  CRISPR gRNA sequence
aaattctttgaattgctggg

SEQ ID NO: 135065 - DNA, 20 bp, Artificial
  CRISPR gRNA sequence
aattctttgaattgctgggt

SEQ ID NO: 135066 - DNA, 20 bp, Artificial
  CRISPR gRNA sequence
tttgaattgctgggttacca

SEQ ID NO: 135067 - DNA, 20 bp, Artificial
  CRISPR gRNA sequence
tgaattgctgggttaccaaa

SEQ ID NO: 135068 - DNA, 20 bp, Artificial
  CRISPR gRNA sequence
gaattgctgggttaccaaat

SEQ ID NO: 135069 - DNA, 20 bp, Artificial
  CRISPR gRNA sequence
aattgctgggttaccaaata

SEQ ID NO: 135070 - DNA, 20 bp, Artificial
  CRISPR gRNA sequence
ctgggttaccaaatatgcaa

SEQ ID NO: 135071 - DNA, 20 bp, Artificial
  CRISPR gRNA sequence
ggttaccaaatatgcaaaat

SEQ ID NO: 135072 - DNA, 20 bp, Artificial
  CRISPR gRNA sequence
ccaaatatgcaaaattttaa

SEQ ID NO: 135073 - DNA, 20 bp, Artificial
  CRISPR gRNA sequence
taaggcttttgatacttcgt

SEQ ID NO: 135074 - DNA, 20 bp, Artificial
  CRISPR gRNA sequence
aaggcttttgatacttcgtt

SEQ ID NO: 135075 - DNA, 20 bp, Artificial
  CRISPR gRNA sequence
aggcttttgatacttcgtta

SEQ ID NO: 135076 - DNA, 20 bp, Artificial
  CRISPR gRNA sequence
ttgatacttcgttatgagtg

SEQ ID NO: 135077 - DNA, 20 bp, Artificial
  CRISPR gRNA sequence
tgatacttcgttatgagtgt

SEQ ID NO: 135078 - DNA, 20 bp, Artificial
  CRISPR gRNA sequence
gatacttcgttatgagtgta

SEQ ID NO: 135079 - DNA, 20 bp, Artificial
  CRISPR gRNA sequence
atacttcgttatgagtgtat

SEQ ID NO: 135080 - DNA, 20 bp, Artificial
  CRISPR gRNA sequence
cgttatgagtgtatttttga

SEQ ID NO: 135081 - DNA, 20 bp, Artificial
  CRISPR gRNA sequence
gttatgagtgtatttttgag

SEQ ID NO: 135082 - DNA, 20 bp, Artificial
  CRISPR gRNA sequence
tgagtgtatttttgagatat

SEQ ID NO: 135083 - DNA, 20 bp, Artificial
  CRISPR gRNA sequence
ttgagatattttccacttga

SEQ ID NO: 135084 - DNA, 20 bp, Artificial
  CRISPR gRNA sequence
tgagatattttccacttgat

SEQ ID NO: 135085 - DNA, 20 bp, Artificial
  CRISPR gRNA sequence
gagatattttccacttgatc

SEQ ID NO: 135086 - DNA, 20 bp, Artificial
  CRISPR gRNA sequence
agatattttccacttgatcc

SEQ ID NO: 135087 - DNA, 20 bp, Artificial
  CRISPR gRNA sequence
tccacttgatccaagcagtg

SEQ ID NO: 135088 - DNA, 20 bp, Artificial
  CRISPR gRNA sequence
ccacttgatccaagcagtgt

SEQ ID NO: 135089 - DNA, 20 bp, Artificial
  CRISPR gRNA sequence
cacttgatccaagcagtgtg

SEQ ID NO: 135090 - DNA, 20 bp, Artificial
  CRISPR gRNA sequence
gatccaagcagtgtgtcact

SEQ ID NO: 135091 - DNA, 20 bp, Artificial
  CRISPR gRNA sequence
atccaagcagtgtgtcacta

SEQ ID NO: 135092 - DNA, 20 bp, Artificial
  CRISPR gRNA sequence
tataactgataaaagcactt

SEQ ID NO: 135093 - DNA, 20 bp, Artificial
  CRISPR gRNA sequence
ataaaagcacttggtctttg

SEQ ID NO: 135094 - DNA, 20 bp, Artificial
  CRISPR gRNA sequence
ggtctttgattatcagatac

SEQ ID NO: 135095 - DNA, 20 bp, Artificial
  CRISPR gRNA sequence
gtctttgattatcagatact

SEQ ID NO: 135096 - DNA, 20 bp, Artificial
  CRISPR gRNA sequence
tgattatcagatactgtctc

SEQ ID NO: 135097 - DNA, 20 bp, Artificial
  CRISPR gRNA sequence
gattatcagatactgtctct

SEQ ID NO: 135098 - DNA, 20 bp, Artificial
  CRISPR gRNA sequence
attatcagatactgtctcta

SEQ ID NO: 135099 - DNA, 20 bp, Artificial
  CRISPR gRNA sequence
tcagatactgtctctaaaat

SEQ ID NO: 135100 - DNA, 20 bp, Artificial
  CRISPR gRNA sequence
tctctaaaattattttaaag

SEQ ID NO: 135101 - DNA, 20 bp, Artificial
  CRISPR gRNA sequence
taaaattattttaaagatta

SEQ ID NO: 135102 - DNA, 20 bp, Artificial
  CRISPR gRNA sequence
aaattattttaaagattaat

SEQ ID NO: 135103 - DNA, 20 bp, Artificial
  CRISPR gRNA sequence
ttttaaagattaatatttgt

SEQ ID NO: 135104 - DNA, 20 bp, Artificial
  CRISPR gRNA sequence
taaagattaatatttgttca

SEQ ID NO: 135105 - DNA, 20 bp, Artificial
  CRISPR gRNA sequence
aaagattaatatttgttcaa

SEQ ID NO: 135106 - DNA, 20 bp, Artificial
  CRISPR gRNA sequence
aagattaatatttgttcaag

SEQ ID NO: 135107 - DNA, 20 bp, Artificial
  CRISPR gRNA sequence
atatttgttcaagtagagaa

SEQ ID NO: 135108 - DNA, 20 bp, Artificial
  CRISPR gRNA sequence
gttcaagtagagaatgaaga

SEQ ID NO: 135109 - DNA, 20 bp, Artificial
  CRISPR gRNA sequence
ttcaagtagagaatgaagat

SEQ ID NO: 135110 - DNA, 20 bp, Artificial
  CRISPR gRNA sequence
aagtagagaatgaagataaa

SEQ ID NO: 135111 - DNA, 20 bp, Artificial
  CRISPR gRNA sequence
gaggccaggtatggggtgtc

SEQ ID NO: 135112 - DNA, 20 bp, Artificial
  CRISPR gRNA sequence
aggccaggtatggggtgtct

SEQ ID NO: 135113 - DNA, 20 bp, Artificial
  CRISPR gRNA sequence
caatcgtggctttgtgttct

SEQ ID NO: 135114 - DNA, 20 bp, Artificial
  CRISPR gRNA sequence
ctttgtgttcttagccgata

SEQ ID NO: 135115 - DNA, 20 bp, Artificial
  CRISPR gRNA sequence
tgtgttcttagccgataaag

SEQ ID NO: 135116 - DNA, 20 bp, Artificial
  CRISPR gRNA sequence
tcttagccgataaagcagtt

SEQ ID NO: 135117 - DNA, 20 bp, Artificial
  CRISPR gRNA sequence
cgataaagcagttcagccaa

SEQ ID NO: 135118 - DNA, 20 bp, Artificial
  CRISPR gRNA sequence
gataaagcagttcagccaat

SEQ ID NO: 135119 - DNA, 20 bp, Artificial
  CRISPR gRNA sequence
ttcagccaatgggaccactg

SEQ ID NO: 135120 - DNA, 20 bp, Artificial
  CRISPR gRNA sequence
cagccaatgggaccactgtg

SEQ ID NO: 135121 - DNA, 20 bp, Artificial
  CRISPR gRNA sequence
agccaatgggaccactgtgg

SEQ ID NO: 135122 - DNA, 20 bp, Artificial
  CRISPR gRNA sequence
aatgggaccactgtggaggc

SEQ ID NO: 135123 - DNA, 20 bp, Artificial
  CRISPR gRNA sequence
atgggaccactgtggaggca

SEQ ID NO: 135124 - DNA, 20 bp, Artificial
  CRISPR gRNA sequence
accactgtggaggcaaggtt

SEQ ID NO: 135125 - DNA, 20 bp, Artificial
  CRISPR gRNA sequence
aggcaaggtttggtgtcaaa

SEQ ID NO: 135126 - DNA, 20 bp, Artificial
  CRISPR gRNA sequence
tttggtgtcaaatagcatgc

SEQ ID NO: 135127 - DNA, 20 bp, Artificial
  CRISPR gRNA sequence
ttgaatgcctttgactgtta

SEQ ID NO: 135128 - DNA, 20 bp, Artificial
  CRISPR gRNA sequence
aatgcctttgactgttaaag

SEQ ID NO: 135129 - DNA, 20 bp, Artificial
  CRISPR gRNA sequence
gcctttgactgttaaagtgg

SEQ ID NO: 135130 - DNA, 20 bp, Artificial
  CRISPR gRNA sequence
cctttgactgttaaagtgga

SEQ ID NO: 135131 - DNA, 20 bp, Artificial
  CRISPR gRNA sequence
tttgactgttaaagtggaag

SEQ ID NO: 135132 - DNA, 20 bp, Artificial
  CRISPR gRNA sequence
ttgactgttaaagtggaagg

SEQ ID NO: 135133 - DNA, 20 bp, Artificial
  CRISPR gRNA sequence
gttaaagtggaaggaggctg

SEQ ID NO: 135134 - DNA, 20 bp, Artificial
  CRISPR gRNA sequence
ttaaagtggaaggaggctgc

SEQ ID NO: 135135 - DNA, 20 bp, Artificial
  CRISPR gRNA sequence
taaagtggaaggaggctgca

SEQ ID NO: 135136 - DNA, 20 bp, Artificial
  CRISPR gRNA sequence
aggaggctgcagggcttcat

SEQ ID NO: 135137 - DNA, 20 bp, Artificial
  CRISPR gRNA sequence
gaggctgcagggcttcattg

SEQ ID NO: 135138 - DNA, 20 bp, Artificial
  CRISPR gRNA sequence
gcagggcttcattggagcct

SEQ ID NO: 135139 - DNA, 20 bp, Artificial
  CRISPR gRNA sequence
agggcttcattggagcctcg

SEQ ID NO: 135140 - DNA, 20 bp, Artificial
  CRISPR gRNA sequence
gagcctcggagtttttcact

SEQ ID NO: 135141 - DNA, 20 bp, Artificial
  CRISPR gRNA sequence
agcctcggagtttttcactg

SEQ ID NO: 135142 - DNA, 20 bp, Artificial
  CRISPR gRNA sequence
ctcggagtttttcactgagg

SEQ ID NO: 135143 - DNA, 20 bp, Artificial
  CRISPR gRNA sequence
tcggagtttttcactgaggc

SEQ ID NO: 135144 - DNA, 20 bp, Artificial
  CRISPR gRNA sequence
cggagtttttcactgaggca

SEQ ID NO: 135145 - DNA, 20 bp, Artificial
  CRISPR gRNA sequence
ggagtttttcactgaggcag

SEQ ID NO: 135146 - DNA, 20 bp, Artificial
  CRISPR gRNA sequence
tttttcactgaggcaggggt

SEQ ID NO: 135147 - DNA, 20 bp, Artificial
  CRISPR gRNA sequence
ctgaggcaggggtcagctga

SEQ ID NO: 135148 - DNA, 20 bp, Artificial
  CRISPR gRNA sequence
caggggtcagctgaaagaca

SEQ ID NO: 135149 - DNA, 20 bp, Artificial
  CRISPR gRNA sequence
agctgaaagacaaagaaaaa

SEQ ID NO: 135150 - DNA, 20 bp, Artificial
  CRISPR gRNA sequence
agacaaagaaaaatggcgaa

SEQ ID NO: 135151 - DNA, 20 bp, Artificial
  CRISPR gRNA sequence
aaaaatggcgaatagtttgt

SEQ ID NO: 135152 - DNA, 20 bp, Artificial
  CRISPR gRNA sequence
aaaatggcgaatagtttgtt

SEQ ID NO: 135153 - DNA, 20 bp, Artificial
  CRISPR gRNA sequence
aaatggcgaatagtttgttg

SEQ ID NO: 135154 - DNA, 20 bp, Artificial
  CRISPR gRNA sequence
aatggcgaatagtttgttgg

SEQ ID NO: 135155 - DNA, 20 bp, Artificial
  CRISPR gRNA sequence
atggcgaatagtttgttggg

SEQ ID NO: 135156 - DNA, 20 bp, Artificial
  CRISPR gRNA sequence
gcgaatagtttgttgggggg

SEQ ID NO: 135157 - DNA, 20 bp, Artificial
  CRISPR gRNA sequence
cgaatagtttgttggggggt

SEQ ID NO: 135158 - DNA, 20 bp, Artificial
  CRISPR gRNA sequence
aatagtttgttggggggtgg

SEQ ID NO: 135159 - DNA, 20 bp, Artificial
  CRISPR gRNA sequence
atagtttgttggggggtggg

SEQ ID NO: 135160 - DNA, 20 bp, Artificial
  CRISPR gRNA sequence
tttgttggggggtgggagga

SEQ ID NO: 135161 - DNA, 20 bp, Artificial
  CRISPR gRNA sequence
ggggtgggaggacagctgtt

SEQ ID NO: 135162 - DNA, 20 bp, Artificial
  CRISPR gRNA sequence
gggtgggaggacagctgttc

SEQ ID NO: 135163 - DNA, 20 bp, Artificial
  CRISPR gRNA sequence
aggacagctgttcgggtttt

SEQ ID NO: 135164 - DNA, 20 bp, Artificial
  CRISPR gRNA sequence
acagctgttcgggttttcag

SEQ ID NO: 135165 - DNA, 20 bp, Artificial
  CRISPR gRNA sequence
agctgttcgggttttcagtg

SEQ ID NO: 135166 - DNA, 20 bp, Artificial
  CRISPR gRNA sequence
tgttcgggttttcagtggag

SEQ ID NO: 135167 - DNA, 20 bp, Artificial
  CRISPR gRNA sequence
tttcagtggagtggacattc

SEQ ID NO: 135168 - DNA, 20 bp, Artificial
  CRISPR gRNA sequence
cttttgtttcctccgtcctt

SEQ ID NO: 135169 - DNA, 20 bp, Artificial
  CRISPR gRNA sequence
ttttgtttcctccgtccttt

SEQ ID NO: 135170 - DNA, 20 bp, Artificial
  CRISPR gRNA sequence
tttgtttcctccgtcctttg

SEQ ID NO: 135171 - DNA, 20 bp, Artificial
  CRISPR gRNA sequence
ttgtttcctccgtcctttgg

SEQ ID NO: 135172 - DNA, 20 bp, Artificial
  CRISPR gRNA sequence
tgtttcctccgtcctttggg

SEQ ID NO: 135173 - DNA, 20 bp, Artificial
  CRISPR gRNA sequence
ttcctccgtcctttgggggg

SEQ ID NO: 135174 - DNA, 20 bp, Artificial
  CRISPR gRNA sequence
tcctccgtcctttggggggt

SEQ ID NO: 135175 - DNA, 20 bp, Artificial
  CRISPR gRNA sequence
cctccgtcctttggggggta

SEQ ID NO: 135176 - DNA, 20 bp, Artificial
  CRISPR gRNA sequence
cgtcctttggggggtaggga

SEQ ID NO: 135177 - DNA, 20 bp, Artificial
  CRISPR gRNA sequence
gtcctttggggggtagggat

SEQ ID NO: 135178 - DNA, 20 bp, Artificial
  CRISPR gRNA sequence
cctttggggggtagggatag

SEQ ID NO: 135179 - DNA, 20 bp, Artificial
  CRISPR gRNA sequence
aggagtgacttaaattctcc

SEQ ID NO: 135180 - DNA, 20 bp, Artificial
  CRISPR gRNA sequence
gtgacttaaattctcccagt

SEQ ID NO: 135181 - DNA, 20 bp, Artificial
  CRISPR gRNA sequence
acttaaattctcccagtcgg

SEQ ID NO: 135182 - DNA, 20 bp, Artificial
  CRISPR gRNA sequence
ttaaattctcccagtcggtg

SEQ ID NO: 135183 - DNA, 20 bp, Artificial
  CRISPR gRNA sequence
taaattctcccagtcggtgg

SEQ ID NO: 135184 - DNA, 20 bp, Artificial
  CRISPR gRNA sequence
aactacatgtaaaattaatg

SEQ ID NO: 135185 - DNA, 20 bp, Artificial
  CRISPR gRNA sequence
tgtaaaattaatgcagttcc

SEQ ID NO: 135186 - DNA, 20 bp, Artificial
  CRISPR gRNA sequence
aaattaatgcagttcccggt

SEQ ID NO: 135187 - DNA, 20 bp, Artificial
  CRISPR gRNA sequence
tttgttttgtgttgaaatga

SEQ ID NO: 135188 - DNA, 20 bp, Artificial
  CRISPR gRNA sequence
ttgaaatgatagaaactgtt

SEQ ID NO: 135189 - DNA, 20 bp, Artificial
  CRISPR gRNA sequence
tgatagaaactgtttagctt

SEQ ID NO: 135190 - DNA, 20 bp, Artificial
  CRISPR gRNA sequence
atagaaactgtttagcttca

SEQ ID NO: 135191 - DNA, 20 bp, Artificial
  CRISPR gRNA sequence
agaaactgtttagcttcaga

SEQ ID NO: 135192 - DNA, 20 bp, Artificial
  CRISPR gRNA sequence
ctgtttagcttcagagagtg

SEQ ID NO: 135193 - DNA, 20 bp, Artificial
  CRISPR gRNA sequence
tagcttcagagagtgtagac

SEQ ID NO: 135194 - DNA, 20 bp, Artificial
  CRISPR gRNA sequence
tgtagacaagttgcactgtt

SEQ ID NO: 135195 - DNA, 20 bp, Artificial
  CRISPR gRNA sequence
aagttgcactgttcagaaaa

SEQ ID NO: 135196 - DNA, 20 bp, Artificial
  CRISPR gRNA sequence
tacattccatgcataccttt

SEQ ID NO: 135197 - DNA, 20 bp, Artificial
  CRISPR gRNA sequence
tgcataccttttggtgcacc

SEQ ID NO: 135198 - DNA, 20 bp, Artificial
  CRISPR gRNA sequence
ctagaataccttgctgtgtt

SEQ ID NO: 135199 - DNA, 20 bp, Artificial
  CRISPR gRNA sequence
gattttgcatgtccttcaac

SEQ ID NO: 135200 - DNA, 20 bp, Artificial
  CRISPR gRNA sequence
attttgcatgtccttcaact

SEQ ID NO: 135201 - DNA, 20 bp, Artificial
  CRISPR gRNA sequence
ttcaactaggatttctttcc

SEQ ID NO: 135202 - DNA, 20 bp, Artificial
  CRISPR gRNA sequence
actaggatttctttcctagt

SEQ ID NO: 135203 - DNA, 20 bp, Artificial
  CRISPR gRNA sequence
ctaggatttctttcctagtt

SEQ ID NO: 135204 - DNA, 20 bp, Artificial
  CRISPR gRNA sequence
tttcctagttgggtatcgac

SEQ ID NO: 135205 - DNA, 20 bp, Artificial
  CRISPR gRNA sequence
tagttgggtatcgacaagat

SEQ ID NO: 135206 - DNA, 20 bp, Artificial
  CRISPR gRNA sequence
agttgggtatcgacaagatc

SEQ ID NO: 135207 - DNA, 20 bp, Artificial
  CRISPR gRNA sequence
tatcgacaagatcaggtaca

SEQ ID NO: 135208 - DNA, 20 bp, Artificial
  CRISPR gRNA sequence
tcgacaagatcaggtacatg

SEQ ID NO: 135209 - DNA, 20 bp, Artificial
  CRISPR gRNA sequence
caagatcaggtacatggaga

SEQ ID NO: 135210 - DNA, 20 bp, Artificial
  CRISPR gRNA sequence
aagatcaggtacatggagaa

SEQ ID NO: 135211 - DNA, 20 bp, Artificial
  CRISPR gRNA sequence
gagaaaggctaatcattttt

SEQ ID NO: 135212 - DNA, 20 bp, Artificial
  CRISPR gRNA sequence
agaaaggctaatcatttttc

SEQ ID NO: 135213 - DNA, 20 bp, Artificial
  CRISPR gRNA sequence
gaaaggctaatcatttttca

SEQ ID NO: 135214 - DNA, 20 bp, Artificial
  CRISPR gRNA sequence
aaaggctaatcatttttcag

SEQ ID NO: 135215 - DNA, 20 bp, Artificial
  CRISPR gRNA sequence
aatcatttttcaggggcaca

SEQ ID NO: 135216 - DNA, 20 bp, Artificial
  CRISPR gRNA sequence
catttttcaggggcacacag

SEQ ID NO: 135217 - DNA, 20 bp, Artificial
  CRISPR gRNA sequence
aaacacttttctctttgcat

SEQ ID NO: 135218 - DNA, 20 bp, Artificial
  CRISPR gRNA sequence
aacacttttctctttgcatt

SEQ ID NO: 135219 - DNA, 20 bp, Artificial
  CRISPR gRNA sequence
caaataattttcctttgttc

SEQ ID NO: 135220 - DNA, 20 bp, Artificial
  CRISPR gRNA sequence
tcctttgttcaagtgccctg

SEQ ID NO: 135221 - DNA, 20 bp, Artificial
  CRISPR gRNA sequence
agtgccctgaagctttccta

SEQ ID NO: 135222 - DNA, 20 bp, Artificial
  CRISPR gRNA sequence
ctgaagctttcctacggaat

SEQ ID NO: 135223 - DNA, 20 bp, Artificial
  CRISPR gRNA sequence
agctttcctacggaataagc

SEQ ID NO: 135224 - DNA, 20 bp, Artificial
  CRISPR gRNA sequence
gctttcctacggaataagct

SEQ ID NO: 135225 - DNA, 20 bp, Artificial
  CRISPR gRNA sequence
ggaataagctgggttgttgt

SEQ ID NO: 135226 - DNA, 20 bp, Artificial
  CRISPR gRNA sequence
aataagctgggttgttgtga

SEQ ID NO: 135227 - DNA, 20 bp, Artificial
  CRISPR gRNA sequence
tttgttgacatctgtgtttt

SEQ ID NO: 135228 - DNA, 20 bp, Artificial
  CRISPR gRNA sequence
gacatctgtgttttcagata

SEQ ID NO: 135229 - DNA, 20 bp, Artificial
  CRISPR gRNA sequence
atctgtgttttcagatatgg

SEQ ID NO: 135230 - DNA, 20 bp, Artificial
  CRISPR gRNA sequence
ggaagcaacactgttgctgt

SEQ ID NO: 135231 - DNA, 20 bp, Artificial
  CRISPR gRNA sequence
aaatacgatttgcactgctg

SEQ ID NO: 135232 - DNA, 20 bp, Artificial
  CRISPR gRNA sequence
aatacgatttgcactgctgc

SEQ ID NO: 135233 - DNA, 20 bp, Artificial
  CRISPR gRNA sequence
tgcactgctgcaggttctaa

SEQ ID NO: 135234 - DNA, 20 bp, Artificial
  CRISPR gRNA sequence
tgctgcaggttctaatggtg

SEQ ID NO: 135235 - DNA, 20 bp, Artificial
  CRISPR gRNA sequence
gctgcaggttctaatggtga

SEQ ID NO: 135236 - DNA, 20 bp, Artificial
  CRISPR gRNA sequence
aatggtgaaggcccacatgc

SEQ ID NO: 135237 - DNA, 20 bp, Artificial
  CRISPR gRNA sequence
ccataactttcttgatttac

SEQ ID NO: 135238 - DNA, 20 bp, Artificial
  CRISPR gRNA sequence
ttgatttaccagtctacctc

SEQ ID NO: 135239 - DNA, 20 bp, Artificial
  CRISPR gRNA sequence
gtctacctctagattctaat

SEQ ID NO: 135240 - DNA, 20 bp, Artificial
  CRISPR gRNA sequence
tacctctagattctaataag

SEQ ID NO: 135241 - DNA, 20 bp, Artificial
  CRISPR gRNA sequence
ctctagattctaataagtag

SEQ ID NO: 135242 - DNA, 20 bp, Artificial
  CRISPR gRNA sequence
ctaataagtagtagttaatg

SEQ ID NO: 135243 - DNA, 20 bp, Artificial
  CRISPR gRNA sequence
tttgtttttaatgcacattt

SEQ ID NO: 135244 - DNA, 20 bp, Artificial
  CRISPR gRNA sequence
ttttaatgcacattttagct

SEQ ID NO: 135245 - DNA, 20 bp, Artificial
  CRISPR gRNA sequence
cacattttagcttagaatgc

SEQ ID NO: 135246 - DNA, 20 bp, Artificial
  CRISPR gRNA sequence
ttttagcttagaatgctggt

SEQ ID NO: 135247 - DNA, 20 bp, Artificial
  CRISPR gRNA sequence
aatatcttcacttatattga

SEQ ID NO: 135248 - DNA, 20 bp, Artificial
  CRISPR gRNA sequence
tcacttatattgacagtgat

SEQ ID NO: 135249 - DNA, 20 bp, Artificial
  CRISPR gRNA sequence
gatgagcaaatatttttcca

SEQ ID NO: 135250 - DNA, 20 bp, Artificial
  CRISPR gRNA sequence
acagatttcacacattttgt

SEQ ID NO: 135251 - DNA, 20 bp, Artificial
  CRISPR gRNA sequence
cagatttcacacattttgtc

SEQ ID NO: 135252 - DNA, 20 bp, Artificial
  CRISPR gRNA sequence
cattttgtcaggtgttgatt

SEQ ID NO: 135253 - DNA, 20 bp, Artificial
  CRISPR gRNA sequence
ttagttctttaaaatgatgt

SEQ ID NO: 135254 - DNA, 20 bp, Artificial
  CRISPR gRNA sequence
tctttaaaatgatgtgagca

SEQ ID NO: 135255 - DNA, 20 bp, Artificial
  CRISPR gRNA sequence
attaaatatttaaaatcctg

SEQ ID NO: 135256 - DNA, 20 bp, Artificial
  CRISPR gRNA sequence
aaaatcctgcagtttgtgaa

SEQ ID NO: 135257 - DNA, 20 bp, Artificial
  CRISPR gRNA sequence
aaatcctgcagtttgtgaat

SEQ ID NO: 135258 - DNA, 20 bp, Artificial
  CRISPR gRNA sequence
cctgcagtttgtgaatagga

SEQ ID NO: 135259 - DNA, 20 bp, Artificial
  CRISPR gRNA sequence
agtttgtgaataggaaagtt

SEQ ID NO: 135260 - DNA, 20 bp, Artificial
  CRISPR gRNA sequence
tttgtgaataggaaagttaa

SEQ ID NO: 135261 - DNA, 20 bp, Artificial
  CRISPR gRNA sequence
gaataggaaagttaagagta

SEQ ID NO: 135262 - DNA, 20 bp, Artificial
  CRISPR gRNA sequence
aataggaaagttaagagtat

SEQ ID NO: 135263 - DNA, 20 bp, Artificial
  CRISPR gRNA sequence
tgtatatatttttctcttta

SEQ ID NO: 135264 - DNA, 20 bp, Artificial
  CRISPR gRNA sequence
tttttctctttatggatata

SEQ ID NO: 135265 - DNA, 20 bp, Artificial
  CRISPR gRNA sequence
ttatggatataaagctaatg

SEQ ID NO: 135266 - DNA, 20 bp, Artificial
  CRISPR gRNA sequence
tatggatataaagctaatgt

SEQ ID NO: 135267 - DNA, 20 bp, Artificial
  CRISPR gRNA sequence
agctaatgtaggttgctaat

SEQ ID NO: 135268 - DNA, 20 bp, Artificial
  CRISPR gRNA sequence
gtaggttgctaatcagtaac

SEQ ID NO: 135269 - DNA, 20 bp, Artificial
  CRISPR gRNA sequence
gttgctaatcagtaaccagc

SEQ ID NO: 135270 - DNA, 20 bp, Artificial
  CRISPR gRNA sequence
aaccagccagttctcatgaa

SEQ ID NO: 135271 - DNA, 20 bp, Artificial
  CRISPR gRNA sequence
aatcttcaatcccacatact

SEQ ID NO: 135272 - DNA, 20 bp, Artificial
  CRISPR gRNA sequence
tttctttttatttgcaaata

SEQ ID NO: 135273 - DNA, 20 bp, Artificial
  CRISPR gRNA sequence
ttatttgcaaatatggaatg

SEQ ID NO: 135274 - DNA, 20 bp, Artificial
  CRISPR gRNA sequence
tatttgcaaatatggaatga

SEQ ID NO: 135275 - DNA, 20 bp, Artificial
  CRISPR gRNA sequence
aaatatggaatgaaggtcat

SEQ ID NO: 135276 - DNA, 20 bp, Artificial
  CRISPR gRNA sequence
aggtcattggaacatttctg

SEQ ID NO: 135277 - DNA, 20 bp, Artificial
  CRISPR gRNA sequence
tcattggaacatttctgcag

SEQ ID NO: 135278 - DNA, 20 bp, Artificial
  CRISPR gRNA sequence
gaacatttctgcagcagact

SEQ ID NO: 135279 - DNA, 20 bp, Artificial
  CRISPR gRNA sequence
tttctgcagcagactcagtg

SEQ ID NO: 135280 - DNA, 20 bp, Artificial
  CRISPR gRNA sequence
tctgcagcagactcagtgtg

SEQ ID NO: 135281 - DNA, 20 bp, Artificial
  CRISPR gRNA sequence
cagactcagtgtggagccgt

SEQ ID NO: 135282 - DNA, 20 bp, Artificial
  CRISPR gRNA sequence
ctcagtgtggagccgtcagc

SEQ ID NO: 135283 - DNA, 20 bp, Artificial
  CRISPR gRNA sequence
agtgtggagccgtcagccag

SEQ ID NO: 135284 - DNA, 20 bp, Artificial
  CRISPR gRNA sequence
agccgtcagccagcagcact

SEQ ID NO: 135285 - DNA, 20 bp, Artificial
  CRISPR gRNA sequence
agccagcagcacttagtctc

SEQ ID NO: 135286 - DNA, 20 bp, Artificial
  CRISPR gRNA sequence
gccagcagcacttagtctct

SEQ ID NO: 135287 - DNA, 20 bp, Artificial
  CRISPR gRNA sequence
cagcacttagtctctgggta

SEQ ID NO: 135288 - DNA, 20 bp, Artificial
  CRISPR gRNA sequence
cttagtctctgggtacggaa

SEQ ID NO: 135289 - DNA, 20 bp, Artificial
  CRISPR gRNA sequence
ttagtctctgggtacggaaa

SEQ ID NO: 135290 - DNA, 20 bp, Artificial
  CRISPR gRNA sequence
agtctctgggtacggaaaag

SEQ ID NO: 135291 - DNA, 20 bp, Artificial
  CRISPR gRNA sequence
ctctgggtacggaaaaggag

SEQ ID NO: 135292 - DNA, 20 bp, Artificial
  CRISPR gRNA sequence
tctgggtacggaaaaggagc

SEQ ID NO: 135293 - DNA, 20 bp, Artificial
  CRISPR gRNA sequence
ggaaaaggagcaggccctat

SEQ ID NO: 135294 - DNA, 20 bp, Artificial
  CRISPR gRNA sequence
aaaaggagcaggccctatta

SEQ ID NO: 135295 - DNA, 20 bp, Artificial
  CRISPR gRNA sequence
aaaggagcaggccctattag

SEQ ID NO: 135296 - DNA, 20 bp, Artificial
  CRISPR gRNA sequence
aggagcaggccctattagag

SEQ ID NO: 135297 - DNA, 20 bp, Artificial
  CRISPR gRNA sequence
agcaggccctattagaggag

SEQ ID NO: 135298 - DNA, 20 bp, Artificial
  CRISPR gRNA sequence
cctattagaggagaagtttc

SEQ ID NO: 135299 - DNA, 20 bp, Artificial
  CRISPR gRNA sequence
ctattagaggagaagtttcg

SEQ ID NO: 135300 - DNA, 20 bp, Artificial
  CRISPR gRNA sequence
tattagaggagaagtttcga

SEQ ID NO: 135301 - DNA, 20 bp, Artificial
  CRISPR gRNA sequence
gggtgtcgatttgccttccc

SEQ ID NO: 135302 - DNA, 20 bp, Artificial
  CRISPR gRNA sequence
ccctagcttcccctctaata

SEQ ID NO: 135303 - DNA, 20 bp, Artificial
  CRISPR gRNA sequence
cctagcttcccctctaataa

SEQ ID NO: 135304 - DNA, 20 bp, Artificial
  CRISPR gRNA sequence
ctctaataaaggatttacct

SEQ ID NO: 135305 - DNA, 20 bp, Artificial
  CRISPR gRNA sequence
ctaataaaggatttacctta

SEQ ID NO: 135306 - DNA, 20 bp, Artificial
  CRISPR gRNA sequence
taataaaggatttaccttag

SEQ ID NO: 135307 - DNA, 20 bp, Artificial
  CRISPR gRNA sequence
gatttaccttagaggactga

SEQ ID NO: 135308 - DNA, 20 bp, Artificial
  CRISPR gRNA sequence
atttaccttagaggactgat

SEQ ID NO: 135309 - DNA, 20 bp, Artificial
  CRISPR gRNA sequence
cttagaggactgataggatt

SEQ ID NO: 135310 - DNA, 20 bp, Artificial
  CRISPR gRNA sequence
ggactgataggatttagatt

SEQ ID NO: 135311 - DNA, 20 bp, Artificial
  CRISPR gRNA sequence
gactgataggatttagattc

SEQ ID NO: 135312 - DNA, 20 bp, Artificial
  CRISPR gRNA sequence
actgataggatttagattcg

SEQ ID NO: 135313 - DNA, 20 bp, Artificial
  CRISPR gRNA sequence
ggatttagattcggggctct

SEQ ID NO: 135314 - DNA, 20 bp, Artificial
  CRISPR gRNA sequence
atttagattcggggctcttg

SEQ ID NO: 135315 - DNA, 20 bp, Artificial
  CRISPR gRNA sequence
ctcttggagttgtaatgata

SEQ ID NO: 135316 - DNA, 20 bp, Artificial
  CRISPR gRNA sequence
tggagttgtaatgatatagc

SEQ ID NO: 135317 - DNA, 20 bp, Artificial
  CRISPR gRNA sequence
tgtaatgatatagcaagtca

SEQ ID NO: 135318 - DNA, 20 bp, Artificial
  CRISPR gRNA sequence
atatagcaagtcaaagttcc

SEQ ID NO: 135319 - DNA, 20 bp, Artificial
  CRISPR gRNA sequence
caagtcaaagttcctggatg

SEQ ID NO: 135320 - DNA, 20 bp, Artificial
  CRISPR gRNA sequence
aagtcaaagttcctggatgc

SEQ ID NO: 135321 - DNA, 20 bp, Artificial
  CRISPR gRNA sequence
gcctctgtcgttgcttgcaa

SEQ ID NO: 135322 - DNA, 20 bp, Artificial
  CRISPR gRNA sequence
aagtgaccttgaaaaactgc

SEQ ID NO: 135323 - DNA, 20 bp, Artificial
  CRISPR gRNA sequence
agtgaccttgaaaaactgct

SEQ ID NO: 135324 - DNA, 20 bp, Artificial
  CRISPR gRNA sequence
gtgaccttgaaaaactgctg

SEQ ID NO: 135325 - DNA, 20 bp, Artificial
  CRISPR gRNA sequence
gaccttgaaaaactgctggg

SEQ ID NO: 135326 - DNA, 20 bp, Artificial
  CRISPR gRNA sequence
aaaaactgctggggagttga

SEQ ID NO: 135327 - DNA, 20 bp, Artificial
  CRISPR gRNA sequence
gctggggagttgaaagattg

SEQ ID NO: 135328 - DNA, 20 bp, Artificial
  CRISPR gRNA sequence
ctggggagttgaaagattga

SEQ ID NO: 135329 - DNA, 20 bp, Artificial
  CRISPR gRNA sequence
agttgaaagattgaaggaca

SEQ ID NO: 135330 - DNA, 20 bp, Artificial
  CRISPR gRNA sequence
aaggacaaagtttgtttata

SEQ ID NO: 135331 - DNA, 20 bp, Artificial
  CRISPR gRNA sequence
aaagtttgtttatacagatt

SEQ ID NO: 135332 - DNA, 20 bp, Artificial
  CRISPR gRNA sequence
ttatacagatttggactgaa

SEQ ID NO: 135333 - DNA, 20 bp, Artificial
  CRISPR gRNA sequence
tggactgaaaagctctattt

SEQ ID NO: 135334 - DNA, 20 bp, Artificial
  CRISPR gRNA sequence
aaagctctatttaagatgaa

SEQ ID NO: 135335 - DNA, 20 bp, Artificial
  CRISPR gRNA sequence
agctctatttaagatgaaaa

SEQ ID NO: 135336 - DNA, 20 bp, Artificial
  CRISPR gRNA sequence
agactgtacttctgatattc

SEQ ID NO: 135337 - DNA, 20 bp, Artificial
  CRISPR gRNA sequence
gtacttctgatattcaagtc

SEQ ID NO: 135338 - DNA, 20 bp, Artificial
  CRISPR gRNA sequence
cttctgatattcaagtcgag

SEQ ID NO: 135339 - DNA, 20 bp, Artificial
  CRISPR gRNA sequence
tgatattcaagtcgagtggt

SEQ ID NO: 135340 - DNA, 20 bp, Artificial
  CRISPR gRNA sequence
tattcaagtcgagtggttag

SEQ ID NO: 135341 - DNA, 20 bp, Artificial
  CRISPR gRNA sequence
attcaagtcgagtggttagt

SEQ ID NO: 135342 - DNA, 20 bp, Artificial
  CRISPR gRNA sequence
tggttagtaggaatatgtta

SEQ ID NO: 135343 - DNA, 20 bp, Artificial
  CRISPR gRNA sequence
gtaggaatatgttatagatt

SEQ ID NO: 135344 - DNA, 20 bp, Artificial
  CRISPR gRNA sequence
aatatgttatagattcagat

SEQ ID NO: 135345 - DNA, 20 bp, Artificial
  CRISPR gRNA sequence
atatgttatagattcagatt

SEQ ID NO: 135346 - DNA, 20 bp, Artificial
  CRISPR gRNA sequence
agattcagattaggaatttt

SEQ ID NO: 135347 - DNA, 20 bp, Artificial
  CRISPR gRNA sequence
gattcagattaggaattttc

SEQ ID NO: 135348 - DNA, 20 bp, Artificial
  CRISPR gRNA sequence
attcagattaggaattttca

SEQ ID NO: 135349 - DNA, 20 bp, Artificial
  CRISPR gRNA sequence
attaggaattttcagggaat

SEQ ID NO: 135350 - DNA, 20 bp, Artificial
  CRISPR gRNA sequence
attttcagggaataagacaa

SEQ ID NO: 135351 - DNA, 20 bp, Artificial
  CRISPR gRNA sequence
ttttcagggaataagacaat

SEQ ID NO: 135352 - DNA, 20 bp, Artificial
  CRISPR gRNA sequence
tttcagggaataagacaata

SEQ ID NO: 135353 - DNA, 20 bp, Artificial
  CRISPR gRNA sequence
tctttttacttccctccccc

SEQ ID NO: 135354 - DNA, 20 bp, Artificial
  CRISPR gRNA sequence
caaaaaattctaaattcttt

SEQ ID NO: 135355 - DNA, 20 bp, Artificial
  CRISPR gRNA sequence
tctaaattcttttggtatga

SEQ ID NO: 135356 - DNA, 20 bp, Artificial
  CRISPR gRNA sequence
attcttttggtatgatagct

SEQ ID NO: 135357 - DNA, 20 bp, Artificial
  CRISPR gRNA sequence
tagctgagtgaactgcctaa

SEQ ID NO: 135358 - DNA, 20 bp, Artificial
  CRISPR gRNA sequence
agtgaactgcctaacagatt

SEQ ID NO: 135359 - DNA, 20 bp, Artificial
  CRISPR gRNA sequence
accttgtcttctttgtaatc

SEQ ID NO: 135360 - DNA, 20 bp, Artificial
  CRISPR gRNA sequence
cttgtcttctttgtaatcta

SEQ ID NO: 135361 - DNA, 20 bp, Artificial
  CRISPR gRNA sequence
ttgtcttctttgtaatctag

SEQ ID NO: 135362 - DNA, 20 bp, Artificial
  CRISPR gRNA sequence
tgtcttctttgtaatctaga

SEQ ID NO: 135363 - DNA, 20 bp, Artificial
  CRISPR gRNA sequence
tttgtaatctagagggttct

SEQ ID NO: 135364 - DNA, 20 bp, Artificial
  CRISPR gRNA sequence
aatctagagggttcttagtg

SEQ ID NO: 135365 - DNA, 20 bp, Artificial
  CRISPR gRNA sequence
atctagagggttcttagtga

SEQ ID NO: 135366 - DNA, 20 bp, Artificial
  CRISPR gRNA sequence
tctagagggttcttagtgaa

SEQ ID NO: 135367 - DNA, 20 bp, Artificial
  CRISPR gRNA sequence
ctagagggttcttagtgaag

SEQ ID NO: 135368 - DNA, 20 bp, Artificial
  CRISPR gRNA sequence
agggttcttagtgaagggga

SEQ ID NO: 135369 - DNA, 20 bp, Artificial
  CRISPR gRNA sequence
ttcttagtgaaggggataga

SEQ ID NO: 135370 - DNA, 20 bp, Artificial
  CRISPR gRNA sequence
gaaggggatagatagtattt

SEQ ID NO: 135371 - DNA, 20 bp, Artificial
  CRISPR gRNA sequence
aaggggatagatagtatttt

SEQ ID NO: 135372 - DNA, 20 bp, Artificial
  CRISPR gRNA sequence
ggggatagatagtattttag

SEQ ID NO: 135373 - DNA, 20 bp, Artificial
  CRISPR gRNA sequence
tagatagtattttaggagtt

SEQ ID NO: 135374 - DNA, 20 bp, Artificial
  CRISPR gRNA sequence
gatagtattttaggagttca

SEQ ID NO: 135375 - DNA, 20 bp, Artificial
  CRISPR gRNA sequence
agtattttaggagttcagag

SEQ ID NO: 135376 - DNA, 20 bp, Artificial
  CRISPR gRNA sequence
cagagtagttgtatttgtga

SEQ ID NO: 135377 - DNA, 20 bp, Artificial
  CRISPR gRNA sequence
agttgtatttgtgaaagttt

SEQ ID NO: 135378 - DNA, 20 bp, Artificial
  CRISPR gRNA sequence
gttgtatttgtgaaagtttt

SEQ ID NO: 135379 - DNA, 20 bp, Artificial
  CRISPR gRNA sequence
ttgtatttgtgaaagttttg

SEQ ID NO: 135380 - DNA, 20 bp, Artificial
  CRISPR gRNA sequence
ttgtgaaagttttggggaat

SEQ ID NO: 135381 - DNA, 20 bp, Artificial
  CRISPR gRNA sequence
ggaattagaatgcttataat

SEQ ID NO: 135382 - DNA, 20 bp, Artificial
  CRISPR gRNA sequence
taataagaaaatgttcattc

SEQ ID NO: 135383 - DNA, 20 bp, Artificial
  CRISPR gRNA sequence
aataagaaaatgttcattct

SEQ ID NO: 135384 - DNA, 20 bp, Artificial
  CRISPR gRNA sequence
aatgttcattctgggaattt

SEQ ID NO: 135385 - DNA, 20 bp, Artificial
  CRISPR gRNA sequence
attctgggaatttaagtcct

SEQ ID NO: 135386 - DNA, 20 bp, Artificial
  CRISPR gRNA sequence
ggaatttaagtcctaagatg

SEQ ID NO: 135387 - DNA, 20 bp, Artificial
  CRISPR gRNA sequence
atttaagtcctaagatgaag

SEQ ID NO: 135388 - DNA, 20 bp, Artificial
  CRISPR gRNA sequence
aagatgaagaagtatgtgtt

SEQ ID NO: 135389 - DNA, 20 bp, Artificial
  CRISPR gRNA sequence
agatgaagaagtatgtgtta

SEQ ID NO: 135390 - DNA, 20 bp, Artificial
  CRISPR gRNA sequence
tgtgttaaggattacatttt

SEQ ID NO: 135391 - DNA, 20 bp, Artificial
  CRISPR gRNA sequence
tgttaaggattacattttaa

SEQ ID NO: 135392 - DNA, 20 bp, Artificial
  CRISPR gRNA sequence
gttaaggattacattttaag

SEQ ID NO: 135393 - DNA, 20 bp, Artificial
  CRISPR gRNA sequence
aaggattacattttaagagg

SEQ ID NO: 135394 - DNA, 20 bp, Artificial
  CRISPR gRNA sequence
attgattatttatatgttat

SEQ ID NO: 135395 - DNA, 20 bp, Artificial
  CRISPR gRNA sequence
ttatatgttatcagttgttc

SEQ ID NO: 135396 - DNA, 20 bp, Artificial
  CRISPR gRNA sequence
tatatatatgattttaaaaa

SEQ ID NO: 135397 - DNA, 20 bp, Artificial
  CRISPR gRNA sequence
tatgattttaaaaacagttg

SEQ ID NO: 135398 - DNA, 20 bp, Artificial
  CRISPR gRNA sequence
atgattttaaaaacagttgt

SEQ ID NO: 135399 - DNA, 20 bp, Artificial
  CRISPR gRNA sequence
aggtgctgacttgaccctgt

SEQ ID NO: 135400 - DNA, 20 bp, Artificial
  CRISPR gRNA sequence
tgacttgaccctgttggccc

SEQ ID NO: 135401 - DNA, 20 bp, Artificial
  CRISPR gRNA sequence
gacttgaccctgttggccct

SEQ ID NO: 135402 - DNA, 20 bp, Artificial
  CRISPR gRNA sequence
cttgaccctgttggccctag

SEQ ID NO: 135403 - DNA, 20 bp, Artificial
  CRISPR gRNA sequence
gaccctgttggccctaggag

SEQ ID NO: 135404 - DNA, 20 bp, Artificial
  CRISPR gRNA sequence
accctgttggccctaggaga

SEQ ID NO: 135405 - DNA, 20 bp, Artificial
  CRISPR gRNA sequence
tggccctaggagaaggcctg

SEQ ID NO: 135406 - DNA, 20 bp, Artificial
  CRISPR gRNA sequence
ccctaggagaaggcctgcag

SEQ ID NO: 135407 - DNA, 20 bp, Artificial
  CRISPR gRNA sequence
cctaggagaaggcctgcagc

SEQ ID NO: 135408 - DNA, 20 bp, Artificial
  CRISPR gRNA sequence
ctaggagaaggcctgcagca

SEQ ID NO: 135409 - DNA, 20 bp, Artificial
  CRISPR gRNA sequence
taggagaaggcctgcagcag

SEQ ID NO: 135410 - DNA, 20 bp, Artificial
  CRISPR gRNA sequence
ggagaaggcctgcagcaggg

SEQ ID NO: 135411 - DNA, 20 bp, Artificial
  CRISPR gRNA sequence
gagaaggcctgcagcagggg

SEQ ID NO: 135412 - DNA, 20 bp, Artificial
  CRISPR gRNA sequence
gcctgcagcaggggaggcaa

SEQ ID NO: 135413 - DNA, 20 bp, Artificial
  CRISPR gRNA sequence
cagcaggggaggcaaaagtg

SEQ ID NO: 135414 - DNA, 20 bp, Artificial
  CRISPR gRNA sequence
agcaggggaggcaaaagtga

SEQ ID NO: 135415 - DNA, 20 bp, Artificial
  CRISPR gRNA sequence
gggaggcaaaagtgaaggtg

SEQ ID NO: 135416 - DNA, 20 bp, Artificial
  CRISPR gRNA sequence
gcaaaagtgaaggtgtggta

SEQ ID NO: 135417 - DNA, 20 bp, Artificial
  CRISPR gRNA sequence
tgaaggtgtggtacagtatg

SEQ ID NO: 135418 - DNA, 20 bp, Artificial
  CRISPR gRNA sequence
atgaagtaaactataaactt

SEQ ID NO: 135419 - DNA, 20 bp, Artificial
  CRISPR gRNA sequence
ctataaacttgagaactttg

SEQ ID NO: 135420 - DNA, 20 bp, Artificial
  CRISPR gRNA sequence
acttgagaactttgtggatt

SEQ ID NO: 135421 - DNA, 20 bp, Artificial
  CRISPR gRNA sequence
actttgtggatttggcttct

SEQ ID NO: 135422 - DNA, 20 bp, Artificial
  CRISPR gRNA sequence
tgtggatttggcttcttgga

SEQ ID NO: 135423 - DNA, 20 bp, Artificial
  CRISPR gRNA sequence
tggcttcttggaaagatgcc

SEQ ID NO: 135424 - DNA, 20 bp, Artificial
  CRISPR gRNA sequence
agatgcccagtcactgcctc

SEQ ID NO: 135425 - DNA, 20 bp, Artificial
  CRISPR gRNA sequence
cccagtcactgcctctagcc

SEQ ID NO: 135426 - DNA, 20 bp, Artificial
  CRISPR gRNA sequence
ccagtcactgcctctagccg

SEQ ID NO: 135427 - DNA, 20 bp, Artificial
  CRISPR gRNA sequence
ggttcttcaccattctcttt

SEQ ID NO: 135428 - DNA, 20 bp, Artificial
  CRISPR gRNA sequence
tttgagaatgacccactacc

SEQ ID NO: 135429 - DNA, 20 bp, Artificial
  CRISPR gRNA sequence
actacctggaaaaatgcaca

SEQ ID NO: 135430 - DNA, 20 bp, Artificial
  CRISPR gRNA sequence
ctacctggaaaaatgcacat

SEQ ID NO: 135431 - DNA, 20 bp, Artificial
  CRISPR gRNA sequence
gtacaaaacctttgatgact

SEQ ID NO: 135432 - DNA, 20 bp, Artificial
  CRISPR gRNA sequence
ttgatgactaagttattttt

SEQ ID NO: 135433 - DNA, 20 bp, Artificial
  CRISPR gRNA sequence
attttttagtgtatgtcaaa

SEQ ID NO: 135434 - DNA, 20 bp, Artificial
  CRISPR gRNA sequence
tcaaatggtatttaacactt

SEQ ID NO: 135435 - DNA, 20 bp, Artificial
  CRISPR gRNA sequence
atggtatttaacacttcagc

SEQ ID NO: 135436 - DNA, 20 bp, Artificial
  CRISPR gRNA sequence
tcagccagataaatgtttac

SEQ ID NO: 135437 - DNA, 20 bp, Artificial
  CRISPR gRNA sequence
aaatgtttactagacaaatg

SEQ ID NO: 135438 - DNA, 20 bp, Artificial
  CRISPR gRNA sequence
aatgaagaaaactttgcttc

SEQ ID NO: 135439 - DNA, 20 bp, Artificial
  CRISPR gRNA sequence
aagaaaactttgcttccaga

SEQ ID NO: 135440 - DNA, 20 bp, Artificial
  CRISPR gRNA sequence
gaaaactttgcttccagaaa

SEQ ID NO: 135441 - DNA, 20 bp, Artificial
  CRISPR gRNA sequence
ctttgcttccagaaagagca

SEQ ID NO: 135442 - DNA, 20 bp, Artificial
  CRISPR gRNA sequence
cagaaagagcaaagaccttc

SEQ ID NO: 135443 - DNA, 20 bp, Artificial
  CRISPR gRNA sequence
gaaagagcaaagaccttcta

SEQ ID NO: 135444 - DNA, 20 bp, Artificial
  CRISPR gRNA sequence
aagagcaaagaccttctaga

SEQ ID NO: 135445 - DNA, 20 bp, Artificial
  CRISPR gRNA sequence
ctagagagctaactctaatt

SEQ ID NO: 135446 - DNA, 20 bp, Artificial
  CRISPR gRNA sequence
tagagagctaactctaattt

SEQ ID NO: 135447 - DNA, 20 bp, Artificial
  CRISPR gRNA sequence
gctaactctaatttaggcca

SEQ ID NO: 135448 - DNA, 20 bp, Artificial
  CRISPR gRNA sequence
ctaactctaatttaggccat

SEQ ID NO: 135449 - DNA, 20 bp, Artificial
  CRISPR gRNA sequence
actctaatttaggccatggg

SEQ ID NO: 135450 - DNA, 20 bp, Artificial
  CRISPR gRNA sequence
ccatgggtggctgtgtgtgt

SEQ ID NO: 135451 - DNA, 20 bp, Artificial
  CRISPR gRNA sequence
tgggtggctgtgtgtgtaag

SEQ ID NO: 135452 - DNA, 20 bp, Artificial
  CRISPR gRNA sequence
gggtggctgtgtgtgtaagt

SEQ ID NO: 135453 - DNA, 20 bp, Artificial
  CRISPR gRNA sequence
ggtggctgtgtgtgtaagtg

SEQ ID NO: 135454 - DNA, 20 bp, Artificial
  CRISPR gRNA sequence
gtggctgtgtgtgtaagtgg

SEQ ID NO: 135455 - DNA, 20 bp, Artificial
  CRISPR gRNA sequence
ggctgtgtgtgtaagtgggg

SEQ ID NO: 135456 - DNA, 20 bp, Artificial
  CRISPR gRNA sequence
gctgtgtgtgtaagtggggg

SEQ ID NO: 135457 - DNA, 20 bp, Artificial
  CRISPR gRNA sequence
gtgtgtaagtgggggaggct

SEQ ID NO: 135458 - DNA, 20 bp, Artificial
  CRISPR gRNA sequence
gtaagtgggggaggcttaga

SEQ ID NO: 135459 - DNA, 20 bp, Artificial
  CRISPR gRNA sequence
taagtgggggaggcttagat

SEQ ID NO: 135460 - DNA, 20 bp, Artificial
  CRISPR gRNA sequence
aagtgggggaggcttagatg

SEQ ID NO: 135461 - DNA, 20 bp, Artificial
  CRISPR gRNA sequence
ggggaggcttagatggggtc

SEQ ID NO: 135462 - DNA, 20 bp, Artificial
  CRISPR gRNA sequence
ggaggcttagatggggtcta

SEQ ID NO: 135463 - DNA, 20 bp, Artificial
  CRISPR gRNA sequence
ttagatggggtctagagata

SEQ ID NO: 135464 - DNA, 20 bp, Artificial
  CRISPR gRNA sequence
acatttatttactctgatca

SEQ ID NO: 135465 - DNA, 20 bp, Artificial
  CRISPR gRNA sequence
ttactctgatcacagtattt

SEQ ID NO: 135466 - DNA, 20 bp, Artificial
  CRISPR gRNA sequence
tactctgatcacagtatttg

SEQ ID NO: 135467 - DNA, 20 bp, Artificial
  CRISPR gRNA sequence
tctgatcacagtatttgagg

SEQ ID NO: 135468 - DNA, 20 bp, Artificial
  CRISPR gRNA sequence
tcacagtatttgaggcagca

SEQ ID NO: 135469 - DNA, 20 bp, Artificial
  CRISPR gRNA sequence
gtatttgaggcagcatggta

SEQ ID NO: 135470 - DNA, 20 bp, Artificial
  CRISPR gRNA sequence
agcatggtacagaccattta

SEQ ID NO: 135471 - DNA, 20 bp, Artificial
  CRISPR gRNA sequence
ggtacagaccatttaaagtc

SEQ ID NO: 135472 - DNA, 20 bp, Artificial
  CRISPR gRNA sequence
tacagaccatttaaagtcaa

SEQ ID NO: 135473 - DNA, 20 bp, Artificial
  CRISPR gRNA sequence
aagtcaagagatctgtgttc

SEQ ID NO: 135474 - DNA, 20 bp, Artificial
  CRISPR gRNA sequence
gccccactcacctttatcac

SEQ ID NO: 135475 - DNA, 20 bp, Artificial
  CRISPR gRNA sequence
cacctttatcaccagctttg

SEQ ID NO: 135476 - DNA, 20 bp, Artificial
  CRISPR gRNA sequence
acctttatcaccagctttgt

SEQ ID NO: 135477 - DNA, 20 bp, Artificial
  CRISPR gRNA sequence
tatcaccagctttgtaggtt

SEQ ID NO: 135478 - DNA, 20 bp, Artificial
  CRISPR gRNA sequence
atcaccagctttgtaggttt

SEQ ID NO: 135479 - DNA, 20 bp, Artificial
  CRISPR gRNA sequence
ccagctttgtaggtttgggc

SEQ ID NO: 135480 - DNA, 20 bp, Artificial
  CRISPR gRNA sequence
ctttgtaggtttgggcaagt

SEQ ID NO: 135481 - DNA, 20 bp, Artificial
  CRISPR gRNA sequence
gtttgggcaagtcagctatt

SEQ ID NO: 135482 - DNA, 20 bp, Artificial
  CRISPR gRNA sequence
gcaagtcagctatttagtgt

SEQ ID NO: 135483 - DNA, 20 bp, Artificial
  CRISPR gRNA sequence
agcttcctcacatgtaaaaa

SEQ ID NO: 135484 - DNA, 20 bp, Artificial
  CRISPR gRNA sequence
gtaaaaatggaacctaaaaa

SEQ ID NO: 135485 - DNA, 20 bp, Artificial
  CRISPR gRNA sequence
cctaaaaatagtgtctgatt

SEQ ID NO: 135486 - DNA, 20 bp, Artificial
  CRISPR gRNA sequence
aaaaatagtgtctgatttag

SEQ ID NO: 135487 - DNA, 20 bp, Artificial
  CRISPR gRNA sequence
atagtgtctgatttagtggc

SEQ ID NO: 135488 - DNA, 20 bp, Artificial
  CRISPR gRNA sequence
tttagtggcgagtcttgaat

SEQ ID NO: 135489 - DNA, 20 bp, Artificial
  CRISPR gRNA sequence
gaatgagatcatgtgtgtca

SEQ ID NO: 135490 - DNA, 20 bp, Artificial
  CRISPR gRNA sequence
aaagtactttgcaaattgtg

SEQ ID NO: 135491 - DNA, 20 bp, Artificial
  CRISPR gRNA sequence
agtactttgcaaattgtgaa

SEQ ID NO: 135492 - DNA, 20 bp, Artificial
  CRISPR gRNA sequence
tgtgaagagctacataatat

SEQ ID NO: 135493 - DNA, 20 bp, Artificial
  CRISPR gRNA sequence
aatattagttgttactaatc

SEQ ID NO: 135494 - DNA, 20 bp, Artificial
  CRISPR gRNA sequence
tgttactaatccagactatt

SEQ ID NO: 135495 - DNA, 20 bp, Artificial
  CRISPR gRNA sequence
gttactaatccagactattt

SEQ ID NO: 135496 - DNA, 20 bp, Artificial
  CRISPR gRNA sequence
ttactaatccagactatttg

SEQ ID NO: 135497 - DNA, 20 bp, Artificial
  CRISPR gRNA sequence
tactaatccagactatttgg

SEQ ID NO: 135498 - DNA, 20 bp, Artificial
  CRISPR gRNA sequence
tgggggatgaaacgtttatg

SEQ ID NO: 135499 - DNA, 20 bp, Artificial
  CRISPR gRNA sequence
ggatgaaacgtttatgaaga

SEQ ID NO: 135500 - DNA, 20 bp, Artificial
  CRISPR gRNA sequence
gatgaaacgtttatgaagat

SEQ ID NO: 135501 - DNA, 20 bp, Artificial
  CRISPR gRNA sequence
aacgtttatgaagataggtg

SEQ ID NO: 135502 - DNA, 20 bp, Artificial
  CRISPR gRNA sequence
tgaagataggtgtggcatca

SEQ ID NO: 135503 - DNA, 20 bp, Artificial
  CRISPR gRNA sequence
ggcatcaaagaaaaaaatgc

SEQ ID NO: 135504 - DNA, 20 bp, Artificial
  CRISPR gRNA sequence
agtattttaatatttgtaaa

SEQ ID NO: 135505 - DNA, 20 bp, Artificial
  CRISPR gRNA sequence
gtattttaatatttgtaaaa

SEQ ID NO: 135506 - DNA, 20 bp, Artificial
  CRISPR gRNA sequence
attttaatatttgtaaaaag

SEQ ID NO: 135507 - DNA, 20 bp, Artificial
  CRISPR gRNA sequence
taatatttgtaaaaaggagt

SEQ ID NO: 135508 - DNA, 20 bp, Artificial
  CRISPR gRNA sequence
atttatttaatgcatatgtt

SEQ ID NO: 135509 - DNA, 20 bp, Artificial
  CRISPR gRNA sequence
aatgcatatgttgagaccac

SEQ ID NO: 135510 - DNA, 20 bp, Artificial
  CRISPR gRNA sequence
ccaccagtcctttactcatc

SEQ ID NO: 135511 - DNA, 20 bp, Artificial
  CRISPR gRNA sequence
actcatcaagatccttgtga

SEQ ID NO: 135512 - DNA, 20 bp, Artificial
  CRISPR gRNA sequence
taacccctttgtcaaaattt

SEQ ID NO: 135513 - DNA, 20 bp, Artificial
  CRISPR gRNA sequence
aacccctttgtcaaaattta

SEQ ID NO: 135514 - DNA, 20 bp, Artificial
  CRISPR gRNA sequence
gtcaaaatttaaggacctct

SEQ ID NO: 135515 - DNA, 20 bp, Artificial
  CRISPR gRNA sequence
aatttaaggacctctcagaa

SEQ ID NO: 135516 - DNA, 20 bp, Artificial
  CRISPR gRNA sequence
atttaaggacctctcagaat

SEQ ID NO: 135517 - DNA, 20 bp, Artificial
  CRISPR gRNA sequence
cctctcagaataggatgaaa

SEQ ID NO: 135518 - DNA, 20 bp, Artificial
  CRISPR gRNA sequence
ctctcagaataggatgaaat

SEQ ID NO: 135519 - DNA, 20 bp, Artificial
  CRISPR gRNA sequence
gatttttaaaaaactcttgt

SEQ ID NO: 135520 - DNA, 20 bp, Artificial
  CRISPR gRNA sequence
taaaaaactcttgttagatt

SEQ ID NO: 135521 - DNA, 20 bp, Artificial
  CRISPR gRNA sequence
aaaaaactcttgttagattt

SEQ ID NO: 135522 - DNA, 20 bp, Artificial
  CRISPR gRNA sequence
tgttagatttaggaacctct

SEQ ID NO: 135523 - DNA, 20 bp, Artificial
  CRISPR gRNA sequence
gaacctctcagaataaaatc

SEQ ID NO: 135524 - DNA, 20 bp, Artificial
  CRISPR gRNA sequence
cctctcagaataaaatctgg

SEQ ID NO: 135525 - DNA, 20 bp, Artificial
  CRISPR gRNA sequence
gcctgttccatttgcattat

SEQ ID NO: 135526 - DNA, 20 bp, Artificial
  CRISPR gRNA sequence
atgagatttgcattacaatg

SEQ ID NO: 135527 - DNA, 20 bp, Artificial
  CRISPR gRNA sequence
tgagatttgcattacaatgc

SEQ ID NO: 135528 - DNA, 20 bp, Artificial
  CRISPR gRNA sequence
atttgcattacaatgcaggt

SEQ ID NO: 135529 - DNA, 20 bp, Artificial
  CRISPR gRNA sequence
acaatgcaggtaagttgtaa

SEQ ID NO: 135530 - DNA, 20 bp, Artificial
  CRISPR gRNA sequence
caggtaagttgtaatggttg

SEQ ID NO: 135531 - DNA, 20 bp, Artificial
  CRISPR gRNA sequence
aatggttgcagatgtttacc

SEQ ID NO: 135532 - DNA, 20 bp, Artificial
  CRISPR gRNA sequence
ggttgcagatgtttaccaag

SEQ ID NO: 135533 - DNA, 20 bp, Artificial
  CRISPR gRNA sequence
ttgcagatgtttaccaagca

SEQ ID NO: 135534 - DNA, 20 bp, Artificial
  CRISPR gRNA sequence
tgcagatgtttaccaagcag

SEQ ID NO: 135535 - DNA, 20 bp, Artificial
  CRISPR gRNA sequence
ccaagcagaggttacatatt

SEQ ID NO: 135536 - DNA, 20 bp, Artificial
  CRISPR gRNA sequence
ttgtataccaaatatttata

SEQ ID NO: 135537 - DNA, 20 bp, Artificial
  CRISPR gRNA sequence
caaatatttataaagtaaac

SEQ ID NO: 135538 - DNA, 20 bp, Artificial
  CRISPR gRNA sequence
tgattatcctgtcaattttc

SEQ ID NO: 135539 - DNA, 20 bp, Artificial
  CRISPR gRNA sequence
atcctgtcaattttcaagca

SEQ ID NO: 135540 - DNA, 20 bp, Artificial
  CRISPR gRNA sequence
tcctgtcaattttcaagcat

SEQ ID NO: 135541 - DNA, 20 bp, Artificial
  CRISPR gRNA sequence
ctgtcaattttcaagcatgg

SEQ ID NO: 135542 - DNA, 20 bp, Artificial
  CRISPR gRNA sequence
tgtcaattttcaagcatggg

SEQ ID NO: 135543 - DNA, 20 bp, Artificial
  CRISPR gRNA sequence
tcaagcatgggaggtaatta

SEQ ID NO: 135544 - DNA, 20 bp, Artificial
  CRISPR gRNA sequence
ggtaattatagcctgctgta

SEQ ID NO: 135545 - DNA, 20 bp, Artificial
  CRISPR gRNA sequence
attatagcctgctgtatagt

SEQ ID NO: 135546 - DNA, 20 bp, Artificial
  CRISPR gRNA sequence
tagcctgctgtatagtaagc

SEQ ID NO: 135547 - DNA, 20 bp, Artificial
  CRISPR gRNA sequence
tatagtaagcaagtaaatgt

SEQ ID NO: 135548 - DNA, 20 bp, Artificial
  CRISPR gRNA sequence
atagtaagcaagtaaatgtt

SEQ ID NO: 135549 - DNA, 20 bp, Artificial
  CRISPR gRNA sequence
tttttttttttttttttttg

SEQ ID NO: 135550 - DNA, 20 bp, Artificial
  CRISPR gRNA sequence
ttttttttttttttgcagac

SEQ ID NO: 135551 - DNA, 20 bp, Artificial
  CRISPR gRNA sequence
tttttttttttttgcagacg

SEQ ID NO: 135552 - DNA, 20 bp, Artificial
  CRISPR gRNA sequence
cgaggtctcgctctgttgcc

SEQ ID NO: 135553 - DNA, 20 bp, Artificial
  CRISPR gRNA sequence
gaggtctcgctctgttgcca

SEQ ID NO: 135554 - DNA, 20 bp, Artificial
  CRISPR gRNA sequence
tctcgctctgttgccaaggc

SEQ ID NO: 135555 - DNA, 20 bp, Artificial
  CRISPR gRNA sequence
tgttgccaaggctggtgtgc

SEQ ID NO: 135556 - DNA, 20 bp, Artificial
  CRISPR gRNA sequence
gttgccaaggctggtgtgcc

SEQ ID NO: 135557 - DNA, 20 bp, Artificial
  CRISPR gRNA sequence
ccaaggctggtgtgccaggc

SEQ ID NO: 135558 - DNA, 20 bp, Artificial
  CRISPR gRNA sequence
aaggctggtgtgccaggctg

SEQ ID NO: 135559 - DNA, 20 bp, Artificial
  CRISPR gRNA sequence
tgtgccaggctggagtgccg

SEQ ID NO: 135560 - DNA, 20 bp, Artificial
  CRISPR gRNA sequence
ggcatgatcatgactcactg

SEQ ID NO: 135561 - DNA, 20 bp, Artificial
  CRISPR gRNA sequence
tcactgcagcctccacctcc

SEQ ID NO: 135562 - DNA, 20 bp, Artificial
  CRISPR gRNA sequence
cactgcagcctccacctcct

SEQ ID NO: 135563 - DNA, 20 bp, Artificial
  CRISPR gRNA sequence
agcctccacctcctgggctc

SEQ ID NO: 135564 - DNA, 20 bp, Artificial
  CRISPR gRNA sequence
ctcaagcaatcctcctactt

SEQ ID NO: 135565 - DNA, 20 bp, Artificial
  CRISPR gRNA sequence
tcctcctacttcagcctcct

SEQ ID NO: 135566 - DNA, 20 bp, Artificial
  CRISPR gRNA sequence
tcctacttcagcctcctgag

SEQ ID NO: 135567 - DNA, 20 bp, Artificial
  CRISPR gRNA sequence
acttcagcctcctgagtagc

SEQ ID NO: 135568 - DNA, 20 bp, Artificial
  CRISPR gRNA sequence
cttcagcctcctgagtagct

SEQ ID NO: 135569 - DNA, 20 bp, Artificial
  CRISPR gRNA sequence
ctcctgagtagctgggacta

SEQ ID NO: 135570 - DNA, 20 bp, Artificial
  CRISPR gRNA sequence
tcctgagtagctgggactac

SEQ ID NO: 135571 - DNA, 20 bp, Artificial
  CRISPR gRNA sequence
tttatttttatttttaaata

SEQ ID NO: 135572 - DNA, 20 bp, Artificial
  CRISPR gRNA sequence
tttttatttttaaatacaga

SEQ ID NO: 135573 - DNA, 20 bp, Artificial
  CRISPR gRNA sequence
ttttatttttaaatacagac

SEQ ID NO: 135574 - DNA, 20 bp, Artificial
  CRISPR gRNA sequence
tttatttttaaatacagacg

SEQ ID NO: 135575 - DNA, 20 bp, Artificial
  CRISPR gRNA sequence
cggggtcttgatttgttgcc

SEQ ID NO: 135576 - DNA, 20 bp, Artificial
  CRISPR gRNA sequence
ggggtcttgatttgttgccc

SEQ ID NO: 135577 - DNA, 20 bp, Artificial
  CRISPR gRNA sequence
ccaggctgatctcaaactcc

SEQ ID NO: 135578 - DNA, 20 bp, Artificial
  CRISPR gRNA sequence
gatctcaaactcctggactc

SEQ ID NO: 135579 - DNA, 20 bp, Artificial
  CRISPR gRNA sequence
ctcaagtgatcctcctgcct

SEQ ID NO: 135580 - DNA, 20 bp, Artificial
  CRISPR gRNA sequence
cctcctgccttggcctccca

SEQ ID NO: 135581 - DNA, 20 bp, Artificial
  CRISPR gRNA sequence
gccttggcctcccaaagtgc

SEQ ID NO: 135582 - DNA, 20 bp, Artificial
  CRISPR gRNA sequence
ccttggcctcccaaagtgct

SEQ ID NO: 135583 - DNA, 20 bp, Artificial
  CRISPR gRNA sequence
tcccaaagtgctgggattac

SEQ ID NO: 135584 - DNA, 20 bp, Artificial
  CRISPR gRNA sequence
agtgctgggattacaagcac

SEQ ID NO: 135585 - DNA, 20 bp, Artificial
  CRISPR gRNA sequence
gtgctgggattacaagcact

SEQ ID NO: 135586 - DNA, 20 bp, Artificial
  CRISPR gRNA sequence
gattacaagcactgggatta

SEQ ID NO: 135587 - DNA, 20 bp, Artificial
  CRISPR gRNA sequence
attacaagcactgggattac

SEQ ID NO: 135588 - DNA, 20 bp, Artificial
  CRISPR gRNA sequence
agcactgggattacaggcat

SEQ ID NO: 135589 - DNA, 20 bp, Artificial
  CRISPR gRNA sequence
tgagccattgtgcccaattg

SEQ ID NO: 135590 - DNA, 20 bp, Artificial
  CRISPR gRNA sequence
gagccattgtgcccaattgt

SEQ ID NO: 135591 - DNA, 20 bp, Artificial
  CRISPR gRNA sequence
aaaaataattgatctctcat

SEQ ID NO: 135592 - DNA, 20 bp, Artificial
  CRISPR gRNA sequence
aatctaacataaatttcaca

SEQ ID NO: 135593 - DNA, 20 bp, Artificial
  CRISPR gRNA sequence
acacagttgatacctactat

SEQ ID NO: 135594 - DNA, 20 bp, Artificial
  CRISPR gRNA sequence
agatacctttctaacataat

SEQ ID NO: 135595 - DNA, 20 bp, Artificial
  CRISPR gRNA sequence
tacctttctaacataattgg

SEQ ID NO: 135596 - DNA, 20 bp, Artificial
  CRISPR gRNA sequence
acataattggtggaaactca

SEQ ID NO: 135597 - DNA, 20 bp, Artificial
  CRISPR gRNA sequence
cataattggtggaaactcat

SEQ ID NO: 135598 - DNA, 20 bp, Artificial
  CRISPR gRNA sequence
ataattggtggaaactcatg

SEQ ID NO: 135599 - DNA, 20 bp, Artificial
  CRISPR gRNA sequence
taattggtggaaactcatgg

SEQ ID NO: 135600 - DNA, 20 bp, Artificial
  CRISPR gRNA sequence
catgggggtttcttttaatc

SEQ ID NO: 135601 - DNA, 20 bp, Artificial
  CRISPR gRNA sequence
tttaatctagtctgcatgcc

SEQ ID NO: 135602 - DNA, 20 bp, Artificial
  CRISPR gRNA sequence
tgcccagtgtcatctatttt

SEQ ID NO: 135603 - DNA, 20 bp, Artificial
  CRISPR gRNA sequence
gcccagtgtcatctattttt

SEQ ID NO: 135604 - DNA, 20 bp, Artificial
  CRISPR gRNA sequence
ggacttccttttttcccccc

SEQ ID NO: 135605 - DNA, 20 bp, Artificial
  CRISPR gRNA sequence
gacttccttttttccccccc

SEQ ID NO: 135606 - DNA, 20 bp, Artificial
  CRISPR gRNA sequence
acttccttttttccccccca

SEQ ID NO: 135607 - DNA, 20 bp, Artificial
  CRISPR gRNA sequence
cttccttttttcccccccag

SEQ ID NO: 135608 - DNA, 20 bp, Artificial
  CRISPR gRNA sequence
ccttttttcccccccagggg

SEQ ID NO: 135609 - DNA, 20 bp, Artificial
  CRISPR gRNA sequence
cttttttcccccccaggggt

SEQ ID NO: 135610 - DNA, 20 bp, Artificial
  CRISPR gRNA sequence
ttttttcccccccaggggtg

SEQ ID NO: 135611 - DNA, 20 bp, Artificial
  CRISPR gRNA sequence
gtttgatttcctgtcctatt

SEQ ID NO: 135612 - DNA, 20 bp, Artificial
  CRISPR gRNA sequence
cctattaagtcacttcctct

SEQ ID NO: 135613 - DNA, 20 bp, Artificial
  CRISPR gRNA sequence
ctattaagtcacttcctctc

SEQ ID NO: 135614 - DNA, 20 bp, Artificial
  CRISPR gRNA sequence
aagtcacttcctctcaggca

SEQ ID NO: 135615 - DNA, 20 bp, Artificial
  CRISPR gRNA sequence
cacttcctctcaggcatggt

SEQ ID NO: 135616 - DNA, 20 bp, Artificial
  CRISPR gRNA sequence
tcctctcaggcatggtcagt

SEQ ID NO: 135617 - DNA, 20 bp, Artificial
  CRISPR gRNA sequence
caggcatggtcagtcagcat

SEQ ID NO: 135618 - DNA, 20 bp, Artificial
  CRISPR gRNA sequence
tctgcttcctatctgtgcat

SEQ ID NO: 135619 - DNA, 20 bp, Artificial
  CRISPR gRNA sequence
gcttcctatctgtgcattgg

SEQ ID NO: 135620 - DNA, 20 bp, Artificial
  CRISPR gRNA sequence
tgcattggaagaatcatatt

SEQ ID NO: 135621 - DNA, 20 bp, Artificial
  CRISPR gRNA sequence
ttggaagaatcatattcaga

SEQ ID NO: 135622 - DNA, 20 bp, Artificial
  CRISPR gRNA sequence
gaatcatattcagacagaat

SEQ ID NO: 135623 - DNA, 20 bp, Artificial
  CRISPR gRNA sequence
aatcatattcagacagaatg

SEQ ID NO: 135624 - DNA, 20 bp, Artificial
  CRISPR gRNA sequence
tattcagacagaatgaggtt

SEQ ID NO: 135625 - DNA, 20 bp, Artificial
  CRISPR gRNA sequence
gactttaccaaataaaattc

SEQ ID NO: 135626 - DNA, 20 bp, Artificial
  CRISPR gRNA sequence
accaaataaaattccagttc

SEQ ID NO: 135627 - DNA, 20 bp, Artificial
  CRISPR gRNA sequence
ccaaataaaattccagttcc

SEQ ID NO: 135628 - DNA, 20 bp, Artificial
  CRISPR gRNA sequence
caaataaaattccagttcca

SEQ ID NO: 135629 - DNA, 20 bp, Artificial
  CRISPR gRNA sequence
attccagttccagggatgtg

SEQ ID NO: 135630 - DNA, 20 bp, Artificial
  CRISPR gRNA sequence
ttccagttccagggatgtgt

SEQ ID NO: 135631 - DNA, 20 bp, Artificial
  CRISPR gRNA sequence
gggatgtgtaggtttaaaaa

SEQ ID NO: 135632 - DNA, 20 bp, Artificial
  CRISPR gRNA sequence
aggtttaaaaacagcaatcg

SEQ ID NO: 135633 - DNA, 20 bp, Artificial
  CRISPR gRNA sequence
aacagcaatcgtggtcactt

SEQ ID NO: 135634 - DNA, 20 bp, Artificial
  CRISPR gRNA sequence
acagcaatcgtggtcacttt

SEQ ID NO: 135635 - DNA, 20 bp, Artificial
  CRISPR gRNA sequence
tgggcttttgtttttaaaac

SEQ ID NO: 135636 - DNA, 20 bp, Artificial
  CRISPR gRNA sequence
ttttgtttttaaaacaagat

SEQ ID NO: 135637 - DNA, 20 bp, Artificial
  CRISPR gRNA sequence
tttgtttttaaaacaagatg

SEQ ID NO: 135638 - DNA, 20 bp, Artificial
  CRISPR gRNA sequence
aagatgaggtctccctttta

SEQ ID NO: 135639 - DNA, 20 bp, Artificial
  CRISPR gRNA sequence
gatgaggtctcccttttaaa

SEQ ID NO: 135640 - DNA, 20 bp, Artificial
  CRISPR gRNA sequence
atgaggtctcccttttaaag

SEQ ID NO: 135641 - DNA, 20 bp, Artificial
  CRISPR gRNA sequence
aaagaggctaaatacttttg

SEQ ID NO: 135642 - DNA, 20 bp, Artificial
  CRISPR gRNA sequence
aagaggctaaatacttttgt

SEQ ID NO: 135643 - DNA, 20 bp, Artificial
  CRISPR gRNA sequence
gaggctaaatacttttgtag

SEQ ID NO: 135644 - DNA, 20 bp, Artificial
  CRISPR gRNA sequence
aaatacttttgtaggagctt

SEQ ID NO: 135645 - DNA, 20 bp, Artificial
  CRISPR gRNA sequence
taacccaaaaaatgtattaa

SEQ ID NO: 135646 - DNA, 20 bp, Artificial
  CRISPR gRNA sequence
aatgtattaaaagttgaaca

SEQ ID NO: 135647 - DNA, 20 bp, Artificial
  CRISPR gRNA sequence
aacatggctgtcttcatgaa

SEQ ID NO: 135648 - DNA, 20 bp, Artificial
  CRISPR gRNA sequence
ttactgataatatatgcata

SEQ ID NO: 135649 - DNA, 20 bp, Artificial
  CRISPR gRNA sequence
actgataatatatgcataca

SEQ ID NO: 135650 - DNA, 20 bp, Artificial
  CRISPR gRNA sequence
gagtttgaatacatctaaat

SEQ ID NO: 135651 - DNA, 20 bp, Artificial
  CRISPR gRNA sequence
agtttgaatacatctaaatt

SEQ ID NO: 135652 - DNA, 20 bp, Artificial
  CRISPR gRNA sequence
atacatctaaattaggctga

SEQ ID NO: 135653 - DNA, 20 bp, Artificial
  CRISPR gRNA sequence
tacatctaaattaggctgat

SEQ ID NO: 135654 - DNA, 20 bp, Artificial
  CRISPR gRNA sequence
ttaggctgatgggaatcact

SEQ ID NO: 135655 - DNA, 20 bp, Artificial
  CRISPR gRNA sequence
taggctgatgggaatcactt

SEQ ID NO: 135656 - DNA, 20 bp, Artificial
  CRISPR gRNA sequence
aggctgatgggaatcactta

SEQ ID NO: 135657 - DNA, 20 bp, Artificial
  CRISPR gRNA sequence
atgggaatcacttagggatc

SEQ ID NO: 135658 - DNA, 20 bp, Artificial
  CRISPR gRNA sequence
aatcacttagggatctagtc

SEQ ID NO: 135659 - DNA, 20 bp, Artificial
  CRISPR gRNA sequence
agtctagttcccttcttgta

SEQ ID NO: 135660 - DNA, 20 bp, Artificial
  CRISPR gRNA sequence
ctagttcccttcttgtaaag

SEQ ID NO: 135661 - DNA, 20 bp, Artificial
  CRISPR gRNA sequence
tagttcccttcttgtaaagt

SEQ ID NO: 135662 - DNA, 20 bp, Artificial
  CRISPR gRNA sequence
agttcccttcttgtaaagtg

SEQ ID NO: 135663 - DNA, 20 bp, Artificial
  CRISPR gRNA sequence
tcttgtaaagtggggaaatt

SEQ ID NO: 135664 - DNA, 20 bp, Artificial
  CRISPR gRNA sequence
cttgtaaagtggggaaattg

SEQ ID NO: 135665 - DNA, 20 bp, Artificial
  CRISPR gRNA sequence
aaagtggggaaattgaggcc

SEQ ID NO: 135666 - DNA, 20 bp, Artificial
  CRISPR gRNA sequence
tggggaaattgaggcccagt

SEQ ID NO: 135667 - DNA, 20 bp, Artificial
  CRISPR gRNA sequence
aaattgaggcccagtaagtt

SEQ ID NO: 135668 - DNA, 20 bp, Artificial
  CRISPR gRNA sequence
aattgaggcccagtaagttc

SEQ ID NO: 135669 - DNA, 20 bp, Artificial
  CRISPR gRNA sequence
aagttcaggtgccctaatcc

SEQ ID NO: 135670 - DNA, 20 bp, Artificial
  CRISPR gRNA sequence
gtgccctaatccaagtcttt

SEQ ID NO: 135671 - DNA, 20 bp, Artificial
  CRISPR gRNA sequence
atccaagtctttcagctttt

SEQ ID NO: 135672 - DNA, 20 bp, Artificial
  CRISPR gRNA sequence
tccaagtctttcagcttttt

SEQ ID NO: 135673 - DNA, 20 bp, Artificial
  CRISPR gRNA sequence
gtctttcagctttttaggaa

SEQ ID NO: 135674 - DNA, 20 bp, Artificial
  CRISPR gRNA sequence
tctttcagctttttaggaac

SEQ ID NO: 135675 - DNA, 20 bp, Artificial
  CRISPR gRNA sequence
ttttaggaacaggcttgtac

SEQ ID NO: 135676 - DNA, 20 bp, Artificial
  CRISPR gRNA sequence
ggaacaggcttgtacaagtt

SEQ ID NO: 135677 - DNA, 20 bp, Artificial
  CRISPR gRNA sequence
aacaggcttgtacaagtttg

SEQ ID NO: 135678 - DNA, 20 bp, Artificial
  CRISPR gRNA sequence
gcatgtttcttttattcctc

SEQ ID NO: 135679 - DNA, 20 bp, Artificial
  CRISPR gRNA sequence
catgtttcttttattcctct

SEQ ID NO: 135680 - DNA, 20 bp, Artificial
  CRISPR gRNA sequence
tttcatgtttcttttctttt

SEQ ID NO: 135681 - DNA, 20 bp, Artificial
  CRISPR gRNA sequence
ttcatgtttcttttcttttt

SEQ ID NO: 135682 - DNA, 20 bp, Artificial
  CRISPR gRNA sequence
ttctttttgggacttctgta

SEQ ID NO: 135683 - DNA, 20 bp, Artificial
  CRISPR gRNA sequence
tctttttgggacttctgtat

SEQ ID NO: 135684 - DNA, 20 bp, Artificial
  CRISPR gRNA sequence
ttctgtataggcttgctgtt

SEQ ID NO: 135685 - DNA, 20 bp, Artificial
  CRISPR gRNA sequence
tctgtataggcttgctgttt

SEQ ID NO: 135686 - DNA, 20 bp, Artificial
  CRISPR gRNA sequence
ataggcttgctgtttgggta

SEQ ID NO: 135687 - DNA, 20 bp, Artificial
  CRISPR gRNA sequence
ggcttgctgtttgggtatag

SEQ ID NO: 135688 - DNA, 20 bp, Artificial
  CRISPR gRNA sequence
gcttgctgtttgggtataga

SEQ ID NO: 135689 - DNA, 20 bp, Artificial
  CRISPR gRNA sequence
ctgtttgggtatagaaggaa

SEQ ID NO: 135690 - DNA, 20 bp, Artificial
  CRISPR gRNA sequence
gtttgggtatagaaggaaca

SEQ ID NO: 135691 - DNA, 20 bp, Artificial
  CRISPR gRNA sequence
ggaacagagaaaatgtgcca

SEQ ID NO: 135692 - DNA, 20 bp, Artificial
  CRISPR gRNA sequence
acagagaaaatgtgccatgg

SEQ ID NO: 135693 - DNA, 20 bp, Artificial
  CRISPR gRNA sequence
agagaaaatgtgccatggaa

SEQ ID NO: 135694 - DNA, 20 bp, Artificial
  CRISPR gRNA sequence
gagaaaatgtgccatggaag

SEQ ID NO: 135695 - DNA, 20 bp, Artificial
  CRISPR gRNA sequence
aatgtgccatggaagaggtt

SEQ ID NO: 135696 - DNA, 20 bp, Artificial
  CRISPR gRNA sequence
gtgccatggaagaggttcag

SEQ ID NO: 135697 - DNA, 20 bp, Artificial
  CRISPR gRNA sequence
ggttcagaagtctttacctg

SEQ ID NO: 135698 - DNA, 20 bp, Artificial
  CRISPR gRNA sequence
agtctttacctgaagtgtgt

SEQ ID NO: 135699 - DNA, 20 bp, Artificial
  CRISPR gRNA sequence
tttacctgaagtgtgttggt

SEQ ID NO: 135700 - DNA, 20 bp, Artificial
  CRISPR gRNA sequence
cctgaagtgtgttggttaga

SEQ ID NO: 135701 - DNA, 20 bp, Artificial
  CRISPR gRNA sequence
gttggttagaaagtctgctg

SEQ ID NO: 135702 - DNA, 20 bp, Artificial
  CRISPR gRNA sequence
ggttagaaagtctgctgcag

SEQ ID NO: 135703 - DNA, 20 bp, Artificial
  CRISPR gRNA sequence
aaagtctgctgcagcagatt

SEQ ID NO: 135704 - DNA, 20 bp, Artificial
  CRISPR gRNA sequence
cagcagatttagtgtccctt

SEQ ID NO: 135705 - DNA, 20 bp, Artificial
  CRISPR gRNA sequence
agcagatttagtgtcccttt

SEQ ID NO: 135706 - DNA, 20 bp, Artificial
  CRISPR gRNA sequence
tagtgtccctttgggatctg

SEQ ID NO: 135707 - DNA, 20 bp, Artificial
  CRISPR gRNA sequence
gatctgaagataccttgcct

SEQ ID NO: 135708 - DNA, 20 bp, Artificial
  CRISPR gRNA sequence
tgaagataccttgcctcagc

SEQ ID NO: 135709 - DNA, 20 bp, Artificial
  CRISPR gRNA sequence
gataccttgcctcagccagt

SEQ ID NO: 135710 - DNA, 20 bp, Artificial
  CRISPR gRNA sequence
cagccagttagttgcttatt

SEQ ID NO: 135711 - DNA, 20 bp, Artificial
  CRISPR gRNA sequence
cagttagttgcttattcaga

SEQ ID NO: 135712 - DNA, 20 bp, Artificial
  CRISPR gRNA sequence
agttgcttattcagaaagct

SEQ ID NO: 135713 - DNA, 20 bp, Artificial
  CRISPR gRNA sequence
ttattcagaaagctgagaac

SEQ ID NO: 135714 - DNA, 20 bp, Artificial
  CRISPR gRNA sequence
tcagaaagctgagaaccagc

SEQ ID NO: 135715 - DNA, 20 bp, Artificial
  CRISPR gRNA sequence
cagaaagctgagaaccagct

SEQ ID NO: 135716 - DNA, 20 bp, Artificial
  CRISPR gRNA sequence
aaagctgagaaccagctagg

SEQ ID NO: 135717 - DNA, 20 bp, Artificial
  CRISPR gRNA sequence
agaaccagctaggaagctaa

SEQ ID NO: 135718 - DNA, 20 bp, Artificial
  CRISPR gRNA sequence
agctaatggtgttcacctgt

SEQ ID NO: 135719 - DNA, 20 bp, Artificial
  CRISPR gRNA sequence
gctaatggtgttcacctgtg

SEQ ID NO: 135720 - DNA, 20 bp, Artificial
  CRISPR gRNA sequence
tgttcacctgtgaggtattc

SEQ ID NO: 135721 - DNA, 20 bp, Artificial
  CRISPR gRNA sequence
cacctgtgaggtattccaga

SEQ ID NO: 135722 - DNA, 20 bp, Artificial
  CRISPR gRNA sequence
tgtgaggtattccagaaagc

SEQ ID NO: 135723 - DNA, 20 bp, Artificial
  CRISPR gRNA sequence
gtgaggtattccagaaagcc

SEQ ID NO: 135724 - DNA, 20 bp, Artificial
  CRISPR gRNA sequence
aggttacttttatgcattat

SEQ ID NO: 135725 - DNA, 20 bp, Artificial
  CRISPR gRNA sequence
ggttacttttatgcattatg

SEQ ID NO: 135726 - DNA, 20 bp, Artificial
  CRISPR gRNA sequence
tttatgcattatgaggaatt

SEQ ID NO: 135727 - DNA, 20 bp, Artificial
  CRISPR gRNA sequence
ttatgcattatgaggaattt

SEQ ID NO: 135728 - DNA, 20 bp, Artificial
  CRISPR gRNA sequence
tatgcattatgaggaattta

SEQ ID NO: 135729 - DNA, 20 bp, Artificial
  CRISPR gRNA sequence
tatacaaacacatcacctgc

SEQ ID NO: 135730 - DNA, 20 bp, Artificial
  CRISPR gRNA sequence
caaacacatcacctgcaagc

SEQ ID NO: 135731 - DNA, 20 bp, Artificial
  CRISPR gRNA sequence
cacatcacctgcaagccagt

SEQ ID NO: 135732 - DNA, 20 bp, Artificial
  CRISPR gRNA sequence
tttttttgttattatatttc

SEQ ID NO: 135733 - DNA, 20 bp, Artificial
  CRISPR gRNA sequence
tgttattatatttcaagaac

SEQ ID NO: 135734 - DNA, 20 bp, Artificial
  CRISPR gRNA sequence
gaacaagctaattcccaaaa

SEQ ID NO: 135735 - DNA, 20 bp, Artificial
  CRISPR gRNA sequence
agctaattcccaaaaaagtt

SEQ ID NO: 135736 - DNA, 20 bp, Artificial
  CRISPR gRNA sequence
ttcccaaaaaagtttggacc

SEQ ID NO: 135737 - DNA, 20 bp, Artificial
  CRISPR gRNA sequence
aagtttggacctggctctta

SEQ ID NO: 135738 - DNA, 20 bp, Artificial
  CRISPR gRNA sequence
ttggacctggctcttaaagt

SEQ ID NO: 135739 - DNA, 20 bp, Artificial
  CRISPR gRNA sequence
ggctcttaaagtgagtccac

SEQ ID NO: 135740 - DNA, 20 bp, Artificial
  CRISPR gRNA sequence
taacctgtatttaataaaca

SEQ ID NO: 135741 - DNA, 20 bp, Artificial
  CRISPR gRNA sequence
tatttaataaacaaagattc

SEQ ID NO: 135742 - DNA, 20 bp, Artificial
  CRISPR gRNA sequence
atttaataaacaaagattcc

SEQ ID NO: 135743 - DNA, 20 bp, Artificial
  CRISPR gRNA sequence
tttaataaacaaagattcca

SEQ ID NO: 135744 - DNA, 20 bp, Artificial
  CRISPR gRNA sequence
aaagattccagggtcatttt

SEQ ID NO: 135745 - DNA, 20 bp, Artificial
  CRISPR gRNA sequence
ggtcattttaagcatttgac

SEQ ID NO: 135746 - DNA, 20 bp, Artificial
  CRISPR gRNA sequence
agcatttgacaagactaaaa

SEQ ID NO: 135747 - DNA, 20 bp, Artificial
  CRISPR gRNA sequence
gcatttgacaagactaaaat

SEQ ID NO: 135748 - DNA, 20 bp, Artificial
  CRISPR gRNA sequence
aaaataggaatcattgttta

SEQ ID NO: 135749 - DNA, 20 bp, Artificial
  CRISPR gRNA sequence
ctgactttactgtttcccat

SEQ ID NO: 135750 - DNA, 20 bp, Artificial
  CRISPR gRNA sequence
tttactgtttcccatcagca

SEQ ID NO: 135751 - DNA, 20 bp, Artificial
  CRISPR gRNA sequence
actgtttcccatcagcaaag

SEQ ID NO: 135752 - DNA, 20 bp, Artificial
  CRISPR gRNA sequence
gtatgtgcttgtgtatgttt

SEQ ID NO: 135753 - DNA, 20 bp, Artificial
  CRISPR gRNA sequence
tgtgcttgtgtatgtttgag

SEQ ID NO: 135754 - DNA, 20 bp, Artificial
  CRISPR gRNA sequence
ttgttctttatattctttga

SEQ ID NO: 135755 - DNA, 20 bp, Artificial
  CRISPR gRNA sequence
taacatttttaatttttctg

SEQ ID NO: 135756 - DNA, 20 bp, Artificial
  CRISPR gRNA sequence
aacatttttaatttttctga

SEQ ID NO: 135757 - DNA, 20 bp, Artificial
  CRISPR gRNA sequence
ggtgatgaccttcatatatt

SEQ ID NO: 135758 - DNA, 20 bp, Artificial
  CRISPR gRNA sequence
accttcatatatttagacaa

SEQ ID NO: 135759 - DNA, 20 bp, Artificial
  CRISPR gRNA sequence
atatatttagacaaaagtta

SEQ ID NO: 135760 - DNA, 20 bp, Artificial
  CRISPR gRNA sequence
caaaagttatagtccattga

SEQ ID NO: 135761 - DNA, 20 bp, Artificial
  CRISPR gRNA sequence
ttatagtccattgaaagaat

SEQ ID NO: 135762 - DNA, 20 bp, Artificial
  CRISPR gRNA sequence
tatagtccattgaaagaatg

SEQ ID NO: 135763 - DNA, 20 bp, Artificial
  CRISPR gRNA sequence
atagtccattgaaagaatga

SEQ ID NO: 135764 - DNA, 20 bp, Artificial
  CRISPR gRNA sequence
aatgagggcttgaacgatgt

SEQ ID NO: 135765 - DNA, 20 bp, Artificial
  CRISPR gRNA sequence
atgtaagttatgtaatattt

SEQ ID NO: 135766 - DNA, 20 bp, Artificial
  CRISPR gRNA sequence
tatgtaatatttaagtccta

SEQ ID NO: 135767 - DNA, 20 bp, Artificial
  CRISPR gRNA sequence
gtcctaaagtgtactgactg

SEQ ID NO: 135768 - DNA, 20 bp, Artificial
  CRISPR gRNA sequence
gtactgactgaagattataa

SEQ ID NO: 135769 - DNA, 20 bp, Artificial
  CRISPR gRNA sequence
actgaagattataatagaca

SEQ ID NO: 135770 - DNA, 20 bp, Artificial
  CRISPR gRNA sequence
aagattataatagacatagc

SEQ ID NO: 135771 - DNA, 20 bp, Artificial
  CRISPR gRNA sequence
ttataatagacatagctgga

SEQ ID NO: 135772 - DNA, 20 bp, Artificial
  CRISPR gRNA sequence
tatttcatgtctacatttcc

SEQ ID NO: 135773 - DNA, 20 bp, Artificial
  CRISPR gRNA sequence
ttcatgtctacatttcccag

SEQ ID NO: 135774 - DNA, 20 bp, Artificial
  CRISPR gRNA sequence
gtctacatttcccagaagtt

SEQ ID NO: 135775 - DNA, 20 bp, Artificial
  CRISPR gRNA sequence
tagttttctttccttttttt

SEQ ID NO: 135776 - DNA, 20 bp, Artificial
  CRISPR gRNA sequence
gttttctttccttttttttg

SEQ ID NO: 135777 - DNA, 20 bp, Artificial
  CRISPR gRNA sequence
ctttccttttttttggagac

SEQ ID NO: 135778 - DNA, 20 bp, Artificial
  CRISPR gRNA sequence
tttccttttttttggagaca

SEQ ID NO: 135779 - DNA, 20 bp, Artificial
  CRISPR gRNA sequence
caaggtcttgctctgtcacc

SEQ ID NO: 135780 - DNA, 20 bp, Artificial
  CRISPR gRNA sequence
aaggtcttgctctgtcaccc

SEQ ID NO: 135781 - DNA, 20 bp, Artificial
  CRISPR gRNA sequence
tcttgctctgtcacccaggc

SEQ ID NO: 135782 - DNA, 20 bp, Artificial
  CRISPR gRNA sequence
ttgctctgtcacccaggcta

SEQ ID NO: 135783 - DNA, 20 bp, Artificial
  CRISPR gRNA sequence
ctgtcacccaggctagagtg

SEQ ID NO: 135784 - DNA, 20 bp, Artificial
  CRISPR gRNA sequence
tcacccaggctagagtgtag

SEQ ID NO: 135785 - DNA, 20 bp, Artificial
  CRISPR gRNA sequence
agagtgtagtggtgtaatca

SEQ ID NO: 135786 - DNA, 20 bp, Artificial
  CRISPR gRNA sequence
tcactgcaaccttaaactcc

SEQ ID NO: 135787 - DNA, 20 bp, Artificial
  CRISPR gRNA sequence
cactgcaaccttaaactcct

SEQ ID NO: 135788 - DNA, 20 bp, Artificial
  CRISPR gRNA sequence
aaccttaaactcctgggctc

SEQ ID NO: 135789 - DNA, 20 bp, Artificial
  CRISPR gRNA sequence
cttaaactcctgggctcaag

SEQ ID NO: 135790 - DNA, 20 bp, Artificial
  CRISPR gRNA sequence
ctcaagcagtcctcccacct

SEQ ID NO: 135791 - DNA, 20 bp, Artificial
  CRISPR gRNA sequence
gtcctcccacctcagcctcc

SEQ ID NO: 135792 - DNA, 20 bp, Artificial
  CRISPR gRNA sequence
cacctcagcctccgagtaat

SEQ ID NO: 135793 - DNA, 20 bp, Artificial
  CRISPR gRNA sequence
acctcagcctccgagtaatt

SEQ ID NO: 135794 - DNA, 20 bp, Artificial
  CRISPR gRNA sequence
cctccgagtaattgggacta

SEQ ID NO: 135795 - DNA, 20 bp, Artificial
  CRISPR gRNA sequence
ggactacagatgcacgctac

SEQ ID NO: 135796 - DNA, 20 bp, Artificial
  CRISPR gRNA sequence
gactacagatgcacgctact

SEQ ID NO: 135797 - DNA, 20 bp, Artificial
  CRISPR gRNA sequence
cagatgcacgctactaggcc

SEQ ID NO: 135798 - DNA, 20 bp, Artificial
  CRISPR gRNA sequence
gctaattaaaaaaaaatttt

SEQ ID NO: 135799 - DNA, 20 bp, Artificial
  CRISPR gRNA sequence
ctaattaaaaaaaaattttg

SEQ ID NO: 135800 - DNA, 20 bp, Artificial
  CRISPR gRNA sequence
taattaaaaaaaaattttga

SEQ ID NO: 135801 - DNA, 20 bp, Artificial
  CRISPR gRNA sequence
ttaaaaaaaaattttgaggg

SEQ ID NO: 135802 - DNA, 20 bp, Artificial
  CRISPR gRNA sequence
taaaaaaaaattttgagggc

SEQ ID NO: 135803 - DNA, 20 bp, Artificial
  CRISPR gRNA sequence
aaaaaaaaattttgagggca

SEQ ID NO: 135804 - DNA, 20 bp, Artificial
  CRISPR gRNA sequence
aaaattttgagggcagggcg

SEQ ID NO: 135805 - DNA, 20 bp, Artificial
  CRISPR gRNA sequence
attttgagggcagggcgtgg

SEQ ID NO: 135806 - DNA, 20 bp, Artificial
  CRISPR gRNA sequence
gtggctcacgcctgtaatcc

SEQ ID NO: 135807 - DNA, 20 bp, Artificial
  CRISPR gRNA sequence
cgcctgtaatcccagcactt

SEQ ID NO: 135808 - DNA, 20 bp, Artificial
  CRISPR gRNA sequence
gcctgtaatcccagcacttt

SEQ ID NO: 135809 - DNA, 20 bp, Artificial
  CRISPR gRNA sequence
ctgtaatcccagcactttgg

SEQ ID NO: 135810 - DNA, 20 bp, Artificial
  CRISPR gRNA sequence
tgtaatcccagcactttggg

SEQ ID NO: 135811 - DNA, 20 bp, Artificial
  CRISPR gRNA sequence
tcccagcactttgggaggcc

SEQ ID NO: 135812 - DNA, 20 bp, Artificial
  CRISPR gRNA sequence
cccagcactttgggaggccg

SEQ ID NO: 135813 - DNA, 20 bp, Artificial
  CRISPR gRNA sequence
agcactttgggaggccgagg

SEQ ID NO: 135814 - DNA, 20 bp, Artificial
  CRISPR gRNA sequence
gcactttgggaggccgaggc

SEQ ID NO: 135815 - DNA, 20 bp, Artificial
  CRISPR gRNA sequence
ctttgggaggccgaggcagg

SEQ ID NO: 135816 - DNA, 20 bp, Artificial
  CRISPR gRNA sequence
ggccgaggcaggcagatcac

SEQ ID NO: 135817 - DNA, 20 bp, Artificial
  CRISPR gRNA sequence
gccgaggcaggcagatcacg

SEQ ID NO: 135818 - DNA, 20 bp, Artificial
  CRISPR gRNA sequence
aggcaggcagatcacgaggt

SEQ ID NO: 135819 - DNA, 20 bp, Artificial
  CRISPR gRNA sequence
ggcaggcagatcacgaggtc

SEQ ID NO: 135820 - DNA, 20 bp, Artificial
  CRISPR gRNA sequence
caggcagatcacgaggtcag

SEQ ID NO: 135821 - DNA, 20 bp, Artificial
  CRISPR gRNA sequence
gatcacgaggtcaggagatc

SEQ ID NO: 135822 - DNA, 20 bp, Artificial
  CRISPR gRNA sequence
tcaggagatcaagaccatcc

SEQ ID NO: 135823 - DNA, 20 bp, Artificial
  CRISPR gRNA sequence
caagaccatcctggctaaca

SEQ ID NO: 135824 - DNA, 20 bp, Artificial
  CRISPR gRNA sequence
ctactaaaaatacaaaaaat

SEQ ID NO: 135825 - DNA, 20 bp, Artificial
  CRISPR gRNA sequence
taaaaatacaaaaaattagc

SEQ ID NO: 135826 - DNA, 20 bp, Artificial
  CRISPR gRNA sequence
aaaaatacaaaaaattagcc

SEQ ID NO: 135827 - DNA, 20 bp, Artificial
  CRISPR gRNA sequence
tacaaaaaattagccgggtg

SEQ ID NO: 135828 - DNA, 20 bp, Artificial
  CRISPR gRNA sequence
aaaaaattagccgggtgtgg

SEQ ID NO: 135829 - DNA, 20 bp, Artificial
  CRISPR gRNA sequence
aaattagccgggtgtggtgg

SEQ ID NO: 135830 - DNA, 20 bp, Artificial
  CRISPR gRNA sequence
aattagccgggtgtggtggc

SEQ ID NO: 135831 - DNA, 20 bp, Artificial
  CRISPR gRNA sequence
ggtgtggtggcgggcgcctg

SEQ ID NO: 135832 - DNA, 20 bp, Artificial
  CRISPR gRNA sequence
gtggcgggcgcctgtagtcc

SEQ ID NO: 135833 - DNA, 20 bp, Artificial
  CRISPR gRNA sequence
cgcctgtagtcccagctact

SEQ ID NO: 135834 - DNA, 20 bp, Artificial
  CRISPR gRNA sequence
ctgtagtcccagctactcgg

SEQ ID NO: 135835 - DNA, 20 bp, Artificial
  CRISPR gRNA sequence
tgtagtcccagctactcggc

SEQ ID NO: 135836 - DNA, 20 bp, Artificial
  CRISPR gRNA sequence
tcccagctactcggcaggct

SEQ ID NO: 135837 - DNA, 20 bp, Artificial
  CRISPR gRNA sequence
cccagctactcggcaggctg

SEQ ID NO: 135838 - DNA, 20 bp, Artificial
  CRISPR gRNA sequence
agctactcggcaggctgagg

SEQ ID NO: 135839 - DNA, 20 bp, Artificial
  CRISPR gRNA sequence
gctactcggcaggctgaggc

SEQ ID NO: 135840 - DNA, 20 bp, Artificial
  CRISPR gRNA sequence
tactcggcaggctgaggcag

SEQ ID NO: 135841 - DNA, 20 bp, Artificial
  CRISPR gRNA sequence
ggcaggctgaggcaggagaa

SEQ ID NO: 135842 - DNA, 20 bp, Artificial
  CRISPR gRNA sequence
gcaggagaatggcatgaatc

SEQ ID NO: 135843 - DNA, 20 bp, Artificial
  CRISPR gRNA sequence
caggagaatggcatgaatcc

SEQ ID NO: 135844 - DNA, 20 bp, Artificial
  CRISPR gRNA sequence
ggagaatggcatgaatccgg

SEQ ID NO: 135845 - DNA, 20 bp, Artificial
  CRISPR gRNA sequence
gagaatggcatgaatccggg

SEQ ID NO: 135846 - DNA, 20 bp, Artificial
  CRISPR gRNA sequence
aatggcatgaatccgggagg

SEQ ID NO: 135847 - DNA, 20 bp, Artificial
  CRISPR gRNA sequence
tggcatgaatccgggaggcg

SEQ ID NO: 135848 - DNA, 20 bp, Artificial
  CRISPR gRNA sequence
aatccgggaggcggagcttg

SEQ ID NO: 135849 - DNA, 20 bp, Artificial
  CRISPR gRNA sequence
cgggaggcggagcttgcagt

SEQ ID NO: 135850 - DNA, 20 bp, Artificial
  CRISPR gRNA sequence
gagcttgcagtgagccgaca

SEQ ID NO: 135851 - DNA, 20 bp, Artificial
  CRISPR gRNA sequence
gacatggcgccactgcactc

SEQ ID NO: 135852 - DNA, 20 bp, Artificial
  CRISPR gRNA sequence
tccagcctgtgcaacaaatc

SEQ ID NO: 135853 - DNA, 20 bp, Artificial
  CRISPR gRNA sequence
taaataaataaataataatt

SEQ ID NO: 135854 - DNA, 20 bp, Artificial
  CRISPR gRNA sequence
taaataaataataatttggc

SEQ ID NO: 135855 - DNA, 20 bp, Artificial
  CRISPR gRNA sequence
aaataaataataatttggct

SEQ ID NO: 135856 - DNA, 20 bp, Artificial
  CRISPR gRNA sequence
aataataatttggctgggtg

SEQ ID NO: 135857 - DNA, 20 bp, Artificial
  CRISPR gRNA sequence
aataatttggctgggtgtgg

SEQ ID NO: 135858 - DNA, 20 bp, Artificial
  CRISPR gRNA sequence
gtggatcatgcctgtaatcc

SEQ ID NO: 135859 - DNA, 20 bp, Artificial
  CRISPR gRNA sequence
tgcctgtaatcccagcactt

SEQ ID NO: 135860 - DNA, 20 bp, Artificial
  CRISPR gRNA sequence
gcctgtaatcccagcacttt

SEQ ID NO: 135861 - DNA, 20 bp, Artificial
  CRISPR gRNA sequence
ctgtaatcccagcactttgg

SEQ ID NO: 135862 - DNA, 20 bp, Artificial
  CRISPR gRNA sequence
tgtaatcccagcactttggg

SEQ ID NO: 135863 - DNA, 20 bp, Artificial
  CRISPR gRNA sequence
tcccagcactttgggaggcc

SEQ ID NO: 135864 - DNA, 20 bp, Artificial
  CRISPR gRNA sequence
cccagcactttgggaggcca

SEQ ID NO: 135865 - DNA, 20 bp, Artificial
  CRISPR gRNA sequence
agcactttgggaggccaagg

SEQ ID NO: 135866 - DNA, 20 bp, Artificial
  CRISPR gRNA sequence
gcactttgggaggccaaggt

SEQ ID NO: 135867 - DNA, 20 bp, Artificial
  CRISPR gRNA sequence
ctttgggaggccaaggtggg

SEQ ID NO: 135868 - DNA, 20 bp, Artificial
  CRISPR gRNA sequence
ccaaggtgggcggatcactt

SEQ ID NO: 135869 - DNA, 20 bp, Artificial
  CRISPR gRNA sequence
caaggtgggcggatcacttg

SEQ ID NO: 135870 - DNA, 20 bp, Artificial
  CRISPR gRNA sequence
gtgggcggatcacttgaggt

SEQ ID NO: 135871 - DNA, 20 bp, Artificial
  CRISPR gRNA sequence
tgggcggatcacttgaggtc

SEQ ID NO: 135872 - DNA, 20 bp, Artificial
  CRISPR gRNA sequence
ggcggatcacttgaggtcag

SEQ ID NO: 135873 - DNA, 20 bp, Artificial
  CRISPR gRNA sequence
tcacttgaggtcaggagttt

SEQ ID NO: 135874 - DNA, 20 bp, Artificial
  CRISPR gRNA sequence
tgaggtcaggagtttgagac

SEQ ID NO: 135875 - DNA, 20 bp, Artificial
  CRISPR gRNA sequence
tcaggagtttgagaccagcc

SEQ ID NO: 135876 - DNA, 20 bp, Artificial
  CRISPR gRNA sequence
tgagaccagcctggccaaca

SEQ ID NO: 135877 - DNA, 20 bp, Artificial
  CRISPR gRNA sequence
ctggccaacatggtgaaacc

SEQ ID NO: 135878 - DNA, 20 bp, Artificial
  CRISPR gRNA sequence
tactaaaaaaacaccgaaat

SEQ ID NO: 135879 - DNA, 20 bp, Artificial
  CRISPR gRNA sequence
aaaaaaacaccgaaattagc

SEQ ID NO: 135880 - DNA, 20 bp, Artificial
  CRISPR gRNA sequence
aaaaaacaccgaaattagcc

SEQ ID NO: 135881 - DNA, 20 bp, Artificial
  CRISPR gRNA sequence
acaccgaaattagccaggcg

SEQ ID NO: 135882 - DNA, 20 bp, Artificial
  CRISPR gRNA sequence
aaattagccaggcgtagtcc

SEQ ID NO: 135883 - DNA, 20 bp, Artificial
  CRISPR gRNA sequence
caggcgtagtcccagctata

SEQ ID NO: 135884 - DNA, 20 bp, Artificial
  CRISPR gRNA sequence
aggcgtagtcccagctatac

SEQ ID NO: 135885 - DNA, 20 bp, Artificial
  CRISPR gRNA sequence
gcgtagtcccagctatacag

SEQ ID NO: 135886 - DNA, 20 bp, Artificial
  CRISPR gRNA sequence
cgtagtcccagctatacagg

SEQ ID NO: 135887 - DNA, 20 bp, Artificial
  CRISPR gRNA sequence
tcccagctatacaggaggct

SEQ ID NO: 135888 - DNA, 20 bp, Artificial
  CRISPR gRNA sequence
cccagctatacaggaggctg

SEQ ID NO: 135889 - DNA, 20 bp, Artificial
  CRISPR gRNA sequence
tatacaggaggctgaggcac

SEQ ID NO: 135890 - DNA, 20 bp, Artificial
  CRISPR gRNA sequence
ggcacaagaattgcttgaac

SEQ ID NO: 135891 - DNA, 20 bp, Artificial
  CRISPR gRNA sequence
gcacaagaattgcttgaact

SEQ ID NO: 135892 - DNA, 20 bp, Artificial
  CRISPR gRNA sequence
acaagaattgcttgaactgg

SEQ ID NO: 135893 - DNA, 20 bp, Artificial
  CRISPR gRNA sequence
caagaattgcttgaactggg

SEQ ID NO: 135894 - DNA, 20 bp, Artificial
  CRISPR gRNA sequence
ttgcttgaactgggaggttg

SEQ ID NO: 135895 - DNA, 20 bp, Artificial
  CRISPR gRNA sequence
ttgaactgggaggttgcagt

SEQ ID NO: 135896 - DNA, 20 bp, Artificial
  CRISPR gRNA sequence
gaggttgcagtgagccatga

SEQ ID NO: 135897 - DNA, 20 bp, Artificial
  CRISPR gRNA sequence
atgatagtgccactgcactc

SEQ ID NO: 135898 - DNA, 20 bp, Artificial
  CRISPR gRNA sequence
agtgccactgcactccagcc

SEQ ID NO: 135899 - DNA, 20 bp, Artificial
  CRISPR gRNA sequence
gtgccactgcactccagcct

SEQ ID NO: 135900 - DNA, 20 bp, Artificial
  CRISPR gRNA sequence
ctgcactccagcctgggcaa

SEQ ID NO: 135901 - DNA, 20 bp, Artificial
  CRISPR gRNA sequence
gcactccagcctgggcaaca

SEQ ID NO: 135902 - DNA, 20 bp, Artificial
  CRISPR gRNA sequence
tccagcctgggcaacagagt

SEQ ID NO: 135903 - DNA, 20 bp, Artificial
  CRISPR gRNA sequence
acagagtgagattccgtctc

SEQ ID NO: 135904 - DNA, 20 bp, Artificial
  CRISPR gRNA sequence
aactttttttttttttcctg

SEQ ID NO: 135905 - DNA, 20 bp, Artificial
  CRISPR gRNA sequence
ttttttttttcctgtagaaa

SEQ ID NO: 135906 - DNA, 20 bp, Artificial
  CRISPR gRNA sequence
ttttttttcctgtagaaatg

SEQ ID NO: 135907 - DNA, 20 bp, Artificial
  CRISPR gRNA sequence
tggagtctcattattttccc

SEQ ID NO: 135908 - DNA, 20 bp, Artificial
  CRISPR gRNA sequence
gtctcattattttccctggc

SEQ ID NO: 135909 - DNA, 20 bp, Artificial
  CRISPR gRNA sequence
cctggctggtctcgaactcc

SEQ ID NO: 135910 - DNA, 20 bp, Artificial
  CRISPR gRNA sequence
gtctcgaactcctggcctca

SEQ ID NO: 135911 - DNA, 20 bp, Artificial
  CRISPR gRNA sequence
tctcgaactcctggcctcaa

SEQ ID NO: 135912 - DNA, 20 bp, Artificial
  CRISPR gRNA sequence
ctcaaaggatctttctacct

SEQ ID NO: 135913 - DNA, 20 bp, Artificial
  CRISPR gRNA sequence
ctttctacctcagcctccca

SEQ ID NO: 135914 - DNA, 20 bp, Artificial
  CRISPR gRNA sequence
acctcagcctcccaaagcac

SEQ ID NO: 135915 - DNA, 20 bp, Artificial
  CRISPR gRNA sequence
tcccaaagcactggcattta

SEQ ID NO: 135916 - DNA, 20 bp, Artificial
  CRISPR gRNA sequence
cccaaagcactggcatttac

SEQ ID NO: 135917 - DNA, 20 bp, Artificial
  CRISPR gRNA sequence
gcactggcatttacaggtgt

SEQ ID NO: 135918 - DNA, 20 bp, Artificial
  CRISPR gRNA sequence
caggtgtgagcatctgtgcc

SEQ ID NO: 135919 - DNA, 20 bp, Artificial
  CRISPR gRNA sequence
tgtgagcatctgtgcctggc

SEQ ID NO: 135920 - DNA, 20 bp, Artificial
  CRISPR gRNA sequence
tgtgttctgctacctccata

SEQ ID NO: 135921 - DNA, 20 bp, Artificial
  CRISPR gRNA sequence
gtgttctgctacctccatat

SEQ ID NO: 135922 - DNA, 20 bp, Artificial
  CRISPR gRNA sequence
tgttctgctacctccatatg

SEQ ID NO: 135923 - DNA, 20 bp, Artificial
  CRISPR gRNA sequence
gttctgctacctccatatgg

SEQ ID NO: 135924 - DNA, 20 bp, Artificial
  CRISPR gRNA sequence
gggcccacctctttataacg

SEQ ID NO: 135925 - DNA, 20 bp, Artificial
  CRISPR gRNA sequence
ccacctctttataacgtggt

SEQ ID NO: 135926 - DNA, 20 bp, Artificial
  CRISPR gRNA sequence
ttatcttcttgtctctccct

SEQ ID NO: 135927 - DNA, 20 bp, Artificial
  CRISPR gRNA sequence
tatcttcttgtctctccctt

SEQ ID NO: 135928 - DNA, 20 bp, Artificial
  CRISPR gRNA sequence
atcttcttgtctctccctta

SEQ ID NO: 135929 - DNA, 20 bp, Artificial
  CRISPR gRNA sequence
tctctcccttagggatccca

SEQ ID NO: 135930 - DNA, 20 bp, Artificial
  CRISPR gRNA sequence
tcccttagggatcccaaagc

SEQ ID NO: 135931 - DNA, 20 bp, Artificial
  CRISPR gRNA sequence
gctgttcaataattgaccaa

SEQ ID NO: 135932 - DNA, 20 bp, Artificial
  CRISPR gRNA sequence
caaaagtttttctctactta

SEQ ID NO: 135933 - DNA, 20 bp, Artificial
  CRISPR gRNA sequence
ttatagtattttttctaaat

SEQ ID NO: 135934 - DNA, 20 bp, Artificial
  CRISPR gRNA sequence
attttttctaaattagatta

SEQ ID NO: 135935 - DNA, 20 bp, Artificial
  CRISPR gRNA sequence
ttctaaattagattacagtc

SEQ ID NO: 135936 - DNA, 20 bp, Artificial
  CRISPR gRNA sequence
agattacagtctagcacctg

SEQ ID NO: 135937 - DNA, 20 bp, Artificial
  CRISPR gRNA sequence
tctagcacctgcagtgaaaa

SEQ ID NO: 135938 - DNA, 20 bp, Artificial
  CRISPR gRNA sequence
ctagcacctgcagtgaaaat

SEQ ID NO: 135939 - DNA, 20 bp, Artificial
  CRISPR gRNA sequence
gcagtgaaaatgggcaatcg

SEQ ID NO: 135940 - DNA, 20 bp, Artificial
  CRISPR gRNA sequence
cagtgaaaatgggcaatcga

SEQ ID NO: 135941 - DNA, 20 bp, Artificial
  CRISPR gRNA sequence
aaaatgggcaatcgaaggat

SEQ ID NO: 135942 - DNA, 20 bp, Artificial
  CRISPR gRNA sequence
aaatgggcaatcgaaggata

SEQ ID NO: 135943 - DNA, 20 bp, Artificial
  CRISPR gRNA sequence
caatcgaaggataaggaatg

SEQ ID NO: 135944 - DNA, 20 bp, Artificial
  CRISPR gRNA sequence
aatcgaaggataaggaatga

SEQ ID NO: 135945 - DNA, 20 bp, Artificial
  CRISPR gRNA sequence
taaggaatgaaggtaaattc

SEQ ID NO: 135946 - DNA, 20 bp, Artificial
  CRISPR gRNA sequence
tgaaggtaaattccagtata

SEQ ID NO: 135947 - DNA, 20 bp, Artificial
  CRISPR gRNA sequence
gaaggtaaattccagtataa

SEQ ID NO: 135948 - DNA, 20 bp, Artificial
  CRISPR gRNA sequence
ggtaaattccagtataaagg

SEQ ID NO: 135949 - DNA, 20 bp, Artificial
  CRISPR gRNA sequence
ccagtataaaggaagaacta

SEQ ID NO: 135950 - DNA, 20 bp, Artificial
  CRISPR gRNA sequence
gaactaaagaaaaaaaaaca

SEQ ID NO: 135951 - DNA, 20 bp, Artificial
  CRISPR gRNA sequence
atagtaaatgtttaacttta

SEQ ID NO: 135952 - DNA, 20 bp, Artificial
  CRISPR gRNA sequence
gtaaatgtttaactttaaag

SEQ ID NO: 135953 - DNA, 20 bp, Artificial
  CRISPR gRNA sequence
cattgtgaccttgtgttcct

SEQ ID NO: 135954 - DNA, 20 bp, Artificial
  CRISPR gRNA sequence
accttgtgttccttagttca

SEQ ID NO: 135955 - DNA, 20 bp, Artificial
  CRISPR gRNA sequence
tgtgttccttagttcaaaga

SEQ ID NO: 135956 - DNA, 20 bp, Artificial
  CRISPR gRNA sequence
gttccttagttcaaagaaag

SEQ ID NO: 135957 - DNA, 20 bp, Artificial
  CRISPR gRNA sequence
aaagaagactaaaataacta

SEQ ID NO: 135958 - DNA, 20 bp, Artificial
  CRISPR gRNA sequence
actaaaataactacagcaaa

SEQ ID NO: 135959 - DNA, 20 bp, Artificial
  CRISPR gRNA sequence
aaaataactacagcaaatag

SEQ ID NO: 135960 - DNA, 20 bp, Artificial
  CRISPR gRNA sequence
aatagcagtgctaattcact

SEQ ID NO: 135961 - DNA, 20 bp, Artificial
  CRISPR gRNA sequence
acttggttatcctttcttct

SEQ ID NO: 135962 - DNA, 20 bp, Artificial
  CRISPR gRNA sequence
tggttatcctttcttcttgg

SEQ ID NO: 135963 - DNA, 20 bp, Artificial
  CRISPR gRNA sequence
tcttggaagtactaccgttt

SEQ ID NO: 135964 - DNA, 20 bp, Artificial
  CRISPR gRNA sequence
accgttttggtctgtttcca

SEQ ID NO: 135965 - DNA, 20 bp, Artificial
  CRISPR gRNA sequence
tttccatagtttcaattaca

SEQ ID NO: 135966 - DNA, 20 bp, Artificial
  CRISPR gRNA sequence
ttcaattacatagaaaacta

SEQ ID NO: 135967 - DNA, 20 bp, Artificial
  CRISPR gRNA sequence
tcaattacatagaaaactaa

SEQ ID NO: 135968 - DNA, 20 bp, Artificial
  CRISPR gRNA sequence
caattacatagaaaactaaa

SEQ ID NO: 135969 - DNA, 20 bp, Artificial
  CRISPR gRNA sequence
ttacatagaaaactaaaggg

SEQ ID NO: 135970 - DNA, 20 bp, Artificial
  CRISPR gRNA sequence
cctgctcaattgaaaatatc

SEQ ID NO: 135971 - DNA, 20 bp, Artificial
  CRISPR gRNA sequence
aaattttcttctgtctacct

SEQ ID NO: 135972 - DNA, 20 bp, Artificial
  CRISPR gRNA sequence
ttctgtctacctaagctata

SEQ ID NO: 135973 - DNA, 20 bp, Artificial
  CRISPR gRNA sequence
gctatatagttcttactttc

SEQ ID NO: 135974 - DNA, 20 bp, Artificial
  CRISPR gRNA sequence
ctatatagttcttactttca

SEQ ID NO: 135975 - DNA, 20 bp, Artificial
  CRISPR gRNA sequence
ttactttcaaggaaatgcta

SEQ ID NO: 135976 - DNA, 20 bp, Artificial
  CRISPR gRNA sequence
tttcaaggaaatgctaaagt

SEQ ID NO: 135977 - DNA, 20 bp, Artificial
  CRISPR gRNA sequence
acgcatgcatgtcttttttg

SEQ ID NO: 135978 - DNA, 20 bp, Artificial
  CRISPR gRNA sequence
gcatgcatgtcttttttgtg

SEQ ID NO: 135979 - DNA, 20 bp, Artificial
  CRISPR gRNA sequence
tacaaataaaattttactct

SEQ ID NO: 135980 - DNA, 20 bp, Artificial
  CRISPR gRNA sequence
tgagactgatgatgtttatc

SEQ ID NO: 135981 - DNA, 20 bp, Artificial
  CRISPR gRNA sequence
tgatgatgtttatcaagtat

SEQ ID NO: 135982 - DNA, 20 bp, Artificial
  CRISPR gRNA sequence
tcaagtattagaaactgata

SEQ ID NO: 135983 - DNA, 20 bp, Artificial
  CRISPR gRNA sequence
gtattagaaactgatatgga

SEQ ID NO: 135984 - DNA, 20 bp, Artificial
  CRISPR gRNA sequence
gaaactgatatggaaagaac

SEQ ID NO: 135985 - DNA, 20 bp, Artificial
  CRISPR gRNA sequence
gaaagaacaagcaaaataca

SEQ ID NO: 135986 - DNA, 20 bp, Artificial
  CRISPR gRNA sequence
caagcaaaatacacagaatt

SEQ ID NO: 135987 - DNA, 20 bp, Artificial
  CRISPR gRNA sequence
agcaaaatacacagaattca

SEQ ID NO: 135988 - DNA, 20 bp, Artificial
  CRISPR gRNA sequence
gcaaaatacacagaattcag

SEQ ID NO: 135989 - DNA, 20 bp, Artificial
  CRISPR gRNA sequence
aaaatacacagaattcagag

SEQ ID NO: 135990 - DNA, 20 bp, Artificial
  CRISPR gRNA sequence
aaatacacagaattcagagg

SEQ ID NO: 135991 - DNA, 20 bp, Artificial
  CRISPR gRNA sequence
aatacacagaattcagagga

SEQ ID NO: 135992 - DNA, 20 bp, Artificial
  CRISPR gRNA sequence
atacacagaattcagaggag

SEQ ID NO: 135993 - DNA, 20 bp, Artificial
  CRISPR gRNA sequence
acacagaattcagaggaggg

SEQ ID NO: 135994 - DNA, 20 bp, Artificial
  CRISPR gRNA sequence
gaggaggggagacgttcgct

SEQ ID NO: 135995 - DNA, 20 bp, Artificial
  CRISPR gRNA sequence
aggaggggagacgttcgctt

SEQ ID NO: 135996 - DNA, 20 bp, Artificial
  CRISPR gRNA sequence
gagacgttcgcttaggaatg

SEQ ID NO: 135997 - DNA, 20 bp, Artificial
  CRISPR gRNA sequence
agacgttcgcttaggaatga

SEQ ID NO: 135998 - DNA, 20 bp, Artificial
  CRISPR gRNA sequence
gttcgcttaggaatgaaggc

SEQ ID NO: 135999 - DNA, 20 bp, Artificial
  CRISPR gRNA sequence
atgaaggcaagctgtttaac

SEQ ID NO: 136000 - DNA, 20 bp, Artificial
  CRISPR gRNA sequence
tgaaggcaagctgtttaact

SEQ ID NO: 136001 - DNA, 20 bp, Artificial
  CRISPR gRNA sequence
gcaagctgtttaactgggtg

SEQ ID NO: 136002 - DNA, 20 bp, Artificial
  CRISPR gRNA sequence
tgtttaactgggtgtagact

SEQ ID NO: 136003 - DNA, 20 bp, Artificial
  CRISPR gRNA sequence
gtttaactgggtgtagactc

SEQ ID NO: 136004 - DNA, 20 bp, Artificial
  CRISPR gRNA sequence
tttaactgggtgtagactca

SEQ ID NO: 136005 - DNA, 20 bp, Artificial
  CRISPR gRNA sequence
taactgggtgtagactcagg

SEQ ID NO: 136006 - DNA, 20 bp, Artificial
  CRISPR gRNA sequence
aactgggtgtagactcaggg

SEQ ID NO: 136007 - DNA, 20 bp, Artificial
  CRISPR gRNA sequence
tgggtgtagactcagggagg

SEQ ID NO: 136008 - DNA, 20 bp, Artificial
  CRISPR gRNA sequence
gggtgtagactcagggaggt

SEQ ID NO: 136009 - DNA, 20 bp, Artificial
  CRISPR gRNA sequence
ggtgtagactcagggaggta

SEQ ID NO: 136010 - DNA, 20 bp, Artificial
  CRISPR gRNA sequence
agactcagggaggtagggac

SEQ ID NO: 136011 - DNA, 20 bp, Artificial
  CRISPR gRNA sequence
gactcagggaggtagggaca

SEQ ID NO: 136012 - DNA, 20 bp, Artificial
  CRISPR gRNA sequence
actcagggaggtagggacaa

SEQ ID NO: 136013 - DNA, 20 bp, Artificial
  CRISPR gRNA sequence
aggtagggacaagggcattc

SEQ ID NO: 136014 - DNA, 20 bp, Artificial
  CRISPR gRNA sequence
gacaagggcattccagacat

SEQ ID NO: 136015 - DNA, 20 bp, Artificial
  CRISPR gRNA sequence
acaagggcattccagacatt

SEQ ID NO: 136016 - DNA, 20 bp, Artificial
  CRISPR gRNA sequence
aagggcattccagacattgg

SEQ ID NO: 136017 - DNA, 20 bp, Artificial
  CRISPR gRNA sequence
ttccagacattgggagcaac

SEQ ID NO: 136018 - DNA, 20 bp, Artificial
  CRISPR gRNA sequence
agacattgggagcaacaagc

SEQ ID NO: 136019 - DNA, 20 bp, Artificial
  CRISPR gRNA sequence
aagcaagatcatgattcaaa

SEQ ID NO: 136020 - DNA, 20 bp, Artificial
  CRISPR gRNA sequence
atgattcaaaaagtacatct

SEQ ID NO: 136021 - DNA, 20 bp, Artificial
  CRISPR gRNA sequence
tgattcaaaaagtacatctt

SEQ ID NO: 136022 - DNA, 20 bp, Artificial
  CRISPR gRNA sequence
caaaaagtacatcttgggtt

SEQ ID NO: 136023 - DNA, 20 bp, Artificial
  CRISPR gRNA sequence
aaaaagtacatcttgggtta

SEQ ID NO: 136024 - DNA, 20 bp, Artificial
  CRISPR gRNA sequence
aaagtacatcttgggttaag

SEQ ID NO: 136025 - DNA, 20 bp, Artificial
  CRISPR gRNA sequence
agtacatcttgggttaagga

SEQ ID NO: 136026 - DNA, 20 bp, Artificial
  CRISPR gRNA sequence
acatcttgggttaaggagag

SEQ ID NO: 136027 - DNA, 20 bp, Artificial
  CRISPR gRNA sequence
gggttaaggagagcagtaaa

SEQ ID NO: 136028 - DNA, 20 bp, Artificial
  CRISPR gRNA sequence
gcagtaaatggtcaactgct

SEQ ID NO: 136029 - DNA, 20 bp, Artificial
  CRISPR gRNA sequence
agtaaatggtcaactgctta

SEQ ID NO: 136030 - DNA, 20 bp, Artificial
  CRISPR gRNA sequence
tggtcaactgcttagagcat

SEQ ID NO: 136031 - DNA, 20 bp, Artificial
  CRISPR gRNA sequence
ggtcaactgcttagagcata

SEQ ID NO: 136032 - DNA, 20 bp, Artificial
  CRISPR gRNA sequence
tcaactgcttagagcataag

SEQ ID NO: 136033 - DNA, 20 bp, Artificial
  CRISPR gRNA sequence
tgcttagagcataaggagat

SEQ ID NO: 136034 - DNA, 20 bp, Artificial
  CRISPR gRNA sequence
agagcataaggagatgagtt

SEQ ID NO: 136035 - DNA, 20 bp, Artificial
  CRISPR gRNA sequence
gagcataaggagatgagtta

SEQ ID NO: 136036 - DNA, 20 bp, Artificial
  CRISPR gRNA sequence
ataaggagatgagttaagga

SEQ ID NO: 136037 - DNA, 20 bp, Artificial
  CRISPR gRNA sequence
taaggagatgagttaaggac

SEQ ID NO: 136038 - DNA, 20 bp, Artificial
  CRISPR gRNA sequence
ggagatgagttaaggacagg

SEQ ID NO: 136039 - DNA, 20 bp, Artificial
  CRISPR gRNA sequence
gagatgagttaaggacagga

SEQ ID NO: 136040 - DNA, 20 bp, Artificial
  CRISPR gRNA sequence
gatgagttaaggacaggaag

SEQ ID NO: 136041 - DNA, 20 bp, Artificial
  CRISPR gRNA sequence
gagttaaggacaggaaggag

SEQ ID NO: 136042 - DNA, 20 bp, Artificial
  CRISPR gRNA sequence
aggacaggaaggagtggtaa

SEQ ID NO: 136043 - DNA, 20 bp, Artificial
  CRISPR gRNA sequence
caggaaggagtggtaaaaga

SEQ ID NO: 136044 - DNA, 20 bp, Artificial
  CRISPR gRNA sequence
gaaggagtggtaaaagaaag

SEQ ID NO: 136045 - DNA, 20 bp, Artificial
  CRISPR gRNA sequence
agtggtaaaagaaagaagta

SEQ ID NO: 136046 - DNA, 20 bp, Artificial
  CRISPR gRNA sequence
tggtaaaagaaagaagtatg

SEQ ID NO: 136047 - DNA, 20 bp, Artificial
  CRISPR gRNA sequence
taaaagaaagaagtatggag

SEQ ID NO: 136048 - DNA, 20 bp, Artificial
  CRISPR gRNA sequence
aagaaagaagtatggagaag

SEQ ID NO: 136049 - DNA, 20 bp, Artificial
  CRISPR gRNA sequence
agaagtatggagaagtagat

SEQ ID NO: 136050 - DNA, 20 bp, Artificial
  CRISPR gRNA sequence
gaagtatggagaagtagatt

SEQ ID NO: 136051 - DNA, 20 bp, Artificial
  CRISPR gRNA sequence
tatggagaagtagattgggt

SEQ ID NO: 136052 - DNA, 20 bp, Artificial
  CRISPR gRNA sequence
gtagattgggtcagatgttg

SEQ ID NO: 136053 - DNA, 20 bp, Artificial
  CRISPR gRNA sequence
tagattgggtcagatgttga

SEQ ID NO: 136054 - DNA, 20 bp, Artificial
  CRISPR gRNA sequence
agattgggtcagatgttgaa

SEQ ID NO: 136055 - DNA, 20 bp, Artificial
  CRISPR gRNA sequence
tgttgaagggccttgtttgc

SEQ ID NO: 136056 - DNA, 20 bp, Artificial
  CRISPR gRNA sequence
gttgaagggccttgtttgct

SEQ ID NO: 136057 - DNA, 20 bp, Artificial
  CRISPR gRNA sequence
agggccttgtttgctaggct

SEQ ID NO: 136058 - DNA, 20 bp, Artificial
  CRISPR gRNA sequence
gctaggctaagaaatttgaa

SEQ ID NO: 136059 - DNA, 20 bp, Artificial
  CRISPR gRNA sequence
gaacagtctctgcttgacgt

SEQ ID NO: 136060 - DNA, 20 bp, Artificial
  CRISPR gRNA sequence
gttggtgaccattgaaaatc

SEQ ID NO: 136061 - DNA, 20 bp, Artificial
  CRISPR gRNA sequence
ttggtgaccattgaaaatct

SEQ ID NO: 136062 - DNA, 20 bp, Artificial
  CRISPR gRNA sequence
tggtgaccattgaaaatctg

SEQ ID NO: 136063 - DNA, 20 bp, Artificial
  CRISPR gRNA sequence
tgaccattgaaaatctgggg

SEQ ID NO: 136064 - DNA, 20 bp, Artificial
  CRISPR gRNA sequence
ccattgaaaatctggggtag

SEQ ID NO: 136065 - DNA, 20 bp, Artificial
  CRISPR gRNA sequence
attgaaaatctggggtagta

SEQ ID NO: 136066 - DNA, 20 bp, Artificial
  CRISPR gRNA sequence
tctggggtagtagagtgatg

SEQ ID NO: 136067 - DNA, 20 bp, Artificial
  CRISPR gRNA sequence
gtagagtgatgtggcattat

SEQ ID NO: 136068 - DNA, 20 bp, Artificial
  CRISPR gRNA sequence
agagtgatgtggcattatga

SEQ ID NO: 136069 - DNA, 20 bp, Artificial
  CRISPR gRNA sequence
atatgatttattatacatct

SEQ ID NO: 136070 - DNA, 20 bp, Artificial
  CRISPR gRNA sequence
tatgatttattatacatctt

SEQ ID NO: 136071 - DNA, 20 bp, Artificial
  CRISPR gRNA sequence
tcttaggttcacaaccctta

SEQ ID NO: 136072 - DNA, 20 bp, Artificial
  CRISPR gRNA sequence
cttaggttcacaacccttat

SEQ ID NO: 136073 - DNA, 20 bp, Artificial
  CRISPR gRNA sequence
cacaacccttataggattat

SEQ ID NO: 136074 - DNA, 20 bp, Artificial
  CRISPR gRNA sequence
acaacccttataggattatt

SEQ ID NO: 136075 - DNA, 20 bp, Artificial
  CRISPR gRNA sequence
aacccttataggattattag

SEQ ID NO: 136076 - DNA, 20 bp, Artificial
  CRISPR gRNA sequence
acccttataggattattagg

SEQ ID NO: 136077 - DNA, 20 bp, Artificial
  CRISPR gRNA sequence
gattattaggaggtttaaaa

SEQ ID NO: 136078 - DNA, 20 bp, Artificial
  CRISPR gRNA sequence
attattaggaggtttaaaat

SEQ ID NO: 136079 - DNA, 20 bp, Artificial
  CRISPR gRNA sequence
attaggaggtttaaaatagg

SEQ ID NO: 136080 - DNA, 20 bp, Artificial
  CRISPR gRNA sequence
ttaaaataggtagtaacata

SEQ ID NO: 136081 - DNA, 20 bp, Artificial
  CRISPR gRNA sequence
taaaataggtagtaacataa

SEQ ID NO: 136082 - DNA, 20 bp, Artificial
  CRISPR gRNA sequence
aaaataggtagtaacataaa

SEQ ID NO: 136083 - DNA, 20 bp, Artificial
  CRISPR gRNA sequence
aggtagtaacataaagggct

SEQ ID NO: 136084 - DNA, 20 bp, Artificial
  CRISPR gRNA sequence
aaagggcttagaattgtacg

SEQ ID NO: 136085 - DNA, 20 bp, Artificial
  CRISPR gRNA sequence
ttagaattgtacgtggcaca

SEQ ID NO: 136086 - DNA, 20 bp, Artificial
  CRISPR gRNA sequence
cagtaactcctaatgaacat

SEQ ID NO: 136087 - DNA, 20 bp, Artificial
  CRISPR gRNA sequence
tcatcatcgtttttattaca

SEQ ID NO: 136088 - DNA, 20 bp, Artificial
  CRISPR gRNA sequence
atcatcgtttttattacatg

SEQ ID NO: 136089 - DNA, 20 bp, Artificial
  CRISPR gRNA sequence
tcatcgtttttattacatgg

SEQ ID NO: 136090 - DNA, 20 bp, Artificial
  CRISPR gRNA sequence
ttttattacatggaggcaat

SEQ ID NO: 136091 - DNA, 20 bp, Artificial
  CRISPR gRNA sequence
tttattacatggaggcaatg

SEQ ID NO: 136092 - DNA, 20 bp, Artificial
  CRISPR gRNA sequence
ttattacatggaggcaatga

SEQ ID NO: 136093 - DNA, 20 bp, Artificial
  CRISPR gRNA sequence
ggaggcaatgagggtctgaa

SEQ ID NO: 136094 - DNA, 20 bp, Artificial
  CRISPR gRNA sequence
aggcaatgagggtctgaaca

SEQ ID NO: 136095 - DNA, 20 bp, Artificial
  CRISPR gRNA sequence
aatgagggtctgaacagaga

SEQ ID NO: 136096 - DNA, 20 bp, Artificial
  CRISPR gRNA sequence
gagggtctgaacagagatag

SEQ ID NO: 136097 - DNA, 20 bp, Artificial
  CRISPR gRNA sequence
ggtctgaacagagatagtgg

SEQ ID NO: 136098 - DNA, 20 bp, Artificial
  CRISPR gRNA sequence
acagagatagtggtagtatg

SEQ ID NO: 136099 - DNA, 20 bp, Artificial
  CRISPR gRNA sequence
agatagtggtagtatgaaga

SEQ ID NO: 136100 - DNA, 20 bp, Artificial
  CRISPR gRNA sequence
gatagtggtagtatgaagaa

SEQ ID NO: 136101 - DNA, 20 bp, Artificial
  CRISPR gRNA sequence
gtggtagtatgaagaaaggt

SEQ ID NO: 136102 - DNA, 20 bp, Artificial
  CRISPR gRNA sequence
tggtagtatgaagaaaggtc

SEQ ID NO: 136103 - DNA, 20 bp, Artificial
  CRISPR gRNA sequence
gtagtatgaagaaaggtcag

SEQ ID NO: 136104 - DNA, 20 bp, Artificial
  CRISPR gRNA sequence
tatgaagaaaggtcaggaga

SEQ ID NO: 136105 - DNA, 20 bp, Artificial
  CRISPR gRNA sequence
ggtcaggagatggacactgt

SEQ ID NO: 136106 - DNA, 20 bp, Artificial
  CRISPR gRNA sequence
actgttggacactgttacta

SEQ ID NO: 136107 - DNA, 20 bp, Artificial
  CRISPR gRNA sequence
gacactgttactatagaatt

SEQ ID NO: 136108 - DNA, 20 bp, Artificial
  CRISPR gRNA sequence
actgttactatagaatttag

SEQ ID NO: 136109 - DNA, 20 bp, Artificial
  CRISPR gRNA sequence
tatagaatttagcagctgat

SEQ ID NO: 136110 - DNA, 20 bp, Artificial
  CRISPR gRNA sequence
tttagcagctgattagaatt

SEQ ID NO: 136111 - DNA, 20 bp, Artificial
  CRISPR gRNA sequence
ttagcagctgattagaattg

SEQ ID NO: 136112 - DNA, 20 bp, Artificial
  CRISPR gRNA sequence
agctgattagaattgaggaa

SEQ ID NO: 136113 - DNA, 20 bp, Artificial
  CRISPR gRNA sequence
ctgattagaattgaggaaca

SEQ ID NO: 136114 - DNA, 20 bp, Artificial
  CRISPR gRNA sequence
tgattagaattgaggaacag

SEQ ID NO: 136115 - DNA, 20 bp, Artificial
  CRISPR gRNA sequence
attagaattgaggaacagag

SEQ ID NO: 136116 - DNA, 20 bp, Artificial
  CRISPR gRNA sequence
attgaggaacagaggagaaa

SEQ ID NO: 136117 - DNA, 20 bp, Artificial
  CRISPR gRNA sequence
aaaaagtgcaaaatgatact

SEQ ID NO: 136118 - DNA, 20 bp, Artificial
  CRISPR gRNA sequence
atgatactgagatttctatc

SEQ ID NO: 136119 - DNA, 20 bp, Artificial
  CRISPR gRNA sequence
actgagatttctatccagtc

SEQ ID NO: 136120 - DNA, 20 bp, Artificial
  CRISPR gRNA sequence
ctgagatttctatccagtct

SEQ ID NO: 136121 - DNA, 20 bp, Artificial
  CRISPR gRNA sequence
ttctatccagtctgggtgac

SEQ ID NO: 136122 - DNA, 20 bp, Artificial
  CRISPR gRNA sequence
ctatccagtctgggtgactg

SEQ ID NO: 136123 - DNA, 20 bp, Artificial
  CRISPR gRNA sequence
tatccagtctgggtgactgg

SEQ ID NO: 136124 - DNA, 20 bp, Artificial
  CRISPR gRNA sequence
cagtctgggtgactggagga

SEQ ID NO: 136125 - DNA, 20 bp, Artificial
  CRISPR gRNA sequence
gggtgactggaggatagaaa

SEQ ID NO: 136126 - DNA, 20 bp, Artificial
  CRISPR gRNA sequence
ggaggatagaaacagaaatt

SEQ ID NO: 136127 - DNA, 20 bp, Artificial
  CRISPR gRNA sequence
gaggatagaaacagaaattt

SEQ ID NO: 136128 - DNA, 20 bp, Artificial
  CRISPR gRNA sequence
gatagaaacagaaatttagg

SEQ ID NO: 136129 - DNA, 20 bp, Artificial
  CRISPR gRNA sequence
tagaaacagaaatttaggaa

SEQ ID NO: 136130 - DNA, 20 bp, Artificial
  CRISPR gRNA sequence
aacagaaatttaggaagagc

SEQ ID NO: 136131 - DNA, 20 bp, Artificial
  CRISPR gRNA sequence
aaatttaggaagagcaagtt

SEQ ID NO: 136132 - DNA, 20 bp, Artificial
  CRISPR gRNA sequence
aatttaggaagagcaagttt

SEQ ID NO: 136133 - DNA, 20 bp, Artificial
  CRISPR gRNA sequence
atttaggaagagcaagtttg

SEQ ID NO: 136134 - DNA, 20 bp, Artificial
  CRISPR gRNA sequence
tttaggaagagcaagtttgg

SEQ ID NO: 136135 - DNA, 20 bp, Artificial
  CRISPR gRNA sequence
ttaggaagagcaagtttggg

SEQ ID NO: 136136 - DNA, 20 bp, Artificial
  CRISPR gRNA sequence
aagagcaagtttggggggaa

SEQ ID NO: 136137 - DNA, 20 bp, Artificial
  CRISPR gRNA sequence
agcaagtttggggggaaaag

SEQ ID NO: 136138 - DNA, 20 bp, Artificial
  CRISPR gRNA sequence
agtttggggggaaaagaaga

SEQ ID NO: 136139 - DNA, 20 bp, Artificial
  CRISPR gRNA sequence
aaaagaagatagatttgatt

SEQ ID NO: 136140 - DNA, 20 bp, Artificial
  CRISPR gRNA sequence
aaagaagatagatttgattt

SEQ ID NO: 136141 - DNA, 20 bp, Artificial
  CRISPR gRNA sequence
aagaagatagatttgatttg

SEQ ID NO: 136142 - DNA, 20 bp, Artificial
  CRISPR gRNA sequence
tagatttgatttggggcacg

SEQ ID NO: 136143 - DNA, 20 bp, Artificial
  CRISPR gRNA sequence
atttggggcacgtggaattt

SEQ ID NO: 136144 - DNA, 20 bp, Artificial
  CRISPR gRNA sequence
ggcacgtggaatttcagttc

SEQ ID NO: 136145 - DNA, 20 bp, Artificial
  CRISPR gRNA sequence
gcacgtggaatttcagttct

SEQ ID NO: 136146 - DNA, 20 bp, Artificial
  CRISPR gRNA sequence
cgtggaatttcagttctggg

SEQ ID NO: 136147 - DNA, 20 bp, Artificial
  CRISPR gRNA sequence
ttcagttctgggtagctttc

SEQ ID NO: 136148 - DNA, 20 bp, Artificial
  CRISPR gRNA sequence
tctgggtagctttctggttg

SEQ ID NO: 136149 - DNA, 20 bp, Artificial
  CRISPR gRNA sequence
gctttctggttgtagatgtc

SEQ ID NO: 136150 - DNA, 20 bp, Artificial
  CRISPR gRNA sequence
tctggttgtagatgtccagc

SEQ ID NO: 136151 - DNA, 20 bp, Artificial
  CRISPR gRNA sequence
ctggttgtagatgtccagcc

SEQ ID NO: 136152 - DNA, 20 bp, Artificial
  CRISPR gRNA sequence
gttgtagatgtccagccagg

SEQ ID NO: 136153 - DNA, 20 bp, Artificial
  CRISPR gRNA sequence
agccaggcagcttgtacatg

SEQ ID NO: 136154 - DNA, 20 bp, Artificial
  CRISPR gRNA sequence
gccaggcagcttgtacatga

SEQ ID NO: 136155 - DNA, 20 bp, Artificial
  CRISPR gRNA sequence
agcttgtacatgaaggactg

SEQ ID NO: 136156 - DNA, 20 bp, Artificial
  CRISPR gRNA sequence
tacatgaaggactgaagctt

SEQ ID NO: 136157 - DNA, 20 bp, Artificial
  CRISPR gRNA sequence
catgaaggactgaagctttg

SEQ ID NO: 136158 - DNA, 20 bp, Artificial
  CRISPR gRNA sequence
ctttggagaaatatcaaaat

SEQ ID NO: 136159 - DNA, 20 bp, Artificial
  CRISPR gRNA sequence
caaaattggtaatgtatatt

SEQ ID NO: 136160 - DNA, 20 bp, Artificial
  CRISPR gRNA sequence
ggtaatgtatatttggaatt

SEQ ID NO: 136161 - DNA, 20 bp, Artificial
  CRISPR gRNA sequence
gtaatgtatatttggaattt

SEQ ID NO: 136162 - DNA, 20 bp, Artificial
  CRISPR gRNA sequence
atatttggaatttaggatca

SEQ ID NO: 136163 - DNA, 20 bp, Artificial
  CRISPR gRNA sequence
atttggaatttaggatcata

SEQ ID NO: 136164 - DNA, 20 bp, Artificial
  CRISPR gRNA sequence
atttaggatcatagagatta

SEQ ID NO: 136165 - DNA, 20 bp, Artificial
  CRISPR gRNA sequence
atagagattatagctgaacc

SEQ ID NO: 136166 - DNA, 20 bp, Artificial
  CRISPR gRNA sequence
tagagattatagctgaacct

SEQ ID NO: 136167 - DNA, 20 bp, Artificial
  CRISPR gRNA sequence
agagattatagctgaaccta

SEQ ID NO: 136168 - DNA, 20 bp, Artificial
  CRISPR gRNA sequence
gagattatagctgaacctag

SEQ ID NO: 136169 - DNA, 20 bp, Artificial
  CRISPR gRNA sequence
agctgaacctaggggacaaa

SEQ ID NO: 136170 - DNA, 20 bp, Artificial
  CRISPR gRNA sequence
gctgaacctaggggacaaac

SEQ ID NO: 136171 - DNA, 20 bp, Artificial
  CRISPR gRNA sequence
tgaacctaggggacaaacag

SEQ ID NO: 136172 - DNA, 20 bp, Artificial
  CRISPR gRNA sequence
aacctaggggacaaacagga

SEQ ID NO: 136173 - DNA, 20 bp, Artificial
  CRISPR gRNA sequence
gggacaaacaggagagaatc

SEQ ID NO: 136174 - DNA, 20 bp, Artificial
  CRISPR gRNA sequence
caaacaggagagaatcaaga

SEQ ID NO: 136175 - DNA, 20 bp, Artificial
  CRISPR gRNA sequence
aacaggagagaatcaagaaa

SEQ ID NO: 136176 - DNA, 20 bp, Artificial
  CRISPR gRNA sequence
gaatcaagaaagagaattga

SEQ ID NO: 136177 - DNA, 20 bp, Artificial
  CRISPR gRNA sequence
tcaagaaagagaattgacag

SEQ ID NO: 136178 - DNA, 20 bp, Artificial
  CRISPR gRNA sequence
aaagagaattgacagaagac

SEQ ID NO: 136179 - DNA, 20 bp, Artificial
  CRISPR gRNA sequence
ctagtgctacatgtcaaaca

SEQ ID NO: 136180 - DNA, 20 bp, Artificial
  CRISPR gRNA sequence
gtgctacatgtcaaacatgg

SEQ ID NO: 136181 - DNA, 20 bp, Artificial
  CRISPR gRNA sequence
cccaaaaatgtctgactcta

SEQ ID NO: 136182 - DNA, 20 bp, Artificial
  CRISPR gRNA sequence
aaatgtctgactctaaagtt

SEQ ID NO: 136183 - DNA, 20 bp, Artificial
  CRISPR gRNA sequence
gactctaaagttgagaaatc

SEQ ID NO: 136184 - DNA, 20 bp, Artificial
  CRISPR gRNA sequence
aagttgagaaatccagaaat

SEQ ID NO: 136185 - DNA, 20 bp, Artificial
  CRISPR gRNA sequence
gagaaatccagaaatgagca

SEQ ID NO: 136186 - DNA, 20 bp, Artificial
  CRISPR gRNA sequence
aaatccagaaatgagcatgg

SEQ ID NO: 136187 - DNA, 20 bp, Artificial
  CRISPR gRNA sequence
atccagaaatgagcatggta

SEQ ID NO: 136188 - DNA, 20 bp, Artificial
  CRISPR gRNA sequence
atgagcatggtagagtcctc

SEQ ID NO: 136189 - DNA, 20 bp, Artificial
  CRISPR gRNA sequence
tgagcatggtagagtcctct

SEQ ID NO: 136190 - DNA, 20 bp, Artificial
  CRISPR gRNA sequence
catggtagagtcctctaggt

SEQ ID NO: 136191 - DNA, 20 bp, Artificial
  CRISPR gRNA sequence
cctctaggtcagtgctctct

SEQ ID NO: 136192 - DNA, 20 bp, Artificial
  CRISPR gRNA sequence
agtgctctctaagctttttt

SEQ ID NO: 136193 - DNA, 20 bp, Artificial
  CRISPR gRNA sequence
gttgcacacccctgttttct

SEQ ID NO: 136194 - DNA, 20 bp, Artificial
  CRISPR gRNA sequence
tgagtgtgcatttcccatgt

SEQ ID NO: 136195 - DNA, 20 bp, Artificial
  CRISPR gRNA sequence
ttaatattctttattccaaa

SEQ ID NO: 136196 - DNA, 20 bp, Artificial
  CRISPR gRNA sequence
attccaaaaagttacttgct

SEQ ID NO: 136197 - DNA, 20 bp, Artificial
  CRISPR gRNA sequence
aagttacttgcttggttttt

SEQ ID NO: 136198 - DNA, 20 bp, Artificial
  CRISPR gRNA sequence
cttgcttggttttttagtat

SEQ ID NO: 136199 - DNA, 20 bp, Artificial
  CRISPR gRNA sequence
tagtattagtttactaaaaa

SEQ ID NO: 136200 - DNA, 20 bp, Artificial
  CRISPR gRNA sequence
gtattagtttactaaaaata

SEQ ID NO: 136201 - DNA, 20 bp, Artificial
  CRISPR gRNA sequence
atctgtaactccccttaatc

SEQ ID NO: 136202 - DNA, 20 bp, Artificial
  CRISPR gRNA sequence
tctgtaactccccttaatcc

SEQ ID NO: 136203 - DNA, 20 bp, Artificial
  CRISPR gRNA sequence
ttaatccaggcgtgtacaac

SEQ ID NO: 136204 - DNA, 20 bp, Artificial
  CRISPR gRNA sequence
taatccaggcgtgtacaaca

SEQ ID NO: 136205 - DNA, 20 bp, Artificial
  CRISPR gRNA sequence
caggcgtgtacaacaaggta

SEQ ID NO: 136206 - DNA, 20 bp, Artificial
  CRISPR gRNA sequence
aggcgtgtacaacaaggtaa

SEQ ID NO: 136207 - DNA, 20 bp, Artificial
  CRISPR gRNA sequence
caaggtaaaggtttcattgt

SEQ ID NO: 136208 - DNA, 20 bp, Artificial
  CRISPR gRNA sequence
gttagcctacatcttcctcg

SEQ ID NO: 136209 - DNA, 20 bp, Artificial
  CRISPR gRNA sequence
tacatcttcctcgcagtcct

SEQ ID NO: 136210 - DNA, 20 bp, Artificial
  CRISPR gRNA sequence
catcttcctcgcagtccttg

SEQ ID NO: 136211 - DNA, 20 bp, Artificial
  CRISPR gRNA sequence
ggagcaccgtatgtaataca

SEQ ID NO: 136212 - DNA, 20 bp, Artificial
  CRISPR gRNA sequence
gtaatacatggtcttctgac

SEQ ID NO: 136213 - DNA, 20 bp, Artificial
  CRISPR gRNA sequence
tctgacaagttcaactaaat

SEQ ID NO: 136214 - DNA, 20 bp, Artificial
  CRISPR gRNA sequence
ctgacaagttcaactaaatg

SEQ ID NO: 136215 - DNA, 20 bp, Artificial
  CRISPR gRNA sequence
tgacaagttcaactaaatga

SEQ ID NO: 136216 - DNA, 20 bp, Artificial
  CRISPR gRNA sequence
ctaaatgagggcatcattat

SEQ ID NO: 136217 - DNA, 20 bp, Artificial
  CRISPR gRNA sequence
agggcatcattatcagctca

SEQ ID NO: 136218 - DNA, 20 bp, Artificial
  CRISPR gRNA sequence
gggcatcattatcagctcat

SEQ ID NO: 136219 - DNA, 20 bp, Artificial
  CRISPR gRNA sequence
tcataggttaaatatttgaa

SEQ ID NO: 136220 - DNA, 20 bp, Artificial
  CRISPR gRNA sequence
ctttctgtgtgtgccttgat

SEQ ID NO: 136221 - DNA, 20 bp, Artificial
  CRISPR gRNA sequence
gtgtgtgccttgataagtaa

SEQ ID NO: 136222 - DNA, 20 bp, Artificial
  CRISPR gRNA sequence
tgccttgataagtaaaagac

SEQ ID NO: 136223 - DNA, 20 bp, Artificial
  CRISPR gRNA sequence
aaagactagaaatacttcct

SEQ ID NO: 136224 - DNA, 20 bp, Artificial
  CRISPR gRNA sequence
agaaatacttccttagaatc

SEQ ID NO: 136225 - DNA, 20 bp, Artificial
  CRISPR gRNA sequence
ggtgaccttcacttgcttta

SEQ ID NO: 136226 - DNA, 20 bp, Artificial
  CRISPR gRNA sequence
agatgtacaaatatttcctt

SEQ ID NO: 136227 - DNA, 20 bp, Artificial
  CRISPR gRNA sequence
tacaaatatttccttgagat

SEQ ID NO: 136228 - DNA, 20 bp, Artificial
  CRISPR gRNA sequence
acatataccatatctccatt

SEQ ID NO: 136229 - DNA, 20 bp, Artificial
  CRISPR gRNA sequence
ccatatctccatttggtaca

SEQ ID NO: 136230 - DNA, 20 bp, Artificial
  CRISPR gRNA sequence
tctccatttggtacaaagac

SEQ ID NO: 136231 - DNA, 20 bp, Artificial
  CRISPR gRNA sequence
ctccatttggtacaaagact

SEQ ID NO: 136232 - DNA, 20 bp, Artificial
  CRISPR gRNA sequence
aagactaggttttatttttt

SEQ ID NO: 136233 - DNA, 20 bp, Artificial
  CRISPR gRNA sequence
ttttattttttgagttgctt

SEQ ID NO: 136234 - DNA, 20 bp, Artificial
  CRISPR gRNA sequence
tttattttttgagttgcttt

SEQ ID NO: 136235 - DNA, 20 bp, Artificial
  CRISPR gRNA sequence
gggcataatcttactgattt

SEQ ID NO: 136236 - DNA, 20 bp, Artificial
  CRISPR gRNA sequence
tagctttgtaaaatctcaaa

SEQ ID NO: 136237 - DNA, 20 bp, Artificial
  CRISPR gRNA sequence
ctttgtaaaatctcaaatgg

SEQ ID NO: 136238 - DNA, 20 bp, Artificial
  CRISPR gRNA sequence
aaatggcagcatcctgcatg

SEQ ID NO: 136239 - DNA, 20 bp, Artificial
  CRISPR gRNA sequence
gctgaccaaaaatacatatg

SEQ ID NO: 136240 - DNA, 20 bp, Artificial
  CRISPR gRNA sequence
ctgaccaaaaatacatatgt

SEQ ID NO: 136241 - DNA, 20 bp, Artificial
  CRISPR gRNA sequence
aaaatacatatgtaggaatt

SEQ ID NO: 136242 - DNA, 20 bp, Artificial
  CRISPR gRNA sequence
atacatatgtaggaatttgg

SEQ ID NO: 136243 - DNA, 20 bp, Artificial
  CRISPR gRNA sequence
ggaatttggcagcatttgct

SEQ ID NO: 136244 - DNA, 20 bp, Artificial
  CRISPR gRNA sequence
tttggcagcatttgctgagc

SEQ ID NO: 136245 - DNA, 20 bp, Artificial
  CRISPR gRNA sequence
tttgctgagcaagtaattta

SEQ ID NO: 136246 - DNA, 20 bp, Artificial
  CRISPR gRNA sequence
tatagcccacatgatcattg

SEQ ID NO: 136247 - DNA, 20 bp, Artificial
  CRISPR gRNA sequence
atgatcattgtagcaccaat

SEQ ID NO: 136248 - DNA, 20 bp, Artificial
  CRISPR gRNA sequence
atcattgtagcaccaatgag

SEQ ID NO: 136249 - DNA, 20 bp, Artificial
  CRISPR gRNA sequence
cagcacacacaattaattac

SEQ ID NO: 136250 - DNA, 20 bp, Artificial
  CRISPR gRNA sequence
agcacacacaattaattacc

SEQ ID NO: 136251 - DNA, 20 bp, Artificial
  CRISPR gRNA sequence
cacaattaattaccaggaat

SEQ ID NO: 136252 - DNA, 20 bp, Artificial
  CRISPR gRNA sequence
ttaattaccaggaatgagac

SEQ ID NO: 136253 - DNA, 20 bp, Artificial
  CRISPR gRNA sequence
aatgagactagcctcatctg

SEQ ID NO: 136254 - DNA, 20 bp, Artificial
  CRISPR gRNA sequence
atgagactagcctcatctgt

SEQ ID NO: 136255 - DNA, 20 bp, Artificial
  CRISPR gRNA sequence
ctagcctcatctgtaggatt

SEQ ID NO: 136256 - DNA, 20 bp, Artificial
  CRISPR gRNA sequence
gcctcatctgtaggatttag

SEQ ID NO: 136257 - DNA, 20 bp, Artificial
  CRISPR gRNA sequence
tttagcagaatttttaatat

SEQ ID NO: 136258 - DNA, 20 bp, Artificial
  CRISPR gRNA sequence
taatataagacacctatatt

SEQ ID NO: 136259 - DNA, 20 bp, Artificial
  CRISPR gRNA sequence
agacacctatatttagtttc

SEQ ID NO: 136260 - DNA, 20 bp, Artificial
  CRISPR gRNA sequence
gacacctatatttagtttct

SEQ ID NO: 136261 - DNA, 20 bp, Artificial
  CRISPR gRNA sequence
attatcctcaatctaaaata

SEQ ID NO: 136262 - DNA, 20 bp, Artificial
  CRISPR gRNA sequence
ttatcctcaatctaaaataa

SEQ ID NO: 136263 - DNA, 20 bp, Artificial
  CRISPR gRNA sequence
caatctaaaataaaggcaat

SEQ ID NO: 136264 - DNA, 20 bp, Artificial
  CRISPR gRNA sequence
ggcaataagaaacttttcac

SEQ ID NO: 136265 - DNA, 20 bp, Artificial
  CRISPR gRNA sequence
caataagaaacttttcacta

SEQ ID NO: 136266 - DNA, 20 bp, Artificial
  CRISPR gRNA sequence
gaaacttttcactagagaaa

SEQ ID NO: 136267 - DNA, 20 bp, Artificial
  CRISPR gRNA sequence
acttttcactagagaaatag

SEQ ID NO: 136268 - DNA, 20 bp, Artificial
  CRISPR gRNA sequence
gagaaatagtggtaaatttc

SEQ ID NO: 136269 - DNA, 20 bp, Artificial
  CRISPR gRNA sequence
ctccatgattattttcctct

SEQ ID NO: 136270 - DNA, 20 bp, Artificial
  CRISPR gRNA sequence
ttttcctcttggaaattcat

SEQ ID NO: 136271 - DNA, 20 bp, Artificial
  CRISPR gRNA sequence
cctcttggaaattcattggc

SEQ ID NO: 136272 - DNA, 20 bp, Artificial
  CRISPR gRNA sequence
tcattggccagatgcccatg

SEQ ID NO: 136273 - DNA, 20 bp, Artificial
  CRISPR gRNA sequence
tgcccatgaagctccccttg

SEQ ID NO: 136274 - DNA, 20 bp, Artificial
  CRISPR gRNA sequence
gcccatgaagctccccttga

SEQ ID NO: 136275 - DNA, 20 bp, Artificial
  CRISPR gRNA sequence
catgaagctccccttgaagg

SEQ ID NO: 136276 - DNA, 20 bp, Artificial
  CRISPR gRNA sequence
agctccccttgaaggtggtt

SEQ ID NO: 136277 - DNA, 20 bp, Artificial
  CRISPR gRNA sequence
aaggtggttaagcaatgtaa

SEQ ID NO: 136278 - DNA, 20 bp, Artificial
  CRISPR gRNA sequence
ttaagcaatgtaatagaatg

SEQ ID NO: 136279 - DNA, 20 bp, Artificial
  CRISPR gRNA sequence
gaatgcagtgtttatatgaa

SEQ ID NO: 136280 - DNA, 20 bp, Artificial
  CRISPR gRNA sequence
tttatatgaatagtacttta

SEQ ID NO: 136281 - DNA, 20 bp, Artificial
  CRISPR gRNA sequence
tatgaatagtactttatagt

SEQ ID NO: 136282 - DNA, 20 bp, Artificial
  CRISPR gRNA sequence
atagtactttatagttagtg

SEQ ID NO: 136283 - DNA, 20 bp, Artificial
  CRISPR gRNA sequence
ttcatactcattctcttatt

SEQ ID NO: 136284 - DNA, 20 bp, Artificial
  CRISPR gRNA sequence
atttggtatctacctaatgt

SEQ ID NO: 136285 - DNA, 20 bp, Artificial
  CRISPR gRNA sequence
tggtatctacctaatgtaag

SEQ ID NO: 136286 - DNA, 20 bp, Artificial
  CRISPR gRNA sequence
ggtatctacctaatgtaagt

SEQ ID NO: 136287 - DNA, 20 bp, Artificial
  CRISPR gRNA sequence
tctacctaatgtaagtagga

SEQ ID NO: 136288 - DNA, 20 bp, Artificial
  CRISPR gRNA sequence
cgattatcatcccccatttt

SEQ ID NO: 136289 - DNA, 20 bp, Artificial
  CRISPR gRNA sequence
gattatcatcccccattttg

SEQ ID NO: 136290 - DNA, 20 bp, Artificial
  CRISPR gRNA sequence
attatcatcccccattttga

SEQ ID NO: 136291 - DNA, 20 bp, Artificial
  CRISPR gRNA sequence
tcatcccccattttgagggt

SEQ ID NO: 136292 - DNA, 20 bp, Artificial
  CRISPR gRNA sequence
ccattttgagggtgagaaaa

SEQ ID NO: 136293 - DNA, 20 bp, Artificial
  CRISPR gRNA sequence
ttttgagggtgagaaaatag

SEQ ID NO: 136294 - DNA, 20 bp, Artificial
  CRISPR gRNA sequence
tttgagggtgagaaaataga

SEQ ID NO: 136295 - DNA, 20 bp, Artificial
  CRISPR gRNA sequence
gagggtgagaaaatagaagg

SEQ ID NO: 136296 - DNA, 20 bp, Artificial
  CRISPR gRNA sequence
gggtgagaaaatagaaggca

SEQ ID NO: 136297 - DNA, 20 bp, Artificial
  CRISPR gRNA sequence
agaaaatagaaggcagagcc

SEQ ID NO: 136298 - DNA, 20 bp, Artificial
  CRISPR gRNA sequence
gaaggcagagcctagtgaca

SEQ ID NO: 136299 - DNA, 20 bp, Artificial
  CRISPR gRNA sequence
aaggcagagcctagtgacaa

SEQ ID NO: 136300 - DNA, 20 bp, Artificial
  CRISPR gRNA sequence
ttcttaccatatatgaaaaa

SEQ ID NO: 136301 - DNA, 20 bp, Artificial
  CRISPR gRNA sequence
catatatgaaaaacagtcta

SEQ ID NO: 136302 - DNA, 20 bp, Artificial
  CRISPR gRNA sequence
tctatagctgtgtccatctt

SEQ ID NO: 136303 - DNA, 20 bp, Artificial
  CRISPR gRNA sequence
ctatagctgtgtccatcttc

SEQ ID NO: 136304 - DNA, 20 bp, Artificial
  CRISPR gRNA sequence
tatagctgtgtccatcttcg

SEQ ID NO: 136305 - DNA, 20 bp, Artificial
  CRISPR gRNA sequence
catacttgcttctcccctga

SEQ ID NO: 136306 - DNA, 20 bp, Artificial
  CRISPR gRNA sequence
atacttgcttctcccctgaa

SEQ ID NO: 136307 - DNA, 20 bp, Artificial
  CRISPR gRNA sequence
tgcttctcccctgaaaggca

SEQ ID NO: 136308 - DNA, 20 bp, Artificial
  CRISPR gRNA sequence
tgaaaggcacagaactttcc

SEQ ID NO: 136309 - DNA, 20 bp, Artificial
  CRISPR gRNA sequence
aaaggcacagaactttccca

SEQ ID NO: 136310 - DNA, 20 bp, Artificial
  CRISPR gRNA sequence
tctcatcaactctcatatta

SEQ ID NO: 136311 - DNA, 20 bp, Artificial
  CRISPR gRNA sequence
tcatattatagactgcttaa

SEQ ID NO: 136312 - DNA, 20 bp, Artificial
  CRISPR gRNA sequence
catattatagactgcttaac

SEQ ID NO: 136313 - DNA, 20 bp, Artificial
  CRISPR gRNA sequence
tgcttaacaggctaatcgta

SEQ ID NO: 136314 - DNA, 20 bp, Artificial
  CRISPR gRNA sequence
gcttaacaggctaatcgtaa

SEQ ID NO: 136315 - DNA, 20 bp, Artificial
  CRISPR gRNA sequence
cttaacaggctaatcgtaaa

SEQ ID NO: 136316 - DNA, 20 bp, Artificial
  CRISPR gRNA sequence
tcgtaaagggaacaaacata

SEQ ID NO: 136317 - DNA, 20 bp, Artificial
  CRISPR gRNA sequence
gtcaaattgaattaccttta

SEQ ID NO: 136318 - DNA, 20 bp, Artificial
  CRISPR gRNA sequence
ctttaaagtgtttgttaaaa

SEQ ID NO: 136319 - DNA, 20 bp, Artificial
  CRISPR gRNA sequence
tttaaagtgtttgttaaaat

SEQ ID NO: 136320 - DNA, 20 bp, Artificial
  CRISPR gRNA sequence
tttgttaaaataggtgaaca

SEQ ID NO: 136321 - DNA, 20 bp, Artificial
  CRISPR gRNA sequence
aggtgaacacggtcactttt

SEQ ID NO: 136322 - DNA, 20 bp, Artificial
  CRISPR gRNA sequence
cacggtcactttttggaaca

SEQ ID NO: 136323 - DNA, 20 bp, Artificial
  CRISPR gRNA sequence
tcactttttggaacaaagca

SEQ ID NO: 136324 - DNA, 20 bp, Artificial
  CRISPR gRNA sequence
tttggaacaaagcatggtac

SEQ ID NO: 136325 - DNA, 20 bp, Artificial
  CRISPR gRNA sequence
ggaacaaagcatggtacaag

SEQ ID NO: 136326 - DNA, 20 bp, Artificial
  CRISPR gRNA sequence
ggtacaagtagataacaatt

SEQ ID NO: 136327 - DNA, 20 bp, Artificial
  CRISPR gRNA sequence
agataacaattgagcactac

SEQ ID NO: 136328 - DNA, 20 bp, Artificial
  CRISPR gRNA sequence
attgagcactaccagtattt

SEQ ID NO: 136329 - DNA, 20 bp, Artificial
  CRISPR gRNA sequence
taatgaatcctaaattcact

SEQ ID NO: 136330 - DNA, 20 bp, Artificial
  CRISPR gRNA sequence
aatgaatcctaaattcacta

SEQ ID NO: 136331 - DNA, 20 bp, Artificial
  CRISPR gRNA sequence
aatcctaaattcactaaggt

SEQ ID NO: 136332 - DNA, 20 bp, Artificial
  CRISPR gRNA sequence
atcctaaattcactaaggtc

SEQ ID NO: 136333 - DNA, 20 bp, Artificial
  CRISPR gRNA sequence
taaattcactaaggtcaggt

SEQ ID NO: 136334 - DNA, 20 bp, Artificial
  CRISPR gRNA sequence
attcactaaggtcaggtaag

SEQ ID NO: 136335 - DNA, 20 bp, Artificial
  CRISPR gRNA sequence
taaggtcaggtaagtagttg

SEQ ID NO: 136336 - DNA, 20 bp, Artificial
  CRISPR gRNA sequence
aaggtcaggtaagtagttga

SEQ ID NO: 136337 - DNA, 20 bp, Artificial
  CRISPR gRNA sequence
gttgaaggattttttccaaa

SEQ ID NO: 136338 - DNA, 20 bp, Artificial
  CRISPR gRNA sequence
attttttccaaatagatatg

SEQ ID NO: 136339 - DNA, 20 bp, Artificial
  CRISPR gRNA sequence
tttccaaatagatatgtggt

SEQ ID NO: 136340 - DNA, 20 bp, Artificial
  CRISPR gRNA sequence
atatgtggttagaattgtat

SEQ ID NO: 136341 - DNA, 20 bp, Artificial
  CRISPR gRNA sequence
tatgtggttagaattgtatt

SEQ ID NO: 136342 - DNA, 20 bp, Artificial
  CRISPR gRNA sequence
gaattgtattaggtattcta

SEQ ID NO: 136343 - DNA, 20 bp, Artificial
  CRISPR gRNA sequence
aggtattctatggtattcct

SEQ ID NO: 136344 - DNA, 20 bp, Artificial
  CRISPR gRNA sequence
tatggtattccttagctatg

SEQ ID NO: 136345 - DNA, 20 bp, Artificial
  CRISPR gRNA sequence
ctatgcagatacatactttg

SEQ ID NO: 136346 - DNA, 20 bp, Artificial
  CRISPR gRNA sequence
catactttgtggtatgtatt

SEQ ID NO: 136347 - DNA, 20 bp, Artificial
  CRISPR gRNA sequence
atactttgtggtatgtattg

SEQ ID NO: 136348 - DNA, 20 bp, Artificial
  CRISPR gRNA sequence
ctttgtggtatgtattgagg

SEQ ID NO: 136349 - DNA, 20 bp, Artificial
  CRISPR gRNA sequence
attgaggcagctcccacatt

SEQ ID NO: 136350 - DNA, 20 bp, Artificial
  CRISPR gRNA sequence
ttgaggcagctcccacattt

SEQ ID NO: 136351 - DNA, 20 bp, Artificial
  CRISPR gRNA sequence
tgggttctcatcttgaaaca

SEQ ID NO: 136352 - DNA, 20 bp, Artificial
  CRISPR gRNA sequence
ggttctcatcttgaaacata

SEQ ID NO: 136353 - DNA, 20 bp, Artificial
  CRISPR gRNA sequence
aacatagagatcgatatttt

SEQ ID NO: 136354 - DNA, 20 bp, Artificial
  CRISPR gRNA sequence
cgatatttttagatgaatca

SEQ ID NO: 136355 - DNA, 20 bp, Artificial
  CRISPR gRNA sequence
tatttttagatgaatcatgg

SEQ ID NO: 136356 - DNA, 20 bp, Artificial
  CRISPR gRNA sequence
ttttgttttgttttgttttt

SEQ ID NO: 136357 - DNA, 20 bp, Artificial
  CRISPR gRNA sequence
gttttgttttgtttttgaga

SEQ ID NO: 136358 - DNA, 20 bp, Artificial
  CRISPR gRNA sequence
tttgttttgtttttgagacg

SEQ ID NO: 136359 - DNA, 20 bp, Artificial
  CRISPR gRNA sequence
acggagtcttgctctgtcgc

SEQ ID NO: 136360 - DNA, 20 bp, Artificial
  CRISPR gRNA sequence
cggagtcttgctctgtcgcc

SEQ ID NO: 136361 - DNA, 20 bp, Artificial
  CRISPR gRNA sequence
gtcttgctctgtcgccaggc

SEQ ID NO: 136362 - DNA, 20 bp, Artificial
  CRISPR gRNA sequence
cttgctctgtcgccaggctg

SEQ ID NO: 136363 - DNA, 20 bp, Artificial
  CRISPR gRNA sequence
tctgtcgccaggctggagtg

SEQ ID NO: 136364 - DNA, 20 bp, Artificial
  CRISPR gRNA sequence
gtcgccaggctggagtgcag

SEQ ID NO: 136365 - DNA, 20 bp, Artificial
  CRISPR gRNA sequence
ggagtgcagtggcacgatct

SEQ ID NO: 136366 - DNA, 20 bp, Artificial
  CRISPR gRNA sequence
tcactgcaacctctgcctcc

SEQ ID NO: 136367 - DNA, 20 bp, Artificial
  CRISPR gRNA sequence
cactgcaacctctgcctccc

SEQ ID NO: 136368 - DNA, 20 bp, Artificial
  CRISPR gRNA sequence
aacctctgcctcccaggttc

SEQ ID NO: 136369 - DNA, 20 bp, Artificial
  CRISPR gRNA sequence
ttcaagcgattctcctgcct

SEQ ID NO: 136370 - DNA, 20 bp, Artificial
  CRISPR gRNA sequence
ttctcctgcctcagcctccc

SEQ ID NO: 136371 - DNA, 20 bp, Artificial
  CRISPR gRNA sequence
tcctgcctcagcctcccgag

SEQ ID NO: 136372 - DNA, 20 bp, Artificial
  CRISPR gRNA sequence
gcctcagcctcccgagtagc

SEQ ID NO: 136373 - DNA, 20 bp, Artificial
  CRISPR gRNA sequence
cctcagcctcccgagtagct

SEQ ID NO: 136374 - DNA, 20 bp, Artificial
  CRISPR gRNA sequence
ctcccgagtagctgggacta

SEQ ID NO: 136375 - DNA, 20 bp, Artificial
  CRISPR gRNA sequence
cagatgtgcgccaccacgcc

SEQ ID NO: 136376 - DNA, 20 bp, Artificial
  CRISPR gRNA sequence
ccagctaatttttgtatttt

SEQ ID NO: 136377 - DNA, 20 bp, Artificial
  CRISPR gRNA sequence
gctaatttttgtatttttag

SEQ ID NO: 136378 - DNA, 20 bp, Artificial
  CRISPR gRNA sequence
taatttttgtatttttagta

SEQ ID NO: 136379 - DNA, 20 bp, Artificial
  CRISPR gRNA sequence
ttttgtatttttagtagaga

SEQ ID NO: 136380 - DNA, 20 bp, Artificial
  CRISPR gRNA sequence
tttgtatttttagtagagac

SEQ ID NO: 136381 - DNA, 20 bp, Artificial
  CRISPR gRNA sequence
ttgtatttttagtagagacg

SEQ ID NO: 136382 - DNA, 20 bp, Artificial
  CRISPR gRNA sequence
gagacggggtttcaccatgt

SEQ ID NO: 136383 - DNA, 20 bp, Artificial
  CRISPR gRNA sequence
cggggtttcaccatgttggc

SEQ ID NO: 136384 - DNA, 20 bp, Artificial
  CRISPR gRNA sequence
gtttcaccatgttggccaga

SEQ ID NO: 136385 - DNA, 20 bp, Artificial
  CRISPR gRNA sequence
acctcgtgatctgcccgcct

SEQ ID NO: 136386 - DNA, 20 bp, Artificial
  CRISPR gRNA sequence
ctgcccgcctcagcctccca

SEQ ID NO: 136387 - DNA, 20 bp, Artificial
  CRISPR gRNA sequence
gcctcagcctcccaaagtgc

SEQ ID NO: 136388 - DNA, 20 bp, Artificial
  CRISPR gRNA sequence
cctcagcctcccaaagtgct

SEQ ID NO: 136389 - DNA, 20 bp, Artificial
  CRISPR gRNA sequence
ctcccaaagtgctgggatta

SEQ ID NO: 136390 - DNA, 20 bp, Artificial
  CRISPR gRNA sequence
tcccaaagtgctgggattac

SEQ ID NO: 136391 - DNA, 20 bp, Artificial
  CRISPR gRNA sequence
agtgctgggattacaggcgt

SEQ ID NO: 136392 - DNA, 20 bp, Artificial
  CRISPR gRNA sequence
gggattacaggcgtgagcca

SEQ ID NO: 136393 - DNA, 20 bp, Artificial
  CRISPR gRNA sequence
caggcgtgagccacggcgcc

SEQ ID NO: 136394 - DNA, 20 bp, Artificial
  CRISPR gRNA sequence
gagccacggcgcctggccca

SEQ ID NO: 136395 - DNA, 20 bp, Artificial
  CRISPR gRNA sequence
atccgttgctttaaatttcc

SEQ ID NO: 136396 - DNA, 20 bp, Artificial
  CRISPR gRNA sequence
ttataatccttgcttacccc

SEQ ID NO: 136397 - DNA, 20 bp, Artificial
  CRISPR gRNA sequence
aatccttgcttacccctagt

SEQ ID NO: 136398 - DNA, 20 bp, Artificial
  CRISPR gRNA sequence
atccttgcttacccctagtg

SEQ ID NO: 136399 - DNA, 20 bp, Artificial
  CRISPR gRNA sequence
cttgcttacccctagtgagg

SEQ ID NO: 136400 - DNA, 20 bp, Artificial
  CRISPR gRNA sequence
acccctagtgaggtggaaca

SEQ ID NO: 136401 - DNA, 20 bp, Artificial
  CRISPR gRNA sequence
cccctagtgaggtggaacaa

SEQ ID NO: 136402 - DNA, 20 bp, Artificial
  CRISPR gRNA sequence
acaaaggaattctgatttct

SEQ ID NO: 136403 - DNA, 20 bp, Artificial
  CRISPR gRNA sequence
aaaggaattctgatttcttg

SEQ ID NO: 136404 - DNA, 20 bp, Artificial
  CRISPR gRNA sequence
aaggaattctgatttcttgg

SEQ ID NO: 136405 - DNA, 20 bp, Artificial
  CRISPR gRNA sequence
attctgatttcttggaggaa

SEQ ID NO: 136406 - DNA, 20 bp, Artificial
  CRISPR gRNA sequence
tgatttcttggaggaatggc

SEQ ID NO: 136407 - DNA, 20 bp, Artificial
  CRISPR gRNA sequence
ttatcaccatgttcacaatg

SEQ ID NO: 136408 - DNA, 20 bp, Artificial
  CRISPR gRNA sequence
ccatgttcacaatgtagcga

SEQ ID NO: 136409 - DNA, 20 bp, Artificial
  CRISPR gRNA sequence
tataattttgaaacactgca

SEQ ID NO: 136410 - DNA, 20 bp, Artificial
  CRISPR gRNA sequence
ttgaaacactgcatagaatt

SEQ ID NO: 136411 - DNA, 20 bp, Artificial
  CRISPR gRNA sequence
aacactgcatagaatttagc

SEQ ID NO: 136412 - DNA, 20 bp, Artificial
  CRISPR gRNA sequence
acactgcatagaatttagcc

SEQ ID NO: 136413 - DNA, 20 bp, Artificial
  CRISPR gRNA sequence
agccaggtgattcctcctat

SEQ ID NO: 136414 - DNA, 20 bp, Artificial
  CRISPR gRNA sequence
caggtgattcctcctataag

SEQ ID NO: 136415 - DNA, 20 bp, Artificial
  CRISPR gRNA sequence
aggtgattcctcctataagt

SEQ ID NO: 136416 - DNA, 20 bp, Artificial
  CRISPR gRNA sequence
tgattcctcctataagtggg

SEQ ID NO: 136417 - DNA, 20 bp, Artificial
  CRISPR gRNA sequence
ctatgaaaacatctccaata

SEQ ID NO: 136418 - DNA, 20 bp, Artificial
  CRISPR gRNA sequence
tatgaaaacatctccaatat

SEQ ID NO: 136419 - DNA, 20 bp, Artificial
  CRISPR gRNA sequence
tgaaaacatctccaatatag

SEQ ID NO: 136420 - DNA, 20 bp, Artificial
  CRISPR gRNA sequence
gaaaacatctccaatatagg

SEQ ID NO: 136421 - DNA, 20 bp, Artificial
  CRISPR gRNA sequence
acatctccaatataggaggc

SEQ ID NO: 136422 - DNA, 20 bp, Artificial
  CRISPR gRNA sequence
catctccaatataggaggct

SEQ ID NO: 136423 - DNA, 20 bp, Artificial
  CRISPR gRNA sequence
ccaatataggaggctgggct

SEQ ID NO: 136424 - DNA, 20 bp, Artificial
  CRISPR gRNA sequence
caatataggaggctgggcta

SEQ ID NO: 136425 - DNA, 20 bp, Artificial
  CRISPR gRNA sequence
aaggctcttcttctgaatta

SEQ ID NO: 136426 - DNA, 20 bp, Artificial
  CRISPR gRNA sequence
ggctcttcttctgaattata

SEQ ID NO: 136427 - DNA, 20 bp, Artificial
  CRISPR gRNA sequence
cttcttctgaattatagaga

SEQ ID NO: 136428 - DNA, 20 bp, Artificial
  CRISPR gRNA sequence
ttcttctgaattatagagaa

SEQ ID NO: 136429 - DNA, 20 bp, Artificial
  CRISPR gRNA sequence
tctgaattatagagaaagga

SEQ ID NO: 136430 - DNA, 20 bp, Artificial
  CRISPR gRNA sequence
tgaattatagagaaaggata

SEQ ID NO: 136431 - DNA, 20 bp, Artificial
  CRISPR gRNA sequence
atagagtgacttcccatcac

SEQ ID NO: 136432 - DNA, 20 bp, Artificial
  CRISPR gRNA sequence
tagagtgacttcccatcacc

SEQ ID NO: 136433 - DNA, 20 bp, Artificial
  CRISPR gRNA sequence
acttcccatcaccaggcccc

SEQ ID NO: 136434 - DNA, 20 bp, Artificial
  CRISPR gRNA sequence
cccatcaccaggcccccaga

SEQ ID NO: 136435 - DNA, 20 bp, Artificial
  CRISPR gRNA sequence
tttctatctccacttttgtt

SEQ ID NO: 136436 - DNA, 20 bp, Artificial
  CRISPR gRNA sequence
ctatctccacttttgtttgg

SEQ ID NO: 136437 - DNA, 20 bp, Artificial
  CRISPR gRNA sequence
ctccacttttgtttggtagc

SEQ ID NO: 136438 - DNA, 20 bp, Artificial
  CRISPR gRNA sequence
acttttgtttggtagctaga

SEQ ID NO: 136439 - DNA, 20 bp, Artificial
  CRISPR gRNA sequence
tgtttggtagctagatggcc

SEQ ID NO: 136440 - DNA, 20 bp, Artificial
  CRISPR gRNA sequence
ccactcctttgatgcaactg

SEQ ID NO: 136441 - DNA, 20 bp, Artificial
  CRISPR gRNA sequence
cctttgatgcaactgcagtt

SEQ ID NO: 136442 - DNA, 20 bp, Artificial
  CRISPR gRNA sequence
tgatgcaactgcagtttagc

SEQ ID NO: 136443 - DNA, 20 bp, Artificial
  CRISPR gRNA sequence
ttagcaagcttgaaaacctt

SEQ ID NO: 136444 - DNA, 20 bp, Artificial
  CRISPR gRNA sequence
aaccttaagctttcttgttt

SEQ ID NO: 136445 - DNA, 20 bp, Artificial
  CRISPR gRNA sequence
ctttctactttgaaatgttt

SEQ ID NO: 136446 - DNA, 20 bp, Artificial
  CRISPR gRNA sequence
ctttgaaatgtttaagaatc

SEQ ID NO: 136447 - DNA, 20 bp, Artificial
  CRISPR gRNA sequence
atctggtatcttgatttttt

SEQ ID NO: 136448 - DNA, 20 bp, Artificial
  CRISPR gRNA sequence
ctggtatcttgatttttttg

SEQ ID NO: 136449 - DNA, 20 bp, Artificial
  CRISPR gRNA sequence
tttttttggagtactttttt

SEQ ID NO: 136450 - DNA, 20 bp, Artificial
  CRISPR gRNA sequence
ttttttggagtacttttttc

SEQ ID NO: 136451 - DNA, 20 bp, Artificial
  CRISPR gRNA sequence
ttttggagtacttttttcag

SEQ ID NO: 136452 - DNA, 20 bp, Artificial
  CRISPR gRNA sequence
ttggagtacttttttcagga

SEQ ID NO: 136453 - DNA, 20 bp, Artificial
  CRISPR gRNA sequence
acttttttcaggagagtgat

SEQ ID NO: 136454 - DNA, 20 bp, Artificial
  CRISPR gRNA sequence
cttttttcaggagagtgatc

SEQ ID NO: 136455 - DNA, 20 bp, Artificial
  CRISPR gRNA sequence
gagagtgatcaggaaaacga

SEQ ID NO: 136456 - DNA, 20 bp, Artificial
  CRISPR gRNA sequence
agagtgatcaggaaaacgaa

SEQ ID NO: 136457 - DNA, 20 bp, Artificial
  CRISPR gRNA sequence
tcaggaaaacgaaaggtaaa

SEQ ID NO: 136458 - DNA, 20 bp, Artificial
  CRISPR gRNA sequence
caggaaaacgaaaggtaaaa

SEQ ID NO: 136459 - DNA, 20 bp, Artificial
  CRISPR gRNA sequence
aaacgaaaggtaaaaaggcc

SEQ ID NO: 136460 - DNA, 20 bp, Artificial
  CRISPR gRNA sequence
cgaaaggtaaaaaggcctgg

SEQ ID NO: 136461 - DNA, 20 bp, Artificial
  CRISPR gRNA sequence
ggcctggtggatttgtgttc

SEQ ID NO: 136462 - DNA, 20 bp, Artificial
  CRISPR gRNA sequence
gcctggtggatttgtgttcc

SEQ ID NO: 136463 - DNA, 20 bp, Artificial
  CRISPR gRNA sequence
gtggatttgtgttccaggct

SEQ ID NO: 136464 - DNA, 20 bp, Artificial
  CRISPR gRNA sequence
tttgtgttccaggctgagaa

SEQ ID NO: 136465 - DNA, 20 bp, Artificial
  CRISPR gRNA sequence
ttccaggctgagaaaagcta

SEQ ID NO: 136466 - DNA, 20 bp, Artificial
  CRISPR gRNA sequence
tccaggctgagaaaagctat

SEQ ID NO: 136467 - DNA, 20 bp, Artificial
  CRISPR gRNA sequence
gagaaaagctataggttctt

SEQ ID NO: 136468 - DNA, 20 bp, Artificial
  CRISPR gRNA sequence
ttctgttgttatcaattcta

SEQ ID NO: 136469 - DNA, 20 bp, Artificial
  CRISPR gRNA sequence
tgttgttatcaattctaaag

SEQ ID NO: 136470 - DNA, 20 bp, Artificial
  CRISPR gRNA sequence
tgttatcaattctaaagtag

SEQ ID NO: 136471 - DNA, 20 bp, Artificial
  CRISPR gRNA sequence
gttatcaattctaaagtaga

SEQ ID NO: 136472 - DNA, 20 bp, Artificial
  CRISPR gRNA sequence
tatcaattctaaagtagaag

SEQ ID NO: 136473 - DNA, 20 bp, Artificial
  CRISPR gRNA sequence
caattctaaagtagaaggag

SEQ ID NO: 136474 - DNA, 20 bp, Artificial
  CRISPR gRNA sequence
agaaggagaagatttaatga

SEQ ID NO: 136475 - DNA, 20 bp, Artificial
  CRISPR gRNA sequence
aaggagaagatttaatgaaa

SEQ ID NO: 136476 - DNA, 20 bp, Artificial
  CRISPR gRNA sequence
gaagatttaatgaaagagca

SEQ ID NO: 136477 - DNA, 20 bp, Artificial
  CRISPR gRNA sequence
taatgaaagagcacagaact

SEQ ID NO: 136478 - DNA, 20 bp, Artificial
  CRISPR gRNA sequence
aagagcacagaactgagaat

SEQ ID NO: 136479 - DNA, 20 bp, Artificial
  CRISPR gRNA sequence
agcacagaactgagaatcag

SEQ ID NO: 136480 - DNA, 20 bp, Artificial
  CRISPR gRNA sequence
atgaattttaatttcacctg

SEQ ID NO: 136481 - DNA, 20 bp, Artificial
  CRISPR gRNA sequence
cctgtggcatatacttgtcc

SEQ ID NO: 136482 - DNA, 20 bp, Artificial
  CRISPR gRNA sequence
ttgtcctggtgaattctgcc

SEQ ID NO: 136483 - DNA, 20 bp, Artificial
  CRISPR gRNA sequence
gtgaattctgccaagttcct

SEQ ID NO: 136484 - DNA, 20 bp, Artificial
  CRISPR gRNA sequence
gccaagttcctcagtccacc

SEQ ID NO: 136485 - DNA, 20 bp, Artificial
  CRISPR gRNA sequence
ttcctcagtccacctggata

SEQ ID NO: 136486 - DNA, 20 bp, Artificial
  CRISPR gRNA sequence
gataaagtatctttatctgt

SEQ ID NO: 136487 - DNA, 20 bp, Artificial
  CRISPR gRNA sequence
ttgcttatcttatgtgttta

SEQ ID NO: 136488 - DNA, 20 bp, Artificial
  CRISPR gRNA sequence
ttatcttatgtgtttatggt

SEQ ID NO: 136489 - DNA, 20 bp, Artificial
  CRISPR gRNA sequence
aaataacatgaaactacttt

SEQ ID NO: 136490 - DNA, 20 bp, Artificial
  CRISPR gRNA sequence
taacatgaaactactttaag

SEQ ID NO: 136491 - DNA, 20 bp, Artificial
  CRISPR gRNA sequence
aaactactttaagaagtgta

SEQ ID NO: 136492 - DNA, 20 bp, Artificial
  CRISPR gRNA sequence
tgtaaagtatgtacaaatgt

SEQ ID NO: 136493 - DNA, 20 bp, Artificial
  CRISPR gRNA sequence
gtaaagtatgtacaaatgta

SEQ ID NO: 136494 - DNA, 20 bp, Artificial
  CRISPR gRNA sequence
taaagtatgtacaaatgtaa

SEQ ID NO: 136495 - DNA, 20 bp, Artificial
  CRISPR gRNA sequence
tatgtacaaatgtaagggat

SEQ ID NO: 136496 - DNA, 20 bp, Artificial
  CRISPR gRNA sequence
agggattagcataactatct

SEQ ID NO: 136497 - DNA, 20 bp, Artificial
  CRISPR gRNA sequence
cagtcactttgccctctttg

SEQ ID NO: 136498 - DNA, 20 bp, Artificial
  CRISPR gRNA sequence
gtcactttgccctctttgaa

SEQ ID NO: 136499 - DNA, 20 bp, Artificial
  CRISPR gRNA sequence
tcactttgccctctttgaag

SEQ ID NO: 136500 - DNA, 20 bp, Artificial
  CRISPR gRNA sequence
tgaagaggtctttatgttct

SEQ ID NO: 136501 - DNA, 20 bp, Artificial
  CRISPR gRNA sequence
tttatgttctcagttcctga

SEQ ID NO: 136502 - DNA, 20 bp, Artificial
  CRISPR gRNA sequence
tcctgacagctgtatacatg

SEQ ID NO: 136503 - DNA, 20 bp, Artificial
  CRISPR gRNA sequence
acagctgtatacatgaagtt

SEQ ID NO: 136504 - DNA, 20 bp, Artificial
  CRISPR gRNA sequence
agctgtatacatgaagttaa

SEQ ID NO: 136505 - DNA, 20 bp, Artificial
  CRISPR gRNA sequence
acatgaagttaagagattta

SEQ ID NO: 136506 - DNA, 20 bp, Artificial
  CRISPR gRNA sequence
aagttaagagatttatggtt

SEQ ID NO: 136507 - DNA, 20 bp, Artificial
  CRISPR gRNA sequence
taagagatttatggtttggt

SEQ ID NO: 136508 - DNA, 20 bp, Artificial
  CRISPR gRNA sequence
gatttatggtttggttggct

SEQ ID NO: 136509 - DNA, 20 bp, Artificial
  CRISPR gRNA sequence
ttatggtttggttggcttgg

SEQ ID NO: 136510 - DNA, 20 bp, Artificial
  CRISPR gRNA sequence
ttaaacatttaaatcaataa

SEQ ID NO: 136511 - DNA, 20 bp, Artificial
  CRISPR gRNA sequence
aatcaataaaagacactaaa

SEQ ID NO: 136512 - DNA, 20 bp, Artificial
  CRISPR gRNA sequence
tcaataaaagacactaaaca

SEQ ID NO: 136513 - DNA, 20 bp, Artificial
  CRISPR gRNA sequence
caataaaagacactaaacag

SEQ ID NO: 136514 - DNA, 20 bp, Artificial
  CRISPR gRNA sequence
aataaaagacactaaacaga

SEQ ID NO: 136515 - DNA, 20 bp, Artificial
  CRISPR gRNA sequence
aaaagacactaaacagaggg

SEQ ID NO: 136516 - DNA, 20 bp, Artificial
  CRISPR gRNA sequence
taaacagagggaagaattca

SEQ ID NO: 136517 - DNA, 20 bp, Artificial
  CRISPR gRNA sequence
aattcacagtgtatctgaat

SEQ ID NO: 136518 - DNA, 20 bp, Artificial
  CRISPR gRNA sequence
tcacagtgtatctgaatgag

SEQ ID NO: 136519 - DNA, 20 bp, Artificial
  CRISPR gRNA sequence
gtatctgaatgagcagaatc

SEQ ID NO: 136520 - DNA, 20 bp, Artificial
  CRISPR gRNA sequence
ctgaatgagcagaatctaga

SEQ ID NO: 136521 - DNA, 20 bp, Artificial
  CRISPR gRNA sequence
aatgagcagaatctagacag

SEQ ID NO: 136522 - DNA, 20 bp, Artificial
  CRISPR gRNA sequence
tctagacagcagaatcaata

SEQ ID NO: 136523 - DNA, 20 bp, Artificial
  CRISPR gRNA sequence
acagcagaatcaatacagcc

SEQ ID NO: 136524 - DNA, 20 bp, Artificial
  CRISPR gRNA sequence
gacattattataacgccctc

SEQ ID NO: 136525 - DNA, 20 bp, Artificial
  CRISPR gRNA sequence
acattattataacgccctct

SEQ ID NO: 136526 - DNA, 20 bp, Artificial
  CRISPR gRNA sequence
cccctgtcccaccacccccc

SEQ ID NO: 136527 - DNA, 20 bp, Artificial
  CRISPR gRNA sequence
cccaccacccccctggtttt

SEQ ID NO: 136528 - DNA, 20 bp, Artificial
  CRISPR gRNA sequence
ccctggtttttagatgtatt

SEQ ID NO: 136529 - DNA, 20 bp, Artificial
  CRISPR gRNA sequence
ttttagatgtattaagtcac

SEQ ID NO: 136530 - DNA, 20 bp, Artificial
  CRISPR gRNA sequence
cagcacaatctcccattttt

SEQ ID NO: 136531 - DNA, 20 bp, Artificial
  CRISPR gRNA sequence
cacaatctcccatttttcag

SEQ ID NO: 136532 - DNA, 20 bp, Artificial
  CRISPR gRNA sequence
caatctcccatttttcagtg

SEQ ID NO: 136533 - DNA, 20 bp, Artificial
  CRISPR gRNA sequence
ttttcagtggagccgatgat

SEQ ID NO: 136534 - DNA, 20 bp, Artificial
  CRISPR gRNA sequence
ataattgtctacattttcca

SEQ ID NO: 136535 - DNA, 20 bp, Artificial
  CRISPR gRNA sequence
attgtctacattttccaaag

SEQ ID NO: 136536 - DNA, 20 bp, Artificial
  CRISPR gRNA sequence
tacattttccaaagtagaac

SEQ ID NO: 136537 - DNA, 20 bp, Artificial
  CRISPR gRNA sequence
tttctccaaccccactcttg

SEQ ID NO: 136538 - DNA, 20 bp, Artificial
  CRISPR gRNA sequence
cactcttgtggctcttccat

SEQ ID NO: 136539 - DNA, 20 bp, Artificial
  CRISPR gRNA sequence
ttccattggattactgcaca

SEQ ID NO: 136540 - DNA, 20 bp, Artificial
  CRISPR gRNA sequence
tccattggattactgcacaa

SEQ ID NO: 136541 - DNA, 20 bp, Artificial
  CRISPR gRNA sequence
acaaaggttactgcacaact

SEQ ID NO: 136542 - DNA, 20 bp, Artificial
  CRISPR gRNA sequence
ggttactgcacaactgagca

SEQ ID NO: 136543 - DNA, 20 bp, Artificial
  CRISPR gRNA sequence
acaactgagcacagatactt

SEQ ID NO: 136544 - DNA, 20 bp, Artificial
  CRISPR gRNA sequence
actgagcacagatacttaag

SEQ ID NO: 136545 - DNA, 20 bp, Artificial
  CRISPR gRNA sequence
ctgagcacagatacttaaga

SEQ ID NO: 136546 - DNA, 20 bp, Artificial
  CRISPR gRNA sequence
gaaggaattttcccatttca

SEQ ID NO: 136547 - DNA, 20 bp, Artificial
  CRISPR gRNA sequence
aattttcccatttcaaagaa

SEQ ID NO: 136548 - DNA, 20 bp, Artificial
  CRISPR gRNA sequence
ccatttcaaagaaaagtacc

SEQ ID NO: 136549 - DNA, 20 bp, Artificial
  CRISPR gRNA sequence
caaagaaaagtacctagaat

SEQ ID NO: 136550 - DNA, 20 bp, Artificial
  CRISPR gRNA sequence
aaagaaaagtacctagaatg

SEQ ID NO: 136551 - DNA, 20 bp, Artificial
  CRISPR gRNA sequence
aaagtacctagaatgaggcc

SEQ ID NO: 136552 - DNA, 20 bp, Artificial
  CRISPR gRNA sequence
aagtacctagaatgaggcca

SEQ ID NO: 136553 - DNA, 20 bp, Artificial
  CRISPR gRNA sequence
agaatgaggccaaggatact

SEQ ID NO: 136554 - DNA, 20 bp, Artificial
  CRISPR gRNA sequence
gaatgaggccaaggatactt

SEQ ID NO: 136555 - DNA, 20 bp, Artificial
  CRISPR gRNA sequence
aatgaggccaaggatacttg

SEQ ID NO: 136556 - DNA, 20 bp, Artificial
  CRISPR gRNA sequence
ggatacttggggtcttaaaa

SEQ ID NO: 136557 - DNA, 20 bp, Artificial
  CRISPR gRNA sequence
gtcttaaaatagttcttgtc

SEQ ID NO: 136558 - DNA, 20 bp, Artificial
  CRISPR gRNA sequence
tcttaaaatagttcttgtcc

SEQ ID NO: 136559 - DNA, 20 bp, Artificial
  CRISPR gRNA sequence
aaatagttcttgtccaggca

SEQ ID NO: 136560 - DNA, 20 bp, Artificial
  CRISPR gRNA sequence
tagttcttgtccaggcatgg

SEQ ID NO: 136561 - DNA, 20 bp, Artificial
  CRISPR gRNA sequence
gtggctcacatctgtaatcc

SEQ ID NO: 136562 - DNA, 20 bp, Artificial
  CRISPR gRNA sequence
catctgtaatcccagcactt

SEQ ID NO: 136563 - DNA, 20 bp, Artificial
  CRISPR gRNA sequence
ctgtaatcccagcactttgg

SEQ ID NO: 136564 - DNA, 20 bp, Artificial
  CRISPR gRNA sequence
tgtaatcccagcactttggc

SEQ ID NO: 136565 - DNA, 20 bp, Artificial
  CRISPR gRNA sequence
cccagcactttggcaggcca

SEQ ID NO: 136566 - DNA, 20 bp, Artificial
  CRISPR gRNA sequence
gcactttggcaggccaaagt

SEQ ID NO: 136567 - DNA, 20 bp, Artificial
  CRISPR gRNA sequence
actttggcaggccaaagtga

SEQ ID NO: 136568 - DNA, 20 bp, Artificial
  CRISPR gRNA sequence
ctttggcaggccaaagtgag

SEQ ID NO: 136569 - DNA, 20 bp, Artificial
  CRISPR gRNA sequence
ccaaagtgagaggatcactt

SEQ ID NO: 136570 - DNA, 20 bp, Artificial
  CRISPR gRNA sequence
gtgagaggatcacttgagcc

SEQ ID NO: 136571 - DNA, 20 bp, Artificial
  CRISPR gRNA sequence
tgagaggatcacttgagccc

SEQ ID NO: 136572 - DNA, 20 bp, Artificial
  CRISPR gRNA sequence
agaggatcacttgagcccag

SEQ ID NO: 136573 - DNA, 20 bp, Artificial
  CRISPR gRNA sequence
tcacttgagcccaggagttt

SEQ ID NO: 136574 - DNA, 20 bp, Artificial
  CRISPR gRNA sequence
tgagcccaggagtttgagac

SEQ ID NO: 136575 - DNA, 20 bp, Artificial
  CRISPR gRNA sequence
ccaggagtttgagaccagcc

SEQ ID NO: 136576 - DNA, 20 bp, Artificial
  CRISPR gRNA sequence
caggagtttgagaccagcct

SEQ ID NO: 136577 - DNA, 20 bp, Artificial
  CRISPR gRNA sequence
agtttgagaccagcctgggc

SEQ ID NO: 136578 - DNA, 20 bp, Artificial
  CRISPR gRNA sequence
tgagaccagcctgggcaaga

SEQ ID NO: 136579 - DNA, 20 bp, Artificial
  CRISPR gRNA sequence
accagcctgggcaagatagc

SEQ ID NO: 136580 - DNA, 20 bp, Artificial
  CRISPR gRNA sequence
ttacaaaaaattttaaaaat

SEQ ID NO: 136581 - DNA, 20 bp, Artificial
  CRISPR gRNA sequence
aaaaaattttaaaaattagc

SEQ ID NO: 136582 - DNA, 20 bp, Artificial
  CRISPR gRNA sequence
aaaaattttaaaaattagcc

SEQ ID NO: 136583 - DNA, 20 bp, Artificial
  CRISPR gRNA sequence
ttttaaaaattagccaggta

SEQ ID NO: 136584 - DNA, 20 bp, Artificial
  CRISPR gRNA sequence
taaaaattagccaggtatgg

SEQ ID NO: 136585 - DNA, 20 bp, Artificial
  CRISPR gRNA sequence
aattagccaggtatggtggc

SEQ ID NO: 136586 - DNA, 20 bp, Artificial
  CRISPR gRNA sequence
ggtatggtggcaagcacctg

SEQ ID NO: 136587 - DNA, 20 bp, Artificial
  CRISPR gRNA sequence
cacctgtagtccccgctact

SEQ ID NO: 136588 - DNA, 20 bp, Artificial
  CRISPR gRNA sequence
acctgtagtccccgctactc

SEQ ID NO: 136589 - DNA, 20 bp, Artificial
  CRISPR gRNA sequence
ctgtagtccccgctactcag

SEQ ID NO: 136590 - DNA, 20 bp, Artificial
  CRISPR gRNA sequence
tgtagtccccgctactcagg

SEQ ID NO: 136591 - DNA, 20 bp, Artificial
  CRISPR gRNA sequence
tccccgctactcaggaggct

SEQ ID NO: 136592 - DNA, 20 bp, Artificial
  CRISPR gRNA sequence
ccgctactcaggaggctgag

SEQ ID NO: 136593 - DNA, 20 bp, Artificial
  CRISPR gRNA sequence
cgctactcaggaggctgagc

SEQ ID NO: 136594 - DNA, 20 bp, Artificial
  CRISPR gRNA sequence
gctactcaggaggctgagca

SEQ ID NO: 136595 - DNA, 20 bp, Artificial
  CRISPR gRNA sequence
ctactcaggaggctgagcag

SEQ ID NO: 136596 - DNA, 20 bp, Artificial
  CRISPR gRNA sequence
actcaggaggctgagcaggg

SEQ ID NO: 136597 - DNA, 20 bp, Artificial
  CRISPR gRNA sequence
ctcaggaggctgagcagggg

SEQ ID NO: 136598 - DNA, 20 bp, Artificial
  CRISPR gRNA sequence
aggggaggatcacttgaacc

SEQ ID NO: 136599 - DNA, 20 bp, Artificial
  CRISPR gRNA sequence
ggggaggatcacttgaaccc

SEQ ID NO: 136600 - DNA, 20 bp, Artificial
  CRISPR gRNA sequence
ggaggatcacttgaacccag

SEQ ID NO: 136601 - DNA, 20 bp, Artificial
  CRISPR gRNA sequence
gaggatcacttgaacccagg

SEQ ID NO: 136602 - DNA, 20 bp, Artificial
  CRISPR gRNA sequence
tcacttgaacccaggaggtt

SEQ ID NO: 136603 - DNA, 20 bp, Artificial
  CRISPR gRNA sequence
cacttgaacccaggaggttg

SEQ ID NO: 136604 - DNA, 20 bp, Artificial
  CRISPR gRNA sequence
aacccaggaggttgaggctt

SEQ ID NO: 136605 - DNA, 20 bp, Artificial
  CRISPR gRNA sequence
caggaggttgaggcttcagt

SEQ ID NO: 136606 - DNA, 20 bp, Artificial
  CRISPR gRNA sequence
atgattacgccactgcactc

SEQ ID NO: 136607 - DNA, 20 bp, Artificial
  CRISPR gRNA sequence
tacgccactgcactccagcg

SEQ ID NO: 136608 - DNA, 20 bp, Artificial
  CRISPR gRNA sequence
acgccactgcactccagcgt

SEQ ID NO: 136609 - DNA, 20 bp, Artificial
  CRISPR gRNA sequence
ctgcactccagcgtgggcaa

SEQ ID NO: 136610 - DNA, 20 bp, Artificial
  CRISPR gRNA sequence
gcactccagcgtgggcaaca

SEQ ID NO: 136611 - DNA, 20 bp, Artificial
  CRISPR gRNA sequence
tccagcgtgggcaacagagc

SEQ ID NO: 136612 - DNA, 20 bp, Artificial
  CRISPR gRNA sequence
tttaaaaaaaattttttttt

SEQ ID NO: 136613 - DNA, 20 bp, Artificial
  CRISPR gRNA sequence
aaatttttttttaagttctt

SEQ ID NO: 136614 - DNA, 20 bp, Artificial
  CRISPR gRNA sequence
aatttttttttaagttcttg

SEQ ID NO: 136615 - DNA, 20 bp, Artificial
  CRISPR gRNA sequence
ggaacctgtgtttgttcatt

SEQ ID NO: 136616 - DNA, 20 bp, Artificial
  CRISPR gRNA sequence
acctgtgtttgttcattcag

SEQ ID NO: 136617 - DNA, 20 bp, Artificial
  CRISPR gRNA sequence
attgaatccccactatgtgc

SEQ ID NO: 136618 - DNA, 20 bp, Artificial
  CRISPR gRNA sequence
ttgaatccccactatgtgca

SEQ ID NO: 136619 - DNA, 20 bp, Artificial
  CRISPR gRNA sequence
gtgcaaggcatatttgcctt

SEQ ID NO: 136620 - DNA, 20 bp, Artificial
  CRISPR gRNA sequence
tgcaaggcatatttgccttg

SEQ ID NO: 136621 - DNA, 20 bp, Artificial
  CRISPR gRNA sequence
gcaaggcatatttgccttga

SEQ ID NO: 136622 - DNA, 20 bp, Artificial
  CRISPR gRNA sequence
tatttgccttgagggtgtat

SEQ ID NO: 136623 - DNA, 20 bp, Artificial
  CRISPR gRNA sequence
gattatgtttgtcttacaaa

SEQ ID NO: 136624 - DNA, 20 bp, Artificial
  CRISPR gRNA sequence
attatgtttgtcttacaaac

SEQ ID NO: 136625 - DNA, 20 bp, Artificial
  CRISPR gRNA sequence
ttatgtttgtcttacaaacg

SEQ ID NO: 136626 - DNA, 20 bp, Artificial
  CRISPR gRNA sequence
tatgtttgtcttacaaacgg

SEQ ID NO: 136627 - DNA, 20 bp, Artificial
  CRISPR gRNA sequence
cttacaaacgggggaaaaaa

SEQ ID NO: 136628 - DNA, 20 bp, Artificial
  CRISPR gRNA sequence
ttacaaacgggggaaaaaat

SEQ ID NO: 136629 - DNA, 20 bp, Artificial
  CRISPR gRNA sequence
acaaacgggggaaaaaatag

SEQ ID NO: 136630 - DNA, 20 bp, Artificial
  CRISPR gRNA sequence
aataggagcatgaaaaattt

SEQ ID NO: 136631 - DNA, 20 bp, Artificial
  CRISPR gRNA sequence
aataatatgccccctaaaaa

SEQ ID NO: 136632 - DNA, 20 bp, Artificial
  CRISPR gRNA sequence
taatatgccccctaaaaaaa

SEQ ID NO: 136633 - DNA, 20 bp, Artificial
  CRISPR gRNA sequence
aaaaagagaacatgttacac

SEQ ID NO: 136634 - DNA, 20 bp, Artificial
  CRISPR gRNA sequence
gaacatgttacacaagtctg

SEQ ID NO: 136635 - DNA, 20 bp, Artificial
  CRISPR gRNA sequence
atgttacacaagtctgaagc

SEQ ID NO: 136636 - DNA, 20 bp, Artificial
  CRISPR gRNA sequence
aagcaagtgaatatgctaat

SEQ ID NO: 136637 - DNA, 20 bp, Artificial
  CRISPR gRNA sequence
gcaagtgaatatgctaatta

SEQ ID NO: 136638 - DNA, 20 bp, Artificial
  CRISPR gRNA sequence
gaatatgctaattagagaaa

SEQ ID NO: 136639 - DNA, 20 bp, Artificial
  CRISPR gRNA sequence
aaatagatttgattgtgtgc

SEQ ID NO: 136640 - DNA, 20 bp, Artificial
  CRISPR gRNA sequence
aatagatttgattgtgtgcc

SEQ ID NO: 136641 - DNA, 20 bp, Artificial
  CRISPR gRNA sequence
atttgattgtgtgccaggaa

SEQ ID NO: 136642 - DNA, 20 bp, Artificial
  CRISPR gRNA sequence
gtgtgccaggaatggtttct

SEQ ID NO: 136643 - DNA, 20 bp, Artificial
  CRISPR gRNA sequence
tgtgccaggaatggtttctt

SEQ ID NO: 136644 - DNA, 20 bp, Artificial
  CRISPR gRNA sequence
gtgccaggaatggtttcttg

SEQ ID NO: 136645 - DNA, 20 bp, Artificial
  CRISPR gRNA sequence
gccaggaatggtttcttggg

SEQ ID NO: 136646 - DNA, 20 bp, Artificial
  CRISPR gRNA sequence
aaaaatttatcatcactgat

SEQ ID NO: 136647 - DNA, 20 bp, Artificial
  CRISPR gRNA sequence
atcactgattagtgaatgtg

SEQ ID NO: 136648 - DNA, 20 bp, Artificial
  CRISPR gRNA sequence
ctgattagtgaatgtgtaga

SEQ ID NO: 136649 - DNA, 20 bp, Artificial
  CRISPR gRNA sequence
ttctttacatttgtactgta

SEQ ID NO: 136650 - DNA, 20 bp, Artificial
  CRISPR gRNA sequence
tctttacatttgtactgtaa

SEQ ID NO: 136651 - DNA, 20 bp, Artificial
  CRISPR gRNA sequence
tacatttgtactgtaaaggc

SEQ ID NO: 136652 - DNA, 20 bp, Artificial
  CRISPR gRNA sequence
gcttcttatcaatgctattg

SEQ ID NO: 136653 - DNA, 20 bp, Artificial
  CRISPR gRNA sequence
tcttatcaatgctattgcag

SEQ ID NO: 136654 - DNA, 20 bp, Artificial
  CRISPR gRNA sequence
ttatcaatgctattgcagaa

SEQ ID NO: 136655 - DNA, 20 bp, Artificial
  CRISPR gRNA sequence
tgcagaagagccttaaacat

SEQ ID NO: 136656 - DNA, 20 bp, Artificial
  CRISPR gRNA sequence
aaacattggtttcaacccat

SEQ ID NO: 136657 - DNA, 20 bp, Artificial
  CRISPR gRNA sequence
attggtttcaacccatgaga

SEQ ID NO: 136658 - DNA, 20 bp, Artificial
  CRISPR gRNA sequence
ttcaacccatgagatagtct

SEQ ID NO: 136659 - DNA, 20 bp, Artificial
  CRISPR gRNA sequence
tctgagaaattccaactttc

SEQ ID NO: 136660 - DNA, 20 bp, Artificial
  CRISPR gRNA sequence
tgtttccttcatgttcactt

SEQ ID NO: 136661 - DNA, 20 bp, Artificial
  CRISPR gRNA sequence
gtttccttcatgttcacttc

SEQ ID NO: 136662 - DNA, 20 bp, Artificial
  CRISPR gRNA sequence
tcatgttcacttcaggatgt

SEQ ID NO: 136663 - DNA, 20 bp, Artificial
  CRISPR gRNA sequence
tcacttcaggatgttggata

SEQ ID NO: 136664 - DNA, 20 bp, Artificial
  CRISPR gRNA sequence
ttcaggatgttggatataga

SEQ ID NO: 136665 - DNA, 20 bp, Artificial
  CRISPR gRNA sequence
aggatgttggatatagatgg

SEQ ID NO: 136666 - DNA, 20 bp, Artificial
  CRISPR gRNA sequence
atgttggatatagatggaag

SEQ ID NO: 136667 - DNA, 20 bp, Artificial
  CRISPR gRNA sequence
tgttggatatagatggaagt

SEQ ID NO: 136668 - DNA, 20 bp, Artificial
  CRISPR gRNA sequence
tggatatagatggaagtggg

SEQ ID NO: 136669 - DNA, 20 bp, Artificial
  CRISPR gRNA sequence
gatatagatggaagtgggtg

SEQ ID NO: 136670 - DNA, 20 bp, Artificial
  CRISPR gRNA sequence
gaagtgggtggagctctctt

SEQ ID NO: 136671 - DNA, 20 bp, Artificial
  CRISPR gRNA sequence
agtgggtggagctctcttta

SEQ ID NO: 136672 - DNA, 20 bp, Artificial
  CRISPR gRNA sequence
gctctctttagagctccaaa

SEQ ID NO: 136673 - DNA, 20 bp, Artificial
  CRISPR gRNA sequence
tccaaacagaatcttttgct

SEQ ID NO: 136674 - DNA, 20 bp, Artificial
  CRISPR gRNA sequence
aacagaatcttttgcttgga

SEQ ID NO: 136675 - DNA, 20 bp, Artificial
  CRISPR gRNA sequence
agaatcttttgcttggatgg

SEQ ID NO: 136676 - DNA, 20 bp, Artificial
  CRISPR gRNA sequence
gaatcttttgcttggatggt

SEQ ID NO: 136677 - DNA, 20 bp, Artificial
  CRISPR gRNA sequence
aatcttttgcttggatggtg

SEQ ID NO: 136678 - DNA, 20 bp, Artificial
  CRISPR gRNA sequence
ttttgcttggatggtggggc

SEQ ID NO: 136679 - DNA, 20 bp, Artificial
  CRISPR gRNA sequence
tttgcttggatggtggggcc

SEQ ID NO: 136680 - DNA, 20 bp, Artificial
  CRISPR gRNA sequence
ttggatggtggggccaggtt

SEQ ID NO: 136681 - DNA, 20 bp, Artificial
  CRISPR gRNA sequence
gatggtggggccaggttgag

SEQ ID NO: 136682 - DNA, 20 bp, Artificial
  CRISPR gRNA sequence
atggtggggccaggttgagt

SEQ ID NO: 136683 - DNA, 20 bp, Artificial
  CRISPR gRNA sequence
tggtggggccaggttgagtg

SEQ ID NO: 136684 - DNA, 20 bp, Artificial
  CRISPR gRNA sequence
gtggggccaggttgagtggg

SEQ ID NO: 136685 - DNA, 20 bp, Artificial
  CRISPR gRNA sequence
aggttgagtggggagctgcc

SEQ ID NO: 136686 - DNA, 20 bp, Artificial
  CRISPR gRNA sequence
gtggggagctgcctggactc

SEQ ID NO: 136687 - DNA, 20 bp, Artificial
  CRISPR gRNA sequence
tggggagctgcctggactcc

SEQ ID NO: 136688 - DNA, 20 bp, Artificial
  CRISPR gRNA sequence
ctctaccctctaacataaac

SEQ ID NO: 136689 - DNA, 20 bp, Artificial
  CRISPR gRNA sequence
ataaacaagattcctttcac

SEQ ID NO: 136690 - DNA, 20 bp, Artificial
  CRISPR gRNA sequence
attcctttcacaagacaaaa

SEQ ID NO: 136691 - DNA, 20 bp, Artificial
  CRISPR gRNA sequence
ttcctttcacaagacaaaac

SEQ ID NO: 136692 - DNA, 20 bp, Artificial
  CRISPR gRNA sequence
acaaaacaggcacgtactcc

SEQ ID NO: 136693 - DNA, 20 bp, Artificial
  CRISPR gRNA sequence
aggcacgtactcctagcttg

SEQ ID NO: 136694 - DNA, 20 bp, Artificial
  CRISPR gRNA sequence
cacgtactcctagcttgtgg

SEQ ID NO: 136695 - DNA, 20 bp, Artificial
  CRISPR gRNA sequence
ctcctagcttgtggaagtct

SEQ ID NO: 136696 - DNA, 20 bp, Artificial
  CRISPR gRNA sequence
tcctagcttgtggaagtctt

SEQ ID NO: 136697 - DNA, 20 bp, Artificial
  CRISPR gRNA sequence
tgtggaagtcttaggtatcc

SEQ ID NO: 136698 - DNA, 20 bp, Artificial
  CRISPR gRNA sequence
gtggaagtcttaggtatcca

SEQ ID NO: 136699 - DNA, 20 bp, Artificial
  CRISPR gRNA sequence
ggaagtcttaggtatccaag

SEQ ID NO: 136700 - DNA, 20 bp, Artificial
  CRISPR gRNA sequence
gtcttaggtatccaaggaga

SEQ ID NO: 136701 - DNA, 20 bp, Artificial
  CRISPR gRNA sequence
ttaggtatccaaggagatgg

SEQ ID NO: 136702 - DNA, 20 bp, Artificial
  CRISPR gRNA sequence
ggtatccaaggagatggtgg

SEQ ID NO: 136703 - DNA, 20 bp, Artificial
  CRISPR gRNA sequence
caaggagatggtggtggttg

SEQ ID NO: 136704 - DNA, 20 bp, Artificial
  CRISPR gRNA sequence
aaggagatggtggtggttgt

SEQ ID NO: 136705 - DNA, 20 bp, Artificial
  CRISPR gRNA sequence
gtggtggttgtgggtttttt

SEQ ID NO: 136706 - DNA, 20 bp, Artificial
  CRISPR gRNA sequence
tggtggttgtgggttttttt

SEQ ID NO: 136707 - DNA, 20 bp, Artificial
  CRISPR gRNA sequence
ggtggttgtgggtttttttg

SEQ ID NO: 136708 - DNA, 20 bp, Artificial
  CRISPR gRNA sequence
tttggggtttttttttgata

SEQ ID NO: 136709 - DNA, 20 bp, Artificial
  CRISPR gRNA sequence
ttggggtttttttttgatac

SEQ ID NO: 136710 - DNA, 20 bp, Artificial
  CRISPR gRNA sequence
tggggtttttttttgataca

SEQ ID NO: 136711 - DNA, 20 bp, Artificial
  CRISPR gRNA sequence
acagggtctcactctgttgc

SEQ ID NO: 136712 - DNA, 20 bp, Artificial
  CRISPR gRNA sequence
cagggtctcactctgttgcc

SEQ ID NO: 136713 - DNA, 20 bp, Artificial
  CRISPR gRNA sequence
ctcactctgttgccaggctg

SEQ ID NO: 136714 - DNA, 20 bp, Artificial
  CRISPR gRNA sequence
tctgttgccaggctgaagtg

SEQ ID NO: 136715 - DNA, 20 bp, Artificial
  CRISPR gRNA sequence
gttgccaggctgaagtgcag

SEQ ID NO: 136716 - DNA, 20 bp, Artificial
  CRISPR gRNA sequence
gaagtgcagtagtgcaatca

SEQ ID NO: 136717 - DNA, 20 bp, Artificial
  CRISPR gRNA sequence
agtgcaatcatggctcattg

SEQ ID NO: 136718 - DNA, 20 bp, Artificial
  CRISPR gRNA sequence
catggctcattgcagtctcc

SEQ ID NO: 136719 - DNA, 20 bp, Artificial
  CRISPR gRNA sequence
attgcagtctcccagctcct

SEQ ID NO: 136720 - DNA, 20 bp, Artificial
  CRISPR gRNA sequence
gtctcccagctcctcggctc

SEQ ID NO: 136721 - DNA, 20 bp, Artificial
  CRISPR gRNA sequence
ctcaagtgatcctcctgccc

SEQ ID NO: 136722 - DNA, 20 bp, Artificial
  CRISPR gRNA sequence
tcctcctgccccagcctcct

SEQ ID NO: 136723 - DNA, 20 bp, Artificial
  CRISPR gRNA sequence
tcctgccccagcctcctgag

SEQ ID NO: 136724 - DNA, 20 bp, Artificial
  CRISPR gRNA sequence
tgccccagcctcctgagtag

SEQ ID NO: 136725 - DNA, 20 bp, Artificial
  CRISPR gRNA sequence
gccccagcctcctgagtagc

SEQ ID NO: 136726 - DNA, 20 bp, Artificial
  CRISPR gRNA sequence
cccagcctcctgagtagcgg

SEQ ID NO: 136727 - DNA, 20 bp, Artificial
  CRISPR gRNA sequence
ctcctgagtagcgggagcta

SEQ ID NO: 136728 - DNA, 20 bp, Artificial
  CRISPR gRNA sequence
tcctgagtagcgggagctac

SEQ ID NO: 136729 - DNA, 20 bp, Artificial
  CRISPR gRNA sequence
tacaggtgcgtgccaccaca

SEQ ID NO: 136730 - DNA, 20 bp, Artificial
  CRISPR gRNA sequence
acaggtgcgtgccaccacac

SEQ ID NO: 136731 - DNA, 20 bp, Artificial
  CRISPR gRNA sequence
taatttttttttcttttttg

SEQ ID NO: 136732 - DNA, 20 bp, Artificial
  CRISPR gRNA sequence
atttttttttcttttttgta

SEQ ID NO: 136733 - DNA, 20 bp, Artificial
  CRISPR gRNA sequence
tttttcttttttgtagagac

SEQ ID NO: 136734 - DNA, 20 bp, Artificial
  CRISPR gRNA sequence
ttttcttttttgtagagacg

SEQ ID NO: 136735 - DNA, 20 bp, Artificial
  CRISPR gRNA sequence
cgaggtctttctatgtttcc

SEQ ID NO: 136736 - DNA, 20 bp, Artificial
  CRISPR gRNA sequence
gaggtctttctatgtttccc

SEQ ID NO: 136737 - DNA, 20 bp, Artificial
  CRISPR gRNA sequence
ccaggctgatcttgaactcc

SEQ ID NO: 136738 - DNA, 20 bp, Artificial
  CRISPR gRNA sequence
caggctgatcttgaactcct

SEQ ID NO: 136739 - DNA, 20 bp, Artificial
  CRISPR gRNA sequence
gatcttgaactcctgggctc

SEQ ID NO: 136740 - DNA, 20 bp, Artificial
  CRISPR gRNA sequence
ctcaagcgatcctcctgctt

SEQ ID NO: 136741 - DNA, 20 bp, Artificial
  CRISPR gRNA sequence
cctcctgctttggcttccca

SEQ ID NO: 136742 - DNA, 20 bp, Artificial
  CRISPR gRNA sequence
ctttggcttcccaaagtgct

SEQ ID NO: 136743 - DNA, 20 bp, Artificial
  CRISPR gRNA sequence
ttcccaaagtgctgagatta

SEQ ID NO: 136744 - DNA, 20 bp, Artificial
  CRISPR gRNA sequence
tcccaaagtgctgagattac

SEQ ID NO: 136745 - DNA, 20 bp, Artificial
  CRISPR gRNA sequence
agtgctgagattacaggcat

SEQ ID NO: 136746 - DNA, 20 bp, Artificial
  CRISPR gRNA sequence
caggcatgagccaccgttcc

SEQ ID NO: 136747 - DNA, 20 bp, Artificial
  CRISPR gRNA sequence
tgagccaccgttcccagccc

SEQ ID NO: 136748 - DNA, 20 bp, Artificial
  CRISPR gRNA sequence
gagccaccgttcccagccca

SEQ ID NO: 136749 - DNA, 20 bp, Artificial
  CRISPR gRNA sequence
gccaccgttcccagcccaag

SEQ ID NO: 136750 - DNA, 20 bp, Artificial
  CRISPR gRNA sequence
agcccaaggagacatattct

SEQ ID NO: 136751 - DNA, 20 bp, Artificial
  CRISPR gRNA sequence
gagacatattctaagaattg

SEQ ID NO: 136752 - DNA, 20 bp, Artificial
  CRISPR gRNA sequence
agacatattctaagaattga

SEQ ID NO: 136753 - DNA, 20 bp, Artificial
  CRISPR gRNA sequence
atattctaagaattgaaggc

SEQ ID NO: 136754 - DNA, 20 bp, Artificial
  CRISPR gRNA sequence
tattctaagaattgaaggcc

SEQ ID NO: 136755 - DNA, 20 bp, Artificial
  CRISPR gRNA sequence
taagaattgaaggccgggcg

SEQ ID NO: 136756 - DNA, 20 bp, Artificial
  CRISPR gRNA sequence
gaattgaaggccgggcgcgg

SEQ ID NO: 136757 - DNA, 20 bp, Artificial
  CRISPR gRNA sequence
gtggctcatgcctgtaatcc

SEQ ID NO: 136758 - DNA, 20 bp, Artificial
  CRISPR gRNA sequence
tgcctgtaatcccagcactt

SEQ ID NO: 136759 - DNA, 20 bp, Artificial
  CRISPR gRNA sequence
gcctgtaatcccagcacttt

SEQ ID NO: 136760 - DNA, 20 bp, Artificial
  CRISPR gRNA sequence
ctgtaatcccagcactttgg

SEQ ID NO: 136761 - DNA, 20 bp, Artificial
  CRISPR gRNA sequence
tgtaatcccagcactttggg

SEQ ID NO: 136762 - DNA, 20 bp, Artificial
  CRISPR gRNA sequence
tcccagcactttgggaggcc

SEQ ID NO: 136763 - DNA, 20 bp, Artificial
  CRISPR gRNA sequence
cccagcactttgggaggcca

SEQ ID NO: 136764 - DNA, 20 bp, Artificial
  CRISPR gRNA sequence
agcactttgggaggccaagg

SEQ ID NO: 136765 - DNA, 20 bp, Artificial
  CRISPR gRNA sequence
gcactttgggaggccaaggt

SEQ ID NO: 136766 - DNA, 20 bp, Artificial
  CRISPR gRNA sequence
ctttgggaggccaaggtggg

SEQ ID NO: 136767 - DNA, 20 bp, Artificial
  CRISPR gRNA sequence
ggaggccaaggtgggcggat

SEQ ID NO: 136768 - DNA, 20 bp, Artificial
  CRISPR gRNA sequence
gaggccaaggtgggcggatc

SEQ ID NO: 136769 - DNA, 20 bp, Artificial
  CRISPR gRNA sequence
ggccaaggtgggcggatcag

SEQ ID NO: 136770 - DNA, 20 bp, Artificial
  CRISPR gRNA sequence
gccaaggtgggcggatcagg

SEQ ID NO: 136771 - DNA, 20 bp, Artificial
  CRISPR gRNA sequence
aggtgggcggatcaggaggt

SEQ ID NO: 136772 - DNA, 20 bp, Artificial
  CRISPR gRNA sequence
ggtgggcggatcaggaggtc

SEQ ID NO: 136773 - DNA, 20 bp, Artificial
  CRISPR gRNA sequence
tgggcggatcaggaggtcag

SEQ ID NO: 136774 - DNA, 20 bp, Artificial
  CRISPR gRNA sequence
cggatcaggaggtcaggaga

SEQ ID NO: 136775 - DNA, 20 bp, Artificial
  CRISPR gRNA sequence
gatcaggaggtcaggagatg

SEQ ID NO: 136776 - DNA, 20 bp, Artificial
  CRISPR gRNA sequence
tcaggagatggagaccatcc

SEQ ID NO: 136777 - DNA, 20 bp, Artificial
  CRISPR gRNA sequence
ggagaccatcctggctaaca

SEQ ID NO: 136778 - DNA, 20 bp, Artificial
  CRISPR gRNA sequence
tctctactaaaaatacaaaa

SEQ ID NO: 136779 - DNA, 20 bp, Artificial
  CRISPR gRNA sequence
tactaaaaatacaaaaaagt

SEQ ID NO: 136780 - DNA, 20 bp, Artificial
  CRISPR gRNA sequence
aaaaatacaaaaaagttagc

SEQ ID NO: 136781 - DNA, 20 bp, Artificial
  CRISPR gRNA sequence
aaaatacaaaaaagttagcc

SEQ ID NO: 136782 - DNA, 20 bp, Artificial
  CRISPR gRNA sequence
acaaaaaagttagccaggcg

SEQ ID NO: 136783 - DNA, 20 bp, Artificial
  CRISPR gRNA sequence
aaaaagttagccaggcgtgg

SEQ ID NO: 136784 - DNA, 20 bp, Artificial
  CRISPR gRNA sequence
aagttagccaggcgtggtgg

SEQ ID NO: 136785 - DNA, 20 bp, Artificial
  CRISPR gRNA sequence
agttagccaggcgtggtggt

SEQ ID NO: 136786 - DNA, 20 bp, Artificial
  CRISPR gRNA sequence
ggcgtggtggtgggcacctg

SEQ ID NO: 136787 - DNA, 20 bp, Artificial
  CRISPR gRNA sequence
gtggtgggcacctgtggtcc

SEQ ID NO: 136788 - DNA, 20 bp, Artificial
  CRISPR gRNA sequence
cacctgtggtcccagctact

SEQ ID NO: 136789 - DNA, 20 bp, Artificial
  CRISPR gRNA sequence
acctgtggtcccagctactt

SEQ ID NO: 136790 - DNA, 20 bp, Artificial
  CRISPR gRNA sequence
ctgtggtcccagctacttgg

SEQ ID NO: 136791 - DNA, 20 bp, Artificial
  CRISPR gRNA sequence
tgtggtcccagctacttggg

SEQ ID NO: 136792 - DNA, 20 bp, Artificial
  CRISPR gRNA sequence
tcccagctacttgggaggct

SEQ ID NO: 136793 - DNA, 20 bp, Artificial
  CRISPR gRNA sequence
cccagctacttgggaggctg

SEQ ID NO: 136794 - DNA, 20 bp, Artificial
  CRISPR gRNA sequence
agctacttgggaggctgagg

SEQ ID NO: 136795 - DNA, 20 bp, Artificial
  CRISPR gRNA sequence
gctacttgggaggctgaggc

SEQ ID NO: 136796 - DNA, 20 bp, Artificial
  CRISPR gRNA sequence
tacttgggaggctgaggcag

SEQ ID NO: 136797 - DNA, 20 bp, Artificial
  CRISPR gRNA sequence
gggaggctgaggcaggagaa

SEQ ID NO: 136798 - DNA, 20 bp, Artificial
  CRISPR gRNA sequence
gctgaggcaggagaatggtg

SEQ ID NO: 136799 - DNA, 20 bp, Artificial
  CRISPR gRNA sequence
gcaggagaatggtgtggacc

SEQ ID NO: 136800 - DNA, 20 bp, Artificial
  CRISPR gRNA sequence
caggagaatggtgtggaccc

SEQ ID NO: 136801 - DNA, 20 bp, Artificial
  CRISPR gRNA sequence
ggagaatggtgtggacccgg

SEQ ID NO: 136802 - DNA, 20 bp, Artificial
  CRISPR gRNA sequence
gagaatggtgtggacccggg

SEQ ID NO: 136803 - DNA, 20 bp, Artificial
  CRISPR gRNA sequence
tggtgtggacccgggaggcg

SEQ ID NO: 136804 - DNA, 20 bp, Artificial
  CRISPR gRNA sequence
gacccgggaggcgaagcttg

SEQ ID NO: 136805 - DNA, 20 bp, Artificial
  CRISPR gRNA sequence
cgggaggcgaagcttgcagt

SEQ ID NO: 136806 - DNA, 20 bp, Artificial
  CRISPR gRNA sequence
ggcgaagcttgcagtgagcc

SEQ ID NO: 136807 - DNA, 20 bp, Artificial
  CRISPR gRNA sequence
aagatcatgctactgcattc

SEQ ID NO: 136808 - DNA, 20 bp, Artificial
  CRISPR gRNA sequence
catgctactgcattccagcc

SEQ ID NO: 136809 - DNA, 20 bp, Artificial
  CRISPR gRNA sequence
atgctactgcattccagcct

SEQ ID NO: 136810 - DNA, 20 bp, Artificial
  CRISPR gRNA sequence
ctgcattccagcctgggtga

SEQ ID NO: 136811 - DNA, 20 bp, Artificial
  CRISPR gRNA sequence
gcattccagcctgggtgaca

SEQ ID NO: 136812 - DNA, 20 bp, Artificial
  CRISPR gRNA sequence
tccagcctgggtgacagagt

SEQ ID NO: 136813 - DNA, 20 bp, Artificial
  CRISPR gRNA sequence
ataaataattaatttaaaaa

SEQ ID NO: 136814 - DNA, 20 bp, Artificial
  CRISPR gRNA sequence
aaaaagaatttaaatgtttt

SEQ ID NO: 136815 - DNA, 20 bp, Artificial
  CRISPR gRNA sequence
gaatttaaatgtttttggat

SEQ ID NO: 136816 - DNA, 20 bp, Artificial
  CRISPR gRNA sequence
taaatgtttttggattagtg

SEQ ID NO: 136817 - DNA, 20 bp, Artificial
  CRISPR gRNA sequence
aatgtttttggattagtgtg

SEQ ID NO: 136818 - DNA, 20 bp, Artificial
  CRISPR gRNA sequence
tgtttttggattagtgtgga

SEQ ID NO: 136819 - DNA, 20 bp, Artificial
  CRISPR gRNA sequence
attagtgtggagagaaaacc

SEQ ID NO: 136820 - DNA, 20 bp, Artificial
  CRISPR gRNA sequence
tgtggagagaaaacctagta

SEQ ID NO: 136821 - DNA, 20 bp, Artificial
  CRISPR gRNA sequence
tattgatcattgacacaccc

SEQ ID NO: 136822 - DNA, 20 bp, Artificial
  CRISPR gRNA sequence
attgatcattgacacaccca

SEQ ID NO: 136823 - DNA, 20 bp, Artificial
  CRISPR gRNA sequence
cacacccaaggatttaaatt

SEQ ID NO: 136824 - DNA, 20 bp, Artificial
  CRISPR gRNA sequence
atttggaacgttcccatgtt

SEQ ID NO: 136825 - DNA, 20 bp, Artificial
  CRISPR gRNA sequence
gcttgaattctttgcttttt

SEQ ID NO: 136826 - DNA, 20 bp, Artificial
  CRISPR gRNA sequence
attctttgcttttttggaac

SEQ ID NO: 136827 - DNA, 20 bp, Artificial
  CRISPR gRNA sequence
tacatttgttccaaatttaa

SEQ ID NO: 136828 - DNA, 20 bp, Artificial
  CRISPR gRNA sequence
gttccaaatttaatagttta

SEQ ID NO: 136829 - DNA, 20 bp, Artificial
  CRISPR gRNA sequence
ttccaaatttaatagtttaa

SEQ ID NO: 136830 - DNA, 20 bp, Artificial
  CRISPR gRNA sequence
tccaaatttaatagtttaaa

SEQ ID NO: 136831 - DNA, 20 bp, Artificial
  CRISPR gRNA sequence
aaattatttcatgtttataa

SEQ ID NO: 136832 - DNA, 20 bp, Artificial
  CRISPR gRNA sequence
attatttcatgtttataaaa

SEQ ID NO: 136833 - DNA, 20 bp, Artificial
  CRISPR gRNA sequence
tttcatgtttataaaagaga

SEQ ID NO: 136834 - DNA, 20 bp, Artificial
  CRISPR gRNA sequence
ttcatgtttataaaagagat

SEQ ID NO: 136835 - DNA, 20 bp, Artificial
  CRISPR gRNA sequence
catgtttataaaagagatag

SEQ ID NO: 136836 - DNA, 20 bp, Artificial
  CRISPR gRNA sequence
tatttccatgcatctgaaac

SEQ ID NO: 136837 - DNA, 20 bp, Artificial
  CRISPR gRNA sequence
atttccatgcatctgaaact

SEQ ID NO: 136838 - DNA, 20 bp, Artificial
  CRISPR gRNA sequence
atctgaaactaggcttttta

SEQ ID NO: 136839 - DNA, 20 bp, Artificial
  CRISPR gRNA sequence
tttttaaagaaatatgtcaa

SEQ ID NO: 136840 - DNA, 20 bp, Artificial
  CRISPR gRNA sequence
aaagaaatatgtcaaaagca

SEQ ID NO: 136841 - DNA, 20 bp, Artificial
  CRISPR gRNA sequence
aaatatgtcaaaagcaaagt

SEQ ID NO: 136842 - DNA, 20 bp, Artificial
  CRISPR gRNA sequence
agcaaagtaagtctaaatta

SEQ ID NO: 136843 - DNA, 20 bp, Artificial
  CRISPR gRNA sequence
caaagtaagtctaaattata

SEQ ID NO: 136844 - DNA, 20 bp, Artificial
  CRISPR gRNA sequence
aagtctaaattatagagaaa

SEQ ID NO: 136845 - DNA, 20 bp, Artificial
  CRISPR gRNA sequence
tctaaattatagagaaaaag

SEQ ID NO: 136846 - DNA, 20 bp, Artificial
  CRISPR gRNA sequence
aattatagagaaaaagaagc

SEQ ID NO: 136847 - DNA, 20 bp, Artificial
  CRISPR gRNA sequence
atagagaaaaagaagctagt

SEQ ID NO: 136848 - DNA, 20 bp, Artificial
  CRISPR gRNA sequence
aaaagaagctagttggtctt

SEQ ID NO: 136849 - DNA, 20 bp, Artificial
  CRISPR gRNA sequence
aaagaagctagttggtcttt

SEQ ID NO: 136850 - DNA, 20 bp, Artificial
  CRISPR gRNA sequence
agctagttggtctttaggct

SEQ ID NO: 136851 - DNA, 20 bp, Artificial
  CRISPR gRNA sequence
tttaggctcggtactgtatc

SEQ ID NO: 136852 - DNA, 20 bp, Artificial
  CRISPR gRNA sequence
ttaggctcggtactgtatct

SEQ ID NO: 136853 - DNA, 20 bp, Artificial
  CRISPR gRNA sequence
gtactgtatctgggactctt

SEQ ID NO: 136854 - DNA, 20 bp, Artificial
  CRISPR gRNA sequence
gtatctgggactcttcagac

SEQ ID NO: 136855 - DNA, 20 bp, Artificial
  CRISPR gRNA sequence
tctgggactcttcagaccag

SEQ ID NO: 136856 - DNA, 20 bp, Artificial
  CRISPR gRNA sequence
ggactcttcagaccagtagt

SEQ ID NO: 136857 - DNA, 20 bp, Artificial
  CRISPR gRNA sequence
ccagtagttggtgtcttgtc

SEQ ID NO: 136858 - DNA, 20 bp, Artificial
  CRISPR gRNA sequence
gttggtgtcttgtctagctt

SEQ ID NO: 136859 - DNA, 20 bp, Artificial
  CRISPR gRNA sequence
ttggtgtcttgtctagcttc

SEQ ID NO: 136860 - DNA, 20 bp, Artificial
  CRISPR gRNA sequence
gtgtcttgtctagcttcagg

SEQ ID NO: 136861 - DNA, 20 bp, Artificial
  CRISPR gRNA sequence
catgatgatatgatgccatc

SEQ ID NO: 136862 - DNA, 20 bp, Artificial
  CRISPR gRNA sequence
tgccatctggcatttgtatg

SEQ ID NO: 136863 - DNA, 20 bp, Artificial
  CRISPR gRNA sequence
tatgaagcttgctatttttt

SEQ ID NO: 136864 - DNA, 20 bp, Artificial
  CRISPR gRNA sequence
atgaagcttgctattttttg

SEQ ID NO: 136865 - DNA, 20 bp, Artificial
  CRISPR gRNA sequence
gttttaccatttgtgtgttt

SEQ ID NO: 136866 - DNA, 20 bp, Artificial
  CRISPR gRNA sequence
tgtgtgtttcagctgctctg

SEQ ID NO: 136867 - DNA, 20 bp, Artificial
  CRISPR gRNA sequence
gtgtgtttcagctgctctgt

SEQ ID NO: 136868 - DNA, 20 bp, Artificial
  CRISPR gRNA sequence
tgctctgtgggatgttgctt

SEQ ID NO: 136869 - DNA, 20 bp, Artificial
  CRISPR gRNA sequence
gggatgttgctttagatgaa

SEQ ID NO: 136870 - DNA, 20 bp, Artificial
  CRISPR gRNA sequence
gatgttgctttagatgaata

SEQ ID NO: 136871 - DNA, 20 bp, Artificial
  CRISPR gRNA sequence
gttgctttagatgaatagag

SEQ ID NO: 136872 - DNA, 20 bp, Artificial
  CRISPR gRNA sequence
agatgaatagagaagtttct

SEQ ID NO: 136873 - DNA, 20 bp, Artificial
  CRISPR gRNA sequence
tgaatagagaagtttctaag

SEQ ID NO: 136874 - DNA, 20 bp, Artificial
  CRISPR gRNA sequence
agagaagtttctaagaagtt

SEQ ID NO: 136875 - DNA, 20 bp, Artificial
  CRISPR gRNA sequence
agaagtttctaagaagttaa

SEQ ID NO: 136876 - DNA, 20 bp, Artificial
  CRISPR gRNA sequence
agaagttaagagatttgctc

SEQ ID NO: 136877 - DNA, 20 bp, Artificial
  CRISPR gRNA sequence
aagagatttgctcaagatca

SEQ ID NO: 136878 - DNA, 20 bp, Artificial
  CRISPR gRNA sequence
tgctcaagatcacagttcgc

SEQ ID NO: 136879 - DNA, 20 bp, Artificial
  CRISPR gRNA sequence
ctcaagatcacagttcgcca

SEQ ID NO: 136880 - DNA, 20 bp, Artificial
  CRISPR gRNA sequence
caagatcacagttcgccaga

SEQ ID NO: 136881 - DNA, 20 bp, Artificial
  CRISPR gRNA sequence
tcacagttcgccagagagct

SEQ ID NO: 136882 - DNA, 20 bp, Artificial
  CRISPR gRNA sequence
gccagagagctaagaacccc

SEQ ID NO: 136883 - DNA, 20 bp, Artificial
  CRISPR gRNA sequence
ccagagagctaagaaccccc

SEQ ID NO: 136884 - DNA, 20 bp, Artificial
  CRISPR gRNA sequence
tatgtatttacctcgtgctt

SEQ ID NO: 136885 - DNA, 20 bp, Artificial
  CRISPR gRNA sequence
ttagtgcccccaactgttcg

SEQ ID NO: 136886 - DNA, 20 bp, Artificial
  CRISPR gRNA sequence
gcccccaactgttcgcagct

SEQ ID NO: 136887 - DNA, 20 bp, Artificial
  CRISPR gRNA sequence
tgttcgcagctgagtattca

SEQ ID NO: 136888 - DNA, 20 bp, Artificial
  CRISPR gRNA sequence
gttcgcagctgagtattcat

SEQ ID NO: 136889 - DNA, 20 bp, Artificial
  CRISPR gRNA sequence
ataggtgctgctaacctgcc

SEQ ID NO: 136890 - DNA, 20 bp, Artificial
  CRISPR gRNA sequence
aggtgctgctaacctgccta

SEQ ID NO: 136891 - DNA, 20 bp, Artificial
  CRISPR gRNA sequence
aacctgcctagagacatgca

SEQ ID NO: 136892 - DNA, 20 bp, Artificial
  CRISPR gRNA sequence
acctgcctagagacatgcaa

SEQ ID NO: 136893 - DNA, 20 bp, Artificial
  CRISPR gRNA sequence
cctgcctagagacatgcaaa

SEQ ID NO: 136894 - DNA, 20 bp, Artificial
  CRISPR gRNA sequence
ctgcctagagacatgcaaag

SEQ ID NO: 136895 - DNA, 20 bp, Artificial
  CRISPR gRNA sequence
cctagagacatgcaaagggg

SEQ ID NO: 136896 - DNA, 20 bp, Artificial
  CRISPR gRNA sequence
ctagagacatgcaaagggga

SEQ ID NO: 136897 - DNA, 20 bp, Artificial
  CRISPR gRNA sequence
tgcaaaggggaaggataaaa

SEQ ID NO: 136898 - DNA, 20 bp, Artificial
  CRISPR gRNA sequence
aggggaaggataaaacagaa

SEQ ID NO: 136899 - DNA, 20 bp, Artificial
  CRISPR gRNA sequence
ggataaaacagaaaagaaaa

SEQ ID NO: 136900 - DNA, 20 bp, Artificial
  CRISPR gRNA sequence
ataaaacagaaaagaaaaaa

SEQ ID NO: 136901 - DNA, 20 bp, Artificial
  CRISPR gRNA sequence
cagaaaagaaaaaagagtga

SEQ ID NO: 136902 - DNA, 20 bp, Artificial
  CRISPR gRNA sequence
aaaaagagtgacagcttaaa

SEQ ID NO: 136903 - DNA, 20 bp, Artificial
  CRISPR gRNA sequence
gacagcttaaacagtgcaaa

SEQ ID NO: 136904 - DNA, 20 bp, Artificial
  CRISPR gRNA sequence
agcttaaacagtgcaaaaag

SEQ ID NO: 136905 - DNA, 20 bp, Artificial
  CRISPR gRNA sequence
gcttaaacagtgcaaaaagt

SEQ ID NO: 136906 - DNA, 20 bp, Artificial
  CRISPR gRNA sequence
aaacagtgcaaaaagtggga

SEQ ID NO: 136907 - DNA, 20 bp, Artificial
  CRISPR gRNA sequence
acagtgcaaaaagtgggaaa

SEQ ID NO: 136908 - DNA, 20 bp, Artificial
  CRISPR gRNA sequence
tgcaaaaagtgggaaagagc

SEQ ID NO: 136909 - DNA, 20 bp, Artificial
  CRISPR gRNA sequence
agagcaagttataataaatc

SEQ ID NO: 136910 - DNA, 20 bp, Artificial
  CRISPR gRNA sequence
caagttataataaatcaaga

SEQ ID NO: 136911 - DNA, 20 bp, Artificial
  CRISPR gRNA sequence
aataaatcaagacagaattt

SEQ ID NO: 136912 - DNA, 20 bp, Artificial
  CRISPR gRNA sequence
taaatcaagacagaatttta

SEQ ID NO: 136913 - DNA, 20 bp, Artificial
  CRISPR gRNA sequence
atttattgtattgtgatctt

SEQ ID NO: 136914 - DNA, 20 bp, Artificial
  CRISPR gRNA sequence
attgtattgtgatcttgagc

SEQ ID NO: 136915 - DNA, 20 bp, Artificial
  CRISPR gRNA sequence
ctcaaccttatctgtaaaat

SEQ ID NO: 136916 - DNA, 20 bp, Artificial
  CRISPR gRNA sequence
ctgtaaaattggaataatat

SEQ ID NO: 136917 - DNA, 20 bp, Artificial
  CRISPR gRNA sequence
atattggtaaatttatcact

SEQ ID NO: 136918 - DNA, 20 bp, Artificial
  CRISPR gRNA sequence
ggtaaatttatcactgagct

SEQ ID NO: 136919 - DNA, 20 bp, Artificial
  CRISPR gRNA sequence
aatttatcactgagctaagt

SEQ ID NO: 136920 - DNA, 20 bp, Artificial
  CRISPR gRNA sequence
atttatcactgagctaagta

SEQ ID NO: 136921 - DNA, 20 bp, Artificial
  CRISPR gRNA sequence
tttatcactgagctaagtaa

SEQ ID NO: 136922 - DNA, 20 bp, Artificial
  CRISPR gRNA sequence
gagctaagtaagggtcaatt

SEQ ID NO: 136923 - DNA, 20 bp, Artificial
  CRISPR gRNA sequence
agctaagtaagggtcaattg

SEQ ID NO: 136924 - DNA, 20 bp, Artificial
  CRISPR gRNA sequence
tcaattgaggatgatgtatg

SEQ ID NO: 136925 - DNA, 20 bp, Artificial
  CRISPR gRNA sequence
catgtattttatgaactctg

SEQ ID NO: 136926 - DNA, 20 bp, Artificial
  CRISPR gRNA sequence
ttatgaactctgaagcccgt

SEQ ID NO: 136927 - DNA, 20 bp, Artificial
  CRISPR gRNA sequence
gaactctgaagcccgtaagt

SEQ ID NO: 136928 - DNA, 20 bp, Artificial
  CRISPR gRNA sequence
ggcatctatgaaacattctt

SEQ ID NO: 136929 - DNA, 20 bp, Artificial
  CRISPR gRNA sequence
atcacacttcttccctctgc

SEQ ID NO: 136930 - DNA, 20 bp, Artificial
  CRISPR gRNA sequence
ctctgctagacacacaaaca

SEQ ID NO: 136931 - DNA, 20 bp, Artificial
  CRISPR gRNA sequence
tctgctagacacacaaacac

SEQ ID NO: 136932 - DNA, 20 bp, Artificial
  CRISPR gRNA sequence
acacaaacacaggatactgc

SEQ ID NO: 136933 - DNA, 20 bp, Artificial
  CRISPR gRNA sequence
cacaggatactgccagaaac

SEQ ID NO: 136934 - DNA, 20 bp, Artificial
  CRISPR gRNA sequence
acaggatactgccagaaact

SEQ ID NO: 136935 - DNA, 20 bp, Artificial
  CRISPR gRNA sequence
gatactgccagaaactgggc

SEQ ID NO: 136936 - DNA, 20 bp, Artificial
  CRISPR gRNA sequence
tactgccagaaactgggcaa

SEQ ID NO: 136937 - DNA, 20 bp, Artificial
  CRISPR gRNA sequence
actgccagaaactgggcaag

SEQ ID NO: 136938 - DNA, 20 bp, Artificial
  CRISPR gRNA sequence
aagaggctgtttgtgaatct

SEQ ID NO: 136939 - DNA, 20 bp, Artificial
  CRISPR gRNA sequence
aggctgtttgtgaatctcag

SEQ ID NO: 136940 - DNA, 20 bp, Artificial
  CRISPR gRNA sequence
ggctgtttgtgaatctcaga

SEQ ID NO: 136941 - DNA, 20 bp, Artificial
  CRISPR gRNA sequence
tgtgaatctcagaaggcacc

SEQ ID NO: 136942 - DNA, 20 bp, Artificial
  CRISPR gRNA sequence
aatctcagaaggcacccggt

SEQ ID NO: 136943 - DNA, 20 bp, Artificial
  CRISPR gRNA sequence
aagaaaatgatgctttgttt

SEQ ID NO: 136944 - DNA, 20 bp, Artificial
  CRISPR gRNA sequence
ttttagaatacaacttaact

SEQ ID NO: 136945 - DNA, 20 bp, Artificial
  CRISPR gRNA sequence
tttagaatacaacttaactt

SEQ ID NO: 136946 - DNA, 20 bp, Artificial
  CRISPR gRNA sequence
atacaacttaacttaggcta

SEQ ID NO: 136947 - DNA, 20 bp, Artificial
  CRISPR gRNA sequence
tacaacttaacttaggctac

SEQ ID NO: 136948 - DNA, 20 bp, Artificial
  CRISPR gRNA sequence
acaggcactctttctgtctc

SEQ ID NO: 136949 - DNA, 20 bp, Artificial
  CRISPR gRNA sequence
ctcatgtcacaattcctttt

SEQ ID NO: 136950 - DNA, 20 bp, Artificial
  CRISPR gRNA sequence
tcatgtcacaattccttttc

SEQ ID NO: 136951 - DNA, 20 bp, Artificial
  CRISPR gRNA sequence
cacaattccttttcgggatt

SEQ ID NO: 136952 - DNA, 20 bp, Artificial
  CRISPR gRNA sequence
acaattccttttcgggattg

SEQ ID NO: 136953 - DNA, 20 bp, Artificial
  CRISPR gRNA sequence
gggattgaggcctgaaaaac

SEQ ID NO: 136954 - DNA, 20 bp, Artificial
  CRISPR gRNA sequence
ttactcaccattcttcctac

SEQ ID NO: 136955 - DNA, 20 bp, Artificial
  CRISPR gRNA sequence
tactcaccattcttcctaca

SEQ ID NO: 136956 - DNA, 20 bp, Artificial
  CRISPR gRNA sequence
acaaggatttatttactcgt

SEQ ID NO: 136957 - DNA, 20 bp, Artificial
  CRISPR gRNA sequence
caaggatttatttactcgtt

SEQ ID NO: 136958 - DNA, 20 bp, Artificial
  CRISPR gRNA sequence
gatttatttactcgttaggc

SEQ ID NO: 136959 - DNA, 20 bp, Artificial
  CRISPR gRNA sequence
tttatttactcgttaggctg

SEQ ID NO: 136960 - DNA, 20 bp, Artificial
  CRISPR gRNA sequence
ttatttactcgttaggctgg

SEQ ID NO: 136961 - DNA, 20 bp, Artificial
  CRISPR gRNA sequence
tatttactcgttaggctgga

SEQ ID NO: 136962 - DNA, 20 bp, Artificial
  CRISPR gRNA sequence
tactcgttaggctggagggt

SEQ ID NO: 136963 - DNA, 20 bp, Artificial
  CRISPR gRNA sequence
ctcgttaggctggagggtca

SEQ ID NO: 136964 - DNA, 20 bp, Artificial
  CRISPR gRNA sequence
cgttaggctggagggtcaga

SEQ ID NO: 136965 - DNA, 20 bp, Artificial
  CRISPR gRNA sequence
tggagggtcagagagactaa

SEQ ID NO: 136966 - DNA, 20 bp, Artificial
  CRISPR gRNA sequence
gagactaacagatacttctg

SEQ ID NO: 136967 - DNA, 20 bp, Artificial
  CRISPR gRNA sequence
agactaacagatacttctgt

SEQ ID NO: 136968 - DNA, 20 bp, Artificial
  CRISPR gRNA sequence
gactaacagatacttctgtg

SEQ ID NO: 136969 - DNA, 20 bp, Artificial
  CRISPR gRNA sequence
taacagatacttctgtgggg

SEQ ID NO: 136970 - DNA, 20 bp, Artificial
  CRISPR gRNA sequence
acagatacttctgtggggca

SEQ ID NO: 136971 - DNA, 20 bp, Artificial
  CRISPR gRNA sequence
cagatacttctgtggggcag

SEQ ID NO: 136972 - DNA, 20 bp, Artificial
  CRISPR gRNA sequence
agatacttctgtggggcaga

SEQ ID NO: 136973 - DNA, 20 bp, Artificial
  CRISPR gRNA sequence
gatacttctgtggggcagag

SEQ ID NO: 136974 - DNA, 20 bp, Artificial
  CRISPR gRNA sequence
atacttctgtggggcagagg

SEQ ID NO: 136975 - DNA, 20 bp, Artificial
  CRISPR gRNA sequence
tctgtggggcagagggggtc

SEQ ID NO: 136976 - DNA, 20 bp, Artificial
  CRISPR gRNA sequence
ggggcagagggggtctggcc

SEQ ID NO: 136977 - DNA, 20 bp, Artificial
  CRISPR gRNA sequence
ggcccagcttacttctaatt

SEQ ID NO: 136978 - DNA, 20 bp, Artificial
  CRISPR gRNA sequence
gcccagcttacttctaattg

SEQ ID NO: 136979 - DNA, 20 bp, Artificial
  CRISPR gRNA sequence
tacttctaattgaggatgaa

SEQ ID NO: 136980 - DNA, 20 bp, Artificial
  CRISPR gRNA sequence
acttctaattgaggatgaac

SEQ ID NO: 136981 - DNA, 20 bp, Artificial
  CRISPR gRNA sequence
ctaattgaggatgaacaggt

SEQ ID NO: 136982 - DNA, 20 bp, Artificial
  CRISPR gRNA sequence
taattgaggatgaacaggtg

SEQ ID NO: 136983 - DNA, 20 bp, Artificial
  CRISPR gRNA sequence
aattgaggatgaacaggtga

SEQ ID NO: 136984 - DNA, 20 bp, Artificial
  CRISPR gRNA sequence
ttgaggatgaacaggtgagg

SEQ ID NO: 136985 - DNA, 20 bp, Artificial
  CRISPR gRNA sequence
tgaggatgaacaggtgaggg

SEQ ID NO: 136986 - DNA, 20 bp, Artificial
  CRISPR gRNA sequence
ggatgaacaggtgagggagg

SEQ ID NO: 136987 - DNA, 20 bp, Artificial
  CRISPR gRNA sequence
gatgaacaggtgagggaggc

SEQ ID NO: 136988 - DNA, 20 bp, Artificial
  CRISPR gRNA sequence
atgaacaggtgagggaggca

SEQ ID NO: 136989 - DNA, 20 bp, Artificial
  CRISPR gRNA sequence
tgaacaggtgagggaggcag

SEQ ID NO: 136990 - DNA, 20 bp, Artificial
  CRISPR gRNA sequence
aacaggtgagggaggcaggg

SEQ ID NO: 136991 - DNA, 20 bp, Artificial
  CRISPR gRNA sequence
gtgagggaggcaggggagct

SEQ ID NO: 136992 - DNA, 20 bp, Artificial
  CRISPR gRNA sequence
gaggcaggggagctaagtaa

SEQ ID NO: 136993 - DNA, 20 bp, Artificial
  CRISPR gRNA sequence
taagtaacagttgtgtgatc

SEQ ID NO: 136994 - DNA, 20 bp, Artificial
  CRISPR gRNA sequence
aagtaacagttgtgtgatct

SEQ ID NO: 136995 - DNA, 20 bp, Artificial
  CRISPR gRNA sequence
acagttgtgtgatctaggac

SEQ ID NO: 136996 - DNA, 20 bp, Artificial
  CRISPR gRNA sequence
aggaccagcttctcaacttc

SEQ ID NO: 136997 - DNA, 20 bp, Artificial
  CRISPR gRNA sequence
agcttctcaacttctagtgt

SEQ ID NO: 136998 - DNA, 20 bp, Artificial
  CRISPR gRNA sequence
tctagtgtcagtttccccat

SEQ ID NO: 136999 - DNA, 20 bp, Artificial
  CRISPR gRNA sequence
cagtttccccatcagtaaat

SEQ ID NO: 137000 - DNA, 20 bp, Artificial
  CRISPR gRNA sequence
agtttccccatcagtaaatc

SEQ ID NO: 137001 - DNA, 20 bp, Artificial
  CRISPR gRNA sequence
gtttccccatcagtaaatca

SEQ ID NO: 137002 - DNA, 20 bp, Artificial
  CRISPR gRNA sequence
gggataaataaaacacctaa

SEQ ID NO: 137003 - DNA, 20 bp, Artificial
  CRISPR gRNA sequence
acctaacagtgctttaaaac

SEQ ID NO: 137004 - DNA, 20 bp, Artificial
  CRISPR gRNA sequence
acagtgctttaaaacaagat

SEQ ID NO: 137005 - DNA, 20 bp, Artificial
  CRISPR gRNA sequence
ttttcttttctttttttttt

SEQ ID NO: 137006 - DNA, 20 bp, Artificial
  CRISPR gRNA sequence
cttttcttttttttttgaga

SEQ ID NO: 137007 - DNA, 20 bp, Artificial
  CRISPR gRNA sequence
ttttcttttttttttgagac

SEQ ID NO: 137008 - DNA, 20 bp, Artificial
  CRISPR gRNA sequence
cttgctctgctgttcctgct

SEQ ID NO: 137009 - DNA, 20 bp, Artificial
  CRISPR gRNA sequence
ttgctctgctgttcctgctc

SEQ ID NO: 137010 - DNA, 20 bp, Artificial
  CRISPR gRNA sequence
tctgctgttcctgctcaggc

SEQ ID NO: 137011 - DNA, 20 bp, Artificial
  CRISPR gRNA sequence
tgctgttcctgctcaggctg

SEQ ID NO: 137012 - DNA, 20 bp, Artificial
  CRISPR gRNA sequence
ttcctgctcaggctggagtg

SEQ ID NO: 137013 - DNA, 20 bp, Artificial
  CRISPR gRNA sequence
ctgctcaggctggagtgcag

SEQ ID NO: 137014 - DNA, 20 bp, Artificial
  CRISPR gRNA sequence
ggagtgcagtggcgcaatca

SEQ ID NO: 137015 - DNA, 20 bp, Artificial
  CRISPR gRNA sequence
ggcgcaatcatggctcactg

SEQ ID NO: 137016 - DNA, 20 bp, Artificial
  CRISPR gRNA sequence
gcgcaatcatggctcactgc

SEQ ID NO: 137017 - DNA, 20 bp, Artificial
  CRISPR gRNA sequence
tcactgcaggcttgaccacc

SEQ ID NO: 137018 - DNA, 20 bp, Artificial
  CRISPR gRNA sequence
cactgcaggcttgaccaccc

SEQ ID NO: 137019 - DNA, 20 bp, Artificial
  CRISPR gRNA sequence
aggcttgaccacccaggctc

SEQ ID NO: 137020 - DNA, 20 bp, Artificial
  CRISPR gRNA sequence
cttgaccacccaggctcaag

SEQ ID NO: 137021 - DNA, 20 bp, Artificial
  CRISPR gRNA sequence
ctcaagcagtcctcccgcct

SEQ ID NO: 137022 - DNA, 20 bp, Artificial
  CRISPR gRNA sequence
tcctcccgcctcagcctcgt

SEQ ID NO: 137023 - DNA, 20 bp, Artificial
  CRISPR gRNA sequence
tcccgcctcagcctcgtgag

SEQ ID NO: 137024 - DNA, 20 bp, Artificial
  CRISPR gRNA sequence
gcctcagcctcgtgagtagc

SEQ ID NO: 137025 - DNA, 20 bp, Artificial
  CRISPR gRNA sequence
cctcagcctcgtgagtagct

SEQ ID NO: 137026 - DNA, 20 bp, Artificial
  CRISPR gRNA sequence
ctcgtgagtagctgggacta

SEQ ID NO: 137027 - DNA, 20 bp, Artificial
  CRISPR gRNA sequence
tcgtgagtagctgggactac

SEQ ID NO: 137028 - DNA, 20 bp, Artificial
  CRISPR gRNA sequence
agtagctgggactacaggtg

SEQ ID NO: 137029 - DNA, 20 bp, Artificial
  CRISPR gRNA sequence
gtagctgggactacaggtgt

SEQ ID NO: 137030 - DNA, 20 bp, Artificial
  CRISPR gRNA sequence
caggtgtgggccactacacc

SEQ ID NO: 137031 - DNA, 20 bp, Artificial
  CRISPR gRNA sequence
tgtgggccactacacctggc

SEQ ID NO: 137032 - DNA, 20 bp, Artificial
  CRISPR gRNA sequence
tttattttttattttctatt

SEQ ID NO: 137033 - DNA, 20 bp, Artificial
  CRISPR gRNA sequence
ttttttattttctattgaga

SEQ ID NO: 137034 - DNA, 20 bp, Artificial
  CRISPR gRNA sequence
tttttattttctattgagat

SEQ ID NO: 137035 - DNA, 20 bp, Artificial
  CRISPR gRNA sequence
ttttattttctattgagatg

SEQ ID NO: 137036 - DNA, 20 bp, Artificial
  CRISPR gRNA sequence
tttattttctattgagatgg

SEQ ID NO: 137037 - DNA, 20 bp, Artificial
  CRISPR gRNA sequence
gggggtctcactatgttgcc

SEQ ID NO: 137038 - DNA, 20 bp, Artificial
  CRISPR gRNA sequence
ggggtctcactatgttgccc

SEQ ID NO: 137039 - DNA, 20 bp, Artificial
  CRISPR gRNA sequence
atgttgcccaggctgatctc

SEQ ID NO: 137040 - DNA, 20 bp, Artificial
  CRISPR gRNA sequence
ccaggctgatctcgagctct

SEQ ID NO: 137041 - DNA, 20 bp, Artificial
  CRISPR gRNA sequence
caggctgatctcgagctctt

SEQ ID NO: 137042 - DNA, 20 bp, Artificial
  CRISPR gRNA sequence
gatctcgagctcttgggttc

SEQ ID NO: 137043 - DNA, 20 bp, Artificial
  CRISPR gRNA sequence
ttcaagtgatcctcccgcct

SEQ ID NO: 137044 - DNA, 20 bp, Artificial
  CRISPR gRNA sequence
atcctcccgccttggcctcc

SEQ ID NO: 137045 - DNA, 20 bp, Artificial
  CRISPR gRNA sequence
cctcccgccttggcctccca

SEQ ID NO: 137046 - DNA, 20 bp, Artificial
  CRISPR gRNA sequence
gccttggcctcccagagtgc

SEQ ID NO: 137047 - DNA, 20 bp, Artificial
  CRISPR gRNA sequence
ccttggcctcccagagtgct

SEQ ID NO: 137048 - DNA, 20 bp, Artificial
  CRISPR gRNA sequence
gcctcccagagtgctaggat

SEQ ID NO: 137049 - DNA, 20 bp, Artificial
  CRISPR gRNA sequence
ctcccagagtgctaggatta

SEQ ID NO: 137050 - DNA, 20 bp, Artificial
  CRISPR gRNA sequence
tcccagagtgctaggattag

SEQ ID NO: 137051 - DNA, 20 bp, Artificial
  CRISPR gRNA sequence
agtgctaggattagaggcat

SEQ ID NO: 137052 - DNA, 20 bp, Artificial
  CRISPR gRNA sequence
gaggcatgagctaccatgcc

SEQ ID NO: 137053 - DNA, 20 bp, Artificial
  CRISPR gRNA sequence
tggctgaacctttttcctta

SEQ ID NO: 137054 - DNA, 20 bp, Artificial
  CRISPR gRNA sequence
ggctgaacctttttccttaa

SEQ ID NO: 137055 - DNA, 20 bp, Artificial
  CRISPR gRNA sequence
gctgaacctttttccttaaa

SEQ ID NO: 137056 - DNA, 20 bp, Artificial
  CRISPR gRNA sequence
aacctttttccttaaagggc

SEQ ID NO: 137057 - DNA, 20 bp, Artificial
  CRISPR gRNA sequence
ccttaaagggccagatattt

SEQ ID NO: 137058 - DNA, 20 bp, Artificial
  CRISPR gRNA sequence
cttaaagggccagatatttt

SEQ ID NO: 137059 - DNA, 20 bp, Artificial
  CRISPR gRNA sequence
gccagatattttaggctttg

SEQ ID NO: 137060 - DNA, 20 bp, Artificial
  CRISPR gRNA sequence
aactcttcaactctactgtt

SEQ ID NO: 137061 - DNA, 20 bp, Artificial
  CRISPR gRNA sequence
actctactgtttagcatgaa

SEQ ID NO: 137062 - DNA, 20 bp, Artificial
  CRISPR gRNA sequence
aacagacaatataaactaat

SEQ ID NO: 137063 - DNA, 20 bp, Artificial
  CRISPR gRNA sequence
acagacaatataaactaatt

SEQ ID NO: 137064 - DNA, 20 bp, Artificial
  CRISPR gRNA sequence
cagacaatataaactaatta

SEQ ID NO: 137065 - DNA, 20 bp, Artificial
  CRISPR gRNA sequence
agacaatataaactaattag

SEQ ID NO: 137066 - DNA, 20 bp, Artificial
  CRISPR gRNA sequence
aatataaactaattaggggc

SEQ ID NO: 137067 - DNA, 20 bp, Artificial
  CRISPR gRNA sequence
aactaattaggggctggaca

SEQ ID NO: 137068 - DNA, 20 bp, Artificial
  CRISPR gRNA sequence
taattaggggctggacatgg

SEQ ID NO: 137069 - DNA, 20 bp, Artificial
  CRISPR gRNA sequence
gtggctcacgcctgtaatcc

SEQ ID NO: 137070 - DNA, 20 bp, Artificial
  CRISPR gRNA sequence
cgcctgtaatcccagcgttt

SEQ ID NO: 137071 - DNA, 20 bp, Artificial
  CRISPR gRNA sequence
gcctgtaatcccagcgtttt

SEQ ID NO: 137072 - DNA, 20 bp, Artificial
  CRISPR gRNA sequence
ctgtaatcccagcgttttgg

SEQ ID NO: 137073 - DNA, 20 bp, Artificial
  CRISPR gRNA sequence
tgtaatcccagcgttttggg

SEQ ID NO: 137074 - DNA, 20 bp, Artificial
  CRISPR gRNA sequence
tcccagcgttttgggaggcc

SEQ ID NO: 137075 - DNA, 20 bp, Artificial
  CRISPR gRNA sequence
cccagcgttttgggaggccg

SEQ ID NO: 137076 - DNA, 20 bp, Artificial
  CRISPR gRNA sequence
agcgttttgggaggccgagg

SEQ ID NO: 137077 - DNA, 20 bp, Artificial
  CRISPR gRNA sequence
gcgttttgggaggccgaggt

SEQ ID NO: 137078 - DNA, 20 bp, Artificial
  CRISPR gRNA sequence
ttttgggaggccgaggtggg

SEQ ID NO: 137079 - DNA, 20 bp, Artificial
  CRISPR gRNA sequence
ccgaggtgggcagatcactt

SEQ ID NO: 137080 - DNA, 20 bp, Artificial
  CRISPR gRNA sequence
cgaggtgggcagatcactta

SEQ ID NO: 137081 - DNA, 20 bp, Artificial
  CRISPR gRNA sequence
gtgggcagatcacttaaggt

SEQ ID NO: 137082 - DNA, 20 bp, Artificial
  CRISPR gRNA sequence
tgggcagatcacttaaggtc

SEQ ID NO: 137083 - DNA, 20 bp, Artificial
  CRISPR gRNA sequence
ggcagatcacttaaggtcag

SEQ ID NO: 137084 - DNA, 20 bp, Artificial
  CRISPR gRNA sequence
tcacttaaggtcaggagttc

SEQ ID NO: 137085 - DNA, 20 bp, Artificial
  CRISPR gRNA sequence
tcaggagttcaagaccaacc

SEQ ID NO: 137086 - DNA, 20 bp, Artificial
  CRISPR gRNA sequence
caagaccaacctggtcaaca

SEQ ID NO: 137087 - DNA, 20 bp, Artificial
  CRISPR gRNA sequence
ctcttcaaaaatacaaaaat

SEQ ID NO: 137088 - DNA, 20 bp, Artificial
  CRISPR gRNA sequence
tcaaaaatacaaaaattagc

SEQ ID NO: 137089 - DNA, 20 bp, Artificial
  CRISPR gRNA sequence
caaaaatacaaaaattagct

SEQ ID NO: 137090 - DNA, 20 bp, Artificial
  CRISPR gRNA sequence
caaaaattagctgggtgtga

SEQ ID NO: 137091 - DNA, 20 bp, Artificial
  CRISPR gRNA sequence
aaattagctgggtgtgatgg

SEQ ID NO: 137092 - DNA, 20 bp, Artificial
  CRISPR gRNA sequence
aattagctgggtgtgatggc

SEQ ID NO: 137093 - DNA, 20 bp, Artificial
  CRISPR gRNA sequence
atggcgggtgcctataatcc

SEQ ID NO: 137094 - DNA, 20 bp, Artificial
  CRISPR gRNA sequence
tgcctataatcccagctgct

SEQ ID NO: 137095 - DNA, 20 bp, Artificial
  CRISPR gRNA sequence
gcctataatcccagctgctt

SEQ ID NO: 137096 - DNA, 20 bp, Artificial
  CRISPR gRNA sequence
ctataatcccagctgcttgg

SEQ ID NO: 137097 - DNA, 20 bp, Artificial
  CRISPR gRNA sequence
tataatcccagctgcttggg

SEQ ID NO: 137098 - DNA, 20 bp, Artificial
  CRISPR gRNA sequence
tcccagctgcttgggaggct

SEQ ID NO: 137099 - DNA, 20 bp, Artificial
  CRISPR gRNA sequence
cccagctgcttgggaggctg

SEQ ID NO: 137100 - DNA, 20 bp, Artificial
  CRISPR gRNA sequence
agctgcttgggaggctgagg

SEQ ID NO: 137101 - DNA, 20 bp, Artificial
  CRISPR gRNA sequence
gctgcttgggaggctgaggt

SEQ ID NO: 137102 - DNA, 20 bp, Artificial
  CRISPR gRNA sequence
tgcttgggaggctgaggtgg

SEQ ID NO: 137103 - DNA, 20 bp, Artificial
  CRISPR gRNA sequence
gtgggagaatcgcttgaacc

SEQ ID NO: 137104 - DNA, 20 bp, Artificial
  CRISPR gRNA sequence
tgggagaatcgcttgaaccc

SEQ ID NO: 137105 - DNA, 20 bp, Artificial
  CRISPR gRNA sequence
ggagaatcgcttgaacccgg

SEQ ID NO: 137106 - DNA, 20 bp, Artificial
  CRISPR gRNA sequence
gagaatcgcttgaacccggg

SEQ ID NO: 137107 - DNA, 20 bp, Artificial
  CRISPR gRNA sequence
aatcgcttgaacccgggagg

SEQ ID NO: 137108 - DNA, 20 bp, Artificial
  CRISPR gRNA sequence
tcgcttgaacccgggaggtg

SEQ ID NO: 137109 - DNA, 20 bp, Artificial
  CRISPR gRNA sequence
cgcttgaacccgggaggtgg

SEQ ID NO: 137110 - DNA, 20 bp, Artificial
  CRISPR gRNA sequence
aacccgggaggtggaggttg

SEQ ID NO: 137111 - DNA, 20 bp, Artificial
  CRISPR gRNA sequence
cgggaggtggaggttgcagt

SEQ ID NO: 137112 - DNA, 20 bp, Artificial
  CRISPR gRNA sequence
ggtggaggttgcagtgagcc

SEQ ID NO: 137113 - DNA, 20 bp, Artificial
  CRISPR gRNA sequence
gagatcgtgccattgtactc

SEQ ID NO: 137114 - DNA, 20 bp, Artificial
  CRISPR gRNA sequence
cgtgccattgtactccagcc

SEQ ID NO: 137115 - DNA, 20 bp, Artificial
  CRISPR gRNA sequence
ttgtactccagcctggatga

SEQ ID NO: 137116 - DNA, 20 bp, Artificial
  CRISPR gRNA sequence
tccagcctggatgacagact

SEQ ID NO: 137117 - DNA, 20 bp, Artificial
  CRISPR gRNA sequence
ccagcctggatgacagactg

SEQ ID NO: 137118 - DNA, 20 bp, Artificial
  CRISPR gRNA sequence
cagactgaggctccgtctaa

SEQ ID NO: 137119 - DNA, 20 bp, Artificial
  CRISPR gRNA sequence
tgaataaataaataaataat

SEQ ID NO: 137120 - DNA, 20 bp, Artificial
  CRISPR gRNA sequence
gaataaataaataaataatt

SEQ ID NO: 137121 - DNA, 20 bp, Artificial
  CRISPR gRNA sequence
aataaataaataaataatta

SEQ ID NO: 137122 - DNA, 20 bp, Artificial
  CRISPR gRNA sequence
taattagggttgatgtcttc

SEQ ID NO: 137123 - DNA, 20 bp, Artificial
  CRISPR gRNA sequence
agtgaaactgtttctaaaaa

SEQ ID NO: 137124 - DNA, 20 bp, Artificial
  CRISPR gRNA sequence
gtgaaactgtttctaaaaac

SEQ ID NO: 137125 - DNA, 20 bp, Artificial
  CRISPR gRNA sequence
ctgtttctaaaaacaggctg

SEQ ID NO: 137126 - DNA, 20 bp, Artificial
  CRISPR gRNA sequence
tgtttctaaaaacaggctgt

SEQ ID NO: 137127 - DNA, 20 bp, Artificial
  CRISPR gRNA sequence
tctaaaaacaggctgtaggc

SEQ ID NO: 137128 - DNA, 20 bp, Artificial
  CRISPR gRNA sequence
aacaggctgtaggccagatg

SEQ ID NO: 137129 - DNA, 20 bp, Artificial
  CRISPR gRNA sequence
gtaggccagatgtggcctat

SEQ ID NO: 137130 - DNA, 20 bp, Artificial
  CRISPR gRNA sequence
cagatgtggcctatgagctg

SEQ ID NO: 137131 - DNA, 20 bp, Artificial
  CRISPR gRNA sequence
ggcctatgagctgtagtttt

SEQ ID NO: 137132 - DNA, 20 bp, Artificial
  CRISPR gRNA sequence
tagtttttagacccttgctt

SEQ ID NO: 137133 - DNA, 20 bp, Artificial
  CRISPR gRNA sequence
ttcatcatacaaaatactga

SEQ ID NO: 137134 - DNA, 20 bp, Artificial
  CRISPR gRNA sequence
ttttattgctgttatatatg

SEQ ID NO: 137135 - DNA, 20 bp, Artificial
  CRISPR gRNA sequence
ttattgctgttatatatgca

SEQ ID NO: 137136 - DNA, 20 bp, Artificial
  CRISPR gRNA sequence
tgctgttatatatgcagaga

SEQ ID NO: 137137 - DNA, 20 bp, Artificial
  CRISPR gRNA sequence
tatatatgcagagatggttt

SEQ ID NO: 137138 - DNA, 20 bp, Artificial
  CRISPR gRNA sequence
tgcagagatggtttaagttt

SEQ ID NO: 137139 - DNA, 20 bp, Artificial
  CRISPR gRNA sequence
ggtttaagtttgagcattga

SEQ ID NO: 137140 - DNA, 20 bp, Artificial
  CRISPR gRNA sequence
gtttaagtttgagcattgaa

SEQ ID NO: 137141 - DNA, 20 bp, Artificial
  CRISPR gRNA sequence
agtttgagcattgaaaggat

SEQ ID NO: 137142 - DNA, 20 bp, Artificial
  CRISPR gRNA sequence
tgagcattgaaaggatgagt

SEQ ID NO: 137143 - DNA, 20 bp, Artificial
  CRISPR gRNA sequence
gatgagtaagaatgtgtgtg

SEQ ID NO: 137144 - DNA, 20 bp, Artificial
  CRISPR gRNA sequence
agtaagaatgtgtgtgaagt

SEQ ID NO: 137145 - DNA, 20 bp, Artificial
  CRISPR gRNA sequence
acatatcgttttctattcca

SEQ ID NO: 137146 - DNA, 20 bp, Artificial
  CRISPR gRNA sequence
gttttctattccacagaaaa

SEQ ID NO: 137147 - DNA, 20 bp, Artificial
  CRISPR gRNA sequence
gtcactttcattgtttatac

SEQ ID NO: 137148 - DNA, 20 bp, Artificial
  CRISPR gRNA sequence
gctgtgccttcatttttctc

SEQ ID NO: 137149 - DNA, 20 bp, Artificial
  CRISPR gRNA sequence
gctacaactatattatgatc

SEQ ID NO: 137150 - DNA, 20 bp, Artificial
  CRISPR gRNA sequence
atgatctggcccctgtttca

SEQ ID NO: 137151 - DNA, 20 bp, Artificial
  CRISPR gRNA sequence
tttcaaagattatattgtac

SEQ ID NO: 137152 - DNA, 20 bp, Artificial
  CRISPR gRNA sequence
atattgtactagataccaaa

SEQ ID NO: 137153 - DNA, 20 bp, Artificial
  CRISPR gRNA sequence
gtactagataccaaatagaa

SEQ ID NO: 137154 - DNA, 20 bp, Artificial
  CRISPR gRNA sequence
gaaaagtatttttgtttttg

SEQ ID NO: 137155 - DNA, 20 bp, Artificial
  CRISPR gRNA sequence
aaaagtatttttgtttttga

SEQ ID NO: 137156 - DNA, 20 bp, Artificial
  CRISPR gRNA sequence
tatttttgtttttgaaggaa

SEQ ID NO: 137157 - DNA, 20 bp, Artificial
  CRISPR gRNA sequence
ttttgtttttgaaggaaaag

SEQ ID NO: 137158 - DNA, 20 bp, Artificial
  CRISPR gRNA sequence
aggaaaagtggctcttctgc

SEQ ID NO: 137159 - DNA, 20 bp, Artificial
  CRISPR gRNA sequence
tgaaaatgtgtccttgtgta

SEQ ID NO: 137160 - DNA, 20 bp, Artificial
  CRISPR gRNA sequence
gtccttgtgtacagatcttt

SEQ ID NO: 137161 - DNA, 20 bp, Artificial
  CRISPR gRNA sequence
tccttgtgtacagatcttta

SEQ ID NO: 137162 - DNA, 20 bp, Artificial
  CRISPR gRNA sequence
cttgtgtacagatctttaag

SEQ ID NO: 137163 - DNA, 20 bp, Artificial
  CRISPR gRNA sequence
tgtgtacagatctttaagga

SEQ ID NO: 137164 - DNA, 20 bp, Artificial
  CRISPR gRNA sequence
gtacagatctttaaggagag

SEQ ID NO: 137165 - DNA, 20 bp, Artificial
  CRISPR gRNA sequence
tctttaaggagagcagtgtg

SEQ ID NO: 137166 - DNA, 20 bp, Artificial
  CRISPR gRNA sequence
agcagtgtgcagccacttct

SEQ ID NO: 137167 - DNA, 20 bp, Artificial
  CRISPR gRNA sequence
gtgcagccacttctaagcct

SEQ ID NO: 137168 - DNA, 20 bp, Artificial
  CRISPR gRNA sequence
acttctaagcctaagtcttt

SEQ ID NO: 137169 - DNA, 20 bp, Artificial
  CRISPR gRNA sequence
cttctaagcctaagtctttt

SEQ ID NO: 137170 - DNA, 20 bp, Artificial
  CRISPR gRNA sequence
ctaagcctaagtcttttagg

SEQ ID NO: 137171 - DNA, 20 bp, Artificial
  CRISPR gRNA sequence
cctaagtcttttaggaagca

SEQ ID NO: 137172 - DNA, 20 bp, Artificial
  CRISPR gRNA sequence
ttttaggaagcatggttttc

SEQ ID NO: 137173 - DNA, 20 bp, Artificial
  CRISPR gRNA sequence
taggaagcatggttttccag

SEQ ID NO: 137174 - DNA, 20 bp, Artificial
  CRISPR gRNA sequence
aggaagcatggttttccagt

SEQ ID NO: 137175 - DNA, 20 bp, Artificial
  CRISPR gRNA sequence
tttccagtaggcactttgaa

SEQ ID NO: 137176 - DNA, 20 bp, Artificial
  CRISPR gRNA sequence
ccagtaggcactttgaaaag

SEQ ID NO: 137177 - DNA, 20 bp, Artificial
  CRISPR gRNA sequence
aaagcggcttcctcttaaca

SEQ ID NO: 137178 - DNA, 20 bp, Artificial
  CRISPR gRNA sequence
ataccttcaaacgtcaaact

SEQ ID NO: 137179 - DNA, 20 bp, Artificial
  CRISPR gRNA sequence
acgtcaaacttggcattaat

SEQ ID NO: 137180 - DNA, 20 bp, Artificial
  CRISPR gRNA sequence
gtcaaacttggcattaatca

SEQ ID NO: 137181 - DNA, 20 bp, Artificial
  CRISPR gRNA sequence
aacttggcattaatcagagt

SEQ ID NO: 137182 - DNA, 20 bp, Artificial
  CRISPR gRNA sequence
acttggcattaatcagagtt

SEQ ID NO: 137183 - DNA, 20 bp, Artificial
  CRISPR gRNA sequence
cttggcattaatcagagttg

SEQ ID NO: 137184 - DNA, 20 bp, Artificial
  CRISPR gRNA sequence
ggcattaatcagagttgggg

SEQ ID NO: 137185 - DNA, 20 bp, Artificial
  CRISPR gRNA sequence
attaatcagagttggggaag

SEQ ID NO: 137186 - DNA, 20 bp, Artificial
  CRISPR gRNA sequence
taatcagagttggggaagta

SEQ ID NO: 137187 - DNA, 20 bp, Artificial
  CRISPR gRNA sequence
tgttattcattcttgtatta

SEQ ID NO: 137188 - DNA, 20 bp, Artificial
  CRISPR gRNA sequence
tattcattcttgtattatag

SEQ ID NO: 137189 - DNA, 20 bp, Artificial
  CRISPR gRNA sequence
attcttgtattatagtagtg

SEQ ID NO: 137190 - DNA, 20 bp, Artificial
  CRISPR gRNA sequence
ttatagtagtgaagactatt

SEQ ID NO: 137191 - DNA, 20 bp, Artificial
  CRISPR gRNA sequence
tagtagtgaagactattcag

SEQ ID NO: 137192 - DNA, 20 bp, Artificial
  CRISPR gRNA sequence
aagactattcagtagcctgc

SEQ ID NO: 137193 - DNA, 20 bp, Artificial
  CRISPR gRNA sequence
agcctgccagtaaatatgac

SEQ ID NO: 137194 - DNA, 20 bp, Artificial
  CRISPR gRNA sequence
tgccagtaaatatgaccagc

SEQ ID NO: 137195 - DNA, 20 bp, Artificial
  CRISPR gRNA sequence
aaatatgaccagctggtacc

SEQ ID NO: 137196 - DNA, 20 bp, Artificial
  CRISPR gRNA sequence
cagctggtacccagctatgt

SEQ ID NO: 137197 - DNA, 20 bp, Artificial
  CRISPR gRNA sequence
agctggtacccagctatgta

SEQ ID NO: 137198 - DNA, 20 bp, Artificial
  CRISPR gRNA sequence
gctggtacccagctatgtaa

SEQ ID NO: 137199 - DNA, 20 bp, Artificial
  CRISPR gRNA sequence
tacccagctatgtaagggtt

SEQ ID NO: 137200 - DNA, 20 bp, Artificial
  CRISPR gRNA sequence
tatgtaagggtttagaatgt

SEQ ID NO: 137201 - DNA, 20 bp, Artificial
  CRISPR gRNA sequence
gggtttagaatgtaagtaat

SEQ ID NO: 137202 - DNA, 20 bp, Artificial
  CRISPR gRNA sequence
ggtttagaatgtaagtaata

SEQ ID NO: 137203 - DNA, 20 bp, Artificial
  CRISPR gRNA sequence
gaatgtaagtaataaggttt

SEQ ID NO: 137204 - DNA, 20 bp, Artificial
  CRISPR gRNA sequence
aatgtaagtaataaggtttc

SEQ ID NO: 137205 - DNA, 20 bp, Artificial
  CRISPR gRNA sequence
aaggtttcaggcactaaacg

SEQ ID NO: 137206 - DNA, 20 bp, Artificial
  CRISPR gRNA sequence
ctaaacgtagtgcctgaact

SEQ ID NO: 137207 - DNA, 20 bp, Artificial
  CRISPR gRNA sequence
gcatgactatataaaaacct

SEQ ID NO: 137208 - DNA, 20 bp, Artificial
  CRISPR gRNA sequence
actatataaaaaccttagat

SEQ ID NO: 137209 - DNA, 20 bp, Artificial
  CRISPR gRNA sequence
aaaccttagatgagtttaaa

SEQ ID NO: 137210 - DNA, 20 bp, Artificial
  CRISPR gRNA sequence
accttagatgagtttaaata

SEQ ID NO: 137211 - DNA, 20 bp, Artificial
  CRISPR gRNA sequence
attgaaccttctcttctctc

SEQ ID NO: 137212 - DNA, 20 bp, Artificial
  CRISPR gRNA sequence
cattcatttattgcatcttc

SEQ ID NO: 137213 - DNA, 20 bp, Artificial
  CRISPR gRNA sequence
tcatttattgcatcttcaag

SEQ ID NO: 137214 - DNA, 20 bp, Artificial
  CRISPR gRNA sequence
tattgcatcttcaagtagtg

SEQ ID NO: 137215 - DNA, 20 bp, Artificial
  CRISPR gRNA sequence
catcttcaagtagtgaagtg

SEQ ID NO: 137216 - DNA, 20 bp, Artificial
  CRISPR gRNA sequence
atcttcaagtagtgaagtgt

SEQ ID NO: 137217 - DNA, 20 bp, Artificial
  CRISPR gRNA sequence
ggacttccccaccaaaccac

SEQ ID NO: 137218 - DNA, 20 bp, Artificial
  CRISPR gRNA sequence
acttccccaccaaaccacca

SEQ ID NO: 137219 - DNA, 20 bp, Artificial
  CRISPR gRNA sequence
caaaccaccagagacccctt

SEQ ID NO: 137220 - DNA, 20 bp, Artificial
  CRISPR gRNA sequence
agacccctttggaatgtgtt

SEQ ID NO: 137221 - DNA, 20 bp, Artificial
  CRISPR gRNA sequence
tgttcagtatacatcattgc

SEQ ID NO: 137222 - DNA, 20 bp, Artificial
  CRISPR gRNA sequence
ttcagtatacatcattgctg

SEQ ID NO: 137223 - DNA, 20 bp, Artificial
  CRISPR gRNA sequence
agtatacatcattgctggag

SEQ ID NO: 137224 - DNA, 20 bp, Artificial
  CRISPR gRNA sequence
acatcattgctggagtggct

SEQ ID NO: 137225 - DNA, 20 bp, Artificial
  CRISPR gRNA sequence
tcattgctggagtggcttag

SEQ ID NO: 137226 - DNA, 20 bp, Artificial
  CRISPR gRNA sequence
attgctggagtggcttagta

SEQ ID NO: 137227 - DNA, 20 bp, Artificial
  CRISPR gRNA sequence
gagtggcttagtagagtgac

SEQ ID NO: 137228 - DNA, 20 bp, Artificial
  CRISPR gRNA sequence
gcttagtagagtgactggcc

SEQ ID NO: 137229 - DNA, 20 bp, Artificial
  CRISPR gRNA sequence
cttagtagagtgactggccc

SEQ ID NO: 137230 - DNA, 20 bp, Artificial
  CRISPR gRNA sequence
ttagtagagtgactggccca

SEQ ID NO: 137231 - DNA, 20 bp, Artificial
  CRISPR gRNA sequence
agtgactggcccagggccac

SEQ ID NO: 137232 - DNA, 20 bp, Artificial
  CRISPR gRNA sequence
actggcccagggccaccagc

SEQ ID NO: 137233 - DNA, 20 bp, Artificial
  CRISPR gRNA sequence
ggcccagggccaccagctag

SEQ ID NO: 137234 - DNA, 20 bp, Artificial
  CRISPR gRNA sequence
gcccagggccaccagctagt

SEQ ID NO: 137235 - DNA, 20 bp, Artificial
  CRISPR gRNA sequence
cagggccaccagctagtagg

SEQ ID NO: 137236 - DNA, 20 bp, Artificial
  CRISPR gRNA sequence
gccaccagctagtaggcagc

SEQ ID NO: 137237 - DNA, 20 bp, Artificial
  CRISPR gRNA sequence
gctagtaggcagcaagcgtc

SEQ ID NO: 137238 - DNA, 20 bp, Artificial
  CRISPR gRNA sequence
ggcagcaagcgtccagtaca

SEQ ID NO: 137239 - DNA, 20 bp, Artificial
  CRISPR gRNA sequence
aagcgtccagtacacagacg

SEQ ID NO: 137240 - DNA, 20 bp, Artificial
  CRISPR gRNA sequence
agcgtccagtacacagacgt

SEQ ID NO: 137241 - DNA, 20 bp, Artificial
  CRISPR gRNA sequence
gacgtaggtcttttaatttc

SEQ ID NO: 137242 - DNA, 20 bp, Artificial
  CRISPR gRNA sequence
aggtcttttaatttccagac

SEQ ID NO: 137243 - DNA, 20 bp, Artificial
  CRISPR gRNA sequence
tcttgtgaaattgtcaattt

SEQ ID NO: 137244 - DNA, 20 bp, Artificial
  CRISPR gRNA sequence
tgaaattgtcaattttagat

SEQ ID NO: 137245 - DNA, 20 bp, Artificial
  CRISPR gRNA sequence
attttagattggttttattt

SEQ ID NO: 137246 - DNA, 20 bp, Artificial
  CRISPR gRNA sequence
tttagattggttttattttg

SEQ ID NO: 137247 - DNA, 20 bp, Artificial
  CRISPR gRNA sequence
tagattggttttattttgga

SEQ ID NO: 137248 - DNA, 20 bp, Artificial
  CRISPR gRNA sequence
ggttttattttggagagtat

SEQ ID NO: 137249 - DNA, 20 bp, Artificial
  CRISPR gRNA sequence
tggagagtataagccttctt

SEQ ID NO: 137250 - DNA, 20 bp, Artificial
  CRISPR gRNA sequence
ccttcttaagaaatgctttt

SEQ ID NO: 137251 - DNA, 20 bp, Artificial
  CRISPR gRNA sequence
ttagctgttgtgatcgataa

SEQ ID NO: 137252 - DNA, 20 bp, Artificial
  CRISPR gRNA sequence
gttgtgatcgataatagcat

SEQ ID NO: 137253 - DNA, 20 bp, Artificial
  CRISPR gRNA sequence
tcgataatagcataagtcct

SEQ ID NO: 137254 - DNA, 20 bp, Artificial
  CRISPR gRNA sequence
cgataatagcataagtccta

SEQ ID NO: 137255 - DNA, 20 bp, Artificial
  CRISPR gRNA sequence
gtgtaaacataaaaaccaaa

SEQ ID NO: 137256 - DNA, 20 bp, Artificial
  CRISPR gRNA sequence
ataaaaaccaaatagtctgt

SEQ ID NO: 137257 - DNA, 20 bp, Artificial
  CRISPR gRNA sequence
atataacatcttacaaacct

SEQ ID NO: 137258 - DNA, 20 bp, Artificial
  CRISPR gRNA sequence
aaccttagctcatttaaatg

SEQ ID NO: 137259 - DNA, 20 bp, Artificial
  CRISPR gRNA sequence
ctcatttaaatgaagaaacc

SEQ ID NO: 137260 - DNA, 20 bp, Artificial
  CRISPR gRNA sequence
aagaaacctagaactaacct

SEQ ID NO: 137261 - DNA, 20 bp, Artificial
  CRISPR gRNA sequence
actaacctcagtaaatacct

SEQ ID NO: 137262 - DNA, 20 bp, Artificial
  CRISPR gRNA sequence
aacctcagtaaatacctgag

SEQ ID NO: 137263 - DNA, 20 bp, Artificial
  CRISPR gRNA sequence
agtaaatacctgagcagtac

SEQ ID NO: 137264 - DNA, 20 bp, Artificial
  CRISPR gRNA sequence
ggtacataaaatgcttgtga

SEQ ID NO: 137265 - DNA, 20 bp, Artificial
  CRISPR gRNA sequence
gcttgtgatagtgctgccac

SEQ ID NO: 137266 - DNA, 20 bp, Artificial
  CRISPR gRNA sequence
cttgtgatagtgctgccact

SEQ ID NO: 137267 - DNA, 20 bp, Artificial
  CRISPR gRNA sequence
ttgtgatagtgctgccacta

SEQ ID NO: 137268 - DNA, 20 bp, Artificial
  CRISPR gRNA sequence
cactagggcaaaatacaata

SEQ ID NO: 137269 - DNA, 20 bp, Artificial
  CRISPR gRNA sequence
ataaagctaacattataata

SEQ ID NO: 137270 - DNA, 20 bp, Artificial
  CRISPR gRNA sequence
aaagctaacattataataaa

SEQ ID NO: 137271 - DNA, 20 bp, Artificial
  CRISPR gRNA sequence
agctaacattataataaaga

SEQ ID NO: 137272 - DNA, 20 bp, Artificial
  CRISPR gRNA sequence
agagagtcacacaaatttgt

SEQ ID NO: 137273 - DNA, 20 bp, Artificial
  CRISPR gRNA sequence
acacaaatttgttggtttcc

SEQ ID NO: 137274 - DNA, 20 bp, Artificial
  CRISPR gRNA sequence
tgttggtttcccagtgcaaa

SEQ ID NO: 137275 - DNA, 20 bp, Artificial
  CRISPR gRNA sequence
tggtttcccagtgcaaatag

SEQ ID NO: 137276 - DNA, 20 bp, Artificial
  CRISPR gRNA sequence
tagaagttatgtttatatta

SEQ ID NO: 137277 - DNA, 20 bp, Artificial
  CRISPR gRNA sequence
gttatgtttatattatagtg

SEQ ID NO: 137278 - DNA, 20 bp, Artificial
  CRISPR gRNA sequence
atattatagtgtagcctatt

SEQ ID NO: 137279 - DNA, 20 bp, Artificial
  CRISPR gRNA sequence
gtagcctattaagtgtgcaa

SEQ ID NO: 137280 - DNA, 20 bp, Artificial
  CRISPR gRNA sequence
ttaattttaaaataccttat

SEQ ID NO: 137281 - DNA, 20 bp, Artificial
  CRISPR gRNA sequence
caaattatcatctgaacttg

SEQ ID NO: 137282 - DNA, 20 bp, Artificial
  CRISPR gRNA sequence
ttatcatctgaacttgcagc

SEQ ID NO: 137283 - DNA, 20 bp, Artificial
  CRISPR gRNA sequence
gtcataaccttttgctgctt

SEQ ID NO: 137284 - DNA, 20 bp, Artificial
  CRISPR gRNA sequence
tcataaccttttgctgcttg

SEQ ID NO: 137285 - DNA, 20 bp, Artificial
  CRISPR gRNA sequence
cataaccttttgctgcttga

SEQ ID NO: 137286 - DNA, 20 bp, Artificial
  CRISPR gRNA sequence
gggtcttgacttgatgatga

SEQ ID NO: 137287 - DNA, 20 bp, Artificial
  CRISPR gRNA sequence
atgatggctgctgactgatt

SEQ ID NO: 137288 - DNA, 20 bp, Artificial
  CRISPR gRNA sequence
tgatggctgctgactgattc

SEQ ID NO: 137289 - DNA, 20 bp, Artificial
  CRISPR gRNA sequence
tggctgctgactgattcggg

SEQ ID NO: 137290 - DNA, 20 bp, Artificial
  CRISPR gRNA sequence
ctgctgactgattcgggtgg

SEQ ID NO: 137291 - DNA, 20 bp, Artificial
  CRISPR gRNA sequence
gattcgggtggtagttgctg

SEQ ID NO: 137292 - DNA, 20 bp, Artificial
  CRISPR gRNA sequence
gggtggtagttgctgaagtt

SEQ ID NO: 137293 - DNA, 20 bp, Artificial
  CRISPR gRNA sequence
ggtggtagttgctgaagttt

SEQ ID NO: 137294 - DNA, 20 bp, Artificial
  CRISPR gRNA sequence
gtggtagttgctgaagtttg

SEQ ID NO: 137295 - DNA, 20 bp, Artificial
  CRISPR gRNA sequence
gtagttgctgaagtttgggg

SEQ ID NO: 137296 - DNA, 20 bp, Artificial
  CRISPR gRNA sequence
gctgaagtttggggtggctt

SEQ ID NO: 137297 - DNA, 20 bp, Artificial
  CRISPR gRNA sequence
gtgtgtgtgtgttttttttt

SEQ ID NO: 137298 - DNA, 20 bp, Artificial
  CRISPR gRNA sequence
gtgtgtgtttttttttgaga

SEQ ID NO: 137299 - DNA, 20 bp, Artificial
  CRISPR gRNA sequence
gtgtgtttttttttgagatg

SEQ ID NO: 137300 - DNA, 20 bp, Artificial
  CRISPR gRNA sequence
ggagtttcgctcctgttgct

SEQ ID NO: 137301 - DNA, 20 bp, Artificial
  CRISPR gRNA sequence
gagtttcgctcctgttgctc

SEQ ID NO: 137302 - DNA, 20 bp, Artificial
  CRISPR gRNA sequence
ttcgctcctgttgctcaggc

SEQ ID NO: 137303 - DNA, 20 bp, Artificial
  CRISPR gRNA sequence
cgctcctgttgctcaggctg

SEQ ID NO: 137304 - DNA, 20 bp, Artificial
  CRISPR gRNA sequence
ctgttgctcaggctggagtg

SEQ ID NO: 137305 - DNA, 20 bp, Artificial
  CRISPR gRNA sequence
ttgctcaggctggagtgcag

SEQ ID NO: 137306 - DNA, 20 bp, Artificial
  CRISPR gRNA sequence
ggagtgcagtggcgccatct

SEQ ID NO: 137307 - DNA, 20 bp, Artificial
  CRISPR gRNA sequence
tcactgcaacctctgcctcc

SEQ ID NO: 137308 - DNA, 20 bp, Artificial
  CRISPR gRNA sequence
cactgcaacctctgcctcct

SEQ ID NO: 137309 - DNA, 20 bp, Artificial
  CRISPR gRNA sequence
aacctctgcctcctgggctc

SEQ ID NO: 137310 - DNA, 20 bp, Artificial
  CRISPR gRNA sequence
ctcaagcgattctgctgccc

SEQ ID NO: 137311 - DNA, 20 bp, Artificial
  CRISPR gRNA sequence
ttctgctgccccagcttccc

SEQ ID NO: 137312 - DNA, 20 bp, Artificial
  CRISPR gRNA sequence
tgctgccccagcttcccaag

SEQ ID NO: 137313 - DNA, 20 bp, Artificial
  CRISPR gRNA sequence
gccccagcttcccaagtagc

SEQ ID NO: 137314 - DNA, 20 bp, Artificial
  CRISPR gRNA sequence
ccccagcttcccaagtagct

SEQ ID NO: 137315 - DNA, 20 bp, Artificial
  CRISPR gRNA sequence
ttcccaagtagctgggattg

SEQ ID NO: 137316 - DNA, 20 bp, Artificial
  CRISPR gRNA sequence
tcccaagtagctgggattgc

SEQ ID NO: 137317 - DNA, 20 bp, Artificial
  CRISPR gRNA sequence
caggcccgcaccaccatgcc

SEQ ID NO: 137318 - DNA, 20 bp, Artificial
  CRISPR gRNA sequence
ccagctaatttttgtatttt

SEQ ID NO: 137319 - DNA, 20 bp, Artificial
  CRISPR gRNA sequence
gctaatttttgtatttttag

SEQ ID NO: 137320 - DNA, 20 bp, Artificial
  CRISPR gRNA sequence
taatttttgtatttttagta

SEQ ID NO: 137321 - DNA, 20 bp, Artificial
  CRISPR gRNA sequence
ttttgtatttttagtagaga

SEQ ID NO: 137322 - DNA, 20 bp, Artificial
  CRISPR gRNA sequence
tttgtatttttagtagagac

SEQ ID NO: 137323 - DNA, 20 bp, Artificial
  CRISPR gRNA sequence
ttgtatttttagtagagacg

SEQ ID NO: 137324 - DNA, 20 bp, Artificial
  CRISPR gRNA sequence
gagacggggtttcaccatgt

SEQ ID NO: 137325 - DNA, 20 bp, Artificial
  CRISPR gRNA sequence
cggggtttcaccatgttggc

SEQ ID NO: 137326 - DNA, 20 bp, Artificial
  CRISPR gRNA sequence
ggggtttcaccatgttggcc

SEQ ID NO: 137327 - DNA, 20 bp, Artificial
  CRISPR gRNA sequence
tttcaccatgttggccaggc

SEQ ID NO: 137328 - DNA, 20 bp, Artificial
  CRISPR gRNA sequence
tggtttcgaactcctgacct

SEQ ID NO: 137329 - DNA, 20 bp, Artificial
  CRISPR gRNA sequence
ggtttcgaactcctgacctc

SEQ ID NO: 137330 - DNA, 20 bp, Artificial
  CRISPR gRNA sequence
ctcaggtgatccacccacct

SEQ ID NO: 137331 - DNA, 20 bp, Artificial
  CRISPR gRNA sequence
ccacccacctcagtctccca

SEQ ID NO: 137332 - DNA, 20 bp, Artificial
  CRISPR gRNA sequence
acctcagtctcccaaagtgc

SEQ ID NO: 137333 - DNA, 20 bp, Artificial
  CRISPR gRNA sequence
cctcagtctcccaaagtgct

SEQ ID NO: 137334 - DNA, 20 bp, Artificial
  CRISPR gRNA sequence
ctcccaaagtgctgggatta

SEQ ID NO: 137335 - DNA, 20 bp, Artificial
  CRISPR gRNA sequence
tcccaaagtgctgggattac

SEQ ID NO: 137336 - DNA, 20 bp, Artificial
  CRISPR gRNA sequence
agtgctgggattacaggcgt

SEQ ID NO: 137337 - DNA, 20 bp, Artificial
  CRISPR gRNA sequence
caggcgtgagccaccgcatc

SEQ ID NO: 137338 - DNA, 20 bp, Artificial
  CRISPR gRNA sequence
cctctctccacactgtcacc

SEQ ID NO: 137339 - DNA, 20 bp, Artificial
  CRISPR gRNA sequence
ctctctccacactgtcaccc

SEQ ID NO: 137340 - DNA, 20 bp, Artificial
  CRISPR gRNA sequence
ctccacactgtcacccaggc

SEQ ID NO: 137341 - DNA, 20 bp, Artificial
  CRISPR gRNA sequence
ccacactgtcacccaggctg

SEQ ID NO: 137342 - DNA, 20 bp, Artificial
  CRISPR gRNA sequence
ctgtcacccaggctggagta

SEQ ID NO: 137343 - DNA, 20 bp, Artificial
  CRISPR gRNA sequence
ggagtacagtgtcatgatct

SEQ ID NO: 137344 - DNA, 20 bp, Artificial
  CRISPR gRNA sequence
tgattgcaacctctgccttc

SEQ ID NO: 137345 - DNA, 20 bp, Artificial
  CRISPR gRNA sequence
gattgcaacctctgccttcc

SEQ ID NO: 137346 - DNA, 20 bp, Artificial
  CRISPR gRNA sequence
aacctctgccttccaggttc

SEQ ID NO: 137347 - DNA, 20 bp, Artificial
  CRISPR gRNA sequence
ttcaagccatcctcctactt

SEQ ID NO: 137348 - DNA, 20 bp, Artificial
  CRISPR gRNA sequence
tcctcctacttcagcctccc

SEQ ID NO: 137349 - DNA, 20 bp, Artificial
  CRISPR gRNA sequence
tcctacttcagcctcccaag

SEQ ID NO: 137350 - DNA, 20 bp, Artificial
  CRISPR gRNA sequence
acttcagcctcccaagtagc

SEQ ID NO: 137351 - DNA, 20 bp, Artificial
  CRISPR gRNA sequence
cttcagcctcccaagtagct

SEQ ID NO: 137352 - DNA, 20 bp, Artificial
  CRISPR gRNA sequence
ctcccaagtagctgggacta

SEQ ID NO: 137353 - DNA, 20 bp, Artificial
  CRISPR gRNA sequence
cagacacgtgccaccacacc

SEQ ID NO: 137354 - DNA, 20 bp, Artificial
  CRISPR gRNA sequence
tgatttttgtattttttgta

SEQ ID NO: 137355 - DNA, 20 bp, Artificial
  CRISPR gRNA sequence
ttttgtattttttgtataga

SEQ ID NO: 137356 - DNA, 20 bp, Artificial
  CRISPR gRNA sequence
tttgtattttttgtatagac

SEQ ID NO: 137357 - DNA, 20 bp, Artificial
  CRISPR gRNA sequence
ttgtattttttgtatagaca

SEQ ID NO: 137358 - DNA, 20 bp, Artificial
  CRISPR gRNA sequence
acagggtctcctgtgttgcc

SEQ ID NO: 137359 - DNA, 20 bp, Artificial
  CRISPR gRNA sequence
atcttgatgtctcaaactcc

SEQ ID NO: 137360 - DNA, 20 bp, Artificial
  CRISPR gRNA sequence
tcttgatgtctcaaactcct

SEQ ID NO: 137361 - DNA, 20 bp, Artificial
  CRISPR gRNA sequence
tgtctcaaactcctgggctg

SEQ ID NO: 137362 - DNA, 20 bp, Artificial
  CRISPR gRNA sequence
ctgaagtgatcctcttgccc

SEQ ID NO: 137363 - DNA, 20 bp, Artificial
  CRISPR gRNA sequence
cctcttgccctagcctccca

SEQ ID NO: 137364 - DNA, 20 bp, Artificial
  CRISPR gRNA sequence
gccctagcctcccaaagtgc

SEQ ID NO: 137365 - DNA, 20 bp, Artificial
  CRISPR gRNA sequence
ccctagcctcccaaagtgct

SEQ ID NO: 137366 - DNA, 20 bp, Artificial
  CRISPR gRNA sequence
tcccaaagtgctgggattac

SEQ ID NO: 137367 - DNA, 20 bp, Artificial
  CRISPR gRNA sequence
agtgctgggattactggcgt

SEQ ID NO: 137368 - DNA, 20 bp, Artificial
  CRISPR gRNA sequence
ctggcgtgagccactgtgcc

SEQ ID NO: 137369 - DNA, 20 bp, Artificial
  CRISPR gRNA sequence
cgtgagccactgtgcctggc

SEQ ID NO: 137370 - DNA, 20 bp, Artificial
  CRISPR gRNA sequence
ggctggcaatttcttaaaat

SEQ ID NO: 137371 - DNA, 20 bp, Artificial
  CRISPR gRNA sequence
gctggcaatttcttaaaata

SEQ ID NO: 137372 - DNA, 20 bp, Artificial
  CRISPR gRNA sequence
ggcaatttcttaaaataagg

SEQ ID NO: 137373 - DNA, 20 bp, Artificial
  CRISPR gRNA sequence
aatttcttaaaataaggcag

SEQ ID NO: 137374 - DNA, 20 bp, Artificial
  CRISPR gRNA sequence
cttaaaataaggcagcagtg

SEQ ID NO: 137375 - DNA, 20 bp, Artificial
  CRISPR gRNA sequence
agcagtgaagtttgttgctt

SEQ ID NO: 137376 - DNA, 20 bp, Artificial
  CRISPR gRNA sequence
gttgactcttcctttcatga

SEQ ID NO: 137377 - DNA, 20 bp, Artificial
  CRISPR gRNA sequence
tttcatgaaagatttctctg

SEQ ID NO: 137378 - DNA, 20 bp, Artificial
  CRISPR gRNA sequence
gtagctgcttttctgtttga

SEQ ID NO: 137379 - DNA, 20 bp, Artificial
  CRISPR gRNA sequence
ctgtttgatagcattttacc

SEQ ID NO: 137380 - DNA, 20 bp, Artificial
  CRISPR gRNA sequence
gtttgatagcattttaccca

SEQ ID NO: 137381 - DNA, 20 bp, Artificial
  CRISPR gRNA sequence
tgatagcattttacccagag

SEQ ID NO: 137382 - DNA, 20 bp, Artificial
  CRISPR gRNA sequence
atagcattttacccagagta

SEQ ID NO: 137383 - DNA, 20 bp, Artificial
  CRISPR gRNA sequence
agtagagcttctttcaaaac

SEQ ID NO: 137384 - DNA, 20 bp, Artificial
  CRISPR gRNA sequence
tagagcttctttcaaaactg

SEQ ID NO: 137385 - DNA, 20 bp, Artificial
  CRISPR gRNA sequence
ctgccactattttatgaact

SEQ ID NO: 137386 - DNA, 20 bp, Artificial
  CRISPR gRNA sequence
atataatattctaatgttca

SEQ ID NO: 137387 - DNA, 20 bp, Artificial
  CRISPR gRNA sequence
aatgttcatagcattttcac

SEQ ID NO: 137388 - DNA, 20 bp, Artificial
  CRISPR gRNA sequence
atgttcatagcattttcact

SEQ ID NO: 137389 - DNA, 20 bp, Artificial
  CRISPR gRNA sequence
gttcatagcattttcactgg

SEQ ID NO: 137390 - DNA, 20 bp, Artificial
  CRISPR gRNA sequence
catagcattttcactgggag

SEQ ID NO: 137391 - DNA, 20 bp, Artificial
  CRISPR gRNA sequence
atagcattttcactgggagt

SEQ ID NO: 137392 - DNA, 20 bp, Artificial
  CRISPR gRNA sequence
ctgggagtaggttccatttc

SEQ ID NO: 137393 - DNA, 20 bp, Artificial
  CRISPR gRNA sequence
tgggagtaggttccatttca

SEQ ID NO: 137394 - DNA, 20 bp, Artificial
  CRISPR gRNA sequence
cgactttctttgccttccat

SEQ ID NO: 137395 - DNA, 20 bp, Artificial
  CRISPR gRNA sequence
ctttctttgccttccataag

SEQ ID NO: 137396 - DNA, 20 bp, Artificial
  CRISPR gRNA sequence
aagcaactcctcatctgtta

SEQ ID NO: 137397 - DNA, 20 bp, Artificial
  CRISPR gRNA sequence
atctgttaaagttttatcat

SEQ ID NO: 137398 - DNA, 20 bp, Artificial
  CRISPR gRNA sequence
aaagttttatcatgagattg

SEQ ID NO: 137399 - DNA, 20 bp, Artificial
  CRISPR gRNA sequence
atcatgagattgcagcaatc

SEQ ID NO: 137400 - DNA, 20 bp, Artificial
  CRISPR gRNA sequence
gcagcaatccagtcacatct

SEQ ID NO: 137401 - DNA, 20 bp, Artificial
  CRISPR gRNA sequence
cagcaatccagtcacatctc

SEQ ID NO: 137402 - DNA, 20 bp, Artificial
  CRISPR gRNA sequence
tcaggctccgcttctaatta

SEQ ID NO: 137403 - DNA, 20 bp, Artificial
  CRISPR gRNA sequence
tgctatttctaccacatcta

SEQ ID NO: 137404 - DNA, 20 bp, Artificial
  CRISPR gRNA sequence
tacagttacttcttccactg

SEQ ID NO: 137405 - DNA, 20 bp, Artificial
  CRISPR gRNA sequence
tcaaacccctcaaaatcatc

SEQ ID NO: 137406 - DNA, 20 bp, Artificial
  CRISPR gRNA sequence
caaacccctcaaaatcatcc

SEQ ID NO: 137407 - DNA, 20 bp, Artificial
  CRISPR gRNA sequence
aacccctcaaaatcatccag

SEQ ID NO: 137408 - DNA, 20 bp, Artificial
  CRISPR gRNA sequence
acccctcaaaatcatccagg

SEQ ID NO: 137409 - DNA, 20 bp, Artificial
  CRISPR gRNA sequence
tcaaaatcatccaggaggat

SEQ ID NO: 137410 - DNA, 20 bp, Artificial
  CRISPR gRNA sequence
aggaggattggaatcaactt

SEQ ID NO: 137411 - DNA, 20 bp, Artificial
  CRISPR gRNA sequence
ttcctcccatgaattttgaa

SEQ ID NO: 137412 - DNA, 20 bp, Artificial
  CRISPR gRNA sequence
gctttttttgtttgtttgtt

SEQ ID NO: 137413 - DNA, 20 bp, Artificial
  CRISPR gRNA sequence
tttttgtttgtttgtttggt

SEQ ID NO: 137414 - DNA, 20 bp, Artificial
  CRISPR gRNA sequence
tgtttgtttgtttggttggt

SEQ ID NO: 137415 - DNA, 20 bp, Artificial
  CRISPR gRNA sequence
tgtttgtttggttggttggt

SEQ ID NO: 137416 - DNA, 20 bp, Artificial
  CRISPR gRNA sequence
tgtttggttggttggttggt

SEQ ID NO: 137417 - DNA, 20 bp, Artificial
  CRISPR gRNA sequence
tggttggttggttggttggt

SEQ ID NO: 137418 - DNA, 20 bp, Artificial
  CRISPR gRNA sequence
tggttggttggttggttttt

SEQ ID NO: 137419 - DNA, 20 bp, Artificial
  CRISPR gRNA sequence
tggttggttggtttttgaga

SEQ ID NO: 137420 - DNA, 20 bp, Artificial
  CRISPR gRNA sequence
ggttggttggtttttgagac

SEQ ID NO: 137421 - DNA, 20 bp, Artificial
  CRISPR gRNA sequence
gttggttggtttttgagaca

SEQ ID NO: 137422 - DNA, 20 bp, Artificial
  CRISPR gRNA sequence
cagggtcttactctgttgcc

SEQ ID NO: 137423 - DNA, 20 bp, Artificial
  CRISPR gRNA sequence
tcttactctgttgcccagac

SEQ ID NO: 137424 - DNA, 20 bp, Artificial
  CRISPR gRNA sequence
ttactctgttgcccagactg

SEQ ID NO: 137425 - DNA, 20 bp, Artificial
  CRISPR gRNA sequence
ctgttgcccagactggagtg

SEQ ID NO: 137426 - DNA, 20 bp, Artificial
  CRISPR gRNA sequence
ttgcccagactggagtgcag

SEQ ID NO: 137427 - DNA, 20 bp, Artificial
  CRISPR gRNA sequence
ccagactggagtgcagtagc

SEQ ID NO: 137428 - DNA, 20 bp, Artificial
  CRISPR gRNA sequence
ggagtgcagtagcaagatct

SEQ ID NO: 137429 - DNA, 20 bp, Artificial
  CRISPR gRNA sequence
agcaagatcttggctcactg

SEQ ID NO: 137430 - DNA, 20 bp, Artificial
  CRISPR gRNA sequence
tcactgcagccctgatctcc

SEQ ID NO: 137431 - DNA, 20 bp, Artificial
  CRISPR gRNA sequence
cactgcagccctgatctccc

SEQ ID NO: 137432 - DNA, 20 bp, Artificial
  CRISPR gRNA sequence
agccctgatctcccaggctc

SEQ ID NO: 137433 - DNA, 20 bp, Artificial
  CRISPR gRNA sequence
ctcaagtgatcctcccacct

SEQ ID NO: 137434 - DNA, 20 bp, Artificial
  CRISPR gRNA sequence
tcctcccacctcagcctcct

SEQ ID NO: 137435 - DNA, 20 bp, Artificial
  CRISPR gRNA sequence
tcccacctcagcctcctaag

SEQ ID NO: 137436 - DNA, 20 bp, Artificial
  CRISPR gRNA sequence
acctcagcctcctaagtagt

SEQ ID NO: 137437 - DNA, 20 bp, Artificial
  CRISPR gRNA sequence
cctcagcctcctaagtagtt

SEQ ID NO: 137438 - DNA, 20 bp, Artificial
  CRISPR gRNA sequence
tcctaagtagttgggacaat

SEQ ID NO: 137439 - DNA, 20 bp, Artificial
  CRISPR gRNA sequence
taagcatgtgccaccacaac

SEQ ID NO: 137440 - DNA, 20 bp, Artificial
  CRISPR gRNA sequence
gctaatttttgtattttttg

SEQ ID NO: 137441 - DNA, 20 bp, Artificial
  CRISPR gRNA sequence
taatttttgtattttttgta

SEQ ID NO: 137442 - DNA, 20 bp, Artificial
  CRISPR gRNA sequence
ttttgtattttttgtagaga

SEQ ID NO: 137443 - DNA, 20 bp, Artificial
  CRISPR gRNA sequence
tttgtattttttgtagagac

SEQ ID NO: 137444 - DNA, 20 bp, Artificial
  CRISPR gRNA sequence
acaggttttgccatgttgcc

SEQ ID NO: 137445 - DNA, 20 bp, Artificial
  CRISPR gRNA sequence
caggttttgccatgttgccc

SEQ ID NO: 137446 - DNA, 20 bp, Artificial
  CRISPR gRNA sequence
ttttgccatgttgcccaggc

SEQ ID NO: 137447 - DNA, 20 bp, Artificial
  CRISPR gRNA sequence
tgttgcccaggctggttttg

SEQ ID NO: 137448 - DNA, 20 bp, Artificial
  CRISPR gRNA sequence
caggctggttttgaagtcct

SEQ ID NO: 137449 - DNA, 20 bp, Artificial
  CRISPR gRNA sequence
ggttttgaagtcctgagcta

SEQ ID NO: 137450 - DNA, 20 bp, Artificial
  CRISPR gRNA sequence
tttgaagtcctgagctaaag

SEQ ID NO: 137451 - DNA, 20 bp, Artificial
  CRISPR gRNA sequence
ctaaagcagtcctcccgcct

SEQ ID NO: 137452 - DNA, 20 bp, Artificial
  CRISPR gRNA sequence
gccttggcctcccaaactgc

SEQ ID NO: 137453 - DNA, 20 bp, Artificial
  CRISPR gRNA sequence
ctcccaaactgctggaatta

SEQ ID NO: 137454 - DNA, 20 bp, Artificial
  CRISPR gRNA sequence
tcccaaactgctggaattac

SEQ ID NO: 137455 - DNA, 20 bp, Artificial
  CRISPR gRNA sequence
actgctggaattacaggcct

SEQ ID NO: 137456 - DNA, 20 bp, Artificial
  CRISPR gRNA sequence
ctgctggaattacaggcctg

SEQ ID NO: 137457 - DNA, 20 bp, Artificial
  CRISPR gRNA sequence
caggcctgaggcactgtgcc

SEQ ID NO: 137458 - DNA, 20 bp, Artificial
  CRISPR gRNA sequence
attctttttttttttttttt

SEQ ID NO: 137459 - DNA, 20 bp, Artificial
  CRISPR gRNA sequence
ttttttttttttttgagaca

SEQ ID NO: 137460 - DNA, 20 bp, Artificial
  CRISPR gRNA sequence
caaagtcttgctctgtcgcc

SEQ ID NO: 137461 - DNA, 20 bp, Artificial
  CRISPR gRNA sequence
aaagtcttgctctgtcgccc

SEQ ID NO: 137462 - DNA, 20 bp, Artificial
  CRISPR gRNA sequence
tcttgctctgtcgcccaggc

SEQ ID NO: 137463 - DNA, 20 bp, Artificial
  CRISPR gRNA sequence
ttgctctgtcgcccaggctg

SEQ ID NO: 137464 - DNA, 20 bp, Artificial
  CRISPR gRNA sequence
ctgtcgcccaggctggagtg

SEQ ID NO: 137465 - DNA, 20 bp, Artificial
  CRISPR gRNA sequence
tcgcccaggctggagtgcag

SEQ ID NO: 137466 - DNA, 20 bp, Artificial
  CRISPR gRNA sequence
ggagtgcagtggcacgattt

SEQ ID NO: 137467 - DNA, 20 bp, Artificial
  CRISPR gRNA sequence
tcactgcaacctccgcctcc

SEQ ID NO: 137468 - DNA, 20 bp, Artificial
  CRISPR gRNA sequence
aacctccgcctcccagattc

SEQ ID NO: 137469 - DNA, 20 bp, Artificial
  CRISPR gRNA sequence
ttcaagtgattctcctgcct

SEQ ID NO: 137470 - DNA, 20 bp, Artificial
  CRISPR gRNA sequence
ttctcctgcctcagctttcc

SEQ ID NO: 137471 - DNA, 20 bp, Artificial
  CRISPR gRNA sequence
tcctgcctcagctttccaag

SEQ ID NO: 137472 - DNA, 20 bp, Artificial
  CRISPR gRNA sequence
gcctcagctttccaagtagc

SEQ ID NO: 137473 - DNA, 20 bp, Artificial
  CRISPR gRNA sequence
cctcagctttccaagtagct

SEQ ID NO: 137474 - DNA, 20 bp, Artificial
  CRISPR gRNA sequence
tttccaagtagctgggattt

SEQ ID NO: 137475 - DNA, 20 bp, Artificial
  CRISPR gRNA sequence
ttccaagtagctgggatttc

SEQ ID NO: 137476 - DNA, 20 bp, Artificial
  CRISPR gRNA sequence
caggcccacaccaccatgcc

SEQ ID NO: 137477 - DNA, 20 bp, Artificial
  CRISPR gRNA sequence
ggctaatttttgtatttttt

SEQ ID NO: 137478 - DNA, 20 bp, Artificial
  CRISPR gRNA sequence
taatttttgtatttttttag

SEQ ID NO: 137479 - DNA, 20 bp, Artificial
  CRISPR gRNA sequence
atttttgtatttttttagta

SEQ ID NO: 137480 - DNA, 20 bp, Artificial
  CRISPR gRNA sequence
ttgtatttttttagtagaga

SEQ ID NO: 137481 - DNA, 20 bp, Artificial
  CRISPR gRNA sequence
tgtatttttttagtagagac

SEQ ID NO: 137482 - DNA, 20 bp, Artificial
  CRISPR gRNA sequence
gtatttttttagtagagaca

SEQ ID NO: 137483 - DNA, 20 bp, Artificial
  CRISPR gRNA sequence
gagacagggtttcaccatgt

SEQ ID NO: 137484 - DNA, 20 bp, Artificial
  CRISPR gRNA sequence
agggtttcaccatgttggcc

SEQ ID NO: 137485 - DNA, 20 bp, Artificial
  CRISPR gRNA sequence
tttcaccatgttggcccggc

SEQ ID NO: 137486 - DNA, 20 bp, Artificial
  CRISPR gRNA sequence
accttgtgattcgcccgcct

SEQ ID NO: 137487 - DNA, 20 bp, Artificial
  CRISPR gRNA sequence
tcgcccgcctcggcctccca

SEQ ID NO: 137488 - DNA, 20 bp, Artificial
  CRISPR gRNA sequence
gcctcggcctcccaaagtgc

SEQ ID NO: 137489 - DNA, 20 bp, Artificial
  CRISPR gRNA sequence
cctcggcctcccaaagtgct

SEQ ID NO: 137490 - DNA, 20 bp, Artificial
  CRISPR gRNA sequence
ctcccaaagtgctaggatta

SEQ ID NO: 137491 - DNA, 20 bp, Artificial
  CRISPR gRNA sequence
tcccaaagtgctaggattac

SEQ ID NO: 137492 - DNA, 20 bp, Artificial
  CRISPR gRNA sequence
agtgctaggattacaggcat

SEQ ID NO: 137493 - DNA, 20 bp, Artificial
  CRISPR gRNA sequence
caggcatgagtcaccgcgcc

SEQ ID NO: 137494 - DNA, 20 bp, Artificial
  CRISPR gRNA sequence
cctgccatgaatattcttaa

SEQ ID NO: 137495 - DNA, 20 bp, Artificial
  CRISPR gRNA sequence
attcttaatggtatttaaaa

SEQ ID NO: 137496 - DNA, 20 bp, Artificial
  CRISPR gRNA sequence
ttaaaatggtgaatcctgtc

SEQ ID NO: 137497 - DNA, 20 bp, Artificial
  CRISPR gRNA sequence
aaatggtgaatcctgtctag

SEQ ID NO: 137498 - DNA, 20 bp, Artificial
  CRISPR gRNA sequence
aatggtgaatcctgtctaga

SEQ ID NO: 137499 - DNA, 20 bp, Artificial
  CRISPR gRNA sequence
aatcctgtctagaaggtttt

SEQ ID NO: 137500 - DNA, 20 bp, Artificial
  CRISPR gRNA sequence
tagaaggttttcagtttact

SEQ ID NO: 137501 - DNA, 20 bp, Artificial
  CRISPR gRNA sequence
cagtttactcagatctgtct

SEQ ID NO: 137502 - DNA, 20 bp, Artificial
  CRISPR gRNA sequence
agtttactcagatctgtctg

SEQ ID NO: 137503 - DNA, 20 bp, Artificial
  CRISPR gRNA sequence
gtctgaggaatccctgtcta

SEQ ID NO: 137504 - DNA, 20 bp, Artificial
  CRISPR gRNA sequence
tgaggaatccctgtctatgg

SEQ ID NO: 137505 - DNA, 20 bp, Artificial
  CRISPR gRNA sequence
atggcagctgtgtccttatg

SEQ ID NO: 137506 - DNA, 20 bp, Artificial
  CRISPR gRNA sequence
tatgaagtgtttttatttct

SEQ ID NO: 137507 - DNA, 20 bp, Artificial
  CRISPR gRNA sequence
aagtgtttttatttctgaga

SEQ ID NO: 137508 - DNA, 20 bp, Artificial
  CRISPR gRNA sequence
gtgtttttatttctgagaca

SEQ ID NO: 137509 - DNA, 20 bp, Artificial
  CRISPR gRNA sequence
cagagtctcactctgtcacc

SEQ ID NO: 137510 - DNA, 20 bp, Artificial
  CRISPR gRNA sequence
agagtctcactctgtcacct

SEQ ID NO: 137511 - DNA, 20 bp, Artificial
  CRISPR gRNA sequence
tctcactctgtcacctaggc

SEQ ID NO: 137512 - DNA, 20 bp, Artificial
  CRISPR gRNA sequence
tcactctgtcacctaggctg

SEQ ID NO: 137513 - DNA, 20 bp, Artificial
  CRISPR gRNA sequence
ctgtcacctaggctggagtg

SEQ ID NO: 137514 - DNA, 20 bp, Artificial
  CRISPR gRNA sequence
tcacctaggctggagtgcag

SEQ ID NO: 137515 - DNA, 20 bp, Artificial
  CRISPR gRNA sequence
ggagtgcagtggtgtgatct

SEQ ID NO: 137516 - DNA, 20 bp, Artificial
  CRISPR gRNA sequence
ggtgtgatctcggatcactg

SEQ ID NO: 137517 - DNA, 20 bp, Artificial
  CRISPR gRNA sequence
atcactgcagcctcatgctt

SEQ ID NO: 137518 - DNA, 20 bp, Artificial
  CRISPR gRNA sequence
cagcctcatgctttggcctc

SEQ ID NO: 137519 - DNA, 20 bp, Artificial
  CRISPR gRNA sequence
gcctcatgctttggcctcta

SEQ ID NO: 137520 - DNA, 20 bp, Artificial
  CRISPR gRNA sequence
tcatgctttggcctctagag

SEQ ID NO: 137521 - DNA, 20 bp, Artificial
  CRISPR gRNA sequence
gctttggcctctagagtagc

SEQ ID NO: 137522 - DNA, 20 bp, Artificial
  CRISPR gRNA sequence
ctttggcctctagagtagct

SEQ ID NO: 137523 - DNA, 20 bp, Artificial
  CRISPR gRNA sequence
ctctagagtagctgggacta

SEQ ID NO: 137524 - DNA, 20 bp, Artificial
  CRISPR gRNA sequence
tctagagtagctgggactac

SEQ ID NO: 137525 - DNA, 20 bp, Artificial
  CRISPR gRNA sequence
gactacaggcgtgcaccaac

SEQ ID NO: 137526 - DNA, 20 bp, Artificial
  CRISPR gRNA sequence
cctgctaatttttgtgtttt

SEQ ID NO: 137527 - DNA, 20 bp, Artificial
  CRISPR gRNA sequence
gctaatttttgtgtttttag

SEQ ID NO: 137528 - DNA, 20 bp, Artificial
  CRISPR gRNA sequence
taatttttgtgtttttagta

SEQ ID NO: 137529 - DNA, 20 bp, Artificial
  CRISPR gRNA sequence
ttttgtgtttttagtagaga

SEQ ID NO: 137530 - DNA, 20 bp, Artificial
  CRISPR gRNA sequence
tttgtgtttttagtagagat

SEQ ID NO: 137531 - DNA, 20 bp, Artificial
  CRISPR gRNA sequence
ttgtgtttttagtagagatg

SEQ ID NO: 137532 - DNA, 20 bp, Artificial
  CRISPR gRNA sequence
gagatggggtttcattatgt

SEQ ID NO: 137533 - DNA, 20 bp, Artificial
  CRISPR gRNA sequence
tggggtttcattatgttggc

SEQ ID NO: 137534 - DNA, 20 bp, Artificial
  CRISPR gRNA sequence
ggggtttcattatgttggcc

SEQ ID NO: 137535 - DNA, 20 bp, Artificial
  CRISPR gRNA sequence
tttcattatgttggccagga

SEQ ID NO: 137536 - DNA, 20 bp, Artificial
  CRISPR gRNA sequence
tggtctcgaactcctgacct

SEQ ID NO: 137537 - DNA, 20 bp, Artificial
  CRISPR gRNA sequence
ggtctcgaactcctgacctc

SEQ ID NO: 137538 - DNA, 20 bp, Artificial
  CRISPR gRNA sequence
ctcaggtgatccttctgcct

SEQ ID NO: 137539 - DNA, 20 bp, Artificial
  CRISPR gRNA sequence
ccttctgccttggcctccca

SEQ ID NO: 137540 - DNA, 20 bp, Artificial
  CRISPR gRNA sequence
gccttggcctcccaaagtgc

SEQ ID NO: 137541 - DNA, 20 bp, Artificial
  CRISPR gRNA sequence
ccttggcctcccaaagtgct

SEQ ID NO: 137542 - DNA, 20 bp, Artificial
  CRISPR gRNA sequence
ctcccaaagtgctgggatta

SEQ ID NO: 137543 - DNA, 20 bp, Artificial
  CRISPR gRNA sequence
tcccaaagtgctgggattat

SEQ ID NO: 137544 - DNA, 20 bp, Artificial
  CRISPR gRNA sequence
agtgctgggattataggcat

SEQ ID NO: 137545 - DNA, 20 bp, Artificial
  CRISPR gRNA sequence
taggcatgagccactgtgcc

SEQ ID NO: 137546 - DNA, 20 bp, Artificial
  CRISPR gRNA sequence
catgtattttcttcaataat

SEQ ID NO: 137547 - DNA, 20 bp, Artificial
  CRISPR gRNA sequence
tgaatgttgaaattactctt

SEQ ID NO: 137548 - DNA, 20 bp, Artificial
  CRISPR gRNA sequence
tgaaattactctttggtcca

SEQ ID NO: 137549 - DNA, 20 bp, Artificial
  CRISPR gRNA sequence
gaaattactctttggtccat

SEQ ID NO: 137550 - DNA, 20 bp, Artificial
  CRISPR gRNA sequence
actctttggtccatgggctg

SEQ ID NO: 137551 - DNA, 20 bp, Artificial
  CRISPR gRNA sequence
ttggtccatgggctgcagaa

SEQ ID NO: 137552 - DNA, 20 bp, Artificial
  CRISPR gRNA sequence
ctgcagaatggatattgtgt

SEQ ID NO: 137553 - DNA, 20 bp, Artificial
  CRISPR gRNA sequence
cagaatggatattgtgttag

SEQ ID NO: 137554 - DNA, 20 bp, Artificial
  CRISPR gRNA sequence
agaatggatattgtgttagc

SEQ ID NO: 137555 - DNA, 20 bp, Artificial
  CRISPR gRNA sequence
aggtgttaaaatactaatct

SEQ ID NO: 137556 - DNA, 20 bp, Artificial
  CRISPR gRNA sequence
gttaaaatactaatctcggc

SEQ ID NO: 137557 - DNA, 20 bp, Artificial
  CRISPR gRNA sequence
ttaaaatactaatctcggct

SEQ ID NO: 137558 - DNA, 20 bp, Artificial
  CRISPR gRNA sequence
ctaatctcggctgggcgcga

SEQ ID NO: 137559 - DNA, 20 bp, Artificial
  CRISPR gRNA sequence
cacctgtaatcccaacactt

SEQ ID NO: 137560 - DNA, 20 bp, Artificial
  CRISPR gRNA sequence
acctgtaatcccaacacttt

SEQ ID NO: 137561 - DNA, 20 bp, Artificial
  CRISPR gRNA sequence
ctgtaatcccaacactttgg

SEQ ID NO: 137562 - DNA, 20 bp, Artificial
  CRISPR gRNA sequence
tgtaatcccaacactttggg

SEQ ID NO: 137563 - DNA, 20 bp, Artificial
  CRISPR gRNA sequence
tcccaacactttgggaggct

SEQ ID NO: 137564 - DNA, 20 bp, Artificial
  CRISPR gRNA sequence
cccaacactttgggaggctg

SEQ ID NO: 137565 - DNA, 20 bp, Artificial
  CRISPR gRNA sequence
aacactttgggaggctgagg

SEQ ID NO: 137566 - DNA, 20 bp, Artificial
  CRISPR gRNA sequence
acactttgggaggctgaggc

SEQ ID NO: 137567 - DNA, 20 bp, Artificial
  CRISPR gRNA sequence
ctttgggaggctgaggcggg

SEQ ID NO: 137568 - DNA, 20 bp, Artificial
  CRISPR gRNA sequence
cgggcggattacttgaaatc

SEQ ID NO: 137569 - DNA, 20 bp, Artificial
  CRISPR gRNA sequence
ggcggattacttgaaatcaa

SEQ ID NO: 137570 - DNA, 20 bp, Artificial
  CRISPR gRNA sequence
ttacttgaaatcaagagttt

SEQ ID NO: 137571 - DNA, 20 bp, Artificial
  CRISPR gRNA sequence
tgaaatcaagagtttgagac

SEQ ID NO: 137572 - DNA, 20 bp, Artificial
  CRISPR gRNA sequence
tcaagagtttgagaccagtc

SEQ ID NO: 137573 - DNA, 20 bp, Artificial
  CRISPR gRNA sequence
tgagaccagtctggccaacg

SEQ ID NO: 137574 - DNA, 20 bp, Artificial
  CRISPR gRNA sequence
tttactaaaattacaaaaat

SEQ ID NO: 137575 - DNA, 20 bp, Artificial
  CRISPR gRNA sequence
ctaaaattacaaaaattagc

SEQ ID NO: 137576 - DNA, 20 bp, Artificial
  CRISPR gRNA sequence
taaaattacaaaaattagct

SEQ ID NO: 137577 - DNA, 20 bp, Artificial
  CRISPR gRNA sequence
ttacaaaaattagctgggcg

SEQ ID NO: 137578 - DNA, 20 bp, Artificial
  CRISPR gRNA sequence
caaaaattagctgggcgtgg

SEQ ID NO: 137579 - DNA, 20 bp, Artificial
  CRISPR gRNA sequence
gtggcgcatgcctgccatcc

SEQ ID NO: 137580 - DNA, 20 bp, Artificial
  CRISPR gRNA sequence
tgcctgccatcccagctact

SEQ ID NO: 137581 - DNA, 20 bp, Artificial
  CRISPR gRNA sequence
gcctgccatcccagctactc

SEQ ID NO: 137582 - DNA, 20 bp, Artificial
  CRISPR gRNA sequence
ctgccatcccagctactcgg

SEQ ID NO: 137583 - DNA, 20 bp, Artificial
  CRISPR gRNA sequence
tgccatcccagctactcggg

SEQ ID NO: 137584 - DNA, 20 bp, Artificial
  CRISPR gRNA sequence
atcccagctactcgggaggc

SEQ ID NO: 137585 - DNA, 20 bp, Artificial
  CRISPR gRNA sequence
tcccagctactcgggaggct

SEQ ID NO: 137586 - DNA, 20 bp, Artificial
  CRISPR gRNA sequence
ctactcgggaggctgggcat

SEQ ID NO: 137587 - DNA, 20 bp, Artificial
  CRISPR gRNA sequence
gcatgagaatcgcttgaacc

SEQ ID NO: 137588 - DNA, 20 bp, Artificial
  CRISPR gRNA sequence
tgagaatcgcttgaacccag

SEQ ID NO: 137589 - DNA, 20 bp, Artificial
  CRISPR gRNA sequence
gagaatcgcttgaacccaga

SEQ ID NO: 137590 - DNA, 20 bp, Artificial
  CRISPR gRNA sequence
aatcgcttgaacccagaagg

SEQ ID NO: 137591 - DNA, 20 bp, Artificial
  CRISPR gRNA sequence
tcgcttgaacccagaaggcg

SEQ ID NO: 137592 - DNA, 20 bp, Artificial
  CRISPR gRNA sequence
cgcttgaacccagaaggcgg

SEQ ID NO: 137593 - DNA, 20 bp, Artificial
  CRISPR gRNA sequence
aacccagaaggcggaggttg

SEQ ID NO: 137594 - DNA, 20 bp, Artificial
  CRISPR gRNA sequence
ggcggaggttgcagtgacct

SEQ ID NO: 137595 - DNA, 20 bp, Artificial
  CRISPR gRNA sequence
gaggttgcagtgacctgaga

SEQ ID NO: 137596 - DNA, 20 bp, Artificial
  CRISPR gRNA sequence
gagatggcaccactgcactc

SEQ ID NO: 137597 - DNA, 20 bp, Artificial
  CRISPR gRNA sequence
ggcaccactgcactccagcc

SEQ ID NO: 137598 - DNA, 20 bp, Artificial
  CRISPR gRNA sequence
gcaccactgcactccagcct

SEQ ID NO: 137599 - DNA, 20 bp, Artificial
  CRISPR gRNA sequence
ctgcactccagcctgggcga

SEQ ID NO: 137600 - DNA, 20 bp, Artificial
  CRISPR gRNA sequence
gcactccagcctgggcgaca

SEQ ID NO: 137601 - DNA, 20 bp, Artificial
  CRISPR gRNA sequence
tccagcctgggcgacagagt

SEQ ID NO: 137602 - DNA, 20 bp, Artificial
  CRISPR gRNA sequence
aaaacaaaacaaaactctga

SEQ ID NO: 137603 - DNA, 20 bp, Artificial
  CRISPR gRNA sequence
aacaaaacaaaactctgatg

SEQ ID NO: 137604 - DNA, 20 bp, Artificial
  CRISPR gRNA sequence
aaactctgatggagttgtgc

SEQ ID NO: 137605 - DNA, 20 bp, Artificial
  CRISPR gRNA sequence
ctctgatggagttgtgcaag

SEQ ID NO: 137606 - DNA, 20 bp, Artificial
  CRISPR gRNA sequence
tgttttttgttttgtttttt

SEQ ID NO: 137607 - DNA, 20 bp, Artificial
  CRISPR gRNA sequence
ttttgttttgttttttgaga

SEQ ID NO: 137608 - DNA, 20 bp, Artificial
  CRISPR gRNA sequence
ttgttttgttttttgagacg

SEQ ID NO: 137609 - DNA, 20 bp, Artificial
  CRISPR gRNA sequence
cggagtctcgctgtgctacc

SEQ ID NO: 137610 - DNA, 20 bp, Artificial
  CRISPR gRNA sequence
ggagtctcgctgtgctaccc

SEQ ID NO: 137611 - DNA, 20 bp, Artificial
  CRISPR gRNA sequence
tctcgctgtgctacccaggc

SEQ ID NO: 137612 - DNA, 20 bp, Artificial
  CRISPR gRNA sequence
tcgctgtgctacccaggctg

SEQ ID NO: 137613 - DNA, 20 bp, Artificial
  CRISPR gRNA sequence
gtgctacccaggctggagtg

SEQ ID NO: 137614 - DNA, 20 bp, Artificial
  CRISPR gRNA sequence
ctacccaggctggagtgcag

SEQ ID NO: 137615 - DNA, 20 bp, Artificial
  CRISPR gRNA sequence
ggagtgcagtggtgcaatct

SEQ ID NO: 137616 - DNA, 20 bp, Artificial
  CRISPR gRNA sequence
tcactgcaacctctgcctcc

SEQ ID NO: 137617 - DNA, 20 bp, Artificial
  CRISPR gRNA sequence
cactgcaacctctgcctcct

SEQ ID NO: 137618 - DNA, 20 bp, Artificial
  CRISPR gRNA sequence
aacctctgcctcctgggttt

SEQ ID NO: 137619 - DNA, 20 bp, Artificial
  CRISPR gRNA sequence
tttaagcgattctcctgcct

SEQ ID NO: 137620 - DNA, 20 bp, Artificial
  CRISPR gRNA sequence
ttctcctgcctcagcctctt

SEQ ID NO: 137621 - DNA, 20 bp, Artificial
  CRISPR gRNA sequence
tcctgcctcagcctcttgag

SEQ ID NO: 137622 - DNA, 20 bp, Artificial
  CRISPR gRNA sequence
gcctcagcctcttgagtagc

SEQ ID NO: 137623 - DNA, 20 bp, Artificial
  CRISPR gRNA sequence
cctcagcctcttgagtagct

SEQ ID NO: 137624 - DNA, 20 bp, Artificial
  CRISPR gRNA sequence
ctcttgagtagctgggatta

SEQ ID NO: 137625 - DNA, 20 bp, Artificial
  CRISPR gRNA sequence
tcttgagtagctgggattac

SEQ ID NO: 137626 - DNA, 20 bp, Artificial
  CRISPR gRNA sequence
caggtgcccgccaccacgcc

SEQ ID NO: 137627 - DNA, 20 bp, Artificial
  CRISPR gRNA sequence
gctaatttttgtatttttaa

SEQ ID NO: 137628 - DNA, 20 bp, Artificial
  CRISPR gRNA sequence
taatttttgtatttttaatg

SEQ ID NO: 137629 - DNA, 20 bp, Artificial
  CRISPR gRNA sequence
tttgtatttttaatggagac

SEQ ID NO: 137630 - DNA, 20 bp, Artificial
  CRISPR gRNA sequence
ttgtatttttaatggagact

SEQ ID NO: 137631 - DNA, 20 bp, Artificial
  CRISPR gRNA sequence
gagactgggtttcactatgt

SEQ ID NO: 137632 - DNA, 20 bp, Artificial
  CRISPR gRNA sequence
ctgggtttcactatgttggc

SEQ ID NO: 137633 - DNA, 20 bp, Artificial
  CRISPR gRNA sequence
tgggtttcactatgttggcc

SEQ ID NO: 137634 - DNA, 20 bp, Artificial
  CRISPR gRNA sequence
tttcactatgttggccaggc

SEQ ID NO: 137635 - DNA, 20 bp, Artificial
  CRISPR gRNA sequence
tggtctcgaactcctgacct

SEQ ID NO: 137636 - DNA, 20 bp, Artificial
  CRISPR gRNA sequence
ggtctcgaactcctgacctc

SEQ ID NO: 137637 - DNA, 20 bp, Artificial
  CRISPR gRNA sequence
ctcaggttatccgcccgcct

SEQ ID NO: 137638 - DNA, 20 bp, Artificial
  CRISPR gRNA sequence
ccgcccgccttggcctccca

SEQ ID NO: 137639 - DNA, 20 bp, Artificial
  CRISPR gRNA sequence
gccttggcctcccaaagtgt

SEQ ID NO: 137640 - DNA, 20 bp, Artificial
  CRISPR gRNA sequence
ccttggcctcccaaagtgtt

SEQ ID NO: 137641 - DNA, 20 bp, Artificial
  CRISPR gRNA sequence
ctcccaaagtgttgggatta

SEQ ID NO: 137642 - DNA, 20 bp, Artificial
  CRISPR gRNA sequence
tcccaaagtgttgggattac

SEQ ID NO: 137643 - DNA, 20 bp, Artificial
  CRISPR gRNA sequence
agtgttgggattacaggcgt

SEQ ID NO: 137644 - DNA, 20 bp, Artificial
  CRISPR gRNA sequence
caggcgtgagccactgctcc

SEQ ID NO: 137645 - DNA, 20 bp, Artificial
  CRISPR gRNA sequence
ccactgctcccagcctccat

SEQ ID NO: 137646 - DNA, 20 bp, Artificial
  CRISPR gRNA sequence
tcccagcctccatcagtttt

SEQ ID NO: 137647 - DNA, 20 bp, Artificial
  CRISPR gRNA sequence
tccatcagtttttggatgac

SEQ ID NO: 137648 - DNA, 20 bp, Artificial
  CRISPR gRNA sequence
ccatcagtttttggatgacc

SEQ ID NO: 137649 - DNA, 20 bp, Artificial
  CRISPR gRNA sequence
tggatgaccaggtatattgt

SEQ ID NO: 137650 - DNA, 20 bp, Artificial
  CRISPR gRNA sequence
tgaccaggtatattgttagt

SEQ ID NO: 137651 - DNA, 20 bp, Artificial
  CRISPR gRNA sequence
ccaggtatattgttagtgag

SEQ ID NO: 137652 - DNA, 20 bp, Artificial
  CRISPR gRNA sequence
agtgagcagtaatattttca

SEQ ID NO: 137653 - DNA, 20 bp, Artificial
  CRISPR gRNA sequence
gtgagcagtaatattttcaa

SEQ ID NO: 137654 - DNA, 20 bp, Artificial
  CRISPR gRNA sequence
caaaggaatcttttttttct

SEQ ID NO: 137655 - DNA, 20 bp, Artificial
  CRISPR gRNA sequence
aggaatcttttttttctgag

SEQ ID NO: 137656 - DNA, 20 bp, Artificial
  CRISPR gRNA sequence
aatcttttttttctgagcag

SEQ ID NO: 137657 - DNA, 20 bp, Artificial
  CRISPR gRNA sequence
atcttttttttctgagcagt

SEQ ID NO: 137658 - DNA, 20 bp, Artificial
  CRISPR gRNA sequence
ttctgagcagtaggtctcaa

SEQ ID NO: 137659 - DNA, 20 bp, Artificial
  CRISPR gRNA sequence
gagcagtaggtctcaacagt

SEQ ID NO: 137660 - DNA, 20 bp, Artificial
  CRISPR gRNA sequence
gtctcaacagtgagcttaaa

SEQ ID NO: 137661 - DNA, 20 bp, Artificial
  CRISPR gRNA sequence
atagtcaaccacgctgtaaa

SEQ ID NO: 137662 - DNA, 20 bp, Artificial
  CRISPR gRNA sequence
aaacagatgtgctgtcatcc

SEQ ID NO: 137663 - DNA, 20 bp, Artificial
  CRISPR gRNA sequence
tccaagctttgctccattta

SEQ ID NO: 137664 - DNA, 20 bp, Artificial
  CRISPR gRNA sequence
caagctttgctccatttata

SEQ ID NO: 137665 - DNA, 20 bp, Artificial
  CRISPR gRNA sequence
tttgctccatttatagagca

SEQ ID NO: 137666 - DNA, 20 bp, Artificial
  CRISPR gRNA sequence
ttgctccatttatagagcac

SEQ ID NO: 137667 - DNA, 20 bp, Artificial
  CRISPR gRNA sequence
ctccatttatagagcacagg

SEQ ID NO: 137668 - DNA, 20 bp, Artificial
  CRISPR gRNA sequence
ccatttatagagcacaggca

SEQ ID NO: 137669 - DNA, 20 bp, Artificial
  CRISPR gRNA sequence
tttatagagcacaggcagag

SEQ ID NO: 137670 - DNA, 20 bp, Artificial
  CRISPR gRNA sequence
gtagattttgtataattctt

SEQ ID NO: 137671 - DNA, 20 bp, Artificial
  CRISPR gRNA sequence
tagattttgtataattctta

SEQ ID NO: 137672 - DNA, 20 bp, Artificial
  CRISPR gRNA sequence
agattttgtataattcttaa

SEQ ID NO: 137673 - DNA, 20 bp, Artificial
  CRISPR gRNA sequence
tgtataattcttaagggccc

SEQ ID NO: 137674 - DNA, 20 bp, Artificial
  CRISPR gRNA sequence
cttaagggccctagaatttt

SEQ ID NO: 137675 - DNA, 20 bp, Artificial
  CRISPR gRNA sequence
gggccctagaatttttggaa

SEQ ID NO: 137676 - DNA, 20 bp, Artificial
  CRISPR gRNA sequence
gaatttttggaatggtaaat

SEQ ID NO: 137677 - DNA, 20 bp, Artificial
  CRISPR gRNA sequence
ttggaatggtaaatgagcat

SEQ ID NO: 137678 - DNA, 20 bp, Artificial
  CRISPR gRNA sequence
taaatgagcatcggcttcca

SEQ ID NO: 137679 - DNA, 20 bp, Artificial
  CRISPR gRNA sequence
aaatgagcatcggcttccac

SEQ ID NO: 137680 - DNA, 20 bp, Artificial
  CRISPR gRNA sequence
cacaggcattgacttctttg

SEQ ID NO: 137681 - DNA, 20 bp, Artificial
  CRISPR gRNA sequence
tgacttctttgtagctatga

SEQ ID NO: 137682 - DNA, 20 bp, Artificial
  CRISPR gRNA sequence
gtagctatgaaagtccttga

SEQ ID NO: 137683 - DNA, 20 bp, Artificial
  CRISPR gRNA sequence
tccttgatggcatcttcttc

SEQ ID NO: 137684 - DNA, 20 bp, Artificial
  CRISPR gRNA sequence
atggcatcttcttccagtaa

SEQ ID NO: 137685 - DNA, 20 bp, Artificial
  CRISPR gRNA sequence
tgaaattctgttgtttaatg

SEQ ID NO: 137686 - DNA, 20 bp, Artificial
  CRISPR gRNA sequence
attctgttgtttaatgtagc

SEQ ID NO: 137687 - DNA, 20 bp, Artificial
  CRISPR gRNA sequence
gccagttgcatcaattactc

SEQ ID NO: 137688 - DNA, 20 bp, Artificial
  CRISPR gRNA sequence
gttgcatcaattactctagc

SEQ ID NO: 137689 - DNA, 20 bp, Artificial
  CRISPR gRNA sequence
aattactctagctagatctt

SEQ ID NO: 137690 - DNA, 20 bp, Artificial
  CRISPR gRNA sequence
attactctagctagatcttc

SEQ ID NO: 137691 - DNA, 20 bp, Artificial
  CRISPR gRNA sequence
cttcgggataaaacttgctg

SEQ ID NO: 137692 - DNA, 20 bp, Artificial
  CRISPR gRNA sequence
acttgctgcagcttctacat

SEQ ID NO: 137693 - DNA, 20 bp, Artificial
  CRISPR gRNA sequence
caccttatacttttatgtta

SEQ ID NO: 137694 - DNA, 20 bp, Artificial
  CRISPR gRNA sequence
ccttatacttttatgttatg

SEQ ID NO: 137695 - DNA, 20 bp, Artificial
  CRISPR gRNA sequence
atacttttatgttatggaga

SEQ ID NO: 137696 - DNA, 20 bp, Artificial
  CRISPR gRNA sequence
atgaaccaacttttcttctg

SEQ ID NO: 137697 - DNA, 20 bp, Artificial
  CRISPR gRNA sequence
tgcagccccctcacctctct

SEQ ID NO: 137698 - DNA, 20 bp, Artificial
  CRISPR gRNA sequence
ctcacctctctcagccttca

SEQ ID NO: 137699 - DNA, 20 bp, Artificial
  CRISPR gRNA sequence
ctctcagccttcatagaatt

SEQ ID NO: 137700 - DNA, 20 bp, Artificial
  CRISPR gRNA sequence
ctcagccttcatagaattga

SEQ ID NO: 137701 - DNA, 20 bp, Artificial
  CRISPR gRNA sequence
gccttcatagaattgagagt

SEQ ID NO: 137702 - DNA, 20 bp, Artificial
  CRISPR gRNA sequence
ccttcatagaattgagagtt

SEQ ID NO: 137703 - DNA, 20 bp, Artificial
  CRISPR gRNA sequence
cttcatagaattgagagtta

SEQ ID NO: 137704 - DNA, 20 bp, Artificial
  CRISPR gRNA sequence
gttagggcattgctccacat

SEQ ID NO: 137705 - DNA, 20 bp, Artificial
  CRISPR gRNA sequence
ttagggcattgctccacatt

SEQ ID NO: 137706 - DNA, 20 bp, Artificial
  CRISPR gRNA sequence
cattgctccacattaggctt

SEQ ID NO: 137707 - DNA, 20 bp, Artificial
  CRISPR gRNA sequence
ccacattaggctttggctta

SEQ ID NO: 137708 - DNA, 20 bp, Artificial
  CRISPR gRNA sequence
cacattaggctttggcttaa

SEQ ID NO: 137709 - DNA, 20 bp, Artificial
  CRISPR gRNA sequence
tttggcttaaaggaatgttg

SEQ ID NO: 137710 - DNA, 20 bp, Artificial
  CRISPR gRNA sequence
gcttaaaggaatgttgtggt

SEQ ID NO: 137711 - DNA, 20 bp, Artificial
  CRISPR gRNA sequence
ggttggtttgatcttctgtc

SEQ ID NO: 137712 - DNA, 20 bp, Artificial
  CRISPR gRNA sequence
cactgaaactttcttcatat

SEQ ID NO: 137713 - DNA, 20 bp, Artificial
  CRISPR gRNA sequence
ctttcttcatatcagcaata

SEQ ID NO: 137714 - DNA, 20 bp, Artificial
  CRISPR gRNA sequence
tttcttatttgtgtgttcac

SEQ ID NO: 137715 - DNA, 20 bp, Artificial
  CRISPR gRNA sequence
tcttatttgtgtgttcactg

SEQ ID NO: 137716 - DNA, 20 bp, Artificial
  CRISPR gRNA sequence
cttatttgtgtgttcactgg

SEQ ID NO: 137717 - DNA, 20 bp, Artificial
  CRISPR gRNA sequence
tatttgtgtgttcactggag

SEQ ID NO: 137718 - DNA, 20 bp, Artificial
  CRISPR gRNA sequence
gagcacttttaatttccttc

SEQ ID NO: 137719 - DNA, 20 bp, Artificial
  CRISPR gRNA sequence
cttcaagaactttttctttg

SEQ ID NO: 137720 - DNA, 20 bp, Artificial
  CRISPR gRNA sequence
gaactttttctttgcagtca

SEQ ID NO: 137721 - DNA, 20 bp, Artificial
  CRISPR gRNA sequence
ttttctttgcagtcacagct

SEQ ID NO: 137722 - DNA, 20 bp, Artificial
  CRISPR gRNA sequence
tttctttgcagtcacagctt

SEQ ID NO: 137723 - DNA, 20 bp, Artificial
  CRISPR gRNA sequence
tttgcagtcacagcttgggt

SEQ ID NO: 137724 - DNA, 20 bp, Artificial
  CRISPR gRNA sequence
tcacagcttgggtaagtgtt

SEQ ID NO: 137725 - DNA, 20 bp, Artificial
  CRISPR gRNA sequence
cttgggtaagtgtttggtgc

SEQ ID NO: 137726 - DNA, 20 bp, Artificial
  CRISPR gRNA sequence
tgggtaagtgtttggtgcaa

SEQ ID NO: 137727 - DNA, 20 bp, Artificial
  CRISPR gRNA sequence
gggtaagtgtttggtgcaag

SEQ ID NO: 137728 - DNA, 20 bp, Artificial
  CRISPR gRNA sequence
agtgtttggtgcaagaggcc

SEQ ID NO: 137729 - DNA, 20 bp, Artificial
  CRISPR gRNA sequence
ggtgcaagaggcctagctct

SEQ ID NO: 137730 - DNA, 20 bp, Artificial
  CRISPR gRNA sequence
gcctagctcttggtccatct

SEQ ID NO: 137731 - DNA, 20 bp, Artificial
  CRISPR gRNA sequence
tcttttttttttttttgaac

SEQ ID NO: 137732 - DNA, 20 bp, Artificial
  CRISPR gRNA sequence
ttttttttttttttgaaccg

SEQ ID NO: 137733 - DNA, 20 bp, Artificial
  CRISPR gRNA sequence
cggagtcttgcactgtcgcc

SEQ ID NO: 137734 - DNA, 20 bp, Artificial
  CRISPR gRNA sequence
ggagtcttgcactgtcgccc

SEQ ID NO: 137735 - DNA, 20 bp, Artificial
  CRISPR gRNA sequence
tcttgcactgtcgcccaggc

SEQ ID NO: 137736 - DNA, 20 bp, Artificial
  CRISPR gRNA sequence
ttgcactgtcgcccaggctg

SEQ ID NO: 137737 - DNA, 20 bp, Artificial
  CRISPR gRNA sequence
tcgcccaggctggagtgcaa

SEQ ID NO: 137738 - DNA, 20 bp, Artificial
  CRISPR gRNA sequence
ggagtgcaatggtacgatct

SEQ ID NO: 137739 - DNA, 20 bp, Artificial
  CRISPR gRNA sequence
tgactgcaaccttcgcctcc

SEQ ID NO: 137740 - DNA, 20 bp, Artificial
  CRISPR gRNA sequence
gactgcaaccttcgcctcct

SEQ ID NO: 137741 - DNA, 20 bp, Artificial
  CRISPR gRNA sequence
aaccttcgcctcctgggttc

SEQ ID NO: 137742 - DNA, 20 bp, Artificial
  CRISPR gRNA sequence
ccttcgcctcctgggttcaa

SEQ ID NO: 137743 - DNA, 20 bp, Artificial
  CRISPR gRNA sequence
ttcaagagattcttctgcct

SEQ ID NO: 137744 - DNA, 20 bp, Artificial
  CRISPR gRNA sequence
ttcttctgcctcagcttccc

SEQ ID NO: 137745 - DNA, 20 bp, Artificial
  CRISPR gRNA sequence
ttctgcctcagcttcccaag

SEQ ID NO: 137746 - DNA, 20 bp, Artificial
  CRISPR gRNA sequence
gcctcagcttcccaagtagc

SEQ ID NO: 137747 - DNA, 20 bp, Artificial
  CRISPR gRNA sequence
cctcagcttcccaagtagct

SEQ ID NO: 137748 - DNA, 20 bp, Artificial
  CRISPR gRNA sequence
ttcccaagtagctgggatta

SEQ ID NO: 137749 - DNA, 20 bp, Artificial
  CRISPR gRNA sequence
tcccaagtagctgggattac

SEQ ID NO: 137750 - DNA, 20 bp, Artificial
  CRISPR gRNA sequence
caggcgcccactaccatgcc

SEQ ID NO: 137751 - DNA, 20 bp, Artificial
  CRISPR gRNA sequence
ctggctaatttttgtatttt

SEQ ID NO: 137752 - DNA, 20 bp, Artificial
  CRISPR gRNA sequence
gctaatttttgtatttttgg

SEQ ID NO: 137753 - DNA, 20 bp, Artificial
  CRISPR gRNA sequence
taatttttgtatttttggta

SEQ ID NO: 137754 - DNA, 20 bp, Artificial
  CRISPR gRNA sequence
tttttgtatttttggtagag

SEQ ID NO: 137755 - DNA, 20 bp, Artificial
  CRISPR gRNA sequence
ttttgtatttttggtagaga

SEQ ID NO: 137756 - DNA, 20 bp, Artificial
  CRISPR gRNA sequence
tttgtatttttggtagagaa

SEQ ID NO: 137757 - DNA, 20 bp, Artificial
  CRISPR gRNA sequence
ttgtatttttggtagagaag

SEQ ID NO: 137758 - DNA, 20 bp, Artificial
  CRISPR gRNA sequence
gagaaggggtttcatcatgt

SEQ ID NO: 137759 - DNA, 20 bp, Artificial
  CRISPR gRNA sequence
aggggtttcatcatgttggt

SEQ ID NO: 137760 - DNA, 20 bp, Artificial
  CRISPR gRNA sequence
ggggtttcatcatgttggtc

SEQ ID NO: 137761 - DNA, 20 bp, Artificial
  CRISPR gRNA sequence
gggtttcatcatgttggtca

SEQ ID NO: 137762 - DNA, 20 bp, Artificial
  CRISPR gRNA sequence
tttcatcatgttggtcaggg

SEQ ID NO: 137763 - DNA, 20 bp, Artificial
  CRISPR gRNA sequence
tggtcttgaactcctgacct

SEQ ID NO: 137764 - DNA, 20 bp, Artificial
  CRISPR gRNA sequence
ggtcttgaactcctgacctc

SEQ ID NO: 137765 - DNA, 20 bp, Artificial
  CRISPR gRNA sequence
ctcaggtgatccacccgcct

SEQ ID NO: 137766 - DNA, 20 bp, Artificial
  CRISPR gRNA sequence
ccacccgcctcggcctccca

SEQ ID NO: 137767 - DNA, 20 bp, Artificial
  CRISPR gRNA sequence
gcctcggcctcccaaagtgc

SEQ ID NO: 137768 - DNA, 20 bp, Artificial
  CRISPR gRNA sequence
cctcggcctcccaaagtgct

SEQ ID NO: 137769 - DNA, 20 bp, Artificial
  CRISPR gRNA sequence
ctcccaaagtgctgggatta

SEQ ID NO: 137770 - DNA, 20 bp, Artificial
  CRISPR gRNA sequence
tcccaaagtgctgggattac

SEQ ID NO: 137771 - DNA, 20 bp, Artificial
  CRISPR gRNA sequence
agtgctgggattacaggcat

SEQ ID NO: 137772 - DNA, 20 bp, Artificial
  CRISPR gRNA sequence
caggcatgagccaccgcgcc

SEQ ID NO: 137773 - DNA, 20 bp, Artificial
  CRISPR gRNA sequence
caccgcgcccagccccatat

SEQ ID NO: 137774 - DNA, 20 bp, Artificial
  CRISPR gRNA sequence
tttgatgtgctttcctcact

SEQ ID NO: 137775 - DNA, 20 bp, Artificial
  CRISPR gRNA sequence
tcactaagcttaatcatttc

SEQ ID NO: 137776 - DNA, 20 bp, Artificial
  CRISPR gRNA sequence
tttctagctttcgattgatt

SEQ ID NO: 137777 - DNA, 20 bp, Artificial
  CRISPR gRNA sequence
tagctttcgattgattgagt

SEQ ID NO: 137778 - DNA, 20 bp, Artificial
  CRISPR gRNA sequence
gctttcgattgattgagtta

SEQ ID NO: 137779 - DNA, 20 bp, Artificial
  CRISPR gRNA sequence
tcgattgattgagttagaga

SEQ ID NO: 137780 - DNA, 20 bp, Artificial
  CRISPR gRNA sequence
gattgattgagttagagaca

SEQ ID NO: 137781 - DNA, 20 bp, Artificial
  CRISPR gRNA sequence
cagagttttgttctgtcacc

SEQ ID NO: 137782 - DNA, 20 bp, Artificial
  CRISPR gRNA sequence
agagttttgttctgtcaccc

SEQ ID NO: 137783 - DNA, 20 bp, Artificial
  CRISPR gRNA sequence
ttttgttctgtcacccaggc

SEQ ID NO: 137784 - DNA, 20 bp, Artificial
  CRISPR gRNA sequence
ttgttctgtcacccaggctg

SEQ ID NO: 137785 - DNA, 20 bp, Artificial
  CRISPR gRNA sequence
ctgtcacccaggctggagtg

SEQ ID NO: 137786 - DNA, 20 bp, Artificial
  CRISPR gRNA sequence
tcacccaggctggagtgtgg

SEQ ID NO: 137787 - DNA, 20 bp, Artificial
  CRISPR gRNA sequence
ggagtgtggtggcatgatca

SEQ ID NO: 137788 - DNA, 20 bp, Artificial
  CRISPR gRNA sequence
atcatagctcactgctgccc

SEQ ID NO: 137789 - DNA, 20 bp, Artificial
  CRISPR gRNA sequence
cccaagtgatcctcccacct

SEQ ID NO: 137790 - DNA, 20 bp, Artificial
  CRISPR gRNA sequence
tcctcccacctcagccttct

SEQ ID NO: 137791 - DNA, 20 bp, Artificial
  CRISPR gRNA sequence
tcccacctcagccttctgag

SEQ ID NO: 137792 - DNA, 20 bp, Artificial
  CRISPR gRNA sequence
acctcagccttctgagtagc

SEQ ID NO: 137793 - DNA, 20 bp, Artificial
  CRISPR gRNA sequence
cctcagccttctgagtagct

SEQ ID NO: 137794 - DNA, 20 bp, Artificial
  CRISPR gRNA sequence
cttctgagtagctaggacca

SEQ ID NO: 137795 - DNA, 20 bp, Artificial
  CRISPR gRNA sequence
ttctgagtagctaggaccac

SEQ ID NO: 137796 - DNA, 20 bp, Artificial
  CRISPR gRNA sequence
ggaccacaggtgcatgccat

SEQ ID NO: 137797 - DNA, 20 bp, Artificial
  CRISPR gRNA sequence
ccacaggtgcatgccatcag

SEQ ID NO: 137798 - DNA, 20 bp, Artificial
  CRISPR gRNA sequence
cacaggtgcatgccatcagc

SEQ ID NO: 137799 - DNA, 20 bp, Artificial
  CRISPR gRNA sequence
gtgcatgccatcagcaggac

SEQ ID NO: 137800 - DNA, 20 bp, Artificial
  CRISPR gRNA sequence
tttttttttttttttttttt

SEQ ID NO: 137801 - DNA, 20 bp, Artificial
  CRISPR gRNA sequence
ttttttttttttttttttgg

SEQ ID NO: 137802 - DNA, 20 bp, Artificial
  CRISPR gRNA sequence
ttttttttttttttttggta

SEQ ID NO: 137803 - DNA, 20 bp, Artificial
  CRISPR gRNA sequence
ttttttttttttggtagaga

SEQ ID NO: 137804 - DNA, 20 bp, Artificial
  CRISPR gRNA sequence
tttttttttttggtagagat

SEQ ID NO: 137805 - DNA, 20 bp, Artificial
  CRISPR gRNA sequence
ttttttttttggtagagata

SEQ ID NO: 137806 - DNA, 20 bp, Artificial
  CRISPR gRNA sequence
tttttttttggtagagatag

SEQ ID NO: 137807 - DNA, 20 bp, Artificial
  CRISPR gRNA sequence
ttttttttggtagagatagg

SEQ ID NO: 137808 - DNA, 20 bp, Artificial
  CRISPR gRNA sequence
gggtgtctctctgtgttgcc

SEQ ID NO: 137809 - DNA, 20 bp, Artificial
  CRISPR gRNA sequence
gtctctctgtgttgccaagc

SEQ ID NO: 137810 - DNA, 20 bp, Artificial
  CRISPR gRNA sequence
ccaagctggtctcgaactcc

SEQ ID NO: 137811 - DNA, 20 bp, Artificial
  CRISPR gRNA sequence
ctcgaactcctggattcatg

SEQ ID NO: 137812 - DNA, 20 bp, Artificial
  CRISPR gRNA sequence
aactcctggattcatgcagt

SEQ ID NO: 137813 - DNA, 20 bp, Artificial
  CRISPR gRNA sequence
ttcatgcagtcagccctcct

SEQ ID NO: 137814 - DNA, 20 bp, Artificial
  CRISPR gRNA sequence
cagccctccttggtgcctca

SEQ ID NO: 137815 - DNA, 20 bp, Artificial
  CRISPR gRNA sequence
tccttggtgcctcaaagttc

SEQ ID NO: 137816 - DNA, 20 bp, Artificial
  CRISPR gRNA sequence
ccttggtgcctcaaagttct

SEQ ID NO: 137817 - DNA, 20 bp, Artificial
  CRISPR gRNA sequence
gcctcaaagttctgggatta

SEQ ID NO: 137818 - DNA, 20 bp, Artificial
  CRISPR gRNA sequence
cctcaaagttctgggattac

SEQ ID NO: 137819 - DNA, 20 bp, Artificial
  CRISPR gRNA sequence
agttctgggattacaggcgt

SEQ ID NO: 137820 - DNA, 20 bp, Artificial
  CRISPR gRNA sequence
caggcgtgagccaccacacc

SEQ ID NO: 137821 - DNA, 20 bp, Artificial
  CRISPR gRNA sequence
gagccaccacacctggcctt

SEQ ID NO: 137822 - DNA, 20 bp, Artificial
  CRISPR gRNA sequence
acacctggcctttagctttt

SEQ ID NO: 137823 - DNA, 20 bp, Artificial
  CRISPR gRNA sequence
ggcctttagcttttaagtga

SEQ ID NO: 137824 - DNA, 20 bp, Artificial
  CRISPR gRNA sequence
agcttttaagtgaaagatgt

SEQ ID NO: 137825 - DNA, 20 bp, Artificial
  CRISPR gRNA sequence
tgttcttttacttgaacgct

SEQ ID NO: 137826 - DNA, 20 bp, Artificial
  CRISPR gRNA sequence
ttcttttacttgaacgctta

SEQ ID NO: 137827 - DNA, 20 bp, Artificial
  CRISPR gRNA sequence
tcttttacttgaacgcttag

SEQ ID NO: 137828 - DNA, 20 bp, Artificial
  CRISPR gRNA sequence
tgaacgcttagaggccgttg

SEQ ID NO: 137829 - DNA, 20 bp, Artificial
  CRISPR gRNA sequence
gaacgcttagaggccgttgt

SEQ ID NO: 137830 - DNA, 20 bp, Artificial
  CRISPR gRNA sequence
aacgcttagaggccgttgta

SEQ ID NO: 137831 - DNA, 20 bp, Artificial
  CRISPR gRNA sequence
gaggccgttgtagggttatt

SEQ ID NO: 137832 - DNA, 20 bp, Artificial
  CRISPR gRNA sequence
gccgttgtagggttattaag

SEQ ID NO: 137833 - DNA, 20 bp, Artificial
  CRISPR gRNA sequence
gttattaagtggcgtaattt

SEQ ID NO: 137834 - DNA, 20 bp, Artificial
  CRISPR gRNA sequence
atttcagtattgctgtgtct

SEQ ID NO: 137835 - DNA, 20 bp, Artificial
  CRISPR gRNA sequence
tttcagtattgctgtgtctc

SEQ ID NO: 137836 - DNA, 20 bp, Artificial
  CRISPR gRNA sequence
tattgctgtgtctcaggtaa

SEQ ID NO: 137837 - DNA, 20 bp, Artificial
  CRISPR gRNA sequence
attgctgtgtctcaggtaat

SEQ ID NO: 137838 - DNA, 20 bp, Artificial
  CRISPR gRNA sequence
ttgctgtgtctcaggtaata

SEQ ID NO: 137839 - DNA, 20 bp, Artificial
  CRISPR gRNA sequence
gctgtgtctcaggtaatagg

SEQ ID NO: 137840 - DNA, 20 bp, Artificial
  CRISPR gRNA sequence
ctgtgtctcaggtaataggg

SEQ ID NO: 137841 - DNA, 20 bp, Artificial
  CRISPR gRNA sequence
ctcaggtaatagggaggccc

SEQ ID NO: 137842 - DNA, 20 bp, Artificial
  CRISPR gRNA sequence
tcaggtaatagggaggcccg

SEQ ID NO: 137843 - DNA, 20 bp, Artificial
  CRISPR gRNA sequence
ggtaatagggaggcccgagg

SEQ ID NO: 137844 - DNA, 20 bp, Artificial
  CRISPR gRNA sequence
gtaatagggaggcccgaggt

SEQ ID NO: 137845 - DNA, 20 bp, Artificial
  CRISPR gRNA sequence
agggaggcccgaggtgggaa

SEQ ID NO: 137846 - DNA, 20 bp, Artificial
  CRISPR gRNA sequence
aggcccgaggtgggaatggc

SEQ ID NO: 137847 - DNA, 20 bp, Artificial
  CRISPR gRNA sequence
ccgaggtgggaatggccagt

SEQ ID NO: 137848 - DNA, 20 bp, Artificial
  CRISPR gRNA sequence
aggtgggaatggccagttgg

SEQ ID NO: 137849 - DNA, 20 bp, Artificial
  CRISPR gRNA sequence
gtgggaatggccagttggta

SEQ ID NO: 137850 - DNA, 20 bp, Artificial
  CRISPR gRNA sequence
ggaatggccagttggtagag

SEQ ID NO: 137851 - DNA, 20 bp, Artificial
  CRISPR gRNA sequence
ttggtagagcagtatctgtg

SEQ ID NO: 137852 - DNA, 20 bp, Artificial
  CRISPR gRNA sequence
agtatctgtgaagcacaata

SEQ ID NO: 137853 - DNA, 20 bp, Artificial
  CRISPR gRNA sequence
aaagtgaaatgcaataaaac

SEQ ID NO: 137854 - DNA, 20 bp, Artificial
  CRISPR gRNA sequence
aagtgaaatgcaataaaaca

SEQ ID NO: 137855 - DNA, 20 bp, Artificial
  CRISPR gRNA sequence
aaatgcaataaaacaaggta

SEQ ID NO: 137856 - DNA, 20 bp, Artificial
  CRISPR gRNA sequence
aaacaaggtatagttgtaaa

SEQ ID NO: 137857 - DNA, 20 bp, Artificial
  CRISPR gRNA sequence
aacaaggtatagttgtaaaa

SEQ ID NO: 137858 - DNA, 20 bp, Artificial
  CRISPR gRNA sequence
aaaaggatgtcacctcatga

SEQ ID NO: 137859 - DNA, 20 bp, Artificial
  CRISPR gRNA sequence
aaggatgtcacctcatgaca

SEQ ID NO: 137860 - DNA, 20 bp, Artificial
  CRISPR gRNA sequence
aggatgtcacctcatgacag

SEQ ID NO: 137861 - DNA, 20 bp, Artificial
  CRISPR gRNA sequence
atgtcacctcatgacagagg

SEQ ID NO: 137862 - DNA, 20 bp, Artificial
  CRISPR gRNA sequence
ggaagatatgatcaaaatgc

SEQ ID NO: 137863 - DNA, 20 bp, Artificial
  CRISPR gRNA sequence
gatcaaaatgcaagtcacaa

SEQ ID NO: 137864 - DNA, 20 bp, Artificial
  CRISPR gRNA sequence
aaaatgcaagtcacaaaagt

SEQ ID NO: 137865 - DNA, 20 bp, Artificial
  CRISPR gRNA sequence
gcaagtcacaaaagtgagtg

SEQ ID NO: 137866 - DNA, 20 bp, Artificial
  CRISPR gRNA sequence
agtcacaaaagtgagtgaag

SEQ ID NO: 137867 - DNA, 20 bp, Artificial
  CRISPR gRNA sequence
gtcacaaaagtgagtgaaga

SEQ ID NO: 137868 - DNA, 20 bp, Artificial
  CRISPR gRNA sequence
caaaagtgagtgaagaaggt

SEQ ID NO: 137869 - DNA, 20 bp, Artificial
  CRISPR gRNA sequence
gaaggtaagtgccttgatca

SEQ ID NO: 137870 - DNA, 20 bp, Artificial
  CRISPR gRNA sequence
aggtaagtgccttgatcata

SEQ ID NO: 137871 - DNA, 20 bp, Artificial
  CRISPR gRNA sequence
gtaagtgccttgatcataga

SEQ ID NO: 137872 - DNA, 20 bp, Artificial
  CRISPR gRNA sequence
gagatacttgttgacatgtt

SEQ ID NO: 137873 - DNA, 20 bp, Artificial
  CRISPR gRNA sequence
tacttgttgacatgttaagt

SEQ ID NO: 137874 - DNA, 20 bp, Artificial
  CRISPR gRNA sequence
cttgttgacatgttaagttg

SEQ ID NO: 137875 - DNA, 20 bp, Artificial
  CRISPR gRNA sequence
catgttaagttggagatgca

SEQ ID NO: 137876 - DNA, 20 bp, Artificial
  CRISPR gRNA sequence
atgttaagttggagatgcac

SEQ ID NO: 137877 - DNA, 20 bp, Artificial
  CRISPR gRNA sequence
aagttggagatgcacaggaa

SEQ ID NO: 137878 - DNA, 20 bp, Artificial
  CRISPR gRNA sequence
tggagatgcacaggaatggt

SEQ ID NO: 137879 - DNA, 20 bp, Artificial
  CRISPR gRNA sequence
ggagatgcacaggaatggtt

SEQ ID NO: 137880 - DNA, 20 bp, Artificial
  CRISPR gRNA sequence
ggttgggaactcaacccaaa

SEQ ID NO: 137881 - DNA, 20 bp, Artificial
  CRISPR gRNA sequence
gaactcaacccaaaaagcct

SEQ ID NO: 137882 - DNA, 20 bp, Artificial
  CRISPR gRNA sequence
aactcaacccaaaaagccta

SEQ ID NO: 137883 - DNA, 20 bp, Artificial
  CRISPR gRNA sequence
actcaacccaaaaagcctaa

SEQ ID NO: 137884 - DNA, 20 bp, Artificial
  CRISPR gRNA sequence
ccaaaaagcctaagggctgc

SEQ ID NO: 137885 - DNA, 20 bp, Artificial
  CRISPR gRNA sequence
aaagcctaagggctgcaagt

SEQ ID NO: 137886 - DNA, 20 bp, Artificial
  CRISPR gRNA sequence
ctaagggctgcaagtcggtt

SEQ ID NO: 137887 - DNA, 20 bp, Artificial
  CRISPR gRNA sequence
taagggctgcaagtcggttt

SEQ ID NO: 137888 - DNA, 20 bp, Artificial
  CRISPR gRNA sequence
aagggctgcaagtcggtttg

SEQ ID NO: 137889 - DNA, 20 bp, Artificial
  CRISPR gRNA sequence
agtcggtttggggaacatta

SEQ ID NO: 137890 - DNA, 20 bp, Artificial
  CRISPR gRNA sequence
gtcggtttggggaacattaa

SEQ ID NO: 137891 - DNA, 20 bp, Artificial
  CRISPR gRNA sequence
tcggtttggggaacattaaa

SEQ ID NO: 137892 - DNA, 20 bp, Artificial
  CRISPR gRNA sequence
cggtttggggaacattaaag

SEQ ID NO: 137893 - DNA, 20 bp, Artificial
  CRISPR gRNA sequence
ccaacattatatttgtttct

SEQ ID NO: 137894 - DNA, 20 bp, Artificial
  CRISPR gRNA sequence
cattatatttgtttcttagt

SEQ ID NO: 137895 - DNA, 20 bp, Artificial
  CRISPR gRNA sequence
tttgtttcttagtcagtact

SEQ ID NO: 137896 - DNA, 20 bp, Artificial
  CRISPR gRNA sequence
ttcttagtcagtactgagct

SEQ ID NO: 137897 - DNA, 20 bp, Artificial
  CRISPR gRNA sequence
atatatttgtttgcatttga

SEQ ID NO: 137898 - DNA, 20 bp, Artificial
  CRISPR gRNA sequence
atttgtttgcatttgacagt

SEQ ID NO: 137899 - DNA, 20 bp, Artificial
  CRISPR gRNA sequence
ttgtttgcatttgacagtga

SEQ ID NO: 137900 - DNA, 20 bp, Artificial
  CRISPR gRNA sequence
gacagtgagagcattatttt

SEQ ID NO: 137901 - DNA, 20 bp, Artificial
  CRISPR gRNA sequence
acagtgagagcattattttt

SEQ ID NO: 137902 - DNA, 20 bp, Artificial
  CRISPR gRNA sequence
ttaggtaaaacatgtcttcc

SEQ ID NO: 137903 - DNA, 20 bp, Artificial
  CRISPR gRNA sequence
taggtaaaacatgtcttccc

SEQ ID NO: 137904 - DNA, 20 bp, Artificial
  CRISPR gRNA sequence
taaaacatgtcttcccagga

SEQ ID NO: 137905 - DNA, 20 bp, Artificial
  CRISPR gRNA sequence
tcttcccaggatggttcaac

SEQ ID NO: 137906 - DNA, 20 bp, Artificial
  CRISPR gRNA sequence
tcccaggatggttcaactag

SEQ ID NO: 137907 - DNA, 20 bp, Artificial
  CRISPR gRNA sequence
ggatggttcaactagtagta

SEQ ID NO: 137908 - DNA, 20 bp, Artificial
  CRISPR gRNA sequence
atggttcaactagtagtaca

SEQ ID NO: 137909 - DNA, 20 bp, Artificial
  CRISPR gRNA sequence
tggttcaactagtagtacag

SEQ ID NO: 137910 - DNA, 20 bp, Artificial
  CRISPR gRNA sequence
ggttcaactagtagtacaga

SEQ ID NO: 137911 - DNA, 20 bp, Artificial
  CRISPR gRNA sequence
ctagtagtacagagggtctt

SEQ ID NO: 137912 - DNA, 20 bp, Artificial
  CRISPR gRNA sequence
gtttgattataatattgatg

SEQ ID NO: 137913 - DNA, 20 bp, Artificial
  CRISPR gRNA sequence
tataatattgatgaagaaaa

SEQ ID NO: 137914 - DNA, 20 bp, Artificial
  CRISPR gRNA sequence
ttgatgaagaaaaaagaaac

SEQ ID NO: 137915 - DNA, 20 bp, Artificial
  CRISPR gRNA sequence
agaaaaaagaaaccagttcc

SEQ ID NO: 137916 - DNA, 20 bp, Artificial
  CRISPR gRNA sequence
aaaagaaaccagttcctggc

SEQ ID NO: 137917 - DNA, 20 bp, Artificial
  CRISPR gRNA sequence
aaagaaaccagttcctggcc

SEQ ID NO: 137918 - DNA, 20 bp, Artificial
  CRISPR gRNA sequence
aagaaaccagttcctggccg

SEQ ID NO: 137919 - DNA, 20 bp, Artificial
  CRISPR gRNA sequence
ggccggggtcactctctgtg

SEQ ID NO: 137920 - DNA, 20 bp, Artificial
  CRISPR gRNA sequence
ccggggtcactctctgtgtg

SEQ ID NO: 137921 - DNA, 20 bp, Artificial
  CRISPR gRNA sequence
tcactctctgtgtggagttt

SEQ ID NO: 137922 - DNA, 20 bp, Artificial
  CRISPR gRNA sequence
gcattgtccccacgtctgtt

SEQ ID NO: 137923 - DNA, 20 bp, Artificial
  CRISPR gRNA sequence
cgtctgtttggttttttttc

SEQ ID NO: 137924 - DNA, 20 bp, Artificial
  CRISPR gRNA sequence
catcccgaatatgtgcatgt

SEQ ID NO: 137925 - DNA, 20 bp, Artificial
  CRISPR gRNA sequence
atcccgaatatgtgcatgtt

SEQ ID NO: 137926 - DNA, 20 bp, Artificial
  CRISPR gRNA sequence
tatgtgcatgttaggttaat

SEQ ID NO: 137927 - DNA, 20 bp, Artificial
  CRISPR gRNA sequence
ttggcacatctaaattgtct

SEQ ID NO: 137928 - DNA, 20 bp, Artificial
  CRISPR gRNA sequence
catctaaattgtctcagcct

SEQ ID NO: 137929 - DNA, 20 bp, Artificial
  CRISPR gRNA sequence
taaattgtctcagcctgagt

SEQ ID NO: 137930 - DNA, 20 bp, Artificial
  CRISPR gRNA sequence
aattgtctcagcctgagtga

SEQ ID NO: 137931 - DNA, 20 bp, Artificial
  CRISPR gRNA sequence
tgagagtgtgccctgtgatt

SEQ ID NO: 137932 - DNA, 20 bp, Artificial
  CRISPR gRNA sequence
tgccctgtgattgagttgtc

SEQ ID NO: 137933 - DNA, 20 bp, Artificial
  CRISPR gRNA sequence
gccctgtgattgagttgtcc

SEQ ID NO: 137934 - DNA, 20 bp, Artificial
  CRISPR gRNA sequence
gtgattgagttgtccaggct

SEQ ID NO: 137935 - DNA, 20 bp, Artificial
  CRISPR gRNA sequence
caccttgtgccctgaactgt

SEQ ID NO: 137936 - DNA, 20 bp, Artificial
  CRISPR gRNA sequence
accttgtgccctgaactgtt

SEQ ID NO: 137937 - DNA, 20 bp, Artificial
  CRISPR gRNA sequence
tgtgccctgaactgttggga

SEQ ID NO: 137938 - DNA, 20 bp, Artificial
  CRISPR gRNA sequence
gtgccctgaactgttgggat

SEQ ID NO: 137939 - DNA, 20 bp, Artificial
  CRISPR gRNA sequence
aatcatctgcaaccctgaac

SEQ ID NO: 137940 - DNA, 20 bp, Artificial
  CRISPR gRNA sequence
caaccctgaactggaataat

SEQ ID NO: 137941 - DNA, 20 bp, Artificial
  CRISPR gRNA sequence
aatcatcttacttttttttt

SEQ ID NO: 137942 - DNA, 20 bp, Artificial
  CRISPR gRNA sequence
atcatcttactttttttttt

SEQ ID NO: 137943 - DNA, 20 bp, Artificial
  CRISPR gRNA sequence
tcttacttttttttttggga

SEQ ID NO: 137944 - DNA, 20 bp, Artificial
  CRISPR gRNA sequence
ttacttttttttttgggacg

SEQ ID NO: 137945 - DNA, 20 bp, Artificial
  CRISPR gRNA sequence
gacggagtcttgctgtatcc

SEQ ID NO: 137946 - DNA, 20 bp, Artificial
  CRISPR gRNA sequence
agtcttgctgtatcccagta

SEQ ID NO: 137947 - DNA, 20 bp, Artificial
  CRISPR gRNA sequence
tcttgctgtatcccagtatg

SEQ ID NO: 137948 - DNA, 20 bp, Artificial
  CRISPR gRNA sequence
ctgtatcccagtatggagtg

SEQ ID NO: 137949 - DNA, 20 bp, Artificial
  CRISPR gRNA sequence
tatcccagtatggagtgcag

SEQ ID NO: 137950 - DNA, 20 bp, Artificial
  CRISPR gRNA sequence
ggagtgcagtggcatgatct

SEQ ID NO: 137951 - DNA, 20 bp, Artificial
  CRISPR gRNA sequence
tcactgcaacctccacctcc

SEQ ID NO: 137952 - DNA, 20 bp, Artificial
  CRISPR gRNA sequence
cactgcaacctccacctcct

SEQ ID NO: 137953 - DNA, 20 bp, Artificial
  CRISPR gRNA sequence
aacctccacctcctgggttc

SEQ ID NO: 137954 - DNA, 20 bp, Artificial
  CRISPR gRNA sequence
ttcaagcgattctcatgcct

SEQ ID NO: 137955 - DNA, 20 bp, Artificial
  CRISPR gRNA sequence
ttctcatgccttagcctccc

SEQ ID NO: 137956 - DNA, 20 bp, Artificial
  CRISPR gRNA sequence
tcatgccttagcctcccaag

SEQ ID NO: 137957 - DNA, 20 bp, Artificial
  CRISPR gRNA sequence
gccttagcctcccaagtagc

SEQ ID NO: 137958 - DNA, 20 bp, Artificial
  CRISPR gRNA sequence
ccttagcctcccaagtagct

SEQ ID NO: 137959 - DNA, 20 bp, Artificial
  CRISPR gRNA sequence
ctcccaagtagctgggatta

SEQ ID NO: 137960 - DNA, 20 bp, Artificial
  CRISPR gRNA sequence
tcccaagtagctgggattac

SEQ ID NO: 137961 - DNA, 20 bp, Artificial
  CRISPR gRNA sequence
caggcgcctgccaccatgcc

SEQ ID NO: 137962 - DNA, 20 bp, Artificial
  CRISPR gRNA sequence
ctggctaatttttgtatttt

SEQ ID NO: 137963 - DNA, 20 bp, Artificial
  CRISPR gRNA sequence
gctaatttttgtatttttag

SEQ ID NO: 137964 - DNA, 20 bp, Artificial
  CRISPR gRNA sequence
taatttttgtatttttagta

SEQ ID NO: 137965 - DNA, 20 bp, Artificial
  CRISPR gRNA sequence
ttttgtatttttagtagaga

SEQ ID NO: 137966 - DNA, 20 bp, Artificial
  CRISPR gRNA sequence
tttgtatttttagtagagac

SEQ ID NO: 137967 - DNA, 20 bp, Artificial
  CRISPR gRNA sequence
ttgtatttttagtagagaca

SEQ ID NO: 137968 - DNA, 20 bp, Artificial
  CRISPR gRNA sequence
gagacagggttttaccatgt

SEQ ID NO: 137969 - DNA, 20 bp, Artificial
  CRISPR gRNA sequence
cagggttttaccatgttggc

SEQ ID NO: 137970 - DNA, 20 bp, Artificial
  CRISPR gRNA sequence
agggttttaccatgttggcc

SEQ ID NO: 137971 - DNA, 20 bp, Artificial
  CRISPR gRNA sequence
ttttaccatgttggccaggc

SEQ ID NO: 137972 - DNA, 20 bp, Artificial
  CRISPR gRNA sequence
tggtcttgaactcctgacct

SEQ ID NO: 137973 - DNA, 20 bp, Artificial
  CRISPR gRNA sequence
ggtcttgaactcctgacctc

SEQ ID NO: 137974 - DNA, 20 bp, Artificial
  CRISPR gRNA sequence
ctcaggtgatcctcctgcct

SEQ ID NO: 137975 - DNA, 20 bp, Artificial
  CRISPR gRNA sequence
cctcctgcctcagcctccca

SEQ ID NO: 137976 - DNA, 20 bp, Artificial
  CRISPR gRNA sequence
ctgcctcagcctcccaaagt

SEQ ID NO: 137977 - DNA, 20 bp, Artificial
  CRISPR gRNA sequence
tgcctcagcctcccaaagtt

SEQ ID NO: 137978 - DNA, 20 bp, Artificial
  CRISPR gRNA sequence
gcctcagcctcccaaagttg

SEQ ID NO: 137979 - DNA, 20 bp, Artificial
  CRISPR gRNA sequence
gcctcccaaagttggggtta

SEQ ID NO: 137980 - DNA, 20 bp, Artificial
  CRISPR gRNA sequence
cctcccaaagttggggttac

SEQ ID NO: 137981 - DNA, 20 bp, Artificial
  CRISPR gRNA sequence
aaagttggggttacaggtgt

SEQ ID NO: 137982 - DNA, 20 bp, Artificial
  CRISPR gRNA sequence
caggtgtgagccaccgcacc

SEQ ID NO: 137983 - DNA, 20 bp, Artificial
  CRISPR gRNA sequence
ctttctttttctttttcttt

SEQ ID NO: 137984 - DNA, 20 bp, Artificial
  CRISPR gRNA sequence
tctttttctttttcttttgg

SEQ ID NO: 137985 - DNA, 20 bp, Artificial
  CRISPR gRNA sequence
ctttttctttttcttttggc

SEQ ID NO: 137986 - DNA, 20 bp, Artificial
  CRISPR gRNA sequence
tttttctttttcttttggcg

SEQ ID NO: 137987 - DNA, 20 bp, Artificial
  CRISPR gRNA sequence
ttttctttttcttttggcgg

SEQ ID NO: 137988 - DNA, 20 bp, Artificial
  CRISPR gRNA sequence
tctttttcttttggcggggg

SEQ ID NO: 137989 - DNA, 20 bp, Artificial
  CRISPR gRNA sequence
ctttttcttttggcgggggc

SEQ ID NO: 137990 - DNA, 20 bp, Artificial
  CRISPR gRNA sequence
tttttcttttggcgggggcg

SEQ ID NO: 137991 - DNA, 20 bp, Artificial
  CRISPR gRNA sequence
ttttcttttggcgggggcgg

SEQ ID NO: 137992 - DNA, 20 bp, Artificial
  CRISPR gRNA sequence
cttttggcgggggcggggga

SEQ ID NO: 137993 - DNA, 20 bp, Artificial
  CRISPR gRNA sequence
tttggcgggggcgggggaca

SEQ ID NO: 137994 - DNA, 20 bp, Artificial
  CRISPR gRNA sequence
acagagtcttgctctgttgc

SEQ ID NO: 137995 - DNA, 20 bp, Artificial
  CRISPR gRNA sequence
cagagtcttgctctgttgcc

SEQ ID NO: 137996 - DNA, 20 bp, Artificial
  CRISPR gRNA sequence
cttgctctgttgccaggctc

SEQ ID NO: 137997 - DNA, 20 bp, Artificial
  CRISPR gRNA sequence
tctgttgccaggctctagtg

SEQ ID NO: 137998 - DNA, 20 bp, Artificial
  CRISPR gRNA sequence
gttgccaggctctagtgcag

SEQ ID NO: 137999 - DNA, 20 bp, Artificial
  CRISPR gRNA sequence
ctagtgcagtggcgcgacct

SEQ ID NO: 138000 - DNA, 20 bp, Artificial
  CRISPR gRNA sequence
ggcgcgacctcagctcactg

SEQ ID NO: 138001 - DNA, 20 bp, Artificial
  CRISPR gRNA sequence
tcactgcagcctccacctcc

SEQ ID NO: 138002 - DNA, 20 bp, Artificial
  CRISPR gRNA sequence
agcctccacctcctggattc

SEQ ID NO: 138003 - DNA, 20 bp, Artificial
  CRISPR gRNA sequence
ttcaagcgattcccccgcct

SEQ ID NO: 138004 - DNA, 20 bp, Artificial
  CRISPR gRNA sequence
ttcccccgcctcagcctcct

SEQ ID NO: 138005 - DNA, 20 bp, Artificial
  CRISPR gRNA sequence
ccccgcctcagcctcctgag

SEQ ID NO: 138006 - DNA, 20 bp, Artificial
  CRISPR gRNA sequence
gcctcagcctcctgagtagc

SEQ ID NO: 138007 - DNA, 20 bp, Artificial
  CRISPR gRNA sequence
cctcagcctcctgagtagct

SEQ ID NO: 138008 - DNA, 20 bp, Artificial
  CRISPR gRNA sequence
ctcctgagtagctgggacta

SEQ ID NO: 138009 - DNA, 20 bp, Artificial
  CRISPR gRNA sequence
tcctgagtagctgggactac

SEQ ID NO: 138010 - DNA, 20 bp, Artificial
  CRISPR gRNA sequence
caggtgtacgccaccacacc

SEQ ID NO: 138011 - DNA, 20 bp, Artificial
  CRISPR gRNA sequence
cagctaattttttatatttt

SEQ ID NO: 138012 - DNA, 20 bp, Artificial
  CRISPR gRNA sequence
ctaattttttatatttttag

SEQ ID NO: 138013 - DNA, 20 bp, Artificial
  CRISPR gRNA sequence
aattttttatatttttagta

SEQ ID NO: 138014 - DNA, 20 bp, Artificial
  CRISPR gRNA sequence
ttttatatttttagtagaga

SEQ ID NO: 138015 - DNA, 20 bp, Artificial
  CRISPR gRNA sequence
tttatatttttagtagagat

SEQ ID NO: 138016 - DNA, 20 bp, Artificial
  CRISPR gRNA sequence
ttatatttttagtagagatg

SEQ ID NO: 138017 - DNA, 20 bp, Artificial
  CRISPR gRNA sequence
gagatggggtttcaccatgt

SEQ ID NO: 138018 - DNA, 20 bp, Artificial
  CRISPR gRNA sequence
tggggtttcaccatgttggc

SEQ ID NO: 138019 - DNA, 20 bp, Artificial
  CRISPR gRNA sequence
ggggtttcaccatgttggcc

SEQ ID NO: 138020 - DNA, 20 bp, Artificial
  CRISPR gRNA sequence
tttcaccatgttggccagga

SEQ ID NO: 138021 - DNA, 20 bp, Artificial
  CRISPR gRNA sequence
acctcgtgatctgcccacct

SEQ ID NO: 138022 - DNA, 20 bp, Artificial
  CRISPR gRNA sequence
ctgcccacctcggcctctca

SEQ ID NO: 138023 - DNA, 20 bp, Artificial
  CRISPR gRNA sequence
acctcggcctctcaaagtgc

SEQ ID NO: 138024 - DNA, 20 bp, Artificial
  CRISPR gRNA sequence
cctcggcctctcaaagtgct

SEQ ID NO: 138025 - DNA, 20 bp, Artificial
  CRISPR gRNA sequence
ctctcaaagtgctgggttta

SEQ ID NO: 138026 - DNA, 20 bp, Artificial
  CRISPR gRNA sequence
tctcaaagtgctgggtttac

SEQ ID NO: 138027 - DNA, 20 bp, Artificial
  CRISPR gRNA sequence
agtgctgggtttacaggcgt

SEQ ID NO: 138028 - DNA, 20 bp, Artificial
  CRISPR gRNA sequence
caggcgtgagccaccgcgcc

SEQ ID NO: 138029 - DNA, 20 bp, Artificial
  CRISPR gRNA sequence
tgagccaccgcgcctggccc

SEQ ID NO: 138030 - DNA, 20 bp, Artificial
  CRISPR gRNA sequence
atctttcttcaatgtatgta

SEQ ID NO: 138031 - DNA, 20 bp, Artificial
  CRISPR gRNA sequence
tgtatagttcatacttattt

SEQ ID NO: 138032 - DNA, 20 bp, Artificial
  CRISPR gRNA sequence
cttatttcagtgtttaatat

SEQ ID NO: 138033 - DNA, 20 bp, Artificial
  CRISPR gRNA sequence
atttcagtgtttaatattag

SEQ ID NO: 138034 - DNA, 20 bp, Artificial
  CRISPR gRNA sequence
gaagtgtcttgatctttatt

SEQ ID NO: 138035 - DNA, 20 bp, Artificial
  CRISPR gRNA sequence
gtgtcttgatctttatttag

SEQ ID NO: 138036 - DNA, 20 bp, Artificial
  CRISPR gRNA sequence
ttgatctttatttagaagtt

SEQ ID NO: 138037 - DNA, 20 bp, Artificial
  CRISPR gRNA sequence
tttggtgatgtttttgtgac

SEQ ID NO: 138038 - DNA, 20 bp, Artificial
  CRISPR gRNA sequence
tgtttttgtgaccagaaata

SEQ ID NO: 138039 - DNA, 20 bp, Artificial
  CRISPR gRNA sequence
ttgtgaccagaaatatggaa

SEQ ID NO: 138040 - DNA, 20 bp, Artificial
  CRISPR gRNA sequence
tgtgaccagaaatatggaat

SEQ ID NO: 138041 - DNA, 20 bp, Artificial
  CRISPR gRNA sequence
taactcttatttatgtcaat

SEQ ID NO: 138042 - DNA, 20 bp, Artificial
  CRISPR gRNA sequence
tatttatgtcaattagcctt

SEQ ID NO: 138043 - DNA, 20 bp, Artificial
  CRISPR gRNA sequence
caattagcctttggtaaaat

SEQ ID NO: 138044 - DNA, 20 bp, Artificial
  CRISPR gRNA sequence
aattggttttgttatatgtt

SEQ ID NO: 138045 - DNA, 20 bp, Artificial
  CRISPR gRNA sequence
ttttgttatatgtttggctt

SEQ ID NO: 138046 - DNA, 20 bp, Artificial
  CRISPR gRNA sequence
tatatgtttggcttaagttg

SEQ ID NO: 138047 - DNA, 20 bp, Artificial
  CRISPR gRNA sequence
tggcttaagttgcggtttcc

SEQ ID NO: 138048 - DNA, 20 bp, Artificial
  CRISPR gRNA sequence
gcttaagttgcggtttccaa

SEQ ID NO: 138049 - DNA, 20 bp, Artificial
  CRISPR gRNA sequence
cggtttccaagagcctatcg

SEQ ID NO: 138050 - DNA, 20 bp, Artificial
  CRISPR gRNA sequence
aagagcctatcgaagacatt

SEQ ID NO: 138051 - DNA, 20 bp, Artificial
  CRISPR gRNA sequence
agagcctatcgaagacatta

SEQ ID NO: 138052 - DNA, 20 bp, Artificial
  CRISPR gRNA sequence
gagcctatcgaagacattaa

SEQ ID NO: 138053 - DNA, 20 bp, Artificial
  CRISPR gRNA sequence
gcctatcgaagacattaagg

SEQ ID NO: 138054 - DNA, 20 bp, Artificial
  CRISPR gRNA sequence
cctatcgaagacattaaggg

SEQ ID NO: 138055 - DNA, 20 bp, Artificial
  CRISPR gRNA sequence
ggacttaactttgctttaat

SEQ ID NO: 138056 - DNA, 20 bp, Artificial
  CRISPR gRNA sequence
cttaactttgctttaattgg

SEQ ID NO: 138057 - DNA, 20 bp, Artificial
  CRISPR gRNA sequence
aactttgctttaattggaag

SEQ ID NO: 138058 - DNA, 20 bp, Artificial
  CRISPR gRNA sequence
gctttaattggaagcagcat

SEQ ID NO: 138059 - DNA, 20 bp, Artificial
  CRISPR gRNA sequence
aattggaagcagcattggtc

SEQ ID NO: 138060 - DNA, 20 bp, Artificial
  CRISPR gRNA sequence
aagcagcattggtcaagaat

SEQ ID NO: 138061 - DNA, 20 bp, Artificial
  CRISPR gRNA sequence
agcagcattggtcaagaatt

SEQ ID NO: 138062 - DNA, 20 bp, Artificial
  CRISPR gRNA sequence
tcaagaattgggtttcattt

SEQ ID NO: 138063 - DNA, 20 bp, Artificial
  CRISPR gRNA sequence
agaattgggtttcattttag

SEQ ID NO: 138064 - DNA, 20 bp, Artificial
  CRISPR gRNA sequence
aattgggtttcattttagcg

SEQ ID NO: 138065 - DNA, 20 bp, Artificial
  CRISPR gRNA sequence
cattttagcggagcttcctg

SEQ ID NO: 138066 - DNA, 20 bp, Artificial
  CRISPR gRNA sequence
ttcctgtggtctttttccct

SEQ ID NO: 138067 - DNA, 20 bp, Artificial
  CRISPR gRNA sequence
tgtggtctttttcccttgga

SEQ ID NO: 138068 - DNA, 20 bp, Artificial
  CRISPR gRNA sequence
ttggacagttgttgtgatgt

SEQ ID NO: 138069 - DNA, 20 bp, Artificial
  CRISPR gRNA sequence
tggacagttgttgtgatgtt

SEQ ID NO: 138070 - DNA, 20 bp, Artificial
  CRISPR gRNA sequence
tgttgtgatgttaggttttt

SEQ ID NO: 138071 - DNA, 20 bp, Artificial
  CRISPR gRNA sequence
atctcccaacaacatctatt

SEQ ID NO: 138072 - DNA, 20 bp, Artificial
  CRISPR gRNA sequence
caacaacatctatttagttt

SEQ ID NO: 138073 - DNA, 20 bp, Artificial
  CRISPR gRNA sequence
atttagttttagttacctca

SEQ ID NO: 138074 - DNA, 20 bp, Artificial
  CRISPR gRNA sequence
ttagttttagttacctcaaa

SEQ ID NO: 138075 - DNA, 20 bp, Artificial
  CRISPR gRNA sequence
tacctcaaagagctgtattg

SEQ ID NO: 138076 - DNA, 20 bp, Artificial
  CRISPR gRNA sequence
acctcaaagagctgtattgt

SEQ ID NO: 138077 - DNA, 20 bp, Artificial
  CRISPR gRNA sequence
aaagagctgtattgtgggtt

SEQ ID NO: 138078 - DNA, 20 bp, Artificial
  CRISPR gRNA sequence
aagagctgtattgtgggttt

SEQ ID NO: 138079 - DNA, 20 bp, Artificial
  CRISPR gRNA sequence
gtgggtttaggctactataa

SEQ ID NO: 138080 - DNA, 20 bp, Artificial
  CRISPR gRNA sequence
gggtttaggctactataaaa

SEQ ID NO: 138081 - DNA, 20 bp, Artificial
  CRISPR gRNA sequence
taggctactataaaagagtt

SEQ ID NO: 138082 - DNA, 20 bp, Artificial
  CRISPR gRNA sequence
tactataaaagagtttggta

SEQ ID NO: 138083 - DNA, 20 bp, Artificial
  CRISPR gRNA sequence
ctataaaagagtttggtata

SEQ ID NO: 138084 - DNA, 20 bp, Artificial
  CRISPR gRNA sequence
agagtttggtatagagaatg

SEQ ID NO: 138085 - DNA, 20 bp, Artificial
  CRISPR gRNA sequence
tagagaatgaagtacatgcc

SEQ ID NO: 138086 - DNA, 20 bp, Artificial
  CRISPR gRNA sequence
agagaatgaagtacatgcca

SEQ ID NO: 138087 - DNA, 20 bp, Artificial
  CRISPR gRNA sequence
atgaagtacatgccaaggaa

SEQ ID NO: 138088 - DNA, 20 bp, Artificial
  CRISPR gRNA sequence
gaagtacatgccaaggaata

SEQ ID NO: 138089 - DNA, 20 bp, Artificial
  CRISPR gRNA sequence
agtacatgccaaggaataga

SEQ ID NO: 138090 - DNA, 20 bp, Artificial
  CRISPR gRNA sequence
aggaatagagagctgaactg

SEQ ID NO: 138091 - DNA, 20 bp, Artificial
  CRISPR gRNA sequence
gagagctgaactgaagtcta

SEQ ID NO: 138092 - DNA, 20 bp, Artificial
  CRISPR gRNA sequence
agagctgaactgaagtctaa

SEQ ID NO: 138093 - DNA, 20 bp, Artificial
  CRISPR gRNA sequence
aactgaagtctaaaggtcct

SEQ ID NO: 138094 - DNA, 20 bp, Artificial
  CRISPR gRNA sequence
agtctaaaggtcctgagttt

SEQ ID NO: 138095 - DNA, 20 bp, Artificial
  CRISPR gRNA sequence
aggtcctgagtttcagaaac

SEQ ID NO: 138096 - DNA, 20 bp, Artificial
  CRISPR gRNA sequence
ggtcctgagtttcagaaacc

SEQ ID NO: 138097 - DNA, 20 bp, Artificial
  CRISPR gRNA sequence
gtcatattgcaataaaacct

SEQ ID NO: 138098 - DNA, 20 bp, Artificial
  CRISPR gRNA sequence
ttagatttctttttatttat

SEQ ID NO: 138099 - DNA, 20 bp, Artificial
  CRISPR gRNA sequence
tagatttctttttatttatg

SEQ ID NO: 138100 - DNA, 20 bp, Artificial
  CRISPR gRNA sequence
acatcctgttgttccatgcc

SEQ ID NO: 138101 - DNA, 20 bp, Artificial
  CRISPR gRNA sequence
catcctgttgttccatgccc

SEQ ID NO: 138102 - DNA, 20 bp, Artificial
  CRISPR gRNA sequence
ccatgcccaggcatatcact

SEQ ID NO: 138103 - DNA, 20 bp, Artificial
  CRISPR gRNA sequence
atgcccaggcatatcactaa

SEQ ID NO: 138104 - DNA, 20 bp, Artificial
  CRISPR gRNA sequence
cccaggcatatcactaagag

SEQ ID NO: 138105 - DNA, 20 bp, Artificial
  CRISPR gRNA sequence
catatcactaagagaagatt

SEQ ID NO: 138106 - DNA, 20 bp, Artificial
  CRISPR gRNA sequence
atcactaagagaagatttgg

SEQ ID NO: 138107 - DNA, 20 bp, Artificial
  CRISPR gRNA sequence
tcactaagagaagatttggc

SEQ ID NO: 138108 - DNA, 20 bp, Artificial
  CRISPR gRNA sequence
aagagaagatttggcaggca

SEQ ID NO: 138109 - DNA, 20 bp, Artificial
  CRISPR gRNA sequence
gatttggcaggcatggtacc

SEQ ID NO: 138110 - DNA, 20 bp, Artificial
  CRISPR gRNA sequence
ggcaggcatggtacctggtt

SEQ ID NO: 138111 - DNA, 20 bp, Artificial
  CRISPR gRNA sequence
caggcatggtacctggttga

SEQ ID NO: 138112 - DNA, 20 bp, Artificial
  CRISPR gRNA sequence
catggtacctggttgagagc

SEQ ID NO: 138113 - DNA, 20 bp, Artificial
  CRISPR gRNA sequence
tggtacctggttgagagcaa

SEQ ID NO: 138114 - DNA, 20 bp, Artificial
  CRISPR gRNA sequence
ggttgagagcaagagcttga

SEQ ID NO: 138115 - DNA, 20 bp, Artificial
  CRISPR gRNA sequence
agatttccaaacaattttaa

SEQ ID NO: 138116 - DNA, 20 bp, Artificial
  CRISPR gRNA sequence
gatttccaaacaattttaaa

SEQ ID NO: 138117 - DNA, 20 bp, Artificial
  CRISPR gRNA sequence
taaaaggaacactctgattt

SEQ ID NO: 138118 - DNA, 20 bp, Artificial
  CRISPR gRNA sequence
aaaaggaacactctgatttt

SEQ ID NO: 138119 - DNA, 20 bp, Artificial
  CRISPR gRNA sequence
ggatgttttgaaaacttctg

SEQ ID NO: 138120 - DNA, 20 bp, Artificial
  CRISPR gRNA sequence
gaagtttcatttttttcttt

SEQ ID NO: 138121 - DNA, 20 bp, Artificial
  CRISPR gRNA sequence
ttttttctttaagaatgata

SEQ ID NO: 138122 - DNA, 20 bp, Artificial
  CRISPR gRNA sequence
ttttctttaagaatgataaa

SEQ ID NO: 138123 - DNA, 20 bp, Artificial
  CRISPR gRNA sequence
taagaatgataaagagtaac

SEQ ID NO: 138124 - DNA, 20 bp, Artificial
  CRISPR gRNA sequence
gataaagagtaactggatat

SEQ ID NO: 138125 - DNA, 20 bp, Artificial
  CRISPR gRNA sequence
taaagagtaactggatataa

SEQ ID NO: 138126 - DNA, 20 bp, Artificial
  CRISPR gRNA sequence
gtaactggatataagagtaa

SEQ ID NO: 138127 - DNA, 20 bp, Artificial
  CRISPR gRNA sequence
ctggatataagagtaacagc

SEQ ID NO: 138128 - DNA, 20 bp, Artificial
  CRISPR gRNA sequence
cagctagattgcccactcat

SEQ ID NO: 138129 - DNA, 20 bp, Artificial
  CRISPR gRNA sequence
ctagattgcccactcatcag

SEQ ID NO: 138130 - DNA, 20 bp, Artificial
  CRISPR gRNA sequence
gattttccccttcttgctaa

SEQ ID NO: 138131 - DNA, 20 bp, Artificial
  CRISPR gRNA sequence
ttccccttcttgctaatgga

SEQ ID NO: 138132 - DNA, 20 bp, Artificial
  CRISPR gRNA sequence
ccttcttgctaatggatggc

SEQ ID NO: 138133 - DNA, 20 bp, Artificial
  CRISPR gRNA sequence
cttcttgctaatggatggcc

SEQ ID NO: 138134 - DNA, 20 bp, Artificial
  CRISPR gRNA sequence
cttgctaatggatggccagg

SEQ ID NO: 138135 - DNA, 20 bp, Artificial
  CRISPR gRNA sequence
tgctaatggatggccaggca

SEQ ID NO: 138136 - DNA, 20 bp, Artificial
  CRISPR gRNA sequence
gctaatggatggccaggcag

SEQ ID NO: 138137 - DNA, 20 bp, Artificial
  CRISPR gRNA sequence
acccattgtcattaatattt

SEQ ID NO: 138138 - DNA, 20 bp, Artificial
  CRISPR gRNA sequence
cagactttgctaatctatcc

SEQ ID NO: 138139 - DNA, 20 bp, Artificial
  CRISPR gRNA sequence
ctatcctggtcacttttctg

SEQ ID NO: 138140 - DNA, 20 bp, Artificial
  CRISPR gRNA sequence
atcctggtcacttttctgaa

SEQ ID NO: 138141 - DNA, 20 bp, Artificial
  CRISPR gRNA sequence
tcctggtcacttttctgaag

SEQ ID NO: 138142 - DNA, 20 bp, Artificial
  CRISPR gRNA sequence
gaagaggttctgactttgaa

SEQ ID NO: 138143 - DNA, 20 bp, Artificial
  CRISPR gRNA sequence
ctttgaaaagatttacactt

SEQ ID NO: 138144 - DNA, 20 bp, Artificial
  CRISPR gRNA sequence
aaaagatttacacttgagaa

SEQ ID NO: 138145 - DNA, 20 bp, Artificial
  CRISPR gRNA sequence
atggtatgcatccacatttc

SEQ ID NO: 138146 - DNA, 20 bp, Artificial
  CRISPR gRNA sequence
catccacatttccagccttc

SEQ ID NO: 138147 - DNA, 20 bp, Artificial
  CRISPR gRNA sequence
cagccttcaagtctgccttt

SEQ ID NO: 138148 - DNA, 20 bp, Artificial
  CRISPR gRNA sequence
caagtctgcctttcagcttc

SEQ ID NO: 138149 - DNA, 20 bp, Artificial
  CRISPR gRNA sequence
ttcagcttccagcactgtct

SEQ ID NO: 138150 - DNA, 20 bp, Artificial
  CRISPR gRNA sequence
cttttattttaaatccattt

SEQ ID NO: 138151 - DNA, 20 bp, Artificial
  CRISPR gRNA sequence
ttaaatccatttcagtaaat

SEQ ID NO: 138152 - DNA, 20 bp, Artificial
  CRISPR gRNA sequence
ccatttcagtaaatcagttt

SEQ ID NO: 138153 - DNA, 20 bp, Artificial
  CRISPR gRNA sequence
catttcagtaaatcagtttc

SEQ ID NO: 138154 - DNA, 20 bp, Artificial
  CRISPR gRNA sequence
ttcagtaaatcagtttcagg

SEQ ID NO: 138155 - DNA, 20 bp, Artificial
  CRISPR gRNA sequence
ttcaggtagatttctgattg

SEQ ID NO: 138156 - DNA, 20 bp, Artificial
  CRISPR gRNA sequence
ctgattgcagtcttgcttta

SEQ ID NO: 138157 - DNA, 20 bp, Artificial
  CRISPR gRNA sequence
gcagtcttgctttaaagtcc

SEQ ID NO: 138158 - DNA, 20 bp, Artificial
  CRISPR gRNA sequence
agtcttgctttaaagtcctg

SEQ ID NO: 138159 - DNA, 20 bp, Artificial
  CRISPR gRNA sequence
ttaaagtcctggagctcatt

SEQ ID NO: 138160 - DNA, 20 bp, Artificial
  CRISPR gRNA sequence
tcctggagctcatttagtct

SEQ ID NO: 138161 - DNA, 20 bp, Artificial
  CRISPR gRNA sequence
gctcatttagtctaagcttc

SEQ ID NO: 138162 - DNA, 20 bp, Artificial
  CRISPR gRNA sequence
tttagtctaagcttctggaa

SEQ ID NO: 138163 - DNA, 20 bp, Artificial
  CRISPR gRNA sequence
gcttgtgtaaccatttcctt

SEQ ID NO: 138164 - DNA, 20 bp, Artificial
  CRISPR gRNA sequence
gtgtaaccatttcctttggt

SEQ ID NO: 138165 - DNA, 20 bp, Artificial
  CRISPR gRNA sequence
tgtaaccatttcctttggtt

SEQ ID NO: 138166 - DNA, 20 bp, Artificial
  CRISPR gRNA sequence
tttggttaggcaattccaat

SEQ ID NO: 138167 - DNA, 20 bp, Artificial
  CRISPR gRNA sequence
ggcaattccaataagtatgt

SEQ ID NO: 138168 - DNA, 20 bp, Artificial
  CRISPR gRNA sequence
gcaattccaataagtatgtc

SEQ ID NO: 138169 - DNA, 20 bp, Artificial
  CRISPR gRNA sequence
caattccaataagtatgtca

SEQ ID NO: 138170 - DNA, 20 bp, Artificial
  CRISPR gRNA sequence
ccaataagtatgtcagggcc

SEQ ID NO: 138171 - DNA, 20 bp, Artificial
  CRISPR gRNA sequence
atgtcagggccaagctttcc

SEQ ID NO: 138172 - DNA, 20 bp, Artificial
  CRISPR gRNA sequence
cccttttttttttttcctga

SEQ ID NO: 138173 - DNA, 20 bp, Artificial
  CRISPR gRNA sequence
ccttttttttttttcctgaa

SEQ ID NO: 138174 - DNA, 20 bp, Artificial
  CRISPR gRNA sequence
ttttcctgaaaggccatacc

SEQ ID NO: 138175 - DNA, 20 bp, Artificial
  CRISPR gRNA sequence
tgaaaggccatacccagcat

SEQ ID NO: 138176 - DNA, 20 bp, Artificial
  CRISPR gRNA sequence
atcagtcttgcacctcctct

SEQ ID NO: 138177 - DNA, 20 bp, Artificial
  CRISPR gRNA sequence
tcagtcttgcacctcctctt

SEQ ID NO: 138178 - DNA, 20 bp, Artificial
  CRISPR gRNA sequence
cagtcttgcacctcctctta

SEQ ID NO: 138179 - DNA, 20 bp, Artificial
  CRISPR gRNA sequence
agtcttgcacctcctcttag

SEQ ID NO: 138180 - DNA, 20 bp, Artificial
  CRISPR gRNA sequence
cacctcctcttaggggtaat

SEQ ID NO: 138181 - DNA, 20 bp, Artificial
  CRISPR gRNA sequence
tcttaggggtaattagttat

SEQ ID NO: 138182 - DNA, 20 bp, Artificial
  CRISPR gRNA sequence
ttagttatcagactgtgtgc

SEQ ID NO: 138183 - DNA, 20 bp, Artificial
  CRISPR gRNA sequence
gactgtgtgctggatactgt

SEQ ID NO: 138184 - DNA, 20 bp, Artificial
  CRISPR gRNA sequence
actgtgtgctggatactgtg

SEQ ID NO: 138185 - DNA, 20 bp, Artificial
  CRISPR gRNA sequence
ctgtgtgctggatactgtga

SEQ ID NO: 138186 - DNA, 20 bp, Artificial
  CRISPR gRNA sequence
gctggatactgtgagggatc

SEQ ID NO: 138187 - DNA, 20 bp, Artificial
  CRISPR gRNA sequence
tggatactgtgagggatcca

SEQ ID NO: 138188 - DNA, 20 bp, Artificial
  CRISPR gRNA sequence
gatactgtgagggatccaga

SEQ ID NO: 138189 - DNA, 20 bp, Artificial
  CRISPR gRNA sequence
ccagagagatgaatcatatg

SEQ ID NO: 138190 - DNA, 20 bp, Artificial
  CRISPR gRNA sequence
catatgcagatcctaccctc

SEQ ID NO: 138191 - DNA, 20 bp, Artificial
  CRISPR gRNA sequence
atatgcagatcctaccctca

SEQ ID NO: 138192 - DNA, 20 bp, Artificial
  CRISPR gRNA sequence
atgcagatcctaccctcaag

SEQ ID NO: 138193 - DNA, 20 bp, Artificial
  CRISPR gRNA sequence
ctaccctcaaggagcttgta

SEQ ID NO: 138194 - DNA, 20 bp, Artificial
  CRISPR gRNA sequence
ccctcaaggagcttgtatag

SEQ ID NO: 138195 - DNA, 20 bp, Artificial
  CRISPR gRNA sequence
cctcaaggagcttgtatagc

SEQ ID NO: 138196 - DNA, 20 bp, Artificial
  CRISPR gRNA sequence
tcaaggagcttgtatagcag

SEQ ID NO: 138197 - DNA, 20 bp, Artificial
  CRISPR gRNA sequence
caaggagcttgtatagcagg

SEQ ID NO: 138198 - DNA, 20 bp, Artificial
  CRISPR gRNA sequence
aaggagcttgtatagcagga

SEQ ID NO: 138199 - DNA, 20 bp, Artificial
  CRISPR gRNA sequence
aggagcttgtatagcaggag

SEQ ID NO: 138200 - DNA, 20 bp, Artificial
  CRISPR gRNA sequence
tgtatagcaggaggggaaat

SEQ ID NO: 138201 - DNA, 20 bp, Artificial
  CRISPR gRNA sequence
cattgatgtgtatgtcatac

SEQ ID NO: 138202 - DNA, 20 bp, Artificial
  CRISPR gRNA sequence
attgatgtgtatgtcataca

SEQ ID NO: 138203 - DNA, 20 bp, Artificial
  CRISPR gRNA sequence
atcaaatacaatgattgtac

SEQ ID NO: 138204 - DNA, 20 bp, Artificial
  CRISPR gRNA sequence
tcaaatacaatgattgtaca

SEQ ID NO: 138205 - DNA, 20 bp, Artificial
  CRISPR gRNA sequence
aatgattgtacaaggtaatg

SEQ ID NO: 138206 - DNA, 20 bp, Artificial
  CRISPR gRNA sequence
attgtacaaggtaatgtggt

SEQ ID NO: 138207 - DNA, 20 bp, Artificial
  CRISPR gRNA sequence
ttgtacaaggtaatgtggtg

SEQ ID NO: 138208 - DNA, 20 bp, Artificial
  CRISPR gRNA sequence
acaaggtaatgtggtgagga

SEQ ID NO: 138209 - DNA, 20 bp, Artificial
  CRISPR gRNA sequence
ggtaatgtggtgaggacaga

SEQ ID NO: 138210 - DNA, 20 bp, Artificial
  CRISPR gRNA sequence
taatgtggtgaggacagaaa

SEQ ID NO: 138211 - DNA, 20 bp, Artificial
  CRISPR gRNA sequence
atgtggtgaggacagaaaga

SEQ ID NO: 138212 - DNA, 20 bp, Artificial
  CRISPR gRNA sequence
tgtggtgaggacagaaagag

SEQ ID NO: 138213 - DNA, 20 bp, Artificial
  CRISPR gRNA sequence
tgaggacagaaagagaggtg

SEQ ID NO: 138214 - DNA, 20 bp, Artificial
  CRISPR gRNA sequence
acagaaagagaggtgcagat

SEQ ID NO: 138215 - DNA, 20 bp, Artificial
  CRISPR gRNA sequence
cagaaagagaggtgcagatc

SEQ ID NO: 138216 - DNA, 20 bp, Artificial
  CRISPR gRNA sequence
cgggcctccttaatgctccc

SEQ ID NO: 138217 - DNA, 20 bp, Artificial
  CRISPR gRNA sequence
gggcctccttaatgctccca

SEQ ID NO: 138218 - DNA, 20 bp, Artificial
  CRISPR gRNA sequence
ggcctccttaatgctcccaa

SEQ ID NO: 138219 - DNA, 20 bp, Artificial
  CRISPR gRNA sequence
cctccttaatgctcccaagg

SEQ ID NO: 138220 - DNA, 20 bp, Artificial
  CRISPR gRNA sequence
ctccttaatgctcccaaggg

SEQ ID NO: 138221 - DNA, 20 bp, Artificial
  CRISPR gRNA sequence
tccttaatgctcccaaggga

SEQ ID NO: 138222 - DNA, 20 bp, Artificial
  CRISPR gRNA sequence
aatgctcccaagggagggac

SEQ ID NO: 138223 - DNA, 20 bp, Artificial
  CRISPR gRNA sequence
cccaagggagggaccagttc

SEQ ID NO: 138224 - DNA, 20 bp, Artificial
  CRISPR gRNA sequence
agggagggaccagttccaga

SEQ ID NO: 138225 - DNA, 20 bp, Artificial
  CRISPR gRNA sequence
gagggaccagttccagaaag

SEQ ID NO: 138226 - DNA, 20 bp, Artificial
  CRISPR gRNA sequence
ggaccagttccagaaagcag

SEQ ID NO: 138227 - DNA, 20 bp, Artificial
  CRISPR gRNA sequence
accagttccagaaagcagta

SEQ ID NO: 138228 - DNA, 20 bp, Artificial
  CRISPR gRNA sequence
aagcagtagagaatacttcg

SEQ ID NO: 138229 - DNA, 20 bp, Artificial
  CRISPR gRNA sequence
gcagtagagaatacttcgtg

SEQ ID NO: 138230 - DNA, 20 bp, Artificial
  CRISPR gRNA sequence
agtagagaatacttcgtgga

SEQ ID NO: 138231 - DNA, 20 bp, Artificial
  CRISPR gRNA sequence
gagaatacttcgtggagaga

SEQ ID NO: 138232 - DNA, 20 bp, Artificial
  CRISPR gRNA sequence
ttcgtggagagatagtaatt

SEQ ID NO: 138233 - DNA, 20 bp, Artificial
  CRISPR gRNA sequence
ggagagatagtaattgagtt

SEQ ID NO: 138234 - DNA, 20 bp, Artificial
  CRISPR gRNA sequence
gtaattgagttgagtgcctg

SEQ ID NO: 138235 - DNA, 20 bp, Artificial
  CRISPR gRNA sequence
gagttgagtgcctgtagtcc

SEQ ID NO: 138236 - DNA, 20 bp, Artificial
  CRISPR gRNA sequence
tgcctgtagtcccagctact

SEQ ID NO: 138237 - DNA, 20 bp, Artificial
  CRISPR gRNA sequence
gcctgtagtcccagctactt

SEQ ID NO: 138238 - DNA, 20 bp, Artificial
  CRISPR gRNA sequence
ctgtagtcccagctacttgg

SEQ ID NO: 138239 - DNA, 20 bp, Artificial
  CRISPR gRNA sequence
tgtagtcccagctacttggg

SEQ ID NO: 138240 - DNA, 20 bp, Artificial
  CRISPR gRNA sequence
cccagctacttgggaggctg

SEQ ID NO: 138241 - DNA, 20 bp, Artificial
  CRISPR gRNA sequence
agctacttgggaggctgtgg

SEQ ID NO: 138242 - DNA, 20 bp, Artificial
  CRISPR gRNA sequence
gctacttgggaggctgtggt

SEQ ID NO: 138243 - DNA, 20 bp, Artificial
  CRISPR gRNA sequence
tacttgggaggctgtggtag

SEQ ID NO: 138244 - DNA, 20 bp, Artificial
  CRISPR gRNA sequence
acttgggaggctgtggtagg

SEQ ID NO: 138245 - DNA, 20 bp, Artificial
  CRISPR gRNA sequence
ctgtggtaggaggattgctt

SEQ ID NO: 138246 - DNA, 20 bp, Artificial
  CRISPR gRNA sequence
gtaggaggattgcttgagcc

SEQ ID NO: 138247 - DNA, 20 bp, Artificial
  CRISPR gRNA sequence
taggaggattgcttgagccc

SEQ ID NO: 138248 - DNA, 20 bp, Artificial
  CRISPR gRNA sequence
ggaggattgcttgagcccag

SEQ ID NO: 138249 - DNA, 20 bp, Artificial
  CRISPR gRNA sequence
gaggattgcttgagcccagg

SEQ ID NO: 138250 - DNA, 20 bp, Artificial
  CRISPR gRNA sequence
gattgcttgagcccaggagg

SEQ ID NO: 138251 - DNA, 20 bp, Artificial
  CRISPR gRNA sequence
ttgcttgagcccaggaggta

SEQ ID NO: 138252 - DNA, 20 bp, Artificial
  CRISPR gRNA sequence
tgcttgagcccaggaggtag

SEQ ID NO: 138253 - DNA, 20 bp, Artificial
  CRISPR gRNA sequence
agcccaggaggtagaggctg

SEQ ID NO: 138254 - DNA, 20 bp, Artificial
  CRISPR gRNA sequence
caggaggtagaggctgcagt

SEQ ID NO: 138255 - DNA, 20 bp, Artificial
  CRISPR gRNA sequence
ggtagaggctgcagtgagcc

SEQ ID NO: 138256 - DNA, 20 bp, Artificial
  CRISPR gRNA sequence
aagatcacaccattgcactc

SEQ ID NO: 138257 - DNA, 20 bp, Artificial
  CRISPR gRNA sequence
cacaccattgcactccagcc

SEQ ID NO: 138258 - DNA, 20 bp, Artificial
  CRISPR gRNA sequence
acaccattgcactccagcct

SEQ ID NO: 138259 - DNA, 20 bp, Artificial
  CRISPR gRNA sequence
ttgcactccagcctgggcaa

SEQ ID NO: 138260 - DNA, 20 bp, Artificial
  CRISPR gRNA sequence
gcactccagcctgggcaaca

SEQ ID NO: 138261 - DNA, 20 bp, Artificial
  CRISPR gRNA sequence
tgggcaacagagcgaaaccc

SEQ ID NO: 138262 - DNA, 20 bp, Artificial
  CRISPR gRNA sequence
cagagcgaaaccctggcttt

SEQ ID NO: 138263 - DNA, 20 bp, Artificial
  CRISPR gRNA sequence
tggctttgagaaaaaaaaaa

SEQ ID NO: 138264 - DNA, 20 bp, Artificial
  CRISPR gRNA sequence
gctttgagaaaaaaaaaata

SEQ ID NO: 138265 - DNA, 20 bp, Artificial
  CRISPR gRNA sequence
tttgagaaaaaaaaaataga

SEQ ID NO: 138266 - DNA, 20 bp, Artificial
  CRISPR gRNA sequence
agaaaaaaaaaatagagaga

SEQ ID NO: 138267 - DNA, 20 bp, Artificial
  CRISPR gRNA sequence
aaaaaaaaaatagagagaaa

SEQ ID NO: 138268 - DNA, 20 bp, Artificial
  CRISPR gRNA sequence
aaaaaaatagagagaaagag

SEQ ID NO: 138269 - DNA, 20 bp, Artificial
  CRISPR gRNA sequence
agagaaagagtagtttaaca

SEQ ID NO: 138270 - DNA, 20 bp, Artificial
  CRISPR gRNA sequence
gagtagtttaacatggaatg

SEQ ID NO: 138271 - DNA, 20 bp, Artificial
  CRISPR gRNA sequence
gtagtttaacatggaatgaa

SEQ ID NO: 138272 - DNA, 20 bp, Artificial
  CRISPR gRNA sequence
tagtttaacatggaatgaag

SEQ ID NO: 138273 - DNA, 20 bp, Artificial
  CRISPR gRNA sequence
acatggaatgaagaggatcc

SEQ ID NO: 138274 - DNA, 20 bp, Artificial
  CRISPR gRNA sequence
aatgaagaggatcctggaat

SEQ ID NO: 138275 - DNA, 20 bp, Artificial
  CRISPR gRNA sequence
tttattattataattttttt

SEQ ID NO: 138276 - DNA, 20 bp, Artificial
  CRISPR gRNA sequence
ttattattataatttttttg

SEQ ID NO: 138277 - DNA, 20 bp, Artificial
  CRISPR gRNA sequence
ttattataatttttttgagg

SEQ ID NO: 138278 - DNA, 20 bp, Artificial
  CRISPR gRNA sequence
tattataatttttttgaggc

SEQ ID NO: 138279 - DNA, 20 bp, Artificial
  CRISPR gRNA sequence
attataatttttttgaggca

SEQ ID NO: 138280 - DNA, 20 bp, Artificial
  CRISPR gRNA sequence
cagggtctccctctgttgcc

SEQ ID NO: 138281 - DNA, 20 bp, Artificial
  CRISPR gRNA sequence
agggtctccctctgttgccc

SEQ ID NO: 138282 - DNA, 20 bp, Artificial
  CRISPR gRNA sequence
tctccctctgttgcccaggc

SEQ ID NO: 138283 - DNA, 20 bp, Artificial
  CRISPR gRNA sequence
tccctctgttgcccaggctg

SEQ ID NO: 138284 - DNA, 20 bp, Artificial
  CRISPR gRNA sequence
ctgttgcccaggctggagtg

SEQ ID NO: 138285 - DNA, 20 bp, Artificial
  CRISPR gRNA sequence
ttgcccaggctggagtgcag

SEQ ID NO: 138286 - DNA, 20 bp, Artificial
  CRISPR gRNA sequence
ggagtgcagtggtgtgatca

SEQ ID NO: 138287 - DNA, 20 bp, Artificial
  CRISPR gRNA sequence
ggtgtgatcatagctcactg

SEQ ID NO: 138288 - DNA, 20 bp, Artificial
  CRISPR gRNA sequence
tcactgtagcctcaaactcc

SEQ ID NO: 138289 - DNA, 20 bp, Artificial
  CRISPR gRNA sequence
cactgtagcctcaaactcct

SEQ ID NO: 138290 - DNA, 20 bp, Artificial
  CRISPR gRNA sequence
tagcctcaaactcctgggcc

SEQ ID NO: 138291 - DNA, 20 bp, Artificial
  CRISPR gRNA sequence
agcctcaaactcctgggccc

SEQ ID NO: 138292 - DNA, 20 bp, Artificial
  CRISPR gRNA sequence
cctcaaactcctgggcccag

SEQ ID NO: 138293 - DNA, 20 bp, Artificial
  CRISPR gRNA sequence
cccaggagatccttctgcct

SEQ ID NO: 138294 - DNA, 20 bp, Artificial
  CRISPR gRNA sequence
tccttctgcctcagcctcct

SEQ ID NO: 138295 - DNA, 20 bp, Artificial
  CRISPR gRNA sequence
ttctgcctcagcctcctgag

SEQ ID NO: 138296 - DNA, 20 bp, Artificial
  CRISPR gRNA sequence
cctcagcctcctgagtagct

SEQ ID NO: 138297 - DNA, 20 bp, Artificial
  CRISPR gRNA sequence
ttttttttattcttcttttt

SEQ ID NO: 138298 - DNA, 20 bp, Artificial
  CRISPR gRNA sequence
ttttattcttctttttgaga

SEQ ID NO: 138299 - DNA, 20 bp, Artificial
  CRISPR gRNA sequence
ttattcttctttttgagatg

SEQ ID NO: 138300 - DNA, 20 bp, Artificial
  CRISPR gRNA sequence
tggagtctcgctctgtcgcc

SEQ ID NO: 138301 - DNA, 20 bp, Artificial
  CRISPR gRNA sequence
ggagtctcgctctgtcgccc

SEQ ID NO: 138302 - DNA, 20 bp, Artificial
  CRISPR gRNA sequence
ctgtcgcccaggctgttgtg

SEQ ID NO: 138303 - DNA, 20 bp, Artificial
  CRISPR gRNA sequence
tcgcccaggctgttgtgcag

SEQ ID NO: 138304 - DNA, 20 bp, Artificial
  CRISPR gRNA sequence
tcactgcaacctccgcttcc

SEQ ID NO: 138305 - DNA, 20 bp, Artificial
  CRISPR gRNA sequence
cactgcaacctccgcttccc

SEQ ID NO: 138306 - DNA, 20 bp, Artificial
  CRISPR gRNA sequence
aacctccgcttcccaggttc

SEQ ID NO: 138307 - DNA, 20 bp, Artificial
  CRISPR gRNA sequence
ttccagtgaaactgttgcct

SEQ ID NO: 138308 - DNA, 20 bp, Artificial
  CRISPR gRNA sequence
aactgttgcctcagcctccc

SEQ ID NO: 138309 - DNA, 20 bp, Artificial
  CRISPR gRNA sequence
tgttgcctcagcctcccaag

SEQ ID NO: 138310 - DNA, 20 bp, Artificial
  CRISPR gRNA sequence
gcctcagcctcccaagtagc

SEQ ID NO: 138311 - DNA, 20 bp, Artificial
  CRISPR gRNA sequence
cctcagcctcccaagtagct

SEQ ID NO: 138312 - DNA, 20 bp, Artificial
  CRISPR gRNA sequence
tcccaagtagctgggattat

SEQ ID NO: 138313 - DNA, 20 bp, Artificial
  CRISPR gRNA sequence
taagcatgtgccaccatgct

SEQ ID NO: 138314 - DNA, 20 bp, Artificial
  CRISPR gRNA sequence
gctaatgtattttgtgtttt

SEQ ID NO: 138315 - DNA, 20 bp, Artificial
  CRISPR gRNA sequence
aatgtattttgtgtttttag

SEQ ID NO: 138316 - DNA, 20 bp, Artificial
  CRISPR gRNA sequence
ttttgtgtttttagtagaaa

SEQ ID NO: 138317 - DNA, 20 bp, Artificial
  CRISPR gRNA sequence
tttgtgtttttagtagaaac

SEQ ID NO: 138318 - DNA, 20 bp, Artificial
  CRISPR gRNA sequence
ttgtgtttttagtagaaaca

SEQ ID NO: 138319 - DNA, 20 bp, Artificial
  CRISPR gRNA sequence
gaaacagggttttgctatat

SEQ ID NO: 138320 - DNA, 20 bp, Artificial
  CRISPR gRNA sequence
cagggttttgctatattagc

SEQ ID NO: 138321 - DNA, 20 bp, Artificial
  CRISPR gRNA sequence
agggttttgctatattagcc

SEQ ID NO: 138322 - DNA, 20 bp, Artificial
  CRISPR gRNA sequence
ttttgctatattagccaggc

SEQ ID NO: 138323 - DNA, 20 bp, Artificial
  CRISPR gRNA sequence
ggtcttgaactcctgacctc

SEQ ID NO: 138324 - DNA, 20 bp, Artificial
  CRISPR gRNA sequence
cctcaagtgatcctccacct

SEQ ID NO: 138325 - DNA, 20 bp, Artificial
  CRISPR gRNA sequence
tcctccacctcagcctccca

SEQ ID NO: 138326 - DNA, 20 bp, Artificial
  CRISPR gRNA sequence
acctcagcctcccaaagtgt

SEQ ID NO: 138327 - DNA, 20 bp, Artificial
  CRISPR gRNA sequence
cctcagcctcccaaagtgtt

SEQ ID NO: 138328 - DNA, 20 bp, Artificial
  CRISPR gRNA sequence
ctcccaaagtgttgggatta

SEQ ID NO: 138329 - DNA, 20 bp, Artificial
  CRISPR gRNA sequence
tcccaaagtgttgggattac

SEQ ID NO: 138330 - DNA, 20 bp, Artificial
  CRISPR gRNA sequence
agtgttgggattacaggtgt

SEQ ID NO: 138331 - DNA, 20 bp, Artificial
  CRISPR gRNA sequence
gggattacaggtgtgagcca

SEQ ID NO: 138332 - DNA, 20 bp, Artificial
  CRISPR gRNA sequence
caggtgtgagccacagcccc

SEQ ID NO: 138333 - DNA, 20 bp, Artificial
  CRISPR gRNA sequence
gccttaaaaaatcctttttt

SEQ ID NO: 138334 - DNA, 20 bp, Artificial
  CRISPR gRNA sequence
cttaaaaaatccttttttta

SEQ ID NO: 138335 - DNA, 20 bp, Artificial
  CRISPR gRNA sequence
aaaaatcctttttttagaga

SEQ ID NO: 138336 - DNA, 20 bp, Artificial
  CRISPR gRNA sequence
aaatcctttttttagagaca

SEQ ID NO: 138337 - DNA, 20 bp, Artificial
  CRISPR gRNA sequence
cagagtctcactgtgttgcc

SEQ ID NO: 138338 - DNA, 20 bp, Artificial
  CRISPR gRNA sequence
agagtctcactgtgttgcca

SEQ ID NO: 138339 - DNA, 20 bp, Artificial
  CRISPR gRNA sequence
tctcactgtgttgccaaggc

SEQ ID NO: 138340 - DNA, 20 bp, Artificial
  CRISPR gRNA sequence
caaggctggtctcaaactac

SEQ ID NO: 138341 - DNA, 20 bp, Artificial
  CRISPR gRNA sequence
ggtctcaaactactggcctg

SEQ ID NO: 138342 - DNA, 20 bp, Artificial
  CRISPR gRNA sequence
ctgaagtgattctcctgtct

SEQ ID NO: 138343 - DNA, 20 bp, Artificial
  CRISPR gRNA sequence
gattctcctgtctcagcctc

SEQ ID NO: 138344 - DNA, 20 bp, Artificial
  CRISPR gRNA sequence
ttctcctgtctcagcctccg

SEQ ID NO: 138345 - DNA, 20 bp, Artificial
  CRISPR gRNA sequence
gtctcagcctccggagttgt

SEQ ID NO: 138346 - DNA, 20 bp, Artificial
  CRISPR gRNA sequence
tctcagcctccggagttgtt

SEQ ID NO: 138347 - DNA, 20 bp, Artificial
  CRISPR gRNA sequence
ctccggagttgttgggatta

SEQ ID NO: 138348 - DNA, 20 bp, Artificial
  CRISPR gRNA sequence
gttgttgggattacagacat

SEQ ID NO: 138349 - DNA, 20 bp, Artificial
  CRISPR gRNA sequence
cagacataagccacaacacc

SEQ ID NO: 138350 - DNA, 20 bp, Artificial
  CRISPR gRNA sequence
cattctttcccttattatcc

SEQ ID NO: 138351 - DNA, 20 bp, Artificial
  CRISPR gRNA sequence
tctttcccttattatcctag

SEQ ID NO: 138352 - DNA, 20 bp, Artificial
  CRISPR gRNA sequence
attatcctagaagatgaacc

SEQ ID NO: 138353 - DNA, 20 bp, Artificial
  CRISPR gRNA sequence
tgaacccagaatattttcca

SEQ ID NO: 138354 - DNA, 20 bp, Artificial
  CRISPR gRNA sequence
gaacccagaatattttccat

SEQ ID NO: 138355 - DNA, 20 bp, Artificial
  CRISPR gRNA sequence
gaatattttccatgggcttg

SEQ ID NO: 138356 - DNA, 20 bp, Artificial
  CRISPR gRNA sequence
gggcttgtagatgttgtaaa

SEQ ID NO: 138357 - DNA, 20 bp, Artificial
  CRISPR gRNA sequence
ttgtaaatggactacttctg

SEQ ID NO: 138358 - DNA, 20 bp, Artificial
  CRISPR gRNA sequence
tgcaattaatgcattaaaat

SEQ ID NO: 138359 - DNA, 20 bp, Artificial
  CRISPR gRNA sequence
caattaatgcattaaaataa

SEQ ID NO: 138360 - DNA, 20 bp, Artificial
  CRISPR gRNA sequence
aattaatgcattaaaataag

SEQ ID NO: 138361 - DNA, 20 bp, Artificial
  CRISPR gRNA sequence
aaataagaggtgattaacta

SEQ ID NO: 138362 - DNA, 20 bp, Artificial
  CRISPR gRNA sequence
tttatttatttatttatttt

SEQ ID NO: 138363 - DNA, 20 bp, Artificial
  CRISPR gRNA sequence
tttatttatttattttgaga

SEQ ID NO: 138364 - DNA, 20 bp, Artificial
  CRISPR gRNA sequence
tatttatttattttgagatg

SEQ ID NO: 138365 - DNA, 20 bp, Artificial
  CRISPR gRNA sequence
tggagtcttgctctgtcacc

SEQ ID NO: 138366 - DNA, 20 bp, Artificial
  CRISPR gRNA sequence
ggagtcttgctctgtcaccc

SEQ ID NO: 138367 - DNA, 20 bp, Artificial
  CRISPR gRNA sequence
tcttgctctgtcacccaggc

SEQ ID NO: 138368 - DNA, 20 bp, Artificial
  CRISPR gRNA sequence
ttgctctgtcacccaggctg

SEQ ID NO: 138369 - DNA, 20 bp, Artificial
  CRISPR gRNA sequence
ctgtcacccaggctggagtg

SEQ ID NO: 138370 - DNA, 20 bp, Artificial
  CRISPR gRNA sequence
tcacccaggctggagtgcag

SEQ ID NO: 138371 - DNA, 20 bp, Artificial
  CRISPR gRNA sequence
ggagtgcagtggcatgacct

SEQ ID NO: 138372 - DNA, 20 bp, Artificial
  CRISPR gRNA sequence
tcactgcaacctccacctcc

SEQ ID NO: 138373 - DNA, 20 bp, Artificial
  CRISPR gRNA sequence
cactgcaacctccacctcct

SEQ ID NO: 138374 - DNA, 20 bp, Artificial
  CRISPR gRNA sequence
acctccacctcctgggtttg

SEQ ID NO: 138375 - DNA, 20 bp, Artificial
  CRISPR gRNA sequence
gtttgcagcctccacctcct

SEQ ID NO: 138376 - DNA, 20 bp, Artificial
  CRISPR gRNA sequence
cctccacctccttggttccc

SEQ ID NO: 138377 - DNA, 20 bp, Artificial
  CRISPR gRNA sequence
ccacctccttggttcccgag

SEQ ID NO: 138378 - DNA, 20 bp, Artificial
  CRISPR gRNA sequence
ctccttggttcccgagtagc

SEQ ID NO: 138379 - DNA, 20 bp, Artificial
  CRISPR gRNA sequence
tccttggttcccgagtagct

SEQ ID NO: 138380 - DNA, 20 bp, Artificial
  CRISPR gRNA sequence
ttcccgagtagctgggacta

SEQ ID NO: 138381 - DNA, 20 bp, Artificial
  CRISPR gRNA sequence
tcccgagtagctgggactac

SEQ ID NO: 138382 - DNA, 20 bp, Artificial
  CRISPR gRNA sequence
actacaggcatgtgccacca

SEQ ID NO: 138383 - DNA, 20 bp, Artificial
  CRISPR gRNA sequence
caggcatgtgccaccacagc

SEQ ID NO: 138384 - DNA, 20 bp, Artificial
  CRISPR gRNA sequence
ccagctaatttttgcatttt

SEQ ID NO: 138385 - DNA, 20 bp, Artificial
  CRISPR gRNA sequence
gctaatttttgcatttttag

SEQ ID NO: 138386 - DNA, 20 bp, Artificial
  CRISPR gRNA sequence
taatttttgcatttttagta

SEQ ID NO: 138387 - DNA, 20 bp, Artificial
  CRISPR gRNA sequence
tttgcatttttagtagagat

SEQ ID NO: 138388 - DNA, 20 bp, Artificial
  CRISPR gRNA sequence
ttgcatttttagtagagatg

SEQ ID NO: 138389 - DNA, 20 bp, Artificial
  CRISPR gRNA sequence
gagatgaggtttcaccatgt

SEQ ID NO: 138390 - DNA, 20 bp, Artificial
  CRISPR gRNA sequence
tgaggtttcaccatgttggc

SEQ ID NO: 138391 - DNA, 20 bp, Artificial
  CRISPR gRNA sequence
gaggtttcaccatgttggcc

SEQ ID NO: 138392 - DNA, 20 bp, Artificial
  CRISPR gRNA sequence
tttcaccatgttggccaggc

SEQ ID NO: 138393 - DNA, 20 bp, Artificial
  CRISPR gRNA sequence
tggtctcgaactcctgacct

SEQ ID NO: 138394 - DNA, 20 bp, Artificial
  CRISPR gRNA sequence
ggtctcgaactcctgacctc

SEQ ID NO: 138395 - DNA, 20 bp, Artificial
  CRISPR gRNA sequence
ctcaggtgatccacccgcct

SEQ ID NO: 138396 - DNA, 20 bp, Artificial
  CRISPR gRNA sequence
ccacccgccttggcctccca

SEQ ID NO: 138397 - DNA, 20 bp, Artificial
  CRISPR gRNA sequence
gccttggcctcccaaagtgc

SEQ ID NO: 138398 - DNA, 20 bp, Artificial
  CRISPR gRNA sequence
ccttggcctcccaaagtgct

SEQ ID NO: 138399 - DNA, 20 bp, Artificial
  CRISPR gRNA sequence
ctcccaaagtgctgggatta

SEQ ID NO: 138400 - DNA, 20 bp, Artificial
  CRISPR gRNA sequence
cagacgtgaaccaccgtgcc

SEQ ID NO: 138401 - DNA, 20 bp, Artificial
  CRISPR gRNA sequence
atatatataatattaattgt

SEQ ID NO: 138402 - DNA, 20 bp, Artificial
  CRISPR gRNA sequence
tatatataatattaattgtt

SEQ ID NO: 138403 - DNA, 20 bp, Artificial
  CRISPR gRNA sequence
ttaattgttgggtgttttta

SEQ ID NO: 138404 - DNA, 20 bp, Artificial
  CRISPR gRNA sequence
tgtttttaaagctccatgca

SEQ ID NO: 138405 - DNA, 20 bp, Artificial
  CRISPR gRNA sequence
ttaaagctccatgcaaagaa

SEQ ID NO: 138406 - DNA, 20 bp, Artificial
  CRISPR gRNA sequence
tgcaaagaatggatctgctt

SEQ ID NO: 138407 - DNA, 20 bp, Artificial
  CRISPR gRNA sequence
gcaaagaatggatctgcttt

SEQ ID NO: 138408 - DNA, 20 bp, Artificial
  CRISPR gRNA sequence
gaatggatctgctttaggaa

SEQ ID NO: 138409 - DNA, 20 bp, Artificial
  CRISPR gRNA sequence
aggaaaagccttttgaataa

SEQ ID NO: 138410 - DNA, 20 bp, Artificial
  CRISPR gRNA sequence
ataaaagtactcactttttc

SEQ ID NO: 138411 - DNA, 20 bp, Artificial
  CRISPR gRNA sequence
taaaagtactcactttttcc

SEQ ID NO: 138412 - DNA, 20 bp, Artificial
  CRISPR gRNA sequence
ttaacaatttatgttcttct

SEQ ID NO: 138413 - DNA, 20 bp, Artificial
  CRISPR gRNA sequence
aacaatttatgttcttctaa

SEQ ID NO: 138414 - DNA, 20 bp, Artificial
  CRISPR gRNA sequence
cattactaataatatctgca

SEQ ID NO: 138415 - DNA, 20 bp, Artificial
  CRISPR gRNA sequence
aataatatctgcaaagatgt

SEQ ID NO: 138416 - DNA, 20 bp, Artificial
  CRISPR gRNA sequence
aacctttttctcttttttcc

SEQ ID NO: 138417 - DNA, 20 bp, Artificial
  CRISPR gRNA sequence
tttttctcttttttcctggt

SEQ ID NO: 138418 - DNA, 20 bp, Artificial
  CRISPR gRNA sequence
ttctcttttttcctggtgag

SEQ ID NO: 138419 - DNA, 20 bp, Artificial
  CRISPR gRNA sequence
gaagaacttgtgtccttcaa

SEQ ID NO: 138420 - DNA, 20 bp, Artificial
  CRISPR gRNA sequence
gaacttgtgtccttcaaaag

SEQ ID NO: 138421 - DNA, 20 bp, Artificial
  CRISPR gRNA sequence
aagattacctttgtctttcg

SEQ ID NO: 138422 - DNA, 20 bp, Artificial
  CRISPR gRNA sequence
ttacctttgtctttcgaagt

SEQ ID NO: 138423 - DNA, 20 bp, Artificial
  CRISPR gRNA sequence
tacctttgtctttcgaagtc

SEQ ID NO: 138424 - DNA, 20 bp, Artificial
  CRISPR gRNA sequence
cgaagtcaggaatttataaa

SEQ ID NO: 138425 - DNA, 20 bp, Artificial
  CRISPR gRNA sequence
aagtcaggaatttataaaaa

SEQ ID NO: 138426 - DNA, 20 bp, Artificial
  CRISPR gRNA sequence
aatttataaaaagagtttgc

SEQ ID NO: 138427 - DNA, 20 bp, Artificial
  CRISPR gRNA sequence
tataaaaagagtttgctgga

SEQ ID NO: 138428 - DNA, 20 bp, Artificial
  CRISPR gRNA sequence
tgctggatggaaaaatcata

SEQ ID NO: 138429 - DNA, 20 bp, Artificial
  CRISPR gRNA sequence
gctggatggaaaaatcataa

SEQ ID NO: 138430 - DNA, 20 bp, Artificial
  CRISPR gRNA sequence
taactctaaaacctaatgta

SEQ ID NO: 138431 - DNA, 20 bp, Artificial
  CRISPR gRNA sequence
ctctaaaacctaatgtaaag

SEQ ID NO: 138432 - DNA, 20 bp, Artificial
  CRISPR gRNA sequence
aaacctaatgtaaagaagaa

SEQ ID NO: 138433 - DNA, 20 bp, Artificial
  CRISPR gRNA sequence
ctaatgtaaagaagaacagt

SEQ ID NO: 138434 - DNA, 20 bp, Artificial
  CRISPR gRNA sequence
aatgtaaagaagaacagtta

SEQ ID NO: 138435 - DNA, 20 bp, Artificial
  CRISPR gRNA sequence
agaacagttagagctgtcca

SEQ ID NO: 138436 - DNA, 20 bp, Artificial
  CRISPR gRNA sequence
cagttagagctgtccaaaga

SEQ ID NO: 138437 - DNA, 20 bp, Artificial
  CRISPR gRNA sequence
agttagagctgtccaaagat

SEQ ID NO: 138438 - DNA, 20 bp, Artificial
  CRISPR gRNA sequence
agagctgtccaaagatggga

SEQ ID NO: 138439 - DNA, 20 bp, Artificial
  CRISPR gRNA sequence
gatgggaaagaatgtcttac

SEQ ID NO: 138440 - DNA, 20 bp, Artificial
  CRISPR gRNA sequence
ggaaagaatgtcttaccagt

SEQ ID NO: 138441 - DNA, 20 bp, Artificial
  CRISPR gRNA sequence
agaatgtcttaccagtaagc

SEQ ID NO: 138442 - DNA, 20 bp, Artificial
  CRISPR gRNA sequence
ttaccagtaagccagtttcc

SEQ ID NO: 138443 - DNA, 20 bp, Artificial
  CRISPR gRNA sequence
gtaagccagtttcccagaac

SEQ ID NO: 138444 - DNA, 20 bp, Artificial
  CRISPR gRNA sequence
aagccagtttcccagaactg

SEQ ID NO: 138445 - DNA, 20 bp, Artificial
  CRISPR gRNA sequence
ccagtttcccagaactggag

SEQ ID NO: 138446 - DNA, 20 bp, Artificial
  CRISPR gRNA sequence
cagtttcccagaactggagt

SEQ ID NO: 138447 - DNA, 20 bp, Artificial
  CRISPR gRNA sequence
agtttcccagaactggagtg

SEQ ID NO: 138448 - DNA, 20 bp, Artificial
  CRISPR gRNA sequence
gtttcccagaactggagtgg

SEQ ID NO: 138449 - DNA, 20 bp, Artificial
  CRISPR gRNA sequence
tttcccagaactggagtggg

SEQ ID NO: 138450 - DNA, 20 bp, Artificial
  CRISPR gRNA sequence
ttcccagaactggagtgggg

SEQ ID NO: 138451 - DNA, 20 bp, Artificial
  CRISPR gRNA sequence
gtgggggggccctcaaatgt

SEQ ID NO: 138452 - DNA, 20 bp, Artificial
  CRISPR gRNA sequence
gggggccctcaaatgtaagc

SEQ ID NO: 138453 - DNA, 20 bp, Artificial
  CRISPR gRNA sequence
tgtaagctggttgaacactt

SEQ ID NO: 138454 - DNA, 20 bp, Artificial
  CRISPR gRNA sequence
gtaagctggttgaacactta

SEQ ID NO: 138455 - DNA, 20 bp, Artificial
  CRISPR gRNA sequence
agctggttgaacacttaagg

SEQ ID NO: 138456 - DNA, 20 bp, Artificial
  CRISPR gRNA sequence
acacttaaggtagaatcacc

SEQ ID NO: 138457 - DNA, 20 bp, Artificial
  CRISPR gRNA sequence
cacttaaggtagaatcaccc

SEQ ID NO: 138458 - DNA, 20 bp, Artificial
  CRISPR gRNA sequence
acttaaggtagaatcacccg

SEQ ID NO: 138459 - DNA, 20 bp, Artificial
  CRISPR gRNA sequence
aaggtagaatcacccggggt

SEQ ID NO: 138460 - DNA, 20 bp, Artificial
  CRISPR gRNA sequence
aggtagaatcacccggggtt

SEQ ID NO: 138461 - DNA, 20 bp, Artificial
  CRISPR gRNA sequence
tagaatcacccggggttggg

SEQ ID NO: 138462 - DNA, 20 bp, Artificial
  CRISPR gRNA sequence
gaatcacccggggttgggca

SEQ ID NO: 138463 - DNA, 20 bp, Artificial
  CRISPR gRNA sequence
aatcacccggggttgggcag

SEQ ID NO: 138464 - DNA, 20 bp, Artificial
  CRISPR gRNA sequence
ccggggttgggcagaggttg

SEQ ID NO: 138465 - DNA, 20 bp, Artificial
  CRISPR gRNA sequence
gttgggcagaggttgaagaa

SEQ ID NO: 138466 - DNA, 20 bp, Artificial
  CRISPR gRNA sequence
agaggttgaagaaaagctgc

SEQ ID NO: 138467 - DNA, 20 bp, Artificial
  CRISPR gRNA sequence
aaagctgcgagcgtcttatg

SEQ ID NO: 138468 - DNA, 20 bp, Artificial
  CRISPR gRNA sequence
aagctgcgagcgtcttatga

SEQ ID NO: 138469 - DNA, 20 bp, Artificial
  CRISPR gRNA sequence
agctgcgagcgtcttatgaa

SEQ ID NO: 138470 - DNA, 20 bp, Artificial
  CRISPR gRNA sequence
gctgcgagcgtcttatgaag

SEQ ID NO: 138471 - DNA, 20 bp, Artificial
  CRISPR gRNA sequence
gcgagcgtcttatgaagggg

SEQ ID NO: 138472 - DNA, 20 bp, Artificial
  CRISPR gRNA sequence
cgagcgtcttatgaaggggt

SEQ ID NO: 138473 - DNA, 20 bp, Artificial
  CRISPR gRNA sequence
tcttatgaaggggtgggcct

SEQ ID NO: 138474 - DNA, 20 bp, Artificial
  CRISPR gRNA sequence
atgtcttttttttttttttt

SEQ ID NO: 138475 - DNA, 20 bp, Artificial
  CRISPR gRNA sequence
agtcctgaacttctatgatg

SEQ ID NO: 138476 - DNA, 20 bp, Artificial
  CRISPR gRNA sequence
ctatgatgcagtaaaatgta

SEQ ID NO: 138477 - DNA, 20 bp, Artificial
  CRISPR gRNA sequence
tatgatgcagtaaaatgtaa

SEQ ID NO: 138478 - DNA, 20 bp, Artificial
  CRISPR gRNA sequence
tatttttcgctttacctatt

SEQ ID NO: 138479 - DNA, 20 bp, Artificial
  CRISPR gRNA sequence
atttttcgctttacctattt

SEQ ID NO: 138480 - DNA, 20 bp, Artificial
  CRISPR gRNA sequence
ctatttgggatttcctaatg

SEQ ID NO: 138481 - DNA, 20 bp, Artificial
  CRISPR gRNA sequence
ttgggatttcctaatgtaga

SEQ ID NO: 138482 - DNA, 20 bp, Artificial
  CRISPR gRNA sequence
tgggatttcctaatgtagat

SEQ ID NO: 138483 - DNA, 20 bp, Artificial
  CRISPR gRNA sequence
cttaacctttaatacatttt

SEQ ID NO: 138484 - DNA, 20 bp, Artificial
  CRISPR gRNA sequence
gtacctaacttccactacta

SEQ ID NO: 138485 - DNA, 20 bp, Artificial
  CRISPR gRNA sequence
acttccactactacagtatg

SEQ ID NO: 138486 - DNA, 20 bp, Artificial
  CRISPR gRNA sequence
ctactacagtatgtggctct

SEQ ID NO: 138487 - DNA, 20 bp, Artificial
  CRISPR gRNA sequence
tacagtatgtggctctgagc

SEQ ID NO: 138488 - DNA, 20 bp, Artificial
  CRISPR gRNA sequence
atgtggctctgagccagcca

SEQ ID NO: 138489 - DNA, 20 bp, Artificial
  CRISPR gRNA sequence
ttcatgatctgttgactaca

SEQ ID NO: 138490 - DNA, 20 bp, Artificial
  CRISPR gRNA sequence
gttgactacacagatgtttg

SEQ ID NO: 138491 - DNA, 20 bp, Artificial
  CRISPR gRNA sequence
ttgactacacagatgtttgc

SEQ ID NO: 138492 - DNA, 20 bp, Artificial
  CRISPR gRNA sequence
tgatcatgcctgcacatctg

SEQ ID NO: 138493 - DNA, 20 bp, Artificial
  CRISPR gRNA sequence
catgcctgcacatctgtagt

SEQ ID NO: 138494 - DNA, 20 bp, Artificial
  CRISPR gRNA sequence
atgcctgcacatctgtagtt

SEQ ID NO: 138495 - DNA, 20 bp, Artificial
  CRISPR gRNA sequence
ctgcacatctgtagttggga

SEQ ID NO: 138496 - DNA, 20 bp, Artificial
  CRISPR gRNA sequence
tgggacagttcaaaatttaa

SEQ ID NO: 138497 - DNA, 20 bp, Artificial
  CRISPR gRNA sequence
gacagttcaaaatttaaaag

SEQ ID NO: 138498 - DNA, 20 bp, Artificial
  CRISPR gRNA sequence
aaatttaaaagcagactgca

SEQ ID NO: 138499 - DNA, 20 bp, Artificial
  CRISPR gRNA sequence
ttaaaagcagactgcacaga

SEQ ID NO: 138500 - DNA, 20 bp, Artificial
  CRISPR gRNA sequence
gcagactgcacagatggttc

SEQ ID NO: 138501 - DNA, 20 bp, Artificial
  CRISPR gRNA sequence
tgtgtacctttgtaatgttt

SEQ ID NO: 138502 - DNA, 20 bp, Artificial
  CRISPR gRNA sequence
gtgtacctttgtaatgtttt

SEQ ID NO: 138503 - DNA, 20 bp, Artificial
  CRISPR gRNA sequence
tgtacctttgtaatgttttg

SEQ ID NO: 138504 - DNA, 20 bp, Artificial
  CRISPR gRNA sequence
gtacctttgtaatgttttgg

SEQ ID NO: 138505 - DNA, 20 bp, Artificial
  CRISPR gRNA sequence
tacctttgtaatgttttggg

SEQ ID NO: 138506 - DNA, 20 bp, Artificial
  CRISPR gRNA sequence
gtaatgttttggggggatat

SEQ ID NO: 138507 - DNA, 20 bp, Artificial
  CRISPR gRNA sequence
aatgttttggggggatatca

SEQ ID NO: 138508 - DNA, 20 bp, Artificial
  CRISPR gRNA sequence
atgttttggggggatatcag

SEQ ID NO: 138509 - DNA, 20 bp, Artificial
  CRISPR gRNA sequence
tttggggggatatcagagga

SEQ ID NO: 138510 - DNA, 20 bp, Artificial
  CRISPR gRNA sequence
gggggatatcagaggacagc

SEQ ID NO: 138511 - DNA, 20 bp, Artificial
  CRISPR gRNA sequence
ggacagccagaatttgttac

SEQ ID NO: 138512 - DNA, 20 bp, Artificial
  CRISPR gRNA sequence
taccagacttttaaatcgta

SEQ ID NO: 138513 - DNA, 20 bp, Artificial
  CRISPR gRNA sequence
accagacttttaaatcgtac

SEQ ID NO: 138514 - DNA, 20 bp, Artificial
  CRISPR gRNA sequence
aactaaacctacccatccat

SEQ ID NO: 138515 - DNA, 20 bp, Artificial
  CRISPR gRNA sequence
aaacctacccatccattagc

SEQ ID NO: 138516 - DNA, 20 bp, Artificial
  CRISPR gRNA sequence
cccatccattagcaagtgta

SEQ ID NO: 138517 - DNA, 20 bp, Artificial
  CRISPR gRNA sequence
catccattagcaagtgtaca

SEQ ID NO: 138518 - DNA, 20 bp, Artificial
  CRISPR gRNA sequence
agtgtacagagatatcgtcc

SEQ ID NO: 138519 - DNA, 20 bp, Artificial
  CRISPR gRNA sequence
gcatctttctcctttgacct

SEQ ID NO: 138520 - DNA, 20 bp, Artificial
  CRISPR gRNA sequence
tctttctcctttgaccttag

SEQ ID NO: 138521 - DNA, 20 bp, Artificial
  CRISPR gRNA sequence
tttgaccttagcagtttgca

SEQ ID NO: 138522 - DNA, 20 bp, Artificial
  CRISPR gRNA sequence
gaccttagcagtttgcatgg

SEQ ID NO: 138523 - DNA, 20 bp, Artificial
  CRISPR gRNA sequence
tttgcatggcagattgtgcc

SEQ ID NO: 138524 - DNA, 20 bp, Artificial
  CRISPR gRNA sequence
atggcagattgtgccaagat

SEQ ID NO: 138525 - DNA, 20 bp, Artificial
  CRISPR gRNA sequence
tggcagattgtgccaagatg

SEQ ID NO: 138526 - DNA, 20 bp, Artificial
  CRISPR gRNA sequence
gtgccaagatgaggcctgtc

SEQ ID NO: 138527 - DNA, 20 bp, Artificial
  CRISPR gRNA sequence
tgccaagatgaggcctgtcc

SEQ ID NO: 138528 - DNA, 20 bp, Artificial
  CRISPR gRNA sequence
gccaagatgaggcctgtcca

SEQ ID NO: 138529 - DNA, 20 bp, Artificial
  CRISPR gRNA sequence
tccagggacccatgcaataa

SEQ ID NO: 138530 - DNA, 20 bp, Artificial
  CRISPR gRNA sequence
ccagggacccatgcaataaa

SEQ ID NO: 138531 - DNA, 20 bp, Artificial
  CRISPR gRNA sequence
ggacccatgcaataaaaggt

SEQ ID NO: 138532 - DNA, 20 bp, Artificial
  CRISPR gRNA sequence
taaaaggttagattctttta

SEQ ID NO: 138533 - DNA, 20 bp, Artificial
  CRISPR gRNA sequence
ttgataattattattatttc

SEQ ID NO: 138534 - DNA, 20 bp, Artificial
  CRISPR gRNA sequence
taattattattatttccaga

SEQ ID NO: 138535 - DNA, 20 bp, Artificial
  CRISPR gRNA sequence
tttgtttgccccatttaaaa

SEQ ID NO: 138536 - DNA, 20 bp, Artificial
  CRISPR gRNA sequence
ttgtttgccccatttaaaaa

SEQ ID NO: 138537 - DNA, 20 bp, Artificial
  CRISPR gRNA sequence
catttaaaaaaggttaaatt

SEQ ID NO: 138538 - DNA, 20 bp, Artificial
  CRISPR gRNA sequence
gtcactgtcttcattttcat

SEQ ID NO: 138539 - DNA, 20 bp, Artificial
  CRISPR gRNA sequence
tcattttcatgagtaccttg

SEQ ID NO: 138540 - DNA, 20 bp, Artificial
  CRISPR gRNA sequence
gataaataactaaacttctc

SEQ ID NO: 138541 - DNA, 20 bp, Artificial
  CRISPR gRNA sequence
aatttttttgttgttgttct

SEQ ID NO: 138542 - DNA, 20 bp, Artificial
  CRISPR gRNA sequence
ttgttgttctcagtacatct

SEQ ID NO: 138543 - DNA, 20 bp, Artificial
  CRISPR gRNA sequence
gttgttctcagtacatctaa

SEQ ID NO: 138544 - DNA, 20 bp, Artificial
  CRISPR gRNA sequence
tgttctcagtacatctaaga

SEQ ID NO: 138545 - DNA, 20 bp, Artificial
  CRISPR gRNA sequence
tctcagtacatctaagagag

SEQ ID NO: 138546 - DNA, 20 bp, Artificial
  CRISPR gRNA sequence
acatctaagagagtagcata

SEQ ID NO: 138547 - DNA, 20 bp, Artificial
  CRISPR gRNA sequence
catctaagagagtagcatat

SEQ ID NO: 138548 - DNA, 20 bp, Artificial
  CRISPR gRNA sequence
gcatataggccatgtgtatg

SEQ ID NO: 138549 - DNA, 20 bp, Artificial
  CRISPR gRNA sequence
tgtggtgataaatgaaaatg

SEQ ID NO: 138550 - DNA, 20 bp, Artificial
  CRISPR gRNA sequence
gtggtgataaatgaaaatgc

SEQ ID NO: 138551 - DNA, 20 bp, Artificial
  CRISPR gRNA sequence
tggtgataaatgaaaatgca

SEQ ID NO: 138552 - DNA, 20 bp, Artificial
  CRISPR gRNA sequence
ggtgataaatgaaaatgcag

SEQ ID NO: 138553 - DNA, 20 bp, Artificial
  CRISPR gRNA sequence
gaaaatgcaggggtcttact

SEQ ID NO: 138554 - DNA, 20 bp, Artificial
  CRISPR gRNA sequence
aggggtcttacttggttatt

SEQ ID NO: 138555 - DNA, 20 bp, Artificial
  CRISPR gRNA sequence
ggggtcttacttggttattt

SEQ ID NO: 138556 - DNA, 20 bp, Artificial
  CRISPR gRNA sequence
tacttggttatttaggactt

SEQ ID NO: 138557 - DNA, 20 bp, Artificial
  CRISPR gRNA sequence
ttaggacttaagattttatc

SEQ ID NO: 138558 - DNA, 20 bp, Artificial
  CRISPR gRNA sequence
cacttccctttaactccctt

SEQ ID NO: 138559 - DNA, 20 bp, Artificial
  CRISPR gRNA sequence
taactcccttcagaaactcc

SEQ ID NO: 138560 - DNA, 20 bp, Artificial
  CRISPR gRNA sequence
tccaagatcatattgtatcc

SEQ ID NO: 138561 - DNA, 20 bp, Artificial
  CRISPR gRNA sequence
ccaagatcatattgtatccc

SEQ ID NO: 138562 - DNA, 20 bp, Artificial
  CRISPR gRNA sequence
tcatattgtatcccaggtac

SEQ ID NO: 138563 - DNA, 20 bp, Artificial
  CRISPR gRNA sequence
caggtactagaatttctgtt

SEQ ID NO: 138564 - DNA, 20 bp, Artificial
  CRISPR gRNA sequence
aatttctgttcagctgttta

SEQ ID NO: 138565 - DNA, 20 bp, Artificial
  CRISPR gRNA sequence
atttctgttcagctgtttat

SEQ ID NO: 138566 - DNA, 20 bp, Artificial
  CRISPR gRNA sequence
tgtttataggcctccaccac

SEQ ID NO: 138567 - DNA, 20 bp, Artificial
  CRISPR gRNA sequence
aggcctccaccacaagaaat

SEQ ID NO: 138568 - DNA, 20 bp, Artificial
  CRISPR gRNA sequence
acccactaatgtcattacac

SEQ ID NO: 138569 - DNA, 20 bp, Artificial
  CRISPR gRNA sequence
accagaatgaaatctgcttt

SEQ ID NO: 138570 - DNA, 20 bp, Artificial
  CRISPR gRNA sequence
ccagaatgaaatctgctttg

SEQ ID NO: 138571 - DNA, 20 bp, Artificial
  CRISPR gRNA sequence
tttcccctcatcatttcctt

SEQ ID NO: 138572 - DNA, 20 bp, Artificial
  CRISPR gRNA sequence
cccctcatcatttcctttag

SEQ ID NO: 138573 - DNA, 20 bp, Artificial
  CRISPR gRNA sequence
ccctcatcatttcctttaga

SEQ ID NO: 138574 - DNA, 20 bp, Artificial
  CRISPR gRNA sequence
atcatttcctttagaaggaa

SEQ ID NO: 138575 - DNA, 20 bp, Artificial
  CRISPR gRNA sequence
tcatttcctttagaaggaaa

SEQ ID NO: 138576 - DNA, 20 bp, Artificial
  CRISPR gRNA sequence
catttcctttagaaggaaaa

SEQ ID NO: 138577 - DNA, 20 bp, Artificial
  CRISPR gRNA sequence
ttcctttagaaggaaaaggg

SEQ ID NO: 138578 - DNA, 20 bp, Artificial
  CRISPR gRNA sequence
tcctttagaaggaaaaggga

SEQ ID NO: 138579 - DNA, 20 bp, Artificial
  CRISPR gRNA sequence
ggaaaagggaaggaaaaaaa

SEQ ID NO: 138580 - DNA, 20 bp, Artificial
  CRISPR gRNA sequence
ggaaaaaaaaagaaaaaaat

SEQ ID NO: 138581 - DNA, 20 bp, Artificial
  CRISPR gRNA sequence
aaaaaaaaagaaaaaaatca

SEQ ID NO: 138582 - DNA, 20 bp, Artificial
  CRISPR gRNA sequence
tcagagacctgtaaacattt

SEQ ID NO: 138583 - DNA, 20 bp, Artificial
  CRISPR gRNA sequence
agagacctgtaaacatttaa

SEQ ID NO: 138584 - DNA, 20 bp, Artificial
  CRISPR gRNA sequence
gtaaacatttaagagtgaat

SEQ ID NO: 138585 - DNA, 20 bp, Artificial
  CRISPR gRNA sequence
gagtgaattggacatcccca

SEQ ID NO: 138586 - DNA, 20 bp, Artificial
  CRISPR gRNA sequence
agtgaattggacatccccac

SEQ ID NO: 138587 - DNA, 20 bp, Artificial
  CRISPR gRNA sequence
acatccccacaggctaaacc

SEQ ID NO: 138588 - DNA, 20 bp, Artificial
  CRISPR gRNA sequence
atccccacaggctaaaccta

SEQ ID NO: 138589 - DNA, 20 bp, Artificial
  CRISPR gRNA sequence
caggctaaacctagagttgt

SEQ ID NO: 138590 - DNA, 20 bp, Artificial
  CRISPR gRNA sequence
ttcattccattctgctgtga

SEQ ID NO: 138591 - DNA, 20 bp, Artificial
  CRISPR gRNA sequence
cattccattctgctgtgata

SEQ ID NO: 138592 - DNA, 20 bp, Artificial
  CRISPR gRNA sequence
ctgtgatagagtgttctgcc

SEQ ID NO: 138593 - DNA, 20 bp, Artificial
  CRISPR gRNA sequence
ctgcccagtatgtatccaca

SEQ ID NO: 138594 - DNA, 20 bp, Artificial
  CRISPR gRNA sequence
gcccagtatgtatccacatg

SEQ ID NO: 138595 - DNA, 20 bp, Artificial
  CRISPR gRNA sequence
gtatgtatccacatggagcc

SEQ ID NO: 138596 - DNA, 20 bp, Artificial
  CRISPR gRNA sequence
gtatccacatggagcctgga

SEQ ID NO: 138597 - DNA, 20 bp, Artificial
  CRISPR gRNA sequence
catggagcctggaaagtaac

SEQ ID NO: 138598 - DNA, 20 bp, Artificial
  CRISPR gRNA sequence
agcctggaaagtaacaagtc

SEQ ID NO: 138599 - DNA, 20 bp, Artificial
  CRISPR gRNA sequence
aagtctggtcatgtgacaac

SEQ ID NO: 138600 - DNA, 20 bp, Artificial
  CRISPR gRNA sequence
ggtcatgtgacaactggctt

SEQ ID NO: 138601 - DNA, 20 bp, Artificial
  CRISPR gRNA sequence
tggctttggtgctttgcttt

SEQ ID NO: 138602 - DNA, 20 bp, Artificial
  CRISPR gRNA sequence
gtgctttgctttcagcccct

SEQ ID NO: 138603 - DNA, 20 bp, Artificial
  CRISPR gRNA sequence
tgctttcagcccctcagaat

SEQ ID NO: 138604 - DNA, 20 bp, Artificial
  CRISPR gRNA sequence
ccctcagaattagttcctaa

SEQ ID NO: 138605 - DNA, 20 bp, Artificial
  CRISPR gRNA sequence
ttagttcctaatggctcaca

SEQ ID NO: 138606 - DNA, 20 bp, Artificial
  CRISPR gRNA sequence
tggctcacatagctccctgc

SEQ ID NO: 138607 - DNA, 20 bp, Artificial
  CRISPR gRNA sequence
ccctgccagcatcccgtcac

SEQ ID NO: 138608 - DNA, 20 bp, Artificial
  CRISPR gRNA sequence
aaccttttcaaataattcct

SEQ ID NO: 138609 - DNA, 20 bp, Artificial
  CRISPR gRNA sequence
tttcaaataattcctcagaa

SEQ ID NO: 138610 - DNA, 20 bp, Artificial
  CRISPR gRNA sequence
tcaaataattcctcagaata

SEQ ID NO: 138611 - DNA, 20 bp, Artificial
  CRISPR gRNA sequence
ttcctcagaatagagattct

SEQ ID NO: 138612 - DNA, 20 bp, Artificial
  CRISPR gRNA sequence
tcctcagaatagagattctt

SEQ ID NO: 138613 - DNA, 20 bp, Artificial
  CRISPR gRNA sequence
ctcagaatagagattcttag

SEQ ID NO: 138614 - DNA, 20 bp, Artificial
  CRISPR gRNA sequence
cagaatagagattcttagga

SEQ ID NO: 138615 - DNA, 20 bp, Artificial
  CRISPR gRNA sequence
tcttgcattttaatatttgc

SEQ ID NO: 138616 - DNA, 20 bp, Artificial
  CRISPR gRNA sequence
cattttaatatttgccagat

SEQ ID NO: 138617 - DNA, 20 bp, Artificial
  CRISPR gRNA sequence
tatttgccagataagcgctt

SEQ ID NO: 138618 - DNA, 20 bp, Artificial
  CRISPR gRNA sequence
gcgcttaagacattacaata

SEQ ID NO: 138619 - DNA, 20 bp, Artificial
  CRISPR gRNA sequence
cgcttaagacattacaatac

SEQ ID NO: 138620 - DNA, 20 bp, Artificial
  CRISPR gRNA sequence
aagacattacaatacaggtt

SEQ ID NO: 138621 - DNA, 20 bp, Artificial
  CRISPR gRNA sequence
tctgaaatccgaaacttttt

SEQ ID NO: 138622 - DNA, 20 bp, Artificial
  CRISPR gRNA sequence
gagccctgacatgacgctca

SEQ ID NO: 138623 - DNA, 20 bp, Artificial
  CRISPR gRNA sequence
agccctgacatgacgctcaa

SEQ ID NO: 138624 - DNA, 20 bp, Artificial
  CRISPR gRNA sequence
gaaatgctcattttcgattt

SEQ ID NO: 138625 - DNA, 20 bp, Artificial
  CRISPR gRNA sequence
cattttcgattttggatttt

SEQ ID NO: 138626 - DNA, 20 bp, Artificial
  CRISPR gRNA sequence
cgattttggattttcagatt

SEQ ID NO: 138627 - DNA, 20 bp, Artificial
  CRISPR gRNA sequence
gattttggattttcagattt

SEQ ID NO: 138628 - DNA, 20 bp, Artificial
  CRISPR gRNA sequence
tcagatttgggatgctcaac

SEQ ID NO: 138629 - DNA, 20 bp, Artificial
  CRISPR gRNA sequence
atttgggatgctcaaccagt

SEQ ID NO: 138630 - DNA, 20 bp, Artificial
  CRISPR gRNA sequence
aaaaaaaaaaaaaaaaaaaa

SEQ ID NO: 138631 - DNA, 20 bp, Artificial
  CRISPR gRNA sequence
aaaaaaaaaaaaaaaaaaaa

SEQ ID NO: 138632 - DNA, 20 bp, Artificial
  CRISPR gRNA sequence
aaaaaaaaaaaaaaaaaggc

SEQ ID NO: 138633 - DNA, 20 bp, Artificial
  CRISPR gRNA sequence
aaaaaaaaaaaaaaaaggct

SEQ ID NO: 138634 - DNA, 20 bp, Artificial
  CRISPR gRNA sequence
aaaaaaaaaaaggctgggcg

SEQ ID NO: 138635 - DNA, 20 bp, Artificial
  CRISPR gRNA sequence
aaaaaaaaggctgggcgcgg

SEQ ID NO: 138636 - DNA, 20 bp, Artificial
  CRISPR gRNA sequence
gtggctcacgcctgtaatcc

SEQ ID NO: 138637 - DNA, 20 bp, Artificial
  CRISPR gRNA sequence
cgcctgtaatcccagcactt

SEQ ID NO: 138638 - DNA, 20 bp, Artificial
  CRISPR gRNA sequence
gcctgtaatcccagcacttt

SEQ ID NO: 138639 - DNA, 20 bp, Artificial
  CRISPR gRNA sequence
ctgtaatcccagcactttgg

SEQ ID NO: 138640 - DNA, 20 bp, Artificial
  CRISPR gRNA sequence
tgtaatcccagcactttggg

SEQ ID NO: 138641 - DNA, 20 bp, Artificial
  CRISPR gRNA sequence
tcccagcactttgggaggac

SEQ ID NO: 138642 - DNA, 20 bp, Artificial
  CRISPR gRNA sequence
cccagcactttgggaggacg

SEQ ID NO: 138643 - DNA, 20 bp, Artificial
  CRISPR gRNA sequence
agcactttgggaggacgagg

SEQ ID NO: 138644 - DNA, 20 bp, Artificial
  CRISPR gRNA sequence
gcactttgggaggacgaggc

SEQ ID NO: 138645 - DNA, 20 bp, Artificial
  CRISPR gRNA sequence
ctttgggaggacgaggcagg

SEQ ID NO: 138646 - DNA, 20 bp, Artificial
  CRISPR gRNA sequence
acgaggcaggtggatcatct

SEQ ID NO: 138647 - DNA, 20 bp, Artificial
  CRISPR gRNA sequence
cgaggcaggtggatcatctg

SEQ ID NO: 138648 - DNA, 20 bp, Artificial
  CRISPR gRNA sequence
gcaggtggatcatctgaggt

SEQ ID NO: 138649 - DNA, 20 bp, Artificial
  CRISPR gRNA sequence
caggtggatcatctgaggtc

SEQ ID NO: 138650 - DNA, 20 bp, Artificial
  CRISPR gRNA sequence
ggtggatcatctgaggtcag

SEQ ID NO: 138651 - DNA, 20 bp, Artificial
  CRISPR gRNA sequence
tcatctgaggtcaggagttt

SEQ ID NO: 138652 - DNA, 20 bp, Artificial
  CRISPR gRNA sequence
catctgaggtcaggagtttg

SEQ ID NO: 138653 - DNA, 20 bp, Artificial
  CRISPR gRNA sequence
ctgaggtcaggagtttgagg

SEQ ID NO: 138654 - DNA, 20 bp, Artificial
  CRISPR gRNA sequence
gtcaggagtttgaggcagcc

SEQ ID NO: 138655 - DNA, 20 bp, Artificial
  CRISPR gRNA sequence
ttgaggcagcctggccaaca

SEQ ID NO: 138656 - DNA, 20 bp, Artificial
  CRISPR gRNA sequence
ttactaaaaatataaaaaat

SEQ ID NO: 138657 - DNA, 20 bp, Artificial
  CRISPR gRNA sequence
taaaaatataaaaaattagc

SEQ ID NO: 138658 - DNA, 20 bp, Artificial
  CRISPR gRNA sequence
aaaaatataaaaaattagct

SEQ ID NO: 138659 - DNA, 20 bp, Artificial
  CRISPR gRNA sequence
tataaaaaattagctaggcg

SEQ ID NO: 138660 - DNA, 20 bp, Artificial
  CRISPR gRNA sequence
aaaaaattagctaggcgtgg

SEQ ID NO: 138661 - DNA, 20 bp, Artificial
  CRISPR gRNA sequence
aaattagctaggcgtggtgg

SEQ ID NO: 138662 - DNA, 20 bp, Artificial
  CRISPR gRNA sequence
gtggcagatgcctgtaatcc

SEQ ID NO: 138663 - DNA, 20 bp, Artificial
  CRISPR gRNA sequence
tgcctgtaatcccagctact

SEQ ID NO: 138664 - DNA, 20 bp, Artificial
  CRISPR gRNA sequence
gcctgtaatcccagctactc

SEQ ID NO: 138665 - DNA, 20 bp, Artificial
  CRISPR gRNA sequence
ctgtaatcccagctactcag

SEQ ID NO: 138666 - DNA, 20 bp, Artificial
  CRISPR gRNA sequence
tgtaatcccagctactcagg

SEQ ID NO: 138667 - DNA, 20 bp, Artificial
  CRISPR gRNA sequence
tcccagctactcaggaggct

SEQ ID NO: 138668 - DNA, 20 bp, Artificial
  CRISPR gRNA sequence
cccagctactcaggaggctg

SEQ ID NO: 138669 - DNA, 20 bp, Artificial
  CRISPR gRNA sequence
agctactcaggaggctgagg

SEQ ID NO: 138670 - DNA, 20 bp, Artificial
  CRISPR gRNA sequence
gctactcaggaggctgaggc

SEQ ID NO: 138671 - DNA, 20 bp, Artificial
  CRISPR gRNA sequence
tactcaggaggctgaggcag

SEQ ID NO: 138672 - DNA, 20 bp, Artificial
  CRISPR gRNA sequence
gcaggagaatcacatgaacc

SEQ ID NO: 138673 - DNA, 20 bp, Artificial
  CRISPR gRNA sequence
caggagaatcacatgaacct

SEQ ID NO: 138674 - DNA, 20 bp, Artificial
  CRISPR gRNA sequence
ggagaatcacatgaacctgg

SEQ ID NO: 138675 - DNA, 20 bp, Artificial
  CRISPR gRNA sequence
gagaatcacatgaacctggg

SEQ ID NO: 138676 - DNA, 20 bp, Artificial
  CRISPR gRNA sequence
aatcacatgaacctgggagg

SEQ ID NO: 138677 - DNA, 20 bp, Artificial
  CRISPR gRNA sequence
tcacatgaacctgggaggca

SEQ ID NO: 138678 - DNA, 20 bp, Artificial
  CRISPR gRNA sequence
cacatgaacctgggaggcag

SEQ ID NO: 138679 - DNA, 20 bp, Artificial
  CRISPR gRNA sequence
aacctgggaggcagaggttg

SEQ ID NO: 138680 - DNA, 20 bp, Artificial
  CRISPR gRNA sequence
tgggaggcagaggttgcagt

SEQ ID NO: 138681 - DNA, 20 bp, Artificial
  CRISPR gRNA sequence
gaaattgcaccactgcactc

SEQ ID NO: 138682 - DNA, 20 bp, Artificial
  CRISPR gRNA sequence
tgcaccactgcactccagtc

SEQ ID NO: 138683 - DNA, 20 bp, Artificial
  CRISPR gRNA sequence
gcaccactgcactccagtct

SEQ ID NO: 138684 - DNA, 20 bp, Artificial
  CRISPR gRNA sequence
tgcactccagtctgggcaac

SEQ ID NO: 138685 - DNA, 20 bp, Artificial
  CRISPR gRNA sequence
cactccagtctgggcaacaa

SEQ ID NO: 138686 - DNA, 20 bp, Artificial
  CRISPR gRNA sequence
aaaaaaaaaaaaaaaaaaaa

SEQ ID NO: 138687 - DNA, 20 bp, Artificial
  CRISPR gRNA sequence
aaaaaaaaaagtcaaaatcc

SEQ ID NO: 138688 - DNA, 20 bp, Artificial
  CRISPR gRNA sequence
gtcaaaatcccagacatttc

SEQ ID NO: 138689 - DNA, 20 bp, Artificial
  CRISPR gRNA sequence
tcccagacatttctggtccc

SEQ ID NO: 138690 - DNA, 20 bp, Artificial
  CRISPR gRNA sequence
cccagacatttctggtcccc

SEQ ID NO: 138691 - DNA, 20 bp, Artificial
  CRISPR gRNA sequence
tttctggtccccaggcattt

SEQ ID NO: 138692 - DNA, 20 bp, Artificial
  CRISPR gRNA sequence
ccccaggcatttcagaattt

SEQ ID NO: 138693 - DNA, 20 bp, Artificial
  CRISPR gRNA sequence
ggcatttcagaatttcagat

SEQ ID NO: 138694 - DNA, 20 bp, Artificial
  CRISPR gRNA sequence
gcatttcagaatttcagata

SEQ ID NO: 138695 - DNA, 20 bp, Artificial
  CRISPR gRNA sequence
catttcagaatttcagataa

SEQ ID NO: 138696 - DNA, 20 bp, Artificial
  CRISPR gRNA sequence
tactcaacctgtgttatcta

SEQ ID NO: 138697 - DNA, 20 bp, Artificial
  CRISPR gRNA sequence
acctgtgttatctacagtta

SEQ ID NO: 138698 - DNA, 20 bp, Artificial
  CRISPR gRNA sequence
tctacagttatagctgacat

SEQ ID NO: 138699 - DNA, 20 bp, Artificial
  CRISPR gRNA sequence
ctacagttatagctgacatg

SEQ ID NO: 138700 - DNA, 20 bp, Artificial
  CRISPR gRNA sequence
atcttccctcctttgtcaca

SEQ ID NO: 138701 - DNA, 20 bp, Artificial
  CRISPR gRNA sequence
ttccctcctttgtcacaaag

SEQ ID NO: 138702 - DNA, 20 bp, Artificial
  CRISPR gRNA sequence
caaagcagttgactaaattg

SEQ ID NO: 138703 - DNA, 20 bp, Artificial
  CRISPR gRNA sequence
aaagcagttgactaaattgc

SEQ ID NO: 138704 - DNA, 20 bp, Artificial
  CRISPR gRNA sequence
gttgactaaattgcaggttc

SEQ ID NO: 138705 - DNA, 20 bp, Artificial
  CRISPR gRNA sequence
tactttttttttttttgcga

SEQ ID NO: 138706 - DNA, 20 bp, Artificial
  CRISPR gRNA sequence
ctttttttttttttgcgatg

SEQ ID NO: 138707 - DNA, 20 bp, Artificial
  CRISPR gRNA sequence
tggagtcttgctctgttgcc

SEQ ID NO: 138708 - DNA, 20 bp, Artificial
  CRISPR gRNA sequence
ggagtcttgctctgttgccc

SEQ ID NO: 138709 - DNA, 20 bp, Artificial
  CRISPR gRNA sequence
tcttgctctgttgcccaggc

SEQ ID NO: 138710 - DNA, 20 bp, Artificial
  CRISPR gRNA sequence
ttgctctgttgcccaggctg

SEQ ID NO: 138711 - DNA, 20 bp, Artificial
  CRISPR gRNA sequence
ttgcccaggctggagtgcaa

SEQ ID NO: 138712 - DNA, 20 bp, Artificial
  CRISPR gRNA sequence
ggagtgcaatggcgtgatct

SEQ ID NO: 138713 - DNA, 20 bp, Artificial
  CRISPR gRNA sequence
tcactgcaacctctgcctcc

SEQ ID NO: 138714 - DNA, 20 bp, Artificial
  CRISPR gRNA sequence
cactgcaacctctgcctcct

SEQ ID NO: 138715 - DNA, 20 bp, Artificial
  CRISPR gRNA sequence
aacctctgcctcctgggttc

SEQ ID NO: 138716 - DNA, 20 bp, Artificial
  CRISPR gRNA sequence
ttcaagcgattctcctgcct

SEQ ID NO: 138717 - DNA, 20 bp, Artificial
  CRISPR gRNA sequence
ttctcctgcctcagcctcct

SEQ ID NO: 138718 - DNA, 20 bp, Artificial
  CRISPR gRNA sequence
gcctcagcctcctgagtaac

SEQ ID NO: 138719 - DNA, 20 bp, Artificial
  CRISPR gRNA sequence
cctcagcctcctgagtaact

SEQ ID NO: 138720 - DNA, 20 bp, Artificial
  CRISPR gRNA sequence
tcctgagtaactgggattac

SEQ ID NO: 138721 - DNA, 20 bp, Artificial
  CRISPR gRNA sequence
caagcgtctgccgccacgcc

SEQ ID NO: 138722 - DNA, 20 bp, Artificial
  CRISPR gRNA sequence
ccggctaatttttgtatttt

SEQ ID NO: 138723 - DNA, 20 bp, Artificial
  CRISPR gRNA sequence
gctaatttttgtatttttag

SEQ ID NO: 138724 - DNA, 20 bp, Artificial
  CRISPR gRNA sequence
taatttttgtatttttagta

SEQ ID NO: 138725 - DNA, 20 bp, Artificial
  CRISPR gRNA sequence
ttttgtatttttagtagaga

SEQ ID NO: 138726 - DNA, 20 bp, Artificial
  CRISPR gRNA sequence
tttgtatttttagtagagat

SEQ ID NO: 138727 - DNA, 20 bp, Artificial
  CRISPR gRNA sequence
ttgtatttttagtagagatg

SEQ ID NO: 138728 - DNA, 20 bp, Artificial
  CRISPR gRNA sequence
tggggtttcaccatgttgcc

SEQ ID NO: 138729 - DNA, 20 bp, Artificial
  CRISPR gRNA sequence
ggggtttcaccatgttgccc

SEQ ID NO: 138730 - DNA, 20 bp, Artificial
  CRISPR gRNA sequence
tttcaccatgttgcccaggc

SEQ ID NO: 138731 - DNA, 20 bp, Artificial
  CRISPR gRNA sequence
tggtctcgaacttttgacct

SEQ ID NO: 138732 - DNA, 20 bp, Artificial
  CRISPR gRNA sequence
ggtctcgaacttttgacctc

SEQ ID NO: 138733 - DNA, 20 bp, Artificial
  CRISPR gRNA sequence
ctcaggtgatccacctgcct

SEQ ID NO: 138734 - DNA, 20 bp, Artificial
  CRISPR gRNA sequence
atccacctgcctcggcttcc

SEQ ID NO: 138735 - DNA, 20 bp, Artificial
  CRISPR gRNA sequence
ccacctgcctcggcttccca

SEQ ID NO: 138736 - DNA, 20 bp, Artificial
  CRISPR gRNA sequence
cctcggcttcccagagtgtt

SEQ ID NO: 138737 - DNA, 20 bp, Artificial
  CRISPR gRNA sequence
ttcccagagtgtttggatta

SEQ ID NO: 138738 - DNA, 20 bp, Artificial
  CRISPR gRNA sequence
tcccagagtgtttggattac

SEQ ID NO: 138739 - DNA, 20 bp, Artificial
  CRISPR gRNA sequence
agtgtttggattacaggcat

SEQ ID NO: 138740 - DNA, 20 bp, Artificial
  CRISPR gRNA sequence
caggcatgagccaccgcacc

SEQ ID NO: 138741 - DNA, 20 bp, Artificial
  CRISPR gRNA sequence
tcgtttttttaactgtcttt

SEQ ID NO: 138742 - DNA, 20 bp, Artificial
  CRISPR gRNA sequence
cgtttttttaactgtcttta

SEQ ID NO: 138743 - DNA, 20 bp, Artificial
  CRISPR gRNA sequence
ttaactgtctttaaggcttc

SEQ ID NO: 138744 - DNA, 20 bp, Artificial
  CRISPR gRNA sequence
tctttaaggcttccagttgc

SEQ ID NO: 138745 - DNA, 20 bp, Artificial
  CRISPR gRNA sequence
cagttgccagtgtgctgtgt

SEQ ID NO: 138746 - DNA, 20 bp, Artificial
  CRISPR gRNA sequence
agttgccagtgtgctgtgtt

SEQ ID NO: 138747 - DNA, 20 bp, Artificial
  CRISPR gRNA sequence
taggcttgtgtttaataaca

SEQ ID NO: 138748 - DNA, 20 bp, Artificial
  CRISPR gRNA sequence
ttgtgtttaataacatggtt

SEQ ID NO: 138749 - DNA, 20 bp, Artificial
  CRISPR gRNA sequence
tgtgtttaataacatggtta

SEQ ID NO: 138750 - DNA, 20 bp, Artificial
  CRISPR gRNA sequence
tttaataacatggttaaggt

SEQ ID NO: 138751 - DNA, 20 bp, Artificial
  CRISPR gRNA sequence
ttaataacatggttaaggtt

SEQ ID NO: 138752 - DNA, 20 bp, Artificial
  CRISPR gRNA sequence
taacatggttaaggttagga

SEQ ID NO: 138753 - DNA, 20 bp, Artificial
  CRISPR gRNA sequence
ggttaaggttaggaaagaac

SEQ ID NO: 138754 - DNA, 20 bp, Artificial
  CRISPR gRNA sequence
gttaaggttaggaaagaact

SEQ ID NO: 138755 - DNA, 20 bp, Artificial
  CRISPR gRNA sequence
taggaaagaactgggcgaac

SEQ ID NO: 138756 - DNA, 20 bp, Artificial
  CRISPR gRNA sequence
aaagaactgggcgaactggc

SEQ ID NO: 138757 - DNA, 20 bp, Artificial
  CRISPR gRNA sequence
gaactgggcgaactggcaag

SEQ ID NO: 138758 - DNA, 20 bp, Artificial
  CRISPR gRNA sequence
actggcaagtagtttcattt

SEQ ID NO: 138759 - DNA, 20 bp, Artificial
  CRISPR gRNA sequence
ctggcaagtagtttcatttc

SEQ ID NO: 138760 - DNA, 20 bp, Artificial
  CRISPR gRNA sequence
tggcaagtagtttcatttca

SEQ ID NO: 138761 - DNA, 20 bp, Artificial
  CRISPR gRNA sequence
ggcaagtagtttcatttcag

SEQ ID NO: 138762 - DNA, 20 bp, Artificial
  CRISPR gRNA sequence
ggggcttcatgttacctaca

SEQ ID NO: 138763 - DNA, 20 bp, Artificial
  CRISPR gRNA sequence
catgttacctacacagttaa

SEQ ID NO: 138764 - DNA, 20 bp, Artificial
  CRISPR gRNA sequence
ttaatggcctcatgtccttt

SEQ ID NO: 138765 - DNA, 20 bp, Artificial
  CRISPR gRNA sequence
tggcctcatgtcctttgaga

SEQ ID NO: 138766 - DNA, 20 bp, Artificial
  CRISPR gRNA sequence
cctttgagacagatttgtct

SEQ ID NO: 138767 - DNA, 20 bp, Artificial
  CRISPR gRNA sequence
gagacagatttgtctgagat

SEQ ID NO: 138768 - DNA, 20 bp, Artificial
  CRISPR gRNA sequence
acagatttgtctgagattag

SEQ ID NO: 138769 - DNA, 20 bp, Artificial
  CRISPR gRNA sequence
cagatttgtctgagattaga

SEQ ID NO: 138770 - DNA, 20 bp, Artificial
  CRISPR gRNA sequence
ttagaaggaataatcatcat

SEQ ID NO: 138771 - DNA, 20 bp, Artificial
  CRISPR gRNA sequence
tagaaggaataatcatcatc

SEQ ID NO: 138772 - DNA, 20 bp, Artificial
  CRISPR gRNA sequence
gaaggaataatcatcatcag

SEQ ID NO: 138773 - DNA, 20 bp, Artificial
  CRISPR gRNA sequence
ataatcatcatcaggagccc

SEQ ID NO: 138774 - DNA, 20 bp, Artificial
  CRISPR gRNA sequence
aatcatcatcaggagcccca

SEQ ID NO: 138775 - DNA, 20 bp, Artificial
  CRISPR gRNA sequence
catcaggagccccagagaaa

SEQ ID NO: 138776 - DNA, 20 bp, Artificial
  CRISPR gRNA sequence
atcaggagccccagagaaac

SEQ ID NO: 138777 - DNA, 20 bp, Artificial
  CRISPR gRNA sequence
gccccagagaaacaggatca

SEQ ID NO: 138778 - DNA, 20 bp, Artificial
  CRISPR gRNA sequence
gatcacagtgtctaaaacaa

SEQ ID NO: 138779 - DNA, 20 bp, Artificial
  CRISPR gRNA sequence
cacagtgtctaaaacaaaag

SEQ ID NO: 138780 - DNA, 20 bp, Artificial
  CRISPR gRNA sequence
ctaaaacaaaagaagaaact

SEQ ID NO: 138781 - DNA, 20 bp, Artificial
  CRISPR gRNA sequence
cttttttttttttttttttt

SEQ ID NO: 138782 - DNA, 20 bp, Artificial
  CRISPR gRNA sequence
ttttttttttttttttgaga

SEQ ID NO: 138783 - DNA, 20 bp, Artificial
  CRISPR gRNA sequence
ttttttttttttttgagacg

SEQ ID NO: 138784 - DNA, 20 bp, Artificial
  CRISPR gRNA sequence
cggagtctcgctctgtcgcc

SEQ ID NO: 138785 - DNA, 20 bp, Artificial
  CRISPR gRNA sequence
ggagtctcgctctgtcgccc

SEQ ID NO: 138786 - DNA, 20 bp, Artificial
  CRISPR gRNA sequence
tctcgctctgtcgcccaggc

SEQ ID NO: 138787 - DNA, 20 bp, Artificial
  CRISPR gRNA sequence
tcgctctgtcgcccaggctg

SEQ ID NO: 138788 - DNA, 20 bp, Artificial
  CRISPR gRNA sequence
ctgtcgcccaggctggagtg

SEQ ID NO: 138789 - DNA, 20 bp, Artificial
  CRISPR gRNA sequence
tcgcccaggctggagtgcag

SEQ ID NO: 138790 - DNA, 20 bp, Artificial
  CRISPR gRNA sequence
cccaggctggagtgcagtgg

SEQ ID NO: 138791 - DNA, 20 bp, Artificial
  CRISPR gRNA sequence
ccaggctggagtgcagtggc

SEQ ID NO: 138792 - DNA, 20 bp, Artificial
  CRISPR gRNA sequence
ggagtgcagtggcgggatct

SEQ ID NO: 138793 - DNA, 20 bp, Artificial
  CRISPR gRNA sequence
gcgggatctcggctcactgc

SEQ ID NO: 138794 - DNA, 20 bp, Artificial
  CRISPR gRNA sequence
tcactgcaagctccgcctcc

SEQ ID NO: 138795 - DNA, 20 bp, Artificial
  CRISPR gRNA sequence
cactgcaagctccgcctccc

SEQ ID NO: 138796 - DNA, 20 bp, Artificial
  CRISPR gRNA sequence
ttcacgccattctcctgcct

SEQ ID NO: 138797 - DNA, 20 bp, Artificial
  CRISPR gRNA sequence
ttctcctgcctcagcctccc

SEQ ID NO: 138798 - DNA, 20 bp, Artificial
  CRISPR gRNA sequence
tcctgcctcagcctcccaag

SEQ ID NO: 138799 - DNA, 20 bp, Artificial
  CRISPR gRNA sequence
gcctcagcctcccaagtagc

SEQ ID NO: 138800 - DNA, 20 bp, Artificial
  CRISPR gRNA sequence
cctcagcctcccaagtagct

SEQ ID NO: 138801 - DNA, 20 bp, Artificial
  CRISPR gRNA sequence
ctcccaagtagctgggacta

SEQ ID NO: 138802 - DNA, 20 bp, Artificial
  CRISPR gRNA sequence
tcccaagtagctgggactac

SEQ ID NO: 138803 - DNA, 20 bp, Artificial
  CRISPR gRNA sequence
caggcgcccgccactacgcc

SEQ ID NO: 138804 - DNA, 20 bp, Artificial
  CRISPR gRNA sequence
cggctaattttttgtatttt

SEQ ID NO: 138805 - DNA, 20 bp, Artificial
  CRISPR gRNA sequence
ctaattttttgtatttttag

SEQ ID NO: 138806 - DNA, 20 bp, Artificial
  CRISPR gRNA sequence
aattttttgtatttttagta

SEQ ID NO: 138807 - DNA, 20 bp, Artificial
  CRISPR gRNA sequence
ttttgtatttttagtagaga

SEQ ID NO: 138808 - DNA, 20 bp, Artificial
  CRISPR gRNA sequence
tttgtatttttagtagagac

SEQ ID NO: 138809 - DNA, 20 bp, Artificial
  CRISPR gRNA sequence
ttgtatttttagtagagacg

SEQ ID NO: 138810 - DNA, 20 bp, Artificial
  CRISPR gRNA sequence
gagacggggtttcactgttt

SEQ ID NO: 138811 - DNA, 20 bp, Artificial
  CRISPR gRNA sequence
cggggtttcactgttttagc

SEQ ID NO: 138812 - DNA, 20 bp, Artificial
  CRISPR gRNA sequence
ggggtttcactgttttagcc

SEQ ID NO: 138813 - DNA, 20 bp, Artificial
  CRISPR gRNA sequence
tttcactgttttagccagga

SEQ ID NO: 138814 - DNA, 20 bp, Artificial
  CRISPR gRNA sequence
accttgtgatccgcccgcct

SEQ ID NO: 138815 - DNA, 20 bp, Artificial
  CRISPR gRNA sequence
ccgcccgcctcggcctccca

SEQ ID NO: 138816 - DNA, 20 bp, Artificial
  CRISPR gRNA sequence
gcctcggcctcccaaagtgc

SEQ ID NO: 138817 - DNA, 20 bp, Artificial
  CRISPR gRNA sequence
cctcggcctcccaaagtgct

SEQ ID NO: 138818 - DNA, 20 bp, Artificial
  CRISPR gRNA sequence
ctcccaaagtgctgggatta

SEQ ID NO: 138819 - DNA, 20 bp, Artificial
  CRISPR gRNA sequence
tcccaaagtgctgggattac

SEQ ID NO: 138820 - DNA, 20 bp, Artificial
  CRISPR gRNA sequence
agtgctgggattacaggcgt

SEQ ID NO: 138821 - DNA, 20 bp, Artificial
  CRISPR gRNA sequence
caggcgtgagccaccgcgcc

SEQ ID NO: 138822 - DNA, 20 bp, Artificial
  CRISPR gRNA sequence
ccggccctctctcttttttt

SEQ ID NO: 138823 - DNA, 20 bp, Artificial
  CRISPR gRNA sequence
ggccctctctctttttttaa

SEQ ID NO: 138824 - DNA, 20 bp, Artificial
  CRISPR gRNA sequence
ctctctctttttttaagaga

SEQ ID NO: 138825 - DNA, 20 bp, Artificial
  CRISPR gRNA sequence
cagacgcttgctatgttgcc

SEQ ID NO: 138826 - DNA, 20 bp, Artificial
  CRISPR gRNA sequence
agacgcttgctatgttgccc

SEQ ID NO: 138827 - DNA, 20 bp, Artificial
  CRISPR gRNA sequence
cccaggctgtcttgaactct

SEQ ID NO: 138828 - DNA, 20 bp, Artificial
  CRISPR gRNA sequence
ccaggctgtcttgaactctt

SEQ ID NO: 138829 - DNA, 20 bp, Artificial
  CRISPR gRNA sequence
tgtcttgaactcttgggccc

SEQ ID NO: 138830 - DNA, 20 bp, Artificial
  CRISPR gRNA sequence
ttgggcccaagtgatcctcc

SEQ ID NO: 138831 - DNA, 20 bp, Artificial
  CRISPR gRNA sequence
tcctcctggctcaccttcct

SEQ ID NO: 138832 - DNA, 20 bp, Artificial
  CRISPR gRNA sequence
tcctggctcaccttcctgag

SEQ ID NO: 138833 - DNA, 20 bp, Artificial
  CRISPR gRNA sequence
ggctcaccttcctgagtagc

SEQ ID NO: 138834 - DNA, 20 bp, Artificial
  CRISPR gRNA sequence
ttcctgagtagctggaacca

SEQ ID NO: 138835 - DNA, 20 bp, Artificial
  CRISPR gRNA sequence
tcctgagtagctggaaccac

SEQ ID NO: 138836 - DNA, 20 bp, Artificial
  CRISPR gRNA sequence
caggcatgcacctttgtgcc

SEQ ID NO: 138837 - DNA, 20 bp, Artificial
  CRISPR gRNA sequence
atgcacctttgtgcccagct

SEQ ID NO: 138838 - DNA, 20 bp, Artificial
  CRISPR gRNA sequence
cagcttggcttttatctttt

SEQ ID NO: 138839 - DNA, 20 bp, Artificial
  CRISPR gRNA sequence
tggcttttatcttttaagac

SEQ ID NO: 138840 - DNA, 20 bp, Artificial
  CRISPR gRNA sequence
ggcttttatcttttaagact

SEQ ID NO: 138841 - DNA, 20 bp, Artificial
  CRISPR gRNA sequence
actgggtttacatttctgta

SEQ ID NO: 138842 - DNA, 20 bp, Artificial
  CRISPR gRNA sequence
ttctgtacagtactaatcac

SEQ ID NO: 138843 - DNA, 20 bp, Artificial
  CRISPR gRNA sequence
tctgtacagtactaatcact

SEQ ID NO: 138844 - DNA, 20 bp, Artificial
  CRISPR gRNA sequence
ctgtacagtactaatcactg

SEQ ID NO: 138845 - DNA, 20 bp, Artificial
  CRISPR gRNA sequence
tcactggggacttttaatat

SEQ ID NO: 138846 - DNA, 20 bp, Artificial
  CRISPR gRNA sequence
tttaatataagaatttgctg

SEQ ID NO: 138847 - DNA, 20 bp, Artificial
  CRISPR gRNA sequence
ttaatataagaatttgctga

SEQ ID NO: 138848 - DNA, 20 bp, Artificial
  CRISPR gRNA sequence
taagaatttgctgaaggctg

SEQ ID NO: 138849 - DNA, 20 bp, Artificial
  CRISPR gRNA sequence
atttgctgaaggctgtggca

SEQ ID NO: 138850 - DNA, 20 bp, Artificial
  CRISPR gRNA sequence
ttgctgaaggctgtggcatg

SEQ ID NO: 138851 - DNA, 20 bp, Artificial
  CRISPR gRNA sequence
tgctgaaggctgtggcatgg

SEQ ID NO: 138852 - DNA, 20 bp, Artificial
  CRISPR gRNA sequence
aaggctgtggcatggaggat

SEQ ID NO: 138853 - DNA, 20 bp, Artificial
  CRISPR gRNA sequence
gctgtggcatggaggatgag

SEQ ID NO: 138854 - DNA, 20 bp, Artificial
  CRISPR gRNA sequence
gcatggaggatgagaagcca

SEQ ID NO: 138855 - DNA, 20 bp, Artificial
  CRISPR gRNA sequence
atggaggatgagaagccaca

SEQ ID NO: 138856 - DNA, 20 bp, Artificial
  CRISPR gRNA sequence
aagccacagagaacttgaaa

SEQ ID NO: 138857 - DNA, 20 bp, Artificial
  CRISPR gRNA sequence
cagagaacttgaaaaagctt

SEQ ID NO: 138858 - DNA, 20 bp, Artificial
  CRISPR gRNA sequence
gaacttgaaaaagctttgga

SEQ ID NO: 138859 - DNA, 20 bp, Artificial
  CRISPR gRNA sequence
tgaaaaagctttggaaagaa

SEQ ID NO: 138860 - DNA, 20 bp, Artificial
  CRISPR gRNA sequence
aagaatggcattgaaaatta

SEQ ID NO: 138861 - DNA, 20 bp, Artificial
  CRISPR gRNA sequence
agaatggcattgaaaattat

SEQ ID NO: 138862 - DNA, 20 bp, Artificial
  CRISPR gRNA sequence
tggcattgaaaattatgggc

SEQ ID NO: 138863 - DNA, 20 bp, Artificial
  CRISPR gRNA sequence
ttgaaaattatgggctagac

SEQ ID NO: 138864 - DNA, 20 bp, Artificial
  CRISPR gRNA sequence
tgaaaattatgggctagact

SEQ ID NO: 138865 - DNA, 20 bp, Artificial
  CRISPR gRNA sequence
gaaaattatgggctagacta

SEQ ID NO: 138866 - DNA, 20 bp, Artificial
  CRISPR gRNA sequence
tgggctagactagggcaaca

SEQ ID NO: 138867 - DNA, 20 bp, Artificial
  CRISPR gRNA sequence
tcctcaccccacacccatat

SEQ ID NO: 138868 - DNA, 20 bp, Artificial
  CRISPR gRNA sequence
tcaccccacacccatataag

SEQ ID NO: 138869 - DNA, 20 bp, Artificial
  CRISPR gRNA sequence
acacccatataagaagttaa

SEQ ID NO: 138870 - DNA, 20 bp, Artificial
  CRISPR gRNA sequence
taaaagtccttgattaacat

SEQ ID NO: 138871 - DNA, 20 bp, Artificial
  CRISPR gRNA sequence
aaaagtccttgattaacatt

SEQ ID NO: 138872 - DNA, 20 bp, Artificial
  CRISPR gRNA sequence
cttgattaacattaggattt

SEQ ID NO: 138873 - DNA, 20 bp, Artificial
  CRISPR gRNA sequence
aggatttcagcttacatttc

SEQ ID NO: 138874 - DNA, 20 bp, Artificial
  CRISPR gRNA sequence
tctagcaacttttgatattc

SEQ ID NO: 138875 - DNA, 20 bp, Artificial
  CRISPR gRNA sequence
gcaacttttgatattctagt

SEQ ID NO: 138876 - DNA, 20 bp, Artificial
  CRISPR gRNA sequence
aacttttgatattctagttg

SEQ ID NO: 138877 - DNA, 20 bp, Artificial
  CRISPR gRNA sequence
acttttgatattctagttgg

SEQ ID NO: 138878 - DNA, 20 bp, Artificial
  CRISPR gRNA sequence
atattctagttggaggtctt

SEQ ID NO: 138879 - DNA, 20 bp, Artificial
  CRISPR gRNA sequence
ttctagttggaggtcttcag

SEQ ID NO: 138880 - DNA, 20 bp, Artificial
  CRISPR gRNA sequence
gaggtcttcagtagtctcta

SEQ ID NO: 138881 - DNA, 20 bp, Artificial
  CRISPR gRNA sequence
ttcagtagtctctatggtat

SEQ ID NO: 138882 - DNA, 20 bp, Artificial
  CRISPR gRNA sequence
gtagtctctatggtataagc

SEQ ID NO: 138883 - DNA, 20 bp, Artificial
  CRISPR gRNA sequence
tctctatggtataagctaga

SEQ ID NO: 138884 - DNA, 20 bp, Artificial
  CRISPR gRNA sequence
ctatggtataagctagatag

SEQ ID NO: 138885 - DNA, 20 bp, Artificial
  CRISPR gRNA sequence
tatggtataagctagataga

SEQ ID NO: 138886 - DNA, 20 bp, Artificial
  CRISPR gRNA sequence
actttcctaccaatgttttt

SEQ ID NO: 138887 - DNA, 20 bp, Artificial
  CRISPR gRNA sequence
taccaatgtttttaagatgt

SEQ ID NO: 138888 - DNA, 20 bp, Artificial
  CRISPR gRNA sequence
agtctgtgttaaaatctttt

SEQ ID NO: 138889 - DNA, 20 bp, Artificial
  CRISPR gRNA sequence
tatataccttatcaaactga

SEQ ID NO: 138890 - DNA, 20 bp, Artificial
  CRISPR gRNA sequence
tatcaaactgaaagattgaa

SEQ ID NO: 138891 - DNA, 20 bp, Artificial
  CRISPR gRNA sequence
aaatatacaaatgcctaatc

SEQ ID NO: 138892 - DNA, 20 bp, Artificial
  CRISPR gRNA sequence
atacaaatgcctaatctgga

SEQ ID NO: 138893 - DNA, 20 bp, Artificial
  CRISPR gRNA sequence
aaatgcctaatctggacaga

SEQ ID NO: 138894 - DNA, 20 bp, Artificial
  CRISPR gRNA sequence
cttatgtatgtgtttatttt

SEQ ID NO: 138895 - DNA, 20 bp, Artificial
  CRISPR gRNA sequence
tgtgtttattttcagttgtc

SEQ ID NO: 138896 - DNA, 20 bp, Artificial
  CRISPR gRNA sequence
ttcagttgtcgagatgtcca

SEQ ID NO: 138897 - DNA, 20 bp, Artificial
  CRISPR gRNA sequence
agttgtcgagatgtccacag

SEQ ID NO: 138898 - DNA, 20 bp, Artificial
  CRISPR gRNA sequence
gttgtcgagatgtccacaga

SEQ ID NO: 138899 - DNA, 20 bp, Artificial
  CRISPR gRNA sequence
tgtcgagatgtccacagaag

SEQ ID NO: 138900 - DNA, 20 bp, Artificial
  CRISPR gRNA sequence
gtcgagatgtccacagaagg

SEQ ID NO: 138901 - DNA, 20 bp, Artificial
  CRISPR gRNA sequence
atgtccacagaaggaggatt

SEQ ID NO: 138902 - DNA, 20 bp, Artificial
  CRISPR gRNA sequence
tccacagaaggaggatttgg

SEQ ID NO: 138903 - DNA, 20 bp, Artificial
  CRISPR gRNA sequence
gaaggaggatttggtggtac

SEQ ID NO: 138904 - DNA, 20 bp, Artificial
  CRISPR gRNA sequence
ggaggatttggtggtactag

SEQ ID NO: 138905 - DNA, 20 bp, Artificial
  CRISPR gRNA sequence
ggatttggtggtactagcag

SEQ ID NO: 138906 - DNA, 20 bp, Artificial
  CRISPR gRNA sequence
gtactagcagcagtgatgcc

SEQ ID NO: 138907 - DNA, 20 bp, Artificial
  CRISPR gRNA sequence
agcagcagtgatgcccagca

SEQ ID NO: 138908 - DNA, 20 bp, Artificial
  CRISPR gRNA sequence
gtgatgcccagcaaagccta

SEQ ID NO: 138909 - DNA, 20 bp, Artificial
  CRISPR gRNA sequence
agcaaagcctacagtcgttc

SEQ ID NO: 138910 - DNA, 20 bp, Artificial
  CRISPR gRNA sequence
gcctacagtcgttctggcct

SEQ ID NO: 138911 - DNA, 20 bp, Artificial
  CRISPR gRNA sequence
cctacagtcgttctggcctc

SEQ ID NO: 138912 - DNA, 20 bp, Artificial
  CRISPR gRNA sequence
gtcgttctggcctcgggtca

SEQ ID NO: 138913 - DNA, 20 bp, Artificial
  CRISPR gRNA sequence
gttctggcctcgggtcatgg

SEQ ID NO: 138914 - DNA, 20 bp, Artificial
  CRISPR gRNA sequence
ctcgggtcatggaagaaatc

SEQ ID NO: 138915 - DNA, 20 bp, Artificial
  CRISPR gRNA sequence
ggaagaaatccggaatttaa

SEQ ID NO: 138916 - DNA, 20 bp, Artificial
  CRISPR gRNA sequence
agaaatccggaatttaacag

SEQ ID NO: 138917 - DNA, 20 bp, Artificial
  CRISPR gRNA sequence
atccggaatttaacagtggt

SEQ ID NO: 138918 - DNA, 20 bp, Artificial
  CRISPR gRNA sequence
tccggaatttaacagtggtg

SEQ ID NO: 138919 - DNA, 20 bp, Artificial
  CRISPR gRNA sequence
ggaatttaacagtggtgagg

SEQ ID NO: 138920 - DNA, 20 bp, Artificial
  CRISPR gRNA sequence
taacagtggtgaggaagaat

SEQ ID NO: 138921 - DNA, 20 bp, Artificial
  CRISPR gRNA sequence
gaagaatgagaaacttttat

SEQ ID NO: 138922 - DNA, 20 bp, Artificial
  CRISPR gRNA sequence
acttttattagaaactttta

SEQ ID NO: 138923 - DNA, 20 bp, Artificial
  CRISPR gRNA sequence
ttttattagaaacttttaaa

SEQ ID NO: 138924 - DNA, 20 bp, Artificial
  CRISPR gRNA sequence
agaaacttttaaagagtata

SEQ ID NO: 138925 - DNA, 20 bp, Artificial
  CRISPR gRNA sequence
aaacttttaaagagtataaa

SEQ ID NO: 138926 - DNA, 20 bp, Artificial
  CRISPR gRNA sequence
ttaaagagtataaagagctc

SEQ ID NO: 138927 - DNA, 20 bp, Artificial
  CRISPR gRNA sequence
taaagagtataaagagctct

SEQ ID NO: 138928 - DNA, 20 bp, Artificial
  CRISPR gRNA sequence
ctgggaaattaaccaaaact

SEQ ID NO: 138929 - DNA, 20 bp, Artificial
  CRISPR gRNA sequence
attaaccaaaactcagacta

SEQ ID NO: 138930 - DNA, 20 bp, Artificial
  CRISPR gRNA sequence
actaaagcatttttaatttc

SEQ ID NO: 138931 - DNA, 20 bp, Artificial
  CRISPR gRNA sequence
tttaatttcaagcacattta

SEQ ID NO: 138932 - DNA, 20 bp, Artificial
  CRISPR gRNA sequence
taatttcaagcacatttaca

SEQ ID NO: 138933 - DNA, 20 bp, Artificial
  CRISPR gRNA sequence
aatttcaagcacatttacag

SEQ ID NO: 138934 - DNA, 20 bp, Artificial
  CRISPR gRNA sequence
caagcacatttacagaggca

SEQ ID NO: 138935 - DNA, 20 bp, Artificial
  CRISPR gRNA sequence
catggttcacccctgacctg

SEQ ID NO: 138936 - DNA, 20 bp, Artificial
  CRISPR gRNA sequence
atggttcacccctgacctgt

SEQ ID NO: 138937 - DNA, 20 bp, Artificial
  CRISPR gRNA sequence
gttcacccctgacctgtggg

SEQ ID NO: 138938 - DNA, 20 bp, Artificial
  CRISPR gRNA sequence
ttcacccctgacctgtgggt

SEQ ID NO: 138939 - DNA, 20 bp, Artificial
  CRISPR gRNA sequence
aaacataatttgccttccgt

SEQ ID NO: 138940 - DNA, 20 bp, Artificial
  CRISPR gRNA sequence
aacataatttgccttccgtg

SEQ ID NO: 138941 - DNA, 20 bp, Artificial
  CRISPR gRNA sequence
gccttccgtgaggtaactgc

SEQ ID NO: 138942 - DNA, 20 bp, Artificial
  CRISPR gRNA sequence
cttccgtgaggtaactgcaa

SEQ ID NO: 138943 - DNA, 20 bp, Artificial
  CRISPR gRNA sequence
tgcaagagtcttttatatct

SEQ ID NO: 138944 - DNA, 20 bp, Artificial
  CRISPR gRNA sequence
tatatctcagtgttcttcca

SEQ ID NO: 138945 - DNA, 20 bp, Artificial
  CRISPR gRNA sequence
atatctcagtgttcttccat

SEQ ID NO: 138946 - DNA, 20 bp, Artificial
  CRISPR gRNA sequence
agtgttcttccataggcgtg

SEQ ID NO: 138947 - DNA, 20 bp, Artificial
  CRISPR gRNA sequence
ttccataggcgtgtggtgtg

SEQ ID NO: 138948 - DNA, 20 bp, Artificial
  CRISPR gRNA sequence
cataggcgtgtggtgtgcag

SEQ ID NO: 138949 - DNA, 20 bp, Artificial
  CRISPR gRNA sequence
gtgcagtggatactttgact

SEQ ID NO: 138950 - DNA, 20 bp, Artificial
  CRISPR gRNA sequence
gcagtggatactttgacttg

SEQ ID NO: 138951 - DNA, 20 bp, Artificial
  CRISPR gRNA sequence
cagtggatactttgacttgg

SEQ ID NO: 138952 - DNA, 20 bp, Artificial
  CRISPR gRNA sequence
tggatactttgacttggagg

SEQ ID NO: 138953 - DNA, 20 bp, Artificial
  CRISPR gRNA sequence
acttggaggtagtttaatgt

SEQ ID NO: 138954 - DNA, 20 bp, Artificial
  CRISPR gRNA sequence
cttggaggtagtttaatgtg

SEQ ID NO: 138955 - DNA, 20 bp, Artificial
  CRISPR gRNA sequence
ttaatgtgaggcatatcctt

SEQ ID NO: 138956 - DNA, 20 bp, Artificial
  CRISPR gRNA sequence
taatgtgaggcatatccttt

SEQ ID NO: 138957 - DNA, 20 bp, Artificial
  CRISPR gRNA sequence
ggcatatcctttaggactta

SEQ ID NO: 138958 - DNA, 20 bp, Artificial
  CRISPR gRNA sequence
ctttaggacttacagaaaaa

SEQ ID NO: 138959 - DNA, 20 bp, Artificial
  CRISPR gRNA sequence
ttaggacttacagaaaaaca

SEQ ID NO: 138960 - DNA, 20 bp, Artificial
  CRISPR gRNA sequence
acagagatctcatcttcctt

SEQ ID NO: 138961 - DNA, 20 bp, Artificial
  CRISPR gRNA sequence
gagatctcatcttccttcag

SEQ ID NO: 138962 - DNA, 20 bp, Artificial
  CRISPR gRNA sequence
tcatcttccttcagtagctg

SEQ ID NO: 138963 - DNA, 20 bp, Artificial
  CRISPR gRNA sequence
gtagctgtagctcaattttt

SEQ ID NO: 138964 - DNA, 20 bp, Artificial
  CRISPR gRNA sequence
tagctgtagctcaatttttt

SEQ ID NO: 138965 - DNA, 20 bp, Artificial
  CRISPR gRNA sequence
tcaattttttaggcctgatt

SEQ ID NO: 138966 - DNA, 20 bp, Artificial
  CRISPR gRNA sequence
attttttaggcctgatttag

SEQ ID NO: 138967 - DNA, 20 bp, Artificial
  CRISPR gRNA sequence
tagtggccctacgacatttc

SEQ ID NO: 138968 - DNA, 20 bp, Artificial
  CRISPR gRNA sequence
cctacgacatttctagaact

SEQ ID NO: 138969 - DNA, 20 bp, Artificial
  CRISPR gRNA sequence
tagaacttggtaaaaactat

SEQ ID NO: 138970 - DNA, 20 bp, Artificial
  CRISPR gRNA sequence
agaacttggtaaaaactatt

SEQ ID NO: 138971 - DNA, 20 bp, Artificial
  CRISPR gRNA sequence
ttcaacaacaaatctattgt

SEQ ID NO: 138972 - DNA, 20 bp, Artificial
  CRISPR gRNA sequence
acaacaaatctattgtgagt

SEQ ID NO: 138973 - DNA, 20 bp, Artificial
  CRISPR gRNA sequence
caacaaatctattgtgagtc

SEQ ID NO: 138974 - DNA, 20 bp, Artificial
  CRISPR gRNA sequence
tgtgagtcaggaactctttc

SEQ ID NO: 138975 - DNA, 20 bp, Artificial
  CRISPR gRNA sequence
gtgagtcaggaactctttct

SEQ ID NO: 138976 - DNA, 20 bp, Artificial
  CRISPR gRNA sequence
aactctttctaggtgttaaa

SEQ ID NO: 138977 - DNA, 20 bp, Artificial
  CRISPR gRNA sequence
aaaaagatatactttgatcg

SEQ ID NO: 138978 - DNA, 20 bp, Artificial
  CRISPR gRNA sequence
ctttgatcgcagtttctcaa

SEQ ID NO: 138979 - DNA, 20 bp, Artificial
  CRISPR gRNA sequence
cagctgcattattgacattt

SEQ ID NO: 138980 - DNA, 20 bp, Artificial
  CRISPR gRNA sequence
agctgcattattgacatttt

SEQ ID NO: 138981 - DNA, 20 bp, Artificial
  CRISPR gRNA sequence
gcattattgacattttgggc

SEQ ID NO: 138982 - DNA, 20 bp, Artificial
  CRISPR gRNA sequence
gccagataattctttgttgt

SEQ ID NO: 138983 - DNA, 20 bp, Artificial
  CRISPR gRNA sequence
ccagataattctttgttgtg

SEQ ID NO: 138984 - DNA, 20 bp, Artificial
  CRISPR gRNA sequence
cagataattctttgttgtga

SEQ ID NO: 138985 - DNA, 20 bp, Artificial
  CRISPR gRNA sequence
agataattctttgttgtgag

SEQ ID NO: 138986 - DNA, 20 bp, Artificial
  CRISPR gRNA sequence
aggggccgtcttatgcataa

SEQ ID NO: 138987 - DNA, 20 bp, Artificial
  CRISPR gRNA sequence
cttatgcataacagcatgtt

SEQ ID NO: 138988 - DNA, 20 bp, Artificial
  CRISPR gRNA sequence
atgcataacagcatgtttag

SEQ ID NO: 138989 - DNA, 20 bp, Artificial
  CRISPR gRNA sequence
agcatgtttagcagcacccc

SEQ ID NO: 138990 - DNA, 20 bp, Artificial
  CRISPR gRNA sequence
cacccctagcctctactcac

SEQ ID NO: 138991 - DNA, 20 bp, Artificial
  CRISPR gRNA sequence
agcctctactcactagatgc

SEQ ID NO: 138992 - DNA, 20 bp, Artificial
  CRISPR gRNA sequence
ctctactcactagatgccag

SEQ ID NO: 138993 - DNA, 20 bp, Artificial
  CRISPR gRNA sequence
tgccagtagcacccctcccc

SEQ ID NO: 138994 - DNA, 20 bp, Artificial
  CRISPR gRNA sequence
cctccccgagttgtgacaac

SEQ ID NO: 138995 - DNA, 20 bp, Artificial
  CRISPR gRNA sequence
tgacaaccagaaaatgtctc

SEQ ID NO: 138996 - DNA, 20 bp, Artificial
  CRISPR gRNA sequence
cagaaaatgtctccagacat

SEQ ID NO: 138997 - DNA, 20 bp, Artificial
  CRISPR gRNA sequence
gacattggcaaatgtcccca

SEQ ID NO: 138998 - DNA, 20 bp, Artificial
  CRISPR gRNA sequence
acattggcaaatgtccccat

SEQ ID NO: 138999 - DNA, 20 bp, Artificial
  CRISPR gRNA sequence
ggcaaaaatcatcccttgtt

SEQ ID NO: 139000 - DNA, 20 bp, Artificial
  CRISPR gRNA sequence
cttgttgagaactactgact

SEQ ID NO: 139001 - DNA, 20 bp, Artificial
  CRISPR gRNA sequence
agaataattaaatataacct

SEQ ID NO: 139002 - DNA, 20 bp, Artificial
  CRISPR gRNA sequence
taaatataacctcggcctgt

SEQ ID NO: 139003 - DNA, 20 bp, Artificial
  CRISPR gRNA sequence
aaatataacctcggcctgtg

SEQ ID NO: 139004 - DNA, 20 bp, Artificial
  CRISPR gRNA sequence
atataacctcggcctgtgag

SEQ ID NO: 139005 - DNA, 20 bp, Artificial
  CRISPR gRNA sequence
cctgtgaggagcttacaatc

SEQ ID NO: 139006 - DNA, 20 bp, Artificial
  CRISPR gRNA sequence
tacaatctagtaattacaac

SEQ ID NO: 139007 - DNA, 20 bp, Artificial
  CRISPR gRNA sequence
taattacaaccagaataatt

SEQ ID NO: 139008 - DNA, 20 bp, Artificial
  CRISPR gRNA sequence
tacaaccagaataatttagt

SEQ ID NO: 139009 - DNA, 20 bp, Artificial
  CRISPR gRNA sequence
aaccagaataatttagtcag

SEQ ID NO: 139010 - DNA, 20 bp, Artificial
  CRISPR gRNA sequence
accagaataatttagtcagt

SEQ ID NO: 139011 - DNA, 20 bp, Artificial
  CRISPR gRNA sequence
ttagtcagtaggtatttact

SEQ ID NO: 139012 - DNA, 20 bp, Artificial
  CRISPR gRNA sequence
ttactaagtacttactgaat

SEQ ID NO: 139013 - DNA, 20 bp, Artificial
  CRISPR gRNA sequence
tactaagtacttactgaatc

SEQ ID NO: 139014 - DNA, 20 bp, Artificial
  CRISPR gRNA sequence
agtacttactgaatcaggca

SEQ ID NO: 139015 - DNA, 20 bp, Artificial
  CRISPR gRNA sequence
actgaatcaggcacagtgat

SEQ ID NO: 139016 - DNA, 20 bp, Artificial
  CRISPR gRNA sequence
aggcacagtgatgagtcctg

SEQ ID NO: 139017 - DNA, 20 bp, Artificial
  CRISPR gRNA sequence
cacagtgatgagtcctgaag

SEQ ID NO: 139018 - DNA, 20 bp, Artificial
  CRISPR gRNA sequence
gatgagtcctgaagcagtaa

SEQ ID NO: 139019 - DNA, 20 bp, Artificial
  CRISPR gRNA sequence
gtcctgaagcagtaaaagtc

SEQ ID NO: 139020 - DNA, 20 bp, Artificial
  CRISPR gRNA sequence
tcctgaagcagtaaaagtca

SEQ ID NO: 139021 - DNA, 20 bp, Artificial
  CRISPR gRNA sequence
ctgaagcagtaaaagtcaag

SEQ ID NO: 139022 - DNA, 20 bp, Artificial
  CRISPR gRNA sequence
gcagtaaaagtcaaggagca

SEQ ID NO: 139023 - DNA, 20 bp, Artificial
  CRISPR gRNA sequence
agtaaaagtcaaggagcaca

SEQ ID NO: 139024 - DNA, 20 bp, Artificial
  CRISPR gRNA sequence
gtaaaagtcaaggagcacag

SEQ ID NO: 139025 - DNA, 20 bp, Artificial
  CRISPR gRNA sequence
gtcaaggagcacagaggaca

SEQ ID NO: 139026 - DNA, 20 bp, Artificial
  CRISPR gRNA sequence
acatagtgcttgattctttc

SEQ ID NO: 139027 - DNA, 20 bp, Artificial
  CRISPR gRNA sequence
gtgcttgattctttctggtt

SEQ ID NO: 139028 - DNA, 20 bp, Artificial
  CRISPR gRNA sequence
gattctttctggttgagttt

SEQ ID NO: 139029 - DNA, 20 bp, Artificial
  CRISPR gRNA sequence
tttctggttgagtttaagta

SEQ ID NO: 139030 - DNA, 20 bp, Artificial
  CRISPR gRNA sequence
ttctggttgagtttaagtaa

SEQ ID NO: 139031 - DNA, 20 bp, Artificial
  CRISPR gRNA sequence
tctggttgagtttaagtaaa

SEQ ID NO: 139032 - DNA, 20 bp, Artificial
  CRISPR gRNA sequence
gtaaagggaacatttttgtt

SEQ ID NO: 139033 - DNA, 20 bp, Artificial
  CRISPR gRNA sequence
tttgttgagtcttaaaatat

SEQ ID NO: 139034 - DNA, 20 bp, Artificial
  CRISPR gRNA sequence
ttgagtcttaaaatatgagt

SEQ ID NO: 139035 - DNA, 20 bp, Artificial
  CRISPR gRNA sequence
aaatatgagtaagcattcac

SEQ ID NO: 139036 - DNA, 20 bp, Artificial
  CRISPR gRNA sequence
gtaagcattcaccagatgtg

SEQ ID NO: 139037 - DNA, 20 bp, Artificial
  CRISPR gRNA sequence
taagcattcaccagatgtga

SEQ ID NO: 139038 - DNA, 20 bp, Artificial
  CRISPR gRNA sequence
cattcaccagatgtgaagga

SEQ ID NO: 139039 - DNA, 20 bp, Artificial
  CRISPR gRNA sequence
attcaccagatgtgaaggat

SEQ ID NO: 139040 - DNA, 20 bp, Artificial
  CRISPR gRNA sequence
tcaccagatgtgaaggatgg

SEQ ID NO: 139041 - DNA, 20 bp, Artificial
  CRISPR gRNA sequence
caccagatgtgaaggatggg

SEQ ID NO: 139042 - DNA, 20 bp, Artificial
  CRISPR gRNA sequence
accagatgtgaaggatggga

SEQ ID NO: 139043 - DNA, 20 bp, Artificial
  CRISPR gRNA sequence
atgtgaaggatgggagggca

SEQ ID NO: 139044 - DNA, 20 bp, Artificial
  CRISPR gRNA sequence
aaggatgggagggcaaagac

SEQ ID NO: 139045 - DNA, 20 bp, Artificial
  CRISPR gRNA sequence
aggatgggagggcaaagaca

SEQ ID NO: 139046 - DNA, 20 bp, Artificial
  CRISPR gRNA sequence
ggatgggagggcaaagacaa

SEQ ID NO: 139047 - DNA, 20 bp, Artificial
  CRISPR gRNA sequence
caaagacaagggcatgcata

SEQ ID NO: 139048 - DNA, 20 bp, Artificial
  CRISPR gRNA sequence
aaagacaagggcatgcataa

SEQ ID NO: 139049 - DNA, 20 bp, Artificial
  CRISPR gRNA sequence
caagggcatgcataaaggca

SEQ ID NO: 139050 - DNA, 20 bp, Artificial
  CRISPR gRNA sequence
agggcatgcataaaggcatg

SEQ ID NO: 139051 - DNA, 20 bp, Artificial
  CRISPR gRNA sequence
gggcatgcataaaggcatgg

SEQ ID NO: 139052 - DNA, 20 bp, Artificial
  CRISPR gRNA sequence
tgcataaaggcatggaggcc

SEQ ID NO: 139053 - DNA, 20 bp, Artificial
  CRISPR gRNA sequence
cataaaggcatggaggccca

SEQ ID NO: 139054 - DNA, 20 bp, Artificial
  CRISPR gRNA sequence
taaaggcatggaggcccaga

SEQ ID NO: 139055 - DNA, 20 bp, Artificial
  CRISPR gRNA sequence
aaaggcatggaggcccagag

SEQ ID NO: 139056 - DNA, 20 bp, Artificial
  CRISPR gRNA sequence
gaggcccagagaggaccttg

SEQ ID NO: 139057 - DNA, 20 bp, Artificial
  CRISPR gRNA sequence
cccagagaggaccttgtagt

SEQ ID NO: 139058 - DNA, 20 bp, Artificial
  CRISPR gRNA sequence
ccagagaggaccttgtagtt

SEQ ID NO: 139059 - DNA, 20 bp, Artificial
  CRISPR gRNA sequence
cagagaggaccttgtagtta

SEQ ID NO: 139060 - DNA, 20 bp, Artificial
  CRISPR gRNA sequence
agagaggaccttgtagttag

SEQ ID NO: 139061 - DNA, 20 bp, Artificial
  CRISPR gRNA sequence
cttgtagttaggggaacatc

SEQ ID NO: 139062 - DNA, 20 bp, Artificial
  CRISPR gRNA sequence
taggggaacatcaagacatt

SEQ ID NO: 139063 - DNA, 20 bp, Artificial
  CRISPR gRNA sequence
ggggaacatcaagacattca

SEQ ID NO: 139064 - DNA, 20 bp, Artificial
  CRISPR gRNA sequence
atcaagacattcagagtgcc

SEQ ID NO: 139065 - DNA, 20 bp, Artificial
  CRISPR gRNA sequence
caagacattcagagtgcctg

SEQ ID NO: 139066 - DNA, 20 bp, Artificial
  CRISPR gRNA sequence
aagacattcagagtgcctgg

SEQ ID NO: 139067 - DNA, 20 bp, Artificial
  CRISPR gRNA sequence
cctggaggttactgtgtgtt

SEQ ID NO: 139068 - DNA, 20 bp, Artificial
  CRISPR gRNA sequence
ggaggttactgtgtgtttag

SEQ ID NO: 139069 - DNA, 20 bp, Artificial
  CRISPR gRNA sequence
aggttactgtgtgtttagtg

SEQ ID NO: 139070 - DNA, 20 bp, Artificial
  CRISPR gRNA sequence
ggttactgtgtgtttagtgg

SEQ ID NO: 139071 - DNA, 20 bp, Artificial
  CRISPR gRNA sequence
ctgtgtgtttagtggaggtt

SEQ ID NO: 139072 - DNA, 20 bp, Artificial
  CRISPR gRNA sequence
tgtgtgtttagtggaggttg

SEQ ID NO: 139073 - DNA, 20 bp, Artificial
  CRISPR gRNA sequence
gtgtgtttagtggaggttga

SEQ ID NO: 139074 - DNA, 20 bp, Artificial
  CRISPR gRNA sequence
tgtttagtggaggttgaggg

SEQ ID NO: 139075 - DNA, 20 bp, Artificial
  CRISPR gRNA sequence
gtttagtggaggttgaggga

SEQ ID NO: 139076 - DNA, 20 bp, Artificial
  CRISPR gRNA sequence
ttagtggaggttgagggaag

SEQ ID NO: 139077 - DNA, 20 bp, Artificial
  CRISPR gRNA sequence
tggaggttgagggaaggagt

SEQ ID NO: 139078 - DNA, 20 bp, Artificial
  CRISPR gRNA sequence
tgagggaaggagtaagtatg

SEQ ID NO: 139079 - DNA, 20 bp, Artificial
  CRISPR gRNA sequence
aaggagtaagtatgtggtat

SEQ ID NO: 139080 - DNA, 20 bp, Artificial
  CRISPR gRNA sequence
ggagtaagtatgtggtatga

SEQ ID NO: 139081 - DNA, 20 bp, Artificial
  CRISPR gRNA sequence
gtaagtatgtggtatgagag

SEQ ID NO: 139082 - DNA, 20 bp, Artificial
  CRISPR gRNA sequence
agtatgtggtatgagagtgg

SEQ ID NO: 139083 - DNA, 20 bp, Artificial
  CRISPR gRNA sequence
atgtggtatgagagtggtag

SEQ ID NO: 139084 - DNA, 20 bp, Artificial
  CRISPR gRNA sequence
tggtatgagagtggtagtgg

SEQ ID NO: 139085 - DNA, 20 bp, Artificial
  CRISPR gRNA sequence
ggtatgagagtggtagtgga

SEQ ID NO: 139086 - DNA, 20 bp, Artificial
  CRISPR gRNA sequence
tgagagtggtagtggaaggt

SEQ ID NO: 139087 - DNA, 20 bp, Artificial
  CRISPR gRNA sequence
agtggtagtggaaggtgaga

SEQ ID NO: 139088 - DNA, 20 bp, Artificial
  CRISPR gRNA sequence
gtggtagtggaaggtgagac

SEQ ID NO: 139089 - DNA, 20 bp, Artificial
  CRISPR gRNA sequence
tagtggaaggtgagacaggt

SEQ ID NO: 139090 - DNA, 20 bp, Artificial
  CRISPR gRNA sequence
gtggaaggtgagacaggtta

SEQ ID NO: 139091 - DNA, 20 bp, Artificial
  CRISPR gRNA sequence
aaggtgagacaggttagagt

SEQ ID NO: 139092 - DNA, 20 bp, Artificial
  CRISPR gRNA sequence
gttggaatattttcataata

SEQ ID NO: 139093 - DNA, 20 bp, Artificial
  CRISPR gRNA sequence
cagttgtcatgtccttaatg

SEQ ID NO: 139094 - DNA, 20 bp, Artificial
  CRISPR gRNA sequence
cttaatgaagaatgttcatt

SEQ ID NO: 139095 - DNA, 20 bp, Artificial
  CRISPR gRNA sequence
ttaatgaagaatgttcatta

SEQ ID NO: 139096 - DNA, 20 bp, Artificial
  CRISPR gRNA sequence
tgttcattaaggtgtcattt

SEQ ID NO: 139097 - DNA, 20 bp, Artificial
  CRISPR gRNA sequence
tgtcattttagcacatacta

SEQ ID NO: 139098 - DNA, 20 bp, Artificial
  CRISPR gRNA sequence
gtcattttagcacatactaa

SEQ ID NO: 139099 - DNA, 20 bp, Artificial
  CRISPR gRNA sequence
cattttagcacatactaaag

SEQ ID NO: 139100 - DNA, 20 bp, Artificial
  CRISPR gRNA sequence
actaaaggagctccccatgt

SEQ ID NO: 139101 - DNA, 20 bp, Artificial
  CRISPR gRNA sequence
tggctgtgtcattcctgccc

SEQ ID NO: 139102 - DNA, 20 bp, Artificial
  CRISPR gRNA sequence
cattcctgccctggaaatac

SEQ ID NO: 139103 - DNA, 20 bp, Artificial
  CRISPR gRNA sequence
ccctggaaatactagcatcc

SEQ ID NO: 139104 - DNA, 20 bp, Artificial
  CRISPR gRNA sequence
tggaaatactagcatcctgg

SEQ ID NO: 139105 - DNA, 20 bp, Artificial
  CRISPR gRNA sequence
gaaatactagcatcctggca

SEQ ID NO: 139106 - DNA, 20 bp, Artificial
  CRISPR gRNA sequence
atactagcatcctggcagag

SEQ ID NO: 139107 - DNA, 20 bp, Artificial
  CRISPR gRNA sequence
catcctggcagagcagacac

SEQ ID NO: 139108 - DNA, 20 bp, Artificial
  CRISPR gRNA sequence
cactggattccttcctgatg

SEQ ID NO: 139109 - DNA, 20 bp, Artificial
  CRISPR gRNA sequence
aattaatgttgcaattgctt

SEQ ID NO: 139110 - DNA, 20 bp, Artificial
  CRISPR gRNA sequence
attaatgttgcaattgctta

SEQ ID NO: 139111 - DNA, 20 bp, Artificial
  CRISPR gRNA sequence
atgttgcaattgcttaaggt

SEQ ID NO: 139112 - DNA, 20 bp, Artificial
  CRISPR gRNA sequence
aacttctgacgttacaatgt

SEQ ID NO: 139113 - DNA, 20 bp, Artificial
  CRISPR gRNA sequence
atacttattatgtaccaact

SEQ ID NO: 139114 - DNA, 20 bp, Artificial
  CRISPR gRNA sequence
tacttattatgtaccaacta

SEQ ID NO: 139115 - DNA, 20 bp, Artificial
  CRISPR gRNA sequence
tgtaccaactaaggctatgc

SEQ ID NO: 139116 - DNA, 20 bp, Artificial
  CRISPR gRNA sequence
taaggctatgctagatactg

SEQ ID NO: 139117 - DNA, 20 bp, Artificial
  CRISPR gRNA sequence
tatgctagatactgtggata

SEQ ID NO: 139118 - DNA, 20 bp, Artificial
  CRISPR gRNA sequence
ctgtggatacagtaatgaac

SEQ ID NO: 139119 - DNA, 20 bp, Artificial
  CRISPR gRNA sequence
ggatacagtaatgaaccaga

SEQ ID NO: 139120 - DNA, 20 bp, Artificial
  CRISPR gRNA sequence
acagtaatgaaccagacaga

SEQ ID NO: 139121 - DNA, 20 bp, Artificial
  CRISPR gRNA sequence
cagtaatgaaccagacagac

SEQ ID NO: 139122 - DNA, 20 bp, Artificial
  CRISPR gRNA sequence
agacaggatcattgcgctca

SEQ ID NO: 139123 - DNA, 20 bp, Artificial
  CRISPR gRNA sequence
catggaacatatattctgat

SEQ ID NO: 139124 - DNA, 20 bp, Artificial
  CRISPR gRNA sequence
gaacatatattctgatgaga

SEQ ID NO: 139125 - DNA, 20 bp, Artificial
  CRISPR gRNA sequence
aacatatattctgatgagac

SEQ ID NO: 139126 - DNA, 20 bp, Artificial
  CRISPR gRNA sequence
gatgagacaggctaataaac

SEQ ID NO: 139127 - DNA, 20 bp, Artificial
  CRISPR gRNA sequence
tgataaatgcccactgactt

SEQ ID NO: 139128 - DNA, 20 bp, Artificial
  CRISPR gRNA sequence
gataaatgcccactgacttc

SEQ ID NO: 139129 - DNA, 20 bp, Artificial
  CRISPR gRNA sequence
ataaatgcccactgacttca

SEQ ID NO: 139130 - DNA, 20 bp, Artificial
  CRISPR gRNA sequence
ccactgacttcagggataaa

SEQ ID NO: 139131 - DNA, 20 bp, Artificial
  CRISPR gRNA sequence
ataaaaagtaattcatgttt

SEQ ID NO: 139132 - DNA, 20 bp, Artificial
  CRISPR gRNA sequence
tcatgttttggatatacctc

SEQ ID NO: 139133 - DNA, 20 bp, Artificial
  CRISPR gRNA sequence
catgttttggatatacctct

SEQ ID NO: 139134 - DNA, 20 bp, Artificial
  CRISPR gRNA sequence
gggtcatgtttgtttatatg

SEQ ID NO: 139135 - DNA, 20 bp, Artificial
  CRISPR gRNA sequence
gtcatgtttgtttatatgaa

SEQ ID NO: 139136 - DNA, 20 bp, Artificial
  CRISPR gRNA sequence
ttgtttatatgaagagtttt

SEQ ID NO: 139137 - DNA, 20 bp, Artificial
  CRISPR gRNA sequence
tttatatgaagagttttcag

SEQ ID NO: 139138 - DNA, 20 bp, Artificial
  CRISPR gRNA sequence
gagttttcagcagttgaact

SEQ ID NO: 139139 - DNA, 20 bp, Artificial
  CRISPR gRNA sequence
ttcagcagttgaacttggct

SEQ ID NO: 139140 - DNA, 20 bp, Artificial
  CRISPR gRNA sequence
gaacttggcttagcctttct

SEQ ID NO: 139141 - DNA, 20 bp, Artificial
  CRISPR gRNA sequence
tggcttagcctttctcagac

SEQ ID NO: 139142 - DNA, 20 bp, Artificial
  CRISPR gRNA sequence
tagcctttctcagactggcc

SEQ ID NO: 139143 - DNA, 20 bp, Artificial
  CRISPR gRNA sequence
agcctttctcagactggcct

SEQ ID NO: 139144 - DNA, 20 bp, Artificial
  CRISPR gRNA sequence
ttctcagactggcctgggtt

SEQ ID NO: 139145 - DNA, 20 bp, Artificial
  CRISPR gRNA sequence
ctcagactggcctgggttca

SEQ ID NO: 139146 - DNA, 20 bp, Artificial
  CRISPR gRNA sequence
agactggcctgggttcagag

SEQ ID NO: 139147 - DNA, 20 bp, Artificial
  CRISPR gRNA sequence
cagagtggatttccactgaa

SEQ ID NO: 139148 - DNA, 20 bp, Artificial
  CRISPR gRNA sequence
aagtcattgttcctcttctg

SEQ ID NO: 139149 - DNA, 20 bp, Artificial
  CRISPR gRNA sequence
ttgttcctcttctgcagtct

SEQ ID NO: 139150 - DNA, 20 bp, Artificial
  CRISPR gRNA sequence
tgttcctcttctgcagtcta

SEQ ID NO: 139151 - DNA, 20 bp, Artificial
  CRISPR gRNA sequence
tcctcttctgcagtctaagg

SEQ ID NO: 139152 - DNA, 20 bp, Artificial
  CRISPR gRNA sequence
tcttctgcagtctaaggtag

SEQ ID NO: 139153 - DNA, 20 bp, Artificial
  CRISPR gRNA sequence
agtagttatctaaactgtct

SEQ ID NO: 139154 - DNA, 20 bp, Artificial
  CRISPR gRNA sequence
ctaaactgtctcagatatga

SEQ ID NO: 139155 - DNA, 20 bp, Artificial
  CRISPR gRNA sequence
aaactgtctcagatatgaaa

SEQ ID NO: 139156 - DNA, 20 bp, Artificial
  CRISPR gRNA sequence
ctgtctcagatatgaaagag

SEQ ID NO: 139157 - DNA, 20 bp, Artificial
  CRISPR gRNA sequence
tgtctcagatatgaaagaga

SEQ ID NO: 139158 - DNA, 20 bp, Artificial
  CRISPR gRNA sequence
gtctcagatatgaaagagaa

SEQ ID NO: 139159 - DNA, 20 bp, Artificial
  CRISPR gRNA sequence
ctcagatatgaaagagaagg

SEQ ID NO: 139160 - DNA, 20 bp, Artificial
  CRISPR gRNA sequence
tcagatatgaaagagaaggg

SEQ ID NO: 139161 - DNA, 20 bp, Artificial
  CRISPR gRNA sequence
gaggaataaatgaaatgata

SEQ ID NO: 139162 - DNA, 20 bp, Artificial
  CRISPR gRNA sequence
aaatgaaatgataaagtcaa

SEQ ID NO: 139163 - DNA, 20 bp, Artificial
  CRISPR gRNA sequence
aatgaaatgataaagtcaaa

SEQ ID NO: 139164 - DNA, 20 bp, Artificial
  CRISPR gRNA sequence
aaatgataaagtcaaaagga

SEQ ID NO: 139165 - DNA, 20 bp, Artificial
  CRISPR gRNA sequence
aatgataaagtcaaaaggat

SEQ ID NO: 139166 - DNA, 20 bp, Artificial
  CRISPR gRNA sequence
atgataaagtcaaaaggatg

SEQ ID NO: 139167 - DNA, 20 bp, Artificial
  CRISPR gRNA sequence
ggggtgttttgttcatattt

SEQ ID NO: 139168 - DNA, 20 bp, Artificial
  CRISPR gRNA sequence
gggtgttttgttcatatttt

SEQ ID NO: 139169 - DNA, 20 bp, Artificial
  CRISPR gRNA sequence
ggtgttttgttcatatttta

SEQ ID NO: 139170 - DNA, 20 bp, Artificial
  CRISPR gRNA sequence
gtgttttgttcatattttag

SEQ ID NO: 139171 - DNA, 20 bp, Artificial
  CRISPR gRNA sequence
tgttttgttcatattttagg

SEQ ID NO: 139172 - DNA, 20 bp, Artificial
  CRISPR gRNA sequence
agggggttaatctcatgatt

SEQ ID NO: 139173 - DNA, 20 bp, Artificial
  CRISPR gRNA sequence
aatctcatgattaagcttat

SEQ ID NO: 139174 - DNA, 20 bp, Artificial
  CRISPR gRNA sequence
tgattaagcttatcagcttt

SEQ ID NO: 139175 - DNA, 20 bp, Artificial
  CRISPR gRNA sequence
agcttatcagcttttggtgc

SEQ ID NO: 139176 - DNA, 20 bp, Artificial
  CRISPR gRNA sequence
gcttatcagcttttggtgct

SEQ ID NO: 139177 - DNA, 20 bp, Artificial
  CRISPR gRNA sequence
cttatcagcttttggtgctg

SEQ ID NO: 139178 - DNA, 20 bp, Artificial
  CRISPR gRNA sequence
tcagcttttggtgctggggt

SEQ ID NO: 139179 - DNA, 20 bp, Artificial
  CRISPR gRNA sequence
ttttggtgctggggtcagct

SEQ ID NO: 139180 - DNA, 20 bp, Artificial
  CRISPR gRNA sequence
gtgtaaaatgaatgctgtcc

SEQ ID NO: 139181 - DNA, 20 bp, Artificial
  CRISPR gRNA sequence
tgtaaaatgaatgctgtcct

SEQ ID NO: 139182 - DNA, 20 bp, Artificial
  CRISPR gRNA sequence
gtaaaatgaatgctgtcctg

SEQ ID NO: 139183 - DNA, 20 bp, Artificial
  CRISPR gRNA sequence
atgaatgctgtcctggggtg

SEQ ID NO: 139184 - DNA, 20 bp, Artificial
  CRISPR gRNA sequence
aatgctgtcctggggtgtgg

SEQ ID NO: 139185 - DNA, 20 bp, Artificial
  CRISPR gRNA sequence
atgctgtcctggggtgtggt

SEQ ID NO: 139186 - DNA, 20 bp, Artificial
  CRISPR gRNA sequence
gtcctggggtgtggtgggac

SEQ ID NO: 139187 - DNA, 20 bp, Artificial
  CRISPR gRNA sequence
tcctggggtgtggtgggact

SEQ ID NO: 139188 - DNA, 20 bp, Artificial
  CRISPR gRNA sequence
gtggtgggactaggccaatc

SEQ ID NO: 139189 - DNA, 20 bp, Artificial
  CRISPR gRNA sequence
tgggactaggccaatcgagc

SEQ ID NO: 139190 - DNA, 20 bp, Artificial
  CRISPR gRNA sequence
aatcgagcaagtctgtgccg

SEQ ID NO: 139191 - DNA, 20 bp, Artificial
  CRISPR gRNA sequence
gcaagtctgtgccgcagctt

SEQ ID NO: 139192 - DNA, 20 bp, Artificial
  CRISPR gRNA sequence
tctgtgccgcagcttgagcc

SEQ ID NO: 139193 - DNA, 20 bp, Artificial
  CRISPR gRNA sequence
tgtgccgcagcttgagccga

SEQ ID NO: 139194 - DNA, 20 bp, Artificial
  CRISPR gRNA sequence
gtgccgcagcttgagccgag

SEQ ID NO: 139195 - DNA, 20 bp, Artificial
  CRISPR gRNA sequence
tgagccgagaggcataaatc

SEQ ID NO: 139196 - DNA, 20 bp, Artificial
  CRISPR gRNA sequence
gagccgagaggcataaatcc

SEQ ID NO: 139197 - DNA, 20 bp, Artificial
  CRISPR gRNA sequence
gagaggcataaatccaggat

SEQ ID NO: 139198 - DNA, 20 bp, Artificial
  CRISPR gRNA sequence
agaggcataaatccaggatc

SEQ ID NO: 139199 - DNA, 20 bp, Artificial
  CRISPR gRNA sequence
gcataaatccaggatcaggc

SEQ ID NO: 139200 - DNA, 20 bp, Artificial
  CRISPR gRNA sequence
taaatccaggatcaggcaag

SEQ ID NO: 139201 - DNA, 20 bp, Artificial
  CRISPR gRNA sequence
tccaggatcaggcaagtggc

SEQ ID NO: 139202 - DNA, 20 bp, Artificial
  CRISPR gRNA sequence
gcaagtggccagataaactc

SEQ ID NO: 139203 - DNA, 20 bp, Artificial
  CRISPR gRNA sequence
aagtggccagataaactctg

SEQ ID NO: 139204 - DNA, 20 bp, Artificial
  CRISPR gRNA sequence
agtggccagataaactctgg

SEQ ID NO: 139205 - DNA, 20 bp, Artificial
  CRISPR gRNA sequence
cagataaactctggaggttt

SEQ ID NO: 139206 - DNA, 20 bp, Artificial
  CRISPR gRNA sequence
aaactctggaggtttaagct

SEQ ID NO: 139207 - DNA, 20 bp, Artificial
  CRISPR gRNA sequence
acttaacttttctgttttgt

SEQ ID NO: 139208 - DNA, 20 bp, Artificial
  CRISPR gRNA sequence
ctttgatttttttttttttt

SEQ ID NO: 139209 - DNA, 20 bp, Artificial
  CRISPR gRNA sequence
tttttttttttttttagttg

SEQ ID NO: 139210 - DNA, 20 bp, Artificial
  CRISPR gRNA sequence
cttatccatttttaaatgta

SEQ ID NO: 139211 - DNA, 20 bp, Artificial
  CRISPR gRNA sequence
ccatttttaaatgtacagtt

SEQ ID NO: 139212 - DNA, 20 bp, Artificial
  CRISPR gRNA sequence
tttttaaatgtacagttcag

SEQ ID NO: 139213 - DNA, 20 bp, Artificial
  CRISPR gRNA sequence
atgtacagttcagaagtgtt

SEQ ID NO: 139214 - DNA, 20 bp, Artificial
  CRISPR gRNA sequence
taagtataatcacattgtta

SEQ ID NO: 139215 - DNA, 20 bp, Artificial
  CRISPR gRNA sequence
attgttatggaacttacctt

SEQ ID NO: 139216 - DNA, 20 bp, Artificial
  CRISPR gRNA sequence
ttgagaattttttcatattg

SEQ ID NO: 139217 - DNA, 20 bp, Artificial
  CRISPR gRNA sequence
gaaactgtgcactcaataaa

SEQ ID NO: 139218 - DNA, 20 bp, Artificial
  CRISPR gRNA sequence
tgactatttttgatacctca

SEQ ID NO: 139219 - DNA, 20 bp, Artificial
  CRISPR gRNA sequence
ctatttttgatacctcatag

SEQ ID NO: 139220 - DNA, 20 bp, Artificial
  CRISPR gRNA sequence
tttttgatacctcatagaag

SEQ ID NO: 139221 - DNA, 20 bp, Artificial
  CRISPR gRNA sequence
ttttgatacctcatagaagt

SEQ ID NO: 139222 - DNA, 20 bp, Artificial
  CRISPR gRNA sequence
agaagtgggatcatatcgta

SEQ ID NO: 139223 - DNA, 20 bp, Artificial
  CRISPR gRNA sequence
aatgttttttttccacttta

SEQ ID NO: 139224 - DNA, 20 bp, Artificial
  CRISPR gRNA sequence
gttttttttccactttacag

SEQ ID NO: 139225 - DNA, 20 bp, Artificial
  CRISPR gRNA sequence
tttttccactttacagtggt

SEQ ID NO: 139226 - DNA, 20 bp, Artificial
  CRISPR gRNA sequence
gttagaaaacgatgtgcatt

SEQ ID NO: 139227 - DNA, 20 bp, Artificial
  CRISPR gRNA sequence
agaaaacgatgtgcattcag

SEQ ID NO: 139228 - DNA, 20 bp, Artificial
  CRISPR gRNA sequence
aaacgatgtgcattcagtag

SEQ ID NO: 139229 - DNA, 20 bp, Artificial
  CRISPR gRNA sequence
ttcagtagcagttgtacttt

SEQ ID NO: 139230 - DNA, 20 bp, Artificial
  CRISPR gRNA sequence
tctgtttttcgctttcaatc

SEQ ID NO: 139231 - DNA, 20 bp, Artificial
  CRISPR gRNA sequence
tctagtattcaataaattat

SEQ ID NO: 139232 - DNA, 20 bp, Artificial
  CRISPR gRNA sequence
ctcaacactttactataaaa

SEQ ID NO: 139233 - DNA, 20 bp, Artificial
  CRISPR gRNA sequence
tcaacactttactataaaat

SEQ ID NO: 139234 - DNA, 20 bp, Artificial
  CRISPR gRNA sequence
caacactttactataaaata

SEQ ID NO: 139235 - DNA, 20 bp, Artificial
  CRISPR gRNA sequence
tatattattttgcccaactt

SEQ ID NO: 139236 - DNA, 20 bp, Artificial
  CRISPR gRNA sequence
atattattttgcccaacttt

SEQ ID NO: 139237 - DNA, 20 bp, Artificial
  CRISPR gRNA sequence
gcccaactttaggctaatgt

SEQ ID NO: 139238 - DNA, 20 bp, Artificial
  CRISPR gRNA sequence
taggctaatgtaagtgttct

SEQ ID NO: 139239 - DNA, 20 bp, Artificial
  CRISPR gRNA sequence
taagtgttctgagcacattt

SEQ ID NO: 139240 - DNA, 20 bp, Artificial
  CRISPR gRNA sequence
aagtgttctgagcacattta

SEQ ID NO: 139241 - DNA, 20 bp, Artificial
  CRISPR gRNA sequence
tgttctgagcacatttaagg

SEQ ID NO: 139242 - DNA, 20 bp, Artificial
  CRISPR gRNA sequence
gttctgagcacatttaaggt

SEQ ID NO: 139243 - DNA, 20 bp, Artificial
  CRISPR gRNA sequence
tgagcacatttaaggtgggc

SEQ ID NO: 139244 - DNA, 20 bp, Artificial
  CRISPR gRNA sequence
gagcacatttaaggtgggcg

SEQ ID NO: 139245 - DNA, 20 bp, Artificial
  CRISPR gRNA sequence
ggcttaactatgatgtttga

SEQ ID NO: 139246 - DNA, 20 bp, Artificial
  CRISPR gRNA sequence
gcttaactatgatgtttgat

SEQ ID NO: 139247 - DNA, 20 bp, Artificial
  CRISPR gRNA sequence
aactatgatgtttgataggc

SEQ ID NO: 139248 - DNA, 20 bp, Artificial
  CRISPR gRNA sequence
actatgatgtttgataggct

SEQ ID NO: 139249 - DNA, 20 bp, Artificial
  CRISPR gRNA sequence
gatgtttgataggctaggtg

SEQ ID NO: 139250 - DNA, 20 bp, Artificial
  CRISPR gRNA sequence
tagtaaatgcattttcaact

SEQ ID NO: 139251 - DNA, 20 bp, Artificial
  CRISPR gRNA sequence
agtaaatgcattttcaactt

SEQ ID NO: 139252 - DNA, 20 bp, Artificial
  CRISPR gRNA sequence
ggatcttttcaacttaacaa

SEQ ID NO: 139253 - DNA, 20 bp, Artificial
  CRISPR gRNA sequence
caacttaacaatagctttat

SEQ ID NO: 139254 - DNA, 20 bp, Artificial
  CRISPR gRNA sequence
aacttaacaatagctttatc

SEQ ID NO: 139255 - DNA, 20 bp, Artificial
  CRISPR gRNA sequence
tcaggatgtaaccccattgt

SEQ ID NO: 139256 - DNA, 20 bp, Artificial
  CRISPR gRNA sequence
ggatgtaaccccattgtaag

SEQ ID NO: 139257 - DNA, 20 bp, Artificial
  CRISPR gRNA sequence
ttgtcttatcttatttcact

SEQ ID NO: 139258 - DNA, 20 bp, Artificial
  CRISPR gRNA sequence
ttcacttagcatgtctgttg

SEQ ID NO: 139259 - DNA, 20 bp, Artificial
  CRISPR gRNA sequence
atgtctgttgaagcatgtga

SEQ ID NO: 139260 - DNA, 20 bp, Artificial
  CRISPR gRNA sequence
tgtctgttgaagcatgtgac

SEQ ID NO: 139261 - DNA, 20 bp, Artificial
  CRISPR gRNA sequence
tcttttttttttttcctttt

SEQ ID NO: 139262 - DNA, 20 bp, Artificial
  CRISPR gRNA sequence
ttttttttttttcctttttg

SEQ ID NO: 139263 - DNA, 20 bp, Artificial
  CRISPR gRNA sequence
ttttttttcctttttggaga

SEQ ID NO: 139264 - DNA, 20 bp, Artificial
  CRISPR gRNA sequence
tttttttcctttttggagac

SEQ ID NO: 139265 - DNA, 20 bp, Artificial
  CRISPR gRNA sequence
ttttttcctttttggagaca

SEQ ID NO: 139266 - DNA, 20 bp, Artificial
  CRISPR gRNA sequence
cagggtctcactctgtcatc

SEQ ID NO: 139267 - DNA, 20 bp, Artificial
  CRISPR gRNA sequence
agggtctcactctgtcatcc

SEQ ID NO: 139268 - DNA, 20 bp, Artificial
  CRISPR gRNA sequence
tctcactctgtcatccaggc

SEQ ID NO: 139269 - DNA, 20 bp, Artificial
  CRISPR gRNA sequence
tcactctgtcatccaggctg

SEQ ID NO: 139270 - DNA, 20 bp, Artificial
  CRISPR gRNA sequence
ctgtcatccaggctggagtg

SEQ ID NO: 139271 - DNA, 20 bp, Artificial
  CRISPR gRNA sequence
tcatccaggctggagtgtag

SEQ ID NO: 139272 - DNA, 20 bp, Artificial
  CRISPR gRNA sequence
ggagtgtagtggtacaatta

SEQ ID NO: 139273 - DNA, 20 bp, Artificial
  CRISPR gRNA sequence
ggtacaattatggctcactg

SEQ ID NO: 139274 - DNA, 20 bp, Artificial
  CRISPR gRNA sequence
tcactgcagcctcgacctct

SEQ ID NO: 139275 - DNA, 20 bp, Artificial
  CRISPR gRNA sequence
cactgcagcctcgacctctc

SEQ ID NO: 139276 - DNA, 20 bp, Artificial
  CRISPR gRNA sequence
agcctcgacctctcaggctc

SEQ ID NO: 139277 - DNA, 20 bp, Artificial
  CRISPR gRNA sequence
ctcaagcgatcctcccgcct

SEQ ID NO: 139278 - DNA, 20 bp, Artificial
  CRISPR gRNA sequence
tcctcccgcctcagcctcct

SEQ ID NO: 139279 - DNA, 20 bp, Artificial
  CRISPR gRNA sequence
tcccgcctcagcctcctgag

SEQ ID NO: 139280 - DNA, 20 bp, Artificial
  CRISPR gRNA sequence
cctcagcctcctgagtagct

SEQ ID NO: 139281 - DNA, 20 bp, Artificial
  CRISPR gRNA sequence
ctcctgagtagctgagacta

SEQ ID NO: 139282 - DNA, 20 bp, Artificial
  CRISPR gRNA sequence
tcctgagtagctgagactac

SEQ ID NO: 139283 - DNA, 20 bp, Artificial
  CRISPR gRNA sequence
caggtgcacgccaccacacc

SEQ ID NO: 139284 - DNA, 20 bp, Artificial
  CRISPR gRNA sequence
ctaatttttgtatttttctg

SEQ ID NO: 139285 - DNA, 20 bp, Artificial
  CRISPR gRNA sequence
aatttttgtatttttctgta

SEQ ID NO: 139286 - DNA, 20 bp, Artificial
  CRISPR gRNA sequence
atttttgtatttttctgtag

SEQ ID NO: 139287 - DNA, 20 bp, Artificial
  CRISPR gRNA sequence
tttgtatttttctgtagagg

SEQ ID NO: 139288 - DNA, 20 bp, Artificial
  CRISPR gRNA sequence
ttgtatttttctgtagaggc

SEQ ID NO: 139289 - DNA, 20 bp, Artificial
  CRISPR gRNA sequence
tgtatttttctgtagaggca

SEQ ID NO: 139290 - DNA, 20 bp, Artificial
  CRISPR gRNA sequence
agggtcccaccatgttaccc

SEQ ID NO: 139291 - DNA, 20 bp, Artificial
  CRISPR gRNA sequence
tcccaccatgttaccctggc

SEQ ID NO: 139292 - DNA, 20 bp, Artificial
  CRISPR gRNA sequence
cctggctggtctcaaacttc

SEQ ID NO: 139293 - DNA, 20 bp, Artificial
  CRISPR gRNA sequence
ctggctggtctcaaacttct

SEQ ID NO: 139294 - DNA, 20 bp, Artificial
  CRISPR gRNA sequence
ggtctcaaacttctgggctc

SEQ ID NO: 139295 - DNA, 20 bp, Artificial
  CRISPR gRNA sequence
cctcccacatctgcctccca

SEQ ID NO: 139296 - DNA, 20 bp, Artificial
  CRISPR gRNA sequence
acatctgcctcccaaagtgc

SEQ ID NO: 139297 - DNA, 20 bp, Artificial
  CRISPR gRNA sequence
catctgcctcccaaagtgct

SEQ ID NO: 139298 - DNA, 20 bp, Artificial
  CRISPR gRNA sequence
ctcccaaagtgctgggatta

SEQ ID NO: 139299 - DNA, 20 bp, Artificial
  CRISPR gRNA sequence
tcccaaagtgctgggattat

SEQ ID NO: 139300 - DNA, 20 bp, Artificial
  CRISPR gRNA sequence
agtgctgggattataggtgt

SEQ ID NO: 139301 - DNA, 20 bp, Artificial
  CRISPR gRNA sequence
taggtgtgagccaccatgcg

SEQ ID NO: 139302 - DNA, 20 bp, Artificial
  CRISPR gRNA sequence
cctttgttttttctttttta

SEQ ID NO: 139303 - DNA, 20 bp, Artificial
  CRISPR gRNA sequence
tttgttttttcttttttaaa

SEQ ID NO: 139304 - DNA, 20 bp, Artificial
  CRISPR gRNA sequence
ttttttcttttttaaagaga

SEQ ID NO: 139305 - DNA, 20 bp, Artificial
  CRISPR gRNA sequence
tttttcttttttaaagagac

SEQ ID NO: 139306 - DNA, 20 bp, Artificial
  CRISPR gRNA sequence
ttttcttttttaaagagaca

SEQ ID NO: 139307 - DNA, 20 bp, Artificial
  CRISPR gRNA sequence
ggtctcactctgttcattgc

SEQ ID NO: 139308 - DNA, 20 bp, Artificial
  CRISPR gRNA sequence
tctcactctgttcattgctg

SEQ ID NO: 139309 - DNA, 20 bp, Artificial
  CRISPR gRNA sequence
ctctgttcattgctggagtg

SEQ ID NO: 139310 - DNA, 20 bp, Artificial
  CRISPR gRNA sequence
tgttcattgctggagtgcag

SEQ ID NO: 139311 - DNA, 20 bp, Artificial
  CRISPR gRNA sequence
tcattgctggagtgcagtgg

SEQ ID NO: 139312 - DNA, 20 bp, Artificial
  CRISPR gRNA sequence
cattgctggagtgcagtggc

SEQ ID NO: 139313 - DNA, 20 bp, Artificial
  CRISPR gRNA sequence
ggagtgcagtggcaggatta

SEQ ID NO: 139314 - DNA, 20 bp, Artificial
  CRISPR gRNA sequence
ggcaggattatagctcactg

SEQ ID NO: 139315 - DNA, 20 bp, Artificial
  CRISPR gRNA sequence
tcactgtagccttgaactct

SEQ ID NO: 139316 - DNA, 20 bp, Artificial
  CRISPR gRNA sequence
cactgtagccttgaactctt

SEQ ID NO: 139317 - DNA, 20 bp, Artificial
  CRISPR gRNA sequence
agccttgaactcttgggctc

SEQ ID NO: 139318 - DNA, 20 bp, Artificial
  CRISPR gRNA sequence
gccttgaactcttgggctca

SEQ ID NO: 139319 - DNA, 20 bp, Artificial
  CRISPR gRNA sequence
ccttgaactcttgggctcaa

SEQ ID NO: 139320 - DNA, 20 bp, Artificial
  CRISPR gRNA sequence
ctcaagggacccttcctact

SEQ ID NO: 139321 - DNA, 20 bp, Artificial
  CRISPR gRNA sequence
cccttcctactcagtccccc

SEQ ID NO: 139322 - DNA, 20 bp, Artificial
  CRISPR gRNA sequence
ttcctactcagtcccccaag

SEQ ID NO: 139323 - DNA, 20 bp, Artificial
  CRISPR gRNA sequence
tactcagtcccccaagtagc

SEQ ID NO: 139324 - DNA, 20 bp, Artificial
  CRISPR gRNA sequence
actcagtcccccaagtagct

SEQ ID NO: 139325 - DNA, 20 bp, Artificial
  CRISPR gRNA sequence
cccccaagtagctaggactc

SEQ ID NO: 139326 - DNA, 20 bp, Artificial
  CRISPR gRNA sequence
tagttgtgcaccaccacacc

SEQ ID NO: 139327 - DNA, 20 bp, Artificial
  CRISPR gRNA sequence
taaaaaaaaaaaatcttatg

SEQ ID NO: 139328 - DNA, 20 bp, Artificial
  CRISPR gRNA sequence
aaaaaaaaaaatcttatgta

SEQ ID NO: 139329 - DNA, 20 bp, Artificial
  CRISPR gRNA sequence
aaaaaaatcttatgtagaga

SEQ ID NO: 139330 - DNA, 20 bp, Artificial
  CRISPR gRNA sequence
aaaaatcttatgtagagatg

SEQ ID NO: 139331 - DNA, 20 bp, Artificial
  CRISPR gRNA sequence
aaaatcttatgtagagatgg

SEQ ID NO: 139332 - DNA, 20 bp, Artificial
  CRISPR gRNA sequence
ggaggtctcactatgttgcc

SEQ ID NO: 139333 - DNA, 20 bp, Artificial
  CRISPR gRNA sequence
gaggtctcactatgttgcct

SEQ ID NO: 139334 - DNA, 20 bp, Artificial
  CRISPR gRNA sequence
tctcactatgttgcctaggc

SEQ ID NO: 139335 - DNA, 20 bp, Artificial
  CRISPR gRNA sequence
ctaggctggtctcaaattcc

SEQ ID NO: 139336 - DNA, 20 bp, Artificial
  CRISPR gRNA sequence
ggtctcaaattcctggcctc

SEQ ID NO: 139337 - DNA, 20 bp, Artificial
  CRISPR gRNA sequence
ctcaagcaatcctcttgcct

SEQ ID NO: 139338 - DNA, 20 bp, Artificial
  CRISPR gRNA sequence
cctcttgccttggccctcca

SEQ ID NO: 139339 - DNA, 20 bp, Artificial
  CRISPR gRNA sequence
gccttggccctccaaagcac

SEQ ID NO: 139340 - DNA, 20 bp, Artificial
  CRISPR gRNA sequence
ccttggccctccaaagcact

SEQ ID NO: 139341 - DNA, 20 bp, Artificial
  CRISPR gRNA sequence
cctccaaagcactgggatta

SEQ ID NO: 139342 - DNA, 20 bp, Artificial
  CRISPR gRNA sequence
agcactgggattacagacat

SEQ ID NO: 139343 - DNA, 20 bp, Artificial
  CRISPR gRNA sequence
cagacatgagccatcatgtc

SEQ ID NO: 139344 - DNA, 20 bp, Artificial
  CRISPR gRNA sequence
cctatccttttttttttttt

SEQ ID NO: 139345 - DNA, 20 bp, Artificial
  CRISPR gRNA sequence
ctatccttttttttttttta

SEQ ID NO: 139346 - DNA, 20 bp, Artificial
  CRISPR gRNA sequence
tcctttttttttttttaagg

SEQ ID NO: 139347 - DNA, 20 bp, Artificial
  CRISPR gRNA sequence
tttatccgttcatctgttaa

SEQ ID NO: 139348 - DNA, 20 bp, Artificial
  CRISPR gRNA sequence
ttcatctgttaatggacatt

SEQ ID NO: 139349 - DNA, 20 bp, Artificial
  CRISPR gRNA sequence
tcatctgttaatggacattt

SEQ ID NO: 139350 - DNA, 20 bp, Artificial
  CRISPR gRNA sequence
ctgttaatggacatttgggt

SEQ ID NO: 139351 - DNA, 20 bp, Artificial
  CRISPR gRNA sequence
tttgggttggtttcacctct

SEQ ID NO: 139352 - DNA, 20 bp, Artificial
  CRISPR gRNA sequence
cacctcttggctattgtgaa

SEQ ID NO: 139353 - DNA, 20 bp, Artificial
  CRISPR gRNA sequence
atagtgctgctgtgttacat

SEQ ID NO: 139354 - DNA, 20 bp, Artificial
  CRISPR gRNA sequence
gagtgtgcaaatacctcttc

SEQ ID NO: 139355 - DNA, 20 bp, Artificial
  CRISPR gRNA sequence
caaatacctcttcaagaccc

SEQ ID NO: 139356 - DNA, 20 bp, Artificial
  CRISPR gRNA sequence
aaatacctcttcaagaccct

SEQ ID NO: 139357 - DNA, 20 bp, Artificial
  CRISPR gRNA sequence
gctttgatttgtaacctact

SEQ ID NO: 139358 - DNA, 20 bp, Artificial
  CRISPR gRNA sequence
ttgtaacctacttggtttac

SEQ ID NO: 139359 - DNA, 20 bp, Artificial
  CRISPR gRNA sequence
tacaagtttgattgccaaca

SEQ ID NO: 139360 - DNA, 20 bp, Artificial
  CRISPR gRNA sequence
tcatgatgttgaccaaattt

SEQ ID NO: 139361 - DNA, 20 bp, Artificial
  CRISPR gRNA sequence
gttgaccaaattttagtacc

SEQ ID NO: 139362 - DNA, 20 bp, Artificial
  CRISPR gRNA sequence
caaattttagtacctagact

SEQ ID NO: 139363 - DNA, 20 bp, Artificial
  CRISPR gRNA sequence
agtacctagacttagtctat

SEQ ID NO: 139364 - DNA, 20 bp, Artificial
  CRISPR gRNA sequence
acctagacttagtctatcag

SEQ ID NO: 139365 - DNA, 20 bp, Artificial
  CRISPR gRNA sequence
cttagtctatcagaagttaa

SEQ ID NO: 139366 - DNA, 20 bp, Artificial
  CRISPR gRNA sequence
tagtctatcagaagttaaaa

SEQ ID NO: 139367 - DNA, 20 bp, Artificial
  CRISPR gRNA sequence
agttaaaagagaattacttt

SEQ ID NO: 139368 - DNA, 20 bp, Artificial
  CRISPR gRNA sequence
gttaaaagagaattactttg

SEQ ID NO: 139369 - DNA, 20 bp, Artificial
  CRISPR gRNA sequence
ttaaaagagaattactttga

SEQ ID NO: 139370 - DNA, 20 bp, Artificial
  CRISPR gRNA sequence
gagaattactttgagggatt

SEQ ID NO: 139371 - DNA, 20 bp, Artificial
  CRISPR gRNA sequence
tactttgagggattcagttt

SEQ ID NO: 139372 - DNA, 20 bp, Artificial
  CRISPR gRNA sequence
gagggattcagttttggttc

SEQ ID NO: 139373 - DNA, 20 bp, Artificial
  CRISPR gRNA sequence
cagttttggttcaagttttg

SEQ ID NO: 139374 - DNA, 20 bp, Artificial
  CRISPR gRNA sequence
agttttggttcaagttttgt

SEQ ID NO: 139375 - DNA, 20 bp, Artificial
  CRISPR gRNA sequence
tggttcaagttttgtgggtg

SEQ ID NO: 139376 - DNA, 20 bp, Artificial
  CRISPR gRNA sequence
gttcaagttttgtgggtgaa

SEQ ID NO: 139377 - DNA, 20 bp, Artificial
  CRISPR gRNA sequence
aagttttgtgggtgaagaga

SEQ ID NO: 139378 - DNA, 20 bp, Artificial
  CRISPR gRNA sequence
ttgtgggtgaagagaaagaa

SEQ ID NO: 139379 - DNA, 20 bp, Artificial
  CRISPR gRNA sequence
ggtgaagagaaagaaaagta

SEQ ID NO: 139380 - DNA, 20 bp, Artificial
  CRISPR gRNA sequence
tgaagagaaagaaaagtaaa

SEQ ID NO: 139381 - DNA, 20 bp, Artificial
  CRISPR gRNA sequence
gaagagaaagaaaagtaaag

SEQ ID NO: 139382 - DNA, 20 bp, Artificial
  CRISPR gRNA sequence
gagaaagaaaagtaaagagg

SEQ ID NO: 139383 - DNA, 20 bp, Artificial
  CRISPR gRNA sequence
gtctttaatccttcttgtat

SEQ ID NO: 139384 - DNA, 20 bp, Artificial
  CRISPR gRNA sequence
ctcctcctatgtacttttga

SEQ ID NO: 139385 - DNA, 20 bp, Artificial
  CRISPR gRNA sequence
tcctcctatgtacttttgaa

SEQ ID NO: 139386 - DNA, 20 bp, Artificial
  CRISPR gRNA sequence
cctcctatgtacttttgaaa

SEQ ID NO: 139387 - DNA, 20 bp, Artificial
  CRISPR gRNA sequence
gtacttttgaaagggactcc

SEQ ID NO: 139388 - DNA, 20 bp, Artificial
  CRISPR gRNA sequence
ccatgctatgtcttttatat

SEQ ID NO: 139389 - DNA, 20 bp, Artificial
  CRISPR gRNA sequence
catgctatgtcttttatatc

SEQ ID NO: 139390 - DNA, 20 bp, Artificial
  CRISPR gRNA sequence
tgtcttttatatcaggtgct

SEQ ID NO: 139391 - DNA, 20 bp, Artificial
  CRISPR gRNA sequence
caggtgcttagaacaatgtc

SEQ ID NO: 139392 - DNA, 20 bp, Artificial
  CRISPR gRNA sequence
ttagaacaatgtctggcatg

SEQ ID NO: 139393 - DNA, 20 bp, Artificial
  CRISPR gRNA sequence
gaacaatgtctggcatgtag

SEQ ID NO: 139394 - DNA, 20 bp, Artificial
  CRISPR gRNA sequence
aacaatgtctggcatgtagt

SEQ ID NO: 139395 - DNA, 20 bp, Artificial
  CRISPR gRNA sequence
caataaatatttgaacaaat

SEQ ID NO: 139396 - DNA, 20 bp, Artificial
  CRISPR gRNA sequence
gaacaaattagactccactt

SEQ ID NO: 139397 - DNA, 20 bp, Artificial
  CRISPR gRNA sequence
aacaaattagactccacttc

SEQ ID NO: 139398 - DNA, 20 bp, Artificial
  CRISPR gRNA sequence
attagactccacttcaggtt

SEQ ID NO: 139399 - DNA, 20 bp, Artificial
  CRISPR gRNA sequence
tccacttcaggtttagtgca

SEQ ID NO: 139400 - DNA, 20 bp, Artificial
  CRISPR gRNA sequence
gcaacatcaattccatattt

SEQ ID NO: 139401 - DNA, 20 bp, Artificial
  CRISPR gRNA sequence
catcaattccatatttgagt

SEQ ID NO: 139402 - DNA, 20 bp, Artificial
  CRISPR gRNA sequence
atttgagtaagaatgcaatc

SEQ ID NO: 139403 - DNA, 20 bp, Artificial
  CRISPR gRNA sequence
agtaagaatgcaatccagta

SEQ ID NO: 139404 - DNA, 20 bp, Artificial
  CRISPR gRNA sequence
agaatgcaatccagtaaagt

SEQ ID NO: 139405 - DNA, 20 bp, Artificial
  CRISPR gRNA sequence
gaatgcaatccagtaaagtc

SEQ ID NO: 139406 - DNA, 20 bp, Artificial
  CRISPR gRNA sequence
aatgcaatccagtaaagtca

SEQ ID NO: 139407 - DNA, 20 bp, Artificial
  CRISPR gRNA sequence
ctcttattttcccctcttct

SEQ ID NO: 139408 - DNA, 20 bp, Artificial
  CRISPR gRNA sequence
tcttattttcccctcttctc

SEQ ID NO: 139409 - DNA, 20 bp, Artificial
  CRISPR gRNA sequence
ttattttcccctcttctcag

SEQ ID NO: 139410 - DNA, 20 bp, Artificial
  CRISPR gRNA sequence
ctcaggagtgcaacacgtga

SEQ ID NO: 139411 - DNA, 20 bp, Artificial
  CRISPR gRNA sequence
tgtaacatgaccaaacattt

SEQ ID NO: 139412 - DNA, 20 bp, Artificial
  CRISPR gRNA sequence
gcatttaatctgtccctttc

SEQ ID NO: 139413 - DNA, 20 bp, Artificial
  CRISPR gRNA sequence
tgtccctttccagaactcaa

SEQ ID NO: 139414 - DNA, 20 bp, Artificial
  CRISPR gRNA sequence
aactcaacagtacttaaaac

SEQ ID NO: 139415 - DNA, 20 bp, Artificial
  CRISPR gRNA sequence
tacttaaaaccagacttcct

SEQ ID NO: 139416 - DNA, 20 bp, Artificial
  CRISPR gRNA sequence
ccagacttcctcagatgtgt

SEQ ID NO: 139417 - DNA, 20 bp, Artificial
  CRISPR gRNA sequence
agacttcctcagatgtgtca

SEQ ID NO: 139418 - DNA, 20 bp, Artificial
  CRISPR gRNA sequence
tcagatgtgtcagagcctct

SEQ ID NO: 139419 - DNA, 20 bp, Artificial
  CRISPR gRNA sequence
cagatgtgtcagagcctctt

SEQ ID NO: 139420 - DNA, 20 bp, Artificial
  CRISPR gRNA sequence
tgacacctcacaatatctaa

SEQ ID NO: 139421 - DNA, 20 bp, Artificial
  CRISPR gRNA sequence
acaatatctaacagattaaa

SEQ ID NO: 139422 - DNA, 20 bp, Artificial
  CRISPR gRNA sequence
aaaattccttatgtttaaac

SEQ ID NO: 139423 - DNA, 20 bp, Artificial
  CRISPR gRNA sequence
tgtttaaactagccaatcat

SEQ ID NO: 139424 - DNA, 20 bp, Artificial
  CRISPR gRNA sequence
caatcataagtaaaacttac

SEQ ID NO: 139425 - DNA, 20 bp, Artificial
  CRISPR gRNA sequence
atattcataaaatgtgatct

SEQ ID NO: 139426 - DNA, 20 bp, Artificial
  CRISPR gRNA sequence
cataaaatgtgatctcagac

SEQ ID NO: 139427 - DNA, 20 bp, Artificial
  CRISPR gRNA sequence
ataaaatgtgatctcagact

SEQ ID NO: 139428 - DNA, 20 bp, Artificial
  CRISPR gRNA sequence
gggacacaatttgtttcaaa

SEQ ID NO: 139429 - DNA, 20 bp, Artificial
  CRISPR gRNA sequence
acacaatttgtttcaaaaag

SEQ ID NO: 139430 - DNA, 20 bp, Artificial
  CRISPR gRNA sequence
gtttcaaaaagaagtaattg

SEQ ID NO: 139431 - DNA, 20 bp, Artificial
  CRISPR gRNA sequence
aagaagtaattgaagtttgc

SEQ ID NO: 139432 - DNA, 20 bp, Artificial
  CRISPR gRNA sequence
tgatatatttcatgatgtgt

SEQ ID NO: 139433 - DNA, 20 bp, Artificial
  CRISPR gRNA sequence
tcatgatgtgttggaaacac

SEQ ID NO: 139434 - DNA, 20 bp, Artificial
  CRISPR gRNA sequence
gtgttggaaacactggcctc

SEQ ID NO: 139435 - DNA, 20 bp, Artificial
  CRISPR gRNA sequence
acactggcctcaagtccttt

SEQ ID NO: 139436 - DNA, 20 bp, Artificial
  CRISPR gRNA sequence
ttttggtctgcgtcctgtaa

SEQ ID NO: 139437 - DNA, 20 bp, Artificial
  CRISPR gRNA sequence
aagcaatttatctttcattt

SEQ ID NO: 139438 - DNA, 20 bp, Artificial
  CRISPR gRNA sequence
cttgttctcatgattcttaa

SEQ ID NO: 139439 - DNA, 20 bp, Artificial
  CRISPR gRNA sequence
catgattcttaaaagctctg

SEQ ID NO: 139440 - DNA, 20 bp, Artificial
  CRISPR gRNA sequence
tctgtagttgtctataaatc

SEQ ID NO: 139441 - DNA, 20 bp, Artificial
  CRISPR gRNA sequence
ctgtagttgtctataaatcc

SEQ ID NO: 139442 - DNA, 20 bp, Artificial
  CRISPR gRNA sequence
tagttgtctataaatccagg

SEQ ID NO: 139443 - DNA, 20 bp, Artificial
  CRISPR gRNA sequence
ctataaatccaggtggtgtt

SEQ ID NO: 139444 - DNA, 20 bp, Artificial
  CRISPR gRNA sequence
aaatccaggtggtgttcagc

SEQ ID NO: 139445 - DNA, 20 bp, Artificial
  CRISPR gRNA sequence
aatccaggtggtgttcagct

SEQ ID NO: 139446 - DNA, 20 bp, Artificial
  CRISPR gRNA sequence
tgttcagctgggattgaaat

SEQ ID NO: 139447 - DNA, 20 bp, Artificial
  CRISPR gRNA sequence
aattagttaaaaaccatatc

SEQ ID NO: 139448 - DNA, 20 bp, Artificial
  CRISPR gRNA sequence
atatcaagatgattgtgcac

SEQ ID NO: 139449 - DNA, 20 bp, Artificial
  CRISPR gRNA sequence
atcaagatgattgtgcacca

SEQ ID NO: 139450 - DNA, 20 bp, Artificial
  CRISPR gRNA sequence
taaaaccctatattcccgca

SEQ ID NO: 139451 - DNA, 20 bp, Artificial
  CRISPR gRNA sequence
aaccctatattcccgcacag

SEQ ID NO: 139452 - DNA, 20 bp, Artificial
  CRISPR gRNA sequence
ccctatattcccgcacagca

SEQ ID NO: 139453 - DNA, 20 bp, Artificial
  CRISPR gRNA sequence
attcccgcacagcagagctc

SEQ ID NO: 139454 - DNA, 20 bp, Artificial
  CRISPR gRNA sequence
ttcccgcacagcagagctct

SEQ ID NO: 139455 - DNA, 20 bp, Artificial
  CRISPR gRNA sequence
gcacagcagagctctgggaa

SEQ ID NO: 139456 - DNA, 20 bp, Artificial
  CRISPR gRNA sequence
gctctgggaacagcaaataa

SEQ ID NO: 139457 - DNA, 20 bp, Artificial
  CRISPR gRNA sequence
ataacagacttcttcgtgtt

SEQ ID NO: 139458 - DNA, 20 bp, Artificial
  CRISPR gRNA sequence
cttcgtgttgagttttgccc

SEQ ID NO: 139459 - DNA, 20 bp, Artificial
  CRISPR gRNA sequence
cgtgttgagttttgccccag

SEQ ID NO: 139460 - DNA, 20 bp, Artificial
  CRISPR gRNA sequence
gtgttgagttttgccccagt

SEQ ID NO: 139461 - DNA, 20 bp, Artificial
  CRISPR gRNA sequence
ccagtgggcctctttgaaaa

SEQ ID NO: 139462 - DNA, 20 bp, Artificial
  CRISPR gRNA sequence
cagtgggcctctttgaaaat

SEQ ID NO: 139463 - DNA, 20 bp, Artificial
  CRISPR gRNA sequence
gggcctctttgaaaatagga

SEQ ID NO: 139464 - DNA, 20 bp, Artificial
  CRISPR gRNA sequence
gcctctttgaaaataggaaa

SEQ ID NO: 139465 - DNA, 20 bp, Artificial
  CRISPR gRNA sequence
ctttgaaaataggaaagaga

SEQ ID NO: 139466 - DNA, 20 bp, Artificial
  CRISPR gRNA sequence
gaaagctaactttgtcttta

SEQ ID NO: 139467 - DNA, 20 bp, Artificial
  CRISPR gRNA sequence
aagctaactttgtctttatg

SEQ ID NO: 139468 - DNA, 20 bp, Artificial
  CRISPR gRNA sequence
agctaactttgtctttatgg

SEQ ID NO: 139469 - DNA, 20 bp, Artificial
  CRISPR gRNA sequence
aactttgtctttatggaggt

SEQ ID NO: 139470 - DNA, 20 bp, Artificial
  CRISPR gRNA sequence
ttgtctttatggaggtgagt

SEQ ID NO: 139471 - DNA, 20 bp, Artificial
  CRISPR gRNA sequence
tgtctttatggaggtgagtt

SEQ ID NO: 139472 - DNA, 20 bp, Artificial
  CRISPR gRNA sequence
gtctttatggaggtgagttg

SEQ ID NO: 139473 - DNA, 20 bp, Artificial
  CRISPR gRNA sequence
tctttatggaggtgagttgg

SEQ ID NO: 139474 - DNA, 20 bp, Artificial
  CRISPR gRNA sequence
ttatggaggtgagttggggg

SEQ ID NO: 139475 - DNA, 20 bp, Artificial
  CRISPR gRNA sequence
tatggaggtgagttgggggc

SEQ ID NO: 139476 - DNA, 20 bp, Artificial
  CRISPR gRNA sequence
ggaggtgagttgggggcagg

SEQ ID NO: 139477 - DNA, 20 bp, Artificial
  CRISPR gRNA sequence
gaggtgagttgggggcaggt

SEQ ID NO: 139478 - DNA, 20 bp, Artificial
  CRISPR gRNA sequence
caacaatgctgaatttcgaa

SEQ ID NO: 139479 - DNA, 20 bp, Artificial
  CRISPR gRNA sequence
cttactctttacatcccatt

SEQ ID NO: 139480 - DNA, 20 bp, Artificial
  CRISPR gRNA sequence
gccttcacttaactgtaatt

SEQ ID NO: 139481 - DNA, 20 bp, Artificial
  CRISPR gRNA sequence
cttaactgtaattgagtgcc

SEQ ID NO: 139482 - DNA, 20 bp, Artificial
  CRISPR gRNA sequence
ttaactgtaattgagtgcct

SEQ ID NO: 139483 - DNA, 20 bp, Artificial
  CRISPR gRNA sequence
ctaggtcactttcttttaat

SEQ ID NO: 139484 - DNA, 20 bp, Artificial
  CRISPR gRNA sequence
ggtcactttcttttaattgg

SEQ ID NO: 139485 - DNA, 20 bp, Artificial
  CRISPR gRNA sequence
agtttcatcttttcattcct

SEQ ID NO: 139486 - DNA, 20 bp, Artificial
  CRISPR gRNA sequence
attcctcagtgcctcctgat

SEQ ID NO: 139487 - DNA, 20 bp, Artificial
  CRISPR gRNA sequence
ttcctcagtgcctcctgatt

SEQ ID NO: 139488 - DNA, 20 bp, Artificial
  CRISPR gRNA sequence
ttctaacattacaatcaaat

SEQ ID NO: 139489 - DNA, 20 bp, Artificial
  CRISPR gRNA sequence
aatcagataactgtttaaac

SEQ ID NO: 139490 - DNA, 20 bp, Artificial
  CRISPR gRNA sequence
taactgtttaaacaagaact

SEQ ID NO: 139491 - DNA, 20 bp, Artificial
  CRISPR gRNA sequence
taaacaagaacttggtgatg

SEQ ID NO: 139492 - DNA, 20 bp, Artificial
  CRISPR gRNA sequence
aaacaagaacttggtgatga

SEQ ID NO: 139493 - DNA, 20 bp, Artificial
  CRISPR gRNA sequence
aagaacttggtgatgaaggt

SEQ ID NO: 139494 - DNA, 20 bp, Artificial
  CRISPR gRNA sequence
aacttggtgatgaaggttgg

SEQ ID NO: 139495 - DNA, 20 bp, Artificial
  CRISPR gRNA sequence
gttggtggactgttacaaaa

SEQ ID NO: 139496 - DNA, 20 bp, Artificial
  CRISPR gRNA sequence
ttggtggactgttacaaaac

SEQ ID NO: 139497 - DNA, 20 bp, Artificial
  CRISPR gRNA sequence
aaacaggtcctgtgctgtgt

SEQ ID NO: 139498 - DNA, 20 bp, Artificial
  CRISPR gRNA sequence
tgctgtgtgagccctttctg

SEQ ID NO: 139499 - DNA, 20 bp, Artificial
  CRISPR gRNA sequence
ctgtgtgagccctttctgta

SEQ ID NO: 139500 - DNA, 20 bp, Artificial
  CRISPR gRNA sequence
tgtgagccctttctgtagag

SEQ ID NO: 139501 - DNA, 20 bp, Artificial
  CRISPR gRNA sequence
attgtctgtatgaaccacgt

SEQ ID NO: 139502 - DNA, 20 bp, Artificial
  CRISPR gRNA sequence
ttgtctgtatgaaccacgtg

SEQ ID NO: 139503 - DNA, 20 bp, Artificial
  CRISPR gRNA sequence
tgtctgtatgaaccacgtga

SEQ ID NO: 139504 - DNA, 20 bp, Artificial
  CRISPR gRNA sequence
tctgtatgaaccacgtgagg

SEQ ID NO: 139505 - DNA, 20 bp, Artificial
  CRISPR gRNA sequence
ctgtatgaaccacgtgaggg

SEQ ID NO: 139506 - DNA, 20 bp, Artificial
  CRISPR gRNA sequence
ttaaaatattgatgctgatt

SEQ ID NO: 139507 - DNA, 20 bp, Artificial
  CRISPR gRNA sequence
aaatattgatgctgatttag

SEQ ID NO: 139508 - DNA, 20 bp, Artificial
  CRISPR gRNA sequence
aatattgatgctgatttagt

SEQ ID NO: 139509 - DNA, 20 bp, Artificial
  CRISPR gRNA sequence
ttgatgctgatttagtaggt

SEQ ID NO: 139510 - DNA, 20 bp, Artificial
  CRISPR gRNA sequence
tgatgctgatttagtaggtt

SEQ ID NO: 139511 - DNA, 20 bp, Artificial
  CRISPR gRNA sequence
ctgatttagtaggttaggaa

SEQ ID NO: 139512 - DNA, 20 bp, Artificial
  CRISPR gRNA sequence
agtaggttaggaacggaacc

SEQ ID NO: 139513 - DNA, 20 bp, Artificial
  CRISPR gRNA sequence
gtaggttaggaacggaacct

SEQ ID NO: 139514 - DNA, 20 bp, Artificial
  CRISPR gRNA sequence
tgggattctgtgtttctttt

SEQ ID NO: 139515 - DNA, 20 bp, Artificial
  CRISPR gRNA sequence
ctgtgtttcttttgagttcc

SEQ ID NO: 139516 - DNA, 20 bp, Artificial
  CRISPR gRNA sequence
tgtgtttcttttgagttccc

SEQ ID NO: 139517 - DNA, 20 bp, Artificial
  CRISPR gRNA sequence
ttcccaggtgataccattgc

SEQ ID NO: 139518 - DNA, 20 bp, Artificial
  CRISPR gRNA sequence
ggtgataccattgctggtcc

SEQ ID NO: 139519 - DNA, 20 bp, Artificial
  CRISPR gRNA sequence
gtgataccattgctggtcca

SEQ ID NO: 139520 - DNA, 20 bp, Artificial
  CRISPR gRNA sequence
tggtccaaggaccttacttt

SEQ ID NO: 139521 - DNA, 20 bp, Artificial
  CRISPR gRNA sequence
tccaaggaccttactttgag

SEQ ID NO: 139522 - DNA, 20 bp, Artificial
  CRISPR gRNA sequence
aaggaccttactttgagtag

SEQ ID NO: 139523 - DNA, 20 bp, Artificial
  CRISPR gRNA sequence
aggaccttactttgagtagc

SEQ ID NO: 139524 - DNA, 20 bp, Artificial
  CRISPR gRNA sequence
ggaccttactttgagtagca

SEQ ID NO: 139525 - DNA, 20 bp, Artificial
  CRISPR gRNA sequence
tgagtagcagggccgtaaaa

SEQ ID NO: 139526 - DNA, 20 bp, Artificial
  CRISPR gRNA sequence
gtagcagggccgtaaaacag

SEQ ID NO: 139527 - DNA, 20 bp, Artificial
  CRISPR gRNA sequence
agtagtccttaactctcact

SEQ ID NO: 139528 - DNA, 20 bp, Artificial
  CRISPR gRNA sequence
cttaactctcacttggatca

SEQ ID NO: 139529 - DNA, 20 bp, Artificial
  CRISPR gRNA sequence
ctcacttggatcatagtcac

SEQ ID NO: 139530 - DNA, 20 bp, Artificial
  CRISPR gRNA sequence
tcacttggatcatagtcaca

SEQ ID NO: 139531 - DNA, 20 bp, Artificial
  CRISPR gRNA sequence
cacttggatcatagtcacaa

SEQ ID NO: 139532 - DNA, 20 bp, Artificial
  CRISPR gRNA sequence
acttggatcatagtcacaag

SEQ ID NO: 139533 - DNA, 20 bp, Artificial
  CRISPR gRNA sequence
ttggatcatagtcacaaggg

SEQ ID NO: 139534 - DNA, 20 bp, Artificial
  CRISPR gRNA sequence
gttttcaaaaaacatgatgc

SEQ ID NO: 139535 - DNA, 20 bp, Artificial
  CRISPR gRNA sequence
gatgccagtactctacccac

SEQ ID NO: 139536 - DNA, 20 bp, Artificial
  CRISPR gRNA sequence
tgccagtactctacccacta

SEQ ID NO: 139537 - DNA, 20 bp, Artificial
  CRISPR gRNA sequence
cagtactctacccactagag

SEQ ID NO: 139538 - DNA, 20 bp, Artificial
  CRISPR gRNA sequence
agtactctacccactagagc

SEQ ID NO: 139539 - DNA, 20 bp, Artificial
  CRISPR gRNA sequence
gtactctacccactagagca

SEQ ID NO: 139540 - DNA, 20 bp, Artificial
  CRISPR gRNA sequence
tactctacccactagagcag

SEQ ID NO: 139541 - DNA, 20 bp, Artificial
  CRISPR gRNA sequence
gagcaggggtccccaacccc

SEQ ID NO: 139542 - DNA, 20 bp, Artificial
  CRISPR gRNA sequence
agcaggggtccccaacccct

SEQ ID NO: 139543 - DNA, 20 bp, Artificial
  CRISPR gRNA sequence
ggtccccaacccctgggcca

SEQ ID NO: 139544 - DNA, 20 bp, Artificial
  CRISPR gRNA sequence
ccaacccctgggccacagac

SEQ ID NO: 139545 - DNA, 20 bp, Artificial
  CRISPR gRNA sequence
ccctgggccacagaccggta

SEQ ID NO: 139546 - DNA, 20 bp, Artificial
  CRISPR gRNA sequence
cctgggccacagaccggtat

SEQ ID NO: 139547 - DNA, 20 bp, Artificial
  CRISPR gRNA sequence
cacagaccggtatgggtcca

SEQ ID NO: 139548 - DNA, 20 bp, Artificial
  CRISPR gRNA sequence
ggtatgggtccatggcctgt

SEQ ID NO: 139549 - DNA, 20 bp, Artificial
  CRISPR gRNA sequence
gtatgggtccatggcctgtt

SEQ ID NO: 139550 - DNA, 20 bp, Artificial
  CRISPR gRNA sequence
tccatggcctgttaggaacc

SEQ ID NO: 139551 - DNA, 20 bp, Artificial
  CRISPR gRNA sequence
ccatggcctgttaggaacct

SEQ ID NO: 139552 - DNA, 20 bp, Artificial
  CRISPR gRNA sequence
cctgttaggaacctaggaac

SEQ ID NO: 139553 - DNA, 20 bp, Artificial
  CRISPR gRNA sequence
ctgttaggaacctaggaact

SEQ ID NO: 139554 - DNA, 20 bp, Artificial
  CRISPR gRNA sequence
aacctaggaactgggctgca

SEQ ID NO: 139555 - DNA, 20 bp, Artificial
  CRISPR gRNA sequence
ctaggaactgggctgcacag

SEQ ID NO: 139556 - DNA, 20 bp, Artificial
  CRISPR gRNA sequence
taggaactgggctgcacagc

SEQ ID NO: 139557 - DNA, 20 bp, Artificial
  CRISPR gRNA sequence
ggaactgggctgcacagcag

SEQ ID NO: 139558 - DNA, 20 bp, Artificial
  CRISPR gRNA sequence
gaactgggctgcacagcagg

SEQ ID NO: 139559 - DNA, 20 bp, Artificial
  CRISPR gRNA sequence
tgggctgcacagcaggaggt

SEQ ID NO: 139560 - DNA, 20 bp, Artificial
  CRISPR gRNA sequence
gctgcacagcaggaggtgag

SEQ ID NO: 139561 - DNA, 20 bp, Artificial
  CRISPR gRNA sequence
cacagcaggaggtgagcagc

SEQ ID NO: 139562 - DNA, 20 bp, Artificial
  CRISPR gRNA sequence
gcaggaggtgagcagccagt

SEQ ID NO: 139563 - DNA, 20 bp, Artificial
  CRISPR gRNA sequence
gaggtgagcagccagtaagc

SEQ ID NO: 139564 - DNA, 20 bp, Artificial
  CRISPR gRNA sequence
gtaagcaagcattactgcct

SEQ ID NO: 139565 - DNA, 20 bp, Artificial
  CRISPR gRNA sequence
gcctgagctccacctcctgt

SEQ ID NO: 139566 - DNA, 20 bp, Artificial
  CRISPR gRNA sequence
agctccacctcctgtcagat

SEQ ID NO: 139567 - DNA, 20 bp, Artificial
  CRISPR gRNA sequence
tccacctcctgtcagatcag

SEQ ID NO: 139568 - DNA, 20 bp, Artificial
  CRISPR gRNA sequence
acctcctgtcagatcagcag

SEQ ID NO: 139569 - DNA, 20 bp, Artificial
  CRISPR gRNA sequence
tgtcagatcagcagtggcat

SEQ ID NO: 139570 - DNA, 20 bp, Artificial
  CRISPR gRNA sequence
gcagtggcattagattctca

SEQ ID NO: 139571 - DNA, 20 bp, Artificial
  CRISPR gRNA sequence
cagtggcattagattctcaa

SEQ ID NO: 139572 - DNA, 20 bp, Artificial
  CRISPR gRNA sequence
ctatcatgaactgcgcatgt

SEQ ID NO: 139573 - DNA, 20 bp, Artificial
  CRISPR gRNA sequence
tatcatgaactgcgcatgtg

SEQ ID NO: 139574 - DNA, 20 bp, Artificial
  CRISPR gRNA sequence
atcatgaactgcgcatgtga

SEQ ID NO: 139575 - DNA, 20 bp, Artificial
  CRISPR gRNA sequence
aactgcgcatgtgagggatc

SEQ ID NO: 139576 - DNA, 20 bp, Artificial
  CRISPR gRNA sequence
actgcgcatgtgagggatct

SEQ ID NO: 139577 - DNA, 20 bp, Artificial
  CRISPR gRNA sequence
gcgcatgtgagggatctagg

SEQ ID NO: 139578 - DNA, 20 bp, Artificial
  CRISPR gRNA sequence
ctaggtagcacactccttat

SEQ ID NO: 139579 - DNA, 20 bp, Artificial
  CRISPR gRNA sequence
atgcccaccctgcccatctc

SEQ ID NO: 139580 - DNA, 20 bp, Artificial
  CRISPR gRNA sequence
aaaattgtcttgcacaaaac

SEQ ID NO: 139581 - DNA, 20 bp, Artificial
  CRISPR gRNA sequence
cttgcacaaaactggttcct

SEQ ID NO: 139582 - DNA, 20 bp, Artificial
  CRISPR gRNA sequence
ttgcacaaaactggttcctg

SEQ ID NO: 139583 - DNA, 20 bp, Artificial
  CRISPR gRNA sequence
acaaaactggttcctgaggt

SEQ ID NO: 139584 - DNA, 20 bp, Artificial
  CRISPR gRNA sequence
caaaactggttcctgaggtt

SEQ ID NO: 139585 - DNA, 20 bp, Artificial
  CRISPR gRNA sequence
aaaactggttcctgaggttg

SEQ ID NO: 139586 - DNA, 20 bp, Artificial
  CRISPR gRNA sequence
gaggttggggaccactgtcc

SEQ ID NO: 139587 - DNA, 20 bp, Artificial
  CRISPR gRNA sequence
ggttggggaccactgtccta

SEQ ID NO: 139588 - DNA, 20 bp, Artificial
  CRISPR gRNA sequence
ctgtcctagagttcctgatt

SEQ ID NO: 139589 - DNA, 20 bp, Artificial
  CRISPR gRNA sequence
cctagagttcctgattcagt

SEQ ID NO: 139590 - DNA, 20 bp, Artificial
  CRISPR gRNA sequence
ttcctgattcagttggtctc

SEQ ID NO: 139591 - DNA, 20 bp, Artificial
  CRISPR gRNA sequence
tcctgattcagttggtctcc

SEQ ID NO: 139592 - DNA, 20 bp, Artificial
  CRISPR gRNA sequence
ctgattcagttggtctccag

SEQ ID NO: 139593 - DNA, 20 bp, Artificial
  CRISPR gRNA sequence
gattcagttggtctccagga

SEQ ID NO: 139594 - DNA, 20 bp, Artificial
  CRISPR gRNA sequence
ttcagttggtctccaggaga

SEQ ID NO: 139595 - DNA, 20 bp, Artificial
  CRISPR gRNA sequence
ttggtctccaggagagagct

SEQ ID NO: 139596 - DNA, 20 bp, Artificial
  CRISPR gRNA sequence
tggtctccaggagagagctc

SEQ ID NO: 139597 - DNA, 20 bp, Artificial
  CRISPR gRNA sequence
tcaggcatcttgtttttcaa

SEQ ID NO: 139598 - DNA, 20 bp, Artificial
  CRISPR gRNA sequence
cttgtttttcaaaagctttt

SEQ ID NO: 139599 - DNA, 20 bp, Artificial
  CRISPR gRNA sequence
ttgtttttcaaaagcttttc

SEQ ID NO: 139600 - DNA, 20 bp, Artificial
  CRISPR gRNA sequence
tttcaggtgattctaacctg

SEQ ID NO: 139601 - DNA, 20 bp, Artificial
  CRISPR gRNA sequence
tgattctaacctgcagcccc

SEQ ID NO: 139602 - DNA, 20 bp, Artificial
  CRISPR gRNA sequence
taacctgcagccccaagatt

SEQ ID NO: 139603 - DNA, 20 bp, Artificial
  CRISPR gRNA sequence
attgagaatcattgatttca

SEQ ID NO: 139604 - DNA, 20 bp, Artificial
  CRISPR gRNA sequence
ttgagaatcattgatttcaa

SEQ ID NO: 139605 - DNA, 20 bp, Artificial
  CRISPR gRNA sequence
tgagaatcattgatttcaaa

SEQ ID NO: 139606 - DNA, 20 bp, Artificial
  CRISPR gRNA sequence
atcattgatttcaaagggtt

SEQ ID NO: 139607 - DNA, 20 bp, Artificial
  CRISPR gRNA sequence
ggttgagaatcttgacttgc

SEQ ID NO: 139608 - DNA, 20 bp, Artificial
  CRISPR gRNA sequence
ttgagaatcttgacttgcca

SEQ ID NO: 139609 - DNA, 20 bp, Artificial
  CRISPR gRNA sequence
gacttgccagagtgcctgac

SEQ ID NO: 139610 - DNA, 20 bp, Artificial
  CRISPR gRNA sequence
acttgccagagtgcctgact

SEQ ID NO: 139611 - DNA, 20 bp, Artificial
  CRISPR gRNA sequence
tgccagagtgcctgactggg

SEQ ID NO: 139612 - DNA, 20 bp, Artificial
  CRISPR gRNA sequence
gccagagtgcctgactgggt

SEQ ID NO: 139613 - DNA, 20 bp, Artificial
  CRISPR gRNA sequence
agtgcctgactgggtaggcc

SEQ ID NO: 139614 - DNA, 20 bp, Artificial
  CRISPR gRNA sequence
ctgactgggtaggcctggaa

SEQ ID NO: 139615 - DNA, 20 bp, Artificial
  CRISPR gRNA sequence
tgactgggtaggcctggaaa

SEQ ID NO: 139616 - DNA, 20 bp, Artificial
  CRISPR gRNA sequence
ctctttattatttgaaactc

SEQ ID NO: 139617 - DNA, 20 bp, Artificial
  CRISPR gRNA sequence
ttgaaactctggatgttctt

SEQ ID NO: 139618 - DNA, 20 bp, Artificial
  CRISPR gRNA sequence
actctggatgttcttcagtg

SEQ ID NO: 139619 - DNA, 20 bp, Artificial
  CRISPR gRNA sequence
gatgttcttcagtgcagccc

SEQ ID NO: 139620 - DNA, 20 bp, Artificial
  CRISPR gRNA sequence
tttgtctccaaactctcatt

SEQ ID NO: 139621 - DNA, 20 bp, Artificial
  CRISPR gRNA sequence
aaactctcattgagtgaatt

SEQ ID NO: 139622 - DNA, 20 bp, Artificial
  CRISPR gRNA sequence
tttgaatttgtcttgaaatg

SEQ ID NO: 139623 - DNA, 20 bp, Artificial
  CRISPR gRNA sequence
gaatttgtcttgaaatgcag

SEQ ID NO: 139624 - DNA, 20 bp, Artificial
  CRISPR gRNA sequence
gtcttgaaatgcagcagttt

SEQ ID NO: 139625 - DNA, 20 bp, Artificial
  CRISPR gRNA sequence
tgaaatgcagcagtttcaga

SEQ ID NO: 139626 - DNA, 20 bp, Artificial
  CRISPR gRNA sequence
aatgcagcagtttcagatgg

SEQ ID NO: 139627 - DNA, 20 bp, Artificial
  CRISPR gRNA sequence
agatggaagcatttttaacg

SEQ ID NO: 139628 - DNA, 20 bp, Artificial
  CRISPR gRNA sequence
gcatttttaacgtagttctt

SEQ ID NO: 139629 - DNA, 20 bp, Artificial
  CRISPR gRNA sequence
tttttaacgtagttctttgg

SEQ ID NO: 139630 - DNA, 20 bp, Artificial
  CRISPR gRNA sequence
ttaacgtagttctttggtag

SEQ ID NO: 139631 - DNA, 20 bp, Artificial
  CRISPR gRNA sequence
cgtagttctttggtagtggt

SEQ ID NO: 139632 - DNA, 20 bp, Artificial
  CRISPR gRNA sequence
gtagttctttggtagtggtc

SEQ ID NO: 139633 - DNA, 20 bp, Artificial
  CRISPR gRNA sequence
agttctttggtagtggtcag

SEQ ID NO: 139634 - DNA, 20 bp, Artificial
  CRISPR gRNA sequence
ttggtagtggtcaggagcat

SEQ ID NO: 139635 - DNA, 20 bp, Artificial
  CRISPR gRNA sequence
caggagcatgagaatgttct

SEQ ID NO: 139636 - DNA, 20 bp, Artificial
  CRISPR gRNA sequence
ggagcatgagaatgttctga

SEQ ID NO: 139637 - DNA, 20 bp, Artificial
  CRISPR gRNA sequence
ctgctcttctgccttactga

SEQ ID NO: 139638 - DNA, 20 bp, Artificial
  CRISPR gRNA sequence
cttactgatagaactcccaa

SEQ ID NO: 139639 - DNA, 20 bp, Artificial
  CRISPR gRNA sequence
actgatagaactcccaaaag

SEQ ID NO: 139640 - DNA, 20 bp, Artificial
  CRISPR gRNA sequence
ctgatagaactcccaaaagt

SEQ ID NO: 139641 - DNA, 20 bp, Artificial
  CRISPR gRNA sequence
tgatagaactcccaaaagta

SEQ ID NO: 139642 - DNA, 20 bp, Artificial
  CRISPR gRNA sequence
gatagaactcccaaaagtag

SEQ ID NO: 139643 - DNA, 20 bp, Artificial
  CRISPR gRNA sequence
atagaactcccaaaagtagg

SEQ ID NO: 139644 - DNA, 20 bp, Artificial
  CRISPR gRNA sequence
tagaactcccaaaagtaggg

SEQ ID NO: 139645 - DNA, 20 bp, Artificial
  CRISPR gRNA sequence
gaactcccaaaagtaggggg

SEQ ID NO: 139646 - DNA, 20 bp, Artificial
  CRISPR gRNA sequence
ctcccaaaagtaggggggag

SEQ ID NO: 139647 - DNA, 20 bp, Artificial
  CRISPR gRNA sequence
taggggggagcagtgtgtgt

SEQ ID NO: 139648 - DNA, 20 bp, Artificial
  CRISPR gRNA sequence
gtgtgtgtcagctgttcttc

SEQ ID NO: 139649 - DNA, 20 bp, Artificial
  CRISPR gRNA sequence
agctgttcttccagttgaat

SEQ ID NO: 139650 - DNA, 20 bp, Artificial
  CRISPR gRNA sequence
tcttccagttgaatcagtat

SEQ ID NO: 139651 - DNA, 20 bp, Artificial
  CRISPR gRNA sequence
cttccagttgaatcagtatc

SEQ ID NO: 139652 - DNA, 20 bp, Artificial
  CRISPR gRNA sequence
tccagttgaatcagtatcag

SEQ ID NO: 139653 - DNA, 20 bp, Artificial
  CRISPR gRNA sequence
agttgaatcagtatcaggag

SEQ ID NO: 139654 - DNA, 20 bp, Artificial
  CRISPR gRNA sequence
gttgaatcagtatcaggaga

SEQ ID NO: 139655 - DNA, 20 bp, Artificial
  CRISPR gRNA sequence
tgaatcagtatcaggagaag

SEQ ID NO: 139656 - DNA, 20 bp, Artificial
  CRISPR gRNA sequence
cagtatcaggagaaggagtt

SEQ ID NO: 139657 - DNA, 20 bp, Artificial
  CRISPR gRNA sequence
agtatcaggagaaggagtta

SEQ ID NO: 139658 - DNA, 20 bp, Artificial
  CRISPR gRNA sequence
tatcaggagaaggagttaag

SEQ ID NO: 139659 - DNA, 20 bp, Artificial
  CRISPR gRNA sequence
gagttaaatgttactcactt

SEQ ID NO: 139660 - DNA, 20 bp, Artificial
  CRISPR gRNA sequence
tgttactcacttcagttaca

SEQ ID NO: 139661 - DNA, 20 bp, Artificial
  CRISPR gRNA sequence
tactcacttcagttacatgg

SEQ ID NO: 139662 - DNA, 20 bp, Artificial
  CRISPR gRNA sequence
cacttcagttacatggtagc

SEQ ID NO: 139663 - DNA, 20 bp, Artificial
  CRISPR gRNA sequence
cagttacatggtagctagtg

SEQ ID NO: 139664 - DNA, 20 bp, Artificial
  CRISPR gRNA sequence
ttacatggtagctagtgaag

SEQ ID NO: 139665 - DNA, 20 bp, Artificial
  CRISPR gRNA sequence
tacatggtagctagtgaagt

SEQ ID NO: 139666 - DNA, 20 bp, Artificial
  CRISPR gRNA sequence
acatggtagctagtgaagtg

SEQ ID NO: 139667 - DNA, 20 bp, Artificial
  CRISPR gRNA sequence
atggtagctagtgaagtggg

SEQ ID NO: 139668 - DNA, 20 bp, Artificial
  CRISPR gRNA sequence
gaagtggggagcatgaatcc

SEQ ID NO: 139669 - DNA, 20 bp, Artificial
  CRISPR gRNA sequence
gagcatgaatccaagtttcg

SEQ ID NO: 139670 - DNA, 20 bp, Artificial
  CRISPR gRNA sequence
agcatgaatccaagtttcgt

SEQ ID NO: 139671 - DNA, 20 bp, Artificial
  CRISPR gRNA sequence
gggcctcaatctactgattg

SEQ ID NO: 139672 - DNA, 20 bp, Artificial
  CRISPR gRNA sequence
gcctcaatctactgattgta

SEQ ID NO: 139673 - DNA, 20 bp, Artificial
  CRISPR gRNA sequence
cctcaatctactgattgtag

SEQ ID NO: 139674 - DNA, 20 bp, Artificial
  CRISPR gRNA sequence
ctcaatctactgattgtaga

SEQ ID NO: 139675 - DNA, 20 bp, Artificial
  CRISPR gRNA sequence
gagggcctcccttttccaac

SEQ ID NO: 139676 - DNA, 20 bp, Artificial
  CRISPR gRNA sequence
tcccttttccaacaagctta

SEQ ID NO: 139677 - DNA, 20 bp, Artificial
  CRISPR gRNA sequence
ggtaaatccttacatgtaac

SEQ ID NO: 139678 - DNA, 20 bp, Artificial
  CRISPR gRNA sequence
aaatccttacatgtaactag

SEQ ID NO: 139679 - DNA, 20 bp, Artificial
  CRISPR gRNA sequence
aatccttacatgtaactaga

SEQ ID NO: 139680 - DNA, 20 bp, Artificial
  CRISPR gRNA sequence
cttacatgtaactagaaggc

SEQ ID NO: 139681 - DNA, 20 bp, Artificial
  CRISPR gRNA sequence
ttacatgtaactagaaggct

SEQ ID NO: 139682 - DNA, 20 bp, Artificial
  CRISPR gRNA sequence
atgtaactagaaggctagga

SEQ ID NO: 139683 - DNA, 20 bp, Artificial
  CRISPR gRNA sequence
tgtaactagaaggctaggat

SEQ ID NO: 139684 - DNA, 20 bp, Artificial
  CRISPR gRNA sequence
agaaggctaggataggatta

SEQ ID NO: 139685 - DNA, 20 bp, Artificial
  CRISPR gRNA sequence
aggataggattatagaaaac

SEQ ID NO: 139686 - DNA, 20 bp, Artificial
  CRISPR gRNA sequence
ggataggattatagaaaact

SEQ ID NO: 139687 - DNA, 20 bp, Artificial
  CRISPR gRNA sequence
gaaaactgggtgattgtcaa

SEQ ID NO: 139688 - DNA, 20 bp, Artificial
  CRISPR gRNA sequence
aaaactgggtgattgtcaac

SEQ ID NO: 139689 - DNA, 20 bp, Artificial
  CRISPR gRNA sequence
aaactgggtgattgtcaaca

SEQ ID NO: 139690 - DNA, 20 bp, Artificial
  CRISPR gRNA sequence
atgaaccatacacacccctc

SEQ ID NO: 139691 - DNA, 20 bp, Artificial
  CRISPR gRNA sequence
acttttacacactgcttctt

SEQ ID NO: 139692 - DNA, 20 bp, Artificial
  CRISPR gRNA sequence
acactgcttcttgagatctc

SEQ ID NO: 139693 - DNA, 20 bp, Artificial
  CRISPR gRNA sequence
cactgcttcttgagatctca

SEQ ID NO: 139694 - DNA, 20 bp, Artificial
  CRISPR gRNA sequence
ttcttgagatctcaaggttt

SEQ ID NO: 139695 - DNA, 20 bp, Artificial
  CRISPR gRNA sequence
tcttgagatctcaaggtttc

SEQ ID NO: 139696 - DNA, 20 bp, Artificial
  CRISPR gRNA sequence
gtttcaggaacatgaaaaaa

SEQ ID NO: 139697 - DNA, 20 bp, Artificial
  CRISPR gRNA sequence
tgaaaaaatagtttgtcaca

SEQ ID NO: 139698 - DNA, 20 bp, Artificial
  CRISPR gRNA sequence
aaatagtttgtcacaaagaa

SEQ ID NO: 139699 - DNA, 20 bp, Artificial
  CRISPR gRNA sequence
tttgtcacaaagaaaagctt

SEQ ID NO: 139700 - DNA, 20 bp, Artificial
  CRISPR gRNA sequence
ttgtcacaaagaaaagcttt

SEQ ID NO: 139701 - DNA, 20 bp, Artificial
  CRISPR gRNA sequence
tcacaaagaaaagctttggg

SEQ ID NO: 139702 - DNA, 20 bp, Artificial
  CRISPR gRNA sequence
cacaaagaaaagctttggga

SEQ ID NO: 139703 - DNA, 20 bp, Artificial
  CRISPR gRNA sequence
acaaagaaaagctttgggaa

SEQ ID NO: 139704 - DNA, 20 bp, Artificial
  CRISPR gRNA sequence
caaagaaaagctttgggaag

SEQ ID NO: 139705 - DNA, 20 bp, Artificial
  CRISPR gRNA sequence
aagctttgggaaggggatta

SEQ ID NO: 139706 - DNA, 20 bp, Artificial
  CRISPR gRNA sequence
ctttgggaaggggattaaag

SEQ ID NO: 139707 - DNA, 20 bp, Artificial
  CRISPR gRNA sequence
ttgggaaggggattaaagca

SEQ ID NO: 139708 - DNA, 20 bp, Artificial
  CRISPR gRNA sequence
gcctcattttacatctctgc

SEQ ID NO: 139709 - DNA, 20 bp, Artificial
  CRISPR gRNA sequence
cctcattttacatctctgca

SEQ ID NO: 139710 - DNA, 20 bp, Artificial
  CRISPR gRNA sequence
cattttacatctctgcaagg

SEQ ID NO: 139711 - DNA, 20 bp, Artificial
  CRISPR gRNA sequence
attttacatctctgcaaggc

SEQ ID NO: 139712 - DNA, 20 bp, Artificial
  CRISPR gRNA sequence
acttttgttgcttttgatta

SEQ ID NO: 139713 - DNA, 20 bp, Artificial
  CRISPR gRNA sequence
tttgttgcttttgattaaag

SEQ ID NO: 139714 - DNA, 20 bp, Artificial
  CRISPR gRNA sequence
tgttgcttttgattaaagaa

SEQ ID NO: 139715 - DNA, 20 bp, Artificial
  CRISPR gRNA sequence
tgattaaagaagagaaattg

SEQ ID NO: 139716 - DNA, 20 bp, Artificial
  CRISPR gRNA sequence
gattaaagaagagaaattga

SEQ ID NO: 139717 - DNA, 20 bp, Artificial
  CRISPR gRNA sequence
ttaaagaagagaaattgaag

SEQ ID NO: 139718 - DNA, 20 bp, Artificial
  CRISPR gRNA sequence
aagagaaattgaaggagtaa

SEQ ID NO: 139719 - DNA, 20 bp, Artificial
  CRISPR gRNA sequence
aatagtttactctttcaatt

SEQ ID NO: 139720 - DNA, 20 bp, Artificial
  CRISPR gRNA sequence
atagtttactctttcaattt

SEQ ID NO: 139721 - DNA, 20 bp, Artificial
  CRISPR gRNA sequence
tagtttactctttcaatttg

SEQ ID NO: 139722 - DNA, 20 bp, Artificial
  CRISPR gRNA sequence
ttactctttcaatttgggga

SEQ ID NO: 139723 - DNA, 20 bp, Artificial
  CRISPR gRNA sequence
actctttcaatttggggaaa

SEQ ID NO: 139724 - DNA, 20 bp, Artificial
  CRISPR gRNA sequence
ctctttcaatttggggaaag

SEQ ID NO: 139725 - DNA, 20 bp, Artificial
  CRISPR gRNA sequence
gaggtcttttttatcaactt

SEQ ID NO: 139726 - DNA, 20 bp, Artificial
  CRISPR gRNA sequence
aggtcttttttatcaacttt

SEQ ID NO: 139727 - DNA, 20 bp, Artificial
  CRISPR gRNA sequence
tttttatcaactttgggctt

SEQ ID NO: 139728 - DNA, 20 bp, Artificial
  CRISPR gRNA sequence
atcaactttgggctttagtt

SEQ ID NO: 139729 - DNA, 20 bp, Artificial
  CRISPR gRNA sequence
gggctttagttaagtaatca

SEQ ID NO: 139730 - DNA, 20 bp, Artificial
  CRISPR gRNA sequence
tacaaattatatttaaaacc

SEQ ID NO: 139731 - DNA, 20 bp, Artificial
  CRISPR gRNA sequence
tatttaaaaccaagccaaac

SEQ ID NO: 139732 - DNA, 20 bp, Artificial
  CRISPR gRNA sequence
tttaaaaccaagccaaacaa

SEQ ID NO: 139733 - DNA, 20 bp, Artificial
  CRISPR gRNA sequence
ccaaacaagagcacacttgc

SEQ ID NO: 139734 - DNA, 20 bp, Artificial
  CRISPR gRNA sequence
aaacaagagcacacttgcaa

SEQ ID NO: 139735 - DNA, 20 bp, Artificial
  CRISPR gRNA sequence
acaagagcacacttgcaaga

SEQ ID NO: 139736 - DNA, 20 bp, Artificial
  CRISPR gRNA sequence
tcatcttgtgctgtatgtat

SEQ ID NO: 139737 - DNA, 20 bp, Artificial
  CRISPR gRNA sequence
ttgtgctgtatgtattagcc

SEQ ID NO: 139738 - DNA, 20 bp, Artificial
  CRISPR gRNA sequence
tgtgctgtatgtattagcct

SEQ ID NO: 139739 - DNA, 20 bp, Artificial
  CRISPR gRNA sequence
tgctgtatgtattagcctgg

SEQ ID NO: 139740 - DNA, 20 bp, Artificial
  CRISPR gRNA sequence
gctgtatgtattagcctggg

SEQ ID NO: 139741 - DNA, 20 bp, Artificial
  CRISPR gRNA sequence
ttagcctgggaggttttcca

SEQ ID NO: 139742 - DNA, 20 bp, Artificial
  CRISPR gRNA sequence
tagcctgggaggttttccaa

SEQ ID NO: 139743 - DNA, 20 bp, Artificial
  CRISPR gRNA sequence
tccaaaggaatgatcatccc

SEQ ID NO: 139744 - DNA, 20 bp, Artificial
  CRISPR gRNA sequence
atcatccctagcattctctt

SEQ ID NO: 139745 - DNA, 20 bp, Artificial
  CRISPR gRNA sequence
ttctctttggcatttctatg

SEQ ID NO: 139746 - DNA, 20 bp, Artificial
  CRISPR gRNA sequence
tcttctgtgatatgccacac

SEQ ID NO: 139747 - DNA, 20 bp, Artificial
  CRISPR gRNA sequence
tctgtgatatgccacacaag

SEQ ID NO: 139748 - DNA, 20 bp, Artificial
  CRISPR gRNA sequence
ctgtgatatgccacacaaga

SEQ ID NO: 139749 - DNA, 20 bp, Artificial
  CRISPR gRNA sequence
tgatatgccacacaagaagg

SEQ ID NO: 139750 - DNA, 20 bp, Artificial
  CRISPR gRNA sequence
tgccacacaagaaggaagac

SEQ ID NO: 139751 - DNA, 20 bp, Artificial
  CRISPR gRNA sequence
cacacaagaaggaagaccag

SEQ ID NO: 139752 - DNA, 20 bp, Artificial
  CRISPR gRNA sequence
gaagaccagtggttgatttc

SEQ ID NO: 139753 - DNA, 20 bp, Artificial
  CRISPR gRNA sequence
aagaccagtggttgatttct

SEQ ID NO: 139754 - DNA, 20 bp, Artificial
  CRISPR gRNA sequence
aaacttttaaaaaaactctt

SEQ ID NO: 139755 - DNA, 20 bp, Artificial
  CRISPR gRNA sequence
aacttttaaaaaaactcttt

SEQ ID NO: 139756 - DNA, 20 bp, Artificial
  CRISPR gRNA sequence
taaaaaaactctttaggatc

SEQ ID NO: 139757 - DNA, 20 bp, Artificial
  CRISPR gRNA sequence
tttaggatctggccccaacc

SEQ ID NO: 139758 - DNA, 20 bp, Artificial
  CRISPR gRNA sequence
ctgcttttcccctctatact

SEQ ID NO: 139759 - DNA, 20 bp, Artificial
  CRISPR gRNA sequence
tgcttttcccctctatactc

SEQ ID NO: 139760 - DNA, 20 bp, Artificial
  CRISPR gRNA sequence
ttttcccctctatactcagg

SEQ ID NO: 139761 - DNA, 20 bp, Artificial
  CRISPR gRNA sequence
tcccctctatactcaggtag

SEQ ID NO: 139762 - DNA, 20 bp, Artificial
  CRISPR gRNA sequence
tagtagatctaaaacttaaa

SEQ ID NO: 139763 - DNA, 20 bp, Artificial
  CRISPR gRNA sequence
agtagatctaaaacttaaat

SEQ ID NO: 139764 - DNA, 20 bp, Artificial
  CRISPR gRNA sequence
acattctcatactttttcaa

SEQ ID NO: 139765 - DNA, 20 bp, Artificial
  CRISPR gRNA sequence
cattctcatactttttcaac

SEQ ID NO: 139766 - DNA, 20 bp, Artificial
  CRISPR gRNA sequence
tttttcaacaggcaaattcc

SEQ ID NO: 139767 - DNA, 20 bp, Artificial
  CRISPR gRNA sequence
ggcaaattcccagcatccct

SEQ ID NO: 139768 - DNA, 20 bp, Artificial
  CRISPR gRNA sequence
agcatcccttagacacaatt

SEQ ID NO: 139769 - DNA, 20 bp, Artificial
  CRISPR gRNA sequence
ttcagatgtcatcccctttg

SEQ ID NO: 139770 - DNA, 20 bp, Artificial
  CRISPR gRNA sequence
ccaatccctcactctccctc

SEQ ID NO: 139771 - DNA, 20 bp, Artificial
  CRISPR gRNA sequence
tccctccagccccacattgc

SEQ ID NO: 139772 - DNA, 20 bp, Artificial
  CRISPR gRNA sequence
cccacattgctagctgtccc

SEQ ID NO: 139773 - DNA, 20 bp, Artificial
  CRISPR gRNA sequence
tgtccttctttgtgtccccg

SEQ ID NO: 139774 - DNA, 20 bp, Artificial
  CRISPR gRNA sequence
gtccttctttgtgtccccgc

SEQ ID NO: 139775 - DNA, 20 bp, Artificial
  CRISPR gRNA sequence
tccttctttgtgtccccgca

SEQ ID NO: 139776 - DNA, 20 bp, Artificial
  CRISPR gRNA sequence
ccttctttgtgtccccgcag

SEQ ID NO: 139777 - DNA, 20 bp, Artificial
  CRISPR gRNA sequence
cgcaggggatccctcccctc

SEQ ID NO: 139778 - DNA, 20 bp, Artificial
  CRISPR gRNA sequence
ggatccctcccctccagtat

SEQ ID NO: 139779 - DNA, 20 bp, Artificial
  CRISPR gRNA sequence
gatccctcccctccagtatt

SEQ ID NO: 139780 - DNA, 20 bp, Artificial
  CRISPR gRNA sequence
ccctcccctccagtattggg

SEQ ID NO: 139781 - DNA, 20 bp, Artificial
  CRISPR gRNA sequence
cctcccctccagtattgggt

SEQ ID NO: 139782 - DNA, 20 bp, Artificial
  CRISPR gRNA sequence
ctcccctccagtattgggta

SEQ ID NO: 139783 - DNA, 20 bp, Artificial
  CRISPR gRNA sequence
tcccctccagtattgggtag

SEQ ID NO: 139784 - DNA, 20 bp, Artificial
  CRISPR gRNA sequence
gactatctctgacaaaccac

SEQ ID NO: 139785 - DNA, 20 bp, Artificial
  CRISPR gRNA sequence
gacaaaccacaagctcttca

SEQ ID NO: 139786 - DNA, 20 bp, Artificial
  CRISPR gRNA sequence
acaaaccacaagctcttcaa

SEQ ID NO: 139787 - DNA, 20 bp, Artificial
  CRISPR gRNA sequence
aaccacaagctcttcaaagg

SEQ ID NO: 139788 - DNA, 20 bp, Artificial
  CRISPR gRNA sequence
accacaagctcttcaaaggt

SEQ ID NO: 139789 - DNA, 20 bp, Artificial
  CRISPR gRNA sequence
cacaagctcttcaaaggtag

SEQ ID NO: 139790 - DNA, 20 bp, Artificial
  CRISPR gRNA sequence
aagctcttcaaaggtaggag

SEQ ID NO: 139791 - DNA, 20 bp, Artificial
  CRISPR gRNA sequence
ttttttctttcttttttaaa

SEQ ID NO: 139792 - DNA, 20 bp, Artificial
  CRISPR gRNA sequence
ctttcttttttaaatagtga

SEQ ID NO: 139793 - DNA, 20 bp, Artificial
  CRISPR gRNA sequence
tttcttttttaaatagtgat

SEQ ID NO: 139794 - DNA, 20 bp, Artificial
  CRISPR gRNA sequence
ttcttttttaaatagtgatg

SEQ ID NO: 139795 - DNA, 20 bp, Artificial
  CRISPR gRNA sequence
tggggtctcactatgttgac

SEQ ID NO: 139796 - DNA, 20 bp, Artificial
  CRISPR gRNA sequence
tctcactatgttgaccagac

SEQ ID NO: 139797 - DNA, 20 bp, Artificial
  CRISPR gRNA sequence
ccagactggtctcaaactcc

SEQ ID NO: 139798 - DNA, 20 bp, Artificial
  CRISPR gRNA sequence
ggtctcaaactcctggcctc

SEQ ID NO: 139799 - DNA, 20 bp, Artificial
  CRISPR gRNA sequence
ctcaagcgattctcccatct

SEQ ID NO: 139800 - DNA, 20 bp, Artificial
  CRISPR gRNA sequence
attctcccatctcagccttc

SEQ ID NO: 139801 - DNA, 20 bp, Artificial
  CRISPR gRNA sequence
tctcccatctcagccttcca

SEQ ID NO: 139802 - DNA, 20 bp, Artificial
  CRISPR gRNA sequence
atctcagccttccagagtgc

SEQ ID NO: 139803 - DNA, 20 bp, Artificial
  CRISPR gRNA sequence
tctcagccttccagagtgct

SEQ ID NO: 139804 - DNA, 20 bp, Artificial
  CRISPR gRNA sequence
cttccagagtgctgggatta

SEQ ID NO: 139805 - DNA, 20 bp, Artificial
  CRISPR gRNA sequence
ttccagagtgctgggattac

SEQ ID NO: 139806 - DNA, 20 bp, Artificial
  CRISPR gRNA sequence
agtgctgggattacaggcat

SEQ ID NO: 139807 - DNA, 20 bp, Artificial
  CRISPR gRNA sequence
caggcatgagccaccatgcc

SEQ ID NO: 139808 - DNA, 20 bp, Artificial
  CRISPR gRNA sequence
ctacatgtgtattttttgca

SEQ ID NO: 139809 - DNA, 20 bp, Artificial
  CRISPR gRNA sequence
catgtgtattttttgcatag

SEQ ID NO: 139810 - DNA, 20 bp, Artificial
  CRISPR gRNA sequence
gtgtattttttgcatagtag

SEQ ID NO: 139811 - DNA, 20 bp, Artificial
  CRISPR gRNA sequence
tgtattttttgcatagtagt

SEQ ID NO: 139812 - DNA, 20 bp, Artificial
  CRISPR gRNA sequence
aggtatcatacatttactat

SEQ ID NO: 139813 - DNA, 20 bp, Artificial
  CRISPR gRNA sequence
tcatacatttactattagtt

SEQ ID NO: 139814 - DNA, 20 bp, Artificial
  CRISPR gRNA sequence
attagttgagttgcttgaat

SEQ ID NO: 139815 - DNA, 20 bp, Artificial
  CRISPR gRNA sequence
ttgcttgaatcagtaaatga

SEQ ID NO: 139816 - DNA, 20 bp, Artificial
  CRISPR gRNA sequence
gcttgaatcagtaaatgaaa

SEQ ID NO: 139817 - DNA, 20 bp, Artificial
  CRISPR gRNA sequence
gaatcagtaaatgaaagagc

SEQ ID NO: 139818 - DNA, 20 bp, Artificial
  CRISPR gRNA sequence
aatcagtaaatgaaagagca

SEQ ID NO: 139819 - DNA, 20 bp, Artificial
  CRISPR gRNA sequence
atcagtaaatgaaagagcaa

SEQ ID NO: 139820 - DNA, 20 bp, Artificial
  CRISPR gRNA sequence
tcagtaaatgaaagagcaag

SEQ ID NO: 139821 - DNA, 20 bp, Artificial
  CRISPR gRNA sequence
gaaagagcaaggggaaaaac

SEQ ID NO: 139822 - DNA, 20 bp, Artificial
  CRISPR gRNA sequence
agcaaggggaaaaacaagaa

SEQ ID NO: 139823 - DNA, 20 bp, Artificial
  CRISPR gRNA sequence
ttttaataaactgaacttct

SEQ ID NO: 139824 - DNA, 20 bp, Artificial
  CRISPR gRNA sequence
cttctaagtctctgttactc

SEQ ID NO: 139825 - DNA, 20 bp, Artificial
  CRISPR gRNA sequence
ttctaagtctctgttactcc

SEQ ID NO: 139826 - DNA, 20 bp, Artificial
  CRISPR gRNA sequence
tctaagtctctgttactcca

SEQ ID NO: 139827 - DNA, 20 bp, Artificial
  CRISPR gRNA sequence
agtctctgttactccagggt

SEQ ID NO: 139828 - DNA, 20 bp, Artificial
  CRISPR gRNA sequence
tgttactccagggttagttt

SEQ ID NO: 139829 - DNA, 20 bp, Artificial
  CRISPR gRNA sequence
tactccagggttagttttag

SEQ ID NO: 139830 - DNA, 20 bp, Artificial
  CRISPR gRNA sequence
ctccagggttagttttagta

SEQ ID NO: 139831 - DNA, 20 bp, Artificial
  CRISPR gRNA sequence
tccagggttagttttagtag

SEQ ID NO: 139832 - DNA, 20 bp, Artificial
  CRISPR gRNA sequence
ccagggttagttttagtaga

SEQ ID NO: 139833 - DNA, 20 bp, Artificial
  CRISPR gRNA sequence
tagttttagtagagggttca

SEQ ID NO: 139834 - DNA, 20 bp, Artificial
  CRISPR gRNA sequence
gaaaatgttgatacctaatt

SEQ ID NO: 139835 - DNA, 20 bp, Artificial
  CRISPR gRNA sequence
tgttgatacctaatttggaa

SEQ ID NO: 139836 - DNA, 20 bp, Artificial
  CRISPR gRNA sequence
gttgatacctaatttggaaa

SEQ ID NO: 139837 - DNA, 20 bp, Artificial
  CRISPR gRNA sequence
tacctaatttggaaaaggaa

SEQ ID NO: 139838 - DNA, 20 bp, Artificial
  CRISPR gRNA sequence
aaaaggaaaagatgaaaaat

SEQ ID NO: 139839 - DNA, 20 bp, Artificial
  CRISPR gRNA sequence
agatgaaaaattggtgtttg

SEQ ID NO: 139840 - DNA, 20 bp, Artificial
  CRISPR gRNA sequence
aaattggtgtttgaagtttg

SEQ ID NO: 139841 - DNA, 20 bp, Artificial
  CRISPR gRNA sequence
attggtgtttgaagtttgta

SEQ ID NO: 139842 - DNA, 20 bp, Artificial
  CRISPR gRNA sequence
ggtgtttgaagtttgtagag

SEQ ID NO: 139843 - DNA, 20 bp, Artificial
  CRISPR gRNA sequence
tgtttgaagtttgtagagca

SEQ ID NO: 139844 - DNA, 20 bp, Artificial
  CRISPR gRNA sequence
ttgaagtttgtagagcagag

SEQ ID NO: 139845 - DNA, 20 bp, Artificial
  CRISPR gRNA sequence
aagtttgtagagcagagtgg

SEQ ID NO: 139846 - DNA, 20 bp, Artificial
  CRISPR gRNA sequence
tgtagagcagagtggtagcc

SEQ ID NO: 139847 - DNA, 20 bp, Artificial
  CRISPR gRNA sequence
agagcagagtggtagccaag

SEQ ID NO: 139848 - DNA, 20 bp, Artificial
  CRISPR gRNA sequence
gtggtagccaagcagcttgt

SEQ ID NO: 139849 - DNA, 20 bp, Artificial
  CRISPR gRNA sequence
tggtagccaagcagcttgtt

SEQ ID NO: 139850 - DNA, 20 bp, Artificial
  CRISPR gRNA sequence
agcagcttgttgggtttgca

SEQ ID NO: 139851 - DNA, 20 bp, Artificial
  CRISPR gRNA sequence
ttgggtttgcatggaaaaat

SEQ ID NO: 139852 - DNA, 20 bp, Artificial
  CRISPR gRNA sequence
catggaaaaattagatgtct

SEQ ID NO: 139853 - DNA, 20 bp, Artificial
  CRISPR gRNA sequence
tggtgtacattttatcctaa

SEQ ID NO: 139854 - DNA, 20 bp, Artificial
  CRISPR gRNA sequence
ttctttctataatcataaaa

SEQ ID NO: 139855 - DNA, 20 bp, Artificial
  CRISPR gRNA sequence
tctttctataatcataaaat

SEQ ID NO: 139856 - DNA, 20 bp, Artificial
  CRISPR gRNA sequence
tataatcataaaataggttc

SEQ ID NO: 139857 - DNA, 20 bp, Artificial
  CRISPR gRNA sequence
ataatcataaaataggttct

SEQ ID NO: 139858 - DNA, 20 bp, Artificial
  CRISPR gRNA sequence
atcataaaataggttctggg

SEQ ID NO: 139859 - DNA, 20 bp, Artificial
  CRISPR gRNA sequence
cctttttttgacatatattt

SEQ ID NO: 139860 - DNA, 20 bp, Artificial
  CRISPR gRNA sequence
atatatttgagattttctgt

SEQ ID NO: 139861 - DNA, 20 bp, Artificial
  CRISPR gRNA sequence
attttctgttggtcttgcaa

SEQ ID NO: 139862 - DNA, 20 bp, Artificial
  CRISPR gRNA sequence
tctgttggtcttgcaaaaga

SEQ ID NO: 139863 - DNA, 20 bp, Artificial
  CRISPR gRNA sequence
aatgtgatgatgcaaattcc

SEQ ID NO: 139864 - DNA, 20 bp, Artificial
  CRISPR gRNA sequence
atgtgatgatgcaaattccc

SEQ ID NO: 139865 - DNA, 20 bp, Artificial
  CRISPR gRNA sequence
gatgatgcaaattcccaggt

SEQ ID NO: 139866 - DNA, 20 bp, Artificial
  CRISPR gRNA sequence
aaattcccaggtgagcatat

SEQ ID NO: 139867 - DNA, 20 bp, Artificial
  CRISPR gRNA sequence
aattcccaggtgagcatatt

SEQ ID NO: 139868 - DNA, 20 bp, Artificial
  CRISPR gRNA sequence
ccaggtgagcatattaggtt

SEQ ID NO: 139869 - DNA, 20 bp, Artificial
  CRISPR gRNA sequence
gtgagcatattaggtttagt

SEQ ID NO: 139870 - DNA, 20 bp, Artificial
  CRISPR gRNA sequence
aggtttagtgagtcacattt

SEQ ID NO: 139871 - DNA, 20 bp, Artificial
  CRISPR gRNA sequence
gtcacatttcagaccactta

SEQ ID NO: 139872 - DNA, 20 bp, Artificial
  CRISPR gRNA sequence
agaatcaatcatttgacacc

SEQ ID NO: 139873 - DNA, 20 bp, Artificial
  CRISPR gRNA sequence
aatcatttgacacctagtcc

SEQ ID NO: 139874 - DNA, 20 bp, Artificial
  CRISPR gRNA sequence
catttgacacctagtcccag

SEQ ID NO: 139875 - DNA, 20 bp, Artificial
  CRISPR gRNA sequence
tttgacacctagtcccagta

SEQ ID NO: 139876 - DNA, 20 bp, Artificial
  CRISPR gRNA sequence
agtagagattttgctgattt

SEQ ID NO: 139877 - DNA, 20 bp, Artificial
  CRISPR gRNA sequence
ttgcaccttcctcttcattg

SEQ ID NO: 139878 - DNA, 20 bp, Artificial
  CRISPR gRNA sequence
ctcaaaattgatttttttcc

SEQ ID NO: 139879 - DNA, 20 bp, Artificial
  CRISPR gRNA sequence
cctagaattgcatccatcat

SEQ ID NO: 139880 - DNA, 20 bp, Artificial
  CRISPR gRNA sequence
ctagaattgcatccatcatt

SEQ ID NO: 139881 - DNA, 20 bp, Artificial
  CRISPR gRNA sequence
ttgggcatgtgtttaaatac

SEQ ID NO: 139882 - DNA, 20 bp, Artificial
  CRISPR gRNA sequence
ggcatgtgtttaaataccag

SEQ ID NO: 139883 - DNA, 20 bp, Artificial
  CRISPR gRNA sequence
agtttcaaaataaaacaaaa

SEQ ID NO: 139884 - DNA, 20 bp, Artificial
  CRISPR gRNA sequence
gtttcaaaataaaacaaaaa

SEQ ID NO: 139885 - DNA, 20 bp, Artificial
  CRISPR gRNA sequence
tttcaaaataaaacaaaaaa

SEQ ID NO: 139886 - DNA, 20 bp, Artificial
  CRISPR gRNA sequence
aataaaacaaaaaagggctt

SEQ ID NO: 139887 - DNA, 20 bp, Artificial
  CRISPR gRNA sequence
ggcttaagtctcaaattatt

SEQ ID NO: 139888 - DNA, 20 bp, Artificial
  CRISPR gRNA sequence
ttaagtctcaaattattgag

SEQ ID NO: 139889 - DNA, 20 bp, Artificial
  CRISPR gRNA sequence
ttgagtagtgctgatcaaaa

SEQ ID NO: 139890 - DNA, 20 bp, Artificial
  CRISPR gRNA sequence
cctttcctaaactatatcca

SEQ ID NO: 139891 - DNA, 20 bp, Artificial
  CRISPR gRNA sequence
cctaaactatatccacagtg

SEQ ID NO: 139892 - DNA, 20 bp, Artificial
  CRISPR gRNA sequence
atatccacagtgaagttata

SEQ ID NO: 139893 - DNA, 20 bp, Artificial
  CRISPR gRNA sequence
tatatggtcctcccccactc

SEQ ID NO: 139894 - DNA, 20 bp, Artificial
  CRISPR gRNA sequence
atatggtcctcccccactcc

SEQ ID NO: 139895 - DNA, 20 bp, Artificial
  CRISPR gRNA sequence
tcccccactccaggcttgtt

SEQ ID NO: 139896 - DNA, 20 bp, Artificial
  CRISPR gRNA sequence
cttgttaagaaaaaataaca

SEQ ID NO: 139897 - DNA, 20 bp, Artificial
  CRISPR gRNA sequence
aataacacagctgttcctaa

SEQ ID NO: 139898 - DNA, 20 bp, Artificial
  CRISPR gRNA sequence
ataacacagctgttcctaaa

SEQ ID NO: 139899 - DNA, 20 bp, Artificial
  CRISPR gRNA sequence
acacagctgttcctaaaagg

SEQ ID NO: 139900 - DNA, 20 bp, Artificial
  CRISPR gRNA sequence
cccccacttgaaacaaattt

SEQ ID NO: 139901 - DNA, 20 bp, Artificial
  CRISPR gRNA sequence
cccacttgaaacaaattttg

SEQ ID NO: 139902 - DNA, 20 bp, Artificial
  CRISPR gRNA sequence
ttgaaacaaattttggagac

SEQ ID NO: 139903 - DNA, 20 bp, Artificial
  CRISPR gRNA sequence
tgaaacaaattttggagaca

SEQ ID NO: 139904 - DNA, 20 bp, Artificial
  CRISPR gRNA sequence
aaggccattgctactgtgat

SEQ ID NO: 139905 - DNA, 20 bp, Artificial
  CRISPR gRNA sequence
ccattgctactgtgatgaga

SEQ ID NO: 139906 - DNA, 20 bp, Artificial
  CRISPR gRNA sequence
cattgctactgtgatgagaa

SEQ ID NO: 139907 - DNA, 20 bp, Artificial
  CRISPR gRNA sequence
ttgctactgtgatgagaaag

SEQ ID NO: 139908 - DNA, 20 bp, Artificial
  CRISPR gRNA sequence
gagaaaggagctctcctccc

SEQ ID NO: 139909 - DNA, 20 bp, Artificial
  CRISPR gRNA sequence
tcctccccagtttctgttgt

SEQ ID NO: 139910 - DNA, 20 bp, Artificial
  CRISPR gRNA sequence
cctccccagtttctgttgtc

SEQ ID NO: 139911 - DNA, 20 bp, Artificial
  CRISPR gRNA sequence
cccagtttctgttgtcaggt

SEQ ID NO: 139912 - DNA, 20 bp, Artificial
  CRISPR gRNA sequence
tgtcaggttagtgcaaatgt

SEQ ID NO: 139913 - DNA, 20 bp, Artificial
  CRISPR gRNA sequence
gttagtgcaaatgtcagaaa

SEQ ID NO: 139914 - DNA, 20 bp, Artificial
  CRISPR gRNA sequence
atgtcagaaatggccactat

SEQ ID NO: 139915 - DNA, 20 bp, Artificial
  CRISPR gRNA sequence
aatggccactatcagttgta

SEQ ID NO: 139916 - DNA, 20 bp, Artificial
  CRISPR gRNA sequence
ctatcagttgtaaagaactg

SEQ ID NO: 139917 - DNA, 20 bp, Artificial
  CRISPR gRNA sequence
taaagaactgtggatcactg

SEQ ID NO: 139918 - DNA, 20 bp, Artificial
  CRISPR gRNA sequence
aactgtggatcactgtggtc

SEQ ID NO: 139919 - DNA, 20 bp, Artificial
  CRISPR gRNA sequence
atcactgtggtcaagtgccc

SEQ ID NO: 139920 - DNA, 20 bp, Artificial
  CRISPR gRNA sequence
aagtgccccggcgttgctgt

SEQ ID NO: 139921 - DNA, 20 bp, Artificial
  CRISPR gRNA sequence
ccccggcgttgctgttagtt

SEQ ID NO: 139922 - DNA, 20 bp, Artificial
  CRISPR gRNA sequence
ctgttagtttggtcactgaa

SEQ ID NO: 139923 - DNA, 20 bp, Artificial
  CRISPR gRNA sequence
ttagtttggtcactgaatgg

SEQ ID NO: 139924 - DNA, 20 bp, Artificial
  CRISPR gRNA sequence
tttggtcactgaatggaaga

SEQ ID NO: 139925 - DNA, 20 bp, Artificial
  CRISPR gRNA sequence
cactgaatggaagaaagaac

SEQ ID NO: 139926 - DNA, 20 bp, Artificial
  CRISPR gRNA sequence
tgaatggaagaaagaactgg

SEQ ID NO: 139927 - DNA, 20 bp, Artificial
  CRISPR gRNA sequence
ggaagaaagaactggcagtt

SEQ ID NO: 139928 - DNA, 20 bp, Artificial
  CRISPR gRNA sequence
aagaaagaactggcagttta

SEQ ID NO: 139929 - DNA, 20 bp, Artificial
  CRISPR gRNA sequence
agaaagaactggcagtttag

SEQ ID NO: 139930 - DNA, 20 bp, Artificial
  CRISPR gRNA sequence
cagtttagaggaatacccct

SEQ ID NO: 139931 - DNA, 20 bp, Artificial
  CRISPR gRNA sequence
ttagaggaatacccctgaga

SEQ ID NO: 139932 - DNA, 20 bp, Artificial
  CRISPR gRNA sequence
tcattttaatctgcatattg

SEQ ID NO: 139933 - DNA, 20 bp, Artificial
  CRISPR gRNA sequence
ttaatctgcatattgcagac

SEQ ID NO: 139934 - DNA, 20 bp, Artificial
  CRISPR gRNA sequence
tgcagactggtaaacttact

SEQ ID NO: 139935 - DNA, 20 bp, Artificial
  CRISPR gRNA sequence
taaacttacttggaaaaaaa

SEQ ID NO: 139936 - DNA, 20 bp, Artificial
  CRISPR gRNA sequence
acttacttggaaaaaaaaag

SEQ ID NO: 139937 - DNA, 20 bp, Artificial
  CRISPR gRNA sequence
cttacttggaaaaaaaaaga

SEQ ID NO: 139938 - DNA, 20 bp, Artificial
  CRISPR gRNA sequence
tgacgaaaaaaaaaaaaaaa

SEQ ID NO: 139939 - DNA, 20 bp, Artificial
  CRISPR gRNA sequence
aaaaaaaaacagatattgct

SEQ ID NO: 139940 - DNA, 20 bp, Artificial
  CRISPR gRNA sequence
aaaaaaaacagatattgctt

SEQ ID NO: 139941 - DNA, 20 bp, Artificial
  CRISPR gRNA sequence
aaaaaaacagatattgcttg

SEQ ID NO: 139942 - DNA, 20 bp, Artificial
  CRISPR gRNA sequence
tgcttggggctgtgtttcat

SEQ ID NO: 139943 - DNA, 20 bp, Artificial
  CRISPR gRNA sequence
cttggggctgtgtttcatga

SEQ ID NO: 139944 - DNA, 20 bp, Artificial
  CRISPR gRNA sequence
gtgtttcatgagagcactgt

SEQ ID NO: 139945 - DNA, 20 bp, Artificial
  CRISPR gRNA sequence
gtttcatgagagcactgtta

SEQ ID NO: 139946 - DNA, 20 bp, Artificial
  CRISPR gRNA sequence
tttcatgagagcactgttag

SEQ ID NO: 139947 - DNA, 20 bp, Artificial
  CRISPR gRNA sequence
gcactgttagaggccatcct

SEQ ID NO: 139948 - DNA, 20 bp, Artificial
  CRISPR gRNA sequence
gccatcctaagctttttcta

SEQ ID NO: 139949 - DNA, 20 bp, Artificial
  CRISPR gRNA sequence
taaagcccattaattctttg

SEQ ID NO: 139950 - DNA, 20 bp, Artificial
  CRISPR gRNA sequence
tttgaagacctgcatatgtt

SEQ ID NO: 139951 - DNA, 20 bp, Artificial
  CRISPR gRNA sequence
agacctgcatatgttaagta

SEQ ID NO: 139952 - DNA, 20 bp, Artificial
  CRISPR gRNA sequence
cctgcatatgttaagtaaag

SEQ ID NO: 139953 - DNA, 20 bp, Artificial
  CRISPR gRNA sequence
agtaaagaagaattttgctc

SEQ ID NO: 139954 - DNA, 20 bp, Artificial
  CRISPR gRNA sequence
taaagaagaattttgctctg

SEQ ID NO: 139955 - DNA, 20 bp, Artificial
  CRISPR gRNA sequence
ctcccgacatacgcttcctg

SEQ ID NO: 139956 - DNA, 20 bp, Artificial
  CRISPR gRNA sequence
cccgacatacgcttcctgaa

SEQ ID NO: 139957 - DNA, 20 bp, Artificial
  CRISPR gRNA sequence
cgacatacgcttcctgaaga

SEQ ID NO: 139958 - DNA, 20 bp, Artificial
  CRISPR gRNA sequence
gacatacgcttcctgaagag

SEQ ID NO: 139959 - DNA, 20 bp, Artificial
  CRISPR gRNA sequence
acatacgcttcctgaagaga

SEQ ID NO: 139960 - DNA, 20 bp, Artificial
  CRISPR gRNA sequence
gcttcctgaagagagggacc

SEQ ID NO: 139961 - DNA, 20 bp, Artificial
  CRISPR gRNA sequence
cctgaagagagggaccaagc

SEQ ID NO: 139962 - DNA, 20 bp, Artificial
  CRISPR gRNA sequence
tgaagagagggaccaagcca

SEQ ID NO: 139963 - DNA, 20 bp, Artificial
  CRISPR gRNA sequence
gcatctcttgttgttcattt

SEQ ID NO: 139964 - DNA, 20 bp, Artificial
  CRISPR gRNA sequence
ctcttgttgttcatttcaga

SEQ ID NO: 139965 - DNA, 20 bp, Artificial
  CRISPR gRNA sequence
ttcatttcagaaagacttcc

SEQ ID NO: 139966 - DNA, 20 bp, Artificial
  CRISPR gRNA sequence
ttcagaaagacttccgagtg

SEQ ID NO: 139967 - DNA, 20 bp, Artificial
  CRISPR gRNA sequence
tcagaaagacttccgagtgc

SEQ ID NO: 139968 - DNA, 20 bp, Artificial
  CRISPR gRNA sequence
ccgagtgcaggaactcccac

SEQ ID NO: 139969 - DNA, 20 bp, Artificial
  CRISPR gRNA sequence
aactcccactggctcgtatt

SEQ ID NO: 139970 - DNA, 20 bp, Artificial
  CRISPR gRNA sequence
tcccactggctcgtattaag

SEQ ID NO: 139971 - DNA, 20 bp, Artificial
  CRISPR gRNA sequence
tattaagaagattatgaaac

SEQ ID NO: 139972 - DNA, 20 bp, Artificial
  CRISPR gRNA sequence
gaagattatgaaactggatg

SEQ ID NO: 139973 - DNA, 20 bp, Artificial
  CRISPR gRNA sequence
tgaaactggatgaagatgtg

SEQ ID NO: 139974 - DNA, 20 bp, Artificial
  CRISPR gRNA sequence
gaaactggatgaagatgtga

SEQ ID NO: 139975 - DNA, 20 bp, Artificial
  CRISPR gRNA sequence
atttttattatttcttattg

SEQ ID NO: 139976 - DNA, 20 bp, Artificial
  CRISPR gRNA sequence
tattatttcttattgaagct

SEQ ID NO: 139977 - DNA, 20 bp, Artificial
  CRISPR gRNA sequence
ttcttattgaagctaagtga

SEQ ID NO: 139978 - DNA, 20 bp, Artificial
  CRISPR gRNA sequence
tcttattgaagctaagtgat

SEQ ID NO: 139979 - DNA, 20 bp, Artificial
  CRISPR gRNA sequence
tattgaagctaagtgatggg

SEQ ID NO: 139980 - DNA, 20 bp, Artificial
  CRISPR gRNA sequence
attgaagctaagtgatgggt

SEQ ID NO: 139981 - DNA, 20 bp, Artificial
  CRISPR gRNA sequence
taggttattgctcatttctc

SEQ ID NO: 139982 - DNA, 20 bp, Artificial
  CRISPR gRNA sequence
ggttattgctcatttctcta

SEQ ID NO: 139983 - DNA, 20 bp, Artificial
  CRISPR gRNA sequence
gctcatttctctagagctca

SEQ ID NO: 139984 - DNA, 20 bp, Artificial
  CRISPR gRNA sequence
agctcaaagtttaattaaac

SEQ ID NO: 139985 - DNA, 20 bp, Artificial
  CRISPR gRNA sequence
ctgtctgttgctttgttatt

SEQ ID NO: 139986 - DNA, 20 bp, Artificial
  CRISPR gRNA sequence
ggttcctgtgcaaaattgtt

SEQ ID NO: 139987 - DNA, 20 bp, Artificial
  CRISPR gRNA sequence
cctgtgcaaaattgttaagt

SEQ ID NO: 139988 - DNA, 20 bp, Artificial
  CRISPR gRNA sequence
ttgttaagtgagccaaaatt

SEQ ID NO: 139989 - DNA, 20 bp, Artificial
  CRISPR gRNA sequence
ttaagtgagccaaaattgag

SEQ ID NO: 139990 - DNA, 20 bp, Artificial
  CRISPR gRNA sequence
gagccaaaattgagcagttt

SEQ ID NO: 139991 - DNA, 20 bp, Artificial
  CRISPR gRNA sequence
gagcagttttggttactata

SEQ ID NO: 139992 - DNA, 20 bp, Artificial
  CRISPR gRNA sequence
ggatcatcctgaaaattttt

SEQ ID NO: 139993 - DNA, 20 bp, Artificial
  CRISPR gRNA sequence
ttttttagatgttgaaaaaa

SEQ ID NO: 139994 - DNA, 20 bp, Artificial
  CRISPR gRNA sequence
gttgaaaaaatagttgatgt

SEQ ID NO: 139995 - DNA, 20 bp, Artificial
  CRISPR gRNA sequence
ttgaaaaaatagttgatgtt

SEQ ID NO: 139996 - DNA, 20 bp, Artificial
  CRISPR gRNA sequence
tgggtttttttttttttttt

SEQ ID NO: 139997 - DNA, 20 bp, Artificial
  CRISPR gRNA sequence
ggttttttttttttttttga

SEQ ID NO: 139998 - DNA, 20 bp, Artificial
  CRISPR gRNA sequence
gagagttttactctgttatc

SEQ ID NO: 139999 - DNA, 20 bp, Artificial
  CRISPR gRNA sequence
agagttttactctgttatcc

SEQ ID NO: 140000 - DNA, 20 bp, Artificial
  CRISPR gRNA sequence
ttactctgttatccaggccg

SEQ ID NO: 140001 - DNA, 20 bp, Artificial
  CRISPR gRNA sequence
ctgttatccaggccgcagtg

SEQ ID NO: 140002 - DNA, 20 bp, Artificial
  CRISPR gRNA sequence
ttatccaggccgcagtgcag

SEQ ID NO: 140003 - DNA, 20 bp, Artificial
  CRISPR gRNA sequence
aggccgcagtgcagtggtgc

SEQ ID NO: 140004 - DNA, 20 bp, Artificial
  CRISPR gRNA sequence
gcagtgcagtggtgcgagct

SEQ ID NO: 140005 - DNA, 20 bp, Artificial
  CRISPR gRNA sequence
tcactgcaacctctgcctcc

SEQ ID NO: 140006 - DNA, 20 bp, Artificial
  CRISPR gRNA sequence
cactgcaacctctgcctccc

SEQ ID NO: 140007 - DNA, 20 bp, Artificial
  CRISPR gRNA sequence
caacctctgcctcccaggtt

SEQ ID NO: 140008 - DNA, 20 bp, Artificial
  CRISPR gRNA sequence
aacctctgcctcccaggttc

SEQ ID NO: 140009 - DNA, 20 bp, Artificial
  CRISPR gRNA sequence
ttcaggcaattcccatgcct

SEQ ID NO: 140010 - DNA, 20 bp, Artificial
  CRISPR gRNA sequence
ttcccatgcctcagactccc

SEQ ID NO: 140011 - DNA, 20 bp, Artificial
  CRISPR gRNA sequence
ccatgcctcagactcccgag

SEQ ID NO: 140012 - DNA, 20 bp, Artificial
  CRISPR gRNA sequence
gcctcagactcccgagtagc

SEQ ID NO: 140013 - DNA, 20 bp, Artificial
  CRISPR gRNA sequence
cctcagactcccgagtagct

SEQ ID NO: 140014 - DNA, 20 bp, Artificial
  CRISPR gRNA sequence
ctcccgagtagctaggatta

SEQ ID NO: 140015 - DNA, 20 bp, Artificial
  CRISPR gRNA sequence
tcccgagtagctaggattac

SEQ ID NO: 140016 - DNA, 20 bp, Artificial
  CRISPR gRNA sequence
caggcgcccgccaccacacc

SEQ ID NO: 140017 - DNA, 20 bp, Artificial
  CRISPR gRNA sequence
gctaatttttgtattttttg

SEQ ID NO: 140018 - DNA, 20 bp, Artificial
  CRISPR gRNA sequence
taatttttgtattttttgta

SEQ ID NO: 140019 - DNA, 20 bp, Artificial
  CRISPR gRNA sequence
ttttgtattttttgtagaga

SEQ ID NO: 140020 - DNA, 20 bp, Artificial
  CRISPR gRNA sequence
tttgtattttttgtagagac

SEQ ID NO: 140021 - DNA, 20 bp, Artificial
  CRISPR gRNA sequence
ttgtattttttgtagagaca

SEQ ID NO: 140022 - DNA, 20 bp, Artificial
  CRISPR gRNA sequence
gagacagggtttcaccatgt

SEQ ID NO: 140023 - DNA, 20 bp, Artificial
  CRISPR gRNA sequence
cagggtttcaccatgttggc

SEQ ID NO: 140024 - DNA, 20 bp, Artificial
  CRISPR gRNA sequence
agggtttcaccatgttggcc

SEQ ID NO: 140025 - DNA, 20 bp, Artificial
  CRISPR gRNA sequence
tttcaccatgttggccaggc

SEQ ID NO: 140026 - DNA, 20 bp, Artificial
  CRISPR gRNA sequence
tggtcttgaactcccgacct

SEQ ID NO: 140027 - DNA, 20 bp, Artificial
  CRISPR gRNA sequence
ggtcttgaactcccgacctc

SEQ ID NO: 140028 - DNA, 20 bp, Artificial
  CRISPR gRNA sequence
atgcctgcctctgcctccca

SEQ ID NO: 140029 - DNA, 20 bp, Artificial
  CRISPR gRNA sequence
gcctctgcctcccaaagtgc

SEQ ID NO: 140030 - DNA, 20 bp, Artificial
  CRISPR gRNA sequence
cctctgcctcccaaagtgct

SEQ ID NO: 140031 - DNA, 20 bp, Artificial
  CRISPR gRNA sequence
ctcccaaagtgctgggatta

SEQ ID NO: 140032 - DNA, 20 bp, Artificial
  CRISPR gRNA sequence
tcccaaagtgctgggattac

SEQ ID NO: 140033 - DNA, 20 bp, Artificial
  CRISPR gRNA sequence
agtgctgggattacaggtgt

SEQ ID NO: 140034 - DNA, 20 bp, Artificial
  CRISPR gRNA sequence
caggtgtgagccaccgcatc

SEQ ID NO: 140035 - DNA, 20 bp, Artificial
  CRISPR gRNA sequence
ctggccttttctttcttttt

SEQ ID NO: 140036 - DNA, 20 bp, Artificial
  CRISPR gRNA sequence
ccttttctttctttttgaga

SEQ ID NO: 140037 - DNA, 20 bp, Artificial
  CRISPR gRNA sequence
cttttctttctttttgagac

SEQ ID NO: 140038 - DNA, 20 bp, Artificial
  CRISPR gRNA sequence
ttttctttctttttgagaca

SEQ ID NO: 140039 - DNA, 20 bp, Artificial
  CRISPR gRNA sequence
cagggtctcactctgtcacc

SEQ ID NO: 140040 - DNA, 20 bp, Artificial
  CRISPR gRNA sequence
agggtctcactctgtcaccc

SEQ ID NO: 140041 - DNA, 20 bp, Artificial
  CRISPR gRNA sequence
tctcactctgtcacccaggc

SEQ ID NO: 140042 - DNA, 20 bp, Artificial
  CRISPR gRNA sequence
tcactctgtcacccaggctg

SEQ ID NO: 140043 - DNA, 20 bp, Artificial
  CRISPR gRNA sequence
cactctgtcacccaggctgg

SEQ ID NO: 140044 - DNA, 20 bp, Artificial
  CRISPR gRNA sequence
actctgtcacccaggctgga

SEQ ID NO: 140045 - DNA, 20 bp, Artificial
  CRISPR gRNA sequence
tcacccaggctggagggcaa

SEQ ID NO: 140046 - DNA, 20 bp, Artificial
  CRISPR gRNA sequence
ggagggcaatggcataatca

SEQ ID NO: 140047 - DNA, 20 bp, Artificial
  CRISPR gRNA sequence
ggcataatcacggctcactg

SEQ ID NO: 140048 - DNA, 20 bp, Artificial
  CRISPR gRNA sequence
tcactgtagccttcacctcc

SEQ ID NO: 140049 - DNA, 20 bp, Artificial
  CRISPR gRNA sequence
cactgtagccttcacctccc

SEQ ID NO: 140050 - DNA, 20 bp, Artificial
  CRISPR gRNA sequence
agccttcacctcccaggctt

SEQ ID NO: 140051 - DNA, 20 bp, Artificial
  CRISPR gRNA sequence
cttaagtgatcttcccacct

SEQ ID NO: 140052 - DNA, 20 bp, Artificial
  CRISPR gRNA sequence
tcttcccacctcagcctccc

SEQ ID NO: 140053 - DNA, 20 bp, Artificial
  CRISPR gRNA sequence
tcccacctcagcctcccaag

SEQ ID NO: 140054 - DNA, 20 bp, Artificial
  CRISPR gRNA sequence
acctcagcctcccaagtagc

SEQ ID NO: 140055 - DNA, 20 bp, Artificial
  CRISPR gRNA sequence
cctcagcctcccaagtagct

SEQ ID NO: 140056 - DNA, 20 bp, Artificial
  CRISPR gRNA sequence
ctcccaagtagctgggacta

SEQ ID NO: 140057 - DNA, 20 bp, Artificial
  CRISPR gRNA sequence
tcccaagtagctgggactac

SEQ ID NO: 140058 - DNA, 20 bp, Artificial
  CRISPR gRNA sequence
caggcacgtgccatcatgtc

SEQ ID NO: 140059 - DNA, 20 bp, Artificial
  CRISPR gRNA sequence
cttaatttttaatgtttttt

SEQ ID NO: 140060 - DNA, 20 bp, Artificial
  CRISPR gRNA sequence
taatttttaatgtttttttg

SEQ ID NO: 140061 - DNA, 20 bp, Artificial
  CRISPR gRNA sequence
tttttaatgtttttttggag

SEQ ID NO: 140062 - DNA, 20 bp, Artificial
  CRISPR gRNA sequence
ttttaatgtttttttggagt

SEQ ID NO: 140063 - DNA, 20 bp, Artificial
  CRISPR gRNA sequence
tttaatgtttttttggagtg

SEQ ID NO: 140064 - DNA, 20 bp, Artificial
  CRISPR gRNA sequence
ttaatgtttttttggagtgg

SEQ ID NO: 140065 - DNA, 20 bp, Artificial
  CRISPR gRNA sequence
tgtttttttggagtggggga

SEQ ID NO: 140066 - DNA, 20 bp, Artificial
  CRISPR gRNA sequence
gtttttttggagtgggggac

SEQ ID NO: 140067 - DNA, 20 bp, Artificial
  CRISPR gRNA sequence
caggatctcaccatgttgtc

SEQ ID NO: 140068 - DNA, 20 bp, Artificial
  CRISPR gRNA sequence
aggatctcaccatgttgtcc

SEQ ID NO: 140069 - DNA, 20 bp, Artificial
  CRISPR gRNA sequence
tctcaccatgttgtccaggc

SEQ ID NO: 140070 - DNA, 20 bp, Artificial
  CRISPR gRNA sequence
ccaggctagtcacgaactcc

SEQ ID NO: 140071 - DNA, 20 bp, Artificial
  CRISPR gRNA sequence
caggctagtcacgaactcct

SEQ ID NO: 140072 - DNA, 20 bp, Artificial
  CRISPR gRNA sequence
agtcacgaactcctgggctc

SEQ ID NO: 140073 - DNA, 20 bp, Artificial
  CRISPR gRNA sequence
cacgaactcctgggctcaag

SEQ ID NO: 140074 - DNA, 20 bp, Artificial
  CRISPR gRNA sequence
cctgggctcaagcagtcctc

SEQ ID NO: 140075 - DNA, 20 bp, Artificial
  CRISPR gRNA sequence
ctcaagcagtcctccagcct

SEQ ID NO: 140076 - DNA, 20 bp, Artificial
  CRISPR gRNA sequence
cctccagcctcagcctccca

SEQ ID NO: 140077 - DNA, 20 bp, Artificial
  CRISPR gRNA sequence
gcctcagcctcccaaagtgc

SEQ ID NO: 140078 - DNA, 20 bp, Artificial
  CRISPR gRNA sequence
cctcagcctcccaaagtgct

SEQ ID NO: 140079 - DNA, 20 bp, Artificial
  CRISPR gRNA sequence
gcctcccaaagtgctaggat

SEQ ID NO: 140080 - DNA, 20 bp, Artificial
  CRISPR gRNA sequence
cctcccaaagtgctaggatt

SEQ ID NO: 140081 - DNA, 20 bp, Artificial
  CRISPR gRNA sequence
aaagtgctaggattaggcat

SEQ ID NO: 140082 - DNA, 20 bp, Artificial
  CRISPR gRNA sequence
taggcatgagccaccatgcc

SEQ ID NO: 140083 - DNA, 20 bp, Artificial
  CRISPR gRNA sequence
catgagccaccatgcccagc

SEQ ID NO: 140084 - DNA, 20 bp, Artificial
  CRISPR gRNA sequence
catgcccagctggtatctca

SEQ ID NO: 140085 - DNA, 20 bp, Artificial
  CRISPR gRNA sequence
gtatctcacagttctgttca

SEQ ID NO: 140086 - DNA, 20 bp, Artificial
  CRISPR gRNA sequence
tcacagttctgttcacagtg

SEQ ID NO: 140087 - DNA, 20 bp, Artificial
  CRISPR gRNA sequence
tacatgtatcatcaaatcaa

SEQ ID NO: 140088 - DNA, 20 bp, Artificial
  CRISPR gRNA sequence
acatgtatcatcaaatcaac

SEQ ID NO: 140089 - DNA, 20 bp, Artificial
  CRISPR gRNA sequence
gtatcatcaaatcaacagga

SEQ ID NO: 140090 - DNA, 20 bp, Artificial
  CRISPR gRNA sequence
acaggacagtgccatcatct

SEQ ID NO: 140091 - DNA, 20 bp, Artificial
  CRISPR gRNA sequence
catcatcttagcgtcttaca

SEQ ID NO: 140092 - DNA, 20 bp, Artificial
  CRISPR gRNA sequence
gtttgttgatctgaactctt

SEQ ID NO: 140093 - DNA, 20 bp, Artificial
  CRISPR gRNA sequence
gttctaaccttttgatctat

SEQ ID NO: 140094 - DNA, 20 bp, Artificial
  CRISPR gRNA sequence
tttacatgaataatacttgt

SEQ ID NO: 140095 - DNA, 20 bp, Artificial
  CRISPR gRNA sequence
tacatgaataatacttgtga

SEQ ID NO: 140096 - DNA, 20 bp, Artificial
  CRISPR gRNA sequence
acatgaataatacttgtgag

SEQ ID NO: 140097 - DNA, 20 bp, Artificial
  CRISPR gRNA sequence
catgaataatacttgtgaga

SEQ ID NO: 140098 - DNA, 20 bp, Artificial
  CRISPR gRNA sequence
tacttgtgagagggtttgcg

SEQ ID NO: 140099 - DNA, 20 bp, Artificial
  CRISPR gRNA sequence
acttgtgagagggtttgcgt

SEQ ID NO: 140100 - DNA, 20 bp, Artificial
  CRISPR gRNA sequence
tgagagggtttgcgtgggct

SEQ ID NO: 140101 - DNA, 20 bp, Artificial
  CRISPR gRNA sequence
cttggccatttctgtattcc

SEQ ID NO: 140102 - DNA, 20 bp, Artificial
  CRISPR gRNA sequence
ttggccatttctgtattcct

SEQ ID NO: 140103 - DNA, 20 bp, Artificial
  CRISPR gRNA sequence
ggccatttctgtattcctag

SEQ ID NO: 140104 - DNA, 20 bp, Artificial
  CRISPR gRNA sequence
ctaggagtccatctccatta

SEQ ID NO: 140105 - DNA, 20 bp, Artificial
  CRISPR gRNA sequence
tccatctccattacagatct

SEQ ID NO: 140106 - DNA, 20 bp, Artificial
  CRISPR gRNA sequence
catctccattacagatctca

SEQ ID NO: 140107 - DNA, 20 bp, Artificial
  CRISPR gRNA sequence
tccattacagatctcagaga

SEQ ID NO: 140108 - DNA, 20 bp, Artificial
  CRISPR gRNA sequence
cattacagatctcagagaaa

SEQ ID NO: 140109 - DNA, 20 bp, Artificial
  CRISPR gRNA sequence
attacagatctcagagaaag

SEQ ID NO: 140110 - DNA, 20 bp, Artificial
  CRISPR gRNA sequence
tctttaccactcaaaattaa

SEQ ID NO: 140111 - DNA, 20 bp, Artificial
  CRISPR gRNA sequence
aatagtcttttgtattttca

SEQ ID NO: 140112 - DNA, 20 bp, Artificial
  CRISPR gRNA sequence
gtcttttgtattttcacaga

SEQ ID NO: 140113 - DNA, 20 bp, Artificial
  CRISPR gRNA sequence
cacagaaagctaacaattga

SEQ ID NO: 140114 - DNA, 20 bp, Artificial
  CRISPR gRNA sequence
atagtaattttcccttttat

SEQ ID NO: 140115 - DNA, 20 bp, Artificial
  CRISPR gRNA sequence
attagctcctttcttcctca

SEQ ID NO: 140116 - DNA, 20 bp, Artificial
  CRISPR gRNA sequence
agctcctttcttcctcacag

SEQ ID NO: 140117 - DNA, 20 bp, Artificial
  CRISPR gRNA sequence
cttcctcacagtagccctgt

SEQ ID NO: 140118 - DNA, 20 bp, Artificial
  CRISPR gRNA sequence
cctgtgagatttgatataat

SEQ ID NO: 140119 - DNA, 20 bp, Artificial
  CRISPR gRNA sequence
tttgatataataagaattat

SEQ ID NO: 140120 - DNA, 20 bp, Artificial
  CRISPR gRNA sequence
gaattatcagttccatttta

SEQ ID NO: 140121 - DNA, 20 bp, Artificial
  CRISPR gRNA sequence
cagttccattttacagacaa

SEQ ID NO: 140122 - DNA, 20 bp, Artificial
  CRISPR gRNA sequence
cattttacagacaatggaaa

SEQ ID NO: 140123 - DNA, 20 bp, Artificial
  CRISPR gRNA sequence
agacaatggaaatagacaca

SEQ ID NO: 140124 - DNA, 20 bp, Artificial
  CRISPR gRNA sequence
acaatggaaatagacacaaa

SEQ ID NO: 140125 - DNA, 20 bp, Artificial
  CRISPR gRNA sequence
caatggaaatagacacaaag

SEQ ID NO: 140126 - DNA, 20 bp, Artificial
  CRISPR gRNA sequence
gaaatagacacaaagaggtt

SEQ ID NO: 140127 - DNA, 20 bp, Artificial
  CRISPR gRNA sequence
aagaggttaagtgactcacc

SEQ ID NO: 140128 - DNA, 20 bp, Artificial
  CRISPR gRNA sequence
gaggttaagtgactcaccca

SEQ ID NO: 140129 - DNA, 20 bp, Artificial
  CRISPR gRNA sequence
aagtgactcacccagagtga

SEQ ID NO: 140130 - DNA, 20 bp, Artificial
  CRISPR gRNA sequence
agtgactcacccagagtgat

SEQ ID NO: 140131 - DNA, 20 bp, Artificial
  CRISPR gRNA sequence
tcacccagagtgataggacc

SEQ ID NO: 140132 - DNA, 20 bp, Artificial
  CRISPR gRNA sequence
atctgctgcttctttaactc

SEQ ID NO: 140133 - DNA, 20 bp, Artificial
  CRISPR gRNA sequence
ctgctgcttctttaactcca

SEQ ID NO: 140134 - DNA, 20 bp, Artificial
  CRISPR gRNA sequence
taactccagagctctttctg

SEQ ID NO: 140135 - DNA, 20 bp, Artificial
  CRISPR gRNA sequence
ttctgtggctgtatcctgca

SEQ ID NO: 140136 - DNA, 20 bp, Artificial
  CRISPR gRNA sequence
ctgcacagactacctcacca

SEQ ID NO: 140137 - DNA, 20 bp, Artificial
  CRISPR gRNA sequence
tgcacagactacctcaccaa

SEQ ID NO: 140138 - DNA, 20 bp, Artificial
  CRISPR gRNA sequence
agactacctcaccaaaggtt

SEQ ID NO: 140139 - DNA, 20 bp, Artificial
  CRISPR gRNA sequence
gtttagaaccttgtttgacc

SEQ ID NO: 140140 - DNA, 20 bp, Artificial
  CRISPR gRNA sequence
ttagaaccttgtttgaccaa

SEQ ID NO: 140141 - DNA, 20 bp, Artificial
  CRISPR gRNA sequence
aagagcttcaactttgaaat

SEQ ID NO: 140142 - DNA, 20 bp, Artificial
  CRISPR gRNA sequence
actttgaaatcagacacatc

SEQ ID NO: 140143 - DNA, 20 bp, Artificial
  CRISPR gRNA sequence
tgaaatcagacacatcaaga

SEQ ID NO: 140144 - DNA, 20 bp, Artificial
  CRISPR gRNA sequence
acacatcaagaaagtttata

SEQ ID NO: 140145 - DNA, 20 bp, Artificial
  CRISPR gRNA sequence
caagaaagtttatatggctt

SEQ ID NO: 140146 - DNA, 20 bp, Artificial
  CRISPR gRNA sequence
ttgagcatttcctatatgcc

SEQ ID NO: 140147 - DNA, 20 bp, Artificial
  CRISPR gRNA sequence
atttcctatatgccaagccc

SEQ ID NO: 140148 - DNA, 20 bp, Artificial
  CRISPR gRNA sequence
tttcctatatgccaagccct

SEQ ID NO: 140149 - DNA, 20 bp, Artificial
  CRISPR gRNA sequence
ctatatgccaagccctgggc

SEQ ID NO: 140150 - DNA, 20 bp, Artificial
  CRISPR gRNA sequence
tatatgccaagccctgggct

SEQ ID NO: 140151 - DNA, 20 bp, Artificial
  CRISPR gRNA sequence
gattgccacaataaaactga

SEQ ID NO: 140152 - DNA, 20 bp, Artificial
  CRISPR gRNA sequence
attgccacaataaaactgaa

SEQ ID NO: 140153 - DNA, 20 bp, Artificial
  CRISPR gRNA sequence
tgaaaggttatcctcttttt

SEQ ID NO: 140154 - DNA, 20 bp, Artificial
  CRISPR gRNA sequence
ctctttttcagtacatgaaa

SEQ ID NO: 140155 - DNA, 20 bp, Artificial
  CRISPR gRNA sequence
cagtacatgaaaaagcccaa

SEQ ID NO: 140156 - DNA, 20 bp, Artificial
  CRISPR gRNA sequence
agtacatgaaaaagcccaaa

SEQ ID NO: 140157 - DNA, 20 bp, Artificial
  CRISPR gRNA sequence
catgaaaaagcccaaaagga

SEQ ID NO: 140158 - DNA, 20 bp, Artificial
  CRISPR gRNA sequence
atgaaaaagcccaaaaggat

SEQ ID NO: 140159 - DNA, 20 bp, Artificial
  CRISPR gRNA sequence
aaaaagcccaaaaggatggg

SEQ ID NO: 140160 - DNA, 20 bp, Artificial
  CRISPR gRNA sequence
gcaattttatccaaatccat

SEQ ID NO: 140161 - DNA, 20 bp, Artificial
  CRISPR gRNA sequence
atccaaatccattggctttc

SEQ ID NO: 140162 - DNA, 20 bp, Artificial
  CRISPR gRNA sequence
ttcctcatattgtttctcct

SEQ ID NO: 140163 - DNA, 20 bp, Artificial
  CRISPR gRNA sequence
catattgtttctccttggat

SEQ ID NO: 140164 - DNA, 20 bp, Artificial
  CRISPR gRNA sequence
acctaaaccctgccacttac

SEQ ID NO: 140165 - DNA, 20 bp, Artificial
  CRISPR gRNA sequence
cctgccacttactggctcta

SEQ ID NO: 140166 - DNA, 20 bp, Artificial
  CRISPR gRNA sequence
acttactggctctatggctg

SEQ ID NO: 140167 - DNA, 20 bp, Artificial
  CRISPR gRNA sequence
cttactggctctatggctgt

SEQ ID NO: 140168 - DNA, 20 bp, Artificial
  CRISPR gRNA sequence
ctggctctatggctgtgggc

SEQ ID NO: 140169 - DNA, 20 bp, Artificial
  CRISPR gRNA sequence
acttcatctctcttgacccc

SEQ ID NO: 140170 - DNA, 20 bp, Artificial
  CRISPR gRNA sequence
ttgacccctagtttctttga

SEQ ID NO: 140171 - DNA, 20 bp, Artificial
  CRISPR gRNA sequence
tgacccctagtttctttgaa

SEQ ID NO: 140172 - DNA, 20 bp, Artificial
  CRISPR gRNA sequence
tttctttgaaaggctattat

SEQ ID NO: 140173 - DNA, 20 bp, Artificial
  CRISPR gRNA sequence
tctttgaaaggctattataa

SEQ ID NO: 140174 - DNA, 20 bp, Artificial
  CRISPR gRNA sequence
tgaaaggctattataagagt

SEQ ID NO: 140175 - DNA, 20 bp, Artificial
  CRISPR gRNA sequence
agtaagaaaacaccttgcac

SEQ ID NO: 140176 - DNA, 20 bp, Artificial
  CRISPR gRNA sequence
gtaagaaaacaccttgcaca

SEQ ID NO: 140177 - DNA, 20 bp, Artificial
  CRISPR gRNA sequence
aaaacaccttgcacaaggtt

SEQ ID NO: 140178 - DNA, 20 bp, Artificial
  CRISPR gRNA sequence
cttgcacaaggtttggcgca

SEQ ID NO: 140179 - DNA, 20 bp, Artificial
  CRISPR gRNA sequence
gtttggcgcatggtatgtgc

SEQ ID NO: 140180 - DNA, 20 bp, Artificial
  CRISPR gRNA sequence
gcgcatggtatgtgctagat

SEQ ID NO: 140181 - DNA, 20 bp, Artificial
  CRISPR gRNA sequence
acctgctttgttcccactca

SEQ ID NO: 140182 - DNA, 20 bp, Artificial
  CRISPR gRNA sequence
ctcatggatttattttacct

SEQ ID NO: 140183 - DNA, 20 bp, Artificial
  CRISPR gRNA sequence
attttaccttggaatctctt

SEQ ID NO: 140184 - DNA, 20 bp, Artificial
  CRISPR gRNA sequence
attttttgacccttgcccca

SEQ ID NO: 140185 - DNA, 20 bp, Artificial
  CRISPR gRNA sequence
cttgccccatagtcccatgc

SEQ ID NO: 140186 - DNA, 20 bp, Artificial
  CRISPR gRNA sequence
ttgccccatagtcccatgcc

SEQ ID NO: 140187 - DNA, 20 bp, Artificial
  CRISPR gRNA sequence
atagtcccatgccaggcaat

SEQ ID NO: 140188 - DNA, 20 bp, Artificial
  CRISPR gRNA sequence
tagtcccatgccaggcaatg

SEQ ID NO: 140189 - DNA, 20 bp, Artificial
  CRISPR gRNA sequence
cccatgccaggcaatgaggc

SEQ ID NO: 140190 - DNA, 20 bp, Artificial
  CRISPR gRNA sequence
catgccaggcaatgaggcaa

SEQ ID NO: 140191 - DNA, 20 bp, Artificial
  CRISPR gRNA sequence
ccaggcaatgaggcaagaga

SEQ ID NO: 140192 - DNA, 20 bp, Artificial
  CRISPR gRNA sequence
caatgaggcaagagacagac

SEQ ID NO: 140193 - DNA, 20 bp, Artificial
  CRISPR gRNA sequence
gactggtttgcatgacttgc

SEQ ID NO: 140194 - DNA, 20 bp, Artificial
  CRISPR gRNA sequence
catgacttgctggtgattga

SEQ ID NO: 140195 - DNA, 20 bp, Artificial
  CRISPR gRNA sequence
atgacttgctggtgattgac

SEQ ID NO: 140196 - DNA, 20 bp, Artificial
  CRISPR gRNA sequence
tgacttgctggtgattgaca

SEQ ID NO: 140197 - DNA, 20 bp, Artificial
  CRISPR gRNA sequence
acttgctggtgattgacagg

SEQ ID NO: 140198 - DNA, 20 bp, Artificial
  CRISPR gRNA sequence
cttgctggtgattgacaggg

SEQ ID NO: 140199 - DNA, 20 bp, Artificial
  CRISPR gRNA sequence
ttgctggtgattgacaggga

SEQ ID NO: 140200 - DNA, 20 bp, Artificial
  CRISPR gRNA sequence
gggagggcctgtgtctgtta

SEQ ID NO: 140201 - DNA, 20 bp, Artificial
  CRISPR gRNA sequence
ctgtgtctgttacagatgat

SEQ ID NO: 140202 - DNA, 20 bp, Artificial
  CRISPR gRNA sequence
tctgttacagatgatcagtg

SEQ ID NO: 140203 - DNA, 20 bp, Artificial
  CRISPR gRNA sequence
gttacagatgatcagtgcag

SEQ ID NO: 140204 - DNA, 20 bp, Artificial
  CRISPR gRNA sequence
aagcgcctgtactctttgcc

SEQ ID NO: 140205 - DNA, 20 bp, Artificial
  CRISPR gRNA sequence
agcgcctgtactctttgcca

SEQ ID NO: 140206 - DNA, 20 bp, Artificial
  CRISPR gRNA sequence
gcctgtactctttgccaagg

SEQ ID NO: 140207 - DNA, 20 bp, Artificial
  CRISPR gRNA sequence
tactctttgccaaggcagcc

SEQ ID NO: 140208 - DNA, 20 bp, Artificial
  CRISPR gRNA sequence
ggcagcccagatttttatca

SEQ ID NO: 140209 - DNA, 20 bp, Artificial
  CRISPR gRNA sequence
cagcccagatttttatcaca

SEQ ID NO: 140210 - DNA, 20 bp, Artificial
  CRISPR gRNA sequence
tatcacagagttgactcttc

SEQ ID NO: 140211 - DNA, 20 bp, Artificial
  CRISPR gRNA sequence
cagagttgactcttcgagcc

SEQ ID NO: 140212 - DNA, 20 bp, Artificial
  CRISPR gRNA sequence
tcttcgagcctggattcaca

SEQ ID NO: 140213 - DNA, 20 bp, Artificial
  CRISPR gRNA sequence
tcgagcctggattcacacag

SEQ ID NO: 140214 - DNA, 20 bp, Artificial
  CRISPR gRNA sequence
ggattcacacagaagataac

SEQ ID NO: 140215 - DNA, 20 bp, Artificial
  CRISPR gRNA sequence
acacagaagataacaagcgc

SEQ ID NO: 140216 - DNA, 20 bp, Artificial
  CRISPR gRNA sequence
ataacaagcgccggactcta

SEQ ID NO: 140217 - DNA, 20 bp, Artificial
  CRISPR gRNA sequence
taacaagcgccggactctac

SEQ ID NO: 140218 - DNA, 20 bp, Artificial
  CRISPR gRNA sequence
ggactctacaggtattattg

SEQ ID NO: 140219 - DNA, 20 bp, Artificial
  CRISPR gRNA sequence
tacaggtattattgcagact

SEQ ID NO: 140220 - DNA, 20 bp, Artificial
  CRISPR gRNA sequence
gtattattgcagacttagat

SEQ ID NO: 140221 - DNA, 20 bp, Artificial
  CRISPR gRNA sequence
tattattgcagacttagatt

SEQ ID NO: 140222 - DNA, 20 bp, Artificial
  CRISPR gRNA sequence
cagacttagattaggaaaac

SEQ ID NO: 140223 - DNA, 20 bp, Artificial
  CRISPR gRNA sequence
agacttagattaggaaaact

SEQ ID NO: 140224 - DNA, 20 bp, Artificial
  CRISPR gRNA sequence
gacttagattaggaaaactg

SEQ ID NO: 140225 - DNA, 20 bp, Artificial
  CRISPR gRNA sequence
tagattaggaaaactggggt

SEQ ID NO: 140226 - DNA, 20 bp, Artificial
  CRISPR gRNA sequence
attaggaaaactggggtaag

SEQ ID NO: 140227 - DNA, 20 bp, Artificial
  CRISPR gRNA sequence
aggaaaactggggtaagcag

SEQ ID NO: 140228 - DNA, 20 bp, Artificial
  CRISPR gRNA sequence
cctttgcctgttttcctgcg

SEQ ID NO: 140229 - DNA, 20 bp, Artificial
  CRISPR gRNA sequence
cctgttttcctgcgtggtgt

SEQ ID NO: 140230 - DNA, 20 bp, Artificial
  CRISPR gRNA sequence
tgttttcctgcgtggtgttg

SEQ ID NO: 140231 - DNA, 20 bp, Artificial
  CRISPR gRNA sequence
ttcctgcgtggtgttggaga

SEQ ID NO: 140232 - DNA, 20 bp, Artificial
  CRISPR gRNA sequence
ggagaaagattgttctcctt

SEQ ID NO: 140233 - DNA, 20 bp, Artificial
  CRISPR gRNA sequence
gagaaagattgttctccttt

SEQ ID NO: 140234 - DNA, 20 bp, Artificial
  CRISPR gRNA sequence
attgttctcctttaggacca

SEQ ID NO: 140235 - DNA, 20 bp, Artificial
  CRISPR gRNA sequence
gaccaaagattgttctcctt

SEQ ID NO: 140236 - DNA, 20 bp, Artificial
  CRISPR gRNA sequence
accaaagattgttctccttt

SEQ ID NO: 140237 - DNA, 20 bp, Artificial
  CRISPR gRNA sequence
attgttctcctttaggacca

SEQ ID NO: 140238 - DNA, 20 bp, Artificial
  CRISPR gRNA sequence
gaccaaagattgttctcctt

SEQ ID NO: 140239 - DNA, 20 bp, Artificial
  CRISPR gRNA sequence
accaaagattgttctccttt

SEQ ID NO: 140240 - DNA, 20 bp, Artificial
  CRISPR gRNA sequence
ttctcctttaggcctctatc

SEQ ID NO: 140241 - DNA, 20 bp, Artificial
  CRISPR gRNA sequence
ctatcaagctgacgtgtcat

SEQ ID NO: 140242 - DNA, 20 bp, Artificial
  CRISPR gRNA sequence
gtcattggcatcaccactgt

SEQ ID NO: 140243 - DNA, 20 bp, Artificial
  CRISPR gRNA sequence
tcattggcatcaccactgtt

SEQ ID NO: 140244 - DNA, 20 bp, Artificial
  CRISPR gRNA sequence
attggcatcaccactgttgg

SEQ ID NO: 140245 - DNA, 20 bp, Artificial
  CRISPR gRNA sequence
ttggcatcaccactgttggg

SEQ ID NO: 140246 - DNA, 20 bp, Artificial
  CRISPR gRNA sequence
gcatcaccactgttgggagg

SEQ ID NO: 140247 - DNA, 20 bp, Artificial
  CRISPR gRNA sequence
tgggaggcagacataccttc

SEQ ID NO: 140248 - DNA, 20 bp, Artificial
  CRISPR gRNA sequence
gcagacataccttctagcca

SEQ ID NO: 140249 - DNA, 20 bp, Artificial
  CRISPR gRNA sequence
aatcttaatcaattctctcc

SEQ ID NO: 140250 - DNA, 20 bp, Artificial
  CRISPR gRNA sequence
caattctctcctggttttca

SEQ ID NO: 140251 - DNA, 20 bp, Artificial
  CRISPR gRNA sequence
ctctcctggttttcacagct

SEQ ID NO: 140252 - DNA, 20 bp, Artificial
  CRISPR gRNA sequence
gtgactgaactcttttccct

SEQ ID NO: 140253 - DNA, 20 bp, Artificial
  CRISPR gRNA sequence
ctgaactcttttcccttggt

SEQ ID NO: 140254 - DNA, 20 bp, Artificial
  CRISPR gRNA sequence
tggtgagccctcactataaa

SEQ ID NO: 140255 - DNA, 20 bp, Artificial
  CRISPR gRNA sequence
gtgagccctcactataaaca

SEQ ID NO: 140256 - DNA, 20 bp, Artificial
  CRISPR gRNA sequence
tgagccctcactataaacag

SEQ ID NO: 140257 - DNA, 20 bp, Artificial
  CRISPR gRNA sequence
ctcactataaacagaggctc

SEQ ID NO: 140258 - DNA, 20 bp, Artificial
  CRISPR gRNA sequence
taaacagaggctcaagtgat

SEQ ID NO: 140259 - DNA, 20 bp, Artificial
  CRISPR gRNA sequence
aacagaggctcaagtgataa

SEQ ID NO: 140260 - DNA, 20 bp, Artificial
  CRISPR gRNA sequence
ttccaaacgtaatcaacttc

SEQ ID NO: 140261 - DNA, 20 bp, Artificial
  CRISPR gRNA sequence
aaacgtaatcaacttctggt

SEQ ID NO: 140262 - DNA, 20 bp, Artificial
  CRISPR gRNA sequence
aacgtaatcaacttctggtt

SEQ ID NO: 140263 - DNA, 20 bp, Artificial
  CRISPR gRNA sequence
cgtaatcaacttctggttgg

SEQ ID NO: 140264 - DNA, 20 bp, Artificial
  CRISPR gRNA sequence
aacttctggttgggagcctt

SEQ ID NO: 140265 - DNA, 20 bp, Artificial
  CRISPR gRNA sequence
cttctggttgggagccttga

SEQ ID NO: 140266 - DNA, 20 bp, Artificial
  CRISPR gRNA sequence
ttgggagccttgagagattc

SEQ ID NO: 140267 - DNA, 20 bp, Artificial
  CRISPR gRNA sequence
tgggagccttgagagattcc

SEQ ID NO: 140268 - DNA, 20 bp, Artificial
  CRISPR gRNA sequence
gagccttgagagattccagg

SEQ ID NO: 140269 - DNA, 20 bp, Artificial
  CRISPR gRNA sequence
gagattccaggaagtatcat

SEQ ID NO: 140270 - DNA, 20 bp, Artificial
  CRISPR gRNA sequence
ggaagtatcatcagtctcac

SEQ ID NO: 140271 - DNA, 20 bp, Artificial
  CRISPR gRNA sequence
atcagtctcactagcttcat

SEQ ID NO: 140272 - DNA, 20 bp, Artificial
  CRISPR gRNA sequence
tcagtctcactagcttcatt

SEQ ID NO: 140273 - DNA, 20 bp, Artificial
  CRISPR gRNA sequence
ttaggctttttgttccttgt

SEQ ID NO: 140274 - DNA, 20 bp, Artificial
  CRISPR gRNA sequence
ttgttccttgtcagccttcc

SEQ ID NO: 140275 - DNA, 20 bp, Artificial
  CRISPR gRNA sequence
tgttccttgtcagccttcct

SEQ ID NO: 140276 - DNA, 20 bp, Artificial
  CRISPR gRNA sequence
ttccttgtcagccttcctgg

SEQ ID NO: 140277 - DNA, 20 bp, Artificial
  CRISPR gRNA sequence
tttaattttaatttttaacc

SEQ ID NO: 140278 - DNA, 20 bp, Artificial
  CRISPR gRNA sequence
attcacattcatactgtatg

SEQ ID NO: 140279 - DNA, 20 bp, Artificial
  CRISPR gRNA sequence
tcacattcatactgtatgca

SEQ ID NO: 140280 - DNA, 20 bp, Artificial
  CRISPR gRNA sequence
catactgtatgcagagccct

SEQ ID NO: 140281 - DNA, 20 bp, Artificial
  CRISPR gRNA sequence
gagcccttggtcattgactc

SEQ ID NO: 140282 - DNA, 20 bp, Artificial
  CRISPR gRNA sequence
ctctagaaaccctcacccta

SEQ ID NO: 140283 - DNA, 20 bp, Artificial
  CRISPR gRNA sequence
gaaaccctcaccctatagcc

SEQ ID NO: 140284 - DNA, 20 bp, Artificial
  CRISPR gRNA sequence
ctcaccctatagccaagccc

SEQ ID NO: 140285 - DNA, 20 bp, Artificial
  CRISPR gRNA sequence
tatagccaagccctggctct

SEQ ID NO: 140286 - DNA, 20 bp, Artificial
  CRISPR gRNA sequence
tagccaagccctggctctta

SEQ ID NO: 140287 - DNA, 20 bp, Artificial
  CRISPR gRNA sequence
agccaagccctggctcttag

SEQ ID NO: 140288 - DNA, 20 bp, Artificial
  CRISPR gRNA sequence
aagccctggctcttagagga

SEQ ID NO: 140289 - DNA, 20 bp, Artificial
  CRISPR gRNA sequence
ctcttagaggaaagatttcc

SEQ ID NO: 140290 - DNA, 20 bp, Artificial
  CRISPR gRNA sequence
aggaaagatttcccagatac

SEQ ID NO: 140291 - DNA, 20 bp, Artificial
  CRISPR gRNA sequence
aaagatttcccagatacaag

SEQ ID NO: 140292 - DNA, 20 bp, Artificial
  CRISPR gRNA sequence
gatttcccagatacaagaag

SEQ ID NO: 140293 - DNA, 20 bp, Artificial
  CRISPR gRNA sequence
tttcccagatacaagaagaa

SEQ ID NO: 140294 - DNA, 20 bp, Artificial
  CRISPR gRNA sequence
tacaagaagaagagtgtaac

SEQ ID NO: 140295 - DNA, 20 bp, Artificial
  CRISPR gRNA sequence
agagtgtaacaagtataaaa

SEQ ID NO: 140296 - DNA, 20 bp, Artificial
  CRISPR gRNA sequence
gtgtaacaagtataaaacag

SEQ ID NO: 140297 - DNA, 20 bp, Artificial
  CRISPR gRNA sequence
taacaagtataaaacagtgg

SEQ ID NO: 140298 - DNA, 20 bp, Artificial
  CRISPR gRNA sequence
caagtataaaacagtggtgg

SEQ ID NO: 140299 - DNA, 20 bp, Artificial
  CRISPR gRNA sequence
gtggcagtattttaacaatg

SEQ ID NO: 140300 - DNA, 20 bp, Artificial
  CRISPR gRNA sequence
agtattttaacaatgaagcc

SEQ ID NO: 140301 - DNA, 20 bp, Artificial
  CRISPR gRNA sequence
ttttaacaatgaagccaaga

SEQ ID NO: 140302 - DNA, 20 bp, Artificial
  CRISPR gRNA sequence
cttgtttccctttacctaca

SEQ ID NO: 140303 - DNA, 20 bp, Artificial
  CRISPR gRNA sequence
gtttccctttacctacaaag

SEQ ID NO: 140304 - DNA, 20 bp, Artificial
  CRISPR gRNA sequence
actgaacacccacaatgtgc

SEQ ID NO: 140305 - DNA, 20 bp, Artificial
  CRISPR gRNA sequence
ctgaacacccacaatgtgcc

SEQ ID NO: 140306 - DNA, 20 bp, Artificial
  CRISPR gRNA sequence
caatgtgccgggcacttttc

SEQ ID NO: 140307 - DNA, 20 bp, Artificial
  CRISPR gRNA sequence
aatgtgccgggcacttttct

SEQ ID NO: 140308 - DNA, 20 bp, Artificial
  CRISPR gRNA sequence
ccgggcacttttctaggctc

SEQ ID NO: 140309 - DNA, 20 bp, Artificial
  CRISPR gRNA sequence
cgggcacttttctaggctct

SEQ ID NO: 140310 - DNA, 20 bp, Artificial
  CRISPR gRNA sequence
gggcacttttctaggctctg

SEQ ID NO: 140311 - DNA, 20 bp, Artificial
  CRISPR gRNA sequence
gggattaacgatacacacaa

SEQ ID NO: 140312 - DNA, 20 bp, Artificial
  CRISPR gRNA sequence
cagacaaaaatccttatctg

SEQ ID NO: 140313 - DNA, 20 bp, Artificial
  CRISPR gRNA sequence
agacaaaaatccttatctgt

SEQ ID NO: 140314 - DNA, 20 bp, Artificial
  CRISPR gRNA sequence
caaaaatccttatctgtggg

SEQ ID NO: 140315 - DNA, 20 bp, Artificial
  CRISPR gRNA sequence
tctgtgggaagcctgcattc

SEQ ID NO: 140316 - DNA, 20 bp, Artificial
  CRISPR gRNA sequence
gggaagcctgcattctagta

SEQ ID NO: 140317 - DNA, 20 bp, Artificial
  CRISPR gRNA sequence
cagcttgtcaatgcgtcata

SEQ ID NO: 140318 - DNA, 20 bp, Artificial
  CRISPR gRNA sequence
ttgtcaatgcgtcataaagt

SEQ ID NO: 140319 - DNA, 20 bp, Artificial
  CRISPR gRNA sequence
tgtcaatgcgtcataaagtt

SEQ ID NO: 140320 - DNA, 20 bp, Artificial
  CRISPR gRNA sequence
ttgtgtacattactatatga

SEQ ID NO: 140321 - DNA, 20 bp, Artificial
  CRISPR gRNA sequence
attactatatgaaagtttta

SEQ ID NO: 140322 - DNA, 20 bp, Artificial
  CRISPR gRNA sequence
tgaaagttttaaagcaaaaa

SEQ ID NO: 140323 - DNA, 20 bp, Artificial
  CRISPR gRNA sequence
caaaaaaagcaaaaaatact

SEQ ID NO: 140324 - DNA, 20 bp, Artificial
  CRISPR gRNA sequence
aataaatgatatgcatgttg

SEQ ID NO: 140325 - DNA, 20 bp, Artificial
  CRISPR gRNA sequence
acaaaatttatgttgccttg

SEQ ID NO: 140326 - DNA, 20 bp, Artificial
  CRISPR gRNA sequence
aatttatgttgccttgaagt

SEQ ID NO: 140327 - DNA, 20 bp, Artificial
  CRISPR gRNA sequence
gttgccttgaagttagtctg

SEQ ID NO: 140328 - DNA, 20 bp, Artificial
  CRISPR gRNA sequence
ttgaagttagtctgtggatc

SEQ ID NO: 140329 - DNA, 20 bp, Artificial
  CRISPR gRNA sequence
gaagttagtctgtggatcca

SEQ ID NO: 140330 - DNA, 20 bp, Artificial
  CRISPR gRNA sequence
agttagtctgtggatccaga

SEQ ID NO: 140331 - DNA, 20 bp, Artificial
  CRISPR gRNA sequence
tctgtggatccagagagatc

SEQ ID NO: 140332 - DNA, 20 bp, Artificial
  CRISPR gRNA sequence
gatccagagagatccagtta

SEQ ID NO: 140333 - DNA, 20 bp, Artificial
  CRISPR gRNA sequence
atccagttaaagctcccttc

SEQ ID NO: 140334 - DNA, 20 bp, Artificial
  CRISPR gRNA sequence
agctcccttcaagatcaatt

SEQ ID NO: 140335 - DNA, 20 bp, Artificial
  CRISPR gRNA sequence
ccttcaagatcaattcagat

SEQ ID NO: 140336 - DNA, 20 bp, Artificial
  CRISPR gRNA sequence
attcagattagaaaataaaa

SEQ ID NO: 140337 - DNA, 20 bp, Artificial
  CRISPR gRNA sequence
ttcagattagaaaataaaat

SEQ ID NO: 140338 - DNA, 20 bp, Artificial
  CRISPR gRNA sequence
aataaaataggcaaaacact

SEQ ID NO: 140339 - DNA, 20 bp, Artificial
  CRISPR gRNA sequence
aaataggcaaaacacttgga

SEQ ID NO: 140340 - DNA, 20 bp, Artificial
  CRISPR gRNA sequence
aaaacacttggacagacctt

SEQ ID NO: 140341 - DNA, 20 bp, Artificial
  CRISPR gRNA sequence
tggacagaccttcagaaaaa

SEQ ID NO: 140342 - DNA, 20 bp, Artificial
  CRISPR gRNA sequence
caaatgcccaataaacccat

SEQ ID NO: 140343 - DNA, 20 bp, Artificial
  CRISPR gRNA sequence
atgcccaataaacccatgag

SEQ ID NO: 140344 - DNA, 20 bp, Artificial
  CRISPR gRNA sequence
gagaagatatgcaacatcat

SEQ ID NO: 140345 - DNA, 20 bp, Artificial
  CRISPR gRNA sequence
tatgcaacatcattagtcat

SEQ ID NO: 140346 - DNA, 20 bp, Artificial
  CRISPR gRNA sequence
atgcaacatcattagtcatc

SEQ ID NO: 140347 - DNA, 20 bp, Artificial
  CRISPR gRNA sequence
tgcaacatcattagtcatca

SEQ ID NO: 140348 - DNA, 20 bp, Artificial
  CRISPR gRNA sequence
atcagggaaataaaaaactg

SEQ ID NO: 140349 - DNA, 20 bp, Artificial
  CRISPR gRNA sequence
gggaaataaaaaactgcagt

SEQ ID NO: 140350 - DNA, 20 bp, Artificial
  CRISPR gRNA sequence
agatactgttttacacccac

SEQ ID NO: 140351 - DNA, 20 bp, Artificial
  CRISPR gRNA sequence
ctagaatacctaaaataaaa

SEQ ID NO: 140352 - DNA, 20 bp, Artificial
  CRISPR gRNA sequence
aaaaaagactgacaatacca

SEQ ID NO: 140353 - DNA, 20 bp, Artificial
  CRISPR gRNA sequence
aagactgacaataccacagt

SEQ ID NO: 140354 - DNA, 20 bp, Artificial
  CRISPR gRNA sequence
ctgacaataccacagttggt

SEQ ID NO: 140355 - DNA, 20 bp, Artificial
  CRISPR gRNA sequence
tgacaataccacagttggtg

SEQ ID NO: 140356 - DNA, 20 bp, Artificial
  CRISPR gRNA sequence
caataccacagttggtgagg

SEQ ID NO: 140357 - DNA, 20 bp, Artificial
  CRISPR gRNA sequence
taccacagttggtgaggaag

SEQ ID NO: 140358 - DNA, 20 bp, Artificial
  CRISPR gRNA sequence
ccacagttggtgaggaagtg

SEQ ID NO: 140359 - DNA, 20 bp, Artificial
  CRISPR gRNA sequence
gtctgaaactcatatattgc

SEQ ID NO: 140360 - DNA, 20 bp, Artificial
  CRISPR gRNA sequence
gaaactcatatattgctggt

SEQ ID NO: 140361 - DNA, 20 bp, Artificial
  CRISPR gRNA sequence
atattgctggtcagaatcta

SEQ ID NO: 140362 - DNA, 20 bp, Artificial
  CRISPR gRNA sequence
ttgctggtcagaatctaaag

SEQ ID NO: 140363 - DNA, 20 bp, Artificial
  CRISPR gRNA sequence
tggtcagaatctaaagtggt

SEQ ID NO: 140364 - DNA, 20 bp, Artificial
  CRISPR gRNA sequence
cagaatctaaagtggtcagt

SEQ ID NO: 140365 - DNA, 20 bp, Artificial
  CRISPR gRNA sequence
cagtcagtttgaaaaaatat

SEQ ID NO: 140366 - DNA, 20 bp, Artificial
  CRISPR gRNA sequence
tatccccctactctgtaacc

SEQ ID NO: 140367 - DNA, 20 bp, Artificial
  CRISPR gRNA sequence
taacccagccatttcattcc

SEQ ID NO: 140368 - DNA, 20 bp, Artificial
  CRISPR gRNA sequence
aacccagccatttcattcct

SEQ ID NO: 140369 - DNA, 20 bp, Artificial
  CRISPR gRNA sequence
attcctaggtttgtacccaa

SEQ ID NO: 140370 - DNA, 20 bp, Artificial
  CRISPR gRNA sequence
gtttgtacccaaaagaactg

SEQ ID NO: 140371 - DNA, 20 bp, Artificial
  CRISPR gRNA sequence
tgtttatactacctcaaaac

SEQ ID NO: 140372 - DNA, 20 bp, Artificial
  CRISPR gRNA sequence
ctcaaaactggaaacaactc

SEQ ID NO: 140373 - DNA, 20 bp, Artificial
  CRISPR gRNA sequence
aactcaagtgtccatcaata

SEQ ID NO: 140374 - DNA, 20 bp, Artificial
  CRISPR gRNA sequence
actcaagtgtccatcaatat

SEQ ID NO: 140375 - DNA, 20 bp, Artificial
  CRISPR gRNA sequence
ggaatatataaacaaattct

SEQ ID NO: 140376 - DNA, 20 bp, Artificial
  CRISPR gRNA sequence
gaatatataaacaaattctg

SEQ ID NO: 140377 - DNA, 20 bp, Artificial
  CRISPR gRNA sequence
attctgaggtattgatgaaa

SEQ ID NO: 140378 - DNA, 20 bp, Artificial
  CRISPR gRNA sequence
tgatgaaatggattcctcct

SEQ ID NO: 140379 - DNA, 20 bp, Artificial
  CRISPR gRNA sequence
gattcctcctcagcaataaa

SEQ ID NO: 140380 - DNA, 20 bp, Artificial
  CRISPR gRNA sequence
aaccattgctccatacaaca

SEQ ID NO: 140381 - DNA, 20 bp, Artificial
  CRISPR gRNA sequence
tacaacatggataaatctca

SEQ ID NO: 140382 - DNA, 20 bp, Artificial
  CRISPR gRNA sequence
caaagatactatgttaacaa

SEQ ID NO: 140383 - DNA, 20 bp, Artificial
  CRISPR gRNA sequence
aaagatactatgttaacaaa

SEQ ID NO: 140384 - DNA, 20 bp, Artificial
  CRISPR gRNA sequence
actatgttaacaaaaggaac

SEQ ID NO: 140385 - DNA, 20 bp, Artificial
  CRISPR gRNA sequence
tatgttaacaaaaggaacca

SEQ ID NO: 140386 - DNA, 20 bp, Artificial
  CRISPR gRNA sequence
atgttaacaaaaggaaccag

SEQ ID NO: 140387 - DNA, 20 bp, Artificial
  CRISPR gRNA sequence
tgttaacaaaaggaaccaga

SEQ ID NO: 140388 - DNA, 20 bp, Artificial
  CRISPR gRNA sequence
accagagggaaaaaattaca

SEQ ID NO: 140389 - DNA, 20 bp, Artificial
  CRISPR gRNA sequence
caatgcattattaccaccta

SEQ ID NO: 140390 - DNA, 20 bp, Artificial
  CRISPR gRNA sequence
attattaccacctatagtga

SEQ ID NO: 140391 - DNA, 20 bp, Artificial
  CRISPR gRNA sequence
ccacctatagtgatagaaat

SEQ ID NO: 140392 - DNA, 20 bp, Artificial
  CRISPR gRNA sequence
acctatagtgatagaaatca

SEQ ID NO: 140393 - DNA, 20 bp, Artificial
  CRISPR gRNA sequence
agtgatagaaatcagagttg

SEQ ID NO: 140394 - DNA, 20 bp, Artificial
  CRISPR gRNA sequence
aaatcagagttgtggttgcc

SEQ ID NO: 140395 - DNA, 20 bp, Artificial
  CRISPR gRNA sequence
gagttgtggttgcccagatt

SEQ ID NO: 140396 - DNA, 20 bp, Artificial
  CRISPR gRNA sequence
agttgtggttgcccagattt

SEQ ID NO: 140397 - DNA, 20 bp, Artificial
  CRISPR gRNA sequence
gttgtggttgcccagattta

SEQ ID NO: 140398 - DNA, 20 bp, Artificial
  CRISPR gRNA sequence
ttgtggttgcccagatttag

SEQ ID NO: 140399 - DNA, 20 bp, Artificial
  CRISPR gRNA sequence
gtggttgcccagatttaggg

SEQ ID NO: 140400 - DNA, 20 bp, Artificial
  CRISPR gRNA sequence
tgcccagatttaggggagtg

SEQ ID NO: 140401 - DNA, 20 bp, Artificial
  CRISPR gRNA sequence
gcccagatttaggggagtgt

SEQ ID NO: 140402 - DNA, 20 bp, Artificial
  CRISPR gRNA sequence
cccagatttaggggagtgtg

SEQ ID NO: 140403 - DNA, 20 bp, Artificial
  CRISPR gRNA sequence
agatttaggggagtgtgggg

SEQ ID NO: 140404 - DNA, 20 bp, Artificial
  CRISPR gRNA sequence
gatttaggggagtgtgggga

SEQ ID NO: 140405 - DNA, 20 bp, Artificial
  CRISPR gRNA sequence
gtgtggggaaggatattgac

SEQ ID NO: 140406 - DNA, 20 bp, Artificial
  CRISPR gRNA sequence
ggggaaggatattgactgga

SEQ ID NO: 140407 - DNA, 20 bp, Artificial
  CRISPR gRNA sequence
gggaaggatattgactggaa

SEQ ID NO: 140408 - DNA, 20 bp, Artificial
  CRISPR gRNA sequence
ggaaggatattgactggaaa

SEQ ID NO: 140409 - DNA, 20 bp, Artificial
  CRISPR gRNA sequence
ggatattgactggaaagggc

SEQ ID NO: 140410 - DNA, 20 bp, Artificial
  CRISPR gRNA sequence
tattgactggaaagggctag

SEQ ID NO: 140411 - DNA, 20 bp, Artificial
  CRISPR gRNA sequence
attgactggaaagggctaga

SEQ ID NO: 140412 - DNA, 20 bp, Artificial
  CRISPR gRNA sequence
atattccttttttatttttt

SEQ ID NO: 140413 - DNA, 20 bp, Artificial
  CRISPR gRNA sequence
tccttttttattttttgaga

SEQ ID NO: 140414 - DNA, 20 bp, Artificial
  CRISPR gRNA sequence
ccttttttattttttgagat

SEQ ID NO: 140415 - DNA, 20 bp, Artificial
  CRISPR gRNA sequence
cttttttattttttgagata

SEQ ID NO: 140416 - DNA, 20 bp, Artificial
  CRISPR gRNA sequence
tgagatagggtctcactctg

SEQ ID NO: 140417 - DNA, 20 bp, Artificial
  CRISPR gRNA sequence
tagggtctcactctgtggcc

SEQ ID NO: 140418 - DNA, 20 bp, Artificial
  CRISPR gRNA sequence
agggtctcactctgtggcct

SEQ ID NO: 140419 - DNA, 20 bp, Artificial
  CRISPR gRNA sequence
tctcactctgtggcctaggc

SEQ ID NO: 140420 - DNA, 20 bp, Artificial
  CRISPR gRNA sequence
tcactctgtggcctaggctg

SEQ ID NO: 140421 - DNA, 20 bp, Artificial
  CRISPR gRNA sequence
ctgtggcctaggctggagtg

SEQ ID NO: 140422 - DNA, 20 bp, Artificial
  CRISPR gRNA sequence
tggcctaggctggagtgcag

SEQ ID NO: 140423 - DNA, 20 bp, Artificial
  CRISPR gRNA sequence
ggagtgcagtggcgcaatca

SEQ ID NO: 140424 - DNA, 20 bp, Artificial
  CRISPR gRNA sequence
ggcgcaatcacagctcattg

SEQ ID NO: 140425 - DNA, 20 bp, Artificial
  CRISPR gRNA sequence
tcattgcagcctcgacctcc

SEQ ID NO: 140426 - DNA, 20 bp, Artificial
  CRISPR gRNA sequence
cattgcagcctcgacctcct

SEQ ID NO: 140427 - DNA, 20 bp, Artificial
  CRISPR gRNA sequence
agcctcgacctcctgggctc

SEQ ID NO: 140428 - DNA, 20 bp, Artificial
  CRISPR gRNA sequence
ctcaagtgatcctcccacct

SEQ ID NO: 140429 - DNA, 20 bp, Artificial
  CRISPR gRNA sequence
tcctcccacctcagcctccc

SEQ ID NO: 140430 - DNA, 20 bp, Artificial
  CRISPR gRNA sequence
tcccacctcagcctcccaag

SEQ ID NO: 140431 - DNA, 20 bp, Artificial
  CRISPR gRNA sequence
cctcagcctcccaagtagct

SEQ ID NO: 140432 - DNA, 20 bp, Artificial
  CRISPR gRNA sequence
ctcccaagtagctgagacta

SEQ ID NO: 140433 - DNA, 20 bp, Artificial
  CRISPR gRNA sequence
tcccaagtagctgagactac

SEQ ID NO: 140434 - DNA, 20 bp, Artificial
  CRISPR gRNA sequence
caggtgcatgccaccatatc

SEQ ID NO: 140435 - DNA, 20 bp, Artificial
  CRISPR gRNA sequence
aatttttgttgttgttgttg

SEQ ID NO: 140436 - DNA, 20 bp, Artificial
  CRISPR gRNA sequence
tttttgttgttgttgttgta

SEQ ID NO: 140437 - DNA, 20 bp, Artificial
  CRISPR gRNA sequence
gttgttgttgttgtagagat

SEQ ID NO: 140438 - DNA, 20 bp, Artificial
  CRISPR gRNA sequence
ttgttgttgttgtagagatg

SEQ ID NO: 140439 - DNA, 20 bp, Artificial
  CRISPR gRNA sequence
tgaggccttactatgttgcc

SEQ ID NO: 140440 - DNA, 20 bp, Artificial
  CRISPR gRNA sequence
aggccttactatgttgccca

SEQ ID NO: 140441 - DNA, 20 bp, Artificial
  CRISPR gRNA sequence
cttactatgttgcccagagc

SEQ ID NO: 140442 - DNA, 20 bp, Artificial
  CRISPR gRNA sequence
agagctggtcttgaaactcc

SEQ ID NO: 140443 - DNA, 20 bp, Artificial
  CRISPR gRNA sequence
ggtcttgaaactcctggctc

SEQ ID NO: 140444 - DNA, 20 bp, Artificial
  CRISPR gRNA sequence
ctcaagcgatcctcctgcct

SEQ ID NO: 140445 - DNA, 20 bp, Artificial
  CRISPR gRNA sequence
tcaagcgatcctcctgcctc

SEQ ID NO: 140446 - DNA, 20 bp, Artificial
  CRISPR gRNA sequence
caagcgatcctcctgcctca

SEQ ID NO: 140447 - DNA, 20 bp, Artificial
  CRISPR gRNA sequence
cctgcctcagggaatttaaa

SEQ ID NO: 140448 - DNA, 20 bp, Artificial
  CRISPR gRNA sequence
taaaaagcaaataaaaattt

SEQ ID NO: 140449 - DNA, 20 bp, Artificial
  CRISPR gRNA sequence
aaaaagcaaataaaaatttt

SEQ ID NO: 140450 - DNA, 20 bp, Artificial
  CRISPR gRNA sequence
aagcaaataaaaattttagg

SEQ ID NO: 140451 - DNA, 20 bp, Artificial
  CRISPR gRNA sequence
aattttaggaagaccaactt

SEQ ID NO: 140452 - DNA, 20 bp, Artificial
  CRISPR gRNA sequence
tctatgtttccaaaatactc

SEQ ID NO: 140453 - DNA, 20 bp, Artificial
  CRISPR gRNA sequence
tagaatattttattatatgc

SEQ ID NO: 140454 - DNA, 20 bp, Artificial
  CRISPR gRNA sequence
gaatattttattatatgctg

SEQ ID NO: 140455 - DNA, 20 bp, Artificial
  CRISPR gRNA sequence
cttttattccatcaataaat

SEQ ID NO: 140456 - DNA, 20 bp, Artificial
  CRISPR gRNA sequence
ccatcaataaatgagccatt

SEQ ID NO: 140457 - DNA, 20 bp, Artificial
  CRISPR gRNA sequence
caataaatgagccatttaga

SEQ ID NO: 140458 - DNA, 20 bp, Artificial
  CRISPR gRNA sequence
atgagccatttagatagatt

SEQ ID NO: 140459 - DNA, 20 bp, Artificial
  CRISPR gRNA sequence
agccatttagatagattgag

SEQ ID NO: 140460 - DNA, 20 bp, Artificial
  CRISPR gRNA sequence
aaaaatgtgacactatattg

SEQ ID NO: 140461 - DNA, 20 bp, Artificial
  CRISPR gRNA sequence
atattgtagtcatcttaaat

SEQ ID NO: 140462 - DNA, 20 bp, Artificial
  CRISPR gRNA sequence
tagtcatcttaaatgagttc

SEQ ID NO: 140463 - DNA, 20 bp, Artificial
  CRISPR gRNA sequence
aaatgagttctggcaatctt

SEQ ID NO: 140464 - DNA, 20 bp, Artificial
  CRISPR gRNA sequence
gagttctggcaatcttaaga

SEQ ID NO: 140465 - DNA, 20 bp, Artificial
  CRISPR gRNA sequence
agttctggcaatcttaagat

SEQ ID NO: 140466 - DNA, 20 bp, Artificial
  CRISPR gRNA sequence
tcttaagatgggccctgctt

SEQ ID NO: 140467 - DNA, 20 bp, Artificial
  CRISPR gRNA sequence
aagatgggccctgcttcagt

SEQ ID NO: 140468 - DNA, 20 bp, Artificial
  CRISPR gRNA sequence
agatgggccctgcttcagtt

SEQ ID NO: 140469 - DNA, 20 bp, Artificial
  CRISPR gRNA sequence
atgggccctgcttcagttgg

SEQ ID NO: 140470 - DNA, 20 bp, Artificial
  CRISPR gRNA sequence
tgggccctgcttcagttggg

SEQ ID NO: 140471 - DNA, 20 bp, Artificial
  CRISPR gRNA sequence
gggccctgcttcagttggga

SEQ ID NO: 140472 - DNA, 20 bp, Artificial
  CRISPR gRNA sequence
agttgggagggtttatcgtc

SEQ ID NO: 140473 - DNA, 20 bp, Artificial
  CRISPR gRNA sequence
agggtttatcgtcaagctcg

SEQ ID NO: 140474 - DNA, 20 bp, Artificial
  CRISPR gRNA sequence
tttatcgtcaagctcgtggt

SEQ ID NO: 140475 - DNA, 20 bp, Artificial
  CRISPR gRNA sequence
tcgtcaagctcgtggttggc

SEQ ID NO: 140476 - DNA, 20 bp, Artificial
  CRISPR gRNA sequence
tcaagctcgtggttggcaag

SEQ ID NO: 140477 - DNA, 20 bp, Artificial
  CRISPR gRNA sequence
caagctcgtggttggcaaga

SEQ ID NO: 140478 - DNA, 20 bp, Artificial
  CRISPR gRNA sequence
aagctcgtggttggcaagaa

SEQ ID NO: 140479 - DNA, 20 bp, Artificial
  CRISPR gRNA sequence
ctcgtggttggcaagaaggg

SEQ ID NO: 140480 - DNA, 20 bp, Artificial
  CRISPR gRNA sequence
ggttggcaagaagggcggac

SEQ ID NO: 140481 - DNA, 20 bp, Artificial
  CRISPR gRNA sequence
ttggcaagaagggcggacta

SEQ ID NO: 140482 - DNA, 20 bp, Artificial
  CRISPR gRNA sequence
cggactagagttttgcattt

SEQ ID NO: 140483 - DNA, 20 bp, Artificial
  CRISPR gRNA sequence
gactagagttttgcatttca

SEQ ID NO: 140484 - DNA, 20 bp, Artificial
  CRISPR gRNA sequence
actagagttttgcatttcag

SEQ ID NO: 140485 - DNA, 20 bp, Artificial
  CRISPR gRNA sequence
agttttgcatttcagaggct

SEQ ID NO: 140486 - DNA, 20 bp, Artificial
  CRISPR gRNA sequence
gttttgcatttcagaggctt

SEQ ID NO: 140487 - DNA, 20 bp, Artificial
  CRISPR gRNA sequence
ttttgcatttcagaggcttg

SEQ ID NO: 140488 - DNA, 20 bp, Artificial
  CRISPR gRNA sequence
tcagaggcttggggccatca

SEQ ID NO: 140489 - DNA, 20 bp, Artificial
  CRISPR gRNA sequence
cttggggccatcacagatac

SEQ ID NO: 140490 - DNA, 20 bp, Artificial
  CRISPR gRNA sequence
ttggggccatcacagataca

SEQ ID NO: 140491 - DNA, 20 bp, Artificial
  CRISPR gRNA sequence
tggggccatcacagatacaa

SEQ ID NO: 140492 - DNA, 20 bp, Artificial
  CRISPR gRNA sequence
gccatcacagatacaaggga

SEQ ID NO: 140493 - DNA, 20 bp, Artificial
  CRISPR gRNA sequence
cctctcctgttttgtccgat

SEQ ID NO: 140494 - DNA, 20 bp, Artificial
  CRISPR gRNA sequence
tgtccgatgagtcacctttt

SEQ ID NO: 140495 - DNA, 20 bp, Artificial
  CRISPR gRNA sequence
gtccgatgagtcacctttta

SEQ ID NO: 140496 - DNA, 20 bp, Artificial
  CRISPR gRNA sequence
atgagtcaccttttaaggtg

SEQ ID NO: 140497 - DNA, 20 bp, Artificial
  CRISPR gRNA sequence
accttttaaggtgtggtata

SEQ ID NO: 140498 - DNA, 20 bp, Artificial
  CRISPR gRNA sequence
cttttaaggtgtggtatata

SEQ ID NO: 140499 - DNA, 20 bp, Artificial
  CRISPR gRNA sequence
tgtggtatatagagtttgct

SEQ ID NO: 140500 - DNA, 20 bp, Artificial
  CRISPR gRNA sequence
gtggtatatagagtttgcta

SEQ ID NO: 140501 - DNA, 20 bp, Artificial
  CRISPR gRNA sequence
agtttgctaaggatttctgt

SEQ ID NO: 140502 - DNA, 20 bp, Artificial
  CRISPR gRNA sequence
tagtgtgttaacattttccc

SEQ ID NO: 140503 - DNA, 20 bp, Artificial
  CRISPR gRNA sequence
ttatgaaaaatttcaaacat

SEQ ID NO: 140504 - DNA, 20 bp, Artificial
  CRISPR gRNA sequence
aaaaatttcaaacataagca

SEQ ID NO: 140505 - DNA, 20 bp, Artificial
  CRISPR gRNA sequence
tcaaacataagcaaagttta

SEQ ID NO: 140506 - DNA, 20 bp, Artificial
  CRISPR gRNA sequence
atacctgtatacttacaacc

SEQ ID NO: 140507 - DNA, 20 bp, Artificial
  CRISPR gRNA sequence
tatccctctatccatccttc

SEQ ID NO: 140508 - DNA, 20 bp, Artificial
  CRISPR gRNA sequence
ccttcaagtaatctgttttt

SEQ ID NO: 140509 - DNA, 20 bp, Artificial
  CRISPR gRNA sequence
ctgtttttaagtgcattgta

SEQ ID NO: 140510 - DNA, 20 bp, Artificial
  CRISPR gRNA sequence
ttaacatgcatatcattcac

SEQ ID NO: 140511 - DNA, 20 bp, Artificial
  CRISPR gRNA sequence
gcatatcattcactagcgtt

SEQ ID NO: 140512 - DNA, 20 bp, Artificial
  CRISPR gRNA sequence
ttccttttgctttaaatctt

SEQ ID NO: 140513 - DNA, 20 bp, Artificial
  CRISPR gRNA sequence
tttgctttaaatctttagta

SEQ ID NO: 140514 - DNA, 20 bp, Artificial
  CRISPR gRNA sequence
cttaactatacataatatgt

SEQ ID NO: 140515 - DNA, 20 bp, Artificial
  CRISPR gRNA sequence
ttaactatacataatatgtt

SEQ ID NO: 140516 - DNA, 20 bp, Artificial
  CRISPR gRNA sequence
atacataatatgttgggttt

SEQ ID NO: 140517 - DNA, 20 bp, Artificial
  CRISPR gRNA sequence
tcttttaattttattattca

SEQ ID NO: 140518 - DNA, 20 bp, Artificial
  CRISPR gRNA sequence
ttaattttattattcaaaga

SEQ ID NO: 140519 - DNA, 20 bp, Artificial
  CRISPR gRNA sequence
taattttattattcaaagaa

SEQ ID NO: 140520 - DNA, 20 bp, Artificial
  CRISPR gRNA sequence
ttttattattcaaagaaagg

SEQ ID NO: 140521 - DNA, 20 bp, Artificial
  CRISPR gRNA sequence
aagaaaggaagtatcacact

SEQ ID NO: 140522 - DNA, 20 bp, Artificial
  CRISPR gRNA sequence
gaaaggaagtatcacacttg

SEQ ID NO: 140523 - DNA, 20 bp, Artificial
  CRISPR gRNA sequence
aaggaagtatcacacttgga

SEQ ID NO: 140524 - DNA, 20 bp, Artificial
  CRISPR gRNA sequence
acttggagagaaacccccat

SEQ ID NO: 140525 - DNA, 20 bp, Artificial
  CRISPR gRNA sequence
ttggagagaaacccccatta

SEQ ID NO: 140526 - DNA, 20 bp, Artificial
  CRISPR gRNA sequence
gagagaaacccccattagag

SEQ ID NO: 140527 - DNA, 20 bp, Artificial
  CRISPR gRNA sequence
agagaaacccccattagagc

SEQ ID NO: 140528 - DNA, 20 bp, Artificial
  CRISPR gRNA sequence
acccccattagagcaggtct

SEQ ID NO: 140529 - DNA, 20 bp, Artificial
  CRISPR gRNA sequence
attagagcaggtcttggttt

SEQ ID NO: 140530 - DNA, 20 bp, Artificial
  CRISPR gRNA sequence
ggtcttggtttcagtatcat

SEQ ID NO: 140531 - DNA, 20 bp, Artificial
  CRISPR gRNA sequence
acctctcttgctgctgttca

SEQ ID NO: 140532 - DNA, 20 bp, Artificial
  CRISPR gRNA sequence
atagcacaaactatgaatat

SEQ ID NO: 140533 - DNA, 20 bp, Artificial
  CRISPR gRNA sequence
atgaatatcagaattctcac

SEQ ID NO: 140534 - DNA, 20 bp, Artificial
  CRISPR gRNA sequence
cacaagctatgttttttatt

SEQ ID NO: 140535 - DNA, 20 bp, Artificial
  CRISPR gRNA sequence
acaagctatgttttttattt

SEQ ID NO: 140536 - DNA, 20 bp, Artificial
  CRISPR gRNA sequence
atgttttttatttgggaatt

SEQ ID NO: 140537 - DNA, 20 bp, Artificial
  CRISPR gRNA sequence
gaactgcaatgataaaccca

SEQ ID NO: 140538 - DNA, 20 bp, Artificial
  CRISPR gRNA sequence
caatgataaacccatggttt

SEQ ID NO: 140539 - DNA, 20 bp, Artificial
  CRISPR gRNA sequence
atggtttaagtattgcaatt

SEQ ID NO: 140540 - DNA, 20 bp, Artificial
  CRISPR gRNA sequence
gaattcccaaataaaaatca

SEQ ID NO: 140541 - DNA, 20 bp, Artificial
  CRISPR gRNA sequence
aaataaaaatcatagcttgt

SEQ ID NO: 140542 - DNA, 20 bp, Artificial
  CRISPR gRNA sequence
aatcatagcttgtgagaact

SEQ ID NO: 140543 - DNA, 20 bp, Artificial
  CRISPR gRNA sequence
ttgtgagaacttagtgtata

SEQ ID NO: 140544 - DNA, 20 bp, Artificial
  CRISPR gRNA sequence
gaacttagtgtatatagatc

SEQ ID NO: 140545 - DNA, 20 bp, Artificial
  CRISPR gRNA sequence
tgacttgaaaatgttgcaaa

SEQ ID NO: 140546 - DNA, 20 bp, Artificial
  CRISPR gRNA sequence
gttgcaaaaagttattgaat

SEQ ID NO: 140547 - DNA, 20 bp, Artificial
  CRISPR gRNA sequence
ttgcaaaaagttattgaatt

SEQ ID NO: 140548 - DNA, 20 bp, Artificial
  CRISPR gRNA sequence
aattcaatacttgtgaacca

SEQ ID NO: 140549 - DNA, 20 bp, Artificial
  CRISPR gRNA sequence
attcaatacttgtgaaccaa

SEQ ID NO: 140550 - DNA, 20 bp, Artificial
  CRISPR gRNA sequence
ttcaatacttgtgaaccaaa

SEQ ID NO: 140551 - DNA, 20 bp, Artificial
  CRISPR gRNA sequence
accaaagggaaaatattatt

SEQ ID NO: 140552 - DNA, 20 bp, Artificial
  CRISPR gRNA sequence
ccaaagggaaaatattattt

SEQ ID NO: 140553 - DNA, 20 bp, Artificial
  CRISPR gRNA sequence
caaagggaaaatattattta

SEQ ID NO: 140554 - DNA, 20 bp, Artificial
  CRISPR gRNA sequence
atattatttagggccttaaa

SEQ ID NO: 140555 - DNA, 20 bp, Artificial
  CRISPR gRNA sequence
aacctaactttgctaaccca

SEQ ID NO: 140556 - DNA, 20 bp, Artificial
  CRISPR gRNA sequence
ttgctaacccacagaatgac

SEQ ID NO: 140557 - DNA, 20 bp, Artificial
  CRISPR gRNA sequence
tgaccagaaacctgctaatt

SEQ ID NO: 140558 - DNA, 20 bp, Artificial
  CRISPR gRNA sequence
aacctgctaattgagattac

SEQ ID NO: 140559 - DNA, 20 bp, Artificial
  CRISPR gRNA sequence
acctgctaattgagattact

SEQ ID NO: 140560 - DNA, 20 bp, Artificial
  CRISPR gRNA sequence
ggtttgtaatttgaaaatcg

SEQ ID NO: 140561 - DNA, 20 bp, Artificial
  CRISPR gRNA sequence
gtttgtaatttgaaaatcgc

SEQ ID NO: 140562 - DNA, 20 bp, Artificial
  CRISPR gRNA sequence
tttgtaatttgaaaatcgcg

SEQ ID NO: 140563 - DNA, 20 bp, Artificial
  CRISPR gRNA sequence
tgtaatttgaaaatcgcggg

SEQ ID NO: 140564 - DNA, 20 bp, Artificial
  CRISPR gRNA sequence
taatttgaaaatcgcgggga

SEQ ID NO: 140565 - DNA, 20 bp, Artificial
  CRISPR gRNA sequence
aatttgaaaatcgcggggag

SEQ ID NO: 140566 - DNA, 20 bp, Artificial
  CRISPR gRNA sequence
aaaatcgcggggagaggatc

SEQ ID NO: 140567 - DNA, 20 bp, Artificial
  CRISPR gRNA sequence
atcgcggggagaggatcaag

SEQ ID NO: 140568 - DNA, 20 bp, Artificial
  CRISPR gRNA sequence
tcgcggggagaggatcaagc

SEQ ID NO: 140569 - DNA, 20 bp, Artificial
  CRISPR gRNA sequence
gcggggagaggatcaagcag

SEQ ID NO: 140570 - DNA, 20 bp, Artificial
  CRISPR gRNA sequence
gggagaggatcaagcaggag

SEQ ID NO: 140571 - DNA, 20 bp, Artificial
  CRISPR gRNA sequence
agaggatcaagcaggagtag

SEQ ID NO: 140572 - DNA, 20 bp, Artificial
  CRISPR gRNA sequence
ggatcaagcaggagtagcag

SEQ ID NO: 140573 - DNA, 20 bp, Artificial
  CRISPR gRNA sequence
caagcaggagtagcagtggt

SEQ ID NO: 140574 - DNA, 20 bp, Artificial
  CRISPR gRNA sequence
agcaggagtagcagtggttg

SEQ ID NO: 140575 - DNA, 20 bp, Artificial
  CRISPR gRNA sequence
gcaggagtagcagtggttgg

SEQ ID NO: 140576 - DNA, 20 bp, Artificial
  CRISPR gRNA sequence
agtagcagtggttggaggct

SEQ ID NO: 140577 - DNA, 20 bp, Artificial
  CRISPR gRNA sequence
ggctcagataccccatttta

SEQ ID NO: 140578 - DNA, 20 bp, Artificial
  CRISPR gRNA sequence
gataccccattttacagtgt

SEQ ID NO: 140579 - DNA, 20 bp, Artificial
  CRISPR gRNA sequence
atctctttcttttttgttga

SEQ ID NO: 140580 - DNA, 20 bp, Artificial
  CRISPR gRNA sequence
ttttgttgatggttgcccac

SEQ ID NO: 140581 - DNA, 20 bp, Artificial
  CRISPR gRNA sequence
tttgttgatggttgcccacc

SEQ ID NO: 140582 - DNA, 20 bp, Artificial
  CRISPR gRNA sequence
ccaccaggtctgatcattta

SEQ ID NO: 140583 - DNA, 20 bp, Artificial
  CRISPR gRNA sequence
tctgatcatttaaagtatat

SEQ ID NO: 140584 - DNA, 20 bp, Artificial
  CRISPR gRNA sequence
tcatttaaagtatatgagtt

SEQ ID NO: 140585 - DNA, 20 bp, Artificial
  CRISPR gRNA sequence
gagtttggctgtgcttattt

SEQ ID NO: 140586 - DNA, 20 bp, Artificial
  CRISPR gRNA sequence
ggctgtgcttatttcagctg

SEQ ID NO: 140587 - DNA, 20 bp, Artificial
  CRISPR gRNA sequence
ttcagctgtagacttgcccg

SEQ ID NO: 140588 - DNA, 20 bp, Artificial
  CRISPR gRNA sequence
tcagctgtagacttgcccgt

SEQ ID NO: 140589 - DNA, 20 bp, Artificial
  CRISPR gRNA sequence
tagacttgcccgtaggtgtt

SEQ ID NO: 140590 - DNA, 20 bp, Artificial
  CRISPR gRNA sequence
ttgcccgtaggtgtttagtt

SEQ ID NO: 140591 - DNA, 20 bp, Artificial
  CRISPR gRNA sequence
aggtgtttagtttggcttaa

SEQ ID NO: 140592 - DNA, 20 bp, Artificial
  CRISPR gRNA sequence
aaaagtcgtcttaccttact

SEQ ID NO: 140593 - DNA, 20 bp, Artificial
  CRISPR gRNA sequence
aagtcgtcttaccttacttg

SEQ ID NO: 140594 - DNA, 20 bp, Artificial
  CRISPR gRNA sequence
agtcgtcttaccttacttgg

SEQ ID NO: 140595 - DNA, 20 bp, Artificial
  CRISPR gRNA sequence
gtcgtcttaccttacttgga

SEQ ID NO: 140596 - DNA, 20 bp, Artificial
  CRISPR gRNA sequence
taccttacttggagggtata

SEQ ID NO: 140597 - DNA, 20 bp, Artificial
  CRISPR gRNA sequence
tacttggagggtataaagcc

SEQ ID NO: 140598 - DNA, 20 bp, Artificial
  CRISPR gRNA sequence
gggtataaagccaagtgaac

SEQ ID NO: 140599 - DNA, 20 bp, Artificial
  CRISPR gRNA sequence
caagtgaactagtttctccc

SEQ ID NO: 140600 - DNA, 20 bp, Artificial
  CRISPR gRNA sequence
aagtgaactagtttctcccc

SEQ ID NO: 140601 - DNA, 20 bp, Artificial
  CRISPR gRNA sequence
cacaccgctcttctttgtta

SEQ ID NO: 140602 - DNA, 20 bp, Artificial
  CRISPR gRNA sequence
caccgctcttctttgttaca

SEQ ID NO: 140603 - DNA, 20 bp, Artificial
  CRISPR gRNA sequence
acagagaaatgatatcgcca

SEQ ID NO: 140604 - DNA, 20 bp, Artificial
  CRISPR gRNA sequence
tggcaattacaaaatttgat

SEQ ID NO: 140605 - DNA, 20 bp, Artificial
  CRISPR gRNA sequence
tttctcatcgatattgttcc

SEQ ID NO: 140606 - DNA, 20 bp, Artificial
  CRISPR gRNA sequence
tctcatcgatattgttccaa

SEQ ID NO: 140607 - DNA, 20 bp, Artificial
  CRISPR gRNA sequence
gagatgaactgaaacctcca

SEQ ID NO: 140608 - DNA, 20 bp, Artificial
  CRISPR gRNA sequence
aactgaaacctccaaagcgt

SEQ ID NO: 140609 - DNA, 20 bp, Artificial
  CRISPR gRNA sequence
actgaaacctccaaagcgtc

SEQ ID NO: 140610 - DNA, 20 bp, Artificial
  CRISPR gRNA sequence
aaacctccaaagcgtcaggt

SEQ ID NO: 140611 - DNA, 20 bp, Artificial
  CRISPR gRNA sequence
aaagcgtcaggtgagctgtg

SEQ ID NO: 140612 - DNA, 20 bp, Artificial
  CRISPR gRNA sequence
aagcgtcaggtgagctgtga

SEQ ID NO: 140613 - DNA, 20 bp, Artificial
  CRISPR gRNA sequence
agcgtcaggtgagctgtgaa

SEQ ID NO: 140614 - DNA, 20 bp, Artificial
  CRISPR gRNA sequence
ggtgagctgtgaagggattg

SEQ ID NO: 140615 - DNA, 20 bp, Artificial
  CRISPR gRNA sequence
attgcagttgctgctgactg

SEQ ID NO: 140616 - DNA, 20 bp, Artificial
  CRISPR gRNA sequence
tgcagttgctgctgactgaa

SEQ ID NO: 140617 - DNA, 20 bp, Artificial
  CRISPR gRNA sequence
ctgaagagcgctttgtatac

SEQ ID NO: 140618 - DNA, 20 bp, Artificial
  CRISPR gRNA sequence
agcgctttgtatactggtgt

SEQ ID NO: 140619 - DNA, 20 bp, Artificial
  CRISPR gRNA sequence
cagatacgctccttctctct

SEQ ID NO: 140620 - DNA, 20 bp, Artificial
  CRISPR gRNA sequence
cgctccttctctctcagcac

SEQ ID NO: 140621 - DNA, 20 bp, Artificial
  CRISPR gRNA sequence
ttccttttgcttctcgtttc

SEQ ID NO: 140622 - DNA, 20 bp, Artificial
  CRISPR gRNA sequence
tttgcttctcgtttctagac

SEQ ID NO: 140623 - DNA, 20 bp, Artificial
  CRISPR gRNA sequence
ctccttctgttactcatttc

SEQ ID NO: 140624 - DNA, 20 bp, Artificial
  CRISPR gRNA sequence
atttctggatacttttaact

SEQ ID NO: 140625 - DNA, 20 bp, Artificial
  CRISPR gRNA sequence
cttttaactcagtgcctccg

SEQ ID NO: 140626 - DNA, 20 bp, Artificial
  CRISPR gRNA sequence
ttaactcagtgcctccgaag

SEQ ID NO: 140627 - DNA, 20 bp, Artificial
  CRISPR gRNA sequence
gtgcctccgaagtggtattt

SEQ ID NO: 140628 - DNA, 20 bp, Artificial
  CRISPR gRNA sequence
aagtggtatttcagtgaaaa

SEQ ID NO: 140629 - DNA, 20 bp, Artificial
  CRISPR gRNA sequence
aatagacaaaatgaaaatga

SEQ ID NO: 140630 - DNA, 20 bp, Artificial
  CRISPR gRNA sequence
aaaatgaaaatgaaagactt

SEQ ID NO: 140631 - DNA, 20 bp, Artificial
  CRISPR gRNA sequence
tgaaagactttagttacaaa

SEQ ID NO: 140632 - DNA, 20 bp, Artificial
  CRISPR gRNA sequence
gactttagttacaaatggta

SEQ ID NO: 140633 - DNA, 20 bp, Artificial
  CRISPR gRNA sequence
tagttacaaatggtaaagtt

SEQ ID NO: 140634 - DNA, 20 bp, Artificial
  CRISPR gRNA sequence
ggtaaagttaagctcatttc

SEQ ID NO: 140635 - DNA, 20 bp, Artificial
  CRISPR gRNA sequence
aagctcatttcaagttatct

SEQ ID NO: 140636 - DNA, 20 bp, Artificial
  CRISPR gRNA sequence
agctcatttcaagttatctt

SEQ ID NO: 140637 - DNA, 20 bp, Artificial
  CRISPR gRNA sequence
tcatttcaagttatcttagg

SEQ ID NO: 140638 - DNA, 20 bp, Artificial
  CRISPR gRNA sequence
agttatcttaggaagtctat

SEQ ID NO: 140639 - DNA, 20 bp, Artificial
  CRISPR gRNA sequence
ttatcttaggaagtctatca

SEQ ID NO: 140640 - DNA, 20 bp, Artificial
  CRISPR gRNA sequence
gtctatcagagctcttcatc

SEQ ID NO: 140641 - DNA, 20 bp, Artificial
  CRISPR gRNA sequence
tctatcagagctcttcatct

SEQ ID NO: 140642 - DNA, 20 bp, Artificial
  CRISPR gRNA sequence
tcagagctcttcatctggga

SEQ ID NO: 140643 - DNA, 20 bp, Artificial
  CRISPR gRNA sequence
cagagctcttcatctgggat

SEQ ID NO: 140644 - DNA, 20 bp, Artificial
  CRISPR gRNA sequence
gagctcttcatctgggatag

SEQ ID NO: 140645 - DNA, 20 bp, Artificial
  CRISPR gRNA sequence
ctgggataggagaatattcc

SEQ ID NO: 140646 - DNA, 20 bp, Artificial
  CRISPR gRNA sequence
gataggagaatattcccaga

SEQ ID NO: 140647 - DNA, 20 bp, Artificial
  CRISPR gRNA sequence
agaatattcccagaaagtta

SEQ ID NO: 140648 - DNA, 20 bp, Artificial
  CRISPR gRNA sequence
tcccagaaagttatagattt

SEQ ID NO: 140649 - DNA, 20 bp, Artificial
  CRISPR gRNA sequence
gttatagattttagattttt

SEQ ID NO: 140650 - DNA, 20 bp, Artificial
  CRISPR gRNA sequence
gattttagatttttaagaaa

SEQ ID NO: 140651 - DNA, 20 bp, Artificial
  CRISPR gRNA sequence
aaacagcttctctatgtgca

SEQ ID NO: 140652 - DNA, 20 bp, Artificial
  CRISPR gRNA sequence
cagcttctctatgtgcacag

SEQ ID NO: 140653 - DNA, 20 bp, Artificial
  CRISPR gRNA sequence
tctatgtgcacagtggcatt

SEQ ID NO: 140654 - DNA, 20 bp, Artificial
  CRISPR gRNA sequence
tatgtgcacagtggcatttg

SEQ ID NO: 140655 - DNA, 20 bp, Artificial
  CRISPR gRNA sequence
acagtggcatttggagtgaa

SEQ ID NO: 140656 - DNA, 20 bp, Artificial
  CRISPR gRNA sequence
ttttctcttcctctatattg

SEQ ID NO: 140657 - DNA, 20 bp, Artificial
  CRISPR gRNA sequence
tggttcattatatctttata

SEQ ID NO: 140658 - DNA, 20 bp, Artificial
  CRISPR gRNA sequence
atagtaccctgactgcacac

SEQ ID NO: 140659 - DNA, 20 bp, Artificial
  CRISPR gRNA sequence
tgcacactagaatcacctgt

SEQ ID NO: 140660 - DNA, 20 bp, Artificial
  CRISPR gRNA sequence
gcacactagaatcacctgtt

SEQ ID NO: 140661 - DNA, 20 bp, Artificial
  CRISPR gRNA sequence
cacactagaatcacctgttg

SEQ ID NO: 140662 - DNA, 20 bp, Artificial
  CRISPR gRNA sequence
tgttggggttttaaaaatat

SEQ ID NO: 140663 - DNA, 20 bp, Artificial
  CRISPR gRNA sequence
gttttaaaaatatcagcgcc

SEQ ID NO: 140664 - DNA, 20 bp, Artificial
  CRISPR gRNA sequence
ttttaaaaatatcagcgccc

SEQ ID NO: 140665 - DNA, 20 bp, Artificial
  CRISPR gRNA sequence
gcccaggctctaacccacat

SEQ ID NO: 140666 - DNA, 20 bp, Artificial
  CRISPR gRNA sequence
ctaacccacatcagctgaat

SEQ ID NO: 140667 - DNA, 20 bp, Artificial
  CRISPR gRNA sequence
gctgaatcagaatctcatga

SEQ ID NO: 140668 - DNA, 20 bp, Artificial
  CRISPR gRNA sequence
tgaatcagaatctcatgatg

SEQ ID NO: 140669 - DNA, 20 bp, Artificial
  CRISPR gRNA sequence
cagaatctcatgatggagcc

SEQ ID NO: 140670 - DNA, 20 bp, Artificial
  CRISPR gRNA sequence
agaatctcatgatggagccc

SEQ ID NO: 140671 - DNA, 20 bp, Artificial
  CRISPR gRNA sequence
tcatgatggagcccaggcat

SEQ ID NO: 140672 - DNA, 20 bp, Artificial
  CRISPR gRNA sequence
cagtaccttttaaaactccc

SEQ ID NO: 140673 - DNA, 20 bp, Artificial
  CRISPR gRNA sequence
ccctggatgcttttaatgtg

SEQ ID NO: 140674 - DNA, 20 bp, Artificial
  CRISPR gRNA sequence
ggatgcttttaatgtgcagt

SEQ ID NO: 140675 - DNA, 20 bp, Artificial
  CRISPR gRNA sequence
tttaatgtgcagtcagattt

SEQ ID NO: 140676 - DNA, 20 bp, Artificial
  CRISPR gRNA sequence
agatttgagaaccaccactt

SEQ ID NO: 140677 - DNA, 20 bp, Artificial
  CRISPR gRNA sequence
caccacttgagctgttttgc

SEQ ID NO: 140678 - DNA, 20 bp, Artificial
  CRISPR gRNA sequence
gctgttttgcaagcaatcac

SEQ ID NO: 140679 - DNA, 20 bp, Artificial
  CRISPR gRNA sequence
ttttgcaagcaatcacaaga

SEQ ID NO: 140680 - DNA, 20 bp, Artificial
  CRISPR gRNA sequence
cttctgcctgcccctctcca

SEQ ID NO: 140681 - DNA, 20 bp, Artificial
  CRISPR gRNA sequence
ttctgcctgcccctctccaa

SEQ ID NO: 140682 - DNA, 20 bp, Artificial
  CRISPR gRNA sequence
cccctctccaaaggtcacac

SEQ ID NO: 140683 - DNA, 20 bp, Artificial
  CRISPR gRNA sequence
ggtcacactagttgtttttt

SEQ ID NO: 140684 - DNA, 20 bp, Artificial
  CRISPR gRNA sequence
tagttgttttttcagcacct

SEQ ID NO: 140685 - DNA, 20 bp, Artificial
  CRISPR gRNA sequence
agttgttttttcagcacctt

SEQ ID NO: 140686 - DNA, 20 bp, Artificial
  CRISPR gRNA sequence
ttcagcaccttgggtgcata

SEQ ID NO: 140687 - DNA, 20 bp, Artificial
  CRISPR gRNA sequence
gctcttaattgtgattgtaa

SEQ ID NO: 140688 - DNA, 20 bp, Artificial
  CRISPR gRNA sequence
tgtaatagacctctgtcctt

SEQ ID NO: 140689 - DNA, 20 bp, Artificial
  CRISPR gRNA sequence
taatagacctctgtccttta

SEQ ID NO: 140690 - DNA, 20 bp, Artificial
  CRISPR gRNA sequence
cctttagagctcattgtttt

SEQ ID NO: 140691 - DNA, 20 bp, Artificial
  CRISPR gRNA sequence
agctcattgttttaagcatg

SEQ ID NO: 140692 - DNA, 20 bp, Artificial
  CRISPR gRNA sequence
atgcagattgcatgattcac

SEQ ID NO: 140693 - DNA, 20 bp, Artificial
  CRISPR gRNA sequence
tgcagattgcatgattcact

SEQ ID NO: 140694 - DNA, 20 bp, Artificial
  CRISPR gRNA sequence
atgattcactaggtgccact

SEQ ID NO: 140695 - DNA, 20 bp, Artificial
  CRISPR gRNA sequence
tgattcactaggtgccactt

SEQ ID NO: 140696 - DNA, 20 bp, Artificial
  CRISPR gRNA sequence
aggtgccacttgggaaattg

SEQ ID NO: 140697 - DNA, 20 bp, Artificial
  CRISPR gRNA sequence
tgccacttgggaaattgtgg

SEQ ID NO: 140698 - DNA, 20 bp, Artificial
  CRISPR gRNA sequence
gaaattgtggcagaatctca

SEQ ID NO: 140699 - DNA, 20 bp, Artificial
  CRISPR gRNA sequence
aaattgtggcagaatctcac

SEQ ID NO: 140700 - DNA, 20 bp, Artificial
  CRISPR gRNA sequence
attgtggcagaatctcacag

SEQ ID NO: 140701 - DNA, 20 bp, Artificial
  CRISPR gRNA sequence
ggcagaatctcacaggagca

SEQ ID NO: 140702 - DNA, 20 bp, Artificial
  CRISPR gRNA sequence
atttttaatgaattatttca

SEQ ID NO: 140703 - DNA, 20 bp, Artificial
  CRISPR gRNA sequence
atttcatagtatattatcct

SEQ ID NO: 140704 - DNA, 20 bp, Artificial
  CRISPR gRNA sequence
tcatagtatattatccttag

SEQ ID NO: 140705 - DNA, 20 bp, Artificial
  CRISPR gRNA sequence
tagtatattatccttagaag

SEQ ID NO: 140706 - DNA, 20 bp, Artificial
  CRISPR gRNA sequence
tatccttagaagcagtcatt

SEQ ID NO: 140707 - DNA, 20 bp, Artificial
  CRISPR gRNA sequence
tagaagcagtcattcagtga

SEQ ID NO: 140708 - DNA, 20 bp, Artificial
  CRISPR gRNA sequence
gacagccattctccccatcc

SEQ ID NO: 140709 - DNA, 20 bp, Artificial
  CRISPR gRNA sequence
tcccagcctgtattaataac

SEQ ID NO: 140710 - DNA, 20 bp, Artificial
  CRISPR gRNA sequence
agcctgtattaataaccagt

SEQ ID NO: 140711 - DNA, 20 bp, Artificial
  CRISPR gRNA sequence
cctgtattaataaccagtca

SEQ ID NO: 140712 - DNA, 20 bp, Artificial
  CRISPR gRNA sequence
tattaataaccagtcagaga

SEQ ID NO: 140713 - DNA, 20 bp, Artificial
  CRISPR gRNA sequence
ataaccagtcagagaaagtc

SEQ ID NO: 140714 - DNA, 20 bp, Artificial
  CRISPR gRNA sequence
taaccagtcagagaaagtct

SEQ ID NO: 140715 - DNA, 20 bp, Artificial
  CRISPR gRNA sequence
accagtcagagaaagtctag

SEQ ID NO: 140716 - DNA, 20 bp, Artificial
  CRISPR gRNA sequence
agtcagagaaagtctaggag

SEQ ID NO: 140717 - DNA, 20 bp, Artificial
  CRISPR gRNA sequence
cagagaaagtctaggagaag

SEQ ID NO: 140718 - DNA, 20 bp, Artificial
  CRISPR gRNA sequence
agagaaagtctaggagaagt

SEQ ID NO: 140719 - DNA, 20 bp, Artificial
  CRISPR gRNA sequence
ttgtaattctgaccctgcat

SEQ ID NO: 140720 - DNA, 20 bp, Artificial
  CRISPR gRNA sequence
tgtaattctgaccctgcatg

SEQ ID NO: 140721 - DNA, 20 bp, Artificial
  CRISPR gRNA sequence
gtaattctgaccctgcatga

SEQ ID NO: 140722 - DNA, 20 bp, Artificial
  CRISPR gRNA sequence
tgaccctgcatgagggcctt

SEQ ID NO: 140723 - DNA, 20 bp, Artificial
  CRISPR gRNA sequence
ctgcatgagggcctttggat

SEQ ID NO: 140724 - DNA, 20 bp, Artificial
  CRISPR gRNA sequence
atgagggcctttggattagc

SEQ ID NO: 140725 - DNA, 20 bp, Artificial
  CRISPR gRNA sequence
gccctctgtcacctccttac

SEQ ID NO: 140726 - DNA, 20 bp, Artificial
  CRISPR gRNA sequence
cctctgtcacctccttacta

SEQ ID NO: 140727 - DNA, 20 bp, Artificial
  CRISPR gRNA sequence
ctgtcacctccttactagag

SEQ ID NO: 140728 - DNA, 20 bp, Artificial
  CRISPR gRNA sequence
tgtcacctccttactagagt

SEQ ID NO: 140729 - DNA, 20 bp, Artificial
  CRISPR gRNA sequence
gtcacctccttactagagta

SEQ ID NO: 140730 - DNA, 20 bp, Artificial
  CRISPR gRNA sequence
cactgcgtctccgttctttc

SEQ ID NO: 140731 - DNA, 20 bp, Artificial
  CRISPR gRNA sequence
actgcgtctccgttctttct

SEQ ID NO: 140732 - DNA, 20 bp, Artificial
  CRISPR gRNA sequence
gcgtctccgttctttctggg

SEQ ID NO: 140733 - DNA, 20 bp, Artificial
  CRISPR gRNA sequence
ctactgtaaacatccttgac

SEQ ID NO: 140734 - DNA, 20 bp, Artificial
  CRISPR gRNA sequence
ctgtaaacatccttgactgg

SEQ ID NO: 140735 - DNA, 20 bp, Artificial
  CRISPR gRNA sequence
catccttgactggaagctgt

SEQ ID NO: 140736 - DNA, 20 bp, Artificial
  CRISPR gRNA sequence
atccttgactggaagctgta

SEQ ID NO: 140737 - DNA, 20 bp, Artificial
  CRISPR gRNA sequence
actggaagctgtaaggtgtt

SEQ ID NO: 140738 - DNA, 20 bp, Artificial
  CRISPR gRNA sequence
tggaagctgtaaggtgttca

SEQ ID NO: 140739 - DNA, 20 bp, Artificial
  CRISPR gRNA sequence
ggaagctgtaaggtgttcag

SEQ ID NO: 140740 - DNA, 20 bp, Artificial
  CRISPR gRNA sequence
aagctgtaaggtgttcagag

SEQ ID NO: 140741 - DNA, 20 bp, Artificial
  CRISPR gRNA sequence
aaggtgttcagaggagcttt

SEQ ID NO: 140742 - DNA, 20 bp, Artificial
  CRISPR gRNA sequence
tgttcagaggagctttcagt

SEQ ID NO: 140743 - DNA, 20 bp, Artificial
  CRISPR gRNA sequence
agctttcagtcggatgttta

SEQ ID NO: 140744 - DNA, 20 bp, Artificial
  CRISPR gRNA sequence
tttcagtcggatgtttacag

SEQ ID NO: 140745 - DNA, 20 bp, Artificial
  CRISPR gRNA sequence
cagtcggatgtttacagcgg

SEQ ID NO: 140746 - DNA, 20 bp, Artificial
  CRISPR gRNA sequence
agtcggatgtttacagcggc

SEQ ID NO: 140747 - DNA, 20 bp, Artificial
  CRISPR gRNA sequence
tttacagcggcaggctgcca

SEQ ID NO: 140748 - DNA, 20 bp, Artificial
  CRISPR gRNA sequence
caggctgccacggtcgtccc

SEQ ID NO: 140749 - DNA, 20 bp, Artificial
  CRISPR gRNA sequence
ggtcgtccccagctacgcac

SEQ ID NO: 140750 - DNA, 20 bp, Artificial
  CRISPR gRNA sequence
gcaccggctttgaaacattg

SEQ ID NO: 140751 - DNA, 20 bp, Artificial
  CRISPR gRNA sequence
caccggctttgaaacattgc

SEQ ID NO: 140752 - DNA, 20 bp, Artificial
  CRISPR gRNA sequence
acattgcaggtttgtgccca

SEQ ID NO: 140753 - DNA, 20 bp, Artificial
  CRISPR gRNA sequence
cattgcaggtttgtgcccac

SEQ ID NO: 140754 - DNA, 20 bp, Artificial
  CRISPR gRNA sequence
acaggctcaattcctcctct

SEQ ID NO: 140755 - DNA, 20 bp, Artificial
  CRISPR gRNA sequence
caggctcaattcctcctctt

SEQ ID NO: 140756 - DNA, 20 bp, Artificial
  CRISPR gRNA sequence
aggctcaattcctcctcttg

SEQ ID NO: 140757 - DNA, 20 bp, Artificial
  CRISPR gRNA sequence
ggctcaattcctcctcttgg

SEQ ID NO: 140758 - DNA, 20 bp, Artificial
  CRISPR gRNA sequence
ggggtccttccctcctctct

SEQ ID NO: 140759 - DNA, 20 bp, Artificial
  CRISPR gRNA sequence
gtccttccctcctctctcag

SEQ ID NO: 140760 - DNA, 20 bp, Artificial
  CRISPR gRNA sequence
cctctctcagaagtcacaac

SEQ ID NO: 140761 - DNA, 20 bp, Artificial
  CRISPR gRNA sequence
cagaagtcacaacaagaact

SEQ ID NO: 140762 - DNA, 20 bp, Artificial
  CRISPR gRNA sequence
agaagtcacaacaagaactc

SEQ ID NO: 140763 - DNA, 20 bp, Artificial
  CRISPR gRNA sequence
tcaggccatttatcttcctt

SEQ ID NO: 140764 - DNA, 20 bp, Artificial
  CRISPR gRNA sequence
atttatcttccttcagaaca

SEQ ID NO: 140765 - DNA, 20 bp, Artificial
  CRISPR gRNA sequence
ttatcttccttcagaacaaa

SEQ ID NO: 140766 - DNA, 20 bp, Artificial
  CRISPR gRNA sequence
tgttttctccttttgtctat

SEQ ID NO: 140767 - DNA, 20 bp, Artificial
  CRISPR gRNA sequence
tttctccttttgtctatcag

SEQ ID NO: 140768 - DNA, 20 bp, Artificial
  CRISPR gRNA sequence
tcagaagccccctttaaaac

SEQ ID NO: 140769 - DNA, 20 bp, Artificial
  CRISPR gRNA sequence
cccctttaaaacaagattgt

SEQ ID NO: 140770 - DNA, 20 bp, Artificial
  CRISPR gRNA sequence
tgtgagctctgtgatgaaat

SEQ ID NO: 140771 - DNA, 20 bp, Artificial
  CRISPR gRNA sequence
gtgagctctgtgatgaaatc

SEQ ID NO: 140772 - DNA, 20 bp, Artificial
  CRISPR gRNA sequence
tgctaactccttgttttctg

SEQ ID NO: 140773 - DNA, 20 bp, Artificial
  CRISPR gRNA sequence
gctaactccttgttttctgt

SEQ ID NO: 140774 - DNA, 20 bp, Artificial
  CRISPR gRNA sequence
gggctgcctgctgaatacac

SEQ ID NO: 140775 - DNA, 20 bp, Artificial
  CRISPR gRNA sequence
tgcctgctgaatacactggc

SEQ ID NO: 140776 - DNA, 20 bp, Artificial
  CRISPR gRNA sequence
cctgctgaatacactggctg

SEQ ID NO: 140777 - DNA, 20 bp, Artificial
  CRISPR gRNA sequence
tgctgaatacactggctgga

SEQ ID NO: 140778 - DNA, 20 bp, Artificial
  CRISPR gRNA sequence
tgaatacactggctggagag

SEQ ID NO: 140779 - DNA, 20 bp, Artificial
  CRISPR gRNA sequence
gaatacactggctggagaga

SEQ ID NO: 140780 - DNA, 20 bp, Artificial
  CRISPR gRNA sequence
aatacactggctggagagaa

SEQ ID NO: 140781 - DNA, 20 bp, Artificial
  CRISPR gRNA sequence
agagaagggtcacatcctgt

SEQ ID NO: 140782 - DNA, 20 bp, Artificial
  CRISPR gRNA sequence
gtcagttcctccaaattcct

SEQ ID NO: 140783 - DNA, 20 bp, Artificial
  CRISPR gRNA sequence
tccaaattcctcagtgcttc

SEQ ID NO: 140784 - DNA, 20 bp, Artificial
  CRISPR gRNA sequence
ccaaattcctcagtgcttct

SEQ ID NO: 140785 - DNA, 20 bp, Artificial
  CRISPR gRNA sequence
ctcagtgcttctgggtctct

SEQ ID NO: 140786 - DNA, 20 bp, Artificial
  CRISPR gRNA sequence
tcagtgcttctgggtctctc

SEQ ID NO: 140787 - DNA, 20 bp, Artificial
  CRISPR gRNA sequence
cagtgcttctgggtctctcg

SEQ ID NO: 140788 - DNA, 20 bp, Artificial
  CRISPR gRNA sequence
gggtctctcggggtgtcata

SEQ ID NO: 140789 - DNA, 20 bp, Artificial
  CRISPR gRNA sequence
tacagctccttattccatct

SEQ ID NO: 140790 - DNA, 20 bp, Artificial
  CRISPR gRNA sequence
gctccttattccatcttagc

SEQ ID NO: 140791 - DNA, 20 bp, Artificial
  CRISPR gRNA sequence
ctatgatccatctgatttta

SEQ ID NO: 140792 - DNA, 20 bp, Artificial
  CRISPR gRNA sequence
atctgattttaaagtgtgtc

SEQ ID NO: 140793 - DNA, 20 bp, Artificial
  CRISPR gRNA sequence
taaagtgtgtctagctgaaa

SEQ ID NO: 140794 - DNA, 20 bp, Artificial
  CRISPR gRNA sequence
tgaaacagcttcttgttgct

SEQ ID NO: 140795 - DNA, 20 bp, Artificial
  CRISPR gRNA sequence
agcttcttgttgcttggatt

SEQ ID NO: 140796 - DNA, 20 bp, Artificial
  CRISPR gRNA sequence
tgcttggatttagttctttg

SEQ ID NO: 140797 - DNA, 20 bp, Artificial
  CRISPR gRNA sequence
gcttggatttagttctttgt

SEQ ID NO: 140798 - DNA, 20 bp, Artificial
  CRISPR gRNA sequence
ttagttctttgtaggtgttc

SEQ ID NO: 140799 - DNA, 20 bp, Artificial
  CRISPR gRNA sequence
tagttctttgtaggtgttcg

SEQ ID NO: 140800 - DNA, 20 bp, Artificial
  CRISPR gRNA sequence
taggtgttcgaggcattgat

SEQ ID NO: 140801 - DNA, 20 bp, Artificial
  CRISPR gRNA sequence
gcattgattggcatcgtatt

SEQ ID NO: 140802 - DNA, 20 bp, Artificial
  CRISPR gRNA sequence
cattgattggcatcgtattc

SEQ ID NO: 140803 - DNA, 20 bp, Artificial
  CRISPR gRNA sequence
gattggcatcgtattcggga

SEQ ID NO: 140804 - DNA, 20 bp, Artificial
  CRISPR gRNA sequence
tattcgggacagctgctgcc

SEQ ID NO: 140805 - DNA, 20 bp, Artificial
  CRISPR gRNA sequence
agctgctgcctggcctttga

SEQ ID NO: 140806 - DNA, 20 bp, Artificial
  CRISPR gRNA sequence
gctgctgcctggcctttgaa

SEQ ID NO: 140807 - DNA, 20 bp, Artificial
  CRISPR gRNA sequence
tgcctggcctttgaaaggtt

SEQ ID NO: 140808 - DNA, 20 bp, Artificial
  CRISPR gRNA sequence
tgaaaggttgagattgctga

SEQ ID NO: 140809 - DNA, 20 bp, Artificial
  CRISPR gRNA sequence
aggttgagattgctgaaagc

SEQ ID NO: 140810 - DNA, 20 bp, Artificial
  CRISPR gRNA sequence
gaaagctggcctgaaattct

SEQ ID NO: 140811 - DNA, 20 bp, Artificial
  CRISPR gRNA sequence
gctggcctgaaattctaaga

SEQ ID NO: 140812 - DNA, 20 bp, Artificial
  CRISPR gRNA sequence
atagcatttttaatcctctg

SEQ ID NO: 140813 - DNA, 20 bp, Artificial
  CRISPR gRNA sequence
tttaatcctctgtagacatg

SEQ ID NO: 140814 - DNA, 20 bp, Artificial
  CRISPR gRNA sequence
ctgtagacatgaagttttcc

SEQ ID NO: 140815 - DNA, 20 bp, Artificial
  CRISPR gRNA sequence
tgtagacatgaagttttccc

SEQ ID NO: 140816 - DNA, 20 bp, Artificial
  CRISPR gRNA sequence
agttttcccaggcttcaaat

SEQ ID NO: 140817 - DNA, 20 bp, Artificial
  CRISPR gRNA sequence
ttcccaggcttcaaattggc

SEQ ID NO: 140818 - DNA, 20 bp, Artificial
  CRISPR gRNA sequence
aaattggctggcacctccta

SEQ ID NO: 140819 - DNA, 20 bp, Artificial
  CRISPR gRNA sequence
tccaaaacccaccctttctg

SEQ ID NO: 140820 - DNA, 20 bp, Artificial
  CRISPR gRNA sequence
ccaaaacccaccctttctga

SEQ ID NO: 140821 - DNA, 20 bp, Artificial
  CRISPR gRNA sequence
aaaacccaccctttctgaag

SEQ ID NO: 140822 - DNA, 20 bp, Artificial
  CRISPR gRNA sequence
aaacccaccctttctgaagg

SEQ ID NO: 140823 - DNA, 20 bp, Artificial
  CRISPR gRNA sequence
cccaccctttctgaaggagg

SEQ ID NO: 140824 - DNA, 20 bp, Artificial
  CRISPR gRNA sequence
accctttctgaaggaggcag

SEQ ID NO: 140825 - DNA, 20 bp, Artificial
  CRISPR gRNA sequence
gcagttcactcttgctacta

SEQ ID NO: 140826 - DNA, 20 bp, Artificial
  CRISPR gRNA sequence
aaagcgaatgtacttttttc

SEQ ID NO: 140827 - DNA, 20 bp, Artificial
  CRISPR gRNA sequence
cgaatgtacttttttccagt

SEQ ID NO: 140828 - DNA, 20 bp, Artificial
  CRISPR gRNA sequence
gaatgtacttttttccagtc

SEQ ID NO: 140829 - DNA, 20 bp, Artificial
  CRISPR gRNA sequence
aatgtacttttttccagtca

SEQ ID NO: 140830 - DNA, 20 bp, Artificial
  CRISPR gRNA sequence
tacttttttccagtcagggc

SEQ ID NO: 140831 - DNA, 20 bp, Artificial
  CRISPR gRNA sequence
gggctggttgcacaacactg

SEQ ID NO: 140832 - DNA, 20 bp, Artificial
  CRISPR gRNA sequence
gctggttgcacaacactgta

SEQ ID NO: 140833 - DNA, 20 bp, Artificial
  CRISPR gRNA sequence
gttgcacaacactgtagaga

SEQ ID NO: 140834 - DNA, 20 bp, Artificial
  CRISPR gRNA sequence
caacactgtagagatggccc

SEQ ID NO: 140835 - DNA, 20 bp, Artificial
  CRISPR gRNA sequence
aacactgtagagatggccct

SEQ ID NO: 140836 - DNA, 20 bp, Artificial
  CRISPR gRNA sequence
gatgtgatgctgctcttctc

SEQ ID NO: 140837 - DNA, 20 bp, Artificial
  CRISPR gRNA sequence
tcttctctggcactgttcgt

SEQ ID NO: 140838 - DNA, 20 bp, Artificial
  CRISPR gRNA sequence
ctggcactgttcgtcagtct

SEQ ID NO: 140839 - DNA, 20 bp, Artificial
  CRISPR gRNA sequence
tgttcgtcagtctcagcttc

SEQ ID NO: 140840 - DNA, 20 bp, Artificial
  CRISPR gRNA sequence
cgtcagtctcagcttctgga

SEQ ID NO: 140841 - DNA, 20 bp, Artificial
  CRISPR gRNA sequence
tcagcttctggaaagattcc

SEQ ID NO: 140842 - DNA, 20 bp, Artificial
  CRISPR gRNA sequence
agcttctggaaagattccaa

SEQ ID NO: 140843 - DNA, 20 bp, Artificial
  CRISPR gRNA sequence
tctggaaagattccaagagc

SEQ ID NO: 140844 - DNA, 20 bp, Artificial
  CRISPR gRNA sequence
gattccaagagcaagccctg

SEQ ID NO: 140845 - DNA, 20 bp, Artificial
  CRISPR gRNA sequence
ccaagagcaagccctgtagt

SEQ ID NO: 140846 - DNA, 20 bp, Artificial
  CRISPR gRNA sequence
caagagcaagccctgtagtt

SEQ ID NO: 140847 - DNA, 20 bp, Artificial
  CRISPR gRNA sequence
aagagcaagccctgtagttg

SEQ ID NO: 140848 - DNA, 20 bp, Artificial
  CRISPR gRNA sequence
gagcaagccctgtagttggg

SEQ ID NO: 140849 - DNA, 20 bp, Artificial
  CRISPR gRNA sequence
agcaagccctgtagttgggg

SEQ ID NO: 140850 - DNA, 20 bp, Artificial
  CRISPR gRNA sequence
agttggggaggccactgcta

SEQ ID NO: 140851 - DNA, 20 bp, Artificial
  CRISPR gRNA sequence
gggaggccactgctaaagtt

SEQ ID NO: 140852 - DNA, 20 bp, Artificial
  CRISPR gRNA sequence
ggccactgctaaagttgagc

SEQ ID NO: 140853 - DNA, 20 bp, Artificial
  CRISPR gRNA sequence
gttgagcaagtgccccattc

SEQ ID NO: 140854 - DNA, 20 bp, Artificial
  CRISPR gRNA sequence
tgccccattctggattgatc

SEQ ID NO: 140855 - DNA, 20 bp, Artificial
  CRISPR gRNA sequence
ctggattgatccagtcatta

SEQ ID NO: 140856 - DNA, 20 bp, Artificial
  CRISPR gRNA sequence
taaagcattgttctgccact

SEQ ID NO: 140857 - DNA, 20 bp, Artificial
  CRISPR gRNA sequence
aaagcattgttctgccactt

SEQ ID NO: 140858 - DNA, 20 bp, Artificial
  CRISPR gRNA sequence
aagcattgttctgccacttg

SEQ ID NO: 140859 - DNA, 20 bp, Artificial
  CRISPR gRNA sequence
ttggggcaacctcccactgc

SEQ ID NO: 140860 - DNA, 20 bp, Artificial
  CRISPR gRNA sequence
tggggcaacctcccactgct

SEQ ID NO: 140861 - DNA, 20 bp, Artificial
  CRISPR gRNA sequence
caacctcccactgctgggaa

SEQ ID NO: 140862 - DNA, 20 bp, Artificial
  CRISPR gRNA sequence
aacctcccactgctgggaaa

SEQ ID NO: 140863 - DNA, 20 bp, Artificial
  CRISPR gRNA sequence
ccactgctgggaaaaggaac

SEQ ID NO: 140864 - DNA, 20 bp, Artificial
  CRISPR gRNA sequence
tgctgggaaaaggaactagt

SEQ ID NO: 140865 - DNA, 20 bp, Artificial
  CRISPR gRNA sequence
agtcagaaatactgaattgt

SEQ ID NO: 140866 - DNA, 20 bp, Artificial
  CRISPR gRNA sequence
aaatactgaattgtgagtcc

SEQ ID NO: 140867 - DNA, 20 bp, Artificial
  CRISPR gRNA sequence
aatactgaattgtgagtcca

SEQ ID NO: 140868 - DNA, 20 bp, Artificial
  CRISPR gRNA sequence
tccaaggccctgacttctca

SEQ ID NO: 140869 - DNA, 20 bp, Artificial
  CRISPR gRNA sequence
ctgacttctcaaagatactt

SEQ ID NO: 140870 - DNA, 20 bp, Artificial
  CRISPR gRNA sequence
gacttctcaaagatacttga

SEQ ID NO: 140871 - DNA, 20 bp, Artificial
  CRISPR gRNA sequence
tgagagtttcgcttgttctt

SEQ ID NO: 140872 - DNA, 20 bp, Artificial
  CRISPR gRNA sequence
agagtttcgcttgttcttca

SEQ ID NO: 140873 - DNA, 20 bp, Artificial
  CRISPR gRNA sequence
gtttcgcttgttcttcagag

SEQ ID NO: 140874 - DNA, 20 bp, Artificial
  CRISPR gRNA sequence
cgcttgttcttcagagaagc

SEQ ID NO: 140875 - DNA, 20 bp, Artificial
  CRISPR gRNA sequence
gttcttcagagaagcaagta

SEQ ID NO: 140876 - DNA, 20 bp, Artificial
  CRISPR gRNA sequence
aagcaagtaaagattatttg

SEQ ID NO: 140877 - DNA, 20 bp, Artificial
  CRISPR gRNA sequence
agcaagtaaagattatttga

SEQ ID NO: 140878 - DNA, 20 bp, Artificial
  CRISPR gRNA sequence
aagtaaagattatttgaagg

SEQ ID NO: 140879 - DNA, 20 bp, Artificial
  CRISPR gRNA sequence
agtaaagattatttgaaggt

SEQ ID NO: 140880 - DNA, 20 bp, Artificial
  CRISPR gRNA sequence
taaagattatttgaaggtag

SEQ ID NO: 140881 - DNA, 20 bp, Artificial
  CRISPR gRNA sequence
aaagattatttgaaggtagg

SEQ ID NO: 140882 - DNA, 20 bp, Artificial
  CRISPR gRNA sequence
gattatttgaaggtaggagg

SEQ ID NO: 140883 - DNA, 20 bp, Artificial
  CRISPR gRNA sequence
tttgaaggtaggaggtagtt

SEQ ID NO: 140884 - DNA, 20 bp, Artificial
  CRISPR gRNA sequence
ttgaaggtaggaggtagttg

SEQ ID NO: 140885 - DNA, 20 bp, Artificial
  CRISPR gRNA sequence
gcctgacttctgccccacta

SEQ ID NO: 140886 - DNA, 20 bp, Artificial
  CRISPR gRNA sequence
tctgccccactaaagctatt

SEQ ID NO: 140887 - DNA, 20 bp, Artificial
  CRISPR gRNA sequence
cactaaagctattgagttga

SEQ ID NO: 140888 - DNA, 20 bp, Artificial
  CRISPR gRNA sequence
ttcacccatttctttaaacc

SEQ ID NO: 140889 - DNA, 20 bp, Artificial
  CRISPR gRNA sequence
aagcataatcatttccttgc

SEQ ID NO: 140890 - DNA, 20 bp, Artificial
  CRISPR gRNA sequence
cttgctggcttgacctccat

SEQ ID NO: 140891 - DNA, 20 bp, Artificial
  CRISPR gRNA sequence
gctggcttgacctccattgg

SEQ ID NO: 140892 - DNA, 20 bp, Artificial
  CRISPR gRNA sequence
ttgacctccattggcagaat

SEQ ID NO: 140893 - DNA, 20 bp, Artificial
  CRISPR gRNA sequence
cagaatgagtcttcataatg

SEQ ID NO: 140894 - DNA, 20 bp, Artificial
  CRISPR gRNA sequence
aatgagtcttcataatgcag

SEQ ID NO: 140895 - DNA, 20 bp, Artificial
  CRISPR gRNA sequence
tgagtcttcataatgcagaa

SEQ ID NO: 140896 - DNA, 20 bp, Artificial
  CRISPR gRNA sequence
ttcataatgcagaagagcct

SEQ ID NO: 140897 - DNA, 20 bp, Artificial
  CRISPR gRNA sequence
agatatgccttcttccattc

SEQ ID NO: 140898 - DNA, 20 bp, Artificial
  CRISPR gRNA sequence
ttcttccattccagtgattt

SEQ ID NO: 140899 - DNA, 20 bp, Artificial
  CRISPR gRNA sequence
ccattccagtgatttgagaa

SEQ ID NO: 140900 - DNA, 20 bp, Artificial
  CRISPR gRNA sequence
ttgtcctaacaacacaaacc

SEQ ID NO: 140901 - DNA, 20 bp, Artificial
  CRISPR gRNA sequence
tgtcctaacaacacaaacct

SEQ ID NO: 140902 - DNA, 20 bp, Artificial
  CRISPR gRNA sequence
aggtgcctccacttgattct

SEQ ID NO: 140903 - DNA, 20 bp, Artificial
  CRISPR gRNA sequence
ccacttgattctcagtgtcc

SEQ ID NO: 140904 - DNA, 20 bp, Artificial
  CRISPR gRNA sequence
tcagtgtcctagatactgtc

SEQ ID NO: 140905 - DNA, 20 bp, Artificial
  CRISPR gRNA sequence
gatactgtctagttcataaa

SEQ ID NO: 140906 - DNA, 20 bp, Artificial
  CRISPR gRNA sequence
gtctagttcataaacagttt

SEQ ID NO: 140907 - DNA, 20 bp, Artificial
  CRISPR gRNA sequence
ctagttcataaacagtttaa

SEQ ID NO: 140908 - DNA, 20 bp, Artificial
  CRISPR gRNA sequence
tagttcataaacagtttaag

SEQ ID NO: 140909 - DNA, 20 bp, Artificial
  CRISPR gRNA sequence
ataaacagtttaagaggatg

SEQ ID NO: 140910 - DNA, 20 bp, Artificial
  CRISPR gRNA sequence
acagtttaagaggatgtagt

SEQ ID NO: 140911 - DNA, 20 bp, Artificial
  CRISPR gRNA sequence
gtttaagaggatgtagtaag

SEQ ID NO: 140912 - DNA, 20 bp, Artificial
  CRISPR gRNA sequence
agaggatgtagtaagcagca

SEQ ID NO: 140913 - DNA, 20 bp, Artificial
  CRISPR gRNA sequence
gaggatgtagtaagcagcat

SEQ ID NO: 140914 - DNA, 20 bp, Artificial
  CRISPR gRNA sequence
ggatgtagtaagcagcatag

SEQ ID NO: 140915 - DNA, 20 bp, Artificial
  CRISPR gRNA sequence
gatgtagtaagcagcatagg

SEQ ID NO: 140916 - DNA, 20 bp, Artificial
  CRISPR gRNA sequence
tgtagtaagcagcataggag

SEQ ID NO: 140917 - DNA, 20 bp, Artificial
  CRISPR gRNA sequence
gagctcttgtcctgctctca

SEQ ID NO: 140918 - DNA, 20 bp, Artificial
  CRISPR gRNA sequence
tgtcctgctctcacagcttt

SEQ ID NO: 140919 - DNA, 20 bp, Artificial
  CRISPR gRNA sequence
ctgctctcacagcttttggc

SEQ ID NO: 140920 - DNA, 20 bp, Artificial
  CRISPR gRNA sequence
gctctcacagcttttggcaa

SEQ ID NO: 140921 - DNA, 20 bp, Artificial
  CRISPR gRNA sequence
gcttttggcaagagatattt

SEQ ID NO: 140922 - DNA, 20 bp, Artificial
  CRISPR gRNA sequence
cttttggcaagagatatttt

SEQ ID NO: 140923 - DNA, 20 bp, Artificial
  CRISPR gRNA sequence
gcaagagatattttgggttc

SEQ ID NO: 140924 - DNA, 20 bp, Artificial
  CRISPR gRNA sequence
agagatattttgggttctgg

SEQ ID NO: 140925 - DNA, 20 bp, Artificial
  CRISPR gRNA sequence
gagatattttgggttctgga

SEQ ID NO: 140926 - DNA, 20 bp, Artificial
  CRISPR gRNA sequence
agatattttgggttctggaa

SEQ ID NO: 140927 - DNA, 20 bp, Artificial
  CRISPR gRNA sequence
gatattttgggttctggaag

SEQ ID NO: 140928 - DNA, 20 bp, Artificial
  CRISPR gRNA sequence
ggttctggaaggggttttta

SEQ ID NO: 140929 - DNA, 20 bp, Artificial
  CRISPR gRNA sequence
gttctggaaggggtttttaa

SEQ ID NO: 140930 - DNA, 20 bp, Artificial
  CRISPR gRNA sequence
ttctggaaggggtttttaaa

SEQ ID NO: 140931 - DNA, 20 bp, Artificial
  CRISPR gRNA sequence
tttgctttttgtctgacaaa

SEQ ID NO: 140932 - DNA, 20 bp, Artificial
  CRISPR gRNA sequence
aaaaagatcatattcaatac

SEQ ID NO: 140933 - DNA, 20 bp, Artificial
  CRISPR gRNA sequence
gatcatattcaatactagat

SEQ ID NO: 140934 - DNA, 20 bp, Artificial
  CRISPR gRNA sequence
attcaatactagatcagctg

SEQ ID NO: 140935 - DNA, 20 bp, Artificial
  CRISPR gRNA sequence
aatactagatcagctgtagt

SEQ ID NO: 140936 - DNA, 20 bp, Artificial
  CRISPR gRNA sequence
atactagatcagctgtagtt

SEQ ID NO: 140937 - DNA, 20 bp, Artificial
  CRISPR gRNA sequence
tactagatcagctgtagttg

SEQ ID NO: 140938 - DNA, 20 bp, Artificial
  CRISPR gRNA sequence
cagctgtagttggggataac

SEQ ID NO: 140939 - DNA, 20 bp, Artificial
  CRISPR gRNA sequence
gctgtagttggggataactg

SEQ ID NO: 140940 - DNA, 20 bp, Artificial
  CRISPR gRNA sequence
aactggagactaaacaatca

SEQ ID NO: 140941 - DNA, 20 bp, Artificial
  CRISPR gRNA sequence
actggagactaaacaatcac

SEQ ID NO: 140942 - DNA, 20 bp, Artificial
  CRISPR gRNA sequence
gactaaacaatcacaggtca

SEQ ID NO: 140943 - DNA, 20 bp, Artificial
  CRISPR gRNA sequence
aaacaatcacaggtcacggc

SEQ ID NO: 140944 - DNA, 20 bp, Artificial
  CRISPR gRNA sequence
caggtcacggctagaaaatg

SEQ ID NO: 140945 - DNA, 20 bp, Artificial
  CRISPR gRNA sequence
aggtcacggctagaaaatgc

SEQ ID NO: 140946 - DNA, 20 bp, Artificial
  CRISPR gRNA sequence
gcaggtgtctccctgctgcc

SEQ ID NO: 140947 - DNA, 20 bp, Artificial
  CRISPR gRNA sequence
ctgctgcctagcttcctaca

SEQ ID NO: 140948 - DNA, 20 bp, Artificial
  CRISPR gRNA sequence
tgcctagcttcctacacagc

SEQ ID NO: 140949 - DNA, 20 bp, Artificial
  CRISPR gRNA sequence
cttcctacacagctggttct

SEQ ID NO: 140950 - DNA, 20 bp, Artificial
  CRISPR gRNA sequence
ttcctacacagctggttctg

SEQ ID NO: 140951 - DNA, 20 bp, Artificial
  CRISPR gRNA sequence
tgtataccctctcattaccc

SEQ ID NO: 140952 - DNA, 20 bp, Artificial
  CRISPR gRNA sequence
tataccctctcattacccaa

SEQ ID NO: 140953 - DNA, 20 bp, Artificial
  CRISPR gRNA sequence
cattacccaagagcttttcc

SEQ ID NO: 140954 - DNA, 20 bp, Artificial
  CRISPR gRNA sequence
acccaagagcttttccaagt

SEQ ID NO: 140955 - DNA, 20 bp, Artificial
  CRISPR gRNA sequence
cccaagagcttttccaagtt

SEQ ID NO: 140956 - DNA, 20 bp, Artificial
  CRISPR gRNA sequence
gagcttttccaagttaggtc

SEQ ID NO: 140957 - DNA, 20 bp, Artificial
  CRISPR gRNA sequence
tccaagttaggtctggattt

SEQ ID NO: 140958 - DNA, 20 bp, Artificial
  CRISPR gRNA sequence
tgtgctttttgtaaaataat

SEQ ID NO: 140959 - DNA, 20 bp, Artificial
  CRISPR gRNA sequence
gtgctttttgtaaaataata

SEQ ID NO: 140960 - DNA, 20 bp, Artificial
  CRISPR gRNA sequence
tgctttttgtaaaataataa

SEQ ID NO: 140961 - DNA, 20 bp, Artificial
  CRISPR gRNA sequence
ctttttgtaaaataataagg

SEQ ID NO: 140962 - DNA, 20 bp, Artificial
  CRISPR gRNA sequence
taaaataataagggagatct

SEQ ID NO: 140963 - DNA, 20 bp, Artificial
  CRISPR gRNA sequence
aataataagggagatctcag

SEQ ID NO: 140964 - DNA, 20 bp, Artificial
  CRISPR gRNA sequence
gggagatctcagtggaacac

SEQ ID NO: 140965 - DNA, 20 bp, Artificial
  CRISPR gRNA sequence
gtaccttgaacctacttcaa

SEQ ID NO: 140966 - DNA, 20 bp, Artificial
  CRISPR gRNA sequence
cctacttcaatagctttgca

SEQ ID NO: 140967 - DNA, 20 bp, Artificial
  CRISPR gRNA sequence
tacttcaatagctttgcaaa

SEQ ID NO: 140968 - DNA, 20 bp, Artificial
  CRISPR gRNA sequence
ttcaatagctttgcaaagag

SEQ ID NO: 140969 - DNA, 20 bp, Artificial
  CRISPR gRNA sequence
atagctttgcaaagagcagt

SEQ ID NO: 140970 - DNA, 20 bp, Artificial
  CRISPR gRNA sequence
agcagttggcttctgtttct

SEQ ID NO: 140971 - DNA, 20 bp, Artificial
  CRISPR gRNA sequence
cttctgtttcttggctgcaa

SEQ ID NO: 140972 - DNA, 20 bp, Artificial
  CRISPR gRNA sequence
ttctgtttcttggctgcaaa

SEQ ID NO: 140973 - DNA, 20 bp, Artificial
  CRISPR gRNA sequence
ttcttggctgcaaaaggtat

SEQ ID NO: 140974 - DNA, 20 bp, Artificial
  CRISPR gRNA sequence
tgcaaaaggtatcagtattt

SEQ ID NO: 140975 - DNA, 20 bp, Artificial
  CRISPR gRNA sequence
tcagtattttagctttgcca

SEQ ID NO: 140976 - DNA, 20 bp, Artificial
  CRISPR gRNA sequence
gctttgccacagccaatacc

SEQ ID NO: 140977 - DNA, 20 bp, Artificial
  CRISPR gRNA sequence
cacagccaatacctagtttc

SEQ ID NO: 140978 - DNA, 20 bp, Artificial
  CRISPR gRNA sequence
acagccaatacctagtttcc

SEQ ID NO: 140979 - DNA, 20 bp, Artificial
  CRISPR gRNA sequence
catttatttataatgatgat

SEQ ID NO: 140980 - DNA, 20 bp, Artificial
  CRISPR gRNA sequence
tatttataatgatgataagt

SEQ ID NO: 140981 - DNA, 20 bp, Artificial
  CRISPR gRNA sequence
atttataatgatgataagtt

SEQ ID NO: 140982 - DNA, 20 bp, Artificial
  CRISPR gRNA sequence
tttataatgatgataagttg

SEQ ID NO: 140983 - DNA, 20 bp, Artificial
  CRISPR gRNA sequence
agttggggttgaaattgttg

SEQ ID NO: 140984 - DNA, 20 bp, Artificial
  CRISPR gRNA sequence
ttgaaattgttgtggaaatt

SEQ ID NO: 140985 - DNA, 20 bp, Artificial
  CRISPR gRNA sequence
ttgttgtggaaattgagacc

SEQ ID NO: 140986 - DNA, 20 bp, Artificial
  CRISPR gRNA sequence
tgagacctagatgaaaataa

SEQ ID NO: 140987 - DNA, 20 bp, Artificial
  CRISPR gRNA sequence
gagacctagatgaaaataaa

SEQ ID NO: 140988 - DNA, 20 bp, Artificial
  CRISPR gRNA sequence
agacctagatgaaaataaaa

SEQ ID NO: 140989 - DNA, 20 bp, Artificial
  CRISPR gRNA sequence
atctccttttccttctgcct

SEQ ID NO: 140990 - DNA, 20 bp, Artificial
  CRISPR gRNA sequence
tgccttagcataatcatatt

SEQ ID NO: 140991 - DNA, 20 bp, Artificial
  CRISPR gRNA sequence
gccttagcataatcatattg

SEQ ID NO: 140992 - DNA, 20 bp, Artificial
  CRISPR gRNA sequence
ccttagcataatcatattga

SEQ ID NO: 140993 - DNA, 20 bp, Artificial
  CRISPR gRNA sequence
gttaaaactatttgtgtctg

SEQ ID NO: 140994 - DNA, 20 bp, Artificial
  CRISPR gRNA sequence
aactatttgtgtctgaagca

SEQ ID NO: 140995 - DNA, 20 bp, Artificial
  CRISPR gRNA sequence
acagactatatcaacctaaa

SEQ ID NO: 140996 - DNA, 20 bp, Artificial
  CRISPR gRNA sequence
actatatcaacctaaaaagt

SEQ ID NO: 140997 - DNA, 20 bp, Artificial
  CRISPR gRNA sequence
agtcagttcatatattaact

SEQ ID NO: 140998 - DNA, 20 bp, Artificial
  CRISPR gRNA sequence
catatattaacttagaaacc

SEQ ID NO: 140999 - DNA, 20 bp, Artificial
  CRISPR gRNA sequence
cttagaaacccagaatgtta

SEQ ID NO: 141000 - DNA, 20 bp, Artificial
  CRISPR gRNA sequence
ttagaaacccagaatgttac

SEQ ID NO: 141001 - DNA, 20 bp, Artificial
  CRISPR gRNA sequence
aatgttacaggtatctccct

SEQ ID NO: 141002 - DNA, 20 bp, Artificial
  CRISPR gRNA sequence
ttacaggtatctccctaagc

SEQ ID NO: 141003 - DNA, 20 bp, Artificial
  CRISPR gRNA sequence
tacaggtatctccctaagct

SEQ ID NO: 141004 - DNA, 20 bp, Artificial
  CRISPR gRNA sequence
aggtatctccctaagctggg

SEQ ID NO: 141005 - DNA, 20 bp, Artificial
  CRISPR gRNA sequence
atctccctaagctgggtaga

SEQ ID NO: 141006 - DNA, 20 bp, Artificial
  CRISPR gRNA sequence
aagctgggtagatggctgtc

SEQ ID NO: 141007 - DNA, 20 bp, Artificial
  CRISPR gRNA sequence
tgtcaagtaaccatgtcatg

SEQ ID NO: 141008 - DNA, 20 bp, Artificial
  CRISPR gRNA sequence
tcaagtaaccatgtcatgca

SEQ ID NO: 141009 - DNA, 20 bp, Artificial
  CRISPR gRNA sequence
atgcagagacccatgtttct

SEQ ID NO: 141010 - DNA, 20 bp, Artificial
  CRISPR gRNA sequence
tgcagagacccatgtttctc

SEQ ID NO: 141011 - DNA, 20 bp, Artificial
  CRISPR gRNA sequence
gcagagacccatgtttctca

SEQ ID NO: 141012 - DNA, 20 bp, Artificial
  CRISPR gRNA sequence
cagagacccatgtttctcag

SEQ ID NO: 141013 - DNA, 20 bp, Artificial
  CRISPR gRNA sequence
agacccatgtttctcagggg

SEQ ID NO: 141014 - DNA, 20 bp, Artificial
  CRISPR gRNA sequence
tgtttctcaggggtagatac

SEQ ID NO: 141015 - DNA, 20 bp, Artificial
  CRISPR gRNA sequence
ttctcaggggtagatactgg

SEQ ID NO: 141016 - DNA, 20 bp, Artificial
  CRISPR gRNA sequence
ggggtagatactggcagtcc

SEQ ID NO: 141017 - DNA, 20 bp, Artificial
  CRISPR gRNA sequence
gatactggcagtcctagttt

SEQ ID NO: 141018 - DNA, 20 bp, Artificial
  CRISPR gRNA sequence
cagtcctagttttagtatcc

SEQ ID NO: 141019 - DNA, 20 bp, Artificial
  CRISPR gRNA sequence
agttttagtatcctagcccc

SEQ ID NO: 141020 - DNA, 20 bp, Artificial
  CRISPR gRNA sequence
gtatcctagcccccagacat

SEQ ID NO: 141021 - DNA, 20 bp, Artificial
  CRISPR gRNA sequence
tatcctagcccccagacatc

SEQ ID NO: 141022 - DNA, 20 bp, Artificial
  CRISPR gRNA sequence
ccccagacatcaggcaaaca

SEQ ID NO: 141023 - DNA, 20 bp, Artificial
  CRISPR gRNA sequence
cccagacatcaggcaaacaa

SEQ ID NO: 141024 - DNA, 20 bp, Artificial
  CRISPR gRNA sequence
tcaggcaaacaaaggatact

SEQ ID NO: 141025 - DNA, 20 bp, Artificial
  CRISPR gRNA sequence
ggatactcagctctgttcca

SEQ ID NO: 141026 - DNA, 20 bp, Artificial
  CRISPR gRNA sequence
gatactcagctctgttccac

SEQ ID NO: 141027 - DNA, 20 bp, Artificial
  CRISPR gRNA sequence
atactcagctctgttccaca

SEQ ID NO: 141028 - DNA, 20 bp, Artificial
  CRISPR gRNA sequence
tactcagctctgttccacag

SEQ ID NO: 141029 - DNA, 20 bp, Artificial
  CRISPR gRNA sequence
ctctgttccacaggggacac

SEQ ID NO: 141030 - DNA, 20 bp, Artificial
  CRISPR gRNA sequence
ctagctgcttcctcacactg

SEQ ID NO: 141031 - DNA, 20 bp, Artificial
  CRISPR gRNA sequence
gcttcctcacactgtggcca

SEQ ID NO: 141032 - DNA, 20 bp, Artificial
  CRISPR gRNA sequence
ttcctcacactgtggccaca

SEQ ID NO: 141033 - DNA, 20 bp, Artificial
  CRISPR gRNA sequence
acactgtggccacagagtct

SEQ ID NO: 141034 - DNA, 20 bp, Artificial
  CRISPR gRNA sequence
actgtggccacagagtctta

SEQ ID NO: 141035 - DNA, 20 bp, Artificial
  CRISPR gRNA sequence
ctgtggccacagagtcttag

SEQ ID NO: 141036 - DNA, 20 bp, Artificial
  CRISPR gRNA sequence
cagagtcttagaggtaccaa

SEQ ID NO: 141037 - DNA, 20 bp, Artificial
  CRISPR gRNA sequence
gagtcttagaggtaccaaaa

SEQ ID NO: 141038 - DNA, 20 bp, Artificial
  CRISPR gRNA sequence
gtcttagaggtaccaaaaga

SEQ ID NO: 141039 - DNA, 20 bp, Artificial
  CRISPR gRNA sequence
agaggtaccaaaagagagtt

SEQ ID NO: 141040 - DNA, 20 bp, Artificial
  CRISPR gRNA sequence
aggtaccaaaagagagttta

SEQ ID NO: 141041 - DNA, 20 bp, Artificial
  CRISPR gRNA sequence
tagagactacttttttctat

SEQ ID NO: 141042 - DNA, 20 bp, Artificial
  CRISPR gRNA sequence
ctacttttttctattggtaa

SEQ ID NO: 141043 - DNA, 20 bp, Artificial
  CRISPR gRNA sequence
tttctattggtaacagctgt

SEQ ID NO: 141044 - DNA, 20 bp, Artificial
  CRISPR gRNA sequence
ttctattggtaacagctgtt

SEQ ID NO: 141045 - DNA, 20 bp, Artificial
  CRISPR gRNA sequence
tggtaacagctgttgggttt

SEQ ID NO: 141046 - DNA, 20 bp, Artificial
  CRISPR gRNA sequence
gtaacagctgttgggtttaa

SEQ ID NO: 141047 - DNA, 20 bp, Artificial
  CRISPR gRNA sequence
tttaagagaatttgtcatat

SEQ ID NO: 141048 - DNA, 20 bp, Artificial
  CRISPR gRNA sequence
agagaatttgtcatatcagc

SEQ ID NO: 141049 - DNA, 20 bp, Artificial
  CRISPR gRNA sequence
aatttgtcatatcagcaagt

SEQ ID NO: 141050 - DNA, 20 bp, Artificial
  CRISPR gRNA sequence
tcatatcagcaagttggatt

SEQ ID NO: 141051 - DNA, 20 bp, Artificial
  CRISPR gRNA sequence
atatcagcaagttggattca

SEQ ID NO: 141052 - DNA, 20 bp, Artificial
  CRISPR gRNA sequence
tcattcatcacgcacttact

SEQ ID NO: 141053 - DNA, 20 bp, Artificial
  CRISPR gRNA sequence
gcacttactgagtgcctacc

SEQ ID NO: 141054 - DNA, 20 bp, Artificial
  CRISPR gRNA sequence
cacttactgagtgcctacct

SEQ ID NO: 141055 - DNA, 20 bp, Artificial
  CRISPR gRNA sequence
tgagtgcctacctgggaacg

SEQ ID NO: 141056 - DNA, 20 bp, Artificial
  CRISPR gRNA sequence
gagtgcctacctgggaacgc

SEQ ID NO: 141057 - DNA, 20 bp, Artificial
  CRISPR gRNA sequence
agtgcctacctgggaacgcg

SEQ ID NO: 141058 - DNA, 20 bp, Artificial
  CRISPR gRNA sequence
gtgcctacctgggaacgcgg

SEQ ID NO: 141059 - DNA, 20 bp, Artificial
  CRISPR gRNA sequence
ctacctgggaacgcggggga

SEQ ID NO: 141060 - DNA, 20 bp, Artificial
  CRISPR gRNA sequence
cctgggaacgcgggggatag

SEQ ID NO: 141061 - DNA, 20 bp, Artificial
  CRISPR gRNA sequence
tgggaacgcgggggatagca

SEQ ID NO: 141062 - DNA, 20 bp, Artificial
  CRISPR gRNA sequence
ggaacgcgggggatagcaga

SEQ ID NO: 141063 - DNA, 20 bp, Artificial
  CRISPR gRNA sequence
cgcgggggatagcagagagc

SEQ ID NO: 141064 - DNA, 20 bp, Artificial
  CRISPR gRNA sequence
cgggggatagcagagagcaa

SEQ ID NO: 141065 - DNA, 20 bp, Artificial
  CRISPR gRNA sequence
ggggatagcagagagcaaga

SEQ ID NO: 141066 - DNA, 20 bp, Artificial
  CRISPR gRNA sequence
ggatagcagagagcaagaga

SEQ ID NO: 141067 - DNA, 20 bp, Artificial
  CRISPR gRNA sequence
agcagagagcaagagagagc

SEQ ID NO: 141068 - DNA, 20 bp, Artificial
  CRISPR gRNA sequence
gcagagagcaagagagagct

SEQ ID NO: 141069 - DNA, 20 bp, Artificial
  CRISPR gRNA sequence
agagctaggctttgccctca

SEQ ID NO: 141070 - DNA, 20 bp, Artificial
  CRISPR gRNA sequence
cctcatggtgcttaacattt

SEQ ID NO: 141071 - DNA, 20 bp, Artificial
  CRISPR gRNA sequence
catggtgcttaacattttag

SEQ ID NO: 141072 - DNA, 20 bp, Artificial
  CRISPR gRNA sequence
tgcttaacattttagtagaa

SEQ ID NO: 141073 - DNA, 20 bp, Artificial
  CRISPR gRNA sequence
taacattttagtagaacaga

SEQ ID NO: 141074 - DNA, 20 bp, Artificial
  CRISPR gRNA sequence
agacagttaatttgacatgc

SEQ ID NO: 141075 - DNA, 20 bp, Artificial
  CRISPR gRNA sequence
agtgcaaaaatgtatactgt

SEQ ID NO: 141076 - DNA, 20 bp, Artificial
  CRISPR gRNA sequence
gtgcaaaaatgtatactgtg

SEQ ID NO: 141077 - DNA, 20 bp, Artificial
  CRISPR gRNA sequence
aaaaatgtatactgtgagga

SEQ ID NO: 141078 - DNA, 20 bp, Artificial
  CRISPR gRNA sequence
atactgtgaggacagtactt

SEQ ID NO: 141079 - DNA, 20 bp, Artificial
  CRISPR gRNA sequence
ctgtgaggacagtactttgg

SEQ ID NO: 141080 - DNA, 20 bp, Artificial
  CRISPR gRNA sequence
aggacagtactttggaagca

SEQ ID NO: 141081 - DNA, 20 bp, Artificial
  CRISPR gRNA sequence
agtactttggaagcacagtt

SEQ ID NO: 141082 - DNA, 20 bp, Artificial
  CRISPR gRNA sequence
gtactttggaagcacagttg

SEQ ID NO: 141083 - DNA, 20 bp, Artificial
  CRISPR gRNA sequence
tactttggaagcacagttga

SEQ ID NO: 141084 - DNA, 20 bp, Artificial
  CRISPR gRNA sequence
acagttgagggcacctaaca

SEQ ID NO: 141085 - DNA, 20 bp, Artificial
  CRISPR gRNA sequence
tgagggcacctaacatagtg

SEQ ID NO: 141086 - DNA, 20 bp, Artificial
  CRISPR gRNA sequence
gagggcacctaacatagtgt

SEQ ID NO: 141087 - DNA, 20 bp, Artificial
  CRISPR gRNA sequence
agggcacctaacatagtgtg

SEQ ID NO: 141088 - DNA, 20 bp, Artificial
  CRISPR gRNA sequence
cacctaacatagtgtgggga

SEQ ID NO: 141089 - DNA, 20 bp, Artificial
  CRISPR gRNA sequence
acctaacatagtgtggggat

SEQ ID NO: 141090 - DNA, 20 bp, Artificial
  CRISPR gRNA sequence
cctaacatagtgtggggatg

SEQ ID NO: 141091 - DNA, 20 bp, Artificial
  CRISPR gRNA sequence
tgtggggatggggtcaatac

SEQ ID NO: 141092 - DNA, 20 bp, Artificial
  CRISPR gRNA sequence
cagctttgtaaatgttactt

SEQ ID NO: 141093 - DNA, 20 bp, Artificial
  CRISPR gRNA sequence
agctttgtaaatgttacttt

SEQ ID NO: 141094 - DNA, 20 bp, Artificial
  CRISPR gRNA sequence
gctttgtaaatgttactttg

SEQ ID NO: 141095 - DNA, 20 bp, Artificial
  CRISPR gRNA sequence
tttgtaaatgttactttggg

SEQ ID NO: 141096 - DNA, 20 bp, Artificial
  CRISPR gRNA sequence
taaatgttactttggggagt

SEQ ID NO: 141097 - DNA, 20 bp, Artificial
  CRISPR gRNA sequence
aatgttactttggggagttg

SEQ ID NO: 141098 - DNA, 20 bp, Artificial
  CRISPR gRNA sequence
atgttactttggggagttgg

SEQ ID NO: 141099 - DNA, 20 bp, Artificial
  CRISPR gRNA sequence
ggggagttggaggcaatcca

SEQ ID NO: 141100 - DNA, 20 bp, Artificial
  CRISPR gRNA sequence
gggagttggaggcaatccac

SEQ ID NO: 141101 - DNA, 20 bp, Artificial
  CRISPR gRNA sequence
ggagttggaggcaatccaca

SEQ ID NO: 141102 - DNA, 20 bp, Artificial
  CRISPR gRNA sequence
cacagggtctgtgtacatct

SEQ ID NO: 141103 - DNA, 20 bp, Artificial
  CRISPR gRNA sequence
agggtctgtgtacatctaag

SEQ ID NO: 141104 - DNA, 20 bp, Artificial
  CRISPR gRNA sequence
aagtgtcttttcctcttttc

SEQ ID NO: 141105 - DNA, 20 bp, Artificial
  CRISPR gRNA sequence
ttttcctcttttctggaacg

SEQ ID NO: 141106 - DNA, 20 bp, Artificial
  CRISPR gRNA sequence
tggcaaactttgccctgaat

SEQ ID NO: 141107 - DNA, 20 bp, Artificial
  CRISPR gRNA sequence
ggcaaactttgccctgaata

SEQ ID NO: 141108 - DNA, 20 bp, Artificial
  CRISPR gRNA sequence
tttgccctgaataaggacat

SEQ ID NO: 141109 - DNA, 20 bp, Artificial
  CRISPR gRNA sequence
aataaggacatgagtaaatt

SEQ ID NO: 141110 - DNA, 20 bp, Artificial
  CRISPR gRNA sequence
atttagctaatatttttact

SEQ ID NO: 141111 - DNA, 20 bp, Artificial
  CRISPR gRNA sequence
agctaatatttttactcagc

SEQ ID NO: 141112 - DNA, 20 bp, Artificial
  CRISPR gRNA sequence
tatttttactcagccagccc

SEQ ID NO: 141113 - DNA, 20 bp, Artificial
  CRISPR gRNA sequence
ttttactcagccagcccaag

SEQ ID NO: 141114 - DNA, 20 bp, Artificial
  CRISPR gRNA sequence
ttttattgtttttgttgtcc

SEQ ID NO: 141115 - DNA, 20 bp, Artificial
  CRISPR gRNA sequence
tttattgtttttgttgtccc

SEQ ID NO: 141116 - DNA, 20 bp, Artificial
  CRISPR gRNA sequence
attgtttttgttgtcccagg

SEQ ID NO: 141117 - DNA, 20 bp, Artificial
  CRISPR gRNA sequence
ttgtttttgttgtcccaggc

SEQ ID NO: 141118 - DNA, 20 bp, Artificial
  CRISPR gRNA sequence
tgtttttgttgtcccaggca

SEQ ID NO: 141119 - DNA, 20 bp, Artificial
  CRISPR gRNA sequence
gtttttgttgtcccaggcag

SEQ ID NO: 141120 - DNA, 20 bp, Artificial
  CRISPR gRNA sequence
caggggcaccatgtgtcaca

SEQ ID NO: 141121 - DNA, 20 bp, Artificial
  CRISPR gRNA sequence
aggggcaccatgtgtcacac

SEQ ID NO: 141122 - DNA, 20 bp, Artificial
  CRISPR gRNA sequence
atgtgtcacacaggtcactc

SEQ ID NO: 141123 - DNA, 20 bp, Artificial
  CRISPR gRNA sequence
tcacacaggtcactccggat

SEQ ID NO: 141124 - DNA, 20 bp, Artificial
  CRISPR gRNA sequence
gatcagacgccgttctgtgt

SEQ ID NO: 141125 - DNA, 20 bp, Artificial
  CRISPR gRNA sequence
cagacgccgttctgtgtcag

SEQ ID NO: 141126 - DNA, 20 bp, Artificial
  CRISPR gRNA sequence
cgccgttctgtgtcagtggt

SEQ ID NO: 141127 - DNA, 20 bp, Artificial
  CRISPR gRNA sequence
gccgttctgtgtcagtggtc

SEQ ID NO: 141128 - DNA, 20 bp, Artificial
  CRISPR gRNA sequence
ccgttctgtgtcagtggtca

SEQ ID NO: 141129 - DNA, 20 bp, Artificial
  CRISPR gRNA sequence
cgttctgtgtcagtggtcag

SEQ ID NO: 141130 - DNA, 20 bp, Artificial
  CRISPR gRNA sequence
ggtcaggggctgatcaaccc

SEQ ID NO: 141131 - DNA, 20 bp, Artificial
  CRISPR gRNA sequence
ctgatcaaccctggaccctg

SEQ ID NO: 141132 - DNA, 20 bp, Artificial
  CRISPR gRNA sequence
tgatcaaccctggaccctgt

SEQ ID NO: 141133 - DNA, 20 bp, Artificial
  CRISPR gRNA sequence
tgtgggctataaccatgctg

SEQ ID NO: 141134 - DNA, 20 bp, Artificial
  CRISPR gRNA sequence
gtgtaaacatcctacactct

SEQ ID NO: 141135 - DNA, 20 bp, Artificial
  CRISPR gRNA sequence
catcctacactctcagctgt

SEQ ID NO: 141136 - DNA, 20 bp, Artificial
  CRISPR gRNA sequence
acactctcagctgtgagctc

SEQ ID NO: 141137 - DNA, 20 bp, Artificial
  CRISPR gRNA sequence
cactctcagctgtgagctca

SEQ ID NO: 141138 - DNA, 20 bp, Artificial
  CRISPR gRNA sequence
tctcagctgtgagctcaagg

SEQ ID NO: 141139 - DNA, 20 bp, Artificial
  CRISPR gRNA sequence
agctgtgagctcaaggtggc

SEQ ID NO: 141140 - DNA, 20 bp, Artificial
  CRISPR gRNA sequence
gctgtgagctcaaggtggct

SEQ ID NO: 141141 - DNA, 20 bp, Artificial
  CRISPR gRNA sequence
tgtgagctcaaggtggctgg

SEQ ID NO: 141142 - DNA, 20 bp, Artificial
  CRISPR gRNA sequence
tgagctcaaggtggctggga

SEQ ID NO: 141143 - DNA, 20 bp, Artificial
  CRISPR gRNA sequence
gagctcaaggtggctgggag

SEQ ID NO: 141144 - DNA, 20 bp, Artificial
  CRISPR gRNA sequence
agctcaaggtggctgggaga

SEQ ID NO: 141145 - DNA, 20 bp, Artificial
  CRISPR gRNA sequence
gttgtttactccttctgcca

SEQ ID NO: 141146 - DNA, 20 bp, Artificial
  CRISPR gRNA sequence
ccttctgccatggaaaacat

SEQ ID NO: 141147 - DNA, 20 bp, Artificial
  CRISPR gRNA sequence
gccatggaaaacatcagctg

SEQ ID NO: 141148 - DNA, 20 bp, Artificial
  CRISPR gRNA sequence
atggaaaacatcagctgaag

SEQ ID NO: 141149 - DNA, 20 bp, Artificial
  CRISPR gRNA sequence
tggaaaacatcagctgaaga

SEQ ID NO: 141150 - DNA, 20 bp, Artificial
  CRISPR gRNA sequence
aacatcagctgaagaaggaa

SEQ ID NO: 141151 - DNA, 20 bp, Artificial
  CRISPR gRNA sequence
aaggaacagtctccactccg

SEQ ID NO: 141152 - DNA, 20 bp, Artificial
  CRISPR gRNA sequence
acagtctccactccgcagat

SEQ ID NO: 141153 - DNA, 20 bp, Artificial
  CRISPR gRNA sequence
tctccactccgcagatcgga

SEQ ID NO: 141154 - DNA, 20 bp, Artificial
  CRISPR gRNA sequence
cagaatgcgacctccctaat

SEQ ID NO: 141155 - DNA, 20 bp, Artificial
  CRISPR gRNA sequence
tgcgacctccctaatcagcc

SEQ ID NO: 141156 - DNA, 20 bp, Artificial
  CRISPR gRNA sequence
gcgacctccctaatcagcca

SEQ ID NO: 141157 - DNA, 20 bp, Artificial
  CRISPR gRNA sequence
acctccctaatcagccaagg

SEQ ID NO: 141158 - DNA, 20 bp, Artificial
  CRISPR gRNA sequence
aatcagccaaggcagtaccc

SEQ ID NO: 141159 - DNA, 20 bp, Artificial
  CRISPR gRNA sequence
cagccaaggcagtaccccag

SEQ ID NO: 141160 - DNA, 20 bp, Artificial
  CRISPR gRNA sequence
gccaaggcagtaccccagcg

SEQ ID NO: 141161 - DNA, 20 bp, Artificial
  CRISPR gRNA sequence
caaggcagtaccccagcgga

SEQ ID NO: 141162 - DNA, 20 bp, Artificial
  CRISPR gRNA sequence
cccagcggagagctgtccat

SEQ ID NO: 141163 - DNA, 20 bp, Artificial
  CRISPR gRNA sequence
ccagcggagagctgtccatc

SEQ ID NO: 141164 - DNA, 20 bp, Artificial
  CRISPR gRNA sequence
gagctgtccatcaggccccc

SEQ ID NO: 141165 - DNA, 20 bp, Artificial
  CRISPR gRNA sequence
agctgtccatcaggccccct

SEQ ID NO: 141166 - DNA, 20 bp, Artificial
  CRISPR gRNA sequence
ccccctgggttgcgcttctg

SEQ ID NO: 141167 - DNA, 20 bp, Artificial
  CRISPR gRNA sequence
tgggttgcgcttctgtggct

SEQ ID NO: 141168 - DNA, 20 bp, Artificial
  CRISPR gRNA sequence
cttctgtggctaagtacaac

SEQ ID NO: 141169 - DNA, 20 bp, Artificial
  CRISPR gRNA sequence
tggctaagtacaaccagaac

SEQ ID NO: 141170 - DNA, 20 bp, Artificial
  CRISPR gRNA sequence
accagaaccagatgtgacac

SEQ ID NO: 141171 - DNA, 20 bp, Artificial
  CRISPR gRNA sequence
gaaccagatgtgacactgga

SEQ ID NO: 141172 - DNA, 20 bp, Artificial
  CRISPR gRNA sequence
acactggatagacatgccct

SEQ ID NO: 141173 - DNA, 20 bp, Artificial
  CRISPR gRNA sequence
agacatgccctcagtgacca

SEQ ID NO: 141174 - DNA, 20 bp, Artificial
  CRISPR gRNA sequence
acatgccctcagtgaccaca

SEQ ID NO: 141175 - DNA, 20 bp, Artificial
  CRISPR gRNA sequence
gtgaccacagagctttcaac

SEQ ID NO: 141176 - DNA, 20 bp, Artificial
  CRISPR gRNA sequence
agctttcaacaagctgtgaa

SEQ ID NO: 141177 - DNA, 20 bp, Artificial
  CRISPR gRNA sequence
ttcaacaagctgtgaaaagc

SEQ ID NO: 141178 - DNA, 20 bp, Artificial
  CRISPR gRNA sequence
tcaacaagctgtgaaaagct

SEQ ID NO: 141179 - DNA, 20 bp, Artificial
  CRISPR gRNA sequence
aaagctgggtacttgcctac

SEQ ID NO: 141180 - DNA, 20 bp, Artificial
  CRISPR gRNA sequence
tgctctcgatcctgaaattt

SEQ ID NO: 141181 - DNA, 20 bp, Artificial
  CRISPR gRNA sequence
tcgatcctgaaatttcagct

SEQ ID NO: 141182 - DNA, 20 bp, Artificial
  CRISPR gRNA sequence
cgatcctgaaatttcagctc

SEQ ID NO: 141183 - DNA, 20 bp, Artificial
  CRISPR gRNA sequence
ctgaaatttcagctcaggaa

SEQ ID NO: 141184 - DNA, 20 bp, Artificial
  CRISPR gRNA sequence
aacctgttctgtcccccttg

SEQ ID NO: 141185 - DNA, 20 bp, Artificial
  CRISPR gRNA sequence
ctgttctgtcccccttgaag

SEQ ID NO: 141186 - DNA, 20 bp, Artificial
  CRISPR gRNA sequence
ttctgtcccccttgaagtgg

SEQ ID NO: 141187 - DNA, 20 bp, Artificial
  CRISPR gRNA sequence
tctgtcccccttgaagtggt

SEQ ID NO: 141188 - DNA, 20 bp, Artificial
  CRISPR gRNA sequence
ctgtcccccttgaagtggtg

SEQ ID NO: 141189 - DNA, 20 bp, Artificial
  CRISPR gRNA sequence
tgaagtggtggggctaaaac

SEQ ID NO: 141190 - DNA, 20 bp, Artificial
  CRISPR gRNA sequence
agtggtggggctaaaacgag

SEQ ID NO: 141191 - DNA, 20 bp, Artificial
  CRISPR gRNA sequence
tggtggggctaaaacgagaa

SEQ ID NO: 141192 - DNA, 20 bp, Artificial
  CRISPR gRNA sequence
cgagaagagtgctgcctatt

SEQ ID NO: 141193 - DNA, 20 bp, Artificial
  CRISPR gRNA sequence
gagaagagtgctgcctattt

SEQ ID NO: 141194 - DNA, 20 bp, Artificial
  CRISPR gRNA sequence
gaagagtgctgcctatttgg

SEQ ID NO: 141195 - DNA, 20 bp, Artificial
  CRISPR gRNA sequence
gtgctgcctatttgggagat

SEQ ID NO: 141196 - DNA, 20 bp, Artificial
  CRISPR gRNA sequence
tgctgcctatttgggagatt

SEQ ID NO: 141197 - DNA, 20 bp, Artificial
  CRISPR gRNA sequence
cctatttgggagattgggac

SEQ ID NO: 141198 - DNA, 20 bp, Artificial
  CRISPR gRNA sequence
ctatttgggagattgggacc

SEQ ID NO: 141199 - DNA, 20 bp, Artificial
  CRISPR gRNA sequence
gggagattgggaccaggcct

SEQ ID NO: 141200 - DNA, 20 bp, Artificial
  CRISPR gRNA sequence
gagattgggaccaggcctga

SEQ ID NO: 141201 - DNA, 20 bp, Artificial
  CRISPR gRNA sequence
agattgggaccaggcctgag

SEQ ID NO: 141202 - DNA, 20 bp, Artificial
  CRISPR gRNA sequence
ggcctgagaggcatgatgtt

SEQ ID NO: 141203 - DNA, 20 bp, Artificial
  CRISPR gRNA sequence
gcctgagaggcatgatgttt

SEQ ID NO: 141204 - DNA, 20 bp, Artificial
  CRISPR gRNA sequence
tgagaggcatgatgtttggg

SEQ ID NO: 141205 - DNA, 20 bp, Artificial
  CRISPR gRNA sequence
atcttcccaacacttgcaat

SEQ ID NO: 141206 - DNA, 20 bp, Artificial
  CRISPR gRNA sequence
cttgcaattagcactgttct

SEQ ID NO: 141207 - DNA, 20 bp, Artificial
  CRISPR gRNA sequence
ttagcactgttctcagatca

SEQ ID NO: 141208 - DNA, 20 bp, Artificial
  CRISPR gRNA sequence
tagcactgttctcagatcac

SEQ ID NO: 141209 - DNA, 20 bp, Artificial
  CRISPR gRNA sequence
tctcagatcacaggccttga

SEQ ID NO: 141210 - DNA, 20 bp, Artificial
  CRISPR gRNA sequence
ccttgacagcatttactgac

SEQ ID NO: 141211 - DNA, 20 bp, Artificial
  CRISPR gRNA sequence
catttactgacaagcactgc

SEQ ID NO: 141212 - DNA, 20 bp, Artificial
  CRISPR gRNA sequence
tgacaagcactgctggtgtg

SEQ ID NO: 141213 - DNA, 20 bp, Artificial
  CRISPR gRNA sequence
cactgctggtgtgtggtttt

SEQ ID NO: 141214 - DNA, 20 bp, Artificial
  CRISPR gRNA sequence
tggtgtgtggtttttagtta

SEQ ID NO: 141215 - DNA, 20 bp, Artificial
  CRISPR gRNA sequence
gtttgcaacttatcatgcaa

SEQ ID NO: 141216 - DNA, 20 bp, Artificial
  CRISPR gRNA sequence
tttgcaacttatcatgcaat

SEQ ID NO: 141217 - DNA, 20 bp, Artificial
  CRISPR gRNA sequence
tgggtgattatttcgtactt

SEQ ID NO: 141218 - DNA, 20 bp, Artificial
  CRISPR gRNA sequence
ttatttcgtacttcagaaat

SEQ ID NO: 141219 - DNA, 20 bp, Artificial
  CRISPR gRNA sequence
aattggctgtatgttttgtg

SEQ ID NO: 141220 - DNA, 20 bp, Artificial
  CRISPR gRNA sequence
tgtatgttttgtgaagccta

SEQ ID NO: 141221 - DNA, 20 bp, Artificial
  CRISPR gRNA sequence
gtatgttttgtgaagcctat

SEQ ID NO: 141222 - DNA, 20 bp, Artificial
  CRISPR gRNA sequence
cctataggatctgttatttt

SEQ ID NO: 141223 - DNA, 20 bp, Artificial
  CRISPR gRNA sequence
ctgttatttttagtttgatt

SEQ ID NO: 141224 - DNA, 20 bp, Artificial
  CRISPR gRNA sequence
ttagtttgatttagcataac

SEQ ID NO: 141225 - DNA, 20 bp, Artificial
  CRISPR gRNA sequence
ctttgaattccactttcctt

SEQ ID NO: 141226 - DNA, 20 bp, Artificial
  CRISPR gRNA sequence
ctttcctttggcttcaaatg

SEQ ID NO: 141227 - DNA, 20 bp, Artificial
  CRISPR gRNA sequence
ttcctttggcttcaaatgtg

SEQ ID NO: 141228 - DNA, 20 bp, Artificial
  CRISPR gRNA sequence
cctttggcttcaaatgtgga

SEQ ID NO: 141229 - DNA, 20 bp, Artificial
  CRISPR gRNA sequence
ggcttcaaatgtggagagct

SEQ ID NO: 141230 - DNA, 20 bp, Artificial
  CRISPR gRNA sequence
aatgtggagagctcagcatt

SEQ ID NO: 141231 - DNA, 20 bp, Artificial
  CRISPR gRNA sequence
gtggagagctcagcattcag

SEQ ID NO: 141232 - DNA, 20 bp, Artificial
  CRISPR gRNA sequence
tggagagctcagcattcagc

SEQ ID NO: 141233 - DNA, 20 bp, Artificial
  CRISPR gRNA sequence
attcagcaggcaactgcaca

SEQ ID NO: 141234 - DNA, 20 bp, Artificial
  CRISPR gRNA sequence
gcaactgcacatagcctgtt

SEQ ID NO: 141235 - DNA, 20 bp, Artificial
  CRISPR gRNA sequence
caactgcacatagcctgttt

SEQ ID NO: 141236 - DNA, 20 bp, Artificial
  CRISPR gRNA sequence
aactgcacatagcctgtttg

SEQ ID NO: 141237 - DNA, 20 bp, Artificial
  CRISPR gRNA sequence
actgcacatagcctgtttgg

SEQ ID NO: 141238 - DNA, 20 bp, Artificial
  CRISPR gRNA sequence
gcacatagcctgtttggggg

SEQ ID NO: 141239 - DNA, 20 bp, Artificial
  CRISPR gRNA sequence
acatagcctgtttgggggaa

SEQ ID NO: 141240 - DNA, 20 bp, Artificial
  CRISPR gRNA sequence
tagcctgtttgggggaagag

SEQ ID NO: 141241 - DNA, 20 bp, Artificial
  CRISPR gRNA sequence
ggaagagtggaaattcactg

SEQ ID NO: 141242 - DNA, 20 bp, Artificial
  CRISPR gRNA sequence
agagtggaaattcactgtgg

SEQ ID NO: 141243 - DNA, 20 bp, Artificial
  CRISPR gRNA sequence
aattcactgtggcggctgct

SEQ ID NO: 141244 - DNA, 20 bp, Artificial
  CRISPR gRNA sequence
cactgtggcggctgctgagt

SEQ ID NO: 141245 - DNA, 20 bp, Artificial
  CRISPR gRNA sequence
ctgcctctctttccacccaa

SEQ ID NO: 141246 - DNA, 20 bp, Artificial
  CRISPR gRNA sequence
tgcctctctttccacccaac

SEQ ID NO: 141247 - DNA, 20 bp, Artificial
  CRISPR gRNA sequence
cctctctttccacccaacag

SEQ ID NO: 141248 - DNA, 20 bp, Artificial
  CRISPR gRNA sequence
ctctctttccacccaacagg

SEQ ID NO: 141249 - DNA, 20 bp, Artificial
  CRISPR gRNA sequence
ctctttccacccaacaggag

SEQ ID NO: 141250 - DNA, 20 bp, Artificial
  CRISPR gRNA sequence
tctttccacccaacaggagg

SEQ ID NO: 141251 - DNA, 20 bp, Artificial
  CRISPR gRNA sequence
cccaacaggaggaggtgcgc

SEQ ID NO: 141252 - DNA, 20 bp, Artificial
  CRISPR gRNA sequence
gccagtctgtaactcctgcc

SEQ ID NO: 141253 - DNA, 20 bp, Artificial
  CRISPR gRNA sequence
gtctgtaactcctgccgagc

SEQ ID NO: 141254 - DNA, 20 bp, Artificial
  CRISPR gRNA sequence
taactcctgccgagccagtc

SEQ ID NO: 141255 - DNA, 20 bp, Artificial
  CRISPR gRNA sequence
agtccagtactatttcacgc

SEQ ID NO: 141256 - DNA, 20 bp, Artificial
  CRISPR gRNA sequence
agtactatttcacgctggct

SEQ ID NO: 141257 - DNA, 20 bp, Artificial
  CRISPR gRNA sequence
tcagcaacccaccgctgtcc

SEQ ID NO: 141258 - DNA, 20 bp, Artificial
  CRISPR gRNA sequence
aacccaccgctgtccaagtc

SEQ ID NO: 141259 - DNA, 20 bp, Artificial
  CRISPR gRNA sequence
acccaccgctgtccaagtcc

SEQ ID NO: 141260 - DNA, 20 bp, Artificial
  CRISPR gRNA sequence
cccaccgctgtccaagtcca

SEQ ID NO: 141261 - DNA, 20 bp, Artificial
  CRISPR gRNA sequence
ccgctgtccaagtccagggc

SEQ ID NO: 141262 - DNA, 20 bp, Artificial
  CRISPR gRNA sequence
ctgtccaagtccagggccag

SEQ ID NO: 141263 - DNA, 20 bp, Artificial
  CRISPR gRNA sequence
ccaagtccagggccagcagc

SEQ ID NO: 141264 - DNA, 20 bp, Artificial
  CRISPR gRNA sequence
caagtccagggccagcagca

SEQ ID NO: 141265 - DNA, 20 bp, Artificial
  CRISPR gRNA sequence
tccagggccagcagcaaggc

SEQ ID NO: 141266 - DNA, 20 bp, Artificial
  CRISPR gRNA sequence
agggccagcagcaaggccag

SEQ ID NO: 141267 - DNA, 20 bp, Artificial
  CRISPR gRNA sequence
cagcaaggccagcagaccac

SEQ ID NO: 141268 - DNA, 20 bp, Artificial
  CRISPR gRNA sequence
ccagctccacgaccaccatc

SEQ ID NO: 141269 - DNA, 20 bp, Artificial
  CRISPR gRNA sequence
tccacgaccaccatccagcc

SEQ ID NO: 141270 - DNA, 20 bp, Artificial
  CRISPR gRNA sequence
ccacgaccaccatccagcct

SEQ ID NO: 141271 - DNA, 20 bp, Artificial
  CRISPR gRNA sequence
cgaccaccatccagcctggg

SEQ ID NO: 141272 - DNA, 20 bp, Artificial
  CRISPR gRNA sequence
ctgggcagatcatcatcgca

SEQ ID NO: 141273 - DNA, 20 bp, Artificial
  CRISPR gRNA sequence
agatcatcatcgcacagcct

SEQ ID NO: 141274 - DNA, 20 bp, Artificial
  CRISPR gRNA sequence
tcatcatcgcacagcctcag

SEQ ID NO: 141275 - DNA, 20 bp, Artificial
  CRISPR gRNA sequence
catcatcgcacagcctcagc

SEQ ID NO: 141276 - DNA, 20 bp, Artificial
  CRISPR gRNA sequence
atcatcgcacagcctcagca

SEQ ID NO: 141277 - DNA, 20 bp, Artificial
  CRISPR gRNA sequence
tcgcacagcctcagcagggc

SEQ ID NO: 141278 - DNA, 20 bp, Artificial
  CRISPR gRNA sequence
cgcacagcctcagcagggcc

SEQ ID NO: 141279 - DNA, 20 bp, Artificial
  CRISPR gRNA sequence
ctcagcagggccaggtctgt

SEQ ID NO: 141280 - DNA, 20 bp, Artificial
  CRISPR gRNA sequence
ggccaggtctgtgagctgct

SEQ ID NO: 141281 - DNA, 20 bp, Artificial
  CRISPR gRNA sequence
gccaggtctgtgagctgctg

SEQ ID NO: 141282 - DNA, 20 bp, Artificial
  CRISPR gRNA sequence
agctgctgaggatgcccatc

SEQ ID NO: 141283 - DNA, 20 bp, Artificial
  CRISPR gRNA sequence
gctgaggatgcccatccagc

SEQ ID NO: 141284 - DNA, 20 bp, Artificial
  CRISPR gRNA sequence
aggatgcccatccagcaaga

SEQ ID NO: 141285 - DNA, 20 bp, Artificial
  CRISPR gRNA sequence
tccagcaagacagtgcccct

SEQ ID NO: 141286 - DNA, 20 bp, Artificial
  CRISPR gRNA sequence
ccagcaagacagtgcccctt

SEQ ID NO: 141287 - DNA, 20 bp, Artificial
  CRISPR gRNA sequence
gacagtgccccttaggtttt

SEQ ID NO: 141288 - DNA, 20 bp, Artificial
  CRISPR gRNA sequence
gtgccccttaggtttttgga

SEQ ID NO: 141289 - DNA, 20 bp, Artificial
  CRISPR gRNA sequence
tgccccttaggtttttggat

SEQ ID NO: 141290 - DNA, 20 bp, Artificial
  CRISPR gRNA sequence
cccttaggtttttggatggg

SEQ ID NO: 141291 - DNA, 20 bp, Artificial
  CRISPR gRNA sequence
cttaggtttttggatgggca

SEQ ID NO: 141292 - DNA, 20 bp, Artificial
  CRISPR gRNA sequence
ttggatgggcagagcttgat

SEQ ID NO: 141293 - DNA, 20 bp, Artificial
  CRISPR gRNA sequence
tggatgggcagagcttgatg

SEQ ID NO: 141294 - DNA, 20 bp, Artificial
  CRISPR gRNA sequence
ggatgggcagagcttgatga

SEQ ID NO: 141295 - DNA, 20 bp, Artificial
  CRISPR gRNA sequence
tgggcagagcttgatgaggg

SEQ ID NO: 141296 - DNA, 20 bp, Artificial
  CRISPR gRNA sequence
ggcagagcttgatgagggca

SEQ ID NO: 141297 - DNA, 20 bp, Artificial
  CRISPR gRNA sequence
cagagcttgatgagggcaga

SEQ ID NO: 141298 - DNA, 20 bp, Artificial
  CRISPR gRNA sequence
agagcttgatgagggcagag

SEQ ID NO: 141299 - DNA, 20 bp, Artificial
  CRISPR gRNA sequence
gcttgatgagggcagagagg

SEQ ID NO: 141300 - DNA, 20 bp, Artificial
  CRISPR gRNA sequence
gatgagggcagagaggcagc

SEQ ID NO: 141301 - DNA, 20 bp, Artificial
  CRISPR gRNA sequence
gagaggcagccagatcatta

SEQ ID NO: 141302 - DNA, 20 bp, Artificial
  CRISPR gRNA sequence
gaggcagccagatcattata

SEQ ID NO: 141303 - DNA, 20 bp, Artificial
  CRISPR gRNA sequence
gccagatcattatagagcac

SEQ ID NO: 141304 - DNA, 20 bp, Artificial
  CRISPR gRNA sequence
attatagagcactggattta

SEQ ID NO: 141305 - DNA, 20 bp, Artificial
  CRISPR gRNA sequence
agagcactggatttaaagtc

SEQ ID NO: 141306 - DNA, 20 bp, Artificial
  CRISPR gRNA sequence
tggatttaaagtctggaaac

SEQ ID NO: 141307 - DNA, 20 bp, Artificial
  CRISPR gRNA sequence
tggaaactggaacttttccc

SEQ ID NO: 141308 - DNA, 20 bp, Artificial
  CRISPR gRNA sequence
ctggaacttttccccagatt

SEQ ID NO: 141309 - DNA, 20 bp, Artificial
  CRISPR gRNA sequence
ttttccccagattcagctac

SEQ ID NO: 141310 - DNA, 20 bp, Artificial
  CRISPR gRNA sequence
tttccccagattcagctact

SEQ ID NO: 141311 - DNA, 20 bp, Artificial
  CRISPR gRNA sequence
ttccccagattcagctactg

SEQ ID NO: 141312 - DNA, 20 bp, Artificial
  CRISPR gRNA sequence
ccagattcagctactggggt

SEQ ID NO: 141313 - DNA, 20 bp, Artificial
  CRISPR gRNA sequence
agatgttaccctaatctctc

SEQ ID NO: 141314 - DNA, 20 bp, Artificial
  CRISPR gRNA sequence
tctggaccctgtttttctca

SEQ ID NO: 141315 - DNA, 20 bp, Artificial
  CRISPR gRNA sequence
ctggaccctgtttttctcaa

SEQ ID NO: 141316 - DNA, 20 bp, Artificial
  CRISPR gRNA sequence
gtttttctcaaaggtcaaat

SEQ ID NO: 141317 - DNA, 20 bp, Artificial
  CRISPR gRNA sequence
tttttctcaaaggtcaaatg

SEQ ID NO: 141318 - DNA, 20 bp, Artificial
  CRISPR gRNA sequence
tctcaaaggtcaaatgagga

SEQ ID NO: 141319 - DNA, 20 bp, Artificial
  CRISPR gRNA sequence
gtcaaatgaggaaagtgtac

SEQ ID NO: 141320 - DNA, 20 bp, Artificial
  CRISPR gRNA sequence
aatgaggaaagtgtactaga

SEQ ID NO: 141321 - DNA, 20 bp, Artificial
  CRISPR gRNA sequence
gtactagacagtatgttctc

SEQ ID NO: 141322 - DNA, 20 bp, Artificial
  CRISPR gRNA sequence
tactagacagtatgttctcc

SEQ ID NO: 141323 - DNA, 20 bp, Artificial
  CRISPR gRNA sequence
atgttctccaggatccctat

SEQ ID NO: 141324 - DNA, 20 bp, Artificial
  CRISPR gRNA sequence
ctccaggatccctattagct

SEQ ID NO: 141325 - DNA, 20 bp, Artificial
  CRISPR gRNA sequence
ccctattagctcagaaattt

SEQ ID NO: 141326 - DNA, 20 bp, Artificial
  CRISPR gRNA sequence
tattagctcagaaattttag

SEQ ID NO: 141327 - DNA, 20 bp, Artificial
  CRISPR gRNA sequence
attagctcagaaattttaga

SEQ ID NO: 141328 - DNA, 20 bp, Artificial
  CRISPR gRNA sequence
ttagctcagaaattttagaa

SEQ ID NO: 141329 - DNA, 20 bp, Artificial
  CRISPR gRNA sequence
aatgtctgaaatgccttatg

SEQ ID NO: 141330 - DNA, 20 bp, Artificial
  CRISPR gRNA sequence
tgtctgaaatgccttatgaa

SEQ ID NO: 141331 - DNA, 20 bp, Artificial
  CRISPR gRNA sequence
ctgaaatgccttatgaagag

SEQ ID NO: 141332 - DNA, 20 bp, Artificial
  CRISPR gRNA sequence
gaaatgccttatgaagagta

SEQ ID NO: 141333 - DNA, 20 bp, Artificial
  CRISPR gRNA sequence
aaatgccttatgaagagtag

SEQ ID NO: 141334 - DNA, 20 bp, Artificial
  CRISPR gRNA sequence
tatgaagagtagaggtgcta

SEQ ID NO: 141335 - DNA, 20 bp, Artificial
  CRISPR gRNA sequence
tgctgtctgtgtgtctgtgt

SEQ ID NO: 141336 - DNA, 20 bp, Artificial
  CRISPR gRNA sequence
tgtctgtgtgtctgtgtgag

SEQ ID NO: 141337 - DNA, 20 bp, Artificial
  CRISPR gRNA sequence
ctgtgtgtctgtgtgagaag

SEQ ID NO: 141338 - DNA, 20 bp, Artificial
  CRISPR gRNA sequence
aagtggaatttgtgccctta

SEQ ID NO: 141339 - DNA, 20 bp, Artificial
  CRISPR gRNA sequence
agtggaatttgtgcccttaa

SEQ ID NO: 141340 - DNA, 20 bp, Artificial
  CRISPR gRNA sequence
gtggaatttgtgcccttaaa

SEQ ID NO: 141341 - DNA, 20 bp, Artificial
  CRISPR gRNA sequence
ggaatttgtgcccttaaagg

SEQ ID NO: 141342 - DNA, 20 bp, Artificial
  CRISPR gRNA sequence
aatttgtgcccttaaaggga

SEQ ID NO: 141343 - DNA, 20 bp, Artificial
  CRISPR gRNA sequence
gtgcccttaaagggagagat

SEQ ID NO: 141344 - DNA, 20 bp, Artificial
  CRISPR gRNA sequence
tgcccttaaagggagagatt

SEQ ID NO: 141345 - DNA, 20 bp, Artificial
  CRISPR gRNA sequence
agagattaggtatcattgcc

SEQ ID NO: 141346 - DNA, 20 bp, Artificial
  CRISPR gRNA sequence
ctctgtcccatatttgtgtt

SEQ ID NO: 141347 - DNA, 20 bp, Artificial
  CRISPR gRNA sequence
gtgaccttctctttttacga

SEQ ID NO: 141348 - DNA, 20 bp, Artificial
  CRISPR gRNA sequence
tctctttttacgatagtaat

SEQ ID NO: 141349 - DNA, 20 bp, Artificial
  CRISPR gRNA sequence
tctttttacgatagtaatca

SEQ ID NO: 141350 - DNA, 20 bp, Artificial
  CRISPR gRNA sequence
ctttttacgatagtaatcag

SEQ ID NO: 141351 - DNA, 20 bp, Artificial
  CRISPR gRNA sequence
cagaggactctttctctccc

SEQ ID NO: 141352 - DNA, 20 bp, Artificial
  CRISPR gRNA sequence
aggactctttctctccccag

SEQ ID NO: 141353 - DNA, 20 bp, Artificial
  CRISPR gRNA sequence
actctttctctccccagtag

SEQ ID NO: 141354 - DNA, 20 bp, Artificial
  CRISPR gRNA sequence
ctctccccagtagtagtgtt

SEQ ID NO: 141355 - DNA, 20 bp, Artificial
  CRISPR gRNA sequence
ctccccagtagtagtgttaa

SEQ ID NO: 141356 - DNA, 20 bp, Artificial
  CRISPR gRNA sequence
cccagtagtagtgttaagag

SEQ ID NO: 141357 - DNA, 20 bp, Artificial
  CRISPR gRNA sequence
agtagtagtgttaagagcag

SEQ ID NO: 141358 - DNA, 20 bp, Artificial
  CRISPR gRNA sequence
gcagtagcattcatgtttgt

SEQ ID NO: 141359 - DNA, 20 bp, Artificial
  CRISPR gRNA sequence
cagtagcattcatgtttgtt

SEQ ID NO: 141360 - DNA, 20 bp, Artificial
  CRISPR gRNA sequence
agtagcattcatgtttgttg

SEQ ID NO: 141361 - DNA, 20 bp, Artificial
  CRISPR gRNA sequence
gtagcattcatgtttgttgg

SEQ ID NO: 141362 - DNA, 20 bp, Artificial
  CRISPR gRNA sequence
atgtttgttgggggtcatgt

SEQ ID NO: 141363 - DNA, 20 bp, Artificial
  CRISPR gRNA sequence
tgtttgttgggggtcatgtg

SEQ ID NO: 141364 - DNA, 20 bp, Artificial
  CRISPR gRNA sequence
ttgggggtcatgtgaggctg

SEQ ID NO: 141365 - DNA, 20 bp, Artificial
  CRISPR gRNA sequence
gggggtcatgtgaggctgca

SEQ ID NO: 141366 - DNA, 20 bp, Artificial
  CRISPR gRNA sequence
tgcagagaactctgtactat

SEQ ID NO: 141367 - DNA, 20 bp, Artificial
  CRISPR gRNA sequence
ttatttattcatcaaacact

SEQ ID NO: 141368 - DNA, 20 bp, Artificial
  CRISPR gRNA sequence
tcaaacactgagcatcctct

SEQ ID NO: 141369 - DNA, 20 bp, Artificial
  CRISPR gRNA sequence
caaacactgagcatcctctg

SEQ ID NO: 141370 - DNA, 20 bp, Artificial
  CRISPR gRNA sequence
aaacactgagcatcctctga

SEQ ID NO: 141371 - DNA, 20 bp, Artificial
  CRISPR gRNA sequence
ctgagcatcctctgagggta

SEQ ID NO: 141372 - DNA, 20 bp, Artificial
  CRISPR gRNA sequence
taaagttctgtgctatgtat

SEQ ID NO: 141373 - DNA, 20 bp, Artificial
  CRISPR gRNA sequence
aaagttctgtgctatgtatt

SEQ ID NO: 141374 - DNA, 20 bp, Artificial
  CRISPR gRNA sequence
aagttctgtgctatgtattg

SEQ ID NO: 141375 - DNA, 20 bp, Artificial
  CRISPR gRNA sequence
gtgctatgtattggggatac

SEQ ID NO: 141376 - DNA, 20 bp, Artificial
  CRISPR gRNA sequence
ggatacaagcatgaataaaa

SEQ ID NO: 141377 - DNA, 20 bp, Artificial
  CRISPR gRNA sequence
ataaaacagtccttattttc

SEQ ID NO: 141378 - DNA, 20 bp, Artificial
  CRISPR gRNA sequence
taaaacagtccttattttca

SEQ ID NO: 141379 - DNA, 20 bp, Artificial
  CRISPR gRNA sequence
ttttcaaggaattcacaatt

SEQ ID NO: 141380 - DNA, 20 bp, Artificial
  CRISPR gRNA sequence
caaggaattcacaatttagt

SEQ ID NO: 141381 - DNA, 20 bp, Artificial
  CRISPR gRNA sequence
aaggaattcacaatttagtt

SEQ ID NO: 141382 - DNA, 20 bp, Artificial
  CRISPR gRNA sequence
aggaattcacaatttagttg

SEQ ID NO: 141383 - DNA, 20 bp, Artificial
  CRISPR gRNA sequence
gttggggatacaaatactta

SEQ ID NO: 141384 - DNA, 20 bp, Artificial
  CRISPR gRNA sequence
ttggggatacaaatacttaa

SEQ ID NO: 141385 - DNA, 20 bp, Artificial
  CRISPR gRNA sequence
ttaaaggttgtaccaccacg

SEQ ID NO: 141386 - DNA, 20 bp, Artificial
  CRISPR gRNA sequence
taaaggttgtaccaccacgt

SEQ ID NO: 141387 - DNA, 20 bp, Artificial
  CRISPR gRNA sequence
ccaccacgtgggaatgtgta

SEQ ID NO: 141388 - DNA, 20 bp, Artificial
  CRISPR gRNA sequence
caccacgtgggaatgtgtac

SEQ ID NO: 141389 - DNA, 20 bp, Artificial
  CRISPR gRNA sequence
accacgtgggaatgtgtaca

SEQ ID NO: 141390 - DNA, 20 bp, Artificial
  CRISPR gRNA sequence
ggaatgtgtacagggtgtta

SEQ ID NO: 141391 - DNA, 20 bp, Artificial
  CRISPR gRNA sequence
gaatgtgtacagggtgttaa

SEQ ID NO: 141392 - DNA, 20 bp, Artificial
  CRISPR gRNA sequence
gtgttaaaggaacacattaa

SEQ ID NO: 141393 - DNA, 20 bp, Artificial
  CRISPR gRNA sequence
ttaaaggaacacattaaaag

SEQ ID NO: 141394 - DNA, 20 bp, Artificial
  CRISPR gRNA sequence
acacattaaaagaagtacct

SEQ ID NO: 141395 - DNA, 20 bp, Artificial
  CRISPR gRNA sequence
ttaaaagaagtaccttggct

SEQ ID NO: 141396 - DNA, 20 bp, Artificial
  CRISPR gRNA sequence
agaagtaccttggctcagcg

SEQ ID NO: 141397 - DNA, 20 bp, Artificial
  CRISPR gRNA sequence
agtaccttggctcagcgcag

SEQ ID NO: 141398 - DNA, 20 bp, Artificial
  CRISPR gRNA sequence
tgcctgtaatcccaacactt

SEQ ID NO: 141399 - DNA, 20 bp, Artificial
  CRISPR gRNA sequence
gcctgtaatcccaacacttt

SEQ ID NO: 141400 - DNA, 20 bp, Artificial
  CRISPR gRNA sequence
ctgtaatcccaacactttgg

SEQ ID NO: 141401 - DNA, 20 bp, Artificial
  CRISPR gRNA sequence
tgtaatcccaacactttggg

SEQ ID NO: 141402 - DNA, 20 bp, Artificial
  CRISPR gRNA sequence
aacactttgggaggccaatg

SEQ ID NO: 141403 - DNA, 20 bp, Artificial
  CRISPR gRNA sequence
acactttgggaggccaatgt

SEQ ID NO: 141404 - DNA, 20 bp, Artificial
  CRISPR gRNA sequence
actttgggaggccaatgtgg

SEQ ID NO: 141405 - DNA, 20 bp, Artificial
  CRISPR gRNA sequence
ctttgggaggccaatgtggg

SEQ ID NO: 141406 - DNA, 20 bp, Artificial
  CRISPR gRNA sequence
aggccaatgtgggaggaacc

SEQ ID NO: 141407 - DNA, 20 bp, Artificial
  CRISPR gRNA sequence
ggccaatgtgggaggaaccc

SEQ ID NO: 141408 - DNA, 20 bp, Artificial
  CRISPR gRNA sequence
ccaatgtgggaggaacccag

SEQ ID NO: 141409 - DNA, 20 bp, Artificial
  CRISPR gRNA sequence
tgggaggaacccaggagttt

SEQ ID NO: 141410 - DNA, 20 bp, Artificial
  CRISPR gRNA sequence
gggaggaacccaggagtttg

SEQ ID NO: 141411 - DNA, 20 bp, Artificial
  CRISPR gRNA sequence
aacccaggagtttgaggtta

SEQ ID NO: 141412 - DNA, 20 bp, Artificial
  CRISPR gRNA sequence
caggagtttgaggttacagt

SEQ ID NO: 141413 - DNA, 20 bp, Artificial
  CRISPR gRNA sequence
aggagtttgaggttacagtg

SEQ ID NO: 141414 - DNA, 20 bp, Artificial
  CRISPR gRNA sequence
agtttgaggttacagtgagg

SEQ ID NO: 141415 - DNA, 20 bp, Artificial
  CRISPR gRNA sequence
gtttgaggttacagtgaggt

SEQ ID NO: 141416 - DNA, 20 bp, Artificial
  CRISPR gRNA sequence
aggatcatgccactgcactt

SEQ ID NO: 141417 - DNA, 20 bp, Artificial
  CRISPR gRNA sequence
catgccactgcacttcagcc

SEQ ID NO: 141418 - DNA, 20 bp, Artificial
  CRISPR gRNA sequence
atgccactgcacttcagcct

SEQ ID NO: 141419 - DNA, 20 bp, Artificial
  CRISPR gRNA sequence
ccactgcacttcagcctggg

SEQ ID NO: 141420 - DNA, 20 bp, Artificial
  CRISPR gRNA sequence
gcacttcagcctgggcagca

SEQ ID NO: 141421 - DNA, 20 bp, Artificial
  CRISPR gRNA sequence
ttcagcctgggcagcacagc

SEQ ID NO: 141422 - DNA, 20 bp, Artificial
  CRISPR gRNA sequence
ttaattaaaaaaaaaaaaaa

SEQ ID NO: 141423 - DNA, 20 bp, Artificial
  CRISPR gRNA sequence
taattaaaaaaaaaaaaaaa

SEQ ID NO: 141424 - DNA, 20 bp, Artificial
  CRISPR gRNA sequence
ttaaaaaaaaaaaaaaaagg

SEQ ID NO: 141425 - DNA, 20 bp, Artificial
  CRISPR gRNA sequence
taaaaaaaaaaaaaaaaggc

SEQ ID NO: 141426 - DNA, 20 bp, Artificial
  CRISPR gRNA sequence
aaaaaaaaaaaaaaaaggca

SEQ ID NO: 141427 - DNA, 20 bp, Artificial
  CRISPR gRNA sequence
aaaaaaaaaaaaaaaggcag

SEQ ID NO: 141428 - DNA, 20 bp, Artificial
  CRISPR gRNA sequence
aaaaaaaaggcaggggcatg

SEQ ID NO: 141429 - DNA, 20 bp, Artificial
  CRISPR gRNA sequence
aaaaaggcaggggcatgtgg

SEQ ID NO: 141430 - DNA, 20 bp, Artificial
  CRISPR gRNA sequence
gtggctcatgtctgtaattc

SEQ ID NO: 141431 - DNA, 20 bp, Artificial
  CRISPR gRNA sequence
tgtctgtaattccagcactt

SEQ ID NO: 141432 - DNA, 20 bp, Artificial
  CRISPR gRNA sequence
gtctgtaattccagcacttt

SEQ ID NO: 141433 - DNA, 20 bp, Artificial
  CRISPR gRNA sequence
ctgtaattccagcactttgg

SEQ ID NO: 141434 - DNA, 20 bp, Artificial
  CRISPR gRNA sequence
tgtaattccagcactttggg

SEQ ID NO: 141435 - DNA, 20 bp, Artificial
  CRISPR gRNA sequence
ttccagcactttgggaggcc

SEQ ID NO: 141436 - DNA, 20 bp, Artificial
  CRISPR gRNA sequence
tccagcactttgggaggccg

SEQ ID NO: 141437 - DNA, 20 bp, Artificial
  CRISPR gRNA sequence
agcactttgggaggccgagg

SEQ ID NO: 141438 - DNA, 20 bp, Artificial
  CRISPR gRNA sequence
gcactttgggaggccgaggc

SEQ ID NO: 141439 - DNA, 20 bp, Artificial
  CRISPR gRNA sequence
actttgggaggccgaggcag

SEQ ID NO: 141440 - DNA, 20 bp, Artificial
  CRISPR gRNA sequence
ctttgggaggccgaggcagg

SEQ ID NO: 141441 - DNA, 20 bp, Artificial
  CRISPR gRNA sequence
ccgaggcaggaggattgctt

SEQ ID NO: 141442 - DNA, 20 bp, Artificial
  CRISPR gRNA sequence
ttgcttgagcccacgtgttc

SEQ ID NO: 141443 - DNA, 20 bp, Artificial
  CRISPR gRNA sequence
tgagcccacgtgttcaagac

SEQ ID NO: 141444 - DNA, 20 bp, Artificial
  CRISPR gRNA sequence
ccacgtgttcaagaccagcc

SEQ ID NO: 141445 - DNA, 20 bp, Artificial
  CRISPR gRNA sequence
cacgtgttcaagaccagcct

SEQ ID NO: 141446 - DNA, 20 bp, Artificial
  CRISPR gRNA sequence
caagaccagcctgggcaaca

SEQ ID NO: 141447 - DNA, 20 bp, Artificial
  CRISPR gRNA sequence
accagcctgggcaacatggt

SEQ ID NO: 141448 - DNA, 20 bp, Artificial
  CRISPR gRNA sequence
tggtgagaccttgtctccac

SEQ ID NO: 141449 - DNA, 20 bp, Artificial
  CRISPR gRNA sequence
ccttgtctccaccagaacat

SEQ ID NO: 141450 - DNA, 20 bp, Artificial
  CRISPR gRNA sequence
ccaccagaacatcagaacat

SEQ ID NO: 141451 - DNA, 20 bp, Artificial
  CRISPR gRNA sequence
cagaacatcagaacattagc

SEQ ID NO: 141452 - DNA, 20 bp, Artificial
  CRISPR gRNA sequence
atcagaacattagccagcca

SEQ ID NO: 141453 - DNA, 20 bp, Artificial
  CRISPR gRNA sequence
agaacattagccagccatgg

SEQ ID NO: 141454 - DNA, 20 bp, Artificial
  CRISPR gRNA sequence
gccatggtggcatgctctta

SEQ ID NO: 141455 - DNA, 20 bp, Artificial
  CRISPR gRNA sequence
gtggcatgctcttatggccc

SEQ ID NO: 141456 - DNA, 20 bp, Artificial
  CRISPR gRNA sequence
tcttatggccccagctactt

SEQ ID NO: 141457 - DNA, 20 bp, Artificial
  CRISPR gRNA sequence
ttatggccccagctacttaa

SEQ ID NO: 141458 - DNA, 20 bp, Artificial
  CRISPR gRNA sequence
tatggccccagctacttaag

SEQ ID NO: 141459 - DNA, 20 bp, Artificial
  CRISPR gRNA sequence
ccccagctacttaagaggct

SEQ ID NO: 141460 - DNA, 20 bp, Artificial
  CRISPR gRNA sequence
agctacttaagaggctgagt

SEQ ID NO: 141461 - DNA, 20 bp, Artificial
  CRISPR gRNA sequence
gctacttaagaggctgagtt

SEQ ID NO: 141462 - DNA, 20 bp, Artificial
  CRISPR gRNA sequence
tacttaagaggctgagttgg

SEQ ID NO: 141463 - DNA, 20 bp, Artificial
  CRISPR gRNA sequence
acttaagaggctgagttggg

SEQ ID NO: 141464 - DNA, 20 bp, Artificial
  CRISPR gRNA sequence
ctgagttgggaggatcgctt

SEQ ID NO: 141465 - DNA, 20 bp, Artificial
  CRISPR gRNA sequence
ttgggaggatcgcttgagcc

SEQ ID NO: 141466 - DNA, 20 bp, Artificial
  CRISPR gRNA sequence
tgggaggatcgcttgagcca

SEQ ID NO: 141467 - DNA, 20 bp, Artificial
  CRISPR gRNA sequence
ggaggatcgcttgagccaag

SEQ ID NO: 141468 - DNA, 20 bp, Artificial
  CRISPR gRNA sequence
gaggatcgcttgagccaagg

SEQ ID NO: 141469 - DNA, 20 bp, Artificial
  CRISPR gRNA sequence
tcgcttgagccaaggaggtc

SEQ ID NO: 141470 - DNA, 20 bp, Artificial
  CRISPR gRNA sequence
cgcttgagccaaggaggtca

SEQ ID NO: 141471 - DNA, 20 bp, Artificial
  CRISPR gRNA sequence
agccaaggaggtcaaggcta

SEQ ID NO: 141472 - DNA, 20 bp, Artificial
  CRISPR gRNA sequence
aaggaggtcaaggctacagt

SEQ ID NO: 141473 - DNA, 20 bp, Artificial
  CRISPR gRNA sequence
gtgattgtgccattgcactc

SEQ ID NO: 141474 - DNA, 20 bp, Artificial
  CRISPR gRNA sequence
ttgtgccattgcactccagc

SEQ ID NO: 141475 - DNA, 20 bp, Artificial
  CRISPR gRNA sequence
tgtgccattgcactccagcc

SEQ ID NO: 141476 - DNA, 20 bp, Artificial
  CRISPR gRNA sequence
gtgccattgcactccagcca

SEQ ID NO: 141477 - DNA, 20 bp, Artificial
  CRISPR gRNA sequence
ttgcactccagccagggtga

SEQ ID NO: 141478 - DNA, 20 bp, Artificial
  CRISPR gRNA sequence
gcactccagccagggtgaca

SEQ ID NO: 141479 - DNA, 20 bp, Artificial
  CRISPR gRNA sequence
tccagccagggtgacagagc

SEQ ID NO: 141480 - DNA, 20 bp, Artificial
  CRISPR gRNA sequence
ctcaaaaaaaaaacaaaaaa

SEQ ID NO: 141481 - DNA, 20 bp, Artificial
  CRISPR gRNA sequence
tatatgtgtgtgtatgtatg

SEQ ID NO: 141482 - DNA, 20 bp, Artificial
  CRISPR gRNA sequence
atatgtgtgtgtatgtatgt

SEQ ID NO: 141483 - DNA, 20 bp, Artificial
  CRISPR gRNA sequence
tatgtgtgtgtatgtatgta

SEQ ID NO: 141484 - DNA, 20 bp, Artificial
  CRISPR gRNA sequence
atgtgtgtgtatgtatgtag

SEQ ID NO: 141485 - DNA, 20 bp, Artificial
  CRISPR gRNA sequence
gtgtgtgtatgtatgtaggg

SEQ ID NO: 141486 - DNA, 20 bp, Artificial
  CRISPR gRNA sequence
tgtgtgtatgtatgtagggg

SEQ ID NO: 141487 - DNA, 20 bp, Artificial
  CRISPR gRNA sequence
gtgtgtatgtatgtagggga

SEQ ID NO: 141488 - DNA, 20 bp, Artificial
  CRISPR gRNA sequence
tgtgtatgtatgtaggggag

SEQ ID NO: 141489 - DNA, 20 bp, Artificial
  CRISPR gRNA sequence
atgtatgtaggggaggggat

SEQ ID NO: 141490 - DNA, 20 bp, Artificial
  CRISPR gRNA sequence
tatgtaggggaggggatgag

SEQ ID NO: 141491 - DNA, 20 bp, Artificial
  CRISPR gRNA sequence
aggggaggggatgagtagct

SEQ ID NO: 141492 - DNA, 20 bp, Artificial
  CRISPR gRNA sequence
gaggggatgagtagctgaga

SEQ ID NO: 141493 - DNA, 20 bp, Artificial
  CRISPR gRNA sequence
tagctgagaaagatgtgaac

SEQ ID NO: 141494 - DNA, 20 bp, Artificial
  CRISPR gRNA sequence
agctgagaaagatgtgaacg

SEQ ID NO: 141495 - DNA, 20 bp, Artificial
  CRISPR gRNA sequence
tgagaaagatgtgaacgagg

SEQ ID NO: 141496 - DNA, 20 bp, Artificial
  CRISPR gRNA sequence
aaagatgtgaacgaggtggt

SEQ ID NO: 141497 - DNA, 20 bp, Artificial
  CRISPR gRNA sequence
gtggtcagataatgtttctg

SEQ ID NO: 141498 - DNA, 20 bp, Artificial
  CRISPR gRNA sequence
tggtcagataatgtttctga

SEQ ID NO: 141499 - DNA, 20 bp, Artificial
  CRISPR gRNA sequence
ggtcagataatgtttctgaa

SEQ ID NO: 141500 - DNA, 20 bp, Artificial
  CRISPR gRNA sequence
gtttctgaagggaataatat

SEQ ID NO: 141501 - DNA, 20 bp, Artificial
  CRISPR gRNA sequence
gaagggaataatatgagtct

SEQ ID NO: 141502 - DNA, 20 bp, Artificial
  CRISPR gRNA sequence
aagggaataatatgagtctt

SEQ ID NO: 141503 - DNA, 20 bp, Artificial
  CRISPR gRNA sequence
agggaataatatgagtcttg

SEQ ID NO: 141504 - DNA, 20 bp, Artificial
  CRISPR gRNA sequence
ataatatgagtcttggggaa

SEQ ID NO: 141505 - DNA, 20 bp, Artificial
  CRISPR gRNA sequence
atatgagtcttggggaacag

SEQ ID NO: 141506 - DNA, 20 bp, Artificial
  CRISPR gRNA sequence
ggaacagtggaaattaatca

SEQ ID NO: 141507 - DNA, 20 bp, Artificial
  CRISPR gRNA sequence
cagtggaaattaatcaaaga

SEQ ID NO: 141508 - DNA, 20 bp, Artificial
  CRISPR gRNA sequence
tggaaattaatcaaagaaag

SEQ ID NO: 141509 - DNA, 20 bp, Artificial
  CRISPR gRNA sequence
ggaaattaatcaaagaaagt

SEQ ID NO: 141510 - DNA, 20 bp, Artificial
  CRISPR gRNA sequence
attaatcaaagaaagtggga

SEQ ID NO: 141511 - DNA, 20 bp, Artificial
  CRISPR gRNA sequence
ttaatcaaagaaagtgggaa

SEQ ID NO: 141512 - DNA, 20 bp, Artificial
  CRISPR gRNA sequence
taatcaaagaaagtgggaaa

SEQ ID NO: 141513 - DNA, 20 bp, Artificial
  CRISPR gRNA sequence
tcaaagaaagtgggaaaggg

SEQ ID NO: 141514 - DNA, 20 bp, Artificial
  CRISPR gRNA sequence
gtgggaaagggtggtattgc

SEQ ID NO: 141515 - DNA, 20 bp, Artificial
  CRISPR gRNA sequence
ggaaagggtggtattgccag

SEQ ID NO: 141516 - DNA, 20 bp, Artificial
  CRISPR gRNA sequence
aaagggtggtattgccagta

SEQ ID NO: 141517 - DNA, 20 bp, Artificial
  CRISPR gRNA sequence
aagggtggtattgccagtag

SEQ ID NO: 141518 - DNA, 20 bp, Artificial
  CRISPR gRNA sequence
agggtggtattgccagtaga

SEQ ID NO: 141519 - DNA, 20 bp, Artificial
  CRISPR gRNA sequence
ggtattgccagtagagggca

SEQ ID NO: 141520 - DNA, 20 bp, Artificial
  CRISPR gRNA sequence
tgccagtagagggcacagca

SEQ ID NO: 141521 - DNA, 20 bp, Artificial
  CRISPR gRNA sequence
gccagtagagggcacagcac

SEQ ID NO: 141522 - DNA, 20 bp, Artificial
  CRISPR gRNA sequence
tagagggcacagcacaggca

SEQ ID NO: 141523 - DNA, 20 bp, Artificial
  CRISPR gRNA sequence
agagggcacagcacaggcaa

SEQ ID NO: 141524 - DNA, 20 bp, Artificial
  CRISPR gRNA sequence
gcacagcacaggcaaaggct

SEQ ID NO: 141525 - DNA, 20 bp, Artificial
  CRISPR gRNA sequence
acagcacaggcaaaggctca

SEQ ID NO: 141526 - DNA, 20 bp, Artificial
  CRISPR gRNA sequence
cagcacaggcaaaggctcag

SEQ ID NO: 141527 - DNA, 20 bp, Artificial
  CRISPR gRNA sequence
acaggcaaaggctcagaggt

SEQ ID NO: 141528 - DNA, 20 bp, Artificial
  CRISPR gRNA sequence
aaaggctcagaggtgagaaa

SEQ ID NO: 141529 - DNA, 20 bp, Artificial
  CRISPR gRNA sequence
ctcagaggtgagaaacagta

SEQ ID NO: 141530 - DNA, 20 bp, Artificial
  CRISPR gRNA sequence
tcagaggtgagaaacagtac

SEQ ID NO: 141531 - DNA, 20 bp, Artificial
  CRISPR gRNA sequence
cagaggtgagaaacagtaca

SEQ ID NO: 141532 - DNA, 20 bp, Artificial
  CRISPR gRNA sequence
agaggtgagaaacagtacag

SEQ ID NO: 141533 - DNA, 20 bp, Artificial
  CRISPR gRNA sequence
gaggtgagaaacagtacagg

SEQ ID NO: 141534 - DNA, 20 bp, Artificial
  CRISPR gRNA sequence
agaaacagtacagggggccg

SEQ ID NO: 141535 - DNA, 20 bp, Artificial
  CRISPR gRNA sequence
gaaacagtacagggggccgt

SEQ ID NO: 141536 - DNA, 20 bp, Artificial
  CRISPR gRNA sequence
cagtacagggggccgtagga

SEQ ID NO: 141537 - DNA, 20 bp, Artificial
  CRISPR gRNA sequence
tacagggggccgtaggaaag

SEQ ID NO: 141538 - DNA, 20 bp, Artificial
  CRISPR gRNA sequence
gggggccgtaggaaagtagt

SEQ ID NO: 141539 - DNA, 20 bp, Artificial
  CRISPR gRNA sequence
ccgtaggaaagtagtcagcg

SEQ ID NO: 141540 - DNA, 20 bp, Artificial
  CRISPR gRNA sequence
cgtaggaaagtagtcagcgt

SEQ ID NO: 141541 - DNA, 20 bp, Artificial
  CRISPR gRNA sequence
gtaggaaagtagtcagcgta

SEQ ID NO: 141542 - DNA, 20 bp, Artificial
  CRISPR gRNA sequence
taggaaagtagtcagcgtag

SEQ ID NO: 141543 - DNA, 20 bp, Artificial
  CRISPR gRNA sequence
gcgtaggggaccatctacgc

SEQ ID NO: 141544 - DNA, 20 bp, Artificial
  CRISPR gRNA sequence
ggggaccatctacgcaagtt

SEQ ID NO: 141545 - DNA, 20 bp, Artificial
  CRISPR gRNA sequence
accatctacgcaagtttgga

SEQ ID NO: 141546 - DNA, 20 bp, Artificial
  CRISPR gRNA sequence
tctacgcaagtttggaaaga

SEQ ID NO: 141547 - DNA, 20 bp, Artificial
  CRISPR gRNA sequence
cgcaagtttggaaagataga

SEQ ID NO: 141548 - DNA, 20 bp, Artificial
  CRISPR gRNA sequence
gatagatagtaaacacatcc

SEQ ID NO: 141549 - DNA, 20 bp, Artificial
  CRISPR gRNA sequence
gatagtaaacacatcctgga

SEQ ID NO: 141550 - DNA, 20 bp, Artificial
  CRISPR gRNA sequence
acagcctcgtatattctaat

SEQ ID NO: 141551 - DNA, 20 bp, Artificial
  CRISPR gRNA sequence
cagcctcgtatattctaata

SEQ ID NO: 141552 - DNA, 20 bp, Artificial
  CRISPR gRNA sequence
gcctcgtatattctaataag

SEQ ID NO: 141553 - DNA, 20 bp, Artificial
  CRISPR gRNA sequence
gtatattctaataaggagct

SEQ ID NO: 141554 - DNA, 20 bp, Artificial
  CRISPR gRNA sequence
aataaggagctgagtttgcc

SEQ ID NO: 141555 - DNA, 20 bp, Artificial
  CRISPR gRNA sequence
aaggagctgagtttgcctag

SEQ ID NO: 141556 - DNA, 20 bp, Artificial
  CRISPR gRNA sequence
ttgcctagaagaaaaaaaaa

SEQ ID NO: 141557 - DNA, 20 bp, Artificial
  CRISPR gRNA sequence
gcctagaagaaaaaaaaatg

SEQ ID NO: 141558 - DNA, 20 bp, Artificial
  CRISPR gRNA sequence
tagaagaaaaaaaaatggag

SEQ ID NO: 141559 - DNA, 20 bp, Artificial
  CRISPR gRNA sequence
gaagaaaaaaaaatggagta

SEQ ID NO: 141560 - DNA, 20 bp, Artificial
  CRISPR gRNA sequence
aagaaaaaaaaatggagtag

SEQ ID NO: 141561 - DNA, 20 bp, Artificial
  CRISPR gRNA sequence
aaaaaaaaatggagtagagg

SEQ ID NO: 141562 - DNA, 20 bp, Artificial
  CRISPR gRNA sequence
gattgattgatgttttttta

SEQ ID NO: 141563 - DNA, 20 bp, Artificial
  CRISPR gRNA sequence
attgatgtttttttaaagat

SEQ ID NO: 141564 - DNA, 20 bp, Artificial
  CRISPR gRNA sequence
taagttctcacttcgtcact

SEQ ID NO: 141565 - DNA, 20 bp, Artificial
  CRISPR gRNA sequence
aagttctcacttcgtcactc

SEQ ID NO: 141566 - DNA, 20 bp, Artificial
  CRISPR gRNA sequence
tctcacttcgtcactcaggc

SEQ ID NO: 141567 - DNA, 20 bp, Artificial
  CRISPR gRNA sequence
tcacttcgtcactcaggctg

SEQ ID NO: 141568 - DNA, 20 bp, Artificial
  CRISPR gRNA sequence
tcgtcactcaggctggagtg

SEQ ID NO: 141569 - DNA, 20 bp, Artificial
  CRISPR gRNA sequence
tcactcaggctggagtgtag

SEQ ID NO: 141570 - DNA, 20 bp, Artificial
  CRISPR gRNA sequence
ggagtgtagtagcacaatca

SEQ ID NO: 141571 - DNA, 20 bp, Artificial
  CRISPR gRNA sequence
agcacaatcatagcttactg

SEQ ID NO: 141572 - DNA, 20 bp, Artificial
  CRISPR gRNA sequence
ttactgcagcttcaaactac

SEQ ID NO: 141573 - DNA, 20 bp, Artificial
  CRISPR gRNA sequence
tactgcagcttcaaactact

SEQ ID NO: 141574 - DNA, 20 bp, Artificial
  CRISPR gRNA sequence
agcttcaaactactgggctc

SEQ ID NO: 141575 - DNA, 20 bp, Artificial
  CRISPR gRNA sequence
ttcaaactactgggctcaag

SEQ ID NO: 141576 - DNA, 20 bp, Artificial
  CRISPR gRNA sequence
ctcaagcagtccttctgcct

SEQ ID NO: 141577 - DNA, 20 bp, Artificial
  CRISPR gRNA sequence
tccttctgcctcagcctccc

SEQ ID NO: 141578 - DNA, 20 bp, Artificial
  CRISPR gRNA sequence
ccttctgcctcagcctcccg

SEQ ID NO: 141579 - DNA, 20 bp, Artificial
  CRISPR gRNA sequence
ttctgcctcagcctcccgag

SEQ ID NO: 141580 - DNA, 20 bp, Artificial
  CRISPR gRNA sequence
gcctcagcctcccgaggagc

SEQ ID NO: 141581 - DNA, 20 bp, Artificial
  CRISPR gRNA sequence
cctcagcctcccgaggagct

SEQ ID NO: 141582 - DNA, 20 bp, Artificial
  CRISPR gRNA sequence
tcccgaggagctgggactcc

SEQ ID NO: 141583 - DNA, 20 bp, Artificial
  CRISPR gRNA sequence
cccgaggagctgggactccc

SEQ ID NO: 141584 - DNA, 20 bp, Artificial
  CRISPR gRNA sequence
caggcatgtgccaccacacc

SEQ ID NO: 141585 - DNA, 20 bp, Artificial
  CRISPR gRNA sequence
gataatttttaatttttttg

SEQ ID NO: 141586 - DNA, 20 bp, Artificial
  CRISPR gRNA sequence
taatttttaatttttttgtg

SEQ ID NO: 141587 - DNA, 20 bp, Artificial
  CRISPR gRNA sequence
ttttaatttttttgtggaga

SEQ ID NO: 141588 - DNA, 20 bp, Artificial
  CRISPR gRNA sequence
tttaatttttttgtggagat

SEQ ID NO: 141589 - DNA, 20 bp, Artificial
  CRISPR gRNA sequence
ttaatttttttgtggagatg

SEQ ID NO: 141590 - DNA, 20 bp, Artificial
  CRISPR gRNA sequence
tggggtctcattatgtttcc

SEQ ID NO: 141591 - DNA, 20 bp, Artificial
  CRISPR gRNA sequence
ggggtctcattatgtttccc

SEQ ID NO: 141592 - DNA, 20 bp, Artificial
  CRISPR gRNA sequence
tctcattatgtttcccaggc

SEQ ID NO: 141593 - DNA, 20 bp, Artificial
  CRISPR gRNA sequence
ccaggctggtctcaaactcc

SEQ ID NO: 141594 - DNA, 20 bp, Artificial
  CRISPR gRNA sequence
tttatgccatcctcccacct

SEQ ID NO: 141595 - DNA, 20 bp, Artificial
  CRISPR gRNA sequence
cctcccaccttggcctccca

SEQ ID NO: 141596 - DNA, 20 bp, Artificial
  CRISPR gRNA sequence
cccaccttggcctcccacag

SEQ ID NO: 141597 - DNA, 20 bp, Artificial
  CRISPR gRNA sequence
accttggcctcccacagtgg

SEQ ID NO: 141598 - DNA, 20 bp, Artificial
  CRISPR gRNA sequence
ccttggcctcccacagtggt

SEQ ID NO: 141599 - DNA, 20 bp, Artificial
  CRISPR gRNA sequence
ctcccacagtggtgggatga

SEQ ID NO: 141600 - DNA, 20 bp, Artificial
  CRISPR gRNA sequence
tcccacagtggtgggatgac

SEQ ID NO: 141601 - DNA, 20 bp, Artificial
  CRISPR gRNA sequence
agtggtgggatgacaggcat

SEQ ID NO: 141602 - DNA, 20 bp, Artificial
  CRISPR gRNA sequence
caggcatgagccaccatgcc

SEQ ID NO: 141603 - DNA, 20 bp, Artificial
  CRISPR gRNA sequence
catgagccaccatgcccagt

SEQ ID NO: 141604 - DNA, 20 bp, Artificial
  CRISPR gRNA sequence
atgagccaccatgcccagtt

SEQ ID NO: 141605 - DNA, 20 bp, Artificial
  CRISPR gRNA sequence
gagccaccatgcccagttag

SEQ ID NO: 141606 - DNA, 20 bp, Artificial
  CRISPR gRNA sequence
agccaccatgcccagttagg

SEQ ID NO: 141607 - DNA, 20 bp, Artificial
  CRISPR gRNA sequence
caccatgcccagttaggagg

SEQ ID NO: 141608 - DNA, 20 bp, Artificial
  CRISPR gRNA sequence
cccagttaggaggtagattt

SEQ ID NO: 141609 - DNA, 20 bp, Artificial
  CRISPR gRNA sequence
agatttaagtaattatgatt

SEQ ID NO: 141610 - DNA, 20 bp, Artificial
  CRISPR gRNA sequence
ttaagtaattatgatttggc

SEQ ID NO: 141611 - DNA, 20 bp, Artificial
  CRISPR gRNA sequence
taagtaattatgatttggcc

SEQ ID NO: 141612 - DNA, 20 bp, Artificial
  CRISPR gRNA sequence
aattatgatttggccaggtg

SEQ ID NO: 141613 - DNA, 20 bp, Artificial
  CRISPR gRNA sequence
tatgatttggccaggtgcgg

SEQ ID NO: 141614 - DNA, 20 bp, Artificial
  CRISPR gRNA sequence
cacctataatcccatcactt

SEQ ID NO: 141615 - DNA, 20 bp, Artificial
  CRISPR gRNA sequence
acctataatcccatcacttt

SEQ ID NO: 141616 - DNA, 20 bp, Artificial
  CRISPR gRNA sequence
ctataatcccatcactttgg

SEQ ID NO: 141617 - DNA, 20 bp, Artificial
  CRISPR gRNA sequence
tataatcccatcactttggg

SEQ ID NO: 141618 - DNA, 20 bp, Artificial
  CRISPR gRNA sequence
cccatcactttgggaggcca

SEQ ID NO: 141619 - DNA, 20 bp, Artificial
  CRISPR gRNA sequence
atcactttgggaggccaaag

SEQ ID NO: 141620 - DNA, 20 bp, Artificial
  CRISPR gRNA sequence
tcactttgggaggccaaagc

SEQ ID NO: 141621 - DNA, 20 bp, Artificial
  CRISPR gRNA sequence
actttgggaggccaaagcag

SEQ ID NO: 141622 - DNA, 20 bp, Artificial
  CRISPR gRNA sequence
ctttgggaggccaaagcagg

SEQ ID NO: 141623 - DNA, 20 bp, Artificial
  CRISPR gRNA sequence
tttgggaggccaaagcagga

SEQ ID NO: 141624 - DNA, 20 bp, Artificial
  CRISPR gRNA sequence
gccaaagcaggagggtcgca

SEQ ID NO: 141625 - DNA, 20 bp, Artificial
  CRISPR gRNA sequence
ccaaagcaggagggtcgcat

SEQ ID NO: 141626 - DNA, 20 bp, Artificial
  CRISPR gRNA sequence
gcaggagggtcgcatgggcc

SEQ ID NO: 141627 - DNA, 20 bp, Artificial
  CRISPR gRNA sequence
caggagggtcgcatgggccc

SEQ ID NO: 141628 - DNA, 20 bp, Artificial
  CRISPR gRNA sequence
ggagggtcgcatgggcccgg

SEQ ID NO: 141629 - DNA, 20 bp, Artificial
  CRISPR gRNA sequence
ggtcgcatgggcccgggagt

SEQ ID NO: 141630 - DNA, 20 bp, Artificial
  CRISPR gRNA sequence
tcgcatgggcccgggagttg

SEQ ID NO: 141631 - DNA, 20 bp, Artificial
  CRISPR gRNA sequence
tgggcccgggagttggagac

SEQ ID NO: 141632 - DNA, 20 bp, Artificial
  CRISPR gRNA sequence
ccgggagttggagaccagcc

SEQ ID NO: 141633 - DNA, 20 bp, Artificial
  CRISPR gRNA sequence
cgggagttggagaccagcct

SEQ ID NO: 141634 - DNA, 20 bp, Artificial
  CRISPR gRNA sequence
ggagaccagcctgggcaata

SEQ ID NO: 141635 - DNA, 20 bp, Artificial
  CRISPR gRNA sequence
accagcctgggcaatatggc

SEQ ID NO: 141636 - DNA, 20 bp, Artificial
  CRISPR gRNA sequence
ttgtctcaaaaacaaacaca

SEQ ID NO: 141637 - DNA, 20 bp, Artificial
  CRISPR gRNA sequence
gtctcaaaaacaaacacaca

SEQ ID NO: 141638 - DNA, 20 bp, Artificial
  CRISPR gRNA sequence
acacacagagaattaaaaat

SEQ ID NO: 141639 - DNA, 20 bp, Artificial
  CRISPR gRNA sequence
gaattaaaaataagtaatta

SEQ ID NO: 141640 - DNA, 20 bp, Artificial
  CRISPR gRNA sequence
taaaaataagtaattatggc

SEQ ID NO: 141641 - DNA, 20 bp, Artificial
  CRISPR gRNA sequence
aaaaataagtaattatggct

SEQ ID NO: 141642 - DNA, 20 bp, Artificial
  CRISPR gRNA sequence
taagtaattatggctgggcg

SEQ ID NO: 141643 - DNA, 20 bp, Artificial
  CRISPR gRNA sequence
gtaattatggctgggcgtag

SEQ ID NO: 141644 - DNA, 20 bp, Artificial
  CRISPR gRNA sequence
gtggctcacacctgtaatcc

SEQ ID NO: 141645 - DNA, 20 bp, Artificial
  CRISPR gRNA sequence
cacctgtaatcccagtactt

SEQ ID NO: 141646 - DNA, 20 bp, Artificial
  CRISPR gRNA sequence
acctgtaatcccagtacttt

SEQ ID NO: 141647 - DNA, 20 bp, Artificial
  CRISPR gRNA sequence
ctgtaatcccagtactttgg

SEQ ID NO: 141648 - DNA, 20 bp, Artificial
  CRISPR gRNA sequence
tgtaatcccagtactttggg

SEQ ID NO: 141649 - DNA, 20 bp, Artificial
  CRISPR gRNA sequence
tcccagtactttgggaggcc

SEQ ID NO: 141650 - DNA, 20 bp, Artificial
  CRISPR gRNA sequence
cccagtactttgggaggccg

SEQ ID NO: 141651 - DNA, 20 bp, Artificial
  CRISPR gRNA sequence
agtactttgggaggccgagg

SEQ ID NO: 141652 - DNA, 20 bp, Artificial
  CRISPR gRNA sequence
gtactttgggaggccgaggt

SEQ ID NO: 141653 - DNA, 20 bp, Artificial
  CRISPR gRNA sequence
ctttgggaggccgaggtggg

SEQ ID NO: 141654 - DNA, 20 bp, Artificial
  CRISPR gRNA sequence
gccgaggtgggcggatcaca

SEQ ID NO: 141655 - DNA, 20 bp, Artificial
  CRISPR gRNA sequence
aggtgggcggatcacaaagc

SEQ ID NO: 141656 - DNA, 20 bp, Artificial
  CRISPR gRNA sequence
ggtgggcggatcacaaagcc

SEQ ID NO: 141657 - DNA, 20 bp, Artificial
  CRISPR gRNA sequence
tgggcggatcacaaagccag

SEQ ID NO: 141658 - DNA, 20 bp, Artificial
  CRISPR gRNA sequence
gatcacaaagccaggagttc

SEQ ID NO: 141659 - DNA, 20 bp, Artificial
  CRISPR gRNA sequence
caaagccaggagttcaagac

SEQ ID NO: 141660 - DNA, 20 bp, Artificial
  CRISPR gRNA sequence
ccaggagttcaagaccagcc

SEQ ID NO: 141661 - DNA, 20 bp, Artificial
  CRISPR gRNA sequence
caagaccagcctggccaata

SEQ ID NO: 141662 - DNA, 20 bp, Artificial
  CRISPR gRNA sequence
tctactaaaaatacaaaaat

SEQ ID NO: 141663 - DNA, 20 bp, Artificial
  CRISPR gRNA sequence
ctaaaaatacaaaaattagc

SEQ ID NO: 141664 - DNA, 20 bp, Artificial
  CRISPR gRNA sequence
taaaaatacaaaaattagcc

SEQ ID NO: 141665 - DNA, 20 bp, Artificial
  CRISPR gRNA sequence
atacaaaaattagccgggcg

SEQ ID NO: 141666 - DNA, 20 bp, Artificial
  CRISPR gRNA sequence
caaaaattagccgggcgtgg

SEQ ID NO: 141667 - DNA, 20 bp, Artificial
  CRISPR gRNA sequence
aaattagccgggcgtggtgg

SEQ ID NO: 141668 - DNA, 20 bp, Artificial
  CRISPR gRNA sequence
aattagccgggcgtggtggc

SEQ ID NO: 141669 - DNA, 20 bp, Artificial
  CRISPR gRNA sequence
ggcgtggtggcgggcgccta

SEQ ID NO: 141670 - DNA, 20 bp, Artificial
  CRISPR gRNA sequence
gtggcgggcgcctatagtcc

SEQ ID NO: 141671 - DNA, 20 bp, Artificial
  CRISPR gRNA sequence
cgcctatagtcccagctacc

SEQ ID NO: 141672 - DNA, 20 bp, Artificial
  CRISPR gRNA sequence
gcctatagtcccagctaccc

SEQ ID NO: 141673 - DNA, 20 bp, Artificial
  CRISPR gRNA sequence
cctatagtcccagctacccg

SEQ ID NO: 141674 - DNA, 20 bp, Artificial
  CRISPR gRNA sequence
tatagtcccagctacccggg

SEQ ID NO: 141675 - DNA, 20 bp, Artificial
  CRISPR gRNA sequence
atagtcccagctacccgggg

SEQ ID NO: 141676 - DNA, 20 bp, Artificial
  CRISPR gRNA sequence
cccagctacccggggaggct

SEQ ID NO: 141677 - DNA, 20 bp, Artificial
  CRISPR gRNA sequence
ccagctacccggggaggctg

SEQ ID NO: 141678 - DNA, 20 bp, Artificial
  CRISPR gRNA sequence
gctacccggggaggctgagg

SEQ ID NO: 141679 - DNA, 20 bp, Artificial
  CRISPR gRNA sequence
ctacccggggaggctgaggc

SEQ ID NO: 141680 - DNA, 20 bp, Artificial
  CRISPR gRNA sequence
acccggggaggctgaggcag

SEQ ID NO: 141681 - DNA, 20 bp, Artificial
  CRISPR gRNA sequence
gcaggagaatctcttgaacc

SEQ ID NO: 141682 - DNA, 20 bp, Artificial
  CRISPR gRNA sequence
caggagaatctcttgaacct

SEQ ID NO: 141683 - DNA, 20 bp, Artificial
  CRISPR gRNA sequence
ggagaatctcttgaacctgg

SEQ ID NO: 141684 - DNA, 20 bp, Artificial
  CRISPR gRNA sequence
gagaatctcttgaacctggg

SEQ ID NO: 141685 - DNA, 20 bp, Artificial
  CRISPR gRNA sequence
aatctcttgaacctgggagg

SEQ ID NO: 141686 - DNA, 20 bp, Artificial
  CRISPR gRNA sequence
aacctgggaggcggatgttg

SEQ ID NO: 141687 - DNA, 20 bp, Artificial
  CRISPR gRNA sequence
tgggaggcggatgttgcagt

SEQ ID NO: 141688 - DNA, 20 bp, Artificial
  CRISPR gRNA sequence
ggcggatgttgcagtaagct

SEQ ID NO: 141689 - DNA, 20 bp, Artificial
  CRISPR gRNA sequence
cgtgccactgcactccaatc

SEQ ID NO: 141690 - DNA, 20 bp, Artificial
  CRISPR gRNA sequence
gtgccactgcactccaatct

SEQ ID NO: 141691 - DNA, 20 bp, Artificial
  CRISPR gRNA sequence
ctgcactccaatctgggtga

SEQ ID NO: 141692 - DNA, 20 bp, Artificial
  CRISPR gRNA sequence
gcactccaatctgggtgaca

SEQ ID NO: 141693 - DNA, 20 bp, Artificial
  CRISPR gRNA sequence
tccaatctgggtgacagagc

SEQ ID NO: 141694 - DNA, 20 bp, Artificial
  CRISPR gRNA sequence
gactgtctcaaaaaaaaaaa

SEQ ID NO: 141695 - DNA, 20 bp, Artificial
  CRISPR gRNA sequence
actgtctcaaaaaaaaaaaa

SEQ ID NO: 141696 - DNA, 20 bp, Artificial
  CRISPR gRNA sequence
aaaaaaggtaattatgattt

SEQ ID NO: 141697 - DNA, 20 bp, Artificial
  CRISPR gRNA sequence
aaaaaggtaattatgatttt

SEQ ID NO: 141698 - DNA, 20 bp, Artificial
  CRISPR gRNA sequence
ccatataacaaaaatgtatt

SEQ ID NO: 141699 - DNA, 20 bp, Artificial
  CRISPR gRNA sequence
attgagtgcttgttctatgc

SEQ ID NO: 141700 - DNA, 20 bp, Artificial
  CRISPR gRNA sequence
ttctatgccagacactgtgc

SEQ ID NO: 141701 - DNA, 20 bp, Artificial
  CRISPR gRNA sequence
tctatgccagacactgtgct

SEQ ID NO: 141702 - DNA, 20 bp, Artificial
  CRISPR gRNA sequence
atgccagacactgtgctagg

SEQ ID NO: 141703 - DNA, 20 bp, Artificial
  CRISPR gRNA sequence
tgccagacactgtgctaggc

SEQ ID NO: 141704 - DNA, 20 bp, Artificial
  CRISPR gRNA sequence
ccagacactgtgctaggcag

SEQ ID NO: 141705 - DNA, 20 bp, Artificial
  CRISPR gRNA sequence
cagacactgtgctaggcagg

SEQ ID NO: 141706 - DNA, 20 bp, Artificial
  CRISPR gRNA sequence
agacactgtgctaggcagga

SEQ ID NO: 141707 - DNA, 20 bp, Artificial
  CRISPR gRNA sequence
gtgctaggcaggagggttca

SEQ ID NO: 141708 - DNA, 20 bp, Artificial
  CRISPR gRNA sequence
gcaggagggttcaaagataa

SEQ ID NO: 141709 - DNA, 20 bp, Artificial
  CRISPR gRNA sequence
gttcaaagataatggctgct

SEQ ID NO: 141710 - DNA, 20 bp, Artificial
  CRISPR gRNA sequence
gataatggctgctcagtcac

SEQ ID NO: 141711 - DNA, 20 bp, Artificial
  CRISPR gRNA sequence
ggctgctcagtcactggctc

SEQ ID NO: 141712 - DNA, 20 bp, Artificial
  CRISPR gRNA sequence
gctgctcagtcactggctca

SEQ ID NO: 141713 - DNA, 20 bp, Artificial
  CRISPR gRNA sequence
tcgactgtatcatgatgcct

SEQ ID NO: 141714 - DNA, 20 bp, Artificial
  CRISPR gRNA sequence
cgactgtatcatgatgccta

SEQ ID NO: 141715 - DNA, 20 bp, Artificial
  CRISPR gRNA sequence
gactgtatcatgatgcctaa

SEQ ID NO: 141716 - DNA, 20 bp, Artificial
  CRISPR gRNA sequence
gatgcctaagggaccttctt

SEQ ID NO: 141717 - DNA, 20 bp, Artificial
  CRISPR gRNA sequence
ggctaatgcttgtgcctctg

SEQ ID NO: 141718 - DNA, 20 bp, Artificial
  CRISPR gRNA sequence
taatgcttgtgcctctgcag

SEQ ID NO: 141719 - DNA, 20 bp, Artificial
  CRISPR gRNA sequence
ggtgaaaactttacctgcca

SEQ ID NO: 141720 - DNA, 20 bp, Artificial
  CRISPR gRNA sequence
gtgaaaactttacctgccaa

SEQ ID NO: 141721 - DNA, 20 bp, Artificial
  CRISPR gRNA sequence
ccaaaggctttatcccttta

SEQ ID NO: 141722 - DNA, 20 bp, Artificial
  CRISPR gRNA sequence
atccctttacagaatgaact

SEQ ID NO: 141723 - DNA, 20 bp, Artificial
  CRISPR gRNA sequence
ccctttacagaatgaactta

SEQ ID NO: 141724 - DNA, 20 bp, Artificial
  CRISPR gRNA sequence
cctttacagaatgaacttag

SEQ ID NO: 141725 - DNA, 20 bp, Artificial
  CRISPR gRNA sequence
ctttacagaatgaacttaga

SEQ ID NO: 141726 - DNA, 20 bp, Artificial
  CRISPR gRNA sequence
ttacagaatgaacttagagg

SEQ ID NO: 141727 - DNA, 20 bp, Artificial
  CRISPR gRNA sequence
gaacttagagggagtctgcc

SEQ ID NO: 141728 - DNA, 20 bp, Artificial
  CRISPR gRNA sequence
aacttagagggagtctgcca

SEQ ID NO: 141729 - DNA, 20 bp, Artificial
  CRISPR gRNA sequence
acttagagggagtctgccaa

SEQ ID NO: 141730 - DNA, 20 bp, Artificial
  CRISPR gRNA sequence
tagagggagtctgccaaggg

SEQ ID NO: 141731 - DNA, 20 bp, Artificial
  CRISPR gRNA sequence
agagggagtctgccaagggc

SEQ ID NO: 141732 - DNA, 20 bp, Artificial
  CRISPR gRNA sequence
tgccaagggcaggctctgat

SEQ ID NO: 141733 - DNA, 20 bp, Artificial
  CRISPR gRNA sequence
tctgattggctgatcatcct

SEQ ID NO: 141734 - DNA, 20 bp, Artificial
  CRISPR gRNA sequence
gattggctgatcatcctaag

SEQ ID NO: 141735 - DNA, 20 bp, Artificial
  CRISPR gRNA sequence
tgatcatcctaagaagctca

SEQ ID NO: 141736 - DNA, 20 bp, Artificial
  CRISPR gRNA sequence
tcatggctgttgtgccctga

SEQ ID NO: 141737 - DNA, 20 bp, Artificial
  CRISPR gRNA sequence
tggctgttgtgccctgacag

SEQ ID NO: 141738 - DNA, 20 bp, Artificial
  CRISPR gRNA sequence
ggctgttgtgccctgacagc

SEQ ID NO: 141739 - DNA, 20 bp, Artificial
  CRISPR gRNA sequence
gctgttgtgccctgacagca

SEQ ID NO: 141740 - DNA, 20 bp, Artificial
  CRISPR gRNA sequence
gcacaccatacatgatttga

SEQ ID NO: 141741 - DNA, 20 bp, Artificial
  CRISPR gRNA sequence
gacagctgccatgctaacac

SEQ ID NO: 141742 - DNA, 20 bp, Artificial
  CRISPR gRNA sequence
ctcattttcctgaaatgatt

SEQ ID NO: 141743 - DNA, 20 bp, Artificial
  CRISPR gRNA sequence
gaaatgatttagaaatacct

SEQ ID NO: 141744 - DNA, 20 bp, Artificial
  CRISPR gRNA sequence
aaataccttggaaatcctct

SEQ ID NO: 141745 - DNA, 20 bp, Artificial
  CRISPR gRNA sequence
aataccttggaaatcctctc

SEQ ID NO: 141746 - DNA, 20 bp, Artificial
  CRISPR gRNA sequence
ggaaatcctctcgggaaaat

SEQ ID NO: 141747 - DNA, 20 bp, Artificial
  CRISPR gRNA sequence
gaaatcctctcgggaaaatt

SEQ ID NO: 141748 - DNA, 20 bp, Artificial
  CRISPR gRNA sequence
tcgggaaaattgggttgata

SEQ ID NO: 141749 - DNA, 20 bp, Artificial
  CRISPR gRNA sequence
aaaattgggttgatacagta

SEQ ID NO: 141750 - DNA, 20 bp, Artificial
  CRISPR gRNA sequence
ggttgatacagtacagtgat

SEQ ID NO: 141751 - DNA, 20 bp, Artificial
  CRISPR gRNA sequence
gatacagtacagtgatgagt

SEQ ID NO: 141752 - DNA, 20 bp, Artificial
  CRISPR gRNA sequence
acagtacagtgatgagttgg

SEQ ID NO: 141753 - DNA, 20 bp, Artificial
  CRISPR gRNA sequence
tggcagcatgcatttctttt

SEQ ID NO: 141754 - DNA, 20 bp, Artificial
  CRISPR gRNA sequence
agcatgcatttctttttagt

SEQ ID NO: 141755 - DNA, 20 bp, Artificial
  CRISPR gRNA sequence
tgcatttctttttagtcagc

SEQ ID NO: 141756 - DNA, 20 bp, Artificial
  CRISPR gRNA sequence
tgtgctcctctctgccaacc

SEQ ID NO: 141757 - DNA, 20 bp, Artificial
  CRISPR gRNA sequence
tctgccaacccagacgtgct

SEQ ID NO: 141758 - DNA, 20 bp, Artificial
  CRISPR gRNA sequence
caacccagacgtgctcagct

SEQ ID NO: 141759 - DNA, 20 bp, Artificial
  CRISPR gRNA sequence
acccagacgtgctcagcttg

SEQ ID NO: 141760 - DNA, 20 bp, Artificial
  CRISPR gRNA sequence
gtgctcagcttggagctgat

SEQ ID NO: 141761 - DNA, 20 bp, Artificial
  CRISPR gRNA sequence
tgctcagcttggagctgata

SEQ ID NO: 141762 - DNA, 20 bp, Artificial
  CRISPR gRNA sequence
ttggagctgataaggcttgt

SEQ ID NO: 141763 - DNA, 20 bp, Artificial
  CRISPR gRNA sequence
tggagctgataaggcttgtg

SEQ ID NO: 141764 - DNA, 20 bp, Artificial
  CRISPR gRNA sequence
gctgataaggcttgtgagga

SEQ ID NO: 141765 - DNA, 20 bp, Artificial
  CRISPR gRNA sequence
taaggcttgtgaggatggtg

SEQ ID NO: 141766 - DNA, 20 bp, Artificial
  CRISPR gRNA sequence
gcttgtgaggatggtgaagt

SEQ ID NO: 141767 - DNA, 20 bp, Artificial
  CRISPR gRNA sequence
atggtgaagttggtccttcc

SEQ ID NO: 141768 - DNA, 20 bp, Artificial
  CRISPR gRNA sequence
tggtccttcccagcatttcc

SEQ ID NO: 141769 - DNA, 20 bp, Artificial
  CRISPR gRNA sequence
gtttcaccatcctgctgctt

SEQ ID NO: 141770 - DNA, 20 bp, Artificial
  CRISPR gRNA sequence
tttcaccatcctgctgcttc

SEQ ID NO: 141771 - DNA, 20 bp, Artificial
  CRISPR gRNA sequence
ttcaccatcctgctgcttca

SEQ ID NO: 141772 - DNA, 20 bp, Artificial
  CRISPR gRNA sequence
accatcctgctgcttcaggg

SEQ ID NO: 141773 - DNA, 20 bp, Artificial
  CRISPR gRNA sequence
tgtgctgtgtcacacctccc

SEQ ID NO: 141774 - DNA, 20 bp, Artificial
  CRISPR gRNA sequence
gtcacacctccctggacccg

SEQ ID NO: 141775 - DNA, 20 bp, Artificial
  CRISPR gRNA sequence
cctccctggacccgtagtga

SEQ ID NO: 141776 - DNA, 20 bp, Artificial
  CRISPR gRNA sequence
cccgtagtgatggctatttc

SEQ ID NO: 141777 - DNA, 20 bp, Artificial
  CRISPR gRNA sequence
agtgatggctatttcaagtt

SEQ ID NO: 141778 - DNA, 20 bp, Artificial
  CRISPR gRNA sequence
ttgagtgcaaatatccttcg

SEQ ID NO: 141779 - DNA, 20 bp, Artificial
  CRISPR gRNA sequence
tgagtgcaaatatccttcgt

SEQ ID NO: 141780 - DNA, 20 bp, Artificial
  CRISPR gRNA sequence
tgcaaatatccttcgtagga

SEQ ID NO: 141781 - DNA, 20 bp, Artificial
  CRISPR gRNA sequence
gacagaatacatatgtatta

SEQ ID NO: 141782 - DNA, 20 bp, Artificial
  CRISPR gRNA sequence
agaatacatatgtattaaag

SEQ ID NO: 141783 - DNA, 20 bp, Artificial
  CRISPR gRNA sequence
aatacatatgtattaaagca

SEQ ID NO: 141784 - DNA, 20 bp, Artificial
  CRISPR gRNA sequence
catatgtattaaagcagagt

SEQ ID NO: 141785 - DNA, 20 bp, Artificial
  CRISPR gRNA sequence
tgtattaaagcagagttgga

SEQ ID NO: 141786 - DNA, 20 bp, Artificial
  CRISPR gRNA sequence
gttggaaagaatgcatattt

SEQ ID NO: 141787 - DNA, 20 bp, Artificial
  CRISPR gRNA sequence
ataaattgaaaacttatttc

SEQ ID NO: 141788 - DNA, 20 bp, Artificial
  CRISPR gRNA sequence
aaattgaaaacttatttctg

SEQ ID NO: 141789 - DNA, 20 bp, Artificial
  CRISPR gRNA sequence
aattgaaaacttatttctgg

SEQ ID NO: 141790 - DNA, 20 bp, Artificial
  CRISPR gRNA sequence
gaaaacttatttctggaggt

SEQ ID NO: 141791 - DNA, 20 bp, Artificial
  CRISPR gRNA sequence
aaaacttatttctggaggtt

SEQ ID NO: 141792 - DNA, 20 bp, Artificial
  CRISPR gRNA sequence
ttatttctggaggttgggaa

SEQ ID NO: 141793 - DNA, 20 bp, Artificial
  CRISPR gRNA sequence
tatttctggaggttgggaat

SEQ ID NO: 141794 - DNA, 20 bp, Artificial
  CRISPR gRNA sequence
ctggaggttgggaataggct

SEQ ID NO: 141795 - DNA, 20 bp, Artificial
  CRISPR gRNA sequence
ataggctgagttgaaaattg

SEQ ID NO: 141796 - DNA, 20 bp, Artificial
  CRISPR gRNA sequence
tgagttgaaaattgtggtac

SEQ ID NO: 141797 - DNA, 20 bp, Artificial
  CRISPR gRNA sequence
tgaaaattgtggtacaagaa

SEQ ID NO: 141798 - DNA, 20 bp, Artificial
  CRISPR gRNA sequence
aaattgtggtacaagaatgg

SEQ ID NO: 141799 - DNA, 20 bp, Artificial
  CRISPR gRNA sequence
atggaagaaatgttttctgt

SEQ ID NO: 141800 - DNA, 20 bp, Artificial
  CRISPR gRNA sequence
agaaatgttttctgttagcc

SEQ ID NO: 141801 - DNA, 20 bp, Artificial
  CRISPR gRNA sequence
tagcccactgcatgtacttt

SEQ ID NO: 141802 - DNA, 20 bp, Artificial
  CRISPR gRNA sequence
cactctgtcgtctttctttt

SEQ ID NO: 141803 - DNA, 20 bp, Artificial
  CRISPR gRNA sequence
ctttctttttggccctcctc

SEQ ID NO: 141804 - DNA, 20 bp, Artificial
  CRISPR gRNA sequence
tttggccctcctccagttta

SEQ ID NO: 141805 - DNA, 20 bp, Artificial
  CRISPR gRNA sequence
agtttatagtaatttctccg

SEQ ID NO: 141806 - DNA, 20 bp, Artificial
  CRISPR gRNA sequence
tgaatctcatctgtcgttcc

SEQ ID NO: 141807 - DNA, 20 bp, Artificial
  CRISPR gRNA sequence
atccccttcccttgtaactt

SEQ ID NO: 141808 - DNA, 20 bp, Artificial
  CRISPR gRNA sequence
cccttgtaactttggatgca

SEQ ID NO: 141809 - DNA, 20 bp, Artificial
  CRISPR gRNA sequence
ggatgcatagttgtaatttt

SEQ ID NO: 141810 - DNA, 20 bp, Artificial
  CRISPR gRNA sequence
gtaattttcagtaacctatg

SEQ ID NO: 141811 - DNA, 20 bp, Artificial
  CRISPR gRNA sequence
ttttcagtaacctatgcagt

SEQ ID NO: 141812 - DNA, 20 bp, Artificial
  CRISPR gRNA sequence
taacctatgcagtcagaatt

SEQ ID NO: 141813 - DNA, 20 bp, Artificial
  CRISPR gRNA sequence
gcagtcagaattaagaacat

SEQ ID NO: 141814 - DNA, 20 bp, Artificial
  CRISPR gRNA sequence
cagaattaagaacatcagaa

SEQ ID NO: 141815 - DNA, 20 bp, Artificial
  CRISPR gRNA sequence
gaacatcagaatagcaacat

SEQ ID NO: 141816 - DNA, 20 bp, Artificial
  CRISPR gRNA sequence
cagaatagcaacatcggttg

SEQ ID NO: 141817 - DNA, 20 bp, Artificial
  CRISPR gRNA sequence
gttgaagtttatgattcatt

SEQ ID NO: 141818 - DNA, 20 bp, Artificial
  CRISPR gRNA sequence
tgaagtttatgattcattga

SEQ ID NO: 141819 - DNA, 20 bp, Artificial
  CRISPR gRNA sequence
atgattcattgagagttcca

SEQ ID NO: 141820 - DNA, 20 bp, Artificial
  CRISPR gRNA sequence
agttccatagtcttcttatt

SEQ ID NO: 141821 - DNA, 20 bp, Artificial
  CRISPR gRNA sequence
gttccatagtcttcttattg

SEQ ID NO: 141822 - DNA, 20 bp, Artificial
  CRISPR gRNA sequence
ttattgaggtgattaattca

SEQ ID NO: 141823 - DNA, 20 bp, Artificial
  CRISPR gRNA sequence
tgaggtgattaattcaaagt

SEQ ID NO: 141824 - DNA, 20 bp, Artificial
  CRISPR gRNA sequence
gaggtgattaattcaaagtg

SEQ ID NO: 141825 - DNA, 20 bp, Artificial
  CRISPR gRNA sequence
ggtgattaattcaaagtgag

SEQ ID NO: 141826 - DNA, 20 bp, Artificial
  CRISPR gRNA sequence
tgattaattcaaagtgagga

SEQ ID NO: 141827 - DNA, 20 bp, Artificial
  CRISPR gRNA sequence
taattcaaagtgaggagaga

SEQ ID NO: 141828 - DNA, 20 bp, Artificial
  CRISPR gRNA sequence
aaagtgaggagagatagtga

SEQ ID NO: 141829 - DNA, 20 bp, Artificial
  CRISPR gRNA sequence
gagagatagtgatggaattc

SEQ ID NO: 141830 - DNA, 20 bp, Artificial
  CRISPR gRNA sequence
gatagtgatggaattcaagt

SEQ ID NO: 141831 - DNA, 20 bp, Artificial
  CRISPR gRNA sequence
atagtgatggaattcaagtc

SEQ ID NO: 141832 - DNA, 20 bp, Artificial
  CRISPR gRNA sequence
tagtgatggaattcaagtca

SEQ ID NO: 141833 - DNA, 20 bp, Artificial
  CRISPR gRNA sequence
atggaattcaagtcagggat

SEQ ID NO: 141834 - DNA, 20 bp, Artificial
  CRISPR gRNA sequence
tggaattcaagtcagggatt

SEQ ID NO: 141835 - DNA, 20 bp, Artificial
  CRISPR gRNA sequence
caagtcagggattgggtgta

SEQ ID NO: 141836 - DNA, 20 bp, Artificial
  CRISPR gRNA sequence
aagtcagggattgggtgtac

SEQ ID NO: 141837 - DNA, 20 bp, Artificial
  CRISPR gRNA sequence
agggattgggtgtacaggtg

SEQ ID NO: 141838 - DNA, 20 bp, Artificial
  CRISPR gRNA sequence
ggtgtacaggtgtagtttaa

SEQ ID NO: 141839 - DNA, 20 bp, Artificial
  CRISPR gRNA sequence
gtgtacaggtgtagtttaaa

SEQ ID NO: 141840 - DNA, 20 bp, Artificial
  CRISPR gRNA sequence
ccccccatcactaccaccac

SEQ ID NO: 141841 - DNA, 20 bp, Artificial
  CRISPR gRNA sequence
catcactaccaccaccagat

SEQ ID NO: 141842 - DNA, 20 bp, Artificial
  CRISPR gRNA sequence
ctaccaccaccagatgagcc

SEQ ID NO: 141843 - DNA, 20 bp, Artificial
  CRISPR gRNA sequence
caccaccagatgagcccaga

SEQ ID NO: 141844 - DNA, 20 bp, Artificial
  CRISPR gRNA sequence
accaccagatgagcccagat

SEQ ID NO: 141845 - DNA, 20 bp, Artificial
  CRISPR gRNA sequence
cccagataggctcactgctc

SEQ ID NO: 141846 - DNA, 20 bp, Artificial
  CRISPR gRNA sequence
ccagataggctcactgctct

SEQ ID NO: 141847 - DNA, 20 bp, Artificial
  CRISPR gRNA sequence
ctgctctaggtaacctgtaa

SEQ ID NO: 141848 - DNA, 20 bp, Artificial
  CRISPR gRNA sequence
taacctgtaaaagtcacaaa

SEQ ID NO: 141849 - DNA, 20 bp, Artificial
  CRISPR gRNA sequence
aaaagtcacaaacagtacta

SEQ ID NO: 141850 - DNA, 20 bp, Artificial
  CRISPR gRNA sequence
aaagtcacaaacagtactaa

SEQ ID NO: 141851 - DNA, 20 bp, Artificial
  CRISPR gRNA sequence
acaaacagtactaaaggttt

SEQ ID NO: 141852 - DNA, 20 bp, Artificial
  CRISPR gRNA sequence
actaaaggtttgagatttga

SEQ ID NO: 141853 - DNA, 20 bp, Artificial
  CRISPR gRNA sequence
gaaagaataattgacccttt

SEQ ID NO: 141854 - DNA, 20 bp, Artificial
  CRISPR gRNA sequence
agaataattgacccttttgg

SEQ ID NO: 141855 - DNA, 20 bp, Artificial
  CRISPR gRNA sequence
ttgtgtctttaccgtctcaa

SEQ ID NO: 141856 - DNA, 20 bp, Artificial
  CRISPR gRNA sequence
gtgtctttaccgtctcaaaa

SEQ ID NO: 141857 - DNA, 20 bp, Artificial
  CRISPR gRNA sequence
tctcaaaagagtacatttca

SEQ ID NO: 141858 - DNA, 20 bp, Artificial
  CRISPR gRNA sequence
ctcaaaagagtacatttcat

SEQ ID NO: 141859 - DNA, 20 bp, Artificial
  CRISPR gRNA sequence
ggactacaaccattgtgtgt

SEQ ID NO: 141860 - DNA, 20 bp, Artificial
  CRISPR gRNA sequence
actacaaccattgtgtgtga

SEQ ID NO: 141861 - DNA, 20 bp, Artificial
  CRISPR gRNA sequence
caaccattgtgtgtgagaga

SEQ ID NO: 141862 - DNA, 20 bp, Artificial
  CRISPR gRNA sequence
tgtgagagacagaatctgcc

SEQ ID NO: 141863 - DNA, 20 bp, Artificial
  CRISPR gRNA sequence
atctgccaagtcatacacat

SEQ ID NO: 141864 - DNA, 20 bp, Artificial
  CRISPR gRNA sequence
tctgccaagtcatacacatt

SEQ ID NO: 141865 - DNA, 20 bp, Artificial
  CRISPR gRNA sequence
gccaagtcatacacattggg

SEQ ID NO: 141866 - DNA, 20 bp, Artificial
  CRISPR gRNA sequence
ggcagaaatttcttaaatct

SEQ ID NO: 141867 - DNA, 20 bp, Artificial
  CRISPR gRNA sequence
aaatctgagattgctatttt

SEQ ID NO: 141868 - DNA, 20 bp, Artificial
  CRISPR gRNA sequence
ctgagattgctatttttaga

SEQ ID NO: 141869 - DNA, 20 bp, Artificial
  CRISPR gRNA sequence
gattgctatttttagaaagt

SEQ ID NO: 141870 - DNA, 20 bp, Artificial
  CRISPR gRNA sequence
ttgctatttttagaaagtta

SEQ ID NO: 141871 - DNA, 20 bp, Artificial
  CRISPR gRNA sequence
ctttcttaaattctattaat

SEQ ID NO: 141872 - DNA, 20 bp, Artificial
  CRISPR gRNA sequence
tttcttaaattctattaatt

SEQ ID NO: 141873 - DNA, 20 bp, Artificial
  CRISPR gRNA sequence
ttcttaaattctattaatta

SEQ ID NO: 141874 - DNA, 20 bp, Artificial
  CRISPR gRNA sequence
tcttaaattctattaattag

SEQ ID NO: 141875 - DNA, 20 bp, Artificial
  CRISPR gRNA sequence
taaattctattaattagggg

SEQ ID NO: 141876 - DNA, 20 bp, Artificial
  CRISPR gRNA sequence
ctattaattaggggtagact

SEQ ID NO: 141877 - DNA, 20 bp, Artificial
  CRISPR gRNA sequence
aattaggggtagacttagtt

SEQ ID NO: 141878 - DNA, 20 bp, Artificial
  CRISPR gRNA sequence
ttaggggtagacttagttaa

SEQ ID NO: 141879 - DNA, 20 bp, Artificial
  CRISPR gRNA sequence
gttaagagtctgtgtcttaa

SEQ ID NO: 141880 - DNA, 20 bp, Artificial
  CRISPR gRNA sequence
gtctgtgtcttaacagtgcc

SEQ ID NO: 141881 - DNA, 20 bp, Artificial
  CRISPR gRNA sequence
gtgtcttaacagtgcccagt

SEQ ID NO: 141882 - DNA, 20 bp, Artificial
  CRISPR gRNA sequence
cttaacagtgcccagtgagt

SEQ ID NO: 141883 - DNA, 20 bp, Artificial
  CRISPR gRNA sequence
aacagtgcccagtgagttag

SEQ ID NO: 141884 - DNA, 20 bp, Artificial
  CRISPR gRNA sequence
tagcagtgtttgctctcctt

SEQ ID NO: 141885 - DNA, 20 bp, Artificial
  CRISPR gRNA sequence
agcagtgtttgctctccttt

SEQ ID NO: 141886 - DNA, 20 bp, Artificial
  CRISPR gRNA sequence
agtgtttgctctcctttggg

SEQ ID NO: 141887 - DNA, 20 bp, Artificial
  CRISPR gRNA sequence
tcctttgggaagccatactg

SEQ ID NO: 141888 - DNA, 20 bp, Artificial
  CRISPR gRNA sequence
tgggaagccatactgtggtc

SEQ ID NO: 141889 - DNA, 20 bp, Artificial
  CRISPR gRNA sequence
ggaagccatactgtggtcca

SEQ ID NO: 141890 - DNA, 20 bp, Artificial
  CRISPR gRNA sequence
agccatactgtggtccagag

SEQ ID NO: 141891 - DNA, 20 bp, Artificial
  CRISPR gRNA sequence
tgtggtccagagcagccatc

SEQ ID NO: 141892 - DNA, 20 bp, Artificial
  CRISPR gRNA sequence
gtccagagcagccatctggc

SEQ ID NO: 141893 - DNA, 20 bp, Artificial
  CRISPR gRNA sequence
gagcagccatctggccagtg

SEQ ID NO: 141894 - DNA, 20 bp, Artificial
  CRISPR gRNA sequence
agcagccatctggccagtgt

SEQ ID NO: 141895 - DNA, 20 bp, Artificial
  CRISPR gRNA sequence
agccatctggccagtgtggg

SEQ ID NO: 141896 - DNA, 20 bp, Artificial
  CRISPR gRNA sequence
gccatctggccagtgtgggc

SEQ ID NO: 141897 - DNA, 20 bp, Artificial
  CRISPR gRNA sequence
tgtgggcaggaattgctctg

SEQ ID NO: 141898 - DNA, 20 bp, Artificial
  CRISPR gRNA sequence
gaattgctctgcagcttgaa

SEQ ID NO: 141899 - DNA, 20 bp, Artificial
  CRISPR gRNA sequence
aattgctctgcagcttgaat

SEQ ID NO: 141900 - DNA, 20 bp, Artificial
  CRISPR gRNA sequence
attgctctgcagcttgaatg

SEQ ID NO: 141901 - DNA, 20 bp, Artificial
  CRISPR gRNA sequence
ctctgcagcttgaatggggt

SEQ ID NO: 141902 - DNA, 20 bp, Artificial
  CRISPR gRNA sequence
ctgcagcttgaatggggtga

SEQ ID NO: 141903 - DNA, 20 bp, Artificial
  CRISPR gRNA sequence
agcttgaatggggtgagagc

SEQ ID NO: 141904 - DNA, 20 bp, Artificial
  CRISPR gRNA sequence
gggtgagagccagcgtgcac

SEQ ID NO: 141905 - DNA, 20 bp, Artificial
  CRISPR gRNA sequence
ggtgagagccagcgtgcact

SEQ ID NO: 141906 - DNA, 20 bp, Artificial
  CRISPR gRNA sequence
gtgagagccagcgtgcacta

SEQ ID NO: 141907 - DNA, 20 bp, Artificial
  CRISPR gRNA sequence
gcgtgcactagggcccgcct

SEQ ID NO: 141908 - DNA, 20 bp, Artificial
  CRISPR gRNA sequence
gtgcactagggcccgccttg

SEQ ID NO: 141909 - DNA, 20 bp, Artificial
  CRISPR gRNA sequence
cctgtgctttatttttctct

SEQ ID NO: 141910 - DNA, 20 bp, Artificial
  CRISPR gRNA sequence
tctcagtgtcttacatgcct

SEQ ID NO: 141911 - DNA, 20 bp, Artificial
  CRISPR gRNA sequence
agtgtcttacatgcctaaga

SEQ ID NO: 141912 - DNA, 20 bp, Artificial
  CRISPR gRNA sequence
tgtcttacatgcctaagaaa

SEQ ID NO: 141913 - DNA, 20 bp, Artificial
  CRISPR gRNA sequence
ccctccaaattcacctgccc

SEQ ID NO: 141914 - DNA, 20 bp, Artificial
  CRISPR gRNA sequence
acctgccccagacttgactt

SEQ ID NO: 141915 - DNA, 20 bp, Artificial
  CRISPR gRNA sequence
cttgactttggctatttctg

SEQ ID NO: 141916 - DNA, 20 bp, Artificial
  CRISPR gRNA sequence
ttggctatttctgaagtaaa

SEQ ID NO: 141917 - DNA, 20 bp, Artificial
  CRISPR gRNA sequence
atttctgaagtaaacggtca

SEQ ID NO: 141918 - DNA, 20 bp, Artificial
  CRISPR gRNA sequence
gttgcttttgattttttctg

SEQ ID NO: 141919 - DNA, 20 bp, Artificial
  CRISPR gRNA sequence
gtgtatgtgccttatcacta

SEQ ID NO: 141920 - DNA, 20 bp, Artificial
  CRISPR gRNA sequence
tgtatgtgccttatcactaa

SEQ ID NO: 141921 - DNA, 20 bp, Artificial
  CRISPR gRNA sequence
gtatgtgccttatcactaaa

SEQ ID NO: 141922 - DNA, 20 bp, Artificial
  CRISPR gRNA sequence
tatgtgccttatcactaaag

SEQ ID NO: 141923 - DNA, 20 bp, Artificial
  CRISPR gRNA sequence
atcactaaaggggctgtgaa

SEQ ID NO: 141924 - DNA, 20 bp, Artificial
  CRISPR gRNA sequence
aaaggggctgtgaaaagttg

SEQ ID NO: 141925 - DNA, 20 bp, Artificial
  CRISPR gRNA sequence
ctgtgaaaagttgcagcatt

SEQ ID NO: 141926 - DNA, 20 bp, Artificial
  CRISPR gRNA sequence
tgtgaaaagttgcagcattt

SEQ ID NO: 141927 - DNA, 20 bp, Artificial
  CRISPR gRNA sequence
gtgaaaagttgcagcatttg

SEQ ID NO: 141928 - DNA, 20 bp, Artificial
  CRISPR gRNA sequence
aagttgcagcatttggggca

SEQ ID NO: 141929 - DNA, 20 bp, Artificial
  CRISPR gRNA sequence
gttgcagcatttggggcaca

SEQ ID NO: 141930 - DNA, 20 bp, Artificial
  CRISPR gRNA sequence
ggggcacagagatttatgtt

SEQ ID NO: 141931 - DNA, 20 bp, Artificial
  CRISPR gRNA sequence
gggcacagagatttatgttt

SEQ ID NO: 141932 - DNA, 20 bp, Artificial
  CRISPR gRNA sequence
catgcaaatatttgtactgt

SEQ ID NO: 141933 - DNA, 20 bp, Artificial
  CRISPR gRNA sequence
tgtgagcctaaaaatatttt

SEQ ID NO: 141934 - DNA, 20 bp, Artificial
  CRISPR gRNA sequence
ttttggtttttctttcgttt

SEQ ID NO: 141935 - DNA, 20 bp, Artificial
  CRISPR gRNA sequence
ttggtttttctttcgttttg

SEQ ID NO: 141936 - DNA, 20 bp, Artificial
  CRISPR gRNA sequence
ggtttttctttcgttttgga

SEQ ID NO: 141937 - DNA, 20 bp, Artificial
  CRISPR gRNA sequence
ttcgttttggagagtaactt

SEQ ID NO: 141938 - DNA, 20 bp, Artificial
  CRISPR gRNA sequence
cttcagcaatgctgtaaacc

SEQ ID NO: 141939 - DNA, 20 bp, Artificial
  CRISPR gRNA sequence
tcagcaatgctgtaaaccca

SEQ ID NO: 141940 - DNA, 20 bp, Artificial
  CRISPR gRNA sequence
cagcaatgctgtaaacccag

SEQ ID NO: 141941 - DNA, 20 bp, Artificial
  CRISPR gRNA sequence
tgtaaacccagaggactctg

SEQ ID NO: 141942 - DNA, 20 bp, Artificial
  CRISPR gRNA sequence
gtaaacccagaggactctgt

SEQ ID NO: 141943 - DNA, 20 bp, Artificial
  CRISPR gRNA sequence
aggactctgtaggttattac

SEQ ID NO: 141944 - DNA, 20 bp, Artificial
  CRISPR gRNA sequence
tgtaggttattactagtact

SEQ ID NO: 141945 - DNA, 20 bp, Artificial
  CRISPR gRNA sequence
tactagtactgagatgacct

SEQ ID NO: 141946 - DNA, 20 bp, Artificial
  CRISPR gRNA sequence
actagtactgagatgacctt

SEQ ID NO: 141947 - DNA, 20 bp, Artificial
  CRISPR gRNA sequence
gagatgaccttaggcattca

SEQ ID NO: 141948 - DNA, 20 bp, Artificial
  CRISPR gRNA sequence
gatgaccttaggcattcatg

SEQ ID NO: 141949 - DNA, 20 bp, Artificial
  CRISPR gRNA sequence
tgaccttaggcattcatgga

SEQ ID NO: 141950 - DNA, 20 bp, Artificial
  CRISPR gRNA sequence
gaccttaggcattcatggag

SEQ ID NO: 141951 - DNA, 20 bp, Artificial
  CRISPR gRNA sequence
accttaggcattcatggaga

SEQ ID NO: 141952 - DNA, 20 bp, Artificial
  CRISPR gRNA sequence
tcatggagagggtttgctcc

SEQ ID NO: 141953 - DNA, 20 bp, Artificial
  CRISPR gRNA sequence
attgctcgttattaacctct

SEQ ID NO: 141954 - DNA, 20 bp, Artificial
  CRISPR gRNA sequence
ttaacctctcggtaatcctg

SEQ ID NO: 141955 - DNA, 20 bp, Artificial
  CRISPR gRNA sequence
taacctctcggtaatcctgt

SEQ ID NO: 141956 - DNA, 20 bp, Artificial
  CRISPR gRNA sequence
tcggtaatcctgtgggctct

SEQ ID NO: 141957 - DNA, 20 bp, Artificial
  CRISPR gRNA sequence
gctctgagcctgaactcacg

SEQ ID NO: 141958 - DNA, 20 bp, Artificial
  CRISPR gRNA sequence
attctcataactcttccttt

SEQ ID NO: 141959 - DNA, 20 bp, Artificial
  CRISPR gRNA sequence
agaccacacctgtgacaatg

SEQ ID NO: 141960 - DNA, 20 bp, Artificial
  CRISPR gRNA sequence
gaccacacctgtgacaatgc

SEQ ID NO: 141961 - DNA, 20 bp, Artificial
  CRISPR gRNA sequence
acacctgtgacaatgcaggt

SEQ ID NO: 141962 - DNA, 20 bp, Artificial
  CRISPR gRNA sequence
acctgtgacaatgcaggttg

SEQ ID NO: 141963 - DNA, 20 bp, Artificial
  CRISPR gRNA sequence
tgtgacaatgcaggttggag

SEQ ID NO: 141964 - DNA, 20 bp, Artificial
  CRISPR gRNA sequence
gtgacaatgcaggttggaga

SEQ ID NO: 141965 - DNA, 20 bp, Artificial
  CRISPR gRNA sequence
caatgcaggttggagaaggt

SEQ ID NO: 141966 - DNA, 20 bp, Artificial
  CRISPR gRNA sequence
tgcaggttggagaaggtcag

SEQ ID NO: 141967 - DNA, 20 bp, Artificial
  CRISPR gRNA sequence
gcaggttggagaaggtcagc

SEQ ID NO: 141968 - DNA, 20 bp, Artificial
  CRISPR gRNA sequence
ttggagaaggtcagcaggtg

SEQ ID NO: 141969 - DNA, 20 bp, Artificial
  CRISPR gRNA sequence
gtcagcaggtgcagattgtc

SEQ ID NO: 141970 - DNA, 20 bp, Artificial
  CRISPR gRNA sequence
tcagcaggtgcagattgtcc

SEQ ID NO: 141971 - DNA, 20 bp, Artificial
  CRISPR gRNA sequence
aggtgcagattgtccaggct

SEQ ID NO: 141972 - DNA, 20 bp, Artificial
  CRISPR gRNA sequence
agattgtccaggctcagcca

SEQ ID NO: 141973 - DNA, 20 bp, Artificial
  CRISPR gRNA sequence
gattgtccaggctcagccac

SEQ ID NO: 141974 - DNA, 20 bp, Artificial
  CRISPR gRNA sequence
attgtccaggctcagccaca

SEQ ID NO: 141975 - DNA, 20 bp, Artificial
  CRISPR gRNA sequence
ccaggctcagccacagggtc

SEQ ID NO: 141976 - DNA, 20 bp, Artificial
  CRISPR gRNA sequence
agccacagggtcaagcccaa

SEQ ID NO: 141977 - DNA, 20 bp, Artificial
  CRISPR gRNA sequence
gccacagggtcaagcccaac

SEQ ID NO: 141978 - DNA, 20 bp, Artificial
  CRISPR gRNA sequence
agggtcaagcccaacaggcc

SEQ ID NO: 141979 - DNA, 20 bp, Artificial
  CRISPR gRNA sequence
ggtcaagcccaacaggccca

SEQ ID NO: 141980 - DNA, 20 bp, Artificial
  CRISPR gRNA sequence
caagcccaacaggcccagag

SEQ ID NO: 141981 - DNA, 20 bp, Artificial
  CRISPR gRNA sequence
caacaggcccagagtggcac

SEQ ID NO: 141982 - DNA, 20 bp, Artificial
  CRISPR gRNA sequence
aggcccagagtggcactgga

SEQ ID NO: 141983 - DNA, 20 bp, Artificial
  CRISPR gRNA sequence
gtggcactggacagaccatg

SEQ ID NO: 141984 - DNA, 20 bp, Artificial
  CRISPR gRNA sequence
tggcactggacagaccatgc

SEQ ID NO: 141985 - DNA, 20 bp, Artificial
  CRISPR gRNA sequence
gacagaccatgcaggtgatg

SEQ ID NO: 141986 - DNA, 20 bp, Artificial
  CRISPR gRNA sequence
agaccatgcaggtgatgcag

SEQ ID NO: 141987 - DNA, 20 bp, Artificial
  CRISPR gRNA sequence
gcagcagatcatcactaaca

SEQ ID NO: 141988 - DNA, 20 bp, Artificial
  CRISPR gRNA sequence
cagcagatcatcactaacac

SEQ ID NO: 141989 - DNA, 20 bp, Artificial
  CRISPR gRNA sequence
gcagatcatcactaacacag

SEQ ID NO: 141990 - DNA, 20 bp, Artificial
  CRISPR gRNA sequence
agatcatcactaacacagga

SEQ ID NO: 141991 - DNA, 20 bp, Artificial
  CRISPR gRNA sequence
tcactaacacaggagagatc

SEQ ID NO: 141992 - DNA, 20 bp, Artificial
  CRISPR gRNA sequence
ctaacacaggagagatccag

SEQ ID NO: 141993 - DNA, 20 bp, Artificial
  CRISPR gRNA sequence
aggagagatccagcagatcc

SEQ ID NO: 141994 - DNA, 20 bp, Artificial
  CRISPR gRNA sequence
gagatccagcagatcccggt

SEQ ID NO: 141995 - DNA, 20 bp, Artificial
  CRISPR gRNA sequence
atcccggtgagtcctgccct

SEQ ID NO: 141996 - DNA, 20 bp, Artificial
  CRISPR gRNA sequence
tcccggtgagtcctgccctg

SEQ ID NO: 141997 - DNA, 20 bp, Artificial
  CRISPR gRNA sequence
ggtctgtctttacaacttta

SEQ ID NO: 141998 - DNA, 20 bp, Artificial
  CRISPR gRNA sequence
ctgtctttacaactttatag

SEQ ID NO: 141999 - DNA, 20 bp, Artificial
  CRISPR gRNA sequence
tgtctttacaactttataga

SEQ ID NO: 142000 - DNA, 20 bp, Artificial
  CRISPR gRNA sequence
tttatagaaggaaatactta

SEQ ID NO: 142001 - DNA, 20 bp, Artificial
  CRISPR gRNA sequence
taccttgatatgtatatcta

SEQ ID NO: 142002 - DNA, 20 bp, Artificial
  CRISPR gRNA sequence
taccttgatatatatatcta

SEQ ID NO: 142003 - DNA, 20 bp, Artificial
  CRISPR gRNA sequence
taccttgatatgtatatcta

SEQ ID NO: 142004 - DNA, 20 bp, Artificial
  CRISPR gRNA sequence
taccttgatatatatatctg

SEQ ID NO: 142005 - DNA, 20 bp, Artificial
  CRISPR gRNA sequence
tatataccttgatatatata

SEQ ID NO: 142006 - DNA, 20 bp, Artificial
  CRISPR gRNA sequence
tataccttgatatatatata

SEQ ID NO: 142007 - DNA, 20 bp, Artificial
  CRISPR gRNA sequence
cataatcctttttttctttt

SEQ ID NO: 142008 - DNA, 20 bp, Artificial
  CRISPR gRNA sequence
ataatcctttttttcttttt

SEQ ID NO: 142009 - DNA, 20 bp, Artificial
  CRISPR gRNA sequence
aatcctttttttctttttag

SEQ ID NO: 142010 - DNA, 20 bp, Artificial
  CRISPR gRNA sequence
ctttttttctttttaggaga

SEQ ID NO: 142011 - DNA, 20 bp, Artificial
  CRISPR gRNA sequence
tttttttctttttaggagac

SEQ ID NO: 142012 - DNA, 20 bp, Artificial
  CRISPR gRNA sequence
acaggtcttgctgtgtcact

SEQ ID NO: 142013 - DNA, 20 bp, Artificial
  CRISPR gRNA sequence
ctgtgtcactcagactgatg

SEQ ID NO: 142014 - DNA, 20 bp, Artificial
  CRISPR gRNA sequence
tcactcagactgatgaagtg

SEQ ID NO: 142015 - DNA, 20 bp, Artificial
  CRISPR gRNA sequence
ctcagactgatgaagtgcag

SEQ ID NO: 142016 - DNA, 20 bp, Artificial
  CRISPR gRNA sequence
gaagtgcagtggcttgatct

SEQ ID NO: 142017 - DNA, 20 bp, Artificial
  CRISPR gRNA sequence
ggcttgatctcagctcactg

SEQ ID NO: 142018 - DNA, 20 bp, Artificial
  CRISPR gRNA sequence
tcactgcagcttccgcctcc

SEQ ID NO: 142019 - DNA, 20 bp, Artificial
  CRISPR gRNA sequence
cactgcagcttccgcctccc

SEQ ID NO: 142020 - DNA, 20 bp, Artificial
  CRISPR gRNA sequence
agcttccgcctcccaggttc

SEQ ID NO: 142021 - DNA, 20 bp, Artificial
  CRISPR gRNA sequence
ttcaagcgattctcctgcct

SEQ ID NO: 142022 - DNA, 20 bp, Artificial
  CRISPR gRNA sequence
ttctcctgcctcagcctccc

SEQ ID NO: 142023 - DNA, 20 bp, Artificial
  CRISPR gRNA sequence
tcctgcctcagcctcccgag

SEQ ID NO: 142024 - DNA, 20 bp, Artificial
  CRISPR gRNA sequence
gcctcagcctcccgagtagc

SEQ ID NO: 142025 - DNA, 20 bp, Artificial
  CRISPR gRNA sequence
cctcagcctcccgagtagct

SEQ ID NO: 142026 - DNA, 20 bp, Artificial
  CRISPR gRNA sequence
ctcccgagtagctgggatta

SEQ ID NO: 142027 - DNA, 20 bp, Artificial
  CRISPR gRNA sequence
tcccgagtagctgggattat

SEQ ID NO: 142028 - DNA, 20 bp, Artificial
  CRISPR gRNA sequence
taggcacgtgccactatgcc

SEQ ID NO: 142029 - DNA, 20 bp, Artificial
  CRISPR gRNA sequence
ccggctgatttttgtatttt

SEQ ID NO: 142030 - DNA, 20 bp, Artificial
  CRISPR gRNA sequence
gctgatttttgtatttttag

SEQ ID NO: 142031 - DNA, 20 bp, Artificial
  CRISPR gRNA sequence
tgatttttgtatttttagta

SEQ ID NO: 142032 - DNA, 20 bp, Artificial
  CRISPR gRNA sequence
ttttgtatttttagtagaga

SEQ ID NO: 142033 - DNA, 20 bp, Artificial
  CRISPR gRNA sequence
tttgtatttttagtagagat

SEQ ID NO: 142034 - DNA, 20 bp, Artificial
  CRISPR gRNA sequence
ttgtatttttagtagagatg

SEQ ID NO: 142035 - DNA, 20 bp, Artificial
  CRISPR gRNA sequence
ttagtagagatggggtttca

SEQ ID NO: 142036 - DNA, 20 bp, Artificial
  CRISPR gRNA sequence
gagatggggtttcacagtgt

SEQ ID NO: 142037 - DNA, 20 bp, Artificial
  CRISPR gRNA sequence
tggggtttcacagtgttggc

SEQ ID NO: 142038 - DNA, 20 bp, Artificial
  CRISPR gRNA sequence
ggggtttcacagtgttggcc

SEQ ID NO: 142039 - DNA, 20 bp, Artificial
  CRISPR gRNA sequence
tttcacagtgttggccaggc

SEQ ID NO: 142040 - DNA, 20 bp, Artificial
  CRISPR gRNA sequence
tggtctctaactcctaacct

SEQ ID NO: 142041 - DNA, 20 bp, Artificial
  CRISPR gRNA sequence
ggtctctaactcctaacctc

SEQ ID NO: 142042 - DNA, 20 bp, Artificial
  CRISPR gRNA sequence
ctcaggtgatccgcccgcct

SEQ ID NO: 142043 - DNA, 20 bp, Artificial
  CRISPR gRNA sequence
ccgcccgcctcggcctccca

SEQ ID NO: 142044 - DNA, 20 bp, Artificial
  CRISPR gRNA sequence
gcctcggcctcccaaagtgc

SEQ ID NO: 142045 - DNA, 20 bp, Artificial
  CRISPR gRNA sequence
cctcggcctcccaaagtgct

SEQ ID NO: 142046 - DNA, 20 bp, Artificial
  CRISPR gRNA sequence
ctcccaaagtgctgggatta

SEQ ID NO: 142047 - DNA, 20 bp, Artificial
  CRISPR gRNA sequence
tcccaaagtgctgggattac

SEQ ID NO: 142048 - DNA, 20 bp, Artificial
  CRISPR gRNA sequence
agtgctgggattacaggcat

SEQ ID NO: 142049 - DNA, 20 bp, Artificial
  CRISPR gRNA sequence
caggcatgagccatcacgcc

SEQ ID NO: 142050 - DNA, 20 bp, Artificial
  CRISPR gRNA sequence
gagccatcacgcccagccct

SEQ ID NO: 142051 - DNA, 20 bp, Artificial
  CRISPR gRNA sequence
ttgtttttaacctatatgcc

SEQ ID NO: 142052 - DNA, 20 bp, Artificial
  CRISPR gRNA sequence
ttccctgctttcctttaatc

SEQ ID NO: 142053 - DNA, 20 bp, Artificial
  CRISPR gRNA sequence
tccctgctttcctttaatct

SEQ ID NO: 142054 - DNA, 20 bp, Artificial
  CRISPR gRNA sequence
gctttcctttaatctaggtt

SEQ ID NO: 142055 - DNA, 20 bp, Artificial
  CRISPR gRNA sequence
ctttcctttaatctaggttc

SEQ ID NO: 142056 - DNA, 20 bp, Artificial
  CRISPR gRNA sequence
aggttcaggttcaccacgat

SEQ ID NO: 142057 - DNA, 20 bp, Artificial
  CRISPR gRNA sequence
ggttcaggttcaccacgatt

SEQ ID NO: 142058 - DNA, 20 bp, Artificial
  CRISPR gRNA sequence
tcaggttcaccacgattggg

SEQ ID NO: 142059 - DNA, 20 bp, Artificial
  CRISPR gRNA sequence
ttcccctcattctacctatg

SEQ ID NO: 142060 - DNA, 20 bp, Artificial
  CRISPR gRNA sequence
tcccctcattctacctatgc

SEQ ID NO: 142061 - DNA, 20 bp, Artificial
  CRISPR gRNA sequence
cccctcattctacctatgca

SEQ ID NO: 142062 - DNA, 20 bp, Artificial
  CRISPR gRNA sequence
ttgtaaccactacccatgcc

SEQ ID NO: 142063 - DNA, 20 bp, Artificial
  CRISPR gRNA sequence
tgtaaccactacccatgcca

SEQ ID NO: 142064 - DNA, 20 bp, Artificial
  CRISPR gRNA sequence
actacccatgccaaggccca

SEQ ID NO: 142065 - DNA, 20 bp, Artificial
  CRISPR gRNA sequence
ctacccatgccaaggcccaa

SEQ ID NO: 142066 - DNA, 20 bp, Artificial
  CRISPR gRNA sequence
ccaaggcccaaaggccctgt

SEQ ID NO: 142067 - DNA, 20 bp, Artificial
  CRISPR gRNA sequence
caaggcccaaaggccctgtg

SEQ ID NO: 142068 - DNA, 20 bp, Artificial
  CRISPR gRNA sequence
ggcccaaaggccctgtgagg

SEQ ID NO: 142069 - DNA, 20 bp, Artificial
  CRISPR gRNA sequence
gaggcagtcctgtatttgat

SEQ ID NO: 142070 - DNA, 20 bp, Artificial
  CRISPR gRNA sequence
gcagtcctgtatttgattag

SEQ ID NO: 142071 - DNA, 20 bp, Artificial
  CRISPR gRNA sequence
agtcctgtatttgattagca

SEQ ID NO: 142072 - DNA, 20 bp, Artificial
  CRISPR gRNA sequence
gtcctgtatttgattagcag

SEQ ID NO: 142073 - DNA, 20 bp, Artificial
  CRISPR gRNA sequence
gtatttgattagcagaggat

SEQ ID NO: 142074 - DNA, 20 bp, Artificial
  CRISPR gRNA sequence
atttgattagcagaggataa

SEQ ID NO: 142075 - DNA, 20 bp, Artificial
  CRISPR gRNA sequence
tttgattagcagaggataag

SEQ ID NO: 142076 - DNA, 20 bp, Artificial
  CRISPR gRNA sequence
ttgattagcagaggataaga

SEQ ID NO: 142077 - DNA, 20 bp, Artificial
  CRISPR gRNA sequence
gattagcagaggataagagg

SEQ ID NO: 142078 - DNA, 20 bp, Artificial
  CRISPR gRNA sequence
attagcagaggataagaggg

SEQ ID NO: 142079 - DNA, 20 bp, Artificial
  CRISPR gRNA sequence
gaggataagagggaggcgta

SEQ ID NO: 142080 - DNA, 20 bp, Artificial
  CRISPR gRNA sequence
aggataagagggaggcgtat

SEQ ID NO: 142081 - DNA, 20 bp, Artificial
  CRISPR gRNA sequence
ggataagagggaggcgtata

SEQ ID NO: 142082 - DNA, 20 bp, Artificial
  CRISPR gRNA sequence
taagagggaggcgtataggg

SEQ ID NO: 142083 - DNA, 20 bp, Artificial
  CRISPR gRNA sequence
aagagggaggcgtataggga

SEQ ID NO: 142084 - DNA, 20 bp, Artificial
  CRISPR gRNA sequence
tacacttgttgcatattcat

SEQ ID NO: 142085 - DNA, 20 bp, Artificial
  CRISPR gRNA sequence
cttgttgcatattcatgagt

SEQ ID NO: 142086 - DNA, 20 bp, Artificial
  CRISPR gRNA sequence
catattcatgagtcagttcc

SEQ ID NO: 142087 - DNA, 20 bp, Artificial
  CRISPR gRNA sequence
attcatgagtcagttcccag

SEQ ID NO: 142088 - DNA, 20 bp, Artificial
  CRISPR gRNA sequence
tcatgagtcagttcccagtg

SEQ ID NO: 142089 - DNA, 20 bp, Artificial
  CRISPR gRNA sequence
tcagttcccagtggagcctg

SEQ ID NO: 142090 - DNA, 20 bp, Artificial
  CRISPR gRNA sequence
tcccagtggagcctgcagca

SEQ ID NO: 142091 - DNA, 20 bp, Artificial
  CRISPR gRNA sequence
cctgcagcaaagtgtatttt

SEQ ID NO: 142092 - DNA, 20 bp, Artificial
  CRISPR gRNA sequence
acttatctattcctttactg

SEQ ID NO: 142093 - DNA, 20 bp, Artificial
  CRISPR gRNA sequence
tgctgcttcctgtgtgcctt

SEQ ID NO: 142094 - DNA, 20 bp, Artificial
  CRISPR gRNA sequence
gctgcttcctgtgtgccttg

SEQ ID NO: 142095 - DNA, 20 bp, Artificial
  CRISPR gRNA sequence
ctgcttcctgtgtgccttga

SEQ ID NO: 142096 - DNA, 20 bp, Artificial
  CRISPR gRNA sequence
ccttgagggatttcatttct

SEQ ID NO: 142097 - DNA, 20 bp, Artificial
  CRISPR gRNA sequence
atttcatttcttagatttgt

SEQ ID NO: 142098 - DNA, 20 bp, Artificial
  CRISPR gRNA sequence
tgtccttgtcttaacacttg

SEQ ID NO: 142099 - DNA, 20 bp, Artificial
  CRISPR gRNA sequence
aacacttgcagtctttacat

SEQ ID NO: 142100 - DNA, 20 bp, Artificial
  CRISPR gRNA sequence
tcattttgaccccccaaaac

SEQ ID NO: 142101 - DNA, 20 bp, Artificial
  CRISPR gRNA sequence
tttgaccccccaaaactgga

SEQ ID NO: 142102 - DNA, 20 bp, Artificial
  CRISPR gRNA sequence
accccccaaaactggaaagt

SEQ ID NO: 142103 - DNA, 20 bp, Artificial
  CRISPR gRNA sequence
aaactggaaagtgagtgaaa

SEQ ID NO: 142104 - DNA, 20 bp, Artificial
  CRISPR gRNA sequence
actggaaagtgagtgaaaca

SEQ ID NO: 142105 - DNA, 20 bp, Artificial
  CRISPR gRNA sequence
ggaaagtgagtgaaacagag

SEQ ID NO: 142106 - DNA, 20 bp, Artificial
  CRISPR gRNA sequence
tttttgtcataaatgaaacg

SEQ ID NO: 142107 - DNA, 20 bp, Artificial
  CRISPR gRNA sequence
ttttgtcataaatgaaacgt

SEQ ID NO: 142108 - DNA, 20 bp, Artificial
  CRISPR gRNA sequence
tgtcataaatgaaacgtagg

SEQ ID NO: 142109 - DNA, 20 bp, Artificial
  CRISPR gRNA sequence
gtcataaatgaaacgtaggc

SEQ ID NO: 142110 - DNA, 20 bp, Artificial
  CRISPR gRNA sequence
aaatgaaacgtaggcaggta

SEQ ID NO: 142111 - DNA, 20 bp, Artificial
  CRISPR gRNA sequence
ggcaggtatagaaactcacg

SEQ ID NO: 142112 - DNA, 20 bp, Artificial
  CRISPR gRNA sequence
tatagaaactcacgtagact

SEQ ID NO: 142113 - DNA, 20 bp, Artificial
  CRISPR gRNA sequence
ctctgtgaaaataactctaa

SEQ ID NO: 142114 - DNA, 20 bp, Artificial
  CRISPR gRNA sequence
aataactctaaaagtatcct

SEQ ID NO: 142115 - DNA, 20 bp, Artificial
  CRISPR gRNA sequence
ctctaaaagtatcctgagat

SEQ ID NO: 142116 - DNA, 20 bp, Artificial
  CRISPR gRNA sequence
aaagtatcctgagatcagtt

SEQ ID NO: 142117 - DNA, 20 bp, Artificial
  CRISPR gRNA sequence
aagtatcctgagatcagttt

SEQ ID NO: 142118 - DNA, 20 bp, Artificial
  CRISPR gRNA sequence
taggaattgttcttcatctg

SEQ ID NO: 142119 - DNA, 20 bp, Artificial
  CRISPR gRNA sequence
ttcttcatctgaagttaaca

SEQ ID NO: 142120 - DNA, 20 bp, Artificial
  CRISPR gRNA sequence
atctgaagttaacatagtaa

SEQ ID NO: 142121 - DNA, 20 bp, Artificial
  CRISPR gRNA sequence
tctgaagttaacatagtaat

SEQ ID NO: 142122 - DNA, 20 bp, Artificial
  CRISPR gRNA sequence
agttaacatagtaataggcc

SEQ ID NO: 142123 - DNA, 20 bp, Artificial
  CRISPR gRNA sequence
ttaacatagtaataggccaa

SEQ ID NO: 142124 - DNA, 20 bp, Artificial
  CRISPR gRNA sequence
catagtaataggccaagaga

SEQ ID NO: 142125 - DNA, 20 bp, Artificial
  CRISPR gRNA sequence
taataggccaagagaaagct

SEQ ID NO: 142126 - DNA, 20 bp, Artificial
  CRISPR gRNA sequence
aataggccaagagaaagctt

SEQ ID NO: 142127 - DNA, 20 bp, Artificial
  CRISPR gRNA sequence
ggccaagagaaagcttagga

SEQ ID NO: 142128 - DNA, 20 bp, Artificial
  CRISPR gRNA sequence
caagagaaagcttaggaaag

SEQ ID NO: 142129 - DNA, 20 bp, Artificial
  CRISPR gRNA sequence
agagaaagcttaggaaagtg

SEQ ID NO: 142130 - DNA, 20 bp, Artificial
  CRISPR gRNA sequence
tcacgtgtgcttacgatacc

SEQ ID NO: 142131 - DNA, 20 bp, Artificial
  CRISPR gRNA sequence
cacgtgtgcttacgataccc

SEQ ID NO: 142132 - DNA, 20 bp, Artificial
  CRISPR gRNA sequence
gcttacgatacccaggattg

SEQ ID NO: 142133 - DNA, 20 bp, Artificial
  CRISPR gRNA sequence
acccaggattgcagatgact

SEQ ID NO: 142134 - DNA, 20 bp, Artificial
  CRISPR gRNA sequence
tctgccttgcttcattgttt

SEQ ID NO: 142135 - DNA, 20 bp, Artificial
  CRISPR gRNA sequence
ttgtttcagtcctcaacccc

SEQ ID NO: 142136 - DNA, 20 bp, Artificial
  CRISPR gRNA sequence
accccaagatttctgttgaa

SEQ ID NO: 142137 - DNA, 20 bp, Artificial
  CRISPR gRNA sequence
tgaatggttctcatttttgc

SEQ ID NO: 142138 - DNA, 20 bp, Artificial
  CRISPR gRNA sequence
ggttctcatttttgcaagcg

SEQ ID NO: 142139 - DNA, 20 bp, Artificial
  CRISPR gRNA sequence
gttctcatttttgcaagcga

SEQ ID NO: 142140 - DNA, 20 bp, Artificial
  CRISPR gRNA sequence
tgcaagcgaaggcaccacca

SEQ ID NO: 142141 - DNA, 20 bp, Artificial
  CRISPR gRNA sequence
gcaagcgaaggcaccaccac

SEQ ID NO: 142142 - DNA, 20 bp, Artificial
  CRISPR gRNA sequence
gcaccaccacaggttcattt

SEQ ID NO: 142143 - DNA, 20 bp, Artificial
  CRISPR gRNA sequence
caccacaggttcatttaaga

SEQ ID NO: 142144 - DNA, 20 bp, Artificial
  CRISPR gRNA sequence
ccacaggttcatttaagaca

SEQ ID NO: 142145 - DNA, 20 bp, Artificial
  CRISPR gRNA sequence
caggttcatttaagacagag

SEQ ID NO: 142146 - DNA, 20 bp, Artificial
  CRISPR gRNA sequence
ggttcatttaagacagagaa

SEQ ID NO: 142147 - DNA, 20 bp, Artificial
  CRISPR gRNA sequence
cagagaagagttccaccttg

SEQ ID NO: 142148 - DNA, 20 bp, Artificial
  CRISPR gRNA sequence
ttgcagatactttaactctc

SEQ ID NO: 142149 - DNA, 20 bp, Artificial
  CRISPR gRNA sequence
tgcagatactttaactctct

SEQ ID NO: 142150 - DNA, 20 bp, Artificial
  CRISPR gRNA sequence
gcagatactttaactctctg

SEQ ID NO: 142151 - DNA, 20 bp, Artificial
  CRISPR gRNA sequence
tactttaactctctggggca

SEQ ID NO: 142152 - DNA, 20 bp, Artificial
  CRISPR gRNA sequence
ctttaactctctggggcaca

SEQ ID NO: 142153 - DNA, 20 bp, Artificial
  CRISPR gRNA sequence
ctctctggggcacagagctt

SEQ ID NO: 142154 - DNA, 20 bp, Artificial
  CRISPR gRNA sequence
tggggcacagagctttagcc

SEQ ID NO: 142155 - DNA, 20 bp, Artificial
  CRISPR gRNA sequence
ggcacagagctttagcccag

SEQ ID NO: 142156 - DNA, 20 bp, Artificial
  CRISPR gRNA sequence
ttagcccagaagatttgttg

SEQ ID NO: 142157 - DNA, 20 bp, Artificial
  CRISPR gRNA sequence
attcactacttcatcttcac

SEQ ID NO: 142158 - DNA, 20 bp, Artificial
  CRISPR gRNA sequence
ctacttcatcttcactggct

SEQ ID NO: 142159 - DNA, 20 bp, Artificial
  CRISPR gRNA sequence
tacttcatcttcactggctc

SEQ ID NO: 142160 - DNA, 20 bp, Artificial
  CRISPR gRNA sequence
actggctcaggcaccttctg

SEQ ID NO: 142161 - DNA, 20 bp, Artificial
  CRISPR gRNA sequence
ctggctcaggcaccttctgt

SEQ ID NO: 142162 - DNA, 20 bp, Artificial
  CRISPR gRNA sequence
ggctcaggcaccttctgtag

SEQ ID NO: 142163 - DNA, 20 bp, Artificial
  CRISPR gRNA sequence
tctgtaggagtcttcatttc

SEQ ID NO: 142164 - DNA, 20 bp, Artificial
  CRISPR gRNA sequence
gtcttcatttccagactctt

SEQ ID NO: 142165 - DNA, 20 bp, Artificial
  CRISPR gRNA sequence
tcttcatttccagactcttt

SEQ ID NO: 142166 - DNA, 20 bp, Artificial
  CRISPR gRNA sequence
tcatttccagactctttagg

SEQ ID NO: 142167 - DNA, 20 bp, Artificial
  CRISPR gRNA sequence
agactctttaggcagctcat

SEQ ID NO: 142168 - DNA, 20 bp, Artificial
  CRISPR gRNA sequence
gctcattggaatgttcctaa

SEQ ID NO: 142169 - DNA, 20 bp, Artificial
  CRISPR gRNA sequence
ggaatgttcctaatagtgat

SEQ ID NO: 142170 - DNA, 20 bp, Artificial
  CRISPR gRNA sequence
ttcctaatagtgatgagctt

SEQ ID NO: 142171 - DNA, 20 bp, Artificial
  CRISPR gRNA sequence
tcctaatagtgatgagcttc

SEQ ID NO: 142172 - DNA, 20 bp, Artificial
  CRISPR gRNA sequence
taatagtgatgagcttcagg

SEQ ID NO: 142173 - DNA, 20 bp, Artificial
  CRISPR gRNA sequence
aatagtgatgagcttcagga

SEQ ID NO: 142174 - DNA, 20 bp, Artificial
  CRISPR gRNA sequence
ttatttccctttcaaaaacc

SEQ ID NO: 142175 - DNA, 20 bp, Artificial
  CRISPR gRNA sequence
atttccctttcaaaaaccca

SEQ ID NO: 142176 - DNA, 20 bp, Artificial
  CRISPR gRNA sequence
tctctgtaattaatgtaaaa

SEQ ID NO: 142177 - DNA, 20 bp, Artificial
  CRISPR gRNA sequence
aattaatgtaaaaaagctat

SEQ ID NO: 142178 - DNA, 20 bp, Artificial
  CRISPR gRNA sequence
attaatgtaaaaaagctatg

SEQ ID NO: 142179 - DNA, 20 bp, Artificial
  CRISPR gRNA sequence
ttaatgtaaaaaagctatga

SEQ ID NO: 142180 - DNA, 20 bp, Artificial
  CRISPR gRNA sequence
aaaaaagctatgagggtccc

SEQ ID NO: 142181 - DNA, 20 bp, Artificial
  CRISPR gRNA sequence
tccccagacctgtcctgctg

SEQ ID NO: 142182 - DNA, 20 bp, Artificial
  CRISPR gRNA sequence
cccagacctgtcctgctgta

SEQ ID NO: 142183 - DNA, 20 bp, Artificial
  CRISPR gRNA sequence
ccagacctgtcctgctgtag

SEQ ID NO: 142184 - DNA, 20 bp, Artificial
  CRISPR gRNA sequence
ctgtcctgctgtagaggaat

SEQ ID NO: 142185 - DNA, 20 bp, Artificial
  CRISPR gRNA sequence
tgtcctgctgtagaggaatg

SEQ ID NO: 142186 - DNA, 20 bp, Artificial
  CRISPR gRNA sequence
gtcctgctgtagaggaatga

SEQ ID NO: 142187 - DNA, 20 bp, Artificial
  CRISPR gRNA sequence
tgctgtagaggaatgaggga

SEQ ID NO: 142188 - DNA, 20 bp, Artificial
  CRISPR gRNA sequence
catcaccaaatgtcttaacc

SEQ ID NO: 142189 - DNA, 20 bp, Artificial
  CRISPR gRNA sequence
atcaccaaatgtcttaacct

SEQ ID NO: 142190 - DNA, 20 bp, Artificial
  CRISPR gRNA sequence
atgtcttaacctaggccaaa

SEQ ID NO: 142191 - DNA, 20 bp, Artificial
  CRISPR gRNA sequence
tgtcttaacctaggccaaaa

SEQ ID NO: 142192 - DNA, 20 bp, Artificial
  CRISPR gRNA sequence
ttaacctaggccaaaaagga

SEQ ID NO: 142193 - DNA, 20 bp, Artificial
  CRISPR gRNA sequence
gaaagcttcttgctttgttg

SEQ ID NO: 142194 - DNA, 20 bp, Artificial
  CRISPR gRNA sequence
aagcttcttgctttgttgaa

SEQ ID NO: 142195 - DNA, 20 bp, Artificial
  CRISPR gRNA sequence
tgctttgttgaagagctgct

SEQ ID NO: 142196 - DNA, 20 bp, Artificial
  CRISPR gRNA sequence
aagagctgcttggaaccatt

SEQ ID NO: 142197 - DNA, 20 bp, Artificial
  CRISPR gRNA sequence
gcttggaaccatttggctca

SEQ ID NO: 142198 - DNA, 20 bp, Artificial
  CRISPR gRNA sequence
ccatttggctcacagctttt

SEQ ID NO: 142199 - DNA, 20 bp, Artificial
  CRISPR gRNA sequence
cacagcttttcagtcacatt

SEQ ID NO: 142200 - DNA, 20 bp, Artificial
  CRISPR gRNA sequence
acagcttttcagtcacattt

SEQ ID NO: 142201 - DNA, 20 bp, Artificial
  CRISPR gRNA sequence
gtcacatttgggtttctgca

SEQ ID NO: 142202 - DNA, 20 bp, Artificial
  CRISPR gRNA sequence
cacatttgggtttctgcaaa

SEQ ID NO: 142203 - DNA, 20 bp, Artificial
  CRISPR gRNA sequence
tttctgcaaagagctcttcc

SEQ ID NO: 142204 - DNA, 20 bp, Artificial
  CRISPR gRNA sequence
tgcaaagagctcttcccagc

SEQ ID NO: 142205 - DNA, 20 bp, Artificial
  CRISPR gRNA sequence
agaaaattttaacatccctg

SEQ ID NO: 142206 - DNA, 20 bp, Artificial
  CRISPR gRNA sequence
tttaacatccctgtagctgt

SEQ ID NO: 142207 - DNA, 20 bp, Artificial
  CRISPR gRNA sequence
agtataccttctcccactcc

SEQ ID NO: 142208 - DNA, 20 bp, Artificial
  CRISPR gRNA sequence
gtataccttctcccactcct

SEQ ID NO: 142209 - DNA, 20 bp, Artificial
  CRISPR gRNA sequence
ccttctcccactcctgggac

SEQ ID NO: 142210 - DNA, 20 bp, Artificial
  CRISPR gRNA sequence
cttctcccactcctgggaca

SEQ ID NO: 142211 - DNA, 20 bp, Artificial
  CRISPR gRNA sequence
ccactcctgggacaaggctt

SEQ ID NO: 142212 - DNA, 20 bp, Artificial
  CRISPR gRNA sequence
gtttttcatcttgtgatccc

SEQ ID NO: 142213 - DNA, 20 bp, Artificial
  CRISPR gRNA sequence
ttcatcttgtgatccctggc

SEQ ID NO: 142214 - DNA, 20 bp, Artificial
  CRISPR gRNA sequence
catcttgtgatccctggctg

SEQ ID NO: 142215 - DNA, 20 bp, Artificial
  CRISPR gRNA sequence
gtgatccctggctggagttc

SEQ ID NO: 142216 - DNA, 20 bp, Artificial
  CRISPR gRNA sequence
tgatccctggctggagttct

SEQ ID NO: 142217 - DNA, 20 bp, Artificial
  CRISPR gRNA sequence
gatccctggctggagttctg

SEQ ID NO: 142218 - DNA, 20 bp, Artificial
  CRISPR gRNA sequence
gctggagttctggggactcc

SEQ ID NO: 142219 - DNA, 20 bp, Artificial
  CRISPR gRNA sequence
gttctggggactcctggaac

SEQ ID NO: 142220 - DNA, 20 bp, Artificial
  CRISPR gRNA sequence
ctcctggaactagccaccat

SEQ ID NO: 142221 - DNA, 20 bp, Artificial
  CRISPR gRNA sequence
ctagccaccatcagtctctg

SEQ ID NO: 142222 - DNA, 20 bp, Artificial
  CRISPR gRNA sequence
caccatcagtctctgtagat

SEQ ID NO: 142223 - DNA, 20 bp, Artificial
  CRISPR gRNA sequence
accatcagtctctgtagatg

SEQ ID NO: 142224 - DNA, 20 bp, Artificial
  CRISPR gRNA sequence
aggttttccaaacttctgcc

SEQ ID NO: 142225 - DNA, 20 bp, Artificial
  CRISPR gRNA sequence
ccagctgccttcctccccac

SEQ ID NO: 142226 - DNA, 20 bp, Artificial
  CRISPR gRNA sequence
aagcaacttaacattgttgc

SEQ ID NO: 142227 - DNA, 20 bp, Artificial
  CRISPR gRNA sequence
agcaacttaacattgttgcc

SEQ ID NO: 142228 - DNA, 20 bp, Artificial
  CRISPR gRNA sequence
aacttaacattgttgccagg

SEQ ID NO: 142229 - DNA, 20 bp, Artificial
  CRISPR gRNA sequence
gttgccaggaagctgcatta

SEQ ID NO: 142230 - DNA, 20 bp, Artificial
  CRISPR gRNA sequence
ttgccaggaagctgcattat

SEQ ID NO: 142231 - DNA, 20 bp, Artificial
  CRISPR gRNA sequence
ggaagctgcattataggatt

SEQ ID NO: 142232 - DNA, 20 bp, Artificial
  CRISPR gRNA sequence
gaagctgcattataggattt

SEQ ID NO: 142233 - DNA, 20 bp, Artificial
  CRISPR gRNA sequence
gctgcattataggatttagg

SEQ ID NO: 142234 - DNA, 20 bp, Artificial
  CRISPR gRNA sequence
ctgcattataggatttaggt

SEQ ID NO: 142235 - DNA, 20 bp, Artificial
  CRISPR gRNA sequence
tgcattataggatttaggtg

SEQ ID NO: 142236 - DNA, 20 bp, Artificial
  CRISPR gRNA sequence
taggatttaggtggggaatt

SEQ ID NO: 142237 - DNA, 20 bp, Artificial
  CRISPR gRNA sequence
aggatttaggtggggaattc

SEQ ID NO: 142238 - DNA, 20 bp, Artificial
  CRISPR gRNA sequence
ttaggtggggaattcaggct

SEQ ID NO: 142239 - DNA, 20 bp, Artificial
  CRISPR gRNA sequence
ggaattcaggcttggcacca

SEQ ID NO: 142240 - DNA, 20 bp, Artificial
  CRISPR gRNA sequence
ggcttggcaccacagcctcc

SEQ ID NO: 142241 - DNA, 20 bp, Artificial
  CRISPR gRNA sequence
ttggcaccacagcctcccag

SEQ ID NO: 142242 - DNA, 20 bp, Artificial
  CRISPR gRNA sequence
agcctcccagcagcttctct

SEQ ID NO: 142243 - DNA, 20 bp, Artificial
  CRISPR gRNA sequence
agcttctcttggcatattct

SEQ ID NO: 142244 - DNA, 20 bp, Artificial
  CRISPR gRNA sequence
gcttctcttggcatattctc

SEQ ID NO: 142245 - DNA, 20 bp, Artificial
  CRISPR gRNA sequence
ctcttggcatattctcagga

SEQ ID NO: 142246 - DNA, 20 bp, Artificial
  CRISPR gRNA sequence
tctcaggaaagaaatgactg

SEQ ID NO: 142247 - DNA, 20 bp, Artificial
  CRISPR gRNA sequence
ctcaggaaagaaatgactgc

SEQ ID NO: 142248 - DNA, 20 bp, Artificial
  CRISPR gRNA sequence
ttgccctgtctcctttgaac

SEQ ID NO: 142249 - DNA, 20 bp, Artificial
  CRISPR gRNA sequence
cctttgaaccagatttttaa

SEQ ID NO: 142250 - DNA, 20 bp, Artificial
  CRISPR gRNA sequence
ctttgaaccagatttttaat

SEQ ID NO: 142251 - DNA, 20 bp, Artificial
  CRISPR gRNA sequence
aaccagatttttaatgggtt

SEQ ID NO: 142252 - DNA, 20 bp, Artificial
  CRISPR gRNA sequence
gatttttaatgggtttagat

SEQ ID NO: 142253 - DNA, 20 bp, Artificial
  CRISPR gRNA sequence
atttttaatgggtttagatt

SEQ ID NO: 142254 - DNA, 20 bp, Artificial
  CRISPR gRNA sequence
gtgtccctccatcttgcctc

SEQ ID NO: 142255 - DNA, 20 bp, Artificial
  CRISPR gRNA sequence
tccctccatcttgcctcaag

SEQ ID NO: 142256 - DNA, 20 bp, Artificial
  CRISPR gRNA sequence
ccctccatcttgcctcaagt

SEQ ID NO: 142257 - DNA, 20 bp, Artificial
  CRISPR gRNA sequence
ttgcctcaagtgggcaattc

SEQ ID NO: 142258 - DNA, 20 bp, Artificial
  CRISPR gRNA sequence
tcaagtgggcaattctggaa

SEQ ID NO: 142259 - DNA, 20 bp, Artificial
  CRISPR gRNA sequence
gaatggtctaccgtgaactt

SEQ ID NO: 142260 - DNA, 20 bp, Artificial
  CRISPR gRNA sequence
atggtctaccgtgaacttga

SEQ ID NO: 142261 - DNA, 20 bp, Artificial
  CRISPR gRNA sequence
tggtctaccgtgaacttgag

SEQ ID NO: 142262 - DNA, 20 bp, Artificial
  CRISPR gRNA sequence
cttgagaggtcgttttttct

SEQ ID NO: 142263 - DNA, 20 bp, Artificial
  CRISPR gRNA sequence
gagaggtcgttttttctcgg

SEQ ID NO: 142264 - DNA, 20 bp, Artificial
  CRISPR gRNA sequence
ctcggtagttcaaattctgt

SEQ ID NO: 142265 - DNA, 20 bp, Artificial
  CRISPR gRNA sequence
tcggtagttcaaattctgtg

SEQ ID NO: 142266 - DNA, 20 bp, Artificial
  CRISPR gRNA sequence
tagttcaaattctgtgaggc

SEQ ID NO: 142267 - DNA, 20 bp, Artificial
  CRISPR gRNA sequence
ttcaaattctgtgaggctgg

SEQ ID NO: 142268 - DNA, 20 bp, Artificial
  CRISPR gRNA sequence
ttctgtgaggctggaagtct

SEQ ID NO: 142269 - DNA, 20 bp, Artificial
  CRISPR gRNA sequence
ctgtgaggctggaagtctca

SEQ ID NO: 142270 - DNA, 20 bp, Artificial
  CRISPR gRNA sequence
tgaggctggaagtctcagag

SEQ ID NO: 142271 - DNA, 20 bp, Artificial
  CRISPR gRNA sequence
ttttgattgaacactgcgtg

SEQ ID NO: 142272 - DNA, 20 bp, Artificial
  CRISPR gRNA sequence
tttgattgaacactgcgtgc

SEQ ID NO: 142273 - DNA, 20 bp, Artificial
  CRISPR gRNA sequence
gaacactgcgtgcaggaatg

SEQ ID NO: 142274 - DNA, 20 bp, Artificial
  CRISPR gRNA sequence
ggaatgcagcttcatcccat

SEQ ID NO: 142275 - DNA, 20 bp, Artificial
  CRISPR gRNA sequence
tcccattagcattttcctca

SEQ ID NO: 142276 - DNA, 20 bp, Artificial
  CRISPR gRNA sequence
cattagcattttcctcatgg

SEQ ID NO: 142277 - DNA, 20 bp, Artificial
  CRISPR gRNA sequence
ttagcattttcctcatggaa

SEQ ID NO: 142278 - DNA, 20 bp, Artificial
  CRISPR gRNA sequence
ttcctcatggaagagtcctg

SEQ ID NO: 142279 - DNA, 20 bp, Artificial
  CRISPR gRNA sequence
catggaagagtcctgcagtg

SEQ ID NO: 142280 - DNA, 20 bp, Artificial
  CRISPR gRNA sequence
gaagagtcctgcagtgaagt

SEQ ID NO: 142281 - DNA, 20 bp, Artificial
  CRISPR gRNA sequence
tgcagtgaagttagctcttg

SEQ ID NO: 142282 - DNA, 20 bp, Artificial
  CRISPR gRNA sequence
gcagtgaagttagctcttga

SEQ ID NO: 142283 - DNA, 20 bp, Artificial
  CRISPR gRNA sequence
tgaagttagctcttgaaggc

SEQ ID NO: 142284 - DNA, 20 bp, Artificial
  CRISPR gRNA sequence
aagttagctcttgaaggcca

SEQ ID NO: 142285 - DNA, 20 bp, Artificial
  CRISPR gRNA sequence
agttagctcttgaaggccag

SEQ ID NO: 142286 - DNA, 20 bp, Artificial
  CRISPR gRNA sequence
gttagctcttgaaggccaga

SEQ ID NO: 142287 - DNA, 20 bp, Artificial
  CRISPR gRNA sequence
ggccagagggaaatttgctc

SEQ ID NO: 142288 - DNA, 20 bp, Artificial
  CRISPR gRNA sequence
ccagagggaaatttgctcca

SEQ ID NO: 142289 - DNA, 20 bp, Artificial
  CRISPR gRNA sequence
gagggaaatttgctccagag

SEQ ID NO: 142290 - DNA, 20 bp, Artificial
  CRISPR gRNA sequence
gggaaatttgctccagagca

SEQ ID NO: 142291 - DNA, 20 bp, Artificial
  CRISPR gRNA sequence
ggaaatttgctccagagcag

SEQ ID NO: 142292 - DNA, 20 bp, Artificial
  CRISPR gRNA sequence
cagaggcaatacttgcctgt

SEQ ID NO: 142293 - DNA, 20 bp, Artificial
  CRISPR gRNA sequence
aatacttgcctgttagccac

SEQ ID NO: 142294 - DNA, 20 bp, Artificial
  CRISPR gRNA sequence
acttgcctgttagccacaag

SEQ ID NO: 142295 - DNA, 20 bp, Artificial
  CRISPR gRNA sequence
agaagcttccccttgcaaca

SEQ ID NO: 142296 - DNA, 20 bp, Artificial
  CRISPR gRNA sequence
gaagcttccccttgcaacaa

SEQ ID NO: 142297 - DNA, 20 bp, Artificial
  CRISPR gRNA sequence
gcttccccttgcaacaaagg

SEQ ID NO: 142298 - DNA, 20 bp, Artificial
  CRISPR gRNA sequence
cttccccttgcaacaaaggc

SEQ ID NO: 142299 - DNA, 20 bp, Artificial
  CRISPR gRNA sequence
cccttgcaacaaaggcaggc

SEQ ID NO: 142300 - DNA, 20 bp, Artificial
  CRISPR gRNA sequence
ccttgcaacaaaggcaggct

SEQ ID NO: 142301 - DNA, 20 bp, Artificial
  CRISPR gRNA sequence
tgcaacaaaggcaggctggg

SEQ ID NO: 142302 - DNA, 20 bp, Artificial
  CRISPR gRNA sequence
acaaaggcaggctgggcagc

SEQ ID NO: 142303 - DNA, 20 bp, Artificial
  CRISPR gRNA sequence
caaaggcaggctgggcagcc

SEQ ID NO: 142304 - DNA, 20 bp, Artificial
  CRISPR gRNA sequence
aaaggcaggctgggcagcca

SEQ ID NO: 142305 - DNA, 20 bp, Artificial
  CRISPR gRNA sequence
ggcaggctgggcagccaggg

SEQ ID NO: 142306 - DNA, 20 bp, Artificial
  CRISPR gRNA sequence
gcaggctgggcagccagggc

SEQ ID NO: 142307 - DNA, 20 bp, Artificial
  CRISPR gRNA sequence
ggctgggcagccagggcagg

SEQ ID NO: 142308 - DNA, 20 bp, Artificial
  CRISPR gRNA sequence
cagccagggcaggtggtttc

SEQ ID NO: 142309 - DNA, 20 bp, Artificial
  CRISPR gRNA sequence
caggtggtttctggaccccg

SEQ ID NO: 142310 - DNA, 20 bp, Artificial
  CRISPR gRNA sequence
tggtttctggaccccgcaga

SEQ ID NO: 142311 - DNA, 20 bp, Artificial
  CRISPR gRNA sequence
gtttctggaccccgcagata

SEQ ID NO: 142312 - DNA, 20 bp, Artificial
  CRISPR gRNA sequence
ggaccccgcagatagagacc

SEQ ID NO: 142313 - DNA, 20 bp, Artificial
  CRISPR gRNA sequence
acctagtctatccatgctcc

SEQ ID NO: 142314 - DNA, 20 bp, Artificial
  CRISPR gRNA sequence
cctttcatttcctctaaatt

SEQ ID NO: 142315 - DNA, 20 bp, Artificial
  CRISPR gRNA sequence
ctttcatttcctctaaattg

SEQ ID NO: 142316 - DNA, 20 bp, Artificial
  CRISPR gRNA sequence
tttcatttcctctaaattga

SEQ ID NO: 142317 - DNA, 20 bp, Artificial
  CRISPR gRNA sequence
attgagggtgtgaatgtctg

SEQ ID NO: 142318 - DNA, 20 bp, Artificial
  CRISPR gRNA sequence
tgctgaccatcatctttgct

SEQ ID NO: 142319 - DNA, 20 bp, Artificial
  CRISPR gRNA sequence
ccatcatctttgctgagcta

SEQ ID NO: 142320 - DNA, 20 bp, Artificial
  CRISPR gRNA sequence
tgagctacagttctctgatg

SEQ ID NO: 142321 - DNA, 20 bp, Artificial
  CRISPR gRNA sequence
ctctgatgtggtaaccgcct

SEQ ID NO: 142322 - DNA, 20 bp, Artificial
  CRISPR gRNA sequence
cttggtcctcttttcatccc

SEQ ID NO: 142323 - DNA, 20 bp, Artificial
  CRISPR gRNA sequence
tcaaaacactaatactttca

SEQ ID NO: 142324 - DNA, 20 bp, Artificial
  CRISPR gRNA sequence
ctaatactttcatggtacac

SEQ ID NO: 142325 - DNA, 20 bp, Artificial
  CRISPR gRNA sequence
aatactttcatggtacactg

SEQ ID NO: 142326 - DNA, 20 bp, Artificial
  CRISPR gRNA sequence
tcatggtacactggagcatt

SEQ ID NO: 142327 - DNA, 20 bp, Artificial
  CRISPR gRNA sequence
atggtacactggagcattaa

SEQ ID NO: 142328 - DNA, 20 bp, Artificial
  CRISPR gRNA sequence
cactggagcattaagagcct

SEQ ID NO: 142329 - DNA, 20 bp, Artificial
  CRISPR gRNA sequence
gagcattaagagcctgagtt

SEQ ID NO: 142330 - DNA, 20 bp, Artificial
  CRISPR gRNA sequence
agcattaagagcctgagtta

SEQ ID NO: 142331 - DNA, 20 bp, Artificial
  CRISPR gRNA sequence
agagcctgagttaaggcttt

SEQ ID NO: 142332 - DNA, 20 bp, Artificial
  CRISPR gRNA sequence
ttttagcacacaattaaatg

SEQ ID NO: 142333 - DNA, 20 bp, Artificial
  CRISPR gRNA sequence
acacaattaaatgcagcatg

SEQ ID NO: 142334 - DNA, 20 bp, Artificial
  CRISPR gRNA sequence
gtggtattattgtattatct

SEQ ID NO: 142335 - DNA, 20 bp, Artificial
  CRISPR gRNA sequence
attatctgagatttaatcgt

SEQ ID NO: 142336 - DNA, 20 bp, Artificial
  CRISPR gRNA sequence
tgagatttaatcgtaagcat

SEQ ID NO: 142337 - DNA, 20 bp, Artificial
  CRISPR gRNA sequence
agatttaatcgtaagcatga

SEQ ID NO: 142338 - DNA, 20 bp, Artificial
  CRISPR gRNA sequence
tcgtaagcatgagagactct

SEQ ID NO: 142339 - DNA, 20 bp, Artificial
  CRISPR gRNA sequence
cgtaagcatgagagactcta

SEQ ID NO: 142340 - DNA, 20 bp, Artificial
  CRISPR gRNA sequence
gtaagcatgagagactctaa

SEQ ID NO: 142341 - DNA, 20 bp, Artificial
  CRISPR gRNA sequence
agactctaagggcgctttcg

SEQ ID NO: 142342 - DNA, 20 bp, Artificial
  CRISPR gRNA sequence
taagggcgctttcgtagctt

SEQ ID NO: 142343 - DNA, 20 bp, Artificial
  CRISPR gRNA sequence
gtagctttggtttcccatga

SEQ ID NO: 142344 - DNA, 20 bp, Artificial
  CRISPR gRNA sequence
tagctttggtttcccatgat

SEQ ID NO: 142345 - DNA, 20 bp, Artificial
  CRISPR gRNA sequence
agctttggtttcccatgatg

SEQ ID NO: 142346 - DNA, 20 bp, Artificial
  CRISPR gRNA sequence
catgatggggttttctatga

SEQ ID NO: 142347 - DNA, 20 bp, Artificial
  CRISPR gRNA sequence
atgatggggttttctatgaa

SEQ ID NO: 142348 - DNA, 20 bp, Artificial
  CRISPR gRNA sequence
ttattgattctgcttcccct

SEQ ID NO: 142349 - DNA, 20 bp, Artificial
  CRISPR gRNA sequence
tattgattctgcttcccctt

SEQ ID NO: 142350 - DNA, 20 bp, Artificial
  CRISPR gRNA sequence
ttgattctgcttccccttgg

SEQ ID NO: 142351 - DNA, 20 bp, Artificial
  CRISPR gRNA sequence
tgattctgcttccccttggg

SEQ ID NO: 142352 - DNA, 20 bp, Artificial
  CRISPR gRNA sequence
gcttccccttgggaggtgtt

SEQ ID NO: 142353 - DNA, 20 bp, Artificial
  CRISPR gRNA sequence
ccccttgggaggtgtttggc

SEQ ID NO: 142354 - DNA, 20 bp, Artificial
  CRISPR gRNA sequence
cttgggaggtgtttggccag

SEQ ID NO: 142355 - DNA, 20 bp, Artificial
  CRISPR gRNA sequence
ggaggtgtttggccagaagc

SEQ ID NO: 142356 - DNA, 20 bp, Artificial
  CRISPR gRNA sequence
gaagctagtgctgaacacca

SEQ ID NO: 142357 - DNA, 20 bp, Artificial
  CRISPR gRNA sequence
ctgaacaccaaagatcctaa

SEQ ID NO: 142358 - DNA, 20 bp, Artificial
  CRISPR gRNA sequence
caaagatcctaaaagcccca

SEQ ID NO: 142359 - DNA, 20 bp, Artificial
  CRISPR gRNA sequence
aagccccacagacccccatc

SEQ ID NO: 142360 - DNA, 20 bp, Artificial
  CRISPR gRNA sequence
ccacagacccccatccagcc

SEQ ID NO: 142361 - DNA, 20 bp, Artificial
  CRISPR gRNA sequence
cccccatccagcctggctct

SEQ ID NO: 142362 - DNA, 20 bp, Artificial
  CRISPR gRNA sequence
ccccatccagcctggctctt

SEQ ID NO: 142363 - DNA, 20 bp, Artificial
  CRISPR gRNA sequence
cccatccagcctggctcttg

SEQ ID NO: 142364 - DNA, 20 bp, Artificial
  CRISPR gRNA sequence
tccagcctggctcttgggga

SEQ ID NO: 142365 - DNA, 20 bp, Artificial
  CRISPR gRNA sequence
cagcctggctcttggggaca

SEQ ID NO: 142366 - DNA, 20 bp, Artificial
  CRISPR gRNA sequence
ctggctcttggggacagaga

SEQ ID NO: 142367 - DNA, 20 bp, Artificial
  CRISPR gRNA sequence
tcttggggacagagatggtt

SEQ ID NO: 142368 - DNA, 20 bp, Artificial
  CRISPR gRNA sequence
tggggacagagatggttaag

SEQ ID NO: 142369 - DNA, 20 bp, Artificial
  CRISPR gRNA sequence
acagagatggttaagcagtc

SEQ ID NO: 142370 - DNA, 20 bp, Artificial
  CRISPR gRNA sequence
gcttttgcctccaaaatgtg

SEQ ID NO: 142371 - DNA, 20 bp, Artificial
  CRISPR gRNA sequence
tgcctccaaaatgtgcagca

SEQ ID NO: 142372 - DNA, 20 bp, Artificial
  CRISPR gRNA sequence
gcctccaaaatgtgcagcat

SEQ ID NO: 142373 - DNA, 20 bp, Artificial
  CRISPR gRNA sequence
cctccaaaatgtgcagcatg

SEQ ID NO: 142374 - DNA, 20 bp, Artificial
  CRISPR gRNA sequence
ccaaaatgtgcagcatgggg

SEQ ID NO: 142375 - DNA, 20 bp, Artificial
  CRISPR gRNA sequence
caaaatgtgcagcatggggc

SEQ ID NO: 142376 - DNA, 20 bp, Artificial
  CRISPR gRNA sequence
aaaatgtgcagcatggggca

SEQ ID NO: 142377 - DNA, 20 bp, Artificial
  CRISPR gRNA sequence
atgtgcagcatggggcaggg

SEQ ID NO: 142378 - DNA, 20 bp, Artificial
  CRISPR gRNA sequence
agcatggggcagggcagtgt

SEQ ID NO: 142379 - DNA, 20 bp, Artificial
  CRISPR gRNA sequence
gcatggggcagggcagtgtg

SEQ ID NO: 142380 - DNA, 20 bp, Artificial
  CRISPR gRNA sequence
catggggcagggcagtgtga

SEQ ID NO: 142381 - DNA, 20 bp, Artificial
  CRISPR gRNA sequence
gcagtgtgagggctatgatg

SEQ ID NO: 142382 - DNA, 20 bp, Artificial
  CRISPR gRNA sequence
agggctatgatgcggaatga

SEQ ID NO: 142383 - DNA, 20 bp, Artificial
  CRISPR gRNA sequence
ggaatgatggctgtttgctt

SEQ ID NO: 142384 - DNA, 20 bp, Artificial
  CRISPR gRNA sequence
gaatgatggctgtttgcttt

SEQ ID NO: 142385 - DNA, 20 bp, Artificial
  CRISPR gRNA sequence
ggctgtttgctttgggatcc

SEQ ID NO: 142386 - DNA, 20 bp, Artificial
  CRISPR gRNA sequence
tgtttgctttgggatcctgg

SEQ ID NO: 142387 - DNA, 20 bp, Artificial
  CRISPR gRNA sequence
tttgggatcctggcagatgc

SEQ ID NO: 142388 - DNA, 20 bp, Artificial
  CRISPR gRNA sequence
gcagatgctggatctcttta

SEQ ID NO: 142389 - DNA, 20 bp, Artificial
  CRISPR gRNA sequence
atgctggatctctttacaga

SEQ ID NO: 142390 - DNA, 20 bp, Artificial
  CRISPR gRNA sequence
tgctggatctctttacagat

SEQ ID NO: 142391 - DNA, 20 bp, Artificial
  CRISPR gRNA sequence
ctggatctctttacagatgg

SEQ ID NO: 142392 - DNA, 20 bp, Artificial
  CRISPR gRNA sequence
ctctttacagatgggagcga

SEQ ID NO: 142393 - DNA, 20 bp, Artificial
  CRISPR gRNA sequence
ctttacagatgggagcgaaa

SEQ ID NO: 142394 - DNA, 20 bp, Artificial
  CRISPR gRNA sequence
tttacagatgggagcgaaag

SEQ ID NO: 142395 - DNA, 20 bp, Artificial
  CRISPR gRNA sequence
agaggcccacacttaatgta

SEQ ID NO: 142396 - DNA, 20 bp, Artificial
  CRISPR gRNA sequence
gaggcccacacttaatgtac

SEQ ID NO: 142397 - DNA, 20 bp, Artificial
  CRISPR gRNA sequence
tacaggcattctgatgatgt

SEQ ID NO: 142398 - DNA, 20 bp, Artificial
  CRISPR gRNA sequence
ggcattctgatgatgtcagt

SEQ ID NO: 142399 - DNA, 20 bp, Artificial
  CRISPR gRNA sequence
tgtcagtcagataaattcct

SEQ ID NO: 142400 - DNA, 20 bp, Artificial
  CRISPR gRNA sequence
gtcagataaattcctaagat

SEQ ID NO: 142401 - DNA, 20 bp, Artificial
  CRISPR gRNA sequence
taagataagctgtgatcatg

SEQ ID NO: 142402 - DNA, 20 bp, Artificial
  CRISPR gRNA sequence
taagctgtgatcatgtagct

SEQ ID NO: 142403 - DNA, 20 bp, Artificial
  CRISPR gRNA sequence
agctgtgatcatgtagctaa

SEQ ID NO: 142404 - DNA, 20 bp, Artificial
  CRISPR gRNA sequence
gtgatcatgtagctaagagc

SEQ ID NO: 142405 - DNA, 20 bp, Artificial
  CRISPR gRNA sequence
gctaagagctggcaaataat

SEQ ID NO: 142406 - DNA, 20 bp, Artificial
  CRISPR gRNA sequence
gctggcaaataatgagcatg

SEQ ID NO: 142407 - DNA, 20 bp, Artificial
  CRISPR gRNA sequence
tgctgttctcacctttgtga

SEQ ID NO: 142408 - DNA, 20 bp, Artificial
  CRISPR gRNA sequence
gctgttctcacctttgtgac

SEQ ID NO: 142409 - DNA, 20 bp, Artificial
  CRISPR gRNA sequence
acctttgtgacaggatcttc

SEQ ID NO: 142410 - DNA, 20 bp, Artificial
  CRISPR gRNA sequence
cctttgtgacaggatcttct

SEQ ID NO: 142411 - DNA, 20 bp, Artificial
  CRISPR gRNA sequence
tttgtgacaggatcttctgg

SEQ ID NO: 142412 - DNA, 20 bp, Artificial
  CRISPR gRNA sequence
tcttctgggagttttttctg

SEQ ID NO: 142413 - DNA, 20 bp, Artificial
  CRISPR gRNA sequence
agttttttctgaagtccatt

SEQ ID NO: 142414 - DNA, 20 bp, Artificial
  CRISPR gRNA sequence
gttttttctgaagtccattc

SEQ ID NO: 142415 - DNA, 20 bp, Artificial
  CRISPR gRNA sequence
ttttttctgaagtccattca

SEQ ID NO: 142416 - DNA, 20 bp, Artificial
  CRISPR gRNA sequence
cttctgtgctgtgtgacttg

SEQ ID NO: 142417 - DNA, 20 bp, Artificial
  CRISPR gRNA sequence
ttctgtgctgtgtgacttgt

SEQ ID NO: 142418 - DNA, 20 bp, Artificial
  CRISPR gRNA sequence
gctgtgtgacttgtgggatg

SEQ ID NO: 142419 - DNA, 20 bp, Artificial
  CRISPR gRNA sequence
ttgttttgacctctgtttaa

SEQ ID NO: 142420 - DNA, 20 bp, Artificial
  CRISPR gRNA sequence
tgttttgacctctgtttaaa

SEQ ID NO: 142421 - DNA, 20 bp, Artificial
  CRISPR gRNA sequence
gttttgacctctgtttaaaa

SEQ ID NO: 142422 - DNA, 20 bp, Artificial
  CRISPR gRNA sequence
tgtttaaaagggactttttt

SEQ ID NO: 142423 - DNA, 20 bp, Artificial
  CRISPR gRNA sequence
gtttaaaagggacttttttc

SEQ ID NO: 142424 - DNA, 20 bp, Artificial
  CRISPR gRNA sequence
tttaaaagggacttttttca

SEQ ID NO: 142425 - DNA, 20 bp, Artificial
  CRISPR gRNA sequence
aaaagggacttttttcaggg

SEQ ID NO: 142426 - DNA, 20 bp, Artificial
  CRISPR gRNA sequence
aaagggacttttttcagggc

SEQ ID NO: 142427 - DNA, 20 bp, Artificial
  CRISPR gRNA sequence
tttttcagggcaggcttctt

SEQ ID NO: 142428 - DNA, 20 bp, Artificial
  CRISPR gRNA sequence
tttcagggcaggcttctttg

SEQ ID NO: 142429 - DNA, 20 bp, Artificial
  CRISPR gRNA sequence
ttcagggcaggcttctttgg

SEQ ID NO: 142430 - DNA, 20 bp, Artificial
  CRISPR gRNA sequence
tcagggcaggcttctttgga

SEQ ID NO: 142431 - DNA, 20 bp, Artificial
  CRISPR gRNA sequence
caggcttctttggagggctt

SEQ ID NO: 142432 - DNA, 20 bp, Artificial
  CRISPR gRNA sequence
aggcttctttggagggcttg

SEQ ID NO: 142433 - DNA, 20 bp, Artificial
  CRISPR gRNA sequence
ggcttctttggagggcttga

SEQ ID NO: 142434 - DNA, 20 bp, Artificial
  CRISPR gRNA sequence
gcttctttggagggcttgag

SEQ ID NO: 142435 - DNA, 20 bp, Artificial
  CRISPR gRNA sequence
tctttggagggcttgagggg

SEQ ID NO: 142436 - DNA, 20 bp, Artificial
  CRISPR gRNA sequence
ctttggagggcttgaggggt

SEQ ID NO: 142437 - DNA, 20 bp, Artificial
  CRISPR gRNA sequence
tttggagggcttgaggggta

SEQ ID NO: 142438 - DNA, 20 bp, Artificial
  CRISPR gRNA sequence
ttggagggcttgaggggtag

SEQ ID NO: 142439 - DNA, 20 bp, Artificial
  CRISPR gRNA sequence
tggagggcttgaggggtagg

SEQ ID NO: 142440 - DNA, 20 bp, Artificial
  CRISPR gRNA sequence
tagggggcaatcaacatctc

SEQ ID NO: 142441 - DNA, 20 bp, Artificial
  CRISPR gRNA sequence
gcaatcaacatctctggtca

SEQ ID NO: 142442 - DNA, 20 bp, Artificial
  CRISPR gRNA sequence
tcaacatctctggtcatgga

SEQ ID NO: 142443 - DNA, 20 bp, Artificial
  CRISPR gRNA sequence
catggaaagtttgcctgttt

SEQ ID NO: 142444 - DNA, 20 bp, Artificial
  CRISPR gRNA sequence
agattatactcaatgtctta

SEQ ID NO: 142445 - DNA, 20 bp, Artificial
  CRISPR gRNA sequence
ctttgtctctgcccctgccc

SEQ ID NO: 142446 - DNA, 20 bp, Artificial
  CRISPR gRNA sequence
tttgtctctgcccctgccct

SEQ ID NO: 142447 - DNA, 20 bp, Artificial
  CRISPR gRNA sequence
ctctgcccctgccctaggtg

SEQ ID NO: 142448 - DNA, 20 bp, Artificial
  CRISPR gRNA sequence
ccctaggtgcagctgaatgc

SEQ ID NO: 142449 - DNA, 20 bp, Artificial
  CRISPR gRNA sequence
aggtgcagctgaatgccggc

SEQ ID NO: 142450 - DNA, 20 bp, Artificial
  CRISPR gRNA sequence
agctgaatgccggccagctg

SEQ ID NO: 142451 - DNA, 20 bp, Artificial
  CRISPR gRNA sequence
ccagctgcagtatatccgct

SEQ ID NO: 142452 - DNA, 20 bp, Artificial
  CRISPR gRNA sequence
tgcagtatatccgcttagcc

SEQ ID NO: 142453 - DNA, 20 bp, Artificial
  CRISPR gRNA sequence
ccgcttagcccagcctgtat

SEQ ID NO: 142454 - DNA, 20 bp, Artificial
  CRISPR gRNA sequence
cgcttagcccagcctgtatc

SEQ ID NO: 142455 - DNA, 20 bp, Artificial
  CRISPR gRNA sequence
ccagcctgtatcaggcactc

SEQ ID NO: 142456 - DNA, 20 bp, Artificial
  CRISPR gRNA sequence
tatcaggcactcaagttgtg

SEQ ID NO: 142457 - DNA, 20 bp, Artificial
  CRISPR gRNA sequence
atcaggcactcaagttgtgc

SEQ ID NO: 142458 - DNA, 20 bp, Artificial
  CRISPR gRNA sequence
tcaggcactcaagttgtgca

SEQ ID NO: 142459 - DNA, 20 bp, Artificial
  CRISPR gRNA sequence
gcactcaagttgtgcaggga

SEQ ID NO: 142460 - DNA, 20 bp, Artificial
  CRISPR gRNA sequence
aagttgtgcagggacagatc

SEQ ID NO: 142461 - DNA, 20 bp, Artificial
  CRISPR gRNA sequence
cacttgccaccaatgctcaa

SEQ ID NO: 142462 - DNA, 20 bp, Artificial
  CRISPR gRNA sequence
acttgccaccaatgctcaac

SEQ ID NO: 142463 - DNA, 20 bp, Artificial
  CRISPR gRNA sequence
tgctcaacaggtatgtgccc

SEQ ID NO: 142464 - DNA, 20 bp, Artificial
  CRISPR gRNA sequence
ctcaacaggtatgtgcccca

SEQ ID NO: 142465 - DNA, 20 bp, Artificial
  CRISPR gRNA sequence
ggtatgtgccccagagacac

SEQ ID NO: 142466 - DNA, 20 bp, Artificial
  CRISPR gRNA sequence
gtatgtgccccagagacaca

SEQ ID NO: 142467 - DNA, 20 bp, Artificial
  CRISPR gRNA sequence
cagagacacaaggcctgtgt

SEQ ID NO: 142468 - DNA, 20 bp, Artificial
  CRISPR gRNA sequence
gagacacaaggcctgtgttg

SEQ ID NO: 142469 - DNA, 20 bp, Artificial
  CRISPR gRNA sequence
acaaggcctgtgttggagac

SEQ ID NO: 142470 - DNA, 20 bp, Artificial
  CRISPR gRNA sequence
caaggcctgtgttggagacc

SEQ ID NO: 142471 - DNA, 20 bp, Artificial
  CRISPR gRNA sequence
aggcctgtgttggagaccag

SEQ ID NO: 142472 - DNA, 20 bp, Artificial
  CRISPR gRNA sequence
cctgtgttggagaccaggag

SEQ ID NO: 142473 - DNA, 20 bp, Artificial
  CRISPR gRNA sequence
tgttggagaccaggagcaga

SEQ ID NO: 142474 - DNA, 20 bp, Artificial
  CRISPR gRNA sequence
caggagcagatggcttctga

SEQ ID NO: 142475 - DNA, 20 bp, Artificial
  CRISPR gRNA sequence
aggagcagatggcttctgac

SEQ ID NO: 142476 - DNA, 20 bp, Artificial
  CRISPR gRNA sequence
gcagatggcttctgacagga

SEQ ID NO: 142477 - DNA, 20 bp, Artificial
  CRISPR gRNA sequence
cagatggcttctgacaggaa

SEQ ID NO: 142478 - DNA, 20 bp, Artificial
  CRISPR gRNA sequence
gatggcttctgacaggaaag

SEQ ID NO: 142479 - DNA, 20 bp, Artificial
  CRISPR gRNA sequence
tctgacaggaaaggagcgct

SEQ ID NO: 142480 - DNA, 20 bp, Artificial
  CRISPR gRNA sequence
ggaaaggagcgctcagcaca

SEQ ID NO: 142481 - DNA, 20 bp, Artificial
  CRISPR gRNA sequence
ttgccacctcatccttcaac

SEQ ID NO: 142482 - DNA, 20 bp, Artificial
  CRISPR gRNA sequence
ccacctcatccttcaaccag

SEQ ID NO: 142483 - DNA, 20 bp, Artificial
  CRISPR gRNA sequence
ctccatatccttctgcaccc

SEQ ID NO: 142484 - DNA, 20 bp, Artificial
  CRISPR gRNA sequence
ccatatccttctgcacccaa

SEQ ID NO: 142485 - DNA, 20 bp, Artificial
  CRISPR gRNA sequence
catatccttctgcacccaag

SEQ ID NO: 142486 - DNA, 20 bp, Artificial
  CRISPR gRNA sequence
ccttctgcacccaagaggca

SEQ ID NO: 142487 - DNA, 20 bp, Artificial
  CRISPR gRNA sequence
cttctgcacccaagaggcat

SEQ ID NO: 142488 - DNA, 20 bp, Artificial
  CRISPR gRNA sequence
ctgcacccaagaggcatggg

SEQ ID NO: 142489 - DNA, 20 bp, Artificial
  CRISPR gRNA sequence
caagaggcatgggtggtaat

SEQ ID NO: 142490 - DNA, 20 bp, Artificial
  CRISPR gRNA sequence
atgggtggtaattggaacat

SEQ ID NO: 142491 - DNA, 20 bp, Artificial
  CRISPR gRNA sequence
taattggaacattagattca

SEQ ID NO: 142492 - DNA, 20 bp, Artificial
  CRISPR gRNA sequence
tctcttaccatcttgttctc

SEQ ID NO: 142493 - DNA, 20 bp, Artificial
  CRISPR gRNA sequence
ctcttaccatcttgttctca

SEQ ID NO: 142494 - DNA, 20 bp, Artificial
  CRISPR gRNA sequence
tcttaccatcttgttctcaa

SEQ ID NO: 142495 - DNA, 20 bp, Artificial
  CRISPR gRNA sequence
cttaccatcttgttctcaag

SEQ ID NO: 142496 - DNA, 20 bp, Artificial
  CRISPR gRNA sequence
catcttgttctcaaggggca

SEQ ID NO: 142497 - DNA, 20 bp, Artificial
  CRISPR gRNA sequence
ctcaaggggcaaagaaatgc

SEQ ID NO: 142498 - DNA, 20 bp, Artificial
  CRISPR gRNA sequence
aggggcaaagaaatgcaagt

SEQ ID NO: 142499 - DNA, 20 bp, Artificial
  CRISPR gRNA sequence
ggggcaaagaaatgcaagtc

SEQ ID NO: 142500 - DNA, 20 bp, Artificial
  CRISPR gRNA sequence
gggcaaagaaatgcaagtca

SEQ ID NO: 142501 - DNA, 20 bp, Artificial
  CRISPR gRNA sequence
ggcaaagaaatgcaagtcag

SEQ ID NO: 142502 - DNA, 20 bp, Artificial
  CRISPR gRNA sequence
aaagaaatgcaagtcagggg

SEQ ID NO: 142503 - DNA, 20 bp, Artificial
  CRISPR gRNA sequence
gcaagtcaggggaagcctcg

SEQ ID NO: 142504 - DNA, 20 bp, Artificial
  CRISPR gRNA sequence
caagtcaggggaagcctcga

SEQ ID NO: 142505 - DNA, 20 bp, Artificial
  CRISPR gRNA sequence
gaagcctcgaaggtgcctga

SEQ ID NO: 142506 - DNA, 20 bp, Artificial
  CRISPR gRNA sequence
ggtgcctgaaagaaacctta

SEQ ID NO: 142507 - DNA, 20 bp, Artificial
  CRISPR gRNA sequence
gtgcctgaaagaaaccttac

SEQ ID NO: 142508 - DNA, 20 bp, Artificial
  CRISPR gRNA sequence
ttacaggtgtgcacacccat

SEQ ID NO: 142509 - DNA, 20 bp, Artificial
  CRISPR gRNA sequence
gtgtgcacacccatcagacc

SEQ ID NO: 142510 - DNA, 20 bp, Artificial
  CRISPR gRNA sequence
tgtgcacacccatcagacct

SEQ ID NO: 142511 - DNA, 20 bp, Artificial
  CRISPR gRNA sequence
cagacctgggaaatgttcga

SEQ ID NO: 142512 - DNA, 20 bp, Artificial
  CRISPR gRNA sequence
tcgacagatcgcctgatcgt

SEQ ID NO: 142513 - DNA, 20 bp, Artificial
  CRISPR gRNA sequence
cgacagatcgcctgatcgtc

SEQ ID NO: 142514 - DNA, 20 bp, Artificial
  CRISPR gRNA sequence
ctgtttccatctttaaaccc

SEQ ID NO: 142515 - DNA, 20 bp, Artificial
  CRISPR gRNA sequence
tttccatctttaaacccaag

SEQ ID NO: 142516 - DNA, 20 bp, Artificial
  CRISPR gRNA sequence
cccaagtggctgttgtgttc

SEQ ID NO: 142517 - DNA, 20 bp, Artificial
  CRISPR gRNA sequence
ctggcacctcctgtgctctt

SEQ ID NO: 142518 - DNA, 20 bp, Artificial
  CRISPR gRNA sequence
cacctcctgtgctctttgga

SEQ ID NO: 142519 - DNA, 20 bp, Artificial
  CRISPR gRNA sequence
tgctctttggaaagcttact

SEQ ID NO: 142520 - DNA, 20 bp, Artificial
  CRISPR gRNA sequence
cctcctcttgcatccctaac

SEQ ID NO: 142521 - DNA, 20 bp, Artificial
  CRISPR gRNA sequence
ctcgtgccctacaatattga

SEQ ID NO: 142522 - DNA, 20 bp, Artificial
  CRISPR gRNA sequence
cctacaatattgatggctat

SEQ ID NO: 142523 - DNA, 20 bp, Artificial
  CRISPR gRNA sequence
atattgatggctatgagtca

SEQ ID NO: 142524 - DNA, 20 bp, Artificial
  CRISPR gRNA sequence
tgatggctatgagtcacaga

SEQ ID NO: 142525 - DNA, 20 bp, Artificial
  CRISPR gRNA sequence
ggctatgagtcacagatggt

SEQ ID NO: 142526 - DNA, 20 bp, Artificial
  CRISPR gRNA sequence
gctatgagtcacagatggtg

SEQ ID NO: 142527 - DNA, 20 bp, Artificial
  CRISPR gRNA sequence
ctatgagtcacagatggtga

SEQ ID NO: 142528 - DNA, 20 bp, Artificial
  CRISPR gRNA sequence
tatgagtcacagatggtgag

SEQ ID NO: 142529 - DNA, 20 bp, Artificial
  CRISPR gRNA sequence
atgagtcacagatggtgagg

SEQ ID NO: 142530 - DNA, 20 bp, Artificial
  CRISPR gRNA sequence
tggtgagggggctgcctccc

SEQ ID NO: 142531 - DNA, 20 bp, Artificial
  CRISPR gRNA sequence
ggtgagggggctgcctccct

SEQ ID NO: 142532 - DNA, 20 bp, Artificial
  CRISPR gRNA sequence
gggggctgcctccctgggct

SEQ ID NO: 142533 - DNA, 20 bp, Artificial
  CRISPR gRNA sequence
ggggctgcctccctgggctt

SEQ ID NO: 142534 - DNA, 20 bp, Artificial
  CRISPR gRNA sequence
gggctgcctccctgggcttg

SEQ ID NO: 142535 - DNA, 20 bp, Artificial
  CRISPR gRNA sequence
ggctgcctccctgggcttgg

SEQ ID NO: 142536 - DNA, 20 bp, Artificial
  CRISPR gRNA sequence
tccctgggcttgggggtgtt

SEQ ID NO: 142537 - DNA, 20 bp, Artificial
  CRISPR gRNA sequence
ccctgggcttgggggtgttg

SEQ ID NO: 142538 - DNA, 20 bp, Artificial
  CRISPR gRNA sequence
cctgggcttgggggtgttga

SEQ ID NO: 142539 - DNA, 20 bp, Artificial
  CRISPR gRNA sequence
cttgggggtgttgagggaca

SEQ ID NO: 142540 - DNA, 20 bp, Artificial
  CRISPR gRNA sequence
ttgggggtgttgagggacat

SEQ ID NO: 142541 - DNA, 20 bp, Artificial
  CRISPR gRNA sequence
agggacatgggtattacttg

SEQ ID NO: 142542 - DNA, 20 bp, Artificial
  CRISPR gRNA sequence
gacatgggtattacttgcag

SEQ ID NO: 142543 - DNA, 20 bp, Artificial
  CRISPR gRNA sequence
tgggtattacttgcagaaga

SEQ ID NO: 142544 - DNA, 20 bp, Artificial
  CRISPR gRNA sequence
gggtattacttgcagaagat

SEQ ID NO: 142545 - DNA, 20 bp, Artificial
  CRISPR gRNA sequence
ggtattacttgcagaagatg

SEQ ID NO: 142546 - DNA, 20 bp, Artificial
  CRISPR gRNA sequence
gtattacttgcagaagatgg

SEQ ID NO: 142547 - DNA, 20 bp, Artificial
  CRISPR gRNA sequence
tattacttgcagaagatggg

SEQ ID NO: 142548 - DNA, 20 bp, Artificial
  CRISPR gRNA sequence
ttgcagaagatggggggtgc

SEQ ID NO: 142549 - DNA, 20 bp, Artificial
  CRISPR gRNA sequence
gaagatggggggtgctggtc

SEQ ID NO: 142550 - DNA, 20 bp, Artificial
  CRISPR gRNA sequence
aagatggggggtgctggtca

SEQ ID NO: 142551 - DNA, 20 bp, Artificial
  CRISPR gRNA sequence
agatggggggtgctggtcaa

SEQ ID NO: 142552 - DNA, 20 bp, Artificial
  CRISPR gRNA sequence
gatggggggtgctggtcaag

SEQ ID NO: 142553 - DNA, 20 bp, Artificial
  CRISPR gRNA sequence
tggggggtgctggtcaaggg

SEQ ID NO: 142554 - DNA, 20 bp, Artificial
  CRISPR gRNA sequence
ggggggtgctggtcaagggg

SEQ ID NO: 142555 - DNA, 20 bp, Artificial
  CRISPR gRNA sequence
tcaaggggaggcattgttaa

SEQ ID NO: 142556 - DNA, 20 bp, Artificial
  CRISPR gRNA sequence
gttaatggattcttttgcct

SEQ ID NO: 142557 - DNA, 20 bp, Artificial
  CRISPR gRNA sequence
ttttgcctcagacccaaaaa

SEQ ID NO: 142558 - DNA, 20 bp, Artificial
  CRISPR gRNA sequence
tgcctcagacccaaaaaaag

SEQ ID NO: 142559 - DNA, 20 bp, Artificial
  CRISPR gRNA sequence
aaaaaaagcagcgatcgttt

SEQ ID NO: 142560 - DNA, 20 bp, Artificial
  CRISPR gRNA sequence
aaaaagcagcgatcgtttaa

SEQ ID NO: 142561 - DNA, 20 bp, Artificial
  CRISPR gRNA sequence
agcagcgatcgtttaagagc

SEQ ID NO: 142562 - DNA, 20 bp, Artificial
  CRISPR gRNA sequence
gtttaagagctggacccgtc

SEQ ID NO: 142563 - DNA, 20 bp, Artificial
  CRISPR gRNA sequence
agagctggacccgtctggcc

SEQ ID NO: 142564 - DNA, 20 bp, Artificial
  CRISPR gRNA sequence
gtctggcccagttgcatttc

SEQ ID NO: 142565 - DNA, 20 bp, Artificial
  CRISPR gRNA sequence
tctggtgatgtatctattga

SEQ ID NO: 142566 - DNA, 20 bp, Artificial
  CRISPR gRNA sequence
ggtgatgtatctattgacag

SEQ ID NO: 142567 - DNA, 20 bp, Artificial
  CRISPR gRNA sequence
gtatctattgacagtggtga

SEQ ID NO: 142568 - DNA, 20 bp, Artificial
  CRISPR gRNA sequence
atctattgacagtggtgaca

SEQ ID NO: 142569 - DNA, 20 bp, Artificial
  CRISPR gRNA sequence
ttgacagtggtgacagagct

SEQ ID NO: 142570 - DNA, 20 bp, Artificial
  CRISPR gRNA sequence
tggtgacagagctgagtttg

SEQ ID NO: 142571 - DNA, 20 bp, Artificial
  CRISPR gRNA sequence
gtgacagagctgagtttgta

SEQ ID NO: 142572 - DNA, 20 bp, Artificial
  CRISPR gRNA sequence
acagagctgagtttgtagag

SEQ ID NO: 142573 - DNA, 20 bp, Artificial
  CRISPR gRNA sequence
cagagctgagtttgtagagc

SEQ ID NO: 142574 - DNA, 20 bp, Artificial
  CRISPR gRNA sequence
gtttgtagagcaggtctcca

SEQ ID NO: 142575 - DNA, 20 bp, Artificial
  CRISPR gRNA sequence
aggtctccaaagatctcatt

SEQ ID NO: 142576 - DNA, 20 bp, Artificial
  CRISPR gRNA sequence
ggtctccaaagatctcattt

SEQ ID NO: 142577 - DNA, 20 bp, Artificial
  CRISPR gRNA sequence
gatctcatttgggaaaatac

SEQ ID NO: 142578 - DNA, 20 bp, Artificial
  CRISPR gRNA sequence
atctcatttgggaaaatacg

SEQ ID NO: 142579 - DNA, 20 bp, Artificial
  CRISPR gRNA sequence
tttgggaaaatacgaggaat

SEQ ID NO: 142580 - DNA, 20 bp, Artificial
  CRISPR gRNA sequence
aaatacgaggaatgagccaa

SEQ ID NO: 142581 - DNA, 20 bp, Artificial
  CRISPR gRNA sequence
acgaggaatgagccaaaagc

SEQ ID NO: 142582 - DNA, 20 bp, Artificial
  CRISPR gRNA sequence
cgaggaatgagccaaaagca

SEQ ID NO: 142583 - DNA, 20 bp, Artificial
  CRISPR gRNA sequence
gagccaaaagcaaggcttct

SEQ ID NO: 142584 - DNA, 20 bp, Artificial
  CRISPR gRNA sequence
caaggcttctgagttccata

SEQ ID NO: 142585 - DNA, 20 bp, Artificial
  CRISPR gRNA sequence
tctgagttccatatagtctc

SEQ ID NO: 142586 - DNA, 20 bp, Artificial
  CRISPR gRNA sequence
ctgagttccatatagtctct

SEQ ID NO: 142587 - DNA, 20 bp, Artificial
  CRISPR gRNA sequence
atatagtctctgggatcatt

SEQ ID NO: 142588 - DNA, 20 bp, Artificial
  CRISPR gRNA sequence
tatagtctctgggatcatta

SEQ ID NO: 142589 - DNA, 20 bp, Artificial
  CRISPR gRNA sequence
atagtctctgggatcattaa

SEQ ID NO: 142590 - DNA, 20 bp, Artificial
  CRISPR gRNA sequence
ctgtttctgtgcccactccc

SEQ ID NO: 142591 - DNA, 20 bp, Artificial
  CRISPR gRNA sequence
gcccactccccggcttacct

SEQ ID NO: 142592 - DNA, 20 bp, Artificial
  CRISPR gRNA sequence
cccactccccggcttaccta

SEQ ID NO: 142593 - DNA, 20 bp, Artificial
  CRISPR gRNA sequence
ccccggcttacctaaggacg

SEQ ID NO: 142594 - DNA, 20 bp, Artificial
  CRISPR gRNA sequence
ctaaggacgcggcttttccg

SEQ ID NO: 142595 - DNA, 20 bp, Artificial
  CRISPR gRNA sequence
actgactcacacccttcccc

SEQ ID NO: 142596 - DNA, 20 bp, Artificial
  CRISPR gRNA sequence
gcccctctttttaacctcat

SEQ ID NO: 142597 - DNA, 20 bp, Artificial
  CRISPR gRNA sequence
aacctcataagattcttccc

SEQ ID NO: 142598 - DNA, 20 bp, Artificial
  CRISPR gRNA sequence
acctcataagattcttccct

SEQ ID NO: 142599 - DNA, 20 bp, Artificial
  CRISPR gRNA sequence
ctgggatccaaaaaacataa

SEQ ID NO: 142600 - DNA, 20 bp, Artificial
  CRISPR gRNA sequence
atccaaaaaacataacggca

SEQ ID NO: 142601 - DNA, 20 bp, Artificial
  CRISPR gRNA sequence
tccaaaaaacataacggcat

SEQ ID NO: 142602 - DNA, 20 bp, Artificial
  CRISPR gRNA sequence
caaaaaacataacggcatgg

SEQ ID NO: 142603 - DNA, 20 bp, Artificial
  CRISPR gRNA sequence
aaaacataacggcatgggag

SEQ ID NO: 142604 - DNA, 20 bp, Artificial
  CRISPR gRNA sequence
aaacataacggcatgggagt

SEQ ID NO: 142605 - DNA, 20 bp, Artificial
  CRISPR gRNA sequence
acataacggcatgggagtgg

SEQ ID NO: 142606 - DNA, 20 bp, Artificial
  CRISPR gRNA sequence
cataacggcatgggagtggg

SEQ ID NO: 142607 - DNA, 20 bp, Artificial
  CRISPR gRNA sequence
gcatgggagtgggaggaaat

SEQ ID NO: 142608 - DNA, 20 bp, Artificial
  CRISPR gRNA sequence
tgggagtgggaggaaatgag

SEQ ID NO: 142609 - DNA, 20 bp, Artificial
  CRISPR gRNA sequence
gggagtgggaggaaatgaga

SEQ ID NO: 142610 - DNA, 20 bp, Artificial
  CRISPR gRNA sequence
agtgggaggaaatgagaagg

SEQ ID NO: 142611 - DNA, 20 bp, Artificial
  CRISPR gRNA sequence
gaaatgagaaggaagcttct

SEQ ID NO: 142612 - DNA, 20 bp, Artificial
  CRISPR gRNA sequence
aaggaagcttcttggttcct

SEQ ID NO: 142613 - DNA, 20 bp, Artificial
  CRISPR gRNA sequence
gaagcttcttggttcctcag

SEQ ID NO: 142614 - DNA, 20 bp, Artificial
  CRISPR gRNA sequence
cttcttggttcctcagaagt

SEQ ID NO: 142615 - DNA, 20 bp, Artificial
  CRISPR gRNA sequence
tggttcctcagaagtcagtt

SEQ ID NO: 142616 - DNA, 20 bp, Artificial
  CRISPR gRNA sequence
ggttcctcagaagtcagttt

SEQ ID NO: 142617 - DNA, 20 bp, Artificial
  CRISPR gRNA sequence
gttcctcagaagtcagtttg

SEQ ID NO: 142618 - DNA, 20 bp, Artificial
  CRISPR gRNA sequence
ctcagaagtcagtttggggc

SEQ ID NO: 142619 - DNA, 20 bp, Artificial
  CRISPR gRNA sequence
tcagaagtcagtttggggct

SEQ ID NO: 142620 - DNA, 20 bp, Artificial
  CRISPR gRNA sequence
agtcagtttggggctgggca

SEQ ID NO: 142621 - DNA, 20 bp, Artificial
  CRISPR gRNA sequence
cagtttggggctgggcacag

SEQ ID NO: 142622 - DNA, 20 bp, Artificial
  CRISPR gRNA sequence
agtttggggctgggcacagt

SEQ ID NO: 142623 - DNA, 20 bp, Artificial
  CRISPR gRNA sequence
gtgggtcacgcctgtaatcc

SEQ ID NO: 142624 - DNA, 20 bp, Artificial
  CRISPR gRNA sequence
cgcctgtaatcccagcactt

SEQ ID NO: 142625 - DNA, 20 bp, Artificial
  CRISPR gRNA sequence
gcctgtaatcccagcacttt

SEQ ID NO: 142626 - DNA, 20 bp, Artificial
  CRISPR gRNA sequence
ctgtaatcccagcactttgg

SEQ ID NO: 142627 - DNA, 20 bp, Artificial
  CRISPR gRNA sequence
tgtaatcccagcactttggg

SEQ ID NO: 142628 - DNA, 20 bp, Artificial
  CRISPR gRNA sequence
gtaatcccagcactttggga

SEQ ID NO: 142629 - DNA, 20 bp, Artificial
  CRISPR gRNA sequence
aatcccagcactttgggagg

SEQ ID NO: 142630 - DNA, 20 bp, Artificial
  CRISPR gRNA sequence
atcccagcactttgggaggg

SEQ ID NO: 142631 - DNA, 20 bp, Artificial
  CRISPR gRNA sequence
agcactttgggagggaggct

SEQ ID NO: 142632 - DNA, 20 bp, Artificial
  CRISPR gRNA sequence
gcactttgggagggaggctg

SEQ ID NO: 142633 - DNA, 20 bp, Artificial
  CRISPR gRNA sequence
ctttgggagggaggctgagg

SEQ ID NO: 142634 - DNA, 20 bp, Artificial
  CRISPR gRNA sequence
tttgggagggaggctgaggc

SEQ ID NO: 142635 - DNA, 20 bp, Artificial
  CRISPR gRNA sequence
gctgaggcaggtgatcacat

SEQ ID NO: 142636 - DNA, 20 bp, Artificial
  CRISPR gRNA sequence
ctgaggcaggtgatcacatg

SEQ ID NO: 142637 - DNA, 20 bp, Artificial
  CRISPR gRNA sequence
ggcaggtgatcacatgaggt

SEQ ID NO: 142638 - DNA, 20 bp, Artificial
  CRISPR gRNA sequence
gcaggtgatcacatgaggtc

SEQ ID NO: 142639 - DNA, 20 bp, Artificial
  CRISPR gRNA sequence
aggtgatcacatgaggtcgg

SEQ ID NO: 142640 - DNA, 20 bp, Artificial
  CRISPR gRNA sequence
tcacatgaggtcgggagttt

SEQ ID NO: 142641 - DNA, 20 bp, Artificial
  CRISPR gRNA sequence
tgaggtcgggagtttgagac

SEQ ID NO: 142642 - DNA, 20 bp, Artificial
  CRISPR gRNA sequence
tcgggagtttgagaccagcc

SEQ ID NO: 142643 - DNA, 20 bp, Artificial
  CRISPR gRNA sequence
tgagaccagcctggccaaca

SEQ ID NO: 142644 - DNA, 20 bp, Artificial
  CRISPR gRNA sequence
ttccactaaaaatacaaaat

SEQ ID NO: 142645 - DNA, 20 bp, Artificial
  CRISPR gRNA sequence
actaaaaatacaaaattagc

SEQ ID NO: 142646 - DNA, 20 bp, Artificial
  CRISPR gRNA sequence
ctaaaaatacaaaattagct

SEQ ID NO: 142647 - DNA, 20 bp, Artificial
  CRISPR gRNA sequence
aatacaaaattagctgggcg

SEQ ID NO: 142648 - DNA, 20 bp, Artificial
  CRISPR gRNA sequence
acaaaattagctgggcgtgg

SEQ ID NO: 142649 - DNA, 20 bp, Artificial
  CRISPR gRNA sequence
gtggtgcatgcctgtcatcc

SEQ ID NO: 142650 - DNA, 20 bp, Artificial
  CRISPR gRNA sequence
tgcctgtcatcccagctact

SEQ ID NO: 142651 - DNA, 20 bp, Artificial
  CRISPR gRNA sequence
gcctgtcatcccagctactt

SEQ ID NO: 142652 - DNA, 20 bp, Artificial
  CRISPR gRNA sequence
ctgtcatcccagctacttgg

SEQ ID NO: 142653 - DNA, 20 bp, Artificial
  CRISPR gRNA sequence
tgtcatcccagctacttggg

SEQ ID NO: 142654 - DNA, 20 bp, Artificial
  CRISPR gRNA sequence
tcccagctacttgggaggct

SEQ ID NO: 142655 - DNA, 20 bp, Artificial
  CRISPR gRNA sequence
tacttgggaggctgagacac

SEQ ID NO: 142656 - DNA, 20 bp, Artificial
  CRISPR gRNA sequence
acacaagaatcacttgaacc

SEQ ID NO: 142657 - DNA, 20 bp, Artificial
  CRISPR gRNA sequence
cacaagaatcacttgaaccc

SEQ ID NO: 142658 - DNA, 20 bp, Artificial
  CRISPR gRNA sequence
caagaatcacttgaacccag

SEQ ID NO: 142659 - DNA, 20 bp, Artificial
  CRISPR gRNA sequence
aagaatcacttgaacccagg

SEQ ID NO: 142660 - DNA, 20 bp, Artificial
  CRISPR gRNA sequence
aatcacttgaacccaggagg

SEQ ID NO: 142661 - DNA, 20 bp, Artificial
  CRISPR gRNA sequence
tcacttgaacccaggaggtg

SEQ ID NO: 142662 - DNA, 20 bp, Artificial
  CRISPR gRNA sequence
cacttgaacccaggaggtgg

SEQ ID NO: 142663 - DNA, 20 bp, Artificial
  CRISPR gRNA sequence
aacccaggaggtggaggttg

SEQ ID NO: 142664 - DNA, 20 bp, Artificial
  CRISPR gRNA sequence
caggaggtggaggttgcagt

SEQ ID NO: 142665 - DNA, 20 bp, Artificial
  CRISPR gRNA sequence
ggtggaggttgcagtgagct

SEQ ID NO: 142666 - DNA, 20 bp, Artificial
  CRISPR gRNA sequence
gagattgtgccactgcactc

SEQ ID NO: 142667 - DNA, 20 bp, Artificial
  CRISPR gRNA sequence
tgtgccactgcactccagcc

SEQ ID NO: 142668 - DNA, 20 bp, Artificial
  CRISPR gRNA sequence
gtgccactgcactccagcct

SEQ ID NO: 142669 - DNA, 20 bp, Artificial
  CRISPR gRNA sequence
ctgcactccagcctgggcga

SEQ ID NO: 142670 - DNA, 20 bp, Artificial
  CRISPR gRNA sequence
gcactccagcctgggcgaca

SEQ ID NO: 142671 - DNA, 20 bp, Artificial
  CRISPR gRNA sequence
tccagcctgggcgacagagt

SEQ ID NO: 142672 - DNA, 20 bp, Artificial
  CRISPR gRNA sequence
caaaaaataaaaattaaaaa

SEQ ID NO: 142673 - DNA, 20 bp, Artificial
  CRISPR gRNA sequence
aaattaaaaaaagtccgttt

SEQ ID NO: 142674 - DNA, 20 bp, Artificial
  CRISPR gRNA sequence
aattaaaaaaagtccgtttt

SEQ ID NO: 142675 - DNA, 20 bp, Artificial
  CRISPR gRNA sequence
aaaaaagtccgttttgggaa

SEQ ID NO: 142676 - DNA, 20 bp, Artificial
  CRISPR gRNA sequence
ccgttttgggaacagaacta

SEQ ID NO: 142677 - DNA, 20 bp, Artificial
  CRISPR gRNA sequence
acagaactaaagccaaaaaa

SEQ ID NO: 142678 - DNA, 20 bp, Artificial
  CRISPR gRNA sequence
cagaactaaagccaaaaaat

SEQ ID NO: 142679 - DNA, 20 bp, Artificial
  CRISPR gRNA sequence
gaactaaagccaaaaaatgg

SEQ ID NO: 142680 - DNA, 20 bp, Artificial
  CRISPR gRNA sequence
actaaagccaaaaaatggga

SEQ ID NO: 142681 - DNA, 20 bp, Artificial
  CRISPR gRNA sequence
ctaaagccaaaaaatgggag

SEQ ID NO: 142682 - DNA, 20 bp, Artificial
  CRISPR gRNA sequence
agccaaaaaatgggagaggc

SEQ ID NO: 142683 - DNA, 20 bp, Artificial
  CRISPR gRNA sequence
gccaaaaaatgggagaggct

SEQ ID NO: 142684 - DNA, 20 bp, Artificial
  CRISPR gRNA sequence
ccaaaaaatgggagaggctg

SEQ ID NO: 142685 - DNA, 20 bp, Artificial
  CRISPR gRNA sequence
aaaaaatgggagaggctggg

SEQ ID NO: 142686 - DNA, 20 bp, Artificial
  CRISPR gRNA sequence
aaatgggagaggctggggag

SEQ ID NO: 142687 - DNA, 20 bp, Artificial
  CRISPR gRNA sequence
gggagaggctggggagaagc

SEQ ID NO: 142688 - DNA, 20 bp, Artificial
  CRISPR gRNA sequence
gaggctggggagaagcaaga

SEQ ID NO: 142689 - DNA, 20 bp, Artificial
  CRISPR gRNA sequence
gctggggagaagcaagaaag

SEQ ID NO: 142690 - DNA, 20 bp, Artificial
  CRISPR gRNA sequence
ggggagaagcaagaaagtgg

SEQ ID NO: 142691 - DNA, 20 bp, Artificial
  CRISPR gRNA sequence
aagcaagaaagtggtagctg

SEQ ID NO: 142692 - DNA, 20 bp, Artificial
  CRISPR gRNA sequence
agcaagaaagtggtagctga

SEQ ID NO: 142693 - DNA, 20 bp, Artificial
  CRISPR gRNA sequence
aatgaaaatctttgtaacaa

SEQ ID NO: 142694 - DNA, 20 bp, Artificial
  CRISPR gRNA sequence
atgaaaatctttgtaacaac

SEQ ID NO: 142695 - DNA, 20 bp, Artificial
  CRISPR gRNA sequence
aattatgacaacctaatact

SEQ ID NO: 142696 - DNA, 20 bp, Artificial
  CRISPR gRNA sequence
tatgacaacctaatacttag

SEQ ID NO: 142697 - DNA, 20 bp, Artificial
  CRISPR gRNA sequence
atgacaacctaatacttagt

SEQ ID NO: 142698 - DNA, 20 bp, Artificial
  CRISPR gRNA sequence
cctaatacttagtaggtgct

SEQ ID NO: 142699 - DNA, 20 bp, Artificial
  CRISPR gRNA sequence
cagtaaatgtttgttgaatg

SEQ ID NO: 142700 - DNA, 20 bp, Artificial
  CRISPR gRNA sequence
taatatgtaaataaaatgta

SEQ ID NO: 142701 - DNA, 20 bp, Artificial
  CRISPR gRNA sequence
aatatgtaaataaaatgtaa

SEQ ID NO: 142702 - DNA, 20 bp, Artificial
  CRISPR gRNA sequence
tgtaaaggtaaatgaaatct

SEQ ID NO: 142703 - DNA, 20 bp, Artificial
  CRISPR gRNA sequence
gaaatctcagctaatatgaa

SEQ ID NO: 142704 - DNA, 20 bp, Artificial
  CRISPR gRNA sequence
aatatgaatggcaatcctgc

SEQ ID NO: 142705 - DNA, 20 bp, Artificial
  CRISPR gRNA sequence
aatggcaatcctgctggcca

SEQ ID NO: 142706 - DNA, 20 bp, Artificial
  CRISPR gRNA sequence
tggcaatcctgctggccaca

SEQ ID NO: 142707 - DNA, 20 bp, Artificial
  CRISPR gRNA sequence
caatcctgctggccacagag

SEQ ID NO: 142708 - DNA, 20 bp, Artificial
  CRISPR gRNA sequence
agttaaccttcttatctatg

SEQ ID NO: 142709 - DNA, 20 bp, Artificial
  CRISPR gRNA sequence
ggaatattttccatttgtct

SEQ ID NO: 142710 - DNA, 20 bp, Artificial
  CRISPR gRNA sequence
gaatattttccatttgtctc

SEQ ID NO: 142711 - DNA, 20 bp, Artificial
  CRISPR gRNA sequence
tgtttattctgcaacatttc

SEQ ID NO: 142712 - DNA, 20 bp, Artificial
  CRISPR gRNA sequence
tctggaatactaactttgta

SEQ ID NO: 142713 - DNA, 20 bp, Artificial
  CRISPR gRNA sequence
ctggaatactaactttgtat

SEQ ID NO: 142714 - DNA, 20 bp, Artificial
  CRISPR gRNA sequence
tttgtatgggctcctgccct

SEQ ID NO: 142715 - DNA, 20 bp, Artificial
  CRISPR gRNA sequence
ttgtatgggctcctgccctc

SEQ ID NO: 142716 - DNA, 20 bp, Artificial
  CRISPR gRNA sequence
tcctgccctcaggcatctta

SEQ ID NO: 142717 - DNA, 20 bp, Artificial
  CRISPR gRNA sequence
cctgccctcaggcatcttat

SEQ ID NO: 142718 - DNA, 20 bp, Artificial
  CRISPR gRNA sequence
tcaggcatcttataggctgt

SEQ ID NO: 142719 - DNA, 20 bp, Artificial
  CRISPR gRNA sequence
ggcatcttataggctgttgg

SEQ ID NO: 142720 - DNA, 20 bp, Artificial
  CRISPR gRNA sequence
gcatcttataggctgttgga

SEQ ID NO: 142721 - DNA, 20 bp, Artificial
  CRISPR gRNA sequence
ttataggctgttggaaggaa

SEQ ID NO: 142722 - DNA, 20 bp, Artificial
  CRISPR gRNA sequence
tataggctgttggaaggaaa

SEQ ID NO: 142723 - DNA, 20 bp, Artificial
  CRISPR gRNA sequence
ggaaggaaaaggaccaaaat

SEQ ID NO: 142724 - DNA, 20 bp, Artificial
  CRISPR gRNA sequence
gaaggaaaaggaccaaaata

SEQ ID NO: 142725 - DNA, 20 bp, Artificial
  CRISPR gRNA sequence
aggaccaaaataaggaacaa

SEQ ID NO: 142726 - DNA, 20 bp, Artificial
  CRISPR gRNA sequence
taaggaacaatagtaaaaaa

SEQ ID NO: 142727 - DNA, 20 bp, Artificial
  CRISPR gRNA sequence
aatagtaaaaaatagtcatg

SEQ ID NO: 142728 - DNA, 20 bp, Artificial
  CRISPR gRNA sequence
gttccctttcttgttcctca

SEQ ID NO: 142729 - DNA, 20 bp, Artificial
  CRISPR gRNA sequence
tcttgttcctcatagcctca

SEQ ID NO: 142730 - DNA, 20 bp, Artificial
  CRISPR gRNA sequence
cttgttcctcatagcctcat

SEQ ID NO: 142731 - DNA, 20 bp, Artificial
  CRISPR gRNA sequence
gttcctcatagcctcatggg

SEQ ID NO: 142732 - DNA, 20 bp, Artificial
  CRISPR gRNA sequence
ttcctcatagcctcatgggt

SEQ ID NO: 142733 - DNA, 20 bp, Artificial
  CRISPR gRNA sequence
tagcctcatgggtaggcctg

SEQ ID NO: 142734 - DNA, 20 bp, Artificial
  CRISPR gRNA sequence
agcctcatgggtaggcctgc

SEQ ID NO: 142735 - DNA, 20 bp, Artificial
  CRISPR gRNA sequence
gcctcatgggtaggcctgca

SEQ ID NO: 142736 - DNA, 20 bp, Artificial
  CRISPR gRNA sequence
cctcatgggtaggcctgcag

SEQ ID NO: 142737 - DNA, 20 bp, Artificial
  CRISPR gRNA sequence
aggcctgcaggggttgtttt

SEQ ID NO: 142738 - DNA, 20 bp, Artificial
  CRISPR gRNA sequence
gcaggggttgtttttggcca

SEQ ID NO: 142739 - DNA, 20 bp, Artificial
  CRISPR gRNA sequence
gggttgtttttggccatggt

SEQ ID NO: 142740 - DNA, 20 bp, Artificial
  CRISPR gRNA sequence
ggttgtttttggccatggtg

SEQ ID NO: 142741 - DNA, 20 bp, Artificial
  CRISPR gRNA sequence
tggccatggtgaggacattt

SEQ ID NO: 142742 - DNA, 20 bp, Artificial
  CRISPR gRNA sequence
gccatggtgaggacatttga

SEQ ID NO: 142743 - DNA, 20 bp, Artificial
  CRISPR gRNA sequence
ccatggtgaggacatttgag

SEQ ID NO: 142744 - DNA, 20 bp, Artificial
  CRISPR gRNA sequence
ggtgaggacatttgagagga

SEQ ID NO: 142745 - DNA, 20 bp, Artificial
  CRISPR gRNA sequence
agaggacagtccttgtcttg

SEQ ID NO: 142746 - DNA, 20 bp, Artificial
  CRISPR gRNA sequence
gaggacagtccttgtcttgc

SEQ ID NO: 142747 - DNA, 20 bp, Artificial
  CRISPR gRNA sequence
acagtccttgtcttgcaggc

SEQ ID NO: 142748 - DNA, 20 bp, Artificial
  CRISPR gRNA sequence
caggctggctgtgatgattc

SEQ ID NO: 142749 - DNA, 20 bp, Artificial
  CRISPR gRNA sequence
aggctggctgtgatgattcc

SEQ ID NO: 142750 - DNA, 20 bp, Artificial
  CRISPR gRNA sequence
gctgtgatgattccaggaaa

SEQ ID NO: 142751 - DNA, 20 bp, Artificial
  CRISPR gRNA sequence
tgattccaggaaatggtaca

SEQ ID NO: 142752 - DNA, 20 bp, Artificial
  CRISPR gRNA sequence
attccaggaaatggtacaca

SEQ ID NO: 142753 - DNA, 20 bp, Artificial
  CRISPR gRNA sequence
ttccaggaaatggtacacag

SEQ ID NO: 142754 - DNA, 20 bp, Artificial
  CRISPR gRNA sequence
tggtacacagaggacactgc

SEQ ID NO: 142755 - DNA, 20 bp, Artificial
  CRISPR gRNA sequence
actgctggccaaatgttcca

SEQ ID NO: 142756 - DNA, 20 bp, Artificial
  CRISPR gRNA sequence
ctgctggccaaatgttccat

SEQ ID NO: 142757 - DNA, 20 bp, Artificial
  CRISPR gRNA sequence
acacatgtgcatgcacaccg

SEQ ID NO: 142758 - DNA, 20 bp, Artificial
  CRISPR gRNA sequence
gcacaccgcagtcttctttc

SEQ ID NO: 142759 - DNA, 20 bp, Artificial
  CRISPR gRNA sequence
agtcttctttctagtttacc

SEQ ID NO: 142760 - DNA, 20 bp, Artificial
  CRISPR gRNA sequence
ctagtttaccgagctgctcc

SEQ ID NO: 142761 - DNA, 20 bp, Artificial
  CRISPR gRNA sequence
gtttaccgagctgctcccag

SEQ ID NO: 142762 - DNA, 20 bp, Artificial
  CRISPR gRNA sequence
agcagttgtcattatatatg

SEQ ID NO: 142763 - DNA, 20 bp, Artificial
  CRISPR gRNA sequence
atatatgcagttctacatgt

SEQ ID NO: 142764 - DNA, 20 bp, Artificial
  CRISPR gRNA sequence
atttatctaaaatccattca

SEQ ID NO: 142765 - DNA, 20 bp, Artificial
  CRISPR gRNA sequence
tccattcacagtccacacat

SEQ ID NO: 142766 - DNA, 20 bp, Artificial
  CRISPR gRNA sequence
cagtccacacataagatttt

SEQ ID NO: 142767 - DNA, 20 bp, Artificial
  CRISPR gRNA sequence
tgttgtctttgttccactcc

SEQ ID NO: 142768 - DNA, 20 bp, Artificial
  CRISPR gRNA sequence
ccttttctcctcccctcctt

SEQ ID NO: 142769 - DNA, 20 bp, Artificial
  CRISPR gRNA sequence
tctcctcccctcctttggcc

SEQ ID NO: 142770 - DNA, 20 bp, Artificial
  CRISPR gRNA sequence
tcctcccctcctttggccca

SEQ ID NO: 142771 - DNA, 20 bp, Artificial
  CRISPR gRNA sequence
cctcccctcctttggcccag

SEQ ID NO: 142772 - DNA, 20 bp, Artificial
  CRISPR gRNA sequence
ctcccctcctttggcccaga

SEQ ID NO: 142773 - DNA, 20 bp, Artificial
  CRISPR gRNA sequence
ctttggcccagagggctgca

SEQ ID NO: 142774 - DNA, 20 bp, Artificial
  CRISPR gRNA sequence
gggctgcacagtgcctctct

SEQ ID NO: 142775 - DNA, 20 bp, Artificial
  CRISPR gRNA sequence
cacagtgcctctctcggaaa

SEQ ID NO: 142776 - DNA, 20 bp, Artificial
  CRISPR gRNA sequence
ctctcggaaaaagtacttca

SEQ ID NO: 142777 - DNA, 20 bp, Artificial
  CRISPR gRNA sequence
tctcggaaaaagtacttcat

SEQ ID NO: 142778 - DNA, 20 bp, Artificial
  CRISPR gRNA sequence
gtacttcataggtttgccat

SEQ ID NO: 142779 - DNA, 20 bp, Artificial
  CRISPR gRNA sequence
tacttcataggtttgccatg

SEQ ID NO: 142780 - DNA, 20 bp, Artificial
  CRISPR gRNA sequence
aggtttgccatgaggactgc

SEQ ID NO: 142781 - DNA, 20 bp, Artificial
  CRISPR gRNA sequence
ggtttgccatgaggactgct

SEQ ID NO: 142782 - DNA, 20 bp, Artificial
  CRISPR gRNA sequence
ccatgaggactgctgggacc

SEQ ID NO: 142783 - DNA, 20 bp, Artificial
  CRISPR gRNA sequence
catgaggactgctgggacca

SEQ ID NO: 142784 - DNA, 20 bp, Artificial
  CRISPR gRNA sequence
gaccaaggccacttgctcgc

SEQ ID NO: 142785 - DNA, 20 bp, Artificial
  CRISPR gRNA sequence
accaaggccacttgctcgcc

SEQ ID NO: 142786 - DNA, 20 bp, Artificial
  CRISPR gRNA sequence
ccaaggccacttgctcgcca

SEQ ID NO: 142787 - DNA, 20 bp, Artificial
  CRISPR gRNA sequence
cgccagggtgtttcatattc

SEQ ID NO: 142788 - DNA, 20 bp, Artificial
  CRISPR gRNA sequence
agggtgtttcatattccagt

SEQ ID NO: 142789 - DNA, 20 bp, Artificial
  CRISPR gRNA sequence
catattccagtcagatgatc

SEQ ID NO: 142790 - DNA, 20 bp, Artificial
  CRISPR gRNA sequence
atattccagtcagatgatct

SEQ ID NO: 142791 - DNA, 20 bp, Artificial
  CRISPR gRNA sequence
gtcagatgatctgggtgata

SEQ ID NO: 142792 - DNA, 20 bp, Artificial
  CRISPR gRNA sequence
tcagatgatctgggtgatac

SEQ ID NO: 142793 - DNA, 20 bp, Artificial
  CRISPR gRNA sequence
tgatctgggtgatacgggtt

SEQ ID NO: 142794 - DNA, 20 bp, Artificial
  CRISPR gRNA sequence
tgggtgatacgggtttggtt

SEQ ID NO: 142795 - DNA, 20 bp, Artificial
  CRISPR gRNA sequence
ggtgatacgggtttggtttg

SEQ ID NO: 142796 - DNA, 20 bp, Artificial
  CRISPR gRNA sequence
tggtttggagcccaccttcc

SEQ ID NO: 142797 - DNA, 20 bp, Artificial
  CRISPR gRNA sequence
agcccaccttccaagaatga

SEQ ID NO: 142798 - DNA, 20 bp, Artificial
  CRISPR gRNA sequence
cccaccttccaagaatgaaa

SEQ ID NO: 142799 - DNA, 20 bp, Artificial
  CRISPR gRNA sequence
ccaccttccaagaatgaaag

SEQ ID NO: 142800 - DNA, 20 bp, Artificial
  CRISPR gRNA sequence
ccactttgtctgacactttg

SEQ ID NO: 142801 - DNA, 20 bp, Artificial
  CRISPR gRNA sequence
actttgcagtccgccttcac

SEQ ID NO: 142802 - DNA, 20 bp, Artificial
  CRISPR gRNA sequence
agtccgccttcactggctga

SEQ ID NO: 142803 - DNA, 20 bp, Artificial
  CRISPR gRNA sequence
ctggctgaaagactgactct

SEQ ID NO: 142804 - DNA, 20 bp, Artificial
  CRISPR gRNA sequence
tggctgaaagactgactctt

SEQ ID NO: 142805 - DNA, 20 bp, Artificial
  CRISPR gRNA sequence
aggacttctaccccaaacca

SEQ ID NO: 142806 - DNA, 20 bp, Artificial
  CRISPR gRNA sequence
ctaccccaaaccatagcacc

SEQ ID NO: 142807 - DNA, 20 bp, Artificial
  CRISPR gRNA sequence
taccccaaaccatagcacct

SEQ ID NO: 142808 - DNA, 20 bp, Artificial
  CRISPR gRNA sequence
accccaaaccatagcaccta

SEQ ID NO: 142809 - DNA, 20 bp, Artificial
  CRISPR gRNA sequence
agggtccatgtgttctgttt

SEQ ID NO: 142810 - DNA, 20 bp, Artificial
  CRISPR gRNA sequence
catgtgttctgtttgagcct

SEQ ID NO: 142811 - DNA, 20 bp, Artificial
  CRISPR gRNA sequence
tgtgttctgtttgagcctca

SEQ ID NO: 142812 - DNA, 20 bp, Artificial
  CRISPR gRNA sequence
ctgtttgagcctcagagttt

SEQ ID NO: 142813 - DNA, 20 bp, Artificial
  CRISPR gRNA sequence
tgagcctcagagtttgagat

SEQ ID NO: 142814 - DNA, 20 bp, Artificial
  CRISPR gRNA sequence
gcctcagagtttgagatgag

SEQ ID NO: 142815 - DNA, 20 bp, Artificial
  CRISPR gRNA sequence
cctcagagtttgagatgagt

SEQ ID NO: 142816 - DNA, 20 bp, Artificial
  CRISPR gRNA sequence
cagagtttgagatgagtggg

SEQ ID NO: 142817 - DNA, 20 bp, Artificial
  CRISPR gRNA sequence
tttgagatgagtgggtggtt

SEQ ID NO: 142818 - DNA, 20 bp, Artificial
  CRISPR gRNA sequence
ttgagatgagtgggtggttg

SEQ ID NO: 142819 - DNA, 20 bp, Artificial
  CRISPR gRNA sequence
tgagatgagtgggtggttga

SEQ ID NO: 142820 - DNA, 20 bp, Artificial
  CRISPR gRNA sequence
agatgagtgggtggttgagg

SEQ ID NO: 142821 - DNA, 20 bp, Artificial
  CRISPR gRNA sequence
tgagtgggtggttgagggag

SEQ ID NO: 142822 - DNA, 20 bp, Artificial
  CRISPR gRNA sequence
gagtgggtggttgagggagt

SEQ ID NO: 142823 - DNA, 20 bp, Artificial
  CRISPR gRNA sequence
ttgagggagtaggcattcat

SEQ ID NO: 142824 - DNA, 20 bp, Artificial
  CRISPR gRNA sequence
gagggagtaggcattcatta

SEQ ID NO: 142825 - DNA, 20 bp, Artificial
  CRISPR gRNA sequence
gggagtaggcattcattaga

SEQ ID NO: 142826 - DNA, 20 bp, Artificial
  CRISPR gRNA sequence
gtaggcattcattagagaga

SEQ ID NO: 142827 - DNA, 20 bp, Artificial
  CRISPR gRNA sequence
taggcattcattagagagat

SEQ ID NO: 142828 - DNA, 20 bp, Artificial
  CRISPR gRNA sequence
attcattagagagatgggtg

SEQ ID NO: 142829 - DNA, 20 bp, Artificial
  CRISPR gRNA sequence
ttcattagagagatgggtgt

SEQ ID NO: 142830 - DNA, 20 bp, Artificial
  CRISPR gRNA sequence
gaactatctattatgtgctc

SEQ ID NO: 142831 - DNA, 20 bp, Artificial
  CRISPR gRNA sequence
aactatctattatgtgctcc

SEQ ID NO: 142832 - DNA, 20 bp, Artificial
  CRISPR gRNA sequence
tgtgctgccaactcttgacg

SEQ ID NO: 142833 - DNA, 20 bp, Artificial
  CRISPR gRNA sequence
ccaactcttgacgtagccat

SEQ ID NO: 142834 - DNA, 20 bp, Artificial
  CRISPR gRNA sequence
cttgacgtagccatcagtgc

SEQ ID NO: 142835 - DNA, 20 bp, Artificial
  CRISPR gRNA sequence
cgtagccatcagtgctagat

SEQ ID NO: 142836 - DNA, 20 bp, Artificial
  CRISPR gRNA sequence
gtagccatcagtgctagatt

SEQ ID NO: 142837 - DNA, 20 bp, Artificial
  CRISPR gRNA sequence
agccatcagtgctagattag

SEQ ID NO: 142838 - DNA, 20 bp, Artificial
  CRISPR gRNA sequence
gccatcagtgctagattagg

SEQ ID NO: 142839 - DNA, 20 bp, Artificial
  CRISPR gRNA sequence
ccatcagtgctagattagga

SEQ ID NO: 142840 - DNA, 20 bp, Artificial
  CRISPR gRNA sequence
catcagtgctagattaggag

SEQ ID NO: 142841 - DNA, 20 bp, Artificial
  CRISPR gRNA sequence
ttgcttgcttactacccatt

SEQ ID NO: 142842 - DNA, 20 bp, Artificial
  CRISPR gRNA sequence
actacccattgagcacctgc

SEQ ID NO: 142843 - DNA, 20 bp, Artificial
  CRISPR gRNA sequence
ctacccattgagcacctgct

SEQ ID NO: 142844 - DNA, 20 bp, Artificial
  CRISPR gRNA sequence
tgatctttatgaccctcttt

SEQ ID NO: 142845 - DNA, 20 bp, Artificial
  CRISPR gRNA sequence
gatctttatgaccctctttt

SEQ ID NO: 142846 - DNA, 20 bp, Artificial
  CRISPR gRNA sequence
ctttatgaccctcttttggg

SEQ ID NO: 142847 - DNA, 20 bp, Artificial
  CRISPR gRNA sequence
tatgaccctcttttgggtgg

SEQ ID NO: 142848 - DNA, 20 bp, Artificial
  CRISPR gRNA sequence
atgaccctcttttgggtggt

SEQ ID NO: 142849 - DNA, 20 bp, Artificial
  CRISPR gRNA sequence
ccctcttttgggtggtgggc

SEQ ID NO: 142850 - DNA, 20 bp, Artificial
  CRISPR gRNA sequence
tcttttgggtggtgggctgg

SEQ ID NO: 142851 - DNA, 20 bp, Artificial
  CRISPR gRNA sequence
tgggtggtgggctggtggat

SEQ ID NO: 142852 - DNA, 20 bp, Artificial
  CRISPR gRNA sequence
ggctggtggatcagaccctg

SEQ ID NO: 142853 - DNA, 20 bp, Artificial
  CRISPR gRNA sequence
ctctaccatcttgattctta

SEQ ID NO: 142854 - DNA, 20 bp, Artificial
  CRISPR gRNA sequence
cttgattcttacagattaca

SEQ ID NO: 142855 - DNA, 20 bp, Artificial
  CRISPR gRNA sequence
attcttacagattacacaga

SEQ ID NO: 142856 - DNA, 20 bp, Artificial
  CRISPR gRNA sequence
tcttacagattacacagaca

SEQ ID NO: 142857 - DNA, 20 bp, Artificial
  CRISPR gRNA sequence
cttacagattacacagacag

SEQ ID NO: 142858 - DNA, 20 bp, Artificial
  CRISPR gRNA sequence
agattacacagacagaggtc

SEQ ID NO: 142859 - DNA, 20 bp, Artificial
  CRISPR gRNA sequence
tacacagacagaggtccagc

SEQ ID NO: 142860 - DNA, 20 bp, Artificial
  CRISPR gRNA sequence
acacagacagaggtccagca

SEQ ID NO: 142861 - DNA, 20 bp, Artificial
  CRISPR gRNA sequence
agacagaggtccagcaagga

SEQ ID NO: 142862 - DNA, 20 bp, Artificial
  CRISPR gRNA sequence
cagaggtccagcaaggacag

SEQ ID NO: 142863 - DNA, 20 bp, Artificial
  CRISPR gRNA sequence
aggtccagcaaggacagcag

SEQ ID NO: 142864 - DNA, 20 bp, Artificial
  CRISPR gRNA sequence
cagcaaggacagcagcagtt

SEQ ID NO: 142865 - DNA, 20 bp, Artificial
  CRISPR gRNA sequence
aaggacagcagcagttcagc

SEQ ID NO: 142866 - DNA, 20 bp, Artificial
  CRISPR gRNA sequence
gcagcagttcagccagttca

SEQ ID NO: 142867 - DNA, 20 bp, Artificial
  CRISPR gRNA sequence
cagttcagccagttcacaga

SEQ ID NO: 142868 - DNA, 20 bp, Artificial
  CRISPR gRNA sequence
tcagccagttcacagatgga

SEQ ID NO: 142869 - DNA, 20 bp, Artificial
  CRISPR gRNA sequence
cagccagttcacagatggac

SEQ ID NO: 142870 - DNA, 20 bp, Artificial
  CRISPR gRNA sequence
ccagttcacagatggacagg

SEQ ID NO: 142871 - DNA, 20 bp, Artificial
  CRISPR gRNA sequence
cagttcacagatggacaggt

SEQ ID NO: 142872 - DNA, 20 bp, Artificial
  CRISPR gRNA sequence
agttcacagatggacaggta

SEQ ID NO: 142873 - DNA, 20 bp, Artificial
  CRISPR gRNA sequence
gacaggtagggtacccaacc

SEQ ID NO: 142874 - DNA, 20 bp, Artificial
  CRISPR gRNA sequence
acaggtagggtacccaacct

SEQ ID NO: 142875 - DNA, 20 bp, Artificial
  CRISPR gRNA sequence
gtagggtacccaacctgggc

SEQ ID NO: 142876 - DNA, 20 bp, Artificial
  CRISPR gRNA sequence
tagggtacccaacctgggct

SEQ ID NO: 142877 - DNA, 20 bp, Artificial
  CRISPR gRNA sequence
ggtacccaacctgggctggg

SEQ ID NO: 142878 - DNA, 20 bp, Artificial
  CRISPR gRNA sequence
tacccaacctgggctgggca

SEQ ID NO: 142879 - DNA, 20 bp, Artificial
  CRISPR gRNA sequence
acccaacctgggctgggcag

SEQ ID NO: 142880 - DNA, 20 bp, Artificial
  CRISPR gRNA sequence
cccaacctgggctgggcaga

SEQ ID NO: 142881 - DNA, 20 bp, Artificial
  CRISPR gRNA sequence
acctgggctgggcagagggt

SEQ ID NO: 142882 - DNA, 20 bp, Artificial
  CRISPR gRNA sequence
cctgggctgggcagagggtg

SEQ ID NO: 142883 - DNA, 20 bp, Artificial
  CRISPR gRNA sequence
gggcagagggtgaggatttg

SEQ ID NO: 142884 - DNA, 20 bp, Artificial
  CRISPR gRNA sequence
ggcagagggtgaggatttgc

SEQ ID NO: 142885 - DNA, 20 bp, Artificial
  CRISPR gRNA sequence
gcagagggtgaggatttgcg

SEQ ID NO: 142886 - DNA, 20 bp, Artificial
  CRISPR gRNA sequence
gagggtgaggatttgcgggg

SEQ ID NO: 142887 - DNA, 20 bp, Artificial
  CRISPR gRNA sequence
agggtgaggatttgcggggc

SEQ ID NO: 142888 - DNA, 20 bp, Artificial
  CRISPR gRNA sequence
gggtgaggatttgcggggca

SEQ ID NO: 142889 - DNA, 20 bp, Artificial
  CRISPR gRNA sequence
tgaggatttgcggggcaggg

SEQ ID NO: 142890 - DNA, 20 bp, Artificial
  CRISPR gRNA sequence
ggatttgcggggcagggtag

SEQ ID NO: 142891 - DNA, 20 bp, Artificial
  CRISPR gRNA sequence
gatttgcggggcagggtagc

SEQ ID NO: 142892 - DNA, 20 bp, Artificial
  CRISPR gRNA sequence
ttgcggggcagggtagcagg

SEQ ID NO: 142893 - DNA, 20 bp, Artificial
  CRISPR gRNA sequence
gcagggtagcaggtagtatc

SEQ ID NO: 142894 - DNA, 20 bp, Artificial
  CRISPR gRNA sequence
cagggtagcaggtagtatct

SEQ ID NO: 142895 - DNA, 20 bp, Artificial
  CRISPR gRNA sequence
tagcaggtagtatctgggtt

SEQ ID NO: 142896 - DNA, 20 bp, Artificial
  CRISPR gRNA sequence
aggtagtatctgggtttgga

SEQ ID NO: 142897 - DNA, 20 bp, Artificial
  CRISPR gRNA sequence
agtatctgggtttggatggt

SEQ ID NO: 142898 - DNA, 20 bp, Artificial
  CRISPR gRNA sequence
gtatctgggtttggatggtt

SEQ ID NO: 142899 - DNA, 20 bp, Artificial
  CRISPR gRNA sequence
tatctgggtttggatggtta

SEQ ID NO: 142900 - DNA, 20 bp, Artificial
  CRISPR gRNA sequence
actgtcctgtcctctactaa

SEQ ID NO: 142901 - DNA, 20 bp, Artificial
  CRISPR gRNA sequence
tcctgtcctctactaacagt

SEQ ID NO: 142902 - DNA, 20 bp, Artificial
  CRISPR gRNA sequence
tgtcctctactaacagtgag

SEQ ID NO: 142903 - DNA, 20 bp, Artificial
  CRISPR gRNA sequence
ctctactaacagtgagtgga

SEQ ID NO: 142904 - DNA, 20 bp, Artificial
  CRISPR gRNA sequence
tggacagaaattgttaaaac

SEQ ID NO: 142905 - DNA, 20 bp, Artificial
  CRISPR gRNA sequence
agaaattgttaaaacaagta

SEQ ID NO: 142906 - DNA, 20 bp, Artificial
  CRISPR gRNA sequence
aacaagtacggtatttaaat

SEQ ID NO: 142907 - DNA, 20 bp, Artificial
  CRISPR gRNA sequence
acaagtacggtatttaaatc

SEQ ID NO: 142908 - DNA, 20 bp, Artificial
  CRISPR gRNA sequence
caagtacggtatttaaatca

SEQ ID NO: 142909 - DNA, 20 bp, Artificial
  CRISPR gRNA sequence
aaatcagggcacctatcctt

SEQ ID NO: 142910 - DNA, 20 bp, Artificial
  CRISPR gRNA sequence
gcacctatcctttagtttta

SEQ ID NO: 142911 - DNA, 20 bp, Artificial
  CRISPR gRNA sequence
atcctttagttttatagact

SEQ ID NO: 142912 - DNA, 20 bp, Artificial
  CRISPR gRNA sequence
ctttagttttatagacttag

SEQ ID NO: 142913 - DNA, 20 bp, Artificial
  CRISPR gRNA sequence
tttagttttatagacttagt

SEQ ID NO: 142914 - DNA, 20 bp, Artificial
  CRISPR gRNA sequence
agtgggaactaaaataatct

SEQ ID NO: 142915 - DNA, 20 bp, Artificial
  CRISPR gRNA sequence
ctaaaataatcttagacatg

SEQ ID NO: 142916 - DNA, 20 bp, Artificial
  CRISPR gRNA sequence
tagcccaaattgccatttta

SEQ ID NO: 142917 - DNA, 20 bp, Artificial
  CRISPR gRNA sequence
caaattgccattttacagat

SEQ ID NO: 142918 - DNA, 20 bp, Artificial
  CRISPR gRNA sequence
cagatgagtaaactgaaccc

SEQ ID NO: 142919 - DNA, 20 bp, Artificial
  CRISPR gRNA sequence
gatgagtaaactgaaccctg

SEQ ID NO: 142920 - DNA, 20 bp, Artificial
  CRISPR gRNA sequence
agtaaactgaaccctggaga

SEQ ID NO: 142921 - DNA, 20 bp, Artificial
  CRISPR gRNA sequence
gtaaactgaaccctggagat

SEQ ID NO: 142922 - DNA, 20 bp, Artificial
  CRISPR gRNA sequence
aactgaaccctggagatggg

SEQ ID NO: 142923 - DNA, 20 bp, Artificial
  CRISPR gRNA sequence
gtgccttgtccatgctcccc

SEQ ID NO: 142924 - DNA, 20 bp, Artificial
  CRISPR gRNA sequence
gctcccctagatgttcattg

SEQ ID NO: 142925 - DNA, 20 bp, Artificial
  CRISPR gRNA sequence
tcccctagatgttcattgca

SEQ ID NO: 142926 - DNA, 20 bp, Artificial
  CRISPR gRNA sequence
ctagatgttcattgcagagc

SEQ ID NO: 142927 - DNA, 20 bp, Artificial
  CRISPR gRNA sequence
tagatgttcattgcagagcc

SEQ ID NO: 142928 - DNA, 20 bp, Artificial
  CRISPR gRNA sequence
gttcattgcagagccaggac

SEQ ID NO: 142929 - DNA, 20 bp, Artificial
  CRISPR gRNA sequence
tcattgcagagccaggacta

SEQ ID NO: 142930 - DNA, 20 bp, Artificial
  CRISPR gRNA sequence
attgcagagccaggactaga

SEQ ID NO: 142931 - DNA, 20 bp, Artificial
  CRISPR gRNA sequence
gcagagccaggactagagag

SEQ ID NO: 142932 - DNA, 20 bp, Artificial
  CRISPR gRNA sequence
cagagccaggactagagagc

SEQ ID NO: 142933 - DNA, 20 bp, Artificial
  CRISPR gRNA sequence
aggtttcctgtttccctctc

SEQ ID NO: 142934 - DNA, 20 bp, Artificial
  CRISPR gRNA sequence
actgtatttttttcccctct

SEQ ID NO: 142935 - DNA, 20 bp, Artificial
  CRISPR gRNA sequence
aagccatgatgctgttttaa

SEQ ID NO: 142936 - DNA, 20 bp, Artificial
  CRISPR gRNA sequence
atgatgctgttttaatagca

SEQ ID NO: 142937 - DNA, 20 bp, Artificial
  CRISPR gRNA sequence
ttttaatagcatggactgtt

SEQ ID NO: 142938 - DNA, 20 bp, Artificial
  CRISPR gRNA sequence
tagcatggactgttgagacg

SEQ ID NO: 142939 - DNA, 20 bp, Artificial
  CRISPR gRNA sequence
gcatggactgttgagacgca

SEQ ID NO: 142940 - DNA, 20 bp, Artificial
  CRISPR gRNA sequence
cagagaacacgtgacctctt

SEQ ID NO: 142941 - DNA, 20 bp, Artificial
  CRISPR gRNA sequence
acgtgacctcttgagctctc

SEQ ID NO: 142942 - DNA, 20 bp, Artificial
  CRISPR gRNA sequence
cgtgacctcttgagctctct

SEQ ID NO: 142943 - DNA, 20 bp, Artificial
  CRISPR gRNA sequence
ctctctgggtgcctgaaatt

SEQ ID NO: 142944 - DNA, 20 bp, Artificial
  CRISPR gRNA sequence
gcctgaaattcagtcatttt

SEQ ID NO: 142945 - DNA, 20 bp, Artificial
  CRISPR gRNA sequence
cagtcattttcagtccatgc

SEQ ID NO: 142946 - DNA, 20 bp, Artificial
  CRISPR gRNA sequence
agtcattttcagtccatgcg

SEQ ID NO: 142947 - DNA, 20 bp, Artificial
  CRISPR gRNA sequence
tcattttcagtccatgcgag

SEQ ID NO: 142948 - DNA, 20 bp, Artificial
  CRISPR gRNA sequence
attttcagtccatgcgagga

SEQ ID NO: 142949 - DNA, 20 bp, Artificial
  CRISPR gRNA sequence
ttccctctgctttcccctca

SEQ ID NO: 142950 - DNA, 20 bp, Artificial
  CRISPR gRNA sequence
tctgctttcccctcacagta

SEQ ID NO: 142951 - DNA, 20 bp, Artificial
  CRISPR gRNA sequence
ttcccctcacagtacagtcc

SEQ ID NO: 142952 - DNA, 20 bp, Artificial
  CRISPR gRNA sequence
cccctcacagtacagtccca

SEQ ID NO: 142953 - DNA, 20 bp, Artificial
  CRISPR gRNA sequence
gtacagtcccagagaccact

SEQ ID NO: 142954 - DNA, 20 bp, Artificial
  CRISPR gRNA sequence
tacagtcccagagaccactg

SEQ ID NO: 142955 - DNA, 20 bp, Artificial
  CRISPR gRNA sequence
agagaccactgaggacatga

SEQ ID NO: 142956 - DNA, 20 bp, Artificial
  CRISPR gRNA sequence
gagaccactgaggacatgat

SEQ ID NO: 142957 - DNA, 20 bp, Artificial
  CRISPR gRNA sequence
ttgtgccctctgctgctcaa

SEQ ID NO: 142958 - DNA, 20 bp, Artificial
  CRISPR gRNA sequence
tgtgccctctgctgctcaaa

SEQ ID NO: 142959 - DNA, 20 bp, Artificial
  CRISPR gRNA sequence
gtgccctctgctgctcaaaa

SEQ ID NO: 142960 - DNA, 20 bp, Artificial
  CRISPR gRNA sequence
gccctctgctgctcaaaagg

SEQ ID NO: 142961 - DNA, 20 bp, Artificial
  CRISPR gRNA sequence
ctctgctgctcaaaagggag

SEQ ID NO: 142962 - DNA, 20 bp, Artificial
  CRISPR gRNA sequence
ctgctgctcaaaagggagaa

SEQ ID NO: 142963 - DNA, 20 bp, Artificial
  CRISPR gRNA sequence
tgctcaaaagggagaagagc

SEQ ID NO: 142964 - DNA, 20 bp, Artificial
  CRISPR gRNA sequence
aaagggagaagagctggcat

SEQ ID NO: 142965 - DNA, 20 bp, Artificial
  CRISPR gRNA sequence
aagggagaagagctggcatc

SEQ ID NO: 142966 - DNA, 20 bp, Artificial
  CRISPR gRNA sequence
ctggcatcaggacccacctc

SEQ ID NO: 142967 - DNA, 20 bp, Artificial
  CRISPR gRNA sequence
gacccacctctggcttctgc

SEQ ID NO: 142968 - DNA, 20 bp, Artificial
  CRISPR gRNA sequence
cttctgccagcaccacatgc

SEQ ID NO: 142969 - DNA, 20 bp, Artificial
  CRISPR gRNA sequence
ttctgccagcaccacatgct

SEQ ID NO: 142970 - DNA, 20 bp, Artificial
  CRISPR gRNA sequence
cacatgctaggcttacatgc

SEQ ID NO: 142971 - DNA, 20 bp, Artificial
  CRISPR gRNA sequence
acatgctaggcttacatgcc

SEQ ID NO: 142972 - DNA, 20 bp, Artificial
  CRISPR gRNA sequence
catgctaggcttacatgcca

SEQ ID NO: 142973 - DNA, 20 bp, Artificial
  CRISPR gRNA sequence
ttacatgccagggctcccat

SEQ ID NO: 142974 - DNA, 20 bp, Artificial
  CRISPR gRNA sequence
tacatgccagggctcccatg

SEQ ID NO: 142975 - DNA, 20 bp, Artificial
  CRISPR gRNA sequence
acatgccagggctcccatga

SEQ ID NO: 142976 - DNA, 20 bp, Artificial
  CRISPR gRNA sequence
ccagggctcccatgagggct

SEQ ID NO: 142977 - DNA, 20 bp, Artificial
  CRISPR gRNA sequence
tcccatgagggcttggcttt

SEQ ID NO: 142978 - DNA, 20 bp, Artificial
  CRISPR gRNA sequence
ggcttggcttttggcttctt

SEQ ID NO: 142979 - DNA, 20 bp, Artificial
  CRISPR gRNA sequence
gcttggcttttggcttcttt

SEQ ID NO: 142980 - DNA, 20 bp, Artificial
  CRISPR gRNA sequence
cttggcttttggcttctttg

SEQ ID NO: 142981 - DNA, 20 bp, Artificial
  CRISPR gRNA sequence
tggcttttggcttctttggg

SEQ ID NO: 142982 - DNA, 20 bp, Artificial
  CRISPR gRNA sequence
tggcttctttggggagcgcc

SEQ ID NO: 142983 - DNA, 20 bp, Artificial
  CRISPR gRNA sequence
ggcttctttggggagcgcct

SEQ ID NO: 142984 - DNA, 20 bp, Artificial
  CRISPR gRNA sequence
tggggagcgcctgggaaacc

SEQ ID NO: 142985 - DNA, 20 bp, Artificial
  CRISPR gRNA sequence
ggagcgcctgggaaaccaag

SEQ ID NO: 142986 - DNA, 20 bp, Artificial
  CRISPR gRNA sequence
tgggaaaccaagtagtcaat

SEQ ID NO: 142987 - DNA, 20 bp, Artificial
  CRISPR gRNA sequence
caattagccctgaccttcct

SEQ ID NO: 142988 - DNA, 20 bp, Artificial
  CRISPR gRNA sequence
ttagccctgaccttcctaag

SEQ ID NO: 142989 - DNA, 20 bp, Artificial
  CRISPR gRNA sequence
accttcctaagtggctgtgt

SEQ ID NO: 142990 - DNA, 20 bp, Artificial
  CRISPR gRNA sequence
gtgagtatcttctccacccc

SEQ ID NO: 142991 - DNA, 20 bp, Artificial
  CRISPR gRNA sequence
gagtatcttctccacccctg

SEQ ID NO: 142992 - DNA, 20 bp, Artificial
  CRISPR gRNA sequence
tctccacccctggagcgtct

SEQ ID NO: 142993 - DNA, 20 bp, Artificial
  CRISPR gRNA sequence
cccctggagcgtcttggcta

SEQ ID NO: 142994 - DNA, 20 bp, Artificial
  CRISPR gRNA sequence
ggagcgtcttggctatagtt

SEQ ID NO: 142995 - DNA, 20 bp, Artificial
  CRISPR gRNA sequence
tatagttaagtgtttaatac

SEQ ID NO: 142996 - DNA, 20 bp, Artificial
  CRISPR gRNA sequence
atagttaagtgtttaatacc

SEQ ID NO: 142997 - DNA, 20 bp, Artificial
  CRISPR gRNA sequence
ttaataccaggccacctcct

SEQ ID NO: 142998 - DNA, 20 bp, Artificial
  CRISPR gRNA sequence
ataccaggccacctccttag

SEQ ID NO: 142999 - DNA, 20 bp, Artificial
  CRISPR gRNA sequence
taccaggccacctccttagc

SEQ ID NO: 143000 - DNA, 20 bp, Artificial
  CRISPR gRNA sequence
accaggccacctccttagca

SEQ ID NO: 143001 - DNA, 20 bp, Artificial
  CRISPR gRNA sequence
cacctccttagcagggtcca

SEQ ID NO: 143002 - DNA, 20 bp, Artificial
  CRISPR gRNA sequence
cctccttagcagggtccatg

SEQ ID NO: 143003 - DNA, 20 bp, Artificial
  CRISPR gRNA sequence
ccatggagaaaattcaaatt

SEQ ID NO: 143004 - DNA, 20 bp, Artificial
  CRISPR gRNA sequence
gagaaaattcaaattcagtt

SEQ ID NO: 143005 - DNA, 20 bp, Artificial
  CRISPR gRNA sequence
attcagtttagtttcaacct

SEQ ID NO: 143006 - DNA, 20 bp, Artificial
  CRISPR gRNA sequence
agtttagtttcaacctgagc

SEQ ID NO: 143007 - DNA, 20 bp, Artificial
  CRISPR gRNA sequence
caacctgagccagatattct

SEQ ID NO: 143008 - DNA, 20 bp, Artificial
  CRISPR gRNA sequence
tgagccagatattctgagaa

SEQ ID NO: 143009 - DNA, 20 bp, Artificial
  CRISPR gRNA sequence
gccagatattctgagaaaag

SEQ ID NO: 143010 - DNA, 20 bp, Artificial
  CRISPR gRNA sequence
ccagatattctgagaaaaga

SEQ ID NO: 143011 - DNA, 20 bp, Artificial
  CRISPR gRNA sequence
agatattctgagaaaagaag

SEQ ID NO: 143012 - DNA, 20 bp, Artificial
  CRISPR gRNA sequence
atattctgagaaaagaagga

SEQ ID NO: 143013 - DNA, 20 bp, Artificial
  CRISPR gRNA sequence
tattctgagaaaagaaggag

SEQ ID NO: 143014 - DNA, 20 bp, Artificial
  CRISPR gRNA sequence
ttctgagaaaagaaggagag

SEQ ID NO: 143015 - DNA, 20 bp, Artificial
  CRISPR gRNA sequence
tctgagaaaagaaggagagg

SEQ ID NO: 143016 - DNA, 20 bp, Artificial
  CRISPR gRNA sequence
ctgagaaaagaaggagagga

SEQ ID NO: 143017 - DNA, 20 bp, Artificial
  CRISPR gRNA sequence
tgagaaaagaaggagaggag

SEQ ID NO: 143018 - DNA, 20 bp, Artificial
  CRISPR gRNA sequence
gagaaaagaaggagaggagg

SEQ ID NO: 143019 - DNA, 20 bp, Artificial
  CRISPR gRNA sequence
ggtaatcctactgcccctgc

SEQ ID NO: 143020 - DNA, 20 bp, Artificial
  CRISPR gRNA sequence
tcctactgcccctgccagtg

SEQ ID NO: 143021 - DNA, 20 bp, Artificial
  CRISPR gRNA sequence
ccctgccagtgtagattacc

SEQ ID NO: 143022 - DNA, 20 bp, Artificial
  CRISPR gRNA sequence
ctgccagtgtagattaccaa

SEQ ID NO: 143023 - DNA, 20 bp, Artificial
  CRISPR gRNA sequence
cagtgtagattaccaagagt

SEQ ID NO: 143024 - DNA, 20 bp, Artificial
  CRISPR gRNA sequence
agtgtagattaccaagagtt

SEQ ID NO: 143025 - DNA, 20 bp, Artificial
  CRISPR gRNA sequence
gtgtagattaccaagagttg

SEQ ID NO: 143026 - DNA, 20 bp, Artificial
  CRISPR gRNA sequence
ttggggaaatgctgacttcc

SEQ ID NO: 143027 - DNA, 20 bp, Artificial
  CRISPR gRNA sequence
aatgctgacttccaagctgc

SEQ ID NO: 143028 - DNA, 20 bp, Artificial
  CRISPR gRNA sequence
tgacttccaagctgctggta

SEQ ID NO: 143029 - DNA, 20 bp, Artificial
  CRISPR gRNA sequence
cttccaagctgctggtacag

SEQ ID NO: 143030 - DNA, 20 bp, Artificial
  CRISPR gRNA sequence
cgaattgcttgtgtttgcca

SEQ ID NO: 143031 - DNA, 20 bp, Artificial
  CRISPR gRNA sequence
aattgcttgtgtttgccaca

SEQ ID NO: 143032 - DNA, 20 bp, Artificial
  CRISPR gRNA sequence
attgcttgtgtttgccacag

SEQ ID NO: 143033 - DNA, 20 bp, Artificial
  CRISPR gRNA sequence
ttgtgtttgccacagaggaa

SEQ ID NO: 143034 - DNA, 20 bp, Artificial
  CRISPR gRNA sequence
tgccacagaggaacagcgtg

SEQ ID NO: 143035 - DNA, 20 bp, Artificial
  CRISPR gRNA sequence
acagaggaacagcgtgcagc

SEQ ID NO: 143036 - DNA, 20 bp, Artificial
  CRISPR gRNA sequence
gaacagcgtgcagcaagctc

SEQ ID NO: 143037 - DNA, 20 bp, Artificial
  CRISPR gRNA sequence
tgcagcaagctcgagtctct

SEQ ID NO: 143038 - DNA, 20 bp, Artificial
  CRISPR gRNA sequence
agctcgagtctctgagctaa

SEQ ID NO: 143039 - DNA, 20 bp, Artificial
  CRISPR gRNA sequence
gctcgagtctctgagctaac

SEQ ID NO: 143040 - DNA, 20 bp, Artificial
  CRISPR gRNA sequence
tcgagtctctgagctaacgg

SEQ ID NO: 143041 - DNA, 20 bp, Artificial
  CRISPR gRNA sequence
gagtctctgagctaacggga

SEQ ID NO: 143042 - DNA, 20 bp, Artificial
  CRISPR gRNA sequence
agtctctgagctaacgggag

SEQ ID NO: 143043 - DNA, 20 bp, Artificial
  CRISPR gRNA sequence
ctctgagctaacgggagagg

SEQ ID NO: 143044 - DNA, 20 bp, Artificial
  CRISPR gRNA sequence
ctgagctaacgggagaggca

SEQ ID NO: 143045 - DNA, 20 bp, Artificial
  CRISPR gRNA sequence
ctaacgggagaggcagagcc

SEQ ID NO: 143046 - DNA, 20 bp, Artificial
  CRISPR gRNA sequence
aacgggagaggcagagccca

SEQ ID NO: 143047 - DNA, 20 bp, Artificial
  CRISPR gRNA sequence
gggagaggcagagcccagag

SEQ ID NO: 143048 - DNA, 20 bp, Artificial
  CRISPR gRNA sequence
ggcagagcccagagaagtga

SEQ ID NO: 143049 - DNA, 20 bp, Artificial
  CRISPR gRNA sequence
gcccagagaagtgaaagcca

SEQ ID NO: 143050 - DNA, 20 bp, Artificial
  CRISPR gRNA sequence
cccagagaagtgaaagccac

SEQ ID NO: 143051 - DNA, 20 bp, Artificial
  CRISPR gRNA sequence
ccacacaccccccctcacac

SEQ ID NO: 143052 - DNA, 20 bp, Artificial
  CRISPR gRNA sequence
cacacaccccccctcacacc

SEQ ID NO: 143053 - DNA, 20 bp, Artificial
  CRISPR gRNA sequence
caccccccctcacaccgggc

SEQ ID NO: 143054 - DNA, 20 bp, Artificial
  CRISPR gRNA sequence
gtgtctgctgctcccaaccc

SEQ ID NO: 143055 - DNA, 20 bp, Artificial
  CRISPR gRNA sequence
tctgctgctcccaaccccag

SEQ ID NO: 143056 - DNA, 20 bp, Artificial
  CRISPR gRNA sequence
tgctgctcccaaccccagca

SEQ ID NO: 143057 - DNA, 20 bp, Artificial
  CRISPR gRNA sequence
ctcctccttctgacgccttg

SEQ ID NO: 143058 - DNA, 20 bp, Artificial
  CRISPR gRNA sequence
ctccttctgacgccttgcag

SEQ ID NO: 143059 - DNA, 20 bp, Artificial
  CRISPR gRNA sequence
tccttctgacgccttgcagt

SEQ ID NO: 143060 - DNA, 20 bp, Artificial
  CRISPR gRNA sequence
ttctgacgccttgcagtggg

SEQ ID NO: 143061 - DNA, 20 bp, Artificial
  CRISPR gRNA sequence
tgacgccttgcagtgggtgg

SEQ ID NO: 143062 - DNA, 20 bp, Artificial
  CRISPR gRNA sequence
ccttgcagtgggtggtggtt

SEQ ID NO: 143063 - DNA, 20 bp, Artificial
  CRISPR gRNA sequence
cttgcagtgggtggtggttg

SEQ ID NO: 143064 - DNA, 20 bp, Artificial
  CRISPR gRNA sequence
tgggtggtggttgaggtatc

SEQ ID NO: 143065 - DNA, 20 bp, Artificial
  CRISPR gRNA sequence
gggtggtggttgaggtatct

SEQ ID NO: 143066 - DNA, 20 bp, Artificial
  CRISPR gRNA sequence
aggtatctgggacccccaac

SEQ ID NO: 143067 - DNA, 20 bp, Artificial
  CRISPR gRNA sequence
ctgggacccccaaccagctc

SEQ ID NO: 143068 - DNA, 20 bp, Artificial
  CRISPR gRNA sequence
cccaaccagctcgagaccca

SEQ ID NO: 143069 - DNA, 20 bp, Artificial
  CRISPR gRNA sequence
ccaaccagctcgagacccat

SEQ ID NO: 143070 - DNA, 20 bp, Artificial
  CRISPR gRNA sequence
caaccagctcgagacccata

SEQ ID NO: 143071 - DNA, 20 bp, Artificial
  CRISPR gRNA sequence
accagctcgagacccatagg

SEQ ID NO: 143072 - DNA, 20 bp, Artificial
  CRISPR gRNA sequence
ggagctgcatgcccctctcc

SEQ ID NO: 143073 - DNA, 20 bp, Artificial
  CRISPR gRNA sequence
gagctgcatgcccctctccc

SEQ ID NO: 143074 - DNA, 20 bp, Artificial
  CRISPR gRNA sequence
agctgcatgcccctctccca

SEQ ID NO: 143075 - DNA, 20 bp, Artificial
  CRISPR gRNA sequence
tctctcctctccacccctcg

SEQ ID NO: 143076 - DNA, 20 bp, Artificial
  CRISPR gRNA sequence
ctcctctccacccctcgcag

SEQ ID NO: 143077 - DNA, 20 bp, Artificial
  CRISPR gRNA sequence
acccctcgcagcagctctac

SEQ ID NO: 143078 - DNA, 20 bp, Artificial
  CRISPR gRNA sequence
cgcagcagctctaccagatc

SEQ ID NO: 143079 - DNA, 20 bp, Artificial
  CRISPR gRNA sequence
gcagctctaccagatccagc

SEQ ID NO: 143080 - DNA, 20 bp, Artificial
  CRISPR gRNA sequence
ccagcaagtcaccatgcctg

SEQ ID NO: 143081 - DNA, 20 bp, Artificial
  CRISPR gRNA sequence
cagcaagtcaccatgcctgc

SEQ ID NO: 143082 - DNA, 20 bp, Artificial
  CRISPR gRNA sequence
aagtcaccatgcctgcgggc

SEQ ID NO: 143083 - DNA, 20 bp, Artificial
  CRISPR gRNA sequence
agtcaccatgcctgcgggcc

SEQ ID NO: 143084 - DNA, 20 bp, Artificial
  CRISPR gRNA sequence
ctgcgggccaggacctcgcc

SEQ ID NO: 143085 - DNA, 20 bp, Artificial
  CRISPR gRNA sequence
tcgcccagcccatgttcatc

SEQ ID NO: 143086 - DNA, 20 bp, Artificial
  CRISPR gRNA sequence
ccagcccatgttcatccagt

SEQ ID NO: 143087 - DNA, 20 bp, Artificial
  CRISPR gRNA sequence
tgttcatccagtcagccaac

SEQ ID NO: 143088 - DNA, 20 bp, Artificial
  CRISPR gRNA sequence
tcagccaaccagccctccga

SEQ ID NO: 143089 - DNA, 20 bp, Artificial
  CRISPR gRNA sequence
cagccaaccagccctccgac

SEQ ID NO: 143090 - DNA, 20 bp, Artificial
  CRISPR gRNA sequence
ccaaccagccctccgacggg

SEQ ID NO: 143091 - DNA, 20 bp, Artificial
  CRISPR gRNA sequence
caaccagccctccgacgggc

SEQ ID NO: 143092 - DNA, 20 bp, Artificial
  CRISPR gRNA sequence
cctccgacgggcaggccccc

SEQ ID NO: 143093 - DNA, 20 bp, Artificial
  CRISPR gRNA sequence
ctccgacgggcaggcccccc

SEQ ID NO: 143094 - DNA, 20 bp, Artificial
  CRISPR gRNA sequence
gggcaggccccccaggtgac

SEQ ID NO: 143095 - DNA, 20 bp, Artificial
  CRISPR gRNA sequence
cccccaggtgaccggcgact

SEQ ID NO: 143096 - DNA, 20 bp, Artificial
  CRISPR gRNA sequence
ccccaggtgaccggcgactg

SEQ ID NO: 143097 - DNA, 20 bp, Artificial
  CRISPR gRNA sequence
cccaggtgaccggcgactga

SEQ ID NO: 143098 - DNA, 20 bp, Artificial
  CRISPR gRNA sequence
tgaccggcgactgagggcct

SEQ ID NO: 143099 - DNA, 20 bp, Artificial
  CRISPR gRNA sequence
cggcgactgagggcctgagc

SEQ ID NO: 143100 - DNA, 20 bp, Artificial
  CRISPR gRNA sequence
gactgagggcctgagctggc

SEQ ID NO: 143101 - DNA, 20 bp, Artificial
  CRISPR gRNA sequence
actgagggcctgagctggca

SEQ ID NO: 143102 - DNA, 20 bp, Artificial
  CRISPR gRNA sequence
gggcctgagctggcaaggcc

SEQ ID NO: 143103 - DNA, 20 bp, Artificial
  CRISPR gRNA sequence
ggcctgagctggcaaggcca

SEQ ID NO: 143104 - DNA, 20 bp, Artificial
  CRISPR gRNA sequence
ccaacacaatttttgccata

SEQ ID NO: 143105 - DNA, 20 bp, Artificial
  CRISPR gRNA sequence
caatttttgccatacagccc

SEQ ID NO: 143106 - DNA, 20 bp, Artificial
  CRISPR gRNA sequence
aatttttgccatacagcccc

SEQ ID NO: 143107 - DNA, 20 bp, Artificial
  CRISPR gRNA sequence
tgccatacagccccaggcaa

SEQ ID NO: 143108 - DNA, 20 bp, Artificial
  CRISPR gRNA sequence
gccatacagccccaggcaat

SEQ ID NO: 143109 - DNA, 20 bp, Artificial
  CRISPR gRNA sequence
acagccccaggcaatgggca

SEQ ID NO: 143110 - DNA, 20 bp, Artificial
  CRISPR gRNA sequence
atgggcacagccttcctccc

SEQ ID NO: 143111 - DNA, 20 bp, Artificial
  CRISPR gRNA sequence
gggcacagccttcctcccca

SEQ ID NO: 143112 - DNA, 20 bp, Artificial
  CRISPR gRNA sequence
ggcacagccttcctccccag

SEQ ID NO: 143113 - DNA, 20 bp, Artificial
  CRISPR gRNA sequence
gccttcctccccagaggacc

SEQ ID NO: 143114 - DNA, 20 bp, Artificial
  CRISPR gRNA sequence
ccagaggacccggccgacct

SEQ ID NO: 143115 - DNA, 20 bp, Artificial
  CRISPR gRNA sequence
gccgacctcagcgcctcctg

SEQ ID NO: 143116 - DNA, 20 bp, Artificial
  CRISPR gRNA sequence
ccgacctcagcgcctcctgc

SEQ ID NO: 143117 - DNA, 20 bp, Artificial
  CRISPR gRNA sequence
cctcagcgcctcctgcaggc

SEQ ID NO: 143118 - DNA, 20 bp, Artificial
  CRISPR gRNA sequence
ctcagcgcctcctgcaggct

SEQ ID NO: 143119 - DNA, 20 bp, Artificial
  CRISPR gRNA sequence
cctcctgcaggctaggacac

SEQ ID NO: 143120 - DNA, 20 bp, Artificial
  CRISPR gRNA sequence
ggtgcactacaccccatgcc

SEQ ID NO: 143121 - DNA, 20 bp, Artificial
  CRISPR gRNA sequence
gtgcactacaccccatgcct

SEQ ID NO: 143122 - DNA, 20 bp, Artificial
  CRISPR gRNA sequence
tgcactacaccccatgcctg

SEQ ID NO: 143123 - DNA, 20 bp, Artificial
  CRISPR gRNA sequence
gcactacaccccatgcctgg

SEQ ID NO: 143124 - DNA, 20 bp, Artificial
  CRISPR gRNA sequence
acaccccatgcctgggggcc

SEQ ID NO: 143125 - DNA, 20 bp, Artificial
  CRISPR gRNA sequence
gcctgggggccgagattctc

SEQ ID NO: 143126 - DNA, 20 bp, Artificial
  CRISPR gRNA sequence
tgggggccgagattctccag

SEQ ID NO: 143127 - DNA, 20 bp, Artificial
  CRISPR gRNA sequence
ggccgagattctccagcaga

SEQ ID NO: 143128 - DNA, 20 bp, Artificial
  CRISPR gRNA sequence
ttttttccatttttttctct

SEQ ID NO: 143129 - DNA, 20 bp, Artificial
  CRISPR gRNA sequence
tttttccatttttttctcta

SEQ ID NO: 143130 - DNA, 20 bp, Artificial
  CRISPR gRNA sequence
aatcaatatttcaatatgtt

SEQ ID NO: 143131 - DNA, 20 bp, Artificial
  CRISPR gRNA sequence
aatattaaataacatattta

SEQ ID NO: 143132 - DNA, 20 bp, Artificial
  CRISPR gRNA sequence
atatttatggcattttcttg

SEQ ID NO: 143133 - DNA, 20 bp, Artificial
  CRISPR gRNA sequence
atttatggcattttcttgaa

SEQ ID NO: 143134 - DNA, 20 bp, Artificial
  CRISPR gRNA sequence
tggcattttcttgaagagtg

SEQ ID NO: 143135 - DNA, 20 bp, Artificial
  CRISPR gRNA sequence
tttcttgaagagtgtggttg

SEQ ID NO: 143136 - DNA, 20 bp, Artificial
  CRISPR gRNA sequence
ttgttactgccacttctttt

SEQ ID NO: 143137 - DNA, 20 bp, Artificial
  CRISPR gRNA sequence
tgttactgccacttcttttt

SEQ ID NO: 143138 - DNA, 20 bp, Artificial
  CRISPR gRNA sequence
ttactgccacttctttttag

SEQ ID NO: 143139 - DNA, 20 bp, Artificial
  CRISPR gRNA sequence
tttttaggagcaaatctccc

SEQ ID NO: 143140 - DNA, 20 bp, Artificial
  CRISPR gRNA sequence
ttttaggagcaaatctcccc

SEQ ID NO: 143141 - DNA, 20 bp, Artificial
  CRISPR gRNA sequence
tttaggagcaaatctcccca

SEQ ID NO: 143142 - DNA, 20 bp, Artificial
  CRISPR gRNA sequence
ttaggagcaaatctccccag

SEQ ID NO: 143143 - DNA, 20 bp, Artificial
  CRISPR gRNA sequence
caaatctccccaggggtgta

SEQ ID NO: 143144 - DNA, 20 bp, Artificial
  CRISPR gRNA sequence
tgtacggtatttcttgactc

SEQ ID NO: 143145 - DNA, 20 bp, Artificial
  CRISPR gRNA sequence
gtacggtatttcttgactct

SEQ ID NO: 143146 - DNA, 20 bp, Artificial
  CRISPR gRNA sequence
gtatttcttgactctgggaa

SEQ ID NO: 143147 - DNA, 20 bp, Artificial
  CRISPR gRNA sequence
tgggaacagctgctaccccc

SEQ ID NO: 143148 - DNA, 20 bp, Artificial
  CRISPR gRNA sequence
ttgccacgttgttctgccct

SEQ ID NO: 143149 - DNA, 20 bp, Artificial
  CRISPR gRNA sequence
cacgttgttctgccctcaga

SEQ ID NO: 143150 - DNA, 20 bp, Artificial
  CRISPR gRNA sequence
gttctgccctcagatggaat

SEQ ID NO: 143151 - DNA, 20 bp, Artificial
  CRISPR gRNA sequence
ttctgccctcagatggaatt

SEQ ID NO: 143152 - DNA, 20 bp, Artificial
  CRISPR gRNA sequence
tggaattaggtgaatgtgtg

SEQ ID NO: 143153 - DNA, 20 bp, Artificial
  CRISPR gRNA sequence
tgtagctgctttttcactcg

SEQ ID NO: 143154 - DNA, 20 bp, Artificial
  CRISPR gRNA sequence
cccatcccttgctctgaccc

SEQ ID NO: 143155 - DNA, 20 bp, Artificial
  CRISPR gRNA sequence
catcccttgctctgacccca

SEQ ID NO: 143156 - DNA, 20 bp, Artificial
  CRISPR gRNA sequence
gagctctgtgtatttgcatc

SEQ ID NO: 143157 - DNA, 20 bp, Artificial
  CRISPR gRNA sequence
gctctgtgtatttgcatcca

SEQ ID NO: 143158 - DNA, 20 bp, Artificial
  CRISPR gRNA sequence
ctctgtgtatttgcatccag

SEQ ID NO: 143159 - DNA, 20 bp, Artificial
  CRISPR gRNA sequence
gtatttgcatccagaggcca

SEQ ID NO: 143160 - DNA, 20 bp, Artificial
  CRISPR gRNA sequence
tggaaacattctttgcattt

SEQ ID NO: 143161 - DNA, 20 bp, Artificial
  CRISPR gRNA sequence
gaaacattctttgcatttaa

SEQ ID NO: 143162 - DNA, 20 bp, Artificial
  CRISPR gRNA sequence
cattctttgcatttaagaga

SEQ ID NO: 143163 - DNA, 20 bp, Artificial
  CRISPR gRNA sequence
agagacagatttattccctg

SEQ ID NO: 143164 - DNA, 20 bp, Artificial
  CRISPR gRNA sequence
agacagatttattccctgtg

SEQ ID NO: 143165 - DNA, 20 bp, Artificial
  CRISPR gRNA sequence
acagatttattccctgtgga

SEQ ID NO: 143166 - DNA, 20 bp, Artificial
  CRISPR gRNA sequence
gatttattccctgtggagag

SEQ ID NO: 143167 - DNA, 20 bp, Artificial
  CRISPR gRNA sequence
atttattccctgtggagagt

SEQ ID NO: 143168 - DNA, 20 bp, Artificial
  CRISPR gRNA sequence
tattccctgtggagagtggg

SEQ ID NO: 143169 - DNA, 20 bp, Artificial
  CRISPR gRNA sequence
attgccacactcttttctcc

SEQ ID NO: 143170 - DNA, 20 bp, Artificial
  CRISPR gRNA sequence
ttgccacactcttttctccc

SEQ ID NO: 143171 - DNA, 20 bp, Artificial
  CRISPR gRNA sequence
tgccacactcttttctccca

SEQ ID NO: 143172 - DNA, 20 bp, Artificial
  CRISPR gRNA sequence
actcttttctcccagggacc

SEQ ID NO: 143173 - DNA, 20 bp, Artificial
  CRISPR gRNA sequence
ctcttttctcccagggaccc

SEQ ID NO: 143174 - DNA, 20 bp, Artificial
  CRISPR gRNA sequence
ctcccagggacccaggaaac

SEQ ID NO: 143175 - DNA, 20 bp, Artificial
  CRISPR gRNA sequence
tcccagggacccaggaaact

SEQ ID NO: 143176 - DNA, 20 bp, Artificial
  CRISPR gRNA sequence
aaatgcattaaaaactgtgc

SEQ ID NO: 143177 - DNA, 20 bp, Artificial
  CRISPR gRNA sequence
ctgtgctagtctcctttgca

SEQ ID NO: 143178 - DNA, 20 bp, Artificial
  CRISPR gRNA sequence
gtctcctttgcatggacttc

SEQ ID NO: 143179 - DNA, 20 bp, Artificial
  CRISPR gRNA sequence
aaatgcaataaatctcattt

SEQ ID NO: 143180 - DNA, 20 bp, Artificial
  CRISPR gRNA sequence
aaatctcattttagataatt

SEQ ID NO: 143181 - DNA, 20 bp, Artificial
  CRISPR gRNA sequence
atctcattttagataattta

SEQ ID NO: 143182 - DNA, 20 bp, Artificial
  CRISPR gRNA sequence
attttagataatttagagtc

SEQ ID NO: 143183 - DNA, 20 bp, Artificial
  CRISPR gRNA sequence
ttttagataatttagagtct

SEQ ID NO: 143184 - DNA, 20 bp, Artificial
  CRISPR gRNA sequence
agagtctgggtttctgtgtc

SEQ ID NO: 143185 - DNA, 20 bp, Artificial
  CRISPR gRNA sequence
gagtctgggtttctgtgtct

SEQ ID NO: 143186 - DNA, 20 bp, Artificial
  CRISPR gRNA sequence
agtctgggtttctgtgtctg

SEQ ID NO: 143187 - DNA, 20 bp, Artificial
  CRISPR gRNA sequence
gtctgggtttctgtgtctgg

SEQ ID NO: 143188 - DNA, 20 bp, Artificial
  CRISPR gRNA sequence
tctgtgtctgggggcattca

SEQ ID NO: 143189 - DNA, 20 bp, Artificial
  CRISPR gRNA sequence
ctgtgtctgggggcattcat

SEQ ID NO: 143190 - DNA, 20 bp, Artificial
  CRISPR gRNA sequence
tgtgtctgggggcattcatg

SEQ ID NO: 143191 - DNA, 20 bp, Artificial
  CRISPR gRNA sequence
attcatggggccactttgct

SEQ ID NO: 143192 - DNA, 20 bp, Artificial
  CRISPR gRNA sequence
atggggccactttgcttgga

SEQ ID NO: 143193 - DNA, 20 bp, Artificial
  CRISPR gRNA sequence
tggggccactttgcttggaa

SEQ ID NO: 143194 - DNA, 20 bp, Artificial
  CRISPR gRNA sequence
tggaaaggttcatttgccct

SEQ ID NO: 143195 - DNA, 20 bp, Artificial
  CRISPR gRNA sequence
ttgccctcagtttgtgtgtc

SEQ ID NO: 143196 - DNA, 20 bp, Artificial
  CRISPR gRNA sequence
tgccctcagtttgtgtgtct

SEQ ID NO: 143197 - DNA, 20 bp, Artificial
  CRISPR gRNA sequence
ccctcagtttgtgtgtctgg

SEQ ID NO: 143198 - DNA, 20 bp, Artificial
  CRISPR gRNA sequence
ctcagtttgtgtgtctggga

SEQ ID NO: 143199 - DNA, 20 bp, Artificial
  CRISPR gRNA sequence
cagtttgtgtgtctgggaga

SEQ ID NO: 143200 - DNA, 20 bp, Artificial
  CRISPR gRNA sequence
agtttgtgtgtctgggagag

SEQ ID NO: 143201 - DNA, 20 bp, Artificial
  CRISPR gRNA sequence
gtttgtgtgtctgggagaga

SEQ ID NO: 143202 - DNA, 20 bp, Artificial
  CRISPR gRNA sequence
ctctcccagacacacaaact

SEQ ID NO: 143203 - DNA, 20 bp, Artificial
  CRISPR gRNA sequence
tctcccagacacacaaactg

SEQ ID NO: 143204 - DNA, 20 bp, Artificial
  CRISPR gRNA sequence
ctcccagacacacaaactga

SEQ ID NO: 143205 - DNA, 20 bp, Artificial
  CRISPR gRNA sequence
gagggcaaatgaacctttcc

SEQ ID NO: 143206 - DNA, 20 bp, Artificial
  CRISPR gRNA sequence
caaatgaacctttccaagca

SEQ ID NO: 143207 - DNA, 20 bp, Artificial
  CRISPR gRNA sequence
atgaacctttccaagcaaag

SEQ ID NO: 143208 - DNA, 20 bp, Artificial
  CRISPR gRNA sequence
agtggccccatgaatgcccc

SEQ ID NO: 143209 - DNA, 20 bp, Artificial
  CRISPR gRNA sequence
cccatgaatgcccccagaca

SEQ ID NO: 143210 - DNA, 20 bp, Artificial
  CRISPR gRNA sequence
tgcccccagacacagaaacc

SEQ ID NO: 143211 - DNA, 20 bp, Artificial
  CRISPR gRNA sequence
gactctaaattatctaaaat

SEQ ID NO: 143212 - DNA, 20 bp, Artificial
  CRISPR gRNA sequence
gagatttattgcatttcatg

SEQ ID NO: 143213 - DNA, 20 bp, Artificial
  CRISPR gRNA sequence
attgcatttcatgcagcttg

SEQ ID NO: 143214 - DNA, 20 bp, Artificial
  CRISPR gRNA sequence
tgcagcttgaagtccatgca

SEQ ID NO: 143215 - DNA, 20 bp, Artificial
  CRISPR gRNA sequence
gcagcttgaagtccatgcaa

SEQ ID NO: 143216 - DNA, 20 bp, Artificial
  CRISPR gRNA sequence
agcttgaagtccatgcaaag

SEQ ID NO: 143217 - DNA, 20 bp, Artificial
  CRISPR gRNA sequence
gaagtccatgcaaaggagac

SEQ ID NO: 143218 - DNA, 20 bp, Artificial
  CRISPR gRNA sequence
ccatgcaaaggagactagca

SEQ ID NO: 143219 - DNA, 20 bp, Artificial
  CRISPR gRNA sequence
ttaatgcatttaaaaaataa

SEQ ID NO: 143220 - DNA, 20 bp, Artificial
  CRISPR gRNA sequence
taatgcatttaaaaaataaa

SEQ ID NO: 143221 - DNA, 20 bp, Artificial
  CRISPR gRNA sequence
aatgcatttaaaaaataaaa

SEQ ID NO: 143222 - DNA, 20 bp, Artificial
  CRISPR gRNA sequence
tgcatttaaaaaataaaagg

SEQ ID NO: 143223 - DNA, 20 bp, Artificial
  CRISPR gRNA sequence
gcatttaaaaaataaaaggg

SEQ ID NO: 143224 - DNA, 20 bp, Artificial
  CRISPR gRNA sequence
tttaaaaaataaaagggagg

SEQ ID NO: 143225 - DNA, 20 bp, Artificial
  CRISPR gRNA sequence
ttaaaaaataaaagggaggt

SEQ ID NO: 143226 - DNA, 20 bp, Artificial
  CRISPR gRNA sequence
aaaaataaaagggaggtggg

SEQ ID NO: 143227 - DNA, 20 bp, Artificial
  CRISPR gRNA sequence
aggtgggcagcaaacacaca

SEQ ID NO: 143228 - DNA, 20 bp, Artificial
  CRISPR gRNA sequence
gcagcaaacacacaaagtcc

SEQ ID NO: 143229 - DNA, 20 bp, Artificial
  CRISPR gRNA sequence
cacacaaagtcctagtttcc

SEQ ID NO: 143230 - DNA, 20 bp, Artificial
  CRISPR gRNA sequence
acacaaagtcctagtttcct

SEQ ID NO: 143231 - DNA, 20 bp, Artificial
  CRISPR gRNA sequence
gtcctagtttcctgggtccc

SEQ ID NO: 143232 - DNA, 20 bp, Artificial
  CRISPR gRNA sequence
tcctagtttcctgggtccct

SEQ ID NO: 143233 - DNA, 20 bp, Artificial
  CRISPR gRNA sequence
ctagtttcctgggtccctgg

SEQ ID NO: 143234 - DNA, 20 bp, Artificial
  CRISPR gRNA sequence
ttcctgggtccctgggagaa

SEQ ID NO: 143235 - DNA, 20 bp, Artificial
  CRISPR gRNA sequence
cctgggtccctgggagaaaa

SEQ ID NO: 143236 - DNA, 20 bp, Artificial
  CRISPR gRNA sequence
gtccctgggagaaaagagtg

SEQ ID NO: 143237 - DNA, 20 bp, Artificial
  CRISPR gRNA sequence
atgaatccacccactctcca

SEQ ID NO: 143238 - DNA, 20 bp, Artificial
  CRISPR gRNA sequence
tgaatccacccactctccac

SEQ ID NO: 143239 - DNA, 20 bp, Artificial
  CRISPR gRNA sequence
gaatccacccactctccaca

SEQ ID NO: 143240 - DNA, 20 bp, Artificial
  CRISPR gRNA sequence
aaatctgtctcttaaatgca

SEQ ID NO: 143241 - DNA, 20 bp, Artificial
  CRISPR gRNA sequence
aaatgcaaagaatgtttcca

SEQ ID NO: 143242 - DNA, 20 bp, Artificial
  CRISPR gRNA sequence
aagaatgtttccatggcctc

SEQ ID NO: 143243 - DNA, 20 bp, Artificial
  CRISPR gRNA sequence
ggcctctggatgcaaataca

SEQ ID NO: 143244 - DNA, 20 bp, Artificial
  CRISPR gRNA sequence
cctctggatgcaaatacaca

SEQ ID NO: 143245 - DNA, 20 bp, Artificial
  CRISPR gRNA sequence
gatgcaaatacacagagctc

SEQ ID NO: 143246 - DNA, 20 bp, Artificial
  CRISPR gRNA sequence
atgcaaatacacagagctct

SEQ ID NO: 143247 - DNA, 20 bp, Artificial
  CRISPR gRNA sequence
tgcaaatacacagagctctg

SEQ ID NO: 143248 - DNA, 20 bp, Artificial
  CRISPR gRNA sequence
aatacacagagctctggggt

SEQ ID NO: 143249 - DNA, 20 bp, Artificial
  CRISPR gRNA sequence
tacacagagctctggggtca

SEQ ID NO: 143250 - DNA, 20 bp, Artificial
  CRISPR gRNA sequence
cagagctctggggtcagagc

SEQ ID NO: 143251 - DNA, 20 bp, Artificial
  CRISPR gRNA sequence
agagctctggggtcagagca

SEQ ID NO: 143252 - DNA, 20 bp, Artificial
  CRISPR gRNA sequence
gagctctggggtcagagcaa

SEQ ID NO: 143253 - DNA, 20 bp, Artificial
  CRISPR gRNA sequence
tctggggtcagagcaaggga

SEQ ID NO: 143254 - DNA, 20 bp, Artificial
  CRISPR gRNA sequence
ctggggtcagagcaagggat

SEQ ID NO: 143255 - DNA, 20 bp, Artificial
  CRISPR gRNA sequence
tggggtcagagcaagggatg

SEQ ID NO: 143256 - DNA, 20 bp, Artificial
  CRISPR gRNA sequence
gggtcagagcaagggatggg

SEQ ID NO: 143257 - DNA, 20 bp, Artificial
  CRISPR gRNA sequence
gtcagagcaagggatgggga

SEQ ID NO: 143258 - DNA, 20 bp, Artificial
  CRISPR gRNA sequence
tcagagcaagggatggggag

SEQ ID NO: 143259 - DNA, 20 bp, Artificial
  CRISPR gRNA sequence
agggatggggagaggaccac

SEQ ID NO: 143260 - DNA, 20 bp, Artificial
  CRISPR gRNA sequence
ggagaggaccacgagtgaaa

SEQ ID NO: 143261 - DNA, 20 bp, Artificial
  CRISPR gRNA sequence
gaggaccacgagtgaaaaag

SEQ ID NO: 143262 - DNA, 20 bp, Artificial
  CRISPR gRNA sequence
acattcacctaattccatct

SEQ ID NO: 143263 - DNA, 20 bp, Artificial
  CRISPR gRNA sequence
cattcacctaattccatctg

SEQ ID NO: 143264 - DNA, 20 bp, Artificial
  CRISPR gRNA sequence
attcacctaattccatctga

SEQ ID NO: 143265 - DNA, 20 bp, Artificial
  CRISPR gRNA sequence
cacctaattccatctgaggg

SEQ ID NO: 143266 - DNA, 20 bp, Artificial
  CRISPR gRNA sequence
catctgagggcagaacaacg

SEQ ID NO: 143267 - DNA, 20 bp, Artificial
  CRISPR gRNA sequence
tgagggcagaacaacgtggc

SEQ ID NO: 143268 - DNA, 20 bp, Artificial
  CRISPR gRNA sequence
cagaacaacgtggcaagtct

SEQ ID NO: 143269 - DNA, 20 bp, Artificial
  CRISPR gRNA sequence
agaacaacgtggcaagtctt

SEQ ID NO: 143270 - DNA, 20 bp, Artificial
  CRISPR gRNA sequence
gaacaacgtggcaagtcttg

SEQ ID NO: 143271 - DNA, 20 bp, Artificial
  CRISPR gRNA sequence
aacaacgtggcaagtcttgg

SEQ ID NO: 143272 - DNA, 20 bp, Artificial
  CRISPR gRNA sequence
aacgtggcaagtcttggggg

SEQ ID NO: 143273 - DNA, 20 bp, Artificial
  CRISPR gRNA sequence
gtggcaagtcttgggggtag

SEQ ID NO: 143274 - DNA, 20 bp, Artificial
  CRISPR gRNA sequence
ttgggggtagcagctgttcc

SEQ ID NO: 143275 - DNA, 20 bp, Artificial
  CRISPR gRNA sequence
gggggtagcagctgttccca

SEQ ID NO: 143276 - DNA, 20 bp, Artificial
  CRISPR gRNA sequence
tagcagctgttcccagagtc

SEQ ID NO: 143277 - DNA, 20 bp, Artificial
  CRISPR gRNA sequence
caagaaataccgtacacccc

SEQ ID NO: 143278 - DNA, 20 bp, Artificial
  CRISPR gRNA sequence
aagaaataccgtacacccct

SEQ ID NO: 143279 - DNA, 20 bp, Artificial
  CRISPR gRNA sequence
agaaataccgtacacccctg

SEQ ID NO: 143280 - DNA, 20 bp, Artificial
  CRISPR gRNA sequence
aaataccgtacacccctggg

SEQ ID NO: 143281 - DNA, 20 bp, Artificial
  CRISPR gRNA sequence
tggggagatttgctcctaaa

SEQ ID NO: 143282 - DNA, 20 bp, Artificial
  CRISPR gRNA sequence
ggagatttgctcctaaaaag

SEQ ID NO: 143283 - DNA, 20 bp, Artificial
  CRISPR gRNA sequence
gatttgctcctaaaaagaag

SEQ ID NO: 143284 - DNA, 20 bp, Artificial
  CRISPR gRNA sequence
ttgctcctaaaaagaagtgg

SEQ ID NO: 143285 - DNA, 20 bp, Artificial
  CRISPR gRNA sequence
gcagtaacaaacaaaaaaaa

SEQ ID NO: 143286 - DNA, 20 bp, Artificial
  CRISPR gRNA sequence
caaaaaaaaaagaaaaacaa

SEQ ID NO: 143287 - DNA, 20 bp, Artificial
  CRISPR gRNA sequence
aaaaaaaaaagaaaaacaaa

SEQ ID NO: 143288 - DNA, 20 bp, Artificial
  CRISPR gRNA sequence
aaaaaaaagaaaaacaaaag

SEQ ID NO: 143289 - DNA, 20 bp, Artificial
  CRISPR gRNA sequence
tttcttcaaccacactcttc

SEQ ID NO: 143290 - DNA, 20 bp, Artificial
  CRISPR gRNA sequence
tatttaatattttaatttca

SEQ ID NO: 143291 - DNA, 20 bp, Artificial
  CRISPR gRNA sequence
atattttaatttcatagcat

SEQ ID NO: 143292 - DNA, 20 bp, Artificial
  CRISPR gRNA sequence
atattgaaatattgattcct

SEQ ID NO: 143293 - DNA, 20 bp, Artificial
  CRISPR gRNA sequence
attgaaatattgattcctta

SEQ ID NO: 143294 - DNA, 20 bp, Artificial
  CRISPR gRNA sequence
tgattccttagagaaaaaaa

SEQ ID NO: 143295 - DNA, 20 bp, Artificial
  CRISPR gRNA sequence
tagagaaaaaaatggaaaaa

SEQ ID NO: 143296 - DNA, 20 bp, Artificial
  CRISPR gRNA sequence
agagaaaaaaatggaaaaaa

SEQ ID NO: 143297 - DNA, 20 bp, Artificial
  CRISPR gRNA sequence
aaaatattgcatctttctgc

SEQ ID NO: 143298 - DNA, 20 bp, Artificial
  CRISPR gRNA sequence
aatattgcatctttctgctg

SEQ ID NO: 143299 - DNA, 20 bp, Artificial
  CRISPR gRNA sequence
atctttctgctggagaatct

SEQ ID NO: 143300 - DNA, 20 bp, Artificial
  CRISPR gRNA sequence
tgctggagaatctcggcccc

SEQ ID NO: 143301 - DNA, 20 bp, Artificial
  CRISPR gRNA sequence
gctggagaatctcggccccc

SEQ ID NO: 143302 - DNA, 20 bp, Artificial
  CRISPR gRNA sequence
agaatctcggcccccaggca

SEQ ID NO: 143303 - DNA, 20 bp, Artificial
  CRISPR gRNA sequence
gaatctcggcccccaggcat

SEQ ID NO: 143304 - DNA, 20 bp, Artificial
  CRISPR gRNA sequence
aatctcggcccccaggcatg

SEQ ID NO: 143305 - DNA, 20 bp, Artificial
  CRISPR gRNA sequence
cggcccccaggcatggggtg

SEQ ID NO: 143306 - DNA, 20 bp, Artificial
  CRISPR gRNA sequence
aggcatggggtgtagtgcac

SEQ ID NO: 143307 - DNA, 20 bp, Artificial
  CRISPR gRNA sequence
ggtgtagtgcaccagtgtcc

SEQ ID NO: 143308 - DNA, 20 bp, Artificial
  CRISPR gRNA sequence
tgcaccagtgtcctagcctg

SEQ ID NO: 143309 - DNA, 20 bp, Artificial
  CRISPR gRNA sequence
gcaccagtgtcctagcctgc

SEQ ID NO: 143310 - DNA, 20 bp, Artificial
  CRISPR gRNA sequence
accagtgtcctagcctgcag

SEQ ID NO: 143311 - DNA, 20 bp, Artificial
  CRISPR gRNA sequence
ccagtgtcctagcctgcagg

SEQ ID NO: 143312 - DNA, 20 bp, Artificial
  CRISPR gRNA sequence
cctagcctgcaggaggcgct

SEQ ID NO: 143313 - DNA, 20 bp, Artificial
  CRISPR gRNA sequence
ctagcctgcaggaggcgctg

SEQ ID NO: 143314 - DNA, 20 bp, Artificial
  CRISPR gRNA sequence
cctgcaggaggcgctgaggt

SEQ ID NO: 143315 - DNA, 20 bp, Artificial
  CRISPR gRNA sequence
caggaggcgctgaggtcggc

SEQ ID NO: 143316 - DNA, 20 bp, Artificial
  CRISPR gRNA sequence
aggaggcgctgaggtcggcc

SEQ ID NO: 143317 - DNA, 20 bp, Artificial
  CRISPR gRNA sequence
ctgaggtcggccgggtcctc

SEQ ID NO: 143318 - DNA, 20 bp, Artificial
  CRISPR gRNA sequence
tgaggtcggccgggtcctct

SEQ ID NO: 143319 - DNA, 20 bp, Artificial
  CRISPR gRNA sequence
gaggtcggccgggtcctctg

SEQ ID NO: 143320 - DNA, 20 bp, Artificial
  CRISPR gRNA sequence
ggtcggccgggtcctctggg

SEQ ID NO: 143321 - DNA, 20 bp, Artificial
  CRISPR gRNA sequence
gtcggccgggtcctctgggg

SEQ ID NO: 143322 - DNA, 20 bp, Artificial
  CRISPR gRNA sequence
ggccgggtcctctggggagg

SEQ ID NO: 143323 - DNA, 20 bp, Artificial
  CRISPR gRNA sequence
gccgggtcctctggggagga

SEQ ID NO: 143324 - DNA, 20 bp, Artificial
  CRISPR gRNA sequence
ggaaggctgtgcccattgcc

SEQ ID NO: 143325 - DNA, 20 bp, Artificial
  CRISPR gRNA sequence
gaaggctgtgcccattgcct

SEQ ID NO: 143326 - DNA, 20 bp, Artificial
  CRISPR gRNA sequence
aaggctgtgcccattgcctg

SEQ ID NO: 143327 - DNA, 20 bp, Artificial
  CRISPR gRNA sequence
gcccattgcctggggctgta

SEQ ID NO: 143328 - DNA, 20 bp, Artificial
  CRISPR gRNA sequence
ctgtatggcaaaaattgtgt

SEQ ID NO: 143329 - DNA, 20 bp, Artificial
  CRISPR gRNA sequence
tgtatggcaaaaattgtgtt

SEQ ID NO: 143330 - DNA, 20 bp, Artificial
  CRISPR gRNA sequence
aaaattgtgttgggtgtcct

SEQ ID NO: 143331 - DNA, 20 bp, Artificial
  CRISPR gRNA sequence
ttgggtgtccttggccttgc

SEQ ID NO: 143332 - DNA, 20 bp, Artificial
  CRISPR gRNA sequence
tgtccttggccttgccagct

SEQ ID NO: 143333 - DNA, 20 bp, Artificial
  CRISPR gRNA sequence
gtccttggccttgccagctc

SEQ ID NO: 143334 - DNA, 20 bp, Artificial
  CRISPR gRNA sequence
gccttgccagctcaggccct

SEQ ID NO: 143335 - DNA, 20 bp, Artificial
  CRISPR gRNA sequence
cagctcaggccctcagtcgc

SEQ ID NO: 143336 - DNA, 20 bp, Artificial
  CRISPR gRNA sequence
gccctcagtcgccggtcacc

SEQ ID NO: 143337 - DNA, 20 bp, Artificial
  CRISPR gRNA sequence
ccctcagtcgccggtcacct

SEQ ID NO: 143338 - DNA, 20 bp, Artificial
  CRISPR gRNA sequence
cctcagtcgccggtcacctg

SEQ ID NO: 143339 - DNA, 20 bp, Artificial
  CRISPR gRNA sequence
ctcagtcgccggtcacctgg

SEQ ID NO: 143340 - DNA, 20 bp, Artificial
  CRISPR gRNA sequence
tcagtcgccggtcacctggg

SEQ ID NO: 143341 - DNA, 20 bp, Artificial
  CRISPR gRNA sequence
cacctggggggcctgcccgt

SEQ ID NO: 143342 - DNA, 20 bp, Artificial
  CRISPR gRNA sequence
cctggggggcctgcccgtcg

SEQ ID NO: 143343 - DNA, 20 bp, Artificial
  CRISPR gRNA sequence
ctggggggcctgcccgtcgg

SEQ ID NO: 143344 - DNA, 20 bp, Artificial
  CRISPR gRNA sequence
tggggggcctgcccgtcgga

SEQ ID NO: 143345 - DNA, 20 bp, Artificial
  CRISPR gRNA sequence
gggcctgcccgtcggagggc

SEQ ID NO: 143346 - DNA, 20 bp, Artificial
  CRISPR gRNA sequence
ctgcccgtcggagggctggt

SEQ ID NO: 143347 - DNA, 20 bp, Artificial
  CRISPR gRNA sequence
cggagggctggttggctgac

SEQ ID NO: 143348 - DNA, 20 bp, Artificial
  CRISPR gRNA sequence
gttggctgactggatgaaca

SEQ ID NO: 143349 - DNA, 20 bp, Artificial
  CRISPR gRNA sequence
ttggctgactggatgaacat

SEQ ID NO: 143350 - DNA, 20 bp, Artificial
  CRISPR gRNA sequence
ctgactggatgaacatgggc

SEQ ID NO: 143351 - DNA, 20 bp, Artificial
  CRISPR gRNA sequence
tgactggatgaacatgggct

SEQ ID NO: 143352 - DNA, 20 bp, Artificial
  CRISPR gRNA sequence
tggatgaacatgggctgggc

SEQ ID NO: 143353 - DNA, 20 bp, Artificial
  CRISPR gRNA sequence
ggatgaacatgggctgggcg

SEQ ID NO: 143354 - DNA, 20 bp, Artificial
  CRISPR gRNA sequence
acatgggctgggcgaggtcc

SEQ ID NO: 143355 - DNA, 20 bp, Artificial
  CRISPR gRNA sequence
ctgggcgaggtcctggcccg

SEQ ID NO: 143356 - DNA, 20 bp, Artificial
  CRISPR gRNA sequence
tgggcgaggtcctggcccgc

SEQ ID NO: 143357 - DNA, 20 bp, Artificial
  CRISPR gRNA sequence
gaggtcctggcccgcaggca

SEQ ID NO: 143358 - DNA, 20 bp, Artificial
  CRISPR gRNA sequence
ccgcaggcatggtgacttgc

SEQ ID NO: 143359 - DNA, 20 bp, Artificial
  CRISPR gRNA sequence
gcatggtgacttgctggatc

SEQ ID NO: 143360 - DNA, 20 bp, Artificial
  CRISPR gRNA sequence
tggtgacttgctggatctgg

SEQ ID NO: 143361 - DNA, 20 bp, Artificial
  CRISPR gRNA sequence
gtgacttgctggatctggta

SEQ ID NO: 143362 - DNA, 20 bp, Artificial
  CRISPR gRNA sequence
ggatctggtagagctgctgc

SEQ ID NO: 143363 - DNA, 20 bp, Artificial
  CRISPR gRNA sequence
gatctggtagagctgctgcg

SEQ ID NO: 143364 - DNA, 20 bp, Artificial
  CRISPR gRNA sequence
atctggtagagctgctgcga

SEQ ID NO: 143365 - DNA, 20 bp, Artificial
  CRISPR gRNA sequence
tctggtagagctgctgcgag

SEQ ID NO: 143366 - DNA, 20 bp, Artificial
  CRISPR gRNA sequence
ggtagagctgctgcgagggg

SEQ ID NO: 143367 - DNA, 20 bp, Artificial
  CRISPR gRNA sequence
tagagctgctgcgaggggtg

SEQ ID NO: 143368 - DNA, 20 bp, Artificial
  CRISPR gRNA sequence
gagctgctgcgaggggtgga

SEQ ID NO: 143369 - DNA, 20 bp, Artificial
  CRISPR gRNA sequence
agctgctgcgaggggtggag

SEQ ID NO: 143370 - DNA, 20 bp, Artificial
  CRISPR gRNA sequence
ctgctgcgaggggtggagag

SEQ ID NO: 143371 - DNA, 20 bp, Artificial
  CRISPR gRNA sequence
gctgcgaggggtggagagga

SEQ ID NO: 143372 - DNA, 20 bp, Artificial
  CRISPR gRNA sequence
tgcgaggggtggagaggaga

SEQ ID NO: 143373 - DNA, 20 bp, Artificial
  CRISPR gRNA sequence
aggggtggagaggagagagt

SEQ ID NO: 143374 - DNA, 20 bp, Artificial
  CRISPR gRNA sequence
ggggtggagaggagagagtg

SEQ ID NO: 143375 - DNA, 20 bp, Artificial
  CRISPR gRNA sequence
ggagagagtgaggtcatccc

SEQ ID NO: 143376 - DNA, 20 bp, Artificial
  CRISPR gRNA sequence
gagagagtgaggtcatccct

SEQ ID NO: 143377 - DNA, 20 bp, Artificial
  CRISPR gRNA sequence
gagagtgaggtcatccctgg

SEQ ID NO: 143378 - DNA, 20 bp, Artificial
  CRISPR gRNA sequence
gagtgaggtcatccctggga

SEQ ID NO: 143379 - DNA, 20 bp, Artificial
  CRISPR gRNA sequence
agtgaggtcatccctgggag

SEQ ID NO: 143380 - DNA, 20 bp, Artificial
  CRISPR gRNA sequence
gtgaggtcatccctgggaga

SEQ ID NO: 143381 - DNA, 20 bp, Artificial
  CRISPR gRNA sequence
tgaggtcatccctgggagag

SEQ ID NO: 143382 - DNA, 20 bp, Artificial
  CRISPR gRNA sequence
atccctgggagaggggcatg

SEQ ID NO: 143383 - DNA, 20 bp, Artificial
  CRISPR gRNA sequence
gaggggcatgcagctcccta

SEQ ID NO: 143384 - DNA, 20 bp, Artificial
  CRISPR gRNA sequence
aggggcatgcagctccctat

SEQ ID NO: 143385 - DNA, 20 bp, Artificial
  CRISPR gRNA sequence
tgcagctccctatgggtctc

SEQ ID NO: 143386 - DNA, 20 bp, Artificial
  CRISPR gRNA sequence
gctccctatgggtctcgagc

SEQ ID NO: 143387 - DNA, 20 bp, Artificial
  CRISPR gRNA sequence
cctatgggtctcgagctggt

SEQ ID NO: 143388 - DNA, 20 bp, Artificial
  CRISPR gRNA sequence
ctatgggtctcgagctggtt

SEQ ID NO: 143389 - DNA, 20 bp, Artificial
  CRISPR gRNA sequence
tatgggtctcgagctggttg

SEQ ID NO: 143390 - DNA, 20 bp, Artificial
  CRISPR gRNA sequence
atgggtctcgagctggttgg

SEQ ID NO: 143391 - DNA, 20 bp, Artificial
  CRISPR gRNA sequence
ctcgagctggttgggggtcc

SEQ ID NO: 143392 - DNA, 20 bp, Artificial
  CRISPR gRNA sequence
cctcaaccaccacccactgc

SEQ ID NO: 143393 - DNA, 20 bp, Artificial
  CRISPR gRNA sequence
ctcaaccaccacccactgca

SEQ ID NO: 143394 - DNA, 20 bp, Artificial
  CRISPR gRNA sequence
caccacccactgcaaggcgt

SEQ ID NO: 143395 - DNA, 20 bp, Artificial
  CRISPR gRNA sequence
cacccactgcaaggcgtcag

SEQ ID NO: 143396 - DNA, 20 bp, Artificial
  CRISPR gRNA sequence
acccactgcaaggcgtcaga

SEQ ID NO: 143397 - DNA, 20 bp, Artificial
  CRISPR gRNA sequence
ccactgcaaggcgtcagaag

SEQ ID NO: 143398 - DNA, 20 bp, Artificial
  CRISPR gRNA sequence
cactgcaaggcgtcagaagg

SEQ ID NO: 143399 - DNA, 20 bp, Artificial
  CRISPR gRNA sequence
ctgcaaggcgtcagaaggag

SEQ ID NO: 143400 - DNA, 20 bp, Artificial
  CRISPR gRNA sequence
tgcaaggcgtcagaaggagg

SEQ ID NO: 143401 - DNA, 20 bp, Artificial
  CRISPR gRNA sequence
gcaaggcgtcagaaggagga

SEQ ID NO: 143402 - DNA, 20 bp, Artificial
  CRISPR gRNA sequence
caaggcgtcagaaggaggag

SEQ ID NO: 143403 - DNA, 20 bp, Artificial
  CRISPR gRNA sequence
ggcgtcagaaggaggagggg

SEQ ID NO: 143404 - DNA, 20 bp, Artificial
  CRISPR gRNA sequence
gtcagaaggaggaggggaag

SEQ ID NO: 143405 - DNA, 20 bp, Artificial
  CRISPR gRNA sequence
cagaaggaggaggggaagtg

SEQ ID NO: 143406 - DNA, 20 bp, Artificial
  CRISPR gRNA sequence
gaggggaagtggagctctgc

SEQ ID NO: 143407 - DNA, 20 bp, Artificial
  CRISPR gRNA sequence
aggggaagtggagctctgct

SEQ ID NO: 143408 - DNA, 20 bp, Artificial
  CRISPR gRNA sequence
ggggaagtggagctctgctg

SEQ ID NO: 143409 - DNA, 20 bp, Artificial
  CRISPR gRNA sequence
aagtggagctctgctggggt

SEQ ID NO: 143410 - DNA, 20 bp, Artificial
  CRISPR gRNA sequence
agtggagctctgctggggtt

SEQ ID NO: 143411 - DNA, 20 bp, Artificial
  CRISPR gRNA sequence
tggagctctgctggggttgg

SEQ ID NO: 143412 - DNA, 20 bp, Artificial
  CRISPR gRNA sequence
agctctgctggggttgggag

SEQ ID NO: 143413 - DNA, 20 bp, Artificial
  CRISPR gRNA sequence
tctgctggggttgggagcag

SEQ ID NO: 143414 - DNA, 20 bp, Artificial
  CRISPR gRNA sequence
ggggttgggagcagcagaca

SEQ ID NO: 143415 - DNA, 20 bp, Artificial
  CRISPR gRNA sequence
gggttgggagcagcagacac

SEQ ID NO: 143416 - DNA, 20 bp, Artificial
  CRISPR gRNA sequence
gttgggagcagcagacacag

SEQ ID NO: 143417 - DNA, 20 bp, Artificial
  CRISPR gRNA sequence
ttgggagcagcagacacagg

SEQ ID NO: 143418 - DNA, 20 bp, Artificial
  CRISPR gRNA sequence
gcagcagacacaggaggcac

SEQ ID NO: 143419 - DNA, 20 bp, Artificial
  CRISPR gRNA sequence
agacacaggaggcaccagcc

SEQ ID NO: 143420 - DNA, 20 bp, Artificial
  CRISPR gRNA sequence
aggaggcaccagcccggtgt

SEQ ID NO: 143421 - DNA, 20 bp, Artificial
  CRISPR gRNA sequence
ggaggcaccagcccggtgtg

SEQ ID NO: 143422 - DNA, 20 bp, Artificial
  CRISPR gRNA sequence
gaggcaccagcccggtgtga

SEQ ID NO: 143423 - DNA, 20 bp, Artificial
  CRISPR gRNA sequence
aggcaccagcccggtgtgag

SEQ ID NO: 143424 - DNA, 20 bp, Artificial
  CRISPR gRNA sequence
ggcaccagcccggtgtgagg

SEQ ID NO: 143425 - DNA, 20 bp, Artificial
  CRISPR gRNA sequence
gcaccagcccggtgtgaggg

SEQ ID NO: 143426 - DNA, 20 bp, Artificial
  CRISPR gRNA sequence
caccagcccggtgtgagggg

SEQ ID NO: 143427 - DNA, 20 bp, Artificial
  CRISPR gRNA sequence
ccggtgtgagggggggtgtg

SEQ ID NO: 143428 - DNA, 20 bp, Artificial
  CRISPR gRNA sequence
gtgtgagggggggtgtgtgg

SEQ ID NO: 143429 - DNA, 20 bp, Artificial
  CRISPR gRNA sequence
tgtgagggggggtgtgtggt

SEQ ID NO: 143430 - DNA, 20 bp, Artificial
  CRISPR gRNA sequence
gagggggggtgtgtggtggg

SEQ ID NO: 143431 - DNA, 20 bp, Artificial
  CRISPR gRNA sequence
agggggggtgtgtggtgggc

SEQ ID NO: 143432 - DNA, 20 bp, Artificial
  CRISPR gRNA sequence
gggggggtgtgtggtgggca

SEQ ID NO: 143433 - DNA, 20 bp, Artificial
  CRISPR gRNA sequence
ggggtgtgtggtgggcaggg

SEQ ID NO: 143434 - DNA, 20 bp, Artificial
  CRISPR gRNA sequence
ggtgtgtggtgggcagggaa

SEQ ID NO: 143435 - DNA, 20 bp, Artificial
  CRISPR gRNA sequence
gtgtgtggtgggcagggaag

SEQ ID NO: 143436 - DNA, 20 bp, Artificial
  CRISPR gRNA sequence
tggtgggcagggaagaggtg

SEQ ID NO: 143437 - DNA, 20 bp, Artificial
  CRISPR gRNA sequence
ggtgggcagggaagaggtgc

SEQ ID NO: 143438 - DNA, 20 bp, Artificial
  CRISPR gRNA sequence
gtgggcagggaagaggtgca

SEQ ID NO: 143439 - DNA, 20 bp, Artificial
  CRISPR gRNA sequence
gggcagggaagaggtgcagg

SEQ ID NO: 143440 - DNA, 20 bp, Artificial
  CRISPR gRNA sequence
gcagggagttgaatttcctg

SEQ ID NO: 143441 - DNA, 20 bp, Artificial
  CRISPR gRNA sequence
tcctgtggctttcacttctc

SEQ ID NO: 143442 - DNA, 20 bp, Artificial
  CRISPR gRNA sequence
cctgtggctttcacttctct

SEQ ID NO: 143443 - DNA, 20 bp, Artificial
  CRISPR gRNA sequence
ctgggctctgcctctcccgt

SEQ ID NO: 143444 - DNA, 20 bp, Artificial
  CRISPR gRNA sequence
ctctgcctctcccgttagct

SEQ ID NO: 143445 - DNA, 20 bp, Artificial
  CRISPR gRNA sequence
ctgcctctcccgttagctca

SEQ ID NO: 143446 - DNA, 20 bp, Artificial
  CRISPR gRNA sequence
tcccgttagctcagagactc

SEQ ID NO: 143447 - DNA, 20 bp, Artificial
  CRISPR gRNA sequence
tgctgcacgctgttcctctg

SEQ ID NO: 143448 - DNA, 20 bp, Artificial
  CRISPR gRNA sequence
tgttcctctgtggcaaacac

SEQ ID NO: 143449 - DNA, 20 bp, Artificial
  CRISPR gRNA sequence
agcaattcgaaccactgtac

SEQ ID NO: 143450 - DNA, 20 bp, Artificial
  CRISPR gRNA sequence
aattcgaaccactgtaccag

SEQ ID NO: 143451 - DNA, 20 bp, Artificial
  CRISPR gRNA sequence
gaaccactgtaccagcagct

SEQ ID NO: 143452 - DNA, 20 bp, Artificial
  CRISPR gRNA sequence
ccactgtaccagcagcttgg

SEQ ID NO: 143453 - DNA, 20 bp, Artificial
  CRISPR gRNA sequence
tgtaccagcagcttggaagt

SEQ ID NO: 143454 - DNA, 20 bp, Artificial
  CRISPR gRNA sequence
gtcagcatttccccaactct

SEQ ID NO: 143455 - DNA, 20 bp, Artificial
  CRISPR gRNA sequence
caactcttggtaatctacac

SEQ ID NO: 143456 - DNA, 20 bp, Artificial
  CRISPR gRNA sequence
ctcttggtaatctacactgg

SEQ ID NO: 143457 - DNA, 20 bp, Artificial
  CRISPR gRNA sequence
tcttggtaatctacactggc

SEQ ID NO: 143458 - DNA, 20 bp, Artificial
  CRISPR gRNA sequence
cttggtaatctacactggca

SEQ ID NO: 143459 - DNA, 20 bp, Artificial
  CRISPR gRNA sequence
ttggtaatctacactggcag

SEQ ID NO: 143460 - DNA, 20 bp, Artificial
  CRISPR gRNA sequence
gtaatctacactggcagggg

SEQ ID NO: 143461 - DNA, 20 bp, Artificial
  CRISPR gRNA sequence
atctacactggcaggggcag

SEQ ID NO: 143462 - DNA, 20 bp, Artificial
  CRISPR gRNA sequence
tctacactggcaggggcagt

SEQ ID NO: 143463 - DNA, 20 bp, Artificial
  CRISPR gRNA sequence
ccctcctctccttcttttct

SEQ ID NO: 143464 - DNA, 20 bp, Artificial
  CRISPR gRNA sequence
ccttcttttctcagaatatc

SEQ ID NO: 143465 - DNA, 20 bp, Artificial
  CRISPR gRNA sequence
ttttctcagaatatctggct

SEQ ID NO: 143466 - DNA, 20 bp, Artificial
  CRISPR gRNA sequence
tttctcagaatatctggctc

SEQ ID NO: 143467 - DNA, 20 bp, Artificial
  CRISPR gRNA sequence
ctgaatttgaattttctcca

SEQ ID NO: 143468 - DNA, 20 bp, Artificial
  CRISPR gRNA sequence
ttttctccatggaccctgct

SEQ ID NO: 143469 - DNA, 20 bp, Artificial
  CRISPR gRNA sequence
tttctccatggaccctgcta

SEQ ID NO: 143470 - DNA, 20 bp, Artificial
  CRISPR gRNA sequence
tctccatggaccctgctaag

SEQ ID NO: 143471 - DNA, 20 bp, Artificial
  CRISPR gRNA sequence
ctccatggaccctgctaagg

SEQ ID NO: 143472 - DNA, 20 bp, Artificial
  CRISPR gRNA sequence
catggaccctgctaaggagg

SEQ ID NO: 143473 - DNA, 20 bp, Artificial
  CRISPR gRNA sequence
accctgctaaggaggtggcc

SEQ ID NO: 143474 - DNA, 20 bp, Artificial
  CRISPR gRNA sequence
tggtattaaacacttaacta

SEQ ID NO: 143475 - DNA, 20 bp, Artificial
  CRISPR gRNA sequence
ttaaacacttaactatagcc

SEQ ID NO: 143476 - DNA, 20 bp, Artificial
  CRISPR gRNA sequence
taactatagccaagacgctc

SEQ ID NO: 143477 - DNA, 20 bp, Artificial
  CRISPR gRNA sequence
aactatagccaagacgctcc

SEQ ID NO: 143478 - DNA, 20 bp, Artificial
  CRISPR gRNA sequence
actatagccaagacgctcca

SEQ ID NO: 143479 - DNA, 20 bp, Artificial
  CRISPR gRNA sequence
ctatagccaagacgctccag

SEQ ID NO: 143480 - DNA, 20 bp, Artificial
  CRISPR gRNA sequence
tagccaagacgctccagggg

SEQ ID NO: 143481 - DNA, 20 bp, Artificial
  CRISPR gRNA sequence
gccaagacgctccaggggtg

SEQ ID NO: 143482 - DNA, 20 bp, Artificial
  CRISPR gRNA sequence
aagacgctccaggggtggag

SEQ ID NO: 143483 - DNA, 20 bp, Artificial
  CRISPR gRNA sequence
gggtggagaagatactcaca

SEQ ID NO: 143484 - DNA, 20 bp, Artificial
  CRISPR gRNA sequence
aagatactcacacagccact

SEQ ID NO: 143485 - DNA, 20 bp, Artificial
  CRISPR gRNA sequence
agatactcacacagccactt

SEQ ID NO: 143486 - DNA, 20 bp, Artificial
  CRISPR gRNA sequence
tactcacacagccacttagg

SEQ ID NO: 143487 - DNA, 20 bp, Artificial
  CRISPR gRNA sequence
actcacacagccacttagga

SEQ ID NO: 143488 - DNA, 20 bp, Artificial
  CRISPR gRNA sequence
acacagccacttaggaaggt

SEQ ID NO: 143489 - DNA, 20 bp, Artificial
  CRISPR gRNA sequence
cacagccacttaggaaggtc

SEQ ID NO: 143490 - DNA, 20 bp, Artificial
  CRISPR gRNA sequence
acagccacttaggaaggtca

SEQ ID NO: 143491 - DNA, 20 bp, Artificial
  CRISPR gRNA sequence
gtcagggctaattgactact

SEQ ID NO: 143492 - DNA, 20 bp, Artificial
  CRISPR gRNA sequence
taattgactacttggtttcc

SEQ ID NO: 143493 - DNA, 20 bp, Artificial
  CRISPR gRNA sequence
aattgactacttggtttccc

SEQ ID NO: 143494 - DNA, 20 bp, Artificial
  CRISPR gRNA sequence
ggtttcccaggcgctcccca

SEQ ID NO: 143495 - DNA, 20 bp, Artificial
  CRISPR gRNA sequence
ttcccaggcgctccccaaag

SEQ ID NO: 143496 - DNA, 20 bp, Artificial
  CRISPR gRNA sequence
gcgctccccaaagaagccaa

SEQ ID NO: 143497 - DNA, 20 bp, Artificial
  CRISPR gRNA sequence
ccccaaagaagccaaaagcc

SEQ ID NO: 143498 - DNA, 20 bp, Artificial
  CRISPR gRNA sequence
agccaaaagccaagccctca

SEQ ID NO: 143499 - DNA, 20 bp, Artificial
  CRISPR gRNA sequence
gccaaaagccaagccctcat

SEQ ID NO: 143500 - DNA, 20 bp, Artificial
  CRISPR gRNA sequence
caaaagccaagccctcatgg

SEQ ID NO: 143501 - DNA, 20 bp, Artificial
  CRISPR gRNA sequence
ccaagccctcatgggagccc

SEQ ID NO: 143502 - DNA, 20 bp, Artificial
  CRISPR gRNA sequence
tcatgggagccctggcatgt

SEQ ID NO: 143503 - DNA, 20 bp, Artificial
  CRISPR gRNA sequence
ggagccctggcatgtaagcc

SEQ ID NO: 143504 - DNA, 20 bp, Artificial
  CRISPR gRNA sequence
tggcatgtaagcctagcatg

SEQ ID NO: 143505 - DNA, 20 bp, Artificial
  CRISPR gRNA sequence
gtaagcctagcatgtggtgc

SEQ ID NO: 143506 - DNA, 20 bp, Artificial
  CRISPR gRNA sequence
agcctagcatgtggtgctgg

SEQ ID NO: 143507 - DNA, 20 bp, Artificial
  CRISPR gRNA sequence
ctagcatgtggtgctggcag

SEQ ID NO: 143508 - DNA, 20 bp, Artificial
  CRISPR gRNA sequence
catgtggtgctggcagaagc

SEQ ID NO: 143509 - DNA, 20 bp, Artificial
  CRISPR gRNA sequence
tgtggtgctggcagaagcca

SEQ ID NO: 143510 - DNA, 20 bp, Artificial
  CRISPR gRNA sequence
gtggtgctggcagaagccag

SEQ ID NO: 143511 - DNA, 20 bp, Artificial
  CRISPR gRNA sequence
gtgctggcagaagccagagg

SEQ ID NO: 143512 - DNA, 20 bp, Artificial
  CRISPR gRNA sequence
tgctggcagaagccagaggt

SEQ ID NO: 143513 - DNA, 20 bp, Artificial
  CRISPR gRNA sequence
ccagaggtgggtcctgatgc

SEQ ID NO: 143514 - DNA, 20 bp, Artificial
  CRISPR gRNA sequence
tgccagctcttctccctttt

SEQ ID NO: 143515 - DNA, 20 bp, Artificial
  CRISPR gRNA sequence
cagctcttctcccttttgag

SEQ ID NO: 143516 - DNA, 20 bp, Artificial
  CRISPR gRNA sequence
ctcttctcccttttgagcag

SEQ ID NO: 143517 - DNA, 20 bp, Artificial
  CRISPR gRNA sequence
cttctcccttttgagcagca

SEQ ID NO: 143518 - DNA, 20 bp, Artificial
  CRISPR gRNA sequence
ttctcccttttgagcagcag

SEQ ID NO: 143519 - DNA, 20 bp, Artificial
  CRISPR gRNA sequence
tctcccttttgagcagcaga

SEQ ID NO: 143520 - DNA, 20 bp, Artificial
  CRISPR gRNA sequence
ttttgagcagcagagggcac

SEQ ID NO: 143521 - DNA, 20 bp, Artificial
  CRISPR gRNA sequence
agcagcagagggcacaagtt

SEQ ID NO: 143522 - DNA, 20 bp, Artificial
  CRISPR gRNA sequence
gcagcagagggcacaagttt

SEQ ID NO: 143523 - DNA, 20 bp, Artificial
  CRISPR gRNA sequence
atgtcatcctatcatgtcct

SEQ ID NO: 143524 - DNA, 20 bp, Artificial
  CRISPR gRNA sequence
tcatcctatcatgtcctcag

SEQ ID NO: 143525 - DNA, 20 bp, Artificial
  CRISPR gRNA sequence
atcatgtcctcagtggtctc

SEQ ID NO: 143526 - DNA, 20 bp, Artificial
  CRISPR gRNA sequence
tcatgtcctcagtggtctct

SEQ ID NO: 143527 - DNA, 20 bp, Artificial
  CRISPR gRNA sequence
ggtctctgggactgtactgt

SEQ ID NO: 143528 - DNA, 20 bp, Artificial
  CRISPR gRNA sequence
gtctctgggactgtactgtg

SEQ ID NO: 143529 - DNA, 20 bp, Artificial
  CRISPR gRNA sequence
tctctgggactgtactgtga

SEQ ID NO: 143530 - DNA, 20 bp, Artificial
  CRISPR gRNA sequence
ctctgggactgtactgtgag

SEQ ID NO: 143531 - DNA, 20 bp, Artificial
  CRISPR gRNA sequence
gggactgtactgtgagggga

SEQ ID NO: 143532 - DNA, 20 bp, Artificial
  CRISPR gRNA sequence
actgtactgtgaggggaaag

SEQ ID NO: 143533 - DNA, 20 bp, Artificial
  CRISPR gRNA sequence
tgtactgtgaggggaaagca

SEQ ID NO: 143534 - DNA, 20 bp, Artificial
  CRISPR gRNA sequence
gtactgtgaggggaaagcag

SEQ ID NO: 143535 - DNA, 20 bp, Artificial
  CRISPR gRNA sequence
tactgtgaggggaaagcaga

SEQ ID NO: 143536 - DNA, 20 bp, Artificial
  CRISPR gRNA sequence
tgaggggaaagcagagggaa

SEQ ID NO: 143537 - DNA, 20 bp, Artificial
  CRISPR gRNA sequence
gaggggaaagcagagggaaa

SEQ ID NO: 143538 - DNA, 20 bp, Artificial
  CRISPR gRNA sequence
aggggaaagcagagggaaaa

SEQ ID NO: 143539 - DNA, 20 bp, Artificial
  CRISPR gRNA sequence
ggaaagcagagggaaaaggg

SEQ ID NO: 143540 - DNA, 20 bp, Artificial
  CRISPR gRNA sequence
gggaagattctctcctcgca

SEQ ID NO: 143541 - DNA, 20 bp, Artificial
  CRISPR gRNA sequence
gactgaaaatgactgaattt

SEQ ID NO: 143542 - DNA, 20 bp, Artificial
  CRISPR gRNA sequence
actgaaaatgactgaatttc

SEQ ID NO: 143543 - DNA, 20 bp, Artificial
  CRISPR gRNA sequence
atgactgaatttcaggcacc

SEQ ID NO: 143544 - DNA, 20 bp, Artificial
  CRISPR gRNA sequence
gactgaatttcaggcaccca

SEQ ID NO: 143545 - DNA, 20 bp, Artificial
  CRISPR gRNA sequence
ctgaatttcaggcacccaga

SEQ ID NO: 143546 - DNA, 20 bp, Artificial
  CRISPR gRNA sequence
ttcaggcacccagagagctc

SEQ ID NO: 143547 - DNA, 20 bp, Artificial
  CRISPR gRNA sequence
caggcacccagagagctcaa

SEQ ID NO: 143548 - DNA, 20 bp, Artificial
  CRISPR gRNA sequence
aggcacccagagagctcaag

SEQ ID NO: 143549 - DNA, 20 bp, Artificial
  CRISPR gRNA sequence
acgtgttctctgcgtctcaa

SEQ ID NO: 143550 - DNA, 20 bp, Artificial
  CRISPR gRNA sequence
aacagtccatgctattaaaa

SEQ ID NO: 143551 - DNA, 20 bp, Artificial
  CRISPR gRNA sequence
atgctattaaaacagcatca

SEQ ID NO: 143552 - DNA, 20 bp, Artificial
  CRISPR gRNA sequence
attaaaacagcatcatggct

SEQ ID NO: 143553 - DNA, 20 bp, Artificial
  CRISPR gRNA sequence
taaaacagcatcatggctta

SEQ ID NO: 143554 - DNA, 20 bp, Artificial
  CRISPR gRNA sequence
aaaacagcatcatggcttag

SEQ ID NO: 143555 - DNA, 20 bp, Artificial
  CRISPR gRNA sequence
aaacagcatcatggcttaga

SEQ ID NO: 143556 - DNA, 20 bp, Artificial
  CRISPR gRNA sequence
aacagcatcatggcttagag

SEQ ID NO: 143557 - DNA, 20 bp, Artificial
  CRISPR gRNA sequence
gcttagaggggaaaaaaata

SEQ ID NO: 143558 - DNA, 20 bp, Artificial
  CRISPR gRNA sequence
aggggaaaaaaatacagttc

SEQ ID NO: 143559 - DNA, 20 bp, Artificial
  CRISPR gRNA sequence
gggaaaaaaatacagttcta

SEQ ID NO: 143560 - DNA, 20 bp, Artificial
  CRISPR gRNA sequence
gaaaaaaatacagttctaga

SEQ ID NO: 143561 - DNA, 20 bp, Artificial
  CRISPR gRNA sequence
aaaaaaatacagttctagag

SEQ ID NO: 143562 - DNA, 20 bp, Artificial
  CRISPR gRNA sequence
aaaaaatacagttctagaga

SEQ ID NO: 143563 - DNA, 20 bp, Artificial
  CRISPR gRNA sequence
tacagttctagagagggaaa

SEQ ID NO: 143564 - DNA, 20 bp, Artificial
  CRISPR gRNA sequence
acagttctagagagggaaac

SEQ ID NO: 143565 - DNA, 20 bp, Artificial
  CRISPR gRNA sequence
gaaacaggaaacctgctctc

SEQ ID NO: 143566 - DNA, 20 bp, Artificial
  CRISPR gRNA sequence
ggaaacctgctctctagtcc

SEQ ID NO: 143567 - DNA, 20 bp, Artificial
  CRISPR gRNA sequence
ctggctctgcaatgaacatc

SEQ ID NO: 143568 - DNA, 20 bp, Artificial
  CRISPR gRNA sequence
tggctctgcaatgaacatct

SEQ ID NO: 143569 - DNA, 20 bp, Artificial
  CRISPR gRNA sequence
ggctctgcaatgaacatcta

SEQ ID NO: 143570 - DNA, 20 bp, Artificial
  CRISPR gRNA sequence
gctctgcaatgaacatctag

SEQ ID NO: 143571 - DNA, 20 bp, Artificial
  CRISPR gRNA sequence
tctgcaatgaacatctaggg

SEQ ID NO: 143572 - DNA, 20 bp, Artificial
  CRISPR gRNA sequence
aatgaacatctaggggagca

SEQ ID NO: 143573 - DNA, 20 bp, Artificial
  CRISPR gRNA sequence
acatctaggggagcatggac

SEQ ID NO: 143574 - DNA, 20 bp, Artificial
  CRISPR gRNA sequence
catctaggggagcatggaca

SEQ ID NO: 143575 - DNA, 20 bp, Artificial
  CRISPR gRNA sequence
gacaaggcacttcccatctc

SEQ ID NO: 143576 - DNA, 20 bp, Artificial
  CRISPR gRNA sequence
acaaggcacttcccatctcc

SEQ ID NO: 143577 - DNA, 20 bp, Artificial
  CRISPR gRNA sequence
caaggcacttcccatctcca

SEQ ID NO: 143578 - DNA, 20 bp, Artificial
  CRISPR gRNA sequence
cacttcccatctccagggtt

SEQ ID NO: 143579 - DNA, 20 bp, Artificial
  CRISPR gRNA sequence
cagtttactcatctgtaaaa

SEQ ID NO: 143580 - DNA, 20 bp, Artificial
  CRISPR gRNA sequence
tcatctgtaaaatggcaatt

SEQ ID NO: 143581 - DNA, 20 bp, Artificial
  CRISPR gRNA sequence
catctgtaaaatggcaattt

SEQ ID NO: 143582 - DNA, 20 bp, Artificial
  CRISPR gRNA sequence
gcaatttgggctacatgtct

SEQ ID NO: 143583 - DNA, 20 bp, Artificial
  CRISPR gRNA sequence
ctacatgtctaagattattt

SEQ ID NO: 143584 - DNA, 20 bp, Artificial
  CRISPR gRNA sequence
agattattttagttcccact

SEQ ID NO: 143585 - DNA, 20 bp, Artificial
  CRISPR gRNA sequence
ccactaagtctataaaacta

SEQ ID NO: 143586 - DNA, 20 bp, Artificial
  CRISPR gRNA sequence
cactaagtctataaaactaa

SEQ ID NO: 143587 - DNA, 20 bp, Artificial
  CRISPR gRNA sequence
aagtctataaaactaaagga

SEQ ID NO: 143588 - DNA, 20 bp, Artificial
  CRISPR gRNA sequence
agtctataaaactaaaggat

SEQ ID NO: 143589 - DNA, 20 bp, Artificial
  CRISPR gRNA sequence
aatttctgtccactcactgt

SEQ ID NO: 143590 - DNA, 20 bp, Artificial
  CRISPR gRNA sequence
ttctgtccactcactgttag

SEQ ID NO: 143591 - DNA, 20 bp, Artificial
  CRISPR gRNA sequence
ctgtccactcactgttagta

SEQ ID NO: 143592 - DNA, 20 bp, Artificial
  CRISPR gRNA sequence
tgtccactcactgttagtag

SEQ ID NO: 143593 - DNA, 20 bp, Artificial
  CRISPR gRNA sequence
cactcactgttagtagagga

SEQ ID NO: 143594 - DNA, 20 bp, Artificial
  CRISPR gRNA sequence
actcactgttagtagaggac

SEQ ID NO: 143595 - DNA, 20 bp, Artificial
  CRISPR gRNA sequence
actgttagtagaggacagga

SEQ ID NO: 143596 - DNA, 20 bp, Artificial
  CRISPR gRNA sequence
ttgccctaaccatccaaacc

SEQ ID NO: 143597 - DNA, 20 bp, Artificial
  CRISPR gRNA sequence
gcaaatcctcaccctctgcc

SEQ ID NO: 143598 - DNA, 20 bp, Artificial
  CRISPR gRNA sequence
tcctcaccctctgcccagcc

SEQ ID NO: 143599 - DNA, 20 bp, Artificial
  CRISPR gRNA sequence
cctcaccctctgcccagccc

SEQ ID NO: 143600 - DNA, 20 bp, Artificial
  CRISPR gRNA sequence
accctctgcccagcccaggt

SEQ ID NO: 143601 - DNA, 20 bp, Artificial
  CRISPR gRNA sequence
ccctctgcccagcccaggtt

SEQ ID NO: 143602 - DNA, 20 bp, Artificial
  CRISPR gRNA sequence
ctacctgtccatctgtgaac

SEQ ID NO: 143603 - DNA, 20 bp, Artificial
  CRISPR gRNA sequence
tgaactgctgctgtccttgc

SEQ ID NO: 143604 - DNA, 20 bp, Artificial
  CRISPR gRNA sequence
cctctgtctgtgtaatctgt

SEQ ID NO: 143605 - DNA, 20 bp, Artificial
  CRISPR gRNA sequence
ctgtgtaatctgtaagaatc

SEQ ID NO: 143606 - DNA, 20 bp, Artificial
  CRISPR gRNA sequence
gtaatctgtaagaatcaaga

SEQ ID NO: 143607 - DNA, 20 bp, Artificial
  CRISPR gRNA sequence
atctgtaagaatcaagatgg

SEQ ID NO: 143608 - DNA, 20 bp, Artificial
  CRISPR gRNA sequence
ctgtaagaatcaagatggta

SEQ ID NO: 143609 - DNA, 20 bp, Artificial
  CRISPR gRNA sequence
aagaatcaagatggtagagt

SEQ ID NO: 143610 - DNA, 20 bp, Artificial
  CRISPR gRNA sequence
agatggtagagttggtatgt

SEQ ID NO: 143611 - DNA, 20 bp, Artificial
  CRISPR gRNA sequence
tagagttggtatgtcagctg

SEQ ID NO: 143612 - DNA, 20 bp, Artificial
  CRISPR gRNA sequence
agagttggtatgtcagctgc

SEQ ID NO: 143613 - DNA, 20 bp, Artificial
  CRISPR gRNA sequence
gagttggtatgtcagctgca

SEQ ID NO: 143614 - DNA, 20 bp, Artificial
  CRISPR gRNA sequence
agctgcagggtctgatccac

SEQ ID NO: 143615 - DNA, 20 bp, Artificial
  CRISPR gRNA sequence
tccaccagcccaccacccaa

SEQ ID NO: 143616 - DNA, 20 bp, Artificial
  CRISPR gRNA sequence
caccagcccaccacccaaaa

SEQ ID NO: 143617 - DNA, 20 bp, Artificial
  CRISPR gRNA sequence
accagcccaccacccaaaag

SEQ ID NO: 143618 - DNA, 20 bp, Artificial
  CRISPR gRNA sequence
ccagcccaccacccaaaaga

SEQ ID NO: 143619 - DNA, 20 bp, Artificial
  CRISPR gRNA sequence
ccacccaaaagagggtcata

SEQ ID NO: 143620 - DNA, 20 bp, Artificial
  CRISPR gRNA sequence
gagggtcataaagatcaaat

SEQ ID NO: 143621 - DNA, 20 bp, Artificial
  CRISPR gRNA sequence
caaatgagacaatgcatata

SEQ ID NO: 143622 - DNA, 20 bp, Artificial
  CRISPR gRNA sequence
gacaatgcatataaagtgcc

SEQ ID NO: 143623 - DNA, 20 bp, Artificial
  CRISPR gRNA sequence
aatgcatataaagtgcccag

SEQ ID NO: 143624 - DNA, 20 bp, Artificial
  CRISPR gRNA sequence
atgcatataaagtgcccagc

SEQ ID NO: 143625 - DNA, 20 bp, Artificial
  CRISPR gRNA sequence
agtgcccagcaggtgctcaa

SEQ ID NO: 143626 - DNA, 20 bp, Artificial
  CRISPR gRNA sequence
gtgcccagcaggtgctcaat

SEQ ID NO: 143627 - DNA, 20 bp, Artificial
  CRISPR gRNA sequence
cccagcaggtgctcaatggg

SEQ ID NO: 143628 - DNA, 20 bp, Artificial
  CRISPR gRNA sequence
gcaggtgctcaatgggtagt

SEQ ID NO: 143629 - DNA, 20 bp, Artificial
  CRISPR gRNA sequence
gtgctcaatgggtagtaagc

SEQ ID NO: 143630 - DNA, 20 bp, Artificial
  CRISPR gRNA sequence
tcaatgggtagtaagcaagc

SEQ ID NO: 143631 - DNA, 20 bp, Artificial
  CRISPR gRNA sequence
agcaagcacccctcctaatc

SEQ ID NO: 143632 - DNA, 20 bp, Artificial
  CRISPR gRNA sequence
ccctcctaatctagcactga

SEQ ID NO: 143633 - DNA, 20 bp, Artificial
  CRISPR gRNA sequence
ctagcactgatggctacgtc

SEQ ID NO: 143634 - DNA, 20 bp, Artificial
  CRISPR gRNA sequence
agcactgatggctacgtcaa

SEQ ID NO: 143635 - DNA, 20 bp, Artificial
  CRISPR gRNA sequence
ctgatggctacgtcaagagt

SEQ ID NO: 143636 - DNA, 20 bp, Artificial
  CRISPR gRNA sequence
atggctacgtcaagagttgg

SEQ ID NO: 143637 - DNA, 20 bp, Artificial
  CRISPR gRNA sequence
cgtcaagagttggcagcaca

SEQ ID NO: 143638 - DNA, 20 bp, Artificial
  CRISPR gRNA sequence
tggcagcacaaagtgacatc

SEQ ID NO: 143639 - DNA, 20 bp, Artificial
  CRISPR gRNA sequence
caaagtgacatcgagaatcc

SEQ ID NO: 143640 - DNA, 20 bp, Artificial
  CRISPR gRNA sequence
aagtgacatcgagaatcctg

SEQ ID NO: 143641 - DNA, 20 bp, Artificial
  CRISPR gRNA sequence
gagaatcctggagcacataa

SEQ ID NO: 143642 - DNA, 20 bp, Artificial
  CRISPR gRNA sequence
atcctggagcacataataga

SEQ ID NO: 143643 - DNA, 20 bp, Artificial
  CRISPR gRNA sequence
acccactcatctcaaactct

SEQ ID NO: 143644 - DNA, 20 bp, Artificial
  CRISPR gRNA sequence
cccactcatctcaaactctg

SEQ ID NO: 143645 - DNA, 20 bp, Artificial
  CRISPR gRNA sequence
ctcaaactctgaggctcaaa

SEQ ID NO: 143646 - DNA, 20 bp, Artificial
  CRISPR gRNA sequence
tgaggctcaaacagaacaca

SEQ ID NO: 143647 - DNA, 20 bp, Artificial
  CRISPR gRNA sequence
caaacagaacacatggaccc

SEQ ID NO: 143648 - DNA, 20 bp, Artificial
  CRISPR gRNA sequence
aaacagaacacatggaccct

SEQ ID NO: 143649 - DNA, 20 bp, Artificial
  CRISPR gRNA sequence
cacatggaccctaggtgcta

SEQ ID NO: 143650 - DNA, 20 bp, Artificial
  CRISPR gRNA sequence
ggaccctaggtgctatggtt

SEQ ID NO: 143651 - DNA, 20 bp, Artificial
  CRISPR gRNA sequence
gaccctaggtgctatggttt

SEQ ID NO: 143652 - DNA, 20 bp, Artificial
  CRISPR gRNA sequence
accctaggtgctatggtttg

SEQ ID NO: 143653 - DNA, 20 bp, Artificial
  CRISPR gRNA sequence
ctaggtgctatggtttgggg

SEQ ID NO: 143654 - DNA, 20 bp, Artificial
  CRISPR gRNA sequence
ggtgctatggtttggggtag

SEQ ID NO: 143655 - DNA, 20 bp, Artificial
  CRISPR gRNA sequence
tggtttggggtagaagtcct

SEQ ID NO: 143656 - DNA, 20 bp, Artificial
  CRISPR gRNA sequence
gtttggggtagaagtcctaa

SEQ ID NO: 143657 - DNA, 20 bp, Artificial
  CRISPR gRNA sequence
ggggtagaagtcctaagagt

SEQ ID NO: 143658 - DNA, 20 bp, Artificial
  CRISPR gRNA sequence
agtcctaagagtcagtcttt

SEQ ID NO: 143659 - DNA, 20 bp, Artificial
  CRISPR gRNA sequence
ctaagagtcagtctttcagc

SEQ ID NO: 143660 - DNA, 20 bp, Artificial
  CRISPR gRNA sequence
agtcagtctttcagccagtg

SEQ ID NO: 143661 - DNA, 20 bp, Artificial
  CRISPR gRNA sequence
gtcagtctttcagccagtga

SEQ ID NO: 143662 - DNA, 20 bp, Artificial
  CRISPR gRNA sequence
agtctttcagccagtgaagg

SEQ ID NO: 143663 - DNA, 20 bp, Artificial
  CRISPR gRNA sequence
gccagtgaaggcggactgca

SEQ ID NO: 143664 - DNA, 20 bp, Artificial
  CRISPR gRNA sequence
gaaggcggactgcaaagtgt

SEQ ID NO: 143665 - DNA, 20 bp, Artificial
  CRISPR gRNA sequence
ggactgcaaagtgtcagaca

SEQ ID NO: 143666 - DNA, 20 bp, Artificial
  CRISPR gRNA sequence
ctgcaaagtgtcagacaaag

SEQ ID NO: 143667 - DNA, 20 bp, Artificial
  CRISPR gRNA sequence
aaagtgtcagacaaagtggt

SEQ ID NO: 143668 - DNA, 20 bp, Artificial
  CRISPR gRNA sequence
gtgtcagacaaagtggtaag

SEQ ID NO: 143669 - DNA, 20 bp, Artificial
  CRISPR gRNA sequence
taagtggcctctttcattct

SEQ ID NO: 143670 - DNA, 20 bp, Artificial
  CRISPR gRNA sequence
gtggcctctttcattcttgg

SEQ ID NO: 143671 - DNA, 20 bp, Artificial
  CRISPR gRNA sequence
tggcctctttcattcttgga

SEQ ID NO: 143672 - DNA, 20 bp, Artificial
  CRISPR gRNA sequence
cctctttcattcttggaagg

SEQ ID NO: 143673 - DNA, 20 bp, Artificial
  CRISPR gRNA sequence
ctctttcattcttggaaggt

SEQ ID NO: 143674 - DNA, 20 bp, Artificial
  CRISPR gRNA sequence
caaaccaaacccgtatcacc

SEQ ID NO: 143675 - DNA, 20 bp, Artificial
  CRISPR gRNA sequence
tatcacccagatcatctgac

SEQ ID NO: 143676 - DNA, 20 bp, Artificial
  CRISPR gRNA sequence
gactggaatatgaaacaccc

SEQ ID NO: 143677 - DNA, 20 bp, Artificial
  CRISPR gRNA sequence
ggaatatgaaacaccctggc

SEQ ID NO: 143678 - DNA, 20 bp, Artificial
  CRISPR gRNA sequence
tatgaaacaccctggcgagc

SEQ ID NO: 143679 - DNA, 20 bp, Artificial
  CRISPR gRNA sequence
gaaacaccctggcgagcaag

SEQ ID NO: 143680 - DNA, 20 bp, Artificial
  CRISPR gRNA sequence
ccctggcgagcaagtggcct

SEQ ID NO: 143681 - DNA, 20 bp, Artificial
  CRISPR gRNA sequence
cgagcaagtggccttggtcc

SEQ ID NO: 143682 - DNA, 20 bp, Artificial
  CRISPR gRNA sequence
gcaagtggccttggtcccag

SEQ ID NO: 143683 - DNA, 20 bp, Artificial
  CRISPR gRNA sequence
cttggtcccagcagtcctca

SEQ ID NO: 143684 - DNA, 20 bp, Artificial
  CRISPR gRNA sequence
gtcctcatggcaaacctatg

SEQ ID NO: 143685 - DNA, 20 bp, Artificial
  CRISPR gRNA sequence
acctatgaagtactttttcc

SEQ ID NO: 143686 - DNA, 20 bp, Artificial
  CRISPR gRNA sequence
ctatgaagtactttttccga

SEQ ID NO: 143687 - DNA, 20 bp, Artificial
  CRISPR gRNA sequence
atgaagtactttttccgaga

SEQ ID NO: 143688 - DNA, 20 bp, Artificial
  CRISPR gRNA sequence
tgaagtactttttccgagag

SEQ ID NO: 143689 - DNA, 20 bp, Artificial
  CRISPR gRNA sequence
tttccgagagaggcactgtg

SEQ ID NO: 143690 - DNA, 20 bp, Artificial
  CRISPR gRNA sequence
agaggcactgtgcagccctc

SEQ ID NO: 143691 - DNA, 20 bp, Artificial
  CRISPR gRNA sequence
gaggcactgtgcagccctct

SEQ ID NO: 143692 - DNA, 20 bp, Artificial
  CRISPR gRNA sequence
ctgtgcagccctctgggcca

SEQ ID NO: 143693 - DNA, 20 bp, Artificial
  CRISPR gRNA sequence
tgtgcagccctctgggccaa

SEQ ID NO: 143694 - DNA, 20 bp, Artificial
  CRISPR gRNA sequence
tgcagccctctgggccaaag

SEQ ID NO: 143695 - DNA, 20 bp, Artificial
  CRISPR gRNA sequence
gcagccctctgggccaaagg

SEQ ID NO: 143696 - DNA, 20 bp, Artificial
  CRISPR gRNA sequence
cagccctctgggccaaagga

SEQ ID NO: 143697 - DNA, 20 bp, Artificial
  CRISPR gRNA sequence
agccctctgggccaaaggag

SEQ ID NO: 143698 - DNA, 20 bp, Artificial
  CRISPR gRNA sequence
ccctctgggccaaaggaggg

SEQ ID NO: 143699 - DNA, 20 bp, Artificial
  CRISPR gRNA sequence
cctctgggccaaaggagggg

SEQ ID NO: 143700 - DNA, 20 bp, Artificial
  CRISPR gRNA sequence
tctgggccaaaggaggggag

SEQ ID NO: 143701 - DNA, 20 bp, Artificial
  CRISPR gRNA sequence
gccaaaggaggggaggagaa

SEQ ID NO: 143702 - DNA, 20 bp, Artificial
  CRISPR gRNA sequence
ccaaaggaggggaggagaaa

SEQ ID NO: 143703 - DNA, 20 bp, Artificial
  CRISPR gRNA sequence
caaaggaggggaggagaaaa

SEQ ID NO: 143704 - DNA, 20 bp, Artificial
  CRISPR gRNA sequence
aaaggaggggaggagaaaag

SEQ ID NO: 143705 - DNA, 20 bp, Artificial
  CRISPR gRNA sequence
aggaggggaggagaaaaggg

SEQ ID NO: 143706 - DNA, 20 bp, Artificial
  CRISPR gRNA sequence
ggaggggaggagaaaagggg

SEQ ID NO: 143707 - DNA, 20 bp, Artificial
  CRISPR gRNA sequence
gaggggaggagaaaagggga

SEQ ID NO: 143708 - DNA, 20 bp, Artificial
  CRISPR gRNA sequence
gaggagaaaaggggagggac

SEQ ID NO: 143709 - DNA, 20 bp, Artificial
  CRISPR gRNA sequence
aggagaaaaggggagggacc

SEQ ID NO: 143710 - DNA, 20 bp, Artificial
  CRISPR gRNA sequence
gagaaaaggggagggaccgg

SEQ ID NO: 143711 - DNA, 20 bp, Artificial
  CRISPR gRNA sequence
aaaaggggagggaccgggag

SEQ ID NO: 143712 - DNA, 20 bp, Artificial
  CRISPR gRNA sequence
gagggaccgggagtggaaca

SEQ ID NO: 143713 - DNA, 20 bp, Artificial
  CRISPR gRNA sequence
acaaagacaacatttatcac

SEQ ID NO: 143714 - DNA, 20 bp, Artificial
  CRISPR gRNA sequence
agtacttaaaatcttatgtg

SEQ ID NO: 143715 - DNA, 20 bp, Artificial
  CRISPR gRNA sequence
tcttatgtgtggactgtgaa

SEQ ID NO: 143716 - DNA, 20 bp, Artificial
  CRISPR gRNA sequence
tgtggactgtgaatggattt

SEQ ID NO: 143717 - DNA, 20 bp, Artificial
  CRISPR gRNA sequence
tagataaatgtactgacatg

SEQ ID NO: 143718 - DNA, 20 bp, Artificial
  CRISPR gRNA sequence
gcatatataatgacaactgc

SEQ ID NO: 143719 - DNA, 20 bp, Artificial
  CRISPR gRNA sequence
catatataatgacaactgct

SEQ ID NO: 143720 - DNA, 20 bp, Artificial
  CRISPR gRNA sequence
tatataatgacaactgctgg

SEQ ID NO: 143721 - DNA, 20 bp, Artificial
  CRISPR gRNA sequence
ataatgacaactgctgggag

SEQ ID NO: 143722 - DNA, 20 bp, Artificial
  CRISPR gRNA sequence
gacaactgctgggagcagct

SEQ ID NO: 143723 - DNA, 20 bp, Artificial
  CRISPR gRNA sequence
ctgggagcagctcggtaaac

SEQ ID NO: 143724 - DNA, 20 bp, Artificial
  CRISPR gRNA sequence
gagcagctcggtaaactaga

SEQ ID NO: 143725 - DNA, 20 bp, Artificial
  CRISPR gRNA sequence
cagctcggtaaactagaaag

SEQ ID NO: 143726 - DNA, 20 bp, Artificial
  CRISPR gRNA sequence
gtaaactagaaagaagactg

SEQ ID NO: 143727 - DNA, 20 bp, Artificial
  CRISPR gRNA sequence
tgcatgcacatgtgttccta

SEQ ID NO: 143728 - DNA, 20 bp, Artificial
  CRISPR gRNA sequence
atgtgttcctatggaacatt

SEQ ID NO: 143729 - DNA, 20 bp, Artificial
  CRISPR gRNA sequence
gttcctatggaacatttggc

SEQ ID NO: 143730 - DNA, 20 bp, Artificial
  CRISPR gRNA sequence
cctatggaacatttggccag

SEQ ID NO: 143731 - DNA, 20 bp, Artificial
  CRISPR gRNA sequence
gtcctctgtgtaccatttcc

SEQ ID NO: 143732 - DNA, 20 bp, Artificial
  CRISPR gRNA sequence
accatttcctggaatcatca

SEQ ID NO: 143733 - DNA, 20 bp, Artificial
  CRISPR gRNA sequence
tttcctggaatcatcacagc

SEQ ID NO: 143734 - DNA, 20 bp, Artificial
  CRISPR gRNA sequence
aatcatcacagccagcctgc

SEQ ID NO: 143735 - DNA, 20 bp, Artificial
  CRISPR gRNA sequence
tcacagccagcctgcaagac

SEQ ID NO: 143736 - DNA, 20 bp, Artificial
  CRISPR gRNA sequence
cacagccagcctgcaagaca

SEQ ID NO: 143737 - DNA, 20 bp, Artificial
  CRISPR gRNA sequence
cctctcaaatgtcctcacca

SEQ ID NO: 143738 - DNA, 20 bp, Artificial
  CRISPR gRNA sequence
atggccaaaaacaacccctg

SEQ ID NO: 143739 - DNA, 20 bp, Artificial
  CRISPR gRNA sequence
tggccaaaaacaacccctgc

SEQ ID NO: 143740 - DNA, 20 bp, Artificial
  CRISPR gRNA sequence
acccctgcaggcctacccat

SEQ ID NO: 143741 - DNA, 20 bp, Artificial
  CRISPR gRNA sequence
cccctgcaggcctacccatg

SEQ ID NO: 143742 - DNA, 20 bp, Artificial
  CRISPR gRNA sequence
aggcctacccatgaggctat

SEQ ID NO: 143743 - DNA, 20 bp, Artificial
  CRISPR gRNA sequence
ggcctacccatgaggctatg

SEQ ID NO: 143744 - DNA, 20 bp, Artificial
  CRISPR gRNA sequence
cccatgaggctatgaggaac

SEQ ID NO: 143745 - DNA, 20 bp, Artificial
  CRISPR gRNA sequence
tgaggctatgaggaacaaga

SEQ ID NO: 143746 - DNA, 20 bp, Artificial
  CRISPR gRNA sequence
gaggctatgaggaacaagaa

SEQ ID NO: 143747 - DNA, 20 bp, Artificial
  CRISPR gRNA sequence
aggctatgaggaacaagaaa

SEQ ID NO: 143748 - DNA, 20 bp, Artificial
  CRISPR gRNA sequence
atgaggaacaagaaagggaa

SEQ ID NO: 143749 - DNA, 20 bp, Artificial
  CRISPR gRNA sequence
tgaggaacaagaaagggaac

SEQ ID NO: 143750 - DNA, 20 bp, Artificial
  CRISPR gRNA sequence
aagaaagggaacaggtatga

SEQ ID NO: 143751 - DNA, 20 bp, Artificial
  CRISPR gRNA sequence
agaaagggaacaggtatgac

SEQ ID NO: 143752 - DNA, 20 bp, Artificial
  CRISPR gRNA sequence
tttactattgttccttattt

SEQ ID NO: 143753 - DNA, 20 bp, Artificial
  CRISPR gRNA sequence
tttggtccttttccttccaa

SEQ ID NO: 143754 - DNA, 20 bp, Artificial
  CRISPR gRNA sequence
ttttccttccaacagcctat

SEQ ID NO: 143755 - DNA, 20 bp, Artificial
  CRISPR gRNA sequence
caacagcctataagatgcct

SEQ ID NO: 143756 - DNA, 20 bp, Artificial
  CRISPR gRNA sequence
aacagcctataagatgcctg

SEQ ID NO: 143757 - DNA, 20 bp, Artificial
  CRISPR gRNA sequence
acagcctataagatgcctga

SEQ ID NO: 143758 - DNA, 20 bp, Artificial
  CRISPR gRNA sequence
gcctataagatgcctgaggg

SEQ ID NO: 143759 - DNA, 20 bp, Artificial
  CRISPR gRNA sequence
cctataagatgcctgagggc

SEQ ID NO: 143760 - DNA, 20 bp, Artificial
  CRISPR gRNA sequence
tataagatgcctgagggcag

SEQ ID NO: 143761 - DNA, 20 bp, Artificial
  CRISPR gRNA sequence
tgagggcaggagcccataca

SEQ ID NO: 143762 - DNA, 20 bp, Artificial
  CRISPR gRNA sequence
ggcaggagcccatacaaagt

SEQ ID NO: 143763 - DNA, 20 bp, Artificial
  CRISPR gRNA sequence
cccatacaaagttagtattc

SEQ ID NO: 143764 - DNA, 20 bp, Artificial
  CRISPR gRNA sequence
ttagtattccagaaatgttg

SEQ ID NO: 143765 - DNA, 20 bp, Artificial
  CRISPR gRNA sequence
agaaatgttgcagaataaac

SEQ ID NO: 143766 - DNA, 20 bp, Artificial
  CRISPR gRNA sequence
atgttgcagaataaacaagt

SEQ ID NO: 143767 - DNA, 20 bp, Artificial
  CRISPR gRNA sequence
cagaataaacaagtgagcct

SEQ ID NO: 143768 - DNA, 20 bp, Artificial
  CRISPR gRNA sequence
acaagtgagcctgagacaaa

SEQ ID NO: 143769 - DNA, 20 bp, Artificial
  CRISPR gRNA sequence
caaatggaaaatattccaca

SEQ ID NO: 143770 - DNA, 20 bp, Artificial
  CRISPR gRNA sequence
ggaaaatattccacatagat

SEQ ID NO: 143771 - DNA, 20 bp, Artificial
  CRISPR gRNA sequence
aaatattccacatagataag

SEQ ID NO: 143772 - DNA, 20 bp, Artificial
  CRISPR gRNA sequence
aatattccacatagataaga

SEQ ID NO: 143773 - DNA, 20 bp, Artificial
  CRISPR gRNA sequence
taagaaggttaactgctctg

SEQ ID NO: 143774 - DNA, 20 bp, Artificial
  CRISPR gRNA sequence
aaggttaactgctctgtggc

SEQ ID NO: 143775 - DNA, 20 bp, Artificial
  CRISPR gRNA sequence
gttaactgctctgtggccag

SEQ ID NO: 143776 - DNA, 20 bp, Artificial
  CRISPR gRNA sequence
ttaactgctctgtggccagc

SEQ ID NO: 143777 - DNA, 20 bp, Artificial
  CRISPR gRNA sequence
agcaggattgccattcatat

SEQ ID NO: 143778 - DNA, 20 bp, Artificial
  CRISPR gRNA sequence
gattgccattcatattagct

SEQ ID NO: 143779 - DNA, 20 bp, Artificial
  CRISPR gRNA sequence
ttatttacatattattcatt

SEQ ID NO: 143780 - DNA, 20 bp, Artificial
  CRISPR gRNA sequence
tcattcaacaaacatttact

SEQ ID NO: 143781 - DNA, 20 bp, Artificial
  CRISPR gRNA sequence
acatttactgagcacctact

SEQ ID NO: 143782 - DNA, 20 bp, Artificial
  CRISPR gRNA sequence
actgagcacctactaagtat

SEQ ID NO: 143783 - DNA, 20 bp, Artificial
  CRISPR gRNA sequence
ctgagcacctactaagtatt

SEQ ID NO: 143784 - DNA, 20 bp, Artificial
  CRISPR gRNA sequence
aattacaacctgttgttaca

SEQ ID NO: 143785 - DNA, 20 bp, Artificial
  CRISPR gRNA sequence
acaaagattttcattgcctt

SEQ ID NO: 143786 - DNA, 20 bp, Artificial
  CRISPR gRNA sequence
accactttcttgcttctccc

SEQ ID NO: 143787 - DNA, 20 bp, Artificial
  CRISPR gRNA sequence
ccccagcctctcccattttt

SEQ ID NO: 143788 - DNA, 20 bp, Artificial
  CRISPR gRNA sequence
cctctcccattttttggctt

SEQ ID NO: 143789 - DNA, 20 bp, Artificial
  CRISPR gRNA sequence
ctttagttctgttcccaaaa

SEQ ID NO: 143790 - DNA, 20 bp, Artificial
  CRISPR gRNA sequence
ttttttaatttttatttttt

SEQ ID NO: 143791 - DNA, 20 bp, Artificial
  CRISPR gRNA sequence
ttaatttttattttttgaga

SEQ ID NO: 143792 - DNA, 20 bp, Artificial
  CRISPR gRNA sequence
aatttttattttttgagaca

SEQ ID NO: 143793 - DNA, 20 bp, Artificial
  CRISPR gRNA sequence
cagagtctcactctgtcgcc

SEQ ID NO: 143794 - DNA, 20 bp, Artificial
  CRISPR gRNA sequence
agagtctcactctgtcgccc

SEQ ID NO: 143795 - DNA, 20 bp, Artificial
  CRISPR gRNA sequence
tctcactctgtcgcccaggc

SEQ ID NO: 143796 - DNA, 20 bp, Artificial
  CRISPR gRNA sequence
tcactctgtcgcccaggctg

SEQ ID NO: 143797 - DNA, 20 bp, Artificial
  CRISPR gRNA sequence
ctgtcgcccaggctggagtg

SEQ ID NO: 143798 - DNA, 20 bp, Artificial
  CRISPR gRNA sequence
tcgcccaggctggagtgcag

SEQ ID NO: 143799 - DNA, 20 bp, Artificial
  CRISPR gRNA sequence
ggagtgcagtggcacaatct

SEQ ID NO: 143800 - DNA, 20 bp, Artificial
  CRISPR gRNA sequence
tcactgcaacctccacctcc

SEQ ID NO: 143801 - DNA, 20 bp, Artificial
  CRISPR gRNA sequence
cactgcaacctccacctcct

SEQ ID NO: 143802 - DNA, 20 bp, Artificial
  CRISPR gRNA sequence
aacctccacctcctgggttc

SEQ ID NO: 143803 - DNA, 20 bp, Artificial
  CRISPR gRNA sequence
ttcaagtgattcttgtgtct

SEQ ID NO: 143804 - DNA, 20 bp, Artificial
  CRISPR gRNA sequence
ttcttgtgtctcagcctccc

SEQ ID NO: 143805 - DNA, 20 bp, Artificial
  CRISPR gRNA sequence
ttgtgtctcagcctcccaag

SEQ ID NO: 143806 - DNA, 20 bp, Artificial
  CRISPR gRNA sequence
gtctcagcctcccaagtagc

SEQ ID NO: 143807 - DNA, 20 bp, Artificial
  CRISPR gRNA sequence
tctcagcctcccaagtagct

SEQ ID NO: 143808 - DNA, 20 bp, Artificial
  CRISPR gRNA sequence
ctcccaagtagctgggatga

SEQ ID NO: 143809 - DNA, 20 bp, Artificial
  CRISPR gRNA sequence
tcccaagtagctgggatgac

SEQ ID NO: 143810 - DNA, 20 bp, Artificial
  CRISPR gRNA sequence
caggcatgcaccaccacgcc

SEQ ID NO: 143811 - DNA, 20 bp, Artificial
  CRISPR gRNA sequence
cccagctaattttgtatttt

SEQ ID NO: 143812 - DNA, 20 bp, Artificial
  CRISPR gRNA sequence
agctaattttgtatttttag

SEQ ID NO: 143813 - DNA, 20 bp, Artificial
  CRISPR gRNA sequence
ttttgtatttttagtggaaa

SEQ ID NO: 143814 - DNA, 20 bp, Artificial
  CRISPR gRNA sequence
tggaaacggttttgccatgt

SEQ ID NO: 143815 - DNA, 20 bp, Artificial
  CRISPR gRNA sequence
aacggttttgccatgttggc

SEQ ID NO: 143816 - DNA, 20 bp, Artificial
  CRISPR gRNA sequence
acggttttgccatgttggcc

SEQ ID NO: 143817 - DNA, 20 bp, Artificial
  CRISPR gRNA sequence
ttttgccatgttggccaggc

SEQ ID NO: 143818 - DNA, 20 bp, Artificial
  CRISPR gRNA sequence
cctcatgtgatcacctgcct

SEQ ID NO: 143819 - DNA, 20 bp, Artificial
  CRISPR gRNA sequence
ctgcctcagcctccctccca

SEQ ID NO: 143820 - DNA, 20 bp, Artificial
  CRISPR gRNA sequence
cagcctccctcccaaagtgc

SEQ ID NO: 143821 - DNA, 20 bp, Artificial
  CRISPR gRNA sequence
agcctccctcccaaagtgct

SEQ ID NO: 143822 - DNA, 20 bp, Artificial
  CRISPR gRNA sequence
ctcccaaagtgctgggatta

SEQ ID NO: 143823 - DNA, 20 bp, Artificial
  CRISPR gRNA sequence
tcccaaagtgctgggattac

SEQ ID NO: 143824 - DNA, 20 bp, Artificial
  CRISPR gRNA sequence
caggcgtgacccactgtgcc

SEQ ID NO: 143825 - DNA, 20 bp, Artificial
  CRISPR gRNA sequence
ccagccccaaactgacttct

SEQ ID NO: 143826 - DNA, 20 bp, Artificial
  CRISPR gRNA sequence
cagccccaaactgacttctg

SEQ ID NO: 143827 - DNA, 20 bp, Artificial
  CRISPR gRNA sequence
aaactgacttctgaggaacc

SEQ ID NO: 143828 - DNA, 20 bp, Artificial
  CRISPR gRNA sequence
ctgacttctgaggaaccaag

SEQ ID NO: 143829 - DNA, 20 bp, Artificial
  CRISPR gRNA sequence
tcccatgccgttatgttttt

SEQ ID NO: 143830 - DNA, 20 bp, Artificial
  CRISPR gRNA sequence
ccgttatgttttttggatcc

SEQ ID NO: 143831 - DNA, 20 bp, Artificial
  CRISPR gRNA sequence
cgttatgttttttggatccc

SEQ ID NO: 143832 - DNA, 20 bp, Artificial
  CRISPR gRNA sequence
gttatgttttttggatccca

SEQ ID NO: 143833 - DNA, 20 bp, Artificial
  CRISPR gRNA sequence
atgttttttggatcccaggg

SEQ ID NO: 143834 - DNA, 20 bp, Artificial
  CRISPR gRNA sequence
atcccagggaagaatcttat

SEQ ID NO: 143835 - DNA, 20 bp, Artificial
  CRISPR gRNA sequence
tcccagggaagaatcttatg

SEQ ID NO: 143836 - DNA, 20 bp, Artificial
  CRISPR gRNA sequence
aagaatcttatgaggttaaa

SEQ ID NO: 143837 - DNA, 20 bp, Artificial
  CRISPR gRNA sequence
gaatcttatgaggttaaaaa

SEQ ID NO: 143838 - DNA, 20 bp, Artificial
  CRISPR gRNA sequence
aatcttatgaggttaaaaag

SEQ ID NO: 143839 - DNA, 20 bp, Artificial
  CRISPR gRNA sequence
atcttatgaggttaaaaaga

SEQ ID NO: 143840 - DNA, 20 bp, Artificial
  CRISPR gRNA sequence
tcttatgaggttaaaaagag

SEQ ID NO: 143841 - DNA, 20 bp, Artificial
  CRISPR gRNA sequence
atgaggttaaaaagaggggc

SEQ ID NO: 143842 - DNA, 20 bp, Artificial
  CRISPR gRNA sequence
tgaggttaaaaagaggggct

SEQ ID NO: 143843 - DNA, 20 bp, Artificial
  CRISPR gRNA sequence
gaggttaaaaagaggggctg

SEQ ID NO: 143844 - DNA, 20 bp, Artificial
  CRISPR gRNA sequence
aggttaaaaagaggggctgg

SEQ ID NO: 143845 - DNA, 20 bp, Artificial
  CRISPR gRNA sequence
ttaaaaagaggggctggggg

SEQ ID NO: 143846 - DNA, 20 bp, Artificial
  CRISPR gRNA sequence
taaaaagaggggctggggga

SEQ ID NO: 143847 - DNA, 20 bp, Artificial
  CRISPR gRNA sequence
aaaaagaggggctgggggaa

SEQ ID NO: 143848 - DNA, 20 bp, Artificial
  CRISPR gRNA sequence
aggggctgggggaagggtgt

SEQ ID NO: 143849 - DNA, 20 bp, Artificial
  CRISPR gRNA sequence
gctgggggaagggtgtgagt

SEQ ID NO: 143850 - DNA, 20 bp, Artificial
  CRISPR gRNA sequence
ggaagggtgtgagtcagtat

SEQ ID NO: 143851 - DNA, 20 bp, Artificial
  CRISPR gRNA sequence
gtgtgagtcagtatcagcta

SEQ ID NO: 143852 - DNA, 20 bp, Artificial
  CRISPR gRNA sequence
agtcagtatcagctacggaa

SEQ ID NO: 143853 - DNA, 20 bp, Artificial
  CRISPR gRNA sequence
ctacggaaaagccgcgtcct

SEQ ID NO: 143854 - DNA, 20 bp, Artificial
  CRISPR gRNA sequence
tacggaaaagccgcgtcctt

SEQ ID NO: 143855 - DNA, 20 bp, Artificial
  CRISPR gRNA sequence
gaaaagccgcgtccttaggt

SEQ ID NO: 143856 - DNA, 20 bp, Artificial
  CRISPR gRNA sequence
agccgcgtccttaggtaagc

SEQ ID NO: 143857 - DNA, 20 bp, Artificial
  CRISPR gRNA sequence
gccgcgtccttaggtaagcc

SEQ ID NO: 143858 - DNA, 20 bp, Artificial
  CRISPR gRNA sequence
ccgcgtccttaggtaagccg

SEQ ID NO: 143859 - DNA, 20 bp, Artificial
  CRISPR gRNA sequence
gcgtccttaggtaagccggg

SEQ ID NO: 143860 - DNA, 20 bp, Artificial
  CRISPR gRNA sequence
tccttaggtaagccggggag

SEQ ID NO: 143861 - DNA, 20 bp, Artificial
  CRISPR gRNA sequence
ccttaggtaagccggggagt

SEQ ID NO: 143862 - DNA, 20 bp, Artificial
  CRISPR gRNA sequence
ggtaagccggggagtgggca

SEQ ID NO: 143863 - DNA, 20 bp, Artificial
  CRISPR gRNA sequence
ccggggagtgggcacagaaa

SEQ ID NO: 143864 - DNA, 20 bp, Artificial
  CRISPR gRNA sequence
gaaacagcccttaatgatcc

SEQ ID NO: 143865 - DNA, 20 bp, Artificial
  CRISPR gRNA sequence
aacagcccttaatgatccca

SEQ ID NO: 143866 - DNA, 20 bp, Artificial
  CRISPR gRNA sequence
taatgatcccagagactata

SEQ ID NO: 143867 - DNA, 20 bp, Artificial
  CRISPR gRNA sequence
cccagagactatatggaact

SEQ ID NO: 143868 - DNA, 20 bp, Artificial
  CRISPR gRNA sequence
agagactatatggaactcag

SEQ ID NO: 143869 - DNA, 20 bp, Artificial
  CRISPR gRNA sequence
gaactcagaagccttgcttt

SEQ ID NO: 143870 - DNA, 20 bp, Artificial
  CRISPR gRNA sequence
ttcctcgtattttcccaaat

SEQ ID NO: 143871 - DNA, 20 bp, Artificial
  CRISPR gRNA sequence
attttcccaaatgagatctt

SEQ ID NO: 143872 - DNA, 20 bp, Artificial
  CRISPR gRNA sequence
tttcccaaatgagatctttg

SEQ ID NO: 143873 - DNA, 20 bp, Artificial
  CRISPR gRNA sequence
ggagacctgctctacaaact

SEQ ID NO: 143874 - DNA, 20 bp, Artificial
  CRISPR gRNA sequence
agctctgtcaccactgtcaa

SEQ ID NO: 143875 - DNA, 20 bp, Artificial
  CRISPR gRNA sequence
actgtcaatagatacatcac

SEQ ID NO: 143876 - DNA, 20 bp, Artificial
  CRISPR gRNA sequence
tacatcaccagaaatgcaac

SEQ ID NO: 143877 - DNA, 20 bp, Artificial
  CRISPR gRNA sequence
acatcaccagaaatgcaact

SEQ ID NO: 143878 - DNA, 20 bp, Artificial
  CRISPR gRNA sequence
caccagaaatgcaactgggc

SEQ ID NO: 143879 - DNA, 20 bp, Artificial
  CRISPR gRNA sequence
agaaatgcaactgggccaga

SEQ ID NO: 143880 - DNA, 20 bp, Artificial
  CRISPR gRNA sequence
gaaatgcaactgggccagac

SEQ ID NO: 143881 - DNA, 20 bp, Artificial
  CRISPR gRNA sequence
gcaactgggccagacgggtc

SEQ ID NO: 143882 - DNA, 20 bp, Artificial
  CRISPR gRNA sequence
taaacgatcgctgctttttt

SEQ ID NO: 143883 - DNA, 20 bp, Artificial
  CRISPR gRNA sequence
aaacgatcgctgcttttttt

SEQ ID NO: 143884 - DNA, 20 bp, Artificial
  CRISPR gRNA sequence
tcgctgctttttttgggtct

SEQ ID NO: 143885 - DNA, 20 bp, Artificial
  CRISPR gRNA sequence
cgctgctttttttgggtctg

SEQ ID NO: 143886 - DNA, 20 bp, Artificial
  CRISPR gRNA sequence
tttttttgggtctgaggcaa

SEQ ID NO: 143887 - DNA, 20 bp, Artificial
  CRISPR gRNA sequence
taacaatgcctccccttgac

SEQ ID NO: 143888 - DNA, 20 bp, Artificial
  CRISPR gRNA sequence
cagcaccccccatcttctgc

SEQ ID NO: 143889 - DNA, 20 bp, Artificial
  CRISPR gRNA sequence
ccatgtccctcaacaccccc

SEQ ID NO: 143890 - DNA, 20 bp, Artificial
  CRISPR gRNA sequence
tccctcaacacccccaagcc

SEQ ID NO: 143891 - DNA, 20 bp, Artificial
  CRISPR gRNA sequence
ccctcaacacccccaagccc

SEQ ID NO: 143892 - DNA, 20 bp, Artificial
  CRISPR gRNA sequence
cctcaacacccccaagccca

SEQ ID NO: 143893 - DNA, 20 bp, Artificial
  CRISPR gRNA sequence
tcaacacccccaagcccagg

SEQ ID NO: 143894 - DNA, 20 bp, Artificial
  CRISPR gRNA sequence
caacacccccaagcccaggg

SEQ ID NO: 143895 - DNA, 20 bp, Artificial
  CRISPR gRNA sequence
cacccccaagcccagggagg

SEQ ID NO: 143896 - DNA, 20 bp, Artificial
  CRISPR gRNA sequence
ccctcaccatctgtgactca

SEQ ID NO: 143897 - DNA, 20 bp, Artificial
  CRISPR gRNA sequence
actcatagccatcaatattg

SEQ ID NO: 143898 - DNA, 20 bp, Artificial
  CRISPR gRNA sequence
ctcatagccatcaatattgt

SEQ ID NO: 143899 - DNA, 20 bp, Artificial
  CRISPR gRNA sequence
tcatagccatcaatattgta

SEQ ID NO: 143900 - DNA, 20 bp, Artificial
  CRISPR gRNA sequence
ccatcaatattgtagggcac

SEQ ID NO: 143901 - DNA, 20 bp, Artificial
  CRISPR gRNA sequence
atcaatattgtagggcacga

SEQ ID NO: 143902 - DNA, 20 bp, Artificial
  CRISPR gRNA sequence
tcaatattgtagggcacgag

SEQ ID NO: 143903 - DNA, 20 bp, Artificial
  CRISPR gRNA sequence
aatattgtagggcacgagag

SEQ ID NO: 143904 - DNA, 20 bp, Artificial
  CRISPR gRNA sequence
tattgtagggcacgagagga

SEQ ID NO: 143905 - DNA, 20 bp, Artificial
  CRISPR gRNA sequence
attgtagggcacgagaggag

SEQ ID NO: 143906 - DNA, 20 bp, Artificial
  CRISPR gRNA sequence
tgtagggcacgagaggagag

SEQ ID NO: 143907 - DNA, 20 bp, Artificial
  CRISPR gRNA sequence
agggcacgagaggagaggag

SEQ ID NO: 143908 - DNA, 20 bp, Artificial
  CRISPR gRNA sequence
gggcacgagaggagaggaga

SEQ ID NO: 143909 - DNA, 20 bp, Artificial
  CRISPR gRNA sequence
ggcacgagaggagaggagaa

SEQ ID NO: 143910 - DNA, 20 bp, Artificial
  CRISPR gRNA sequence
gaggagaagggcaatttttc

SEQ ID NO: 143911 - DNA, 20 bp, Artificial
  CRISPR gRNA sequence
agaagggcaatttttctggt

SEQ ID NO: 143912 - DNA, 20 bp, Artificial
  CRISPR gRNA sequence
gaagggcaatttttctggtt

SEQ ID NO: 143913 - DNA, 20 bp, Artificial
  CRISPR gRNA sequence
aagggcaatttttctggtta

SEQ ID NO: 143914 - DNA, 20 bp, Artificial
  CRISPR gRNA sequence
atttttctggttagggatgc

SEQ ID NO: 143915 - DNA, 20 bp, Artificial
  CRISPR gRNA sequence
ttttctggttagggatgcaa

SEQ ID NO: 143916 - DNA, 20 bp, Artificial
  CRISPR gRNA sequence
tttctggttagggatgcaag

SEQ ID NO: 143917 - DNA, 20 bp, Artificial
  CRISPR gRNA sequence
tctggttagggatgcaagag

SEQ ID NO: 143918 - DNA, 20 bp, Artificial
  CRISPR gRNA sequence
ctggttagggatgcaagagg

SEQ ID NO: 143919 - DNA, 20 bp, Artificial
  CRISPR gRNA sequence
gttagggatgcaagaggagg

SEQ ID NO: 143920 - DNA, 20 bp, Artificial
  CRISPR gRNA sequence
ttagggatgcaagaggaggt

SEQ ID NO: 143921 - DNA, 20 bp, Artificial
  CRISPR gRNA sequence
tagggatgcaagaggaggta

SEQ ID NO: 143922 - DNA, 20 bp, Artificial
  CRISPR gRNA sequence
agggatgcaagaggaggtag

SEQ ID NO: 143923 - DNA, 20 bp, Artificial
  CRISPR gRNA sequence
aggaggtaggggtaaaatct

SEQ ID NO: 143924 - DNA, 20 bp, Artificial
  CRISPR gRNA sequence
ggtaggggtaaaatctaagt

SEQ ID NO: 143925 - DNA, 20 bp, Artificial
  CRISPR gRNA sequence
aaatctaagtaagctttcca

SEQ ID NO: 143926 - DNA, 20 bp, Artificial
  CRISPR gRNA sequence
atctaagtaagctttccaaa

SEQ ID NO: 143927 - DNA, 20 bp, Artificial
  CRISPR gRNA sequence
agtaagctttccaaagagca

SEQ ID NO: 143928 - DNA, 20 bp, Artificial
  CRISPR gRNA sequence
gtaagctttccaaagagcac

SEQ ID NO: 143929 - DNA, 20 bp, Artificial
  CRISPR gRNA sequence
aagctttccaaagagcacag

SEQ ID NO: 143930 - DNA, 20 bp, Artificial
  CRISPR gRNA sequence
agctttccaaagagcacagg

SEQ ID NO: 143931 - DNA, 20 bp, Artificial
  CRISPR gRNA sequence
ccaaagagcacaggaggtgc

SEQ ID NO: 143932 - DNA, 20 bp, Artificial
  CRISPR gRNA sequence
caggaggtgccagaacacaa

SEQ ID NO: 143933 - DNA, 20 bp, Artificial
  CRISPR gRNA sequence
gccagaacacaacagccact

SEQ ID NO: 143934 - DNA, 20 bp, Artificial
  CRISPR gRNA sequence
ccagaacacaacagccactt

SEQ ID NO: 143935 - DNA, 20 bp, Artificial
  CRISPR gRNA sequence
acaacagccacttgggttta

SEQ ID NO: 143936 - DNA, 20 bp, Artificial
  CRISPR gRNA sequence
cagccacttgggtttaaaga

SEQ ID NO: 143937 - DNA, 20 bp, Artificial
  CRISPR gRNA sequence
cttgggtttaaagatggaaa

SEQ ID NO: 143938 - DNA, 20 bp, Artificial
  CRISPR gRNA sequence
gatggaaacagcctgacgat

SEQ ID NO: 143939 - DNA, 20 bp, Artificial
  CRISPR gRNA sequence
atggaaacagcctgacgatc

SEQ ID NO: 143940 - DNA, 20 bp, Artificial
  CRISPR gRNA sequence
gcgatctgtcgaacatttcc

SEQ ID NO: 143941 - DNA, 20 bp, Artificial
  CRISPR gRNA sequence
cgatctgtcgaacatttccc

SEQ ID NO: 143942 - DNA, 20 bp, Artificial
  CRISPR gRNA sequence
cgaacatttcccaggtctga

SEQ ID NO: 143943 - DNA, 20 bp, Artificial
  CRISPR gRNA sequence
gaacatttcccaggtctgat

SEQ ID NO: 143944 - DNA, 20 bp, Artificial
  CRISPR gRNA sequence
tgatgggtgtgcacacctgt

SEQ ID NO: 143945 - DNA, 20 bp, Artificial
  CRISPR gRNA sequence
gatgggtgtgcacacctgta

SEQ ID NO: 143946 - DNA, 20 bp, Artificial
  CRISPR gRNA sequence
cacacctgtaaggtttcttt

SEQ ID NO: 143947 - DNA, 20 bp, Artificial
  CRISPR gRNA sequence
acacctgtaaggtttctttc

SEQ ID NO: 143948 - DNA, 20 bp, Artificial
  CRISPR gRNA sequence
ggtttctttcaggcaccttc

SEQ ID NO: 143949 - DNA, 20 bp, Artificial
  CRISPR gRNA sequence
gtttctttcaggcaccttcg

SEQ ID NO: 143950 - DNA, 20 bp, Artificial
  CRISPR gRNA sequence
cttgcatttctttgcccctt

SEQ ID NO: 143951 - DNA, 20 bp, Artificial
  CRISPR gRNA sequence
tttctttgccccttgagaac

SEQ ID NO: 143952 - DNA, 20 bp, Artificial
  CRISPR gRNA sequence
tttgccccttgagaacaaga

SEQ ID NO: 143953 - DNA, 20 bp, Artificial
  CRISPR gRNA sequence
ccccttgagaacaagatggt

SEQ ID NO: 143954 - DNA, 20 bp, Artificial
  CRISPR gRNA sequence
ccttgagaacaagatggtaa

SEQ ID NO: 143955 - DNA, 20 bp, Artificial
  CRISPR gRNA sequence
caattaccacccatgcctct

SEQ ID NO: 143956 - DNA, 20 bp, Artificial
  CRISPR gRNA sequence
aattaccacccatgcctctt

SEQ ID NO: 143957 - DNA, 20 bp, Artificial
  CRISPR gRNA sequence
ccacccatgcctcttgggtg

SEQ ID NO: 143958 - DNA, 20 bp, Artificial
  CRISPR gRNA sequence
cccatgcctcttgggtgcag

SEQ ID NO: 143959 - DNA, 20 bp, Artificial
  CRISPR gRNA sequence
ccatgcctcttgggtgcaga

SEQ ID NO: 143960 - DNA, 20 bp, Artificial
  CRISPR gRNA sequence
ctcttgggtgcagaaggata

SEQ ID NO: 143961 - DNA, 20 bp, Artificial
  CRISPR gRNA sequence
cttgggtgcagaaggatatg

SEQ ID NO: 143962 - DNA, 20 bp, Artificial
  CRISPR gRNA sequence
ttgggtgcagaaggatatgg

SEQ ID NO: 143963 - DNA, 20 bp, Artificial
  CRISPR gRNA sequence
tgggtgcagaaggatatgga

SEQ ID NO: 143964 - DNA, 20 bp, Artificial
  CRISPR gRNA sequence
gcagaaggatatggagggtg

SEQ ID NO: 143965 - DNA, 20 bp, Artificial
  CRISPR gRNA sequence
cagaaggatatggagggtgt

SEQ ID NO: 143966 - DNA, 20 bp, Artificial
  CRISPR gRNA sequence
agaaggatatggagggtgtg

SEQ ID NO: 143967 - DNA, 20 bp, Artificial
  CRISPR gRNA sequence
gaaggatatggagggtgtgg

SEQ ID NO: 143968 - DNA, 20 bp, Artificial
  CRISPR gRNA sequence
ggatatggagggtgtggggg

SEQ ID NO: 143969 - DNA, 20 bp, Artificial
  CRISPR gRNA sequence
gggtgtgggggtggtgcttc

SEQ ID NO: 143970 - DNA, 20 bp, Artificial
  CRISPR gRNA sequence
gggggtggtgcttctggttg

SEQ ID NO: 143971 - DNA, 20 bp, Artificial
  CRISPR gRNA sequence
ggggtggtgcttctggttga

SEQ ID NO: 143972 - DNA, 20 bp, Artificial
  CRISPR gRNA sequence
ggtgcttctggttgaaggat

SEQ ID NO: 143973 - DNA, 20 bp, Artificial
  CRISPR gRNA sequence
gtgcttctggttgaaggatg

SEQ ID NO: 143974 - DNA, 20 bp, Artificial
  CRISPR gRNA sequence
cttctggttgaaggatgagg

SEQ ID NO: 143975 - DNA, 20 bp, Artificial
  CRISPR gRNA sequence
tggttgaaggatgaggtggc

SEQ ID NO: 143976 - DNA, 20 bp, Artificial
  CRISPR gRNA sequence
tgaaggatgaggtggcaaga

SEQ ID NO: 143977 - DNA, 20 bp, Artificial
  CRISPR gRNA sequence
tggcaagacagctgtgtgct

SEQ ID NO: 143978 - DNA, 20 bp, Artificial
  CRISPR gRNA sequence
gctgagcgctcctttcctgt

SEQ ID NO: 143979 - DNA, 20 bp, Artificial
  CRISPR gRNA sequence
gagcgctcctttcctgtcag

SEQ ID NO: 143980 - DNA, 20 bp, Artificial
  CRISPR gRNA sequence
tgtcagaagccatctgctcc

SEQ ID NO: 143981 - DNA, 20 bp, Artificial
  CRISPR gRNA sequence
tctgctcctggtctccaaca

SEQ ID NO: 143982 - DNA, 20 bp, Artificial
  CRISPR gRNA sequence
ctgctcctggtctccaacac

SEQ ID NO: 143983 - DNA, 20 bp, Artificial
  CRISPR gRNA sequence
caacacaggccttgtgtctc

SEQ ID NO: 143984 - DNA, 20 bp, Artificial
  CRISPR gRNA sequence
aacacaggccttgtgtctct

SEQ ID NO: 143985 - DNA, 20 bp, Artificial
  CRISPR gRNA sequence
acacaggccttgtgtctctg

SEQ ID NO: 143986 - DNA, 20 bp, Artificial
  CRISPR gRNA sequence
ctctggggcacatacctgtt

SEQ ID NO: 143987 - DNA, 20 bp, Artificial
  CRISPR gRNA sequence
ggcacatacctgttgagcat

SEQ ID NO: 143988 - DNA, 20 bp, Artificial
  CRISPR gRNA sequence
acatacctgttgagcattgg

SEQ ID NO: 143989 - DNA, 20 bp, Artificial
  CRISPR gRNA sequence
acctgttgagcattggtggc

SEQ ID NO: 143990 - DNA, 20 bp, Artificial
  CRISPR gRNA sequence
gagcattggtggcaagtgtc

SEQ ID NO: 143991 - DNA, 20 bp, Artificial
  CRISPR gRNA sequence
gatctgtccctgcacaactt

SEQ ID NO: 143992 - DNA, 20 bp, Artificial
  CRISPR gRNA sequence
cacaacttgagtgcctgata

SEQ ID NO: 143993 - DNA, 20 bp, Artificial
  CRISPR gRNA sequence
acaacttgagtgcctgatac

SEQ ID NO: 143994 - DNA, 20 bp, Artificial
  CRISPR gRNA sequence
cttgagtgcctgatacaggc

SEQ ID NO: 143995 - DNA, 20 bp, Artificial
  CRISPR gRNA sequence
ttgagtgcctgatacaggct

SEQ ID NO: 143996 - DNA, 20 bp, Artificial
  CRISPR gRNA sequence
tgcctgatacaggctgggct

SEQ ID NO: 143997 - DNA, 20 bp, Artificial
  CRISPR gRNA sequence
ctgatacaggctgggctaag

SEQ ID NO: 143998 - DNA, 20 bp, Artificial
  CRISPR gRNA sequence
tgggctaagcggatatactg

SEQ ID NO: 143999 - DNA, 20 bp, Artificial
  CRISPR gRNA sequence
ctaagcggatatactgcagc

SEQ ID NO: 144000 - DNA, 20 bp, Artificial
  CRISPR gRNA sequence
gcggatatactgcagctggc

SEQ ID NO: 144001 - DNA, 20 bp, Artificial
  CRISPR gRNA sequence
tactgcagctggccggcatt

SEQ ID NO: 144002 - DNA, 20 bp, Artificial
  CRISPR gRNA sequence
ggccggcattcagctgcacc

SEQ ID NO: 144003 - DNA, 20 bp, Artificial
  CRISPR gRNA sequence
gccggcattcagctgcacct

SEQ ID NO: 144004 - DNA, 20 bp, Artificial
  CRISPR gRNA sequence
ccggcattcagctgcaccta

SEQ ID NO: 144005 - DNA, 20 bp, Artificial
  CRISPR gRNA sequence
gcattcagctgcacctaggg

SEQ ID NO: 144006 - DNA, 20 bp, Artificial
  CRISPR gRNA sequence
cattcagctgcacctagggc

SEQ ID NO: 144007 - DNA, 20 bp, Artificial
  CRISPR gRNA sequence
attcagctgcacctagggca

SEQ ID NO: 144008 - DNA, 20 bp, Artificial
  CRISPR gRNA sequence
ttcagctgcacctagggcag

SEQ ID NO: 144009 - DNA, 20 bp, Artificial
  CRISPR gRNA sequence
agctgcacctagggcagggg

SEQ ID NO: 144010 - DNA, 20 bp, Artificial
  CRISPR gRNA sequence
ctgcacctagggcaggggca

SEQ ID NO: 144011 - DNA, 20 bp, Artificial
  CRISPR gRNA sequence
ctagggcaggggcagagaca

SEQ ID NO: 144012 - DNA, 20 bp, Artificial
  CRISPR gRNA sequence
agggcaggggcagagacaaa

SEQ ID NO: 144013 - DNA, 20 bp, Artificial
  CRISPR gRNA sequence
ggcagagacaaagagaccat

SEQ ID NO: 144014 - DNA, 20 bp, Artificial
  CRISPR gRNA sequence
caaagagaccataagacatt

SEQ ID NO: 144015 - DNA, 20 bp, Artificial
  CRISPR gRNA sequence
acattgagtataatctcaaa

SEQ ID NO: 144016 - DNA, 20 bp, Artificial
  CRISPR gRNA sequence
cattgagtataatctcaaac

SEQ ID NO: 144017 - DNA, 20 bp, Artificial
  CRISPR gRNA sequence
acaggcaaactttccatgac

SEQ ID NO: 144018 - DNA, 20 bp, Artificial
  CRISPR gRNA sequence
aggcaaactttccatgacca

SEQ ID NO: 144019 - DNA, 20 bp, Artificial
  CRISPR gRNA sequence
ttgattgccccctacccctc

SEQ ID NO: 144020 - DNA, 20 bp, Artificial
  CRISPR gRNA sequence
cctacccctcaagccctcca

SEQ ID NO: 144021 - DNA, 20 bp, Artificial
  CRISPR gRNA sequence
acccctcaagccctccaaag

SEQ ID NO: 144022 - DNA, 20 bp, Artificial
  CRISPR gRNA sequence
aaagaagcctgccctgaaaa

SEQ ID NO: 144023 - DNA, 20 bp, Artificial
  CRISPR gRNA sequence
tgaaaaaagtcccttttaaa

SEQ ID NO: 144024 - DNA, 20 bp, Artificial
  CRISPR gRNA sequence
aaaaaagtcccttttaaaca

SEQ ID NO: 144025 - DNA, 20 bp, Artificial
  CRISPR gRNA sequence
aaaaagtcccttttaaacag

SEQ ID NO: 144026 - DNA, 20 bp, Artificial
  CRISPR gRNA sequence
ttttaaacagaggtcaaaac

SEQ ID NO: 144027 - DNA, 20 bp, Artificial
  CRISPR gRNA sequence
gaggtcaaaacaagcaaaat

SEQ ID NO: 144028 - DNA, 20 bp, Artificial
  CRISPR gRNA sequence
tcagaacatccacatcccac

SEQ ID NO: 144029 - DNA, 20 bp, Artificial
  CRISPR gRNA sequence
tccacatcccacaagtcaca

SEQ ID NO: 144030 - DNA, 20 bp, Artificial
  CRISPR gRNA sequence
atcccacaagtcacacagca

SEQ ID NO: 144031 - DNA, 20 bp, Artificial
  CRISPR gRNA sequence
ccacaagtcacacagcacag

SEQ ID NO: 144032 - DNA, 20 bp, Artificial
  CRISPR gRNA sequence
acaagtcacacagcacagaa

SEQ ID NO: 144033 - DNA, 20 bp, Artificial
  CRISPR gRNA sequence
aagagaatatattccctgaa

SEQ ID NO: 144034 - DNA, 20 bp, Artificial
  CRISPR gRNA sequence
tatattccctgaatggactt

SEQ ID NO: 144035 - DNA, 20 bp, Artificial
  CRISPR gRNA sequence
tggacttcagaaaaaactcc

SEQ ID NO: 144036 - DNA, 20 bp, Artificial
  CRISPR gRNA sequence
acttcagaaaaaactcccag

SEQ ID NO: 144037 - DNA, 20 bp, Artificial
  CRISPR gRNA sequence
tcccagaagatcctgtcaca

SEQ ID NO: 144038 - DNA, 20 bp, Artificial
  CRISPR gRNA sequence
cccagaagatcctgtcacaa

SEQ ID NO: 144039 - DNA, 20 bp, Artificial
  CRISPR gRNA sequence
gaagatcctgtcacaaaggt

SEQ ID NO: 144040 - DNA, 20 bp, Artificial
  CRISPR gRNA sequence
tcctgtcacaaaggtgagaa

SEQ ID NO: 144041 - DNA, 20 bp, Artificial
  CRISPR gRNA sequence
tcacaaaggtgagaacagca

SEQ ID NO: 144042 - DNA, 20 bp, Artificial
  CRISPR gRNA sequence
gctgcatgctcattatttgc

SEQ ID NO: 144043 - DNA, 20 bp, Artificial
  CRISPR gRNA sequence
gctcattatttgccagctct

SEQ ID NO: 144044 - DNA, 20 bp, Artificial
  CRISPR gRNA sequence
agctcttagctacatgatca

SEQ ID NO: 144045 - DNA, 20 bp, Artificial
  CRISPR gRNA sequence
tacatgatcacagcttatct

SEQ ID NO: 144046 - DNA, 20 bp, Artificial
  CRISPR gRNA sequence
acatgatcacagcttatctt

SEQ ID NO: 144047 - DNA, 20 bp, Artificial
  CRISPR gRNA sequence
atttatctgactgacatcat

SEQ ID NO: 144048 - DNA, 20 bp, Artificial
  CRISPR gRNA sequence
catcagaatgcctgtacatt

SEQ ID NO: 144049 - DNA, 20 bp, Artificial
  CRISPR gRNA sequence
gaatgcctgtacattaagtg

SEQ ID NO: 144050 - DNA, 20 bp, Artificial
  CRISPR gRNA sequence
aatgcctgtacattaagtgt

SEQ ID NO: 144051 - DNA, 20 bp, Artificial
  CRISPR gRNA sequence
ctctttcgctcccatctgta

SEQ ID NO: 144052 - DNA, 20 bp, Artificial
  CRISPR gRNA sequence
ctttcgctcccatctgtaaa

SEQ ID NO: 144053 - DNA, 20 bp, Artificial
  CRISPR gRNA sequence
ctcccatctgtaaagagatc

SEQ ID NO: 144054 - DNA, 20 bp, Artificial
  CRISPR gRNA sequence
taaagagatccagcatctgc

SEQ ID NO: 144055 - DNA, 20 bp, Artificial
  CRISPR gRNA sequence
aaagagatccagcatctgcc

SEQ ID NO: 144056 - DNA, 20 bp, Artificial
  CRISPR gRNA sequence
cagcatctgccaggatccca

SEQ ID NO: 144057 - DNA, 20 bp, Artificial
  CRISPR gRNA sequence
tgccaggatcccaaagcaaa

SEQ ID NO: 144058 - DNA, 20 bp, Artificial
  CRISPR gRNA sequence
acagccatcattccgcatca

SEQ ID NO: 144059 - DNA, 20 bp, Artificial
  CRISPR gRNA sequence
ctgccccatgctgcacattt

SEQ ID NO: 144060 - DNA, 20 bp, Artificial
  CRISPR gRNA sequence
gccccatgctgcacattttg

SEQ ID NO: 144061 - DNA, 20 bp, Artificial
  CRISPR gRNA sequence
ccccatgctgcacattttgg

SEQ ID NO: 144062 - DNA, 20 bp, Artificial
  CRISPR gRNA sequence
gctgcacattttggaggcaa

SEQ ID NO: 144063 - DNA, 20 bp, Artificial
  CRISPR gRNA sequence
cacattttggaggcaaaagc

SEQ ID NO: 144064 - DNA, 20 bp, Artificial
  CRISPR gRNA sequence
gcttaaccatctctgtcccc

SEQ ID NO: 144065 - DNA, 20 bp, Artificial
  CRISPR gRNA sequence
ttaaccatctctgtccccaa

SEQ ID NO: 144066 - DNA, 20 bp, Artificial
  CRISPR gRNA sequence
ccatctctgtccccaagagc

SEQ ID NO: 144067 - DNA, 20 bp, Artificial
  CRISPR gRNA sequence
catctctgtccccaagagcc

SEQ ID NO: 144068 - DNA, 20 bp, Artificial
  CRISPR gRNA sequence
tctgtccccaagagccaggc

SEQ ID NO: 144069 - DNA, 20 bp, Artificial
  CRISPR gRNA sequence
tccccaagagccaggctgga

SEQ ID NO: 144070 - DNA, 20 bp, Artificial
  CRISPR gRNA sequence
ccccaagagccaggctggat

SEQ ID NO: 144071 - DNA, 20 bp, Artificial
  CRISPR gRNA sequence
cccaagagccaggctggatg

SEQ ID NO: 144072 - DNA, 20 bp, Artificial
  CRISPR gRNA sequence
ccaagagccaggctggatgg

SEQ ID NO: 144073 - DNA, 20 bp, Artificial
  CRISPR gRNA sequence
ccaggctggatgggggtctg

SEQ ID NO: 144074 - DNA, 20 bp, Artificial
  CRISPR gRNA sequence
caggctggatgggggtctgt

SEQ ID NO: 144075 - DNA, 20 bp, Artificial
  CRISPR gRNA sequence
aggctggatgggggtctgtg

SEQ ID NO: 144076 - DNA, 20 bp, Artificial
  CRISPR gRNA sequence
atgggggtctgtggggcttt

SEQ ID NO: 144077 - DNA, 20 bp, Artificial
  CRISPR gRNA sequence
tgggggtctgtggggctttt

SEQ ID NO: 144078 - DNA, 20 bp, Artificial
  CRISPR gRNA sequence
tgtggggcttttaggatctt

SEQ ID NO: 144079 - DNA, 20 bp, Artificial
  CRISPR gRNA sequence
cttttaggatctttggtgtt

SEQ ID NO: 144080 - DNA, 20 bp, Artificial
  CRISPR gRNA sequence
ggatctttggtgttcagcac

SEQ ID NO: 144081 - DNA, 20 bp, Artificial
  CRISPR gRNA sequence
tggtgttcagcactagcttc

SEQ ID NO: 144082 - DNA, 20 bp, Artificial
  CRISPR gRNA sequence
cttctggccaaacacctccc

SEQ ID NO: 144083 - DNA, 20 bp, Artificial
  CRISPR gRNA sequence
ttctggccaaacacctccca

SEQ ID NO: 144084 - DNA, 20 bp, Artificial
  CRISPR gRNA sequence
tctggccaaacacctcccaa

SEQ ID NO: 144085 - DNA, 20 bp, Artificial
  CRISPR gRNA sequence
ctggccaaacacctcccaag

SEQ ID NO: 144086 - DNA, 20 bp, Artificial
  CRISPR gRNA sequence
gccaaacacctcccaagggg

SEQ ID NO: 144087 - DNA, 20 bp, Artificial
  CRISPR gRNA sequence
aaacacctcccaaggggaag

SEQ ID NO: 144088 - DNA, 20 bp, Artificial
  CRISPR gRNA sequence
cagaatcaataaacctttca

SEQ ID NO: 144089 - DNA, 20 bp, Artificial
  CRISPR gRNA sequence
tttcatagaaaaccccatca

SEQ ID NO: 144090 - DNA, 20 bp, Artificial
  CRISPR gRNA sequence
ttcatagaaaaccccatcat

SEQ ID NO: 144091 - DNA, 20 bp, Artificial
  CRISPR gRNA sequence
aaccccatcatgggaaacca

SEQ ID NO: 144092 - DNA, 20 bp, Artificial
  CRISPR gRNA sequence
atgggaaaccaaagctacga

SEQ ID NO: 144093 - DNA, 20 bp, Artificial
  CRISPR gRNA sequence
caaagctacgaaagcgccct

SEQ ID NO: 144094 - DNA, 20 bp, Artificial
  CRISPR gRNA sequence
aagctacgaaagcgccctta

SEQ ID NO: 144095 - DNA, 20 bp, Artificial
  CRISPR gRNA sequence
tcatgcttacgattaaatct

SEQ ID NO: 144096 - DNA, 20 bp, Artificial
  CRISPR gRNA sequence
tgcatttaattgtgtgctaa

SEQ ID NO: 144097 - DNA, 20 bp, Artificial
  CRISPR gRNA sequence
gtgtgctaaaagccttaact

SEQ ID NO: 144098 - DNA, 20 bp, Artificial
  CRISPR gRNA sequence
tgtgctaaaagccttaactc

SEQ ID NO: 144099 - DNA, 20 bp, Artificial
  CRISPR gRNA sequence
aactcaggctcttaatgctc

SEQ ID NO: 144100 - DNA, 20 bp, Artificial
  CRISPR gRNA sequence
aatgctccagtgtaccatga

SEQ ID NO: 144101 - DNA, 20 bp, Artificial
  CRISPR gRNA sequence
ccagtgtaccatgaaagtat

SEQ ID NO: 144102 - DNA, 20 bp, Artificial
  CRISPR gRNA sequence
catgaaagtattagtgtttt

SEQ ID NO: 144103 - DNA, 20 bp, Artificial
  CRISPR gRNA sequence
aaagtattagtgttttgagc

SEQ ID NO: 144104 - DNA, 20 bp, Artificial
  CRISPR gRNA sequence
aagtattagtgttttgagct

SEQ ID NO: 144105 - DNA, 20 bp, Artificial
  CRISPR gRNA sequence
agtattagtgttttgagctg

SEQ ID NO: 144106 - DNA, 20 bp, Artificial
  CRISPR gRNA sequence
tgttttgagctggggatgaa

SEQ ID NO: 144107 - DNA, 20 bp, Artificial
  CRISPR gRNA sequence
ttttgagctggggatgaaaa

SEQ ID NO: 144108 - DNA, 20 bp, Artificial
  CRISPR gRNA sequence
tttgagctggggatgaaaag

SEQ ID NO: 144109 - DNA, 20 bp, Artificial
  CRISPR gRNA sequence
ctggggatgaaaagaggacc

SEQ ID NO: 144110 - DNA, 20 bp, Artificial
  CRISPR gRNA sequence
tggggatgaaaagaggacca

SEQ ID NO: 144111 - DNA, 20 bp, Artificial
  CRISPR gRNA sequence
ggatgaaaagaggaccaagg

SEQ ID NO: 144112 - DNA, 20 bp, Artificial
  CRISPR gRNA sequence
gaccaaggcggttaccacat

SEQ ID NO: 144113 - DNA, 20 bp, Artificial
  CRISPR gRNA sequence
ccaaggcggttaccacatca

SEQ ID NO: 144114 - DNA, 20 bp, Artificial
  CRISPR gRNA sequence
gttaccacatcagagaactg

SEQ ID NO: 144115 - DNA, 20 bp, Artificial
  CRISPR gRNA sequence
cacatcagagaactgtagct

SEQ ID NO: 144116 - DNA, 20 bp, Artificial
  CRISPR gRNA sequence
cagagaactgtagctcagca

SEQ ID NO: 144117 - DNA, 20 bp, Artificial
  CRISPR gRNA sequence
ctgtagctcagcaaagatga

SEQ ID NO: 144118 - DNA, 20 bp, Artificial
  CRISPR gRNA sequence
agctcagcaaagatgatggt

SEQ ID NO: 144119 - DNA, 20 bp, Artificial
  CRISPR gRNA sequence
tcagcaaagatgatggtcag

SEQ ID NO: 144120 - DNA, 20 bp, Artificial
  CRISPR gRNA sequence
agcaaagatgatggtcagca

SEQ ID NO: 144121 - DNA, 20 bp, Artificial
  CRISPR gRNA sequence
gcaaagatgatggtcagcag

SEQ ID NO: 144122 - DNA, 20 bp, Artificial
  CRISPR gRNA sequence
aaagatgatggtcagcagag

SEQ ID NO: 144123 - DNA, 20 bp, Artificial
  CRISPR gRNA sequence
aagatgatggtcagcagagg

SEQ ID NO: 144124 - DNA, 20 bp, Artificial
  CRISPR gRNA sequence
tggtcagcagaggaggactg

SEQ ID NO: 144125 - DNA, 20 bp, Artificial
  CRISPR gRNA sequence
agacattcacaccctcaatt

SEQ ID NO: 144126 - DNA, 20 bp, Artificial
  CRISPR gRNA sequence
acattcacaccctcaattta

SEQ ID NO: 144127 - DNA, 20 bp, Artificial
  CRISPR gRNA sequence
cattcacaccctcaatttag

SEQ ID NO: 144128 - DNA, 20 bp, Artificial
  CRISPR gRNA sequence
cctcaatttagaggaaatga

SEQ ID NO: 144129 - DNA, 20 bp, Artificial
  CRISPR gRNA sequence
ctcaatttagaggaaatgaa

SEQ ID NO: 144130 - DNA, 20 bp, Artificial
  CRISPR gRNA sequence
tcaatttagaggaaatgaaa

SEQ ID NO: 144131 - DNA, 20 bp, Artificial
  CRISPR gRNA sequence
caatttagaggaaatgaaag

SEQ ID NO: 144132 - DNA, 20 bp, Artificial
  CRISPR gRNA sequence
agaggaaatgaaaggggttc

SEQ ID NO: 144133 - DNA, 20 bp, Artificial
  CRISPR gRNA sequence
gaggaaatgaaaggggttct

SEQ ID NO: 144134 - DNA, 20 bp, Artificial
  CRISPR gRNA sequence
ggaaatgaaaggggttctgg

SEQ ID NO: 144135 - DNA, 20 bp, Artificial
  CRISPR gRNA sequence
tgaaaggggttctgggagca

SEQ ID NO: 144136 - DNA, 20 bp, Artificial
  CRISPR gRNA sequence
aggggttctgggagcatgga

SEQ ID NO: 144137 - DNA, 20 bp, Artificial
  CRISPR gRNA sequence
ttctgggagcatggatagac

SEQ ID NO: 144138 - DNA, 20 bp, Artificial
  CRISPR gRNA sequence
tctgggagcatggatagact

SEQ ID NO: 144139 - DNA, 20 bp, Artificial
  CRISPR gRNA sequence
atagactaggtctctatctg

SEQ ID NO: 144140 - DNA, 20 bp, Artificial
  CRISPR gRNA sequence
tagactaggtctctatctgc

SEQ ID NO: 144141 - DNA, 20 bp, Artificial
  CRISPR gRNA sequence
agactaggtctctatctgcg

SEQ ID NO: 144142 - DNA, 20 bp, Artificial
  CRISPR gRNA sequence
aggtctctatctgcggggtc

SEQ ID NO: 144143 - DNA, 20 bp, Artificial
  CRISPR gRNA sequence
ggtccagaaaccacctgccc

SEQ ID NO: 144144 - DNA, 20 bp, Artificial
  CRISPR gRNA sequence
aaccacctgccctggctgcc

SEQ ID NO: 144145 - DNA, 20 bp, Artificial
  CRISPR gRNA sequence
gcccagcctgcctttgttgc

SEQ ID NO: 144146 - DNA, 20 bp, Artificial
  CRISPR gRNA sequence
cccagcctgcctttgttgca

SEQ ID NO: 144147 - DNA, 20 bp, Artificial
  CRISPR gRNA sequence
ccagcctgcctttgttgcaa

SEQ ID NO: 144148 - DNA, 20 bp, Artificial
  CRISPR gRNA sequence
cagcctgcctttgttgcaag

SEQ ID NO: 144149 - DNA, 20 bp, Artificial
  CRISPR gRNA sequence
cctgcctttgttgcaagggg

SEQ ID NO: 144150 - DNA, 20 bp, Artificial
  CRISPR gRNA sequence
ttgcaaggggaagcttcttg

SEQ ID NO: 144151 - DNA, 20 bp, Artificial
  CRISPR gRNA sequence
gggaagcttcttgtggctaa

SEQ ID NO: 144152 - DNA, 20 bp, Artificial
  CRISPR gRNA sequence
ggaagcttcttgtggctaac

SEQ ID NO: 144153 - DNA, 20 bp, Artificial
  CRISPR gRNA sequence
gcttcttgtggctaacaggc

SEQ ID NO: 144154 - DNA, 20 bp, Artificial
  CRISPR gRNA sequence
ggcaagtattgcctctgctc

SEQ ID NO: 144155 - DNA, 20 bp, Artificial
  CRISPR gRNA sequence
caagtattgcctctgctctg

SEQ ID NO: 144156 - DNA, 20 bp, Artificial
  CRISPR gRNA sequence
ctctggagcaaatttccctc

SEQ ID NO: 144157 - DNA, 20 bp, Artificial
  CRISPR gRNA sequence
caaatttccctctggccttc

SEQ ID NO: 144158 - DNA, 20 bp, Artificial
  CRISPR gRNA sequence
aatttccctctggccttcaa

SEQ ID NO: 144159 - DNA, 20 bp, Artificial
  CRISPR gRNA sequence
ttcaagagctaacttcactg

SEQ ID NO: 144160 - DNA, 20 bp, Artificial
  CRISPR gRNA sequence
tcaagagctaacttcactgc

SEQ ID NO: 144161 - DNA, 20 bp, Artificial
  CRISPR gRNA sequence
tcactgcaggactcttccat

SEQ ID NO: 144162 - DNA, 20 bp, Artificial
  CRISPR gRNA sequence
cactgcaggactcttccatg

SEQ ID NO: 144163 - DNA, 20 bp, Artificial
  CRISPR gRNA sequence
ttccatgaggaaaatgctaa

SEQ ID NO: 144164 - DNA, 20 bp, Artificial
  CRISPR gRNA sequence
tccatgaggaaaatgctaat

SEQ ID NO: 144165 - DNA, 20 bp, Artificial
  CRISPR gRNA sequence
aggaaaatgctaatgggatg

SEQ ID NO: 144166 - DNA, 20 bp, Artificial
  CRISPR gRNA sequence
tgaagctgcattcctgcacg

SEQ ID NO: 144167 - DNA, 20 bp, Artificial
  CRISPR gRNA sequence
ttcaatcaaaatgcttctct

SEQ ID NO: 144168 - DNA, 20 bp, Artificial
  CRISPR gRNA sequence
aaatgcttctctgagacttc

SEQ ID NO: 144169 - DNA, 20 bp, Artificial
  CRISPR gRNA sequence
ctctgagacttccagcctca

SEQ ID NO: 144170 - DNA, 20 bp, Artificial
  CRISPR gRNA sequence
ctcacagaatttgaactacc

SEQ ID NO: 144171 - DNA, 20 bp, Artificial
  CRISPR gRNA sequence
ccgagaaaaaacgacctctc

SEQ ID NO: 144172 - DNA, 20 bp, Artificial
  CRISPR gRNA sequence
aaaacgacctctcaagttca

SEQ ID NO: 144173 - DNA, 20 bp, Artificial
  CRISPR gRNA sequence
acgacctctcaagttcacgg

SEQ ID NO: 144174 - DNA, 20 bp, Artificial
  CRISPR gRNA sequence
aagttcacggtagaccattc

SEQ ID NO: 144175 - DNA, 20 bp, Artificial
  CRISPR gRNA sequence
cattccagaattgcccactt

SEQ ID NO: 144176 - DNA, 20 bp, Artificial
  CRISPR gRNA sequence
attccagaattgcccacttg

SEQ ID NO: 144177 - DNA, 20 bp, Artificial
  CRISPR gRNA sequence
cagaattgcccacttgaggc

SEQ ID NO: 144178 - DNA, 20 bp, Artificial
  CRISPR gRNA sequence
attgcccacttgaggcaaga

SEQ ID NO: 144179 - DNA, 20 bp, Artificial
  CRISPR gRNA sequence
tgcccacttgaggcaagatg

SEQ ID NO: 144180 - DNA, 20 bp, Artificial
  CRISPR gRNA sequence
gcccacttgaggcaagatgg

SEQ ID NO: 144181 - DNA, 20 bp, Artificial
  CRISPR gRNA sequence
cccacttgaggcaagatgga

SEQ ID NO: 144182 - DNA, 20 bp, Artificial
  CRISPR gRNA sequence
atctaaacccattaaaaatc

SEQ ID NO: 144183 - DNA, 20 bp, Artificial
  CRISPR gRNA sequence
cccattaaaaatctggttca

SEQ ID NO: 144184 - DNA, 20 bp, Artificial
  CRISPR gRNA sequence
ccattaaaaatctggttcaa

SEQ ID NO: 144185 - DNA, 20 bp, Artificial
  CRISPR gRNA sequence
attaaaaatctggttcaaag

SEQ ID NO: 144186 - DNA, 20 bp, Artificial
  CRISPR gRNA sequence
aaaatctggttcaaaggaga

SEQ ID NO: 144187 - DNA, 20 bp, Artificial
  CRISPR gRNA sequence
aaatctggttcaaaggagac

SEQ ID NO: 144188 - DNA, 20 bp, Artificial
  CRISPR gRNA sequence
aatctggttcaaaggagaca

SEQ ID NO: 144189 - DNA, 20 bp, Artificial
  CRISPR gRNA sequence
tggttcaaaggagacagggc

SEQ ID NO: 144190 - DNA, 20 bp, Artificial
  CRISPR gRNA sequence
gttcaaaggagacagggcaa

SEQ ID NO: 144191 - DNA, 20 bp, Artificial
  CRISPR gRNA sequence
aggagacagggcaagagtat

SEQ ID NO: 144192 - DNA, 20 bp, Artificial
  CRISPR gRNA sequence
ggagacagggcaagagtatt

SEQ ID NO: 144193 - DNA, 20 bp, Artificial
  CRISPR gRNA sequence
ggcaagagtattaggacctg

SEQ ID NO: 144194 - DNA, 20 bp, Artificial
  CRISPR gRNA sequence
cctgcagtcatttctttcct

SEQ ID NO: 144195 - DNA, 20 bp, Artificial
  CRISPR gRNA sequence
ttctttcctgagaatatgcc

SEQ ID NO: 144196 - DNA, 20 bp, Artificial
  CRISPR gRNA sequence
ctttcctgagaatatgccaa

SEQ ID NO: 144197 - DNA, 20 bp, Artificial
  CRISPR gRNA sequence
tcctgagaatatgccaagag

SEQ ID NO: 144198 - DNA, 20 bp, Artificial
  CRISPR gRNA sequence
aatatgccaagagaagctgc

SEQ ID NO: 144199 - DNA, 20 bp, Artificial
  CRISPR gRNA sequence
atatgccaagagaagctgct

SEQ ID NO: 144200 - DNA, 20 bp, Artificial
  CRISPR gRNA sequence
atgccaagagaagctgctgg

SEQ ID NO: 144201 - DNA, 20 bp, Artificial
  CRISPR gRNA sequence
tgccaagagaagctgctggg

SEQ ID NO: 144202 - DNA, 20 bp, Artificial
  CRISPR gRNA sequence
gagaagctgctgggaggctg

SEQ ID NO: 144203 - DNA, 20 bp, Artificial
  CRISPR gRNA sequence
tgctgggaggctgtggtgcc

SEQ ID NO: 144204 - DNA, 20 bp, Artificial
  CRISPR gRNA sequence
cccacctaaatcctataatg

SEQ ID NO: 144205 - DNA, 20 bp, Artificial
  CRISPR gRNA sequence
aatcctataatgcagcttcc

SEQ ID NO: 144206 - DNA, 20 bp, Artificial
  CRISPR gRNA sequence
agcttcctggcaacaatgtt

SEQ ID NO: 144207 - DNA, 20 bp, Artificial
  CRISPR gRNA sequence
caacaatgttaagttgcttg

SEQ ID NO: 144208 - DNA, 20 bp, Artificial
  CRISPR gRNA sequence
aacaatgttaagttgcttgt

SEQ ID NO: 144209 - DNA, 20 bp, Artificial
  CRISPR gRNA sequence
acaatgttaagttgcttgtg

SEQ ID NO: 144210 - DNA, 20 bp, Artificial
  CRISPR gRNA sequence
aatgttaagttgcttgtggg

SEQ ID NO: 144211 - DNA, 20 bp, Artificial
  CRISPR gRNA sequence
atgttaagttgcttgtgggg

SEQ ID NO: 144212 - DNA, 20 bp, Artificial
  CRISPR gRNA sequence
ttaagttgcttgtggggagg

SEQ ID NO: 144213 - DNA, 20 bp, Artificial
  CRISPR gRNA sequence
taagttgcttgtggggagga

SEQ ID NO: 144214 - DNA, 20 bp, Artificial
  CRISPR gRNA sequence
gttgcttgtggggaggaagg

SEQ ID NO: 144215 - DNA, 20 bp, Artificial
  CRISPR gRNA sequence
cttgtggggaggaaggcagc

SEQ ID NO: 144216 - DNA, 20 bp, Artificial
  CRISPR gRNA sequence
ttgtggggaggaaggcagct

SEQ ID NO: 144217 - DNA, 20 bp, Artificial
  CRISPR gRNA sequence
tggggaggaaggcagctggg

SEQ ID NO: 144218 - DNA, 20 bp, Artificial
  CRISPR gRNA sequence
ggaggaaggcagctgggcag

SEQ ID NO: 144219 - DNA, 20 bp, Artificial
  CRISPR gRNA sequence
aaggcagctgggcagaagtt

SEQ ID NO: 144220 - DNA, 20 bp, Artificial
  CRISPR gRNA sequence
agtttggaaaacctcatcta

SEQ ID NO: 144221 - DNA, 20 bp, Artificial
  CRISPR gRNA sequence
tttggaaaacctcatctaca

SEQ ID NO: 144222 - DNA, 20 bp, Artificial
  CRISPR gRNA sequence
acctcatctacagagactga

SEQ ID NO: 144223 - DNA, 20 bp, Artificial
  CRISPR gRNA sequence
tcatctacagagactgatgg

SEQ ID NO: 144224 - DNA, 20 bp, Artificial
  CRISPR gRNA sequence
ctacagagactgatggtggc

SEQ ID NO: 144225 - DNA, 20 bp, Artificial
  CRISPR gRNA sequence
agactgatggtggctagttc

SEQ ID NO: 144226 - DNA, 20 bp, Artificial
  CRISPR gRNA sequence
gactgatggtggctagttcc

SEQ ID NO: 144227 - DNA, 20 bp, Artificial
  CRISPR gRNA sequence
ctgatggtggctagttccag

SEQ ID NO: 144228 - DNA, 20 bp, Artificial
  CRISPR gRNA sequence
tggctagttccaggagtccc

SEQ ID NO: 144229 - DNA, 20 bp, Artificial
  CRISPR gRNA sequence
tccaggagtccccagaactc

SEQ ID NO: 144230 - DNA, 20 bp, Artificial
  CRISPR gRNA sequence
ggagtccccagaactccagc

SEQ ID NO: 144231 - DNA, 20 bp, Artificial
  CRISPR gRNA sequence
gagtccccagaactccagcc

SEQ ID NO: 144232 - DNA, 20 bp, Artificial
  CRISPR gRNA sequence
agtccccagaactccagcca

SEQ ID NO: 144233 - DNA, 20 bp, Artificial
  CRISPR gRNA sequence
gaactccagccagggatcac

SEQ ID NO: 144234 - DNA, 20 bp, Artificial
  CRISPR gRNA sequence
gatcacaagatgaaaaacta

SEQ ID NO: 144235 - DNA, 20 bp, Artificial
  CRISPR gRNA sequence
gaaaaactaaagccttgtcc

SEQ ID NO: 144236 - DNA, 20 bp, Artificial
  CRISPR gRNA sequence
aaaaactaaagccttgtccc

SEQ ID NO: 144237 - DNA, 20 bp, Artificial
  CRISPR gRNA sequence
aaactaaagccttgtcccag

SEQ ID NO: 144238 - DNA, 20 bp, Artificial
  CRISPR gRNA sequence
ctaaagccttgtcccaggag

SEQ ID NO: 144239 - DNA, 20 bp, Artificial
  CRISPR gRNA sequence
taaagccttgtcccaggagt

SEQ ID NO: 144240 - DNA, 20 bp, Artificial
  CRISPR gRNA sequence
aagccttgtcccaggagtgg

SEQ ID NO: 144241 - DNA, 20 bp, Artificial
  CRISPR gRNA sequence
ccttgtcccaggagtgggag

SEQ ID NO: 144242 - DNA, 20 bp, Artificial
  CRISPR gRNA sequence
cttgtcccaggagtgggaga

SEQ ID NO: 144243 - DNA, 20 bp, Artificial
  CRISPR gRNA sequence
agtgggagaaggtatactga

SEQ ID NO: 144244 - DNA, 20 bp, Artificial
  CRISPR gRNA sequence
agaaggtatactgacagcta

SEQ ID NO: 144245 - DNA, 20 bp, Artificial
  CRISPR gRNA sequence
gaaggtatactgacagctac

SEQ ID NO: 144246 - DNA, 20 bp, Artificial
  CRISPR gRNA sequence
aaggtatactgacagctaca

SEQ ID NO: 144247 - DNA, 20 bp, Artificial
  CRISPR gRNA sequence
acagggatgttaaaattttc

SEQ ID NO: 144248 - DNA, 20 bp, Artificial
  CRISPR gRNA sequence
ggatgttaaaattttctagc

SEQ ID NO: 144249 - DNA, 20 bp, Artificial
  CRISPR gRNA sequence
gatgttaaaattttctagct

SEQ ID NO: 144250 - DNA, 20 bp, Artificial
  CRISPR gRNA sequence
gttaaaattttctagctggg

SEQ ID NO: 144251 - DNA, 20 bp, Artificial
  CRISPR gRNA sequence
taaaattttctagctgggaa

SEQ ID NO: 144252 - DNA, 20 bp, Artificial
  CRISPR gRNA sequence
tagctgggaagagctctttg

SEQ ID NO: 144253 - DNA, 20 bp, Artificial
  CRISPR gRNA sequence
gaaacccaaatgtgactgaa

SEQ ID NO: 144254 - DNA, 20 bp, Artificial
  CRISPR gRNA sequence
aaatgtgactgaaaagctgt

SEQ ID NO: 144255 - DNA, 20 bp, Artificial
  CRISPR gRNA sequence
ctgaaaagctgtgagccaaa

SEQ ID NO: 144256 - DNA, 20 bp, Artificial
  CRISPR gRNA sequence
gctgtgagccaaatggttcc

SEQ ID NO: 144257 - DNA, 20 bp, Artificial
  CRISPR gRNA sequence
gtgagccaaatggttccaag

SEQ ID NO: 144258 - DNA, 20 bp, Artificial
  CRISPR gRNA sequence
ttccaagcagctcttcaaca

SEQ ID NO: 144259 - DNA, 20 bp, Artificial
  CRISPR gRNA sequence
aagcagctcttcaacaaagc

SEQ ID NO: 144260 - DNA, 20 bp, Artificial
  CRISPR gRNA sequence
cagctcttcaacaaagcaag

SEQ ID NO: 144261 - DNA, 20 bp, Artificial
  CRISPR gRNA sequence
aagcaagaagctttcctttt

SEQ ID NO: 144262 - DNA, 20 bp, Artificial
  CRISPR gRNA sequence
agaagctttcctttttggcc

SEQ ID NO: 144263 - DNA, 20 bp, Artificial
  CRISPR gRNA sequence
gaagctttcctttttggcct

SEQ ID NO: 144264 - DNA, 20 bp, Artificial
  CRISPR gRNA sequence
tttcctttttggcctaggtt

SEQ ID NO: 144265 - DNA, 20 bp, Artificial
  CRISPR gRNA sequence
ttggcctaggttaagacatt

SEQ ID NO: 144266 - DNA, 20 bp, Artificial
  CRISPR gRNA sequence
atccgtccctcattcctcta

SEQ ID NO: 144267 - DNA, 20 bp, Artificial
  CRISPR gRNA sequence
cgtccctcattcctctacag

SEQ ID NO: 144268 - DNA, 20 bp, Artificial
  CRISPR gRNA sequence
gtccctcattcctctacagc

SEQ ID NO: 144269 - DNA, 20 bp, Artificial
  CRISPR gRNA sequence
ctcattcctctacagcagga

SEQ ID NO: 144270 - DNA, 20 bp, Artificial
  CRISPR gRNA sequence
tcattcctctacagcaggac

SEQ ID NO: 144271 - DNA, 20 bp, Artificial
  CRISPR gRNA sequence
cctctacagcaggacaggtc

SEQ ID NO: 144272 - DNA, 20 bp, Artificial
  CRISPR gRNA sequence
ctctacagcaggacaggtct

SEQ ID NO: 144273 - DNA, 20 bp, Artificial
  CRISPR gRNA sequence
tctacagcaggacaggtctg

SEQ ID NO: 144274 - DNA, 20 bp, Artificial
  CRISPR gRNA sequence
gacaggtctggggaccctca

SEQ ID NO: 144275 - DNA, 20 bp, Artificial
  CRISPR gRNA sequence
tagcttttttacattaatta

SEQ ID NO: 144276 - DNA, 20 bp, Artificial
  CRISPR gRNA sequence
gcttttttacattaattaca

SEQ ID NO: 144277 - DNA, 20 bp, Artificial
  CRISPR gRNA sequence
acattaattacagagaaaat

SEQ ID NO: 144278 - DNA, 20 bp, Artificial
  CRISPR gRNA sequence
attacagagaaaataagctc

SEQ ID NO: 144279 - DNA, 20 bp, Artificial
  CRISPR gRNA sequence
ttacagagaaaataagctct

SEQ ID NO: 144280 - DNA, 20 bp, Artificial
  CRISPR gRNA sequence
aataagctctgggtttttga

SEQ ID NO: 144281 - DNA, 20 bp, Artificial
  CRISPR gRNA sequence
ataagctctgggtttttgaa

SEQ ID NO: 144282 - DNA, 20 bp, Artificial
  CRISPR gRNA sequence
taagctctgggtttttgaaa

SEQ ID NO: 144283 - DNA, 20 bp, Artificial
  CRISPR gRNA sequence
gggtttttgaaagggaaata

SEQ ID NO: 144284 - DNA, 20 bp, Artificial
  CRISPR gRNA sequence
gaaataaagtttccttcctg

SEQ ID NO: 144285 - DNA, 20 bp, Artificial
  CRISPR gRNA sequence
ttcctgaagctcatcactat

SEQ ID NO: 144286 - DNA, 20 bp, Artificial
  CRISPR gRNA sequence
tcctgaagctcatcactatt

SEQ ID NO: 144287 - DNA, 20 bp, Artificial
  CRISPR gRNA sequence
actattaggaacattccaat

SEQ ID NO: 144288 - DNA, 20 bp, Artificial
  CRISPR gRNA sequence
acattccaatgagctgccta

SEQ ID NO: 144289 - DNA, 20 bp, Artificial
  CRISPR gRNA sequence
attccaatgagctgcctaaa

SEQ ID NO: 144290 - DNA, 20 bp, Artificial
  CRISPR gRNA sequence
aatgagctgcctaaagagtc

SEQ ID NO: 144291 - DNA, 20 bp, Artificial
  CRISPR gRNA sequence
gcctaaagagtctggaaatg

SEQ ID NO: 144292 - DNA, 20 bp, Artificial
  CRISPR gRNA sequence
tctggaaatgaagactccta

SEQ ID NO: 144293 - DNA, 20 bp, Artificial
  CRISPR gRNA sequence
ggaaatgaagactcctacag

SEQ ID NO: 144294 - DNA, 20 bp, Artificial
  CRISPR gRNA sequence
gaaatgaagactcctacaga

SEQ ID NO: 144295 - DNA, 20 bp, Artificial
  CRISPR gRNA sequence
gactcctacagaaggtgcct

SEQ ID NO: 144296 - DNA, 20 bp, Artificial
  CRISPR gRNA sequence
cctacagaaggtgcctgagc

SEQ ID NO: 144297 - DNA, 20 bp, Artificial
  CRISPR gRNA sequence
agaaggtgcctgagccagtg

SEQ ID NO: 144298 - DNA, 20 bp, Artificial
  CRISPR gRNA sequence
tgcctgagccagtgaagatg

SEQ ID NO: 144299 - DNA, 20 bp, Artificial
  CRISPR gRNA sequence
ctgagccagtgaagatgaag

SEQ ID NO: 144300 - DNA, 20 bp, Artificial
  CRISPR gRNA sequence
gaattctgcaacaaatcttc

SEQ ID NO: 144301 - DNA, 20 bp, Artificial
  CRISPR gRNA sequence
aattctgcaacaaatcttct

SEQ ID NO: 144302 - DNA, 20 bp, Artificial
  CRISPR gRNA sequence
gcaacaaatcttctgggcta

SEQ ID NO: 144303 - DNA, 20 bp, Artificial
  CRISPR gRNA sequence
tgggctaaagctctgtgccc

SEQ ID NO: 144304 - DNA, 20 bp, Artificial
  CRISPR gRNA sequence
ggctaaagctctgtgcccca

SEQ ID NO: 144305 - DNA, 20 bp, Artificial
  CRISPR gRNA sequence
ctaaagctctgtgccccaga

SEQ ID NO: 144306 - DNA, 20 bp, Artificial
  CRISPR gRNA sequence
ctctgtgccccagagagtta

SEQ ID NO: 144307 - DNA, 20 bp, Artificial
  CRISPR gRNA sequence
cagagagttaaagtatctgc

SEQ ID NO: 144308 - DNA, 20 bp, Artificial
  CRISPR gRNA sequence
agagagttaaagtatctgca

SEQ ID NO: 144309 - DNA, 20 bp, Artificial
  CRISPR gRNA sequence
gagttaaagtatctgcaagg

SEQ ID NO: 144310 - DNA, 20 bp, Artificial
  CRISPR gRNA sequence
ctctgtcttaaatgaacctg

SEQ ID NO: 144311 - DNA, 20 bp, Artificial
  CRISPR gRNA sequence
tgtcttaaatgaacctgtgg

SEQ ID NO: 144312 - DNA, 20 bp, Artificial
  CRISPR gRNA sequence
gtgccttcgcttgcaaaaat

SEQ ID NO: 144313 - DNA, 20 bp, Artificial
  CRISPR gRNA sequence
caaaaatgagaaccattcaa

SEQ ID NO: 144314 - DNA, 20 bp, Artificial
  CRISPR gRNA sequence
gaaccattcaacagaaatct

SEQ ID NO: 144315 - DNA, 20 bp, Artificial
  CRISPR gRNA sequence
aaccattcaacagaaatctt

SEQ ID NO: 144316 - DNA, 20 bp, Artificial
  CRISPR gRNA sequence
accattcaacagaaatcttg

SEQ ID NO: 144317 - DNA, 20 bp, Artificial
  CRISPR gRNA sequence
tcaacagaaatcttggggtt

SEQ ID NO: 144318 - DNA, 20 bp, Artificial
  CRISPR gRNA sequence
caacagaaatcttggggttg

SEQ ID NO: 144319 - DNA, 20 bp, Artificial
  CRISPR gRNA sequence
ggttgaggactgaaacaatg

SEQ ID NO: 144320 - DNA, 20 bp, Artificial
  CRISPR gRNA sequence
gaggactgaaacaatgaagc

SEQ ID NO: 144321 - DNA, 20 bp, Artificial
  CRISPR gRNA sequence
aggactgaaacaatgaagca

SEQ ID NO: 144322 - DNA, 20 bp, Artificial
  CRISPR gRNA sequence
actgaaacaatgaagcaagg

SEQ ID NO: 144323 - DNA, 20 bp, Artificial
  CRISPR gRNA sequence
tgaaacaatgaagcaaggca

SEQ ID NO: 144324 - DNA, 20 bp, Artificial
  CRISPR gRNA sequence
caatgaagcaaggcagagct

SEQ ID NO: 144325 - DNA, 20 bp, Artificial
  CRISPR gRNA sequence
agctcagtcatctgcaatcc

SEQ ID NO: 144326 - DNA, 20 bp, Artificial
  CRISPR gRNA sequence
gctcagtcatctgcaatcct

SEQ ID NO: 144327 - DNA, 20 bp, Artificial
  CRISPR gRNA sequence
tctgcaatcctgggtatcgt

SEQ ID NO: 144328 - DNA, 20 bp, Artificial
  CRISPR gRNA sequence
tgggtatcgtaagcacacgt

SEQ ID NO: 144329 - DNA, 20 bp, Artificial
  CRISPR gRNA sequence
ggtatcgtaagcacacgtga

SEQ ID NO: 144330 - DNA, 20 bp, Artificial
  CRISPR gRNA sequence
tatcgtaagcacacgtgaga

SEQ ID NO: 144331 - DNA, 20 bp, Artificial
  CRISPR gRNA sequence
atcgtaagcacacgtgagag

SEQ ID NO: 144332 - DNA, 20 bp, Artificial
  CRISPR gRNA sequence
gtaagcacacgtgagagagg

SEQ ID NO: 144333 - DNA, 20 bp, Artificial
  CRISPR gRNA sequence
aagcacacgtgagagaggta

SEQ ID NO: 144334 - DNA, 20 bp, Artificial
  CRISPR gRNA sequence
acacgtgagagaggtagaga

SEQ ID NO: 144335 - DNA, 20 bp, Artificial
  CRISPR gRNA sequence
acgtgagagaggtagagaaa

SEQ ID NO: 144336 - DNA, 20 bp, Artificial
  CRISPR gRNA sequence
catacacactccactttcct

SEQ ID NO: 144337 - DNA, 20 bp, Artificial
  CRISPR gRNA sequence
cactttcctaagctttctct

SEQ ID NO: 144338 - DNA, 20 bp, Artificial
  CRISPR gRNA sequence
gcctattactatgttaactt

SEQ ID NO: 144339 - DNA, 20 bp, Artificial
  CRISPR gRNA sequence
tactatgttaacttcagatg

SEQ ID NO: 144340 - DNA, 20 bp, Artificial
  CRISPR gRNA sequence
aacaattcctaaactgatct

SEQ ID NO: 144341 - DNA, 20 bp, Artificial
  CRISPR gRNA sequence
acaattcctaaactgatctc

SEQ ID NO: 144342 - DNA, 20 bp, Artificial
  CRISPR gRNA sequence
aactgatctcaggatacttt

SEQ ID NO: 144343 - DNA, 20 bp, Artificial
  CRISPR gRNA sequence
ctgatctcaggatactttta

SEQ ID NO: 144344 - DNA, 20 bp, Artificial
  CRISPR gRNA sequence
tacttttagagttattttca

SEQ ID NO: 144345 - DNA, 20 bp, Artificial
  CRISPR gRNA sequence
cttttagagttattttcaca

SEQ ID NO: 144346 - DNA, 20 bp, Artificial
  CRISPR gRNA sequence
ttttagagttattttcacag

SEQ ID NO: 144347 - DNA, 20 bp, Artificial
  CRISPR gRNA sequence
tagagttattttcacagagg

SEQ ID NO: 144348 - DNA, 20 bp, Artificial
  CRISPR gRNA sequence
agttattttcacagaggaag

SEQ ID NO: 144349 - DNA, 20 bp, Artificial
  CRISPR gRNA sequence
cacagaggaagtggttaacc

SEQ ID NO: 144350 - DNA, 20 bp, Artificial
  CRISPR gRNA sequence
gtggttaaccaagtctacgt

SEQ ID NO: 144351 - DNA, 20 bp, Artificial
  CRISPR gRNA sequence
cgtttcatttatgacaaaaa

SEQ ID NO: 144352 - DNA, 20 bp, Artificial
  CRISPR gRNA sequence
catttatgacaaaaatggca

SEQ ID NO: 144353 - DNA, 20 bp, Artificial
  CRISPR gRNA sequence
atttatgacaaaaatggcaa

SEQ ID NO: 144354 - DNA, 20 bp, Artificial
  CRISPR gRNA sequence
tttatgacaaaaatggcaaa

SEQ ID NO: 144355 - DNA, 20 bp, Artificial
  CRISPR gRNA sequence
atgacaaaaatggcaaaggg

SEQ ID NO: 144356 - DNA, 20 bp, Artificial
  CRISPR gRNA sequence
tgacaaaaatggcaaagggc

SEQ ID NO: 144357 - DNA, 20 bp, Artificial
  CRISPR gRNA sequence
gacaaaaatggcaaagggca

SEQ ID NO: 144358 - DNA, 20 bp, Artificial
  CRISPR gRNA sequence
aaatggcaaagggcagggaa

SEQ ID NO: 144359 - DNA, 20 bp, Artificial
  CRISPR gRNA sequence
tggcaaagggcagggaatag

SEQ ID NO: 144360 - DNA, 20 bp, Artificial
  CRISPR gRNA sequence
ggcaaagggcagggaataga

SEQ ID NO: 144361 - DNA, 20 bp, Artificial
  CRISPR gRNA sequence
gctctgtttcactcactttc

SEQ ID NO: 144362 - DNA, 20 bp, Artificial
  CRISPR gRNA sequence
tttcactcactttccagttt

SEQ ID NO: 144363 - DNA, 20 bp, Artificial
  CRISPR gRNA sequence
ttcactcactttccagtttt

SEQ ID NO: 144364 - DNA, 20 bp, Artificial
  CRISPR gRNA sequence
tcactcactttccagttttg

SEQ ID NO: 144365 - DNA, 20 bp, Artificial
  CRISPR gRNA sequence
cactcactttccagttttgg

SEQ ID NO: 144366 - DNA, 20 bp, Artificial
  CRISPR gRNA sequence
actcactttccagttttggg

SEQ ID NO: 144367 - DNA, 20 bp, Artificial
  CRISPR gRNA sequence
gggtcaaaatgaccaatgta

SEQ ID NO: 144368 - DNA, 20 bp, Artificial
  CRISPR gRNA sequence
atgaccaatgtaaagactgc

SEQ ID NO: 144369 - DNA, 20 bp, Artificial
  CRISPR gRNA sequence
atgtaaagactgcaagtgtt

SEQ ID NO: 144370 - DNA, 20 bp, Artificial
  CRISPR gRNA sequence
aagactgcaagtgttaagac

SEQ ID NO: 144371 - DNA, 20 bp, Artificial
  CRISPR gRNA sequence
agactgcaagtgttaagaca

SEQ ID NO: 144372 - DNA, 20 bp, Artificial
  CRISPR gRNA sequence
gacaaggacacattttacaa

SEQ ID NO: 144373 - DNA, 20 bp, Artificial
  CRISPR gRNA sequence
acaaggacacattttacaaa

SEQ ID NO: 144374 - DNA, 20 bp, Artificial
  CRISPR gRNA sequence
aaggacacattttacaaaag

SEQ ID NO: 144375 - DNA, 20 bp, Artificial
  CRISPR gRNA sequence
caaaaggagtacaaataaaa

SEQ ID NO: 144376 - DNA, 20 bp, Artificial
  CRISPR gRNA sequence
ataaaaaagccaacaaatct

SEQ ID NO: 144377 - DNA, 20 bp, Artificial
  CRISPR gRNA sequence
tctaagaaatgaaatccctc

SEQ ID NO: 144378 - DNA, 20 bp, Artificial
  CRISPR gRNA sequence
ctaagaaatgaaatccctca

SEQ ID NO: 144379 - DNA, 20 bp, Artificial
  CRISPR gRNA sequence
atgaaatccctcaaggcaca

SEQ ID NO: 144380 - DNA, 20 bp, Artificial
  CRISPR gRNA sequence
tgaaatccctcaaggcacac

SEQ ID NO: 144381 - DNA, 20 bp, Artificial
  CRISPR gRNA sequence
aatccctcaaggcacacagg

SEQ ID NO: 144382 - DNA, 20 bp, Artificial
  CRISPR gRNA sequence
ccctcaaggcacacaggaag

SEQ ID NO: 144383 - DNA, 20 bp, Artificial
  CRISPR gRNA sequence
tcaaggcacacaggaagcag

SEQ ID NO: 144384 - DNA, 20 bp, Artificial
  CRISPR gRNA sequence
acacaggaagcagcagtcca

SEQ ID NO: 144385 - DNA, 20 bp, Artificial
  CRISPR gRNA sequence
ggaagcagcagtccacagta

SEQ ID NO: 144386 - DNA, 20 bp, Artificial
  CRISPR gRNA sequence
gaagcagcagtccacagtaa

SEQ ID NO: 144387 - DNA, 20 bp, Artificial
  CRISPR gRNA sequence
agcagtccacagtaaaggaa

SEQ ID NO: 144388 - DNA, 20 bp, Artificial
  CRISPR gRNA sequence
tccacagtaaaggaatagat

SEQ ID NO: 144389 - DNA, 20 bp, Artificial
  CRISPR gRNA sequence
ggaatagataagttatatga

SEQ ID NO: 144390 - DNA, 20 bp, Artificial
  CRISPR gRNA sequence
gccaaaaatacactttgctg

SEQ ID NO: 144391 - DNA, 20 bp, Artificial
  CRISPR gRNA sequence
ccaaaaatacactttgctgc

SEQ ID NO: 144392 - DNA, 20 bp, Artificial
  CRISPR gRNA sequence
cactttgctgcaggctccac

SEQ ID NO: 144393 - DNA, 20 bp, Artificial
  CRISPR gRNA sequence
actttgctgcaggctccact

SEQ ID NO: 144394 - DNA, 20 bp, Artificial
  CRISPR gRNA sequence
ctgactcatgaatatgcaac

SEQ ID NO: 144395 - DNA, 20 bp, Artificial
  CRISPR gRNA sequence
atatgcaacaagtgtattta

SEQ ID NO: 144396 - DNA, 20 bp, Artificial
  CRISPR gRNA sequence
tatcctctgctaatcaaata

SEQ ID NO: 144397 - DNA, 20 bp, Artificial
  CRISPR gRNA sequence
atcctctgctaatcaaatac

SEQ ID NO: 144398 - DNA, 20 bp, Artificial
  CRISPR gRNA sequence
tcaaatacaggactgcctca

SEQ ID NO: 144399 - DNA, 20 bp, Artificial
  CRISPR gRNA sequence
caaatacaggactgcctcac

SEQ ID NO: 144400 - DNA, 20 bp, Artificial
  CRISPR gRNA sequence
aaatacaggactgcctcaca

SEQ ID NO: 144401 - DNA, 20 bp, Artificial
  CRISPR gRNA sequence
ggactgcctcacagggcctt

SEQ ID NO: 144402 - DNA, 20 bp, Artificial
  CRISPR gRNA sequence
gactgcctcacagggccttt

SEQ ID NO: 144403 - DNA, 20 bp, Artificial
  CRISPR gRNA sequence
ctcacagggcctttgggcct

SEQ ID NO: 144404 - DNA, 20 bp, Artificial
  CRISPR gRNA sequence
agggcctttgggccttggca

SEQ ID NO: 144405 - DNA, 20 bp, Artificial
  CRISPR gRNA sequence
gggcctttgggccttggcat

SEQ ID NO: 144406 - DNA, 20 bp, Artificial
  CRISPR gRNA sequence
cctttgggccttggcatggg

SEQ ID NO: 144407 - DNA, 20 bp, Artificial
  CRISPR gRNA sequence
ttgggccttggcatgggtag

SEQ ID NO: 144408 - DNA, 20 bp, Artificial
  CRISPR gRNA sequence
gttacaatgatttccctgca

SEQ ID NO: 144409 - DNA, 20 bp, Artificial
  CRISPR gRNA sequence
ttacaatgatttccctgcat

SEQ ID NO: 144410 - DNA, 20 bp, Artificial
  CRISPR gRNA sequence
caatgatttccctgcatagg

SEQ ID NO: 144411 - DNA, 20 bp, Artificial
  CRISPR gRNA sequence
tttccctgcataggtagaat

SEQ ID NO: 144412 - DNA, 20 bp, Artificial
  CRISPR gRNA sequence
ttccctgcataggtagaatg

SEQ ID NO: 144413 - DNA, 20 bp, Artificial
  CRISPR gRNA sequence
tccctgcataggtagaatga

SEQ ID NO: 144414 - DNA, 20 bp, Artificial
  CRISPR gRNA sequence
ccctgcataggtagaatgag

SEQ ID NO: 144415 - DNA, 20 bp, Artificial
  CRISPR gRNA sequence
aggtagaatgaggggaaatc

SEQ ID NO: 144416 - DNA, 20 bp, Artificial
  CRISPR gRNA sequence
gtagaatgaggggaaatcga

SEQ ID NO: 144417 - DNA, 20 bp, Artificial
  CRISPR gRNA sequence
gaatgaggggaaatcgagag

SEQ ID NO: 144418 - DNA, 20 bp, Artificial
  CRISPR gRNA sequence
cgagagaagccgcccaatcg

SEQ ID NO: 144419 - DNA, 20 bp, Artificial
  CRISPR gRNA sequence
aatcgtggtgaacctgaacc

SEQ ID NO: 144420 - DNA, 20 bp, Artificial
  CRISPR gRNA sequence
gtgaacctgaacctagatta

SEQ ID NO: 144421 - DNA, 20 bp, Artificial
  CRISPR gRNA sequence
tgaacctgaacctagattaa

SEQ ID NO: 144422 - DNA, 20 bp, Artificial
  CRISPR gRNA sequence
cctgaacctagattaaagga

SEQ ID NO: 144423 - DNA, 20 bp, Artificial
  CRISPR gRNA sequence
gaacctagattaaaggaaag

SEQ ID NO: 144424 - DNA, 20 bp, Artificial
  CRISPR gRNA sequence
aacctagattaaaggaaagc

SEQ ID NO: 144425 - DNA, 20 bp, Artificial
  CRISPR gRNA sequence
acctagattaaaggaaagca

SEQ ID NO: 144426 - DNA, 20 bp, Artificial
  CRISPR gRNA sequence
aggaaagcagggaacaaaca

SEQ ID NO: 144427 - DNA, 20 bp, Artificial
  CRISPR gRNA sequence
agcagggaacaaacacagtg

SEQ ID NO: 144428 - DNA, 20 bp, Artificial
  CRISPR gRNA sequence
gggaacaaacacagtgaagc

SEQ ID NO: 144429 - DNA, 20 bp, Artificial
  CRISPR gRNA sequence
aaacacagtgaagcaagttg

SEQ ID NO: 144430 - DNA, 20 bp, Artificial
  CRISPR gRNA sequence
acagtgaagcaagttgtggt

SEQ ID NO: 144431 - DNA, 20 bp, Artificial
  CRISPR gRNA sequence
cagtgaagcaagttgtggtc

SEQ ID NO: 144432 - DNA, 20 bp, Artificial
  CRISPR gRNA sequence
caagttgtggtcaggaacac

SEQ ID NO: 144433 - DNA, 20 bp, Artificial
  CRISPR gRNA sequence
aagttgtggtcaggaacact

SEQ ID NO: 144434 - DNA, 20 bp, Artificial
  CRISPR gRNA sequence
ggtcaggaacactgggcata

SEQ ID NO: 144435 - DNA, 20 bp, Artificial
  CRISPR gRNA sequence
gtcaggaacactgggcatat

SEQ ID NO: 144436 - DNA, 20 bp, Artificial
  CRISPR gRNA sequence
acacacgcatatatataaat

SEQ ID NO: 144437 - DNA, 20 bp, Artificial
  CRISPR gRNA sequence
catatatataaataagtact

SEQ ID NO: 144438 - DNA, 20 bp, Artificial
  CRISPR gRNA sequence
atatatataaataagtactg

SEQ ID NO: 144439 - DNA, 20 bp, Artificial
  CRISPR gRNA sequence
tatatataaataagtactga

SEQ ID NO: 144440 - DNA, 20 bp, Artificial
  CRISPR gRNA sequence
tataaataagtactgagggc

SEQ ID NO: 144441 - DNA, 20 bp, Artificial
  CRISPR gRNA sequence
ataaataagtactgagggct

SEQ ID NO: 144442 - DNA, 20 bp, Artificial
  CRISPR gRNA sequence
gtactgagggctgggcgtga

SEQ ID NO: 144443 - DNA, 20 bp, Artificial
  CRISPR gRNA sequence
atggctcatgcctgtaatcc

SEQ ID NO: 144444 - DNA, 20 bp, Artificial
  CRISPR gRNA sequence
tgcctgtaatcccagcactt

SEQ ID NO: 144445 - DNA, 20 bp, Artificial
  CRISPR gRNA sequence
gcctgtaatcccagcacttt

SEQ ID NO: 144446 - DNA, 20 bp, Artificial
  CRISPR gRNA sequence
ctgtaatcccagcactttgg

SEQ ID NO: 144447 - DNA, 20 bp, Artificial
  CRISPR gRNA sequence
tgtaatcccagcactttggg

SEQ ID NO: 144448 - DNA, 20 bp, Artificial
  CRISPR gRNA sequence
tcccagcactttgggaggcc

SEQ ID NO: 144449 - DNA, 20 bp, Artificial
  CRISPR gRNA sequence
cccagcactttgggaggccg

SEQ ID NO: 144450 - DNA, 20 bp, Artificial
  CRISPR gRNA sequence
agcactttgggaggccgagg

SEQ ID NO: 144451 - DNA, 20 bp, Artificial
  CRISPR gRNA sequence
gcactttgggaggccgaggc

SEQ ID NO: 144452 - DNA, 20 bp, Artificial
  CRISPR gRNA sequence
ctttgggaggccgaggcggg

SEQ ID NO: 144453 - DNA, 20 bp, Artificial
  CRISPR gRNA sequence
ccgaggcgggcggatcacct

SEQ ID NO: 144454 - DNA, 20 bp, Artificial
  CRISPR gRNA sequence
cgaggcgggcggatcacctg

SEQ ID NO: 144455 - DNA, 20 bp, Artificial
  CRISPR gRNA sequence
gcgggcggatcacctgaggt

SEQ ID NO: 144456 - DNA, 20 bp, Artificial
  CRISPR gRNA sequence
cgggcggatcacctgaggtt

SEQ ID NO: 144457 - DNA, 20 bp, Artificial
  CRISPR gRNA sequence
ggcggatcacctgaggttag

SEQ ID NO: 144458 - DNA, 20 bp, Artificial
  CRISPR gRNA sequence
gatcacctgaggttaggagt

SEQ ID NO: 144459 - DNA, 20 bp, Artificial
  CRISPR gRNA sequence
tcacctgaggttaggagtta

SEQ ID NO: 144460 - DNA, 20 bp, Artificial
  CRISPR gRNA sequence
tgaggttaggagttagagac

SEQ ID NO: 144461 - DNA, 20 bp, Artificial
  CRISPR gRNA sequence
ttaggagttagagaccagcc

SEQ ID NO: 144462 - DNA, 20 bp, Artificial
  CRISPR gRNA sequence
tctactaaaaatacaaaaat

SEQ ID NO: 144463 - DNA, 20 bp, Artificial
  CRISPR gRNA sequence
ctaaaaatacaaaaatcagc

SEQ ID NO: 144464 - DNA, 20 bp, Artificial
  CRISPR gRNA sequence
taaaaatacaaaaatcagcc

SEQ ID NO: 144465 - DNA, 20 bp, Artificial
  CRISPR gRNA sequence
atacaaaaatcagccgggca

SEQ ID NO: 144466 - DNA, 20 bp, Artificial
  CRISPR gRNA sequence
caaaaatcagccgggcatag

SEQ ID NO: 144467 - DNA, 20 bp, Artificial
  CRISPR gRNA sequence
gtggcacgtgcctataatcc

SEQ ID NO: 144468 - DNA, 20 bp, Artificial
  CRISPR gRNA sequence
tgcctataatcccagctact

SEQ ID NO: 144469 - DNA, 20 bp, Artificial
  CRISPR gRNA sequence
gcctataatcccagctactc

SEQ ID NO: 144470 - DNA, 20 bp, Artificial
  CRISPR gRNA sequence
ctataatcccagctactcgg

SEQ ID NO: 144471 - DNA, 20 bp, Artificial
  CRISPR gRNA sequence
tataatcccagctactcggg

SEQ ID NO: 144472 - DNA, 20 bp, Artificial
  CRISPR gRNA sequence
tcccagctactcgggaggct

SEQ ID NO: 144473 - DNA, 20 bp, Artificial
  CRISPR gRNA sequence
cccagctactcgggaggctg

SEQ ID NO: 144474 - DNA, 20 bp, Artificial
  CRISPR gRNA sequence
agctactcgggaggctgagg

SEQ ID NO: 144475 - DNA, 20 bp, Artificial
  CRISPR gRNA sequence
gctactcgggaggctgaggc

SEQ ID NO: 144476 - DNA, 20 bp, Artificial
  CRISPR gRNA sequence
tactcgggaggctgaggcag

SEQ ID NO: 144477 - DNA, 20 bp, Artificial
  CRISPR gRNA sequence
gcaggagaatcgcttgaacc

SEQ ID NO: 144478 - DNA, 20 bp, Artificial
  CRISPR gRNA sequence
caggagaatcgcttgaacct

SEQ ID NO: 144479 - DNA, 20 bp, Artificial
  CRISPR gRNA sequence
ggagaatcgcttgaacctgg

SEQ ID NO: 144480 - DNA, 20 bp, Artificial
  CRISPR gRNA sequence
gagaatcgcttgaacctggg

SEQ ID NO: 144481 - DNA, 20 bp, Artificial
  CRISPR gRNA sequence
aatcgcttgaacctgggagg

SEQ ID NO: 144482 - DNA, 20 bp, Artificial
  CRISPR gRNA sequence
cgcttgaacctgggaggcgg

SEQ ID NO: 144483 - DNA, 20 bp, Artificial
  CRISPR gRNA sequence
aacctgggaggcggaagctg

SEQ ID NO: 144484 - DNA, 20 bp, Artificial
  CRISPR gRNA sequence
tgggaggcggaagctgcagt

SEQ ID NO: 144485 - DNA, 20 bp, Artificial
  CRISPR gRNA sequence
ggcggaagctgcagtgagct

SEQ ID NO: 144486 - DNA, 20 bp, Artificial
  CRISPR gRNA sequence
agctgcagtgagctgagatc

SEQ ID NO: 144487 - DNA, 20 bp, Artificial
  CRISPR gRNA sequence
atcaagccactgcacttcat

SEQ ID NO: 144488 - DNA, 20 bp, Artificial
  CRISPR gRNA sequence
ccactgcacttcatcagtct

SEQ ID NO: 144489 - DNA, 20 bp, Artificial
  CRISPR gRNA sequence
cttcatcagtctgagtgaca

SEQ ID NO: 144490 - DNA, 20 bp, Artificial
  CRISPR gRNA sequence
atcagtctgagtgacacagc

SEQ ID NO: 144491 - DNA, 20 bp, Artificial
  CRISPR gRNA sequence
agcaagacctgtctcctaaa

SEQ ID NO: 144492 - DNA, 20 bp, Artificial
  CRISPR gRNA sequence
ctgtctcctaaaaagaaaaa

SEQ ID NO: 144493 - DNA, 20 bp, Artificial
  CRISPR gRNA sequence
tgtctcctaaaaagaaaaaa

SEQ ID NO: 144494 - DNA, 20 bp, Artificial
  CRISPR gRNA sequence
tatatctctatatatatatc

SEQ ID NO: 144495 - DNA, 20 bp, Artificial
  CRISPR gRNA sequence
atatctctatatatatatca

SEQ ID NO: 144496 - DNA, 20 bp, Artificial
  CRISPR gRNA sequence
tatatatcaaggtatatata

SEQ ID NO: 144497 - DNA, 20 bp, Artificial
  CRISPR gRNA sequence
tcaaggtatatatatagcta

SEQ ID NO: 144498 - DNA, 20 bp, Artificial
  CRISPR gRNA sequence
tagctacagatatatatatc

SEQ ID NO: 144499 - DNA, 20 bp, Artificial
  CRISPR gRNA sequence
agctacagatatatatatca

SEQ ID NO: 144500 - DNA, 20 bp, Artificial
  CRISPR gRNA sequence
tatatatcaaggtatatata

SEQ ID NO: 144501 - DNA, 20 bp, Artificial
  CRISPR gRNA sequence
tcaaggtatatatatagcta

SEQ ID NO: 144502 - DNA, 20 bp, Artificial
  CRISPR gRNA sequence
tagctatagatatacatatc

SEQ ID NO: 144503 - DNA, 20 bp, Artificial
  CRISPR gRNA sequence
agctatagatatacatatca

SEQ ID NO: 144504 - DNA, 20 bp, Artificial
  CRISPR gRNA sequence
tatacatatcaaggtatata

SEQ ID NO: 144505 - DNA, 20 bp, Artificial
  CRISPR gRNA sequence
tacatatcaaggtatatata

SEQ ID NO: 144506 - DNA, 20 bp, Artificial
  CRISPR gRNA sequence
gagacatacatatatatatc

SEQ ID NO: 144507 - DNA, 20 bp, Artificial
  CRISPR gRNA sequence
agacatacatatatatatca

SEQ ID NO: 144508 - DNA, 20 bp, Artificial
  CRISPR gRNA sequence
tatatatcaaggtatatata

SEQ ID NO: 144509 - DNA, 20 bp, Artificial
  CRISPR gRNA sequence
tcaaggtatatatatagcta

SEQ ID NO: 144510 - DNA, 20 bp, Artificial
  CRISPR gRNA sequence
tagctatagatatatatatc

SEQ ID NO: 144511 - DNA, 20 bp, Artificial
  CRISPR gRNA sequence
agctatagatatatatatca

SEQ ID NO: 144512 - DNA, 20 bp, Artificial
  CRISPR gRNA sequence
tatatatcaaggtatatata

SEQ ID NO: 144513 - DNA, 20 bp, Artificial
  CRISPR gRNA sequence
tcaaggtatatatatagcta

SEQ ID NO: 144514 - DNA, 20 bp, Artificial
  CRISPR gRNA sequence
tagctatagatatacatatc

SEQ ID NO: 144515 - DNA, 20 bp, Artificial
  CRISPR gRNA sequence
agctatagatatacatatca

SEQ ID NO: 144516 - DNA, 20 bp, Artificial
  CRISPR gRNA sequence
tatacatatcaaggtatata

SEQ ID NO: 144517 - DNA, 20 bp, Artificial
  CRISPR gRNA sequence
tacatatcaaggtatatata

SEQ ID NO: 144518 - DNA, 20 bp, Artificial
  CRISPR gRNA sequence
gagatatacatatatatatc

SEQ ID NO: 144519 - DNA, 20 bp, Artificial
  CRISPR gRNA sequence
agatatacatatatatatca

SEQ ID NO: 144520 - DNA, 20 bp, Artificial
  CRISPR gRNA sequence
atcaaggtatatatatcttt

SEQ ID NO: 144521 - DNA, 20 bp, Artificial
  CRISPR gRNA sequence
tttaagtatttccttctata

SEQ ID NO: 144522 - DNA, 20 bp, Artificial
  CRISPR gRNA sequence
tttccttctataaagttgta

SEQ ID NO: 144523 - DNA, 20 bp, Artificial
  CRISPR gRNA sequence
cttctataaagttgtaaaga

SEQ ID NO: 144524 - DNA, 20 bp, Artificial
  CRISPR gRNA sequence
aaagttgtaaagacagacct

SEQ ID NO: 144525 - DNA, 20 bp, Artificial
  CRISPR gRNA sequence
aagttgtaaagacagacctc

SEQ ID NO: 144526 - DNA, 20 bp, Artificial
  CRISPR gRNA sequence
agttgtaaagacagacctca

SEQ ID NO: 144527 - DNA, 20 bp, Artificial
  CRISPR gRNA sequence
tgtaaagacagacctcaggg

SEQ ID NO: 144528 - DNA, 20 bp, Artificial
  CRISPR gRNA sequence
gtaaagacagacctcagggc

SEQ ID NO: 144529 - DNA, 20 bp, Artificial
  CRISPR gRNA sequence
gacctcagggcaggactcac

SEQ ID NO: 144530 - DNA, 20 bp, Artificial
  CRISPR gRNA sequence
acctcagggcaggactcacc

SEQ ID NO: 144531 - DNA, 20 bp, Artificial
  CRISPR gRNA sequence
caggactcaccgggatctgc

SEQ ID NO: 144532 - DNA, 20 bp, Artificial
  CRISPR gRNA sequence
ctgctggatctctcctgtgt

SEQ ID NO: 144533 - DNA, 20 bp, Artificial
  CRISPR gRNA sequence
gatctgctgcatcacctgca

SEQ ID NO: 144534 - DNA, 20 bp, Artificial
  CRISPR gRNA sequence
catcacctgcatggtctgtc

SEQ ID NO: 144535 - DNA, 20 bp, Artificial
  CRISPR gRNA sequence
tggtctgtccagtgccactc

SEQ ID NO: 144536 - DNA, 20 bp, Artificial
  CRISPR gRNA sequence
ggtctgtccagtgccactct

SEQ ID NO: 144537 - DNA, 20 bp, Artificial
  CRISPR gRNA sequence
cagtgccactctgggcctgt

SEQ ID NO: 144538 - DNA, 20 bp, Artificial
  CRISPR gRNA sequence
agtgccactctgggcctgtt

SEQ ID NO: 144539 - DNA, 20 bp, Artificial
  CRISPR gRNA sequence
gcctgttgggcttgaccctg

SEQ ID NO: 144540 - DNA, 20 bp, Artificial
  CRISPR gRNA sequence
ttgggcttgaccctgtggct

SEQ ID NO: 144541 - DNA, 20 bp, Artificial
  CRISPR gRNA sequence
cttgaccctgtggctgagcc

SEQ ID NO: 144542 - DNA, 20 bp, Artificial
  CRISPR gRNA sequence
ttctccaacctgcattgtca

SEQ ID NO: 144543 - DNA, 20 bp, Artificial
  CRISPR gRNA sequence
tctccaacctgcattgtcac

SEQ ID NO: 144544 - DNA, 20 bp, Artificial
  CRISPR gRNA sequence
aacctgcattgtcacaggtg

SEQ ID NO: 144545 - DNA, 20 bp, Artificial
  CRISPR gRNA sequence
ttgtcacaggtgtggtctga

SEQ ID NO: 144546 - DNA, 20 bp, Artificial
  CRISPR gRNA sequence
tgtcacaggtgtggtctgaa

SEQ ID NO: 144547 - DNA, 20 bp, Artificial
  CRISPR gRNA sequence
cacaggtgtggtctgaaagg

SEQ ID NO: 144548 - DNA, 20 bp, Artificial
  CRISPR gRNA sequence
caggtgtggtctgaaaggaa

SEQ ID NO: 144549 - DNA, 20 bp, Artificial
  CRISPR gRNA sequence
ggtctgaaaggaagagttat

SEQ ID NO: 144550 - DNA, 20 bp, Artificial
  CRISPR gRNA sequence
gagttatgagaatgctgcgt

SEQ ID NO: 144551 - DNA, 20 bp, Artificial
  CRISPR gRNA sequence
atgagaatgctgcgtgagtt

SEQ ID NO: 144552 - DNA, 20 bp, Artificial
  CRISPR gRNA sequence
tgagaatgctgcgtgagttc

SEQ ID NO: 144553 - DNA, 20 bp, Artificial
  CRISPR gRNA sequence
atgctgcgtgagttcaggct

SEQ ID NO: 144554 - DNA, 20 bp, Artificial
  CRISPR gRNA sequence
gctgcgtgagttcaggctca

SEQ ID NO: 144555 - DNA, 20 bp, Artificial
  CRISPR gRNA sequence
gagttcaggctcagagccca

SEQ ID NO: 144556 - DNA, 20 bp, Artificial
  CRISPR gRNA sequence
agttcaggctcagagcccac

SEQ ID NO: 144557 - DNA, 20 bp, Artificial
  CRISPR gRNA sequence
tcagagcccacaggattacc

SEQ ID NO: 144558 - DNA, 20 bp, Artificial
  CRISPR gRNA sequence
agagcccacaggattaccga

SEQ ID NO: 144559 - DNA, 20 bp, Artificial
  CRISPR gRNA sequence
gagcccacaggattaccgag

SEQ ID NO: 144560 - DNA, 20 bp, Artificial
  CRISPR gRNA sequence
attaccgagaggttaataac

SEQ ID NO: 144561 - DNA, 20 bp, Artificial
  CRISPR gRNA sequence
gttaataacgagcaatgtgc

SEQ ID NO: 144562 - DNA, 20 bp, Artificial
  CRISPR gRNA sequence
ttaataacgagcaatgtgct

SEQ ID NO: 144563 - DNA, 20 bp, Artificial
  CRISPR gRNA sequence
aataacgagcaatgtgctgg

SEQ ID NO: 144564 - DNA, 20 bp, Artificial
  CRISPR gRNA sequence
aaccctctccatgaatgcct

SEQ ID NO: 144565 - DNA, 20 bp, Artificial
  CRISPR gRNA sequence
accctctccatgaatgccta

SEQ ID NO: 144566 - DNA, 20 bp, Artificial
  CRISPR gRNA sequence
atgaatgcctaaggtcatct

SEQ ID NO: 144567 - DNA, 20 bp, Artificial
  CRISPR gRNA sequence
gcctaaggtcatctcagtac

SEQ ID NO: 144568 - DNA, 20 bp, Artificial
  CRISPR gRNA sequence
tcagtactagtaataaccta

SEQ ID NO: 144569 - DNA, 20 bp, Artificial
  CRISPR gRNA sequence
agtactagtaataacctaca

SEQ ID NO: 144570 - DNA, 20 bp, Artificial
  CRISPR gRNA sequence
taataacctacagagtcctc

SEQ ID NO: 144571 - DNA, 20 bp, Artificial
  CRISPR gRNA sequence
aataacctacagagtcctct

SEQ ID NO: 144572 - DNA, 20 bp, Artificial
  CRISPR gRNA sequence
tacagagtcctctgggttta

SEQ ID NO: 144573 - DNA, 20 bp, Artificial
  CRISPR gRNA sequence
ctgggtttacagcattgctg

SEQ ID NO: 144574 - DNA, 20 bp, Artificial
  CRISPR gRNA sequence
gaagttactctccaaaacga

SEQ ID NO: 144575 - DNA, 20 bp, Artificial
  CRISPR gRNA sequence
agaaaaaccaaaaatatttt

SEQ ID NO: 144576 - DNA, 20 bp, Artificial
  CRISPR gRNA sequence
gaaaaaccaaaaatattttt

SEQ ID NO: 144577 - DNA, 20 bp, Artificial
  CRISPR gRNA sequence
caaaaatatttttaggctca

SEQ ID NO: 144578 - DNA, 20 bp, Artificial
  CRISPR gRNA sequence
tcacagtacaaatatttgca

SEQ ID NO: 144579 - DNA, 20 bp, Artificial
  CRISPR gRNA sequence
cacagtacaaatatttgcat

SEQ ID NO: 144580 - DNA, 20 bp, Artificial
  CRISPR gRNA sequence
ccaaatgctgcaacttttca

SEQ ID NO: 144581 - DNA, 20 bp, Artificial
  CRISPR gRNA sequence
gcaacttttcacagcccctt

SEQ ID NO: 144582 - DNA, 20 bp, Artificial
  CRISPR gRNA sequence
ttcacagcccctttagtgat

SEQ ID NO: 144583 - DNA, 20 bp, Artificial
  CRISPR gRNA sequence
tcacagcccctttagtgata

SEQ ID NO: 144584 - DNA, 20 bp, Artificial
  CRISPR gRNA sequence
gtgataaggcacatacacta

SEQ ID NO: 144585 - DNA, 20 bp, Artificial
  CRISPR gRNA sequence
tacactacagaaaaaatcaa

SEQ ID NO: 144586 - DNA, 20 bp, Artificial
  CRISPR gRNA sequence
gcaaccatgaccgtttactt

SEQ ID NO: 144587 - DNA, 20 bp, Artificial
  CRISPR gRNA sequence
atgaccgtttacttcagaaa

SEQ ID NO: 144588 - DNA, 20 bp, Artificial
  CRISPR gRNA sequence
gtttacttcagaaatagcca

SEQ ID NO: 144589 - DNA, 20 bp, Artificial
  CRISPR gRNA sequence
cttcagaaatagccaaagtc

SEQ ID NO: 144590 - DNA, 20 bp, Artificial
  CRISPR gRNA sequence
gaaatagccaaagtcaagtc

SEQ ID NO: 144591 - DNA, 20 bp, Artificial
  CRISPR gRNA sequence
aaatagccaaagtcaagtct

SEQ ID NO: 144592 - DNA, 20 bp, Artificial
  CRISPR gRNA sequence
aatagccaaagtcaagtctg

SEQ ID NO: 144593 - DNA, 20 bp, Artificial
  CRISPR gRNA sequence
agccaaagtcaagtctgggg

SEQ ID NO: 144594 - DNA, 20 bp, Artificial
  CRISPR gRNA sequence
gccaaagtcaagtctggggc

SEQ ID NO: 144595 - DNA, 20 bp, Artificial
  CRISPR gRNA sequence
aagtctggggcaggtgaatt

SEQ ID NO: 144596 - DNA, 20 bp, Artificial
  CRISPR gRNA sequence
gtctggggcaggtgaatttg

SEQ ID NO: 144597 - DNA, 20 bp, Artificial
  CRISPR gRNA sequence
tctggggcaggtgaatttgg

SEQ ID NO: 144598 - DNA, 20 bp, Artificial
  CRISPR gRNA sequence
ctggggcaggtgaatttgga

SEQ ID NO: 144599 - DNA, 20 bp, Artificial
  CRISPR gRNA sequence
tggggcaggtgaatttggag

SEQ ID NO: 144600 - DNA, 20 bp, Artificial
  CRISPR gRNA sequence
atttggaggggaacattaaa

SEQ ID NO: 144601 - DNA, 20 bp, Artificial
  CRISPR gRNA sequence
ggaggggaacattaaatgga

SEQ ID NO: 144602 - DNA, 20 bp, Artificial
  CRISPR gRNA sequence
gaggggaacattaaatggaa

SEQ ID NO: 144603 - DNA, 20 bp, Artificial
  CRISPR gRNA sequence
aggggaacattaaatggaaa

SEQ ID NO: 144604 - DNA, 20 bp, Artificial
  CRISPR gRNA sequence
gaacattaaatggaaagggt

SEQ ID NO: 144605 - DNA, 20 bp, Artificial
  CRISPR gRNA sequence
agggtcagtatgaatttatt

SEQ ID NO: 144606 - DNA, 20 bp, Artificial
  CRISPR gRNA sequence
cagtatgaatttatttagtt

SEQ ID NO: 144607 - DNA, 20 bp, Artificial
  CRISPR gRNA sequence
agtatgaatttatttagttc

SEQ ID NO: 144608 - DNA, 20 bp, Artificial
  CRISPR gRNA sequence
gtatgaatttatttagttca

SEQ ID NO: 144609 - DNA, 20 bp, Artificial
  CRISPR gRNA sequence
cagggtcatgtgctctttct

SEQ ID NO: 144610 - DNA, 20 bp, Artificial
  CRISPR gRNA sequence
agggtcatgtgctctttctt

SEQ ID NO: 144611 - DNA, 20 bp, Artificial
  CRISPR gRNA sequence
gtgctctttcttaggcatgt

SEQ ID NO: 144612 - DNA, 20 bp, Artificial
  CRISPR gRNA sequence
tcttaggcatgtaagacact

SEQ ID NO: 144613 - DNA, 20 bp, Artificial
  CRISPR gRNA sequence
ttaggcatgtaagacactga

SEQ ID NO: 144614 - DNA, 20 bp, Artificial
  CRISPR gRNA sequence
aagacactgagagaaaaata

SEQ ID NO: 144615 - DNA, 20 bp, Artificial
  CRISPR gRNA sequence
actgagagaaaaataaagca

SEQ ID NO: 144616 - DNA, 20 bp, Artificial
  CRISPR gRNA sequence
ctgagagaaaaataaagcac

SEQ ID NO: 144617 - DNA, 20 bp, Artificial
  CRISPR gRNA sequence
tgagagaaaaataaagcaca

SEQ ID NO: 144618 - DNA, 20 bp, Artificial
  CRISPR gRNA sequence
gagagaaaaataaagcacag

SEQ ID NO: 144619 - DNA, 20 bp, Artificial
  CRISPR gRNA sequence
aagcacaggggtgcatctcc

SEQ ID NO: 144620 - DNA, 20 bp, Artificial
  CRISPR gRNA sequence
agcacaggggtgcatctcca

SEQ ID NO: 144621 - DNA, 20 bp, Artificial
  CRISPR gRNA sequence
acaggggtgcatctccaagg

SEQ ID NO: 144622 - DNA, 20 bp, Artificial
  CRISPR gRNA sequence
caggggtgcatctccaaggc

SEQ ID NO: 144623 - DNA, 20 bp, Artificial
  CRISPR gRNA sequence
tgcatctccaaggcgggccc

SEQ ID NO: 144624 - DNA, 20 bp, Artificial
  CRISPR gRNA sequence
aggcgggccctagtgcacgc

SEQ ID NO: 144625 - DNA, 20 bp, Artificial
  CRISPR gRNA sequence
cgctggctctcaccccattc

SEQ ID NO: 144626 - DNA, 20 bp, Artificial
  CRISPR gRNA sequence
ctctcaccccattcaagctg

SEQ ID NO: 144627 - DNA, 20 bp, Artificial
  CRISPR gRNA sequence
ctcaccccattcaagctgca

SEQ ID NO: 144628 - DNA, 20 bp, Artificial
  CRISPR gRNA sequence
agagcaattcctgcccacac

SEQ ID NO: 144629 - DNA, 20 bp, Artificial
  CRISPR gRNA sequence
caattcctgcccacactggc

SEQ ID NO: 144630 - DNA, 20 bp, Artificial
  CRISPR gRNA sequence
tcctgcccacactggccaga

SEQ ID NO: 144631 - DNA, 20 bp, Artificial
  CRISPR gRNA sequence
cactggccagatggctgctc

SEQ ID NO: 144632 - DNA, 20 bp, Artificial
  CRISPR gRNA sequence
cagatggctgctctggacca

SEQ ID NO: 144633 - DNA, 20 bp, Artificial
  CRISPR gRNA sequence
ggctgctctggaccacagta

SEQ ID NO: 144634 - DNA, 20 bp, Artificial
  CRISPR gRNA sequence
gaccacagtatggcttccca

SEQ ID NO: 144635 - DNA, 20 bp, Artificial
  CRISPR gRNA sequence
accacagtatggcttcccaa

SEQ ID NO: 144636 - DNA, 20 bp, Artificial
  CRISPR gRNA sequence
cacagtatggcttcccaaag

SEQ ID NO: 144637 - DNA, 20 bp, Artificial
  CRISPR gRNA sequence
cagtatggcttcccaaagga

SEQ ID NO: 144638 - DNA, 20 bp, Artificial
  CRISPR gRNA sequence
agcaaacactgctaactcac

SEQ ID NO: 144639 - DNA, 20 bp, Artificial
  CRISPR gRNA sequence
gcaaacactgctaactcact

SEQ ID NO: 144640 - DNA, 20 bp, Artificial
  CRISPR gRNA sequence
ctaactcactgggcactgtt

SEQ ID NO: 144641 - DNA, 20 bp, Artificial
  CRISPR gRNA sequence
cactgggcactgttaagaca

SEQ ID NO: 144642 - DNA, 20 bp, Artificial
  CRISPR gRNA sequence
taagacacagactcttaact

SEQ ID NO: 144643 - DNA, 20 bp, Artificial
  CRISPR gRNA sequence
ctaagtctacccctaattaa

SEQ ID NO: 144644 - DNA, 20 bp, Artificial
  CRISPR gRNA sequence
acccctaattaatagaattt

SEQ ID NO: 144645 - DNA, 20 bp, Artificial
  CRISPR gRNA sequence
ctaattaatagaatttaaga

SEQ ID NO: 144646 - DNA, 20 bp, Artificial
  CRISPR gRNA sequence
ttaatagaatttaagaaagc

SEQ ID NO: 144647 - DNA, 20 bp, Artificial
  CRISPR gRNA sequence
gaactctaactttctaaaaa

SEQ ID NO: 144648 - DNA, 20 bp, Artificial
  CRISPR gRNA sequence
ctttctaaaaatagcaatct

SEQ ID NO: 144649 - DNA, 20 bp, Artificial
  CRISPR gRNA sequence
aaaatagcaatctcagattt

SEQ ID NO: 144650 - DNA, 20 bp, Artificial
  CRISPR gRNA sequence
tctgcccaatgtgtatgact

SEQ ID NO: 144651 - DNA, 20 bp, Artificial
  CRISPR gRNA sequence
gcccaatgtgtatgacttgg

SEQ ID NO: 144652 - DNA, 20 bp, Artificial
  CRISPR gRNA sequence
attctgtctctcacacacaa

SEQ ID NO: 144653 - DNA, 20 bp, Artificial
  CRISPR gRNA sequence
tctctcacacacaatggttg

SEQ ID NO: 144654 - DNA, 20 bp, Artificial
  CRISPR gRNA sequence
cctatgaaatgtactctttt

SEQ ID NO: 144655 - DNA, 20 bp, Artificial
  CRISPR gRNA sequence
tgaaatgtactcttttgaga

SEQ ID NO: 144656 - DNA, 20 bp, Artificial
  CRISPR gRNA sequence
tgtactcttttgagacggta

SEQ ID NO: 144657 - DNA, 20 bp, Artificial
  CRISPR gRNA sequence
ttttgagacggtaaagacac

SEQ ID NO: 144658 - DNA, 20 bp, Artificial
  CRISPR gRNA sequence
gtaaagacacaagctgccaa

SEQ ID NO: 144659 - DNA, 20 bp, Artificial
  CRISPR gRNA sequence
taaagacacaagctgccaaa

SEQ ID NO: 144660 - DNA, 20 bp, Artificial
  CRISPR gRNA sequence
aaagacacaagctgccaaaa

SEQ ID NO: 144661 - DNA, 20 bp, Artificial
  CRISPR gRNA sequence
tctttcaaatctcaaacctt

SEQ ID NO: 144662 - DNA, 20 bp, Artificial
  CRISPR gRNA sequence
agtactgtttgtgactttta

SEQ ID NO: 144663 - DNA, 20 bp, Artificial
  CRISPR gRNA sequence
gtactgtttgtgacttttac

SEQ ID NO: 144664 - DNA, 20 bp, Artificial
  CRISPR gRNA sequence
tgtgacttttacaggttacc

SEQ ID NO: 144665 - DNA, 20 bp, Artificial
  CRISPR gRNA sequence
tgacttttacaggttaccta

SEQ ID NO: 144666 - DNA, 20 bp, Artificial
  CRISPR gRNA sequence
cttttacaggttacctagag

SEQ ID NO: 144667 - DNA, 20 bp, Artificial
  CRISPR gRNA sequence
tacaggttacctagagcagt

SEQ ID NO: 144668 - DNA, 20 bp, Artificial
  CRISPR gRNA sequence
cctagagcagtgagcctatc

SEQ ID NO: 144669 - DNA, 20 bp, Artificial
  CRISPR gRNA sequence
ctagagcagtgagcctatct

SEQ ID NO: 144670 - DNA, 20 bp, Artificial
  CRISPR gRNA sequence
tgagcctatctgggctcatc

SEQ ID NO: 144671 - DNA, 20 bp, Artificial
  CRISPR gRNA sequence
gcctatctgggctcatctgg

SEQ ID NO: 144672 - DNA, 20 bp, Artificial
  CRISPR gRNA sequence
tatctgggctcatctggtgg

SEQ ID NO: 144673 - DNA, 20 bp, Artificial
  CRISPR gRNA sequence
ctgggctcatctggtggtgg

SEQ ID NO: 144674 - DNA, 20 bp, Artificial
  CRISPR gRNA sequence
tcatctggtggtggtagtga

SEQ ID NO: 144675 - DNA, 20 bp, Artificial
  CRISPR gRNA sequence
catctggtggtggtagtgat

SEQ ID NO: 144676 - DNA, 20 bp, Artificial
  CRISPR gRNA sequence
atctggtggtggtagtgatg

SEQ ID NO: 144677 - DNA, 20 bp, Artificial
  CRISPR gRNA sequence
tctggtggtggtagtgatgg

SEQ ID NO: 144678 - DNA, 20 bp, Artificial
  CRISPR gRNA sequence
ctggtggtggtagtgatggg

SEQ ID NO: 144679 - DNA, 20 bp, Artificial
  CRISPR gRNA sequence
gtggtggtagtgatgggggg

SEQ ID NO: 144680 - DNA, 20 bp, Artificial
  CRISPR gRNA sequence
gtggtagtgatggggggtgg

SEQ ID NO: 144681 - DNA, 20 bp, Artificial
  CRISPR gRNA sequence
tggtagtgatggggggtggc

SEQ ID NO: 144682 - DNA, 20 bp, Artificial
  CRISPR gRNA sequence
ggtagtgatggggggtggcg

SEQ ID NO: 144683 - DNA, 20 bp, Artificial
  CRISPR gRNA sequence
gtagtgatggggggtggcgg

SEQ ID NO: 144684 - DNA, 20 bp, Artificial
  CRISPR gRNA sequence
gatggggggtggcgggggtg

SEQ ID NO: 144685 - DNA, 20 bp, Artificial
  CRISPR gRNA sequence
atggggggtggcgggggtgt

SEQ ID NO: 144686 - DNA, 20 bp, Artificial
  CRISPR gRNA sequence
gggtggcgggggtgtgggcg

SEQ ID NO: 144687 - DNA, 20 bp, Artificial
  CRISPR gRNA sequence
ggtggcgggggtgtgggcgt

SEQ ID NO: 144688 - DNA, 20 bp, Artificial
  CRISPR gRNA sequence
ggcgggggtgtgggcgtggg

SEQ ID NO: 144689 - DNA, 20 bp, Artificial
  CRISPR gRNA sequence
cgggggtgtgggcgtgggtg

SEQ ID NO: 144690 - DNA, 20 bp, Artificial
  CRISPR gRNA sequence
tttgaattaatcacctcaat

SEQ ID NO: 144691 - DNA, 20 bp, Artificial
  CRISPR gRNA sequence
gaattaatcacctcaataag

SEQ ID NO: 144692 - DNA, 20 bp, Artificial
  CRISPR gRNA sequence
tcacctcaataagaagacta

SEQ ID NO: 144693 - DNA, 20 bp, Artificial
  CRISPR gRNA sequence
tgttcttaattctgactgca

SEQ ID NO: 144694 - DNA, 20 bp, Artificial
  CRISPR gRNA sequence
gttcttaattctgactgcat

SEQ ID NO: 144695 - DNA, 20 bp, Artificial
  CRISPR gRNA sequence
aaattacaactatgcatcca

SEQ ID NO: 144696 - DNA, 20 bp, Artificial
  CRISPR gRNA sequence
aactatgcatccaaagttac

SEQ ID NO: 144697 - DNA, 20 bp, Artificial
  CRISPR gRNA sequence
actatgcatccaaagttaca

SEQ ID NO: 144698 - DNA, 20 bp, Artificial
  CRISPR gRNA sequence
ctatgcatccaaagttacaa

SEQ ID NO: 144699 - DNA, 20 bp, Artificial
  CRISPR gRNA sequence
tgcatccaaagttacaaggg

SEQ ID NO: 144700 - DNA, 20 bp, Artificial
  CRISPR gRNA sequence
gcatccaaagttacaaggga

SEQ ID NO: 144701 - DNA, 20 bp, Artificial
  CRISPR gRNA sequence
catccaaagttacaagggaa

SEQ ID NO: 144702 - DNA, 20 bp, Artificial
  CRISPR gRNA sequence
atccaaagttacaagggaag

SEQ ID NO: 144703 - DNA, 20 bp, Artificial
  CRISPR gRNA sequence
caagggaaggggatgtgttc

SEQ ID NO: 144704 - DNA, 20 bp, Artificial
  CRISPR gRNA sequence
aagggaaggggatgtgttct

SEQ ID NO: 144705 - DNA, 20 bp, Artificial
  CRISPR gRNA sequence
gggatgtgttctgggaacga

SEQ ID NO: 144706 - DNA, 20 bp, Artificial
  CRISPR gRNA sequence
gtgttctgggaacgacagat

SEQ ID NO: 144707 - DNA, 20 bp, Artificial
  CRISPR gRNA sequence
gggaacgacagatgagattc

SEQ ID NO: 144708 - DNA, 20 bp, Artificial
  CRISPR gRNA sequence
ggaacgacagatgagattca

SEQ ID NO: 144709 - DNA, 20 bp, Artificial
  CRISPR gRNA sequence
gaacgacagatgagattcaa

SEQ ID NO: 144710 - DNA, 20 bp, Artificial
  CRISPR gRNA sequence
tgagattcaagggattacta

SEQ ID NO: 144711 - DNA, 20 bp, Artificial
  CRISPR gRNA sequence
agattcaagggattactacg

SEQ ID NO: 144712 - DNA, 20 bp, Artificial
  CRISPR gRNA sequence
acggagaaattactataaac

SEQ ID NO: 144713 - DNA, 20 bp, Artificial
  CRISPR gRNA sequence
ggagaaattactataaactg

SEQ ID NO: 144714 - DNA, 20 bp, Artificial
  CRISPR gRNA sequence
gagaaattactataaactgg

SEQ ID NO: 144715 - DNA, 20 bp, Artificial
  CRISPR gRNA sequence
gaaattactataaactggag

SEQ ID NO: 144716 - DNA, 20 bp, Artificial
  CRISPR gRNA sequence
aaattactataaactggagg

SEQ ID NO: 144717 - DNA, 20 bp, Artificial
  CRISPR gRNA sequence
aattactataaactggagga

SEQ ID NO: 144718 - DNA, 20 bp, Artificial
  CRISPR gRNA sequence
taaactggaggagggccaaa

SEQ ID NO: 144719 - DNA, 20 bp, Artificial
  CRISPR gRNA sequence
ctggaggagggccaaaaaga

SEQ ID NO: 144720 - DNA, 20 bp, Artificial
  CRISPR gRNA sequence
agggccaaaaagaaagacga

SEQ ID NO: 144721 - DNA, 20 bp, Artificial
  CRISPR gRNA sequence
ggccaaaaagaaagacgaca

SEQ ID NO: 144722 - DNA, 20 bp, Artificial
  CRISPR gRNA sequence
aagacgacagagtgttctaa

SEQ ID NO: 144723 - DNA, 20 bp, Artificial
  CRISPR gRNA sequence
gagtgttctaaaagtacatg

SEQ ID NO: 144724 - DNA, 20 bp, Artificial
  CRISPR gRNA sequence
tgttctaaaagtacatgcag

SEQ ID NO: 144725 - DNA, 20 bp, Artificial
  CRISPR gRNA sequence
gttctaaaagtacatgcagt

SEQ ID NO: 144726 - DNA, 20 bp, Artificial
  CRISPR gRNA sequence
taaaagtacatgcagtgggc

SEQ ID NO: 144727 - DNA, 20 bp, Artificial
  CRISPR gRNA sequence
aaaagtacatgcagtgggct

SEQ ID NO: 144728 - DNA, 20 bp, Artificial
  CRISPR gRNA sequence
catgcagtgggctaggctaa

SEQ ID NO: 144729 - DNA, 20 bp, Artificial
  CRISPR gRNA sequence
ttgtaccacaattttcaact

SEQ ID NO: 144730 - DNA, 20 bp, Artificial
  CRISPR gRNA sequence
ctcagcctattcccaacctc

SEQ ID NO: 144731 - DNA, 20 bp, Artificial
  CRISPR gRNA sequence
tattcccaacctccagaaat

SEQ ID NO: 144732 - DNA, 20 bp, Artificial
  CRISPR gRNA sequence
aataagttttcaatttatga

SEQ ID NO: 144733 - DNA, 20 bp, Artificial
  CRISPR gRNA sequence
tcaatttatgacagaaaaca

SEQ ID NO: 144734 - DNA, 20 bp, Artificial
  CRISPR gRNA sequence
caatttatgacagaaaacac

SEQ ID NO: 144735 - DNA, 20 bp, Artificial
  CRISPR gRNA sequence
catatgtattctgtcctacg

SEQ ID NO: 144736 - DNA, 20 bp, Artificial
  CRISPR gRNA sequence
atatgtattctgtcctacga

SEQ ID NO: 144737 - DNA, 20 bp, Artificial
  CRISPR gRNA sequence
tatttgcactcaacttgaaa

SEQ ID NO: 144738 - DNA, 20 bp, Artificial
  CRISPR gRNA sequence
acttgaaatagccatcacta

SEQ ID NO: 144739 - DNA, 20 bp, Artificial
  CRISPR gRNA sequence
cttgaaatagccatcactac

SEQ ID NO: 144740 - DNA, 20 bp, Artificial
  CRISPR gRNA sequence
aatagccatcactacgggtc

SEQ ID NO: 144741 - DNA, 20 bp, Artificial
  CRISPR gRNA sequence
atagccatcactacgggtcc

SEQ ID NO: 144742 - DNA, 20 bp, Artificial
  CRISPR gRNA sequence
tagccatcactacgggtcca

SEQ ID NO: 144743 - DNA, 20 bp, Artificial
  CRISPR gRNA sequence
gccatcactacgggtccagg

SEQ ID NO: 144744 - DNA, 20 bp, Artificial
  CRISPR gRNA sequence
ccatcactacgggtccaggg

SEQ ID NO: 144745 - DNA, 20 bp, Artificial
  CRISPR gRNA sequence
gggtccagggaggtgtgaca

SEQ ID NO: 144746 - DNA, 20 bp, Artificial
  CRISPR gRNA sequence
agggaggtgtgacacagcac

SEQ ID NO: 144747 - DNA, 20 bp, Artificial
  CRISPR gRNA sequence
gggaggtgtgacacagcaca

SEQ ID NO: 144748 - DNA, 20 bp, Artificial
  CRISPR gRNA sequence
cacagcacaaggccaccctg

SEQ ID NO: 144749 - DNA, 20 bp, Artificial
  CRISPR gRNA sequence
agcacaaggccaccctgaag

SEQ ID NO: 144750 - DNA, 20 bp, Artificial
  CRISPR gRNA sequence
acaaggccaccctgaagcag

SEQ ID NO: 144751 - DNA, 20 bp, Artificial
  CRISPR gRNA sequence
caaggccaccctgaagcagc

SEQ ID NO: 144752 - DNA, 20 bp, Artificial
  CRISPR gRNA sequence
gccaccctgaagcagcagga

SEQ ID NO: 144753 - DNA, 20 bp, Artificial
  CRISPR gRNA sequence
gcagcaggatggtgaaacaa

SEQ ID NO: 144754 - DNA, 20 bp, Artificial
  CRISPR gRNA sequence
caggatggtgaaacaacagc

SEQ ID NO: 144755 - DNA, 20 bp, Artificial
  CRISPR gRNA sequence
aggatggtgaaacaacagcc

SEQ ID NO: 144756 - DNA, 20 bp, Artificial
  CRISPR gRNA sequence
aaacaacagccaggaaatgc

SEQ ID NO: 144757 - DNA, 20 bp, Artificial
  CRISPR gRNA sequence
aacaacagccaggaaatgct

SEQ ID NO: 144758 - DNA, 20 bp, Artificial
  CRISPR gRNA sequence
aacagccaggaaatgctggg

SEQ ID NO: 144759 - DNA, 20 bp, Artificial
  CRISPR gRNA sequence
acagccaggaaatgctggga

SEQ ID NO: 144760 - DNA, 20 bp, Artificial
  CRISPR gRNA sequence
accaacttcaccatcctcac

SEQ ID NO: 144761 - DNA, 20 bp, Artificial
  CRISPR gRNA sequence
accatcctcacaagccttat

SEQ ID NO: 144762 - DNA, 20 bp, Artificial
  CRISPR gRNA sequence
tcacaagccttatcagctcc

SEQ ID NO: 144763 - DNA, 20 bp, Artificial
  CRISPR gRNA sequence
agccttatcagctccaagct

SEQ ID NO: 144764 - DNA, 20 bp, Artificial
  CRISPR gRNA sequence
agctccaagctgagcacgtc

SEQ ID NO: 144765 - DNA, 20 bp, Artificial
  CRISPR gRNA sequence
gctccaagctgagcacgtct

SEQ ID NO: 144766 - DNA, 20 bp, Artificial
  CRISPR gRNA sequence
caagctgagcacgtctgggt

SEQ ID NO: 144767 - DNA, 20 bp, Artificial
  CRISPR gRNA sequence
gctgagcacgtctgggttgg

SEQ ID NO: 144768 - DNA, 20 bp, Artificial
  CRISPR gRNA sequence
tgagcacgtctgggttggca

SEQ ID NO: 144769 - DNA, 20 bp, Artificial
  CRISPR gRNA sequence
agcacgtctgggttggcaga

SEQ ID NO: 144770 - DNA, 20 bp, Artificial
  CRISPR gRNA sequence
gcacgtctgggttggcagag

SEQ ID NO: 144771 - DNA, 20 bp, Artificial
  CRISPR gRNA sequence
acgtctgggttggcagagag

SEQ ID NO: 144772 - DNA, 20 bp, Artificial
  CRISPR gRNA sequence
tgggttggcagagaggagca

SEQ ID NO: 144773 - DNA, 20 bp, Artificial
  CRISPR gRNA sequence
tgaaattctcgctgactaaa

SEQ ID NO: 144774 - DNA, 20 bp, Artificial
  CRISPR gRNA sequence
tgtatcaacccaattttccc

SEQ ID NO: 144775 - DNA, 20 bp, Artificial
  CRISPR gRNA sequence
tatcaacccaattttcccga

SEQ ID NO: 144776 - DNA, 20 bp, Artificial
  CRISPR gRNA sequence
atcaacccaattttcccgag

SEQ ID NO: 144777 - DNA, 20 bp, Artificial
  CRISPR gRNA sequence
attttcccgagaggatttcc

SEQ ID NO: 144778 - DNA, 20 bp, Artificial
  CRISPR gRNA sequence
ttttcccgagaggatttcca

SEQ ID NO: 144779 - DNA, 20 bp, Artificial
  CRISPR gRNA sequence
aaggtatttctaaatcattt

SEQ ID NO: 144780 - DNA, 20 bp, Artificial
  CRISPR gRNA sequence
aggtatttctaaatcatttc

SEQ ID NO: 144781 - DNA, 20 bp, Artificial
  CRISPR gRNA sequence
ctaaatcatttcaggaaaat

SEQ ID NO: 144782 - DNA, 20 bp, Artificial
  CRISPR gRNA sequence
taaatcatttcaggaaaatg

SEQ ID NO: 144783 - DNA, 20 bp, Artificial
  CRISPR gRNA sequence
aaatcatttcaggaaaatga

SEQ ID NO: 144784 - DNA, 20 bp, Artificial
  CRISPR gRNA sequence
aggaaaatgagggcttgtgt

SEQ ID NO: 144785 - DNA, 20 bp, Artificial
  CRISPR gRNA sequence
aatgagggcttgtgttagca

SEQ ID NO: 144786 - DNA, 20 bp, Artificial
  CRISPR gRNA sequence
gagggcttgtgttagcatgg

SEQ ID NO: 144787 - DNA, 20 bp, Artificial
  CRISPR gRNA sequence
ggcagctgtcaaatcatgta

SEQ ID NO: 144788 - DNA, 20 bp, Artificial
  CRISPR gRNA sequence
tgtatggtgtgccctgctgt

SEQ ID NO: 144789 - DNA, 20 bp, Artificial
  CRISPR gRNA sequence
gtatggtgtgccctgctgtc

SEQ ID NO: 144790 - DNA, 20 bp, Artificial
  CRISPR gRNA sequence
tatggtgtgccctgctgtca

SEQ ID NO: 144791 - DNA, 20 bp, Artificial
  CRISPR gRNA sequence
gccctgctgtcagggcacaa

SEQ ID NO: 144792 - DNA, 20 bp, Artificial
  CRISPR gRNA sequence
tgtcagggcacaacagccat

SEQ ID NO: 144793 - DNA, 20 bp, Artificial
  CRISPR gRNA sequence
cacaacagccatgagcttct

SEQ ID NO: 144794 - DNA, 20 bp, Artificial
  CRISPR gRNA sequence
acaacagccatgagcttctt

SEQ ID NO: 144795 - DNA, 20 bp, Artificial
  CRISPR gRNA sequence
catgagcttcttaggatgat

SEQ ID NO: 144796 - DNA, 20 bp, Artificial
  CRISPR gRNA sequence
tcttaggatgatcagccaat

SEQ ID NO: 144797 - DNA, 20 bp, Artificial
  CRISPR gRNA sequence
ttaggatgatcagccaatca

SEQ ID NO: 144798 - DNA, 20 bp, Artificial
  CRISPR gRNA sequence
agccaatcagagcctgccct

SEQ ID NO: 144799 - DNA, 20 bp, Artificial
  CRISPR gRNA sequence
caatcagagcctgcccttgg

SEQ ID NO: 144800 - DNA, 20 bp, Artificial
  CRISPR gRNA sequence
gcccttggcagactccctct

SEQ ID NO: 144801 - DNA, 20 bp, Artificial
  CRISPR gRNA sequence
ccctctaagttcattctgta

SEQ ID NO: 144802 - DNA, 20 bp, Artificial
  CRISPR gRNA sequence
cctctaagttcattctgtaa

SEQ ID NO: 144803 - DNA, 20 bp, Artificial
  CRISPR gRNA sequence
ctctaagttcattctgtaaa

SEQ ID NO: 144804 - DNA, 20 bp, Artificial
  CRISPR gRNA sequence
gttcattctgtaaagggata

SEQ ID NO: 144805 - DNA, 20 bp, Artificial
  CRISPR gRNA sequence
ctgtaaagggataaagcctt

SEQ ID NO: 144806 - DNA, 20 bp, Artificial
  CRISPR gRNA sequence
taaagggataaagcctttgg

SEQ ID NO: 144807 - DNA, 20 bp, Artificial
  CRISPR gRNA sequence
aaagggataaagcctttggc

SEQ ID NO: 144808 - DNA, 20 bp, Artificial
  CRISPR gRNA sequence
gataaagcctttggcaggta

SEQ ID NO: 144809 - DNA, 20 bp, Artificial
  CRISPR gRNA sequence
aggtaaagttttcaccactg

SEQ ID NO: 144810 - DNA, 20 bp, Artificial
  CRISPR gRNA sequence
gtaaagttttcaccactgca

SEQ ID NO: 144811 - DNA, 20 bp, Artificial
  CRISPR gRNA sequence
taaagttttcaccactgcag

SEQ ID NO: 144812 - DNA, 20 bp, Artificial
  CRISPR gRNA sequence
tttcaccactgcagaggcac

SEQ ID NO: 144813 - DNA, 20 bp, Artificial
  CRISPR gRNA sequence
cactgcagaggcacaagcat

SEQ ID NO: 144814 - DNA, 20 bp, Artificial
  CRISPR gRNA sequence
agaggcacaagcattagcca

SEQ ID NO: 144815 - DNA, 20 bp, Artificial
  CRISPR gRNA sequence
ggcacaagcattagccaaag

SEQ ID NO: 144816 - DNA, 20 bp, Artificial
  CRISPR gRNA sequence
gcacaagcattagccaaaga

SEQ ID NO: 144817 - DNA, 20 bp, Artificial
  CRISPR gRNA sequence
attagccaaagaaggtccct

SEQ ID NO: 144818 - DNA, 20 bp, Artificial
  CRISPR gRNA sequence
ttagccaaagaaggtccctt

SEQ ID NO: 144819 - DNA, 20 bp, Artificial
  CRISPR gRNA sequence
gtcccttaggcatcatgata

SEQ ID NO: 144820 - DNA, 20 bp, Artificial
  CRISPR gRNA sequence
ttaggcatcatgatacagtc

SEQ ID NO: 144821 - DNA, 20 bp, Artificial
  CRISPR gRNA sequence
taggcatcatgatacagtcg

SEQ ID NO: 144822 - DNA, 20 bp, Artificial
  CRISPR gRNA sequence
catgatacagtcgaggcctt

SEQ ID NO: 144823 - DNA, 20 bp, Artificial
  CRISPR gRNA sequence
atacagtcgaggccttgagc

SEQ ID NO: 144824 - DNA, 20 bp, Artificial
  CRISPR gRNA sequence
gaggccttgagccagtgact

SEQ ID NO: 144825 - DNA, 20 bp, Artificial
  CRISPR gRNA sequence
gccttgagccagtgactgag

SEQ ID NO: 144826 - DNA, 20 bp, Artificial
  CRISPR gRNA sequence
tatctttgaaccctcctgcc

SEQ ID NO: 144827 - DNA, 20 bp, Artificial
  CRISPR gRNA sequence
ttgaaccctcctgcctagca

SEQ ID NO: 144828 - DNA, 20 bp, Artificial
  CRISPR gRNA sequence
ctcctgcctagcacagtgtc

SEQ ID NO: 144829 - DNA, 20 bp, Artificial
  CRISPR gRNA sequence
gcctagcacagtgtctggca

SEQ ID NO: 144830 - DNA, 20 bp, Artificial
  CRISPR gRNA sequence
cacagtgtctggcatagaac

SEQ ID NO: 144831 - DNA, 20 bp, Artificial
  CRISPR gRNA sequence
ctcaatacatttttgttata

SEQ ID NO: 144832 - DNA, 20 bp, Artificial
  CRISPR gRNA sequence
tacatttttgttatatggat

SEQ ID NO: 144833 - DNA, 20 bp, Artificial
  CRISPR gRNA sequence
gttatatggataagtaaaat

SEQ ID NO: 144834 - DNA, 20 bp, Artificial
  CRISPR gRNA sequence
atatggataagtaaaatgag

SEQ ID NO: 144835 - DNA, 20 bp, Artificial
  CRISPR gRNA sequence
atggataagtaaaatgagca

SEQ ID NO: 144836 - DNA, 20 bp, Artificial
  CRISPR gRNA sequence
aattaccttttttttttttt

SEQ ID NO: 144837 - DNA, 20 bp, Artificial
  CRISPR gRNA sequence
acctttttttttttttgaga

SEQ ID NO: 144838 - DNA, 20 bp, Artificial
  CRISPR gRNA sequence
gacagtctcgctctgtcacc

SEQ ID NO: 144839 - DNA, 20 bp, Artificial
  CRISPR gRNA sequence
tctcgctctgtcacccagat

SEQ ID NO: 144840 - DNA, 20 bp, Artificial
  CRISPR gRNA sequence
tcgctctgtcacccagattg

SEQ ID NO: 144841 - DNA, 20 bp, Artificial
  CRISPR gRNA sequence
ctgtcacccagattggagtg

SEQ ID NO: 144842 - DNA, 20 bp, Artificial
  CRISPR gRNA sequence
tcacccagattggagtgcag

SEQ ID NO: 144843 - DNA, 20 bp, Artificial
  CRISPR gRNA sequence
ggagtgcagtggcacgatct

SEQ ID NO: 144844 - DNA, 20 bp, Artificial
  CRISPR gRNA sequence
ttactgcaacatccgcctcc

SEQ ID NO: 144845 - DNA, 20 bp, Artificial
  CRISPR gRNA sequence
tactgcaacatccgcctccc

SEQ ID NO: 144846 - DNA, 20 bp, Artificial
  CRISPR gRNA sequence
aacatccgcctcccaggttc

SEQ ID NO: 144847 - DNA, 20 bp, Artificial
  CRISPR gRNA sequence
catccgcctcccaggttcaa

SEQ ID NO: 144848 - DNA, 20 bp, Artificial
  CRISPR gRNA sequence
ttcaagagattctcctgcct

SEQ ID NO: 144849 - DNA, 20 bp, Artificial
  CRISPR gRNA sequence
ttctcctgcctcagcctccc

SEQ ID NO: 144850 - DNA, 20 bp, Artificial
  CRISPR gRNA sequence
tctcctgcctcagcctcccc

SEQ ID NO: 144851 - DNA, 20 bp, Artificial
  CRISPR gRNA sequence
cctgcctcagcctccccggg

SEQ ID NO: 144852 - DNA, 20 bp, Artificial
  CRISPR gRNA sequence
cctcagcctccccgggtagc

SEQ ID NO: 144853 - DNA, 20 bp, Artificial
  CRISPR gRNA sequence
ctcagcctccccgggtagct

SEQ ID NO: 144854 - DNA, 20 bp, Artificial
  CRISPR gRNA sequence
tccccgggtagctgggacta

SEQ ID NO: 144855 - DNA, 20 bp, Artificial
  CRISPR gRNA sequence
ccccgggtagctgggactat

SEQ ID NO: 144856 - DNA, 20 bp, Artificial
  CRISPR gRNA sequence
taggcgcccgccaccacgcc

SEQ ID NO: 144857 - DNA, 20 bp, Artificial
  CRISPR gRNA sequence
ccggctaatttttgtatttt

SEQ ID NO: 144858 - DNA, 20 bp, Artificial
  CRISPR gRNA sequence
gctaatttttgtatttttag

SEQ ID NO: 144859 - DNA, 20 bp, Artificial
  CRISPR gRNA sequence
taatttttgtatttttagta

SEQ ID NO: 144860 - DNA, 20 bp, Artificial
  CRISPR gRNA sequence
ttttgtatttttagtagaga

SEQ ID NO: 144861 - DNA, 20 bp, Artificial
  CRISPR gRNA sequence
tttgtatttttagtagagat

SEQ ID NO: 144862 - DNA, 20 bp, Artificial
  CRISPR gRNA sequence
ttgtatttttagtagagatg

SEQ ID NO: 144863 - DNA, 20 bp, Artificial
  CRISPR gRNA sequence
gagatggggtttcaccatat

SEQ ID NO: 144864 - DNA, 20 bp, Artificial
  CRISPR gRNA sequence
tggggtttcaccatattggc

SEQ ID NO: 144865 - DNA, 20 bp, Artificial
  CRISPR gRNA sequence
ggggtttcaccatattggcc

SEQ ID NO: 144866 - DNA, 20 bp, Artificial
  CRISPR gRNA sequence
tttcaccatattggccaggc

SEQ ID NO: 144867 - DNA, 20 bp, Artificial
  CRISPR gRNA sequence
ccaggctggtcttgaactcc

SEQ ID NO: 144868 - DNA, 20 bp, Artificial
  CRISPR gRNA sequence
gctttgtgatccgcccacct

SEQ ID NO: 144869 - DNA, 20 bp, Artificial
  CRISPR gRNA sequence
ccgcccacctcggcctccca

SEQ ID NO: 144870 - DNA, 20 bp, Artificial
  CRISPR gRNA sequence
acctcggcctcccaaagtac

SEQ ID NO: 144871 - DNA, 20 bp, Artificial
  CRISPR gRNA sequence
cctcggcctcccaaagtact

SEQ ID NO: 144872 - DNA, 20 bp, Artificial
  CRISPR gRNA sequence
ctcccaaagtactgggatta

SEQ ID NO: 144873 - DNA, 20 bp, Artificial
  CRISPR gRNA sequence
tcccaaagtactgggattac

SEQ ID NO: 144874 - DNA, 20 bp, Artificial
  CRISPR gRNA sequence
agtactgggattacaggtgt

SEQ ID NO: 144875 - DNA, 20 bp, Artificial
  CRISPR gRNA sequence
caggtgtgagccactacgcc

SEQ ID NO: 144876 - DNA, 20 bp, Artificial
  CRISPR gRNA sequence
ttctctgtgtgtttgttttt

SEQ ID NO: 144877 - DNA, 20 bp, Artificial
  CRISPR gRNA sequence
tgtgtgtttgtttttgagac

SEQ ID NO: 144878 - DNA, 20 bp, Artificial
  CRISPR gRNA sequence
gtgtgtttgtttttgagaca

SEQ ID NO: 144879 - DNA, 20 bp, Artificial
  CRISPR gRNA sequence
caaggtcttgccatattgcc

SEQ ID NO: 144880 - DNA, 20 bp, Artificial
  CRISPR gRNA sequence
aaggtcttgccatattgccc

SEQ ID NO: 144881 - DNA, 20 bp, Artificial
  CRISPR gRNA sequence
tcttgccatattgcccaggc

SEQ ID NO: 144882 - DNA, 20 bp, Artificial
  CRISPR gRNA sequence
ccaggctggtctccaactcc

SEQ ID NO: 144883 - DNA, 20 bp, Artificial
  CRISPR gRNA sequence
caggctggtctccaactccc

SEQ ID NO: 144884 - DNA, 20 bp, Artificial
  CRISPR gRNA sequence
cccatgcgaccctcctgctt

SEQ ID NO: 144885 - DNA, 20 bp, Artificial
  CRISPR gRNA sequence
cctcctgctttggcctccca

SEQ ID NO: 144886 - DNA, 20 bp, Artificial
  CRISPR gRNA sequence
gctttggcctcccaaagtga

SEQ ID NO: 144887 - DNA, 20 bp, Artificial
  CRISPR gRNA sequence
ctttggcctcccaaagtgat

SEQ ID NO: 144888 - DNA, 20 bp, Artificial
  CRISPR gRNA sequence
ctcccaaagtgatgggatta

SEQ ID NO: 144889 - DNA, 20 bp, Artificial
  CRISPR gRNA sequence
tcccaaagtgatgggattat

SEQ ID NO: 144890 - DNA, 20 bp, Artificial
  CRISPR gRNA sequence
agtgatgggattataggtgt

SEQ ID NO: 144891 - DNA, 20 bp, Artificial
  CRISPR gRNA sequence
taggtgtgagccaccgcacc

SEQ ID NO: 144892 - DNA, 20 bp, Artificial
  CRISPR gRNA sequence
acttaaatctacctcctaac

SEQ ID NO: 144893 - DNA, 20 bp, Artificial
  CRISPR gRNA sequence
cttaaatctacctcctaact

SEQ ID NO: 144894 - DNA, 20 bp, Artificial
  CRISPR gRNA sequence
atctacctcctaactgggca

SEQ ID NO: 144895 - DNA, 20 bp, Artificial
  CRISPR gRNA sequence
tacctcctaactgggcatgg

SEQ ID NO: 144896 - DNA, 20 bp, Artificial
  CRISPR gRNA sequence
tgcctgtcatcccaccactg

SEQ ID NO: 144897 - DNA, 20 bp, Artificial
  CRISPR gRNA sequence
gcctgtcatcccaccactgt

SEQ ID NO: 144898 - DNA, 20 bp, Artificial
  CRISPR gRNA sequence
ctgtcatcccaccactgtgg

SEQ ID NO: 144899 - DNA, 20 bp, Artificial
  CRISPR gRNA sequence
tgtcatcccaccactgtggg

SEQ ID NO: 144900 - DNA, 20 bp, Artificial
  CRISPR gRNA sequence
tcccaccactgtgggaggcc

SEQ ID NO: 144901 - DNA, 20 bp, Artificial
  CRISPR gRNA sequence
cccaccactgtgggaggcca

SEQ ID NO: 144902 - DNA, 20 bp, Artificial
  CRISPR gRNA sequence
accactgtgggaggccaagg

SEQ ID NO: 144903 - DNA, 20 bp, Artificial
  CRISPR gRNA sequence
ccactgtgggaggccaaggt

SEQ ID NO: 144904 - DNA, 20 bp, Artificial
  CRISPR gRNA sequence
actgtgggaggccaaggtgg

SEQ ID NO: 144905 - DNA, 20 bp, Artificial
  CRISPR gRNA sequence
ctgtgggaggccaaggtggg

SEQ ID NO: 144906 - DNA, 20 bp, Artificial
  CRISPR gRNA sequence
gggaggccaaggtgggagga

SEQ ID NO: 144907 - DNA, 20 bp, Artificial
  CRISPR gRNA sequence
caaggtgggaggatggcata

SEQ ID NO: 144908 - DNA, 20 bp, Artificial
  CRISPR gRNA sequence
gtgggaggatggcataaagc

SEQ ID NO: 144909 - DNA, 20 bp, Artificial
  CRISPR gRNA sequence
tgggaggatggcataaagcc

SEQ ID NO: 144910 - DNA, 20 bp, Artificial
  CRISPR gRNA sequence
ggaggatggcataaagccag

SEQ ID NO: 144911 - DNA, 20 bp, Artificial
  CRISPR gRNA sequence
tggcataaagccaggagttt

SEQ ID NO: 144912 - DNA, 20 bp, Artificial
  CRISPR gRNA sequence
taaagccaggagtttgagac

SEQ ID NO: 144913 - DNA, 20 bp, Artificial
  CRISPR gRNA sequence
ccaggagtttgagaccagcc

SEQ ID NO: 144914 - DNA, 20 bp, Artificial
  CRISPR gRNA sequence
caggagtttgagaccagcct

SEQ ID NO: 144915 - DNA, 20 bp, Artificial
  CRISPR gRNA sequence
accagcctgggaaacataat

SEQ ID NO: 144916 - DNA, 20 bp, Artificial
  CRISPR gRNA sequence
caaaaaaattaaaaattatc

SEQ ID NO: 144917 - DNA, 20 bp, Artificial
  CRISPR gRNA sequence
aaaaaaattaaaaattatcc

SEQ ID NO: 144918 - DNA, 20 bp, Artificial
  CRISPR gRNA sequence
aattaaaaattatccaggtg

SEQ ID NO: 144919 - DNA, 20 bp, Artificial
  CRISPR gRNA sequence
taaaaattatccaggtgtgg

SEQ ID NO: 144920 - DNA, 20 bp, Artificial
  CRISPR gRNA sequence
caggtgtggtggcacatgcc

SEQ ID NO: 144921 - DNA, 20 bp, Artificial
  CRISPR gRNA sequence
aggtgtggtggcacatgcct

SEQ ID NO: 144922 - DNA, 20 bp, Artificial
  CRISPR gRNA sequence
gtgtggtggcacatgcctgg

SEQ ID NO: 144923 - DNA, 20 bp, Artificial
  CRISPR gRNA sequence
tggcacatgcctgggagtcc

SEQ ID NO: 144924 - DNA, 20 bp, Artificial
  CRISPR gRNA sequence
gcctgggagtcccagctcct

SEQ ID NO: 144925 - DNA, 20 bp, Artificial
  CRISPR gRNA sequence
cctgggagtcccagctcctc

SEQ ID NO: 144926 - DNA, 20 bp, Artificial
  CRISPR gRNA sequence
tgggagtcccagctcctcgg

SEQ ID NO: 144927 - DNA, 20 bp, Artificial
  CRISPR gRNA sequence
gggagtcccagctcctcggg

SEQ ID NO: 144928 - DNA, 20 bp, Artificial
  CRISPR gRNA sequence
tcccagctcctcgggaggct

SEQ ID NO: 144929 - DNA, 20 bp, Artificial
  CRISPR gRNA sequence
cccagctcctcgggaggctg

SEQ ID NO: 144930 - DNA, 20 bp, Artificial
  CRISPR gRNA sequence
agctcctcgggaggctgagg

SEQ ID NO: 144931 - DNA, 20 bp, Artificial
  CRISPR gRNA sequence
tcctcgggaggctgaggcag

SEQ ID NO: 144932 - DNA, 20 bp, Artificial
  CRISPR gRNA sequence
cctcgggaggctgaggcaga

SEQ ID NO: 144933 - DNA, 20 bp, Artificial
  CRISPR gRNA sequence
ctgaggcagaaggactgctt

SEQ ID NO: 144934 - DNA, 20 bp, Artificial
  CRISPR gRNA sequence
gcagaaggactgcttgagcc

SEQ ID NO: 144935 - DNA, 20 bp, Artificial
  CRISPR gRNA sequence
gaaggactgcttgagcccag

SEQ ID NO: 144936 - DNA, 20 bp, Artificial
  CRISPR gRNA sequence
tgcttgagcccagtagtttg

SEQ ID NO: 144937 - DNA, 20 bp, Artificial
  CRISPR gRNA sequence
agcccagtagtttgaagctg

SEQ ID NO: 144938 - DNA, 20 bp, Artificial
  CRISPR gRNA sequence
cagtagtttgaagctgcagt

SEQ ID NO: 144939 - DNA, 20 bp, Artificial
  CRISPR gRNA sequence
atgattgtgctactacactc

SEQ ID NO: 144940 - DNA, 20 bp, Artificial
  CRISPR gRNA sequence
gtgctactacactccagcct

SEQ ID NO: 144941 - DNA, 20 bp, Artificial
  CRISPR gRNA sequence
acactccagcctgagtgacg

SEQ ID NO: 144942 - DNA, 20 bp, Artificial
  CRISPR gRNA sequence
tccagcctgagtgacgaagt

SEQ ID NO: 144943 - DNA, 20 bp, Artificial
  CRISPR gRNA sequence
tactccatttttttttcttc

SEQ ID NO: 144944 - DNA, 20 bp, Artificial
  CRISPR gRNA sequence
actccatttttttttcttct

SEQ ID NO: 144945 - DNA, 20 bp, Artificial
  CRISPR gRNA sequence
ttttttcttctaggcaaact

SEQ ID NO: 144946 - DNA, 20 bp, Artificial
  CRISPR gRNA sequence
aggcaaactcagctccttat

SEQ ID NO: 144947 - DNA, 20 bp, Artificial
  CRISPR gRNA sequence
agctccttattagaatatac

SEQ ID NO: 144948 - DNA, 20 bp, Artificial
  CRISPR gRNA sequence
gctccttattagaatatacg

SEQ ID NO: 144949 - DNA, 20 bp, Artificial
  CRISPR gRNA sequence
ttagaatatacgaggctgtc

SEQ ID NO: 144950 - DNA, 20 bp, Artificial
  CRISPR gRNA sequence
tagaatatacgaggctgtcc

SEQ ID NO: 144951 - DNA, 20 bp, Artificial
  CRISPR gRNA sequence
tctatctttccaaacttgcg

SEQ ID NO: 144952 - DNA, 20 bp, Artificial
  CRISPR gRNA sequence
tctttccaaacttgcgtaga

SEQ ID NO: 144953 - DNA, 20 bp, Artificial
  CRISPR gRNA sequence
ctacgctgactactttccta

SEQ ID NO: 144954 - DNA, 20 bp, Artificial
  CRISPR gRNA sequence
ctgtactgtttctcacctct

SEQ ID NO: 144955 - DNA, 20 bp, Artificial
  CRISPR gRNA sequence
gcctgtgctgtgccctctac

SEQ ID NO: 144956 - DNA, 20 bp, Artificial
  CRISPR gRNA sequence
attaatttccactgttcccc

SEQ ID NO: 144957 - DNA, 20 bp, Artificial
  CRISPR gRNA sequence
aagactcatattattccctt

SEQ ID NO: 144958 - DNA, 20 bp, Artificial
  CRISPR gRNA sequence
cacctcgttcacatctttct

SEQ ID NO: 144959 - DNA, 20 bp, Artificial
  CRISPR gRNA sequence
cttttttttgtttttttttt

SEQ ID NO: 144960 - DNA, 20 bp, Artificial
  CRISPR gRNA sequence
tttttgttttttttttgaga

SEQ ID NO: 144961 - DNA, 20 bp, Artificial
  CRISPR gRNA sequence
ttttgttttttttttgagac

SEQ ID NO: 144962 - DNA, 20 bp, Artificial
  CRISPR gRNA sequence
aggatcttgctctgtcaccc

SEQ ID NO: 144963 - DNA, 20 bp, Artificial
  CRISPR gRNA sequence
tcttgctctgtcaccctggc

SEQ ID NO: 144964 - DNA, 20 bp, Artificial
  CRISPR gRNA sequence
ttgctctgtcaccctggctg

SEQ ID NO: 144965 - DNA, 20 bp, Artificial
  CRISPR gRNA sequence
tcaccctggctggagtgcaa

SEQ ID NO: 144966 - DNA, 20 bp, Artificial
  CRISPR gRNA sequence
ggagtgcaatggcacaatca

SEQ ID NO: 144967 - DNA, 20 bp, Artificial
  CRISPR gRNA sequence
ggcacaatcacagctcactg

SEQ ID NO: 144968 - DNA, 20 bp, Artificial
  CRISPR gRNA sequence
cactgtagccttgacctcct

SEQ ID NO: 144969 - DNA, 20 bp, Artificial
  CRISPR gRNA sequence
agccttgacctccttggctc

SEQ ID NO: 144970 - DNA, 20 bp, Artificial
  CRISPR gRNA sequence
ctcaagcgatcctcccaact

SEQ ID NO: 144971 - DNA, 20 bp, Artificial
  CRISPR gRNA sequence
tcctcccaactcagcctctt

SEQ ID NO: 144972 - DNA, 20 bp, Artificial
  CRISPR gRNA sequence
tcccaactcagcctcttaag

SEQ ID NO: 144973 - DNA, 20 bp, Artificial
  CRISPR gRNA sequence
aactcagcctcttaagtagc

SEQ ID NO: 144974 - DNA, 20 bp, Artificial
  CRISPR gRNA sequence
actcagcctcttaagtagct

SEQ ID NO: 144975 - DNA, 20 bp, Artificial
  CRISPR gRNA sequence
ctcagcctcttaagtagctg

SEQ ID NO: 144976 - DNA, 20 bp, Artificial
  CRISPR gRNA sequence
tcttaagtagctggggccat

SEQ ID NO: 144977 - DNA, 20 bp, Artificial
  CRISPR gRNA sequence
ttaagtagctggggccataa

SEQ ID NO: 144978 - DNA, 20 bp, Artificial
  CRISPR gRNA sequence
gccataagagcatgccacca

SEQ ID NO: 144979 - DNA, 20 bp, Artificial
  CRISPR gRNA sequence
taagagcatgccaccatggc

SEQ ID NO: 144980 - DNA, 20 bp, Artificial
  CRISPR gRNA sequence
tggctaatgttctgatgttc

SEQ ID NO: 144981 - DNA, 20 bp, Artificial
  CRISPR gRNA sequence
ctaatgttctgatgttctgg

SEQ ID NO: 144982 - DNA, 20 bp, Artificial
  CRISPR gRNA sequence
aatgttctgatgttctggtg

SEQ ID NO: 144983 - DNA, 20 bp, Artificial
  CRISPR gRNA sequence
tctgatgttctggtggagac

SEQ ID NO: 144984 - DNA, 20 bp, Artificial
  CRISPR gRNA sequence
ctgatgttctggtggagaca

SEQ ID NO: 144985 - DNA, 20 bp, Artificial
  CRISPR gRNA sequence
caaggtctcaccatgttgcc

SEQ ID NO: 144986 - DNA, 20 bp, Artificial
  CRISPR gRNA sequence
aaggtctcaccatgttgccc

SEQ ID NO: 144987 - DNA, 20 bp, Artificial
  CRISPR gRNA sequence
tctcaccatgttgcccaggc

SEQ ID NO: 144988 - DNA, 20 bp, Artificial
  CRISPR gRNA sequence
ccaggctggtcttgaacacg

SEQ ID NO: 144989 - DNA, 20 bp, Artificial
  CRISPR gRNA sequence
caggctggtcttgaacacgt

SEQ ID NO: 144990 - DNA, 20 bp, Artificial
  CRISPR gRNA sequence
ggtcttgaacacgtgggctc

SEQ ID NO: 144991 - DNA, 20 bp, Artificial
  CRISPR gRNA sequence
ctcaagcaatcctcctgcct

SEQ ID NO: 144992 - DNA, 20 bp, Artificial
  CRISPR gRNA sequence
cctcctgcctcggcctccca

SEQ ID NO: 144993 - DNA, 20 bp, Artificial
  CRISPR gRNA sequence
gcctcggcctcccaaagtgc

SEQ ID NO: 144994 - DNA, 20 bp, Artificial
  CRISPR gRNA sequence
ctcccaaagtgctggaatta

SEQ ID NO: 144995 - DNA, 20 bp, Artificial
  CRISPR gRNA sequence
agtgctggaattacagacat

SEQ ID NO: 144996 - DNA, 20 bp, Artificial
  CRISPR gRNA sequence
tttttttttttttttaatta

SEQ ID NO: 144997 - DNA, 20 bp, Artificial
  CRISPR gRNA sequence
ttttttttttttaattaaag

SEQ ID NO: 144998 - DNA, 20 bp, Artificial
  CRISPR gRNA sequence
ttttttttttaattaaagaa

SEQ ID NO: 144999 - DNA, 20 bp, Artificial
  CRISPR gRNA sequence
tttttttttaattaaagaag

SEQ ID NO: 145000 - DNA, 20 bp, Artificial
  CRISPR gRNA sequence
agaggtcttgctgtgctgcc

SEQ ID NO: 145001 - DNA, 20 bp, Artificial
  CRISPR gRNA sequence
gaggtcttgctgtgctgccc

SEQ ID NO: 145002 - DNA, 20 bp, Artificial
  CRISPR gRNA sequence
ttgctgtgctgcccaggctg

SEQ ID NO: 145003 - DNA, 20 bp, Artificial
  CRISPR gRNA sequence
gtgctgcccaggctgaagtg

SEQ ID NO: 145004 - DNA, 20 bp, Artificial
  CRISPR gRNA sequence
ctgcccaggctgaagtgcag

SEQ ID NO: 145005 - DNA, 20 bp, Artificial
  CRISPR gRNA sequence
tcactgtaacctcaaactcc

SEQ ID NO: 145006 - DNA, 20 bp, Artificial
  CRISPR gRNA sequence
cactgtaacctcaaactcct

SEQ ID NO: 145007 - DNA, 20 bp, Artificial
  CRISPR gRNA sequence
ctcctgggttcctcccacat

SEQ ID NO: 145008 - DNA, 20 bp, Artificial
  CRISPR gRNA sequence
cctcccacattggcctccca

SEQ ID NO: 145009 - DNA, 20 bp, Artificial
  CRISPR gRNA sequence
acattggcctcccaaagtgt

SEQ ID NO: 145010 - DNA, 20 bp, Artificial
  CRISPR gRNA sequence
cattggcctcccaaagtgtt

SEQ ID NO: 145011 - DNA, 20 bp, Artificial
  CRISPR gRNA sequence
ctcccaaagtgttgggatta

SEQ ID NO: 145012 - DNA, 20 bp, Artificial
  CRISPR gRNA sequence
tcccaaagtgttgggattac

SEQ ID NO: 145013 - DNA, 20 bp, Artificial
  CRISPR gRNA sequence
agtgttgggattacaggcat

SEQ ID NO: 145014 - DNA, 20 bp, Artificial
  CRISPR gRNA sequence
caggcatgagccactgcgct

SEQ ID NO: 145015 - DNA, 20 bp, Artificial
  CRISPR gRNA sequence
atgagccactgcgctgagcc

SEQ ID NO: 145016 - DNA, 20 bp, Artificial
  CRISPR gRNA sequence
tgagccactgcgctgagcca

SEQ ID NO: 145017 - DNA, 20 bp, Artificial
  CRISPR gRNA sequence
accctgtacacattcccacg

SEQ ID NO: 145018 - DNA, 20 bp, Artificial
  CRISPR gRNA sequence
ctgtacacattcccacgtgg

SEQ ID NO: 145019 - DNA, 20 bp, Artificial
  CRISPR gRNA sequence
cacgtggtggtacaaccttt

SEQ ID NO: 145020 - DNA, 20 bp, Artificial
  CRISPR gRNA sequence
attgtgaattccttgaaaat

SEQ ID NO: 145021 - DNA, 20 bp, Artificial
  CRISPR gRNA sequence
ttgtgaattccttgaaaata

SEQ ID NO: 145022 - DNA, 20 bp, Artificial
  CRISPR gRNA sequence
atgcttgtatccccaataca

SEQ ID NO: 145023 - DNA, 20 bp, Artificial
  CRISPR gRNA sequence
tgtatccccaatacatagca

SEQ ID NO: 145024 - DNA, 20 bp, Artificial
  CRISPR gRNA sequence
atagcacagaactttaccct

SEQ ID NO: 145025 - DNA, 20 bp, Artificial
  CRISPR gRNA sequence
agcacagaactttaccctca

SEQ ID NO: 145026 - DNA, 20 bp, Artificial
  CRISPR gRNA sequence
gcacagaactttaccctcag

SEQ ID NO: 145027 - DNA, 20 bp, Artificial
  CRISPR gRNA sequence
ctttaccctcagaggatgct

SEQ ID NO: 145028 - DNA, 20 bp, Artificial
  CRISPR gRNA sequence
gatgaataaataatgattga

SEQ ID NO: 145029 - DNA, 20 bp, Artificial
  CRISPR gRNA sequence
tgaataaataatgattgaca

SEQ ID NO: 145030 - DNA, 20 bp, Artificial
  CRISPR gRNA sequence
ataatgattgacagagaatt

SEQ ID NO: 145031 - DNA, 20 bp, Artificial
  CRISPR gRNA sequence
attgacagagaatttggatt

SEQ ID NO: 145032 - DNA, 20 bp, Artificial
  CRISPR gRNA sequence
tgacagagaatttggattca

SEQ ID NO: 145033 - DNA, 20 bp, Artificial
  CRISPR gRNA sequence
gaatttggattcagagctca

SEQ ID NO: 145034 - DNA, 20 bp, Artificial
  CRISPR gRNA sequence
tggattcagagctcatagta

SEQ ID NO: 145035 - DNA, 20 bp, Artificial
  CRISPR gRNA sequence
gattcagagctcatagtaca

SEQ ID NO: 145036 - DNA, 20 bp, Artificial
  CRISPR gRNA sequence
tcatagtacagagttctctg

SEQ ID NO: 145037 - DNA, 20 bp, Artificial
  CRISPR gRNA sequence
actgctcttaacactactac

SEQ ID NO: 145038 - DNA, 20 bp, Artificial
  CRISPR gRNA sequence
ctgctcttaacactactact

SEQ ID NO: 145039 - DNA, 20 bp, Artificial
  CRISPR gRNA sequence
tgctcttaacactactactg

SEQ ID NO: 145040 - DNA, 20 bp, Artificial
  CRISPR gRNA sequence
ctcttaacactactactggg

SEQ ID NO: 145041 - DNA, 20 bp, Artificial
  CRISPR gRNA sequence
cttaacactactactgggga

SEQ ID NO: 145042 - DNA, 20 bp, Artificial
  CRISPR gRNA sequence
acactactactggggagaga

SEQ ID NO: 145043 - DNA, 20 bp, Artificial
  CRISPR gRNA sequence
actactactggggagagaaa

SEQ ID NO: 145044 - DNA, 20 bp, Artificial
  CRISPR gRNA sequence
cctctgattactatcgtaaa

SEQ ID NO: 145045 - DNA, 20 bp, Artificial
  CRISPR gRNA sequence
tctgattactatcgtaaaaa

SEQ ID NO: 145046 - DNA, 20 bp, Artificial
  CRISPR gRNA sequence
gattactatcgtaaaaagag

SEQ ID NO: 145047 - DNA, 20 bp, Artificial
  CRISPR gRNA sequence
attactatcgtaaaaagaga

SEQ ID NO: 145048 - DNA, 20 bp, Artificial
  CRISPR gRNA sequence
aaggtcacttaacacaaata

SEQ ID NO: 145049 - DNA, 20 bp, Artificial
  CRISPR gRNA sequence
aggtcacttaacacaaatat

SEQ ID NO: 145050 - DNA, 20 bp, Artificial
  CRISPR gRNA sequence
cacttaacacaaatatggga

SEQ ID NO: 145051 - DNA, 20 bp, Artificial
  CRISPR gRNA sequence
cttaacacaaatatgggaca

SEQ ID NO: 145052 - DNA, 20 bp, Artificial
  CRISPR gRNA sequence
aatatgggacagagaaatga

SEQ ID NO: 145053 - DNA, 20 bp, Artificial
  CRISPR gRNA sequence
atatgggacagagaaatgac

SEQ ID NO: 145054 - DNA, 20 bp, Artificial
  CRISPR gRNA sequence
tatgggacagagaaatgacg

SEQ ID NO: 145055 - DNA, 20 bp, Artificial
  CRISPR gRNA sequence
tgggacagagaaatgacggg

SEQ ID NO: 145056 - DNA, 20 bp, Artificial
  CRISPR gRNA sequence
gacagagaaatgacggggag

SEQ ID NO: 145057 - DNA, 20 bp, Artificial
  CRISPR gRNA sequence
acagagaaatgacggggaga

SEQ ID NO: 145058 - DNA, 20 bp, Artificial
  CRISPR gRNA sequence
agagaaatgacggggagaag

SEQ ID NO: 145059 - DNA, 20 bp, Artificial
  CRISPR gRNA sequence
gggagaaggagtatgcaact

SEQ ID NO: 145060 - DNA, 20 bp, Artificial
  CRISPR gRNA sequence
gatacctaatctctcccttt

SEQ ID NO: 145061 - DNA, 20 bp, Artificial
  CRISPR gRNA sequence
atacctaatctctcccttta

SEQ ID NO: 145062 - DNA, 20 bp, Artificial
  CRISPR gRNA sequence
tacctaatctctccctttaa

SEQ ID NO: 145063 - DNA, 20 bp, Artificial
  CRISPR gRNA sequence
cacaaattccacttctcaca

SEQ ID NO: 145064 - DNA, 20 bp, Artificial
  CRISPR gRNA sequence
ccacttctcacacagacaca

SEQ ID NO: 145065 - DNA, 20 bp, Artificial
  CRISPR gRNA sequence
ttctcacacagacacacaga

SEQ ID NO: 145066 - DNA, 20 bp, Artificial
  CRISPR gRNA sequence
tcacacagacacacagacag

SEQ ID NO: 145067 - DNA, 20 bp, Artificial
  CRISPR gRNA sequence
cacacagacacacagacagc

SEQ ID NO: 145068 - DNA, 20 bp, Artificial
  CRISPR gRNA sequence
agacacacagacagcaggca

SEQ ID NO: 145069 - DNA, 20 bp, Artificial
  CRISPR gRNA sequence
acacacagacagcaggcatg

SEQ ID NO: 145070 - DNA, 20 bp, Artificial
  CRISPR gRNA sequence
agcaggcatggagttcactt

SEQ ID NO: 145071 - DNA, 20 bp, Artificial
  CRISPR gRNA sequence
ttagcacctctactcttcat

SEQ ID NO: 145072 - DNA, 20 bp, Artificial
  CRISPR gRNA sequence
tagcacctctactcttcata

SEQ ID NO: 145073 - DNA, 20 bp, Artificial
  CRISPR gRNA sequence
ctactcttcataaggcattt

SEQ ID NO: 145074 - DNA, 20 bp, Artificial
  CRISPR gRNA sequence
ttttcccttctaaaatttct

SEQ ID NO: 145075 - DNA, 20 bp, Artificial
  CRISPR gRNA sequence
ttctaaaatttctgagctaa

SEQ ID NO: 145076 - DNA, 20 bp, Artificial
  CRISPR gRNA sequence
tctaaaatttctgagctaat

SEQ ID NO: 145077 - DNA, 20 bp, Artificial
  CRISPR gRNA sequence
ctaaaatttctgagctaata

SEQ ID NO: 145078 - DNA, 20 bp, Artificial
  CRISPR gRNA sequence
ttctgagctaatagggatcc

SEQ ID NO: 145079 - DNA, 20 bp, Artificial
  CRISPR gRNA sequence
ctgagctaatagggatcctg

SEQ ID NO: 145080 - DNA, 20 bp, Artificial
  CRISPR gRNA sequence
atcctggagaacatactgtc

SEQ ID NO: 145081 - DNA, 20 bp, Artificial
  CRISPR gRNA sequence
actttcctcatttgaccttt

SEQ ID NO: 145082 - DNA, 20 bp, Artificial
  CRISPR gRNA sequence
catttgacctttgagaaaaa

SEQ ID NO: 145083 - DNA, 20 bp, Artificial
  CRISPR gRNA sequence
atttgacctttgagaaaaac

SEQ ID NO: 145084 - DNA, 20 bp, Artificial
  CRISPR gRNA sequence
tttgacctttgagaaaaaca

SEQ ID NO: 145085 - DNA, 20 bp, Artificial
  CRISPR gRNA sequence
cctttgagaaaaacagggtc

SEQ ID NO: 145086 - DNA, 20 bp, Artificial
  CRISPR gRNA sequence
tttgagaaaaacagggtcca

SEQ ID NO: 145087 - DNA, 20 bp, Artificial
  CRISPR gRNA sequence
tgagaaaaacagggtccaga

SEQ ID NO: 145088 - DNA, 20 bp, Artificial
  CRISPR gRNA sequence
aaaacagggtccagagagat

SEQ ID NO: 145089 - DNA, 20 bp, Artificial
  CRISPR gRNA sequence
aaacagggtccagagagatt

SEQ ID NO: 145090 - DNA, 20 bp, Artificial
  CRISPR gRNA sequence
aacagggtccagagagatta

SEQ ID NO: 145091 - DNA, 20 bp, Artificial
  CRISPR gRNA sequence
attagggtaacatctcaccc

SEQ ID NO: 145092 - DNA, 20 bp, Artificial
  CRISPR gRNA sequence
agggtaacatctcaccccag

SEQ ID NO: 145093 - DNA, 20 bp, Artificial
  CRISPR gRNA sequence
ctcaccccagtagctgaatc

SEQ ID NO: 145094 - DNA, 20 bp, Artificial
  CRISPR gRNA sequence
tcaccccagtagctgaatct

SEQ ID NO: 145095 - DNA, 20 bp, Artificial
  CRISPR gRNA sequence
caccccagtagctgaatctg

SEQ ID NO: 145096 - DNA, 20 bp, Artificial
  CRISPR gRNA sequence
cagtagctgaatctggggaa

SEQ ID NO: 145097 - DNA, 20 bp, Artificial
  CRISPR gRNA sequence
ctgaatctggggaaaagttc

SEQ ID NO: 145098 - DNA, 20 bp, Artificial
  CRISPR gRNA sequence
tggggaaaagttccagtttc

SEQ ID NO: 145099 - DNA, 20 bp, Artificial
  CRISPR gRNA sequence
cagtttccagactttaaatc

SEQ ID NO: 145100 - DNA, 20 bp, Artificial
  CRISPR gRNA sequence
tccagtgctctataatgatc

SEQ ID NO: 145101 - DNA, 20 bp, Artificial
  CRISPR gRNA sequence
gctgcctctctgccctcatc

SEQ ID NO: 145102 - DNA, 20 bp, Artificial
  CRISPR gRNA sequence
ctctgcccatccaaaaacct

SEQ ID NO: 145103 - DNA, 20 bp, Artificial
  CRISPR gRNA sequence
tctgcccatccaaaaaccta

SEQ ID NO: 145104 - DNA, 20 bp, Artificial
  CRISPR gRNA sequence
ctgcccatccaaaaacctaa

SEQ ID NO: 145105 - DNA, 20 bp, Artificial
  CRISPR gRNA sequence
tgcccatccaaaaacctaag

SEQ ID NO: 145106 - DNA, 20 bp, Artificial
  CRISPR gRNA sequence
cctaaggggcactgtcttgc

SEQ ID NO: 145107 - DNA, 20 bp, Artificial
  CRISPR gRNA sequence
aggggcactgtcttgctgga

SEQ ID NO: 145108 - DNA, 20 bp, Artificial
  CRISPR gRNA sequence
ggggcactgtcttgctggat

SEQ ID NO: 145109 - DNA, 20 bp, Artificial
  CRISPR gRNA sequence
tcttgctggatgggcatcct

SEQ ID NO: 145110 - DNA, 20 bp, Artificial
  CRISPR gRNA sequence
tgctggatgggcatcctcag

SEQ ID NO: 145111 - DNA, 20 bp, Artificial
  CRISPR gRNA sequence
tgggcatcctcagcagctca

SEQ ID NO: 145112 - DNA, 20 bp, Artificial
  CRISPR gRNA sequence
tcctcagcagctcacagacc

SEQ ID NO: 145113 - DNA, 20 bp, Artificial
  CRISPR gRNA sequence
ctcacagacctggccctgct

SEQ ID NO: 145114 - DNA, 20 bp, Artificial
  CRISPR gRNA sequence
tcacagacctggccctgctg

SEQ ID NO: 145115 - DNA, 20 bp, Artificial
  CRISPR gRNA sequence
ctgtgcgatgatgatctgcc

SEQ ID NO: 145116 - DNA, 20 bp, Artificial
  CRISPR gRNA sequence
tgtgcgatgatgatctgccc

SEQ ID NO: 145117 - DNA, 20 bp, Artificial
  CRISPR gRNA sequence
cgatgatgatctgcccaggc

SEQ ID NO: 145118 - DNA, 20 bp, Artificial
  CRISPR gRNA sequence
gatgatctgcccaggctgga

SEQ ID NO: 145119 - DNA, 20 bp, Artificial
  CRISPR gRNA sequence
gatctgcccaggctggatgg

SEQ ID NO: 145120 - DNA, 20 bp, Artificial
  CRISPR gRNA sequence
cccaggctggatggtggtcg

SEQ ID NO: 145121 - DNA, 20 bp, Artificial
  CRISPR gRNA sequence
caggctggatggtggtcgtg

SEQ ID NO: 145122 - DNA, 20 bp, Artificial
  CRISPR gRNA sequence
ctggatggtggtcgtggagc

SEQ ID NO: 145123 - DNA, 20 bp, Artificial
  CRISPR gRNA sequence
gatggtggtcgtggagctgg

SEQ ID NO: 145124 - DNA, 20 bp, Artificial
  CRISPR gRNA sequence
tcgtggagctggtggtctgc

SEQ ID NO: 145125 - DNA, 20 bp, Artificial
  CRISPR gRNA sequence
tggtctgctggccttgctgc

SEQ ID NO: 145126 - DNA, 20 bp, Artificial
  CRISPR gRNA sequence
gctggccttgctgctggccc

SEQ ID NO: 145127 - DNA, 20 bp, Artificial
  CRISPR gRNA sequence
cttgctgctggccctggact

SEQ ID NO: 145128 - DNA, 20 bp, Artificial
  CRISPR gRNA sequence
ctgctggccctggacttgga

SEQ ID NO: 145129 - DNA, 20 bp, Artificial
  CRISPR gRNA sequence
ctggccctggacttggacag

SEQ ID NO: 145130 - DNA, 20 bp, Artificial
  CRISPR gRNA sequence
gccctggacttggacagcgg

SEQ ID NO: 145131 - DNA, 20 bp, Artificial
  CRISPR gRNA sequence
ccctggacttggacagcggt

SEQ ID NO: 145132 - DNA, 20 bp, Artificial
  CRISPR gRNA sequence
ttggacagcggtgggttgct

SEQ ID NO: 145133 - DNA, 20 bp, Artificial
  CRISPR gRNA sequence
acagcggtgggttgctgagc

SEQ ID NO: 145134 - DNA, 20 bp, Artificial
  CRISPR gRNA sequence
gttgctgagccagcgtgaaa

SEQ ID NO: 145135 - DNA, 20 bp, Artificial
  CRISPR gRNA sequence
gagccagcgtgaaatagtac

SEQ ID NO: 145136 - DNA, 20 bp, Artificial
  CRISPR gRNA sequence
agcgtgaaatagtactggac

SEQ ID NO: 145137 - DNA, 20 bp, Artificial
  CRISPR gRNA sequence
gaaatagtactggactggct

SEQ ID NO: 145138 - DNA, 20 bp, Artificial
  CRISPR gRNA sequence
atagtactggactggctcgg

SEQ ID NO: 145139 - DNA, 20 bp, Artificial
  CRISPR gRNA sequence
tagtactggactggctcggc

SEQ ID NO: 145140 - DNA, 20 bp, Artificial
  CRISPR gRNA sequence
gtactggactggctcggcag

SEQ ID NO: 145141 - DNA, 20 bp, Artificial
  CRISPR gRNA sequence
gactggctcggcaggagtta

SEQ ID NO: 145142 - DNA, 20 bp, Artificial
  CRISPR gRNA sequence
gctcggcaggagttacagac

SEQ ID NO: 145143 - DNA, 20 bp, Artificial
  CRISPR gRNA sequence
actggcgcacctcctcctgt

SEQ ID NO: 145144 - DNA, 20 bp, Artificial
  CRISPR gRNA sequence
ctggcgcacctcctcctgtt

SEQ ID NO: 145145 - DNA, 20 bp, Artificial
  CRISPR gRNA sequence
gcgcacctcctcctgttggg

SEQ ID NO: 145146 - DNA, 20 bp, Artificial
  CRISPR gRNA sequence
acctcctcctgttgggtgga

SEQ ID NO: 145147 - DNA, 20 bp, Artificial
  CRISPR gRNA sequence
ctcctcctgttgggtggaaa

SEQ ID NO: 145148 - DNA, 20 bp, Artificial
  CRISPR gRNA sequence
cctcctgttgggtggaaaga

SEQ ID NO: 145149 - DNA, 20 bp, Artificial
  CRISPR gRNA sequence
ctcctgttgggtggaaagag

SEQ ID NO: 145150 - DNA, 20 bp, Artificial
  CRISPR gRNA sequence
ctgttgggtggaaagagagg

SEQ ID NO: 145151 - DNA, 20 bp, Artificial
  CRISPR gRNA sequence
tgttgggtggaaagagaggc

SEQ ID NO: 145152 - DNA, 20 bp, Artificial
  CRISPR gRNA sequence
gggtggaaagagaggcaggt

SEQ ID NO: 145153 - DNA, 20 bp, Artificial
  CRISPR gRNA sequence
gtggaaagagaggcaggtaa

SEQ ID NO: 145154 - DNA, 20 bp, Artificial
  CRISPR gRNA sequence
tggaaagagaggcaggtaag

SEQ ID NO: 145155 - DNA, 20 bp, Artificial
  CRISPR gRNA sequence
agagaggcaggtaagaggaa

SEQ ID NO: 145156 - DNA, 20 bp, Artificial
  CRISPR gRNA sequence
taagaggaaaagaaccaact

SEQ ID NO: 145157 - DNA, 20 bp, Artificial
  CRISPR gRNA sequence
gaggaaaagaaccaactcag

SEQ ID NO: 145158 - DNA, 20 bp, Artificial
  CRISPR gRNA sequence
aaccaactcagcagccgcca

SEQ ID NO: 145159 - DNA, 20 bp, Artificial
  CRISPR gRNA sequence
atttccactcttcccccaaa

SEQ ID NO: 145160 - DNA, 20 bp, Artificial
  CRISPR gRNA sequence
tttccactcttcccccaaac

SEQ ID NO: 145161 - DNA, 20 bp, Artificial
  CRISPR gRNA sequence
tcccccaaacaggctatgtg

SEQ ID NO: 145162 - DNA, 20 bp, Artificial
  CRISPR gRNA sequence
gcagttgcctgctgaatgct

SEQ ID NO: 145163 - DNA, 20 bp, Artificial
  CRISPR gRNA sequence
tgctgagctctccacatttg

SEQ ID NO: 145164 - DNA, 20 bp, Artificial
  CRISPR gRNA sequence
gctctccacatttgaagcca

SEQ ID NO: 145165 - DNA, 20 bp, Artificial
  CRISPR gRNA sequence
ctctccacatttgaagccaa

SEQ ID NO: 145166 - DNA, 20 bp, Artificial
  CRISPR gRNA sequence
ccacatttgaagccaaagga

SEQ ID NO: 145167 - DNA, 20 bp, Artificial
  CRISPR gRNA sequence
catttgaagccaaaggaaag

SEQ ID NO: 145168 - DNA, 20 bp, Artificial
  CRISPR gRNA sequence
ccaaaggaaagtggaattca

SEQ ID NO: 145169 - DNA, 20 bp, Artificial
  CRISPR gRNA sequence
aaaggaaagtggaattcaaa

SEQ ID NO: 145170 - DNA, 20 bp, Artificial
  CRISPR gRNA sequence
aaagtggaattcaaagagac

SEQ ID NO: 145171 - DNA, 20 bp, Artificial
  CRISPR gRNA sequence
ctaaatcaaactaaaaataa

SEQ ID NO: 145172 - DNA, 20 bp, Artificial
  CRISPR gRNA sequence
actaaaaataacagatccta

SEQ ID NO: 145173 - DNA, 20 bp, Artificial
  CRISPR gRNA sequence
ctaaaaataacagatcctat

SEQ ID NO: 145174 - DNA, 20 bp, Artificial
  CRISPR gRNA sequence
tataggcttcacaaaacata

SEQ ID NO: 145175 - DNA, 20 bp, Artificial
  CRISPR gRNA sequence
aaacatacagccaatttctg

SEQ ID NO: 145176 - DNA, 20 bp, Artificial
  CRISPR gRNA sequence
ataatcacccattgcatgat

SEQ ID NO: 145177 - DNA, 20 bp, Artificial
  CRISPR gRNA sequence
attgcatgataagttgcaaa

SEQ ID NO: 145178 - DNA, 20 bp, Artificial
  CRISPR gRNA sequence
ttgcatgataagttgcaaac

SEQ ID NO: 145179 - DNA, 20 bp, Artificial
  CRISPR gRNA sequence
taagttgcaaacgggcaaat

SEQ ID NO: 145180 - DNA, 20 bp, Artificial
  CRISPR gRNA sequence
cgtaactaaaaaccacacac

SEQ ID NO: 145181 - DNA, 20 bp, Artificial
  CRISPR gRNA sequence
aactaaaaaccacacaccag

SEQ ID NO: 145182 - DNA, 20 bp, Artificial
  CRISPR gRNA sequence
cacacaccagcagtgcttgt

SEQ ID NO: 145183 - DNA, 20 bp, Artificial
  CRISPR gRNA sequence
gcttgtcagtaaatgctgtc

SEQ ID NO: 145184 - DNA, 20 bp, Artificial
  CRISPR gRNA sequence
cttgtcagtaaatgctgtca

SEQ ID NO: 145185 - DNA, 20 bp, Artificial
  CRISPR gRNA sequence
gctgtcaaggcctgtgatct

SEQ ID NO: 145186 - DNA, 20 bp, Artificial
  CRISPR gRNA sequence
caaggcctgtgatctgagaa

SEQ ID NO: 145187 - DNA, 20 bp, Artificial
  CRISPR gRNA sequence
ctgagaacagtgctaattgc

SEQ ID NO: 145188 - DNA, 20 bp, Artificial
  CRISPR gRNA sequence
acagtgctaattgcaagtgt

SEQ ID NO: 145189 - DNA, 20 bp, Artificial
  CRISPR gRNA sequence
cagtgctaattgcaagtgtt

SEQ ID NO: 145190 - DNA, 20 bp, Artificial
  CRISPR gRNA sequence
tgctaattgcaagtgttggg

SEQ ID NO: 145191 - DNA, 20 bp, Artificial
  CRISPR gRNA sequence
tacccaaacatcatgcctct

SEQ ID NO: 145192 - DNA, 20 bp, Artificial
  CRISPR gRNA sequence
acccaaacatcatgcctctc

SEQ ID NO: 145193 - DNA, 20 bp, Artificial
  CRISPR gRNA sequence
aacatcatgcctctcaggcc

SEQ ID NO: 145194 - DNA, 20 bp, Artificial
  CRISPR gRNA sequence
cctggtcccaatctcccaaa

SEQ ID NO: 145195 - DNA, 20 bp, Artificial
  CRISPR gRNA sequence
ctggtcccaatctcccaaat

SEQ ID NO: 145196 - DNA, 20 bp, Artificial
  CRISPR gRNA sequence
gtcccaatctcccaaatagg

SEQ ID NO: 145197 - DNA, 20 bp, Artificial
  CRISPR gRNA sequence
aggcagcactcttctcgttt

SEQ ID NO: 145198 - DNA, 20 bp, Artificial
  CRISPR gRNA sequence
cgttttagccccaccacttc

SEQ ID NO: 145199 - DNA, 20 bp, Artificial
  CRISPR gRNA sequence
gttttagccccaccacttca

SEQ ID NO: 145200 - DNA, 20 bp, Artificial
  CRISPR gRNA sequence
ttttagccccaccacttcaa

SEQ ID NO: 145201 - DNA, 20 bp, Artificial
  CRISPR gRNA sequence
tttagccccaccacttcaag

SEQ ID NO: 145202 - DNA, 20 bp, Artificial
  CRISPR gRNA sequence
ttagccccaccacttcaagg

SEQ ID NO: 145203 - DNA, 20 bp, Artificial
  CRISPR gRNA sequence
ccccaccacttcaaggggga

SEQ ID NO: 145204 - DNA, 20 bp, Artificial
  CRISPR gRNA sequence
ccacttcaagggggacagaa

SEQ ID NO: 145205 - DNA, 20 bp, Artificial
  CRISPR gRNA sequence
cacttcaagggggacagaac

SEQ ID NO: 145206 - DNA, 20 bp, Artificial
  CRISPR gRNA sequence
agggggacagaacaggttaa

SEQ ID NO: 145207 - DNA, 20 bp, Artificial
  CRISPR gRNA sequence
gggggacagaacaggttaat

SEQ ID NO: 145208 - DNA, 20 bp, Artificial
  CRISPR gRNA sequence
cagaacaggttaatgggaaa

SEQ ID NO: 145209 - DNA, 20 bp, Artificial
  CRISPR gRNA sequence
agaacaggttaatgggaaac

SEQ ID NO: 145210 - DNA, 20 bp, Artificial
  CRISPR gRNA sequence
gaacaggttaatgggaaaca

SEQ ID NO: 145211 - DNA, 20 bp, Artificial
  CRISPR gRNA sequence
tgggaaacagggcttttcct

SEQ ID NO: 145212 - DNA, 20 bp, Artificial
  CRISPR gRNA sequence
cttttcctgagctgaaattt

SEQ ID NO: 145213 - DNA, 20 bp, Artificial
  CRISPR gRNA sequence
ttttcctgagctgaaatttc

SEQ ID NO: 145214 - DNA, 20 bp, Artificial
  CRISPR gRNA sequence
tgagctgaaatttcaggatc

SEQ ID NO: 145215 - DNA, 20 bp, Artificial
  CRISPR gRNA sequence
agctgaaatttcaggatcga

SEQ ID NO: 145216 - DNA, 20 bp, Artificial
  CRISPR gRNA sequence
aatttcaggatcgagagcac

SEQ ID NO: 145217 - DNA, 20 bp, Artificial
  CRISPR gRNA sequence
ttcaggatcgagagcactgg

SEQ ID NO: 145218 - DNA, 20 bp, Artificial
  CRISPR gRNA sequence
tcaggatcgagagcactggt

SEQ ID NO: 145219 - DNA, 20 bp, Artificial
  CRISPR gRNA sequence
gatcgagagcactggtaggc

SEQ ID NO: 145220 - DNA, 20 bp, Artificial
  CRISPR gRNA sequence
agcactggtaggcaagtacc

SEQ ID NO: 145221 - DNA, 20 bp, Artificial
  CRISPR gRNA sequence
ggcaagtacccagcttttca

SEQ ID NO: 145222 - DNA, 20 bp, Artificial
  CRISPR gRNA sequence
agcttttcacagcttgttga

SEQ ID NO: 145223 - DNA, 20 bp, Artificial
  CRISPR gRNA sequence
acagcttgttgaaagctctg

SEQ ID NO: 145224 - DNA, 20 bp, Artificial
  CRISPR gRNA sequence
ttgaaagctctgtggtcact

SEQ ID NO: 145225 - DNA, 20 bp, Artificial
  CRISPR gRNA sequence
tgaaagctctgtggtcactg

SEQ ID NO: 145226 - DNA, 20 bp, Artificial
  CRISPR gRNA sequence
gaaagctctgtggtcactga

SEQ ID NO: 145227 - DNA, 20 bp, Artificial
  CRISPR gRNA sequence
tcactgagggcatgtctatc

SEQ ID NO: 145228 - DNA, 20 bp, Artificial
  CRISPR gRNA sequence
tgtctatccagtgtcacatc

SEQ ID NO: 145229 - DNA, 20 bp, Artificial
  CRISPR gRNA sequence
tccagtgtcacatctggttc

SEQ ID NO: 145230 - DNA, 20 bp, Artificial
  CRISPR gRNA sequence
catctggttctggttgtact

SEQ ID NO: 145231 - DNA, 20 bp, Artificial
  CRISPR gRNA sequence
gttctggttgtacttagcca

SEQ ID NO: 145232 - DNA, 20 bp, Artificial
  CRISPR gRNA sequence
ctggttgtacttagccacag

SEQ ID NO: 145233 - DNA, 20 bp, Artificial
  CRISPR gRNA sequence
ttagccacagaagcgcaacc

SEQ ID NO: 145234 - DNA, 20 bp, Artificial
  CRISPR gRNA sequence
tagccacagaagcgcaaccc

SEQ ID NO: 145235 - DNA, 20 bp, Artificial
  CRISPR gRNA sequence
agccacagaagcgcaaccca

SEQ ID NO: 145236 - DNA, 20 bp, Artificial
  CRISPR gRNA sequence
gccacagaagcgcaacccag

SEQ ID NO: 145237 - DNA, 20 bp, Artificial
  CRISPR gRNA sequence
ccacagaagcgcaacccagg

SEQ ID NO: 145238 - DNA, 20 bp, Artificial
  CRISPR gRNA sequence
gcgcaacccagggggcctga

SEQ ID NO: 145239 - DNA, 20 bp, Artificial
  CRISPR gRNA sequence
aacccagggggcctgatgga

SEQ ID NO: 145240 - DNA, 20 bp, Artificial
  CRISPR gRNA sequence
cctgatggacagctctccgc

SEQ ID NO: 145241 - DNA, 20 bp, Artificial
  CRISPR gRNA sequence
ctgatggacagctctccgct

SEQ ID NO: 145242 - DNA, 20 bp, Artificial
  CRISPR gRNA sequence
tgatggacagctctccgctg

SEQ ID NO: 145243 - DNA, 20 bp, Artificial
  CRISPR gRNA sequence
tctccgctggggtactgcct

SEQ ID NO: 145244 - DNA, 20 bp, Artificial
  CRISPR gRNA sequence
ggggtactgccttggctgat

SEQ ID NO: 145245 - DNA, 20 bp, Artificial
  CRISPR gRNA sequence
gggtactgccttggctgatt

SEQ ID NO: 145246 - DNA, 20 bp, Artificial
  CRISPR gRNA sequence
ggtactgccttggctgatta

SEQ ID NO: 145247 - DNA, 20 bp, Artificial
  CRISPR gRNA sequence
tactgccttggctgattagg

SEQ ID NO: 145248 - DNA, 20 bp, Artificial
  CRISPR gRNA sequence
actgccttggctgattaggg

SEQ ID NO: 145249 - DNA, 20 bp, Artificial
  CRISPR gRNA sequence
gtcgcattctgtccgatctg

SEQ ID NO: 145250 - DNA, 20 bp, Artificial
  CRISPR gRNA sequence
cgcattctgtccgatctgcg

SEQ ID NO: 145251 - DNA, 20 bp, Artificial
  CRISPR gRNA sequence
attctgtccgatctgcggag

SEQ ID NO: 145252 - DNA, 20 bp, Artificial
  CRISPR gRNA sequence
tctgtccgatctgcggagtg

SEQ ID NO: 145253 - DNA, 20 bp, Artificial
  CRISPR gRNA sequence
agtggagactgttccttctt

SEQ ID NO: 145254 - DNA, 20 bp, Artificial
  CRISPR gRNA sequence
tcttcagctgatgttttcca

SEQ ID NO: 145255 - DNA, 20 bp, Artificial
  CRISPR gRNA sequence
tcagctgatgttttccatgg

SEQ ID NO: 145256 - DNA, 20 bp, Artificial
  CRISPR gRNA sequence
gctgatgttttccatggcag

SEQ ID NO: 145257 - DNA, 20 bp, Artificial
  CRISPR gRNA sequence
ctgatgttttccatggcaga

SEQ ID NO: 145258 - DNA, 20 bp, Artificial
  CRISPR gRNA sequence
gatgttttccatggcagaag

SEQ ID NO: 145259 - DNA, 20 bp, Artificial
  CRISPR gRNA sequence
aggagtaaacaaccctctcc

SEQ ID NO: 145260 - DNA, 20 bp, Artificial
  CRISPR gRNA sequence
aaccctctcccagccacctt

SEQ ID NO: 145261 - DNA, 20 bp, Artificial
  CRISPR gRNA sequence
tcccagccaccttgagctca

SEQ ID NO: 145262 - DNA, 20 bp, Artificial
  CRISPR gRNA sequence
gccaccttgagctcacagct

SEQ ID NO: 145263 - DNA, 20 bp, Artificial
  CRISPR gRNA sequence
caccttgagctcacagctga

SEQ ID NO: 145264 - DNA, 20 bp, Artificial
  CRISPR gRNA sequence
tgagctcacagctgagagtg

SEQ ID NO: 145265 - DNA, 20 bp, Artificial
  CRISPR gRNA sequence
gagctcacagctgagagtgt

SEQ ID NO: 145266 - DNA, 20 bp, Artificial
  CRISPR gRNA sequence
taggatgtttacacacacta

SEQ ID NO: 145267 - DNA, 20 bp, Artificial
  CRISPR gRNA sequence
tgtttacacacactacagca

SEQ ID NO: 145268 - DNA, 20 bp, Artificial
  CRISPR gRNA sequence
cacacactacagcatggtta

SEQ ID NO: 145269 - DNA, 20 bp, Artificial
  CRISPR gRNA sequence
tacagcatggttatagccca

SEQ ID NO: 145270 - DNA, 20 bp, Artificial
  CRISPR gRNA sequence
acagcatggttatagcccac

SEQ ID NO: 145271 - DNA, 20 bp, Artificial
  CRISPR gRNA sequence
cagcatggttatagcccaca

SEQ ID NO: 145272 - DNA, 20 bp, Artificial
  CRISPR gRNA sequence
tggttatagcccacagggtc

SEQ ID NO: 145273 - DNA, 20 bp, Artificial
  CRISPR gRNA sequence
ggttatagcccacagggtcc

SEQ ID NO: 145274 - DNA, 20 bp, Artificial
  CRISPR gRNA sequence
gttatagcccacagggtcca

SEQ ID NO: 145275 - DNA, 20 bp, Artificial
  CRISPR gRNA sequence
ccacagggtccagggttgat

SEQ ID NO: 145276 - DNA, 20 bp, Artificial
  CRISPR gRNA sequence
tcagcccctgaccactgaca

SEQ ID NO: 145277 - DNA, 20 bp, Artificial
  CRISPR gRNA sequence
ccctgaccactgacacagaa

SEQ ID NO: 145278 - DNA, 20 bp, Artificial
  CRISPR gRNA sequence
acacagaacggcgtctgatc

SEQ ID NO: 145279 - DNA, 20 bp, Artificial
  CRISPR gRNA sequence
acagaacggcgtctgatccg

SEQ ID NO: 145280 - DNA, 20 bp, Artificial
  CRISPR gRNA sequence
ggagtgacctgtgtgacaca

SEQ ID NO: 145281 - DNA, 20 bp, Artificial
  CRISPR gRNA sequence
tgacacatggtgcccctgcc

SEQ ID NO: 145282 - DNA, 20 bp, Artificial
  CRISPR gRNA sequence
gacacatggtgcccctgcct

SEQ ID NO: 145283 - DNA, 20 bp, Artificial
  CRISPR gRNA sequence
caacaaaaacaataaaaaca

SEQ ID NO: 145284 - DNA, 20 bp, Artificial
  CRISPR gRNA sequence
aataaaaacacagaaccact

SEQ ID NO: 145285 - DNA, 20 bp, Artificial
  CRISPR gRNA sequence
ataaaaacacagaaccactt

SEQ ID NO: 145286 - DNA, 20 bp, Artificial
  CRISPR gRNA sequence
aaacacagaaccacttgggc

SEQ ID NO: 145287 - DNA, 20 bp, Artificial
  CRISPR gRNA sequence
cagaaccacttgggctggct

SEQ ID NO: 145288 - DNA, 20 bp, Artificial
  CRISPR gRNA sequence
ggctggctgagtaaaaatat

SEQ ID NO: 145289 - DNA, 20 bp, Artificial
  CRISPR gRNA sequence
aatttactcatgtccttatt

SEQ ID NO: 145290 - DNA, 20 bp, Artificial
  CRISPR gRNA sequence
atttactcatgtccttattc

SEQ ID NO: 145291 - DNA, 20 bp, Artificial
  CRISPR gRNA sequence
tttactcatgtccttattca

SEQ ID NO: 145292 - DNA, 20 bp, Artificial
  CRISPR gRNA sequence
tcatgtccttattcagggca

SEQ ID NO: 145293 - DNA, 20 bp, Artificial
  CRISPR gRNA sequence
gggcaaagtttgccacgttc

SEQ ID NO: 145294 - DNA, 20 bp, Artificial
  CRISPR gRNA sequence
aagtttgccacgttccagaa

SEQ ID NO: 145295 - DNA, 20 bp, Artificial
  CRISPR gRNA sequence
gtttgccacgttccagaaaa

SEQ ID NO: 145296 - DNA, 20 bp, Artificial
  CRISPR gRNA sequence
tttgccacgttccagaaaag

SEQ ID NO: 145297 - DNA, 20 bp, Artificial
  CRISPR gRNA sequence
cacgttccagaaaagaggaa

SEQ ID NO: 145298 - DNA, 20 bp, Artificial
  CRISPR gRNA sequence
aaagaggaaaagacacttct

SEQ ID NO: 145299 - DNA, 20 bp, Artificial
  CRISPR gRNA sequence
agacacttcttagatgtaca

SEQ ID NO: 145300 - DNA, 20 bp, Artificial
  CRISPR gRNA sequence
ttagatgtacacagaccctg

SEQ ID NO: 145301 - DNA, 20 bp, Artificial
  CRISPR gRNA sequence
ggattgcctccaactcccca

SEQ ID NO: 145302 - DNA, 20 bp, Artificial
  CRISPR gRNA sequence
tccccaaagtaacatttaca

SEQ ID NO: 145303 - DNA, 20 bp, Artificial
  CRISPR gRNA sequence
caaagtaacatttacaaagc

SEQ ID NO: 145304 - DNA, 20 bp, Artificial
  CRISPR gRNA sequence
accccatccccacactatgt

SEQ ID NO: 145305 - DNA, 20 bp, Artificial
  CRISPR gRNA sequence
ccccatccccacactatgtt

SEQ ID NO: 145306 - DNA, 20 bp, Artificial
  CRISPR gRNA sequence
tgccctcaactgtgcttcca

SEQ ID NO: 145307 - DNA, 20 bp, Artificial
  CRISPR gRNA sequence
cttccaaagtactgtcctca

SEQ ID NO: 145308 - DNA, 20 bp, Artificial
  CRISPR gRNA sequence
gtctgttctactaaaatgtt

SEQ ID NO: 145309 - DNA, 20 bp, Artificial
  CRISPR gRNA sequence
actaaaatgttaagcaccat

SEQ ID NO: 145310 - DNA, 20 bp, Artificial
  CRISPR gRNA sequence
ctaaaatgttaagcaccatg

SEQ ID NO: 145311 - DNA, 20 bp, Artificial
  CRISPR gRNA sequence
taaaatgttaagcaccatga

SEQ ID NO: 145312 - DNA, 20 bp, Artificial
  CRISPR gRNA sequence
tgttaagcaccatgagggca

SEQ ID NO: 145313 - DNA, 20 bp, Artificial
  CRISPR gRNA sequence
agcaccatgagggcaaagcc

SEQ ID NO: 145314 - DNA, 20 bp, Artificial
  CRISPR gRNA sequence
tctgctatcccccgcgttcc

SEQ ID NO: 145315 - DNA, 20 bp, Artificial
  CRISPR gRNA sequence
ctgctatcccccgcgttccc

SEQ ID NO: 145316 - DNA, 20 bp, Artificial
  CRISPR gRNA sequence
ctatcccccgcgttcccagg

SEQ ID NO: 145317 - DNA, 20 bp, Artificial
  CRISPR gRNA sequence
tatcccccgcgttcccaggt

SEQ ID NO: 145318 - DNA, 20 bp, Artificial
  CRISPR gRNA sequence
cgcgttcccaggtaggcact

SEQ ID NO: 145319 - DNA, 20 bp, Artificial
  CRISPR gRNA sequence
ttcccaggtaggcactcagt

SEQ ID NO: 145320 - DNA, 20 bp, Artificial
  CRISPR gRNA sequence
agtgcgtgatgaatgatgaa

SEQ ID NO: 145321 - DNA, 20 bp, Artificial
  CRISPR gRNA sequence
tgatgaatgatgaatggatt

SEQ ID NO: 145322 - DNA, 20 bp, Artificial
  CRISPR gRNA sequence
gaatgatgaatggatttaga

SEQ ID NO: 145323 - DNA, 20 bp, Artificial
  CRISPR gRNA sequence
aatgatgaatggatttagac

SEQ ID NO: 145324 - DNA, 20 bp, Artificial
  CRISPR gRNA sequence
gatgaatggatttagacagg

SEQ ID NO: 145325 - DNA, 20 bp, Artificial
  CRISPR gRNA sequence
aatggatttagacaggcaga

SEQ ID NO: 145326 - DNA, 20 bp, Artificial
  CRISPR gRNA sequence
gatttagacaggcagacagt

SEQ ID NO: 145327 - DNA, 20 bp, Artificial
  CRISPR gRNA sequence
tttagacaggcagacagtta

SEQ ID NO: 145328 - DNA, 20 bp, Artificial
  CRISPR gRNA sequence
ttagacaggcagacagttag

SEQ ID NO: 145329 - DNA, 20 bp, Artificial
  CRISPR gRNA sequence
gacaggcagacagttagagg

SEQ ID NO: 145330 - DNA, 20 bp, Artificial
  CRISPR gRNA sequence
acaggcagacagttagaggc

SEQ ID NO: 145331 - DNA, 20 bp, Artificial
  CRISPR gRNA sequence
gcagacagttagaggcagga

SEQ ID NO: 145332 - DNA, 20 bp, Artificial
  CRISPR gRNA sequence
gacagttagaggcaggaaag

SEQ ID NO: 145333 - DNA, 20 bp, Artificial
  CRISPR gRNA sequence
acaaattctcttaaacccaa

SEQ ID NO: 145334 - DNA, 20 bp, Artificial
  CRISPR gRNA sequence
aacccaacagctgttaccaa

SEQ ID NO: 145335 - DNA, 20 bp, Artificial
  CRISPR gRNA sequence
cagctgttaccaatagaaaa

SEQ ID NO: 145336 - DNA, 20 bp, Artificial
  CRISPR gRNA sequence
ctgttaccaatagaaaaaag

SEQ ID NO: 145337 - DNA, 20 bp, Artificial
  CRISPR gRNA sequence
gtagtctctaaactctcttt

SEQ ID NO: 145338 - DNA, 20 bp, Artificial
  CRISPR gRNA sequence
aactctcttttggtacctct

SEQ ID NO: 145339 - DNA, 20 bp, Artificial
  CRISPR gRNA sequence
ttggtacctctaagactctg

SEQ ID NO: 145340 - DNA, 20 bp, Artificial
  CRISPR gRNA sequence
cctctaagactctgtggcca

SEQ ID NO: 145341 - DNA, 20 bp, Artificial
  CRISPR gRNA sequence
agactctgtggccacagtgt

SEQ ID NO: 145342 - DNA, 20 bp, Artificial
  CRISPR gRNA sequence
gactctgtggccacagtgtg

SEQ ID NO: 145343 - DNA, 20 bp, Artificial
  CRISPR gRNA sequence
tctgtggccacagtgtgagg

SEQ ID NO: 145344 - DNA, 20 bp, Artificial
  CRISPR gRNA sequence
gtggccacagtgtgaggaag

SEQ ID NO: 145345 - DNA, 20 bp, Artificial
  CRISPR gRNA sequence
ccacagtgtgaggaagcagc

SEQ ID NO: 145346 - DNA, 20 bp, Artificial
  CRISPR gRNA sequence
gaagcagctagtgtcccctg

SEQ ID NO: 145347 - DNA, 20 bp, Artificial
  CRISPR gRNA sequence
agctagtgtcccctgtggaa

SEQ ID NO: 145348 - DNA, 20 bp, Artificial
  CRISPR gRNA sequence
ctagtgtcccctgtggaaca

SEQ ID NO: 145349 - DNA, 20 bp, Artificial
  CRISPR gRNA sequence
gtcccctgtggaacagagct

SEQ ID NO: 145350 - DNA, 20 bp, Artificial
  CRISPR gRNA sequence
tcctttgtttgcctgatgtc

SEQ ID NO: 145351 - DNA, 20 bp, Artificial
  CRISPR gRNA sequence
cctttgtttgcctgatgtct

SEQ ID NO: 145352 - DNA, 20 bp, Artificial
  CRISPR gRNA sequence
ctttgtttgcctgatgtctg

SEQ ID NO: 145353 - DNA, 20 bp, Artificial
  CRISPR gRNA sequence
tttgtttgcctgatgtctgg

SEQ ID NO: 145354 - DNA, 20 bp, Artificial
  CRISPR gRNA sequence
tttgcctgatgtctgggggc

SEQ ID NO: 145355 - DNA, 20 bp, Artificial
  CRISPR gRNA sequence
ttgcctgatgtctgggggct

SEQ ID NO: 145356 - DNA, 20 bp, Artificial
  CRISPR gRNA sequence
gggggctaggatactaaaac

SEQ ID NO: 145357 - DNA, 20 bp, Artificial
  CRISPR gRNA sequence
ggggctaggatactaaaact

SEQ ID NO: 145358 - DNA, 20 bp, Artificial
  CRISPR gRNA sequence
gatactaaaactaggactgc

SEQ ID NO: 145359 - DNA, 20 bp, Artificial
  CRISPR gRNA sequence
gactgccagtatctacccct

SEQ ID NO: 145360 - DNA, 20 bp, Artificial
  CRISPR gRNA sequence
gtatctacccctgagaaaca

SEQ ID NO: 145361 - DNA, 20 bp, Artificial
  CRISPR gRNA sequence
tatctacccctgagaaacat

SEQ ID NO: 145362 - DNA, 20 bp, Artificial
  CRISPR gRNA sequence
acatgggtctctgcatgaca

SEQ ID NO: 145363 - DNA, 20 bp, Artificial
  CRISPR gRNA sequence
tgcatgacatggttacttga

SEQ ID NO: 145364 - DNA, 20 bp, Artificial
  CRISPR gRNA sequence
ttacttgacagccatctacc

SEQ ID NO: 145365 - DNA, 20 bp, Artificial
  CRISPR gRNA sequence
tgacagccatctacccagct

SEQ ID NO: 145366 - DNA, 20 bp, Artificial
  CRISPR gRNA sequence
gacagccatctacccagctt

SEQ ID NO: 145367 - DNA, 20 bp, Artificial
  CRISPR gRNA sequence
acagccatctacccagctta

SEQ ID NO: 145368 - DNA, 20 bp, Artificial
  CRISPR gRNA sequence
agccatctacccagcttagg

SEQ ID NO: 145369 - DNA, 20 bp, Artificial
  CRISPR gRNA sequence
gggagatacctgtaacattc

SEQ ID NO: 145370 - DNA, 20 bp, Artificial
  CRISPR gRNA sequence
ggagatacctgtaacattct

SEQ ID NO: 145371 - DNA, 20 bp, Artificial
  CRISPR gRNA sequence
ctgtaacattctgggtttct

SEQ ID NO: 145372 - DNA, 20 bp, Artificial
  CRISPR gRNA sequence
taatatatgaactgactttt

SEQ ID NO: 145373 - DNA, 20 bp, Artificial
  CRISPR gRNA sequence
aatatatgaactgacttttt

SEQ ID NO: 145374 - DNA, 20 bp, Artificial
  CRISPR gRNA sequence
actgactttttaggttgata

SEQ ID NO: 145375 - DNA, 20 bp, Artificial
  CRISPR gRNA sequence
ggttgatatagtctgtgctt

SEQ ID NO: 145376 - DNA, 20 bp, Artificial
  CRISPR gRNA sequence
gtctgtgcttcagacacaaa

SEQ ID NO: 145377 - DNA, 20 bp, Artificial
  CRISPR gRNA sequence
accctcaatatgattatgct

SEQ ID NO: 145378 - DNA, 20 bp, Artificial
  CRISPR gRNA sequence
ccctcaatatgattatgcta

SEQ ID NO: 145379 - DNA, 20 bp, Artificial
  CRISPR gRNA sequence
tcaatatgattatgctaagg

SEQ ID NO: 145380 - DNA, 20 bp, Artificial
  CRISPR gRNA sequence
atatgattatgctaaggcag

SEQ ID NO: 145381 - DNA, 20 bp, Artificial
  CRISPR gRNA sequence
tatgattatgctaaggcaga

SEQ ID NO: 145382 - DNA, 20 bp, Artificial
  CRISPR gRNA sequence
ttatgctaaggcagaaggaa

SEQ ID NO: 145383 - DNA, 20 bp, Artificial
  CRISPR gRNA sequence
tatgctaaggcagaaggaaa

SEQ ID NO: 145384 - DNA, 20 bp, Artificial
  CRISPR gRNA sequence
tgctaaggcagaaggaaaag

SEQ ID NO: 145385 - DNA, 20 bp, Artificial
  CRISPR gRNA sequence
gattcccttttattttcatc

SEQ ID NO: 145386 - DNA, 20 bp, Artificial
  CRISPR gRNA sequence
attcccttttattttcatct

SEQ ID NO: 145387 - DNA, 20 bp, Artificial
  CRISPR gRNA sequence
tcatcattataaataaatgt

SEQ ID NO: 145388 - DNA, 20 bp, Artificial
  CRISPR gRNA sequence
attataaataaatgtcagcc

SEQ ID NO: 145389 - DNA, 20 bp, Artificial
  CRISPR gRNA sequence
ataaatgtcagcctggaaac

SEQ ID NO: 145390 - DNA, 20 bp, Artificial
  CRISPR gRNA sequence
taaatgtcagcctggaaact

SEQ ID NO: 145391 - DNA, 20 bp, Artificial
  CRISPR gRNA sequence
tcagcctggaaactaggtat

SEQ ID NO: 145392 - DNA, 20 bp, Artificial
  CRISPR gRNA sequence
tggaaactaggtattggctg

SEQ ID NO: 145393 - DNA, 20 bp, Artificial
  CRISPR gRNA sequence
actaggtattggctgtggca

SEQ ID NO: 145394 - DNA, 20 bp, Artificial
  CRISPR gRNA sequence
taaaatactgataccttttg

SEQ ID NO: 145395 - DNA, 20 bp, Artificial
  CRISPR gRNA sequence
tactgataccttttgcagcc

SEQ ID NO: 145396 - DNA, 20 bp, Artificial
  CRISPR gRNA sequence
taccttttgcagccaagaaa

SEQ ID NO: 145397 - DNA, 20 bp, Artificial
  CRISPR gRNA sequence
cttttgcagccaagaaacag

SEQ ID NO: 145398 - DNA, 20 bp, Artificial
  CRISPR gRNA sequence
gaagccaactgctctttgca

SEQ ID NO: 145399 - DNA, 20 bp, Artificial
  CRISPR gRNA sequence
tgctctttgcaaagctattg

SEQ ID NO: 145400 - DNA, 20 bp, Artificial
  CRISPR gRNA sequence
tctttgcaaagctattgaag

SEQ ID NO: 145401 - DNA, 20 bp, Artificial
  CRISPR gRNA sequence
ctttgcaaagctattgaagt

SEQ ID NO: 145402 - DNA, 20 bp, Artificial
  CRISPR gRNA sequence
aaagctattgaagtaggttc

SEQ ID NO: 145403 - DNA, 20 bp, Artificial
  CRISPR gRNA sequence
aagctattgaagtaggttca

SEQ ID NO: 145404 - DNA, 20 bp, Artificial
  CRISPR gRNA sequence
caaggtacttgtgttccact

SEQ ID NO: 145405 - DNA, 20 bp, Artificial
  CRISPR gRNA sequence
ctcccttattattttacaaa

SEQ ID NO: 145406 - DNA, 20 bp, Artificial
  CRISPR gRNA sequence
aagcacaaatcactgaaatc

SEQ ID NO: 145407 - DNA, 20 bp, Artificial
  CRISPR gRNA sequence
actgaaatccagacctaact

SEQ ID NO: 145408 - DNA, 20 bp, Artificial
  CRISPR gRNA sequence
aatccagacctaacttggaa

SEQ ID NO: 145409 - DNA, 20 bp, Artificial
  CRISPR gRNA sequence
acctaacttggaaaagctct

SEQ ID NO: 145410 - DNA, 20 bp, Artificial
  CRISPR gRNA sequence
cctaacttggaaaagctctt

SEQ ID NO: 145411 - DNA, 20 bp, Artificial
  CRISPR gRNA sequence
tggaaaagctcttgggtaat

SEQ ID NO: 145412 - DNA, 20 bp, Artificial
  CRISPR gRNA sequence
gaaaagctcttgggtaatga

SEQ ID NO: 145413 - DNA, 20 bp, Artificial
  CRISPR gRNA sequence
aaaagctcttgggtaatgag

SEQ ID NO: 145414 - DNA, 20 bp, Artificial
  CRISPR gRNA sequence
aaagctcttgggtaatgaga

SEQ ID NO: 145415 - DNA, 20 bp, Artificial
  CRISPR gRNA sequence
ttgggtaatgagagggtata

SEQ ID NO: 145416 - DNA, 20 bp, Artificial
  CRISPR gRNA sequence
tgggtaatgagagggtatac

SEQ ID NO: 145417 - DNA, 20 bp, Artificial
  CRISPR gRNA sequence
atgagagggtatacaggaat

SEQ ID NO: 145418 - DNA, 20 bp, Artificial
  CRISPR gRNA sequence
gagagggtatacaggaatga

SEQ ID NO: 145419 - DNA, 20 bp, Artificial
  CRISPR gRNA sequence
gtatacaggaatgagagcct

SEQ ID NO: 145420 - DNA, 20 bp, Artificial
  CRISPR gRNA sequence
aggaatgagagcctcagaac

SEQ ID NO: 145421 - DNA, 20 bp, Artificial
  CRISPR gRNA sequence
gagcctcagaaccagctgtg

SEQ ID NO: 145422 - DNA, 20 bp, Artificial
  CRISPR gRNA sequence
agcctcagaaccagctgtgt

SEQ ID NO: 145423 - DNA, 20 bp, Artificial
  CRISPR gRNA sequence
ctcagaaccagctgtgtagg

SEQ ID NO: 145424 - DNA, 20 bp, Artificial
  CRISPR gRNA sequence
gaaccagctgtgtaggaagc

SEQ ID NO: 145425 - DNA, 20 bp, Artificial
  CRISPR gRNA sequence
aaccagctgtgtaggaagct

SEQ ID NO: 145426 - DNA, 20 bp, Artificial
  CRISPR gRNA sequence
cagctgtgtaggaagctagg

SEQ ID NO: 145427 - DNA, 20 bp, Artificial
  CRISPR gRNA sequence
ctgtgtaggaagctaggcag

SEQ ID NO: 145428 - DNA, 20 bp, Artificial
  CRISPR gRNA sequence
tgtgtaggaagctaggcagc

SEQ ID NO: 145429 - DNA, 20 bp, Artificial
  CRISPR gRNA sequence
gtgtaggaagctaggcagca

SEQ ID NO: 145430 - DNA, 20 bp, Artificial
  CRISPR gRNA sequence
gtaggaagctaggcagcagg

SEQ ID NO: 145431 - DNA, 20 bp, Artificial
  CRISPR gRNA sequence
agggagacacctgcattttc

SEQ ID NO: 145432 - DNA, 20 bp, Artificial
  CRISPR gRNA sequence
agccgtgacctgtgattgtt

SEQ ID NO: 145433 - DNA, 20 bp, Artificial
  CRISPR gRNA sequence
acctgtgattgtttagtctc

SEQ ID NO: 145434 - DNA, 20 bp, Artificial
  CRISPR gRNA sequence
tctccagttatccccaacta

SEQ ID NO: 145435 - DNA, 20 bp, Artificial
  CRISPR gRNA sequence
atccccaactacagctgatc

SEQ ID NO: 145436 - DNA, 20 bp, Artificial
  CRISPR gRNA sequence
attgaatatgatctttttgt

SEQ ID NO: 145437 - DNA, 20 bp, Artificial
  CRISPR gRNA sequence
tgatctttttgtcagacaaa

SEQ ID NO: 145438 - DNA, 20 bp, Artificial
  CRISPR gRNA sequence
aaccctttaaaaaccccttc

SEQ ID NO: 145439 - DNA, 20 bp, Artificial
  CRISPR gRNA sequence
cccaaaatatctcttgccaa

SEQ ID NO: 145440 - DNA, 20 bp, Artificial
  CRISPR gRNA sequence
tatctcttgccaaaagctgt

SEQ ID NO: 145441 - DNA, 20 bp, Artificial
  CRISPR gRNA sequence
tctcttgccaaaagctgtga

SEQ ID NO: 145442 - DNA, 20 bp, Artificial
  CRISPR gRNA sequence
cttgccaaaagctgtgagag

SEQ ID NO: 145443 - DNA, 20 bp, Artificial
  CRISPR gRNA sequence
ttgccaaaagctgtgagagc

SEQ ID NO: 145444 - DNA, 20 bp, Artificial
  CRISPR gRNA sequence
aaaagctgtgagagcaggac

SEQ ID NO: 145445 - DNA, 20 bp, Artificial
  CRISPR gRNA sequence
aagctgtgagagcaggacaa

SEQ ID NO: 145446 - DNA, 20 bp, Artificial
  CRISPR gRNA sequence
ctcttaaactgtttatgaac

SEQ ID NO: 145447 - DNA, 20 bp, Artificial
  CRISPR gRNA sequence
taaactgtttatgaactaga

SEQ ID NO: 145448 - DNA, 20 bp, Artificial
  CRISPR gRNA sequence
tttatgaactagacagtatc

SEQ ID NO: 145449 - DNA, 20 bp, Artificial
  CRISPR gRNA sequence
ttatgaactagacagtatct

SEQ ID NO: 145450 - DNA, 20 bp, Artificial
  CRISPR gRNA sequence
tagacagtatctaggacact

SEQ ID NO: 145451 - DNA, 20 bp, Artificial
  CRISPR gRNA sequence
tatctaggacactgagaatc

SEQ ID NO: 145452 - DNA, 20 bp, Artificial
  CRISPR gRNA sequence
ctaggacactgagaatcaag

SEQ ID NO: 145453 - DNA, 20 bp, Artificial
  CRISPR gRNA sequence
aggacactgagaatcaagtg

SEQ ID NO: 145454 - DNA, 20 bp, Artificial
  CRISPR gRNA sequence
ggacactgagaatcaagtgg

SEQ ID NO: 145455 - DNA, 20 bp, Artificial
  CRISPR gRNA sequence
gagaatcaagtggaggcacc

SEQ ID NO: 145456 - DNA, 20 bp, Artificial
  CRISPR gRNA sequence
agaatcaagtggaggcacct

SEQ ID NO: 145457 - DNA, 20 bp, Artificial
  CRISPR gRNA sequence
ggcacctaggtttgtgttgt

SEQ ID NO: 145458 - DNA, 20 bp, Artificial
  CRISPR gRNA sequence
gcacctaggtttgtgttgtt

SEQ ID NO: 145459 - DNA, 20 bp, Artificial
  CRISPR gRNA sequence
taggtttgtgttgttaggac

SEQ ID NO: 145460 - DNA, 20 bp, Artificial
  CRISPR gRNA sequence
aggtttgtgttgttaggaca

SEQ ID NO: 145461 - DNA, 20 bp, Artificial
  CRISPR gRNA sequence
cacaactgttctcaaatcac

SEQ ID NO: 145462 - DNA, 20 bp, Artificial
  CRISPR gRNA sequence
ctgttctcaaatcactggaa

SEQ ID NO: 145463 - DNA, 20 bp, Artificial
  CRISPR gRNA sequence
ttctcaaatcactggaatgg

SEQ ID NO: 145464 - DNA, 20 bp, Artificial
  CRISPR gRNA sequence
tcaaatcactggaatggaag

SEQ ID NO: 145465 - DNA, 20 bp, Artificial
  CRISPR gRNA sequence
caaatcactggaatggaaga

SEQ ID NO: 145466 - DNA, 20 bp, Artificial
  CRISPR gRNA sequence
gaatggaagaaggcatatct

SEQ ID NO: 145467 - DNA, 20 bp, Artificial
  CRISPR gRNA sequence
aatggaagaaggcatatcta

SEQ ID NO: 145468 - DNA, 20 bp, Artificial
  CRISPR gRNA sequence
taaggctcttctgcattatg

SEQ ID NO: 145469 - DNA, 20 bp, Artificial
  CRISPR gRNA sequence
atgaagactcattctgccaa

SEQ ID NO: 145470 - DNA, 20 bp, Artificial
  CRISPR gRNA sequence
gaagactcattctgccaatg

SEQ ID NO: 145471 - DNA, 20 bp, Artificial
  CRISPR gRNA sequence
aagactcattctgccaatgg

SEQ ID NO: 145472 - DNA, 20 bp, Artificial
  CRISPR gRNA sequence
tcattctgccaatggaggtc

SEQ ID NO: 145473 - DNA, 20 bp, Artificial
  CRISPR gRNA sequence
tctgccaatggaggtcaagc

SEQ ID NO: 145474 - DNA, 20 bp, Artificial
  CRISPR gRNA sequence
ccaatggaggtcaagccagc

SEQ ID NO: 145475 - DNA, 20 bp, Artificial
  CRISPR gRNA sequence
caatggaggtcaagccagca

SEQ ID NO: 145476 - DNA, 20 bp, Artificial
  CRISPR gRNA sequence
agcaaggaaatgattatgct

SEQ ID NO: 145477 - DNA, 20 bp, Artificial
  CRISPR gRNA sequence
aaatgattatgcttggttta

SEQ ID NO: 145478 - DNA, 20 bp, Artificial
  CRISPR gRNA sequence
ttatgcttggtttaaagaaa

SEQ ID NO: 145479 - DNA, 20 bp, Artificial
  CRISPR gRNA sequence
tatgcttggtttaaagaaat

SEQ ID NO: 145480 - DNA, 20 bp, Artificial
  CRISPR gRNA sequence
ggtttaaagaaatgggtgaa

SEQ ID NO: 145481 - DNA, 20 bp, Artificial
  CRISPR gRNA sequence
aaaagataatgacatttcaa

SEQ ID NO: 145482 - DNA, 20 bp, Artificial
  CRISPR gRNA sequence
aaagataatgacatttcaat

SEQ ID NO: 145483 - DNA, 20 bp, Artificial
  CRISPR gRNA sequence
gataatgacatttcaatggg

SEQ ID NO: 145484 - DNA, 20 bp, Artificial
  CRISPR gRNA sequence
ataatgacatttcaatgggc

SEQ ID NO: 145485 - DNA, 20 bp, Artificial
  CRISPR gRNA sequence
ggcaggaactttcaactcaa

SEQ ID NO: 145486 - DNA, 20 bp, Artificial
  CRISPR gRNA sequence
aactttcaactcaatagctt

SEQ ID NO: 145487 - DNA, 20 bp, Artificial
  CRISPR gRNA sequence
tttcaactcaatagctttag

SEQ ID NO: 145488 - DNA, 20 bp, Artificial
  CRISPR gRNA sequence
ttcaactcaatagctttagt

SEQ ID NO: 145489 - DNA, 20 bp, Artificial
  CRISPR gRNA sequence
tcaactcaatagctttagtg

SEQ ID NO: 145490 - DNA, 20 bp, Artificial
  CRISPR gRNA sequence
actcaatagctttagtgggg

SEQ ID NO: 145491 - DNA, 20 bp, Artificial
  CRISPR gRNA sequence
caatagctttagtggggcag

SEQ ID NO: 145492 - DNA, 20 bp, Artificial
  CRISPR gRNA sequence
agctttagtggggcagaagt

SEQ ID NO: 145493 - DNA, 20 bp, Artificial
  CRISPR gRNA sequence
gctttagtggggcagaagtc

SEQ ID NO: 145494 - DNA, 20 bp, Artificial
  CRISPR gRNA sequence
aatctttacttgcttctctg

SEQ ID NO: 145495 - DNA, 20 bp, Artificial
  CRISPR gRNA sequence
tacttgcttctctgaagaac

SEQ ID NO: 145496 - DNA, 20 bp, Artificial
  CRISPR gRNA sequence
gaagaacaagcgaaactctc

SEQ ID NO: 145497 - DNA, 20 bp, Artificial
  CRISPR gRNA sequence
cgaaactctcaagtatcttt

SEQ ID NO: 145498 - DNA, 20 bp, Artificial
  CRISPR gRNA sequence
aactctcaagtatctttgag

SEQ ID NO: 145499 - DNA, 20 bp, Artificial
  CRISPR gRNA sequence
ctcaagtatctttgagaagt

SEQ ID NO: 145500 - DNA, 20 bp, Artificial
  CRISPR gRNA sequence
tcaagtatctttgagaagtc

SEQ ID NO: 145501 - DNA, 20 bp, Artificial
  CRISPR gRNA sequence
caagtatctttgagaagtca

SEQ ID NO: 145502 - DNA, 20 bp, Artificial
  CRISPR gRNA sequence
tctttgagaagtcagggcct

SEQ ID NO: 145503 - DNA, 20 bp, Artificial
  CRISPR gRNA sequence
agggccttggactcacaatt

SEQ ID NO: 145504 - DNA, 20 bp, Artificial
  CRISPR gRNA sequence
cacaattcagtatttctgac

SEQ ID NO: 145505 - DNA, 20 bp, Artificial
  CRISPR gRNA sequence
ttctgactagttccttttcc

SEQ ID NO: 145506 - DNA, 20 bp, Artificial
  CRISPR gRNA sequence
tgactagttccttttcccag

SEQ ID NO: 145507 - DNA, 20 bp, Artificial
  CRISPR gRNA sequence
ctagttccttttcccagcag

SEQ ID NO: 145508 - DNA, 20 bp, Artificial
  CRISPR gRNA sequence
tagttccttttcccagcagt

SEQ ID NO: 145509 - DNA, 20 bp, Artificial
  CRISPR gRNA sequence
gttccttttcccagcagtgg

SEQ ID NO: 145510 - DNA, 20 bp, Artificial
  CRISPR gRNA sequence
ttccttttcccagcagtggg

SEQ ID NO: 145511 - DNA, 20 bp, Artificial
  CRISPR gRNA sequence
cagcagtgggaggttgcccc

SEQ ID NO: 145512 - DNA, 20 bp, Artificial
  CRISPR gRNA sequence
cagtgggaggttgccccaag

SEQ ID NO: 145513 - DNA, 20 bp, Artificial
  CRISPR gRNA sequence
tgggaggttgccccaagtgg

SEQ ID NO: 145514 - DNA, 20 bp, Artificial
  CRISPR gRNA sequence
cagaacaatgctttaatgac

SEQ ID NO: 145515 - DNA, 20 bp, Artificial
  CRISPR gRNA sequence
ctttaatgactggatcaatc

SEQ ID NO: 145516 - DNA, 20 bp, Artificial
  CRISPR gRNA sequence
atgactggatcaatccagaa

SEQ ID NO: 145517 - DNA, 20 bp, Artificial
  CRISPR gRNA sequence
tgactggatcaatccagaat

SEQ ID NO: 145518 - DNA, 20 bp, Artificial
  CRISPR gRNA sequence
gactggatcaatccagaatg

SEQ ID NO: 145519 - DNA, 20 bp, Artificial
  CRISPR gRNA sequence
atggggcacttgctcaactt

SEQ ID NO: 145520 - DNA, 20 bp, Artificial
  CRISPR gRNA sequence
gggcacttgctcaactttag

SEQ ID NO: 145521 - DNA, 20 bp, Artificial
  CRISPR gRNA sequence
cacttgctcaactttagcag

SEQ ID NO: 145522 - DNA, 20 bp, Artificial
  CRISPR gRNA sequence
agcagtggcctccccaacta

SEQ ID NO: 145523 - DNA, 20 bp, Artificial
  CRISPR gRNA sequence
gcagtggcctccccaactac

SEQ ID NO: 145524 - DNA, 20 bp, Artificial
  CRISPR gRNA sequence
cagtggcctccccaactaca

SEQ ID NO: 145525 - DNA, 20 bp, Artificial
  CRISPR gRNA sequence
ccaactacagggcttgctct

SEQ ID NO: 145526 - DNA, 20 bp, Artificial
  CRISPR gRNA sequence
gcttgctcttggaatctttc

SEQ ID NO: 145527 - DNA, 20 bp, Artificial
  CRISPR gRNA sequence
tgctcttggaatctttccag

SEQ ID NO: 145528 - DNA, 20 bp, Artificial
  CRISPR gRNA sequence
ttggaatctttccagaagct

SEQ ID NO: 145529 - DNA, 20 bp, Artificial
  CRISPR gRNA sequence
cagaagctgagactgacgaa

SEQ ID NO: 145530 - DNA, 20 bp, Artificial
  CRISPR gRNA sequence
ctgagactgacgaacagtgc

SEQ ID NO: 145531 - DNA, 20 bp, Artificial
  CRISPR gRNA sequence
gagactgacgaacagtgcca

SEQ ID NO: 145532 - DNA, 20 bp, Artificial
  CRISPR gRNA sequence
actgacgaacagtgccagag

SEQ ID NO: 145533 - DNA, 20 bp, Artificial
  CRISPR gRNA sequence
tgacgaacagtgccagagaa

SEQ ID NO: 145534 - DNA, 20 bp, Artificial
  CRISPR gRNA sequence
cgaacagtgccagagaagag

SEQ ID NO: 145535 - DNA, 20 bp, Artificial
  CRISPR gRNA sequence
agaagagcagcatcacatcc

SEQ ID NO: 145536 - DNA, 20 bp, Artificial
  CRISPR gRNA sequence
gaagagcagcatcacatcct

SEQ ID NO: 145537 - DNA, 20 bp, Artificial
  CRISPR gRNA sequence
aagagcagcatcacatccta

SEQ ID NO: 145538 - DNA, 20 bp, Artificial
  CRISPR gRNA sequence
acatcctagggccatctcta

SEQ ID NO: 145539 - DNA, 20 bp, Artificial
  CRISPR gRNA sequence
tctctacagtgttgtgcaac

SEQ ID NO: 145540 - DNA, 20 bp, Artificial
  CRISPR gRNA sequence
gttgtgcaaccagccctgac

SEQ ID NO: 145541 - DNA, 20 bp, Artificial
  CRISPR gRNA sequence
aaccagccctgactggaaaa

SEQ ID NO: 145542 - DNA, 20 bp, Artificial
  CRISPR gRNA sequence
ggaaaaaagtacattcgctt

SEQ ID NO: 145543 - DNA, 20 bp, Artificial
  CRISPR gRNA sequence
aaaaagtacattcgctttag

SEQ ID NO: 145544 - DNA, 20 bp, Artificial
  CRISPR gRNA sequence
agtacattcgctttagtagc

SEQ ID NO: 145545 - DNA, 20 bp, Artificial
  CRISPR gRNA sequence
tacattcgctttagtagcaa

SEQ ID NO: 145546 - DNA, 20 bp, Artificial
  CRISPR gRNA sequence
gagtgaactgctgcctcctt

SEQ ID NO: 145547 - DNA, 20 bp, Artificial
  CRISPR gRNA sequence
gaactgctgcctccttcaga

SEQ ID NO: 145548 - DNA, 20 bp, Artificial
  CRISPR gRNA sequence
aactgctgcctccttcagaa

SEQ ID NO: 145549 - DNA, 20 bp, Artificial
  CRISPR gRNA sequence
actgctgcctccttcagaaa

SEQ ID NO: 145550 - DNA, 20 bp, Artificial
  CRISPR gRNA sequence
gctgcctccttcagaaaggg

SEQ ID NO: 145551 - DNA, 20 bp, Artificial
  CRISPR gRNA sequence
ctgcctccttcagaaagggt

SEQ ID NO: 145552 - DNA, 20 bp, Artificial
  CRISPR gRNA sequence
ccttcagaaagggtgggttt

SEQ ID NO: 145553 - DNA, 20 bp, Artificial
  CRISPR gRNA sequence
ttcagaaagggtgggttttg

SEQ ID NO: 145554 - DNA, 20 bp, Artificial
  CRISPR gRNA sequence
cagaaagggtgggttttgga

SEQ ID NO: 145555 - DNA, 20 bp, Artificial
  CRISPR gRNA sequence
aaagggtgggttttggagag

SEQ ID NO: 145556 - DNA, 20 bp, Artificial
  CRISPR gRNA sequence
aagggtgggttttggagagt

SEQ ID NO: 145557 - DNA, 20 bp, Artificial
  CRISPR gRNA sequence
tttggagagtaggcgtttta

SEQ ID NO: 145558 - DNA, 20 bp, Artificial
  CRISPR gRNA sequence
ttggagagtaggcgttttaa

SEQ ID NO: 145559 - DNA, 20 bp, Artificial
  CRISPR gRNA sequence
gtaggcgttttaaaggactt

SEQ ID NO: 145560 - DNA, 20 bp, Artificial
  CRISPR gRNA sequence
taggcgttttaaaggacttt

SEQ ID NO: 145561 - DNA, 20 bp, Artificial
  CRISPR gRNA sequence
ggcgttttaaaggactttag

SEQ ID NO: 145562 - DNA, 20 bp, Artificial
  CRISPR gRNA sequence
gcgttttaaaggactttagg

SEQ ID NO: 145563 - DNA, 20 bp, Artificial
  CRISPR gRNA sequence
taaaggactttaggaggtgc

SEQ ID NO: 145564 - DNA, 20 bp, Artificial
  CRISPR gRNA sequence
aggaggtgccagccaatttg

SEQ ID NO: 145565 - DNA, 20 bp, Artificial
  CRISPR gRNA sequence
gtgccagccaatttgaagcc

SEQ ID NO: 145566 - DNA, 20 bp, Artificial
  CRISPR gRNA sequence
tgccagccaatttgaagcct

SEQ ID NO: 145567 - DNA, 20 bp, Artificial
  CRISPR gRNA sequence
ctgggaaaacttcatgtcta

SEQ ID NO: 145568 - DNA, 20 bp, Artificial
  CRISPR gRNA sequence
gggaaaacttcatgtctaca

SEQ ID NO: 145569 - DNA, 20 bp, Artificial
  CRISPR gRNA sequence
ggaaaacttcatgtctacag

SEQ ID NO: 145570 - DNA, 20 bp, Artificial
  CRISPR gRNA sequence
gaggattaaaaatgctatct

SEQ ID NO: 145571 - DNA, 20 bp, Artificial
  CRISPR gRNA sequence
aaaatgctatcttagaattt

SEQ ID NO: 145572 - DNA, 20 bp, Artificial
  CRISPR gRNA sequence
aaatgctatcttagaatttc

SEQ ID NO: 145573 - DNA, 20 bp, Artificial
  CRISPR gRNA sequence
gctatcttagaatttcaggc

SEQ ID NO: 145574 - DNA, 20 bp, Artificial
  CRISPR gRNA sequence
tagaatttcaggccagcttt

SEQ ID NO: 145575 - DNA, 20 bp, Artificial
  CRISPR gRNA sequence
tcagcaatctcaacctttca

SEQ ID NO: 145576 - DNA, 20 bp, Artificial
  CRISPR gRNA sequence
cagcaatctcaacctttcaa

SEQ ID NO: 145577 - DNA, 20 bp, Artificial
  CRISPR gRNA sequence
aatctcaacctttcaaaggc

SEQ ID NO: 145578 - DNA, 20 bp, Artificial
  CRISPR gRNA sequence
atctcaacctttcaaaggcc

SEQ ID NO: 145579 - DNA, 20 bp, Artificial
  CRISPR gRNA sequence
tcaacctttcaaaggccagg

SEQ ID NO: 145580 - DNA, 20 bp, Artificial
  CRISPR gRNA sequence
acctttcaaaggccaggcag

SEQ ID NO: 145581 - DNA, 20 bp, Artificial
  CRISPR gRNA sequence
caatgcctcgaacacctaca

SEQ ID NO: 145582 - DNA, 20 bp, Artificial
  CRISPR gRNA sequence
acctacaaagaactaaatcc

SEQ ID NO: 145583 - DNA, 20 bp, Artificial
  CRISPR gRNA sequence
aagaactaaatccaagcaac

SEQ ID NO: 145584 - DNA, 20 bp, Artificial
  CRISPR gRNA sequence
aactaaatccaagcaacaag

SEQ ID NO: 145585 - DNA, 20 bp, Artificial
  CRISPR gRNA sequence
caagcaacaagaagctgttt

SEQ ID NO: 145586 - DNA, 20 bp, Artificial
  CRISPR gRNA sequence
caacaagaagctgtttcagc

SEQ ID NO: 145587 - DNA, 20 bp, Artificial
  CRISPR gRNA sequence
agctagacacactttaaaat

SEQ ID NO: 145588 - DNA, 20 bp, Artificial
  CRISPR gRNA sequence
agacacactttaaaatcaga

SEQ ID NO: 145589 - DNA, 20 bp, Artificial
  CRISPR gRNA sequence
ctttaaaatcagatggatca

SEQ ID NO: 145590 - DNA, 20 bp, Artificial
  CRISPR gRNA sequence
cagatggatcatagcatttt

SEQ ID NO: 145591 - DNA, 20 bp, Artificial
  CRISPR gRNA sequence
ggatcatagcattttgagtc

SEQ ID NO: 145592 - DNA, 20 bp, Artificial
  CRISPR gRNA sequence
atagcattttgagtctggct

SEQ ID NO: 145593 - DNA, 20 bp, Artificial
  CRISPR gRNA sequence
cattttgagtctggctaaga

SEQ ID NO: 145594 - DNA, 20 bp, Artificial
  CRISPR gRNA sequence
gagtctggctaagatggaat

SEQ ID NO: 145595 - DNA, 20 bp, Artificial
  CRISPR gRNA sequence
agtctggctaagatggaata

SEQ ID NO: 145596 - DNA, 20 bp, Artificial
  CRISPR gRNA sequence
tctggctaagatggaataag

SEQ ID NO: 145597 - DNA, 20 bp, Artificial
  CRISPR gRNA sequence
aaggagctgtatgacacccc

SEQ ID NO: 145598 - DNA, 20 bp, Artificial
  CRISPR gRNA sequence
ggagctgtatgacaccccga

SEQ ID NO: 145599 - DNA, 20 bp, Artificial
  CRISPR gRNA sequence
gtatgacaccccgagagacc

SEQ ID NO: 145600 - DNA, 20 bp, Artificial
  CRISPR gRNA sequence
tgacaccccgagagacccag

SEQ ID NO: 145601 - DNA, 20 bp, Artificial
  CRISPR gRNA sequence
ccgagagacccagaagcact

SEQ ID NO: 145602 - DNA, 20 bp, Artificial
  CRISPR gRNA sequence
cgagagacccagaagcactg

SEQ ID NO: 145603 - DNA, 20 bp, Artificial
  CRISPR gRNA sequence
cccagaagcactgaggaatt

SEQ ID NO: 145604 - DNA, 20 bp, Artificial
  CRISPR gRNA sequence
cagaagcactgaggaatttg

SEQ ID NO: 145605 - DNA, 20 bp, Artificial
  CRISPR gRNA sequence
agaagcactgaggaatttgg

SEQ ID NO: 145606 - DNA, 20 bp, Artificial
  CRISPR gRNA sequence
gaggaatttggaggaactga

SEQ ID NO: 145607 - DNA, 20 bp, Artificial
  CRISPR gRNA sequence
aggaatttggaggaactgac

SEQ ID NO: 145608 - DNA, 20 bp, Artificial
  CRISPR gRNA sequence
caggatgtgacccttctctc

SEQ ID NO: 145609 - DNA, 20 bp, Artificial
  CRISPR gRNA sequence
atgtgacccttctctccagc

SEQ ID NO: 145610 - DNA, 20 bp, Artificial
  CRISPR gRNA sequence
ttctctccagccagtgtatt

SEQ ID NO: 145611 - DNA, 20 bp, Artificial
  CRISPR gRNA sequence
tctccagccagtgtattcag

SEQ ID NO: 145612 - DNA, 20 bp, Artificial
  CRISPR gRNA sequence
ctccagccagtgtattcagc

SEQ ID NO: 145613 - DNA, 20 bp, Artificial
  CRISPR gRNA sequence
cagccagtgtattcagcagg

SEQ ID NO: 145614 - DNA, 20 bp, Artificial
  CRISPR gRNA sequence
tgtattcagcaggcagccca

SEQ ID NO: 145615 - DNA, 20 bp, Artificial
  CRISPR gRNA sequence
gcaggcagcccacagaaaac

SEQ ID NO: 145616 - DNA, 20 bp, Artificial
  CRISPR gRNA sequence
caggcagcccacagaaaaca

SEQ ID NO: 145617 - DNA, 20 bp, Artificial
  CRISPR gRNA sequence
ggcagcccacagaaaacaag

SEQ ID NO: 145618 - DNA, 20 bp, Artificial
  CRISPR gRNA sequence
gcccacagaaaacaaggagt

SEQ ID NO: 145619 - DNA, 20 bp, Artificial
  CRISPR gRNA sequence
aaacaaggagttagcacaat

SEQ ID NO: 145620 - DNA, 20 bp, Artificial
  CRISPR gRNA sequence
acaaggagttagcacaatga

SEQ ID NO: 145621 - DNA, 20 bp, Artificial
  CRISPR gRNA sequence
ggagttagcacaatgagagt

SEQ ID NO: 145622 - DNA, 20 bp, Artificial
  CRISPR gRNA sequence
ttagcacaatgagagtgagc

SEQ ID NO: 145623 - DNA, 20 bp, Artificial
  CRISPR gRNA sequence
tagcacaatgagagtgagca

SEQ ID NO: 145624 - DNA, 20 bp, Artificial
  CRISPR gRNA sequence
agcaaggcctgatttcatca

SEQ ID NO: 145625 - DNA, 20 bp, Artificial
  CRISPR gRNA sequence
caaggcctgatttcatcaca

SEQ ID NO: 145626 - DNA, 20 bp, Artificial
  CRISPR gRNA sequence
gagctcacaatcttgtttta

SEQ ID NO: 145627 - DNA, 20 bp, Artificial
  CRISPR gRNA sequence
agctcacaatcttgttttaa

SEQ ID NO: 145628 - DNA, 20 bp, Artificial
  CRISPR gRNA sequence
gctcacaatcttgttttaaa

SEQ ID NO: 145629 - DNA, 20 bp, Artificial
  CRISPR gRNA sequence
ctcacaatcttgttttaaag

SEQ ID NO: 145630 - DNA, 20 bp, Artificial
  CRISPR gRNA sequence
tcacaatcttgttttaaagg

SEQ ID NO: 145631 - DNA, 20 bp, Artificial
  CRISPR gRNA sequence
gttttaaagggggcttctga

SEQ ID NO: 145632 - DNA, 20 bp, Artificial
  CRISPR gRNA sequence
agggggcttctgatagacaa

SEQ ID NO: 145633 - DNA, 20 bp, Artificial
  CRISPR gRNA sequence
gggggcttctgatagacaaa

SEQ ID NO: 145634 - DNA, 20 bp, Artificial
  CRISPR gRNA sequence
gggcttctgatagacaaaag

SEQ ID NO: 145635 - DNA, 20 bp, Artificial
  CRISPR gRNA sequence
aaggagaaaacaatttcaac

SEQ ID NO: 145636 - DNA, 20 bp, Artificial
  CRISPR gRNA sequence
aggagaaaacaatttcaaca

SEQ ID NO: 145637 - DNA, 20 bp, Artificial
  CRISPR gRNA sequence
gaaaacaatttcaacaagga

SEQ ID NO: 145638 - DNA, 20 bp, Artificial
  CRISPR gRNA sequence
aacaatttcaacaaggaaag

SEQ ID NO: 145639 - DNA, 20 bp, Artificial
  CRISPR gRNA sequence
acaatttcaacaaggaaagc

SEQ ID NO: 145640 - DNA, 20 bp, Artificial
  CRISPR gRNA sequence
gtatgatactctttgttctg

SEQ ID NO: 145641 - DNA, 20 bp, Artificial
  CRISPR gRNA sequence
tatgatactctttgttctga

SEQ ID NO: 145642 - DNA, 20 bp, Artificial
  CRISPR gRNA sequence
gatactctttgttctgaagg

SEQ ID NO: 145643 - DNA, 20 bp, Artificial
  CRISPR gRNA sequence
ttgttctgaaggaagataaa

SEQ ID NO: 145644 - DNA, 20 bp, Artificial
  CRISPR gRNA sequence
tgaaggaagataaatggcct

SEQ ID NO: 145645 - DNA, 20 bp, Artificial
  CRISPR gRNA sequence
gagttcttgttgtgacttct

SEQ ID NO: 145646 - DNA, 20 bp, Artificial
  CRISPR gRNA sequence
gttcttgttgtgacttctga

SEQ ID NO: 145647 - DNA, 20 bp, Artificial
  CRISPR gRNA sequence
tcttgttgtgacttctgaga

SEQ ID NO: 145648 - DNA, 20 bp, Artificial
  CRISPR gRNA sequence
cttgttgtgacttctgagag

SEQ ID NO: 145649 - DNA, 20 bp, Artificial
  CRISPR gRNA sequence
tgttgtgacttctgagagag

SEQ ID NO: 145650 - DNA, 20 bp, Artificial
  CRISPR gRNA sequence
gttgtgacttctgagagagg

SEQ ID NO: 145651 - DNA, 20 bp, Artificial
  CRISPR gRNA sequence
ttgtgacttctgagagagga

SEQ ID NO: 145652 - DNA, 20 bp, Artificial
  CRISPR gRNA sequence
tgacttctgagagaggaggg

SEQ ID NO: 145653 - DNA, 20 bp, Artificial
  CRISPR gRNA sequence
gacttctgagagaggaggga

SEQ ID NO: 145654 - DNA, 20 bp, Artificial
  CRISPR gRNA sequence
gagaggagggaaggaccccc

SEQ ID NO: 145655 - DNA, 20 bp, Artificial
  CRISPR gRNA sequence
gaggagggaaggacccccaa

SEQ ID NO: 145656 - DNA, 20 bp, Artificial
  CRISPR gRNA sequence
aggagggaaggacccccaag

SEQ ID NO: 145657 - DNA, 20 bp, Artificial
  CRISPR gRNA sequence
gagggaaggacccccaagag

SEQ ID NO: 145658 - DNA, 20 bp, Artificial
  CRISPR gRNA sequence
agggaaggacccccaagagg

SEQ ID NO: 145659 - DNA, 20 bp, Artificial
  CRISPR gRNA sequence
gacccccaagaggaggaatt

SEQ ID NO: 145660 - DNA, 20 bp, Artificial
  CRISPR gRNA sequence
aagaggaggaattgagcctg

SEQ ID NO: 145661 - DNA, 20 bp, Artificial
  CRISPR gRNA sequence
agaggaggaattgagcctgt

SEQ ID NO: 145662 - DNA, 20 bp, Artificial
  CRISPR gRNA sequence
cacaaacctgcaatgtttca

SEQ ID NO: 145663 - DNA, 20 bp, Artificial
  CRISPR gRNA sequence
aacctgcaatgtttcaaagc

SEQ ID NO: 145664 - DNA, 20 bp, Artificial
  CRISPR gRNA sequence
aatgtttcaaagccggtgcg

SEQ ID NO: 145665 - DNA, 20 bp, Artificial
  CRISPR gRNA sequence
tttcaaagccggtgcgtagc

SEQ ID NO: 145666 - DNA, 20 bp, Artificial
  CRISPR gRNA sequence
ttcaaagccggtgcgtagct

SEQ ID NO: 145667 - DNA, 20 bp, Artificial
  CRISPR gRNA sequence
tcaaagccggtgcgtagctg

SEQ ID NO: 145668 - DNA, 20 bp, Artificial
  CRISPR gRNA sequence
tgcgtagctggggacgaccg

SEQ ID NO: 145669 - DNA, 20 bp, Artificial
  CRISPR gRNA sequence
gtagctggggacgaccgtgg

SEQ ID NO: 145670 - DNA, 20 bp, Artificial
  CRISPR gRNA sequence
cgctgtaaacatccgactga

SEQ ID NO: 145671 - DNA, 20 bp, Artificial
  CRISPR gRNA sequence
aagctcctctgaacacctta

SEQ ID NO: 145672 - DNA, 20 bp, Artificial
  CRISPR gRNA sequence
tctgaacaccttacagcttc

SEQ ID NO: 145673 - DNA, 20 bp, Artificial
  CRISPR gRNA sequence
acaccttacagcttccagtc

SEQ ID NO: 145674 - DNA, 20 bp, Artificial
  CRISPR gRNA sequence
caccttacagcttccagtca

SEQ ID NO: 145675 - DNA, 20 bp, Artificial
  CRISPR gRNA sequence
cttccagtcaaggatgttta

SEQ ID NO: 145676 - DNA, 20 bp, Artificial
  CRISPR gRNA sequence
ccagtcaaggatgtttacag

SEQ ID NO: 145677 - DNA, 20 bp, Artificial
  CRISPR gRNA sequence
caaggatgtttacagtagca

SEQ ID NO: 145678 - DNA, 20 bp, Artificial
  CRISPR gRNA sequence
ttacagtagcaaagactgcc

SEQ ID NO: 145679 - DNA, 20 bp, Artificial
  CRISPR gRNA sequence
agtagcaaagactgcccaga

SEQ ID NO: 145680 - DNA, 20 bp, Artificial
  CRISPR gRNA sequence
caaagactgcccagaaagaa

SEQ ID NO: 145681 - DNA, 20 bp, Artificial
  CRISPR gRNA sequence
aagactgcccagaaagaacg

SEQ ID NO: 145682 - DNA, 20 bp, Artificial
  CRISPR gRNA sequence
gcccagaaagaacggagacg

SEQ ID NO: 145683 - DNA, 20 bp, Artificial
  CRISPR gRNA sequence
agaaagaacggagacgcagt

SEQ ID NO: 145684 - DNA, 20 bp, Artificial
  CRISPR gRNA sequence
gaaagaacggagacgcagtg

SEQ ID NO: 145685 - DNA, 20 bp, Artificial
  CRISPR gRNA sequence
cagtgaggcacaccctactc

SEQ ID NO: 145686 - DNA, 20 bp, Artificial
  CRISPR gRNA sequence
gaggcacaccctactctagt

SEQ ID NO: 145687 - DNA, 20 bp, Artificial
  CRISPR gRNA sequence
aggcacaccctactctagta

SEQ ID NO: 145688 - DNA, 20 bp, Artificial
  CRISPR gRNA sequence
gcacaccctactctagtaag

SEQ ID NO: 145689 - DNA, 20 bp, Artificial
  CRISPR gRNA sequence
cacaccctactctagtaagg

SEQ ID NO: 145690 - DNA, 20 bp, Artificial
  CRISPR gRNA sequence
ctactctagtaaggaggtga

SEQ ID NO: 145691 - DNA, 20 bp, Artificial
  CRISPR gRNA sequence
actctagtaaggaggtgaca

SEQ ID NO: 145692 - DNA, 20 bp, Artificial
  CRISPR gRNA sequence
ctctagtaaggaggtgacag

SEQ ID NO: 145693 - DNA, 20 bp, Artificial
  CRISPR gRNA sequence
tctagtaaggaggtgacaga

SEQ ID NO: 145694 - DNA, 20 bp, Artificial
  CRISPR gRNA sequence
acagagggcttgctaatcca

SEQ ID NO: 145695 - DNA, 20 bp, Artificial
  CRISPR gRNA sequence
cagagggcttgctaatccaa

SEQ ID NO: 145696 - DNA, 20 bp, Artificial
  CRISPR gRNA sequence
ctaatccaaaggccctcatg

SEQ ID NO: 145697 - DNA, 20 bp, Artificial
  CRISPR gRNA sequence
taatccaaaggccctcatgc

SEQ ID NO: 145698 - DNA, 20 bp, Artificial
  CRISPR gRNA sequence
aatccaaaggccctcatgca

SEQ ID NO: 145699 - DNA, 20 bp, Artificial
  CRISPR gRNA sequence
caaaggccctcatgcagggt

SEQ ID NO: 145700 - DNA, 20 bp, Artificial
  CRISPR gRNA sequence
tcagaattacaaatgttcat

SEQ ID NO: 145701 - DNA, 20 bp, Artificial
  CRISPR gRNA sequence
cagaattacaaatgttcatt

SEQ ID NO: 145702 - DNA, 20 bp, Artificial
  CRISPR gRNA sequence
attaggatgcccacttctcc

SEQ ID NO: 145703 - DNA, 20 bp, Artificial
  CRISPR gRNA sequence
tctcctagactttctctgac

SEQ ID NO: 145704 - DNA, 20 bp, Artificial
  CRISPR gRNA sequence
tctctgactggttattaata

SEQ ID NO: 145705 - DNA, 20 bp, Artificial
  CRISPR gRNA sequence
ctctgactggttattaatac

SEQ ID NO: 145706 - DNA, 20 bp, Artificial
  CRISPR gRNA sequence
gactggttattaatacaggc

SEQ ID NO: 145707 - DNA, 20 bp, Artificial
  CRISPR gRNA sequence
actggttattaatacaggct

SEQ ID NO: 145708 - DNA, 20 bp, Artificial
  CRISPR gRNA sequence
gttattaatacaggctggga

SEQ ID NO: 145709 - DNA, 20 bp, Artificial
  CRISPR gRNA sequence
ttattaatacaggctgggat

SEQ ID NO: 145710 - DNA, 20 bp, Artificial
  CRISPR gRNA sequence
tattaatacaggctgggatg

SEQ ID NO: 145711 - DNA, 20 bp, Artificial
  CRISPR gRNA sequence
ttaatacaggctgggatggg

SEQ ID NO: 145712 - DNA, 20 bp, Artificial
  CRISPR gRNA sequence
acaggctgggatggggagaa

SEQ ID NO: 145713 - DNA, 20 bp, Artificial
  CRISPR gRNA sequence
gtcactgaatgactgcttct

SEQ ID NO: 145714 - DNA, 20 bp, Artificial
  CRISPR gRNA sequence
tcactgaatgactgcttcta

SEQ ID NO: 145715 - DNA, 20 bp, Artificial
  CRISPR gRNA sequence
gaaataattcattaaaaata

SEQ ID NO: 145716 - DNA, 20 bp, Artificial
  CRISPR gRNA sequence
aaataaagttttatataaca

SEQ ID NO: 145717 - DNA, 20 bp, Artificial
  CRISPR gRNA sequence
aaagttttatataacaaagc

SEQ ID NO: 145718 - DNA, 20 bp, Artificial
  CRISPR gRNA sequence
gttttatataacaaagcaag

SEQ ID NO: 145719 - DNA, 20 bp, Artificial
  CRISPR gRNA sequence
tataacaaagcaagcagaac

SEQ ID NO: 145720 - DNA, 20 bp, Artificial
  CRISPR gRNA sequence
ataacaaagcaagcagaaca

SEQ ID NO: 145721 - DNA, 20 bp, Artificial
  CRISPR gRNA sequence
aaagcaagcagaacaaggca

SEQ ID NO: 145722 - DNA, 20 bp, Artificial
  CRISPR gRNA sequence
aggcacagctttgctcctgt

SEQ ID NO: 145723 - DNA, 20 bp, Artificial
  CRISPR gRNA sequence
agattctgccacaatttccc

SEQ ID NO: 145724 - DNA, 20 bp, Artificial
  CRISPR gRNA sequence
ttctgccacaatttcccaag

SEQ ID NO: 145725 - DNA, 20 bp, Artificial
  CRISPR gRNA sequence
acaatttcccaagtggcacc

SEQ ID NO: 145726 - DNA, 20 bp, Artificial
  CRISPR gRNA sequence
atctgcatgcttaaaacaat

SEQ ID NO: 145727 - DNA, 20 bp, Artificial
  CRISPR gRNA sequence
gcttaaaacaatgagctcta

SEQ ID NO: 145728 - DNA, 20 bp, Artificial
  CRISPR gRNA sequence
cttaaaacaatgagctctaa

SEQ ID NO: 145729 - DNA, 20 bp, Artificial
  CRISPR gRNA sequence
aaacaatgagctctaaagga

SEQ ID NO: 145730 - DNA, 20 bp, Artificial
  CRISPR gRNA sequence
acaatgagctctaaaggaca

SEQ ID NO: 145731 - DNA, 20 bp, Artificial
  CRISPR gRNA sequence
caatgagctctaaaggacag

SEQ ID NO: 145732 - DNA, 20 bp, Artificial
  CRISPR gRNA sequence
ggtctattacaatcacaatt

SEQ ID NO: 145733 - DNA, 20 bp, Artificial
  CRISPR gRNA sequence
tctattacaatcacaattaa

SEQ ID NO: 145734 - DNA, 20 bp, Artificial
  CRISPR gRNA sequence
attaagagctatatgcaccc

SEQ ID NO: 145735 - DNA, 20 bp, Artificial
  CRISPR gRNA sequence
ttaagagctatatgcaccca

SEQ ID NO: 145736 - DNA, 20 bp, Artificial
  CRISPR gRNA sequence
caaggtgctgaaaaaacaac

SEQ ID NO: 145737 - DNA, 20 bp, Artificial
  CRISPR gRNA sequence
aaaacaactagtgtgacctt

SEQ ID NO: 145738 - DNA, 20 bp, Artificial
  CRISPR gRNA sequence
aacaactagtgtgacctttg

SEQ ID NO: 145739 - DNA, 20 bp, Artificial
  CRISPR gRNA sequence
caactagtgtgacctttgga

SEQ ID NO: 145740 - DNA, 20 bp, Artificial
  CRISPR gRNA sequence
aactagtgtgacctttggag

SEQ ID NO: 145741 - DNA, 20 bp, Artificial
  CRISPR gRNA sequence
actagtgtgacctttggaga

SEQ ID NO: 145742 - DNA, 20 bp, Artificial
  CRISPR gRNA sequence
ctagtgtgacctttggagag

SEQ ID NO: 145743 - DNA, 20 bp, Artificial
  CRISPR gRNA sequence
gtgtgacctttggagagggg

SEQ ID NO: 145744 - DNA, 20 bp, Artificial
  CRISPR gRNA sequence
tgtgacctttggagaggggc

SEQ ID NO: 145745 - DNA, 20 bp, Artificial
  CRISPR gRNA sequence
gacctttggagaggggcagg

SEQ ID NO: 145746 - DNA, 20 bp, Artificial
  CRISPR gRNA sequence
ctttggagaggggcaggcag

SEQ ID NO: 145747 - DNA, 20 bp, Artificial
  CRISPR gRNA sequence
ttggagaggggcaggcagaa

SEQ ID NO: 145748 - DNA, 20 bp, Artificial
  CRISPR gRNA sequence
agaggggcaggcagaagaga

SEQ ID NO: 145749 - DNA, 20 bp, Artificial
  CRISPR gRNA sequence
gaggggcaggcagaagagac

SEQ ID NO: 145750 - DNA, 20 bp, Artificial
  CRISPR gRNA sequence
gggcaggcagaagagacggg

SEQ ID NO: 145751 - DNA, 20 bp, Artificial
  CRISPR gRNA sequence
ggcaggcagaagagacggga

SEQ ID NO: 145752 - DNA, 20 bp, Artificial
  CRISPR gRNA sequence
aggcagaagagacgggaagg

SEQ ID NO: 145753 - DNA, 20 bp, Artificial
  CRISPR gRNA sequence
tcttgtgattgcttgcaaaa

SEQ ID NO: 145754 - DNA, 20 bp, Artificial
  CRISPR gRNA sequence
gattgcttgcaaaacagctc

SEQ ID NO: 145755 - DNA, 20 bp, Artificial
  CRISPR gRNA sequence
tgcttgcaaaacagctcaag

SEQ ID NO: 145756 - DNA, 20 bp, Artificial
  CRISPR gRNA sequence
ttgcaaaacagctcaagtgg

SEQ ID NO: 145757 - DNA, 20 bp, Artificial
  CRISPR gRNA sequence
caaatctgactgcacattaa

SEQ ID NO: 145758 - DNA, 20 bp, Artificial
  CRISPR gRNA sequence
gactgcacattaaaagcatc

SEQ ID NO: 145759 - DNA, 20 bp, Artificial
  CRISPR gRNA sequence
actgcacattaaaagcatcc

SEQ ID NO: 145760 - DNA, 20 bp, Artificial
  CRISPR gRNA sequence
ctgcacattaaaagcatcca

SEQ ID NO: 145761 - DNA, 20 bp, Artificial
  CRISPR gRNA sequence
gcacattaaaagcatccagg

SEQ ID NO: 145762 - DNA, 20 bp, Artificial
  CRISPR gRNA sequence
aagcatccagggagttttaa

SEQ ID NO: 145763 - DNA, 20 bp, Artificial
  CRISPR gRNA sequence
agcatccagggagttttaaa

SEQ ID NO: 145764 - DNA, 20 bp, Artificial
  CRISPR gRNA sequence
ttttaaaaggtactgatgcc

SEQ ID NO: 145765 - DNA, 20 bp, Artificial
  CRISPR gRNA sequence
tttaaaaggtactgatgcct

SEQ ID NO: 145766 - DNA, 20 bp, Artificial
  CRISPR gRNA sequence
tgatgcctgggctccatcat

SEQ ID NO: 145767 - DNA, 20 bp, Artificial
  CRISPR gRNA sequence
tccatcatgagattctgatt

SEQ ID NO: 145768 - DNA, 20 bp, Artificial
  CRISPR gRNA sequence
agattctgattcagctgatg

SEQ ID NO: 145769 - DNA, 20 bp, Artificial
  CRISPR gRNA sequence
gattctgattcagctgatgt

SEQ ID NO: 145770 - DNA, 20 bp, Artificial
  CRISPR gRNA sequence
ctgattcagctgatgtgggt

SEQ ID NO: 145771 - DNA, 20 bp, Artificial
  CRISPR gRNA sequence
gattcagctgatgtgggtta

SEQ ID NO: 145772 - DNA, 20 bp, Artificial
  CRISPR gRNA sequence
agctgatgtgggttagagcc

SEQ ID NO: 145773 - DNA, 20 bp, Artificial
  CRISPR gRNA sequence
gctgatgtgggttagagcct

SEQ ID NO: 145774 - DNA, 20 bp, Artificial
  CRISPR gRNA sequence
tgatatttttaaaaccccaa

SEQ ID NO: 145775 - DNA, 20 bp, Artificial
  CRISPR gRNA sequence
gatatttttaaaaccccaac

SEQ ID NO: 145776 - DNA, 20 bp, Artificial
  CRISPR gRNA sequence
aaaaccccaacaggtgattc

SEQ ID NO: 145777 - DNA, 20 bp, Artificial
  CRISPR gRNA sequence
caacaggtgattctagtgtg

SEQ ID NO: 145778 - DNA, 20 bp, Artificial
  CRISPR gRNA sequence
aggtgattctagtgtgcagt

SEQ ID NO: 145779 - DNA, 20 bp, Artificial
  CRISPR gRNA sequence
ggtgattctagtgtgcagtc

SEQ ID NO: 145780 - DNA, 20 bp, Artificial
  CRISPR gRNA sequence
gtgattctagtgtgcagtca

SEQ ID NO: 145781 - DNA, 20 bp, Artificial
  CRISPR gRNA sequence
tgcagtcagggtactatata

SEQ ID NO: 145782 - DNA, 20 bp, Artificial
  CRISPR gRNA sequence
agatataatgaaccacaata

SEQ ID NO: 145783 - DNA, 20 bp, Artificial
  CRISPR gRNA sequence
atataatgaaccacaatata

SEQ ID NO: 145784 - DNA, 20 bp, Artificial
  CRISPR gRNA sequence
tataatgaaccacaatatag

SEQ ID NO: 145785 - DNA, 20 bp, Artificial
  CRISPR gRNA sequence
aatgaaccacaatatagagg

SEQ ID NO: 145786 - DNA, 20 bp, Artificial
  CRISPR gRNA sequence
tgaaccacaatatagaggaa

SEQ ID NO: 145787 - DNA, 20 bp, Artificial
  CRISPR gRNA sequence
atatagaggaagagaaaaca

SEQ ID NO: 145788 - DNA, 20 bp, Artificial
  CRISPR gRNA sequence
tccaaatgccactgtgcaca

SEQ ID NO: 145789 - DNA, 20 bp, Artificial
  CRISPR gRNA sequence
caaatgccactgtgcacata

SEQ ID NO: 145790 - DNA, 20 bp, Artificial
  CRISPR gRNA sequence
atgccactgtgcacatagag

SEQ ID NO: 145791 - DNA, 20 bp, Artificial
  CRISPR gRNA sequence
atctaaaatctataactttc

SEQ ID NO: 145792 - DNA, 20 bp, Artificial
  CRISPR gRNA sequence
tctaaaatctataactttct

SEQ ID NO: 145793 - DNA, 20 bp, Artificial
  CRISPR gRNA sequence
ctgggaatattctcctatcc

SEQ ID NO: 145794 - DNA, 20 bp, Artificial
  CRISPR gRNA sequence
atattctcctatcccagatg

SEQ ID NO: 145795 - DNA, 20 bp, Artificial
  CRISPR gRNA sequence
attctcctatcccagatgaa

SEQ ID NO: 145796 - DNA, 20 bp, Artificial
  CRISPR gRNA sequence
tcccagatgaagagctctga

SEQ ID NO: 145797 - DNA, 20 bp, Artificial
  CRISPR gRNA sequence
agagctctgatagacttcct

SEQ ID NO: 145798 - DNA, 20 bp, Artificial
  CRISPR gRNA sequence
ttcctaagataacttgaaat

SEQ ID NO: 145799 - DNA, 20 bp, Artificial
  CRISPR gRNA sequence
aactttaccatttgtaacta

SEQ ID NO: 145800 - DNA, 20 bp, Artificial
  CRISPR gRNA sequence
ttttcactgaaataccactt

SEQ ID NO: 145801 - DNA, 20 bp, Artificial
  CRISPR gRNA sequence
ttcactgaaataccacttcg

SEQ ID NO: 145802 - DNA, 20 bp, Artificial
  CRISPR gRNA sequence
tcactgaaataccacttcgg

SEQ ID NO: 145803 - DNA, 20 bp, Artificial
  CRISPR gRNA sequence
aataccacttcggaggcact

SEQ ID NO: 145804 - DNA, 20 bp, Artificial
  CRISPR gRNA sequence
cttcggaggcactgagttaa

SEQ ID NO: 145805 - DNA, 20 bp, Artificial
  CRISPR gRNA sequence
ggcactgagttaaaagtatc

SEQ ID NO: 145806 - DNA, 20 bp, Artificial
  CRISPR gRNA sequence
agttaaaagtatccagaaat

SEQ ID NO: 145807 - DNA, 20 bp, Artificial
  CRISPR gRNA sequence
aagtatccagaaatgagtaa

SEQ ID NO: 145808 - DNA, 20 bp, Artificial
  CRISPR gRNA sequence
tatccagaaatgagtaacag

SEQ ID NO: 145809 - DNA, 20 bp, Artificial
  CRISPR gRNA sequence
atccagaaatgagtaacaga

SEQ ID NO: 145810 - DNA, 20 bp, Artificial
  CRISPR gRNA sequence
ccagaaatgagtaacagaag

SEQ ID NO: 145811 - DNA, 20 bp, Artificial
  CRISPR gRNA sequence
gagtaacagaaggagatgtt

SEQ ID NO: 145812 - DNA, 20 bp, Artificial
  CRISPR gRNA sequence
ggagatgttaagaatgaatc

SEQ ID NO: 145813 - DNA, 20 bp, Artificial
  CRISPR gRNA sequence
tgttaagaatgaatctggtc

SEQ ID NO: 145814 - DNA, 20 bp, Artificial
  CRISPR gRNA sequence
aatgaatctggtctagaaac

SEQ ID NO: 145815 - DNA, 20 bp, Artificial
  CRISPR gRNA sequence
gaatctggtctagaaacgag

SEQ ID NO: 145816 - DNA, 20 bp, Artificial
  CRISPR gRNA sequence
ggtctagaaacgagaagcaa

SEQ ID NO: 145817 - DNA, 20 bp, Artificial
  CRISPR gRNA sequence
gtctagaaacgagaagcaaa

SEQ ID NO: 145818 - DNA, 20 bp, Artificial
  CRISPR gRNA sequence
gaaacgagaagcaaaaggaa

SEQ ID NO: 145819 - DNA, 20 bp, Artificial
  CRISPR gRNA sequence
aatagcaaatgacttgtgct

SEQ ID NO: 145820 - DNA, 20 bp, Artificial
  CRISPR gRNA sequence
tagcaaatgacttgtgctga

SEQ ID NO: 145821 - DNA, 20 bp, Artificial
  CRISPR gRNA sequence
gcaaatgacttgtgctgaga

SEQ ID NO: 145822 - DNA, 20 bp, Artificial
  CRISPR gRNA sequence
aatgacttgtgctgagagag

SEQ ID NO: 145823 - DNA, 20 bp, Artificial
  CRISPR gRNA sequence
atgacttgtgctgagagaga

SEQ ID NO: 145824 - DNA, 20 bp, Artificial
  CRISPR gRNA sequence
gacttgtgctgagagagaag

SEQ ID NO: 145825 - DNA, 20 bp, Artificial
  CRISPR gRNA sequence
agaaggagcgtatctgacac

SEQ ID NO: 145826 - DNA, 20 bp, Artificial
  CRISPR gRNA sequence
gtatctgacaccagtataca

SEQ ID NO: 145827 - DNA, 20 bp, Artificial
  CRISPR gRNA sequence
ccagtatacaaagcgctctt

SEQ ID NO: 145828 - DNA, 20 bp, Artificial
  CRISPR gRNA sequence
tatacaaagcgctcttcagt

SEQ ID NO: 145829 - DNA, 20 bp, Artificial
  CRISPR gRNA sequence
acaaagcgctcttcagtcag

SEQ ID NO: 145830 - DNA, 20 bp, Artificial
  CRISPR gRNA sequence
cagcaactgcaatcccttca

SEQ ID NO: 145831 - DNA, 20 bp, Artificial
  CRISPR gRNA sequence
tcacagctcacctgacgctt

SEQ ID NO: 145832 - DNA, 20 bp, Artificial
  CRISPR gRNA sequence
acagctcacctgacgctttg

SEQ ID NO: 145833 - DNA, 20 bp, Artificial
  CRISPR gRNA sequence
cagctcacctgacgctttgg

SEQ ID NO: 145834 - DNA, 20 bp, Artificial
  CRISPR gRNA sequence
acctgacgctttggaggttt

SEQ ID NO: 145835 - DNA, 20 bp, Artificial
  CRISPR gRNA sequence
ggaggtttcagttcatctct

SEQ ID NO: 145836 - DNA, 20 bp, Artificial
  CRISPR gRNA sequence
tctcttggaacaatatcgat

SEQ ID NO: 145837 - DNA, 20 bp, Artificial
  CRISPR gRNA sequence
atcaaattttgtaattgcca

SEQ ID NO: 145838 - DNA, 20 bp, Artificial
  CRISPR gRNA sequence
gatatcatttctctgtaaca

SEQ ID NO: 145839 - DNA, 20 bp, Artificial
  CRISPR gRNA sequence
atcatttctctgtaacaaag

SEQ ID NO: 145840 - DNA, 20 bp, Artificial
  CRISPR gRNA sequence
catttctctgtaacaaagaa

SEQ ID NO: 145841 - DNA, 20 bp, Artificial
  CRISPR gRNA sequence
ttctctgtaacaaagaagag

SEQ ID NO: 145842 - DNA, 20 bp, Artificial
  CRISPR gRNA sequence
agaagagcggtgtgaaaaat

SEQ ID NO: 145843 - DNA, 20 bp, Artificial
  CRISPR gRNA sequence
agcggtgtgaaaaattagcc

SEQ ID NO: 145844 - DNA, 20 bp, Artificial
  CRISPR gRNA sequence
gcggtgtgaaaaattagcct

SEQ ID NO: 145845 - DNA, 20 bp, Artificial
  CRISPR gRNA sequence
cggtgtgaaaaattagcctg

SEQ ID NO: 145846 - DNA, 20 bp, Artificial
  CRISPR gRNA sequence
gtgtgaaaaattagcctggg

SEQ ID NO: 145847 - DNA, 20 bp, Artificial
  CRISPR gRNA sequence
aaattagcctggggagaaac

SEQ ID NO: 145848 - DNA, 20 bp, Artificial
  CRISPR gRNA sequence
tggggagaaactagttcact

SEQ ID NO: 145849 - DNA, 20 bp, Artificial
  CRISPR gRNA sequence
cacttggctttataccctcc

SEQ ID NO: 145850 - DNA, 20 bp, Artificial
  CRISPR gRNA sequence
tggctttataccctccaagt

SEQ ID NO: 145851 - DNA, 20 bp, Artificial
  CRISPR gRNA sequence
ggctttataccctccaagta

SEQ ID NO: 145852 - DNA, 20 bp, Artificial
  CRISPR gRNA sequence
ttataccctccaagtaaggt

SEQ ID NO: 145853 - DNA, 20 bp, Artificial
  CRISPR gRNA sequence
agtaaggtaagacgactttt

SEQ ID NO: 145854 - DNA, 20 bp, Artificial
  CRISPR gRNA sequence
taagccaaactaaacaccta

SEQ ID NO: 145855 - DNA, 20 bp, Artificial
  CRISPR gRNA sequence
aagccaaactaaacacctac

SEQ ID NO: 145856 - DNA, 20 bp, Artificial
  CRISPR gRNA sequence
caaactaaacacctacgggc

SEQ ID NO: 145857 - DNA, 20 bp, Artificial
  CRISPR gRNA sequence
aacacctacgggcaagtcta

SEQ ID NO: 145858 - DNA, 20 bp, Artificial
  CRISPR gRNA sequence
ggcaagtctacagctgaaat

SEQ ID NO: 145859 - DNA, 20 bp, Artificial
  CRISPR gRNA sequence
gtctacagctgaaataagca

SEQ ID NO: 145860 - DNA, 20 bp, Artificial
  CRISPR gRNA sequence
actcatatactttaaatgat

SEQ ID NO: 145861 - DNA, 20 bp, Artificial
  CRISPR gRNA sequence
atactttaaatgatcagacc

SEQ ID NO: 145862 - DNA, 20 bp, Artificial
  CRISPR gRNA sequence
ctttaaatgatcagacctgg

SEQ ID NO: 145863 - DNA, 20 bp, Artificial
  CRISPR gRNA sequence
tttaaatgatcagacctggt

SEQ ID NO: 145864 - DNA, 20 bp, Artificial
  CRISPR gRNA sequence
gtgggcaaccatcaacaaaa

SEQ ID NO: 145865 - DNA, 20 bp, Artificial
  CRISPR gRNA sequence
gcaaccatcaacaaaaaaga

SEQ ID NO: 145866 - DNA, 20 bp, Artificial
  CRISPR gRNA sequence
aaccatcaacaaaaaagaaa

SEQ ID NO: 145867 - DNA, 20 bp, Artificial
  CRISPR gRNA sequence
atgtaactcacactgtaaaa

SEQ ID NO: 145868 - DNA, 20 bp, Artificial
  CRISPR gRNA sequence
tgtaactcacactgtaaaat

SEQ ID NO: 145869 - DNA, 20 bp, Artificial
  CRISPR gRNA sequence
gtaactcacactgtaaaatg

SEQ ID NO: 145870 - DNA, 20 bp, Artificial
  CRISPR gRNA sequence
cactgtaaaatggggtatct

SEQ ID NO: 145871 - DNA, 20 bp, Artificial
  CRISPR gRNA sequence
cgattttcaaattacaaacc

SEQ ID NO: 145872 - DNA, 20 bp, Artificial
  CRISPR gRNA sequence
acaaacctagtaatctcaat

SEQ ID NO: 145873 - DNA, 20 bp, Artificial
  CRISPR gRNA sequence
aacctagtaatctcaattag

SEQ ID NO: 145874 - DNA, 20 bp, Artificial
  CRISPR gRNA sequence
acctagtaatctcaattagc

SEQ ID NO: 145875 - DNA, 20 bp, Artificial
  CRISPR gRNA sequence
aatctcaattagcaggtttc

SEQ ID NO: 145876 - DNA, 20 bp, Artificial
  CRISPR gRNA sequence
gcaggtttctggtcattctg

SEQ ID NO: 145877 - DNA, 20 bp, Artificial
  CRISPR gRNA sequence
caggtttctggtcattctgt

SEQ ID NO: 145878 - DNA, 20 bp, Artificial
  CRISPR gRNA sequence
tttctggtcattctgtgggt

SEQ ID NO: 145879 - DNA, 20 bp, Artificial
  CRISPR gRNA sequence
ggtcattctgtgggttagca

SEQ ID NO: 145880 - DNA, 20 bp, Artificial
  CRISPR gRNA sequence
attctgtgggttagcaaagt

SEQ ID NO: 145881 - DNA, 20 bp, Artificial
  CRISPR gRNA sequence
ttctgtgggttagcaaagtt

SEQ ID NO: 145882 - DNA, 20 bp, Artificial
  CRISPR gRNA sequence
gttaggtttataatcttttt

SEQ ID NO: 145883 - DNA, 20 bp, Artificial
  CRISPR gRNA sequence
ttaggtttataatcttttta

SEQ ID NO: 145884 - DNA, 20 bp, Artificial
  CRISPR gRNA sequence
cctaaataatattttccctt

SEQ ID NO: 145885 - DNA, 20 bp, Artificial
  CRISPR gRNA sequence
atattttccctttggttcac

SEQ ID NO: 145886 - DNA, 20 bp, Artificial
  CRISPR gRNA sequence
ttggttcacaagtattgaat

SEQ ID NO: 145887 - DNA, 20 bp, Artificial
  CRISPR gRNA sequence
tggttcacaagtattgaatt

SEQ ID NO: 145888 - DNA, 20 bp, Artificial
  CRISPR gRNA sequence
taactttttgcaacattttc

SEQ ID NO: 145889 - DNA, 20 bp, Artificial
  CRISPR gRNA sequence
ttgcaacattttcaagtcac

SEQ ID NO: 145890 - DNA, 20 bp, Artificial
  CRISPR gRNA sequence
tcactggatctatatacact

SEQ ID NO: 145891 - DNA, 20 bp, Artificial
  CRISPR gRNA sequence
tatatacactaagttctcac

SEQ ID NO: 145892 - DNA, 20 bp, Artificial
  CRISPR gRNA sequence
cacaagctatgatttttatt

SEQ ID NO: 145893 - DNA, 20 bp, Artificial
  CRISPR gRNA sequence
acaagctatgatttttattt

SEQ ID NO: 145894 - DNA, 20 bp, Artificial
  CRISPR gRNA sequence
aaattgcaatacttaaacca

SEQ ID NO: 145895 - DNA, 20 bp, Artificial
  CRISPR gRNA sequence
aattgcaatacttaaaccat

SEQ ID NO: 145896 - DNA, 20 bp, Artificial
  CRISPR gRNA sequence
aaaccatgggtttatcattg

SEQ ID NO: 145897 - DNA, 20 bp, Artificial
  CRISPR gRNA sequence
gaattcccaaataaaaaaca

SEQ ID NO: 145898 - DNA, 20 bp, Artificial
  CRISPR gRNA sequence
aaataaaaaacatagcttgt

SEQ ID NO: 145899 - DNA, 20 bp, Artificial
  CRISPR gRNA sequence
tgtgagaattctgatattca

SEQ ID NO: 145900 - DNA, 20 bp, Artificial
  CRISPR gRNA sequence
ttcatagtttgtgctatgaa

SEQ ID NO: 145901 - DNA, 20 bp, Artificial
  CRISPR gRNA sequence
atagtttgtgctatgaacag

SEQ ID NO: 145902 - DNA, 20 bp, Artificial
  CRISPR gRNA sequence
tttgtgctatgaacagcagc

SEQ ID NO: 145903 - DNA, 20 bp, Artificial
  CRISPR gRNA sequence
tgtgctatgaacagcagcaa

SEQ ID NO: 145904 - DNA, 20 bp, Artificial
  CRISPR gRNA sequence
tgctatgaacagcagcaaga

SEQ ID NO: 145905 - DNA, 20 bp, Artificial
  CRISPR gRNA sequence
gctatgaacagcagcaagag

SEQ ID NO: 145906 - DNA, 20 bp, Artificial
  CRISPR gRNA sequence
tgaacagcagcaagagaggt

SEQ ID NO: 145907 - DNA, 20 bp, Artificial
  CRISPR gRNA sequence
aacagcagcaagagaggtaa

SEQ ID NO: 145908 - DNA, 20 bp, Artificial
  CRISPR gRNA sequence
gcaagagaggtaagagaaca

SEQ ID NO: 145909 - DNA, 20 bp, Artificial
  CRISPR gRNA sequence
caagagaggtaagagaacac

SEQ ID NO: 145910 - DNA, 20 bp, Artificial
  CRISPR gRNA sequence
agagaggtaagagaacacag

SEQ ID NO: 145911 - DNA, 20 bp, Artificial
  CRISPR gRNA sequence
aggtaagagaacacaggagt

SEQ ID NO: 145912 - DNA, 20 bp, Artificial
  CRISPR gRNA sequence
taagagaacacaggagtcag

SEQ ID NO: 145913 - DNA, 20 bp, Artificial
  CRISPR gRNA sequence
aagagaacacaggagtcaga

SEQ ID NO: 145914 - DNA, 20 bp, Artificial
  CRISPR gRNA sequence
aggctaatgatactgaaacc

SEQ ID NO: 145915 - DNA, 20 bp, Artificial
  CRISPR gRNA sequence
gaaaccaagacctgctctaa

SEQ ID NO: 145916 - DNA, 20 bp, Artificial
  CRISPR gRNA sequence
aaaccaagacctgctctaat

SEQ ID NO: 145917 - DNA, 20 bp, Artificial
  CRISPR gRNA sequence
aaccaagacctgctctaatg

SEQ ID NO: 145918 - DNA, 20 bp, Artificial
  CRISPR gRNA sequence
accaagacctgctctaatgg

SEQ ID NO: 145919 - DNA, 20 bp, Artificial
  CRISPR gRNA sequence
tctaatgggggtttctctcc

SEQ ID NO: 145920 - DNA, 20 bp, Artificial
  CRISPR gRNA sequence
tctttgaataataaaattaa

SEQ ID NO: 145921 - DNA, 20 bp, Artificial
  CRISPR gRNA sequence
aaaacccaacatattatgta

SEQ ID NO: 145922 - DNA, 20 bp, Artificial
  CRISPR gRNA sequence
ccaacatattatgtatagtt

SEQ ID NO: 145923 - DNA, 20 bp, Artificial
  CRISPR gRNA sequence
aagatttgtgtactttacta

SEQ ID NO: 145924 - DNA, 20 bp, Artificial
  CRISPR gRNA sequence
tgtactttactaaagattta

SEQ ID NO: 145925 - DNA, 20 bp, Artificial
  CRISPR gRNA sequence
ttactaaagatttaaagcaa

SEQ ID NO: 145926 - DNA, 20 bp, Artificial
  CRISPR gRNA sequence
tactaaagatttaaagcaaa

SEQ ID NO: 145927 - DNA, 20 bp, Artificial
  CRISPR gRNA sequence
tatgaaaaaacactgaacgc

SEQ ID NO: 145928 - DNA, 20 bp, Artificial
  CRISPR gRNA sequence
agtgaatgatatgcatgtta

SEQ ID NO: 145929 - DNA, 20 bp, Artificial
  CRISPR gRNA sequence
gatatgcatgttaaagtatt

SEQ ID NO: 145930 - DNA, 20 bp, Artificial
  CRISPR gRNA sequence
atatgcatgttaaagtattt

SEQ ID NO: 145931 - DNA, 20 bp, Artificial
  CRISPR gRNA sequence
catgttaaagtatttgggca

SEQ ID NO: 145932 - DNA, 20 bp, Artificial
  CRISPR gRNA sequence
ctttacaatgcacttaaaaa

SEQ ID NO: 145933 - DNA, 20 bp, Artificial
  CRISPR gRNA sequence
acttaaaaacagattacttg

SEQ ID NO: 145934 - DNA, 20 bp, Artificial
  CRISPR gRNA sequence
cttaaaaacagattacttga

SEQ ID NO: 145935 - DNA, 20 bp, Artificial
  CRISPR gRNA sequence
aaaacagattacttgaagga

SEQ ID NO: 145936 - DNA, 20 bp, Artificial
  CRISPR gRNA sequence
cagattacttgaaggatgga

SEQ ID NO: 145937 - DNA, 20 bp, Artificial
  CRISPR gRNA sequence
gattacttgaaggatggata

SEQ ID NO: 145938 - DNA, 20 bp, Artificial
  CRISPR gRNA sequence
attacttgaaggatggatag

SEQ ID NO: 145939 - DNA, 20 bp, Artificial
  CRISPR gRNA sequence
ttacttgaaggatggataga

SEQ ID NO: 145940 - DNA, 20 bp, Artificial
  CRISPR gRNA sequence
aggatggatagagggataaa

SEQ ID NO: 145941 - DNA, 20 bp, Artificial
  CRISPR gRNA sequence
atagagggataaacagatat

SEQ ID NO: 145942 - DNA, 20 bp, Artificial
  CRISPR gRNA sequence
aacagatatgagaataaaat

SEQ ID NO: 145943 - DNA, 20 bp, Artificial
  CRISPR gRNA sequence
atatgagaataaaataagca

SEQ ID NO: 145944 - DNA, 20 bp, Artificial
  CRISPR gRNA sequence
taagcatagtaaaatgttta

SEQ ID NO: 145945 - DNA, 20 bp, Artificial
  CRISPR gRNA sequence
gcatagtaaaatgtttatgg

SEQ ID NO: 145946 - DNA, 20 bp, Artificial
  CRISPR gRNA sequence
aaaatgtttatggtagaatc

SEQ ID NO: 145947 - DNA, 20 bp, Artificial
  CRISPR gRNA sequence
aaatgtttatggtagaatct

SEQ ID NO: 145948 - DNA, 20 bp, Artificial
  CRISPR gRNA sequence
tatggtagaatctaggttgt

SEQ ID NO: 145949 - DNA, 20 bp, Artificial
  CRISPR gRNA sequence
gaatctaggttgtaagtata

SEQ ID NO: 145950 - DNA, 20 bp, Artificial
  CRISPR gRNA sequence
aatctaggttgtaagtatac

SEQ ID NO: 145951 - DNA, 20 bp, Artificial
  CRISPR gRNA sequence
aatttttcataataaaatgc

SEQ ID NO: 145952 - DNA, 20 bp, Artificial
  CRISPR gRNA sequence
atttttcataataaaatgct

SEQ ID NO: 145953 - DNA, 20 bp, Artificial
  CRISPR gRNA sequence
tttttcataataaaatgctg

SEQ ID NO: 145954 - DNA, 20 bp, Artificial
  CRISPR gRNA sequence
ggaaaatgttaacacactaa

SEQ ID NO: 145955 - DNA, 20 bp, Artificial
  CRISPR gRNA sequence
aacacactaacagaaatcct

SEQ ID NO: 145956 - DNA, 20 bp, Artificial
  CRISPR gRNA sequence
ctctatataccacaccttaa

SEQ ID NO: 145957 - DNA, 20 bp, Artificial
  CRISPR gRNA sequence
tctatataccacaccttaaa

SEQ ID NO: 145958 - DNA, 20 bp, Artificial
  CRISPR gRNA sequence
caccttaaaaggtgactcat

SEQ ID NO: 145959 - DNA, 20 bp, Artificial
  CRISPR gRNA sequence
aggtgactcatcggacaaaa

SEQ ID NO: 145960 - DNA, 20 bp, Artificial
  CRISPR gRNA sequence
ggtgactcatcggacaaaac

SEQ ID NO: 145961 - DNA, 20 bp, Artificial
  CRISPR gRNA sequence
tgactcatcggacaaaacag

SEQ ID NO: 145962 - DNA, 20 bp, Artificial
  CRISPR gRNA sequence
actcatcggacaaaacagga

SEQ ID NO: 145963 - DNA, 20 bp, Artificial
  CRISPR gRNA sequence
ctcatcggacaaaacaggag

SEQ ID NO: 145964 - DNA, 20 bp, Artificial
  CRISPR gRNA sequence
tcggacaaaacaggagagga

SEQ ID NO: 145965 - DNA, 20 bp, Artificial
  CRISPR gRNA sequence
tctttcccttgtatctgtga

SEQ ID NO: 145966 - DNA, 20 bp, Artificial
  CRISPR gRNA sequence
cttgtatctgtgatggcccc

SEQ ID NO: 145967 - DNA, 20 bp, Artificial
  CRISPR gRNA sequence
gcctctgaaatgcaaaactc

SEQ ID NO: 145968 - DNA, 20 bp, Artificial
  CRISPR gRNA sequence
ccgcccttcttgccaaccac

SEQ ID NO: 145969 - DNA, 20 bp, Artificial
  CRISPR gRNA sequence
acgataaaccctcccaactg

SEQ ID NO: 145970 - DNA, 20 bp, Artificial
  CRISPR gRNA sequence
ataaaccctcccaactgaag

SEQ ID NO: 145971 - DNA, 20 bp, Artificial
  CRISPR gRNA sequence
taaaccctcccaactgaagc

SEQ ID NO: 145972 - DNA, 20 bp, Artificial
  CRISPR gRNA sequence
aaaccctcccaactgaagca

SEQ ID NO: 145973 - DNA, 20 bp, Artificial
  CRISPR gRNA sequence
actgaagcagggcccatctt

SEQ ID NO: 145974 - DNA, 20 bp, Artificial
  CRISPR gRNA sequence
agggcccatcttaagattgc

SEQ ID NO: 145975 - DNA, 20 bp, Artificial
  CRISPR gRNA sequence
aagattgccagaactcattt

SEQ ID NO: 145976 - DNA, 20 bp, Artificial
  CRISPR gRNA sequence
catttaagatgactacaata

SEQ ID NO: 145977 - DNA, 20 bp, Artificial
  CRISPR gRNA sequence
atctactcaatctatctaaa

SEQ ID NO: 145978 - DNA, 20 bp, Artificial
  CRISPR gRNA sequence
ctaaatggctcatttattga

SEQ ID NO: 145979 - DNA, 20 bp, Artificial
  CRISPR gRNA sequence
ctcatttattgatggaataa

SEQ ID NO: 145980 - DNA, 20 bp, Artificial
  CRISPR gRNA sequence
tcatttattgatggaataaa

SEQ ID NO: 145981 - DNA, 20 bp, Artificial
  CRISPR gRNA sequence
catttattgatggaataaaa

SEQ ID NO: 145982 - DNA, 20 bp, Artificial
  CRISPR gRNA sequence
atttattgatggaataaaag

SEQ ID NO: 145983 - DNA, 20 bp, Artificial
  CRISPR gRNA sequence
tgatggaataaaaggggaaa

SEQ ID NO: 145984 - DNA, 20 bp, Artificial
  CRISPR gRNA sequence
agaaaaataataaacatctc

SEQ ID NO: 145985 - DNA, 20 bp, Artificial
  CRISPR gRNA sequence
cagcatataataaaatattc

SEQ ID NO: 145986 - DNA, 20 bp, Artificial
  CRISPR gRNA sequence
gcatataataaaatattcta

SEQ ID NO: 145987 - DNA, 20 bp, Artificial
  CRISPR gRNA sequence
taaaatattctagagtattt

SEQ ID NO: 145988 - DNA, 20 bp, Artificial
  CRISPR gRNA sequence
tctagagtattttggaaaca

SEQ ID NO: 145989 - DNA, 20 bp, Artificial
  CRISPR gRNA sequence
ttggaaacatagatatactt

SEQ ID NO: 145990 - DNA, 20 bp, Artificial
  CRISPR gRNA sequence
aaacatagatatacttaagt

SEQ ID NO: 145991 - DNA, 20 bp, Artificial
  CRISPR gRNA sequence
atttgctttttaaattccct

SEQ ID NO: 145992 - DNA, 20 bp, Artificial
  CRISPR gRNA sequence
tttgctttttaaattccctg

SEQ ID NO: 145993 - DNA, 20 bp, Artificial
  CRISPR gRNA sequence
gctttttaaattccctgagg

SEQ ID NO: 145994 - DNA, 20 bp, Artificial
  CRISPR gRNA sequence
ctttttaaattccctgaggc

SEQ ID NO: 145995 - DNA, 20 bp, Artificial
  CRISPR gRNA sequence
ttttaaattccctgaggcag

SEQ ID NO: 145996 - DNA, 20 bp, Artificial
  CRISPR gRNA sequence
tttaaattccctgaggcagg

SEQ ID NO: 145997 - DNA, 20 bp, Artificial
  CRISPR gRNA sequence
ctgaggcaggaggatcgctt

SEQ ID NO: 145998 - DNA, 20 bp, Artificial
  CRISPR gRNA sequence
ggcaggaggatcgcttgagc

SEQ ID NO: 145999 - DNA, 20 bp, Artificial
  CRISPR gRNA sequence
gcaggaggatcgcttgagcc

SEQ ID NO: 146000 - DNA, 20 bp, Artificial
  CRISPR gRNA sequence
aggaggatcgcttgagccag

SEQ ID NO: 146001 - DNA, 20 bp, Artificial
  CRISPR gRNA sequence
tcgcttgagccaggagtttc

SEQ ID NO: 146002 - DNA, 20 bp, Artificial
  CRISPR gRNA sequence
tgagccaggagtttcaagac

SEQ ID NO: 146003 - DNA, 20 bp, Artificial
  CRISPR gRNA sequence
aggagtttcaagaccagctc

SEQ ID NO: 146004 - DNA, 20 bp, Artificial
  CRISPR gRNA sequence
ggagtttcaagaccagctct

SEQ ID NO: 146005 - DNA, 20 bp, Artificial
  CRISPR gRNA sequence
aagaccagctctgggcaaca

SEQ ID NO: 146006 - DNA, 20 bp, Artificial
  CRISPR gRNA sequence
ccagctctgggcaacatagt

SEQ ID NO: 146007 - DNA, 20 bp, Artificial
  CRISPR gRNA sequence
cagctctgggcaacatagta

SEQ ID NO: 146008 - DNA, 20 bp, Artificial
  CRISPR gRNA sequence
acaacaacaacaaaaatttt

SEQ ID NO: 146009 - DNA, 20 bp, Artificial
  CRISPR gRNA sequence
caacaacaaaaattttaagc

SEQ ID NO: 146010 - DNA, 20 bp, Artificial
  CRISPR gRNA sequence
caaaaattttaagccagata

SEQ ID NO: 146011 - DNA, 20 bp, Artificial
  CRISPR gRNA sequence
aaattttaagccagatatgg

SEQ ID NO: 146012 - DNA, 20 bp, Artificial
  CRISPR gRNA sequence
gatatggtggcatgcacctg

SEQ ID NO: 146013 - DNA, 20 bp, Artificial
  CRISPR gRNA sequence
gtggcatgcacctgtagtct

SEQ ID NO: 146014 - DNA, 20 bp, Artificial
  CRISPR gRNA sequence
cacctgtagtctcagctact

SEQ ID NO: 146015 - DNA, 20 bp, Artificial
  CRISPR gRNA sequence
acctgtagtctcagctactt

SEQ ID NO: 146016 - DNA, 20 bp, Artificial
  CRISPR gRNA sequence
ctgtagtctcagctacttgg

SEQ ID NO: 146017 - DNA, 20 bp, Artificial
  CRISPR gRNA sequence
tgtagtctcagctacttggg

SEQ ID NO: 146018 - DNA, 20 bp, Artificial
  CRISPR gRNA sequence
tctcagctacttgggaggct

SEQ ID NO: 146019 - DNA, 20 bp, Artificial
  CRISPR gRNA sequence
ctcagctacttgggaggctg

SEQ ID NO: 146020 - DNA, 20 bp, Artificial
  CRISPR gRNA sequence
agctacttgggaggctgagg

SEQ ID NO: 146021 - DNA, 20 bp, Artificial
  CRISPR gRNA sequence
gctacttgggaggctgaggt

SEQ ID NO: 146022 - DNA, 20 bp, Artificial
  CRISPR gRNA sequence
tacttgggaggctgaggtgg

SEQ ID NO: 146023 - DNA, 20 bp, Artificial
  CRISPR gRNA sequence
acttgggaggctgaggtggg

SEQ ID NO: 146024 - DNA, 20 bp, Artificial
  CRISPR gRNA sequence
ctgaggtgggaggatcactt

SEQ ID NO: 146025 - DNA, 20 bp, Artificial
  CRISPR gRNA sequence
gtgggaggatcacttgagcc

SEQ ID NO: 146026 - DNA, 20 bp, Artificial
  CRISPR gRNA sequence
tgggaggatcacttgagccc

SEQ ID NO: 146027 - DNA, 20 bp, Artificial
  CRISPR gRNA sequence
ggaggatcacttgagcccag

SEQ ID NO: 146028 - DNA, 20 bp, Artificial
  CRISPR gRNA sequence
gaggatcacttgagcccagg

SEQ ID NO: 146029 - DNA, 20 bp, Artificial
  CRISPR gRNA sequence
tcacttgagcccaggaggtc

SEQ ID NO: 146030 - DNA, 20 bp, Artificial
  CRISPR gRNA sequence
cacttgagcccaggaggtcg

SEQ ID NO: 146031 - DNA, 20 bp, Artificial
  CRISPR gRNA sequence
caggaggtcgaggctgcaat

SEQ ID NO: 146032 - DNA, 20 bp, Artificial
  CRISPR gRNA sequence
gtgattgcgccactgcactc

SEQ ID NO: 146033 - DNA, 20 bp, Artificial
  CRISPR gRNA sequence
tgcgccactgcactccagcc

SEQ ID NO: 146034 - DNA, 20 bp, Artificial
  CRISPR gRNA sequence
gcgccactgcactccagcct

SEQ ID NO: 146035 - DNA, 20 bp, Artificial
  CRISPR gRNA sequence
ctgcactccagcctaggcca

SEQ ID NO: 146036 - DNA, 20 bp, Artificial
  CRISPR gRNA sequence
gcactccagcctaggccaca

SEQ ID NO: 146037 - DNA, 20 bp, Artificial
  CRISPR gRNA sequence
tccagcctaggccacagagt

SEQ ID NO: 146038 - DNA, 20 bp, Artificial
  CRISPR gRNA sequence
ccctatctcaaaaaataaaa

SEQ ID NO: 146039 - DNA, 20 bp, Artificial
  CRISPR gRNA sequence
cctatctcaaaaaataaaaa

SEQ ID NO: 146040 - DNA, 20 bp, Artificial
  CRISPR gRNA sequence
caaaaaataaaaaaggaata

SEQ ID NO: 146041 - DNA, 20 bp, Artificial
  CRISPR gRNA sequence
aaataaaaaaggaatataga

SEQ ID NO: 146042 - DNA, 20 bp, Artificial
  CRISPR gRNA sequence
ggaatatagaaagttccttc

SEQ ID NO: 146043 - DNA, 20 bp, Artificial
  CRISPR gRNA sequence
aagttccttctagccctttc

SEQ ID NO: 146044 - DNA, 20 bp, Artificial
  CRISPR gRNA sequence
tccccacactcccctaaatc

SEQ ID NO: 146045 - DNA, 20 bp, Artificial
  CRISPR gRNA sequence
ccccacactcccctaaatct

SEQ ID NO: 146046 - DNA, 20 bp, Artificial
  CRISPR gRNA sequence
aactctgatttctatcacta

SEQ ID NO: 146047 - DNA, 20 bp, Artificial
  CRISPR gRNA sequence
actctgatttctatcactat

SEQ ID NO: 146048 - DNA, 20 bp, Artificial
  CRISPR gRNA sequence
ctgatttctatcactatagg

SEQ ID NO: 146049 - DNA, 20 bp, Artificial
  CRISPR gRNA sequence
actatgtaattttttccctc

SEQ ID NO: 146050 - DNA, 20 bp, Artificial
  CRISPR gRNA sequence
tctggttccttttgttaaca

SEQ ID NO: 146051 - DNA, 20 bp, Artificial
  CRISPR gRNA sequence
tttgttaacatagtatcttt

SEQ ID NO: 146052 - DNA, 20 bp, Artificial
  CRISPR gRNA sequence
tgagatttatccatgttgta

SEQ ID NO: 146053 - DNA, 20 bp, Artificial
  CRISPR gRNA sequence
agatttatccatgttgtatg

SEQ ID NO: 146054 - DNA, 20 bp, Artificial
  CRISPR gRNA sequence
atccatgttgtatggagcaa

SEQ ID NO: 146055 - DNA, 20 bp, Artificial
  CRISPR gRNA sequence
gtttgtttctttttattgct

SEQ ID NO: 146056 - DNA, 20 bp, Artificial
  CRISPR gRNA sequence
tttgtttctttttattgctg

SEQ ID NO: 146057 - DNA, 20 bp, Artificial
  CRISPR gRNA sequence
tgtttctttttattgctgag

SEQ ID NO: 146058 - DNA, 20 bp, Artificial
  CRISPR gRNA sequence
gtttctttttattgctgagg

SEQ ID NO: 146059 - DNA, 20 bp, Artificial
  CRISPR gRNA sequence
aatccatttcatcaatacct

SEQ ID NO: 146060 - DNA, 20 bp, Artificial
  CRISPR gRNA sequence
tttatatattcctatattga

SEQ ID NO: 146061 - DNA, 20 bp, Artificial
  CRISPR gRNA sequence
tcctatattgatggacactt

SEQ ID NO: 146062 - DNA, 20 bp, Artificial
  CRISPR gRNA sequence
atggacacttgagttgtttc

SEQ ID NO: 146063 - DNA, 20 bp, Artificial
  CRISPR gRNA sequence
cttgagttgtttccagtttt

SEQ ID NO: 146064 - DNA, 20 bp, Artificial
  CRISPR gRNA sequence
ttgagttgtttccagttttg

SEQ ID NO: 146065 - DNA, 20 bp, Artificial
  CRISPR gRNA sequence
agttgtttccagttttgagg

SEQ ID NO: 146066 - DNA, 20 bp, Artificial
  CRISPR gRNA sequence
agttttgaggtagtataaac

SEQ ID NO: 146067 - DNA, 20 bp, Artificial
  CRISPR gRNA sequence
gttttgaggtagtataaaca

SEQ ID NO: 146068 - DNA, 20 bp, Artificial
  CRISPR gRNA sequence
gtagtataaacaaggttgtt

SEQ ID NO: 146069 - DNA, 20 bp, Artificial
  CRISPR gRNA sequence
agtataaacaaggttgttaa

SEQ ID NO: 146070 - DNA, 20 bp, Artificial
  CRISPR gRNA sequence
tgttaagagcatttttatat

SEQ ID NO: 146071 - DNA, 20 bp, Artificial
  CRISPR gRNA sequence
agagcatttttatataagaa

SEQ ID NO: 146072 - DNA, 20 bp, Artificial
  CRISPR gRNA sequence
tttttatataagaatggcta

SEQ ID NO: 146073 - DNA, 20 bp, Artificial
  CRISPR gRNA sequence
aagaatggctacagttcttt

SEQ ID NO: 146074 - DNA, 20 bp, Artificial
  CRISPR gRNA sequence
agaatggctacagttctttt

SEQ ID NO: 146075 - DNA, 20 bp, Artificial
  CRISPR gRNA sequence
agttcttttgggtacaaacc

SEQ ID NO: 146076 - DNA, 20 bp, Artificial
  CRISPR gRNA sequence
gttcttttgggtacaaacct

SEQ ID NO: 146077 - DNA, 20 bp, Artificial
  CRISPR gRNA sequence
gtacaaacctaggaatgaaa

SEQ ID NO: 146078 - DNA, 20 bp, Artificial
  CRISPR gRNA sequence
aaacctaggaatgaaatggc

SEQ ID NO: 146079 - DNA, 20 bp, Artificial
  CRISPR gRNA sequence
aacctaggaatgaaatggct

SEQ ID NO: 146080 - DNA, 20 bp, Artificial
  CRISPR gRNA sequence
ggaatgaaatggctgggtta

SEQ ID NO: 146081 - DNA, 20 bp, Artificial
  CRISPR gRNA sequence
aatgaaatggctgggttaca

SEQ ID NO: 146082 - DNA, 20 bp, Artificial
  CRISPR gRNA sequence
gaaatggctgggttacagag

SEQ ID NO: 146083 - DNA, 20 bp, Artificial
  CRISPR gRNA sequence
aaatggctgggttacagagt

SEQ ID NO: 146084 - DNA, 20 bp, Artificial
  CRISPR gRNA sequence
aatggctgggttacagagta

SEQ ID NO: 146085 - DNA, 20 bp, Artificial
  CRISPR gRNA sequence
atggctgggttacagagtag

SEQ ID NO: 146086 - DNA, 20 bp, Artificial
  CRISPR gRNA sequence
tggctgggttacagagtagg

SEQ ID NO: 146087 - DNA, 20 bp, Artificial
  CRISPR gRNA sequence
gagtagggggatatgtttat

SEQ ID NO: 146088 - DNA, 20 bp, Artificial
  CRISPR gRNA sequence
ttcaaactgactgaccactt

SEQ ID NO: 146089 - DNA, 20 bp, Artificial
  CRISPR gRNA sequence
tgaccactttagattctgac

SEQ ID NO: 146090 - DNA, 20 bp, Artificial
  CRISPR gRNA sequence
gattctgaccagcaatatat

SEQ ID NO: 146091 - DNA, 20 bp, Artificial
  CRISPR gRNA sequence
gaccagcaatatatgagttt

SEQ ID NO: 146092 - DNA, 20 bp, Artificial
  CRISPR gRNA sequence
ctccacttcctcaccaactg

SEQ ID NO: 146093 - DNA, 20 bp, Artificial
  CRISPR gRNA sequence
ctcaccaactgtggtattgt

SEQ ID NO: 146094 - DNA, 20 bp, Artificial
  CRISPR gRNA sequence
attgtcagtcttttttattt

SEQ ID NO: 146095 - DNA, 20 bp, Artificial
  CRISPR gRNA sequence
ttgtcagtcttttttatttt

SEQ ID NO: 146096 - DNA, 20 bp, Artificial
  CRISPR gRNA sequence
cttttttattttaggtattc

SEQ ID NO: 146097 - DNA, 20 bp, Artificial
  CRISPR gRNA sequence
ttttattttaggtattctag

SEQ ID NO: 146098 - DNA, 20 bp, Artificial
  CRISPR gRNA sequence
tttattttaggtattctagt

SEQ ID NO: 146099 - DNA, 20 bp, Artificial
  CRISPR gRNA sequence
gtattctagtgggtgtaaaa

SEQ ID NO: 146100 - DNA, 20 bp, Artificial
  CRISPR gRNA sequence
tgtaaaacagtatctcactg

SEQ ID NO: 146101 - DNA, 20 bp, Artificial
  CRISPR gRNA sequence
tgatgttgcatatcttctca

SEQ ID NO: 146102 - DNA, 20 bp, Artificial
  CRISPR gRNA sequence
gatgttgcatatcttctcat

SEQ ID NO: 146103 - DNA, 20 bp, Artificial
  CRISPR gRNA sequence
atatcttctcatgggtttat

SEQ ID NO: 146104 - DNA, 20 bp, Artificial
  CRISPR gRNA sequence
tatcttctcatgggtttatt

SEQ ID NO: 146105 - DNA, 20 bp, Artificial
  CRISPR gRNA sequence
tttgtttatctttttttctg

SEQ ID NO: 146106 - DNA, 20 bp, Artificial
  CRISPR gRNA sequence
ttgtttatctttttttctga

SEQ ID NO: 146107 - DNA, 20 bp, Artificial
  CRISPR gRNA sequence
ttttttctgaaggtctgtcc

SEQ ID NO: 146108 - DNA, 20 bp, Artificial
  CRISPR gRNA sequence
tctaatctgaattgatcttg

SEQ ID NO: 146109 - DNA, 20 bp, Artificial
  CRISPR gRNA sequence
ctaatctgaattgatcttga

SEQ ID NO: 146110 - DNA, 20 bp, Artificial
  CRISPR gRNA sequence
taatctgaattgatcttgaa

SEQ ID NO: 146111 - DNA, 20 bp, Artificial
  CRISPR gRNA sequence
atctgaattgatcttgaagg

SEQ ID NO: 146112 - DNA, 20 bp, Artificial
  CRISPR gRNA sequence
atcttgaagggagctttaac

SEQ ID NO: 146113 - DNA, 20 bp, Artificial
  CRISPR gRNA sequence
gagctttaactggatctctc

SEQ ID NO: 146114 - DNA, 20 bp, Artificial
  CRISPR gRNA sequence
actggatctctctggatcca

SEQ ID NO: 146115 - DNA, 20 bp, Artificial
  CRISPR gRNA sequence
tggatccacagactaacttc

SEQ ID NO: 146116 - DNA, 20 bp, Artificial
  CRISPR gRNA sequence
ggatccacagactaacttca

SEQ ID NO: 146117 - DNA, 20 bp, Artificial
  CRISPR gRNA sequence
tcaacatgcatatcatttat

SEQ ID NO: 146118 - DNA, 20 bp, Artificial
  CRISPR gRNA sequence
aacatgcatatcatttattg

SEQ ID NO: 146119 - DNA, 20 bp, Artificial
  CRISPR gRNA sequence
gcatatcatttattggagct

SEQ ID NO: 146120 - DNA, 20 bp, Artificial
  CRISPR gRNA sequence
tttgctttaaaactttcata

SEQ ID NO: 146121 - DNA, 20 bp, Artificial
  CRISPR gRNA sequence
taactttatgacgcattgac

SEQ ID NO: 146122 - DNA, 20 bp, Artificial
  CRISPR gRNA sequence
gacgcattgacaagctgtac

SEQ ID NO: 146123 - DNA, 20 bp, Artificial
  CRISPR gRNA sequence
tgacaagctgtactagaatg

SEQ ID NO: 146124 - DNA, 20 bp, Artificial
  CRISPR gRNA sequence
gacaagctgtactagaatgc

SEQ ID NO: 146125 - DNA, 20 bp, Artificial
  CRISPR gRNA sequence
actagaatgcaggcttccca

SEQ ID NO: 146126 - DNA, 20 bp, Artificial
  CRISPR gRNA sequence
aatgcaggcttcccacagat

SEQ ID NO: 146127 - DNA, 20 bp, Artificial
  CRISPR gRNA sequence
atgcaggcttcccacagata

SEQ ID NO: 146128 - DNA, 20 bp, Artificial
  CRISPR gRNA sequence
ttgtgtgtatcgttaatccc

SEQ ID NO: 146129 - DNA, 20 bp, Artificial
  CRISPR gRNA sequence
gtgtgtatcgttaatcccca

SEQ ID NO: 146130 - DNA, 20 bp, Artificial
  CRISPR gRNA sequence
tatcgttaatccccagagcc

SEQ ID NO: 146131 - DNA, 20 bp, Artificial
  CRISPR gRNA sequence
ttaatccccagagcctagaa

SEQ ID NO: 146132 - DNA, 20 bp, Artificial
  CRISPR gRNA sequence
ccagagcctagaaaagtgcc

SEQ ID NO: 146133 - DNA, 20 bp, Artificial
  CRISPR gRNA sequence
gaaaagtgcccggcacattg

SEQ ID NO: 146134 - DNA, 20 bp, Artificial
  CRISPR gRNA sequence
aaaagtgcccggcacattgt

SEQ ID NO: 146135 - DNA, 20 bp, Artificial
  CRISPR gRNA sequence
cccggcacattgtgggtgtt

SEQ ID NO: 146136 - DNA, 20 bp, Artificial
  CRISPR gRNA sequence
gcacattgtgggtgttcagt

SEQ ID NO: 146137 - DNA, 20 bp, Artificial
  CRISPR gRNA sequence
gggtgttcagtaagtatttt

SEQ ID NO: 146138 - DNA, 20 bp, Artificial
  CRISPR gRNA sequence
cacatgcattttctactttg

SEQ ID NO: 146139 - DNA, 20 bp, Artificial
  CRISPR gRNA sequence
acatgcattttctactttgt

SEQ ID NO: 146140 - DNA, 20 bp, Artificial
  CRISPR gRNA sequence
cattttctactttgtaggta

SEQ ID NO: 146141 - DNA, 20 bp, Artificial
  CRISPR gRNA sequence
attttctactttgtaggtaa

SEQ ID NO: 146142 - DNA, 20 bp, Artificial
  CRISPR gRNA sequence
ttttctactttgtaggtaaa

SEQ ID NO: 146143 - DNA, 20 bp, Artificial
  CRISPR gRNA sequence
ctttgtaggtaaagggaaac

SEQ ID NO: 146144 - DNA, 20 bp, Artificial
  CRISPR gRNA sequence
tgtaggtaaagggaaacaag

SEQ ID NO: 146145 - DNA, 20 bp, Artificial
  CRISPR gRNA sequence
taggtaaagggaaacaagaa

SEQ ID NO: 146146 - DNA, 20 bp, Artificial
  CRISPR gRNA sequence
gagaaaataatttactttct

SEQ ID NO: 146147 - DNA, 20 bp, Artificial
  CRISPR gRNA sequence
tacactcttcttcttgtatc

SEQ ID NO: 146148 - DNA, 20 bp, Artificial
  CRISPR gRNA sequence
acactcttcttcttgtatct

SEQ ID NO: 146149 - DNA, 20 bp, Artificial
  CRISPR gRNA sequence
atctgggaaatctttcctct

SEQ ID NO: 146150 - DNA, 20 bp, Artificial
  CRISPR gRNA sequence
ctgggaaatctttcctctaa

SEQ ID NO: 146151 - DNA, 20 bp, Artificial
  CRISPR gRNA sequence
gaaatctttcctctaagagc

SEQ ID NO: 146152 - DNA, 20 bp, Artificial
  CRISPR gRNA sequence
aaatctttcctctaagagcc

SEQ ID NO: 146153 - DNA, 20 bp, Artificial
  CRISPR gRNA sequence
aatctttcctctaagagcca

SEQ ID NO: 146154 - DNA, 20 bp, Artificial
  CRISPR gRNA sequence
ttcctctaagagccagggct

SEQ ID NO: 146155 - DNA, 20 bp, Artificial
  CRISPR gRNA sequence
taagagccagggcttggcta

SEQ ID NO: 146156 - DNA, 20 bp, Artificial
  CRISPR gRNA sequence
aagagccagggcttggctat

SEQ ID NO: 146157 - DNA, 20 bp, Artificial
  CRISPR gRNA sequence
agagccagggcttggctata

SEQ ID NO: 146158 - DNA, 20 bp, Artificial
  CRISPR gRNA sequence
ccagggcttggctatagggt

SEQ ID NO: 146159 - DNA, 20 bp, Artificial
  CRISPR gRNA sequence
cagggcttggctatagggtg

SEQ ID NO: 146160 - DNA, 20 bp, Artificial
  CRISPR gRNA sequence
agggcttggctatagggtga

SEQ ID NO: 146161 - DNA, 20 bp, Artificial
  CRISPR gRNA sequence
ggctatagggtgagggtttc

SEQ ID NO: 146162 - DNA, 20 bp, Artificial
  CRISPR gRNA sequence
ctatagggtgagggtttcta

SEQ ID NO: 146163 - DNA, 20 bp, Artificial
  CRISPR gRNA sequence
ggtttctagagtcaatgacc

SEQ ID NO: 146164 - DNA, 20 bp, Artificial
  CRISPR gRNA sequence
gtttctagagtcaatgacca

SEQ ID NO: 146165 - DNA, 20 bp, Artificial
  CRISPR gRNA sequence
tttctagagtcaatgaccaa

SEQ ID NO: 146166 - DNA, 20 bp, Artificial
  CRISPR gRNA sequence
atgaccaagggctctgcata

SEQ ID NO: 146167 - DNA, 20 bp, Artificial
  CRISPR gRNA sequence
cagtatgaatgtgaattcgc

SEQ ID NO: 146168 - DNA, 20 bp, Artificial
  CRISPR gRNA sequence
agtatgaatgtgaattcgct

SEQ ID NO: 146169 - DNA, 20 bp, Artificial
  CRISPR gRNA sequence
aaaattaaaattaaaaaaaa

SEQ ID NO: 146170 - DNA, 20 bp, Artificial
  CRISPR gRNA sequence
attaaaattaaaaaaaaaag

SEQ ID NO: 146171 - DNA, 20 bp, Artificial
  CRISPR gRNA sequence
aaaattaaaaaaaaaagaag

SEQ ID NO: 146172 - DNA, 20 bp, Artificial
  CRISPR gRNA sequence
aaaaaaaaaagaagaagaaa

SEQ ID NO: 146173 - DNA, 20 bp, Artificial
  CRISPR gRNA sequence
aaaaagaagaagaaaaagaa

SEQ ID NO: 146174 - DNA, 20 bp, Artificial
  CRISPR gRNA sequence
aaaagaagaagaaaaagaaa

SEQ ID NO: 146175 - DNA, 20 bp, Artificial
  CRISPR gRNA sequence
aagaaaaagaaaaggactcc

SEQ ID NO: 146176 - DNA, 20 bp, Artificial
  CRISPR gRNA sequence
agaaaaagaaaaggactccc

SEQ ID NO: 146177 - DNA, 20 bp, Artificial
  CRISPR gRNA sequence
aaaagaaaaggactcccagg

SEQ ID NO: 146178 - DNA, 20 bp, Artificial
  CRISPR gRNA sequence
aaagaaaaggactcccagga

SEQ ID NO: 146179 - DNA, 20 bp, Artificial
  CRISPR gRNA sequence
ggactcccaggaaggctgac

SEQ ID NO: 146180 - DNA, 20 bp, Artificial
  CRISPR gRNA sequence
gactcccaggaaggctgaca

SEQ ID NO: 146181 - DNA, 20 bp, Artificial
  CRISPR gRNA sequence
gaaggctgacaaggaacaaa

SEQ ID NO: 146182 - DNA, 20 bp, Artificial
  CRISPR gRNA sequence
aaggaacaaaaagcctaatg

SEQ ID NO: 146183 - DNA, 20 bp, Artificial
  CRISPR gRNA sequence
aacaaaaagcctaatgaagc

SEQ ID NO: 146184 - DNA, 20 bp, Artificial
  CRISPR gRNA sequence
aaaagcctaatgaagctagt

SEQ ID NO: 146185 - DNA, 20 bp, Artificial
  CRISPR gRNA sequence
gtgagactgatgatacttcc

SEQ ID NO: 146186 - DNA, 20 bp, Artificial
  CRISPR gRNA sequence
gatacttcctggaatctctc

SEQ ID NO: 146187 - DNA, 20 bp, Artificial
  CRISPR gRNA sequence
atacttcctggaatctctca

SEQ ID NO: 146188 - DNA, 20 bp, Artificial
  CRISPR gRNA sequence
aatctctcaaggctcccaac

SEQ ID NO: 146189 - DNA, 20 bp, Artificial
  CRISPR gRNA sequence
ctctcaaggctcccaaccag

SEQ ID NO: 146190 - DNA, 20 bp, Artificial
  CRISPR gRNA sequence
aaccagaagttgattacgtt

SEQ ID NO: 146191 - DNA, 20 bp, Artificial
  CRISPR gRNA sequence
aagttgattacgtttggaaa

SEQ ID NO: 146192 - DNA, 20 bp, Artificial
  CRISPR gRNA sequence
agttgattacgtttggaaac

SEQ ID NO: 146193 - DNA, 20 bp, Artificial
  CRISPR gRNA sequence
ggtaaatactcttatcactt

SEQ ID NO: 146194 - DNA, 20 bp, Artificial
  CRISPR gRNA sequence
atcacttgagcctctgttta

SEQ ID NO: 146195 - DNA, 20 bp, Artificial
  CRISPR gRNA sequence
cttgagcctctgtttatagt

SEQ ID NO: 146196 - DNA, 20 bp, Artificial
  CRISPR gRNA sequence
ttgagcctctgtttatagtg

SEQ ID NO: 146197 - DNA, 20 bp, Artificial
  CRISPR gRNA sequence
tgagcctctgtttatagtga

SEQ ID NO: 146198 - DNA, 20 bp, Artificial
  CRISPR gRNA sequence
gtttatagtgagggctcacc

SEQ ID NO: 146199 - DNA, 20 bp, Artificial
  CRISPR gRNA sequence
tttatagtgagggctcacca

SEQ ID NO: 146200 - DNA, 20 bp, Artificial
  CRISPR gRNA sequence
ttatagtgagggctcaccaa

SEQ ID NO: 146201 - DNA, 20 bp, Artificial
  CRISPR gRNA sequence
gtgagggctcaccaagggaa

SEQ ID NO: 146202 - DNA, 20 bp, Artificial
  CRISPR gRNA sequence
gagggctcaccaagggaaaa

SEQ ID NO: 146203 - DNA, 20 bp, Artificial
  CRISPR gRNA sequence
ctcaccaagggaaaagagtt

SEQ ID NO: 146204 - DNA, 20 bp, Artificial
  CRISPR gRNA sequence
gggaaaagagttcagtcact

SEQ ID NO: 146205 - DNA, 20 bp, Artificial
  CRISPR gRNA sequence
agtcactaagctgtgaaaac

SEQ ID NO: 146206 - DNA, 20 bp, Artificial
  CRISPR gRNA sequence
gtcactaagctgtgaaaacc

SEQ ID NO: 146207 - DNA, 20 bp, Artificial
  CRISPR gRNA sequence
cactaagctgtgaaaaccag

SEQ ID NO: 146208 - DNA, 20 bp, Artificial
  CRISPR gRNA sequence
ctaagctgtgaaaaccagga

SEQ ID NO: 146209 - DNA, 20 bp, Artificial
  CRISPR gRNA sequence
aaaccaggagagaattgatt

SEQ ID NO: 146210 - DNA, 20 bp, Artificial
  CRISPR gRNA sequence
agagaattgattaagatttt

SEQ ID NO: 146211 - DNA, 20 bp, Artificial
  CRISPR gRNA sequence
gaattgattaagatttttgg

SEQ ID NO: 146212 - DNA, 20 bp, Artificial
  CRISPR gRNA sequence
attgattaagatttttggtg

SEQ ID NO: 146213 - DNA, 20 bp, Artificial
  CRISPR gRNA sequence
gtggagaaacacaatcacca

SEQ ID NO: 146214 - DNA, 20 bp, Artificial
  CRISPR gRNA sequence
agaaacacaatcaccatggc

SEQ ID NO: 146215 - DNA, 20 bp, Artificial
  CRISPR gRNA sequence
aacacaatcaccatggctag

SEQ ID NO: 146216 - DNA, 20 bp, Artificial
  CRISPR gRNA sequence
acacaatcaccatggctaga

SEQ ID NO: 146217 - DNA, 20 bp, Artificial
  CRISPR gRNA sequence
aaggtatgtctgcctcccaa

SEQ ID NO: 146218 - DNA, 20 bp, Artificial
  CRISPR gRNA sequence
gtatgtctgcctcccaacag

SEQ ID NO: 146219 - DNA, 20 bp, Artificial
  CRISPR gRNA sequence
tggtgatgccaatgacacgt

SEQ ID NO: 146220 - DNA, 20 bp, Artificial
  CRISPR gRNA sequence
ccaatgacacgtcagcttga

SEQ ID NO: 146221 - DNA, 20 bp, Artificial
  CRISPR gRNA sequence
aatgacacgtcagcttgata

SEQ ID NO: 146222 - DNA, 20 bp, Artificial
  CRISPR gRNA sequence
atgacacgtcagcttgatag

SEQ ID NO: 146223 - DNA, 20 bp, Artificial
  CRISPR gRNA sequence
gtcagcttgatagaggccta

SEQ ID NO: 146224 - DNA, 20 bp, Artificial
  CRISPR gRNA sequence
tcagcttgatagaggcctaa

SEQ ID NO: 146225 - DNA, 20 bp, Artificial
  CRISPR gRNA sequence
agcttgatagaggcctaaag

SEQ ID NO: 146226 - DNA, 20 bp, Artificial
  CRISPR gRNA sequence
gcctaaaggagaacaatctt

SEQ ID NO: 146227 - DNA, 20 bp, Artificial
  CRISPR gRNA sequence
gagaacaatctttggtccta

SEQ ID NO: 146228 - DNA, 20 bp, Artificial
  CRISPR gRNA sequence
agaacaatctttggtcctaa

SEQ ID NO: 146229 - DNA, 20 bp, Artificial
  CRISPR gRNA sequence
aacaatctttggtcctaaag

SEQ ID NO: 146230 - DNA, 20 bp, Artificial
  CRISPR gRNA sequence
tcctaaaggagaacaatctt

SEQ ID NO: 146231 - DNA, 20 bp, Artificial
  CRISPR gRNA sequence
gagaacaatctttggtccta

SEQ ID NO: 146232 - DNA, 20 bp, Artificial
  CRISPR gRNA sequence
agaacaatctttggtcctaa

SEQ ID NO: 146233 - DNA, 20 bp, Artificial
  CRISPR gRNA sequence
aacaatctttggtcctaaag

SEQ ID NO: 146234 - DNA, 20 bp, Artificial
  CRISPR gRNA sequence
aatctttctccaacaccacg

SEQ ID NO: 146235 - DNA, 20 bp, Artificial
  CRISPR gRNA sequence
atctttctccaacaccacgc

SEQ ID NO: 146236 - DNA, 20 bp, Artificial
  CRISPR gRNA sequence
tccaacaccacgcaggaaaa

SEQ ID NO: 146237 - DNA, 20 bp, Artificial
  CRISPR gRNA sequence
ccaacaccacgcaggaaaac

SEQ ID NO: 146238 - DNA, 20 bp, Artificial
  CRISPR gRNA sequence
accacgcaggaaaacaggca

SEQ ID NO: 146239 - DNA, 20 bp, Artificial
  CRISPR gRNA sequence
ccacgcaggaaaacaggcaa

SEQ ID NO: 146240 - DNA, 20 bp, Artificial
  CRISPR gRNA sequence
gcaaaggctgctgcttaccc

SEQ ID NO: 146241 - DNA, 20 bp, Artificial
  CRISPR gRNA sequence
taccccagttttcctaatct

SEQ ID NO: 146242 - DNA, 20 bp, Artificial
  CRISPR gRNA sequence
taagtctgcaataatacctg

SEQ ID NO: 146243 - DNA, 20 bp, Artificial
  CRISPR gRNA sequence
agtctgcaataatacctgta

SEQ ID NO: 146244 - DNA, 20 bp, Artificial
  CRISPR gRNA sequence
gcaataatacctgtagagtc

SEQ ID NO: 146245 - DNA, 20 bp, Artificial
  CRISPR gRNA sequence
tgttatcttctgtgtgaatc

SEQ ID NO: 146246 - DNA, 20 bp, Artificial
  CRISPR gRNA sequence
gttatcttctgtgtgaatcc

SEQ ID NO: 146247 - DNA, 20 bp, Artificial
  CRISPR gRNA sequence
tctgtgtgaatccaggctcg

SEQ ID NO: 146248 - DNA, 20 bp, Artificial
  CRISPR gRNA sequence
tgtgtgaatccaggctcgaa

SEQ ID NO: 146249 - DNA, 20 bp, Artificial
  CRISPR gRNA sequence
tcaactctgtgataaaaatc

SEQ ID NO: 146250 - DNA, 20 bp, Artificial
  CRISPR gRNA sequence
caactctgtgataaaaatct

SEQ ID NO: 146251 - DNA, 20 bp, Artificial
  CRISPR gRNA sequence
gataaaaatctgggctgcct

SEQ ID NO: 146252 - DNA, 20 bp, Artificial
  CRISPR gRNA sequence
aaatctgggctgccttggca

SEQ ID NO: 146253 - DNA, 20 bp, Artificial
  CRISPR gRNA sequence
atctgggctgccttggcaaa

SEQ ID NO: 146254 - DNA, 20 bp, Artificial
  CRISPR gRNA sequence
ggctgccttggcaaagagta

SEQ ID NO: 146255 - DNA, 20 bp, Artificial
  CRISPR gRNA sequence
gctgccttggcaaagagtac

SEQ ID NO: 146256 - DNA, 20 bp, Artificial
  CRISPR gRNA sequence
tctgcactgatcatctgtaa

SEQ ID NO: 146257 - DNA, 20 bp, Artificial
  CRISPR gRNA sequence
ctgatcatctgtaacagaca

SEQ ID NO: 146258 - DNA, 20 bp, Artificial
  CRISPR gRNA sequence
tgatcatctgtaacagacac

SEQ ID NO: 146259 - DNA, 20 bp, Artificial
  CRISPR gRNA sequence
aggccctccctgtcaatcac

SEQ ID NO: 146260 - DNA, 20 bp, Artificial
  CRISPR gRNA sequence
cctccctgtcaatcaccagc

SEQ ID NO: 146261 - DNA, 20 bp, Artificial
  CRISPR gRNA sequence
caccagcaagtcatgcaaac

SEQ ID NO: 146262 - DNA, 20 bp, Artificial
  CRISPR gRNA sequence
ctgtctcttgcctcattgcc

SEQ ID NO: 146263 - DNA, 20 bp, Artificial
  CRISPR gRNA sequence
tcttgcctcattgcctggca

SEQ ID NO: 146264 - DNA, 20 bp, Artificial
  CRISPR gRNA sequence
cttgcctcattgcctggcat

SEQ ID NO: 146265 - DNA, 20 bp, Artificial
  CRISPR gRNA sequence
cattgcctggcatgggacta

SEQ ID NO: 146266 - DNA, 20 bp, Artificial
  CRISPR gRNA sequence
attgcctggcatgggactat

SEQ ID NO: 146267 - DNA, 20 bp, Artificial
  CRISPR gRNA sequence
ttgcctggcatgggactatg

SEQ ID NO: 146268 - DNA, 20 bp, Artificial
  CRISPR gRNA sequence
ctggcatgggactatggggc

SEQ ID NO: 146269 - DNA, 20 bp, Artificial
  CRISPR gRNA sequence
tggcatgggactatggggca

SEQ ID NO: 146270 - DNA, 20 bp, Artificial
  CRISPR gRNA sequence
ggcatgggactatggggcaa

SEQ ID NO: 146271 - DNA, 20 bp, Artificial
  CRISPR gRNA sequence
tggggcaagggtcaaaaaat

SEQ ID NO: 146272 - DNA, 20 bp, Artificial
  CRISPR gRNA sequence
ggggcaagggtcaaaaaatg

SEQ ID NO: 146273 - DNA, 20 bp, Artificial
  CRISPR gRNA sequence
gcaagggtcaaaaaatgagg

SEQ ID NO: 146274 - DNA, 20 bp, Artificial
  CRISPR gRNA sequence
aaaaatgaggtggtatactc

SEQ ID NO: 146275 - DNA, 20 bp, Artificial
  CRISPR gRNA sequence
aaatgaggtggtatactcaa

SEQ ID NO: 146276 - DNA, 20 bp, Artificial
  CRISPR gRNA sequence
tggtatactcaagagattcc

SEQ ID NO: 146277 - DNA, 20 bp, Artificial
  CRISPR gRNA sequence
ggtatactcaagagattcca

SEQ ID NO: 146278 - DNA, 20 bp, Artificial
  CRISPR gRNA sequence
ccaaggtaaaataaatccat

SEQ ID NO: 146279 - DNA, 20 bp, Artificial
  CRISPR gRNA sequence
aggtaaaataaatccatgag

SEQ ID NO: 146280 - DNA, 20 bp, Artificial
  CRISPR gRNA sequence
ggtaaaataaatccatgagt

SEQ ID NO: 146281 - DNA, 20 bp, Artificial
  CRISPR gRNA sequence
taaatccatgagtgggaaca

SEQ ID NO: 146282 - DNA, 20 bp, Artificial
  CRISPR gRNA sequence
atccatgagtgggaacaaag

SEQ ID NO: 146283 - DNA, 20 bp, Artificial
  CRISPR gRNA sequence
tccatgagtgggaacaaagc

SEQ ID NO: 146284 - DNA, 20 bp, Artificial
  CRISPR gRNA sequence
agtgggaacaaagcaggtaa

SEQ ID NO: 146285 - DNA, 20 bp, Artificial
  CRISPR gRNA sequence
gtgggaacaaagcaggtaac

SEQ ID NO: 146286 - DNA, 20 bp, Artificial
  CRISPR gRNA sequence
tgggaacaaagcaggtaaca

SEQ ID NO: 146287 - DNA, 20 bp, Artificial
  CRISPR gRNA sequence
ggaacaaagcaggtaacagg

SEQ ID NO: 146288 - DNA, 20 bp, Artificial
  CRISPR gRNA sequence
caaagcaggtaacagggaga

SEQ ID NO: 146289 - DNA, 20 bp, Artificial
  CRISPR gRNA sequence
agggagaaagaatacttatc

SEQ ID NO: 146290 - DNA, 20 bp, Artificial
  CRISPR gRNA sequence
ccatgcgccaaaccttgtgc

SEQ ID NO: 146291 - DNA, 20 bp, Artificial
  CRISPR gRNA sequence
catgcgccaaaccttgtgca

SEQ ID NO: 146292 - DNA, 20 bp, Artificial
  CRISPR gRNA sequence
gtgttttcttactcttataa

SEQ ID NO: 146293 - DNA, 20 bp, Artificial
  CRISPR gRNA sequence
actcttataatagcctttca

SEQ ID NO: 146294 - DNA, 20 bp, Artificial
  CRISPR gRNA sequence
taatagcctttcaaagaaac

SEQ ID NO: 146295 - DNA, 20 bp, Artificial
  CRISPR gRNA sequence
aatagcctttcaaagaaact

SEQ ID NO: 146296 - DNA, 20 bp, Artificial
  CRISPR gRNA sequence
atagcctttcaaagaaacta

SEQ ID NO: 146297 - DNA, 20 bp, Artificial
  CRISPR gRNA sequence
tagcctttcaaagaaactag

SEQ ID NO: 146298 - DNA, 20 bp, Artificial
  CRISPR gRNA sequence
tttcaaagaaactaggggtc

SEQ ID NO: 146299 - DNA, 20 bp, Artificial
  CRISPR gRNA sequence
tcaaagaaactaggggtcaa

SEQ ID NO: 146300 - DNA, 20 bp, Artificial
  CRISPR gRNA sequence
aaagaaactaggggtcaaga

SEQ ID NO: 146301 - DNA, 20 bp, Artificial
  CRISPR gRNA sequence
actaggggtcaagagagatg

SEQ ID NO: 146302 - DNA, 20 bp, Artificial
  CRISPR gRNA sequence
gagatgaagtgacttgccca

SEQ ID NO: 146303 - DNA, 20 bp, Artificial
  CRISPR gRNA sequence
aagtgacttgcccacagcca

SEQ ID NO: 146304 - DNA, 20 bp, Artificial
  CRISPR gRNA sequence
gtgacttgcccacagccata

SEQ ID NO: 146305 - DNA, 20 bp, Artificial
  CRISPR gRNA sequence
cttgcccacagccatagagc

SEQ ID NO: 146306 - DNA, 20 bp, Artificial
  CRISPR gRNA sequence
cccacagccatagagccagt

SEQ ID NO: 146307 - DNA, 20 bp, Artificial
  CRISPR gRNA sequence
acagccatagagccagtaag

SEQ ID NO: 146308 - DNA, 20 bp, Artificial
  CRISPR gRNA sequence
gccatagagccagtaagtgg

SEQ ID NO: 146309 - DNA, 20 bp, Artificial
  CRISPR gRNA sequence
ccatagagccagtaagtggc

SEQ ID NO: 146310 - DNA, 20 bp, Artificial
  CRISPR gRNA sequence
catagagccagtaagtggca

SEQ ID NO: 146311 - DNA, 20 bp, Artificial
  CRISPR gRNA sequence
agccagtaagtggcagggtt

SEQ ID NO: 146312 - DNA, 20 bp, Artificial
  CRISPR gRNA sequence
gccagtaagtggcagggttt

SEQ ID NO: 146313 - DNA, 20 bp, Artificial
  CRISPR gRNA sequence
cagggtttaggttctaatcc

SEQ ID NO: 146314 - DNA, 20 bp, Artificial
  CRISPR gRNA sequence
agggtttaggttctaatcca

SEQ ID NO: 146315 - DNA, 20 bp, Artificial
  CRISPR gRNA sequence
ggtttaggttctaatccaag

SEQ ID NO: 146316 - DNA, 20 bp, Artificial
  CRISPR gRNA sequence
aatccaaggagaaacaatat

SEQ ID NO: 146317 - DNA, 20 bp, Artificial
  CRISPR gRNA sequence
atccaaggagaaacaatatg

SEQ ID NO: 146318 - DNA, 20 bp, Artificial
  CRISPR gRNA sequence
caaggagaaacaatatgagg

SEQ ID NO: 146319 - DNA, 20 bp, Artificial
  CRISPR gRNA sequence
aaggagaaacaatatgagga

SEQ ID NO: 146320 - DNA, 20 bp, Artificial
  CRISPR gRNA sequence
ggagaaacaatatgaggaag

SEQ ID NO: 146321 - DNA, 20 bp, Artificial
  CRISPR gRNA sequence
acaatatgaggaaggagaat

SEQ ID NO: 146322 - DNA, 20 bp, Artificial
  CRISPR gRNA sequence
aggaaggagaatgagcttga

SEQ ID NO: 146323 - DNA, 20 bp, Artificial
  CRISPR gRNA sequence
agaatgagcttgaaagccaa

SEQ ID NO: 146324 - DNA, 20 bp, Artificial
  CRISPR gRNA sequence
agcttgaaagccaatggatt

SEQ ID NO: 146325 - DNA, 20 bp, Artificial
  CRISPR gRNA sequence
aatggatttggataaaattg

SEQ ID NO: 146326 - DNA, 20 bp, Artificial
  CRISPR gRNA sequence
atggatttggataaaattgc

SEQ ID NO: 146327 - DNA, 20 bp, Artificial
  CRISPR gRNA sequence
ttgcaggcttcccatccttt

SEQ ID NO: 146328 - DNA, 20 bp, Artificial
  CRISPR gRNA sequence
tgcaggcttcccatcctttt

SEQ ID NO: 146329 - DNA, 20 bp, Artificial
  CRISPR gRNA sequence
ggctttttcatgtactgaaa

SEQ ID NO: 146330 - DNA, 20 bp, Artificial
  CRISPR gRNA sequence
ctttttcatgtactgaaaaa

SEQ ID NO: 146331 - DNA, 20 bp, Artificial
  CRISPR gRNA sequence
tttttcatgtactgaaaaag

SEQ ID NO: 146332 - DNA, 20 bp, Artificial
  CRISPR gRNA sequence
tgaaaaagaggataaccttt

SEQ ID NO: 146333 - DNA, 20 bp, Artificial
  CRISPR gRNA sequence
ataacctttcagttttattg

SEQ ID NO: 146334 - DNA, 20 bp, Artificial
  CRISPR gRNA sequence
ttttattgtggcaatcaaat

SEQ ID NO: 146335 - DNA, 20 bp, Artificial
  CRISPR gRNA sequence
aatgagataatatatgtacc

SEQ ID NO: 146336 - DNA, 20 bp, Artificial
  CRISPR gRNA sequence
gataatatatgtacccagcc

SEQ ID NO: 146337 - DNA, 20 bp, Artificial
  CRISPR gRNA sequence
ataatatatgtacccagccc

SEQ ID NO: 146338 - DNA, 20 bp, Artificial
  CRISPR gRNA sequence
taatatatgtacccagccca

SEQ ID NO: 146339 - DNA, 20 bp, Artificial
  CRISPR gRNA sequence
tatgtacccagcccagggct

SEQ ID NO: 146340 - DNA, 20 bp, Artificial
  CRISPR gRNA sequence
ccagcccagggcttggcata

SEQ ID NO: 146341 - DNA, 20 bp, Artificial
  CRISPR gRNA sequence
cagcccagggcttggcatat

SEQ ID NO: 146342 - DNA, 20 bp, Artificial
  CRISPR gRNA sequence
ttggcatataggaaatgctc

SEQ ID NO: 146343 - DNA, 20 bp, Artificial
  CRISPR gRNA sequence
tcttgatgtgtctgatttca

SEQ ID NO: 146344 - DNA, 20 bp, Artificial
  CRISPR gRNA sequence
tgtgtctgatttcaaagttg

SEQ ID NO: 146345 - DNA, 20 bp, Artificial
  CRISPR gRNA sequence
gatttcaaagttgaagctct

SEQ ID NO: 146346 - DNA, 20 bp, Artificial
  CRISPR gRNA sequence
gttgaagctcttggtcaaac

SEQ ID NO: 146347 - DNA, 20 bp, Artificial
  CRISPR gRNA sequence
ttgaagctcttggtcaaaca

SEQ ID NO: 146348 - DNA, 20 bp, Artificial
  CRISPR gRNA sequence
caaacaaggttctaaacctt

SEQ ID NO: 146349 - DNA, 20 bp, Artificial
  CRISPR gRNA sequence
caaggttctaaacctttggt

SEQ ID NO: 146350 - DNA, 20 bp, Artificial
  CRISPR gRNA sequence
aaggttctaaacctttggtg

SEQ ID NO: 146351 - DNA, 20 bp, Artificial
  CRISPR gRNA sequence
gttctaaacctttggtgagg

SEQ ID NO: 146352 - DNA, 20 bp, Artificial
  CRISPR gRNA sequence
ctttggtgaggtagtctgtg

SEQ ID NO: 146353 - DNA, 20 bp, Artificial
  CRISPR gRNA sequence
tttggtgaggtagtctgtgc

SEQ ID NO: 146354 - DNA, 20 bp, Artificial
  CRISPR gRNA sequence
gaggtagtctgtgcaggata

SEQ ID NO: 146355 - DNA, 20 bp, Artificial
  CRISPR gRNA sequence
gtctgtgcaggatacagcca

SEQ ID NO: 146356 - DNA, 20 bp, Artificial
  CRISPR gRNA sequence
gtgcaggatacagccacaga

SEQ ID NO: 146357 - DNA, 20 bp, Artificial
  CRISPR gRNA sequence
gcaggatacagccacagaaa

SEQ ID NO: 146358 - DNA, 20 bp, Artificial
  CRISPR gRNA sequence
tacagccacagaaagagctc

SEQ ID NO: 146359 - DNA, 20 bp, Artificial
  CRISPR gRNA sequence
cagccacagaaagagctctg

SEQ ID NO: 146360 - DNA, 20 bp, Artificial
  CRISPR gRNA sequence
cagaaagagctctggagtta

SEQ ID NO: 146361 - DNA, 20 bp, Artificial
  CRISPR gRNA sequence
aaagagctctggagttaaag

SEQ ID NO: 146362 - DNA, 20 bp, Artificial
  CRISPR gRNA sequence
gagctctggagttaaagaag

SEQ ID NO: 146363 - DNA, 20 bp, Artificial
  CRISPR gRNA sequence
ctctggagttaaagaagcag

SEQ ID NO: 146364 - DNA, 20 bp, Artificial
  CRISPR gRNA sequence
ggagttaaagaagcagcaga

SEQ ID NO: 146365 - DNA, 20 bp, Artificial
  CRISPR gRNA sequence
gagttaaagaagcagcagat

SEQ ID NO: 146366 - DNA, 20 bp, Artificial
  CRISPR gRNA sequence
aagaagcagcagatgggaaa

SEQ ID NO: 146367 - DNA, 20 bp, Artificial
  CRISPR gRNA sequence
agaagcagcagatgggaaat

SEQ ID NO: 146368 - DNA, 20 bp, Artificial
  CRISPR gRNA sequence
gcagatgggaaatgggatct

SEQ ID NO: 146369 - DNA, 20 bp, Artificial
  CRISPR gRNA sequence
ggatcttggtcctatcactc

SEQ ID NO: 146370 - DNA, 20 bp, Artificial
  CRISPR gRNA sequence
gatcttggtcctatcactct

SEQ ID NO: 146371 - DNA, 20 bp, Artificial
  CRISPR gRNA sequence
ttggtcctatcactctgggt

SEQ ID NO: 146372 - DNA, 20 bp, Artificial
  CRISPR gRNA sequence
tatttccattgtctgtaaaa

SEQ ID NO: 146373 - DNA, 20 bp, Artificial
  CRISPR gRNA sequence
tcttattatatcaaatctca

SEQ ID NO: 146374 - DNA, 20 bp, Artificial
  CRISPR gRNA sequence
cttattatatcaaatctcac

SEQ ID NO: 146375 - DNA, 20 bp, Artificial
  CRISPR gRNA sequence
ttattatatcaaatctcaca

SEQ ID NO: 146376 - DNA, 20 bp, Artificial
  CRISPR gRNA sequence
aaatctcacagggctactgt

SEQ ID NO: 146377 - DNA, 20 bp, Artificial
  CRISPR gRNA sequence
aatctcacagggctactgtg

SEQ ID NO: 146378 - DNA, 20 bp, Artificial
  CRISPR gRNA sequence
ctcacagggctactgtgagg

SEQ ID NO: 146379 - DNA, 20 bp, Artificial
  CRISPR gRNA sequence
cagggctactgtgaggaaga

SEQ ID NO: 146380 - DNA, 20 bp, Artificial
  CRISPR gRNA sequence
agggctactgtgaggaagaa

SEQ ID NO: 146381 - DNA, 20 bp, Artificial
  CRISPR gRNA sequence
ggctactgtgaggaagaaag

SEQ ID NO: 146382 - DNA, 20 bp, Artificial
  CRISPR gRNA sequence
aggaagaaaggagctaataa

SEQ ID NO: 146383 - DNA, 20 bp, Artificial
  CRISPR gRNA sequence
ggaagaaaggagctaataaa

SEQ ID NO: 146384 - DNA, 20 bp, Artificial
  CRISPR gRNA sequence
gaagaaaggagctaataaaa

SEQ ID NO: 146385 - DNA, 20 bp, Artificial
  CRISPR gRNA sequence
ggaaaattactatcaattgt

SEQ ID NO: 146386 - DNA, 20 bp, Artificial
  CRISPR gRNA sequence
agctttctgtgaaaatacaa

SEQ ID NO: 146387 - DNA, 20 bp, Artificial
  CRISPR gRNA sequence
tacaaaagactattaatttt

SEQ ID NO: 146388 - DNA, 20 bp, Artificial
  CRISPR gRNA sequence
aaaagactattaattttgag

SEQ ID NO: 146389 - DNA, 20 bp, Artificial
  CRISPR gRNA sequence
actattaattttgagtggta

SEQ ID NO: 146390 - DNA, 20 bp, Artificial
  CRISPR gRNA sequence
tattaattttgagtggtaaa

SEQ ID NO: 146391 - DNA, 20 bp, Artificial
  CRISPR gRNA sequence
aattttgagtggtaaagaga

SEQ ID NO: 146392 - DNA, 20 bp, Artificial
  CRISPR gRNA sequence
ttttgagtggtaaagagaca

SEQ ID NO: 146393 - DNA, 20 bp, Artificial
  CRISPR gRNA sequence
gacagagttcctctttctct

SEQ ID NO: 146394 - DNA, 20 bp, Artificial
  CRISPR gRNA sequence
tctttctctgagatctgtaa

SEQ ID NO: 146395 - DNA, 20 bp, Artificial
  CRISPR gRNA sequence
tttctctgagatctgtaatg

SEQ ID NO: 146396 - DNA, 20 bp, Artificial
  CRISPR gRNA sequence
tctgagatctgtaatggaga

SEQ ID NO: 146397 - DNA, 20 bp, Artificial
  CRISPR gRNA sequence
ctgtaatggagatggactcc

SEQ ID NO: 146398 - DNA, 20 bp, Artificial
  CRISPR gRNA sequence
tgtaatggagatggactcct

SEQ ID NO: 146399 - DNA, 20 bp, Artificial
  CRISPR gRNA sequence
gagatggactcctaggaata

SEQ ID NO: 146400 - DNA, 20 bp, Artificial
  CRISPR gRNA sequence
gactcctaggaatacagaaa

SEQ ID NO: 146401 - DNA, 20 bp, Artificial
  CRISPR gRNA sequence
ctaggaatacagaaatggcc

SEQ ID NO: 146402 - DNA, 20 bp, Artificial
  CRISPR gRNA sequence
gcccacgcaaaccctctcac

SEQ ID NO: 146403 - DNA, 20 bp, Artificial
  CRISPR gRNA sequence
cacaagtattattcatgtaa

SEQ ID NO: 146404 - DNA, 20 bp, Artificial
  CRISPR gRNA sequence
attcatgtaaaagaaactca

SEQ ID NO: 146405 - DNA, 20 bp, Artificial
  CRISPR gRNA sequence
aaaagaaactcatagatcaa

SEQ ID NO: 146406 - DNA, 20 bp, Artificial
  CRISPR gRNA sequence
aaagaaactcatagatcaaa

SEQ ID NO: 146407 - DNA, 20 bp, Artificial
  CRISPR gRNA sequence
aaactcatagatcaaaaggt

SEQ ID NO: 146408 - DNA, 20 bp, Artificial
  CRISPR gRNA sequence
catagatcaaaaggttagaa

SEQ ID NO: 146409 - DNA, 20 bp, Artificial
  CRISPR gRNA sequence
atagatcaaaaggttagaac

SEQ ID NO: 146410 - DNA, 20 bp, Artificial
  CRISPR gRNA sequence
gatcaaaaggttagaacagg

SEQ ID NO: 146411 - DNA, 20 bp, Artificial
  CRISPR gRNA sequence
atcattatcaaaaatttctt

SEQ ID NO: 146412 - DNA, 20 bp, Artificial
  CRISPR gRNA sequence
cattatcaaaaatttcttaa

SEQ ID NO: 146413 - DNA, 20 bp, Artificial
  CRISPR gRNA sequence
tcaaaaatttcttaagagtt

SEQ ID NO: 146414 - DNA, 20 bp, Artificial
  CRISPR gRNA sequence
ttcagatcaacaaactatgt

SEQ ID NO: 146415 - DNA, 20 bp, Artificial
  CRISPR gRNA sequence
aacaaactatgtaagacgct

SEQ ID NO: 146416 - DNA, 20 bp, Artificial
  CRISPR gRNA sequence
tatgtaagacgctaagatga

SEQ ID NO: 146417 - DNA, 20 bp, Artificial
  CRISPR gRNA sequence
tgtatatactacactgtgaa

SEQ ID NO: 146418 - DNA, 20 bp, Artificial
  CRISPR gRNA sequence
tacactgtgaacagaactgt

SEQ ID NO: 146419 - DNA, 20 bp, Artificial
  CRISPR gRNA sequence
tgaacagaactgtgagatac

SEQ ID NO: 146420 - DNA, 20 bp, Artificial
  CRISPR gRNA sequence
cagaactgtgagataccagc

SEQ ID NO: 146421 - DNA, 20 bp, Artificial
  CRISPR gRNA sequence
agaactgtgagataccagct

SEQ ID NO: 146422 - DNA, 20 bp, Artificial
  CRISPR gRNA sequence
tgtgagataccagctgggca

SEQ ID NO: 146423 - DNA, 20 bp, Artificial
  CRISPR gRNA sequence
gagataccagctgggcatgg

SEQ ID NO: 146424 - DNA, 20 bp, Artificial
  CRISPR gRNA sequence
tggtggctcatgcctaatcc

SEQ ID NO: 146425 - DNA, 20 bp, Artificial
  CRISPR gRNA sequence
catgcctaatcctagcactt

SEQ ID NO: 146426 - DNA, 20 bp, Artificial
  CRISPR gRNA sequence
atgcctaatcctagcacttt

SEQ ID NO: 146427 - DNA, 20 bp, Artificial
  CRISPR gRNA sequence
gcctaatcctagcactttgg

SEQ ID NO: 146428 - DNA, 20 bp, Artificial
  CRISPR gRNA sequence
cctaatcctagcactttggg

SEQ ID NO: 146429 - DNA, 20 bp, Artificial
  CRISPR gRNA sequence
tcctagcactttgggaggct

SEQ ID NO: 146430 - DNA, 20 bp, Artificial
  CRISPR gRNA sequence
cctagcactttgggaggctg

SEQ ID NO: 146431 - DNA, 20 bp, Artificial
  CRISPR gRNA sequence
gcactttgggaggctgaggc

SEQ ID NO: 146432 - DNA, 20 bp, Artificial
  CRISPR gRNA sequence
actttgggaggctgaggctg

SEQ ID NO: 146433 - DNA, 20 bp, Artificial
  CRISPR gRNA sequence
ctttgggaggctgaggctgg

SEQ ID NO: 146434 - DNA, 20 bp, Artificial
  CRISPR gRNA sequence
ctgaggctggaggactgctt

SEQ ID NO: 146435 - DNA, 20 bp, Artificial
  CRISPR gRNA sequence
gctggaggactgcttgagcc

SEQ ID NO: 146436 - DNA, 20 bp, Artificial
  CRISPR gRNA sequence
ctggaggactgcttgagccc

SEQ ID NO: 146437 - DNA, 20 bp, Artificial
  CRISPR gRNA sequence
ggaggactgcttgagcccag

SEQ ID NO: 146438 - DNA, 20 bp, Artificial
  CRISPR gRNA sequence
tgagcccaggagttcgtgac

SEQ ID NO: 146439 - DNA, 20 bp, Artificial
  CRISPR gRNA sequence
ccaggagttcgtgactagcc

SEQ ID NO: 146440 - DNA, 20 bp, Artificial
  CRISPR gRNA sequence
cgtgactagcctggacaaca

SEQ ID NO: 146441 - DNA, 20 bp, Artificial
  CRISPR gRNA sequence
actagcctggacaacatggt

SEQ ID NO: 146442 - DNA, 20 bp, Artificial
  CRISPR gRNA sequence
ccaaaaaaacattaaaaatt

SEQ ID NO: 146443 - DNA, 20 bp, Artificial
  CRISPR gRNA sequence
aaaaacattaaaaattaagc

SEQ ID NO: 146444 - DNA, 20 bp, Artificial
  CRISPR gRNA sequence
aaaaattaagccagacatga

SEQ ID NO: 146445 - DNA, 20 bp, Artificial
  CRISPR gRNA sequence
gacatgatggcacgtgcctg

SEQ ID NO: 146446 - DNA, 20 bp, Artificial
  CRISPR gRNA sequence
atggcacgtgcctgtagtcc

SEQ ID NO: 146447 - DNA, 20 bp, Artificial
  CRISPR gRNA sequence
tgcctgtagtcccagctact

SEQ ID NO: 146448 - DNA, 20 bp, Artificial
  CRISPR gRNA sequence
gcctgtagtcccagctactt

SEQ ID NO: 146449 - DNA, 20 bp, Artificial
  CRISPR gRNA sequence
ctgtagtcccagctacttgg

SEQ ID NO: 146450 - DNA, 20 bp, Artificial
  CRISPR gRNA sequence
tgtagtcccagctacttggg

SEQ ID NO: 146451 - DNA, 20 bp, Artificial
  CRISPR gRNA sequence
tcccagctacttgggaggct

SEQ ID NO: 146452 - DNA, 20 bp, Artificial
  CRISPR gRNA sequence
cccagctacttgggaggctg

SEQ ID NO: 146453 - DNA, 20 bp, Artificial
  CRISPR gRNA sequence
agctacttgggaggctgagg

SEQ ID NO: 146454 - DNA, 20 bp, Artificial
  CRISPR gRNA sequence
gctacttgggaggctgaggt

SEQ ID NO: 146455 - DNA, 20 bp, Artificial
  CRISPR gRNA sequence
acttgggaggctgaggtggg

SEQ ID NO: 146456 - DNA, 20 bp, Artificial
  CRISPR gRNA sequence
ctgaggtgggaagatcactt

SEQ ID NO: 146457 - DNA, 20 bp, Artificial
  CRISPR gRNA sequence
gtgggaagatcacttaagcc

SEQ ID NO: 146458 - DNA, 20 bp, Artificial
  CRISPR gRNA sequence
tgggaagatcacttaagcct

SEQ ID NO: 146459 - DNA, 20 bp, Artificial
  CRISPR gRNA sequence
ggaagatcacttaagcctgg

SEQ ID NO: 146460 - DNA, 20 bp, Artificial
  CRISPR gRNA sequence
gaagatcacttaagcctggg

SEQ ID NO: 146461 - DNA, 20 bp, Artificial
  CRISPR gRNA sequence
tcacttaagcctgggaggtg

SEQ ID NO: 146462 - DNA, 20 bp, Artificial
  CRISPR gRNA sequence
cacttaagcctgggaggtga

SEQ ID NO: 146463 - DNA, 20 bp, Artificial
  CRISPR gRNA sequence
agcctgggaggtgaaggcta

SEQ ID NO: 146464 - DNA, 20 bp, Artificial
  CRISPR gRNA sequence
tgggaggtgaaggctacagt

SEQ ID NO: 146465 - DNA, 20 bp, Artificial
  CRISPR gRNA sequence
gtgattatgccattgccctc

SEQ ID NO: 146466 - DNA, 20 bp, Artificial
  CRISPR gRNA sequence
tatgccattgccctccagcc

SEQ ID NO: 146467 - DNA, 20 bp, Artificial
  CRISPR gRNA sequence
atgccattgccctccagcct

SEQ ID NO: 146468 - DNA, 20 bp, Artificial
  CRISPR gRNA sequence
ttgccctccagcctgggtga

SEQ ID NO: 146469 - DNA, 20 bp, Artificial
  CRISPR gRNA sequence
gccctccagcctgggtgaca

SEQ ID NO: 146470 - DNA, 20 bp, Artificial
  CRISPR gRNA sequence
tccagcctgggtgacagagt

SEQ ID NO: 146471 - DNA, 20 bp, Artificial
  CRISPR gRNA sequence
gagtgagaccctgtctcaaa

SEQ ID NO: 146472 - DNA, 20 bp, Artificial
  CRISPR gRNA sequence
gagaccctgtctcaaaaaga

SEQ ID NO: 146473 - DNA, 20 bp, Artificial
  CRISPR gRNA sequence
cctgtctcaaaaagaaagaa

SEQ ID NO: 146474 - DNA, 20 bp, Artificial
  CRISPR gRNA sequence
ctgtctcaaaaagaaagaaa

SEQ ID NO: 146475 - DNA, 20 bp, Artificial
  CRISPR gRNA sequence
ctcaaaaagaaagaaaaggc

SEQ ID NO: 146476 - DNA, 20 bp, Artificial
  CRISPR gRNA sequence
aagaaagaaaaggccagatg

SEQ ID NO: 146477 - DNA, 20 bp, Artificial
  CRISPR gRNA sequence
aaagaaaaggccagatgcgg

SEQ ID NO: 146478 - DNA, 20 bp, Artificial
  CRISPR gRNA sequence
gtggctcacacctgtaatcc

SEQ ID NO: 146479 - DNA, 20 bp, Artificial
  CRISPR gRNA sequence
cacctgtaatcccagcactt

SEQ ID NO: 146480 - DNA, 20 bp, Artificial
  CRISPR gRNA sequence
acctgtaatcccagcacttt

SEQ ID NO: 146481 - DNA, 20 bp, Artificial
  CRISPR gRNA sequence
ctgtaatcccagcactttgg

SEQ ID NO: 146482 - DNA, 20 bp, Artificial
  CRISPR gRNA sequence
tgtaatcccagcactttggg

SEQ ID NO: 146483 - DNA, 20 bp, Artificial
  CRISPR gRNA sequence
aatcccagcactttgggagg

SEQ ID NO: 146484 - DNA, 20 bp, Artificial
  CRISPR gRNA sequence
tcccagcactttgggaggca

SEQ ID NO: 146485 - DNA, 20 bp, Artificial
  CRISPR gRNA sequence
cccagcactttgggaggcag

SEQ ID NO: 146486 - DNA, 20 bp, Artificial
  CRISPR gRNA sequence
agcactttgggaggcagagg

SEQ ID NO: 146487 - DNA, 20 bp, Artificial
  CRISPR gRNA sequence
gcactttgggaggcagaggc

SEQ ID NO: 146488 - DNA, 20 bp, Artificial
  CRISPR gRNA sequence
cagaggcaggcatatcacct

SEQ ID NO: 146489 - DNA, 20 bp, Artificial
  CRISPR gRNA sequence
agaggcaggcatatcacctg

SEQ ID NO: 146490 - DNA, 20 bp, Artificial
  CRISPR gRNA sequence
gcaggcatatcacctgaggt

SEQ ID NO: 146491 - DNA, 20 bp, Artificial
  CRISPR gRNA sequence
caggcatatcacctgaggtc

SEQ ID NO: 146492 - DNA, 20 bp, Artificial
  CRISPR gRNA sequence
ggcatatcacctgaggtcgg

SEQ ID NO: 146493 - DNA, 20 bp, Artificial
  CRISPR gRNA sequence
tcacctgaggtcgggagttc

SEQ ID NO: 146494 - DNA, 20 bp, Artificial
  CRISPR gRNA sequence
tgaggtcgggagttcaagac

SEQ ID NO: 146495 - DNA, 20 bp, Artificial
  CRISPR gRNA sequence
tcgggagttcaagaccagcc

SEQ ID NO: 146496 - DNA, 20 bp, Artificial
  CRISPR gRNA sequence
caagaccagcctggccaaca

SEQ ID NO: 146497 - DNA, 20 bp, Artificial
  CRISPR gRNA sequence
tctacaaaaaatacaaaaat

SEQ ID NO: 146498 - DNA, 20 bp, Artificial
  CRISPR gRNA sequence
caaaaaatacaaaaattagc

SEQ ID NO: 146499 - DNA, 20 bp, Artificial
  CRISPR gRNA sequence
aaaaaatacaaaaattagct

SEQ ID NO: 146500 - DNA, 20 bp, Artificial
  CRISPR gRNA sequence
atacaaaaattagctaggtg

SEQ ID NO: 146501 - DNA, 20 bp, Artificial
  CRISPR gRNA sequence
caaaaattagctaggtgtgg

SEQ ID NO: 146502 - DNA, 20 bp, Artificial
  CRISPR gRNA sequence
aaattagctaggtgtggtgg

SEQ ID NO: 146503 - DNA, 20 bp, Artificial
  CRISPR gRNA sequence
aattagctaggtgtggtggc

SEQ ID NO: 146504 - DNA, 20 bp, Artificial
  CRISPR gRNA sequence
gtggcgggcgcctgtaatcc

SEQ ID NO: 146505 - DNA, 20 bp, Artificial
  CRISPR gRNA sequence
cgcctgtaatcctagctact

SEQ ID NO: 146506 - DNA, 20 bp, Artificial
  CRISPR gRNA sequence
gcctgtaatcctagctactc

SEQ ID NO: 146507 - DNA, 20 bp, Artificial
  CRISPR gRNA sequence
ctgtaatcctagctactcgg

SEQ ID NO: 146508 - DNA, 20 bp, Artificial
  CRISPR gRNA sequence
tcctagctactcgggagtct

SEQ ID NO: 146509 - DNA, 20 bp, Artificial
  CRISPR gRNA sequence
cctagctactcgggagtctg

SEQ ID NO: 146510 - DNA, 20 bp, Artificial
  CRISPR gRNA sequence
ctactcgggagtctgaggca

SEQ ID NO: 146511 - DNA, 20 bp, Artificial
  CRISPR gRNA sequence
tactcgggagtctgaggcat

SEQ ID NO: 146512 - DNA, 20 bp, Artificial
  CRISPR gRNA sequence
gcatgggaattgcctgaacc

SEQ ID NO: 146513 - DNA, 20 bp, Artificial
  CRISPR gRNA sequence
catgggaattgcctgaacct

SEQ ID NO: 146514 - DNA, 20 bp, Artificial
  CRISPR gRNA sequence
tgggaattgcctgaacctgg

SEQ ID NO: 146515 - DNA, 20 bp, Artificial
  CRISPR gRNA sequence
gggaattgcctgaacctggg

SEQ ID NO: 146516 - DNA, 20 bp, Artificial
  CRISPR gRNA sequence
aattgcctgaacctgggagg

SEQ ID NO: 146517 - DNA, 20 bp, Artificial
  CRISPR gRNA sequence
ttgcctgaacctgggaggca

SEQ ID NO: 146518 - DNA, 20 bp, Artificial
  CRISPR gRNA sequence
tgcctgaacctgggaggcag

SEQ ID NO: 146519 - DNA, 20 bp, Artificial
  CRISPR gRNA sequence
aacctgggaggcagaggttg

SEQ ID NO: 146520 - DNA, 20 bp, Artificial
  CRISPR gRNA sequence
tgggaggcagaggttgcagt

SEQ ID NO: 146521 - DNA, 20 bp, Artificial
  CRISPR gRNA sequence
ggcagaggttgcagtgagct

SEQ ID NO: 146522 - DNA, 20 bp, Artificial
  CRISPR gRNA sequence
aagctcgcaccactgcactg

SEQ ID NO: 146523 - DNA, 20 bp, Artificial
  CRISPR gRNA sequence
cgcaccactgcactgcggcc

SEQ ID NO: 146524 - DNA, 20 bp, Artificial
  CRISPR gRNA sequence
ctgcactgcggcctggataa

SEQ ID NO: 146525 - DNA, 20 bp, Artificial
  CRISPR gRNA sequence
gcactgcggcctggataaca

SEQ ID NO: 146526 - DNA, 20 bp, Artificial
  CRISPR gRNA sequence
ttcaacatctaaaaaatttt

SEQ ID NO: 146527 - DNA, 20 bp, Artificial
  CRISPR gRNA sequence
tcaacatctaaaaaattttc

SEQ ID NO: 146528 - DNA, 20 bp, Artificial
  CRISPR gRNA sequence
aattttcaggatgatccata

SEQ ID NO: 146529 - DNA, 20 bp, Artificial
  CRISPR gRNA sequence
taaccaaaactgctcaattt

SEQ ID NO: 146530 - DNA, 20 bp, Artificial
  CRISPR gRNA sequence
gctcacttaacaattttgca

SEQ ID NO: 146531 - DNA, 20 bp, Artificial
  CRISPR gRNA sequence
ctcacttaacaattttgcac

SEQ ID NO: 146532 - DNA, 20 bp, Artificial
  CRISPR gRNA sequence
tgcacaggaaccaaataaca

SEQ ID NO: 146533 - DNA, 20 bp, Artificial
  CRISPR gRNA sequence
ggaaccaaataacaaagcaa

SEQ ID NO: 146534 - DNA, 20 bp, Artificial
  CRISPR gRNA sequence
ccaaataacaaagcaacaga

SEQ ID NO: 146535 - DNA, 20 bp, Artificial
  CRISPR gRNA sequence
ttcttgtttaattaaacttt

SEQ ID NO: 146536 - DNA, 20 bp, Artificial
  CRISPR gRNA sequence
tttaattaaactttgagctc

SEQ ID NO: 146537 - DNA, 20 bp, Artificial
  CRISPR gRNA sequence
taattaaactttgagctcta

SEQ ID NO: 146538 - DNA, 20 bp, Artificial
  CRISPR gRNA sequence
actttgagctctagagaaat

SEQ ID NO: 146539 - DNA, 20 bp, Artificial
  CRISPR gRNA sequence
gcaataacctacccatcact

SEQ ID NO: 146540 - DNA, 20 bp, Artificial
  CRISPR gRNA sequence
acccatcacttagcttcaat

SEQ ID NO: 146541 - DNA, 20 bp, Artificial
  CRISPR gRNA sequence
ttcaccttcacatcttcatc

SEQ ID NO: 146542 - DNA, 20 bp, Artificial
  CRISPR gRNA sequence
tttcataatcttcttaatac

SEQ ID NO: 146543 - DNA, 20 bp, Artificial
  CRISPR gRNA sequence
ataatcttcttaatacgagc

SEQ ID NO: 146544 - DNA, 20 bp, Artificial
  CRISPR gRNA sequence
atcttcttaatacgagccag

SEQ ID NO: 146545 - DNA, 20 bp, Artificial
  CRISPR gRNA sequence
tcttcttaatacgagccagt

SEQ ID NO: 146546 - DNA, 20 bp, Artificial
  CRISPR gRNA sequence
ttcttaatacgagccagtgg

SEQ ID NO: 146547 - DNA, 20 bp, Artificial
  CRISPR gRNA sequence
ccagtgggagttcctgcact

SEQ ID NO: 146548 - DNA, 20 bp, Artificial
  CRISPR gRNA sequence
gtgggagttcctgcactcgg

SEQ ID NO: 146549 - DNA, 20 bp, Artificial
  CRISPR gRNA sequence
gtctttctgaaatgaacaac

SEQ ID NO: 146550 - DNA, 20 bp, Artificial
  CRISPR gRNA sequence
ctttctgaaatgaacaacaa

SEQ ID NO: 146551 - DNA, 20 bp, Artificial
  CRISPR gRNA sequence
aacaacaagagatgcataaa

SEQ ID NO: 146552 - DNA, 20 bp, Artificial
  CRISPR gRNA sequence
aacaagagatgcataaatgg

SEQ ID NO: 146553 - DNA, 20 bp, Artificial
  CRISPR gRNA sequence
acaagagatgcataaatggt

SEQ ID NO: 146554 - DNA, 20 bp, Artificial
  CRISPR gRNA sequence
caagagatgcataaatggtg

SEQ ID NO: 146555 - DNA, 20 bp, Artificial
  CRISPR gRNA sequence
taaatggtggggacaatcaa

SEQ ID NO: 146556 - DNA, 20 bp, Artificial
  CRISPR gRNA sequence
ggtggggacaatcaacagtg

SEQ ID NO: 146557 - DNA, 20 bp, Artificial
  CRISPR gRNA sequence
ggacaatcaacagtgtggca

SEQ ID NO: 146558 - DNA, 20 bp, Artificial
  CRISPR gRNA sequence
aacagtgtggcaaagcatga

SEQ ID NO: 146559 - DNA, 20 bp, Artificial
  CRISPR gRNA sequence
acagtgtggcaaagcatgac

SEQ ID NO: 146560 - DNA, 20 bp, Artificial
  CRISPR gRNA sequence
gtgtggcaaagcatgacagg

SEQ ID NO: 146561 - DNA, 20 bp, Artificial
  CRISPR gRNA sequence
tggcaaagcatgacaggcag

SEQ ID NO: 146562 - DNA, 20 bp, Artificial
  CRISPR gRNA sequence
ggcaaagcatgacaggcagt

SEQ ID NO: 146563 - DNA, 20 bp, Artificial
  CRISPR gRNA sequence
acaggcagtaggaaacactc

SEQ ID NO: 146564 - DNA, 20 bp, Artificial
  CRISPR gRNA sequence
cagtaggaaacactctggct

SEQ ID NO: 146565 - DNA, 20 bp, Artificial
  CRISPR gRNA sequence
tctggcttggtccctctctt

SEQ ID NO: 146566 - DNA, 20 bp, Artificial
  CRISPR gRNA sequence
ctggcttggtccctctcttc

SEQ ID NO: 146567 - DNA, 20 bp, Artificial
  CRISPR gRNA sequence
gcttggtccctctcttcagg

SEQ ID NO: 146568 - DNA, 20 bp, Artificial
  CRISPR gRNA sequence
tctcttcaggaagcgtatgt

SEQ ID NO: 146569 - DNA, 20 bp, Artificial
  CRISPR gRNA sequence
ctcttcaggaagcgtatgtc

SEQ ID NO: 146570 - DNA, 20 bp, Artificial
  CRISPR gRNA sequence
cttcaggaagcgtatgtcgg

SEQ ID NO: 146571 - DNA, 20 bp, Artificial
  CRISPR gRNA sequence
tcaggaagcgtatgtcggga

SEQ ID NO: 146572 - DNA, 20 bp, Artificial
  CRISPR gRNA sequence
ggaagcgtatgtcgggagag

SEQ ID NO: 146573 - DNA, 20 bp, Artificial
  CRISPR gRNA sequence
gaagcgtatgtcgggagaga

SEQ ID NO: 146574 - DNA, 20 bp, Artificial
  CRISPR gRNA sequence
gtatgtcgggagagaaggta

SEQ ID NO: 146575 - DNA, 20 bp, Artificial
  CRISPR gRNA sequence
gagaaggtacagatgaaatg

SEQ ID NO: 146576 - DNA, 20 bp, Artificial
  CRISPR gRNA sequence
agatgaaatgaagaaaatac

SEQ ID NO: 146577 - DNA, 20 bp, Artificial
  CRISPR gRNA sequence
aatgaagaaaatacaagctc

SEQ ID NO: 146578 - DNA, 20 bp, Artificial
  CRISPR gRNA sequence
tgaagaaaatacaagctcca

SEQ ID NO: 146579 - DNA, 20 bp, Artificial
  CRISPR gRNA sequence
tcttctttacttaacatatg

SEQ ID NO: 146580 - DNA, 20 bp, Artificial
  CRISPR gRNA sequence
cttctttacttaacatatgc

SEQ ID NO: 146581 - DNA, 20 bp, Artificial
  CRISPR gRNA sequence
ttaacatatgcaggtcttca

SEQ ID NO: 146582 - DNA, 20 bp, Artificial
  CRISPR gRNA sequence
gcaggtcttcaaagaattaa

SEQ ID NO: 146583 - DNA, 20 bp, Artificial
  CRISPR gRNA sequence
caggtcttcaaagaattaat

SEQ ID NO: 146584 - DNA, 20 bp, Artificial
  CRISPR gRNA sequence
ttcaaagaattaatgggctt

SEQ ID NO: 146585 - DNA, 20 bp, Artificial
  CRISPR gRNA sequence
gaattaatgggctttagaaa

SEQ ID NO: 146586 - DNA, 20 bp, Artificial
  CRISPR gRNA sequence
aatgggctttagaaaaagct

SEQ ID NO: 146587 - DNA, 20 bp, Artificial
  CRISPR gRNA sequence
atgggctttagaaaaagctt

SEQ ID NO: 146588 - DNA, 20 bp, Artificial
  CRISPR gRNA sequence
gctttagaaaaagcttagga

SEQ ID NO: 146589 - DNA, 20 bp, Artificial
  CRISPR gRNA sequence
aagcttaggatggcctctaa

SEQ ID NO: 146590 - DNA, 20 bp, Artificial
  CRISPR gRNA sequence
aacagtgctctcatgaaaca

SEQ ID NO: 146591 - DNA, 20 bp, Artificial
  CRISPR gRNA sequence
ctctcatgaaacacagcccc

SEQ ID NO: 146592 - DNA, 20 bp, Artificial
  CRISPR gRNA sequence
tgtttttttttttttttcgt

SEQ ID NO: 146593 - DNA, 20 bp, Artificial
  CRISPR gRNA sequence
tttttttcgtcagcacaaca

SEQ ID NO: 146594 - DNA, 20 bp, Artificial
  CRISPR gRNA sequence
tttttcgtcagcacaacata

SEQ ID NO: 146595 - DNA, 20 bp, Artificial
  CRISPR gRNA sequence
ttttcgtcagcacaacatag

SEQ ID NO: 146596 - DNA, 20 bp, Artificial
  CRISPR gRNA sequence
tttcgtcagcacaacataga

SEQ ID NO: 146597 - DNA, 20 bp, Artificial
  CRISPR gRNA sequence
acaacatagagggacattat

SEQ ID NO: 146598 - DNA, 20 bp, Artificial
  CRISPR gRNA sequence
agcgccttctttttttttcc

SEQ ID NO: 146599 - DNA, 20 bp, Artificial
  CRISPR gRNA sequence
ccttctttttttttccaagt

SEQ ID NO: 146600 - DNA, 20 bp, Artificial
  CRISPR gRNA sequence
ttttttccaagtaagtttac

SEQ ID NO: 146601 - DNA, 20 bp, Artificial
  CRISPR gRNA sequence
gtttaccagtctgcaatatg

SEQ ID NO: 146602 - DNA, 20 bp, Artificial
  CRISPR gRNA sequence
tgcaatatgcagattaaaat

SEQ ID NO: 146603 - DNA, 20 bp, Artificial
  CRISPR gRNA sequence
ttaaaatgagatttctgtct

SEQ ID NO: 146604 - DNA, 20 bp, Artificial
  CRISPR gRNA sequence
taaaatgagatttctgtctc

SEQ ID NO: 146605 - DNA, 20 bp, Artificial
  CRISPR gRNA sequence
aaaatgagatttctgtctca

SEQ ID NO: 146606 - DNA, 20 bp, Artificial
  CRISPR gRNA sequence
aaatgagatttctgtctcag

SEQ ID NO: 146607 - DNA, 20 bp, Artificial
  CRISPR gRNA sequence
ggggtattcctctaaactgc

SEQ ID NO: 146608 - DNA, 20 bp, Artificial
  CRISPR gRNA sequence
tgccagttctttcttccatt

SEQ ID NO: 146609 - DNA, 20 bp, Artificial
  CRISPR gRNA sequence
ccattcagtgaccaaactaa

SEQ ID NO: 146610 - DNA, 20 bp, Artificial
  CRISPR gRNA sequence
gaccaaactaacagcaacgc

SEQ ID NO: 146611 - DNA, 20 bp, Artificial
  CRISPR gRNA sequence
accaaactaacagcaacgcc

SEQ ID NO: 146612 - DNA, 20 bp, Artificial
  CRISPR gRNA sequence
ccaaactaacagcaacgccg

SEQ ID NO: 146613 - DNA, 20 bp, Artificial
  CRISPR gRNA sequence
aacgccggggcacttgacca

SEQ ID NO: 146614 - DNA, 20 bp, Artificial
  CRISPR gRNA sequence
cacttgaccacagtgatcca

SEQ ID NO: 146615 - DNA, 20 bp, Artificial
  CRISPR gRNA sequence
ccacagttctttacaactga

SEQ ID NO: 146616 - DNA, 20 bp, Artificial
  CRISPR gRNA sequence
cagttctttacaactgatag

SEQ ID NO: 146617 - DNA, 20 bp, Artificial
  CRISPR gRNA sequence
catttgcactaacctgacaa

SEQ ID NO: 146618 - DNA, 20 bp, Artificial
  CRISPR gRNA sequence
actaacctgacaacagaaac

SEQ ID NO: 146619 - DNA, 20 bp, Artificial
  CRISPR gRNA sequence
ctaacctgacaacagaaact

SEQ ID NO: 146620 - DNA, 20 bp, Artificial
  CRISPR gRNA sequence
taacctgacaacagaaactg

SEQ ID NO: 146621 - DNA, 20 bp, Artificial
  CRISPR gRNA sequence
acctgacaacagaaactggg

SEQ ID NO: 146622 - DNA, 20 bp, Artificial
  CRISPR gRNA sequence
cctgacaacagaaactgggg

SEQ ID NO: 146623 - DNA, 20 bp, Artificial
  CRISPR gRNA sequence
tgacaacagaaactggggag

SEQ ID NO: 146624 - DNA, 20 bp, Artificial
  CRISPR gRNA sequence
acaacagaaactggggagga

SEQ ID NO: 146625 - DNA, 20 bp, Artificial
  CRISPR gRNA sequence
ggagagctcctttctcatca

SEQ ID NO: 146626 - DNA, 20 bp, Artificial
  CRISPR gRNA sequence
gagctcctttctcatcacag

SEQ ID NO: 146627 - DNA, 20 bp, Artificial
  CRISPR gRNA sequence
ctttctcatcacagtagcaa

SEQ ID NO: 146628 - DNA, 20 bp, Artificial
  CRISPR gRNA sequence
ttgtctccaaaatttgtttc

SEQ ID NO: 146629 - DNA, 20 bp, Artificial
  CRISPR gRNA sequence
tctccaaaatttgtttcaag

SEQ ID NO: 146630 - DNA, 20 bp, Artificial
  CRISPR gRNA sequence
ctccaaaatttgtttcaagt

SEQ ID NO: 146631 - DNA, 20 bp, Artificial
  CRISPR gRNA sequence
tccaaaatttgtttcaagtg

SEQ ID NO: 146632 - DNA, 20 bp, Artificial
  CRISPR gRNA sequence
ccaaaatttgtttcaagtgg

SEQ ID NO: 146633 - DNA, 20 bp, Artificial
  CRISPR gRNA sequence
aaatttgtttcaagtggggg

SEQ ID NO: 146634 - DNA, 20 bp, Artificial
  CRISPR gRNA sequence
atttgtttcaagtgggggta

SEQ ID NO: 146635 - DNA, 20 bp, Artificial
  CRISPR gRNA sequence
tttgtttcaagtgggggtag

SEQ ID NO: 146636 - DNA, 20 bp, Artificial
  CRISPR gRNA sequence
tgtttcaagtgggggtagag

SEQ ID NO: 146637 - DNA, 20 bp, Artificial
  CRISPR gRNA sequence
caagtgggggtagaggagta

SEQ ID NO: 146638 - DNA, 20 bp, Artificial
  CRISPR gRNA sequence
ggggtagaggagtatagaaa

SEQ ID NO: 146639 - DNA, 20 bp, Artificial
  CRISPR gRNA sequence
gggtagaggagtatagaaaa

SEQ ID NO: 146640 - DNA, 20 bp, Artificial
  CRISPR gRNA sequence
gaggagtatagaaaaaggat

SEQ ID NO: 146641 - DNA, 20 bp, Artificial
  CRISPR gRNA sequence
aggagtatagaaaaaggatg

SEQ ID NO: 146642 - DNA, 20 bp, Artificial
  CRISPR gRNA sequence
ggagtatagaaaaaggatga

SEQ ID NO: 146643 - DNA, 20 bp, Artificial
  CRISPR gRNA sequence
aaggatgagggtgaatttgt

SEQ ID NO: 146644 - DNA, 20 bp, Artificial
  CRISPR gRNA sequence
tgaatttgtcagctgccttt

SEQ ID NO: 146645 - DNA, 20 bp, Artificial
  CRISPR gRNA sequence
gaatttgtcagctgcctttt

SEQ ID NO: 146646 - DNA, 20 bp, Artificial
  CRISPR gRNA sequence
tgtcagctgccttttaggaa

SEQ ID NO: 146647 - DNA, 20 bp, Artificial
  CRISPR gRNA sequence
ctgtgttattttttcttaac

SEQ ID NO: 146648 - DNA, 20 bp, Artificial
  CRISPR gRNA sequence
ttattttttcttaacaagcc

SEQ ID NO: 146649 - DNA, 20 bp, Artificial
  CRISPR gRNA sequence
attttttcttaacaagcctg

SEQ ID NO: 146650 - DNA, 20 bp, Artificial
  CRISPR gRNA sequence
ttttcttaacaagcctggag

SEQ ID NO: 146651 - DNA, 20 bp, Artificial
  CRISPR gRNA sequence
tttcttaacaagcctggagt

SEQ ID NO: 146652 - DNA, 20 bp, Artificial
  CRISPR gRNA sequence
ttcttaacaagcctggagtg

SEQ ID NO: 146653 - DNA, 20 bp, Artificial
  CRISPR gRNA sequence
tcttaacaagcctggagtgg

SEQ ID NO: 146654 - DNA, 20 bp, Artificial
  CRISPR gRNA sequence
ttaacaagcctggagtgggg

SEQ ID NO: 146655 - DNA, 20 bp, Artificial
  CRISPR gRNA sequence
taacaagcctggagtggggg

SEQ ID NO: 146656 - DNA, 20 bp, Artificial
  CRISPR gRNA sequence
aggaccatataacttcactg

SEQ ID NO: 146657 - DNA, 20 bp, Artificial
  CRISPR gRNA sequence
atataacttcactgtggata

SEQ ID NO: 146658 - DNA, 20 bp, Artificial
  CRISPR gRNA sequence
acttcactgtggatatagtt

SEQ ID NO: 146659 - DNA, 20 bp, Artificial
  CRISPR gRNA sequence
cttcactgtggatatagttt

SEQ ID NO: 146660 - DNA, 20 bp, Artificial
  CRISPR gRNA sequence
actgtggatatagtttagga

SEQ ID NO: 146661 - DNA, 20 bp, Artificial
  CRISPR gRNA sequence
ctgtggatatagtttaggaa

SEQ ID NO: 146662 - DNA, 20 bp, Artificial
  CRISPR gRNA sequence
tgtggatatagtttaggaaa

SEQ ID NO: 146663 - DNA, 20 bp, Artificial
  CRISPR gRNA sequence
taggaaagggcttttttgat

SEQ ID NO: 146664 - DNA, 20 bp, Artificial
  CRISPR gRNA sequence
tcagcactactcaataattt

SEQ ID NO: 146665 - DNA, 20 bp, Artificial
  CRISPR gRNA sequence
tactcaataatttgagactt

SEQ ID NO: 146666 - DNA, 20 bp, Artificial
  CRISPR gRNA sequence
ttgttttattttgaaactac

SEQ ID NO: 146667 - DNA, 20 bp, Artificial
  CRISPR gRNA sequence
tttaaacacatgcccaatga

SEQ ID NO: 146668 - DNA, 20 bp, Artificial
  CRISPR gRNA sequence
cccaatgatggatgcaattc

SEQ ID NO: 146669 - DNA, 20 bp, Artificial
  CRISPR gRNA sequence
ccaatgatggatgcaattct

SEQ ID NO: 146670 - DNA, 20 bp, Artificial
  CRISPR gRNA sequence
ctaggaaaaaaatcaatttt

SEQ ID NO: 146671 - DNA, 20 bp, Artificial
  CRISPR gRNA sequence
aaaaaatcaattttgagttt

SEQ ID NO: 146672 - DNA, 20 bp, Artificial
  CRISPR gRNA sequence
aaaatcaattttgagtttca

SEQ ID NO: 146673 - DNA, 20 bp, Artificial
  CRISPR gRNA sequence
tgagtttcagagctgcaatg

SEQ ID NO: 146674 - DNA, 20 bp, Artificial
  CRISPR gRNA sequence
agtttcagagctgcaatgaa

SEQ ID NO: 146675 - DNA, 20 bp, Artificial
  CRISPR gRNA sequence
gtttcagagctgcaatgaag

SEQ ID NO: 146676 - DNA, 20 bp, Artificial
  CRISPR gRNA sequence
tcagagctgcaatgaagagg

SEQ ID NO: 146677 - DNA, 20 bp, Artificial
  CRISPR gRNA sequence
cagagctgcaatgaagagga

SEQ ID NO: 146678 - DNA, 20 bp, Artificial
  CRISPR gRNA sequence
gcaatgaagaggaaggtgca

SEQ ID NO: 146679 - DNA, 20 bp, Artificial
  CRISPR gRNA sequence
caatgaagaggaaggtgcaa

SEQ ID NO: 146680 - DNA, 20 bp, Artificial
  CRISPR gRNA sequence
tgaagaggaaggtgcaaagg

SEQ ID NO: 146681 - DNA, 20 bp, Artificial
  CRISPR gRNA sequence
gaaggtgcaaaggcagatat

SEQ ID NO: 146682 - DNA, 20 bp, Artificial
  CRISPR gRNA sequence
aggcagatattagctaaaat

SEQ ID NO: 146683 - DNA, 20 bp, Artificial
  CRISPR gRNA sequence
aaaatcagcaaaatctctac

SEQ ID NO: 146684 - DNA, 20 bp, Artificial
  CRISPR gRNA sequence
aaatcagcaaaatctctact

SEQ ID NO: 146685 - DNA, 20 bp, Artificial
  CRISPR gRNA sequence
agcaaaatctctactgggac

SEQ ID NO: 146686 - DNA, 20 bp, Artificial
  CRISPR gRNA sequence
gcaaaatctctactgggact

SEQ ID NO: 146687 - DNA, 20 bp, Artificial
  CRISPR gRNA sequence
tgtcaaatgattgattctat

SEQ ID NO: 146688 - DNA, 20 bp, Artificial
  CRISPR gRNA sequence
caaatgattgattctataag

SEQ ID NO: 146689 - DNA, 20 bp, Artificial
  CRISPR gRNA sequence
ctaaacctaatatgctcacc

SEQ ID NO: 146690 - DNA, 20 bp, Artificial
  CRISPR gRNA sequence
taaacctaatatgctcacct

SEQ ID NO: 146691 - DNA, 20 bp, Artificial
  CRISPR gRNA sequence
gaatttgcatcatcacatta

SEQ ID NO: 146692 - DNA, 20 bp, Artificial
  CRISPR gRNA sequence
tttgcatcatcacattatgg

SEQ ID NO: 146693 - DNA, 20 bp, Artificial
  CRISPR gRNA sequence
ttgcatcatcacattatgga

SEQ ID NO: 146694 - DNA, 20 bp, Artificial
  CRISPR gRNA sequence
gcatcatcacattatggaag

SEQ ID NO: 146695 - DNA, 20 bp, Artificial
  CRISPR gRNA sequence
ggaaggagcatatattattt

SEQ ID NO: 146696 - DNA, 20 bp, Artificial
  CRISPR gRNA sequence
tcagatttgatgtaattaac

SEQ ID NO: 146697 - DNA, 20 bp, Artificial
  CRISPR gRNA sequence
ttgatgtaattaacaagcat

SEQ ID NO: 146698 - DNA, 20 bp, Artificial
  CRISPR gRNA sequence
ataagtgaactttcttttgc

SEQ ID NO: 146699 - DNA, 20 bp, Artificial
  CRISPR gRNA sequence
actttcttttgcaagaccaa

SEQ ID NO: 146700 - DNA, 20 bp, Artificial
  CRISPR gRNA sequence
tctcaaatatatgtcaaaaa

SEQ ID NO: 146701 - DNA, 20 bp, Artificial
  CRISPR gRNA sequence
ctcaaatatatgtcaaaaaa

SEQ ID NO: 146702 - DNA, 20 bp, Artificial
  CRISPR gRNA sequence
tatgtcaaaaaaaggtattt

SEQ ID NO: 146703 - DNA, 20 bp, Artificial
  CRISPR gRNA sequence
gtattttggaaaaacatcaa

SEQ ID NO: 146704 - DNA, 20 bp, Artificial
  CRISPR gRNA sequence
aaaaacatcaacagtcttcc

SEQ ID NO: 146705 - DNA, 20 bp, Artificial
  CRISPR gRNA sequence
cagaacctattttatgatta

SEQ ID NO: 146706 - DNA, 20 bp, Artificial
  CRISPR gRNA sequence
acctattttatgattataga

SEQ ID NO: 146707 - DNA, 20 bp, Artificial
  CRISPR gRNA sequence
tattttatgattatagaaag

SEQ ID NO: 146708 - DNA, 20 bp, Artificial
  CRISPR gRNA sequence
ttttatgattatagaaagaa

SEQ ID NO: 146709 - DNA, 20 bp, Artificial
  CRISPR gRNA sequence
atagaaagaagagaatctat

SEQ ID NO: 146710 - DNA, 20 bp, Artificial
  CRISPR gRNA sequence
tagaaagaagagaatctatt

SEQ ID NO: 146711 - DNA, 20 bp, Artificial
  CRISPR gRNA sequence
attaggataaaatgtacacc

SEQ ID NO: 146712 - DNA, 20 bp, Artificial
  CRISPR gRNA sequence
tttttccatgcaaacccaac

SEQ ID NO: 146713 - DNA, 20 bp, Artificial
  CRISPR gRNA sequence
tgcaaacccaacaagctgct

SEQ ID NO: 146714 - DNA, 20 bp, Artificial
  CRISPR gRNA sequence
catcttttccttttccaaat

SEQ ID NO: 146715 - DNA, 20 bp, Artificial
  CRISPR gRNA sequence
atcttttccttttccaaatt

SEQ ID NO: 146716 - DNA, 20 bp, Artificial
  CRISPR gRNA sequence
ccctctactaaaactaaccc

SEQ ID NO: 146717 - DNA, 20 bp, Artificial
  CRISPR gRNA sequence
ctctactaaaactaaccctg

SEQ ID NO: 146718 - DNA, 20 bp, Artificial
  CRISPR gRNA sequence
taaaactaaccctggagtaa

SEQ ID NO: 146719 - DNA, 20 bp, Artificial
  CRISPR gRNA sequence
aaactaaccctggagtaaca

SEQ ID NO: 146720 - DNA, 20 bp, Artificial
  CRISPR gRNA sequence
accctggagtaacagagact

SEQ ID NO: 146721 - DNA, 20 bp, Artificial
  CRISPR gRNA sequence
ctggagtaacagagacttag

SEQ ID NO: 146722 - DNA, 20 bp, Artificial
  CRISPR gRNA sequence
gtaacagagacttagaagtt

SEQ ID NO: 146723 - DNA, 20 bp, Artificial
  CRISPR gRNA sequence
gtttattaaaatttcaacaa

SEQ ID NO: 146724 - DNA, 20 bp, Artificial
  CRISPR gRNA sequence
tttattaaaatttcaacaaa

SEQ ID NO: 146725 - DNA, 20 bp, Artificial
  CRISPR gRNA sequence
aaaatttcaacaaaaggaaa

SEQ ID NO: 146726 - DNA, 20 bp, Artificial
  CRISPR gRNA sequence
atttcaacaaaaggaaacag

SEQ ID NO: 146727 - DNA, 20 bp, Artificial
  CRISPR gRNA sequence
aacaaaaggaaacagtagcg

SEQ ID NO: 146728 - DNA, 20 bp, Artificial
  CRISPR gRNA sequence
acaaaaggaaacagtagcgc

SEQ ID NO: 146729 - DNA, 20 bp, Artificial
  CRISPR gRNA sequence
gctctttcatttactgattc

SEQ ID NO: 146730 - DNA, 20 bp, Artificial
  CRISPR gRNA sequence
gattcaagcaactcaactaa

SEQ ID NO: 146731 - DNA, 20 bp, Artificial
  CRISPR gRNA sequence
ctatgcaaaaaatacacatg

SEQ ID NO: 146732 - DNA, 20 bp, Artificial
  CRISPR gRNA sequence
tatgcaaaaaatacacatgt

SEQ ID NO: 146733 - DNA, 20 bp, Artificial
  CRISPR gRNA sequence
caaaaaatacacatgtaggc

SEQ ID NO: 146734 - DNA, 20 bp, Artificial
  CRISPR gRNA sequence
aaaaaatacacatgtaggcc

SEQ ID NO: 146735 - DNA, 20 bp, Artificial
  CRISPR gRNA sequence
atacacatgtaggccaggca

SEQ ID NO: 146736 - DNA, 20 bp, Artificial
  CRISPR gRNA sequence
cacatgtaggccaggcatgg

SEQ ID NO: 146737 - DNA, 20 bp, Artificial
  CRISPR gRNA sequence
gtggctcatgcctgtaatcc

SEQ ID NO: 146738 - DNA, 20 bp, Artificial
  CRISPR gRNA sequence
tgcctgtaatcccagcactc

SEQ ID NO: 146739 - DNA, 20 bp, Artificial
  CRISPR gRNA sequence
ctgtaatcccagcactctgg

SEQ ID NO: 146740 - DNA, 20 bp, Artificial
  CRISPR gRNA sequence
tgtaatcccagcactctgga

SEQ ID NO: 146741 - DNA, 20 bp, Artificial
  CRISPR gRNA sequence
tcccagcactctggaaggct

SEQ ID NO: 146742 - DNA, 20 bp, Artificial
  CRISPR gRNA sequence
agcactctggaaggctgaga

SEQ ID NO: 146743 - DNA, 20 bp, Artificial
  CRISPR gRNA sequence
gcactctggaaggctgagat

SEQ ID NO: 146744 - DNA, 20 bp, Artificial
  CRISPR gRNA sequence
actctggaaggctgagatgg

SEQ ID NO: 146745 - DNA, 20 bp, Artificial
  CRISPR gRNA sequence
ctgagatgggagaatcgctt

SEQ ID NO: 146746 - DNA, 20 bp, Artificial
  CRISPR gRNA sequence
tgagatgggagaatcgcttg

SEQ ID NO: 146747 - DNA, 20 bp, Artificial
  CRISPR gRNA sequence
atgggagaatcgcttgaggc

SEQ ID NO: 146748 - DNA, 20 bp, Artificial
  CRISPR gRNA sequence
tgggagaatcgcttgaggcc

SEQ ID NO: 146749 - DNA, 20 bp, Artificial
  CRISPR gRNA sequence
ggagaatcgcttgaggccag

SEQ ID NO: 146750 - DNA, 20 bp, Artificial
  CRISPR gRNA sequence
tcgcttgaggccaggagttt

SEQ ID NO: 146751 - DNA, 20 bp, Artificial
  CRISPR gRNA sequence
tgaggccaggagtttgagac

SEQ ID NO: 146752 - DNA, 20 bp, Artificial
  CRISPR gRNA sequence
ccaggagtttgagaccagtc

SEQ ID NO: 146753 - DNA, 20 bp, Artificial
  CRISPR gRNA sequence
tgagaccagtctggtcaaca

SEQ ID NO: 146754 - DNA, 20 bp, Artificial
  CRISPR gRNA sequence
accagtctggtcaacatagt

SEQ ID NO: 146755 - DNA, 20 bp, Artificial
  CRISPR gRNA sequence
gaccccatcactatttaaaa

SEQ ID NO: 146756 - DNA, 20 bp, Artificial
  CRISPR gRNA sequence
ccatcactatttaaaaaaga

SEQ ID NO: 146757 - DNA, 20 bp, Artificial
  CRISPR gRNA sequence
cacatctactcctacctttg

SEQ ID NO: 146758 - DNA, 20 bp, Artificial
  CRISPR gRNA sequence
catctactcctacctttgaa

SEQ ID NO: 146759 - DNA, 20 bp, Artificial
  CRISPR gRNA sequence
tcctacctttgaagagcttg

SEQ ID NO: 146760 - DNA, 20 bp, Artificial
  CRISPR gRNA sequence
ttgaagagcttgtggtttgt

SEQ ID NO: 146761 - DNA, 20 bp, Artificial
  CRISPR gRNA sequence
gaagagcttgtggtttgtca

SEQ ID NO: 146762 - DNA, 20 bp, Artificial
  CRISPR gRNA sequence
agcttgtggtttgtcagaga

SEQ ID NO: 146763 - DNA, 20 bp, Artificial
  CRISPR gRNA sequence
tataatcccctacccaatac

SEQ ID NO: 146764 - DNA, 20 bp, Artificial
  CRISPR gRNA sequence
taatcccctacccaatactg

SEQ ID NO: 146765 - DNA, 20 bp, Artificial
  CRISPR gRNA sequence
aatcccctacccaatactgg

SEQ ID NO: 146766 - DNA, 20 bp, Artificial
  CRISPR gRNA sequence
atcccctacccaatactgga

SEQ ID NO: 146767 - DNA, 20 bp, Artificial
  CRISPR gRNA sequence
tcccctacccaatactggag

SEQ ID NO: 146768 - DNA, 20 bp, Artificial
  CRISPR gRNA sequence
ccctacccaatactggaggg

SEQ ID NO: 146769 - DNA, 20 bp, Artificial
  CRISPR gRNA sequence
cctacccaatactggagggg

SEQ ID NO: 146770 - DNA, 20 bp, Artificial
  CRISPR gRNA sequence
ctacccaatactggagggga

SEQ ID NO: 146771 - DNA, 20 bp, Artificial
  CRISPR gRNA sequence
tggaggggagggatcccctg

SEQ ID NO: 146772 - DNA, 20 bp, Artificial
  CRISPR gRNA sequence
ggaggggagggatcccctgc

SEQ ID NO: 146773 - DNA, 20 bp, Artificial
  CRISPR gRNA sequence
gaggggagggatcccctgcg

SEQ ID NO: 146774 - DNA, 20 bp, Artificial
  CRISPR gRNA sequence
ggatcccctgcggggacaca

SEQ ID NO: 146775 - DNA, 20 bp, Artificial
  CRISPR gRNA sequence
tcccctgcggggacacaaag

SEQ ID NO: 146776 - DNA, 20 bp, Artificial
  CRISPR gRNA sequence
cccctgcggggacacaaaga

SEQ ID NO: 146777 - DNA, 20 bp, Artificial
  CRISPR gRNA sequence
cacaaagaaggacatattgc

SEQ ID NO: 146778 - DNA, 20 bp, Artificial
  CRISPR gRNA sequence
acaaagaaggacatattgct

SEQ ID NO: 146779 - DNA, 20 bp, Artificial
  CRISPR gRNA sequence
caaagaaggacatattgcta

SEQ ID NO: 146780 - DNA, 20 bp, Artificial
  CRISPR gRNA sequence
gaaggacatattgctaggga

SEQ ID NO: 146781 - DNA, 20 bp, Artificial
  CRISPR gRNA sequence
gacatattgctagggacagc

SEQ ID NO: 146782 - DNA, 20 bp, Artificial
  CRISPR gRNA sequence
gctagggacagctagcaatg

SEQ ID NO: 146783 - DNA, 20 bp, Artificial
  CRISPR gRNA sequence
ctagggacagctagcaatgt

SEQ ID NO: 146784 - DNA, 20 bp, Artificial
  CRISPR gRNA sequence
tagggacagctagcaatgtg

SEQ ID NO: 146785 - DNA, 20 bp, Artificial
  CRISPR gRNA sequence
gacagctagcaatgtggggc

SEQ ID NO: 146786 - DNA, 20 bp, Artificial
  CRISPR gRNA sequence
cagctagcaatgtggggctg

SEQ ID NO: 146787 - DNA, 20 bp, Artificial
  CRISPR gRNA sequence
agctagcaatgtggggctgg

SEQ ID NO: 146788 - DNA, 20 bp, Artificial
  CRISPR gRNA sequence
gctagcaatgtggggctgga

SEQ ID NO: 146789 - DNA, 20 bp, Artificial
  CRISPR gRNA sequence
tagcaatgtggggctggagg

SEQ ID NO: 146790 - DNA, 20 bp, Artificial
  CRISPR gRNA sequence
gcaatgtggggctggaggga

SEQ ID NO: 146791 - DNA, 20 bp, Artificial
  CRISPR gRNA sequence
tgtggggctggagggagagt

SEQ ID NO: 146792 - DNA, 20 bp, Artificial
  CRISPR gRNA sequence
gtggggctggagggagagtg

SEQ ID NO: 146793 - DNA, 20 bp, Artificial
  CRISPR gRNA sequence
tggggctggagggagagtga

SEQ ID NO: 146794 - DNA, 20 bp, Artificial
  CRISPR gRNA sequence
ctggagggagagtgagggat

SEQ ID NO: 146795 - DNA, 20 bp, Artificial
  CRISPR gRNA sequence
tggagggagagtgagggatt

SEQ ID NO: 146796 - DNA, 20 bp, Artificial
  CRISPR gRNA sequence
ggattgggaaatgttccaca

SEQ ID NO: 146797 - DNA, 20 bp, Artificial
  CRISPR gRNA sequence
gattgggaaatgttccacaa

SEQ ID NO: 146798 - DNA, 20 bp, Artificial
  CRISPR gRNA sequence
attgggaaatgttccacaaa

SEQ ID NO: 146799 - DNA, 20 bp, Artificial
  CRISPR gRNA sequence
ttgggaaatgttccacaaag

SEQ ID NO: 146800 - DNA, 20 bp, Artificial
  CRISPR gRNA sequence
atgacatctgaattgtgtct

SEQ ID NO: 146801 - DNA, 20 bp, Artificial
  CRISPR gRNA sequence
tgacatctgaattgtgtcta

SEQ ID NO: 146802 - DNA, 20 bp, Artificial
  CRISPR gRNA sequence
gacatctgaattgtgtctaa

SEQ ID NO: 146803 - DNA, 20 bp, Artificial
  CRISPR gRNA sequence
gaattgtgtctaagggatgc

SEQ ID NO: 146804 - DNA, 20 bp, Artificial
  CRISPR gRNA sequence
aattgtgtctaagggatgct

SEQ ID NO: 146805 - DNA, 20 bp, Artificial
  CRISPR gRNA sequence
tgggaatttgcctgttgaaa

SEQ ID NO: 146806 - DNA, 20 bp, Artificial
  CRISPR gRNA sequence
tttgcctgttgaaaaagtat

SEQ ID NO: 146807 - DNA, 20 bp, Artificial
  CRISPR gRNA sequence
aaaagtatgagaatgttatt

SEQ ID NO: 146808 - DNA, 20 bp, Artificial
  CRISPR gRNA sequence
gtatgagaatgttattcaga

SEQ ID NO: 146809 - DNA, 20 bp, Artificial
  CRISPR gRNA sequence
gttattcagacagaacaaca

SEQ ID NO: 146810 - DNA, 20 bp, Artificial
  CRISPR gRNA sequence
ttcagacagaacaacaaaga

SEQ ID NO: 146811 - DNA, 20 bp, Artificial
  CRISPR gRNA sequence
cagacagaacaacaaagaca

SEQ ID NO: 146812 - DNA, 20 bp, Artificial
  CRISPR gRNA sequence
gacagaacaacaaagacaga

SEQ ID NO: 146813 - DNA, 20 bp, Artificial
  CRISPR gRNA sequence
cagaacaacaaagacagaga

SEQ ID NO: 146814 - DNA, 20 bp, Artificial
  CRISPR gRNA sequence
gaacaacaaagacagagaga

SEQ ID NO: 146815 - DNA, 20 bp, Artificial
  CRISPR gRNA sequence
gagagagagacaaaaaatca

SEQ ID NO: 146816 - DNA, 20 bp, Artificial
  CRISPR gRNA sequence
caaaaaatcacagcctattt

SEQ ID NO: 146817 - DNA, 20 bp, Artificial
  CRISPR gRNA sequence
atcacagcctatttaagttt

SEQ ID NO: 146818 - DNA, 20 bp, Artificial
  CRISPR gRNA sequence
aagttttagatctactacct

SEQ ID NO: 146819 - DNA, 20 bp, Artificial
  CRISPR gRNA sequence
ttagatctactacctgagta

SEQ ID NO: 146820 - DNA, 20 bp, Artificial
  CRISPR gRNA sequence
agatctactacctgagtata

SEQ ID NO: 146821 - DNA, 20 bp, Artificial
  CRISPR gRNA sequence
gatctactacctgagtatag

SEQ ID NO: 146822 - DNA, 20 bp, Artificial
  CRISPR gRNA sequence
atctactacctgagtataga

SEQ ID NO: 146823 - DNA, 20 bp, Artificial
  CRISPR gRNA sequence
tctactacctgagtatagag

SEQ ID NO: 146824 - DNA, 20 bp, Artificial
  CRISPR gRNA sequence
tacctgagtatagaggggaa

SEQ ID NO: 146825 - DNA, 20 bp, Artificial
  CRISPR gRNA sequence
ctgagtatagaggggaaaag

SEQ ID NO: 146826 - DNA, 20 bp, Artificial
  CRISPR gRNA sequence
tgagtatagaggggaaaagc

SEQ ID NO: 146827 - DNA, 20 bp, Artificial
  CRISPR gRNA sequence
tatagaggggaaaagcagga

SEQ ID NO: 146828 - DNA, 20 bp, Artificial
  CRISPR gRNA sequence
tagaggggaaaagcaggaaa

SEQ ID NO: 146829 - DNA, 20 bp, Artificial
  CRISPR gRNA sequence
agaggggaaaagcaggaaag

SEQ ID NO: 146830 - DNA, 20 bp, Artificial
  CRISPR gRNA sequence
aaaagcaggaaagaggatac

SEQ ID NO: 146831 - DNA, 20 bp, Artificial
  CRISPR gRNA sequence
aaagcaggaaagaggatact

SEQ ID NO: 146832 - DNA, 20 bp, Artificial
  CRISPR gRNA sequence
caggaaagaggatactgggt

SEQ ID NO: 146833 - DNA, 20 bp, Artificial
  CRISPR gRNA sequence
aggaaagaggatactgggtt

SEQ ID NO: 146834 - DNA, 20 bp, Artificial
  CRISPR gRNA sequence
ggaaagaggatactgggttg

SEQ ID NO: 146835 - DNA, 20 bp, Artificial
  CRISPR gRNA sequence
agaggatactgggttggggc

SEQ ID NO: 146836 - DNA, 20 bp, Artificial
  CRISPR gRNA sequence
tgggttggggccagatccta

SEQ ID NO: 146837 - DNA, 20 bp, Artificial
  CRISPR gRNA sequence
ggttggggccagatcctaaa

SEQ ID NO: 146838 - DNA, 20 bp, Artificial
  CRISPR gRNA sequence
atcctaaagagtttttttaa

SEQ ID NO: 146839 - DNA, 20 bp, Artificial
  CRISPR gRNA sequence
tttttttaaaagtttaatcc

SEQ ID NO: 146840 - DNA, 20 bp, Artificial
  CRISPR gRNA sequence
taatcccagaaatcaaccac

SEQ ID NO: 146841 - DNA, 20 bp, Artificial
  CRISPR gRNA sequence
cactggtcttccttcttgtg

SEQ ID NO: 146842 - DNA, 20 bp, Artificial
  CRISPR gRNA sequence
ccttcttgtgtggcatatca

SEQ ID NO: 146843 - DNA, 20 bp, Artificial
  CRISPR gRNA sequence
tcttgtgtggcatatcacag

SEQ ID NO: 146844 - DNA, 20 bp, Artificial
  CRISPR gRNA sequence
cagaagatgatgacactaca

SEQ ID NO: 146845 - DNA, 20 bp, Artificial
  CRISPR gRNA sequence
gacactacatagaaatgcca

SEQ ID NO: 146846 - DNA, 20 bp, Artificial
  CRISPR gRNA sequence
cactacatagaaatgccaaa

SEQ ID NO: 146847 - DNA, 20 bp, Artificial
  CRISPR gRNA sequence
agaaatgccaaagagaatgc

SEQ ID NO: 146848 - DNA, 20 bp, Artificial
  CRISPR gRNA sequence
gaaatgccaaagagaatgct

SEQ ID NO: 146849 - DNA, 20 bp, Artificial
  CRISPR gRNA sequence
aaatgccaaagagaatgcta

SEQ ID NO: 146850 - DNA, 20 bp, Artificial
  CRISPR gRNA sequence
gctagggatgatcattcctt

SEQ ID NO: 146851 - DNA, 20 bp, Artificial
  CRISPR gRNA sequence
cattcctttggaaaacctcc

SEQ ID NO: 146852 - DNA, 20 bp, Artificial
  CRISPR gRNA sequence
attcctttggaaaacctccc

SEQ ID NO: 146853 - DNA, 20 bp, Artificial
  CRISPR gRNA sequence
acctcccaggctaatacata

SEQ ID NO: 146854 - DNA, 20 bp, Artificial
  CRISPR gRNA sequence
caggctaatacatacagcac

SEQ ID NO: 146855 - DNA, 20 bp, Artificial
  CRISPR gRNA sequence
gcacaagatgatcatacatt

SEQ ID NO: 146856 - DNA, 20 bp, Artificial
  CRISPR gRNA sequence
catacatttagctctcttgc

SEQ ID NO: 146857 - DNA, 20 bp, Artificial
  CRISPR gRNA sequence
cttgcaagtgtgctcttgtt

SEQ ID NO: 146858 - DNA, 20 bp, Artificial
  CRISPR gRNA sequence
aagtgtgctcttgtttggct

SEQ ID NO: 146859 - DNA, 20 bp, Artificial
  CRISPR gRNA sequence
gttttaaatataatttgtac

SEQ ID NO: 146860 - DNA, 20 bp, Artificial
  CRISPR gRNA sequence
gttccatgattacttaacta

SEQ ID NO: 146861 - DNA, 20 bp, Artificial
  CRISPR gRNA sequence
gattacttaactaaagccca

SEQ ID NO: 146862 - DNA, 20 bp, Artificial
  CRISPR gRNA sequence
aaagcccaaagttgataaaa

SEQ ID NO: 146863 - DNA, 20 bp, Artificial
  CRISPR gRNA sequence
gacctctttccccaaattga

SEQ ID NO: 146864 - DNA, 20 bp, Artificial
  CRISPR gRNA sequence
cctctttccccaaattgaaa

SEQ ID NO: 146865 - DNA, 20 bp, Artificial
  CRISPR gRNA sequence
aatttctcttctttaatcaa

SEQ ID NO: 146866 - DNA, 20 bp, Artificial
  CRISPR gRNA sequence
tctttaatcaaaagcaacaa

SEQ ID NO: 146867 - DNA, 20 bp, Artificial
  CRISPR gRNA sequence
aatcaaaagcaacaaaagtc

SEQ ID NO: 146868 - DNA, 20 bp, Artificial
  CRISPR gRNA sequence
atcaaaagcaacaaaagtca

SEQ ID NO: 146869 - DNA, 20 bp, Artificial
  CRISPR gRNA sequence
agcaacaaaagtcaaggatc

SEQ ID NO: 146870 - DNA, 20 bp, Artificial
  CRISPR gRNA sequence
caacaaaagtcaaggatcaa

SEQ ID NO: 146871 - DNA, 20 bp, Artificial
  CRISPR gRNA sequence
aagagatcattcccgccttg

SEQ ID NO: 146872 - DNA, 20 bp, Artificial
  CRISPR gRNA sequence
gagatcattcccgccttgca

SEQ ID NO: 146873 - DNA, 20 bp, Artificial
  CRISPR gRNA sequence
gccttgcagagatgtaaaat

SEQ ID NO: 146874 - DNA, 20 bp, Artificial
  CRISPR gRNA sequence
ccttgcagagatgtaaaatg

SEQ ID NO: 146875 - DNA, 20 bp, Artificial
  CRISPR gRNA sequence
tgcagagatgtaaaatgagg

SEQ ID NO: 146876 - DNA, 20 bp, Artificial
  CRISPR gRNA sequence
atgaggcagaaatttataat

SEQ ID NO: 146877 - DNA, 20 bp, Artificial
  CRISPR gRNA sequence
ctgctttaatccccttccca

SEQ ID NO: 146878 - DNA, 20 bp, Artificial
  CRISPR gRNA sequence
tttcatgttcctgaaacctt

SEQ ID NO: 146879 - DNA, 20 bp, Artificial
  CRISPR gRNA sequence
tcctgaaaccttgagatctc

SEQ ID NO: 146880 - DNA, 20 bp, Artificial
  CRISPR gRNA sequence
tgaaaccttgagatctcaag

SEQ ID NO: 146881 - DNA, 20 bp, Artificial
  CRISPR gRNA sequence
aaccttgagatctcaagaag

SEQ ID NO: 146882 - DNA, 20 bp, Artificial
  CRISPR gRNA sequence
tctcaagaagcagtgtgtaa

SEQ ID NO: 146883 - DNA, 20 bp, Artificial
  CRISPR gRNA sequence
caagaagcagtgtgtaaaag

SEQ ID NO: 146884 - DNA, 20 bp, Artificial
  CRISPR gRNA sequence
agtgtgtaaaagtggatctt

SEQ ID NO: 146885 - DNA, 20 bp, Artificial
  CRISPR gRNA sequence
gtgtgtaaaagtggatcttg

SEQ ID NO: 146886 - DNA, 20 bp, Artificial
  CRISPR gRNA sequence
tgtgtaaaagtggatcttga

SEQ ID NO: 146887 - DNA, 20 bp, Artificial
  CRISPR gRNA sequence
gtgtaaaagtggatcttgag

SEQ ID NO: 146888 - DNA, 20 bp, Artificial
  CRISPR gRNA sequence
tggatcttgaggggtgtgta

SEQ ID NO: 146889 - DNA, 20 bp, Artificial
  CRISPR gRNA sequence
catccctgttgacaatcacc

SEQ ID NO: 146890 - DNA, 20 bp, Artificial
  CRISPR gRNA sequence
agttttctataatcctatcc

SEQ ID NO: 146891 - DNA, 20 bp, Artificial
  CRISPR gRNA sequence
ataatcctatcctagccttc

SEQ ID NO: 146892 - DNA, 20 bp, Artificial
  CRISPR gRNA sequence
ctagccttctagttacatgt

SEQ ID NO: 146893 - DNA, 20 bp, Artificial
  CRISPR gRNA sequence
tagccttctagttacatgta

SEQ ID NO: 146894 - DNA, 20 bp, Artificial
  CRISPR gRNA sequence
tacatgtaaggatttaccat

SEQ ID NO: 146895 - DNA, 20 bp, Artificial
  CRISPR gRNA sequence
aggatttaccataagcttgt

SEQ ID NO: 146896 - DNA, 20 bp, Artificial
  CRISPR gRNA sequence
ttaccataagcttgttggaa

SEQ ID NO: 146897 - DNA, 20 bp, Artificial
  CRISPR gRNA sequence
taccataagcttgttggaaa

SEQ ID NO: 146898 - DNA, 20 bp, Artificial
  CRISPR gRNA sequence
accataagcttgttggaaaa

SEQ ID NO: 146899 - DNA, 20 bp, Artificial
  CRISPR gRNA sequence
cataagcttgttggaaaagg

SEQ ID NO: 146900 - DNA, 20 bp, Artificial
  CRISPR gRNA sequence
ataagcttgttggaaaaggg

SEQ ID NO: 146901 - DNA, 20 bp, Artificial
  CRISPR gRNA sequence
aaagggaggccctctacaat

SEQ ID NO: 146902 - DNA, 20 bp, Artificial
  CRISPR gRNA sequence
gggaggccctctacaatcag

SEQ ID NO: 146903 - DNA, 20 bp, Artificial
  CRISPR gRNA sequence
ccctctacaatcagtagatt

SEQ ID NO: 146904 - DNA, 20 bp, Artificial
  CRISPR gRNA sequence
cctctacaatcagtagattg

SEQ ID NO: 146905 - DNA, 20 bp, Artificial
  CRISPR gRNA sequence
agattgaggcccacgaaact

SEQ ID NO: 146906 - DNA, 20 bp, Artificial
  CRISPR gRNA sequence
attcatgctccccacttcac

SEQ ID NO: 146907 - DNA, 20 bp, Artificial
  CRISPR gRNA sequence
cactagctaccatgtaactg

SEQ ID NO: 146908 - DNA, 20 bp, Artificial
  CRISPR gRNA sequence
agctaccatgtaactgaagt

SEQ ID NO: 146909 - DNA, 20 bp, Artificial
  CRISPR gRNA sequence
tctcctgatactgattcaac

SEQ ID NO: 146910 - DNA, 20 bp, Artificial
  CRISPR gRNA sequence
cctgatactgattcaactgg

SEQ ID NO: 146911 - DNA, 20 bp, Artificial
  CRISPR gRNA sequence
tactgattcaactggaagaa

SEQ ID NO: 146912 - DNA, 20 bp, Artificial
  CRISPR gRNA sequence
acactgctcccccctacttt

SEQ ID NO: 146913 - DNA, 20 bp, Artificial
  CRISPR gRNA sequence
cactgctcccccctactttt

SEQ ID NO: 146914 - DNA, 20 bp, Artificial
  CRISPR gRNA sequence
ctgctcccccctacttttgg

SEQ ID NO: 146915 - DNA, 20 bp, Artificial
  CRISPR gRNA sequence
cctacttttgggagttctat

SEQ ID NO: 146916 - DNA, 20 bp, Artificial
  CRISPR gRNA sequence
cttttgggagttctatcagt

SEQ ID NO: 146917 - DNA, 20 bp, Artificial
  CRISPR gRNA sequence
ttttgggagttctatcagta

SEQ ID NO: 146918 - DNA, 20 bp, Artificial
  CRISPR gRNA sequence
tgggagttctatcagtaagg

SEQ ID NO: 146919 - DNA, 20 bp, Artificial
  CRISPR gRNA sequence
gagttctatcagtaaggcag

SEQ ID NO: 146920 - DNA, 20 bp, Artificial
  CRISPR gRNA sequence
gttctatcagtaaggcagaa

SEQ ID NO: 146921 - DNA, 20 bp, Artificial
  CRISPR gRNA sequence
ctatcagtaaggcagaagag

SEQ ID NO: 146922 - DNA, 20 bp, Artificial
  CRISPR gRNA sequence
cagaagagcagattatctct

SEQ ID NO: 146923 - DNA, 20 bp, Artificial
  CRISPR gRNA sequence
catgctcctgaccactacca

SEQ ID NO: 146924 - DNA, 20 bp, Artificial
  CRISPR gRNA sequence
atctgaaactgctgcatttc

SEQ ID NO: 146925 - DNA, 20 bp, Artificial
  CRISPR gRNA sequence
caaatctgaattcactcaat

SEQ ID NO: 146926 - DNA, 20 bp, Artificial
  CRISPR gRNA sequence
aatctgaattcactcaatga

SEQ ID NO: 146927 - DNA, 20 bp, Artificial
  CRISPR gRNA sequence
gaattcactcaatgagagtt

SEQ ID NO: 146928 - DNA, 20 bp, Artificial
  CRISPR gRNA sequence
attcactcaatgagagtttg

SEQ ID NO: 146929 - DNA, 20 bp, Artificial
  CRISPR gRNA sequence
tcaatgagagtttggagaca

SEQ ID NO: 146930 - DNA, 20 bp, Artificial
  CRISPR gRNA sequence
gagagtttggagacaaagaa

SEQ ID NO: 146931 - DNA, 20 bp, Artificial
  CRISPR gRNA sequence
tggagacaaagaaaagtcaa

SEQ ID NO: 146932 - DNA, 20 bp, Artificial
  CRISPR gRNA sequence
aaagaaaagtcaacagatct

SEQ ID NO: 146933 - DNA, 20 bp, Artificial
  CRISPR gRNA sequence
aagaaaagtcaacagatctt

SEQ ID NO: 146934 - DNA, 20 bp, Artificial
  CRISPR gRNA sequence
acagatcttgggctgcactg

SEQ ID NO: 146935 - DNA, 20 bp, Artificial
  CRISPR gRNA sequence
gggctgcactgaagaacatc

SEQ ID NO: 146936 - DNA, 20 bp, Artificial
  CRISPR gRNA sequence
gctgcactgaagaacatcca

SEQ ID NO: 146937 - DNA, 20 bp, Artificial
  CRISPR gRNA sequence
atccagagtttcaaataata

SEQ ID NO: 146938 - DNA, 20 bp, Artificial
  CRISPR gRNA sequence
ccagagtttcaaataataaa

SEQ ID NO: 146939 - DNA, 20 bp, Artificial
  CRISPR gRNA sequence
taataaagagaaaccttttc

SEQ ID NO: 146940 - DNA, 20 bp, Artificial
  CRISPR gRNA sequence
aataaagagaaaccttttcc

SEQ ID NO: 146941 - DNA, 20 bp, Artificial
  CRISPR gRNA sequence
aaaccttttccaggcctacc

SEQ ID NO: 146942 - DNA, 20 bp, Artificial
  CRISPR gRNA sequence
cttttccaggcctacccagt

SEQ ID NO: 146943 - DNA, 20 bp, Artificial
  CRISPR gRNA sequence
ttttccaggcctacccagtc

SEQ ID NO: 146944 - DNA, 20 bp, Artificial
  CRISPR gRNA sequence
gcctacccagtcaggcactc

SEQ ID NO: 146945 - DNA, 20 bp, Artificial
  CRISPR gRNA sequence
acccagtcaggcactctggc

SEQ ID NO: 146946 - DNA, 20 bp, Artificial
  CRISPR gRNA sequence
gtcaggcactctggcaagtc

SEQ ID NO: 146947 - DNA, 20 bp, Artificial
  CRISPR gRNA sequence
aaatcaatgattctcaatct

SEQ ID NO: 146948 - DNA, 20 bp, Artificial
  CRISPR gRNA sequence
aatcaatgattctcaatctt

SEQ ID NO: 146949 - DNA, 20 bp, Artificial
  CRISPR gRNA sequence
atcaatgattctcaatcttg

SEQ ID NO: 146950 - DNA, 20 bp, Artificial
  CRISPR gRNA sequence
gattctcaatcttggggctg

SEQ ID NO: 146951 - DNA, 20 bp, Artificial
  CRISPR gRNA sequence
attctcaatcttggggctgc

SEQ ID NO: 146952 - DNA, 20 bp, Artificial
  CRISPR gRNA sequence
tcaatcttggggctgcaggt

SEQ ID NO: 146953 - DNA, 20 bp, Artificial
  CRISPR gRNA sequence
gcaggttagaatcacctgaa

SEQ ID NO: 146954 - DNA, 20 bp, Artificial
  CRISPR gRNA sequence
ctgaaaagcttttgaaaaac

SEQ ID NO: 146955 - DNA, 20 bp, Artificial
  CRISPR gRNA sequence
ttttgaaaaacaagatgcct

SEQ ID NO: 146956 - DNA, 20 bp, Artificial
  CRISPR gRNA sequence
aagatgcctgagctctctcc

SEQ ID NO: 146957 - DNA, 20 bp, Artificial
  CRISPR gRNA sequence
gatgcctgagctctctcctg

SEQ ID NO: 146958 - DNA, 20 bp, Artificial
  CRISPR gRNA sequence
ctcctggagaccaactgaat

SEQ ID NO: 146959 - DNA, 20 bp, Artificial
  CRISPR gRNA sequence
tcctggagaccaactgaatc

SEQ ID NO: 146960 - DNA, 20 bp, Artificial
  CRISPR gRNA sequence
accaactgaatcaggaactc

SEQ ID NO: 146961 - DNA, 20 bp, Artificial
  CRISPR gRNA sequence
ccaactgaatcaggaactct

SEQ ID NO: 146962 - DNA, 20 bp, Artificial
  CRISPR gRNA sequence
ctgaatcaggaactctagga

SEQ ID NO: 146963 - DNA, 20 bp, Artificial
  CRISPR gRNA sequence
aatcaggaactctaggacag

SEQ ID NO: 146964 - DNA, 20 bp, Artificial
  CRISPR gRNA sequence
aggacagtggtccccaacct

SEQ ID NO: 146965 - DNA, 20 bp, Artificial
  CRISPR gRNA sequence
ggacagtggtccccaacctc

SEQ ID NO: 146966 - DNA, 20 bp, Artificial
  CRISPR gRNA sequence
tggtccccaacctcaggaac

SEQ ID NO: 146967 - DNA, 20 bp, Artificial
  CRISPR gRNA sequence
ctcaggaaccagttttgtgc

SEQ ID NO: 146968 - DNA, 20 bp, Artificial
  CRISPR gRNA sequence
tttgtgcaagacaatttttc

SEQ ID NO: 146969 - DNA, 20 bp, Artificial
  CRISPR gRNA sequence
tgtgcaagacaatttttcca

SEQ ID NO: 146970 - DNA, 20 bp, Artificial
  CRISPR gRNA sequence
caagacaatttttccagaga

SEQ ID NO: 146971 - DNA, 20 bp, Artificial
  CRISPR gRNA sequence
aagacaatttttccagagat

SEQ ID NO: 146972 - DNA, 20 bp, Artificial
  CRISPR gRNA sequence
acaatttttccagagatggg

SEQ ID NO: 146973 - DNA, 20 bp, Artificial
  CRISPR gRNA sequence
caatttttccagagatgggc

SEQ ID NO: 146974 - DNA, 20 bp, Artificial
  CRISPR gRNA sequence
aatttttccagagatgggca

SEQ ID NO: 146975 - DNA, 20 bp, Artificial
  CRISPR gRNA sequence
ttttccagagatgggcaggg

SEQ ID NO: 146976 - DNA, 20 bp, Artificial
  CRISPR gRNA sequence
tttccagagatgggcagggt

SEQ ID NO: 146977 - DNA, 20 bp, Artificial
  CRISPR gRNA sequence
gagatgggcagggtgggcat

SEQ ID NO: 146978 - DNA, 20 bp, Artificial
  CRISPR gRNA sequence
ggtgggcattagattctcat

SEQ ID NO: 146979 - DNA, 20 bp, Artificial
  CRISPR gRNA sequence
gtgggcattagattctcata

SEQ ID NO: 146980 - DNA, 20 bp, Artificial
  CRISPR gRNA sequence
gggcattagattctcataag

SEQ ID NO: 146981 - DNA, 20 bp, Artificial
  CRISPR gRNA sequence
ctcataaggagtgtgctacc

SEQ ID NO: 146982 - DNA, 20 bp, Artificial
  CRISPR gRNA sequence
acctagatccctcacatgcg

SEQ ID NO: 146983 - DNA, 20 bp, Artificial
  CRISPR gRNA sequence
ctcacatgcgcagttcatga

SEQ ID NO: 146984 - DNA, 20 bp, Artificial
  CRISPR gRNA sequence
tcacatgcgcagttcatgat

SEQ ID NO: 146985 - DNA, 20 bp, Artificial
  CRISPR gRNA sequence
cacatgcgcagttcatgata

SEQ ID NO: 146986 - DNA, 20 bp, Artificial
  CRISPR gRNA sequence
gatagggttcacattccttt

SEQ ID NO: 146987 - DNA, 20 bp, Artificial
  CRISPR gRNA sequence
taatgccactgctgatctga

SEQ ID NO: 146988 - DNA, 20 bp, Artificial
  CRISPR gRNA sequence
aatgccactgctgatctgac

SEQ ID NO: 146989 - DNA, 20 bp, Artificial
  CRISPR gRNA sequence
tgccactgctgatctgacag

SEQ ID NO: 146990 - DNA, 20 bp, Artificial
  CRISPR gRNA sequence
gccactgctgatctgacagg

SEQ ID NO: 146991 - DNA, 20 bp, Artificial
  CRISPR gRNA sequence
actgctgatctgacaggagg

SEQ ID NO: 146992 - DNA, 20 bp, Artificial
  CRISPR gRNA sequence
tgctgatctgacaggaggtg

SEQ ID NO: 146993 - DNA, 20 bp, Artificial
  CRISPR gRNA sequence
atctgacaggaggtggagct

SEQ ID NO: 146994 - DNA, 20 bp, Artificial
  CRISPR gRNA sequence
tctgacaggaggtggagctc

SEQ ID NO: 146995 - DNA, 20 bp, Artificial
  CRISPR gRNA sequence
gacaggaggtggagctcagg

SEQ ID NO: 146996 - DNA, 20 bp, Artificial
  CRISPR gRNA sequence
aggcagtaatgcttgcttac

SEQ ID NO: 146997 - DNA, 20 bp, Artificial
  CRISPR gRNA sequence
gctgctcacctcctgctgtg

SEQ ID NO: 146998 - DNA, 20 bp, Artificial
  CRISPR gRNA sequence
tcacctcctgctgtgcagcc

SEQ ID NO: 146999 - DNA, 20 bp, Artificial
  CRISPR gRNA sequence
ctgctgtgcagcccagttcc

SEQ ID NO: 147000 - DNA, 20 bp, Artificial
  CRISPR gRNA sequence
tgctgtgcagcccagttcct

SEQ ID NO: 147001 - DNA, 20 bp, Artificial
  CRISPR gRNA sequence
cccagttcctaggttcctaa

SEQ ID NO: 147002 - DNA, 20 bp, Artificial
  CRISPR gRNA sequence
ccagttcctaggttcctaac

SEQ ID NO: 147003 - DNA, 20 bp, Artificial
  CRISPR gRNA sequence
cctaggttcctaacaggcca

SEQ ID NO: 147004 - DNA, 20 bp, Artificial
  CRISPR gRNA sequence
aacaggccatggacccatac

SEQ ID NO: 147005 - DNA, 20 bp, Artificial
  CRISPR gRNA sequence
catggacccataccggtctg

SEQ ID NO: 147006 - DNA, 20 bp, Artificial
  CRISPR gRNA sequence
acccataccggtctgtggcc

SEQ ID NO: 147007 - DNA, 20 bp, Artificial
  CRISPR gRNA sequence
cccataccggtctgtggccc

SEQ ID NO: 147008 - DNA, 20 bp, Artificial
  CRISPR gRNA sequence
ccataccggtctgtggccca

SEQ ID NO: 147009 - DNA, 20 bp, Artificial
  CRISPR gRNA sequence
cataccggtctgtggcccag

SEQ ID NO: 147010 - DNA, 20 bp, Artificial
  CRISPR gRNA sequence
ccggtctgtggcccaggggt

SEQ ID NO: 147011 - DNA, 20 bp, Artificial
  CRISPR gRNA sequence
cggtctgtggcccaggggtt

SEQ ID NO: 147012 - DNA, 20 bp, Artificial
  CRISPR gRNA sequence
ggtctgtggcccaggggttg

SEQ ID NO: 147013 - DNA, 20 bp, Artificial
  CRISPR gRNA sequence
ggggttggggacccctgctc

SEQ ID NO: 147014 - DNA, 20 bp, Artificial
  CRISPR gRNA sequence
gttggggacccctgctctag

SEQ ID NO: 147015 - DNA, 20 bp, Artificial
  CRISPR gRNA sequence
ttggggacccctgctctagt

SEQ ID NO: 147016 - DNA, 20 bp, Artificial
  CRISPR gRNA sequence
gggacccctgctctagtggg

SEQ ID NO: 147017 - DNA, 20 bp, Artificial
  CRISPR gRNA sequence
gacccctgctctagtgggta

SEQ ID NO: 147018 - DNA, 20 bp, Artificial
  CRISPR gRNA sequence
tgctctagtgggtagagtac

SEQ ID NO: 147019 - DNA, 20 bp, Artificial
  CRISPR gRNA sequence
tccccttgtgactatgatcc

SEQ ID NO: 147020 - DNA, 20 bp, Artificial
  CRISPR gRNA sequence
cttgtgactatgatccaagt

SEQ ID NO: 147021 - DNA, 20 bp, Artificial
  CRISPR gRNA sequence
tgtgactatgatccaagtga

SEQ ID NO: 147022 - DNA, 20 bp, Artificial
  CRISPR gRNA sequence
ctatgatccaagtgagagtt

SEQ ID NO: 147023 - DNA, 20 bp, Artificial
  CRISPR gRNA sequence
tatgatccaagtgagagtta

SEQ ID NO: 147024 - DNA, 20 bp, Artificial
  CRISPR gRNA sequence
agttaaggactactgtttta

SEQ ID NO: 147025 - DNA, 20 bp, Artificial
  CRISPR gRNA sequence
ttttacggccctgctactca

SEQ ID NO: 147026 - DNA, 20 bp, Artificial
  CRISPR gRNA sequence
acggccctgctactcaaagt

SEQ ID NO: 147027 - DNA, 20 bp, Artificial
  CRISPR gRNA sequence
cggccctgctactcaaagta

SEQ ID NO: 147028 - DNA, 20 bp, Artificial
  CRISPR gRNA sequence
gctactcaaagtaaggtcct

SEQ ID NO: 147029 - DNA, 20 bp, Artificial
  CRISPR gRNA sequence
tcaaagtaaggtccttggac

SEQ ID NO: 147030 - DNA, 20 bp, Artificial
  CRISPR gRNA sequence
taaggtccttggaccagcaa

SEQ ID NO: 147031 - DNA, 20 bp, Artificial
  CRISPR gRNA sequence
ggaccagcaatggtatcacc

SEQ ID NO: 147032 - DNA, 20 bp, Artificial
  CRISPR gRNA sequence
gaccagcaatggtatcacct

SEQ ID NO: 147033 - DNA, 20 bp, Artificial
  CRISPR gRNA sequence
ggtatcacctgggaactcaa

SEQ ID NO: 147034 - DNA, 20 bp, Artificial
  CRISPR gRNA sequence
ctgggaactcaaaagaaaca

SEQ ID NO: 147035 - DNA, 20 bp, Artificial
  CRISPR gRNA sequence
tcaaaagaaacacagaatcc

SEQ ID NO: 147036 - DNA, 20 bp, Artificial
  CRISPR gRNA sequence
caaaagaaacacagaatccc

SEQ ID NO: 147037 - DNA, 20 bp, Artificial
  CRISPR gRNA sequence
ccgttcctaacctactaaat

SEQ ID NO: 147038 - DNA, 20 bp, Artificial
  CRISPR gRNA sequence
taaatcagcatcaatatttt

SEQ ID NO: 147039 - DNA, 20 bp, Artificial
  CRISPR gRNA sequence
atcagcatcaatattttaag

SEQ ID NO: 147040 - DNA, 20 bp, Artificial
  CRISPR gRNA sequence
taagaagatcctccctcacg

SEQ ID NO: 147041 - DNA, 20 bp, Artificial
  CRISPR gRNA sequence
cctccctcacgtggttcata

SEQ ID NO: 147042 - DNA, 20 bp, Artificial
  CRISPR gRNA sequence
cgtggttcatacagacaata

SEQ ID NO: 147043 - DNA, 20 bp, Artificial
  CRISPR gRNA sequence
tcatacagacaataaagttt

SEQ ID NO: 147044 - DNA, 20 bp, Artificial
  CRISPR gRNA sequence
tacagacaataaagtttgag

SEQ ID NO: 147045 - DNA, 20 bp, Artificial
  CRISPR gRNA sequence
gtttgagaagcactgctcta

SEQ ID NO: 147046 - DNA, 20 bp, Artificial
  CRISPR gRNA sequence
gagaagcactgctctacaga

SEQ ID NO: 147047 - DNA, 20 bp, Artificial
  CRISPR gRNA sequence
agaagcactgctctacagaa

SEQ ID NO: 147048 - DNA, 20 bp, Artificial
  CRISPR gRNA sequence
gaagcactgctctacagaaa

SEQ ID NO: 147049 - DNA, 20 bp, Artificial
  CRISPR gRNA sequence
ctctacagaaagggctcaca

SEQ ID NO: 147050 - DNA, 20 bp, Artificial
  CRISPR gRNA sequence
cagaaagggctcacacagca

SEQ ID NO: 147051 - DNA, 20 bp, Artificial
  CRISPR gRNA sequence
agaaagggctcacacagcac

SEQ ID NO: 147052 - DNA, 20 bp, Artificial
  CRISPR gRNA sequence
gcacaggacctgttttgtaa

SEQ ID NO: 147053 - DNA, 20 bp, Artificial
  CRISPR gRNA sequence
gtccaccaaccttcatcacc

SEQ ID NO: 147054 - DNA, 20 bp, Artificial
  CRISPR gRNA sequence
tcaccaagttcttgtttaaa

SEQ ID NO: 147055 - DNA, 20 bp, Artificial
  CRISPR gRNA sequence
atctgatttgattgtaatgt

SEQ ID NO: 147056 - DNA, 20 bp, Artificial
  CRISPR gRNA sequence
tagaaatgtcatcacccaat

SEQ ID NO: 147057 - DNA, 20 bp, Artificial
  CRISPR gRNA sequence
agaaatgtcatcacccaatc

SEQ ID NO: 147058 - DNA, 20 bp, Artificial
  CRISPR gRNA sequence
aaatgtcatcacccaatcag

SEQ ID NO: 147059 - DNA, 20 bp, Artificial
  CRISPR gRNA sequence
aatgtcatcacccaatcagg

SEQ ID NO: 147060 - DNA, 20 bp, Artificial
  CRISPR gRNA sequence
tcacccaatcaggaggcact

SEQ ID NO: 147061 - DNA, 20 bp, Artificial
  CRISPR gRNA sequence
cacccaatcaggaggcactg

SEQ ID NO: 147062 - DNA, 20 bp, Artificial
  CRISPR gRNA sequence
aggaggcactgaggaatgaa

SEQ ID NO: 147063 - DNA, 20 bp, Artificial
  CRISPR gRNA sequence
aagatgaaactgccaattaa

SEQ ID NO: 147064 - DNA, 20 bp, Artificial
  CRISPR gRNA sequence
tgaaactgccaattaaaaga

SEQ ID NO: 147065 - DNA, 20 bp, Artificial
  CRISPR gRNA sequence
ccaattaaaagaaagtgacc

SEQ ID NO: 147066 - DNA, 20 bp, Artificial
  CRISPR gRNA sequence
caattaaaagaaagtgacct

SEQ ID NO: 147067 - DNA, 20 bp, Artificial
  CRISPR gRNA sequence
gtgacctaggcactcaatta

SEQ ID NO: 147068 - DNA, 20 bp, Artificial
  CRISPR gRNA sequence
ctaggcactcaattacagtt

SEQ ID NO: 147069 - DNA, 20 bp, Artificial
  CRISPR gRNA sequence
cactcaattacagttaagtg

SEQ ID NO: 147070 - DNA, 20 bp, Artificial
  CRISPR gRNA sequence
actcaattacagttaagtga

SEQ ID NO: 147071 - DNA, 20 bp, Artificial
  CRISPR gRNA sequence
acagttaagtgaaggctgaa

SEQ ID NO: 147072 - DNA, 20 bp, Artificial
  CRISPR gRNA sequence
cagttaagtgaaggctgaat

SEQ ID NO: 147073 - DNA, 20 bp, Artificial
  CRISPR gRNA sequence
tgaaggctgaatgggatgta

SEQ ID NO: 147074 - DNA, 20 bp, Artificial
  CRISPR gRNA sequence
aaggctgaatgggatgtaaa

SEQ ID NO: 147075 - DNA, 20 bp, Artificial
  CRISPR gRNA sequence
ctgaatgggatgtaaagagt

SEQ ID NO: 147076 - DNA, 20 bp, Artificial
  CRISPR gRNA sequence
aatgggatgtaaagagtaag

SEQ ID NO: 147077 - DNA, 20 bp, Artificial
  CRISPR gRNA sequence
tgggatgtaaagagtaagta

SEQ ID NO: 147078 - DNA, 20 bp, Artificial
  CRISPR gRNA sequence
gtaaagagtaagtagagaat

SEQ ID NO: 147079 - DNA, 20 bp, Artificial
  CRISPR gRNA sequence
agatttttcttttcgaaatt

SEQ ID NO: 147080 - DNA, 20 bp, Artificial
  CRISPR gRNA sequence
gcccccaactcacctccata

SEQ ID NO: 147081 - DNA, 20 bp, Artificial
  CRISPR gRNA sequence
aactcacctccataaagaca

SEQ ID NO: 147082 - DNA, 20 bp, Artificial
  CRISPR gRNA sequence
cacctccataaagacaaagt

SEQ ID NO: 147083 - DNA, 20 bp, Artificial
  CRISPR gRNA sequence
ctttctctttcctattttca

SEQ ID NO: 147084 - DNA, 20 bp, Artificial
  CRISPR gRNA sequence
ttctctttcctattttcaaa

SEQ ID NO: 147085 - DNA, 20 bp, Artificial
  CRISPR gRNA sequence
tctctttcctattttcaaag

SEQ ID NO: 147086 - DNA, 20 bp, Artificial
  CRISPR gRNA sequence
ctattttcaaagaggcccac

SEQ ID NO: 147087 - DNA, 20 bp, Artificial
  CRISPR gRNA sequence
tattttcaaagaggcccact

SEQ ID NO: 147088 - DNA, 20 bp, Artificial
  CRISPR gRNA sequence
attttcaaagaggcccactg

SEQ ID NO: 147089 - DNA, 20 bp, Artificial
  CRISPR gRNA sequence
ctggggcaaaactcaacacg

SEQ ID NO: 147090 - DNA, 20 bp, Artificial
  CRISPR gRNA sequence
gggcaaaactcaacacgaag

SEQ ID NO: 147091 - DNA, 20 bp, Artificial
  CRISPR gRNA sequence
agtctgttatttgctgttcc

SEQ ID NO: 147092 - DNA, 20 bp, Artificial
  CRISPR gRNA sequence
tctgttatttgctgttccca

SEQ ID NO: 147093 - DNA, 20 bp, Artificial
  CRISPR gRNA sequence
gttcccagagctctgctgtg

SEQ ID NO: 147094 - DNA, 20 bp, Artificial
  CRISPR gRNA sequence
ttcccagagctctgctgtgc

SEQ ID NO: 147095 - DNA, 20 bp, Artificial
  CRISPR gRNA sequence
agctctgctgtgcgggaata

SEQ ID NO: 147096 - DNA, 20 bp, Artificial
  CRISPR gRNA sequence
gctctgctgtgcgggaatat

SEQ ID NO: 147097 - DNA, 20 bp, Artificial
  CRISPR gRNA sequence
ctctgctgtgcgggaatata

SEQ ID NO: 147098 - DNA, 20 bp, Artificial
  CRISPR gRNA sequence
agggttttacacaatcactc

SEQ ID NO: 147099 - DNA, 20 bp, Artificial
  CRISPR gRNA sequence
ggtgcacaatcatcttgata

SEQ ID NO: 147100 - DNA, 20 bp, Artificial
  CRISPR gRNA sequence
tttttaactaatttcaatcc

SEQ ID NO: 147101 - DNA, 20 bp, Artificial
  CRISPR gRNA sequence
aatcccagctgaacaccacc

SEQ ID NO: 147102 - DNA, 20 bp, Artificial
  CRISPR gRNA sequence
ctgaacaccacctggattta

SEQ ID NO: 147103 - DNA, 20 bp, Artificial
  CRISPR gRNA sequence
cctggatttatagacaacta

SEQ ID NO: 147104 - DNA, 20 bp, Artificial
  CRISPR gRNA sequence
tggatttatagacaactaca

SEQ ID NO: 147105 - DNA, 20 bp, Artificial
  CRISPR gRNA sequence
tagacaactacagagctttt

SEQ ID NO: 147106 - DNA, 20 bp, Artificial
  CRISPR gRNA sequence
acagagcttttaagaatcat

SEQ ID NO: 147107 - DNA, 20 bp, Artificial
  CRISPR gRNA sequence
cttttaagaatcatgagaac

SEQ ID NO: 147108 - DNA, 20 bp, Artificial
  CRISPR gRNA sequence
atgagaacaagctaaaatga

SEQ ID NO: 147109 - DNA, 20 bp, Artificial
  CRISPR gRNA sequence
tgaaagataaattgctttta

SEQ ID NO: 147110 - DNA, 20 bp, Artificial
  CRISPR gRNA sequence
gaaagataaattgcttttac

SEQ ID NO: 147111 - DNA, 20 bp, Artificial
  CRISPR gRNA sequence
taaattgcttttacaggacg

SEQ ID NO: 147112 - DNA, 20 bp, Artificial
  CRISPR gRNA sequence
ttttacaggacgcagaccaa

SEQ ID NO: 147113 - DNA, 20 bp, Artificial
  CRISPR gRNA sequence
tttacaggacgcagaccaaa

SEQ ID NO: 147114 - DNA, 20 bp, Artificial
  CRISPR gRNA sequence
gacgcagaccaaaaggactt

SEQ ID NO: 147115 - DNA, 20 bp, Artificial
  CRISPR gRNA sequence
acgcagaccaaaaggacttg

SEQ ID NO: 147116 - DNA, 20 bp, Artificial
  CRISPR gRNA sequence
agaccaaaaggacttgaggc

SEQ ID NO: 147117 - DNA, 20 bp, Artificial
  CRISPR gRNA sequence
acatcatgaaatatatcatc

SEQ ID NO: 147118 - DNA, 20 bp, Artificial
  CRISPR gRNA sequence
ttttgaaacaaattgtgtcc

SEQ ID NO: 147119 - DNA, 20 bp, Artificial
  CRISPR gRNA sequence
aacaaattgtgtcccagtct

SEQ ID NO: 147120 - DNA, 20 bp, Artificial
  CRISPR gRNA sequence
cattttatgaatattctcgt

SEQ ID NO: 147121 - DNA, 20 bp, Artificial
  CRISPR gRNA sequence
tcgtaagttttacttatgat

SEQ ID NO: 147122 - DNA, 20 bp, Artificial
  CRISPR gRNA sequence
aagttttacttatgattggc

SEQ ID NO: 147123 - DNA, 20 bp, Artificial
  CRISPR gRNA sequence
tgattggctagtttaaacat

SEQ ID NO: 147124 - DNA, 20 bp, Artificial
  CRISPR gRNA sequence
gattggctagtttaaacata

SEQ ID NO: 147125 - DNA, 20 bp, Artificial
  CRISPR gRNA sequence
tttttttctttttaatctgt

SEQ ID NO: 147126 - DNA, 20 bp, Artificial
  CRISPR gRNA sequence
tttaatctgttagatattgt

SEQ ID NO: 147127 - DNA, 20 bp, Artificial
  CRISPR gRNA sequence
ttaatctgttagatattgtg

SEQ ID NO: 147128 - DNA, 20 bp, Artificial
  CRISPR gRNA sequence
atattgtgaggtgtcaacct

SEQ ID NO: 147129 - DNA, 20 bp, Artificial
  CRISPR gRNA sequence
attgtgaggtgtcaacctaa

SEQ ID NO: 147130 - DNA, 20 bp, Artificial
  CRISPR gRNA sequence
ttgtgaggtgtcaacctaag

SEQ ID NO: 147131 - DNA, 20 bp, Artificial
  CRISPR gRNA sequence
taagaggctctgacacatct

SEQ ID NO: 147132 - DNA, 20 bp, Artificial
  CRISPR gRNA sequence
aagaggctctgacacatctg

SEQ ID NO: 147133 - DNA, 20 bp, Artificial
  CRISPR gRNA sequence
aggctctgacacatctgagg

SEQ ID NO: 147134 - DNA, 20 bp, Artificial
  CRISPR gRNA sequence
ctgacacatctgaggaagtc

SEQ ID NO: 147135 - DNA, 20 bp, Artificial
  CRISPR gRNA sequence
atctgaggaagtctggtttt

SEQ ID NO: 147136 - DNA, 20 bp, Artificial
  CRISPR gRNA sequence
gtctggttttaagtactgtt

SEQ ID NO: 147137 - DNA, 20 bp, Artificial
  CRISPR gRNA sequence
ttttaagtactgttgagttc

SEQ ID NO: 147138 - DNA, 20 bp, Artificial
  CRISPR gRNA sequence
aagtactgttgagttctgga

SEQ ID NO: 147139 - DNA, 20 bp, Artificial
  CRISPR gRNA sequence
agtactgttgagttctggaa

SEQ ID NO: 147140 - DNA, 20 bp, Artificial
  CRISPR gRNA sequence
gtactgttgagttctggaaa

SEQ ID NO: 147141 - DNA, 20 bp, Artificial
  CRISPR gRNA sequence
tgttgagttctggaaaggga

SEQ ID NO: 147142 - DNA, 20 bp, Artificial
  CRISPR gRNA sequence
agattaaatgctaaaatgtt

SEQ ID NO: 147143 - DNA, 20 bp, Artificial
  CRISPR gRNA sequence
aaatgtttggtcatgttaca

SEQ ID NO: 147144 - DNA, 20 bp, Artificial
  CRISPR gRNA sequence
aatgtttggtcatgttacac

SEQ ID NO: 147145 - DNA, 20 bp, Artificial
  CRISPR gRNA sequence
gtttggtcatgttacacagg

SEQ ID NO: 147146 - DNA, 20 bp, Artificial
  CRISPR gRNA sequence
tggtcatgttacacaggcag

SEQ ID NO: 147147 - DNA, 20 bp, Artificial
  CRISPR gRNA sequence
atgttacacaggcagcagcg

SEQ ID NO: 147148 - DNA, 20 bp, Artificial
  CRISPR gRNA sequence
tacacaggcagcagcgcagt

SEQ ID NO: 147149 - DNA, 20 bp, Artificial
  CRISPR gRNA sequence
cacaggcagcagcgcagtca

SEQ ID NO: 147150 - DNA, 20 bp, Artificial
  CRISPR gRNA sequence
aggcagcagcgcagtcagag

SEQ ID NO: 147151 - DNA, 20 bp, Artificial
  CRISPR gRNA sequence
cagcagcgcagtcagagaag

SEQ ID NO: 147152 - DNA, 20 bp, Artificial
  CRISPR gRNA sequence
ccatcacgtgttgcactcct

SEQ ID NO: 147153 - DNA, 20 bp, Artificial
  CRISPR gRNA sequence
tcacgtgttgcactcctgag

SEQ ID NO: 147154 - DNA, 20 bp, Artificial
  CRISPR gRNA sequence
acgtgttgcactcctgagaa

SEQ ID NO: 147155 - DNA, 20 bp, Artificial
  CRISPR gRNA sequence
cgtgttgcactcctgagaag

SEQ ID NO: 147156 - DNA, 20 bp, Artificial
  CRISPR gRNA sequence
gtgttgcactcctgagaaga

SEQ ID NO: 147157 - DNA, 20 bp, Artificial
  CRISPR gRNA sequence
tgttgcactcctgagaagag

SEQ ID NO: 147158 - DNA, 20 bp, Artificial
  CRISPR gRNA sequence
tcctgagaagaggggaaaat

SEQ ID NO: 147159 - DNA, 20 bp, Artificial
  CRISPR gRNA sequence
ctgagaagaggggaaaataa

SEQ ID NO: 147160 - DNA, 20 bp, Artificial
  CRISPR gRNA sequence
ggggaaaataagagtcacac

SEQ ID NO: 147161 - DNA, 20 bp, Artificial
  CRISPR gRNA sequence
gggaaaataagagtcacaca

SEQ ID NO: 147162 - DNA, 20 bp, Artificial
  CRISPR gRNA sequence
ggaaaataagagtcacacaa

SEQ ID NO: 147163 - DNA, 20 bp, Artificial
  CRISPR gRNA sequence
aaaaattaccctgactttac

SEQ ID NO: 147164 - DNA, 20 bp, Artificial
  CRISPR gRNA sequence
attgcattcttactcaaata

SEQ ID NO: 147165 - DNA, 20 bp, Artificial
  CRISPR gRNA sequence
gttgctttgcactaaacctg

SEQ ID NO: 147166 - DNA, 20 bp, Artificial
  CRISPR gRNA sequence
gctttgcactaaacctgaag

SEQ ID NO: 147167 - DNA, 20 bp, Artificial
  CRISPR gRNA sequence
tttgcactaaacctgaagtg

SEQ ID NO: 147168 - DNA, 20 bp, Artificial
  CRISPR gRNA sequence
attgtgcacctactacatgc

SEQ ID NO: 147169 - DNA, 20 bp, Artificial
  CRISPR gRNA sequence
tacatgccagacattgttct

SEQ ID NO: 147170 - DNA, 20 bp, Artificial
  CRISPR gRNA sequence
gttctaagcacctgatataa

SEQ ID NO: 147171 - DNA, 20 bp, Artificial
  CRISPR gRNA sequence
agcacctgatataaaagaca

SEQ ID NO: 147172 - DNA, 20 bp, Artificial
  CRISPR gRNA sequence
ctgatataaaagacatagca

SEQ ID NO: 147173 - DNA, 20 bp, Artificial
  CRISPR gRNA sequence
atataaaagacatagcatgg

SEQ ID NO: 147174 - DNA, 20 bp, Artificial
  CRISPR gRNA sequence
ataaaagacatagcatggca

SEQ ID NO: 147175 - DNA, 20 bp, Artificial
  CRISPR gRNA sequence
taaaagacatagcatggcag

SEQ ID NO: 147176 - DNA, 20 bp, Artificial
  CRISPR gRNA sequence
gacatagcatggcagaggtc

SEQ ID NO: 147177 - DNA, 20 bp, Artificial
  CRISPR gRNA sequence
acatagcatggcagaggtct

SEQ ID NO: 147178 - DNA, 20 bp, Artificial
  CRISPR gRNA sequence
atagcatggcagaggtctag

SEQ ID NO: 147179 - DNA, 20 bp, Artificial
  CRISPR gRNA sequence
ggtctaggagtccctttcaa

SEQ ID NO: 147180 - DNA, 20 bp, Artificial
  CRISPR gRNA sequence
gagtccctttcaaaagtaca

SEQ ID NO: 147181 - DNA, 20 bp, Artificial
  CRISPR gRNA sequence
agtccctttcaaaagtacat

SEQ ID NO: 147182 - DNA, 20 bp, Artificial
  CRISPR gRNA sequence
tccctttcaaaagtacatag

SEQ ID NO: 147183 - DNA, 20 bp, Artificial
  CRISPR gRNA sequence
ccctttcaaaagtacatagg

SEQ ID NO: 147184 - DNA, 20 bp, Artificial
  CRISPR gRNA sequence
ctttcaaaagtacataggag

SEQ ID NO: 147185 - DNA, 20 bp, Artificial
  CRISPR gRNA sequence
cataggaggagaattttaat

SEQ ID NO: 147186 - DNA, 20 bp, Artificial
  CRISPR gRNA sequence
ttttaattagtcaccaatac

SEQ ID NO: 147187 - DNA, 20 bp, Artificial
  CRISPR gRNA sequence
taattagtcaccaatacaag

SEQ ID NO: 147188 - DNA, 20 bp, Artificial
  CRISPR gRNA sequence
aattagtcaccaatacaaga

SEQ ID NO: 147189 - DNA, 20 bp, Artificial
  CRISPR gRNA sequence
caccaatacaagaaggatta

SEQ ID NO: 147190 - DNA, 20 bp, Artificial
  CRISPR gRNA sequence
aaccaaaactgaatccctca

SEQ ID NO: 147191 - DNA, 20 bp, Artificial
  CRISPR gRNA sequence
aattctcttttaacttctga

SEQ ID NO: 147192 - DNA, 20 bp, Artificial
  CRISPR gRNA sequence
cttttaacttctgatagact

SEQ ID NO: 147193 - DNA, 20 bp, Artificial
  CRISPR gRNA sequence
aacttctgatagactaagtc

SEQ ID NO: 147194 - DNA, 20 bp, Artificial
  CRISPR gRNA sequence
acttctgatagactaagtct

SEQ ID NO: 147195 - DNA, 20 bp, Artificial
  CRISPR gRNA sequence
taagtctaggtactaaaatt

SEQ ID NO: 147196 - DNA, 20 bp, Artificial
  CRISPR gRNA sequence
aatttggtcaacatcatgat

SEQ ID NO: 147197 - DNA, 20 bp, Artificial
  CRISPR gRNA sequence
aacatcatgatcagctttgt

SEQ ID NO: 147198 - DNA, 20 bp, Artificial
  CRISPR gRNA sequence
ggcaatcaaacttgtaaacc

SEQ ID NO: 147199 - DNA, 20 bp, Artificial
  CRISPR gRNA sequence
aatcaaacttgtaaaccaag

SEQ ID NO: 147200 - DNA, 20 bp, Artificial
  CRISPR gRNA sequence
atcaaacttgtaaaccaagt

SEQ ID NO: 147201 - DNA, 20 bp, Artificial
  CRISPR gRNA sequence
accaagtaggttacaaatca

SEQ ID NO: 147202 - DNA, 20 bp, Artificial
  CRISPR gRNA sequence
gtaggttacaaatcaaagcc

SEQ ID NO: 147203 - DNA, 20 bp, Artificial
  CRISPR gRNA sequence
taggttacaaatcaaagccc

SEQ ID NO: 147204 - DNA, 20 bp, Artificial
  CRISPR gRNA sequence
aggttacaaatcaaagccca

SEQ ID NO: 147205 - DNA, 20 bp, Artificial
  CRISPR gRNA sequence
aatcaaagcccagggtcttg

SEQ ID NO: 147206 - DNA, 20 bp, Artificial
  CRISPR gRNA sequence
tcaaagcccagggtcttgaa

SEQ ID NO: 147207 - DNA, 20 bp, Artificial
  CRISPR gRNA sequence
caaagcccagggtcttgaag

SEQ ID NO: 147208 - DNA, 20 bp, Artificial
  CRISPR gRNA sequence
atttgcacactcatgtaaca

SEQ ID NO: 147209 - DNA, 20 bp, Artificial
  CRISPR gRNA sequence
tgcacactcatgtaacacag

SEQ ID NO: 147210 - DNA, 20 bp, Artificial
  CRISPR gRNA sequence
cacagcagcactattcacaa

SEQ ID NO: 147211 - DNA, 20 bp, Artificial
  CRISPR gRNA sequence
cagcactattcacaatagcc

SEQ ID NO: 147212 - DNA, 20 bp, Artificial
  CRISPR gRNA sequence
gcactattcacaatagccaa

SEQ ID NO: 147213 - DNA, 20 bp, Artificial
  CRISPR gRNA sequence
cactattcacaatagccaag

SEQ ID NO: 147214 - DNA, 20 bp, Artificial
  CRISPR gRNA sequence
ccaacccaaatgtccattaa

SEQ ID NO: 147215 - DNA, 20 bp, Artificial
  CRISPR gRNA sequence
aatgtccattaacagatgaa

SEQ ID NO: 147216 - DNA, 20 bp, Artificial
  CRISPR gRNA sequence
atgaacggataaacaaaatg

SEQ ID NO: 147217 - DNA, 20 bp, Artificial
  CRISPR gRNA sequence
aatgtggtatatacatacaa

SEQ ID NO: 147218 - DNA, 20 bp, Artificial
  CRISPR gRNA sequence
atgtggtatatacatacaac

SEQ ID NO: 147219 - DNA, 20 bp, Artificial
  CRISPR gRNA sequence
tgtggtatatacatacaaca

SEQ ID NO: 147220 - DNA, 20 bp, Artificial
  CRISPR gRNA sequence
ttctgccttaaaaaaaaaaa

SEQ ID NO: 147221 - DNA, 20 bp, Artificial
  CRISPR gRNA sequence
tctgccttaaaaaaaaaaaa

SEQ ID NO: 147222 - DNA, 20 bp, Artificial
  CRISPR gRNA sequence
ccttaaaaaaaaaaaaagga

SEQ ID NO: 147223 - DNA, 20 bp, Artificial
  CRISPR gRNA sequence
cttaaaaaaaaaaaaaggat

SEQ ID NO: 147224 - DNA, 20 bp, Artificial
  CRISPR gRNA sequence
aaaaaaaaaaaaggataggc

SEQ ID NO: 147225 - DNA, 20 bp, Artificial
  CRISPR gRNA sequence
aaaggataggccagacatga

SEQ ID NO: 147226 - DNA, 20 bp, Artificial
  CRISPR gRNA sequence
atggctcatgtctgtaatcc

SEQ ID NO: 147227 - DNA, 20 bp, Artificial
  CRISPR gRNA sequence
tgtctgtaatcccagtgctt

SEQ ID NO: 147228 - DNA, 20 bp, Artificial
  CRISPR gRNA sequence
tctgtaatcccagtgctttg

SEQ ID NO: 147229 - DNA, 20 bp, Artificial
  CRISPR gRNA sequence
ctgtaatcccagtgctttgg

SEQ ID NO: 147230 - DNA, 20 bp, Artificial
  CRISPR gRNA sequence
tgtaatcccagtgctttgga

SEQ ID NO: 147231 - DNA, 20 bp, Artificial
  CRISPR gRNA sequence
tcccagtgctttggagggcc

SEQ ID NO: 147232 - DNA, 20 bp, Artificial
  CRISPR gRNA sequence
cccagtgctttggagggcca

SEQ ID NO: 147233 - DNA, 20 bp, Artificial
  CRISPR gRNA sequence
gtgctttggagggccaaggc

SEQ ID NO: 147234 - DNA, 20 bp, Artificial
  CRISPR gRNA sequence
gctttggagggccaaggcaa

SEQ ID NO: 147235 - DNA, 20 bp, Artificial
  CRISPR gRNA sequence
ctttggagggccaaggcaag

SEQ ID NO: 147236 - DNA, 20 bp, Artificial
  CRISPR gRNA sequence
ccaaggcaagaggattgctt

SEQ ID NO: 147237 - DNA, 20 bp, Artificial
  CRISPR gRNA sequence
caaggcaagaggattgcttg

SEQ ID NO: 147238 - DNA, 20 bp, Artificial
  CRISPR gRNA sequence
gcaagaggattgcttgaggc

SEQ ID NO: 147239 - DNA, 20 bp, Artificial
  CRISPR gRNA sequence
caagaggattgcttgaggcc

SEQ ID NO: 147240 - DNA, 20 bp, Artificial
  CRISPR gRNA sequence
ttgcttgaggccaggaattt

SEQ ID NO: 147241 - DNA, 20 bp, Artificial
  CRISPR gRNA sequence
tgaggccaggaatttgagac

SEQ ID NO: 147242 - DNA, 20 bp, Artificial
  CRISPR gRNA sequence
ccaggaatttgagaccagcc

SEQ ID NO: 147243 - DNA, 20 bp, Artificial
  CRISPR gRNA sequence
caggaatttgagaccagcct

SEQ ID NO: 147244 - DNA, 20 bp, Artificial
  CRISPR gRNA sequence
tgagaccagcctaggcaaca

SEQ ID NO: 147245 - DNA, 20 bp, Artificial
  CRISPR gRNA sequence
accagcctaggcaacatagt

SEQ ID NO: 147246 - DNA, 20 bp, Artificial
  CRISPR gRNA sequence
tgagacctccatctctacat

SEQ ID NO: 147247 - DNA, 20 bp, Artificial
  CRISPR gRNA sequence
taagattttttttttttaat

SEQ ID NO: 147248 - DNA, 20 bp, Artificial
  CRISPR gRNA sequence
attttttttttttaattagc

SEQ ID NO: 147249 - DNA, 20 bp, Artificial
  CRISPR gRNA sequence
ttttttttttttaattagcc

SEQ ID NO: 147250 - DNA, 20 bp, Artificial
  CRISPR gRNA sequence
tttttttaattagccaggtg

SEQ ID NO: 147251 - DNA, 20 bp, Artificial
  CRISPR gRNA sequence
ttttaattagccaggtgtgg

SEQ ID NO: 147252 - DNA, 20 bp, Artificial
  CRISPR gRNA sequence
caggtgtggtggtgcacaac

SEQ ID NO: 147253 - DNA, 20 bp, Artificial
  CRISPR gRNA sequence
ggtgtggtggtgcacaacta

SEQ ID NO: 147254 - DNA, 20 bp, Artificial
  CRISPR gRNA sequence
gtggtgcacaactagagtcc

SEQ ID NO: 147255 - DNA, 20 bp, Artificial
  CRISPR gRNA sequence
caactagagtcctagctact

SEQ ID NO: 147256 - DNA, 20 bp, Artificial
  CRISPR gRNA sequence
aactagagtcctagctactt

SEQ ID NO: 147257 - DNA, 20 bp, Artificial
  CRISPR gRNA sequence
actagagtcctagctacttg

SEQ ID NO: 147258 - DNA, 20 bp, Artificial
  CRISPR gRNA sequence
ctagagtcctagctacttgg

SEQ ID NO: 147259 - DNA, 20 bp, Artificial
  CRISPR gRNA sequence
tcctagctacttgggggact

SEQ ID NO: 147260 - DNA, 20 bp, Artificial
  CRISPR gRNA sequence
tagctacttgggggactgag

SEQ ID NO: 147261 - DNA, 20 bp, Artificial
  CRISPR gRNA sequence
agctacttgggggactgagt

SEQ ID NO: 147262 - DNA, 20 bp, Artificial
  CRISPR gRNA sequence
tacttgggggactgagtagg

SEQ ID NO: 147263 - DNA, 20 bp, Artificial
  CRISPR gRNA sequence
acttgggggactgagtagga

SEQ ID NO: 147264 - DNA, 20 bp, Artificial
  CRISPR gRNA sequence
cttgggggactgagtaggaa

SEQ ID NO: 147265 - DNA, 20 bp, Artificial
  CRISPR gRNA sequence
ctgagtaggaagggtccctt

SEQ ID NO: 147266 - DNA, 20 bp, Artificial
  CRISPR gRNA sequence
aggaagggtcccttgagccc

SEQ ID NO: 147267 - DNA, 20 bp, Artificial
  CRISPR gRNA sequence
gaagggtcccttgagcccaa

SEQ ID NO: 147268 - DNA, 20 bp, Artificial
  CRISPR gRNA sequence
tcccttgagcccaagagttc

SEQ ID NO: 147269 - DNA, 20 bp, Artificial
  CRISPR gRNA sequence
cccttgagcccaagagttca

SEQ ID NO: 147270 - DNA, 20 bp, Artificial
  CRISPR gRNA sequence
agcccaagagttcaaggcta

SEQ ID NO: 147271 - DNA, 20 bp, Artificial
  CRISPR gRNA sequence
caagagttcaaggctacagt

SEQ ID NO: 147272 - DNA, 20 bp, Artificial
  CRISPR gRNA sequence
ataatcctgccactgcactc

SEQ ID NO: 147273 - DNA, 20 bp, Artificial
  CRISPR gRNA sequence
cactgcactccagcaatgaa

SEQ ID NO: 147274 - DNA, 20 bp, Artificial
  CRISPR gRNA sequence
ctgcactccagcaatgaaca

SEQ ID NO: 147275 - DNA, 20 bp, Artificial
  CRISPR gRNA sequence
actccagcaatgaacagagt

SEQ ID NO: 147276 - DNA, 20 bp, Artificial
  CRISPR gRNA sequence
gagaccctgtctctttaaaa

SEQ ID NO: 147277 - DNA, 20 bp, Artificial
  CRISPR gRNA sequence
tctttaaaaaagaaaaaaca

SEQ ID NO: 147278 - DNA, 20 bp, Artificial
  CRISPR gRNA sequence
ctttaaaaaagaaaaaacaa

SEQ ID NO: 147279 - DNA, 20 bp, Artificial
  CRISPR gRNA sequence
gaaaaaacaaaggccacgca

SEQ ID NO: 147280 - DNA, 20 bp, Artificial
  CRISPR gRNA sequence
aaaacaaaggccacgcatgg

SEQ ID NO: 147281 - DNA, 20 bp, Artificial
  CRISPR gRNA sequence
gtggctcacacctataatcc

SEQ ID NO: 147282 - DNA, 20 bp, Artificial
  CRISPR gRNA sequence
cacctataatcccagcactt

SEQ ID NO: 147283 - DNA, 20 bp, Artificial
  CRISPR gRNA sequence
acctataatcccagcacttt

SEQ ID NO: 147284 - DNA, 20 bp, Artificial
  CRISPR gRNA sequence
ctataatcccagcactttgg

SEQ ID NO: 147285 - DNA, 20 bp, Artificial
  CRISPR gRNA sequence
tataatcccagcactttggg

SEQ ID NO: 147286 - DNA, 20 bp, Artificial
  CRISPR gRNA sequence
aatcccagcactttgggagg

SEQ ID NO: 147287 - DNA, 20 bp, Artificial
  CRISPR gRNA sequence
agcactttgggaggcagatg

SEQ ID NO: 147288 - DNA, 20 bp, Artificial
  CRISPR gRNA sequence
gcactttgggaggcagatgt

SEQ ID NO: 147289 - DNA, 20 bp, Artificial
  CRISPR gRNA sequence
actttgggaggcagatgtgg

SEQ ID NO: 147290 - DNA, 20 bp, Artificial
  CRISPR gRNA sequence
ctttgggaggcagatgtggg

SEQ ID NO: 147291 - DNA, 20 bp, Artificial
  CRISPR gRNA sequence
cagatgtgggaggaatgctt

SEQ ID NO: 147292 - DNA, 20 bp, Artificial
  CRISPR gRNA sequence
gtgggaggaatgcttgagcc

SEQ ID NO: 147293 - DNA, 20 bp, Artificial
  CRISPR gRNA sequence
ggaggaatgcttgagcccag

SEQ ID NO: 147294 - DNA, 20 bp, Artificial
  CRISPR gRNA sequence
atgcttgagcccagaagttt

SEQ ID NO: 147295 - DNA, 20 bp, Artificial
  CRISPR gRNA sequence
tgagcccagaagtttgagac

SEQ ID NO: 147296 - DNA, 20 bp, Artificial
  CRISPR gRNA sequence
cccagaagtttgagaccagc

SEQ ID NO: 147297 - DNA, 20 bp, Artificial
  CRISPR gRNA sequence
ccagaagtttgagaccagcc

SEQ ID NO: 147298 - DNA, 20 bp, Artificial
  CRISPR gRNA sequence
cagaagtttgagaccagcca

SEQ ID NO: 147299 - DNA, 20 bp, Artificial
  CRISPR gRNA sequence
tgagaccagccagggtaaca

SEQ ID NO: 147300 - DNA, 20 bp, Artificial
  CRISPR gRNA sequence
gaccagccagggtaacatgg

SEQ ID NO: 147301 - DNA, 20 bp, Artificial
  CRISPR gRNA sequence
accagccagggtaacatggt

SEQ ID NO: 147302 - DNA, 20 bp, Artificial
  CRISPR gRNA sequence
atggtgggaccctgcctcta

SEQ ID NO: 147303 - DNA, 20 bp, Artificial
  CRISPR gRNA sequence
ctacagaaaaatacaaaaat

SEQ ID NO: 147304 - DNA, 20 bp, Artificial
  CRISPR gRNA sequence
agaaaaatacaaaaattagc

SEQ ID NO: 147305 - DNA, 20 bp, Artificial
  CRISPR gRNA sequence
gaaaaatacaaaaattagct

SEQ ID NO: 147306 - DNA, 20 bp, Artificial
  CRISPR gRNA sequence
atacaaaaattagctgggtg

SEQ ID NO: 147307 - DNA, 20 bp, Artificial
  CRISPR gRNA sequence
caaaaattagctgggtgtgg

SEQ ID NO: 147308 - DNA, 20 bp, Artificial
  CRISPR gRNA sequence
ggtgtggtggcgtgcacctg

SEQ ID NO: 147309 - DNA, 20 bp, Artificial
  CRISPR gRNA sequence
gtggcgtgcacctgtagtct

SEQ ID NO: 147310 - DNA, 20 bp, Artificial
  CRISPR gRNA sequence
cacctgtagtctcagctact

SEQ ID NO: 147311 - DNA, 20 bp, Artificial
  CRISPR gRNA sequence
acctgtagtctcagctactc

SEQ ID NO: 147312 - DNA, 20 bp, Artificial
  CRISPR gRNA sequence
ctgtagtctcagctactcag

SEQ ID NO: 147313 - DNA, 20 bp, Artificial
  CRISPR gRNA sequence
tgtagtctcagctactcagg

SEQ ID NO: 147314 - DNA, 20 bp, Artificial
  CRISPR gRNA sequence
tctcagctactcaggaggct

SEQ ID NO: 147315 - DNA, 20 bp, Artificial
  CRISPR gRNA sequence
ctcagctactcaggaggctg

SEQ ID NO: 147316 - DNA, 20 bp, Artificial
  CRISPR gRNA sequence
agctactcaggaggctgagg

SEQ ID NO: 147317 - DNA, 20 bp, Artificial
  CRISPR gRNA sequence
gctactcaggaggctgaggc

SEQ ID NO: 147318 - DNA, 20 bp, Artificial
  CRISPR gRNA sequence
tactcaggaggctgaggcgg

SEQ ID NO: 147319 - DNA, 20 bp, Artificial
  CRISPR gRNA sequence
actcaggaggctgaggcggg

SEQ ID NO: 147320 - DNA, 20 bp, Artificial
  CRISPR gRNA sequence
ctgaggcgggaggatcgctt

SEQ ID NO: 147321 - DNA, 20 bp, Artificial
  CRISPR gRNA sequence
cgggaggatcgcttgagcct

SEQ ID NO: 147322 - DNA, 20 bp, Artificial
  CRISPR gRNA sequence
ggaggatcgcttgagcctga

SEQ ID NO: 147323 - DNA, 20 bp, Artificial
  CRISPR gRNA sequence
gaggatcgcttgagcctgag

SEQ ID NO: 147324 - DNA, 20 bp, Artificial
  CRISPR gRNA sequence
tcgcttgagcctgagaggtc

SEQ ID NO: 147325 - DNA, 20 bp, Artificial
  CRISPR gRNA sequence
cgcttgagcctgagaggtcg

SEQ ID NO: 147326 - DNA, 20 bp, Artificial
  CRISPR gRNA sequence
agcctgagaggtcgaggctg

SEQ ID NO: 147327 - DNA, 20 bp, Artificial
  CRISPR gRNA sequence
tgagaggtcgaggctgcagt

SEQ ID NO: 147328 - DNA, 20 bp, Artificial
  CRISPR gRNA sequence
ataattgtaccactacactc

SEQ ID NO: 147329 - DNA, 20 bp, Artificial
  CRISPR gRNA sequence
tgtaccactacactccagcc

SEQ ID NO: 147330 - DNA, 20 bp, Artificial
  CRISPR gRNA sequence
ctacactccagcctggatga

SEQ ID NO: 147331 - DNA, 20 bp, Artificial
  CRISPR gRNA sequence
acactccagcctggatgaca

SEQ ID NO: 147332 - DNA, 20 bp, Artificial
  CRISPR gRNA sequence
tccagcctggatgacagagt

SEQ ID NO: 147333 - DNA, 20 bp, Artificial
  CRISPR gRNA sequence
agtgagaccctgtctccaaa

SEQ ID NO: 147334 - DNA, 20 bp, Artificial
  CRISPR gRNA sequence
gtgagaccctgtctccaaaa

SEQ ID NO: 147335 - DNA, 20 bp, Artificial
  CRISPR gRNA sequence
tccaaaaaggaaaaaaaaaa

SEQ ID NO: 147336 - DNA, 20 bp, Artificial
  CRISPR gRNA sequence
aggaaaaaaaaaaaagaaaa

SEQ ID NO: 147337 - DNA, 20 bp, Artificial
  CRISPR gRNA sequence
aaaaaagaaaaaagataaaa

SEQ ID NO: 147338 - DNA, 20 bp, Artificial
  CRISPR gRNA sequence
aaaaagaaaaaagataaaaa

SEQ ID NO: 147339 - DNA, 20 bp, Artificial
  CRISPR gRNA sequence
agaaaaaagataaaaaagga

SEQ ID NO: 147340 - DNA, 20 bp, Artificial
  CRISPR gRNA sequence
catcctgtcacatgcttcaa

SEQ ID NO: 147341 - DNA, 20 bp, Artificial
  CRISPR gRNA sequence
catgcttcaacagacatgct

SEQ ID NO: 147342 - DNA, 20 bp, Artificial
  CRISPR gRNA sequence
acagacatgctaagtgaaat

SEQ ID NO: 147343 - DNA, 20 bp, Artificial
  CRISPR gRNA sequence
catgctaagtgaaataagat

SEQ ID NO: 147344 - DNA, 20 bp, Artificial
  CRISPR gRNA sequence
gtgaaataagataagacaaa

SEQ ID NO: 147345 - DNA, 20 bp, Artificial
  CRISPR gRNA sequence
ataagacaaaaagacaaata

SEQ ID NO: 147346 - DNA, 20 bp, Artificial
  CRISPR gRNA sequence
agatgttgttctacttacaa

SEQ ID NO: 147347 - DNA, 20 bp, Artificial
  CRISPR gRNA sequence
gatgttgttctacttacaat

SEQ ID NO: 147348 - DNA, 20 bp, Artificial
  CRISPR gRNA sequence
atgttgttctacttacaatg

SEQ ID NO: 147349 - DNA, 20 bp, Artificial
  CRISPR gRNA sequence
aatggggttacatcctgata

SEQ ID NO: 147350 - DNA, 20 bp, Artificial
  CRISPR gRNA sequence
atcctgataaagctattgtt

SEQ ID NO: 147351 - DNA, 20 bp, Artificial
  CRISPR gRNA sequence
aaagctattgttaagttgaa

SEQ ID NO: 147352 - DNA, 20 bp, Artificial
  CRISPR gRNA sequence
tgttaagttgaaaagatcct

SEQ ID NO: 147353 - DNA, 20 bp, Artificial
  CRISPR gRNA sequence
gaaaatgcatttactacacc

SEQ ID NO: 147354 - DNA, 20 bp, Artificial
  CRISPR gRNA sequence
acctagcctatcaaacatca

SEQ ID NO: 147355 - DNA, 20 bp, Artificial
  CRISPR gRNA sequence
gcctatcaaacatcatagtt

SEQ ID NO: 147356 - DNA, 20 bp, Artificial
  CRISPR gRNA sequence
tcgcccaccttaaatgtgct

SEQ ID NO: 147357 - DNA, 20 bp, Artificial
  CRISPR gRNA sequence
tgtgctcagaacacttacat

SEQ ID NO: 147358 - DNA, 20 bp, Artificial
  CRISPR gRNA sequence
agaacacttacattagccta

SEQ ID NO: 147359 - DNA, 20 bp, Artificial
  CRISPR gRNA sequence
cacttacattagcctaaagt

SEQ ID NO: 147360 - DNA, 20 bp, Artificial
  CRISPR gRNA sequence
acttacattagcctaaagtt

SEQ ID NO: 147361 - DNA, 20 bp, Artificial
  CRISPR gRNA sequence
ataacacaaaccctatttta

SEQ ID NO: 147362 - DNA, 20 bp, Artificial
  CRISPR gRNA sequence
acaaaccctattttatagta

SEQ ID NO: 147363 - DNA, 20 bp, Artificial
  CRISPR gRNA sequence
ctattttatagtaaagtgtt

SEQ ID NO: 147364 - DNA, 20 bp, Artificial
  CRISPR gRNA sequence
tctcataatttattgaatac

SEQ ID NO: 147365 - DNA, 20 bp, Artificial
  CRISPR gRNA sequence
tttattgaatactagattga

SEQ ID NO: 147366 - DNA, 20 bp, Artificial
  CRISPR gRNA sequence
actagattgaaagcgaaaaa

SEQ ID NO: 147367 - DNA, 20 bp, Artificial
  CRISPR gRNA sequence
attgaaagcgaaaaacagaa

SEQ ID NO: 147368 - DNA, 20 bp, Artificial
  CRISPR gRNA sequence
cgaaaaacagaatggttgaa

SEQ ID NO: 147369 - DNA, 20 bp, Artificial
  CRISPR gRNA sequence
gaaaaacagaatggttgaat

SEQ ID NO: 147370 - DNA, 20 bp, Artificial
  CRISPR gRNA sequence
aatggttgaatgggtactca

SEQ ID NO: 147371 - DNA, 20 bp, Artificial
  CRISPR gRNA sequence
atcgttttctaaccactgta

SEQ ID NO: 147372 - DNA, 20 bp, Artificial
  CRISPR gRNA sequence
gttttctaaccactgtaaag

SEQ ID NO: 147373 - DNA, 20 bp, Artificial
  CRISPR gRNA sequence
taaagtggaaaaaaaacatt

SEQ ID NO: 147374 - DNA, 20 bp, Artificial
  CRISPR gRNA sequence
acattaagttgaatcattgt

SEQ ID NO: 147375 - DNA, 20 bp, Artificial
  CRISPR gRNA sequence
ttaagttgaatcattgtaag

SEQ ID NO: 147376 - DNA, 20 bp, Artificial
  CRISPR gRNA sequence
taagttgaatcattgtaagt

SEQ ID NO: 147377 - DNA, 20 bp, Artificial
  CRISPR gRNA sequence
aagttgaatcattgtaagta

SEQ ID NO: 147378 - DNA, 20 bp, Artificial
  CRISPR gRNA sequence
agttgaatcattgtaagtag

SEQ ID NO: 147379 - DNA, 20 bp, Artificial
  CRISPR gRNA sequence
cgatatgatcccacttctat

SEQ ID NO: 147380 - DNA, 20 bp, Artificial
  CRISPR gRNA sequence
gatatgatcccacttctatg

SEQ ID NO: 147381 - DNA, 20 bp, Artificial
  CRISPR gRNA sequence
cttctatgaggtatcaaaaa

SEQ ID NO: 147382 - DNA, 20 bp, Artificial
  CRISPR gRNA sequence
atcaaaaatagtcaaattca

SEQ ID NO: 147383 - DNA, 20 bp, Artificial
  CRISPR gRNA sequence
aaaatagtcaaattcataga

SEQ ID NO: 147384 - DNA, 20 bp, Artificial
  CRISPR gRNA sequence
atagtcaaattcatagaaag

SEQ ID NO: 147385 - DNA, 20 bp, Artificial
  CRISPR gRNA sequence
caaattcatagaaagcagaa

SEQ ID NO: 147386 - DNA, 20 bp, Artificial
  CRISPR gRNA sequence
attcatagaaagcagaatgg

SEQ ID NO: 147387 - DNA, 20 bp, Artificial
  CRISPR gRNA sequence
cagaatggtggctgtttatt

SEQ ID NO: 147388 - DNA, 20 bp, Artificial
  CRISPR gRNA sequence
gtggctgtttattgagtgca

SEQ ID NO: 147389 - DNA, 20 bp, Artificial
  CRISPR gRNA sequence
gtttattgagtgcacagttt

SEQ ID NO: 147390 - DNA, 20 bp, Artificial
  CRISPR gRNA sequence
tgcaatatgaaaaaattctc

SEQ ID NO: 147391 - DNA, 20 bp, Artificial
  CRISPR gRNA sequence
gcaatatgaaaaaattctca

SEQ ID NO: 147392 - DNA, 20 bp, Artificial
  CRISPR gRNA sequence
tatgaaaaaattctcaaggt

SEQ ID NO: 147393 - DNA, 20 bp, Artificial
  CRISPR gRNA sequence
ctgaactgtacatttaaaaa

SEQ ID NO: 147394 - DNA, 20 bp, Artificial
  CRISPR gRNA sequence
ctgtacatttaaaaatggat

SEQ ID NO: 147395 - DNA, 20 bp, Artificial
  CRISPR gRNA sequence
tgtacatttaaaaatggata

SEQ ID NO: 147396 - DNA, 20 bp, Artificial
  CRISPR gRNA sequence
gtacatttaaaaatggataa

SEQ ID NO: 147397 - DNA, 20 bp, Artificial
  CRISPR gRNA sequence
tacatttaaaaatggataag

SEQ ID NO: 147398 - DNA, 20 bp, Artificial
  CRISPR gRNA sequence
ctaaaaaaaaaaaaaaatca

SEQ ID NO: 147399 - DNA, 20 bp, Artificial
  CRISPR gRNA sequence
aaaatcaaagtccaacaaaa

SEQ ID NO: 147400 - DNA, 20 bp, Artificial
  CRISPR gRNA sequence
caaagtccaacaaaacagaa

SEQ ID NO: 147401 - DNA, 20 bp, Artificial
  CRISPR gRNA sequence
tccaacaaaacagaaaagtt

SEQ ID NO: 147402 - DNA, 20 bp, Artificial
  CRISPR gRNA sequence
aaacagaaaagttaagtgct

SEQ ID NO: 147403 - DNA, 20 bp, Artificial
  CRISPR gRNA sequence
aagtgctgagcttaaacctc

SEQ ID NO: 147404 - DNA, 20 bp, Artificial
  CRISPR gRNA sequence
gtgctgagcttaaacctcca

SEQ ID NO: 147405 - DNA, 20 bp, Artificial
  CRISPR gRNA sequence
ttaaacctccagagtttatc

SEQ ID NO: 147406 - DNA, 20 bp, Artificial
  CRISPR gRNA sequence
tctggccacttgcctgatcc

SEQ ID NO: 147407 - DNA, 20 bp, Artificial
  CRISPR gRNA sequence
gatcctggatttatgcctct

SEQ ID NO: 147408 - DNA, 20 bp, Artificial
  CRISPR gRNA sequence
ggatttatgcctctcggctc

SEQ ID NO: 147409 - DNA, 20 bp, Artificial
  CRISPR gRNA sequence
atgcctctcggctcaagctg

SEQ ID NO: 147410 - DNA, 20 bp, Artificial
  CRISPR gRNA sequence
tctcggctcaagctgcggca

SEQ ID NO: 147411 - DNA, 20 bp, Artificial
  CRISPR gRNA sequence
gcggcacagacttgctcgat

SEQ ID NO: 147412 - DNA, 20 bp, Artificial
  CRISPR gRNA sequence
acagacttgctcgattggcc

SEQ ID NO: 147413 - DNA, 20 bp, Artificial
  CRISPR gRNA sequence
ggcctagtcccaccacaccc

SEQ ID NO: 147414 - DNA, 20 bp, Artificial
  CRISPR gRNA sequence
gcctagtcccaccacacccc

SEQ ID NO: 147415 - DNA, 20 bp, Artificial
  CRISPR gRNA sequence
agtcccaccacaccccagga

SEQ ID NO: 147416 - DNA, 20 bp, Artificial
  CRISPR gRNA sequence
gacagcattcattttacacc

SEQ ID NO: 147417 - DNA, 20 bp, Artificial
  CRISPR gRNA sequence
attttacaccaagctgaccc

SEQ ID NO: 147418 - DNA, 20 bp, Artificial
  CRISPR gRNA sequence
caagctgaccccagcaccaa

SEQ ID NO: 147419 - DNA, 20 bp, Artificial
  CRISPR gRNA sequence
ccccagcaccaaaagctgat

SEQ ID NO: 147420 - DNA, 20 bp, Artificial
  CRISPR gRNA sequence
aagctgataagcttaatcat

SEQ ID NO: 147421 - DNA, 20 bp, Artificial
  CRISPR gRNA sequence
ctcccttctctttcatatct

SEQ ID NO: 147422 - DNA, 20 bp, Artificial
  CRISPR gRNA sequence
cttctctttcatatctgaga

SEQ ID NO: 147423 - DNA, 20 bp, Artificial
  CRISPR gRNA sequence
ctttcatatctgagacagtt

SEQ ID NO: 147424 - DNA, 20 bp, Artificial
  CRISPR gRNA sequence
agtttagataactactacct

SEQ ID NO: 147425 - DNA, 20 bp, Artificial
  CRISPR gRNA sequence
ataactactaccttagactg

SEQ ID NO: 147426 - DNA, 20 bp, Artificial
  CRISPR gRNA sequence
actactaccttagactgcag

SEQ ID NO: 147427 - DNA, 20 bp, Artificial
  CRISPR gRNA sequence
tactaccttagactgcagaa

SEQ ID NO: 147428 - DNA, 20 bp, Artificial
  CRISPR gRNA sequence
actaccttagactgcagaag

SEQ ID NO: 147429 - DNA, 20 bp, Artificial
  CRISPR gRNA sequence
gaagaggaacaatgactttt

SEQ ID NO: 147430 - DNA, 20 bp, Artificial
  CRISPR gRNA sequence
gaggaacaatgacttttcag

SEQ ID NO: 147431 - DNA, 20 bp, Artificial
  CRISPR gRNA sequence
gtggaaatccactctgaacc

SEQ ID NO: 147432 - DNA, 20 bp, Artificial
  CRISPR gRNA sequence
tggaaatccactctgaaccc

SEQ ID NO: 147433 - DNA, 20 bp, Artificial
  CRISPR gRNA sequence
aatccactctgaacccaggc

SEQ ID NO: 147434 - DNA, 20 bp, Artificial
  CRISPR gRNA sequence
ctctgaacccaggccagtct

SEQ ID NO: 147435 - DNA, 20 bp, Artificial
  CRISPR gRNA sequence
gaacccaggccagtctgaga

SEQ ID NO: 147436 - DNA, 20 bp, Artificial
  CRISPR gRNA sequence
aacccaggccagtctgagaa

SEQ ID NO: 147437 - DNA, 20 bp, Artificial
  CRISPR gRNA sequence
aggccagtctgagaaaggct

SEQ ID NO: 147438 - DNA, 20 bp, Artificial
  CRISPR gRNA sequence
agtctgagaaaggctaagcc

SEQ ID NO: 147439 - DNA, 20 bp, Artificial
  CRISPR gRNA sequence
tcatataaacaaacatgacc

SEQ ID NO: 147440 - DNA, 20 bp, Artificial
  CRISPR gRNA sequence
atataaacaaacatgaccca

SEQ ID NO: 147441 - DNA, 20 bp, Artificial
  CRISPR gRNA sequence
tataaacaaacatgacccag

SEQ ID NO: 147442 - DNA, 20 bp, Artificial
  CRISPR gRNA sequence
tgaattactttttatccctg

SEQ ID NO: 147443 - DNA, 20 bp, Artificial
  CRISPR gRNA sequence
ttactttttatccctgaagt

SEQ ID NO: 147444 - DNA, 20 bp, Artificial
  CRISPR gRNA sequence
ctttttatccctgaagtcag

SEQ ID NO: 147445 - DNA, 20 bp, Artificial
  CRISPR gRNA sequence
tttttatccctgaagtcagt

SEQ ID NO: 147446 - DNA, 20 bp, Artificial
  CRISPR gRNA sequence
cagtgggcatttatcataat

SEQ ID NO: 147447 - DNA, 20 bp, Artificial
  CRISPR gRNA sequence
ttcattaattacttgtttat

SEQ ID NO: 147448 - DNA, 20 bp, Artificial
  CRISPR gRNA sequence
tgtttattagcctgtctcat

SEQ ID NO: 147449 - DNA, 20 bp, Artificial
  CRISPR gRNA sequence
catcagaatatatgttccat

SEQ ID NO: 147450 - DNA, 20 bp, Artificial
  CRISPR gRNA sequence
gcgcaatgatcctgtctgtc

SEQ ID NO: 147451 - DNA, 20 bp, Artificial
  CRISPR gRNA sequence
ctggttcattactgtatcca

SEQ ID NO: 147452 - DNA, 20 bp, Artificial
  CRISPR gRNA sequence
attactgtatccacagtatc

SEQ ID NO: 147453 - DNA, 20 bp, Artificial
  CRISPR gRNA sequence
tgtatccacagtatctagca

SEQ ID NO: 147454 - DNA, 20 bp, Artificial
  CRISPR gRNA sequence
cacagtatctagcatagcct

SEQ ID NO: 147455 - DNA, 20 bp, Artificial
  CRISPR gRNA sequence
gtatctagcatagccttagt

SEQ ID NO: 147456 - DNA, 20 bp, Artificial
  CRISPR gRNA sequence
agccttagttggtacataat

SEQ ID NO: 147457 - DNA, 20 bp, Artificial
  CRISPR gRNA sequence
gtacataataagtatttgtt

SEQ ID NO: 147458 - DNA, 20 bp, Artificial
  CRISPR gRNA sequence
ataaactgacattgtaacgt

SEQ ID NO: 147459 - DNA, 20 bp, Artificial
  CRISPR gRNA sequence
aactgacattgtaacgtcag

SEQ ID NO: 147460 - DNA, 20 bp, Artificial
  CRISPR gRNA sequence
cattgtaacgtcagaagtta

SEQ ID NO: 147461 - DNA, 20 bp, Artificial
  CRISPR gRNA sequence
attgtaacgtcagaagttaa

SEQ ID NO: 147462 - DNA, 20 bp, Artificial
  CRISPR gRNA sequence
agttaaaggtcactaacctt

SEQ ID NO: 147463 - DNA, 20 bp, Artificial
  CRISPR gRNA sequence
ttgcaacattaattctacat

SEQ ID NO: 147464 - DNA, 20 bp, Artificial
  CRISPR gRNA sequence
tgcaacattaattctacatc

SEQ ID NO: 147465 - DNA, 20 bp, Artificial
  CRISPR gRNA sequence
aacattaattctacatcagg

SEQ ID NO: 147466 - DNA, 20 bp, Artificial
  CRISPR gRNA sequence
acattaattctacatcagga

SEQ ID NO: 147467 - DNA, 20 bp, Artificial
  CRISPR gRNA sequence
ttctacatcaggaaggaatc

SEQ ID NO: 147468 - DNA, 20 bp, Artificial
  CRISPR gRNA sequence
gaatccagtgtctgctctgc

SEQ ID NO: 147469 - DNA, 20 bp, Artificial
  CRISPR gRNA sequence
aatccagtgtctgctctgcc

SEQ ID NO: 147470 - DNA, 20 bp, Artificial
  CRISPR gRNA sequence
tgtctgctctgccaggatgc

SEQ ID NO: 147471 - DNA, 20 bp, Artificial
  CRISPR gRNA sequence
tgccaggatgctagtatttc

SEQ ID NO: 147472 - DNA, 20 bp, Artificial
  CRISPR gRNA sequence
gccaggatgctagtatttcc

SEQ ID NO: 147473 - DNA, 20 bp, Artificial
  CRISPR gRNA sequence
ccaggatgctagtatttcca

SEQ ID NO: 147474 - DNA, 20 bp, Artificial
  CRISPR gRNA sequence
ggatgctagtatttccaggg

SEQ ID NO: 147475 - DNA, 20 bp, Artificial
  CRISPR gRNA sequence
gatgctagtatttccagggc

SEQ ID NO: 147476 - DNA, 20 bp, Artificial
  CRISPR gRNA sequence
tttccagggcaggaatgaca

SEQ ID NO: 147477 - DNA, 20 bp, Artificial
  CRISPR gRNA sequence
caggaatgacacagccaaca

SEQ ID NO: 147478 - DNA, 20 bp, Artificial
  CRISPR gRNA sequence
aggaatgacacagccaacat

SEQ ID NO: 147479 - DNA, 20 bp, Artificial
  CRISPR gRNA sequence
ggaatgacacagccaacatg

SEQ ID NO: 147480 - DNA, 20 bp, Artificial
  CRISPR gRNA sequence
aatgacacagccaacatggg

SEQ ID NO: 147481 - DNA, 20 bp, Artificial
  CRISPR gRNA sequence
gccaacatggggagctcctt

SEQ ID NO: 147482 - DNA, 20 bp, Artificial
  CRISPR gRNA sequence
cttaatgaacattcttcatt

SEQ ID NO: 147483 - DNA, 20 bp, Artificial
  CRISPR gRNA sequence
ttaatgaacattcttcatta

SEQ ID NO: 147484 - DNA, 20 bp, Artificial
  CRISPR gRNA sequence
ctcaacctccactaaacaca

SEQ ID NO: 147485 - DNA, 20 bp, Artificial
  CRISPR gRNA sequence
actaaacacacagtaacctc

SEQ ID NO: 147486 - DNA, 20 bp, Artificial
  CRISPR gRNA sequence
ctaaacacacagtaacctcc

SEQ ID NO: 147487 - DNA, 20 bp, Artificial
  CRISPR gRNA sequence
cttgatgttcccctaactac

SEQ ID NO: 147488 - DNA, 20 bp, Artificial
  CRISPR gRNA sequence
ttgatgttcccctaactaca

SEQ ID NO: 147489 - DNA, 20 bp, Artificial
  CRISPR gRNA sequence
cctaactacaaggtcctctc

SEQ ID NO: 147490 - DNA, 20 bp, Artificial
  CRISPR gRNA sequence
ctaactacaaggtcctctct

SEQ ID NO: 147491 - DNA, 20 bp, Artificial
  CRISPR gRNA sequence
gccctcccatccttcacatc

SEQ ID NO: 147492 - DNA, 20 bp, Artificial
  CRISPR gRNA sequence
tgaatgcttactcatatttt

SEQ ID NO: 147493 - DNA, 20 bp, Artificial
  CRISPR gRNA sequence
tccctttacttaaactcaac

SEQ ID NO: 147494 - DNA, 20 bp, Artificial
  CRISPR gRNA sequence
tttacttaaactcaaccaga

SEQ ID NO: 147495 - DNA, 20 bp, Artificial
  CRISPR gRNA sequence
aaactcaaccagaaagaatc

SEQ ID NO: 147496 - DNA, 20 bp, Artificial
  CRISPR gRNA sequence
ctccttgacttttactgctt

SEQ ID NO: 147497 - DNA, 20 bp, Artificial
  CRISPR gRNA sequence
tccttgacttttactgcttc

SEQ ID NO: 147498 - DNA, 20 bp, Artificial
  CRISPR gRNA sequence
actcatcactgtgcctgatt

SEQ ID NO: 147499 - DNA, 20 bp, Artificial
  CRISPR gRNA sequence
atcactgtgcctgattcagt

SEQ ID NO: 147500 - DNA, 20 bp, Artificial
  CRISPR gRNA sequence
tgcctgattcagtaagtact

SEQ ID NO: 147501 - DNA, 20 bp, Artificial
  CRISPR gRNA sequence
acctactgactaaattattc

SEQ ID NO: 147502 - DNA, 20 bp, Artificial
  CRISPR gRNA sequence
attattctggttgtaattac

SEQ ID NO: 147503 - DNA, 20 bp, Artificial
  CRISPR gRNA sequence
ggttgtaattactagattgt

SEQ ID NO: 147504 - DNA, 20 bp, Artificial
  CRISPR gRNA sequence
actagattgtaagctcctca

SEQ ID NO: 147505 - DNA, 20 bp, Artificial
  CRISPR gRNA sequence
ctagattgtaagctcctcac

SEQ ID NO: 147506 - DNA, 20 bp, Artificial
  CRISPR gRNA sequence
ttgtaagctcctcacaggcc

SEQ ID NO: 147507 - DNA, 20 bp, Artificial
  CRISPR gRNA sequence
tgtaagctcctcacaggccg

SEQ ID NO: 147508 - DNA, 20 bp, Artificial
  CRISPR gRNA sequence
aggttatatttaattattct

SEQ ID NO: 147509 - DNA, 20 bp, Artificial
  CRISPR gRNA sequence
tatatttaattattctgagt

SEQ ID NO: 147510 - DNA, 20 bp, Artificial
  CRISPR gRNA sequence
atttaattattctgagtcag

SEQ ID NO: 147511 - DNA, 20 bp, Artificial
  CRISPR gRNA sequence
ctgagtcagtagttctcaac

SEQ ID NO: 147512 - DNA, 20 bp, Artificial
  CRISPR gRNA sequence
tgagtcagtagttctcaaca

SEQ ID NO: 147513 - DNA, 20 bp, Artificial
  CRISPR gRNA sequence
gagtcagtagttctcaacaa

SEQ ID NO: 147514 - DNA, 20 bp, Artificial
  CRISPR gRNA sequence
caagggatgatttttgccca

SEQ ID NO: 147515 - DNA, 20 bp, Artificial
  CRISPR gRNA sequence
aagggatgatttttgcccat

SEQ ID NO: 147516 - DNA, 20 bp, Artificial
  CRISPR gRNA sequence
agggatgatttttgcccatg

SEQ ID NO: 147517 - DNA, 20 bp, Artificial
  CRISPR gRNA sequence
tggggacatttgccaatgtc

SEQ ID NO: 147518 - DNA, 20 bp, Artificial
  CRISPR gRNA sequence
gggacatttgccaatgtctg

SEQ ID NO: 147519 - DNA, 20 bp, Artificial
  CRISPR gRNA sequence
caatgtctggagacattttc

SEQ ID NO: 147520 - DNA, 20 bp, Artificial
  CRISPR gRNA sequence
attttctggttgtcacaact

SEQ ID NO: 147521 - DNA, 20 bp, Artificial
  CRISPR gRNA sequence
ttttctggttgtcacaactc

SEQ ID NO: 147522 - DNA, 20 bp, Artificial
  CRISPR gRNA sequence
tttctggttgtcacaactcg

SEQ ID NO: 147523 - DNA, 20 bp, Artificial
  CRISPR gRNA sequence
tctggttgtcacaactcggg

SEQ ID NO: 147524 - DNA, 20 bp, Artificial
  CRISPR gRNA sequence
ctggttgtcacaactcgggg

SEQ ID NO: 147525 - DNA, 20 bp, Artificial
  CRISPR gRNA sequence
tggttgtcacaactcgggga

SEQ ID NO: 147526 - DNA, 20 bp, Artificial
  CRISPR gRNA sequence
ggttgtcacaactcggggag

SEQ ID NO: 147527 - DNA, 20 bp, Artificial
  CRISPR gRNA sequence
aactcggggaggggtgctac

SEQ ID NO: 147528 - DNA, 20 bp, Artificial
  CRISPR gRNA sequence
ggaggggtgctactggcatc

SEQ ID NO: 147529 - DNA, 20 bp, Artificial
  CRISPR gRNA sequence
gggtgctactggcatctagt

SEQ ID NO: 147530 - DNA, 20 bp, Artificial
  CRISPR gRNA sequence
tgctactggcatctagtgag

SEQ ID NO: 147531 - DNA, 20 bp, Artificial
  CRISPR gRNA sequence
ctactggcatctagtgagta

SEQ ID NO: 147532 - DNA, 20 bp, Artificial
  CRISPR gRNA sequence
tactggcatctagtgagtag

SEQ ID NO: 147533 - DNA, 20 bp, Artificial
  CRISPR gRNA sequence
ggcatctagtgagtagaggc

SEQ ID NO: 147534 - DNA, 20 bp, Artificial
  CRISPR gRNA sequence
gcatctagtgagtagaggct

SEQ ID NO: 147535 - DNA, 20 bp, Artificial
  CRISPR gRNA sequence
catctagtgagtagaggcta

SEQ ID NO: 147536 - DNA, 20 bp, Artificial
  CRISPR gRNA sequence
atctagtgagtagaggctag

SEQ ID NO: 147537 - DNA, 20 bp, Artificial
  CRISPR gRNA sequence
ctaaacatgctgttatgcat

SEQ ID NO: 147538 - DNA, 20 bp, Artificial
  CRISPR gRNA sequence
acatgctgttatgcataaga

SEQ ID NO: 147539 - DNA, 20 bp, Artificial
  CRISPR gRNA sequence
taagacggcccctcacaaca

SEQ ID NO: 147540 - DNA, 20 bp, Artificial
  CRISPR gRNA sequence
cctcacaacaaagaattatc

SEQ ID NO: 147541 - DNA, 20 bp, Artificial
  CRISPR gRNA sequence
ggcccaaaatgtcaataatg

SEQ ID NO: 147542 - DNA, 20 bp, Artificial
  CRISPR gRNA sequence
atgtcaataatgcagctgtt

SEQ ID NO: 147543 - DNA, 20 bp, Artificial
  CRISPR gRNA sequence
ctgttgagaaactgcgatca

SEQ ID NO: 147544 - DNA, 20 bp, Artificial
  CRISPR gRNA sequence
aagtatatctttttaacacc

SEQ ID NO: 147545 - DNA, 20 bp, Artificial
  CRISPR gRNA sequence
atatctttttaacacctaga

SEQ ID NO: 147546 - DNA, 20 bp, Artificial
  CRISPR gRNA sequence
atctttttaacacctagaaa

SEQ ID NO: 147547 - DNA, 20 bp, Artificial
  CRISPR gRNA sequence
aaagagttcctgactcacaa

SEQ ID NO: 147548 - DNA, 20 bp, Artificial
  CRISPR gRNA sequence
ttgttgaataaattgcccaa

SEQ ID NO: 147549 - DNA, 20 bp, Artificial
  CRISPR gRNA sequence
attgcccaatagtttttacc

SEQ ID NO: 147550 - DNA, 20 bp, Artificial
  CRISPR gRNA sequence
caatagtttttaccaagttc

SEQ ID NO: 147551 - DNA, 20 bp, Artificial
  CRISPR gRNA sequence
accaagttctagaaatgtcg

SEQ ID NO: 147552 - DNA, 20 bp, Artificial
  CRISPR gRNA sequence
ccaagttctagaaatgtcgt

SEQ ID NO: 147553 - DNA, 20 bp, Artificial
  CRISPR gRNA sequence
caagttctagaaatgtcgta

SEQ ID NO: 147554 - DNA, 20 bp, Artificial
  CRISPR gRNA sequence
atgtcgtagggccactaaat

SEQ ID NO: 147555 - DNA, 20 bp, Artificial
  CRISPR gRNA sequence
tgtcgtagggccactaaatc

SEQ ID NO: 147556 - DNA, 20 bp, Artificial
  CRISPR gRNA sequence
taaatcaggcctaaaaaatt

SEQ ID NO: 147557 - DNA, 20 bp, Artificial
  CRISPR gRNA sequence
aggcctaaaaaattgagcta

SEQ ID NO: 147558 - DNA, 20 bp, Artificial
  CRISPR gRNA sequence
aaattgagctacagctactg

SEQ ID NO: 147559 - DNA, 20 bp, Artificial
  CRISPR gRNA sequence
aattgagctacagctactga

SEQ ID NO: 147560 - DNA, 20 bp, Artificial
  CRISPR gRNA sequence
tgagctacagctactgaagg

SEQ ID NO: 147561 - DNA, 20 bp, Artificial
  CRISPR gRNA sequence
tacagctactgaaggaagat

SEQ ID NO: 147562 - DNA, 20 bp, Artificial
  CRISPR gRNA sequence
tgagatctctgtttttctgt

SEQ ID NO: 147563 - DNA, 20 bp, Artificial
  CRISPR gRNA sequence
ctgtttttctgtaagtccta

SEQ ID NO: 147564 - DNA, 20 bp, Artificial
  CRISPR gRNA sequence
tgtttttctgtaagtcctaa

SEQ ID NO: 147565 - DNA, 20 bp, Artificial
  CRISPR gRNA sequence
cctcacattaaactacctcc

SEQ ID NO: 147566 - DNA, 20 bp, Artificial
  CRISPR gRNA sequence
attaaactacctccaagtca

SEQ ID NO: 147567 - DNA, 20 bp, Artificial
  CRISPR gRNA sequence
cactgcacaccacacgccta

SEQ ID NO: 147568 - DNA, 20 bp, Artificial
  CRISPR gRNA sequence
tgcacaccacacgcctatgg

SEQ ID NO: 147569 - DNA, 20 bp, Artificial
  CRISPR gRNA sequence
cacgcctatggaagaacact

SEQ ID NO: 147570 - DNA, 20 bp, Artificial
  CRISPR gRNA sequence
ggaagaacactgagatataa

SEQ ID NO: 147571 - DNA, 20 bp, Artificial
  CRISPR gRNA sequence
tgagatataaaagactcttg

SEQ ID NO: 147572 - DNA, 20 bp, Artificial
  CRISPR gRNA sequence
agactcttgcagttacctca

SEQ ID NO: 147573 - DNA, 20 bp, Artificial
  CRISPR gRNA sequence
ctcttgcagttacctcacgg

SEQ ID NO: 147574 - DNA, 20 bp, Artificial
  CRISPR gRNA sequence
tcttgcagttacctcacgga

SEQ ID NO: 147575 - DNA, 20 bp, Artificial
  CRISPR gRNA sequence
tgttttcattttcctaccca

SEQ ID NO: 147576 - DNA, 20 bp, Artificial
  CRISPR gRNA sequence
gttttcattttcctacccac

SEQ ID NO: 147577 - DNA, 20 bp, Artificial
  CRISPR gRNA sequence
tcattttcctacccacaggt

SEQ ID NO: 147578 - DNA, 20 bp, Artificial
  CRISPR gRNA sequence
cattttcctacccacaggtc

SEQ ID NO: 147579 - DNA, 20 bp, Artificial
  CRISPR gRNA sequence
attttcctacccacaggtca

SEQ ID NO: 147580 - DNA, 20 bp, Artificial
  CRISPR gRNA sequence
ttttcctacccacaggtcag

SEQ ID NO: 147581 - DNA, 20 bp, Artificial
  CRISPR gRNA sequence
gcttgaaattaaaaatgctt

SEQ ID NO: 147582 - DNA, 20 bp, Artificial
  CRISPR gRNA sequence
aattaaaaatgctttagtct

SEQ ID NO: 147583 - DNA, 20 bp, Artificial
  CRISPR gRNA sequence
aaatgctttagtctgagttt

SEQ ID NO: 147584 - DNA, 20 bp, Artificial
  CRISPR gRNA sequence
ctgagttttggttaatttcc

SEQ ID NO: 147585 - DNA, 20 bp, Artificial
  CRISPR gRNA sequence
gagttttggttaatttccca

SEQ ID NO: 147586 - DNA, 20 bp, Artificial
  CRISPR gRNA sequence
gagctctttatactctttaa

SEQ ID NO: 147587 - DNA, 20 bp, Artificial
  CRISPR gRNA sequence
tctttaaaagtttctaataa

SEQ ID NO: 147588 - DNA, 20 bp, Artificial
  CRISPR gRNA sequence
tcctcaccactgttaaattc

SEQ ID NO: 147589 - DNA, 20 bp, Artificial
  CRISPR gRNA sequence
ccggatttcttccatgaccc

SEQ ID NO: 147590 - DNA, 20 bp, Artificial
  CRISPR gRNA sequence
cggatttcttccatgacccg

SEQ ID NO: 147591 - DNA, 20 bp, Artificial
  CRISPR gRNA sequence
tttcttccatgacccgaggc

SEQ ID NO: 147592 - DNA, 20 bp, Artificial
  CRISPR gRNA sequence
acccgaggccagaacgactg

SEQ ID NO: 147593 - DNA, 20 bp, Artificial
  CRISPR gRNA sequence
cccgaggccagaacgactgt

SEQ ID NO: 147594 - DNA, 20 bp, Artificial
  CRISPR gRNA sequence
agaacgactgtaggctttgc

SEQ ID NO: 147595 - DNA, 20 bp, Artificial
  CRISPR gRNA sequence
gaacgactgtaggctttgct

SEQ ID NO: 147596 - DNA, 20 bp, Artificial
  CRISPR gRNA sequence
ttgctgggcatcactgctgc

SEQ ID NO: 147597 - DNA, 20 bp, Artificial
  CRISPR gRNA sequence
accaccaaatcctccttctg

SEQ ID NO: 147598 - DNA, 20 bp, Artificial
  CRISPR gRNA sequence
ctgaaaataaacacatacat

SEQ ID NO: 147599 - DNA, 20 bp, Artificial
  CRISPR gRNA sequence
aacacatacataagacacat

SEQ ID NO: 147600 - DNA, 20 bp, Artificial
  CRISPR gRNA sequence
aagacacattagaaacaata

SEQ ID NO: 147601 - DNA, 20 bp, Artificial
  CRISPR gRNA sequence
cacattagaaacaataaagt

SEQ ID NO: 147602 - DNA, 20 bp, Artificial
  CRISPR gRNA sequence
ataaagtcagactttctgtc

SEQ ID NO: 147603 - DNA, 20 bp, Artificial
  CRISPR gRNA sequence
gtcagactttctgtccagat

SEQ ID NO: 147604 - DNA, 20 bp, Artificial
  CRISPR gRNA sequence
tcagactttctgtccagatt

SEQ ID NO: 147605 - DNA, 20 bp, Artificial
  CRISPR gRNA sequence
attaggcatttgtatatttg

SEQ ID NO: 147606 - DNA, 20 bp, Artificial
  CRISPR gRNA sequence
tatgaatctattcaatcttt

SEQ ID NO: 147607 - DNA, 20 bp, Artificial
  CRISPR gRNA sequence
attcaatctttcagtttgat

SEQ ID NO: 147608 - DNA, 20 bp, Artificial
  CRISPR gRNA sequence
ttcaatctttcagtttgata

SEQ ID NO: 147609 - DNA, 20 bp, Artificial
  CRISPR gRNA sequence
aggtatataattacgctaaa

SEQ ID NO: 147610 - DNA, 20 bp, Artificial
  CRISPR gRNA sequence
acgctaaaaagattttaaca

SEQ ID NO: 147611 - DNA, 20 bp, Artificial
  CRISPR gRNA sequence
gacttacatcttaaaaacat

SEQ ID NO: 147612 - DNA, 20 bp, Artificial
  CRISPR gRNA sequence
ttacatcttaaaaacattgg

SEQ ID NO: 147613 - DNA, 20 bp, Artificial
  CRISPR gRNA sequence
tacatcttaaaaacattggt

SEQ ID NO: 147614 - DNA, 20 bp, Artificial
  CRISPR gRNA sequence
tcttaaaaacattggtagga

SEQ ID NO: 147615 - DNA, 20 bp, Artificial
  CRISPR gRNA sequence
ggaaagtttttccttctatc

SEQ ID NO: 147616 - DNA, 20 bp, Artificial
  CRISPR gRNA sequence
cttctatctagcttatacca

SEQ ID NO: 147617 - DNA, 20 bp, Artificial
  CRISPR gRNA sequence
tctatctagcttataccata

SEQ ID NO: 147618 - DNA, 20 bp, Artificial
  CRISPR gRNA sequence
ttataccatagagactactg

SEQ ID NO: 147619 - DNA, 20 bp, Artificial
  CRISPR gRNA sequence
gactactgaagacctccaac

SEQ ID NO: 147620 - DNA, 20 bp, Artificial
  CRISPR gRNA sequence
acctccaactagaatatcaa

SEQ ID NO: 147621 - DNA, 20 bp, Artificial
  CRISPR gRNA sequence
actagaatatcaaaagttgc

SEQ ID NO: 147622 - DNA, 20 bp, Artificial
  CRISPR gRNA sequence
tcaaaagttgctagaaatgt

SEQ ID NO: 147623 - DNA, 20 bp, Artificial
  CRISPR gRNA sequence
ctgaaatcctaatgttaatc

SEQ ID NO: 147624 - DNA, 20 bp, Artificial
  CRISPR gRNA sequence
tgaaatcctaatgttaatca

SEQ ID NO: 147625 - DNA, 20 bp, Artificial
  CRISPR gRNA sequence
aggacttttaacttcttata

SEQ ID NO: 147626 - DNA, 20 bp, Artificial
  CRISPR gRNA sequence
ggacttttaacttcttatat

SEQ ID NO: 147627 - DNA, 20 bp, Artificial
  CRISPR gRNA sequence
tttaacttcttatatgggtg

SEQ ID NO: 147628 - DNA, 20 bp, Artificial
  CRISPR gRNA sequence
ttaacttcttatatgggtgt

SEQ ID NO: 147629 - DNA, 20 bp, Artificial
  CRISPR gRNA sequence
taacttcttatatgggtgtg

SEQ ID NO: 147630 - DNA, 20 bp, Artificial
  CRISPR gRNA sequence
ttcttatatgggtgtggggt

SEQ ID NO: 147631 - DNA, 20 bp, Artificial
  CRISPR gRNA sequence
tcttatatgggtgtggggtg

SEQ ID NO: 147632 - DNA, 20 bp, Artificial
  CRISPR gRNA sequence
atatgggtgtggggtgagga

SEQ ID NO: 147633 - DNA, 20 bp, Artificial
  CRISPR gRNA sequence
aggaaagtactttgttgccc

SEQ ID NO: 147634 - DNA, 20 bp, Artificial
  CRISPR gRNA sequence
agtactttgttgccctagtc

SEQ ID NO: 147635 - DNA, 20 bp, Artificial
  CRISPR gRNA sequence
tttcaatgccattctttcca

SEQ ID NO: 147636 - DNA, 20 bp, Artificial
  CRISPR gRNA sequence
attctttccaaagctttttc

SEQ ID NO: 147637 - DNA, 20 bp, Artificial
  CRISPR gRNA sequence
aagctttttcaagttctctg

SEQ ID NO: 147638 - DNA, 20 bp, Artificial
  CRISPR gRNA sequence
gcttctcatcctccatgcca

SEQ ID NO: 147639 - DNA, 20 bp, Artificial
  CRISPR gRNA sequence
atcctccatgccacagcctt

SEQ ID NO: 147640 - DNA, 20 bp, Artificial
  CRISPR gRNA sequence
tcagcaaattcttatattaa

SEQ ID NO: 147641 - DNA, 20 bp, Artificial
  CRISPR gRNA sequence
attcttatattaaaagtccc

SEQ ID NO: 147642 - DNA, 20 bp, Artificial
  CRISPR gRNA sequence
tattaaaagtccccagtgat

SEQ ID NO: 147643 - DNA, 20 bp, Artificial
  CRISPR gRNA sequence
ccccagtgattagtactgta

SEQ ID NO: 147644 - DNA, 20 bp, Artificial
  CRISPR gRNA sequence
actgtacagaaatgtaaacc

SEQ ID NO: 147645 - DNA, 20 bp, Artificial
  CRISPR gRNA sequence
aaatgtaaacccagtcttaa

SEQ ID NO: 147646 - DNA, 20 bp, Artificial
  CRISPR gRNA sequence
aacccagtcttaaaagataa

SEQ ID NO: 147647 - DNA, 20 bp, Artificial
  CRISPR gRNA sequence
agtcttaaaagataaaagcc

SEQ ID NO: 147648 - DNA, 20 bp, Artificial
  CRISPR gRNA sequence
ttaaaagataaaagccaagc

SEQ ID NO: 147649 - DNA, 20 bp, Artificial
  CRISPR gRNA sequence
taaaagataaaagccaagct

SEQ ID NO: 147650 - DNA, 20 bp, Artificial
  CRISPR gRNA sequence
taaaagccaagctgggcaca

SEQ ID NO: 147651 - DNA, 20 bp, Artificial
  CRISPR gRNA sequence
aaaagccaagctgggcacaa

SEQ ID NO: 147652 - DNA, 20 bp, Artificial
  CRISPR gRNA sequence
ggcacaaaggtgcatgcctg

SEQ ID NO: 147653 - DNA, 20 bp, Artificial
  CRISPR gRNA sequence
aaggtgcatgcctgtggttc

SEQ ID NO: 147654 - DNA, 20 bp, Artificial
  CRISPR gRNA sequence
tgcctgtggttccagctact

SEQ ID NO: 147655 - DNA, 20 bp, Artificial
  CRISPR gRNA sequence
gcctgtggttccagctactc

SEQ ID NO: 147656 - DNA, 20 bp, Artificial
  CRISPR gRNA sequence
tgtggttccagctactcagg

SEQ ID NO: 147657 - DNA, 20 bp, Artificial
  CRISPR gRNA sequence
gtggttccagctactcagga

SEQ ID NO: 147658 - DNA, 20 bp, Artificial
  CRISPR gRNA sequence
ttccagctactcaggaaggt

SEQ ID NO: 147659 - DNA, 20 bp, Artificial
  CRISPR gRNA sequence
agctactcaggaaggtgagc

SEQ ID NO: 147660 - DNA, 20 bp, Artificial
  CRISPR gRNA sequence
gctactcaggaaggtgagcc

SEQ ID NO: 147661 - DNA, 20 bp, Artificial
  CRISPR gRNA sequence
tactcaggaaggtgagccag

SEQ ID NO: 147662 - DNA, 20 bp, Artificial
  CRISPR gRNA sequence
actcaggaaggtgagccagg

SEQ ID NO: 147663 - DNA, 20 bp, Artificial
  CRISPR gRNA sequence
ggtgagccaggaggatcact

SEQ ID NO: 147664 - DNA, 20 bp, Artificial
  CRISPR gRNA sequence
gtgagccaggaggatcactt

SEQ ID NO: 147665 - DNA, 20 bp, Artificial
  CRISPR gRNA sequence
caggaggatcacttgggccc

SEQ ID NO: 147666 - DNA, 20 bp, Artificial
  CRISPR gRNA sequence
ggaggatcacttgggcccaa

SEQ ID NO: 147667 - DNA, 20 bp, Artificial
  CRISPR gRNA sequence
tcacttgggcccaagagttc

SEQ ID NO: 147668 - DNA, 20 bp, Artificial
  CRISPR gRNA sequence
ttgggcccaagagttcaaga

SEQ ID NO: 147669 - DNA, 20 bp, Artificial
  CRISPR gRNA sequence
cccaagagttcaagacagcc

SEQ ID NO: 147670 - DNA, 20 bp, Artificial
  CRISPR gRNA sequence
ccaagagttcaagacagcct

SEQ ID NO: 147671 - DNA, 20 bp, Artificial
  CRISPR gRNA sequence
tcaagacagcctgggcaaca

SEQ ID NO: 147672 - DNA, 20 bp, Artificial
  CRISPR gRNA sequence
gacagcctgggcaacatagc

SEQ ID NO: 147673 - DNA, 20 bp, Artificial
  CRISPR gRNA sequence
aagcgtctgtctcttaaaaa

SEQ ID NO: 147674 - DNA, 20 bp, Artificial
  CRISPR gRNA sequence
gcgtctgtctcttaaaaaaa

SEQ ID NO: 147675 - DNA, 20 bp, Artificial
  CRISPR gRNA sequence
gtctgtctcttaaaaaaaga

SEQ ID NO: 147676 - DNA, 20 bp, Artificial
  CRISPR gRNA sequence
ctgtctcttaaaaaaagaga

SEQ ID NO: 147677 - DNA, 20 bp, Artificial
  CRISPR gRNA sequence
tgtctcttaaaaaaagagag

SEQ ID NO: 147678 - DNA, 20 bp, Artificial
  CRISPR gRNA sequence
gtctcttaaaaaaagagaga

SEQ ID NO: 147679 - DNA, 20 bp, Artificial
  CRISPR gRNA sequence
cttaaaaaaagagagagggc

SEQ ID NO: 147680 - DNA, 20 bp, Artificial
  CRISPR gRNA sequence
ttaaaaaaagagagagggcc

SEQ ID NO: 147681 - DNA, 20 bp, Artificial
  CRISPR gRNA sequence
aaaagagagagggccgggcg

SEQ ID NO: 147682 - DNA, 20 bp, Artificial
  CRISPR gRNA sequence
agagagagggccgggcgcgg

SEQ ID NO: 147683 - DNA, 20 bp, Artificial
  CRISPR gRNA sequence
gtggctcacgcctgtaatcc

SEQ ID NO: 147684 - DNA, 20 bp, Artificial
  CRISPR gRNA sequence
cgcctgtaatcccagcactt

SEQ ID NO: 147685 - DNA, 20 bp, Artificial
  CRISPR gRNA sequence
gcctgtaatcccagcacttt

SEQ ID NO: 147686 - DNA, 20 bp, Artificial
  CRISPR gRNA sequence
ctgtaatcccagcactttgg

SEQ ID NO: 147687 - DNA, 20 bp, Artificial
  CRISPR gRNA sequence
tgtaatcccagcactttggg

SEQ ID NO: 147688 - DNA, 20 bp, Artificial
  CRISPR gRNA sequence
tcccagcactttgggaggcc

SEQ ID NO: 147689 - DNA, 20 bp, Artificial
  CRISPR gRNA sequence
cccagcactttgggaggccg

SEQ ID NO: 147690 - DNA, 20 bp, Artificial
  CRISPR gRNA sequence
agcactttgggaggccgagg

SEQ ID NO: 147691 - DNA, 20 bp, Artificial
  CRISPR gRNA sequence
gcactttgggaggccgaggc

SEQ ID NO: 147692 - DNA, 20 bp, Artificial
  CRISPR gRNA sequence
ctttgggaggccgaggcggg

SEQ ID NO: 147693 - DNA, 20 bp, Artificial
  CRISPR gRNA sequence
ggccgaggcgggcggatcac

SEQ ID NO: 147694 - DNA, 20 bp, Artificial
  CRISPR gRNA sequence
gccgaggcgggcggatcaca

SEQ ID NO: 147695 - DNA, 20 bp, Artificial
  CRISPR gRNA sequence
aggcgggcggatcacaaggt

SEQ ID NO: 147696 - DNA, 20 bp, Artificial
  CRISPR gRNA sequence
ggcgggcggatcacaaggtc

SEQ ID NO: 147697 - DNA, 20 bp, Artificial
  CRISPR gRNA sequence
cgggcggatcacaaggtcag

SEQ ID NO: 147698 - DNA, 20 bp, Artificial
  CRISPR gRNA sequence
gatcacaaggtcaggagatc

SEQ ID NO: 147699 - DNA, 20 bp, Artificial
  CRISPR gRNA sequence
tcaggagatcgagaccatcc

SEQ ID NO: 147700 - DNA, 20 bp, Artificial
  CRISPR gRNA sequence
cgagaccatcctggctaaaa

SEQ ID NO: 147701 - DNA, 20 bp, Artificial
  CRISPR gRNA sequence
ctactaaaaatacaaaaaat

SEQ ID NO: 147702 - DNA, 20 bp, Artificial
  CRISPR gRNA sequence
taaaaatacaaaaaattagc

SEQ ID NO: 147703 - DNA, 20 bp, Artificial
  CRISPR gRNA sequence
aaaaatacaaaaaattagcc

SEQ ID NO: 147704 - DNA, 20 bp, Artificial
  CRISPR gRNA sequence
tacaaaaaattagccgggcg

SEQ ID NO: 147705 - DNA, 20 bp, Artificial
  CRISPR gRNA sequence
aaaaaattagccgggcgtag

SEQ ID NO: 147706 - DNA, 20 bp, Artificial
  CRISPR gRNA sequence
aaattagccgggcgtagtgg

SEQ ID NO: 147707 - DNA, 20 bp, Artificial
  CRISPR gRNA sequence
aattagccgggcgtagtggc

SEQ ID NO: 147708 - DNA, 20 bp, Artificial
  CRISPR gRNA sequence
ggcgtagtggcgggcgcctg

SEQ ID NO: 147709 - DNA, 20 bp, Artificial
  CRISPR gRNA sequence
gtggcgggcgcctgtagtcc

SEQ ID NO: 147710 - DNA, 20 bp, Artificial
  CRISPR gRNA sequence
cgcctgtagtcccagctact

SEQ ID NO: 147711 - DNA, 20 bp, Artificial
  CRISPR gRNA sequence
gcctgtagtcccagctactt

SEQ ID NO: 147712 - DNA, 20 bp, Artificial
  CRISPR gRNA sequence
ctgtagtcccagctacttgg

SEQ ID NO: 147713 - DNA, 20 bp, Artificial
  CRISPR gRNA sequence
tgtagtcccagctacttggg

SEQ ID NO: 147714 - DNA, 20 bp, Artificial
  CRISPR gRNA sequence
tcccagctacttgggaggct

SEQ ID NO: 147715 - DNA, 20 bp, Artificial
  CRISPR gRNA sequence
cccagctacttgggaggctg

SEQ ID NO: 147716 - DNA, 20 bp, Artificial
  CRISPR gRNA sequence
agctacttgggaggctgagg

SEQ ID NO: 147717 - DNA, 20 bp, Artificial
  CRISPR gRNA sequence
gctacttgggaggctgaggc

SEQ ID NO: 147718 - DNA, 20 bp, Artificial
  CRISPR gRNA sequence
tacttgggaggctgaggcag

SEQ ID NO: 147719 - DNA, 20 bp, Artificial
  CRISPR gRNA sequence
gggaggctgaggcaggagaa

SEQ ID NO: 147720 - DNA, 20 bp, Artificial
  CRISPR gRNA sequence
gcaggagaatggcgtgaacc

SEQ ID NO: 147721 - DNA, 20 bp, Artificial
  CRISPR gRNA sequence
caggagaatggcgtgaaccc

SEQ ID NO: 147722 - DNA, 20 bp, Artificial
  CRISPR gRNA sequence
ggagaatggcgtgaacccgg

SEQ ID NO: 147723 - DNA, 20 bp, Artificial
  CRISPR gRNA sequence
gagaatggcgtgaacccggg

SEQ ID NO: 147724 - DNA, 20 bp, Artificial
  CRISPR gRNA sequence
aatggcgtgaacccgggagg

SEQ ID NO: 147725 - DNA, 20 bp, Artificial
  CRISPR gRNA sequence
tggcgtgaacccgggaggcg

SEQ ID NO: 147726 - DNA, 20 bp, Artificial
  CRISPR gRNA sequence
aacccgggaggcggagcttg

SEQ ID NO: 147727 - DNA, 20 bp, Artificial
  CRISPR gRNA sequence
cgggaggcggagcttgcagt

SEQ ID NO: 147728 - DNA, 20 bp, Artificial
  CRISPR gRNA sequence
ggcggagcttgcagtgagcc

SEQ ID NO: 147729 - DNA, 20 bp, Artificial
  CRISPR gRNA sequence
gagatcccgccactgcactc

SEQ ID NO: 147730 - DNA, 20 bp, Artificial
  CRISPR gRNA sequence
cccgccactgcactccagcc

SEQ ID NO: 147731 - DNA, 20 bp, Artificial
  CRISPR gRNA sequence
ccgccactgcactccagcct

SEQ ID NO: 147732 - DNA, 20 bp, Artificial
  CRISPR gRNA sequence
ctgcactccagcctgggcga

SEQ ID NO: 147733 - DNA, 20 bp, Artificial
  CRISPR gRNA sequence
gcactccagcctgggcgaca

SEQ ID NO: 147734 - DNA, 20 bp, Artificial
  CRISPR gRNA sequence
tccagcctgggcgacagagc

SEQ ID NO: 147735 - DNA, 20 bp, Artificial
  CRISPR gRNA sequence
ctcaaaaaaaaaaaaaaaaa

SEQ ID NO: 147736 - DNA, 20 bp, Artificial
  CRISPR gRNA sequence
caaaaaaaaaaaaaaaaaaa

SEQ ID NO: 147737 - DNA, 20 bp, Artificial
  CRISPR gRNA sequence
aaaaaaaaaaaaaaaaaaga

SEQ ID NO: 147738 - DNA, 20 bp, Artificial
  CRISPR gRNA sequence
aaaaaaaaaaaaaaaagaga

SEQ ID NO: 147739 - DNA, 20 bp, Artificial
  CRISPR gRNA sequence
aaaaaaaaaaaaaagagaga

SEQ ID NO: 147740 - DNA, 20 bp, Artificial
  CRISPR gRNA sequence
aaaaagagagagagcacgct

SEQ ID NO: 147741 - DNA, 20 bp, Artificial
  CRISPR gRNA sequence
ctaagtttcttcttttgttt

SEQ ID NO: 147742 - DNA, 20 bp, Artificial
  CRISPR gRNA sequence
acactgtgatcctgtttctc

SEQ ID NO: 147743 - DNA, 20 bp, Artificial
  CRISPR gRNA sequence
cactgtgatcctgtttctct

SEQ ID NO: 147744 - DNA, 20 bp, Artificial
  CRISPR gRNA sequence
actgtgatcctgtttctctg

SEQ ID NO: 147745 - DNA, 20 bp, Artificial
  CRISPR gRNA sequence
atgattattccttctaatct

SEQ ID NO: 147746 - DNA, 20 bp, Artificial
  CRISPR gRNA sequence
tctcagacaaatctgtctca

SEQ ID NO: 147747 - DNA, 20 bp, Artificial
  CRISPR gRNA sequence
ctcagacaaatctgtctcaa

SEQ ID NO: 147748 - DNA, 20 bp, Artificial
  CRISPR gRNA sequence
aaatctgtctcaaaggacat

SEQ ID NO: 147749 - DNA, 20 bp, Artificial
  CRISPR gRNA sequence
aatctgtctcaaaggacatg

SEQ ID NO: 147750 - DNA, 20 bp, Artificial
  CRISPR gRNA sequence
acatgaggccattaactgtg

SEQ ID NO: 147751 - DNA, 20 bp, Artificial
  CRISPR gRNA sequence
catgaggccattaactgtgt

SEQ ID NO: 147752 - DNA, 20 bp, Artificial
  CRISPR gRNA sequence
ttaactgtgtaggtaacatg

SEQ ID NO: 147753 - DNA, 20 bp, Artificial
  CRISPR gRNA sequence
cctgaaatgaaactacttgc

SEQ ID NO: 147754 - DNA, 20 bp, Artificial
  CRISPR gRNA sequence
aaactacttgccagttcgcc

SEQ ID NO: 147755 - DNA, 20 bp, Artificial
  CRISPR gRNA sequence
ttaaccatgttattaaacac

SEQ ID NO: 147756 - DNA, 20 bp, Artificial
  CRISPR gRNA sequence
tattaaacacaagcctaaca

SEQ ID NO: 147757 - DNA, 20 bp, Artificial
  CRISPR gRNA sequence
acaagcctaacacagcacac

SEQ ID NO: 147758 - DNA, 20 bp, Artificial
  CRISPR gRNA sequence
taacacagcacactggcaac

SEQ ID NO: 147759 - DNA, 20 bp, Artificial
  CRISPR gRNA sequence
cacagcacactggcaactgg

SEQ ID NO: 147760 - DNA, 20 bp, Artificial
  CRISPR gRNA sequence
actggcaactggaagcctta

SEQ ID NO: 147761 - DNA, 20 bp, Artificial
  CRISPR gRNA sequence
gcaactggaagccttaaaga

SEQ ID NO: 147762 - DNA, 20 bp, Artificial
  CRISPR gRNA sequence
taaagacagttaaaaaaacg

SEQ ID NO: 147763 - DNA, 20 bp, Artificial
  CRISPR gRNA sequence
aaagacagttaaaaaaacga

SEQ ID NO: 147764 - DNA, 20 bp, Artificial
  CRISPR gRNA sequence
agacagttaaaaaaacgaag

SEQ ID NO: 147765 - DNA, 20 bp, Artificial
  CRISPR gRNA sequence
acagttaaaaaaacgaagga

SEQ ID NO: 147766 - DNA, 20 bp, Artificial
  CRISPR gRNA sequence
cagttaaaaaaacgaaggag

SEQ ID NO: 147767 - DNA, 20 bp, Artificial
  CRISPR gRNA sequence
taaaaaaacgaaggagaggc

SEQ ID NO: 147768 - DNA, 20 bp, Artificial
  CRISPR gRNA sequence
aaaaaaacgaaggagaggcc

SEQ ID NO: 147769 - DNA, 20 bp, Artificial
  CRISPR gRNA sequence
aacgaaggagaggccaggtg

SEQ ID NO: 147770 - DNA, 20 bp, Artificial
  CRISPR gRNA sequence
gaaggagaggccaggtgcgg

SEQ ID NO: 147771 - DNA, 20 bp, Artificial
  CRISPR gRNA sequence
tgcctgtaatccaaacactc

SEQ ID NO: 147772 - DNA, 20 bp, Artificial
  CRISPR gRNA sequence
gcctgtaatccaaacactct

SEQ ID NO: 147773 - DNA, 20 bp, Artificial
  CRISPR gRNA sequence
tgtaatccaaacactctggg

SEQ ID NO: 147774 - DNA, 20 bp, Artificial
  CRISPR gRNA sequence
tccaaacactctgggaagcc

SEQ ID NO: 147775 - DNA, 20 bp, Artificial
  CRISPR gRNA sequence
ccaaacactctgggaagccg

SEQ ID NO: 147776 - DNA, 20 bp, Artificial
  CRISPR gRNA sequence
aacactctgggaagccgagg

SEQ ID NO: 147777 - DNA, 20 bp, Artificial
  CRISPR gRNA sequence
acactctgggaagccgaggc

SEQ ID NO: 147778 - DNA, 20 bp, Artificial
  CRISPR gRNA sequence
ctctgggaagccgaggcagg

SEQ ID NO: 147779 - DNA, 20 bp, Artificial
  CRISPR gRNA sequence
ccgaggcaggtggatcacct

SEQ ID NO: 147780 - DNA, 20 bp, Artificial
  CRISPR gRNA sequence
cgaggcaggtggatcacctg

SEQ ID NO: 147781 - DNA, 20 bp, Artificial
  CRISPR gRNA sequence
ggtggatcacctgaggtcaa

SEQ ID NO: 147782 - DNA, 20 bp, Artificial
  CRISPR gRNA sequence
tcacctgaggtcaaaagttc

SEQ ID NO: 147783 - DNA, 20 bp, Artificial
  CRISPR gRNA sequence
tgaggtcaaaagttcgagac

SEQ ID NO: 147784 - DNA, 20 bp, Artificial
  CRISPR gRNA sequence
tcaaaagttcgagaccagcc

SEQ ID NO: 147785 - DNA, 20 bp, Artificial
  CRISPR gRNA sequence
caaaagttcgagaccagcct

SEQ ID NO: 147786 - DNA, 20 bp, Artificial
  CRISPR gRNA sequence
cgagaccagcctgggcaaca

SEQ ID NO: 147787 - DNA, 20 bp, Artificial
  CRISPR gRNA sequence
tctactaaaaatacaaaaat

SEQ ID NO: 147788 - DNA, 20 bp, Artificial
  CRISPR gRNA sequence
ctaaaaatacaaaaattagc

SEQ ID NO: 147789 - DNA, 20 bp, Artificial
  CRISPR gRNA sequence
taaaaatacaaaaattagcc

SEQ ID NO: 147790 - DNA, 20 bp, Artificial
  CRISPR gRNA sequence
atacaaaaattagccgggcg

SEQ ID NO: 147791 - DNA, 20 bp, Artificial
  CRISPR gRNA sequence
caaaaattagccgggcgtgg

SEQ ID NO: 147792 - DNA, 20 bp, Artificial
  CRISPR gRNA sequence
aaattagccgggcgtggcgg

SEQ ID NO: 147793 - DNA, 20 bp, Artificial
  CRISPR gRNA sequence
gcggcagacgcttgtaatcc

SEQ ID NO: 147794 - DNA, 20 bp, Artificial
  CRISPR gRNA sequence
cgcttgtaatcccagttact

SEQ ID NO: 147795 - DNA, 20 bp, Artificial
  CRISPR gRNA sequence
gcttgtaatcccagttactc

SEQ ID NO: 147796 - DNA, 20 bp, Artificial
  CRISPR gRNA sequence
ttgtaatcccagttactcag

SEQ ID NO: 147797 - DNA, 20 bp, Artificial
  CRISPR gRNA sequence
tgtaatcccagttactcagg

SEQ ID NO: 147798 - DNA, 20 bp, Artificial
  CRISPR gRNA sequence
tcccagttactcaggaggct

SEQ ID NO: 147799 - DNA, 20 bp, Artificial
  CRISPR gRNA sequence
cccagttactcaggaggctg

SEQ ID NO: 147800 - DNA, 20 bp, Artificial
  CRISPR gRNA sequence
agttactcaggaggctgagg

SEQ ID NO: 147801 - DNA, 20 bp, Artificial
  CRISPR gRNA sequence
gttactcaggaggctgaggc

SEQ ID NO: 147802 - DNA, 20 bp, Artificial
  CRISPR gRNA sequence
tactcaggaggctgaggcag

SEQ ID NO: 147803 - DNA, 20 bp, Artificial
  CRISPR gRNA sequence
gcaggagaatcgcttgaacc

SEQ ID NO: 147804 - DNA, 20 bp, Artificial
  CRISPR gRNA sequence
caggagaatcgcttgaaccc

SEQ ID NO: 147805 - DNA, 20 bp, Artificial
  CRISPR gRNA sequence
ggagaatcgcttgaacccag

SEQ ID NO: 147806 - DNA, 20 bp, Artificial
  CRISPR gRNA sequence
gagaatcgcttgaacccagg

SEQ ID NO: 147807 - DNA, 20 bp, Artificial
  CRISPR gRNA sequence
aatcgcttgaacccaggagg

SEQ ID NO: 147808 - DNA, 20 bp, Artificial
  CRISPR gRNA sequence
tcgcttgaacccaggaggca

SEQ ID NO: 147809 - DNA, 20 bp, Artificial
  CRISPR gRNA sequence
cgcttgaacccaggaggcag

SEQ ID NO: 147810 - DNA, 20 bp, Artificial
  CRISPR gRNA sequence
aacccaggaggcagaggttg

SEQ ID NO: 147811 - DNA, 20 bp, Artificial
  CRISPR gRNA sequence
caggaggcagaggttgcagt

SEQ ID NO: 147812 - DNA, 20 bp, Artificial
  CRISPR gRNA sequence
ggcagaggttgcagtgagcc

SEQ ID NO: 147813 - DNA, 20 bp, Artificial
  CRISPR gRNA sequence
aagatcacgccattgcactc

SEQ ID NO: 147814 - DNA, 20 bp, Artificial
  CRISPR gRNA sequence
cacgccattgcactccagcc

SEQ ID NO: 147815 - DNA, 20 bp, Artificial
  CRISPR gRNA sequence
acgccattgcactccagcct

SEQ ID NO: 147816 - DNA, 20 bp, Artificial
  CRISPR gRNA sequence
ttgcactccagcctgggcaa

SEQ ID NO: 147817 - DNA, 20 bp, Artificial
  CRISPR gRNA sequence
gcactccagcctgggcaaca

SEQ ID NO: 147818 - DNA, 20 bp, Artificial
  CRISPR gRNA sequence
tccagcctgggcaacagagc

SEQ ID NO: 147819 - DNA, 20 bp, Artificial
  CRISPR gRNA sequence
ctccatcgcaaaaaaaaaaa

SEQ ID NO: 147820 - DNA, 20 bp, Artificial
  CRISPR gRNA sequence
catcgcaaaaaaaaaaaaag

SEQ ID NO: 147821 - DNA, 20 bp, Artificial
  CRISPR gRNA sequence
aaaaaaagtagaattaaaat

SEQ ID NO: 147822 - DNA, 20 bp, Artificial
  CRISPR gRNA sequence
aaaaaagtagaattaaaatt

SEQ ID NO: 147823 - DNA, 20 bp, Artificial
  CRISPR gRNA sequence
aagtagaattaaaattagga

SEQ ID NO: 147824 - DNA, 20 bp, Artificial
  CRISPR gRNA sequence
gtagaattaaaattaggata

SEQ ID NO: 147825 - DNA, 20 bp, Artificial
  CRISPR gRNA sequence
aattaaaattaggatagaga

SEQ ID NO: 147826 - DNA, 20 bp, Artificial
  CRISPR gRNA sequence
ttaaaattaggatagagaaa

SEQ ID NO: 147827 - DNA, 20 bp, Artificial
  CRISPR gRNA sequence
taaaattaggatagagaaag

SEQ ID NO: 147828 - DNA, 20 bp, Artificial
  CRISPR gRNA sequence
aaaattaggatagagaaaga

SEQ ID NO: 147829 - DNA, 20 bp, Artificial
  CRISPR gRNA sequence
ttaggatagagaaagagggc

SEQ ID NO: 147830 - DNA, 20 bp, Artificial
  CRISPR gRNA sequence
gagggctagaacctgcaatt

SEQ ID NO: 147831 - DNA, 20 bp, Artificial
  CRISPR gRNA sequence
tagtcaactgctttgtgaca

SEQ ID NO: 147832 - DNA, 20 bp, Artificial
  CRISPR gRNA sequence
agtcaactgctttgtgacaa

SEQ ID NO: 147833 - DNA, 20 bp, Artificial
  CRISPR gRNA sequence
tcaactgctttgtgacaaag

SEQ ID NO: 147834 - DNA, 20 bp, Artificial
  CRISPR gRNA sequence
caactgctttgtgacaaagg

SEQ ID NO: 147835 - DNA, 20 bp, Artificial
  CRISPR gRNA sequence
aactgctttgtgacaaagga

SEQ ID NO: 147836 - DNA, 20 bp, Artificial
  CRISPR gRNA sequence
tgctttgtgacaaaggaggg

SEQ ID NO: 147837 - DNA, 20 bp, Artificial
  CRISPR gRNA sequence
acaaaggagggaagatgaat

SEQ ID NO: 147838 - DNA, 20 bp, Artificial
  CRISPR gRNA sequence
caaaggagggaagatgaata

SEQ ID NO: 147839 - DNA, 20 bp, Artificial
  CRISPR gRNA sequence
atgaataaggatcctcatgt

SEQ ID NO: 147840 - DNA, 20 bp, Artificial
  CRISPR gRNA sequence
cctcatgtcagctataactg

SEQ ID NO: 147841 - DNA, 20 bp, Artificial
  CRISPR gRNA sequence
agctataactgtagataaca

SEQ ID NO: 147842 - DNA, 20 bp, Artificial
  CRISPR gRNA sequence
gctataactgtagataacac

SEQ ID NO: 147843 - DNA, 20 bp, Artificial
  CRISPR gRNA sequence
aactgtagataacacaggtt

SEQ ID NO: 147844 - DNA, 20 bp, Artificial
  CRISPR gRNA sequence
atctgaaattctgaaatgcc

SEQ ID NO: 147845 - DNA, 20 bp, Artificial
  CRISPR gRNA sequence
tctgaaattctgaaatgcct

SEQ ID NO: 147846 - DNA, 20 bp, Artificial
  CRISPR gRNA sequence
ctgaaattctgaaatgcctg

SEQ ID NO: 147847 - DNA, 20 bp, Artificial
  CRISPR gRNA sequence
attctgaaatgcctggggac

SEQ ID NO: 147848 - DNA, 20 bp, Artificial
  CRISPR gRNA sequence
gcctggggaccagaaatgtc

SEQ ID NO: 147849 - DNA, 20 bp, Artificial
  CRISPR gRNA sequence
cctggggaccagaaatgtct

SEQ ID NO: 147850 - DNA, 20 bp, Artificial
  CRISPR gRNA sequence
tttttttttttttttttttt

SEQ ID NO: 147851 - DNA, 20 bp, Artificial
  CRISPR gRNA sequence
ttttttttttttttttgaga

SEQ ID NO: 147852 - DNA, 20 bp, Artificial
  CRISPR gRNA sequence
ttttttttttttttgagaca

SEQ ID NO: 147853 - DNA, 20 bp, Artificial
  CRISPR gRNA sequence
agagtttcgctcttgttgcc

SEQ ID NO: 147854 - DNA, 20 bp, Artificial
  CRISPR gRNA sequence
ttcgctcttgttgcccagac

SEQ ID NO: 147855 - DNA, 20 bp, Artificial
  CRISPR gRNA sequence
cgctcttgttgcccagactg

SEQ ID NO: 147856 - DNA, 20 bp, Artificial
  CRISPR gRNA sequence
ttgttgcccagactggagtg

SEQ ID NO: 147857 - DNA, 20 bp, Artificial
  CRISPR gRNA sequence
ttgcccagactggagtgcag

SEQ ID NO: 147858 - DNA, 20 bp, Artificial
  CRISPR gRNA sequence
ggagtgcagtggtgcaattt

SEQ ID NO: 147859 - DNA, 20 bp, Artificial
  CRISPR gRNA sequence
tcactgcaacctctgcctcc

SEQ ID NO: 147860 - DNA, 20 bp, Artificial
  CRISPR gRNA sequence
cactgcaacctctgcctccc

SEQ ID NO: 147861 - DNA, 20 bp, Artificial
  CRISPR gRNA sequence
ttcatgtgattctcctgcct

SEQ ID NO: 147862 - DNA, 20 bp, Artificial
  CRISPR gRNA sequence
ttctcctgcctcagcctcct

SEQ ID NO: 147863 - DNA, 20 bp, Artificial
  CRISPR gRNA sequence
tcctgcctcagcctcctgag

SEQ ID NO: 147864 - DNA, 20 bp, Artificial
  CRISPR gRNA sequence
gcctcagcctcctgagtagc

SEQ ID NO: 147865 - DNA, 20 bp, Artificial
  CRISPR gRNA sequence
cctcagcctcctgagtagct

SEQ ID NO: 147866 - DNA, 20 bp, Artificial
  CRISPR gRNA sequence
ctcctgagtagctgggatta

SEQ ID NO: 147867 - DNA, 20 bp, Artificial
  CRISPR gRNA sequence
tcctgagtagctgggattac

SEQ ID NO: 147868 - DNA, 20 bp, Artificial
  CRISPR gRNA sequence
caggcatctgccaccacgcc

SEQ ID NO: 147869 - DNA, 20 bp, Artificial
  CRISPR gRNA sequence
tagctaattttttatatttt

SEQ ID NO: 147870 - DNA, 20 bp, Artificial
  CRISPR gRNA sequence
aattttttatatttttagta

SEQ ID NO: 147871 - DNA, 20 bp, Artificial
  CRISPR gRNA sequence
ttttatatttttagtaaaga

SEQ ID NO: 147872 - DNA, 20 bp, Artificial
  CRISPR gRNA sequence
tttatatttttagtaaagat

SEQ ID NO: 147873 - DNA, 20 bp, Artificial
  CRISPR gRNA sequence
ttatatttttagtaaagatg

SEQ ID NO: 147874 - DNA, 20 bp, Artificial
  CRISPR gRNA sequence
aagatggggtttcgccatgt

SEQ ID NO: 147875 - DNA, 20 bp, Artificial
  CRISPR gRNA sequence
tggggtttcgccatgttggc

SEQ ID NO: 147876 - DNA, 20 bp, Artificial
  CRISPR gRNA sequence
ggggtttcgccatgttggcc

SEQ ID NO: 147877 - DNA, 20 bp, Artificial
  CRISPR gRNA sequence
ctgcctcaaactcctgacct

SEQ ID NO: 147878 - DNA, 20 bp, Artificial
  CRISPR gRNA sequence
ccacctgcctcgtcctccca

SEQ ID NO: 147879 - DNA, 20 bp, Artificial
  CRISPR gRNA sequence
gcctcgtcctcccaaagtgc

SEQ ID NO: 147880 - DNA, 20 bp, Artificial
  CRISPR gRNA sequence
cctcgtcctcccaaagtgct

SEQ ID NO: 147881 - DNA, 20 bp, Artificial
  CRISPR gRNA sequence
ctcccaaagtgctgggatta

SEQ ID NO: 147882 - DNA, 20 bp, Artificial
  CRISPR gRNA sequence
tcccaaagtgctgggattac

SEQ ID NO: 147883 - DNA, 20 bp, Artificial
  CRISPR gRNA sequence
agtgctgggattacaggcgt

SEQ ID NO: 147884 - DNA, 20 bp, Artificial
  CRISPR gRNA sequence
caggcgtgagccaccgcgcc

SEQ ID NO: 147885 - DNA, 20 bp, Artificial
  CRISPR gRNA sequence
tttttttttttttttttttt

SEQ ID NO: 147886 - DNA, 20 bp, Artificial
  CRISPR gRNA sequence
tttttttttttttttggaat

SEQ ID NO: 147887 - DNA, 20 bp, Artificial
  CRISPR gRNA sequence
taagtttgcattatacttac

SEQ ID NO: 147888 - DNA, 20 bp, Artificial
  CRISPR gRNA sequence
ttgcattatacttactggtt

SEQ ID NO: 147889 - DNA, 20 bp, Artificial
  CRISPR gRNA sequence
gaaaatccaaaatcgaaaat

SEQ ID NO: 147890 - DNA, 20 bp, Artificial
  CRISPR gRNA sequence
cgaaaatgagcatttccttt

SEQ ID NO: 147891 - DNA, 20 bp, Artificial
  CRISPR gRNA sequence
atttcctttgagcgtcatgt

SEQ ID NO: 147892 - DNA, 20 bp, Artificial
  CRISPR gRNA sequence
tttcctttgagcgtcatgtc

SEQ ID NO: 147893 - DNA, 20 bp, Artificial
  CRISPR gRNA sequence
ttcctttgagcgtcatgtca

SEQ ID NO: 147894 - DNA, 20 bp, Artificial
  CRISPR gRNA sequence
gcgtcatgtcagggctcaaa

SEQ ID NO: 147895 - DNA, 20 bp, Artificial
  CRISPR gRNA sequence
tgtcagggctcaaaaagttt

SEQ ID NO: 147896 - DNA, 20 bp, Artificial
  CRISPR gRNA sequence
gctcaaaaagtttcggattt

SEQ ID NO: 147897 - DNA, 20 bp, Artificial
  CRISPR gRNA sequence
agtttcggatttcagatttt

SEQ ID NO: 147898 - DNA, 20 bp, Artificial
  CRISPR gRNA sequence
ggatttcagattttcagatt

SEQ ID NO: 147899 - DNA, 20 bp, Artificial
  CRISPR gRNA sequence
gatttcagattttcagatta

SEQ ID NO: 147900 - DNA, 20 bp, Artificial
  CRISPR gRNA sequence
aacctgtattgtaatgtctt

SEQ ID NO: 147901 - DNA, 20 bp, Artificial
  CRISPR gRNA sequence
taatgtcttaagcgcttatc

SEQ ID NO: 147902 - DNA, 20 bp, Artificial
  CRISPR gRNA sequence
tctggcaaatattaaaatgc

SEQ ID NO: 147903 - DNA, 20 bp, Artificial
  CRISPR gRNA sequence
caaatattaaaatgcaagaa

SEQ ID NO: 147904 - DNA, 20 bp, Artificial
  CRISPR gRNA sequence
gaacagtttaattaaacaca

SEQ ID NO: 147905 - DNA, 20 bp, Artificial
  CRISPR gRNA sequence
gtttaattaaacacaaagaa

SEQ ID NO: 147906 - DNA, 20 bp, Artificial
  CRISPR gRNA sequence
ttaattaaacacaaagaatg

SEQ ID NO: 147907 - DNA, 20 bp, Artificial
  CRISPR gRNA sequence
acacaaagaatggagaaatt

SEQ ID NO: 147908 - DNA, 20 bp, Artificial
  CRISPR gRNA sequence
gagaaatttagtgctctcct

SEQ ID NO: 147909 - DNA, 20 bp, Artificial
  CRISPR gRNA sequence
ctcctaagaatctctattct

SEQ ID NO: 147910 - DNA, 20 bp, Artificial
  CRISPR gRNA sequence
tcctaagaatctctattctg

SEQ ID NO: 147911 - DNA, 20 bp, Artificial
  CRISPR gRNA sequence
attctgaggaattatttgaa

SEQ ID NO: 147912 - DNA, 20 bp, Artificial
  CRISPR gRNA sequence
ttctgaggaattatttgaaa

SEQ ID NO: 147913 - DNA, 20 bp, Artificial
  CRISPR gRNA sequence
tttgaaaaggtttaacgtgc

SEQ ID NO: 147914 - DNA, 20 bp, Artificial
  CRISPR gRNA sequence
aaggtttaacgtgccagtga

SEQ ID NO: 147915 - DNA, 20 bp, Artificial
  CRISPR gRNA sequence
aggtttaacgtgccagtgac

SEQ ID NO: 147916 - DNA, 20 bp, Artificial
  CRISPR gRNA sequence
acgtgccagtgacgggatgc

SEQ ID NO: 147917 - DNA, 20 bp, Artificial
  CRISPR gRNA sequence
tgccagtgacgggatgctgg

SEQ ID NO: 147918 - DNA, 20 bp, Artificial
  CRISPR gRNA sequence
gccagtgacgggatgctggc

SEQ ID NO: 147919 - DNA, 20 bp, Artificial
  CRISPR gRNA sequence
ccagtgacgggatgctggca

SEQ ID NO: 147920 - DNA, 20 bp, Artificial
  CRISPR gRNA sequence
agtgacgggatgctggcagg

SEQ ID NO: 147921 - DNA, 20 bp, Artificial
  CRISPR gRNA sequence
atgctggcagggagctatgt

SEQ ID NO: 147922 - DNA, 20 bp, Artificial
  CRISPR gRNA sequence
cagggagctatgtgagccat

SEQ ID NO: 147923 - DNA, 20 bp, Artificial
  CRISPR gRNA sequence
agggagctatgtgagccatt

SEQ ID NO: 147924 - DNA, 20 bp, Artificial
  CRISPR gRNA sequence
agccattaggaactaattct

SEQ ID NO: 147925 - DNA, 20 bp, Artificial
  CRISPR gRNA sequence
gccattaggaactaattctg

SEQ ID NO: 147926 - DNA, 20 bp, Artificial
  CRISPR gRNA sequence
ccattaggaactaattctga

SEQ ID NO: 147927 - DNA, 20 bp, Artificial
  CRISPR gRNA sequence
cattaggaactaattctgag

SEQ ID NO: 147928 - DNA, 20 bp, Artificial
  CRISPR gRNA sequence
aactaattctgaggggctga

SEQ ID NO: 147929 - DNA, 20 bp, Artificial
  CRISPR gRNA sequence
attctgaggggctgaaagca

SEQ ID NO: 147930 - DNA, 20 bp, Artificial
  CRISPR gRNA sequence
gggctgaaagcaaagcacca

SEQ ID NO: 147931 - DNA, 20 bp, Artificial
  CRISPR gRNA sequence
tgaaagcaaagcaccaaagc

SEQ ID NO: 147932 - DNA, 20 bp, Artificial
  CRISPR gRNA sequence
aaagccagttgtcacatgac

SEQ ID NO: 147933 - DNA, 20 bp, Artificial
  CRISPR gRNA sequence
tgaccagacttgttactttc

SEQ ID NO: 147934 - DNA, 20 bp, Artificial
  CRISPR gRNA sequence
gaccagacttgttactttcc

SEQ ID NO: 147935 - DNA, 20 bp, Artificial
  CRISPR gRNA sequence
gttactttccaggctccatg

SEQ ID NO: 147936 - DNA, 20 bp, Artificial
  CRISPR gRNA sequence
ggctccatgtggatacatac

SEQ ID NO: 147937 - DNA, 20 bp, Artificial
  CRISPR gRNA sequence
gctccatgtggatacatact

SEQ ID NO: 147938 - DNA, 20 bp, Artificial
  CRISPR gRNA sequence
ccatgtggatacatactggg

SEQ ID NO: 147939 - DNA, 20 bp, Artificial
  CRISPR gRNA sequence
ctgggcagaacactctatca

SEQ ID NO: 147940 - DNA, 20 bp, Artificial
  CRISPR gRNA sequence
ggcagaacactctatcacag

SEQ ID NO: 147941 - DNA, 20 bp, Artificial
  CRISPR gRNA sequence
aacactctatcacagcagaa

SEQ ID NO: 147942 - DNA, 20 bp, Artificial
  CRISPR gRNA sequence
atcacagcagaatggaatga

SEQ ID NO: 147943 - DNA, 20 bp, Artificial
  CRISPR gRNA sequence
ggaatgaaagctgacaactc

SEQ ID NO: 147944 - DNA, 20 bp, Artificial
  CRISPR gRNA sequence
gaatgaaagctgacaactct

SEQ ID NO: 147945 - DNA, 20 bp, Artificial
  CRISPR gRNA sequence
aaagctgacaactctaggtt

SEQ ID NO: 147946 - DNA, 20 bp, Artificial
  CRISPR gRNA sequence
acaactctaggtttagcctg

SEQ ID NO: 147947 - DNA, 20 bp, Artificial
  CRISPR gRNA sequence
caactctaggtttagcctgt

SEQ ID NO: 147948 - DNA, 20 bp, Artificial
  CRISPR gRNA sequence
aactctaggtttagcctgtg

SEQ ID NO: 147949 - DNA, 20 bp, Artificial
  CRISPR gRNA sequence
aattcactcttaaatgttta

SEQ ID NO: 147950 - DNA, 20 bp, Artificial
  CRISPR gRNA sequence
attcactcttaaatgtttac

SEQ ID NO: 147951 - DNA, 20 bp, Artificial
  CRISPR gRNA sequence
ttccttcccttttccttcta

SEQ ID NO: 147952 - DNA, 20 bp, Artificial
  CRISPR gRNA sequence
tccttcccttttccttctaa

SEQ ID NO: 147953 - DNA, 20 bp, Artificial
  CRISPR gRNA sequence
ttccttctaaaggaaatgat

SEQ ID NO: 147954 - DNA, 20 bp, Artificial
  CRISPR gRNA sequence
tccttctaaaggaaatgatg

SEQ ID NO: 147955 - DNA, 20 bp, Artificial
  CRISPR gRNA sequence
ccttctaaaggaaatgatga

SEQ ID NO: 147956 - DNA, 20 bp, Artificial
  CRISPR gRNA sequence
cttctaaaggaaatgatgag

SEQ ID NO: 147957 - DNA, 20 bp, Artificial
  CRISPR gRNA sequence
taaaggaaatgatgagggga

SEQ ID NO: 147958 - DNA, 20 bp, Artificial
  CRISPR gRNA sequence
aaatgatgaggggaaagaaa

SEQ ID NO: 147959 - DNA, 20 bp, Artificial
  CRISPR gRNA sequence
tgatgaggggaaagaaatgg

SEQ ID NO: 147960 - DNA, 20 bp, Artificial
  CRISPR gRNA sequence
gatgaggggaaagaaatgga

SEQ ID NO: 147961 - DNA, 20 bp, Artificial
  CRISPR gRNA sequence
tggaaggaaaacaacaatac

SEQ ID NO: 147962 - DNA, 20 bp, Artificial
  CRISPR gRNA sequence
aaacaacaatacaagcctca

SEQ ID NO: 147963 - DNA, 20 bp, Artificial
  CRISPR gRNA sequence
caacaatacaagcctcaaag

SEQ ID NO: 147964 - DNA, 20 bp, Artificial
  CRISPR gRNA sequence
cctcaaagcagatttcattc

SEQ ID NO: 147965 - DNA, 20 bp, Artificial
  CRISPR gRNA sequence
tcattctggtgtaatgacat

SEQ ID NO: 147966 - DNA, 20 bp, Artificial
  CRISPR gRNA sequence
ttctggtgtaatgacattag

SEQ ID NO: 147967 - DNA, 20 bp, Artificial
  CRISPR gRNA sequence
tctggtgtaatgacattagt

SEQ ID NO: 147968 - DNA, 20 bp, Artificial
  CRISPR gRNA sequence
attagtgggtgatgatgtaa

SEQ ID NO: 147969 - DNA, 20 bp, Artificial
  CRISPR gRNA sequence
ttagtgggtgatgatgtaat

SEQ ID NO: 147970 - DNA, 20 bp, Artificial
  CRISPR gRNA sequence
gggtgatgatgtaatgggaa

SEQ ID NO: 147971 - DNA, 20 bp, Artificial
  CRISPR gRNA sequence
ggtgatgatgtaatgggaat

SEQ ID NO: 147972 - DNA, 20 bp, Artificial
  CRISPR gRNA sequence
tgatgtaatgggaataggtt

SEQ ID NO: 147973 - DNA, 20 bp, Artificial
  CRISPR gRNA sequence
atgtaatgggaataggtttg

SEQ ID NO: 147974 - DNA, 20 bp, Artificial
  CRISPR gRNA sequence
ggtttggagccaatttcttg

SEQ ID NO: 147975 - DNA, 20 bp, Artificial
  CRISPR gRNA sequence
ttggagccaatttcttgtgg

SEQ ID NO: 147976 - DNA, 20 bp, Artificial
  CRISPR gRNA sequence
ggagccaatttcttgtggtg

SEQ ID NO: 147977 - DNA, 20 bp, Artificial
  CRISPR gRNA sequence
gagccaatttcttgtggtgg

SEQ ID NO: 147978 - DNA, 20 bp, Artificial
  CRISPR gRNA sequence
ttgtggtggaggcctataaa

SEQ ID NO: 147979 - DNA, 20 bp, Artificial
  CRISPR gRNA sequence
gaggcctataaacagctgaa

SEQ ID NO: 147980 - DNA, 20 bp, Artificial
  CRISPR gRNA sequence
aaacagctgaacagaaattc

SEQ ID NO: 147981 - DNA, 20 bp, Artificial
  CRISPR gRNA sequence
tgaacagaaattctagtacc

SEQ ID NO: 147982 - DNA, 20 bp, Artificial
  CRISPR gRNA sequence
gaacagaaattctagtacct

SEQ ID NO: 147983 - DNA, 20 bp, Artificial
  CRISPR gRNA sequence
cctgggatacaatatgatct

SEQ ID NO: 147984 - DNA, 20 bp, Artificial
  CRISPR gRNA sequence
tgggatacaatatgatcttg

SEQ ID NO: 147985 - DNA, 20 bp, Artificial
  CRISPR gRNA sequence
atatgatcttggagtttctg

SEQ ID NO: 147986 - DNA, 20 bp, Artificial
  CRISPR gRNA sequence
tatgatcttggagtttctga

SEQ ID NO: 147987 - DNA, 20 bp, Artificial
  CRISPR gRNA sequence
atgatcttggagtttctgaa

SEQ ID NO: 147988 - DNA, 20 bp, Artificial
  CRISPR gRNA sequence
gatcttggagtttctgaagg

SEQ ID NO: 147989 - DNA, 20 bp, Artificial
  CRISPR gRNA sequence
ggagtttctgaagggagtta

SEQ ID NO: 147990 - DNA, 20 bp, Artificial
  CRISPR gRNA sequence
gagtttctgaagggagttaa

SEQ ID NO: 147991 - DNA, 20 bp, Artificial
  CRISPR gRNA sequence
agtttctgaagggagttaaa

SEQ ID NO: 147992 - DNA, 20 bp, Artificial
  CRISPR gRNA sequence
ttctgaagggagttaaaggg

SEQ ID NO: 147993 - DNA, 20 bp, Artificial
  CRISPR gRNA sequence
taaagggaagtgttcaatca

SEQ ID NO: 147994 - DNA, 20 bp, Artificial
  CRISPR gRNA sequence
caatcacagttgaaaatgac

SEQ ID NO: 147995 - DNA, 20 bp, Artificial
  CRISPR gRNA sequence
aaatgactagataaaatctt

SEQ ID NO: 147996 - DNA, 20 bp, Artificial
  CRISPR gRNA sequence
atcttaagtcctaaataacc

SEQ ID NO: 147997 - DNA, 20 bp, Artificial
  CRISPR gRNA sequence
taagtcctaaataaccaagt

SEQ ID NO: 147998 - DNA, 20 bp, Artificial
  CRISPR gRNA sequence
catttatcaccacatacaca

SEQ ID NO: 147999 - DNA, 20 bp, Artificial
  CRISPR gRNA sequence
tggcctatatgctactctct

SEQ ID NO: 148000 - DNA, 20 bp, Artificial
  CRISPR gRNA sequence
gctactctcttagatgtact

SEQ ID NO: 148001 - DNA, 20 bp, Artificial
  CRISPR gRNA sequence
agaacaacaacaaaaaaatt

SEQ ID NO: 148002 - DNA, 20 bp, Artificial
  CRISPR gRNA sequence
gaacaacaacaaaaaaatta

SEQ ID NO: 148003 - DNA, 20 bp, Artificial
  CRISPR gRNA sequence
acaaaaaaattaaggtaatc

SEQ ID NO: 148004 - DNA, 20 bp, Artificial
  CRISPR gRNA sequence
aaaaaaattaaggtaatcta

SEQ ID NO: 148005 - DNA, 20 bp, Artificial
  CRISPR gRNA sequence
aaaattaaggtaatctagag

SEQ ID NO: 148006 - DNA, 20 bp, Artificial
  CRISPR gRNA sequence
taaggtaatctagagaagtt

SEQ ID NO: 148007 - DNA, 20 bp, Artificial
  CRISPR gRNA sequence
tagttatttatcattattaa

SEQ ID NO: 148008 - DNA, 20 bp, Artificial
  CRISPR gRNA sequence
cattattaatagttttctac

SEQ ID NO: 148009 - DNA, 20 bp, Artificial
  CRISPR gRNA sequence
attattaatagttttctaca

SEQ ID NO: 148010 - DNA, 20 bp, Artificial
  CRISPR gRNA sequence
acaaggtactcatgaaaatg

SEQ ID NO: 148011 - DNA, 20 bp, Artificial
  CRISPR gRNA sequence
ggtactcatgaaaatgaaga

SEQ ID NO: 148012 - DNA, 20 bp, Artificial
  CRISPR gRNA sequence
tcaatttaaccttttttaaa

SEQ ID NO: 148013 - DNA, 20 bp, Artificial
  CRISPR gRNA sequence
caatttaaccttttttaaat

SEQ ID NO: 148014 - DNA, 20 bp, Artificial
  CRISPR gRNA sequence
aatttaaccttttttaaatg

SEQ ID NO: 148015 - DNA, 20 bp, Artificial
  CRISPR gRNA sequence
ggcaaacaaaaatatctttc

SEQ ID NO: 148016 - DNA, 20 bp, Artificial
  CRISPR gRNA sequence
aaataataataattatcaaa

SEQ ID NO: 148017 - DNA, 20 bp, Artificial
  CRISPR gRNA sequence
taattatcaaaaagctttaa

SEQ ID NO: 148018 - DNA, 20 bp, Artificial
  CRISPR gRNA sequence
gaatctaaccttttattgca

SEQ ID NO: 148019 - DNA, 20 bp, Artificial
  CRISPR gRNA sequence
aatctaaccttttattgcat

SEQ ID NO: 148020 - DNA, 20 bp, Artificial
  CRISPR gRNA sequence
ccttttattgcatgggtccc

SEQ ID NO: 148021 - DNA, 20 bp, Artificial
  CRISPR gRNA sequence
ttattgcatgggtccctgga

SEQ ID NO: 148022 - DNA, 20 bp, Artificial
  CRISPR gRNA sequence
tattgcatgggtccctggac

SEQ ID NO: 148023 - DNA, 20 bp, Artificial
  CRISPR gRNA sequence
tccctggacaggcctcatct

SEQ ID NO: 148024 - DNA, 20 bp, Artificial
  CRISPR gRNA sequence
aatctgccatgcaaactgct

SEQ ID NO: 148025 - DNA, 20 bp, Artificial
  CRISPR gRNA sequence
atctgccatgcaaactgcta

SEQ ID NO: 148026 - DNA, 20 bp, Artificial
  CRISPR gRNA sequence
catgcaaactgctaaggtca

SEQ ID NO: 148027 - DNA, 20 bp, Artificial
  CRISPR gRNA sequence
atgcaaactgctaaggtcaa

SEQ ID NO: 148028 - DNA, 20 bp, Artificial
  CRISPR gRNA sequence
gcaaactgctaaggtcaaag

SEQ ID NO: 148029 - DNA, 20 bp, Artificial
  CRISPR gRNA sequence
actgctaaggtcaaaggaga

SEQ ID NO: 148030 - DNA, 20 bp, Artificial
  CRISPR gRNA sequence
ggagaaagatgcacaattgc

SEQ ID NO: 148031 - DNA, 20 bp, Artificial
  CRISPR gRNA sequence
gagaaagatgcacaattgcc

SEQ ID NO: 148032 - DNA, 20 bp, Artificial
  CRISPR gRNA sequence
tatctctgtacacttgctaa

SEQ ID NO: 148033 - DNA, 20 bp, Artificial
  CRISPR gRNA sequence
tctgtacacttgctaatgga

SEQ ID NO: 148034 - DNA, 20 bp, Artificial
  CRISPR gRNA sequence
ctgtacacttgctaatggat

SEQ ID NO: 148035 - DNA, 20 bp, Artificial
  CRISPR gRNA sequence
tacacttgctaatggatggg

SEQ ID NO: 148036 - DNA, 20 bp, Artificial
  CRISPR gRNA sequence
acacttgctaatggatgggt

SEQ ID NO: 148037 - DNA, 20 bp, Artificial
  CRISPR gRNA sequence
tgctaatggatgggtaggtt

SEQ ID NO: 148038 - DNA, 20 bp, Artificial
  CRISPR gRNA sequence
aatggatgggtaggtttagt

SEQ ID NO: 148039 - DNA, 20 bp, Artificial
  CRISPR gRNA sequence
tggatgggtaggtttagttg

SEQ ID NO: 148040 - DNA, 20 bp, Artificial
  CRISPR gRNA sequence
gtaggtttagttggagtaca

SEQ ID NO: 148041 - DNA, 20 bp, Artificial
  CRISPR gRNA sequence
caaagacctgtacgatttaa

SEQ ID NO: 148042 - DNA, 20 bp, Artificial
  CRISPR gRNA sequence
acctgtacgatttaaaagtc

SEQ ID NO: 148043 - DNA, 20 bp, Artificial
  CRISPR gRNA sequence
aaaagtctggtaacaaattc

SEQ ID NO: 148044 - DNA, 20 bp, Artificial
  CRISPR gRNA sequence
tatccccccaaaacattaca

SEQ ID NO: 148045 - DNA, 20 bp, Artificial
  CRISPR gRNA sequence
atccccccaaaacattacaa

SEQ ID NO: 148046 - DNA, 20 bp, Artificial
  CRISPR gRNA sequence
acaaaggtacacaattcaaa

SEQ ID NO: 148047 - DNA, 20 bp, Artificial
  CRISPR gRNA sequence
cacaattcaaaaagcacgtc

SEQ ID NO: 148048 - DNA, 20 bp, Artificial
  CRISPR gRNA sequence
cacgtctagaaccatctgtg

SEQ ID NO: 148049 - DNA, 20 bp, Artificial
  CRISPR gRNA sequence
attttgaactgtcccaacta

SEQ ID NO: 148050 - DNA, 20 bp, Artificial
  CRISPR gRNA sequence
ctgtcccaactacagatgtg

SEQ ID NO: 148051 - DNA, 20 bp, Artificial
  CRISPR gRNA sequence
tgtcccaactacagatgtgc

SEQ ID NO: 148052 - DNA, 20 bp, Artificial
  CRISPR gRNA sequence
tacagatgtgcaggcatgat

SEQ ID NO: 148053 - DNA, 20 bp, Artificial
  CRISPR gRNA sequence
tcagcccgcaaacatctgtg

SEQ ID NO: 148054 - DNA, 20 bp, Artificial
  CRISPR gRNA sequence
gcaaacatctgtgtagtcaa

SEQ ID NO: 148055 - DNA, 20 bp, Artificial
  CRISPR gRNA sequence
gtcaacagatcatgaatctt

SEQ ID NO: 148056 - DNA, 20 bp, Artificial
  CRISPR gRNA sequence
acagatcatgaatctttggc

SEQ ID NO: 148057 - DNA, 20 bp, Artificial
  CRISPR gRNA sequence
tcatgaatctttggctggct

SEQ ID NO: 148058 - DNA, 20 bp, Artificial
  CRISPR gRNA sequence
atgaatctttggctggctca

SEQ ID NO: 148059 - DNA, 20 bp, Artificial
  CRISPR gRNA sequence
tggctcagagccacatactg

SEQ ID NO: 148060 - DNA, 20 bp, Artificial
  CRISPR gRNA sequence
ctcagagccacatactgtag

SEQ ID NO: 148061 - DNA, 20 bp, Artificial
  CRISPR gRNA sequence
agagccacatactgtagtag

SEQ ID NO: 148062 - DNA, 20 bp, Artificial
  CRISPR gRNA sequence
gccacatactgtagtagtgg

SEQ ID NO: 148063 - DNA, 20 bp, Artificial
  CRISPR gRNA sequence
catactgtagtagtggaagt

SEQ ID NO: 148064 - DNA, 20 bp, Artificial
  CRISPR gRNA sequence
atactgtagtagtggaagtt

SEQ ID NO: 148065 - DNA, 20 bp, Artificial
  CRISPR gRNA sequence
agtggaagttaggtacaaaa

SEQ ID NO: 148066 - DNA, 20 bp, Artificial
  CRISPR gRNA sequence
ggaagttaggtacaaaacag

SEQ ID NO: 148067 - DNA, 20 bp, Artificial
  CRISPR gRNA sequence
cagaagttatcaaatttttt

SEQ ID NO: 148068 - DNA, 20 bp, Artificial
  CRISPR gRNA sequence
ttggaactgaaaatgtatta

SEQ ID NO: 148069 - DNA, 20 bp, Artificial
  CRISPR gRNA sequence
tggaactgaaaatgtattaa

SEQ ID NO: 148070 - DNA, 20 bp, Artificial
  CRISPR gRNA sequence
ctgaaaatgtattaaaggtt

SEQ ID NO: 148071 - DNA, 20 bp, Artificial
  CRISPR gRNA sequence
aaaggttaagttttaaaatt

SEQ ID NO: 148072 - DNA, 20 bp, Artificial
  CRISPR gRNA sequence
ggttaagttttaaaattgag

SEQ ID NO: 148073 - DNA, 20 bp, Artificial
  CRISPR gRNA sequence
attgagaagcccatctacat

SEQ ID NO: 148074 - DNA, 20 bp, Artificial
  CRISPR gRNA sequence
ttgagaagcccatctacatt

SEQ ID NO: 148075 - DNA, 20 bp, Artificial
  CRISPR gRNA sequence
ctacattaggaaatcccaaa

SEQ ID NO: 148076 - DNA, 20 bp, Artificial
  CRISPR gRNA sequence
tacattaggaaatcccaaat

SEQ ID NO: 148077 - DNA, 20 bp, Artificial
  CRISPR gRNA sequence
taggaaatcccaaataggta

SEQ ID NO: 148078 - DNA, 20 bp, Artificial
  CRISPR gRNA sequence
ataggtaaagcgaaaaatac

SEQ ID NO: 148079 - DNA, 20 bp, Artificial
  CRISPR gRNA sequence
ctttacattttactgcatca

SEQ ID NO: 148080 - DNA, 20 bp, Artificial
  CRISPR gRNA sequence
tacattttactgcatcatag

SEQ ID NO: 148081 - DNA, 20 bp, Artificial
  CRISPR gRNA sequence
tttactgcatcatagaagtt

SEQ ID NO: 148082 - DNA, 20 bp, Artificial
  CRISPR gRNA sequence
ttactgcatcatagaagttc

SEQ ID NO: 148083 - DNA, 20 bp, Artificial
  CRISPR gRNA sequence
aggactgaaaaaaaaaaaaa

SEQ ID NO: 148084 - DNA, 20 bp, Artificial
  CRISPR gRNA sequence
aaaaaaaaaaaaaaagacat

SEQ ID NO: 148085 - DNA, 20 bp, Artificial
  CRISPR gRNA sequence
aaaaaaaaaaaaaagacata

SEQ ID NO: 148086 - DNA, 20 bp, Artificial
  CRISPR gRNA sequence
aaaaaaaaaaaagacataag

SEQ ID NO: 148087 - DNA, 20 bp, Artificial
  CRISPR gRNA sequence
aaaagacataaggagacact

SEQ ID NO: 148088 - DNA, 20 bp, Artificial
  CRISPR gRNA sequence
aaagacataaggagacactc

SEQ ID NO: 148089 - DNA, 20 bp, Artificial
  CRISPR gRNA sequence
actcaggcccaccccttcat

SEQ ID NO: 148090 - DNA, 20 bp, Artificial
  CRISPR gRNA sequence
accccttcataagacgctcg

SEQ ID NO: 148091 - DNA, 20 bp, Artificial
  CRISPR gRNA sequence
cttcaacctctgcccaaccc

SEQ ID NO: 148092 - DNA, 20 bp, Artificial
  CRISPR gRNA sequence
ttcaacctctgcccaacccc

SEQ ID NO: 148093 - DNA, 20 bp, Artificial
  CRISPR gRNA sequence
accccgggtgattctacctt

SEQ ID NO: 148094 - DNA, 20 bp, Artificial
  CRISPR gRNA sequence
ttctaccttaagtgttcaac

SEQ ID NO: 148095 - DNA, 20 bp, Artificial
  CRISPR gRNA sequence
tgttcaaccagcttacattt

SEQ ID NO: 148096 - DNA, 20 bp, Artificial
  CRISPR gRNA sequence
gttcaaccagcttacatttg

SEQ ID NO: 148097 - DNA, 20 bp, Artificial
  CRISPR gRNA sequence
ttcaaccagcttacatttga

SEQ ID NO: 148098 - DNA, 20 bp, Artificial
  CRISPR gRNA sequence
atttgagggcccccccactc

SEQ ID NO: 148099 - DNA, 20 bp, Artificial
  CRISPR gRNA sequence
gggcccccccactccagttc

SEQ ID NO: 148100 - DNA, 20 bp, Artificial
  CRISPR gRNA sequence
ggcccccccactccagttct

SEQ ID NO: 148101 - DNA, 20 bp, Artificial
  CRISPR gRNA sequence
ccactccagttctgggaaac

SEQ ID NO: 148102 - DNA, 20 bp, Artificial
  CRISPR gRNA sequence
gttctgggaaactggcttac

SEQ ID NO: 148103 - DNA, 20 bp, Artificial
  CRISPR gRNA sequence
tgggaaactggcttactggt

SEQ ID NO: 148104 - DNA, 20 bp, Artificial
  CRISPR gRNA sequence
aagacattctttcccatctt

SEQ ID NO: 148105 - DNA, 20 bp, Artificial
  CRISPR gRNA sequence
cattctttcccatctttgga

SEQ ID NO: 148106 - DNA, 20 bp, Artificial
  CRISPR gRNA sequence
ctaactgttcttctttacat

SEQ ID NO: 148107 - DNA, 20 bp, Artificial
  CRISPR gRNA sequence
taactgttcttctttacatt

SEQ ID NO: 148108 - DNA, 20 bp, Artificial
  CRISPR gRNA sequence
ttcttctttacattaggttt

SEQ ID NO: 148109 - DNA, 20 bp, Artificial
  CRISPR gRNA sequence
cttctttacattaggtttta

SEQ ID NO: 148110 - DNA, 20 bp, Artificial
  CRISPR gRNA sequence
tacattaggttttagagtta

SEQ ID NO: 148111 - DNA, 20 bp, Artificial
  CRISPR gRNA sequence
gcctttatgatttttccatc

SEQ ID NO: 148112 - DNA, 20 bp, Artificial
  CRISPR gRNA sequence
ttataaattcctgacttcga

SEQ ID NO: 148113 - DNA, 20 bp, Artificial
  CRISPR gRNA sequence
attcctgacttcgaaagaca

SEQ ID NO: 148114 - DNA, 20 bp, Artificial
  CRISPR gRNA sequence
ttcctgacttcgaaagacaa

SEQ ID NO: 148115 - DNA, 20 bp, Artificial
  CRISPR gRNA sequence
acaaaggtaatcttcttttg

SEQ ID NO: 148116 - DNA, 20 bp, Artificial
  CRISPR gRNA sequence
caaaggtaatcttcttttga

SEQ ID NO: 148117 - DNA, 20 bp, Artificial
  CRISPR gRNA sequence
aatcttcttttgaaggacac

SEQ ID NO: 148118 - DNA, 20 bp, Artificial
  CRISPR gRNA sequence
aggacacaagttcttctcac

SEQ ID NO: 148119 - DNA, 20 bp, Artificial
  CRISPR gRNA sequence
ggacacaagttcttctcacc

SEQ ID NO: 148120 - DNA, 20 bp, Artificial
  CRISPR gRNA sequence
agttcttctcaccaggaaaa

SEQ ID NO: 148121 - DNA, 20 bp, Artificial
  CRISPR gRNA sequence
ttcttctcaccaggaaaaaa

SEQ ID NO: 148122 - DNA, 20 bp, Artificial
  CRISPR gRNA sequence
tcaccaggaaaaaagagaaa

SEQ ID NO: 148123 - DNA, 20 bp, Artificial
  CRISPR gRNA sequence
caccaggaaaaaagagaaaa

SEQ ID NO: 148124 - DNA, 20 bp, Artificial
  CRISPR gRNA sequence
aaaaaagagaaaaaggtttg

SEQ ID NO: 148125 - DNA, 20 bp, Artificial
  CRISPR gRNA sequence
catgttttctaacatctttg

SEQ ID NO: 148126 - DNA, 20 bp, Artificial
  CRISPR gRNA sequence
aacatctttgcagatattat

SEQ ID NO: 148127 - DNA, 20 bp, Artificial
  CRISPR gRNA sequence
atattattagtaatgtctct

SEQ ID NO: 148128 - DNA, 20 bp, Artificial
  CRISPR gRNA sequence
ttattagtaatgtctcttag

SEQ ID NO: 148129 - DNA, 20 bp, Artificial
  CRISPR gRNA sequence
aaattgttaatgtaaattcc

SEQ ID NO: 148130 - DNA, 20 bp, Artificial
  CRISPR gRNA sequence
ttaatgtaaattcctggaaa

SEQ ID NO: 148131 - DNA, 20 bp, Artificial
  CRISPR gRNA sequence
tgtaaattcctggaaaaagt

SEQ ID NO: 148132 - DNA, 20 bp, Artificial
  CRISPR gRNA sequence
aagtgagtacttttattcaa

SEQ ID NO: 148133 - DNA, 20 bp, Artificial
  CRISPR gRNA sequence
agtgagtacttttattcaaa

SEQ ID NO: 148134 - DNA, 20 bp, Artificial
  CRISPR gRNA sequence
tattcaaaaggcttttccta

SEQ ID NO: 148135 - DNA, 20 bp, Artificial
  CRISPR gRNA sequence
tcaaaaggcttttcctaaag

SEQ ID NO: 148136 - DNA, 20 bp, Artificial
  CRISPR gRNA sequence
aagcagatccattctttgca

SEQ ID NO: 148137 - DNA, 20 bp, Artificial
  CRISPR gRNA sequence
gcagatccattctttgcatg

SEQ ID NO: 148138 - DNA, 20 bp, Artificial
  CRISPR gRNA sequence
caattaatattatatatata

SEQ ID NO: 148139 - DNA, 20 bp, Artificial
  CRISPR gRNA sequence
ttaatattatatatataaag

SEQ ID NO: 148140 - DNA, 20 bp, Artificial
  CRISPR gRNA sequence
taatattatatatataaagc

SEQ ID NO: 148141 - DNA, 20 bp, Artificial
  CRISPR gRNA sequence
attatatatataaagcaggc

SEQ ID NO: 148142 - DNA, 20 bp, Artificial
  CRISPR gRNA sequence
ttatatatataaagcaggcc

SEQ ID NO: 148143 - DNA, 20 bp, Artificial
  CRISPR gRNA sequence
tatataaagcaggccgggca

SEQ ID NO: 148144 - DNA, 20 bp, Artificial
  CRISPR gRNA sequence
ataaagcaggccgggcacgg

SEQ ID NO: 148145 - DNA, 20 bp, Artificial
  CRISPR gRNA sequence
gtggttcacgtctgtaatcc

SEQ ID NO: 148146 - DNA, 20 bp, Artificial
  CRISPR gRNA sequence
cgtctgtaatcccagcactt

SEQ ID NO: 148147 - DNA, 20 bp, Artificial
  CRISPR gRNA sequence
gtctgtaatcccagcacttt

SEQ ID NO: 148148 - DNA, 20 bp, Artificial
  CRISPR gRNA sequence
ctgtaatcccagcactttgg

SEQ ID NO: 148149 - DNA, 20 bp, Artificial
  CRISPR gRNA sequence
tgtaatcccagcactttggg

SEQ ID NO: 148150 - DNA, 20 bp, Artificial
  CRISPR gRNA sequence
tcccagcactttgggaggcc

SEQ ID NO: 148151 - DNA, 20 bp, Artificial
  CRISPR gRNA sequence
cccagcactttgggaggcca

SEQ ID NO: 148152 - DNA, 20 bp, Artificial
  CRISPR gRNA sequence
agcactttgggaggccaagg

SEQ ID NO: 148153 - DNA, 20 bp, Artificial
  CRISPR gRNA sequence
gcactttgggaggccaaggc

SEQ ID NO: 148154 - DNA, 20 bp, Artificial
  CRISPR gRNA sequence
ctttgggaggccaaggcggg

SEQ ID NO: 148155 - DNA, 20 bp, Artificial
  CRISPR gRNA sequence
ccaaggcgggtggatcacct

SEQ ID NO: 148156 - DNA, 20 bp, Artificial
  CRISPR gRNA sequence
caaggcgggtggatcacctg

SEQ ID NO: 148157 - DNA, 20 bp, Artificial
  CRISPR gRNA sequence
gcgggtggatcacctgaggt

SEQ ID NO: 148158 - DNA, 20 bp, Artificial
  CRISPR gRNA sequence
cgggtggatcacctgaggtc

SEQ ID NO: 148159 - DNA, 20 bp, Artificial
  CRISPR gRNA sequence
ggtggatcacctgaggtcag

SEQ ID NO: 148160 - DNA, 20 bp, Artificial
  CRISPR gRNA sequence
tcacctgaggtcaggagttc

SEQ ID NO: 148161 - DNA, 20 bp, Artificial
  CRISPR gRNA sequence
tgaggtcaggagttcgagac

SEQ ID NO: 148162 - DNA, 20 bp, Artificial
  CRISPR gRNA sequence
tcaggagttcgagaccagcc

SEQ ID NO: 148163 - DNA, 20 bp, Artificial
  CRISPR gRNA sequence
cgagaccagcctggccaaca

SEQ ID NO: 148164 - DNA, 20 bp, Artificial
  CRISPR gRNA sequence
tctactaaaaatgcaaaaat

SEQ ID NO: 148165 - DNA, 20 bp, Artificial
  CRISPR gRNA sequence
ctaaaaatgcaaaaattagc

SEQ ID NO: 148166 - DNA, 20 bp, Artificial
  CRISPR gRNA sequence
atgcaaaaattagctggctg

SEQ ID NO: 148167 - DNA, 20 bp, Artificial
  CRISPR gRNA sequence
caaaaattagctggctgtgg

SEQ ID NO: 148168 - DNA, 20 bp, Artificial
  CRISPR gRNA sequence
gctgtggtggcacatgcctg

SEQ ID NO: 148169 - DNA, 20 bp, Artificial
  CRISPR gRNA sequence
gtggcacatgcctgtagtcc

SEQ ID NO: 148170 - DNA, 20 bp, Artificial
  CRISPR gRNA sequence
tgcctgtagtcccagctact

SEQ ID NO: 148171 - DNA, 20 bp, Artificial
  CRISPR gRNA sequence
gcctgtagtcccagctactc

SEQ ID NO: 148172 - DNA, 20 bp, Artificial
  CRISPR gRNA sequence
gtcccagctactcgggaacc

SEQ ID NO: 148173 - DNA, 20 bp, Artificial
  CRISPR gRNA sequence
tcccagctactcgggaacca

SEQ ID NO: 148174 - DNA, 20 bp, Artificial
  CRISPR gRNA sequence
ccagctactcgggaaccaag

SEQ ID NO: 148175 - DNA, 20 bp, Artificial
  CRISPR gRNA sequence
cagctactcgggaaccaagg

SEQ ID NO: 148176 - DNA, 20 bp, Artificial
  CRISPR gRNA sequence
ctactcgggaaccaaggagg

SEQ ID NO: 148177 - DNA, 20 bp, Artificial
  CRISPR gRNA sequence
actcgggaaccaaggaggtg

SEQ ID NO: 148178 - DNA, 20 bp, Artificial
  CRISPR gRNA sequence
ctcgggaaccaaggaggtgg

SEQ ID NO: 148179 - DNA, 20 bp, Artificial
  CRISPR gRNA sequence
ggaggtggaggctgcaaacc

SEQ ID NO: 148180 - DNA, 20 bp, Artificial
  CRISPR gRNA sequence
gaggtggaggctgcaaaccc

SEQ ID NO: 148181 - DNA, 20 bp, Artificial
  CRISPR gRNA sequence
ggtggaggctgcaaacccag

SEQ ID NO: 148182 - DNA, 20 bp, Artificial
  CRISPR gRNA sequence
gtggaggctgcaaacccagg

SEQ ID NO: 148183 - DNA, 20 bp, Artificial
  CRISPR gRNA sequence
gaggctgcaaacccaggagg

SEQ ID NO: 148184 - DNA, 20 bp, Artificial
  CRISPR gRNA sequence
ggctgcaaacccaggaggtg

SEQ ID NO: 148185 - DNA, 20 bp, Artificial
  CRISPR gRNA sequence
gctgcaaacccaggaggtgg

SEQ ID NO: 148186 - DNA, 20 bp, Artificial
  CRISPR gRNA sequence
aacccaggaggtggaggttg

SEQ ID NO: 148187 - DNA, 20 bp, Artificial
  CRISPR gRNA sequence
caggaggtggaggttgcagt

SEQ ID NO: 148188 - DNA, 20 bp, Artificial
  CRISPR gRNA sequence
ggtggaggttgcagtgagcc

SEQ ID NO: 148189 - DNA, 20 bp, Artificial
  CRISPR gRNA sequence
gtggaggttgcagtgagccg

SEQ ID NO: 148190 - DNA, 20 bp, Artificial
  CRISPR gRNA sequence
gaggtcatgccactgcactc

SEQ ID NO: 148191 - DNA, 20 bp, Artificial
  CRISPR gRNA sequence
catgccactgcactccagcc

SEQ ID NO: 148192 - DNA, 20 bp, Artificial
  CRISPR gRNA sequence
atgccactgcactccagcct

SEQ ID NO: 148193 - DNA, 20 bp, Artificial
  CRISPR gRNA sequence
ctgcactccagcctgggtga

SEQ ID NO: 148194 - DNA, 20 bp, Artificial
  CRISPR gRNA sequence
gcactccagcctgggtgaca

SEQ ID NO: 148195 - DNA, 20 bp, Artificial
  CRISPR gRNA sequence
tccagcctgggtgacagagc

SEQ ID NO: 148196 - DNA, 20 bp, Artificial
  CRISPR gRNA sequence
aataaataaataaataaata

SEQ ID NO: 148197 - DNA, 20 bp, Artificial
  CRISPR gRNA sequence
ataaataaataaagcaaccg

SEQ ID NO: 148198 - DNA, 20 bp, Artificial
  CRISPR gRNA sequence
caaataaattgattttgcta

SEQ ID NO: 148199 - DNA, 20 bp, Artificial
  CRISPR gRNA sequence
ataaattgattttgctacag

SEQ ID NO: 148200 - DNA, 20 bp, Artificial
  CRISPR gRNA sequence
aattgattttgctacagaag

SEQ ID NO: 148201 - DNA, 20 bp, Artificial
  CRISPR gRNA sequence
agtccatttacaacatctac

SEQ ID NO: 148202 - DNA, 20 bp, Artificial
  CRISPR gRNA sequence
ttacaacatctacaagccca

SEQ ID NO: 148203 - DNA, 20 bp, Artificial
  CRISPR gRNA sequence
caagcccatggaaaatattc

SEQ ID NO: 148204 - DNA, 20 bp, Artificial
  CRISPR gRNA sequence
aagcccatggaaaatattct

SEQ ID NO: 148205 - DNA, 20 bp, Artificial
  CRISPR gRNA sequence
aatattctgggttcatcttc

SEQ ID NO: 148206 - DNA, 20 bp, Artificial
  CRISPR gRNA sequence
atattctgggttcatcttct

SEQ ID NO: 148207 - DNA, 20 bp, Artificial
  CRISPR gRNA sequence
ggttcatcttctaggataat

SEQ ID NO: 148208 - DNA, 20 bp, Artificial
  CRISPR gRNA sequence
gttcatcttctaggataata

SEQ ID NO: 148209 - DNA, 20 bp, Artificial
  CRISPR gRNA sequence
ttcatcttctaggataataa

SEQ ID NO: 148210 - DNA, 20 bp, Artificial
  CRISPR gRNA sequence
tcttctaggataataaggga

SEQ ID NO: 148211 - DNA, 20 bp, Artificial
  CRISPR gRNA sequence
aagggaaagaatgtatttaa

SEQ ID NO: 148212 - DNA, 20 bp, Artificial
  CRISPR gRNA sequence
gaaagaatgtatttaaaagt

SEQ ID NO: 148213 - DNA, 20 bp, Artificial
  CRISPR gRNA sequence
aagaatgtatttaaaagtaa

SEQ ID NO: 148214 - DNA, 20 bp, Artificial
  CRISPR gRNA sequence
agaatgtatttaaaagtaag

SEQ ID NO: 148215 - DNA, 20 bp, Artificial
  CRISPR gRNA sequence
aatgtatttaaaagtaagag

SEQ ID NO: 148216 - DNA, 20 bp, Artificial
  CRISPR gRNA sequence
atgtatttaaaagtaagagg

SEQ ID NO: 148217 - DNA, 20 bp, Artificial
  CRISPR gRNA sequence
atttaaaagtaagaggaggc

SEQ ID NO: 148218 - DNA, 20 bp, Artificial
  CRISPR gRNA sequence
tttaaaagtaagaggaggct

SEQ ID NO: 148219 - DNA, 20 bp, Artificial
  CRISPR gRNA sequence
taagaggaggctgggtgttg

SEQ ID NO: 148220 - DNA, 20 bp, Artificial
  CRISPR gRNA sequence
gtctgtaatcccaacaactc

SEQ ID NO: 148221 - DNA, 20 bp, Artificial
  CRISPR gRNA sequence
ctgtaatcccaacaactccg

SEQ ID NO: 148222 - DNA, 20 bp, Artificial
  CRISPR gRNA sequence
tgtaatcccaacaactccgg

SEQ ID NO: 148223 - DNA, 20 bp, Artificial
  CRISPR gRNA sequence
tcccaacaactccggaggct

SEQ ID NO: 148224 - DNA, 20 bp, Artificial
  CRISPR gRNA sequence
aacaactccggaggctgaga

SEQ ID NO: 148225 - DNA, 20 bp, Artificial
  CRISPR gRNA sequence
acaactccggaggctgagac

SEQ ID NO: 148226 - DNA, 20 bp, Artificial
  CRISPR gRNA sequence
aactccggaggctgagacag

SEQ ID NO: 148227 - DNA, 20 bp, Artificial
  CRISPR gRNA sequence
ctgagacaggagaatcactt

SEQ ID NO: 148228 - DNA, 20 bp, Artificial
  CRISPR gRNA sequence
tgagacaggagaatcacttc

SEQ ID NO: 148229 - DNA, 20 bp, Artificial
  CRISPR gRNA sequence
acaggagaatcacttcaggc

SEQ ID NO: 148230 - DNA, 20 bp, Artificial
  CRISPR gRNA sequence
ggagaatcacttcaggccag

SEQ ID NO: 148231 - DNA, 20 bp, Artificial
  CRISPR gRNA sequence
tcacttcaggccagtagttt

SEQ ID NO: 148232 - DNA, 20 bp, Artificial
  CRISPR gRNA sequence
tcaggccagtagtttgagac

SEQ ID NO: 148233 - DNA, 20 bp, Artificial
  CRISPR gRNA sequence
cagtagtttgagaccagcct

SEQ ID NO: 148234 - DNA, 20 bp, Artificial
  CRISPR gRNA sequence
tgagaccagccttggcaaca

SEQ ID NO: 148235 - DNA, 20 bp, Artificial
  CRISPR gRNA sequence
accagccttggcaacacagt

SEQ ID NO: 148236 - DNA, 20 bp, Artificial
  CRISPR gRNA sequence
tgagactctgtctctaaaaa

SEQ ID NO: 148237 - DNA, 20 bp, Artificial
  CRISPR gRNA sequence
gagactctgtctctaaaaaa

SEQ ID NO: 148238 - DNA, 20 bp, Artificial
  CRISPR gRNA sequence
ctctaaaaaaaggatttttt

SEQ ID NO: 148239 - DNA, 20 bp, Artificial
  CRISPR gRNA sequence
tctaaaaaaaggatttttta

SEQ ID NO: 148240 - DNA, 20 bp, Artificial
  CRISPR gRNA sequence
aaaaaaggattttttaaggc

SEQ ID NO: 148241 - DNA, 20 bp, Artificial
  CRISPR gRNA sequence
aaaaaggattttttaaggcc

SEQ ID NO: 148242 - DNA, 20 bp, Artificial
  CRISPR gRNA sequence
aaaaggattttttaaggcca

SEQ ID NO: 148243 - DNA, 20 bp, Artificial
  CRISPR gRNA sequence
aaaggattttttaaggccag

SEQ ID NO: 148244 - DNA, 20 bp, Artificial
  CRISPR gRNA sequence
ttttttaaggccaggggctg

SEQ ID NO: 148245 - DNA, 20 bp, Artificial
  CRISPR gRNA sequence
cacctgtaatcccaacactt

SEQ ID NO: 148246 - DNA, 20 bp, Artificial
  CRISPR gRNA sequence
acctgtaatcccaacacttt

SEQ ID NO: 148247 - DNA, 20 bp, Artificial
  CRISPR gRNA sequence
ctgtaatcccaacactttgg

SEQ ID NO: 148248 - DNA, 20 bp, Artificial
  CRISPR gRNA sequence
tgtaatcccaacactttggg

SEQ ID NO: 148249 - DNA, 20 bp, Artificial
  CRISPR gRNA sequence
tcccaacactttgggaggct

SEQ ID NO: 148250 - DNA, 20 bp, Artificial
  CRISPR gRNA sequence
cccaacactttgggaggctg

SEQ ID NO: 148251 - DNA, 20 bp, Artificial
  CRISPR gRNA sequence
aacactttgggaggctgagg

SEQ ID NO: 148252 - DNA, 20 bp, Artificial
  CRISPR gRNA sequence
cactttgggaggctgaggtg

SEQ ID NO: 148253 - DNA, 20 bp, Artificial
  CRISPR gRNA sequence
actttgggaggctgaggtgg

SEQ ID NO: 148254 - DNA, 20 bp, Artificial
  CRISPR gRNA sequence
gctgaggtggaggatcactt

SEQ ID NO: 148255 - DNA, 20 bp, Artificial
  CRISPR gRNA sequence
ctgaggtggaggatcacttg

SEQ ID NO: 148256 - DNA, 20 bp, Artificial
  CRISPR gRNA sequence
ggtggaggatcacttgaggt

SEQ ID NO: 148257 - DNA, 20 bp, Artificial
  CRISPR gRNA sequence
gtggaggatcacttgaggtc

SEQ ID NO: 148258 - DNA, 20 bp, Artificial
  CRISPR gRNA sequence
ggaggatcacttgaggtcag

SEQ ID NO: 148259 - DNA, 20 bp, Artificial
  CRISPR gRNA sequence
tcacttgaggtcaggagttc

SEQ ID NO: 148260 - DNA, 20 bp, Artificial
  CRISPR gRNA sequence
tgaggtcaggagttcaagac

SEQ ID NO: 148261 - DNA, 20 bp, Artificial
  CRISPR gRNA sequence
tcaggagttcaagaccagcc

SEQ ID NO: 148262 - DNA, 20 bp, Artificial
  CRISPR gRNA sequence
caagaccagcctggctaata

SEQ ID NO: 148263 - DNA, 20 bp, Artificial
  CRISPR gRNA sequence
actaaaaacacaaaatacat

SEQ ID NO: 148264 - DNA, 20 bp, Artificial
  CRISPR gRNA sequence
aaacacaaaatacattagcc

SEQ ID NO: 148265 - DNA, 20 bp, Artificial
  CRISPR gRNA sequence
caaaatacattagccgagca

SEQ ID NO: 148266 - DNA, 20 bp, Artificial
  CRISPR gRNA sequence
aatacattagccgagcatgg

SEQ ID NO: 148267 - DNA, 20 bp, Artificial
  CRISPR gRNA sequence
gtggcacatgcttataatcc

SEQ ID NO: 148268 - DNA, 20 bp, Artificial
  CRISPR gRNA sequence
tgcttataatcccagctact

SEQ ID NO: 148269 - DNA, 20 bp, Artificial
  CRISPR gRNA sequence
gcttataatcccagctactt

SEQ ID NO: 148270 - DNA, 20 bp, Artificial
  CRISPR gRNA sequence
ttataatcccagctacttgg

SEQ ID NO: 148271 - DNA, 20 bp, Artificial
  CRISPR gRNA sequence
tataatcccagctacttggg

SEQ ID NO: 148272 - DNA, 20 bp, Artificial
  CRISPR gRNA sequence
tcccagctacttgggaggct

SEQ ID NO: 148273 - DNA, 20 bp, Artificial
  CRISPR gRNA sequence
cccagctacttgggaggctg

SEQ ID NO: 148274 - DNA, 20 bp, Artificial
  CRISPR gRNA sequence
tacttgggaggctgaggcaa

SEQ ID NO: 148275 - DNA, 20 bp, Artificial
  CRISPR gRNA sequence
ggctgaggcaacagtttcac

SEQ ID NO: 148276 - DNA, 20 bp, Artificial
  CRISPR gRNA sequence
gcaacagtttcactggaacc

SEQ ID NO: 148277 - DNA, 20 bp, Artificial
  CRISPR gRNA sequence
caacagtttcactggaacct

SEQ ID NO: 148278 - DNA, 20 bp, Artificial
  CRISPR gRNA sequence
cagtttcactggaacctggg

SEQ ID NO: 148279 - DNA, 20 bp, Artificial
  CRISPR gRNA sequence
tttcactggaacctgggaag

SEQ ID NO: 148280 - DNA, 20 bp, Artificial
  CRISPR gRNA sequence
tcactggaacctgggaagcg

SEQ ID NO: 148281 - DNA, 20 bp, Artificial
  CRISPR gRNA sequence
cactggaacctgggaagcgg

SEQ ID NO: 148282 - DNA, 20 bp, Artificial
  CRISPR gRNA sequence
aacctgggaagcggaggttg

SEQ ID NO: 148283 - DNA, 20 bp, Artificial
  CRISPR gRNA sequence
tgggaagcggaggttgcagt

SEQ ID NO: 148284 - DNA, 20 bp, Artificial
  CRISPR gRNA sequence
agcggaggttgcagtgagtc

SEQ ID NO: 148285 - DNA, 20 bp, Artificial
  CRISPR gRNA sequence
aagataatgccactgcacaa

SEQ ID NO: 148286 - DNA, 20 bp, Artificial
  CRISPR gRNA sequence
aatgccactgcacaacagcc

SEQ ID NO: 148287 - DNA, 20 bp, Artificial
  CRISPR gRNA sequence
atgccactgcacaacagcct

SEQ ID NO: 148288 - DNA, 20 bp, Artificial
  CRISPR gRNA sequence
ctgcacaacagcctgggcga

SEQ ID NO: 148289 - DNA, 20 bp, Artificial
  CRISPR gRNA sequence
gcacaacagcctgggcgaca

SEQ ID NO: 148290 - DNA, 20 bp, Artificial
  CRISPR gRNA sequence
aacagcctgggcgacagagc

SEQ ID NO: 148291 - DNA, 20 bp, Artificial
  CRISPR gRNA sequence
gagcgagactccatctcaaa

SEQ ID NO: 148292 - DNA, 20 bp, Artificial
  CRISPR gRNA sequence
cgagactccatctcaaaaag

SEQ ID NO: 148293 - DNA, 20 bp, Artificial
  CRISPR gRNA sequence
ataaaaaaaaaatttttaaa

SEQ ID NO: 148294 - DNA, 20 bp, Artificial
  CRISPR gRNA sequence
taaaaaaaaaatttttaaat

SEQ ID NO: 148295 - DNA, 20 bp, Artificial
  CRISPR gRNA sequence
aaatttttaaataggcattg

SEQ ID NO: 148296 - DNA, 20 bp, Artificial
  CRISPR gRNA sequence
gcattgtggcacacacgtgt

SEQ ID NO: 148297 - DNA, 20 bp, Artificial
  CRISPR gRNA sequence
tggcacacacgtgtaagtct

SEQ ID NO: 148298 - DNA, 20 bp, Artificial
  CRISPR gRNA sequence
acgtgtaagtcttagctact

SEQ ID NO: 148299 - DNA, 20 bp, Artificial
  CRISPR gRNA sequence
cgtgtaagtcttagctactc

SEQ ID NO: 148300 - DNA, 20 bp, Artificial
  CRISPR gRNA sequence
tgtaagtcttagctactcag

SEQ ID NO: 148301 - DNA, 20 bp, Artificial
  CRISPR gRNA sequence
gtaagtcttagctactcagg

SEQ ID NO: 148302 - DNA, 20 bp, Artificial
  CRISPR gRNA sequence
tcttagctactcaggaggct

SEQ ID NO: 148303 - DNA, 20 bp, Artificial
  CRISPR gRNA sequence
cttagctactcaggaggctg

SEQ ID NO: 148304 - DNA, 20 bp, Artificial
  CRISPR gRNA sequence
agctactcaggaggctgagg

SEQ ID NO: 148305 - DNA, 20 bp, Artificial
  CRISPR gRNA sequence
tactcaggaggctgaggcag

SEQ ID NO: 148306 - DNA, 20 bp, Artificial
  CRISPR gRNA sequence
actcaggaggctgaggcaga

SEQ ID NO: 148307 - DNA, 20 bp, Artificial
  CRISPR gRNA sequence
gctgaggcagaaggatctcc

SEQ ID NO: 148308 - DNA, 20 bp, Artificial
  CRISPR gRNA sequence
ctgaggcagaaggatctcct

SEQ ID NO: 148309 - DNA, 20 bp, Artificial
  CRISPR gRNA sequence
gcagaaggatctcctgggcc

SEQ ID NO: 148310 - DNA, 20 bp, Artificial
  CRISPR gRNA sequence
cagaaggatctcctgggccc

SEQ ID NO: 148311 - DNA, 20 bp, Artificial
  CRISPR gRNA sequence
gaaggatctcctgggcccag

SEQ ID NO: 148312 - DNA, 20 bp, Artificial
  CRISPR gRNA sequence
tctcctgggcccaggagttt

SEQ ID NO: 148313 - DNA, 20 bp, Artificial
  CRISPR gRNA sequence
ctcctgggcccaggagtttg

SEQ ID NO: 148314 - DNA, 20 bp, Artificial
  CRISPR gRNA sequence
ggcccaggagtttgaggcta

SEQ ID NO: 148315 - DNA, 20 bp, Artificial
  CRISPR gRNA sequence
caggagtttgaggctacagt

SEQ ID NO: 148316 - DNA, 20 bp, Artificial
  CRISPR gRNA sequence
atgatcacaccactgcactc

SEQ ID NO: 148317 - DNA, 20 bp, Artificial
  CRISPR gRNA sequence
cacaccactgcactccagcc

SEQ ID NO: 148318 - DNA, 20 bp, Artificial
  CRISPR gRNA sequence
acaccactgcactccagcct

SEQ ID NO: 148319 - DNA, 20 bp, Artificial
  CRISPR gRNA sequence
ctgcactccagcctgggcaa

SEQ ID NO: 148320 - DNA, 20 bp, Artificial
  CRISPR gRNA sequence
gcactccagcctgggcaaca

SEQ ID NO: 148321 - DNA, 20 bp, Artificial
  CRISPR gRNA sequence
cactccagcctgggcaacag

SEQ ID NO: 148322 - DNA, 20 bp, Artificial
  CRISPR gRNA sequence
actccagcctgggcaacaga

SEQ ID NO: 148323 - DNA, 20 bp, Artificial
  CRISPR gRNA sequence
tccagcctgggcaacagagg

SEQ ID NO: 148324 - DNA, 20 bp, Artificial
  CRISPR gRNA sequence
attataataataaaaaatac

SEQ ID NO: 148325 - DNA, 20 bp, Artificial
  CRISPR gRNA sequence
taataaaaaatacaagaaaa

SEQ ID NO: 148326 - DNA, 20 bp, Artificial
  CRISPR gRNA sequence
ataaaaaatacaagaaaaaa

SEQ ID NO: 148327 - DNA, 20 bp, Artificial
  CRISPR gRNA sequence
aagaaaaaagagactcattc

SEQ ID NO: 148328 - DNA, 20 bp, Artificial
  CRISPR gRNA sequence
agaaaaaagagactcattcc

SEQ ID NO: 148329 - DNA, 20 bp, Artificial
  CRISPR gRNA sequence
tctctattttttttttctca

SEQ ID NO: 148330 - DNA, 20 bp, Artificial
  CRISPR gRNA sequence
tattttttttttctcaaagc

SEQ ID NO: 148331 - DNA, 20 bp, Artificial
  CRISPR gRNA sequence
attttttttttctcaaagcc

SEQ ID NO: 148332 - DNA, 20 bp, Artificial
  CRISPR gRNA sequence
ttttttttttctcaaagcca

SEQ ID NO: 148333 - DNA, 20 bp, Artificial
  CRISPR gRNA sequence
cagggtttcgctctgttgcc

SEQ ID NO: 148334 - DNA, 20 bp, Artificial
  CRISPR gRNA sequence
agggtttcgctctgttgccc

SEQ ID NO: 148335 - DNA, 20 bp, Artificial
  CRISPR gRNA sequence
tttcgctctgttgcccaggc

SEQ ID NO: 148336 - DNA, 20 bp, Artificial
  CRISPR gRNA sequence
tcgctctgttgcccaggctg

SEQ ID NO: 148337 - DNA, 20 bp, Artificial
  CRISPR gRNA sequence
ttgcccaggctggagtgcaa

SEQ ID NO: 148338 - DNA, 20 bp, Artificial
  CRISPR gRNA sequence
ggagtgcaatggtgtgatct

SEQ ID NO: 148339 - DNA, 20 bp, Artificial
  CRISPR gRNA sequence
ggtgtgatcttggctcactg

SEQ ID NO: 148340 - DNA, 20 bp, Artificial
  CRISPR gRNA sequence
tcactgcagcctctacctcc

SEQ ID NO: 148341 - DNA, 20 bp, Artificial
  CRISPR gRNA sequence
cactgcagcctctacctcct

SEQ ID NO: 148342 - DNA, 20 bp, Artificial
  CRISPR gRNA sequence
agcctctacctcctgggctc

SEQ ID NO: 148343 - DNA, 20 bp, Artificial
  CRISPR gRNA sequence
ctcaagcaatcctcctacca

SEQ ID NO: 148344 - DNA, 20 bp, Artificial
  CRISPR gRNA sequence
tcctcctaccacagcctccc

SEQ ID NO: 148345 - DNA, 20 bp, Artificial
  CRISPR gRNA sequence
tcctaccacagcctcccaag

SEQ ID NO: 148346 - DNA, 20 bp, Artificial
  CRISPR gRNA sequence
accacagcctcccaagtagc

SEQ ID NO: 148347 - DNA, 20 bp, Artificial
  CRISPR gRNA sequence
ccacagcctcccaagtagct

SEQ ID NO: 148348 - DNA, 20 bp, Artificial
  CRISPR gRNA sequence
ctcccaagtagctgggacta

SEQ ID NO: 148349 - DNA, 20 bp, Artificial
  CRISPR gRNA sequence
tcccaagtagctgggactac

SEQ ID NO: 148350 - DNA, 20 bp, Artificial
  CRISPR gRNA sequence
tcaattactatctctccacg

SEQ ID NO: 148351 - DNA, 20 bp, Artificial
  CRISPR gRNA sequence
aagtattctctactgctttc

SEQ ID NO: 148352 - DNA, 20 bp, Artificial
  CRISPR gRNA sequence
tctctactgctttctggaac

SEQ ID NO: 148353 - DNA, 20 bp, Artificial
  CRISPR gRNA sequence
tctggaactggtccctccct

SEQ ID NO: 148354 - DNA, 20 bp, Artificial
  CRISPR gRNA sequence
ctggaactggtccctccctt

SEQ ID NO: 148355 - DNA, 20 bp, Artificial
  CRISPR gRNA sequence
ggaactggtccctcccttgg

SEQ ID NO: 148356 - DNA, 20 bp, Artificial
  CRISPR gRNA sequence
gtccctcccttgggagcatt

SEQ ID NO: 148357 - DNA, 20 bp, Artificial
  CRISPR gRNA sequence
tccctcccttgggagcatta

SEQ ID NO: 148358 - DNA, 20 bp, Artificial
  CRISPR gRNA sequence
cctcccttgggagcattaag

SEQ ID NO: 148359 - DNA, 20 bp, Artificial
  CRISPR gRNA sequence
ctcccttgggagcattaagg

SEQ ID NO: 148360 - DNA, 20 bp, Artificial
  CRISPR gRNA sequence
tatttcccctcctgctatac

SEQ ID NO: 148361 - DNA, 20 bp, Artificial
  CRISPR gRNA sequence
tcctgctatacaagctcctt

SEQ ID NO: 148362 - DNA, 20 bp, Artificial
  CRISPR gRNA sequence
cctgctatacaagctccttg

SEQ ID NO: 148363 - DNA, 20 bp, Artificial
  CRISPR gRNA sequence
ctgctatacaagctccttga

SEQ ID NO: 148364 - DNA, 20 bp, Artificial
  CRISPR gRNA sequence
ctatacaagctccttgaggg

SEQ ID NO: 148365 - DNA, 20 bp, Artificial
  CRISPR gRNA sequence
tatacaagctccttgagggt

SEQ ID NO: 148366 - DNA, 20 bp, Artificial
  CRISPR gRNA sequence
ctgcatatgattcatctctc

SEQ ID NO: 148367 - DNA, 20 bp, Artificial
  CRISPR gRNA sequence
tcatctctctggatccctca

SEQ ID NO: 148368 - DNA, 20 bp, Artificial
  CRISPR gRNA sequence
tctggatccctcacagtatc

SEQ ID NO: 148369 - DNA, 20 bp, Artificial
  CRISPR gRNA sequence
ccctcacagtatccagcaca

SEQ ID NO: 148370 - DNA, 20 bp, Artificial
  CRISPR gRNA sequence
tctgataactaattacccct

SEQ ID NO: 148371 - DNA, 20 bp, Artificial
  CRISPR gRNA sequence
tgataactaattacccctaa

SEQ ID NO: 148372 - DNA, 20 bp, Artificial
  CRISPR gRNA sequence
gataactaattacccctaag

SEQ ID NO: 148373 - DNA, 20 bp, Artificial
  CRISPR gRNA sequence
taactaattacccctaagag

SEQ ID NO: 148374 - DNA, 20 bp, Artificial
  CRISPR gRNA sequence
aactaattacccctaagagg

SEQ ID NO: 148375 - DNA, 20 bp, Artificial
  CRISPR gRNA sequence
ttacccctaagaggaggtgc

SEQ ID NO: 148376 - DNA, 20 bp, Artificial
  CRISPR gRNA sequence
aggaggtgcaagactgatgc

SEQ ID NO: 148377 - DNA, 20 bp, Artificial
  CRISPR gRNA sequence
ggaggtgcaagactgatgct

SEQ ID NO: 148378 - DNA, 20 bp, Artificial
  CRISPR gRNA sequence
tgcaagactgatgctgggta

SEQ ID NO: 148379 - DNA, 20 bp, Artificial
  CRISPR gRNA sequence
tgatgctgggtatggccttt

SEQ ID NO: 148380 - DNA, 20 bp, Artificial
  CRISPR gRNA sequence
gatgctgggtatggcctttc

SEQ ID NO: 148381 - DNA, 20 bp, Artificial
  CRISPR gRNA sequence
gcctttcaggaaaaaaaaaa

SEQ ID NO: 148382 - DNA, 20 bp, Artificial
  CRISPR gRNA sequence
cctttcaggaaaaaaaaaaa

SEQ ID NO: 148383 - DNA, 20 bp, Artificial
  CRISPR gRNA sequence
ctttcaggaaaaaaaaaaaa

SEQ ID NO: 148384 - DNA, 20 bp, Artificial
  CRISPR gRNA sequence
tttcaggaaaaaaaaaaaag

SEQ ID NO: 148385 - DNA, 20 bp, Artificial
  CRISPR gRNA sequence
ttcaggaaaaaaaaaaaagg

SEQ ID NO: 148386 - DNA, 20 bp, Artificial
  CRISPR gRNA sequence
tcaggaaaaaaaaaaaaggg

SEQ ID NO: 148387 - DNA, 20 bp, Artificial
  CRISPR gRNA sequence
caggaaaaaaaaaaaagggg

SEQ ID NO: 148388 - DNA, 20 bp, Artificial
  CRISPR gRNA sequence
aggaaaaaaaaaaaaggggg

SEQ ID NO: 148389 - DNA, 20 bp, Artificial
  CRISPR gRNA sequence
ggaaaaaaaaaaaagggggg

SEQ ID NO: 148390 - DNA, 20 bp, Artificial
  CRISPR gRNA sequence
gaaaaaaaaaaaaggggggg

SEQ ID NO: 148391 - DNA, 20 bp, Artificial
  CRISPR gRNA sequence
aaaaaaaaaaaagggggggg

SEQ ID NO: 148392 - DNA, 20 bp, Artificial
  CRISPR gRNA sequence
aagggggggggggcgaatct

SEQ ID NO: 148393 - DNA, 20 bp, Artificial
  CRISPR gRNA sequence
gggggggggcgaatcttgga

SEQ ID NO: 148394 - DNA, 20 bp, Artificial
  CRISPR gRNA sequence
ggggcgaatcttggaaagct

SEQ ID NO: 148395 - DNA, 20 bp, Artificial
  CRISPR gRNA sequence
cttggccctgacatacttat

SEQ ID NO: 148396 - DNA, 20 bp, Artificial
  CRISPR gRNA sequence
ttattggaattgcctaacca

SEQ ID NO: 148397 - DNA, 20 bp, Artificial
  CRISPR gRNA sequence
tattggaattgcctaaccaa

SEQ ID NO: 148398 - DNA, 20 bp, Artificial
  CRISPR gRNA sequence
aattgcctaaccaaaggaaa

SEQ ID NO: 148399 - DNA, 20 bp, Artificial
  CRISPR gRNA sequence
accaaaggaaatggttacac

SEQ ID NO: 148400 - DNA, 20 bp, Artificial
  CRISPR gRNA sequence
aatggttacacaagctattc

SEQ ID NO: 148401 - DNA, 20 bp, Artificial
  CRISPR gRNA sequence
ggttacacaagctattccag

SEQ ID NO: 148402 - DNA, 20 bp, Artificial
  CRISPR gRNA sequence
cacaagctattccagaagct

SEQ ID NO: 148403 - DNA, 20 bp, Artificial
  CRISPR gRNA sequence
tccagaagcttagactaaat

SEQ ID NO: 148404 - DNA, 20 bp, Artificial
  CRISPR gRNA sequence
agcttagactaaatgagctc

SEQ ID NO: 148405 - DNA, 20 bp, Artificial
  CRISPR gRNA sequence
gcttagactaaatgagctcc

SEQ ID NO: 148406 - DNA, 20 bp, Artificial
  CRISPR gRNA sequence
aaatgagctccaggacttta

SEQ ID NO: 148407 - DNA, 20 bp, Artificial
  CRISPR gRNA sequence
gagctccaggactttaaagc

SEQ ID NO: 148408 - DNA, 20 bp, Artificial
  CRISPR gRNA sequence
ctttaaagcaagactgcaat

SEQ ID NO: 148409 - DNA, 20 bp, Artificial
  CRISPR gRNA sequence
ctgaaactgatttactgaaa

SEQ ID NO: 148410 - DNA, 20 bp, Artificial
  CRISPR gRNA sequence
ctgaaatggatttaaaataa

SEQ ID NO: 148411 - DNA, 20 bp, Artificial
  CRISPR gRNA sequence
tgaaatggatttaaaataaa

SEQ ID NO: 148412 - DNA, 20 bp, Artificial
  CRISPR gRNA sequence
gaaatggatttaaaataaaa

SEQ ID NO: 148413 - DNA, 20 bp, Artificial
  CRISPR gRNA sequence
aaatggatttaaaataaaag

SEQ ID NO: 148414 - DNA, 20 bp, Artificial
  CRISPR gRNA sequence
tttaaaataaaaggggatga

SEQ ID NO: 148415 - DNA, 20 bp, Artificial
  CRISPR gRNA sequence
aaataaaaggggatgacaga

SEQ ID NO: 148416 - DNA, 20 bp, Artificial
  CRISPR gRNA sequence
aataaaaggggatgacagaa

SEQ ID NO: 148417 - DNA, 20 bp, Artificial
  CRISPR gRNA sequence
acacacacacacaaacatct

SEQ ID NO: 148418 - DNA, 20 bp, Artificial
  CRISPR gRNA sequence
acacacacaaacatctaaga

SEQ ID NO: 148419 - DNA, 20 bp, Artificial
  CRISPR gRNA sequence
acaaacatctaagacagtgc

SEQ ID NO: 148420 - DNA, 20 bp, Artificial
  CRISPR gRNA sequence
aacatctaagacagtgctgg

SEQ ID NO: 148421 - DNA, 20 bp, Artificial
  CRISPR gRNA sequence
aagacagtgctggaagctga

SEQ ID NO: 148422 - DNA, 20 bp, Artificial
  CRISPR gRNA sequence
agacagtgctggaagctgaa

SEQ ID NO: 148423 - DNA, 20 bp, Artificial
  CRISPR gRNA sequence
cagtgctggaagctgaaagg

SEQ ID NO: 148424 - DNA, 20 bp, Artificial
  CRISPR gRNA sequence
gaagctgaaaggcagacttg

SEQ ID NO: 148425 - DNA, 20 bp, Artificial
  CRISPR gRNA sequence
aagctgaaaggcagacttga

SEQ ID NO: 148426 - DNA, 20 bp, Artificial
  CRISPR gRNA sequence
tgaaaggcagacttgaaggc

SEQ ID NO: 148427 - DNA, 20 bp, Artificial
  CRISPR gRNA sequence
agacttgaaggctggaaatg

SEQ ID NO: 148428 - DNA, 20 bp, Artificial
  CRISPR gRNA sequence
tgtggatgcataccattctc

SEQ ID NO: 148429 - DNA, 20 bp, Artificial
  CRISPR gRNA sequence
ctcaagtgtaaatcttttca

SEQ ID NO: 148430 - DNA, 20 bp, Artificial
  CRISPR gRNA sequence
agtgtaaatcttttcaaagt

SEQ ID NO: 148431 - DNA, 20 bp, Artificial
  CRISPR gRNA sequence
tttcaaagtcagaacctctt

SEQ ID NO: 148432 - DNA, 20 bp, Artificial
  CRISPR gRNA sequence
aagtcagaacctcttcagaa

SEQ ID NO: 148433 - DNA, 20 bp, Artificial
  CRISPR gRNA sequence
aacctcttcagaaaagtgac

SEQ ID NO: 148434 - DNA, 20 bp, Artificial
  CRISPR gRNA sequence
acctcttcagaaaagtgacc

SEQ ID NO: 148435 - DNA, 20 bp, Artificial
  CRISPR gRNA sequence
cttcagaaaagtgaccagga

SEQ ID NO: 148436 - DNA, 20 bp, Artificial
  CRISPR gRNA sequence
gaaaagtgaccaggatagat

SEQ ID NO: 148437 - DNA, 20 bp, Artificial
  CRISPR gRNA sequence
gtgaccaggatagattagca

SEQ ID NO: 148438 - DNA, 20 bp, Artificial
  CRISPR gRNA sequence
gtctgaaatattaatgacaa

SEQ ID NO: 148439 - DNA, 20 bp, Artificial
  CRISPR gRNA sequence
tctgaaatattaatgacaat

SEQ ID NO: 148440 - DNA, 20 bp, Artificial
  CRISPR gRNA sequence
aaatattaatgacaatgggt

SEQ ID NO: 148441 - DNA, 20 bp, Artificial
  CRISPR gRNA sequence
tattaatgacaatgggtaag

SEQ ID NO: 148442 - DNA, 20 bp, Artificial
  CRISPR gRNA sequence
attaatgacaatgggtaagt

SEQ ID NO: 148443 - DNA, 20 bp, Artificial
  CRISPR gRNA sequence
taatgacaatgggtaagtag

SEQ ID NO: 148444 - DNA, 20 bp, Artificial
  CRISPR gRNA sequence
aatgacaatgggtaagtagg

SEQ ID NO: 148445 - DNA, 20 bp, Artificial
  CRISPR gRNA sequence
gacaatgggtaagtaggagg

SEQ ID NO: 148446 - DNA, 20 bp, Artificial
  CRISPR gRNA sequence
ggaagataaatacctctgcc

SEQ ID NO: 148447 - DNA, 20 bp, Artificial
  CRISPR gRNA sequence
acctctgcctggccatccat

SEQ ID NO: 148448 - DNA, 20 bp, Artificial
  CRISPR gRNA sequence
ctgcctggccatccattagc

SEQ ID NO: 148449 - DNA, 20 bp, Artificial
  CRISPR gRNA sequence
cctggccatccattagcaag

SEQ ID NO: 148450 - DNA, 20 bp, Artificial
  CRISPR gRNA sequence
ctggccatccattagcaaga

SEQ ID NO: 148451 - DNA, 20 bp, Artificial
  CRISPR gRNA sequence
tggccatccattagcaagaa

SEQ ID NO: 148452 - DNA, 20 bp, Artificial
  CRISPR gRNA sequence
ggccatccattagcaagaag

SEQ ID NO: 148453 - DNA, 20 bp, Artificial
  CRISPR gRNA sequence
gcaagaaggggaaaatcatg

SEQ ID NO: 148454 - DNA, 20 bp, Artificial
  CRISPR gRNA sequence
agaaggggaaaatcatgcag

SEQ ID NO: 148455 - DNA, 20 bp, Artificial
  CRISPR gRNA sequence
ggggaaaatcatgcagaagt

SEQ ID NO: 148456 - DNA, 20 bp, Artificial
  CRISPR gRNA sequence
cagaagtgagatgatttgat

SEQ ID NO: 148457 - DNA, 20 bp, Artificial
  CRISPR gRNA sequence
gatttgatcagaccactgat

SEQ ID NO: 148458 - DNA, 20 bp, Artificial
  CRISPR gRNA sequence
ttgatcagaccactgatgag

SEQ ID NO: 148459 - DNA, 20 bp, Artificial
  CRISPR gRNA sequence
tgatcagaccactgatgagt

SEQ ID NO: 148460 - DNA, 20 bp, Artificial
  CRISPR gRNA sequence
ccactgatgagtgggcaatc

SEQ ID NO: 148461 - DNA, 20 bp, Artificial
  CRISPR gRNA sequence
ctagctgttactcttatatc

SEQ ID NO: 148462 - DNA, 20 bp, Artificial
  CRISPR gRNA sequence
gttactctttatcattctta

SEQ ID NO: 148463 - DNA, 20 bp, Artificial
  CRISPR gRNA sequence
taaagaaaaaaatgaaactt

SEQ ID NO: 148464 - DNA, 20 bp, Artificial
  CRISPR gRNA sequence
agaaaaaaatgaaacttcag

SEQ ID NO: 148465 - DNA, 20 bp, Artificial
  CRISPR gRNA sequence
ttttcaaaacatcccaaaat

SEQ ID NO: 148466 - DNA, 20 bp, Artificial
  CRISPR gRNA sequence
ttcaaaacatcccaaaatca

SEQ ID NO: 148467 - DNA, 20 bp, Artificial
  CRISPR gRNA sequence
gtgttccttttaaaattgtt

SEQ ID NO: 148468 - DNA, 20 bp, Artificial
  CRISPR gRNA sequence
aaattgtttggaaatctttc

SEQ ID NO: 148469 - DNA, 20 bp, Artificial
  CRISPR gRNA sequence
ttcaagctcttgctctcaac

SEQ ID NO: 148470 - DNA, 20 bp, Artificial
  CRISPR gRNA sequence
tcaagctcttgctctcaacc

SEQ ID NO: 148471 - DNA, 20 bp, Artificial
  CRISPR gRNA sequence
atgcctgccaaatcttctct

SEQ ID NO: 148472 - DNA, 20 bp, Artificial
  CRISPR gRNA sequence
tcttctcttagtgatatgcc

SEQ ID NO: 148473 - DNA, 20 bp, Artificial
  CRISPR gRNA sequence
cttctcttagtgatatgcct

SEQ ID NO: 148474 - DNA, 20 bp, Artificial
  CRISPR gRNA sequence
cttagtgatatgcctgggca

SEQ ID NO: 148475 - DNA, 20 bp, Artificial
  CRISPR gRNA sequence
tatgcctgggcatggaacaa

SEQ ID NO: 148476 - DNA, 20 bp, Artificial
  CRISPR gRNA sequence
atgcctgggcatggaacaac

SEQ ID NO: 148477 - DNA, 20 bp, Artificial
  CRISPR gRNA sequence
ttatcaacctcataaataaa

SEQ ID NO: 148478 - DNA, 20 bp, Artificial
  CRISPR gRNA sequence
tcataaataaaaagaaatct

SEQ ID NO: 148479 - DNA, 20 bp, Artificial
  CRISPR gRNA sequence
cataaataaaaagaaatcta

SEQ ID NO: 148480 - DNA, 20 bp, Artificial
  CRISPR gRNA sequence
ggttttattgcaatatgacc

SEQ ID NO: 148481 - DNA, 20 bp, Artificial
  CRISPR gRNA sequence
atgacctggtttctgaaact

SEQ ID NO: 148482 - DNA, 20 bp, Artificial
  CRISPR gRNA sequence
tgacctggtttctgaaactc

SEQ ID NO: 148483 - DNA, 20 bp, Artificial
  CRISPR gRNA sequence
tttctgaaactcaggacctt

SEQ ID NO: 148484 - DNA, 20 bp, Artificial
  CRISPR gRNA sequence
aactcaggacctttagactt

SEQ ID NO: 148485 - DNA, 20 bp, Artificial
  CRISPR gRNA sequence
aggacctttagacttcagtt

SEQ ID NO: 148486 - DNA, 20 bp, Artificial
  CRISPR gRNA sequence
cagttcagctctctattcct

SEQ ID NO: 148487 - DNA, 20 bp, Artificial
  CRISPR gRNA sequence
ctctataccaaactctttta

SEQ ID NO: 148488 - DNA, 20 bp, Artificial
  CRISPR gRNA sequence
tataccaaactcttttatag

SEQ ID NO: 148489 - DNA, 20 bp, Artificial
  CRISPR gRNA sequence
agtagcctaaacccacaata

SEQ ID NO: 148490 - DNA, 20 bp, Artificial
  CRISPR gRNA sequence
aacccacaatacagctcttt

SEQ ID NO: 148491 - DNA, 20 bp, Artificial
  CRISPR gRNA sequence
acccacaatacagctctttg

SEQ ID NO: 148492 - DNA, 20 bp, Artificial
  CRISPR gRNA sequence
ttgaggtaactaaaactaaa

SEQ ID NO: 148493 - DNA, 20 bp, Artificial
  CRISPR gRNA sequence
taaaactaaatagatgttgt

SEQ ID NO: 148494 - DNA, 20 bp, Artificial
  CRISPR gRNA sequence
aaaactaaatagatgttgtt

SEQ ID NO: 148495 - DNA, 20 bp, Artificial
  CRISPR gRNA sequence
aactaaatagatgttgttgg

SEQ ID NO: 148496 - DNA, 20 bp, Artificial
  CRISPR gRNA sequence
taacatcacaacaactgtcc

SEQ ID NO: 148497 - DNA, 20 bp, Artificial
  CRISPR gRNA sequence
aacatcacaacaactgtcca

SEQ ID NO: 148498 - DNA, 20 bp, Artificial
  CRISPR gRNA sequence
acatcacaacaactgtccaa

SEQ ID NO: 148499 - DNA, 20 bp, Artificial
  CRISPR gRNA sequence
caacaactgtccaagggaaa

SEQ ID NO: 148500 - DNA, 20 bp, Artificial
  CRISPR gRNA sequence
tgtccaagggaaaaagacca

SEQ ID NO: 148501 - DNA, 20 bp, Artificial
  CRISPR gRNA sequence
gtccaagggaaaaagaccac

SEQ ID NO: 148502 - DNA, 20 bp, Artificial
  CRISPR gRNA sequence
caagggaaaaagaccacagg

SEQ ID NO: 148503 - DNA, 20 bp, Artificial
  CRISPR gRNA sequence
accaatgctgcttccaatta

SEQ ID NO: 148504 - DNA, 20 bp, Artificial
  CRISPR gRNA sequence
tgctgcttccaattaaagca

SEQ ID NO: 148505 - DNA, 20 bp, Artificial
  CRISPR gRNA sequence
cttccaattaaagcaaagtt

SEQ ID NO: 148506 - DNA, 20 bp, Artificial
  CRISPR gRNA sequence
tcctcccttaatgtcttcga

SEQ ID NO: 148507 - DNA, 20 bp, Artificial
  CRISPR gRNA sequence
cctcccttaatgtcttcgat

SEQ ID NO: 148508 - DNA, 20 bp, Artificial
  CRISPR gRNA sequence
taatgtcttcgataggctct

SEQ ID NO: 148509 - DNA, 20 bp, Artificial
  CRISPR gRNA sequence
gctcttggaaaccgcaactt

SEQ ID NO: 148510 - DNA, 20 bp, Artificial
  CRISPR gRNA sequence
taacaaaaccaattttacca

SEQ ID NO: 148511 - DNA, 20 bp, Artificial
  CRISPR gRNA sequence
aacaaaaccaattttaccaa

SEQ ID NO: 148512 - DNA, 20 bp, Artificial
  CRISPR gRNA sequence
aaaggctaattgacataaat

SEQ ID NO: 148513 - DNA, 20 bp, Artificial
  CRISPR gRNA sequence
aggctaattgacataaataa

SEQ ID NO: 148514 - DNA, 20 bp, Artificial
  CRISPR gRNA sequence
taattgacataaataagagt

SEQ ID NO: 148515 - DNA, 20 bp, Artificial
  CRISPR gRNA sequence
tagttcctattccatatttc

SEQ ID NO: 148516 - DNA, 20 bp, Artificial
  CRISPR gRNA sequence
catcaccaaacttctaaata

SEQ ID NO: 148517 - DNA, 20 bp, Artificial
  CRISPR gRNA sequence
caaacttctaaataaagatc

SEQ ID NO: 148518 - DNA, 20 bp, Artificial
  CRISPR gRNA sequence
ctaatattaaacactgaaat

SEQ ID NO: 148519 - DNA, 20 bp, Artificial
  CRISPR gRNA sequence
tatgaactatacatacattg

SEQ ID NO: 148520 - DNA, 20 bp, Artificial
  CRISPR gRNA sequence
aactatacatacattgaaga

SEQ ID NO: 148521 - DNA, 20 bp, Artificial
  CRISPR gRNA sequence
acatacattgaagaaagatt

SEQ ID NO: 148522 - DNA, 20 bp, Artificial
  CRISPR gRNA sequence
aagaaagattaagaaaaata

SEQ ID NO: 148523 - DNA, 20 bp, Artificial
  CRISPR gRNA sequence
agaaagattaagaaaaataa

SEQ ID NO: 148524 - DNA, 20 bp, Artificial
  CRISPR gRNA sequence
agattaagaaaaataaaggc

SEQ ID NO: 148525 - DNA, 20 bp, Artificial
  CRISPR gRNA sequence
gattaagaaaaataaaggcc

SEQ ID NO: 148526 - DNA, 20 bp, Artificial
  CRISPR gRNA sequence
attaagaaaaataaaggccg

SEQ ID NO: 148527 - DNA, 20 bp, Artificial
  CRISPR gRNA sequence
agaaaaataaaggccggggc

SEQ ID NO: 148528 - DNA, 20 bp, Artificial
  CRISPR gRNA sequence
gaaaaataaaggccggggcc

SEQ ID NO: 148529 - DNA, 20 bp, Artificial
  CRISPR gRNA sequence
ataaaggccggggccaggcg

SEQ ID NO: 148530 - DNA, 20 bp, Artificial
  CRISPR gRNA sequence
aaggccggggccaggcgcgg

SEQ ID NO: 148531 - DNA, 20 bp, Artificial
  CRISPR gRNA sequence
gtggctcacgcctgtaaacc

SEQ ID NO: 148532 - DNA, 20 bp, Artificial
  CRISPR gRNA sequence
gcctgtaaacccagcacttt

SEQ ID NO: 148533 - DNA, 20 bp, Artificial
  CRISPR gRNA sequence
ctgtaaacccagcactttga

SEQ ID NO: 148534 - DNA, 20 bp, Artificial
  CRISPR gRNA sequence
tgtaaacccagcactttgag

SEQ ID NO: 148535 - DNA, 20 bp, Artificial
  CRISPR gRNA sequence
acccagcactttgagaggcc

SEQ ID NO: 148536 - DNA, 20 bp, Artificial
  CRISPR gRNA sequence
cccagcactttgagaggccg

SEQ ID NO: 148537 - DNA, 20 bp, Artificial
  CRISPR gRNA sequence
agcactttgagaggccgagg

SEQ ID NO: 148538 - DNA, 20 bp, Artificial
  CRISPR gRNA sequence
gcactttgagaggccgaggt

SEQ ID NO: 148539 - DNA, 20 bp, Artificial
  CRISPR gRNA sequence
ctttgagaggccgaggtggg

SEQ ID NO: 148540 - DNA, 20 bp, Artificial
  CRISPR gRNA sequence
ggccgaggtgggcagatcac

SEQ ID NO: 148541 - DNA, 20 bp, Artificial
  CRISPR gRNA sequence
gccgaggtgggcagatcacg

SEQ ID NO: 148542 - DNA, 20 bp, Artificial
  CRISPR gRNA sequence
aggtgggcagatcacgaggt

SEQ ID NO: 148543 - DNA, 20 bp, Artificial
  CRISPR gRNA sequence
ggtgggcagatcacgaggtc

SEQ ID NO: 148544 - DNA, 20 bp, Artificial
  CRISPR gRNA sequence
tgggcagatcacgaggtcag

SEQ ID NO: 148545 - DNA, 20 bp, Artificial
  CRISPR gRNA sequence
gatcacgaggtcaggagatt

SEQ ID NO: 148546 - DNA, 20 bp, Artificial
  CRISPR gRNA sequence
tcaggagattgagaccatcc

SEQ ID NO: 148547 - DNA, 20 bp, Artificial
  CRISPR gRNA sequence
tgagaccatcctggccaaca

SEQ ID NO: 148548 - DNA, 20 bp, Artificial
  CRISPR gRNA sequence
ctactaaaaatataaaaaat

SEQ ID NO: 148549 - DNA, 20 bp, Artificial
  CRISPR gRNA sequence
taaaaatataaaaaattagc

SEQ ID NO: 148550 - DNA, 20 bp, Artificial
  CRISPR gRNA sequence
aaaaatataaaaaattagct

SEQ ID NO: 148551 - DNA, 20 bp, Artificial
  CRISPR gRNA sequence
tataaaaaattagctgggtg

SEQ ID NO: 148552 - DNA, 20 bp, Artificial
  CRISPR gRNA sequence
aaaaaattagctgggtgtgg

SEQ ID NO: 148553 - DNA, 20 bp, Artificial
  CRISPR gRNA sequence
ggtgtggtggcgtacacctg

SEQ ID NO: 148554 - DNA, 20 bp, Artificial
  CRISPR gRNA sequence
gtggcgtacacctgtagtcc

SEQ ID NO: 148555 - DNA, 20 bp, Artificial
  CRISPR gRNA sequence
cacctgtagtcccagctact

SEQ ID NO: 148556 - DNA, 20 bp, Artificial
  CRISPR gRNA sequence
acctgtagtcccagctactc

SEQ ID NO: 148557 - DNA, 20 bp, Artificial
  CRISPR gRNA sequence
ctgtagtcccagctactcag

SEQ ID NO: 148558 - DNA, 20 bp, Artificial
  CRISPR gRNA sequence
tgtagtcccagctactcagg

SEQ ID NO: 148559 - DNA, 20 bp, Artificial
  CRISPR gRNA sequence
tcccagctactcaggaggct

SEQ ID NO: 148560 - DNA, 20 bp, Artificial
  CRISPR gRNA sequence
cccagctactcaggaggctg

SEQ ID NO: 148561 - DNA, 20 bp, Artificial
  CRISPR gRNA sequence
agctactcaggaggctgagg

SEQ ID NO: 148562 - DNA, 20 bp, Artificial
  CRISPR gRNA sequence
gctactcaggaggctgaggc

SEQ ID NO: 148563 - DNA, 20 bp, Artificial
  CRISPR gRNA sequence
ctactcaggaggctgaggcg

SEQ ID NO: 148564 - DNA, 20 bp, Artificial
  CRISPR gRNA sequence
tactcaggaggctgaggcgg

SEQ ID NO: 148565 - DNA, 20 bp, Artificial
  CRISPR gRNA sequence
gcgggggaatcgcttgaatc

SEQ ID NO: 148566 - DNA, 20 bp, Artificial
  CRISPR gRNA sequence
cgggggaatcgcttgaatcc

SEQ ID NO: 148567 - DNA, 20 bp, Artificial
  CRISPR gRNA sequence
ggggaatcgcttgaatccag

SEQ ID NO: 148568 - DNA, 20 bp, Artificial
  CRISPR gRNA sequence
gggaatcgcttgaatccagg

SEQ ID NO: 148569 - DNA, 20 bp, Artificial
  CRISPR gRNA sequence
aatcgcttgaatccaggagg

SEQ ID NO: 148570 - DNA, 20 bp, Artificial
  CRISPR gRNA sequence
tcgcttgaatccaggaggtg

SEQ ID NO: 148571 - DNA, 20 bp, Artificial
  CRISPR gRNA sequence
cgcttgaatccaggaggtgg

SEQ ID NO: 148572 - DNA, 20 bp, Artificial
  CRISPR gRNA sequence
aatccaggaggtggaggctg

SEQ ID NO: 148573 - DNA, 20 bp, Artificial
  CRISPR gRNA sequence
caggaggtggaggctgcagt

SEQ ID NO: 148574 - DNA, 20 bp, Artificial
  CRISPR gRNA sequence
ggtggaggctgcagtgagct

SEQ ID NO: 148575 - DNA, 20 bp, Artificial
  CRISPR gRNA sequence
gtggaggctgcagtgagctg

SEQ ID NO: 148576 - DNA, 20 bp, Artificial
  CRISPR gRNA sequence
ctgaggtcgcgccactgcac

SEQ ID NO: 148577 - DNA, 20 bp, Artificial
  CRISPR gRNA sequence
gaggtcgcgccactgcacta

SEQ ID NO: 148578 - DNA, 20 bp, Artificial
  CRISPR gRNA sequence
cgcgccactgcactagagcc

SEQ ID NO: 148579 - DNA, 20 bp, Artificial
  CRISPR gRNA sequence
actgcactagagcctggcaa

SEQ ID NO: 148580 - DNA, 20 bp, Artificial
  CRISPR gRNA sequence
tgcactagagcctggcaaca

SEQ ID NO: 148581 - DNA, 20 bp, Artificial
  CRISPR gRNA sequence
ctagagcctggcaacagagc

SEQ ID NO: 148582 - DNA, 20 bp, Artificial
  CRISPR gRNA sequence
ctgtcccccgcccccgccaa

SEQ ID NO: 148583 - DNA, 20 bp, Artificial
  CRISPR gRNA sequence
cccgcccccgccaaaagaaa

SEQ ID NO: 148584 - DNA, 20 bp, Artificial
  CRISPR gRNA sequence
cccgccaaaagaaaaagaaa

SEQ ID NO: 148585 - DNA, 20 bp, Artificial
  CRISPR gRNA sequence
ccaaaagaaaaagaaaaaga

SEQ ID NO: 148586 - DNA, 20 bp, Artificial
  CRISPR gRNA sequence
caaaagaaaaagaaaaagaa

SEQ ID NO: 148587 - DNA, 20 bp, Artificial
  CRISPR gRNA sequence
agaaaaagaaaaagaaaggc

SEQ ID NO: 148588 - DNA, 20 bp, Artificial
  CRISPR gRNA sequence
gaaaaagaaaaagaaaggcc

SEQ ID NO: 148589 - DNA, 20 bp, Artificial
  CRISPR gRNA sequence
agaaaaagaaaggccaggtg

SEQ ID NO: 148590 - DNA, 20 bp, Artificial
  CRISPR gRNA sequence
aaaagaaaggccaggtgcgg

SEQ ID NO: 148591 - DNA, 20 bp, Artificial
  CRISPR gRNA sequence
cacacctgtaaccccaactt

SEQ ID NO: 148592 - DNA, 20 bp, Artificial
  CRISPR gRNA sequence
acacctgtaaccccaacttt

SEQ ID NO: 148593 - DNA, 20 bp, Artificial
  CRISPR gRNA sequence
acctgtaaccccaactttgg

SEQ ID NO: 148594 - DNA, 20 bp, Artificial
  CRISPR gRNA sequence
cctgtaaccccaactttggg

SEQ ID NO: 148595 - DNA, 20 bp, Artificial
  CRISPR gRNA sequence
aaccccaactttgggaggct

SEQ ID NO: 148596 - DNA, 20 bp, Artificial
  CRISPR gRNA sequence
accccaactttgggaggctg

SEQ ID NO: 148597 - DNA, 20 bp, Artificial
  CRISPR gRNA sequence
ccaactttgggaggctgagg

SEQ ID NO: 148598 - DNA, 20 bp, Artificial
  CRISPR gRNA sequence
caactttgggaggctgaggc

SEQ ID NO: 148599 - DNA, 20 bp, Artificial
  CRISPR gRNA sequence
actttgggaggctgaggcag

SEQ ID NO: 148600 - DNA, 20 bp, Artificial
  CRISPR gRNA sequence
ctttgggaggctgaggcagg

SEQ ID NO: 148601 - DNA, 20 bp, Artificial
  CRISPR gRNA sequence
ctgaggcaggaggatcacct

SEQ ID NO: 148602 - DNA, 20 bp, Artificial
  CRISPR gRNA sequence
tgaggcaggaggatcacctg

SEQ ID NO: 148603 - DNA, 20 bp, Artificial
  CRISPR gRNA sequence
gcaggaggatcacctgaggt

SEQ ID NO: 148604 - DNA, 20 bp, Artificial
  CRISPR gRNA sequence
caggaggatcacctgaggtc

SEQ ID NO: 148605 - DNA, 20 bp, Artificial
  CRISPR gRNA sequence
ggaggatcacctgaggtcag

SEQ ID NO: 148606 - DNA, 20 bp, Artificial
  CRISPR gRNA sequence
tcacctgaggtcaggagttc

SEQ ID NO: 148607 - DNA, 20 bp, Artificial
  CRISPR gRNA sequence
tgaggtcaggagttcaagac

SEQ ID NO: 148608 - DNA, 20 bp, Artificial
  CRISPR gRNA sequence
tcaggagttcaagaccagcc

SEQ ID NO: 148609 - DNA, 20 bp, Artificial
  CRISPR gRNA sequence
caagaccagcctggccaaca

SEQ ID NO: 148610 - DNA, 20 bp, Artificial
  CRISPR gRNA sequence
tctactaaaaatacaaaaat

SEQ ID NO: 148611 - DNA, 20 bp, Artificial
  CRISPR gRNA sequence
ctaaaaatacaaaaattagc

SEQ ID NO: 148612 - DNA, 20 bp, Artificial
  CRISPR gRNA sequence
taaaaatacaaaaattagcc

SEQ ID NO: 148613 - DNA, 20 bp, Artificial
  CRISPR gRNA sequence
atacaaaaattagccaggca

SEQ ID NO: 148614 - DNA, 20 bp, Artificial
  CRISPR gRNA sequence
caaaaattagccaggcatgg

SEQ ID NO: 148615 - DNA, 20 bp, Artificial
  CRISPR gRNA sequence
aaattagccaggcatggtgg

SEQ ID NO: 148616 - DNA, 20 bp, Artificial
  CRISPR gRNA sequence
aattagccaggcatggtggc

SEQ ID NO: 148617 - DNA, 20 bp, Artificial
  CRISPR gRNA sequence
gtggcaggcgcctgtaatcc

SEQ ID NO: 148618 - DNA, 20 bp, Artificial
  CRISPR gRNA sequence
cgcctgtaatcccagctact

SEQ ID NO: 148619 - DNA, 20 bp, Artificial
  CRISPR gRNA sequence
gcctgtaatcccagctactt

SEQ ID NO: 148620 - DNA, 20 bp, Artificial
  CRISPR gRNA sequence
ctgtaatcccagctacttgg

SEQ ID NO: 148621 - DNA, 20 bp, Artificial
  CRISPR gRNA sequence
tgtaatcccagctacttggg

SEQ ID NO: 148622 - DNA, 20 bp, Artificial
  CRISPR gRNA sequence
tcccagctacttgggaggct

SEQ ID NO: 148623 - DNA, 20 bp, Artificial
  CRISPR gRNA sequence
cccagctacttgggaggcta

SEQ ID NO: 148624 - DNA, 20 bp, Artificial
  CRISPR gRNA sequence
tacttgggaggctaaggcat

SEQ ID NO: 148625 - DNA, 20 bp, Artificial
  CRISPR gRNA sequence
gcatgagaatcgcttgaacc

SEQ ID NO: 148626 - DNA, 20 bp, Artificial
  CRISPR gRNA sequence
catgagaatcgcttgaaccc

SEQ ID NO: 148627 - DNA, 20 bp, Artificial
  CRISPR gRNA sequence
tgagaatcgcttgaacccag

SEQ ID NO: 148628 - DNA, 20 bp, Artificial
  CRISPR gRNA sequence
gagaatcgcttgaacccagg

SEQ ID NO: 148629 - DNA, 20 bp, Artificial
  CRISPR gRNA sequence
aatcgcttgaacccaggagg

SEQ ID NO: 148630 - DNA, 20 bp, Artificial
  CRISPR gRNA sequence
tcgcttgaacccaggaggtg

SEQ ID NO: 148631 - DNA, 20 bp, Artificial
  CRISPR gRNA sequence
cgcttgaacccaggaggtgg

SEQ ID NO: 148632 - DNA, 20 bp, Artificial
  CRISPR gRNA sequence
aacccaggaggtggaggttg

SEQ ID NO: 148633 - DNA, 20 bp, Artificial
  CRISPR gRNA sequence
ggtggaggttgcagtgaacc

SEQ ID NO: 148634 - DNA, 20 bp, Artificial
  CRISPR gRNA sequence
catgccactgcactccatac

SEQ ID NO: 148635 - DNA, 20 bp, Artificial
  CRISPR gRNA sequence
atgccactgcactccatact

SEQ ID NO: 148636 - DNA, 20 bp, Artificial
  CRISPR gRNA sequence
ctgcactccatactgggata

SEQ ID NO: 148637 - DNA, 20 bp, Artificial
  CRISPR gRNA sequence
actccatactgggatacagc

SEQ ID NO: 148638 - DNA, 20 bp, Artificial
  CRISPR gRNA sequence
agactccgtcccaaaaaaaa

SEQ ID NO: 148639 - DNA, 20 bp, Artificial
  CRISPR gRNA sequence
tccgtcccaaaaaaaaaagt

SEQ ID NO: 148640 - DNA, 20 bp, Artificial
  CRISPR gRNA sequence
gattatttatccaattattc

SEQ ID NO: 148641 - DNA, 20 bp, Artificial
  CRISPR gRNA sequence
tttatccaattattccagtt

SEQ ID NO: 148642 - DNA, 20 bp, Artificial
  CRISPR gRNA sequence
ttatccaattattccagttc

SEQ ID NO: 148643 - DNA, 20 bp, Artificial
  CRISPR gRNA sequence
tatccaattattccagttca

SEQ ID NO: 148644 - DNA, 20 bp, Artificial
  CRISPR gRNA sequence
attattccagttcagggttg

SEQ ID NO: 148645 - DNA, 20 bp, Artificial
  CRISPR gRNA sequence
ttcagggttgcagatgattg

SEQ ID NO: 148646 - DNA, 20 bp, Artificial
  CRISPR gRNA sequence
atgattgaagcctatcccaa

SEQ ID NO: 148647 - DNA, 20 bp, Artificial
  CRISPR gRNA sequence
tgaagcctatcccaacagtt

SEQ ID NO: 148648 - DNA, 20 bp, Artificial
  CRISPR gRNA sequence
gaagcctatcccaacagttc

SEQ ID NO: 148649 - DNA, 20 bp, Artificial
  CRISPR gRNA sequence
aagcctatcccaacagttca

SEQ ID NO: 148650 - DNA, 20 bp, Artificial
  CRISPR gRNA sequence
atcccaacagttcagggcac

SEQ ID NO: 148651 - DNA, 20 bp, Artificial
  CRISPR gRNA sequence
tcccaacagttcagggcaca

SEQ ID NO: 148652 - DNA, 20 bp, Artificial
  CRISPR gRNA sequence
caacagttcagggcacaagg

SEQ ID NO: 148653 - DNA, 20 bp, Artificial
  CRISPR gRNA sequence
aacagttcagggcacaaggt

SEQ ID NO: 148654 - DNA, 20 bp, Artificial
  CRISPR gRNA sequence
cagggcacaaggtgggaacc

SEQ ID NO: 148655 - DNA, 20 bp, Artificial
  CRISPR gRNA sequence
cacaaggtgggaaccaagcc

SEQ ID NO: 148656 - DNA, 20 bp, Artificial
  CRISPR gRNA sequence
aagcctggacaactcaatca

SEQ ID NO: 148657 - DNA, 20 bp, Artificial
  CRISPR gRNA sequence
agcctggacaactcaatcac

SEQ ID NO: 148658 - DNA, 20 bp, Artificial
  CRISPR gRNA sequence
gcctggacaactcaatcaca

SEQ ID NO: 148659 - DNA, 20 bp, Artificial
  CRISPR gRNA sequence
tcacagggcacactctcact

SEQ ID NO: 148660 - DNA, 20 bp, Artificial
  CRISPR gRNA sequence
cacagggcacactctcactc

SEQ ID NO: 148661 - DNA, 20 bp, Artificial
  CRISPR gRNA sequence
ggcacactctcactcaggct

SEQ ID NO: 148662 - DNA, 20 bp, Artificial
  CRISPR gRNA sequence
tcactcaggctgagacaatt

SEQ ID NO: 148663 - DNA, 20 bp, Artificial
  CRISPR gRNA sequence
taacctaacatgcacatatt

SEQ ID NO: 148664 - DNA, 20 bp, Artificial
  CRISPR gRNA sequence
aacctaacatgcacatattc

SEQ ID NO: 148665 - DNA, 20 bp, Artificial
  CRISPR gRNA sequence
catgcacatattcgggatgc

SEQ ID NO: 148666 - DNA, 20 bp, Artificial
  CRISPR gRNA sequence
gcacatattcgggatgcaag

SEQ ID NO: 148667 - DNA, 20 bp, Artificial
  CRISPR gRNA sequence
atattcgggatgcaagaaga

SEQ ID NO: 148668 - DNA, 20 bp, Artificial
  CRISPR gRNA sequence
ttcgggatgcaagaagaaag

SEQ ID NO: 148669 - DNA, 20 bp, Artificial
  CRISPR gRNA sequence
cgggatgcaagaagaaagca

SEQ ID NO: 148670 - DNA, 20 bp, Artificial
  CRISPR gRNA sequence
gcaagaagaaagcagagtac

SEQ ID NO: 148671 - DNA, 20 bp, Artificial
  CRISPR gRNA sequence
gtactggaaaaaaaaccaaa

SEQ ID NO: 148672 - DNA, 20 bp, Artificial
  CRISPR gRNA sequence
gaaaaaaaaccaaacagacg

SEQ ID NO: 148673 - DNA, 20 bp, Artificial
  CRISPR gRNA sequence
aaaaaaaaccaaacagacgt

SEQ ID NO: 148674 - DNA, 20 bp, Artificial
  CRISPR gRNA sequence
aaaaaaaccaaacagacgtg

SEQ ID NO: 148675 - DNA, 20 bp, Artificial
  CRISPR gRNA sequence
gacaatgctcaaactccaca

SEQ ID NO: 148676 - DNA, 20 bp, Artificial
  CRISPR gRNA sequence
caatgctcaaactccacaca

SEQ ID NO: 148677 - DNA, 20 bp, Artificial
  CRISPR gRNA sequence
atgctcaaactccacacaga

SEQ ID NO: 148678 - DNA, 20 bp, Artificial
  CRISPR gRNA sequence
ctccacacagagagtgaccc

SEQ ID NO: 148679 - DNA, 20 bp, Artificial
  CRISPR gRNA sequence
acacagagagtgaccccggc

SEQ ID NO: 148680 - DNA, 20 bp, Artificial
  CRISPR gRNA sequence
cacagagagtgaccccggcc

SEQ ID NO: 148681 - DNA, 20 bp, Artificial
  CRISPR gRNA sequence
gagtgaccccggccaggaac

SEQ ID NO: 148682 - DNA, 20 bp, Artificial
  CRISPR gRNA sequence
taatcaaacaacattgtctg

SEQ ID NO: 148683 - DNA, 20 bp, Artificial
  CRISPR gRNA sequence
ctgaagaccctctgtactac

SEQ ID NO: 148684 - DNA, 20 bp, Artificial
  CRISPR gRNA sequence
tactactagttgaaccatcc

SEQ ID NO: 148685 - DNA, 20 bp, Artificial
  CRISPR gRNA sequence
actactagttgaaccatcct

SEQ ID NO: 148686 - DNA, 20 bp, Artificial
  CRISPR gRNA sequence
actagttgaaccatcctggg

SEQ ID NO: 148687 - DNA, 20 bp, Artificial
  CRISPR gRNA sequence
aaatgcaaacaaatatatct

SEQ ID NO: 148688 - DNA, 20 bp, Artificial
  CRISPR gRNA sequence
caaacaaatatatcttagct

SEQ ID NO: 148689 - DNA, 20 bp, Artificial
  CRISPR gRNA sequence
atcttagctcagtactgact

SEQ ID NO: 148690 - DNA, 20 bp, Artificial
  CRISPR gRNA sequence
ctaagaaacaaatataatgt

SEQ ID NO: 148691 - DNA, 20 bp, Artificial
  CRISPR gRNA sequence
atgttccccaaaccgacttg

SEQ ID NO: 148692 - DNA, 20 bp, Artificial
  CRISPR gRNA sequence
ccaaaccgacttgcagccct

SEQ ID NO: 148693 - DNA, 20 bp, Artificial
  CRISPR gRNA sequence
caaaccgacttgcagccctt

SEQ ID NO: 148694 - DNA, 20 bp, Artificial
  CRISPR gRNA sequence
cttgcagcccttaggctttt

SEQ ID NO: 148695 - DNA, 20 bp, Artificial
  CRISPR gRNA sequence
ttgcagcccttaggcttttt

SEQ ID NO: 148696 - DNA, 20 bp, Artificial
  CRISPR gRNA sequence
gcccttaggctttttgggtt

SEQ ID NO: 148697 - DNA, 20 bp, Artificial
  CRISPR gRNA sequence
ctccaacttaacatgtcaac

SEQ ID NO: 148698 - DNA, 20 bp, Artificial
  CRISPR gRNA sequence
acaagtatctctctatgatc

SEQ ID NO: 148699 - DNA, 20 bp, Artificial
  CRISPR gRNA sequence
caagtatctctctatgatca

SEQ ID NO: 148700 - DNA, 20 bp, Artificial
  CRISPR gRNA sequence
atcatatcttcctctgtcat

SEQ ID NO: 148701 - DNA, 20 bp, Artificial
  CRISPR gRNA sequence
tcatatcttcctctgtcatg

SEQ ID NO: 148702 - DNA, 20 bp, Artificial
  CRISPR gRNA sequence
tttcactttattgtgcttca

SEQ ID NO: 148703 - DNA, 20 bp, Artificial
  CRISPR gRNA sequence
acagatactgctctaccaac

SEQ ID NO: 148704 - DNA, 20 bp, Artificial
  CRISPR gRNA sequence
ccaactggccattcccacct

SEQ ID NO: 148705 - DNA, 20 bp, Artificial
  CRISPR gRNA sequence
caactggccattcccacctc

SEQ ID NO: 148706 - DNA, 20 bp, Artificial
  CRISPR gRNA sequence
ctcgggcctccctattacct

SEQ ID NO: 148707 - DNA, 20 bp, Artificial
  CRISPR gRNA sequence
cctccctattacctgagaca

SEQ ID NO: 148708 - DNA, 20 bp, Artificial
  CRISPR gRNA sequence
gccacttaataaccctacaa

SEQ ID NO: 148709 - DNA, 20 bp, Artificial
  CRISPR gRNA sequence
ataaccctacaacggcctct

SEQ ID NO: 148710 - DNA, 20 bp, Artificial
  CRISPR gRNA sequence
acaacggcctctaagcgttc

SEQ ID NO: 148711 - DNA, 20 bp, Artificial
  CRISPR gRNA sequence
gcctctaagcgttcaagtaa

SEQ ID NO: 148712 - DNA, 20 bp, Artificial
  CRISPR gRNA sequence
taagcgttcaagtaaaagaa

SEQ ID NO: 148713 - DNA, 20 bp, Artificial
  CRISPR gRNA sequence
gtctcacatctttcacttaa

SEQ ID NO: 148714 - DNA, 20 bp, Artificial
  CRISPR gRNA sequence
catctttcacttaaaagcta

SEQ ID NO: 148715 - DNA, 20 bp, Artificial
  CRISPR gRNA sequence
atctttcacttaaaagctaa

SEQ ID NO: 148716 - DNA, 20 bp, Artificial
  CRISPR gRNA sequence
ttcacttaaaagctaaaggc

SEQ ID NO: 148717 - DNA, 20 bp, Artificial
  CRISPR gRNA sequence
tcacttaaaagctaaaggcc

SEQ ID NO: 148718 - DNA, 20 bp, Artificial
  CRISPR gRNA sequence
taaaagctaaaggccaggtg

SEQ ID NO: 148719 - DNA, 20 bp, Artificial
  CRISPR gRNA sequence
aagctaaaggccaggtgtgg

SEQ ID NO: 148720 - DNA, 20 bp, Artificial
  CRISPR gRNA sequence
gtggctcacgcctgtaatcc

SEQ ID NO: 148721 - DNA, 20 bp, Artificial
  CRISPR gRNA sequence
gcctgtaatcccagaacttt

SEQ ID NO: 148722 - DNA, 20 bp, Artificial
  CRISPR gRNA sequence
cctgtaatcccagaactttg

SEQ ID NO: 148723 - DNA, 20 bp, Artificial
  CRISPR gRNA sequence
tcccagaactttgaggcacc

SEQ ID NO: 148724 - DNA, 20 bp, Artificial
  CRISPR gRNA sequence
cccagaactttgaggcacca

SEQ ID NO: 148725 - DNA, 20 bp, Artificial
  CRISPR gRNA sequence
cagaactttgaggcaccaag

SEQ ID NO: 148726 - DNA, 20 bp, Artificial
  CRISPR gRNA sequence
agaactttgaggcaccaagg

SEQ ID NO: 148727 - DNA, 20 bp, Artificial
  CRISPR gRNA sequence
gaactttgaggcaccaagga

SEQ ID NO: 148728 - DNA, 20 bp, Artificial
  CRISPR gRNA sequence
gagggctgactgcatgaatc

SEQ ID NO: 148729 - DNA, 20 bp, Artificial
  CRISPR gRNA sequence
agggctgactgcatgaatcc

SEQ ID NO: 148730 - DNA, 20 bp, Artificial
  CRISPR gRNA sequence
ggctgactgcatgaatccag

SEQ ID NO: 148731 - DNA, 20 bp, Artificial
  CRISPR gRNA sequence
ctgcatgaatccaggagttc

SEQ ID NO: 148732 - DNA, 20 bp, Artificial
  CRISPR gRNA sequence
tgaatccaggagttcgagac

SEQ ID NO: 148733 - DNA, 20 bp, Artificial
  CRISPR gRNA sequence
ccaggagttcgagaccagct

SEQ ID NO: 148734 - DNA, 20 bp, Artificial
  CRISPR gRNA sequence
tcgagaccagcttggcaaca

SEQ ID NO: 148735 - DNA, 20 bp, Artificial
  CRISPR gRNA sequence
gagaccagcttggcaacaca

SEQ ID NO: 148736 - DNA, 20 bp, Artificial
  CRISPR gRNA sequence
gaccagcttggcaacacaga

SEQ ID NO: 148737 - DNA, 20 bp, Artificial
  CRISPR gRNA sequence
aaaaaaaaaaaaaaaaaaaa

SEQ ID NO: 148738 - DNA, 20 bp, Artificial
  CRISPR gRNA sequence
aaaaaaaaaaaaaaaaagaa

SEQ ID NO: 148739 - DNA, 20 bp, Artificial
  CRISPR gRNA sequence
aaaaaaaaaaaaagaaaaga

SEQ ID NO: 148740 - DNA, 20 bp, Artificial
  CRISPR gRNA sequence
aaaagaaaagaaagaaaaat

SEQ ID NO: 148741 - DNA, 20 bp, Artificial
  CRISPR gRNA sequence
gaaaagaaagaaaaattagc

SEQ ID NO: 148742 - DNA, 20 bp, Artificial
  CRISPR gRNA sequence
aaattagccagtcctgctga

SEQ ID NO: 148743 - DNA, 20 bp, Artificial
  CRISPR gRNA sequence
ctgctgatggcatgcacctg

SEQ ID NO: 148744 - DNA, 20 bp, Artificial
  CRISPR gRNA sequence
atggcatgcacctgtggtcc

SEQ ID NO: 148745 - DNA, 20 bp, Artificial
  CRISPR gRNA sequence
cacctgtggtcctagctact

SEQ ID NO: 148746 - DNA, 20 bp, Artificial
  CRISPR gRNA sequence
ctgtggtcctagctactcag

SEQ ID NO: 148747 - DNA, 20 bp, Artificial
  CRISPR gRNA sequence
tgtggtcctagctactcaga

SEQ ID NO: 148748 - DNA, 20 bp, Artificial
  CRISPR gRNA sequence
tcctagctactcagaaggct

SEQ ID NO: 148749 - DNA, 20 bp, Artificial
  CRISPR gRNA sequence
cctagctactcagaaggctg

SEQ ID NO: 148750 - DNA, 20 bp, Artificial
  CRISPR gRNA sequence
agctactcagaaggctgagg

SEQ ID NO: 148751 - DNA, 20 bp, Artificial
  CRISPR gRNA sequence
gctactcagaaggctgaggt

SEQ ID NO: 148752 - DNA, 20 bp, Artificial
  CRISPR gRNA sequence
tactcagaaggctgaggtgg

SEQ ID NO: 148753 - DNA, 20 bp, Artificial
  CRISPR gRNA sequence
actcagaaggctgaggtggg

SEQ ID NO: 148754 - DNA, 20 bp, Artificial
  CRISPR gRNA sequence
gctgaggtgggaggatcact

SEQ ID NO: 148755 - DNA, 20 bp, Artificial
  CRISPR gRNA sequence
ctgaggtgggaggatcactt

SEQ ID NO: 148756 - DNA, 20 bp, Artificial
  CRISPR gRNA sequence
aggtgggaggatcacttggg

SEQ ID NO: 148757 - DNA, 20 bp, Artificial
  CRISPR gRNA sequence
tgggaggatcacttgggcag

SEQ ID NO: 148758 - DNA, 20 bp, Artificial
  CRISPR gRNA sequence
aggatcacttgggcagcagt

SEQ ID NO: 148759 - DNA, 20 bp, Artificial
  CRISPR gRNA sequence
atgatcatgccaccacactc

SEQ ID NO: 148760 - DNA, 20 bp, Artificial
  CRISPR gRNA sequence
catgccaccacactccagcc

SEQ ID NO: 148761 - DNA, 20 bp, Artificial
  CRISPR gRNA sequence
atgccaccacactccagcct

SEQ ID NO: 148762 - DNA, 20 bp, Artificial
  CRISPR gRNA sequence
ccacactccagcctgggtga

SEQ ID NO: 148763 - DNA, 20 bp, Artificial
  CRISPR gRNA sequence
tctctaactcaatcaatcga

SEQ ID NO: 148764 - DNA, 20 bp, Artificial
  CRISPR gRNA sequence
taactcaatcaatcgaaagc

SEQ ID NO: 148765 - DNA, 20 bp, Artificial
  CRISPR gRNA sequence
atcgaaagctagaaatgatt

SEQ ID NO: 148766 - DNA, 20 bp, Artificial
  CRISPR gRNA sequence
aagctagaaatgattaagct

SEQ ID NO: 148767 - DNA, 20 bp, Artificial
  CRISPR gRNA sequence
tagaaatgattaagcttagt

SEQ ID NO: 148768 - DNA, 20 bp, Artificial
  CRISPR gRNA sequence
agaaatgattaagcttagtg

SEQ ID NO: 148769 - DNA, 20 bp, Artificial
  CRISPR gRNA sequence
atgattaagcttagtgagga

SEQ ID NO: 148770 - DNA, 20 bp, Artificial
  CRISPR gRNA sequence
tagtgaggaaagcacatcaa

SEQ ID NO: 148771 - DNA, 20 bp, Artificial
  CRISPR gRNA sequence
aagcacatcaaaagctgata

SEQ ID NO: 148772 - DNA, 20 bp, Artificial
  CRISPR gRNA sequence
agcacatcaaaagctgatat

SEQ ID NO: 148773 - DNA, 20 bp, Artificial
  CRISPR gRNA sequence
gcacatcaaaagctgatatg

SEQ ID NO: 148774 - DNA, 20 bp, Artificial
  CRISPR gRNA sequence
atcaaaagctgatatggggc

SEQ ID NO: 148775 - DNA, 20 bp, Artificial
  CRISPR gRNA sequence
tcaaaagctgatatggggct

SEQ ID NO: 148776 - DNA, 20 bp, Artificial
  CRISPR gRNA sequence
agctgatatggggctgggcg

SEQ ID NO: 148777 - DNA, 20 bp, Artificial
  CRISPR gRNA sequence
tgatatggggctgggcgcgg

SEQ ID NO: 148778 - DNA, 20 bp, Artificial
  CRISPR gRNA sequence
gtggctcatgcctgtaatcc

SEQ ID NO: 148779 - DNA, 20 bp, Artificial
  CRISPR gRNA sequence
tgcctgtaatcccagcactt

SEQ ID NO: 148780 - DNA, 20 bp, Artificial
  CRISPR gRNA sequence
gcctgtaatcccagcacttt

SEQ ID NO: 148781 - DNA, 20 bp, Artificial
  CRISPR gRNA sequence
ctgtaatcccagcactttgg

SEQ ID NO: 148782 - DNA, 20 bp, Artificial
  CRISPR gRNA sequence
tgtaatcccagcactttggg

SEQ ID NO: 148783 - DNA, 20 bp, Artificial
  CRISPR gRNA sequence
tcccagcactttgggaggcc

SEQ ID NO: 148784 - DNA, 20 bp, Artificial
  CRISPR gRNA sequence
cccagcactttgggaggccg

SEQ ID NO: 148785 - DNA, 20 bp, Artificial
  CRISPR gRNA sequence
agcactttgggaggccgagg

SEQ ID NO: 148786 - DNA, 20 bp, Artificial
  CRISPR gRNA sequence
gcactttgggaggccgaggc

SEQ ID NO: 148787 - DNA, 20 bp, Artificial
  CRISPR gRNA sequence
ctttgggaggccgaggcggg

SEQ ID NO: 148788 - DNA, 20 bp, Artificial
  CRISPR gRNA sequence
ccgaggcgggtggatcacct

SEQ ID NO: 148789 - DNA, 20 bp, Artificial
  CRISPR gRNA sequence
cgaggcgggtggatcacctg

SEQ ID NO: 148790 - DNA, 20 bp, Artificial
  CRISPR gRNA sequence
gcgggtggatcacctgaggt

SEQ ID NO: 148791 - DNA, 20 bp, Artificial
  CRISPR gRNA sequence
cgggtggatcacctgaggtc

SEQ ID NO: 148792 - DNA, 20 bp, Artificial
  CRISPR gRNA sequence
ggtggatcacctgaggtcag

SEQ ID NO: 148793 - DNA, 20 bp, Artificial
  CRISPR gRNA sequence
tcacctgaggtcaggagttc

SEQ ID NO: 148794 - DNA, 20 bp, Artificial
  CRISPR gRNA sequence
tctaccaaaaatacaaaaat

SEQ ID NO: 148795 - DNA, 20 bp, Artificial
  CRISPR gRNA sequence
ccaaaaatacaaaaattagc

SEQ ID NO: 148796 - DNA, 20 bp, Artificial
  CRISPR gRNA sequence
caaaaatacaaaaattagcc

SEQ ID NO: 148797 - DNA, 20 bp, Artificial
  CRISPR gRNA sequence
atacaaaaattagccaggca

SEQ ID NO: 148798 - DNA, 20 bp, Artificial
  CRISPR gRNA sequence
caaaaattagccaggcatgg

SEQ ID NO: 148799 - DNA, 20 bp, Artificial
  CRISPR gRNA sequence
aaattagccaggcatggtag

SEQ ID NO: 148800 - DNA, 20 bp, Artificial
  CRISPR gRNA sequence
aattagccaggcatggtagt

SEQ ID NO: 148801 - DNA, 20 bp, Artificial
  CRISPR gRNA sequence
gtagtgggcgcctgtaatcc

SEQ ID NO: 148802 - DNA, 20 bp, Artificial
  CRISPR gRNA sequence
cgcctgtaatcccagctact

SEQ ID NO: 148803 - DNA, 20 bp, Artificial
  CRISPR gRNA sequence
gcctgtaatcccagctactt

SEQ ID NO: 148804 - DNA, 20 bp, Artificial
  CRISPR gRNA sequence
tgtaatcccagctacttggg

SEQ ID NO: 148805 - DNA, 20 bp, Artificial
  CRISPR gRNA sequence
tcccagctacttgggaagct

SEQ ID NO: 148806 - DNA, 20 bp, Artificial
  CRISPR gRNA sequence
cccagctacttgggaagctg

SEQ ID NO: 148807 - DNA, 20 bp, Artificial
  CRISPR gRNA sequence
agctacttgggaagctgagg

SEQ ID NO: 148808 - DNA, 20 bp, Artificial
  CRISPR gRNA sequence
tacttgggaagctgaggcag

SEQ ID NO: 148809 - DNA, 20 bp, Artificial
  CRISPR gRNA sequence
gcagaagaatctcttgaacc

SEQ ID NO: 148810 - DNA, 20 bp, Artificial
  CRISPR gRNA sequence
cagaagaatctcttgaaccc

SEQ ID NO: 148811 - DNA, 20 bp, Artificial
  CRISPR gRNA sequence
gaagaatctcttgaacccag

SEQ ID NO: 148812 - DNA, 20 bp, Artificial
  CRISPR gRNA sequence
aagaatctcttgaacccagg

SEQ ID NO: 148813 - DNA, 20 bp, Artificial
  CRISPR gRNA sequence
tctcttgaacccaggaggcg

SEQ ID NO: 148814 - DNA, 20 bp, Artificial
  CRISPR gRNA sequence
ctcttgaacccaggaggcga

SEQ ID NO: 148815 - DNA, 20 bp, Artificial
  CRISPR gRNA sequence
aacccaggaggcgaaggttg

SEQ ID NO: 148816 - DNA, 20 bp, Artificial
  CRISPR gRNA sequence
caggaggcgaaggttgcagt

SEQ ID NO: 148817 - DNA, 20 bp, Artificial
  CRISPR gRNA sequence
ggcgaaggttgcagtcagct

SEQ ID NO: 148818 - DNA, 20 bp, Artificial
  CRISPR gRNA sequence
gagatcgtaccattgcactc

SEQ ID NO: 148819 - DNA, 20 bp, Artificial
  CRISPR gRNA sequence
cgtaccattgcactccagcc

SEQ ID NO: 148820 - DNA, 20 bp, Artificial
  CRISPR gRNA sequence
gtaccattgcactccagcct

SEQ ID NO: 148821 - DNA, 20 bp, Artificial
  CRISPR gRNA sequence
ttgcactccagcctgggcga

SEQ ID NO: 148822 - DNA, 20 bp, Artificial
  CRISPR gRNA sequence
tccagcctgggcgacagtgc

SEQ ID NO: 148823 - DNA, 20 bp, Artificial
  CRISPR gRNA sequence
tgggcgacagtgcaagactc

SEQ ID NO: 148824 - DNA, 20 bp, Artificial
  CRISPR gRNA sequence
tccggttcaaaaaaaaaaaa

SEQ ID NO: 148825 - DNA, 20 bp, Artificial
  CRISPR gRNA sequence
cggttcaaaaaaaaaaaaaa

SEQ ID NO: 148826 - DNA, 20 bp, Artificial
  CRISPR gRNA sequence
caaaaaaaaaaaaaagagct

SEQ ID NO: 148827 - DNA, 20 bp, Artificial
  CRISPR gRNA sequence
aaaaaaaaaaagagctgaga

SEQ ID NO: 148828 - DNA, 20 bp, Artificial
  CRISPR gRNA sequence
aaaaagagctgagatggacc

SEQ ID NO: 148829 - DNA, 20 bp, Artificial
  CRISPR gRNA sequence
aaagagctgagatggaccaa

SEQ ID NO: 148830 - DNA, 20 bp, Artificial
  CRISPR gRNA sequence
agctgagatggaccaagagc

SEQ ID NO: 148831 - DNA, 20 bp, Artificial
  CRISPR gRNA sequence
gctgagatggaccaagagct

SEQ ID NO: 148832 - DNA, 20 bp, Artificial
  CRISPR gRNA sequence
cttgcaccaaacacttaccc

SEQ ID NO: 148833 - DNA, 20 bp, Artificial
  CRISPR gRNA sequence
ttacccaagctgtgactgca

SEQ ID NO: 148834 - DNA, 20 bp, Artificial
  CRISPR gRNA sequence
aagctgtgactgcaaagaaa

SEQ ID NO: 148835 - DNA, 20 bp, Artificial
  CRISPR gRNA sequence
ctgcaaagaaaaagttcttg

SEQ ID NO: 148836 - DNA, 20 bp, Artificial
  CRISPR gRNA sequence
tgcaaagaaaaagttcttga

SEQ ID NO: 148837 - DNA, 20 bp, Artificial
  CRISPR gRNA sequence
aagttcttgaaggaaattaa

SEQ ID NO: 148838 - DNA, 20 bp, Artificial
  CRISPR gRNA sequence
ggaaattaaaagtgctcctc

SEQ ID NO: 148839 - DNA, 20 bp, Artificial
  CRISPR gRNA sequence
cctccagtgaacacacaaat

SEQ ID NO: 148840 - DNA, 20 bp, Artificial
  CRISPR gRNA sequence
cagtgaacacacaaataaga

SEQ ID NO: 148841 - DNA, 20 bp, Artificial
  CRISPR gRNA sequence
cacacaaataagaaagcaaa

SEQ ID NO: 148842 - DNA, 20 bp, Artificial
  CRISPR gRNA sequence
acagctttattgctgatatg

SEQ ID NO: 148843 - DNA, 20 bp, Artificial
  CRISPR gRNA sequence
ctttattgctgatatgaaga

SEQ ID NO: 148844 - DNA, 20 bp, Artificial
  CRISPR gRNA sequence
tgctgatatgaagaaagttt

SEQ ID NO: 148845 - DNA, 20 bp, Artificial
  CRISPR gRNA sequence
tgatatgaagaaagtttcag

SEQ ID NO: 148846 - DNA, 20 bp, Artificial
  CRISPR gRNA sequence
tgaagaaagtttcagtggtc

SEQ ID NO: 148847 - DNA, 20 bp, Artificial
  CRISPR gRNA sequence
gaaagtttcagtggtctaga

SEQ ID NO: 148848 - DNA, 20 bp, Artificial
  CRISPR gRNA sequence
agtttcagtggtctagacag

SEQ ID NO: 148849 - DNA, 20 bp, Artificial
  CRISPR gRNA sequence
accaaccacaacattccttt

SEQ ID NO: 148850 - DNA, 20 bp, Artificial
  CRISPR gRNA sequence
cacaacattcctttaagcca

SEQ ID NO: 148851 - DNA, 20 bp, Artificial
  CRISPR gRNA sequence
ctttaagccaaagcctaatg

SEQ ID NO: 148852 - DNA, 20 bp, Artificial
  CRISPR gRNA sequence
ttaagccaaagcctaatgtg

SEQ ID NO: 148853 - DNA, 20 bp, Artificial
  CRISPR gRNA sequence
ccctaactctcaattctatg

SEQ ID NO: 148854 - DNA, 20 bp, Artificial
  CRISPR gRNA sequence
cctaactctcaattctatga

SEQ ID NO: 148855 - DNA, 20 bp, Artificial
  CRISPR gRNA sequence
ctctcaattctatgaaggct

SEQ ID NO: 148856 - DNA, 20 bp, Artificial
  CRISPR gRNA sequence
ctcaattctatgaaggctga

SEQ ID NO: 148857 - DNA, 20 bp, Artificial
  CRISPR gRNA sequence
caattctatgaaggctgaga

SEQ ID NO: 148858 - DNA, 20 bp, Artificial
  CRISPR gRNA sequence
aattctatgaaggctgagag

SEQ ID NO: 148859 - DNA, 20 bp, Artificial
  CRISPR gRNA sequence
ctatgaaggctgagagaggt

SEQ ID NO: 148860 - DNA, 20 bp, Artificial
  CRISPR gRNA sequence
tatgaaggctgagagaggtg

SEQ ID NO: 148861 - DNA, 20 bp, Artificial
  CRISPR gRNA sequence
atgaaggctgagagaggtga

SEQ ID NO: 148862 - DNA, 20 bp, Artificial
  CRISPR gRNA sequence
tgaaggctgagagaggtgag

SEQ ID NO: 148863 - DNA, 20 bp, Artificial
  CRISPR gRNA sequence
gaaggctgagagaggtgagg

SEQ ID NO: 148864 - DNA, 20 bp, Artificial
  CRISPR gRNA sequence
tgagagaggtgagggggctg

SEQ ID NO: 148865 - DNA, 20 bp, Artificial
  CRISPR gRNA sequence
gagaggtgagggggctgcag

SEQ ID NO: 148866 - DNA, 20 bp, Artificial
  CRISPR gRNA sequence
gtgagggggctgcagaagaa

SEQ ID NO: 148867 - DNA, 20 bp, Artificial
  CRISPR gRNA sequence
gggggctgcagaagaaaagt

SEQ ID NO: 148868 - DNA, 20 bp, Artificial
  CRISPR gRNA sequence
cagaagaaaagttggttcat

SEQ ID NO: 148869 - DNA, 20 bp, Artificial
  CRISPR gRNA sequence
agaagaaaagttggttcatg

SEQ ID NO: 148870 - DNA, 20 bp, Artificial
  CRISPR gRNA sequence
aaagttggttcatgaggttt

SEQ ID NO: 148871 - DNA, 20 bp, Artificial
  CRISPR gRNA sequence
tggttcatgaggtttaagca

SEQ ID NO: 148872 - DNA, 20 bp, Artificial
  CRISPR gRNA sequence
ttcatgaggtttaagcaaag

SEQ ID NO: 148873 - DNA, 20 bp, Artificial
  CRISPR gRNA sequence
aagccatctccataacataa

SEQ ID NO: 148874 - DNA, 20 bp, Artificial
  CRISPR gRNA sequence
tctccataacataaaagtat

SEQ ID NO: 148875 - DNA, 20 bp, Artificial
  CRISPR gRNA sequence
ctccataacataaaagtata

SEQ ID NO: 148876 - DNA, 20 bp, Artificial
  CRISPR gRNA sequence
taacataaaagtataaggtg

SEQ ID NO: 148877 - DNA, 20 bp, Artificial
  CRISPR gRNA sequence
cataaaagtataaggtgaag

SEQ ID NO: 148878 - DNA, 20 bp, Artificial
  CRISPR gRNA sequence
aaagtataaggtgaagtagc

SEQ ID NO: 148879 - DNA, 20 bp, Artificial
  CRISPR gRNA sequence
tgaagtagcaagtgctaatg

SEQ ID NO: 148880 - DNA, 20 bp, Artificial
  CRISPR gRNA sequence
agtagcaagtgctaatgtag

SEQ ID NO: 148881 - DNA, 20 bp, Artificial
  CRISPR gRNA sequence
aagtgctaatgtagaagctg

SEQ ID NO: 148882 - DNA, 20 bp, Artificial
  CRISPR gRNA sequence
gctaatgtagaagctgcagc

SEQ ID NO: 148883 - DNA, 20 bp, Artificial
  CRISPR gRNA sequence
ctgcagcaagttttatcccg

SEQ ID NO: 148884 - DNA, 20 bp, Artificial
  CRISPR gRNA sequence
caagttttatcccgaagatc

SEQ ID NO: 148885 - DNA, 20 bp, Artificial
  CRISPR gRNA sequence
ttttatcccgaagatctagc

SEQ ID NO: 148886 - DNA, 20 bp, Artificial
  CRISPR gRNA sequence
ttatcccgaagatctagcta

SEQ ID NO: 148887 - DNA, 20 bp, Artificial
  CRISPR gRNA sequence
gctagagtaattgatgcaac

SEQ ID NO: 148888 - DNA, 20 bp, Artificial
  CRISPR gRNA sequence
caactggctacattaaacaa

SEQ ID NO: 148889 - DNA, 20 bp, Artificial
  CRISPR gRNA sequence
tacattaaacaacagaattt

SEQ ID NO: 148890 - DNA, 20 bp, Artificial
  CRISPR gRNA sequence
taaacaacagaatttcagtg

SEQ ID NO: 148891 - DNA, 20 bp, Artificial
  CRISPR gRNA sequence
gaatttcagtgcagacaaaa

SEQ ID NO: 148892 - DNA, 20 bp, Artificial
  CRISPR gRNA sequence
cagacaaaatggacttttac

SEQ ID NO: 148893 - DNA, 20 bp, Artificial
  CRISPR gRNA sequence
acaaaatggacttttactgg

SEQ ID NO: 148894 - DNA, 20 bp, Artificial
  CRISPR gRNA sequence
aaatggacttttactggaag

SEQ ID NO: 148895 - DNA, 20 bp, Artificial
  CRISPR gRNA sequence
tactggaagaagatgccatc

SEQ ID NO: 148896 - DNA, 20 bp, Artificial
  CRISPR gRNA sequence
actggaagaagatgccatca

SEQ ID NO: 148897 - DNA, 20 bp, Artificial
  CRISPR gRNA sequence
gatgccatcaaggactttca

SEQ ID NO: 148898 - DNA, 20 bp, Artificial
  CRISPR gRNA sequence
caaggactttcatagctaca

SEQ ID NO: 148899 - DNA, 20 bp, Artificial
  CRISPR gRNA sequence
ggactttcatagctacaaag

SEQ ID NO: 148900 - DNA, 20 bp, Artificial
  CRISPR gRNA sequence
tacaaagaagtcaatgcctg

SEQ ID NO: 148901 - DNA, 20 bp, Artificial
  CRISPR gRNA sequence
aaagaagtcaatgcctgtgg

SEQ ID NO: 148902 - DNA, 20 bp, Artificial
  CRISPR gRNA sequence
atttaccattccaaaaattc

SEQ ID NO: 148903 - DNA, 20 bp, Artificial
  CRISPR gRNA sequence
tttaccattccaaaaattct

SEQ ID NO: 148904 - DNA, 20 bp, Artificial
  CRISPR gRNA sequence
ttaccattccaaaaattcta

SEQ ID NO: 148905 - DNA, 20 bp, Artificial
  CRISPR gRNA sequence
ccaaaaattctagggccctt

SEQ ID NO: 148906 - DNA, 20 bp, Artificial
  CRISPR gRNA sequence
ctctgcctgtgctctataaa

SEQ ID NO: 148907 - DNA, 20 bp, Artificial
  CRISPR gRNA sequence
ctgcctgtgctctataaatg

SEQ ID NO: 148908 - DNA, 20 bp, Artificial
  CRISPR gRNA sequence
tgtgctctataaatggagca

SEQ ID NO: 148909 - DNA, 20 bp, Artificial
  CRISPR gRNA sequence
tctataaatggagcaaagct

SEQ ID NO: 148910 - DNA, 20 bp, Artificial
  CRISPR gRNA sequence
atggagcaaagcttggatga

SEQ ID NO: 148911 - DNA, 20 bp, Artificial
  CRISPR gRNA sequence
gatgacagcacatctgttta

SEQ ID NO: 148912 - DNA, 20 bp, Artificial
  CRISPR gRNA sequence
cagcacatctgtttacagcg

SEQ ID NO: 148913 - DNA, 20 bp, Artificial
  CRISPR gRNA sequence
tacagcgtggttgactattt

SEQ ID NO: 148914 - DNA, 20 bp, Artificial
  CRISPR gRNA sequence
gactatttaagctcactgtt

SEQ ID NO: 148915 - DNA, 20 bp, Artificial
  CRISPR gRNA sequence
cactgttgagacctactgct

SEQ ID NO: 148916 - DNA, 20 bp, Artificial
  CRISPR gRNA sequence
gacctactgctcagaaaaaa

SEQ ID NO: 148917 - DNA, 20 bp, Artificial
  CRISPR gRNA sequence
ctgctcactaacaatatacc

SEQ ID NO: 148918 - DNA, 20 bp, Artificial
  CRISPR gRNA sequence
cctggtcatccaaaaactga

SEQ ID NO: 148919 - DNA, 20 bp, Artificial
  CRISPR gRNA sequence
tggtcatccaaaaactgatg

SEQ ID NO: 148920 - DNA, 20 bp, Artificial
  CRISPR gRNA sequence
ggtcatccaaaaactgatgg

SEQ ID NO: 148921 - DNA, 20 bp, Artificial
  CRISPR gRNA sequence
atccaaaaactgatggaggc

SEQ ID NO: 148922 - DNA, 20 bp, Artificial
  CRISPR gRNA sequence
tccaaaaactgatggaggct

SEQ ID NO: 148923 - DNA, 20 bp, Artificial
  CRISPR gRNA sequence
caaaaactgatggaggctgg

SEQ ID NO: 148924 - DNA, 20 bp, Artificial
  CRISPR gRNA sequence
aaactgatggaggctgggag

SEQ ID NO: 148925 - DNA, 20 bp, Artificial
  CRISPR gRNA sequence
ctgatggaggctgggagcag

SEQ ID NO: 148926 - DNA, 20 bp, Artificial
  CRISPR gRNA sequence
cgcctgtaatcccaacactt

SEQ ID NO: 148927 - DNA, 20 bp, Artificial
  CRISPR gRNA sequence
gcctgtaatcccaacacttt

SEQ ID NO: 148928 - DNA, 20 bp, Artificial
  CRISPR gRNA sequence
ctgtaatcccaacactttgg

SEQ ID NO: 148929 - DNA, 20 bp, Artificial
  CRISPR gRNA sequence
tgtaatcccaacactttggg

SEQ ID NO: 148930 - DNA, 20 bp, Artificial
  CRISPR gRNA sequence
tcccaacactttgggaggcc

SEQ ID NO: 148931 - DNA, 20 bp, Artificial
  CRISPR gRNA sequence
cccaacactttgggaggcca

SEQ ID NO: 148932 - DNA, 20 bp, Artificial
  CRISPR gRNA sequence
aacactttgggaggccaagg

SEQ ID NO: 148933 - DNA, 20 bp, Artificial
  CRISPR gRNA sequence
acactttgggaggccaaggc

SEQ ID NO: 148934 - DNA, 20 bp, Artificial
  CRISPR gRNA sequence
ctttgggaggccaaggcggg

SEQ ID NO: 148935 - DNA, 20 bp, Artificial
  CRISPR gRNA sequence
ccaaggcgggcggataacct

SEQ ID NO: 148936 - DNA, 20 bp, Artificial
  CRISPR gRNA sequence
caaggcgggcggataacctg

SEQ ID NO: 148937 - DNA, 20 bp, Artificial
  CRISPR gRNA sequence
gcgggcggataacctgaggt

SEQ ID NO: 148938 - DNA, 20 bp, Artificial
  CRISPR gRNA sequence
cgggcggataacctgaggtc

SEQ ID NO: 148939 - DNA, 20 bp, Artificial
  CRISPR gRNA sequence
ggcggataacctgaggtcag

SEQ ID NO: 148940 - DNA, 20 bp, Artificial
  CRISPR gRNA sequence
taacctgaggtcaggagttc

SEQ ID NO: 148941 - DNA, 20 bp, Artificial
  CRISPR gRNA sequence
tgaggtcaggagttcgagac

SEQ ID NO: 148942 - DNA, 20 bp, Artificial
  CRISPR gRNA sequence
tcaggagttcgagaccagcc

SEQ ID NO: 148943 - DNA, 20 bp, Artificial
  CRISPR gRNA sequence
cgagaccagcctggccaaca

SEQ ID NO: 148944 - DNA, 20 bp, Artificial
  CRISPR gRNA sequence
ctggccaacatagtgaaacc

SEQ ID NO: 148945 - DNA, 20 bp, Artificial
  CRISPR gRNA sequence
tccattaaaaatacaaaaat

SEQ ID NO: 148946 - DNA, 20 bp, Artificial
  CRISPR gRNA sequence
taaaaatacaaaaattagct

SEQ ID NO: 148947 - DNA, 20 bp, Artificial
  CRISPR gRNA sequence
atacaaaaattagctcggcg

SEQ ID NO: 148948 - DNA, 20 bp, Artificial
  CRISPR gRNA sequence
caaaaattagctcggcgtgg

SEQ ID NO: 148949 - DNA, 20 bp, Artificial
  CRISPR gRNA sequence
aaattagctcggcgtggtgg

SEQ ID NO: 148950 - DNA, 20 bp, Artificial
  CRISPR gRNA sequence
aattagctcggcgtggtggc

SEQ ID NO: 148951 - DNA, 20 bp, Artificial
  CRISPR gRNA sequence
gtggcgggcacctgtaatcc

SEQ ID NO: 148952 - DNA, 20 bp, Artificial
  CRISPR gRNA sequence
acctgtaatcccagctactc

SEQ ID NO: 148953 - DNA, 20 bp, Artificial
  CRISPR gRNA sequence
ctgtaatcccagctactcaa

SEQ ID NO: 148954 - DNA, 20 bp, Artificial
  CRISPR gRNA sequence
tgtaatcccagctactcaag

SEQ ID NO: 148955 - DNA, 20 bp, Artificial
  CRISPR gRNA sequence
tcccagctactcaagaggct

SEQ ID NO: 148956 - DNA, 20 bp, Artificial
  CRISPR gRNA sequence
cccagctactcaagaggctg

SEQ ID NO: 148957 - DNA, 20 bp, Artificial
  CRISPR gRNA sequence
agctactcaagaggctgagg

SEQ ID NO: 148958 - DNA, 20 bp, Artificial
  CRISPR gRNA sequence
gctactcaagaggctgaggc

SEQ ID NO: 148959 - DNA, 20 bp, Artificial
  CRISPR gRNA sequence
tactcaagaggctgaggcag

SEQ ID NO: 148960 - DNA, 20 bp, Artificial
  CRISPR gRNA sequence
gcaggagaatcgcttaaacc

SEQ ID NO: 148961 - DNA, 20 bp, Artificial
  CRISPR gRNA sequence
caggagaatcgcttaaaccc

SEQ ID NO: 148962 - DNA, 20 bp, Artificial
  CRISPR gRNA sequence
ggagaatcgcttaaacccag

SEQ ID NO: 148963 - DNA, 20 bp, Artificial
  CRISPR gRNA sequence
gagaatcgcttaaacccagg

SEQ ID NO: 148964 - DNA, 20 bp, Artificial
  CRISPR gRNA sequence
aatcgcttaaacccaggagg

SEQ ID NO: 148965 - DNA, 20 bp, Artificial
  CRISPR gRNA sequence
tcgcttaaacccaggaggca

SEQ ID NO: 148966 - DNA, 20 bp, Artificial
  CRISPR gRNA sequence
cgcttaaacccaggaggcag

SEQ ID NO: 148967 - DNA, 20 bp, Artificial
  CRISPR gRNA sequence
aacccaggaggcagaggttg

SEQ ID NO: 148968 - DNA, 20 bp, Artificial
  CRISPR gRNA sequence
caggaggcagaggttgcagt

SEQ ID NO: 148969 - DNA, 20 bp, Artificial
  CRISPR gRNA sequence
ggcagaggttgcagtgagcc

SEQ ID NO: 148970 - DNA, 20 bp, Artificial
  CRISPR gRNA sequence
aagattgcaccactgcactc

SEQ ID NO: 148971 - DNA, 20 bp, Artificial
  CRISPR gRNA sequence
tgcaccactgcactccagcc

SEQ ID NO: 148972 - DNA, 20 bp, Artificial
  CRISPR gRNA sequence
gcaccactgcactccagcct

SEQ ID NO: 148973 - DNA, 20 bp, Artificial
  CRISPR gRNA sequence
ccactgcactccagcctggg

SEQ ID NO: 148974 - DNA, 20 bp, Artificial
  CRISPR gRNA sequence
gcactccagcctgggtagca

SEQ ID NO: 148975 - DNA, 20 bp, Artificial
  CRISPR gRNA sequence
tccagcctgggtagcacagc

SEQ ID NO: 148976 - DNA, 20 bp, Artificial
  CRISPR gRNA sequence
atctgcttgcacaactccat

SEQ ID NO: 148977 - DNA, 20 bp, Artificial
  CRISPR gRNA sequence
ctgcttgcacaactccatca

SEQ ID NO: 148978 - DNA, 20 bp, Artificial
  CRISPR gRNA sequence
agttttgttttgttttgtga

SEQ ID NO: 148979 - DNA, 20 bp, Artificial
  CRISPR gRNA sequence
gacagtctcactctgtcgcc

SEQ ID NO: 148980 - DNA, 20 bp, Artificial
  CRISPR gRNA sequence
acagtctcactctgtcgccc

SEQ ID NO: 148981 - DNA, 20 bp, Artificial
  CRISPR gRNA sequence
tctcactctgtcgcccaggc

SEQ ID NO: 148982 - DNA, 20 bp, Artificial
  CRISPR gRNA sequence
tcactctgtcgcccaggctg

SEQ ID NO: 148983 - DNA, 20 bp, Artificial
  CRISPR gRNA sequence
ctgtcgcccaggctggagtg

SEQ ID NO: 148984 - DNA, 20 bp, Artificial
  CRISPR gRNA sequence
tcgcccaggctggagtgcag

SEQ ID NO: 148985 - DNA, 20 bp, Artificial
  CRISPR gRNA sequence
ggagtgcagtggtgccatct

SEQ ID NO: 148986 - DNA, 20 bp, Artificial
  CRISPR gRNA sequence
gagtgcagtggtgccatctc

SEQ ID NO: 148987 - DNA, 20 bp, Artificial
  CRISPR gRNA sequence
tcactgcaacctccgccttc

SEQ ID NO: 148988 - DNA, 20 bp, Artificial
  CRISPR gRNA sequence
cactgcaacctccgccttct

SEQ ID NO: 148989 - DNA, 20 bp, Artificial
  CRISPR gRNA sequence
aacctccgccttctgggttc

SEQ ID NO: 148990 - DNA, 20 bp, Artificial
  CRISPR gRNA sequence
gttcaagcgattctcatgcc

SEQ ID NO: 148991 - DNA, 20 bp, Artificial
  CRISPR gRNA sequence
attctcatgcccagcctccc

SEQ ID NO: 148992 - DNA, 20 bp, Artificial
  CRISPR gRNA sequence
ctcatgcccagcctcccgag

SEQ ID NO: 148993 - DNA, 20 bp, Artificial
  CRISPR gRNA sequence
tgcccagcctcccgagtagc

SEQ ID NO: 148994 - DNA, 20 bp, Artificial
  CRISPR gRNA sequence
gcccagcctcccgagtagct

SEQ ID NO: 148995 - DNA, 20 bp, Artificial
  CRISPR gRNA sequence
agcctcccgagtagctggga

SEQ ID NO: 148996 - DNA, 20 bp, Artificial
  CRISPR gRNA sequence
ctcccgagtagctgggatgg

SEQ ID NO: 148997 - DNA, 20 bp, Artificial
  CRISPR gRNA sequence
tcccgagtagctgggatggc

SEQ ID NO: 148998 - DNA, 20 bp, Artificial
  CRISPR gRNA sequence
caggcatgcgccaccacgcc

SEQ ID NO: 148999 - DNA, 20 bp, Artificial
  CRISPR gRNA sequence
ccagctaatttttgtaattt

SEQ ID NO: 149000 - DNA, 20 bp, Artificial
  CRISPR gRNA sequence
taatttttgtaattttagta

SEQ ID NO: 149001 - DNA, 20 bp, Artificial
  CRISPR gRNA sequence
ttttgtaattttagtaaaga

SEQ ID NO: 149002 - DNA, 20 bp, Artificial
  CRISPR gRNA sequence
tttgtaattttagtaaagac

SEQ ID NO: 149003 - DNA, 20 bp, Artificial
  CRISPR gRNA sequence
ttgtaattttagtaaagaca

SEQ ID NO: 149004 - DNA, 20 bp, Artificial
  CRISPR gRNA sequence
aagacagggtttcgccacgt

SEQ ID NO: 149005 - DNA, 20 bp, Artificial
  CRISPR gRNA sequence
cagggtttcgccacgttggc

SEQ ID NO: 149006 - DNA, 20 bp, Artificial
  CRISPR gRNA sequence
tttcgccacgttggccagac

SEQ ID NO: 149007 - DNA, 20 bp, Artificial
  CRISPR gRNA sequence
ggtctcaaactcttgatttc

SEQ ID NO: 149008 - DNA, 20 bp, Artificial
  CRISPR gRNA sequence
ttcaagtaatccgcccgcct

SEQ ID NO: 149009 - DNA, 20 bp, Artificial
  CRISPR gRNA sequence
ccgcccgcctcagcctccca

SEQ ID NO: 149010 - DNA, 20 bp, Artificial
  CRISPR gRNA sequence
gcctcagcctcccaaagtgt

SEQ ID NO: 149011 - DNA, 20 bp, Artificial
  CRISPR gRNA sequence
cctcagcctcccaaagtgtt

SEQ ID NO: 149012 - DNA, 20 bp, Artificial
  CRISPR gRNA sequence
ctcccaaagtgttgggatta

SEQ ID NO: 149013 - DNA, 20 bp, Artificial
  CRISPR gRNA sequence
tcccaaagtgttgggattac

SEQ ID NO: 149014 - DNA, 20 bp, Artificial
  CRISPR gRNA sequence
caggtgtaaaccatcgcgcc

SEQ ID NO: 149015 - DNA, 20 bp, Artificial
  CRISPR gRNA sequence
gtaaaccatcgcgcccagcc

SEQ ID NO: 149016 - DNA, 20 bp, Artificial
  CRISPR gRNA sequence
ccatcgcgcccagccgagat

SEQ ID NO: 149017 - DNA, 20 bp, Artificial
  CRISPR gRNA sequence
ctaacacaatatccattctg

SEQ ID NO: 149018 - DNA, 20 bp, Artificial
  CRISPR gRNA sequence
aatatccattctgcagccca

SEQ ID NO: 149019 - DNA, 20 bp, Artificial
  CRISPR gRNA sequence
attctgcagcccatggacca

SEQ ID NO: 149020 - DNA, 20 bp, Artificial
  CRISPR gRNA sequence
tctgcagcccatggaccaaa

SEQ ID NO: 149021 - DNA, 20 bp, Artificial
  CRISPR gRNA sequence
aaagagtaatttcaacattc

SEQ ID NO: 149022 - DNA, 20 bp, Artificial
  CRISPR gRNA sequence
acattcaagtcttattattg

SEQ ID NO: 149023 - DNA, 20 bp, Artificial
  CRISPR gRNA sequence
ttattattgaagaaaataca

SEQ ID NO: 149024 - DNA, 20 bp, Artificial
  CRISPR gRNA sequence
tattgaagaaaatacatggc

SEQ ID NO: 149025 - DNA, 20 bp, Artificial
  CRISPR gRNA sequence
attgaagaaaatacatggcc

SEQ ID NO: 149026 - DNA, 20 bp, Artificial
  CRISPR gRNA sequence
agaaaatacatggccgggca

SEQ ID NO: 149027 - DNA, 20 bp, Artificial
  CRISPR gRNA sequence
aaatacatggccgggcacag

SEQ ID NO: 149028 - DNA, 20 bp, Artificial
  CRISPR gRNA sequence
gtggctcatgcctataatcc

SEQ ID NO: 149029 - DNA, 20 bp, Artificial
  CRISPR gRNA sequence
tgcctataatcccagcactt

SEQ ID NO: 149030 - DNA, 20 bp, Artificial
  CRISPR gRNA sequence
gcctataatcccagcacttt

SEQ ID NO: 149031 - DNA, 20 bp, Artificial
  CRISPR gRNA sequence
ctataatcccagcactttgg

SEQ ID NO: 149032 - DNA, 20 bp, Artificial
  CRISPR gRNA sequence
tataatcccagcactttggg

SEQ ID NO: 149033 - DNA, 20 bp, Artificial
  CRISPR gRNA sequence
tcccagcactttgggaggcc

SEQ ID NO: 149034 - DNA, 20 bp, Artificial
  CRISPR gRNA sequence
cccagcactttgggaggcca

SEQ ID NO: 149035 - DNA, 20 bp, Artificial
  CRISPR gRNA sequence
agcactttgggaggccaagg

SEQ ID NO: 149036 - DNA, 20 bp, Artificial
  CRISPR gRNA sequence
actttgggaggccaaggcag

SEQ ID NO: 149037 - DNA, 20 bp, Artificial
  CRISPR gRNA sequence
ctttgggaggccaaggcaga

SEQ ID NO: 149038 - DNA, 20 bp, Artificial
  CRISPR gRNA sequence
ccaaggcagaaggatcacct

SEQ ID NO: 149039 - DNA, 20 bp, Artificial
  CRISPR gRNA sequence
caaggcagaaggatcacctg

SEQ ID NO: 149040 - DNA, 20 bp, Artificial
  CRISPR gRNA sequence
gcagaaggatcacctgaggt

SEQ ID NO: 149041 - DNA, 20 bp, Artificial
  CRISPR gRNA sequence
cagaaggatcacctgaggtc

SEQ ID NO: 149042 - DNA, 20 bp, Artificial
  CRISPR gRNA sequence
gaaggatcacctgaggtcag

SEQ ID NO: 149043 - DNA, 20 bp, Artificial
  CRISPR gRNA sequence
tcacctgaggtcaggagttc

SEQ ID NO: 149044 - DNA, 20 bp, Artificial
  CRISPR gRNA sequence
tcaggagttcgagaccatcc

SEQ ID NO: 149045 - DNA, 20 bp, Artificial
  CRISPR gRNA sequence
tctactaaaaacacaaaaat

SEQ ID NO: 149046 - DNA, 20 bp, Artificial
  CRISPR gRNA sequence
actaaaaacacaaaaattag

SEQ ID NO: 149047 - DNA, 20 bp, Artificial
  CRISPR gRNA sequence
ctaaaaacacaaaaattagc

SEQ ID NO: 149048 - DNA, 20 bp, Artificial
  CRISPR gRNA sequence
taaaaacacaaaaattagca

SEQ ID NO: 149049 - DNA, 20 bp, Artificial
  CRISPR gRNA sequence
caaaaattagcagggcttgt

SEQ ID NO: 149050 - DNA, 20 bp, Artificial
  CRISPR gRNA sequence
ggcttgttggtgcacgcctg

SEQ ID NO: 149051 - DNA, 20 bp, Artificial
  CRISPR gRNA sequence
ttggtgcacgcctgtagtcc

SEQ ID NO: 149052 - DNA, 20 bp, Artificial
  CRISPR gRNA sequence
gcctgtagtcccagctactc

SEQ ID NO: 149053 - DNA, 20 bp, Artificial
  CRISPR gRNA sequence
ctgtagtcccagctactcta

SEQ ID NO: 149054 - DNA, 20 bp, Artificial
  CRISPR gRNA sequence
tgtagtcccagctactctag

SEQ ID NO: 149055 - DNA, 20 bp, Artificial
  CRISPR gRNA sequence
cccagctactctagaggcca

SEQ ID NO: 149056 - DNA, 20 bp, Artificial
  CRISPR gRNA sequence
tactctagaggccaaagcat

SEQ ID NO: 149057 - DNA, 20 bp, Artificial
  CRISPR gRNA sequence
actctagaggccaaagcatg

SEQ ID NO: 149058 - DNA, 20 bp, Artificial
  CRISPR gRNA sequence
gaggccaaagcatgaggctg

SEQ ID NO: 149059 - DNA, 20 bp, Artificial
  CRISPR gRNA sequence
gcatgaggctgcagtgatcc

SEQ ID NO: 149060 - DNA, 20 bp, Artificial
  CRISPR gRNA sequence
gagatcacaccactgcactc

SEQ ID NO: 149061 - DNA, 20 bp, Artificial
  CRISPR gRNA sequence
cacaccactgcactccagcc

SEQ ID NO: 149062 - DNA, 20 bp, Artificial
  CRISPR gRNA sequence
acaccactgcactccagcct

SEQ ID NO: 149063 - DNA, 20 bp, Artificial
  CRISPR gRNA sequence
ctgcactccagcctaggtga

SEQ ID NO: 149064 - DNA, 20 bp, Artificial
  CRISPR gRNA sequence
gcactccagcctaggtgaca

SEQ ID NO: 149065 - DNA, 20 bp, Artificial
  CRISPR gRNA sequence
tccagcctaggtgacagagt

SEQ ID NO: 149066 - DNA, 20 bp, Artificial
  CRISPR gRNA sequence
gacagagtgagactctgtct

SEQ ID NO: 149067 - DNA, 20 bp, Artificial
  CRISPR gRNA sequence
cagaaataaaaacacttcat

SEQ ID NO: 149068 - DNA, 20 bp, Artificial
  CRISPR gRNA sequence
agaaataaaaacacttcata

SEQ ID NO: 149069 - DNA, 20 bp, Artificial
  CRISPR gRNA sequence
aaaaacacttcataaggaca

SEQ ID NO: 149070 - DNA, 20 bp, Artificial
  CRISPR gRNA sequence
tcataaggacacagctgcca

SEQ ID NO: 149071 - DNA, 20 bp, Artificial
  CRISPR gRNA sequence
aaggacacagctgccataga

SEQ ID NO: 149072 - DNA, 20 bp, Artificial
  CRISPR gRNA sequence
aggacacagctgccatagac

SEQ ID NO: 149073 - DNA, 20 bp, Artificial
  CRISPR gRNA sequence
ggacacagctgccatagaca

SEQ ID NO: 149074 - DNA, 20 bp, Artificial
  CRISPR gRNA sequence
tgccatagacagggattcct

SEQ ID NO: 149075 - DNA, 20 bp, Artificial
  CRISPR gRNA sequence
atagacagggattcctcaga

SEQ ID NO: 149076 - DNA, 20 bp, Artificial
  CRISPR gRNA sequence
gggattcctcagacagatct

SEQ ID NO: 149077 - DNA, 20 bp, Artificial
  CRISPR gRNA sequence
tgagtaaactgaaaaccttc

SEQ ID NO: 149078 - DNA, 20 bp, Artificial
  CRISPR gRNA sequence
taaactgaaaaccttctaga

SEQ ID NO: 149079 - DNA, 20 bp, Artificial
  CRISPR gRNA sequence
aaactgaaaaccttctagac

SEQ ID NO: 149080 - DNA, 20 bp, Artificial
  CRISPR gRNA sequence
tcaccattttaaataccatt

SEQ ID NO: 149081 - DNA, 20 bp, Artificial
  CRISPR gRNA sequence
aataccattaagaatattca

SEQ ID NO: 149082 - DNA, 20 bp, Artificial
  CRISPR gRNA sequence
accattaagaatattcatgg

SEQ ID NO: 149083 - DNA, 20 bp, Artificial
  CRISPR gRNA sequence
ccattaagaatattcatggc

SEQ ID NO: 149084 - DNA, 20 bp, Artificial
  CRISPR gRNA sequence
taagaatattcatggcaggc

SEQ ID NO: 149085 - DNA, 20 bp, Artificial
  CRISPR gRNA sequence
aagaatattcatggcaggct

SEQ ID NO: 149086 - DNA, 20 bp, Artificial
  CRISPR gRNA sequence
tattcatggcaggctgggcg

SEQ ID NO: 149087 - DNA, 20 bp, Artificial
  CRISPR gRNA sequence
gtgactcatgcctgtaatcc

SEQ ID NO: 149088 - DNA, 20 bp, Artificial
  CRISPR gRNA sequence
tgcctgtaatcctagcactt

SEQ ID NO: 149089 - DNA, 20 bp, Artificial
  CRISPR gRNA sequence
gcctgtaatcctagcacttt

SEQ ID NO: 149090 - DNA, 20 bp, Artificial
  CRISPR gRNA sequence
ctgtaatcctagcactttgg

SEQ ID NO: 149091 - DNA, 20 bp, Artificial
  CRISPR gRNA sequence
tgtaatcctagcactttggg

SEQ ID NO: 149092 - DNA, 20 bp, Artificial
  CRISPR gRNA sequence
tcctagcactttgggaggcc

SEQ ID NO: 149093 - DNA, 20 bp, Artificial
  CRISPR gRNA sequence
cctagcactttgggaggccg

SEQ ID NO: 149094 - DNA, 20 bp, Artificial
  CRISPR gRNA sequence
agcactttgggaggccgagg

SEQ ID NO: 149095 - DNA, 20 bp, Artificial
  CRISPR gRNA sequence
gcactttgggaggccgaggc

SEQ ID NO: 149096 - DNA, 20 bp, Artificial
  CRISPR gRNA sequence
ggccgaggcgggcgaatcac

SEQ ID NO: 149097 - DNA, 20 bp, Artificial
  CRISPR gRNA sequence
gccgaggcgggcgaatcaca

SEQ ID NO: 149098 - DNA, 20 bp, Artificial
  CRISPR gRNA sequence
cgggcgaatcacaaggtcat

SEQ ID NO: 149099 - DNA, 20 bp, Artificial
  CRISPR gRNA sequence
aatcacaaggtcatgagttt

SEQ ID NO: 149100 - DNA, 20 bp, Artificial
  CRISPR gRNA sequence
caaggtcatgagtttgagac

SEQ ID NO: 149101 - DNA, 20 bp, Artificial
  CRISPR gRNA sequence
gtcatgagtttgagaccagc

SEQ ID NO: 149102 - DNA, 20 bp, Artificial
  CRISPR gRNA sequence
tcatgagtttgagaccagcc

SEQ ID NO: 149103 - DNA, 20 bp, Artificial
  CRISPR gRNA sequence
tgagaccagccgggccaaca

SEQ ID NO: 149104 - DNA, 20 bp, Artificial
  CRISPR gRNA sequence
tactaaaaaaatacaaaaat

SEQ ID NO: 149105 - DNA, 20 bp, Artificial
  CRISPR gRNA sequence
aaaaaaatacaaaaattagc

SEQ ID NO: 149106 - DNA, 20 bp, Artificial
  CRISPR gRNA sequence
aaaaaatacaaaaattagcc

SEQ ID NO: 149107 - DNA, 20 bp, Artificial
  CRISPR gRNA sequence
atacaaaaattagccgggca

SEQ ID NO: 149108 - DNA, 20 bp, Artificial
  CRISPR gRNA sequence
caaaaattagccgggcatgg

SEQ ID NO: 149109 - DNA, 20 bp, Artificial
  CRISPR gRNA sequence
attagccgggcatggtggtg

SEQ ID NO: 149110 - DNA, 20 bp, Artificial
  CRISPR gRNA sequence
ttagccgggcatggtggtgt

SEQ ID NO: 149111 - DNA, 20 bp, Artificial
  CRISPR gRNA sequence
gtggtgtgggcctgaaatcc

SEQ ID NO: 149112 - DNA, 20 bp, Artificial
  CRISPR gRNA sequence
ggcctgaaatcccagctact

SEQ ID NO: 149113 - DNA, 20 bp, Artificial
  CRISPR gRNA sequence
tgaaatcccagctacttgga

SEQ ID NO: 149114 - DNA, 20 bp, Artificial
  CRISPR gRNA sequence
tcccagctacttggaaagct

SEQ ID NO: 149115 - DNA, 20 bp, Artificial
  CRISPR gRNA sequence
cccagctacttggaaagctg

SEQ ID NO: 149116 - DNA, 20 bp, Artificial
  CRISPR gRNA sequence
agctacttggaaagctgagg

SEQ ID NO: 149117 - DNA, 20 bp, Artificial
  CRISPR gRNA sequence
gctacttggaaagctgaggc

SEQ ID NO: 149118 - DNA, 20 bp, Artificial
  CRISPR gRNA sequence
tacttggaaagctgaggcag

SEQ ID NO: 149119 - DNA, 20 bp, Artificial
  CRISPR gRNA sequence
gcaggagaatcacttgaatc

SEQ ID NO: 149120 - DNA, 20 bp, Artificial
  CRISPR gRNA sequence
caggagaatcacttgaatct

SEQ ID NO: 149121 - DNA, 20 bp, Artificial
  CRISPR gRNA sequence
ggagaatcacttgaatctgg

SEQ ID NO: 149122 - DNA, 20 bp, Artificial
  CRISPR gRNA sequence
gagaatcacttgaatctggg

SEQ ID NO: 149123 - DNA, 20 bp, Artificial
  CRISPR gRNA sequence
aatcacttgaatctgggagg

SEQ ID NO: 149124 - DNA, 20 bp, Artificial
  CRISPR gRNA sequence
tcacttgaatctgggaggcg

SEQ ID NO: 149125 - DNA, 20 bp, Artificial
  CRISPR gRNA sequence
cacttgaatctgggaggcgg

SEQ ID NO: 149126 - DNA, 20 bp, Artificial
  CRISPR gRNA sequence
aatctgggaggcggaggttg

SEQ ID NO: 149127 - DNA, 20 bp, Artificial
  CRISPR gRNA sequence
tgggaggcggaggttgcagt

SEQ ID NO: 149128 - DNA, 20 bp, Artificial
  CRISPR gRNA sequence
gaaatcgtgccactgcactc

SEQ ID NO: 149129 - DNA, 20 bp, Artificial
  CRISPR gRNA sequence
cgtgccactgcactccagcc

SEQ ID NO: 149130 - DNA, 20 bp, Artificial
  CRISPR gRNA sequence
gtgccactgcactccagcct

SEQ ID NO: 149131 - DNA, 20 bp, Artificial
  CRISPR gRNA sequence
ctgcactccagcctgggcga

SEQ ID NO: 149132 - DNA, 20 bp, Artificial
  CRISPR gRNA sequence
gcactccagcctgggcgaca

SEQ ID NO: 149133 - DNA, 20 bp, Artificial
  CRISPR gRNA sequence
tccagcctgggcgacagagc

SEQ ID NO: 149134 - DNA, 20 bp, Artificial
  CRISPR gRNA sequence
tgtctcaaaaaaaaaaaaaa

SEQ ID NO: 149135 - DNA, 20 bp, Artificial
  CRISPR gRNA sequence
aaaaaaaaaaagaatattca

SEQ ID NO: 149136 - DNA, 20 bp, Artificial
  CRISPR gRNA sequence
aaaaaaagaatattcatggc

SEQ ID NO: 149137 - DNA, 20 bp, Artificial
  CRISPR gRNA sequence
aaaaaagaatattcatggcc

SEQ ID NO: 149138 - DNA, 20 bp, Artificial
  CRISPR gRNA sequence
agaatattcatggccaggca

SEQ ID NO: 149139 - DNA, 20 bp, Artificial
  CRISPR gRNA sequence
catggccaggcacagtgcct

SEQ ID NO: 149140 - DNA, 20 bp, Artificial
  CRISPR gRNA sequence
atggccaggcacagtgcctc

SEQ ID NO: 149141 - DNA, 20 bp, Artificial
  CRISPR gRNA sequence
gtgcctcaggcctgtaattc

SEQ ID NO: 149142 - DNA, 20 bp, Artificial
  CRISPR gRNA sequence
cctcaggcctgtaattccag

SEQ ID NO: 149143 - DNA, 20 bp, Artificial
  CRISPR gRNA sequence
ggcctgtaattccagcagtt

SEQ ID NO: 149144 - DNA, 20 bp, Artificial
  CRISPR gRNA sequence
gcctgtaattccagcagttt

SEQ ID NO: 149145 - DNA, 20 bp, Artificial
  CRISPR gRNA sequence
ctgtaattccagcagtttgg

SEQ ID NO: 149146 - DNA, 20 bp, Artificial
  CRISPR gRNA sequence
tgtaattccagcagtttggg

SEQ ID NO: 149147 - DNA, 20 bp, Artificial
  CRISPR gRNA sequence
ttccagcagtttgggaggcc

SEQ ID NO: 149148 - DNA, 20 bp, Artificial
  CRISPR gRNA sequence
tccagcagtttgggaggcca

SEQ ID NO: 149149 - DNA, 20 bp, Artificial
  CRISPR gRNA sequence
agcagtttgggaggccaagg

SEQ ID NO: 149150 - DNA, 20 bp, Artificial
  CRISPR gRNA sequence
gcagtttgggaggccaaggc

SEQ ID NO: 149151 - DNA, 20 bp, Artificial
  CRISPR gRNA sequence
agtttgggaggccaaggcgg

SEQ ID NO: 149152 - DNA, 20 bp, Artificial
  CRISPR gRNA sequence
gtttgggaggccaaggcggg

SEQ ID NO: 149153 - DNA, 20 bp, Artificial
  CRISPR gRNA sequence
ccaaggcgggaggactgctt

SEQ ID NO: 149154 - DNA, 20 bp, Artificial
  CRISPR gRNA sequence
gcgggaggactgctttagct

SEQ ID NO: 149155 - DNA, 20 bp, Artificial
  CRISPR gRNA sequence
cgggaggactgctttagctc

SEQ ID NO: 149156 - DNA, 20 bp, Artificial
  CRISPR gRNA sequence
ttagctcaggacttcaaaac

SEQ ID NO: 149157 - DNA, 20 bp, Artificial
  CRISPR gRNA sequence
tcaggacttcaaaaccagcc

SEQ ID NO: 149158 - DNA, 20 bp, Artificial
  CRISPR gRNA sequence
caggacttcaaaaccagcct

SEQ ID NO: 149159 - DNA, 20 bp, Artificial
  CRISPR gRNA sequence
caaaaccagcctgggcaaca

SEQ ID NO: 149160 - DNA, 20 bp, Artificial
  CRISPR gRNA sequence
tctacaaaaaatacaaaaat

SEQ ID NO: 149161 - DNA, 20 bp, Artificial
  CRISPR gRNA sequence
caaaaaatacaaaaattagc

SEQ ID NO: 149162 - DNA, 20 bp, Artificial
  CRISPR gRNA sequence
atacaaaaattagctggttg

SEQ ID NO: 149163 - DNA, 20 bp, Artificial
  CRISPR gRNA sequence
caaaaattagctggttgtgg

SEQ ID NO: 149164 - DNA, 20 bp, Artificial
  CRISPR gRNA sequence
tgcttattgtcccaactact

SEQ ID NO: 149165 - DNA, 20 bp, Artificial
  CRISPR gRNA sequence
gcttattgtcccaactactt

SEQ ID NO: 149166 - DNA, 20 bp, Artificial
  CRISPR gRNA sequence
ttattgtcccaactacttag

SEQ ID NO: 149167 - DNA, 20 bp, Artificial
  CRISPR gRNA sequence
tattgtcccaactacttagg

SEQ ID NO: 149168 - DNA, 20 bp, Artificial
  CRISPR gRNA sequence
tcccaactacttaggaggct

SEQ ID NO: 149169 - DNA, 20 bp, Artificial
  CRISPR gRNA sequence
cccaactacttaggaggctg

SEQ ID NO: 149170 - DNA, 20 bp, Artificial
  CRISPR gRNA sequence
aactacttaggaggctgagg

SEQ ID NO: 149171 - DNA, 20 bp, Artificial
  CRISPR gRNA sequence
actacttaggaggctgaggt

SEQ ID NO: 149172 - DNA, 20 bp, Artificial
  CRISPR gRNA sequence
tacttaggaggctgaggtgg

SEQ ID NO: 149173 - DNA, 20 bp, Artificial
  CRISPR gRNA sequence
acttaggaggctgaggtggg

SEQ ID NO: 149174 - DNA, 20 bp, Artificial
  CRISPR gRNA sequence
ctgaggtgggaggatcactt

SEQ ID NO: 149175 - DNA, 20 bp, Artificial
  CRISPR gRNA sequence
gtgggaggatcacttgagcc

SEQ ID NO: 149176 - DNA, 20 bp, Artificial
  CRISPR gRNA sequence
tgggaggatcacttgagcct

SEQ ID NO: 149177 - DNA, 20 bp, Artificial
  CRISPR gRNA sequence
ggaggatcacttgagcctgg

SEQ ID NO: 149178 - DNA, 20 bp, Artificial
  CRISPR gRNA sequence
atcacttgagcctgggagat

SEQ ID NO: 149179 - DNA, 20 bp, Artificial
  CRISPR gRNA sequence
tcacttgagcctgggagatc

SEQ ID NO: 149180 - DNA, 20 bp, Artificial
  CRISPR gRNA sequence
cacttgagcctgggagatca

SEQ ID NO: 149181 - DNA, 20 bp, Artificial
  CRISPR gRNA sequence
agcctgggagatcagggctg

SEQ ID NO: 149182 - DNA, 20 bp, Artificial
  CRISPR gRNA sequence
tgggagatcagggctgcagt

SEQ ID NO: 149183 - DNA, 20 bp, Artificial
  CRISPR gRNA sequence
gatcagggctgcagtgagcc

SEQ ID NO: 149184 - DNA, 20 bp, Artificial
  CRISPR gRNA sequence
aagatcttgctactgcactc

SEQ ID NO: 149185 - DNA, 20 bp, Artificial
  CRISPR gRNA sequence
cttgctactgcactccagtc

SEQ ID NO: 149186 - DNA, 20 bp, Artificial
  CRISPR gRNA sequence
ttgctactgcactccagtct

SEQ ID NO: 149187 - DNA, 20 bp, Artificial
  CRISPR gRNA sequence
ctgcactccagtctgggcaa

SEQ ID NO: 149188 - DNA, 20 bp, Artificial
  CRISPR gRNA sequence
gcactccagtctgggcaaca

SEQ ID NO: 149189 - DNA, 20 bp, Artificial
  CRISPR gRNA sequence
tccagtctgggcaacagagt

SEQ ID NO: 149190 - DNA, 20 bp, Artificial
  CRISPR gRNA sequence
accaaacaaacaaacaaaaa

SEQ ID NO: 149191 - DNA, 20 bp, Artificial
  CRISPR gRNA sequence
aaaaagccattcaaaattca

SEQ ID NO: 149192 - DNA, 20 bp, Artificial
  CRISPR gRNA sequence
aaaagccattcaaaattcat

SEQ ID NO: 149193 - DNA, 20 bp, Artificial
  CRISPR gRNA sequence
aagccattcaaaattcatgg

SEQ ID NO: 149194 - DNA, 20 bp, Artificial
  CRISPR gRNA sequence
agccattcaaaattcatggg

SEQ ID NO: 149195 - DNA, 20 bp, Artificial
  CRISPR gRNA sequence
cattcaaaattcatgggagg

SEQ ID NO: 149196 - DNA, 20 bp, Artificial
  CRISPR gRNA sequence
agtcaaaatataaacattaa

SEQ ID NO: 149197 - DNA, 20 bp, Artificial
  CRISPR gRNA sequence
gtcaaaatataaacattaac

SEQ ID NO: 149198 - DNA, 20 bp, Artificial
  CRISPR gRNA sequence
caaaatataaacattaacag

SEQ ID NO: 149199 - DNA, 20 bp, Artificial
  CRISPR gRNA sequence
taaacattaacaggagtctg

SEQ ID NO: 149200 - DNA, 20 bp, Artificial
  CRISPR gRNA sequence
gaagttgattccaatcctcc

SEQ ID NO: 149201 - DNA, 20 bp, Artificial
  CRISPR gRNA sequence
caatcctcctggatgatttt

SEQ ID NO: 149202 - DNA, 20 bp, Artificial
  CRISPR gRNA sequence
aatcctcctggatgattttg

SEQ ID NO: 149203 - DNA, 20 bp, Artificial
  CRISPR gRNA sequence
atcctcctggatgattttga

SEQ ID NO: 149204 - DNA, 20 bp, Artificial
  CRISPR gRNA sequence
tcctcctggatgattttgag

SEQ ID NO: 149205 - DNA, 20 bp, Artificial
  CRISPR gRNA sequence
tggatgattttgaggggttt

SEQ ID NO: 149206 - DNA, 20 bp, Artificial
  CRISPR gRNA sequence
ttttgaggggtttgagactt

SEQ ID NO: 149207 - DNA, 20 bp, Artificial
  CRISPR gRNA sequence
tgaggggtttgagacttcag

SEQ ID NO: 149208 - DNA, 20 bp, Artificial
  CRISPR gRNA sequence
ggggtttgagacttcagtgg

SEQ ID NO: 149209 - DNA, 20 bp, Artificial
  CRISPR gRNA sequence
gtttgagacttcagtggaag

SEQ ID NO: 149210 - DNA, 20 bp, Artificial
  CRISPR gRNA sequence
ttcagtggaagaagtaactg

SEQ ID NO: 149211 - DNA, 20 bp, Artificial
  CRISPR gRNA sequence
ggaagaagtaactgtagatg

SEQ ID NO: 149212 - DNA, 20 bp, Artificial
  CRISPR gRNA sequence
agaagtaactgtagatgtgg

SEQ ID NO: 149213 - DNA, 20 bp, Artificial
  CRISPR gRNA sequence
aactgtagatgtggtagaaa

SEQ ID NO: 149214 - DNA, 20 bp, Artificial
  CRISPR gRNA sequence
gtagatgtggtagaaatagc

SEQ ID NO: 149215 - DNA, 20 bp, Artificial
  CRISPR gRNA sequence
agatgtggtagaaatagcaa

SEQ ID NO: 149216 - DNA, 20 bp, Artificial
  CRISPR gRNA sequence
aatagcaagagaactgtaat

SEQ ID NO: 149217 - DNA, 20 bp, Artificial
  CRISPR gRNA sequence
agcaagagaactgtaattag

SEQ ID NO: 149218 - DNA, 20 bp, Artificial
  CRISPR gRNA sequence
aagagaactgtaattagaag

SEQ ID NO: 149219 - DNA, 20 bp, Artificial
  CRISPR gRNA sequence
gagaactgtaattagaagcg

SEQ ID NO: 149220 - DNA, 20 bp, Artificial
  CRISPR gRNA sequence
tgtaattagaagcggagcct

SEQ ID NO: 149221 - DNA, 20 bp, Artificial
  CRISPR gRNA sequence
agcggagcctgagatgtgac

SEQ ID NO: 149222 - DNA, 20 bp, Artificial
  CRISPR gRNA sequence
atctcatgataaaactttaa

SEQ ID NO: 149223 - DNA, 20 bp, Artificial
  CRISPR gRNA sequence
atgataaaactttaacagat

SEQ ID NO: 149224 - DNA, 20 bp, Artificial
  CRISPR gRNA sequence
tgataaaactttaacagatg

SEQ ID NO: 149225 - DNA, 20 bp, Artificial
  CRISPR gRNA sequence
ataaaactttaacagatgag

SEQ ID NO: 149226 - DNA, 20 bp, Artificial
  CRISPR gRNA sequence
agatgaggagttgcttctta

SEQ ID NO: 149227 - DNA, 20 bp, Artificial
  CRISPR gRNA sequence
tgaggagttgcttcttatgg

SEQ ID NO: 149228 - DNA, 20 bp, Artificial
  CRISPR gRNA sequence
gaggagttgcttcttatgga

SEQ ID NO: 149229 - DNA, 20 bp, Artificial
  CRISPR gRNA sequence
gttgcttcttatggaaggca

SEQ ID NO: 149230 - DNA, 20 bp, Artificial
  CRISPR gRNA sequence
cttcttatggaaggcaaaga

SEQ ID NO: 149231 - DNA, 20 bp, Artificial
  CRISPR gRNA sequence
aagaaagtcgttccttgaaa

SEQ ID NO: 149232 - DNA, 20 bp, Artificial
  CRISPR gRNA sequence
cttgaaatggaacctactcc

SEQ ID NO: 149233 - DNA, 20 bp, Artificial
  CRISPR gRNA sequence
agtgaaaatgctatgaacat

SEQ ID NO: 149234 - DNA, 20 bp, Artificial
  CRISPR gRNA sequence
attagaatattatataaact

SEQ ID NO: 149235 - DNA, 20 bp, Artificial
  CRISPR gRNA sequence
tataaacttagttcataaaa

SEQ ID NO: 149236 - DNA, 20 bp, Artificial
  CRISPR gRNA sequence
aaacttagttcataaaatag

SEQ ID NO: 149237 - DNA, 20 bp, Artificial
  CRISPR gRNA sequence
cttagttcataaaatagtgg

SEQ ID NO: 149238 - DNA, 20 bp, Artificial
  CRISPR gRNA sequence
ttagttcataaaatagtggc

SEQ ID NO: 149239 - DNA, 20 bp, Artificial
  CRISPR gRNA sequence
ataaaatagtggcaggattt

SEQ ID NO: 149240 - DNA, 20 bp, Artificial
  CRISPR gRNA sequence
aaaatagtggcaggatttga

SEQ ID NO: 149241 - DNA, 20 bp, Artificial
  CRISPR gRNA sequence
aaatagtggcaggatttgag

SEQ ID NO: 149242 - DNA, 20 bp, Artificial
  CRISPR gRNA sequence
ggatttgagaggacaaactc

SEQ ID NO: 149243 - DNA, 20 bp, Artificial
  CRISPR gRNA sequence
aggacaaactccagttttga

SEQ ID NO: 149244 - DNA, 20 bp, Artificial
  CRISPR gRNA sequence
acaaactccagttttgaaag

SEQ ID NO: 149245 - DNA, 20 bp, Artificial
  CRISPR gRNA sequence
ttttgaaagaagctctactc

SEQ ID NO: 149246 - DNA, 20 bp, Artificial
  CRISPR gRNA sequence
tttgaaagaagctctactct

SEQ ID NO: 149247 - DNA, 20 bp, Artificial
  CRISPR gRNA sequence
ctgggtaaaatgctatcaaa

SEQ ID NO: 149248 - DNA, 20 bp, Artificial
  CRISPR gRNA sequence
taaaatgctatcaaacagaa

SEQ ID NO: 149249 - DNA, 20 bp, Artificial
  CRISPR gRNA sequence
aatgctatcaaacagaaaag

SEQ ID NO: 149250 - DNA, 20 bp, Artificial
  CRISPR gRNA sequence
atcaaacagaaaagcagcta

SEQ ID NO: 149251 - DNA, 20 bp, Artificial
  CRISPR gRNA sequence
caaacagaaaagcagctaca

SEQ ID NO: 149252 - DNA, 20 bp, Artificial
  CRISPR gRNA sequence
tacagagaaatctttcatga

SEQ ID NO: 149253 - DNA, 20 bp, Artificial
  CRISPR gRNA sequence
acagagaaatctttcatgaa

SEQ ID NO: 149254 - DNA, 20 bp, Artificial
  CRISPR gRNA sequence
gagaaatctttcatgaaagg

SEQ ID NO: 149255 - DNA, 20 bp, Artificial
  CRISPR gRNA sequence
gaaatctttcatgaaaggaa

SEQ ID NO: 149256 - DNA, 20 bp, Artificial
  CRISPR gRNA sequence
atgaaaggaagagtcaactg

SEQ ID NO: 149257 - DNA, 20 bp, Artificial
  CRISPR gRNA sequence
cttcactgctgccttatttt

SEQ ID NO: 149258 - DNA, 20 bp, Artificial
  CRISPR gRNA sequence
gccttattttaagaaattgc

SEQ ID NO: 149259 - DNA, 20 bp, Artificial
  CRISPR gRNA sequence
tattttaagaaattgccagc

SEQ ID NO: 149260 - DNA, 20 bp, Artificial
  CRISPR gRNA sequence
attttaagaaattgccagcc

SEQ ID NO: 149261 - DNA, 20 bp, Artificial
  CRISPR gRNA sequence
aagaaattgccagccaggca

SEQ ID NO: 149262 - DNA, 20 bp, Artificial
  CRISPR gRNA sequence
aaattgccagccaggcacag

SEQ ID NO: 149263 - DNA, 20 bp, Artificial
  CRISPR gRNA sequence
ccaggcacagtggctcacgc

SEQ ID NO: 149264 - DNA, 20 bp, Artificial
  CRISPR gRNA sequence
gtggctcacgccagtaatcc

SEQ ID NO: 149265 - DNA, 20 bp, Artificial
  CRISPR gRNA sequence
cgccagtaatcccagcactt

SEQ ID NO: 149266 - DNA, 20 bp, Artificial
  CRISPR gRNA sequence
gccagtaatcccagcacttt

SEQ ID NO: 149267 - DNA, 20 bp, Artificial
  CRISPR gRNA sequence
cagtaatcccagcactttgg

SEQ ID NO: 149268 - DNA, 20 bp, Artificial
  CRISPR gRNA sequence
agtaatcccagcactttggg

SEQ ID NO: 149269 - DNA, 20 bp, Artificial
  CRISPR gRNA sequence
atcccagcactttgggaggc

SEQ ID NO: 149270 - DNA, 20 bp, Artificial
  CRISPR gRNA sequence
tcccagcactttgggaggct

SEQ ID NO: 149271 - DNA, 20 bp, Artificial
  CRISPR gRNA sequence
cccagcactttgggaggcta

SEQ ID NO: 149272 - DNA, 20 bp, Artificial
  CRISPR gRNA sequence
gcactttgggaggctagggc

SEQ ID NO: 149273 - DNA, 20 bp, Artificial
  CRISPR gRNA sequence
actttgggaggctagggcaa

SEQ ID NO: 149274 - DNA, 20 bp, Artificial
  CRISPR gRNA sequence
ctttgggaggctagggcaag

SEQ ID NO: 149275 - DNA, 20 bp, Artificial
  CRISPR gRNA sequence
ctagggcaagaggatcactt

SEQ ID NO: 149276 - DNA, 20 bp, Artificial
  CRISPR gRNA sequence
gcaagaggatcacttcagcc

SEQ ID NO: 149277 - DNA, 20 bp, Artificial
  CRISPR gRNA sequence
caagaggatcacttcagccc

SEQ ID NO: 149278 - DNA, 20 bp, Artificial
  CRISPR gRNA sequence
agaggatcacttcagcccag

SEQ ID NO: 149279 - DNA, 20 bp, Artificial
  CRISPR gRNA sequence
tcacttcagcccaggagttt

SEQ ID NO: 149280 - DNA, 20 bp, Artificial
  CRISPR gRNA sequence
gcccaggagtttgagacatc

SEQ ID NO: 149281 - DNA, 20 bp, Artificial
  CRISPR gRNA sequence
ggagtttgagacatcaagat

SEQ ID NO: 149282 - DNA, 20 bp, Artificial
  CRISPR gRNA sequence
ttgagacatcaagatcagtc

SEQ ID NO: 149283 - DNA, 20 bp, Artificial
  CRISPR gRNA sequence
tgagacatcaagatcagtct

SEQ ID NO: 149284 - DNA, 20 bp, Artificial
  CRISPR gRNA sequence
caagatcagtctgggcaaca

SEQ ID NO: 149285 - DNA, 20 bp, Artificial
  CRISPR gRNA sequence
aagatcagtctgggcaacac

SEQ ID NO: 149286 - DNA, 20 bp, Artificial
  CRISPR gRNA sequence
gatcagtctgggcaacacag

SEQ ID NO: 149287 - DNA, 20 bp, Artificial
  CRISPR gRNA sequence
tatacaaaaaatacaaaaat

SEQ ID NO: 149288 - DNA, 20 bp, Artificial
  CRISPR gRNA sequence
caaaaaatacaaaaatcagc

SEQ ID NO: 149289 - DNA, 20 bp, Artificial
  CRISPR gRNA sequence
aaaaaatacaaaaatcagct

SEQ ID NO: 149290 - DNA, 20 bp, Artificial
  CRISPR gRNA sequence
atacaaaaatcagctgggtg

SEQ ID NO: 149291 - DNA, 20 bp, Artificial
  CRISPR gRNA sequence
caaaaatcagctgggtgtgg

SEQ ID NO: 149292 - DNA, 20 bp, Artificial
  CRISPR gRNA sequence
ggtgtggtggcacgtgtctg

SEQ ID NO: 149293 - DNA, 20 bp, Artificial
  CRISPR gRNA sequence
gtggcacgtgtctgtagtcc

SEQ ID NO: 149294 - DNA, 20 bp, Artificial
  CRISPR gRNA sequence
tgtctgtagtcccagctact

SEQ ID NO: 149295 - DNA, 20 bp, Artificial
  CRISPR gRNA sequence
gtctgtagtcccagctactt

SEQ ID NO: 149296 - DNA, 20 bp, Artificial
  CRISPR gRNA sequence
ctgtagtcccagctacttgg

SEQ ID NO: 149297 - DNA, 20 bp, Artificial
  CRISPR gRNA sequence
tgtagtcccagctacttggg

SEQ ID NO: 149298 - DNA, 20 bp, Artificial
  CRISPR gRNA sequence
cccagctacttgggaggctg

SEQ ID NO: 149299 - DNA, 20 bp, Artificial
  CRISPR gRNA sequence
agctacttgggaggctgaag

SEQ ID NO: 149300 - DNA, 20 bp, Artificial
  CRISPR gRNA sequence
gctacttgggaggctgaagt

SEQ ID NO: 149301 - DNA, 20 bp, Artificial
  CRISPR gRNA sequence
tacttgggaggctgaagtag

SEQ ID NO: 149302 - DNA, 20 bp, Artificial
  CRISPR gRNA sequence
acttgggaggctgaagtagg

SEQ ID NO: 149303 - DNA, 20 bp, Artificial
  CRISPR gRNA sequence
gggaggctgaagtaggagga

SEQ ID NO: 149304 - DNA, 20 bp, Artificial
  CRISPR gRNA sequence
gtaggaggatggcttgaacc

SEQ ID NO: 149305 - DNA, 20 bp, Artificial
  CRISPR gRNA sequence
ggaggatggcttgaacctgg

SEQ ID NO: 149306 - DNA, 20 bp, Artificial
  CRISPR gRNA sequence
gaggatggcttgaacctgga

SEQ ID NO: 149307 - DNA, 20 bp, Artificial
  CRISPR gRNA sequence
gatggcttgaacctggaagg

SEQ ID NO: 149308 - DNA, 20 bp, Artificial
  CRISPR gRNA sequence
tggcttgaacctggaaggca

SEQ ID NO: 149309 - DNA, 20 bp, Artificial
  CRISPR gRNA sequence
ggcttgaacctggaaggcag

SEQ ID NO: 149310 - DNA, 20 bp, Artificial
  CRISPR gRNA sequence
tggaaggcagaggttgcaat

SEQ ID NO: 149311 - DNA, 20 bp, Artificial
  CRISPR gRNA sequence
ggcagaggttgcaatcagcc

SEQ ID NO: 149312 - DNA, 20 bp, Artificial
  CRISPR gRNA sequence
aagatcatgacactgtactc

SEQ ID NO: 149313 - DNA, 20 bp, Artificial
  CRISPR gRNA sequence
catgacactgtactccagcc

SEQ ID NO: 149314 - DNA, 20 bp, Artificial
  CRISPR gRNA sequence
atgacactgtactccagcct

SEQ ID NO: 149315 - DNA, 20 bp, Artificial
  CRISPR gRNA sequence
ctgtactccagcctgggtga

SEQ ID NO: 149316 - DNA, 20 bp, Artificial
  CRISPR gRNA sequence
ctccagcctgggtgacagtg

SEQ ID NO: 149317 - DNA, 20 bp, Artificial
  CRISPR gRNA sequence
ccagcctgggtgacagtgtg

SEQ ID NO: 149318 - DNA, 20 bp, Artificial
  CRISPR gRNA sequence
agcctgggtgacagtgtgga

SEQ ID NO: 149319 - DNA, 20 bp, Artificial
  CRISPR gRNA sequence
cctgggtgacagtgtggaga

SEQ ID NO: 149320 - DNA, 20 bp, Artificial
  CRISPR gRNA sequence
ctgggtgacagtgtggagag

SEQ ID NO: 149321 - DNA, 20 bp, Artificial
  CRISPR gRNA sequence
gagagaggaaaaaaaaaaaa

SEQ ID NO: 149322 - DNA, 20 bp, Artificial
  CRISPR gRNA sequence
agagaggaaaaaaaaaaaac

SEQ ID NO: 149323 - DNA, 20 bp, Artificial
  CRISPR gRNA sequence
aggaaaaaaaaaaaacaggc

SEQ ID NO: 149324 - DNA, 20 bp, Artificial
  CRISPR gRNA sequence
aaaaaaaaacaggccagatg

SEQ ID NO: 149325 - DNA, 20 bp, Artificial
  CRISPR gRNA sequence
aaaaaacaggccagatgcgg

SEQ ID NO: 149326 - DNA, 20 bp, Artificial
  CRISPR gRNA sequence
gtggctcacgcctgtaatcc

SEQ ID NO: 149327 - DNA, 20 bp, Artificial
  CRISPR gRNA sequence
cgcctgtaatcccagcactt

SEQ ID NO: 149328 - DNA, 20 bp, Artificial
  CRISPR gRNA sequence
gcctgtaatcccagcacttt

SEQ ID NO: 149329 - DNA, 20 bp, Artificial
  CRISPR gRNA sequence
ctgtaatcccagcactttgg

SEQ ID NO: 149330 - DNA, 20 bp, Artificial
  CRISPR gRNA sequence
tcccagcactttgggagact

SEQ ID NO: 149331 - DNA, 20 bp, Artificial
  CRISPR gRNA sequence
cccagcactttgggagactg

SEQ ID NO: 149332 - DNA, 20 bp, Artificial
  CRISPR gRNA sequence
agcactttgggagactgagg

SEQ ID NO: 149333 - DNA, 20 bp, Artificial
  CRISPR gRNA sequence
gcactttgggagactgaggt

SEQ ID NO: 149334 - DNA, 20 bp, Artificial
  CRISPR gRNA sequence
ctttgggagactgaggtggg

SEQ ID NO: 149335 - DNA, 20 bp, Artificial
  CRISPR gRNA sequence
ctgaggtgggtggatcacct

SEQ ID NO: 149336 - DNA, 20 bp, Artificial
  CRISPR gRNA sequence
tgaggtgggtggatcacctg

SEQ ID NO: 149337 - DNA, 20 bp, Artificial
  CRISPR gRNA sequence
gtgggtggatcacctgaggt

SEQ ID NO: 149338 - DNA, 20 bp, Artificial
  CRISPR gRNA sequence
tgggtggatcacctgaggtc

SEQ ID NO: 149339 - DNA, 20 bp, Artificial
  CRISPR gRNA sequence
ggtggatcacctgaggtcag

SEQ ID NO: 149340 - DNA, 20 bp, Artificial
  CRISPR gRNA sequence
tgaggtcaggagttcgaaac

SEQ ID NO: 149341 - DNA, 20 bp, Artificial
  CRISPR gRNA sequence
tcaggagttcgaaaccagcc

SEQ ID NO: 149342 - DNA, 20 bp, Artificial
  CRISPR gRNA sequence
cgaaaccagcctggccaaca

SEQ ID NO: 149343 - DNA, 20 bp, Artificial
  CRISPR gRNA sequence
tctactaaaaatacaaaaat

SEQ ID NO: 149344 - DNA, 20 bp, Artificial
  CRISPR gRNA sequence
ctaaaaatacaaaaattagc

SEQ ID NO: 149345 - DNA, 20 bp, Artificial
  CRISPR gRNA sequence
taaaaatacaaaaattagct

SEQ ID NO: 149346 - DNA, 20 bp, Artificial
  CRISPR gRNA sequence
atacaaaaattagctgggca

SEQ ID NO: 149347 - DNA, 20 bp, Artificial
  CRISPR gRNA sequence
caaaaattagctgggcatgg

SEQ ID NO: 149348 - DNA, 20 bp, Artificial
  CRISPR gRNA sequence
attagctgggcatggtggtg

SEQ ID NO: 149349 - DNA, 20 bp, Artificial
  CRISPR gRNA sequence
ttagctgggcatggtggtgc

SEQ ID NO: 149350 - DNA, 20 bp, Artificial
  CRISPR gRNA sequence
gtggtgcgggcctgcaatcc

SEQ ID NO: 149351 - DNA, 20 bp, Artificial
  CRISPR gRNA sequence
ggcctgcaatcccagctact

SEQ ID NO: 149352 - DNA, 20 bp, Artificial
  CRISPR gRNA sequence
gcctgcaatcccagctactt

SEQ ID NO: 149353 - DNA, 20 bp, Artificial
  CRISPR gRNA sequence
tgcaatcccagctacttggg

SEQ ID NO: 149354 - DNA, 20 bp, Artificial
  CRISPR gRNA sequence
atcccagctacttgggaagc

SEQ ID NO: 149355 - DNA, 20 bp, Artificial
  CRISPR gRNA sequence
tcccagctacttgggaagct

SEQ ID NO: 149356 - DNA, 20 bp, Artificial
  CRISPR gRNA sequence
cccagctacttgggaagctg

SEQ ID NO: 149357 - DNA, 20 bp, Artificial
  CRISPR gRNA sequence
agctacttgggaagctgggg

SEQ ID NO: 149358 - DNA, 20 bp, Artificial
  CRISPR gRNA sequence
tacttgggaagctggggcag

SEQ ID NO: 149359 - DNA, 20 bp, Artificial
  CRISPR gRNA sequence
ctggggcagcagaatcgctt

SEQ ID NO: 149360 - DNA, 20 bp, Artificial
  CRISPR gRNA sequence
gcagcagaatcgcttgagcc

SEQ ID NO: 149361 - DNA, 20 bp, Artificial
  CRISPR gRNA sequence
cagcagaatcgcttgagccc

SEQ ID NO: 149362 - DNA, 20 bp, Artificial
  CRISPR gRNA sequence
gcagaatcgcttgagcccag

SEQ ID NO: 149363 - DNA, 20 bp, Artificial
  CRISPR gRNA sequence
cagaatcgcttgagcccagg

SEQ ID NO: 149364 - DNA, 20 bp, Artificial
  CRISPR gRNA sequence
aatcgcttgagcccaggagg

SEQ ID NO: 149365 - DNA, 20 bp, Artificial
  CRISPR gRNA sequence
tcgcttgagcccaggaggca

SEQ ID NO: 149366 - DNA, 20 bp, Artificial
  CRISPR gRNA sequence
cgcttgagcccaggaggcag

SEQ ID NO: 149367 - DNA, 20 bp, Artificial
  CRISPR gRNA sequence
agcccaggaggcagaggttg

SEQ ID NO: 149368 - DNA, 20 bp, Artificial
  CRISPR gRNA sequence
caggaggcagaggttgcagt

SEQ ID NO: 149369 - DNA, 20 bp, Artificial
  CRISPR gRNA sequence
ggcagaggttgcagtgagct

SEQ ID NO: 149370 - DNA, 20 bp, Artificial
  CRISPR gRNA sequence
gaggttgcagtgagctgaga

SEQ ID NO: 149371 - DNA, 20 bp, Artificial
  CRISPR gRNA sequence
gagatggcgccactgcactc

SEQ ID NO: 149372 - DNA, 20 bp, Artificial
  CRISPR gRNA sequence
gcgccactgcactccagcct

SEQ ID NO: 149373 - DNA, 20 bp, Artificial
  CRISPR gRNA sequence
ctgcactccagcctgagcaa

SEQ ID NO: 149374 - DNA, 20 bp, Artificial
  CRISPR gRNA sequence
tgcactccagcctgagcaac

SEQ ID NO: 149375 - DNA, 20 bp, Artificial
  CRISPR gRNA sequence
cactccagcctgagcaacag

SEQ ID NO: 149376 - DNA, 20 bp, Artificial
  CRISPR gRNA sequence
cacacacacaaacacataca

SEQ ID NO: 149377 - DNA, 20 bp, Artificial
  CRISPR gRNA sequence
cacatacacagaaattgcca

SEQ ID NO: 149378 - DNA, 20 bp, Artificial
  CRISPR gRNA sequence
gccaaagccaccccaaactt

SEQ ID NO: 149379 - DNA, 20 bp, Artificial
  CRISPR gRNA sequence
tcagcaactaccacccgaat

SEQ ID NO: 149380 - DNA, 20 bp, Artificial
  CRISPR gRNA sequence
caactaccacccgaatcagt

SEQ ID NO: 149381 - DNA, 20 bp, Artificial
  CRISPR gRNA sequence
ctaccacccgaatcagtcag

SEQ ID NO: 149382 - DNA, 20 bp, Artificial
  CRISPR gRNA sequence
agtcagcagccatcatcatc

SEQ ID NO: 149383 - DNA, 20 bp, Artificial
  CRISPR gRNA sequence
gcagccatcatcatcaagtc

SEQ ID NO: 149384 - DNA, 20 bp, Artificial
  CRISPR gRNA sequence
atcatcaagtcaagaccctc

SEQ ID NO: 149385 - DNA, 20 bp, Artificial
  CRISPR gRNA sequence
atcaagtcaagaccctcaag

SEQ ID NO: 149386 - DNA, 20 bp, Artificial
  CRISPR gRNA sequence
tcaagaccctcaagcagcaa

SEQ ID NO: 149387 - DNA, 20 bp, Artificial
  CRISPR gRNA sequence
caagaccctcaagcagcaaa

SEQ ID NO: 149388 - DNA, 20 bp, Artificial
  CRISPR gRNA sequence
aaaaggttatgacttgctgc

SEQ ID NO: 149389 - DNA, 20 bp, Artificial
  CRISPR gRNA sequence
gttatgacttgctgcaagtt

SEQ ID NO: 149390 - DNA, 20 bp, Artificial
  CRISPR gRNA sequence
taatttgcatttttaccaat

SEQ ID NO: 149391 - DNA, 20 bp, Artificial
  CRISPR gRNA sequence
aatttgcatttttaccaata

SEQ ID NO: 149392 - DNA, 20 bp, Artificial
  CRISPR gRNA sequence
aggtattttaaaattaaaat

SEQ ID NO: 149393 - DNA, 20 bp, Artificial
  CRISPR gRNA sequence
attaaaataagcacattttt

SEQ ID NO: 149394 - DNA, 20 bp, Artificial
  CRISPR gRNA sequence
ttatgctgttgcacacttaa

SEQ ID NO: 149395 - DNA, 20 bp, Artificial
  CRISPR gRNA sequence
tatgctgttgcacacttaat

SEQ ID NO: 149396 - DNA, 20 bp, Artificial
  CRISPR gRNA sequence
aacataacttctatttgcac

SEQ ID NO: 149397 - DNA, 20 bp, Artificial
  CRISPR gRNA sequence
acataacttctatttgcact

SEQ ID NO: 149398 - DNA, 20 bp, Artificial
  CRISPR gRNA sequence
gactctctttattataatgt

SEQ ID NO: 149399 - DNA, 20 bp, Artificial
  CRISPR gRNA sequence
agctttattgtattttgccc

SEQ ID NO: 149400 - DNA, 20 bp, Artificial
  CRISPR gRNA sequence
tttattgtattttgccctag

SEQ ID NO: 149401 - DNA, 20 bp, Artificial
  CRISPR gRNA sequence
attgtattttgccctagtgg

SEQ ID NO: 149402 - DNA, 20 bp, Artificial
  CRISPR gRNA sequence
cctagtggcagcactatcac

SEQ ID NO: 149403 - DNA, 20 bp, Artificial
  CRISPR gRNA sequence
atcacaagcattttatgtac

SEQ ID NO: 149404 - DNA, 20 bp, Artificial
  CRISPR gRNA sequence
ttttatgtaccagtactgct

SEQ ID NO: 149405 - DNA, 20 bp, Artificial
  CRISPR gRNA sequence
tttatgtaccagtactgctc

SEQ ID NO: 149406 - DNA, 20 bp, Artificial
  CRISPR gRNA sequence
gtactgctcaggtatttact

SEQ ID NO: 149407 - DNA, 20 bp, Artificial
  CRISPR gRNA sequence
tactgctcaggtatttactg

SEQ ID NO: 149408 - DNA, 20 bp, Artificial
  CRISPR gRNA sequence
gctcaggtatttactgaggt

SEQ ID NO: 149409 - DNA, 20 bp, Artificial
  CRISPR gRNA sequence
gtatttactgaggttagttc

SEQ ID NO: 149410 - DNA, 20 bp, Artificial
  CRISPR gRNA sequence
tatttactgaggttagttct

SEQ ID NO: 149411 - DNA, 20 bp, Artificial
  CRISPR gRNA sequence
ctaggtttcttcatttaaat

SEQ ID NO: 149412 - DNA, 20 bp, Artificial
  CRISPR gRNA sequence
tttcttcatttaaatgagct

SEQ ID NO: 149413 - DNA, 20 bp, Artificial
  CRISPR gRNA sequence
ttcttcatttaaatgagcta

SEQ ID NO: 149414 - DNA, 20 bp, Artificial
  CRISPR gRNA sequence
ttaaatgagctaaggtttgt

SEQ ID NO: 149415 - DNA, 20 bp, Artificial
  CRISPR gRNA sequence
tgttatattttaaatgatga

SEQ ID NO: 149416 - DNA, 20 bp, Artificial
  CRISPR gRNA sequence
gttatattttaaatgatgat

SEQ ID NO: 149417 - DNA, 20 bp, Artificial
  CRISPR gRNA sequence
tatattttaaatgatgatgg

SEQ ID NO: 149418 - DNA, 20 bp, Artificial
  CRISPR gRNA sequence
ttaaatgatgatgggagata

SEQ ID NO: 149419 - DNA, 20 bp, Artificial
  CRISPR gRNA sequence
aaatgatgatgggagataca

SEQ ID NO: 149420 - DNA, 20 bp, Artificial
  CRISPR gRNA sequence
gatgatgggagatacagaga

SEQ ID NO: 149421 - DNA, 20 bp, Artificial
  CRISPR gRNA sequence
atgatgggagatacagagaa

SEQ ID NO: 149422 - DNA, 20 bp, Artificial
  CRISPR gRNA sequence
atgggagatacagagaaagg

SEQ ID NO: 149423 - DNA, 20 bp, Artificial
  CRISPR gRNA sequence
agaatattaataaaaataaa

SEQ ID NO: 149424 - DNA, 20 bp, Artificial
  CRISPR gRNA sequence
tattaataaaaataaatgga

SEQ ID NO: 149425 - DNA, 20 bp, Artificial
  CRISPR gRNA sequence
ataaaaataaatggatggat

SEQ ID NO: 149426 - DNA, 20 bp, Artificial
  CRISPR gRNA sequence
taaaaataaatggatggatg

SEQ ID NO: 149427 - DNA, 20 bp, Artificial
  CRISPR gRNA sequence
aaaaataaatggatggatga

SEQ ID NO: 149428 - DNA, 20 bp, Artificial
  CRISPR gRNA sequence
ataaatggatggatgaggga

SEQ ID NO: 149429 - DNA, 20 bp, Artificial
  CRISPR gRNA sequence
taaatggatggatgagggaa

SEQ ID NO: 149430 - DNA, 20 bp, Artificial
  CRISPR gRNA sequence
aaatggatggatgagggaaa

SEQ ID NO: 149431 - DNA, 20 bp, Artificial
  CRISPR gRNA sequence
aatggatggatgagggaaag

SEQ ID NO: 149432 - DNA, 20 bp, Artificial
  CRISPR gRNA sequence
atggatggatgagggaaagg

SEQ ID NO: 149433 - DNA, 20 bp, Artificial
  CRISPR gRNA sequence
tggatggatgagggaaaggg

SEQ ID NO: 149434 - DNA, 20 bp, Artificial
  CRISPR gRNA sequence
atggatgagggaaagggggg

SEQ ID NO: 149435 - DNA, 20 bp, Artificial
  CRISPR gRNA sequence
tggatgagggaaaggggggt

SEQ ID NO: 149436 - DNA, 20 bp, Artificial
  CRISPR gRNA sequence
gggtaggatttatttactaa

SEQ ID NO: 149437 - DNA, 20 bp, Artificial
  CRISPR gRNA sequence
ttatttactaacagactatt

SEQ ID NO: 149438 - DNA, 20 bp, Artificial
  CRISPR gRNA sequence
atttggtttttatgtttaca

SEQ ID NO: 149439 - DNA, 20 bp, Artificial
  CRISPR gRNA sequence
ggtttttatgtttacacaga

SEQ ID NO: 149440 - DNA, 20 bp, Artificial
  CRISPR gRNA sequence
atgtttacacagatggacct

SEQ ID NO: 149441 - DNA, 20 bp, Artificial
  CRISPR gRNA sequence
tgtttacacagatggacctt

SEQ ID NO: 149442 - DNA, 20 bp, Artificial
  CRISPR gRNA sequence
tatgctattatcgatcacaa

SEQ ID NO: 149443 - DNA, 20 bp, Artificial
  CRISPR gRNA sequence
tatcgatcacaacagctaaa

SEQ ID NO: 149444 - DNA, 20 bp, Artificial
  CRISPR gRNA sequence
acagctaaaaagcatttctt

SEQ ID NO: 149445 - DNA, 20 bp, Artificial
  CRISPR gRNA sequence
gctaaaaagcatttcttaag

SEQ ID NO: 149446 - DNA, 20 bp, Artificial
  CRISPR gRNA sequence
ctaaaaagcatttcttaaga

SEQ ID NO: 149447 - DNA, 20 bp, Artificial
  CRISPR gRNA sequence
tctaaaattgacaatttcac

SEQ ID NO: 149448 - DNA, 20 bp, Artificial
  CRISPR gRNA sequence
aaaattgacaatttcacaag

SEQ ID NO: 149449 - DNA, 20 bp, Artificial
  CRISPR gRNA sequence
caatttcacaagaagaaaaa

SEQ ID NO: 149450 - DNA, 20 bp, Artificial
  CRISPR gRNA sequence
cacaagaagaaaaacagcac

SEQ ID NO: 149451 - DNA, 20 bp, Artificial
  CRISPR gRNA sequence
gaagaaaaacagcactggtc

SEQ ID NO: 149452 - DNA, 20 bp, Artificial
  CRISPR gRNA sequence
agcactggtctggaaattaa

SEQ ID NO: 149453 - DNA, 20 bp, Artificial
  CRISPR gRNA sequence
aaagacctacgtctgtgtac

SEQ ID NO: 149454 - DNA, 20 bp, Artificial
  CRISPR gRNA sequence
actggacgcttgctgcctac

SEQ ID NO: 149455 - DNA, 20 bp, Artificial
  CRISPR gRNA sequence
gacgcttgctgcctactagc

SEQ ID NO: 149456 - DNA, 20 bp, Artificial
  CRISPR gRNA sequence
gcttgctgcctactagctgg

SEQ ID NO: 149457 - DNA, 20 bp, Artificial
  CRISPR gRNA sequence
tgcctactagctggtggccc

SEQ ID NO: 149458 - DNA, 20 bp, Artificial
  CRISPR gRNA sequence
gcctactagctggtggccct

SEQ ID NO: 149459 - DNA, 20 bp, Artificial
  CRISPR gRNA sequence
actagctggtggccctgggc

SEQ ID NO: 149460 - DNA, 20 bp, Artificial
  CRISPR gRNA sequence
cctgggccagtcactctact

SEQ ID NO: 149461 - DNA, 20 bp, Artificial
  CRISPR gRNA sequence
gtcactctactaagccactc

SEQ ID NO: 149462 - DNA, 20 bp, Artificial
  CRISPR gRNA sequence
tgtatactgaacacattcca

SEQ ID NO: 149463 - DNA, 20 bp, Artificial
  CRISPR gRNA sequence
gtatactgaacacattccaa

SEQ ID NO: 149464 - DNA, 20 bp, Artificial
  CRISPR gRNA sequence
tatactgaacacattccaaa

SEQ ID NO: 149465 - DNA, 20 bp, Artificial
  CRISPR gRNA sequence
atactgaacacattccaaag

SEQ ID NO: 149466 - DNA, 20 bp, Artificial
  CRISPR gRNA sequence
acacattccaaaggggtctc

SEQ ID NO: 149467 - DNA, 20 bp, Artificial
  CRISPR gRNA sequence
cattccaaaggggtctctgg

SEQ ID NO: 149468 - DNA, 20 bp, Artificial
  CRISPR gRNA sequence
caaaggggtctctggtggtt

SEQ ID NO: 149469 - DNA, 20 bp, Artificial
  CRISPR gRNA sequence
aggggtctctggtggtttgg

SEQ ID NO: 149470 - DNA, 20 bp, Artificial
  CRISPR gRNA sequence
ggggtctctggtggtttggt

SEQ ID NO: 149471 - DNA, 20 bp, Artificial
  CRISPR gRNA sequence
gggtctctggtggtttggtg

SEQ ID NO: 149472 - DNA, 20 bp, Artificial
  CRISPR gRNA sequence
tctctggtggtttggtgggg

SEQ ID NO: 149473 - DNA, 20 bp, Artificial
  CRISPR gRNA sequence
gtcctacacttcactacttg

SEQ ID NO: 149474 - DNA, 20 bp, Artificial
  CRISPR gRNA sequence
tgcaataaatgaatgaatac

SEQ ID NO: 149475 - DNA, 20 bp, Artificial
  CRISPR gRNA sequence
gcaataaatgaatgaataca

SEQ ID NO: 149476 - DNA, 20 bp, Artificial
  CRISPR gRNA sequence
caataaatgaatgaatacaa

SEQ ID NO: 149477 - DNA, 20 bp, Artificial
  CRISPR gRNA sequence
taaatgaatgaatacaaggg

SEQ ID NO: 149478 - DNA, 20 bp, Artificial
  CRISPR gRNA sequence
aaatgaatgaatacaaggga

SEQ ID NO: 149479 - DNA, 20 bp, Artificial
  CRISPR gRNA sequence
aatgaatacaagggaaggca

SEQ ID NO: 149480 - DNA, 20 bp, Artificial
  CRISPR gRNA sequence
acaagggaaggcaaagtgac

SEQ ID NO: 149481 - DNA, 20 bp, Artificial
  CRISPR gRNA sequence
aagggaaggcaaagtgacta

SEQ ID NO: 149482 - DNA, 20 bp, Artificial
  CRISPR gRNA sequence
gggaaggcaaagtgactaga

SEQ ID NO: 149483 - DNA, 20 bp, Artificial
  CRISPR gRNA sequence
aaggcaaagtgactagagag

SEQ ID NO: 149484 - DNA, 20 bp, Artificial
  CRISPR gRNA sequence
ggcaaagtgactagagagaa

SEQ ID NO: 149485 - DNA, 20 bp, Artificial
  CRISPR gRNA sequence
aaagtgactagagagaagag

SEQ ID NO: 149486 - DNA, 20 bp, Artificial
  CRISPR gRNA sequence
aagtgactagagagaagaga

SEQ ID NO: 149487 - DNA, 20 bp, Artificial
  CRISPR gRNA sequence
agagagaagagaaggttcaa

SEQ ID NO: 149488 - DNA, 20 bp, Artificial
  CRISPR gRNA sequence
gtctctatttaaactcatct

SEQ ID NO: 149489 - DNA, 20 bp, Artificial
  CRISPR gRNA sequence
tctctatttaaactcatcta

SEQ ID NO: 149490 - DNA, 20 bp, Artificial
  CRISPR gRNA sequence
actcatctaaggtttttata

SEQ ID NO: 149491 - DNA, 20 bp, Artificial
  CRISPR gRNA sequence
aaggtttttatatagtcatg

SEQ ID NO: 149492 - DNA, 20 bp, Artificial
  CRISPR gRNA sequence
aggtttttatatagtcatgc

SEQ ID NO: 149493 - DNA, 20 bp, Artificial
  CRISPR gRNA sequence
atatagtcatgcaggaaact

SEQ ID NO: 149494 - DNA, 20 bp, Artificial
  CRISPR gRNA sequence
gtcatgcaggaaactaagtt

SEQ ID NO: 149495 - DNA, 20 bp, Artificial
  CRISPR gRNA sequence
tcatgcaggaaactaagttc

SEQ ID NO: 149496 - DNA, 20 bp, Artificial
  CRISPR gRNA sequence
ctaagttcaggcactacgtt

SEQ ID NO: 149497 - DNA, 20 bp, Artificial
  CRISPR gRNA sequence
ttacattctaaacccttaca

SEQ ID NO: 149498 - DNA, 20 bp, Artificial
  CRISPR gRNA sequence
attctaaacccttacatagc

SEQ ID NO: 149499 - DNA, 20 bp, Artificial
  CRISPR gRNA sequence
ttctaaacccttacatagct

SEQ ID NO: 149500 - DNA, 20 bp, Artificial
  CRISPR gRNA sequence
acccttacatagctgggtac

SEQ ID NO: 149501 - DNA, 20 bp, Artificial
  CRISPR gRNA sequence
ttacatagctgggtaccagc

SEQ ID NO: 149502 - DNA, 20 bp, Artificial
  CRISPR gRNA sequence
taccagctggtcatatttac

SEQ ID NO: 149503 - DNA, 20 bp, Artificial
  CRISPR gRNA sequence
cagctggtcatatttactgg

SEQ ID NO: 149504 - DNA, 20 bp, Artificial
  CRISPR gRNA sequence
agctggtcatatttactggc

SEQ ID NO: 149505 - DNA, 20 bp, Artificial
  CRISPR gRNA sequence
tttactggcaggctactgaa

SEQ ID NO: 149506 - DNA, 20 bp, Artificial
  CRISPR gRNA sequence
agtcttcactactataatac

SEQ ID NO: 149507 - DNA, 20 bp, Artificial
  CRISPR gRNA sequence
taatacaagaatgaataaca

SEQ ID NO: 149508 - DNA, 20 bp, Artificial
  CRISPR gRNA sequence
ccccaactctgattaatgcc

SEQ ID NO: 149509 - DNA, 20 bp, Artificial
  CRISPR gRNA sequence
aatgccaagtttgacgtttg

SEQ ID NO: 149510 - DNA, 20 bp, Artificial
  CRISPR gRNA sequence
atgccaagtttgacgtttga

SEQ ID NO: 149511 - DNA, 20 bp, Artificial
  CRISPR gRNA sequence
tttgaaggtatatctgtgtt

SEQ ID NO: 149512 - DNA, 20 bp, Artificial
  CRISPR gRNA sequence
tgaaggtatatctgtgttaa

SEQ ID NO: 149513 - DNA, 20 bp, Artificial
  CRISPR gRNA sequence
gaaggtatatctgtgttaag

SEQ ID NO: 149514 - DNA, 20 bp, Artificial
  CRISPR gRNA sequence
ggtatatctgtgttaagagg

SEQ ID NO: 149515 - DNA, 20 bp, Artificial
  CRISPR gRNA sequence
taagaggaagccgcttttca

SEQ ID NO: 149516 - DNA, 20 bp, Artificial
  CRISPR gRNA sequence
ccgcttttcaaagtgcctac

SEQ ID NO: 149517 - DNA, 20 bp, Artificial
  CRISPR gRNA sequence
tggaaaaccatgcttcctaa

SEQ ID NO: 149518 - DNA, 20 bp, Artificial
  CRISPR gRNA sequence
accatgcttcctaaaagact

SEQ ID NO: 149519 - DNA, 20 bp, Artificial
  CRISPR gRNA sequence
ccatgcttcctaaaagactt

SEQ ID NO: 149520 - DNA, 20 bp, Artificial
  CRISPR gRNA sequence
cttcctaaaagacttaggct

SEQ ID NO: 149521 - DNA, 20 bp, Artificial
  CRISPR gRNA sequence
cctaaaagacttaggcttag

SEQ ID NO: 149522 - DNA, 20 bp, Artificial
  CRISPR gRNA sequence
aaaagacttaggcttagaag

SEQ ID NO: 149523 - DNA, 20 bp, Artificial
  CRISPR gRNA sequence
gctgcacactgctctcctta

SEQ ID NO: 149524 - DNA, 20 bp, Artificial
  CRISPR gRNA sequence
ctccttaaagatctgtacac

SEQ ID NO: 149525 - DNA, 20 bp, Artificial
  CRISPR gRNA sequence
tccttaaagatctgtacaca

SEQ ID NO: 149526 - DNA, 20 bp, Artificial
  CRISPR gRNA sequence
acaaggacacattttcaaac

SEQ ID NO: 149527 - DNA, 20 bp, Artificial
  CRISPR gRNA sequence
aggacacattttcaaactgg

SEQ ID NO: 149528 - DNA, 20 bp, Artificial
  CRISPR gRNA sequence
acacattttcaaactggcag

SEQ ID NO: 149529 - DNA, 20 bp, Artificial
  CRISPR gRNA sequence
acattttcaaactggcagaa

SEQ ID NO: 149530 - DNA, 20 bp, Artificial
  CRISPR gRNA sequence
aacaaaaatacttttctatt

SEQ ID NO: 149531 - DNA, 20 bp, Artificial
  CRISPR gRNA sequence
atacttttctatttggtatc

SEQ ID NO: 149532 - DNA, 20 bp, Artificial
  CRISPR gRNA sequence
gtacaatataatctttgaaa

SEQ ID NO: 149533 - DNA, 20 bp, Artificial
  CRISPR gRNA sequence
tacaatataatctttgaaac

SEQ ID NO: 149534 - DNA, 20 bp, Artificial
  CRISPR gRNA sequence
acaatataatctttgaaaca

SEQ ID NO: 149535 - DNA, 20 bp, Artificial
  CRISPR gRNA sequence
caatataatctttgaaacag

SEQ ID NO: 149536 - DNA, 20 bp, Artificial
  CRISPR gRNA sequence
ataatctttgaaacaggggc

SEQ ID NO: 149537 - DNA, 20 bp, Artificial
  CRISPR gRNA sequence
acaggggccagatcataata

SEQ ID NO: 149538 - DNA, 20 bp, Artificial
  CRISPR gRNA sequence
gccagatcataatatagttg

SEQ ID NO: 149539 - DNA, 20 bp, Artificial
  CRISPR gRNA sequence
taatatagttgtagcacaac

SEQ ID NO: 149540 - DNA, 20 bp, Artificial
  CRISPR gRNA sequence
atatagttgtagcacaacta

SEQ ID NO: 149541 - DNA, 20 bp, Artificial
  CRISPR gRNA sequence
agcacaactagagaaaaatg

SEQ ID NO: 149542 - DNA, 20 bp, Artificial
  CRISPR gRNA sequence
gcacaactagagaaaaatga

SEQ ID NO: 149543 - DNA, 20 bp, Artificial
  CRISPR gRNA sequence
actagagaaaaatgaaggca

SEQ ID NO: 149544 - DNA, 20 bp, Artificial
  CRISPR gRNA sequence
aaaaatgaaggcacagcaac

SEQ ID NO: 149545 - DNA, 20 bp, Artificial
  CRISPR gRNA sequence
gcaactggtataaacaatga

SEQ ID NO: 149546 - DNA, 20 bp, Artificial
  CRISPR gRNA sequence
ggtataaacaatgaaagtga

SEQ ID NO: 149547 - DNA, 20 bp, Artificial
  CRISPR gRNA sequence
gtataaacaatgaaagtgac

SEQ ID NO: 149548 - DNA, 20 bp, Artificial
  CRISPR gRNA sequence
taaacaatgaaagtgacggg

SEQ ID NO: 149549 - DNA, 20 bp, Artificial
  CRISPR gRNA sequence
aaacaatgaaagtgacggga

SEQ ID NO: 149550 - DNA, 20 bp, Artificial
  CRISPR gRNA sequence
aagtgacgggaaggcatgaa

SEQ ID NO: 149551 - DNA, 20 bp, Artificial
  CRISPR gRNA sequence
catttgaaaacttttttctg

SEQ ID NO: 149552 - DNA, 20 bp, Artificial
  CRISPR gRNA sequence
gaaaacttttttctgtggaa

SEQ ID NO: 149553 - DNA, 20 bp, Artificial
  CRISPR gRNA sequence
aaccatctctgcatatataa

SEQ ID NO: 149554 - DNA, 20 bp, Artificial
  CRISPR gRNA sequence
taacagcaataaaacactat

SEQ ID NO: 149555 - DNA, 20 bp, Artificial
  CRISPR gRNA sequence
tatcagtattttgtatgatg

SEQ ID NO: 149556 - DNA, 20 bp, Artificial
  CRISPR gRNA sequence
tattttgtatgatgaagaaa

SEQ ID NO: 149557 - DNA, 20 bp, Artificial
  CRISPR gRNA sequence
attttgtatgatgaagaaaa

SEQ ID NO: 149558 - DNA, 20 bp, Artificial
  CRISPR gRNA sequence
tatgatgaagaaaaaggatc

SEQ ID NO: 149559 - DNA, 20 bp, Artificial
  CRISPR gRNA sequence
aagaaaaaggatcaagtatt

SEQ ID NO: 149560 - DNA, 20 bp, Artificial
  CRISPR gRNA sequence
aaaggatcaagtatttagtg

SEQ ID NO: 149561 - DNA, 20 bp, Artificial
  CRISPR gRNA sequence
gtatttagtgaagtattcta

SEQ ID NO: 149562 - DNA, 20 bp, Artificial
  CRISPR gRNA sequence
ttagtgaagtattctaaagc

SEQ ID NO: 149563 - DNA, 20 bp, Artificial
  CRISPR gRNA sequence
tagtgaagtattctaaagca

SEQ ID NO: 149564 - DNA, 20 bp, Artificial
  CRISPR gRNA sequence
agtgaagtattctaaagcaa

SEQ ID NO: 149565 - DNA, 20 bp, Artificial
  CRISPR gRNA sequence
aagcaagggtctaaaaacta

SEQ ID NO: 149566 - DNA, 20 bp, Artificial
  CRISPR gRNA sequence
ggtctaaaaactacagctca

SEQ ID NO: 149567 - DNA, 20 bp, Artificial
  CRISPR gRNA sequence
gtctaaaaactacagctcat

SEQ ID NO: 149568 - DNA, 20 bp, Artificial
  CRISPR gRNA sequence
tacagctcataggccacatc

SEQ ID NO: 149569 - DNA, 20 bp, Artificial
  CRISPR gRNA sequence
cataggccacatctggccta

SEQ ID NO: 149570 - DNA, 20 bp, Artificial
  CRISPR gRNA sequence
tctggcctacagcctgtttt

SEQ ID NO: 149571 - DNA, 20 bp, Artificial
  CRISPR gRNA sequence
ctacagcctgtttttagaaa

SEQ ID NO: 149572 - DNA, 20 bp, Artificial
  CRISPR gRNA sequence
gtttttagaaacagtttcac

SEQ ID NO: 149573 - DNA, 20 bp, Artificial
  CRISPR gRNA sequence
tttagaaacagtttcactgg

SEQ ID NO: 149574 - DNA, 20 bp, Artificial
  CRISPR gRNA sequence
tttatttattcatttacttt

SEQ ID NO: 149575 - DNA, 20 bp, Artificial
  CRISPR gRNA sequence
tttattcatttacttttaga

SEQ ID NO: 149576 - DNA, 20 bp, Artificial
  CRISPR gRNA sequence
tattcatttacttttagacg

SEQ ID NO: 149577 - DNA, 20 bp, Artificial
  CRISPR gRNA sequence
tttacttttagacggagcct

SEQ ID NO: 149578 - DNA, 20 bp, Artificial
  CRISPR gRNA sequence
cggagcctcagtctgtcatc

SEQ ID NO: 149579 - DNA, 20 bp, Artificial
  CRISPR gRNA sequence
ggagcctcagtctgtcatcc

SEQ ID NO: 149580 - DNA, 20 bp, Artificial
  CRISPR gRNA sequence
cctcagtctgtcatccaggc

SEQ ID NO: 149581 - DNA, 20 bp, Artificial
  CRISPR gRNA sequence
tcagtctgtcatccaggctg

SEQ ID NO: 149582 - DNA, 20 bp, Artificial
  CRISPR gRNA sequence
tcatccaggctggagtacaa

SEQ ID NO: 149583 - DNA, 20 bp, Artificial
  CRISPR gRNA sequence
ggagtacaatggcacgatct

SEQ ID NO: 149584 - DNA, 20 bp, Artificial
  CRISPR gRNA sequence
tcactgcaacctccacctcc

SEQ ID NO: 149585 - DNA, 20 bp, Artificial
  CRISPR gRNA sequence
cactgcaacctccacctccc

SEQ ID NO: 149586 - DNA, 20 bp, Artificial
  CRISPR gRNA sequence
aacctccacctcccgggttc

SEQ ID NO: 149587 - DNA, 20 bp, Artificial
  CRISPR gRNA sequence
ttcaagcgattctcccacct

SEQ ID NO: 149588 - DNA, 20 bp, Artificial
  CRISPR gRNA sequence
ttctcccacctcagcctccc

SEQ ID NO: 149589 - DNA, 20 bp, Artificial
  CRISPR gRNA sequence
tcccacctcagcctcccaag

SEQ ID NO: 149590 - DNA, 20 bp, Artificial
  CRISPR gRNA sequence
acctcagcctcccaagcagc

SEQ ID NO: 149591 - DNA, 20 bp, Artificial
  CRISPR gRNA sequence
cctcagcctcccaagcagct

SEQ ID NO: 149592 - DNA, 20 bp, Artificial
  CRISPR gRNA sequence
ctcccaagcagctgggatta

SEQ ID NO: 149593 - DNA, 20 bp, Artificial
  CRISPR gRNA sequence
tcccaagcagctgggattat

SEQ ID NO: 149594 - DNA, 20 bp, Artificial
  CRISPR gRNA sequence
taggcacccgccatcacacc

SEQ ID NO: 149595 - DNA, 20 bp, Artificial
  CRISPR gRNA sequence
agctaatttttgtatttttg

SEQ ID NO: 149596 - DNA, 20 bp, Artificial
  CRISPR gRNA sequence
ctaatttttgtatttttgaa

SEQ ID NO: 149597 - DNA, 20 bp, Artificial
  CRISPR gRNA sequence
tttttgtatttttgaagaga

SEQ ID NO: 149598 - DNA, 20 bp, Artificial
  CRISPR gRNA sequence
ttttgtatttttgaagagac

SEQ ID NO: 149599 - DNA, 20 bp, Artificial
  CRISPR gRNA sequence
acgggtttcaccatgttgac

SEQ ID NO: 149600 - DNA, 20 bp, Artificial
  CRISPR gRNA sequence
cgggtttcaccatgttgacc

SEQ ID NO: 149601 - DNA, 20 bp, Artificial
  CRISPR gRNA sequence
tttcaccatgttgaccaggt

SEQ ID NO: 149602 - DNA, 20 bp, Artificial
  CRISPR gRNA sequence
ggtcttgaactcctgacctt

SEQ ID NO: 149603 - DNA, 20 bp, Artificial
  CRISPR gRNA sequence
cttaagtgatctgcccacct

SEQ ID NO: 149604 - DNA, 20 bp, Artificial
  CRISPR gRNA sequence
acctcggcctcccaaaacgc

SEQ ID NO: 149605 - DNA, 20 bp, Artificial
  CRISPR gRNA sequence
cctcggcctcccaaaacgct

SEQ ID NO: 149606 - DNA, 20 bp, Artificial
  CRISPR gRNA sequence
ctcccaaaacgctgggatta

SEQ ID NO: 149607 - DNA, 20 bp, Artificial
  CRISPR gRNA sequence
tcccaaaacgctgggattac

SEQ ID NO: 149608 - DNA, 20 bp, Artificial
  CRISPR gRNA sequence
aacgctgggattacaggcgt

SEQ ID NO: 149609 - DNA, 20 bp, Artificial
  CRISPR gRNA sequence
caggcgtgagccaccatgtc

SEQ ID NO: 149610 - DNA, 20 bp, Artificial
  CRISPR gRNA sequence
caccatgtccagcccctaat

SEQ ID NO: 149611 - DNA, 20 bp, Artificial
  CRISPR gRNA sequence
tattgtctgttcatgctaaa

SEQ ID NO: 149612 - DNA, 20 bp, Artificial
  CRISPR gRNA sequence
tgtctgttcatgctaaacag

SEQ ID NO: 149613 - DNA, 20 bp, Artificial
  CRISPR gRNA sequence
tctgttcatgctaaacagta

SEQ ID NO: 149614 - DNA, 20 bp, Artificial
  CRISPR gRNA sequence
catgctaaacagtagagttg

SEQ ID NO: 149615 - DNA, 20 bp, Artificial
  CRISPR gRNA sequence
tgctaaacagtagagttgaa

SEQ ID NO: 149616 - DNA, 20 bp, Artificial
  CRISPR gRNA sequence
gagttacaacaaaaatcata

SEQ ID NO: 149617 - DNA, 20 bp, Artificial
  CRISPR gRNA sequence
acaaaaatcatacagccaca

SEQ ID NO: 149618 - DNA, 20 bp, Artificial
  CRISPR gRNA sequence
gccacaaagcctaaaatatc

SEQ ID NO: 149619 - DNA, 20 bp, Artificial
  CRISPR gRNA sequence
cctaaaatatctggcccttt

SEQ ID NO: 149620 - DNA, 20 bp, Artificial
  CRISPR gRNA sequence
ctaaaatatctggcccttta

SEQ ID NO: 149621 - DNA, 20 bp, Artificial
  CRISPR gRNA sequence
tatctggccctttaaggaaa

SEQ ID NO: 149622 - DNA, 20 bp, Artificial
  CRISPR gRNA sequence
atctggccctttaaggaaaa

SEQ ID NO: 149623 - DNA, 20 bp, Artificial
  CRISPR gRNA sequence
gccctttaaggaaaaaggtt

SEQ ID NO: 149624 - DNA, 20 bp, Artificial
  CRISPR gRNA sequence
tttaaggaaaaaggttcagc

SEQ ID NO: 149625 - DNA, 20 bp, Artificial
  CRISPR gRNA sequence
ttaaggaaaaaggttcagcc

SEQ ID NO: 149626 - DNA, 20 bp, Artificial
  CRISPR gRNA sequence
gaaaaaggttcagccaggca

SEQ ID NO: 149627 - DNA, 20 bp, Artificial
  CRISPR gRNA sequence
aaaggttcagccaggcatgg

SEQ ID NO: 149628 - DNA, 20 bp, Artificial
  CRISPR gRNA sequence
gtagctcatgcctctaatcc

SEQ ID NO: 149629 - DNA, 20 bp, Artificial
  CRISPR gRNA sequence
tgcctctaatcctagcactc

SEQ ID NO: 149630 - DNA, 20 bp, Artificial
  CRISPR gRNA sequence
gcctctaatcctagcactct

SEQ ID NO: 149631 - DNA, 20 bp, Artificial
  CRISPR gRNA sequence
ctctaatcctagcactctgg

SEQ ID NO: 149632 - DNA, 20 bp, Artificial
  CRISPR gRNA sequence
tctaatcctagcactctggg

SEQ ID NO: 149633 - DNA, 20 bp, Artificial
  CRISPR gRNA sequence
tcctagcactctgggaggcc

SEQ ID NO: 149634 - DNA, 20 bp, Artificial
  CRISPR gRNA sequence
cctagcactctgggaggcca

SEQ ID NO: 149635 - DNA, 20 bp, Artificial
  CRISPR gRNA sequence
agcactctgggaggccaagg

SEQ ID NO: 149636 - DNA, 20 bp, Artificial
  CRISPR gRNA sequence
gcactctgggaggccaaggc

SEQ ID NO: 149637 - DNA, 20 bp, Artificial
  CRISPR gRNA sequence
actctgggaggccaaggcgg

SEQ ID NO: 149638 - DNA, 20 bp, Artificial
  CRISPR gRNA sequence
ctctgggaggccaaggcggg

SEQ ID NO: 149639 - DNA, 20 bp, Artificial
  CRISPR gRNA sequence
cgggaggatcacttgaaccc

SEQ ID NO: 149640 - DNA, 20 bp, Artificial
  CRISPR gRNA sequence
ggaggatcacttgaacccaa

SEQ ID NO: 149641 - DNA, 20 bp, Artificial
  CRISPR gRNA sequence
tcacttgaacccaagagctc

SEQ ID NO: 149642 - DNA, 20 bp, Artificial
  CRISPR gRNA sequence
tgaacccaagagctcgagat

SEQ ID NO: 149643 - DNA, 20 bp, Artificial
  CRISPR gRNA sequence
ccaagagctcgagatcagcc

SEQ ID NO: 149644 - DNA, 20 bp, Artificial
  CRISPR gRNA sequence
caagagctcgagatcagcct

SEQ ID NO: 149645 - DNA, 20 bp, Artificial
  CRISPR gRNA sequence
cgagatcagcctgggcaaca

SEQ ID NO: 149646 - DNA, 20 bp, Artificial
  CRISPR gRNA sequence
atcagcctgggcaacatagt

SEQ ID NO: 149647 - DNA, 20 bp, Artificial
  CRISPR gRNA sequence
tagtgagacccccatctcaa

SEQ ID NO: 149648 - DNA, 20 bp, Artificial
  CRISPR gRNA sequence
gaaaataaaaaataaaaaac

SEQ ID NO: 149649 - DNA, 20 bp, Artificial
  CRISPR gRNA sequence
ataaaaaataaaaaactagc

SEQ ID NO: 149650 - DNA, 20 bp, Artificial
  CRISPR gRNA sequence
taaaaaataaaaaactagcc

SEQ ID NO: 149651 - DNA, 20 bp, Artificial
  CRISPR gRNA sequence
aataaaaaactagccaggtg

SEQ ID NO: 149652 - DNA, 20 bp, Artificial
  CRISPR gRNA sequence
aaaaaactagccaggtgtag

SEQ ID NO: 149653 - DNA, 20 bp, Artificial
  CRISPR gRNA sequence
ggtgtagtggcccacacctg

SEQ ID NO: 149654 - DNA, 20 bp, Artificial
  CRISPR gRNA sequence
gtggcccacacctgtagtcc

SEQ ID NO: 149655 - DNA, 20 bp, Artificial
  CRISPR gRNA sequence
ctgtagtcccagctactcac

SEQ ID NO: 149656 - DNA, 20 bp, Artificial
  CRISPR gRNA sequence
tgtagtcccagctactcacg

SEQ ID NO: 149657 - DNA, 20 bp, Artificial
  CRISPR gRNA sequence
tcccagctactcacgaggct

SEQ ID NO: 149658 - DNA, 20 bp, Artificial
  CRISPR gRNA sequence
cccagctactcacgaggctg

SEQ ID NO: 149659 - DNA, 20 bp, Artificial
  CRISPR gRNA sequence
agctactcacgaggctgagg

SEQ ID NO: 149660 - DNA, 20 bp, Artificial
  CRISPR gRNA sequence
gctactcacgaggctgaggc

SEQ ID NO: 149661 - DNA, 20 bp, Artificial
  CRISPR gRNA sequence
tactcacgaggctgaggcgg

SEQ ID NO: 149662 - DNA, 20 bp, Artificial
  CRISPR gRNA sequence
actcacgaggctgaggcggg

SEQ ID NO: 149663 - DNA, 20 bp, Artificial
  CRISPR gRNA sequence
ctgaggcgggaggactgctt

SEQ ID NO: 149664 - DNA, 20 bp, Artificial
  CRISPR gRNA sequence
gcgggaggactgcttgagcc

SEQ ID NO: 149665 - DNA, 20 bp, Artificial
  CRISPR gRNA sequence
cgggaggactgcttgagcct

SEQ ID NO: 149666 - DNA, 20 bp, Artificial
  CRISPR gRNA sequence
gaggactgcttgagcctggg

SEQ ID NO: 149667 - DNA, 20 bp, Artificial
  CRISPR gRNA sequence
ctgcttgagcctgggtggtc

SEQ ID NO: 149668 - DNA, 20 bp, Artificial
  CRISPR gRNA sequence
agcctgggtggtcaagcctg

SEQ ID NO: 149669 - DNA, 20 bp, Artificial
  CRISPR gRNA sequence
tgggtggtcaagcctgcagt

SEQ ID NO: 149670 - DNA, 20 bp, Artificial
  CRISPR gRNA sequence
atgattgcgccactgcactc

SEQ ID NO: 149671 - DNA, 20 bp, Artificial
  CRISPR gRNA sequence
gcgccactgcactccagcct

SEQ ID NO: 149672 - DNA, 20 bp, Artificial
  CRISPR gRNA sequence
ccactgcactccagcctgag

SEQ ID NO: 149673 - DNA, 20 bp, Artificial
  CRISPR gRNA sequence
cactgcactccagcctgagc

SEQ ID NO: 149674 - DNA, 20 bp, Artificial
  CRISPR gRNA sequence
cactccagcctgagcaggaa

SEQ ID NO: 149675 - DNA, 20 bp, Artificial
  CRISPR gRNA sequence
tccagcctgagcaggaacag

SEQ ID NO: 149676 - DNA, 20 bp, Artificial
  CRISPR gRNA sequence
cagcctgagcaggaacagca

SEQ ID NO: 149677 - DNA, 20 bp, Artificial
  CRISPR gRNA sequence
ctgagcaggaacagcagagc

SEQ ID NO: 149678 - DNA, 20 bp, Artificial
  CRISPR gRNA sequence
agatcctgtctcaaaaaaaa

SEQ ID NO: 149679 - DNA, 20 bp, Artificial
  CRISPR gRNA sequence
ctgtctcaaaaaaaaaagaa

SEQ ID NO: 149680 - DNA, 20 bp, Artificial
  CRISPR gRNA sequence
tcaaaaaaaaaagaaaagaa

SEQ ID NO: 149681 - DNA, 20 bp, Artificial
  CRISPR gRNA sequence
aaaaaagaaaagaaaagaaa

SEQ ID NO: 149682 - DNA, 20 bp, Artificial
  CRISPR gRNA sequence
gaaaagaaaagaaaaagttt

SEQ ID NO: 149683 - DNA, 20 bp, Artificial
  CRISPR gRNA sequence
aatattctgatcttgtttta

SEQ ID NO: 149684 - DNA, 20 bp, Artificial
  CRISPR gRNA sequence
atcttgttttaaagcactgt

SEQ ID NO: 149685 - DNA, 20 bp, Artificial
  CRISPR gRNA sequence
tcttgttttaaagcactgtt

SEQ ID NO: 149686 - DNA, 20 bp, Artificial
  CRISPR gRNA sequence
atttatccctgatttactga

SEQ ID NO: 149687 - DNA, 20 bp, Artificial
  CRISPR gRNA sequence
tttatccctgatttactgat

SEQ ID NO: 149688 - DNA, 20 bp, Artificial
  CRISPR gRNA sequence
ttatccctgatttactgatg

SEQ ID NO: 149689 - DNA, 20 bp, Artificial
  CRISPR gRNA sequence
actgatggggaaactgacac

SEQ ID NO: 149690 - DNA, 20 bp, Artificial
  CRISPR gRNA sequence
gatggggaaactgacactag

SEQ ID NO: 149691 - DNA, 20 bp, Artificial
  CRISPR gRNA sequence
ggaaactgacactagaagtt

SEQ ID NO: 149692 - DNA, 20 bp, Artificial
  CRISPR gRNA sequence
aactgacactagaagttgag

SEQ ID NO: 149693 - DNA, 20 bp, Artificial
  CRISPR gRNA sequence
gacactagaagttgagaagc

SEQ ID NO: 149694 - DNA, 20 bp, Artificial
  CRISPR gRNA sequence
agaagttgagaagctggtcc

SEQ ID NO: 149695 - DNA, 20 bp, Artificial
  CRISPR gRNA sequence
tagatcacacaactgttact

SEQ ID NO: 149696 - DNA, 20 bp, Artificial
  CRISPR gRNA sequence
ctcacctgttcatcctcaat

SEQ ID NO: 149697 - DNA, 20 bp, Artificial
  CRISPR gRNA sequence
acctgttcatcctcaattag

SEQ ID NO: 149698 - DNA, 20 bp, Artificial
  CRISPR gRNA sequence
gttcatcctcaattagaagt

SEQ ID NO: 149699 - DNA, 20 bp, Artificial
  CRISPR gRNA sequence
atcctcaattagaagtaagc

SEQ ID NO: 149700 - DNA, 20 bp, Artificial
  CRISPR gRNA sequence
tcctcaattagaagtaagct

SEQ ID NO: 149701 - DNA, 20 bp, Artificial
  CRISPR gRNA sequence
caattagaagtaagctgggc

SEQ ID NO: 149702 - DNA, 20 bp, Artificial
  CRISPR gRNA sequence
gccagaccccctctgcccca

SEQ ID NO: 149703 - DNA, 20 bp, Artificial
  CRISPR gRNA sequence
agaccccctctgccccacag

SEQ ID NO: 149704 - DNA, 20 bp, Artificial
  CRISPR gRNA sequence
tgccccacagaagtatctgt

SEQ ID NO: 149705 - DNA, 20 bp, Artificial
  CRISPR gRNA sequence
tgttagtctctctgaccctc

SEQ ID NO: 149706 - DNA, 20 bp, Artificial
  CRISPR gRNA sequence
ctctgaccctccagcctaac

SEQ ID NO: 149707 - DNA, 20 bp, Artificial
  CRISPR gRNA sequence
aacgagtaaataaatccttg

SEQ ID NO: 149708 - DNA, 20 bp, Artificial
  CRISPR gRNA sequence
acgagtaaataaatccttgt

SEQ ID NO: 149709 - DNA, 20 bp, Artificial
  CRISPR gRNA sequence
agtaaataaatccttgtagg

SEQ ID NO: 149710 - DNA, 20 bp, Artificial
  CRISPR gRNA sequence
ataaatccttgtaggaagaa

SEQ ID NO: 149711 - DNA, 20 bp, Artificial
  CRISPR gRNA sequence
atccttgtaggaagaatggt

SEQ ID NO: 149712 - DNA, 20 bp, Artificial
  CRISPR gRNA sequence
taggaagaatggtgagtaac

SEQ ID NO: 149713 - DNA, 20 bp, Artificial
  CRISPR gRNA sequence
atggtgagtaactggttttt

SEQ ID NO: 149714 - DNA, 20 bp, Artificial
  CRISPR gRNA sequence
tggtgagtaactggtttttc

SEQ ID NO: 149715 - DNA, 20 bp, Artificial
  CRISPR gRNA sequence
tttcaggcctcaatcccgaa

SEQ ID NO: 149716 - DNA, 20 bp, Artificial
  CRISPR gRNA sequence
ttcaggcctcaatcccgaaa

SEQ ID NO: 149717 - DNA, 20 bp, Artificial
  CRISPR gRNA sequence
ccgaaaaggaattgtgacat

SEQ ID NO: 149718 - DNA, 20 bp, Artificial
  CRISPR gRNA sequence
aaaggaattgtgacatgagc

SEQ ID NO: 149719 - DNA, 20 bp, Artificial
  CRISPR gRNA sequence
aggaattgtgacatgagcta

SEQ ID NO: 149720 - DNA, 20 bp, Artificial
  CRISPR gRNA sequence
attgtgacatgagctagaga

SEQ ID NO: 149721 - DNA, 20 bp, Artificial
  CRISPR gRNA sequence
tgacatgagctagagacaga

SEQ ID NO: 149722 - DNA, 20 bp, Artificial
  CRISPR gRNA sequence
acatgagctagagacagaaa

SEQ ID NO: 149723 - DNA, 20 bp, Artificial
  CRISPR gRNA sequence
agagacagaaagagtgcctg

SEQ ID NO: 149724 - DNA, 20 bp, Artificial
  CRISPR gRNA sequence
agaaagagtgcctgtagcct

SEQ ID NO: 149725 - DNA, 20 bp, Artificial
  CRISPR gRNA sequence
gagtgcctgtagcctaagtt

SEQ ID NO: 149726 - DNA, 20 bp, Artificial
  CRISPR gRNA sequence
ttaagttgtattctaaaaca

SEQ ID NO: 149727 - DNA, 20 bp, Artificial
  CRISPR gRNA sequence
acaaagcatcattttcttac

SEQ ID NO: 149728 - DNA, 20 bp, Artificial
  CRISPR gRNA sequence
caaagcatcattttcttacc

SEQ ID NO: 149729 - DNA, 20 bp, Artificial
  CRISPR gRNA sequence
tttcttaccgggtgccttct

SEQ ID NO: 149730 - DNA, 20 bp, Artificial
  CRISPR gRNA sequence
tgccttctgagattcacaaa

SEQ ID NO: 149731 - DNA, 20 bp, Artificial
  CRISPR gRNA sequence
ttcacaaacagcctcttgcc

SEQ ID NO: 149732 - DNA, 20 bp, Artificial
  CRISPR gRNA sequence
acagcctcttgcccagtttc

SEQ ID NO: 149733 - DNA, 20 bp, Artificial
  CRISPR gRNA sequence
gcctcttgcccagtttctgg

SEQ ID NO: 149734 - DNA, 20 bp, Artificial
  CRISPR gRNA sequence
gtatcctgtgtttgtgtgtc

SEQ ID NO: 149735 - DNA, 20 bp, Artificial
  CRISPR gRNA sequence
tcctgtgtttgtgtgtctag

SEQ ID NO: 149736 - DNA, 20 bp, Artificial
  CRISPR gRNA sequence
ctgtgtttgtgtgtctagca

SEQ ID NO: 149737 - DNA, 20 bp, Artificial
  CRISPR gRNA sequence
tgtgtttgtgtgtctagcag

SEQ ID NO: 149738 - DNA, 20 bp, Artificial
  CRISPR gRNA sequence
gtgtttgtgtgtctagcaga

SEQ ID NO: 149739 - DNA, 20 bp, Artificial
  CRISPR gRNA sequence
tttgtgtgtctagcagaggg

SEQ ID NO: 149740 - DNA, 20 bp, Artificial
  CRISPR gRNA sequence
gtgtgtctagcagagggaag

SEQ ID NO: 149741 - DNA, 20 bp, Artificial
  CRISPR gRNA sequence
agggaagaagtgtgattctg

SEQ ID NO: 149742 - DNA, 20 bp, Artificial
  CRISPR gRNA sequence
tgattctgaagaatgtttca

SEQ ID NO: 149743 - DNA, 20 bp, Artificial
  CRISPR gRNA sequence
gtttcatagatgccaactta

SEQ ID NO: 149744 - DNA, 20 bp, Artificial
  CRISPR gRNA sequence
tttcatagatgccaacttac

SEQ ID NO: 149745 - DNA, 20 bp, Artificial
  CRISPR gRNA sequence
agatgccaacttacgggctt

SEQ ID NO: 149746 - DNA, 20 bp, Artificial
  CRISPR gRNA sequence
atgccaacttacgggcttca

SEQ ID NO: 149747 - DNA, 20 bp, Artificial
  CRISPR gRNA sequence
atcctcaattgacccttact

SEQ ID NO: 149748 - DNA, 20 bp, Artificial
  CRISPR gRNA sequence
caattgacccttacttagct

SEQ ID NO: 149749 - DNA, 20 bp, Artificial
  CRISPR gRNA sequence
ccaatattattccaatttta

SEQ ID NO: 149750 - DNA, 20 bp, Artificial
  CRISPR gRNA sequence
attattccaattttacagat

SEQ ID NO: 149751 - DNA, 20 bp, Artificial
  CRISPR gRNA sequence
ttattccaattttacagata

SEQ ID NO: 149752 - DNA, 20 bp, Artificial
  CRISPR gRNA sequence
ccaattttacagataaggtt

SEQ ID NO: 149753 - DNA, 20 bp, Artificial
  CRISPR gRNA sequence
caattttacagataaggttg

SEQ ID NO: 149754 - DNA, 20 bp, Artificial
  CRISPR gRNA sequence
aattttacagataaggttga

SEQ ID NO: 149755 - DNA, 20 bp, Artificial
  CRISPR gRNA sequence
gaatatcaaattacttgctc

SEQ ID NO: 149756 - DNA, 20 bp, Artificial
  CRISPR gRNA sequence
atcacaatacaataaatgat

SEQ ID NO: 149757 - DNA, 20 bp, Artificial
  CRISPR gRNA sequence
aatgatgagtcaaaatgcaa

SEQ ID NO: 149758 - DNA, 20 bp, Artificial
  CRISPR gRNA sequence
tcccactttttgcactgttt

SEQ ID NO: 149759 - DNA, 20 bp, Artificial
  CRISPR gRNA sequence
ccttcccctttgcatgtctc

SEQ ID NO: 149760 - DNA, 20 bp, Artificial
  CRISPR gRNA sequence
cttcccctttgcatgtctct

SEQ ID NO: 149761 - DNA, 20 bp, Artificial
  CRISPR gRNA sequence
cccctttgcatgtctctagg

SEQ ID NO: 149762 - DNA, 20 bp, Artificial
  CRISPR gRNA sequence
ccctttgcatgtctctaggc

SEQ ID NO: 149763 - DNA, 20 bp, Artificial
  CRISPR gRNA sequence
ttgcatgtctctaggcaggt

SEQ ID NO: 149764 - DNA, 20 bp, Artificial
  CRISPR gRNA sequence
catgtctctaggcaggttag

SEQ ID NO: 149765 - DNA, 20 bp, Artificial
  CRISPR gRNA sequence
tagcagcacctatgaatact

SEQ ID NO: 149766 - DNA, 20 bp, Artificial
  CRISPR gRNA sequence
tatgaatactcagctgcgaa

SEQ ID NO: 149767 - DNA, 20 bp, Artificial
  CRISPR gRNA sequence
aatactcagctgcgaacagt

SEQ ID NO: 149768 - DNA, 20 bp, Artificial
  CRISPR gRNA sequence
atactcagctgcgaacagtt

SEQ ID NO: 149769 - DNA, 20 bp, Artificial
  CRISPR gRNA sequence
tactcagctgcgaacagttg

SEQ ID NO: 149770 - DNA, 20 bp, Artificial
  CRISPR gRNA sequence
actcagctgcgaacagttgg

SEQ ID NO: 149771 - DNA, 20 bp, Artificial
  CRISPR gRNA sequence
gcgaacagttgggggcacta

SEQ ID NO: 149772 - DNA, 20 bp, Artificial
  CRISPR gRNA sequence
agttgggggcactaaagcac

SEQ ID NO: 149773 - DNA, 20 bp, Artificial
  CRISPR gRNA sequence
gttgggggcactaaagcacg

SEQ ID NO: 149774 - DNA, 20 bp, Artificial
  CRISPR gRNA sequence
cataaataaataaaatgtat

SEQ ID NO: 149775 - DNA, 20 bp, Artificial
  CRISPR gRNA sequence
taaataaaatgtattggacc

SEQ ID NO: 149776 - DNA, 20 bp, Artificial
  CRISPR gRNA sequence
aaataaaatgtattggacct

SEQ ID NO: 149777 - DNA, 20 bp, Artificial
  CRISPR gRNA sequence
aataaaatgtattggacctg

SEQ ID NO: 149778 - DNA, 20 bp, Artificial
  CRISPR gRNA sequence
ataaaatgtattggacctgg

SEQ ID NO: 149779 - DNA, 20 bp, Artificial
  CRISPR gRNA sequence
gtattggacctgggggttct

SEQ ID NO: 149780 - DNA, 20 bp, Artificial
  CRISPR gRNA sequence
cctgggggttcttagctctc

SEQ ID NO: 149781 - DNA, 20 bp, Artificial
  CRISPR gRNA sequence
ctctggcgaactgtgatctt

SEQ ID NO: 149782 - DNA, 20 bp, Artificial
  CRISPR gRNA sequence
gagcaaatctcttaacttct

SEQ ID NO: 149783 - DNA, 20 bp, Artificial
  CRISPR gRNA sequence
gaaacttctctattcatcta

SEQ ID NO: 149784 - DNA, 20 bp, Artificial
  CRISPR gRNA sequence
tcatctaaagcaacatccca

SEQ ID NO: 149785 - DNA, 20 bp, Artificial
  CRISPR gRNA sequence
atctaaagcaacatcccaca

SEQ ID NO: 149786 - DNA, 20 bp, Artificial
  CRISPR gRNA sequence
taaagcaacatcccacagag

SEQ ID NO: 149787 - DNA, 20 bp, Artificial
  CRISPR gRNA sequence
gagcagctgaaacacacaaa

SEQ ID NO: 149788 - DNA, 20 bp, Artificial
  CRISPR gRNA sequence
acaaatggtaaaacacatgt

SEQ ID NO: 149789 - DNA, 20 bp, Artificial
  CRISPR gRNA sequence
aatggtaaaacacatgttag

SEQ ID NO: 149790 - DNA, 20 bp, Artificial
  CRISPR gRNA sequence
atggtaaaacacatgttaga

SEQ ID NO: 149791 - DNA, 20 bp, Artificial
  CRISPR gRNA sequence
tgttagaaggcctcaaaaaa

SEQ ID NO: 149792 - DNA, 20 bp, Artificial
  CRISPR gRNA sequence
agaaggcctcaaaaaatagc

SEQ ID NO: 149793 - DNA, 20 bp, Artificial
  CRISPR gRNA sequence
agcaagcttcatacaaatgc

SEQ ID NO: 149794 - DNA, 20 bp, Artificial
  CRISPR gRNA sequence
agcttcatacaaatgccaga

SEQ ID NO: 149795 - DNA, 20 bp, Artificial
  CRISPR gRNA sequence
cagatggcatcatatcatca

SEQ ID NO: 149796 - DNA, 20 bp, Artificial
  CRISPR gRNA sequence
catatcatcatggctgcctg

SEQ ID NO: 149797 - DNA, 20 bp, Artificial
  CRISPR gRNA sequence
tcatcatggctgcctgaagc

SEQ ID NO: 149798 - DNA, 20 bp, Artificial
  CRISPR gRNA sequence
atggctgcctgaagctagac

SEQ ID NO: 149799 - DNA, 20 bp, Artificial
  CRISPR gRNA sequence
ctagacaagacaccaactac

SEQ ID NO: 149800 - DNA, 20 bp, Artificial
  CRISPR gRNA sequence
agacaccaactactggtctg

SEQ ID NO: 149801 - DNA, 20 bp, Artificial
  CRISPR gRNA sequence
acaccaactactggtctgaa

SEQ ID NO: 149802 - DNA, 20 bp, Artificial
  CRISPR gRNA sequence
actactggtctgaagagtcc

SEQ ID NO: 149803 - DNA, 20 bp, Artificial
  CRISPR gRNA sequence
ggtctgaagagtcccagata

SEQ ID NO: 149804 - DNA, 20 bp, Artificial
  CRISPR gRNA sequence
agagtcccagatacagtacc

SEQ ID NO: 149805 - DNA, 20 bp, Artificial
  CRISPR gRNA sequence
cagatacagtaccgagccta

SEQ ID NO: 149806 - DNA, 20 bp, Artificial
  CRISPR gRNA sequence
taccgagcctaaagaccaac

SEQ ID NO: 149807 - DNA, 20 bp, Artificial
  CRISPR gRNA sequence
gcttctttttctctataatt

SEQ ID NO: 149808 - DNA, 20 bp, Artificial
  CRISPR gRNA sequence
ttttgacatatttctttaaa

SEQ ID NO: 149809 - DNA, 20 bp, Artificial
  CRISPR gRNA sequence
acatatttctttaaaaagcc

SEQ ID NO: 149810 - DNA, 20 bp, Artificial
  CRISPR gRNA sequence
ttctttaaaaagcctagttt

SEQ ID NO: 149811 - DNA, 20 bp, Artificial
  CRISPR gRNA sequence
aaagcctagtttcagatgca

SEQ ID NO: 149812 - DNA, 20 bp, Artificial
  CRISPR gRNA sequence
catggaaatacatattaaaa

SEQ ID NO: 149813 - DNA, 20 bp, Artificial
  CRISPR gRNA sequence
tggaaatacatattaaaata

SEQ ID NO: 149814 - DNA, 20 bp, Artificial
  CRISPR gRNA sequence
aatacatattaaaatagaga

SEQ ID NO: 149815 - DNA, 20 bp, Artificial
  CRISPR gRNA sequence
ataaacatgaaataattttt

SEQ ID NO: 149816 - DNA, 20 bp, Artificial
  CRISPR gRNA sequence
gccctttaaactattaaatt

SEQ ID NO: 149817 - DNA, 20 bp, Artificial
  CRISPR gRNA sequence
taaatttggaacaaatgtac

SEQ ID NO: 149818 - DNA, 20 bp, Artificial
  CRISPR gRNA sequence
caaatgtactagttccaaaa

SEQ ID NO: 149819 - DNA, 20 bp, Artificial
  CRISPR gRNA sequence
gtactagttccaaaaaagca

SEQ ID NO: 149820 - DNA, 20 bp, Artificial
  CRISPR gRNA sequence
tccaaaaaagcaaagaattc

SEQ ID NO: 149821 - DNA, 20 bp, Artificial
  CRISPR gRNA sequence
caaagaattcaagctgaaca

SEQ ID NO: 149822 - DNA, 20 bp, Artificial
  CRISPR gRNA sequence
aaagaattcaagctgaacat

SEQ ID NO: 149823 - DNA, 20 bp, Artificial
  CRISPR gRNA sequence
acgttccaaatttaaatcct

SEQ ID NO: 149824 - DNA, 20 bp, Artificial
  CRISPR gRNA sequence
cgttccaaatttaaatcctt

SEQ ID NO: 149825 - DNA, 20 bp, Artificial
  CRISPR gRNA sequence
ttgggtgtgtcaatgatcaa

SEQ ID NO: 149826 - DNA, 20 bp, Artificial
  CRISPR gRNA sequence
tcaatgatcaatagctatac

SEQ ID NO: 149827 - DNA, 20 bp, Artificial
  CRISPR gRNA sequence
caatgatcaatagctatact

SEQ ID NO: 149828 - DNA, 20 bp, Artificial
  CRISPR gRNA sequence
atttatttatatatattttt

SEQ ID NO: 149829 - DNA, 20 bp, Artificial
  CRISPR gRNA sequence
tttatttatatatatttttt

SEQ ID NO: 149830 - DNA, 20 bp, Artificial
  CRISPR gRNA sequence
tttatatatattttttggga

SEQ ID NO: 149831 - DNA, 20 bp, Artificial
  CRISPR gRNA sequence
tggaatctcactctgtcacc

SEQ ID NO: 149832 - DNA, 20 bp, Artificial
  CRISPR gRNA sequence
ggaatctcactctgtcaccc

SEQ ID NO: 149833 - DNA, 20 bp, Artificial
  CRISPR gRNA sequence
tctcactctgtcacccaggc

SEQ ID NO: 149834 - DNA, 20 bp, Artificial
  CRISPR gRNA sequence
ctgtcacccaggctggaatg

SEQ ID NO: 149835 - DNA, 20 bp, Artificial
  CRISPR gRNA sequence
tcacccaggctggaatgcag

SEQ ID NO: 149836 - DNA, 20 bp, Artificial
  CRISPR gRNA sequence
ggaatgcagtagcatgatct

SEQ ID NO: 149837 - DNA, 20 bp, Artificial
  CRISPR gRNA sequence
gcatgatcttggctcactgc

SEQ ID NO: 149838 - DNA, 20 bp, Artificial
  CRISPR gRNA sequence
tcactgcaagcttcgcctcc

SEQ ID NO: 149839 - DNA, 20 bp, Artificial
  CRISPR gRNA sequence
cactgcaagcttcgcctccc

SEQ ID NO: 149840 - DNA, 20 bp, Artificial
  CRISPR gRNA sequence
tccacaccattctcctgcct

SEQ ID NO: 149841 - DNA, 20 bp, Artificial
  CRISPR gRNA sequence
ttctcctgcctcagcctccc

SEQ ID NO: 149842 - DNA, 20 bp, Artificial
  CRISPR gRNA sequence
tcctgcctcagcctcccaag

SEQ ID NO: 149843 - DNA, 20 bp, Artificial
  CRISPR gRNA sequence
gcctcagcctcccaagtagc

SEQ ID NO: 149844 - DNA, 20 bp, Artificial
  CRISPR gRNA sequence
cctcagcctcccaagtagct

SEQ ID NO: 149845 - DNA, 20 bp, Artificial
  CRISPR gRNA sequence
ctcccaagtagctgggacca

SEQ ID NO: 149846 - DNA, 20 bp, Artificial
  CRISPR gRNA sequence
tcccaagtagctgggaccac

SEQ ID NO: 149847 - DNA, 20 bp, Artificial
  CRISPR gRNA sequence
caggtgcccaccaccacgcc

SEQ ID NO: 149848 - DNA, 20 bp, Artificial
  CRISPR gRNA sequence
ggctaacttttttgtatttt

SEQ ID NO: 149849 - DNA, 20 bp, Artificial
  CRISPR gRNA sequence
taacttttttgtatttttag

SEQ ID NO: 149850 - DNA, 20 bp, Artificial
  CRISPR gRNA sequence
acttttttgtatttttagta

SEQ ID NO: 149851 - DNA, 20 bp, Artificial
  CRISPR gRNA sequence
ttttgtatttttagtagaga

SEQ ID NO: 149852 - DNA, 20 bp, Artificial
  CRISPR gRNA sequence
tttgtatttttagtagagac

SEQ ID NO: 149853 - DNA, 20 bp, Artificial
  CRISPR gRNA sequence
ttgtatttttagtagagaca

SEQ ID NO: 149854 - DNA, 20 bp, Artificial
  CRISPR gRNA sequence
gagacagggtttcaccgtgt

SEQ ID NO: 149855 - DNA, 20 bp, Artificial
  CRISPR gRNA sequence
cagggtttcaccgtgttagc

SEQ ID NO: 149856 - DNA, 20 bp, Artificial
  CRISPR gRNA sequence
agggtttcaccgtgttagcc

SEQ ID NO: 149857 - DNA, 20 bp, Artificial
  CRISPR gRNA sequence
tttcaccgtgttagccagga

SEQ ID NO: 149858 - DNA, 20 bp, Artificial
  CRISPR gRNA sequence
acctcctgatccgcccacct

SEQ ID NO: 149859 - DNA, 20 bp, Artificial
  CRISPR gRNA sequence
ccgcccaccttggcctccca

SEQ ID NO: 149860 - DNA, 20 bp, Artificial
  CRISPR gRNA sequence
accttggcctcccaaagtgc

SEQ ID NO: 149861 - DNA, 20 bp, Artificial
  CRISPR gRNA sequence
ccttggcctcccaaagtgct

SEQ ID NO: 149862 - DNA, 20 bp, Artificial
  CRISPR gRNA sequence
ctcccaaagtgctgggatta

SEQ ID NO: 149863 - DNA, 20 bp, Artificial
  CRISPR gRNA sequence
tcccaaagtgctgggattac

SEQ ID NO: 149864 - DNA, 20 bp, Artificial
  CRISPR gRNA sequence
agtgctgggattacaggcat

SEQ ID NO: 149865 - DNA, 20 bp, Artificial
  CRISPR gRNA sequence
caggcatgagccaccgcgcc

SEQ ID NO: 149866 - DNA, 20 bp, Artificial
  CRISPR gRNA sequence
cgcgcccggccttcaattct

SEQ ID NO: 149867 - DNA, 20 bp, Artificial
  CRISPR gRNA sequence
attcttagaatatgtctcct

SEQ ID NO: 149868 - DNA, 20 bp, Artificial
  CRISPR gRNA sequence
ttcttagaatatgtctcctt

SEQ ID NO: 149869 - DNA, 20 bp, Artificial
  CRISPR gRNA sequence
tagaatatgtctccttgggc

SEQ ID NO: 149870 - DNA, 20 bp, Artificial
  CRISPR gRNA sequence
agaatatgtctccttgggct

SEQ ID NO: 149871 - DNA, 20 bp, Artificial
  CRISPR gRNA sequence
atgtctccttgggctgggaa

SEQ ID NO: 149872 - DNA, 20 bp, Artificial
  CRISPR gRNA sequence
tctccttgggctgggaacgg

SEQ ID NO: 149873 - DNA, 20 bp, Artificial
  CRISPR gRNA sequence
gtggctcatgcctgtaatct

SEQ ID NO: 149874 - DNA, 20 bp, Artificial
  CRISPR gRNA sequence
tgcctgtaatctcagcactt

SEQ ID NO: 149875 - DNA, 20 bp, Artificial
  CRISPR gRNA sequence
gcctgtaatctcagcacttt

SEQ ID NO: 149876 - DNA, 20 bp, Artificial
  CRISPR gRNA sequence
tgtaatctcagcactttggg

SEQ ID NO: 149877 - DNA, 20 bp, Artificial
  CRISPR gRNA sequence
ctcagcactttgggaagcca

SEQ ID NO: 149878 - DNA, 20 bp, Artificial
  CRISPR gRNA sequence
agcactttgggaagccaaag

SEQ ID NO: 149879 - DNA, 20 bp, Artificial
  CRISPR gRNA sequence
gcactttgggaagccaaagc

SEQ ID NO: 149880 - DNA, 20 bp, Artificial
  CRISPR gRNA sequence
actttgggaagccaaagcag

SEQ ID NO: 149881 - DNA, 20 bp, Artificial
  CRISPR gRNA sequence
ctttgggaagccaaagcagg

SEQ ID NO: 149882 - DNA, 20 bp, Artificial
  CRISPR gRNA sequence
ccaaagcaggaggatcgctt

SEQ ID NO: 149883 - DNA, 20 bp, Artificial
  CRISPR gRNA sequence
gcaggaggatcgcttgagcc

SEQ ID NO: 149884 - DNA, 20 bp, Artificial
  CRISPR gRNA sequence
caggaggatcgcttgagccc

SEQ ID NO: 149885 - DNA, 20 bp, Artificial
  CRISPR gRNA sequence
ggaggatcgcttgagcccag

SEQ ID NO: 149886 - DNA, 20 bp, Artificial
  CRISPR gRNA sequence
tcgcttgagcccaggagttc

SEQ ID NO: 149887 - DNA, 20 bp, Artificial
  CRISPR gRNA sequence
tgagcccaggagttcaagat

SEQ ID NO: 149888 - DNA, 20 bp, Artificial
  CRISPR gRNA sequence
ccaggagttcaagatcagcc

SEQ ID NO: 149889 - DNA, 20 bp, Artificial
  CRISPR gRNA sequence
caggagttcaagatcagcct

SEQ ID NO: 149890 - DNA, 20 bp, Artificial
  CRISPR gRNA sequence
caagatcagcctgggaaaca

SEQ ID NO: 149891 - DNA, 20 bp, Artificial
  CRISPR gRNA sequence
atcagcctgggaaacataga

SEQ ID NO: 149892 - DNA, 20 bp, Artificial
  CRISPR gRNA sequence
aagacctcgtctctacaaaa

SEQ ID NO: 149893 - DNA, 20 bp, Artificial
  CRISPR gRNA sequence
tacaaaaaagaaaaaaaaat

SEQ ID NO: 149894 - DNA, 20 bp, Artificial
  CRISPR gRNA sequence
gaaaaaaaaattagcctgtg

SEQ ID NO: 149895 - DNA, 20 bp, Artificial
  CRISPR gRNA sequence
aaaaaaattagcctgtgtgg

SEQ ID NO: 149896 - DNA, 20 bp, Artificial
  CRISPR gRNA sequence
tgtgtggtggcacgcacctg

SEQ ID NO: 149897 - DNA, 20 bp, Artificial
  CRISPR gRNA sequence
cacctgtagctcccgctact

SEQ ID NO: 149898 - DNA, 20 bp, Artificial
  CRISPR gRNA sequence
acctgtagctcccgctactc

SEQ ID NO: 149899 - DNA, 20 bp, Artificial
  CRISPR gRNA sequence
ctgtagctcccgctactcag

SEQ ID NO: 149900 - DNA, 20 bp, Artificial
  CRISPR gRNA sequence
tgtagctcccgctactcagg

SEQ ID NO: 149901 - DNA, 20 bp, Artificial
  CRISPR gRNA sequence
gctcccgctactcaggaggc

SEQ ID NO: 149902 - DNA, 20 bp, Artificial
  CRISPR gRNA sequence
ctcccgctactcaggaggct

SEQ ID NO: 149903 - DNA, 20 bp, Artificial
  CRISPR gRNA sequence
tcccgctactcaggaggctg

SEQ ID NO: 149904 - DNA, 20 bp, Artificial
  CRISPR gRNA sequence
cgctactcaggaggctgggg

SEQ ID NO: 149905 - DNA, 20 bp, Artificial
  CRISPR gRNA sequence
gctactcaggaggctggggc

SEQ ID NO: 149906 - DNA, 20 bp, Artificial
  CRISPR gRNA sequence
tactcaggaggctggggcag

SEQ ID NO: 149907 - DNA, 20 bp, Artificial
  CRISPR gRNA sequence
actcaggaggctggggcagg

SEQ ID NO: 149908 - DNA, 20 bp, Artificial
  CRISPR gRNA sequence
ctggggcaggaggatcactt

SEQ ID NO: 149909 - DNA, 20 bp, Artificial
  CRISPR gRNA sequence
gcaggaggatcacttgagcc

SEQ ID NO: 149910 - DNA, 20 bp, Artificial
  CRISPR gRNA sequence
caggaggatcacttgagccg

SEQ ID NO: 149911 - DNA, 20 bp, Artificial
  CRISPR gRNA sequence
ggaggatcacttgagccgag

SEQ ID NO: 149912 - DNA, 20 bp, Artificial
  CRISPR gRNA sequence
gatcacttgagccgaggagc

SEQ ID NO: 149913 - DNA, 20 bp, Artificial
  CRISPR gRNA sequence
atcacttgagccgaggagct

SEQ ID NO: 149914 - DNA, 20 bp, Artificial
  CRISPR gRNA sequence
cacttgagccgaggagctgg

SEQ ID NO: 149915 - DNA, 20 bp, Artificial
  CRISPR gRNA sequence
aggagctgggagactgcaat

SEQ ID NO: 149916 - DNA, 20 bp, Artificial
  CRISPR gRNA sequence
atgattgcactactgcactt

SEQ ID NO: 149917 - DNA, 20 bp, Artificial
  CRISPR gRNA sequence
tgcactactgcacttcagcc

SEQ ID NO: 149918 - DNA, 20 bp, Artificial
  CRISPR gRNA sequence
actgcacttcagcctggcaa

SEQ ID NO: 149919 - DNA, 20 bp, Artificial
  CRISPR gRNA sequence
tgcacttcagcctggcaaca

SEQ ID NO: 149920 - DNA, 20 bp, Artificial
  CRISPR gRNA sequence
cttcagcctggcaacagagt

SEQ ID NO: 149921 - DNA, 20 bp, Artificial
  CRISPR gRNA sequence
cacaaccaccaccatctcct

SEQ ID NO: 149922 - DNA, 20 bp, Artificial
  CRISPR gRNA sequence
caccatctccttggatacct

SEQ ID NO: 149923 - DNA, 20 bp, Artificial
  CRISPR gRNA sequence
tggatacctaagacttccac

SEQ ID NO: 149924 - DNA, 20 bp, Artificial
  CRISPR gRNA sequence
tacctaagacttccacaagc

SEQ ID NO: 149925 - DNA, 20 bp, Artificial
  CRISPR gRNA sequence
acctaagacttccacaagct

SEQ ID NO: 149926 - DNA, 20 bp, Artificial
  CRISPR gRNA sequence
ctaagacttccacaagctag

SEQ ID NO: 149927 - DNA, 20 bp, Artificial
  CRISPR gRNA sequence
gtgcctgttttgtcttgtga

SEQ ID NO: 149928 - DNA, 20 bp, Artificial
  CRISPR gRNA sequence
tgcctgttttgtcttgtgaa

SEQ ID NO: 149929 - DNA, 20 bp, Artificial
  CRISPR gRNA sequence
gaaaggaatcttgtttatgt

SEQ ID NO: 149930 - DNA, 20 bp, Artificial
  CRISPR gRNA sequence
aaggaatcttgtttatgtta

SEQ ID NO: 149931 - DNA, 20 bp, Artificial
  CRISPR gRNA sequence
aggaatcttgtttatgttag

SEQ ID NO: 149932 - DNA, 20 bp, Artificial
  CRISPR gRNA sequence
ggaatcttgtttatgttaga

SEQ ID NO: 149933 - DNA, 20 bp, Artificial
  CRISPR gRNA sequence
atcttgtttatgttagaggg

SEQ ID NO: 149934 - DNA, 20 bp, Artificial
  CRISPR gRNA sequence
cttgtttatgttagagggta

SEQ ID NO: 149935 - DNA, 20 bp, Artificial
  CRISPR gRNA sequence
ttgtttatgttagagggtag

SEQ ID NO: 149936 - DNA, 20 bp, Artificial
  CRISPR gRNA sequence
gttagagggtagaggaaacc

SEQ ID NO: 149937 - DNA, 20 bp, Artificial
  CRISPR gRNA sequence
tagagggtagaggaaacctg

SEQ ID NO: 149938 - DNA, 20 bp, Artificial
  CRISPR gRNA sequence
ggtagaggaaacctggagtc

SEQ ID NO: 149939 - DNA, 20 bp, Artificial
  CRISPR gRNA sequence
gtagaggaaacctggagtcc

SEQ ID NO: 149940 - DNA, 20 bp, Artificial
  CRISPR gRNA sequence
gaggaaacctggagtccagg

SEQ ID NO: 149941 - DNA, 20 bp, Artificial
  CRISPR gRNA sequence
aggcagctccccactcaacc

SEQ ID NO: 149942 - DNA, 20 bp, Artificial
  CRISPR gRNA sequence
tcaacctggccccaccatcc

SEQ ID NO: 149943 - DNA, 20 bp, Artificial
  CRISPR gRNA sequence
tggccccaccatccaagcaa

SEQ ID NO: 149944 - DNA, 20 bp, Artificial
  CRISPR gRNA sequence
tccaagcaaaagattctgtt

SEQ ID NO: 149945 - DNA, 20 bp, Artificial
  CRISPR gRNA sequence
caagcaaaagattctgtttg

SEQ ID NO: 149946 - DNA, 20 bp, Artificial
  CRISPR gRNA sequence
agattctgtttggagctcta

SEQ ID NO: 149947 - DNA, 20 bp, Artificial
  CRISPR gRNA sequence
attctgtttggagctctaaa

SEQ ID NO: 149948 - DNA, 20 bp, Artificial
  CRISPR gRNA sequence
tctgtttggagctctaaaga

SEQ ID NO: 149949 - DNA, 20 bp, Artificial
  CRISPR gRNA sequence
catctatatccaacatcctg

SEQ ID NO: 149950 - DNA, 20 bp, Artificial
  CRISPR gRNA sequence
aacatcctgaagtgaacatg

SEQ ID NO: 149951 - DNA, 20 bp, Artificial
  CRISPR gRNA sequence
acatcctgaagtgaacatga

SEQ ID NO: 149952 - DNA, 20 bp, Artificial
  CRISPR gRNA sequence
aacatgaaggaaacatgttc

SEQ ID NO: 149953 - DNA, 20 bp, Artificial
  CRISPR gRNA sequence
tgaaggaaacatgttctgga

SEQ ID NO: 149954 - DNA, 20 bp, Artificial
  CRISPR gRNA sequence
ggaaacatgttctggaaagt

SEQ ID NO: 149955 - DNA, 20 bp, Artificial
  CRISPR gRNA sequence
tctggaaagttggaatttct

SEQ ID NO: 149956 - DNA, 20 bp, Artificial
  CRISPR gRNA sequence
gaatttctcagactatctca

SEQ ID NO: 149957 - DNA, 20 bp, Artificial
  CRISPR gRNA sequence
aatttctcagactatctcat

SEQ ID NO: 149958 - DNA, 20 bp, Artificial
  CRISPR gRNA sequence
atgggttgaaaccaatgttt

SEQ ID NO: 149959 - DNA, 20 bp, Artificial
  CRISPR gRNA sequence
tgggttgaaaccaatgttta

SEQ ID NO: 149960 - DNA, 20 bp, Artificial
  CRISPR gRNA sequence
tgtttaaggctcttctgcaa

SEQ ID NO: 149961 - DNA, 20 bp, Artificial
  CRISPR gRNA sequence
tcttctgcaatagcattgat

SEQ ID NO: 149962 - DNA, 20 bp, Artificial
  CRISPR gRNA sequence
tctgcaatagcattgataag

SEQ ID NO: 149963 - DNA, 20 bp, Artificial
  CRISPR gRNA sequence
tgataagaagcttgccttta

SEQ ID NO: 149964 - DNA, 20 bp, Artificial
  CRISPR gRNA sequence
gcctttacagtacaaatgta

SEQ ID NO: 149965 - DNA, 20 bp, Artificial
  CRISPR gRNA sequence
ctgtctacacattcactaat

SEQ ID NO: 149966 - DNA, 20 bp, Artificial
  CRISPR gRNA sequence
gataaattttttttctcccc

SEQ ID NO: 149967 - DNA, 20 bp, Artificial
  CRISPR gRNA sequence
tctccccaagaaaccattcc

SEQ ID NO: 149968 - DNA, 20 bp, Artificial
  CRISPR gRNA sequence
atcaaatctatttctctaat

SEQ ID NO: 149969 - DNA, 20 bp, Artificial
  CRISPR gRNA sequence
attagcatattcacttgctt

SEQ ID NO: 149970 - DNA, 20 bp, Artificial
  CRISPR gRNA sequence
tgtaacatgttctctttttt

SEQ ID NO: 149971 - DNA, 20 bp, Artificial
  CRISPR gRNA sequence
gtaacatgttctcttttttt

SEQ ID NO: 149972 - DNA, 20 bp, Artificial
  CRISPR gRNA sequence
taacatgttctcttttttta

SEQ ID NO: 149973 - DNA, 20 bp, Artificial
  CRISPR gRNA sequence
aacatgttctctttttttag

SEQ ID NO: 149974 - DNA, 20 bp, Artificial
  CRISPR gRNA sequence
acatgttctctttttttagg

SEQ ID NO: 149975 - DNA, 20 bp, Artificial
  CRISPR gRNA sequence
tagggggcatattatttttt

SEQ ID NO: 149976 - DNA, 20 bp, Artificial
  CRISPR gRNA sequence
ctattttttcccccgtttgt

SEQ ID NO: 149977 - DNA, 20 bp, Artificial
  CRISPR gRNA sequence
tttgtttctgatacaccctc

SEQ ID NO: 149978 - DNA, 20 bp, Artificial
  CRISPR gRNA sequence
ttgtttctgatacaccctca

SEQ ID NO: 149979 - DNA, 20 bp, Artificial
  CRISPR gRNA sequence
aggcaaatatgccttgcaca

SEQ ID NO: 149980 - DNA, 20 bp, Artificial
  CRISPR gRNA sequence
caaatatgccttgcacatag

SEQ ID NO: 149981 - DNA, 20 bp, Artificial
  CRISPR gRNA sequence
aaatatgccttgcacatagt

SEQ ID NO: 149982 - DNA, 20 bp, Artificial
  CRISPR gRNA sequence
aatatgccttgcacatagtg

SEQ ID NO: 149983 - DNA, 20 bp, Artificial
  CRISPR gRNA sequence
atctactgaatgaacaaaca

SEQ ID NO: 149984 - DNA, 20 bp, Artificial
  CRISPR gRNA sequence
tctactgaatgaacaaacac

SEQ ID NO: 149985 - DNA, 20 bp, Artificial
  CRISPR gRNA sequence
tgaacaaacacaggttcctc

SEQ ID NO: 149986 - DNA, 20 bp, Artificial
  CRISPR gRNA sequence
aaaaaattttttttaaataa

SEQ ID NO: 149987 - DNA, 20 bp, Artificial
  CRISPR gRNA sequence
tcttgctctgttgcccacgc

SEQ ID NO: 149988 - DNA, 20 bp, Artificial
  CRISPR gRNA sequence
ttgctctgttgcccacgctg

SEQ ID NO: 149989 - DNA, 20 bp, Artificial
  CRISPR gRNA sequence
ctgttgcccacgctggagtg

SEQ ID NO: 149990 - DNA, 20 bp, Artificial
  CRISPR gRNA sequence
ttgcccacgctggagtgcag

SEQ ID NO: 149991 - DNA, 20 bp, Artificial
  CRISPR gRNA sequence
ggagtgcagtggcgtaatca

SEQ ID NO: 149992 - DNA, 20 bp, Artificial
  CRISPR gRNA sequence
ggcgtaatcatggctcactg

SEQ ID NO: 149993 - DNA, 20 bp, Artificial
  CRISPR gRNA sequence
tcactgaagcctcaacctcc

SEQ ID NO: 149994 - DNA, 20 bp, Artificial
  CRISPR gRNA sequence
cactgaagcctcaacctcct

SEQ ID NO: 149995 - DNA, 20 bp, Artificial
  CRISPR gRNA sequence
agcctcaacctcctgggttc

SEQ ID NO: 149996 - DNA, 20 bp, Artificial
  CRISPR gRNA sequence
tcaagtgatcctcccctgct

SEQ ID NO: 149997 - DNA, 20 bp, Artificial
  CRISPR gRNA sequence
cctcccctgctcagcctcct

SEQ ID NO: 149998 - DNA, 20 bp, Artificial
  CRISPR gRNA sequence
cccctgctcagcctcctgag

SEQ ID NO: 149999 - DNA, 20 bp, Artificial
  CRISPR gRNA sequence
ctgctcagcctcctgagtag

SEQ ID NO: 150000 - DNA, 20 bp, Artificial
  CRISPR gRNA sequence
tgctcagcctcctgagtagc

SEQ ID NO: 150001 - DNA, 20 bp, Artificial
  CRISPR gRNA sequence
gctcagcctcctgagtagcg

SEQ ID NO: 150002 - DNA, 20 bp, Artificial
  CRISPR gRNA sequence
ctcctgagtagcggggacta

SEQ ID NO: 150003 - DNA, 20 bp, Artificial
  CRISPR gRNA sequence
tcctgagtagcggggactac

SEQ ID NO: 150004 - DNA, 20 bp, Artificial
  CRISPR gRNA sequence
caggtgcttgccaccatacc

SEQ ID NO: 150005 - DNA, 20 bp, Artificial
  CRISPR gRNA sequence
aatttttaaaattttttgta

SEQ ID NO: 150006 - DNA, 20 bp, Artificial
  CRISPR gRNA sequence
tttaaaattttttgtaaaga

SEQ ID NO: 150007 - DNA, 20 bp, Artificial
  CRISPR gRNA sequence
ttaaaattttttgtaaagac

SEQ ID NO: 150008 - DNA, 20 bp, Artificial
  CRISPR gRNA sequence
taaaattttttgtaaagaca

SEQ ID NO: 150009 - DNA, 20 bp, Artificial
  CRISPR gRNA sequence
cagggtcttgctatcttgcc

SEQ ID NO: 150010 - DNA, 20 bp, Artificial
  CRISPR gRNA sequence
agggtcttgctatcttgccc

SEQ ID NO: 150011 - DNA, 20 bp, Artificial
  CRISPR gRNA sequence
tcttgctatcttgcccaggc

SEQ ID NO: 150012 - DNA, 20 bp, Artificial
  CRISPR gRNA sequence
ccaggctggtctcaaactcc

SEQ ID NO: 150013 - DNA, 20 bp, Artificial
  CRISPR gRNA sequence
caggctggtctcaaactcct

SEQ ID NO: 150014 - DNA, 20 bp, Artificial
  CRISPR gRNA sequence
ggtctcaaactcctgggctc

SEQ ID NO: 150015 - DNA, 20 bp, Artificial
  CRISPR gRNA sequence
ctcaagtgatcctctcactt

SEQ ID NO: 150016 - DNA, 20 bp, Artificial
  CRISPR gRNA sequence
cctctcactttggcctgcca

SEQ ID NO: 150017 - DNA, 20 bp, Artificial
  CRISPR gRNA sequence
actttggcctgccaaagtgc

SEQ ID NO: 150018 - DNA, 20 bp, Artificial
  CRISPR gRNA sequence
ctttggcctgccaaagtgct

SEQ ID NO: 150019 - DNA, 20 bp, Artificial
  CRISPR gRNA sequence
ctgccaaagtgctgggatta

SEQ ID NO: 150020 - DNA, 20 bp, Artificial
  CRISPR gRNA sequence
agtgctgggattacagatgt

SEQ ID NO: 150021 - DNA, 20 bp, Artificial
  CRISPR gRNA sequence
cagatgtgagccaccatgcc

SEQ ID NO: 150022 - DNA, 20 bp, Artificial
  CRISPR gRNA sequence
gtgagccaccatgcctggac

SEQ ID NO: 150023 - DNA, 20 bp, Artificial
  CRISPR gRNA sequence
gcctggacaagaactatttt

SEQ ID NO: 150024 - DNA, 20 bp, Artificial
  CRISPR gRNA sequence
aagaactattttaagacccc

SEQ ID NO: 150025 - DNA, 20 bp, Artificial
  CRISPR gRNA sequence
tttaagaccccaagtatcct

SEQ ID NO: 150026 - DNA, 20 bp, Artificial
  CRISPR gRNA sequence
aagtatccttggcctcattc

SEQ ID NO: 150027 - DNA, 20 bp, Artificial
  CRISPR gRNA sequence
agtatccttggcctcattct

SEQ ID NO: 150028 - DNA, 20 bp, Artificial
  CRISPR gRNA sequence
ctaggtacttttctttgaaa

SEQ ID NO: 150029 - DNA, 20 bp, Artificial
  CRISPR gRNA sequence
taggtacttttctttgaaat

SEQ ID NO: 150030 - DNA, 20 bp, Artificial
  CRISPR gRNA sequence
aaatgggaaaattccttctt

SEQ ID NO: 150031 - DNA, 20 bp, Artificial
  CRISPR gRNA sequence
ccttcttaagtatctgtgct

SEQ ID NO: 150032 - DNA, 20 bp, Artificial
  CRISPR gRNA sequence
agtatctgtgctcagttgtg

SEQ ID NO: 150033 - DNA, 20 bp, Artificial
  CRISPR gRNA sequence
gttgtgcagtaacctttgtg

SEQ ID NO: 150034 - DNA, 20 bp, Artificial
  CRISPR gRNA sequence
acctttgtgcagtaatccaa

SEQ ID NO: 150035 - DNA, 20 bp, Artificial
  CRISPR gRNA sequence
tttgtgcagtaatccaatgg

SEQ ID NO: 150036 - DNA, 20 bp, Artificial
  CRISPR gRNA sequence
tgtgcagtaatccaatggaa

SEQ ID NO: 150037 - DNA, 20 bp, Artificial
  CRISPR gRNA sequence
taatccaatggaagagccac

SEQ ID NO: 150038 - DNA, 20 bp, Artificial
  CRISPR gRNA sequence
atccaatggaagagccacaa

SEQ ID NO: 150039 - DNA, 20 bp, Artificial
  CRISPR gRNA sequence
caatggaagagccacaagag

SEQ ID NO: 150040 - DNA, 20 bp, Artificial
  CRISPR gRNA sequence
aatggaagagccacaagagt

SEQ ID NO: 150041 - DNA, 20 bp, Artificial
  CRISPR gRNA sequence
atggaagagccacaagagtg

SEQ ID NO: 150042 - DNA, 20 bp, Artificial
  CRISPR gRNA sequence
aagagccacaagagtggggt

SEQ ID NO: 150043 - DNA, 20 bp, Artificial
  CRISPR gRNA sequence
gagccacaagagtggggttg

SEQ ID NO: 150044 - DNA, 20 bp, Artificial
  CRISPR gRNA sequence
gagaaaaacttgttctactt

SEQ ID NO: 150045 - DNA, 20 bp, Artificial
  CRISPR gRNA sequence
ttgttctactttggaaaatg

SEQ ID NO: 150046 - DNA, 20 bp, Artificial
  CRISPR gRNA sequence
gtagacaattatctaatcat

SEQ ID NO: 150047 - DNA, 20 bp, Artificial
  CRISPR gRNA sequence
tcatcggctccactgaaaaa

SEQ ID NO: 150048 - DNA, 20 bp, Artificial
  CRISPR gRNA sequence
catcggctccactgaaaaat

SEQ ID NO: 150049 - DNA, 20 bp, Artificial
  CRISPR gRNA sequence
tcggctccactgaaaaatgg

SEQ ID NO: 150050 - DNA, 20 bp, Artificial
  CRISPR gRNA sequence
tgaaaaatgggagattgtgc

SEQ ID NO: 150051 - DNA, 20 bp, Artificial
  CRISPR gRNA sequence
gacttaatacatctaaaaac

SEQ ID NO: 150052 - DNA, 20 bp, Artificial
  CRISPR gRNA sequence
acttaatacatctaaaaacc

SEQ ID NO: 150053 - DNA, 20 bp, Artificial
  CRISPR gRNA sequence
cttaatacatctaaaaacca

SEQ ID NO: 150054 - DNA, 20 bp, Artificial
  CRISPR gRNA sequence
ttaatacatctaaaaaccag

SEQ ID NO: 150055 - DNA, 20 bp, Artificial
  CRISPR gRNA sequence
taatacatctaaaaaccagg

SEQ ID NO: 150056 - DNA, 20 bp, Artificial
  CRISPR gRNA sequence
aatacatctaaaaaccaggg

SEQ ID NO: 150057 - DNA, 20 bp, Artificial
  CRISPR gRNA sequence
acatctaaaaaccagggggg

SEQ ID NO: 150058 - DNA, 20 bp, Artificial
  CRISPR gRNA sequence
tctaaaaaccaggggggtgg

SEQ ID NO: 150059 - DNA, 20 bp, Artificial
  CRISPR gRNA sequence
ctaaaaaccaggggggtggt

SEQ ID NO: 150060 - DNA, 20 bp, Artificial
  CRISPR gRNA sequence
aaaccaggggggtggtggga

SEQ ID NO: 150061 - DNA, 20 bp, Artificial
  CRISPR gRNA sequence
aaccaggggggtggtgggac

SEQ ID NO: 150062 - DNA, 20 bp, Artificial
  CRISPR gRNA sequence
accaggggggtggtgggaca

SEQ ID NO: 150063 - DNA, 20 bp, Artificial
  CRISPR gRNA sequence
ccaggggggtggtgggacag

SEQ ID NO: 150064 - DNA, 20 bp, Artificial
  CRISPR gRNA sequence
ggggggtggtgggacagggg

SEQ ID NO: 150065 - DNA, 20 bp, Artificial
  CRISPR gRNA sequence
gggggtggtgggacagggga

SEQ ID NO: 150066 - DNA, 20 bp, Artificial
  CRISPR gRNA sequence
ggtggtgggacaggggaagg

SEQ ID NO: 150067 - DNA, 20 bp, Artificial
  CRISPR gRNA sequence
aaaattgtcaattaaaaacc

SEQ ID NO: 150068 - DNA, 20 bp, Artificial
  CRISPR gRNA sequence
aattgtcaattaaaaaccta

SEQ ID NO: 150069 - DNA, 20 bp, Artificial
  CRISPR gRNA sequence
attgtcaattaaaaacctag

SEQ ID NO: 150070 - DNA, 20 bp, Artificial
  CRISPR gRNA sequence
ttgtcaattaaaaacctaga

SEQ ID NO: 150071 - DNA, 20 bp, Artificial
  CRISPR gRNA sequence
cgttataataatgtcaatat

SEQ ID NO: 150072 - DNA, 20 bp, Artificial
  CRISPR gRNA sequence
taataatgtcaatatgagct

SEQ ID NO: 150073 - DNA, 20 bp, Artificial
  CRISPR gRNA sequence
gctgtattgattctgctgtc

SEQ ID NO: 150074 - DNA, 20 bp, Artificial
  CRISPR gRNA sequence
ctgtctagattctgctcatt

SEQ ID NO: 150075 - DNA, 20 bp, Artificial
  CRISPR gRNA sequence
tgtgaattcttccctctgtt

SEQ ID NO: 150076 - DNA, 20 bp, Artificial
  CRISPR gRNA sequence
ttattgatttaaatgtttaa

SEQ ID NO: 150077 - DNA, 20 bp, Artificial
  CRISPR gRNA sequence
attgatttaaatgtttaaaa

SEQ ID NO: 150078 - DNA, 20 bp, Artificial
  CRISPR gRNA sequence
ttgatttaaatgtttaaaag

SEQ ID NO: 150079 - DNA, 20 bp, Artificial
  CRISPR gRNA sequence
gatttaaatgtttaaaagag

SEQ ID NO: 150080 - DNA, 20 bp, Artificial
  CRISPR gRNA sequence
ttaaatgtttaaaagaggag

SEQ ID NO: 150081 - DNA, 20 bp, Artificial
  CRISPR gRNA sequence
atgtttaaaagaggagaaga

SEQ ID NO: 150082 - DNA, 20 bp, Artificial
  CRISPR gRNA sequence
ttaaaagaggagaagaaaga

SEQ ID NO: 150083 - DNA, 20 bp, Artificial
  CRISPR gRNA sequence
taaaagaggagaagaaagaa

SEQ ID NO: 150084 - DNA, 20 bp, Artificial
  CRISPR gRNA sequence
aaaggaaaacgacatgaaat

SEQ ID NO: 150085 - DNA, 20 bp, Artificial
  CRISPR gRNA sequence
tgaaatgagacaaatcttcc

SEQ ID NO: 150086 - DNA, 20 bp, Artificial
  CRISPR gRNA sequence
atctcttaacttcatgtata

SEQ ID NO: 150087 - DNA, 20 bp, Artificial
  CRISPR gRNA sequence
aacttcatgtatacagctgt

SEQ ID NO: 150088 - DNA, 20 bp, Artificial
  CRISPR gRNA sequence
acttcatgtatacagctgtc

SEQ ID NO: 150089 - DNA, 20 bp, Artificial
  CRISPR gRNA sequence
gtatacagctgtcaggaact

SEQ ID NO: 150090 - DNA, 20 bp, Artificial
  CRISPR gRNA sequence
tgtcaggaactgagaacata

SEQ ID NO: 150091 - DNA, 20 bp, Artificial
  CRISPR gRNA sequence
agaacataaagacctcttca

SEQ ID NO: 150092 - DNA, 20 bp, Artificial
  CRISPR gRNA sequence
aacataaagacctcttcaaa

SEQ ID NO: 150093 - DNA, 20 bp, Artificial
  CRISPR gRNA sequence
acataaagacctcttcaaag

SEQ ID NO: 150094 - DNA, 20 bp, Artificial
  CRISPR gRNA sequence
cataaagacctcttcaaaga

SEQ ID NO: 150095 - DNA, 20 bp, Artificial
  CRISPR gRNA sequence
agacctcttcaaagagggca

SEQ ID NO: 150096 - DNA, 20 bp, Artificial
  CRISPR gRNA sequence
tcaaagagggcaaagtgact

SEQ ID NO: 150097 - DNA, 20 bp, Artificial
  CRISPR gRNA sequence
agagggcaaagtgactgaga

SEQ ID NO: 150098 - DNA, 20 bp, Artificial
  CRISPR gRNA sequence
tacatactttacacttctta

SEQ ID NO: 150099 - DNA, 20 bp, Artificial
  CRISPR gRNA sequence
atactttacacttcttaaag

SEQ ID NO: 150100 - DNA, 20 bp, Artificial
  CRISPR gRNA sequence
gtttctcaccataaacacat

SEQ ID NO: 150101 - DNA, 20 bp, Artificial
  CRISPR gRNA sequence
tcaccataaacacataagat

SEQ ID NO: 150102 - DNA, 20 bp, Artificial
  CRISPR gRNA sequence
aagataagcaacacatctga

SEQ ID NO: 150103 - DNA, 20 bp, Artificial
  CRISPR gRNA sequence
agcaacacatctgacagata

SEQ ID NO: 150104 - DNA, 20 bp, Artificial
  CRISPR gRNA sequence
acagataaagatactttatc

SEQ ID NO: 150105 - DNA, 20 bp, Artificial
  CRISPR gRNA sequence
cagataaagatactttatcc

SEQ ID NO: 150106 - DNA, 20 bp, Artificial
  CRISPR gRNA sequence
ataaagatactttatccagg

SEQ ID NO: 150107 - DNA, 20 bp, Artificial
  CRISPR gRNA sequence
atactttatccaggtggact

SEQ ID NO: 150108 - DNA, 20 bp, Artificial
  CRISPR gRNA sequence
tactttatccaggtggactg

SEQ ID NO: 150109 - DNA, 20 bp, Artificial
  CRISPR gRNA sequence
tccaggtggactgaggaact

SEQ ID NO: 150110 - DNA, 20 bp, Artificial
  CRISPR gRNA sequence
aggtggactgaggaacttgg

SEQ ID NO: 150111 - DNA, 20 bp, Artificial
  CRISPR gRNA sequence
aggaacttggcagaattcac

SEQ ID NO: 150112 - DNA, 20 bp, Artificial
  CRISPR gRNA sequence
ggaacttggcagaattcacc

SEQ ID NO: 150113 - DNA, 20 bp, Artificial
  CRISPR gRNA sequence
ttggcagaattcaccaggac

SEQ ID NO: 150114 - DNA, 20 bp, Artificial
  CRISPR gRNA sequence
accaggacaagtatatgcca

SEQ ID NO: 150115 - DNA, 20 bp, Artificial
  CRISPR gRNA sequence
ccaggacaagtatatgccac

SEQ ID NO: 150116 - DNA, 20 bp, Artificial
  CRISPR gRNA sequence
aattcatgtcttctgattct

SEQ ID NO: 150117 - DNA, 20 bp, Artificial
  CRISPR gRNA sequence
taaatcttctccttctactt

SEQ ID NO: 150118 - DNA, 20 bp, Artificial
  CRISPR gRNA sequence
tactttagaattgataacaa

SEQ ID NO: 150119 - DNA, 20 bp, Artificial
  CRISPR gRNA sequence
caacagaaaacacaaaactt

SEQ ID NO: 150120 - DNA, 20 bp, Artificial
  CRISPR gRNA sequence
acacaaaacttaagaaccta

SEQ ID NO: 150121 - DNA, 20 bp, Artificial
  CRISPR gRNA sequence
taagaacctatagcttttct

SEQ ID NO: 150122 - DNA, 20 bp, Artificial
  CRISPR gRNA sequence
acctatagcttttctcagcc

SEQ ID NO: 150123 - DNA, 20 bp, Artificial
  CRISPR gRNA sequence
agcctggaacacaaatccac

SEQ ID NO: 150124 - DNA, 20 bp, Artificial
  CRISPR gRNA sequence
gcctggaacacaaatccacc

SEQ ID NO: 150125 - DNA, 20 bp, Artificial
  CRISPR gRNA sequence
cctgatcactctcctgaaaa

SEQ ID NO: 150126 - DNA, 20 bp, Artificial
  CRISPR gRNA sequence
aaaagtactccaaaaaaatc

SEQ ID NO: 150127 - DNA, 20 bp, Artificial
  CRISPR gRNA sequence
ctccaaaaaaatcaagatac

SEQ ID NO: 150128 - DNA, 20 bp, Artificial
  CRISPR gRNA sequence
ccagattcttaaacatttca

SEQ ID NO: 150129 - DNA, 20 bp, Artificial
  CRISPR gRNA sequence
gattcttaaacatttcaaag

SEQ ID NO: 150130 - DNA, 20 bp, Artificial
  CRISPR gRNA sequence
cttaaacatttcaaagtaga

SEQ ID NO: 150131 - DNA, 20 bp, Artificial
  CRISPR gRNA sequence
tcaaagtagaaagcttaaac

SEQ ID NO: 150132 - DNA, 20 bp, Artificial
  CRISPR gRNA sequence
agtagaaagcttaaacaaga

SEQ ID NO: 150133 - DNA, 20 bp, Artificial
  CRISPR gRNA sequence
aagcttaaacaagaaagctt

SEQ ID NO: 150134 - DNA, 20 bp, Artificial
  CRISPR gRNA sequence
agcttaaacaagaaagctta

SEQ ID NO: 150135 - DNA, 20 bp, Artificial
  CRISPR gRNA sequence
caagaaagcttaaggttttc

SEQ ID NO: 150136 - DNA, 20 bp, Artificial
  CRISPR gRNA sequence
ttttcaagcttgctaaactg

SEQ ID NO: 150137 - DNA, 20 bp, Artificial
  CRISPR gRNA sequence
gctaaactgcagttgcatca

SEQ ID NO: 150138 - DNA, 20 bp, Artificial
  CRISPR gRNA sequence
ctaaactgcagttgcatcaa

SEQ ID NO: 150139 - DNA, 20 bp, Artificial
  CRISPR gRNA sequence
aaactgcagttgcatcaaag

SEQ ID NO: 150140 - DNA, 20 bp, Artificial
  CRISPR gRNA sequence
ctgcagttgcatcaaaggag

SEQ ID NO: 150141 - DNA, 20 bp, Artificial
  CRISPR gRNA sequence
tgcagttgcatcaaaggagt

SEQ ID NO: 150142 - DNA, 20 bp, Artificial
  CRISPR gRNA sequence
ttgcatcaaaggagtgggac

SEQ ID NO: 150143 - DNA, 20 bp, Artificial
  CRISPR gRNA sequence
tgcatcaaaggagtgggact

SEQ ID NO: 150144 - DNA, 20 bp, Artificial
  CRISPR gRNA sequence
aggagtgggactaggccatc

SEQ ID NO: 150145 - DNA, 20 bp, Artificial
  CRISPR gRNA sequence
gccatctagctaccaaacaa

SEQ ID NO: 150146 - DNA, 20 bp, Artificial
  CRISPR gRNA sequence
atctagctaccaaacaaaag

SEQ ID NO: 150147 - DNA, 20 bp, Artificial
  CRISPR gRNA sequence
ctagctaccaaacaaaagtg

SEQ ID NO: 150148 - DNA, 20 bp, Artificial
  CRISPR gRNA sequence
ctaccaaacaaaagtggaga

SEQ ID NO: 150149 - DNA, 20 bp, Artificial
  CRISPR gRNA sequence
caaacaaaagtggagataga

SEQ ID NO: 150150 - DNA, 20 bp, Artificial
  CRISPR gRNA sequence
aaacaaaagtggagatagaa

SEQ ID NO: 150151 - DNA, 20 bp, Artificial
  CRISPR gRNA sequence
aagtggagatagaaaggatc

SEQ ID NO: 150152 - DNA, 20 bp, Artificial
  CRISPR gRNA sequence
aaaggatcaagttcactttc

SEQ ID NO: 150153 - DNA, 20 bp, Artificial
  CRISPR gRNA sequence
aaggatcaagttcactttct

SEQ ID NO: 150154 - DNA, 20 bp, Artificial
  CRISPR gRNA sequence
aggatcaagttcactttctg

SEQ ID NO: 150155 - DNA, 20 bp, Artificial
  CRISPR gRNA sequence
ggatcaagttcactttctgg

SEQ ID NO: 150156 - DNA, 20 bp, Artificial
  CRISPR gRNA sequence
aagttcactttctgggggcc

SEQ ID NO: 150157 - DNA, 20 bp, Artificial
  CRISPR gRNA sequence
actttctgggggcctggtga

SEQ ID NO: 150158 - DNA, 20 bp, Artificial
  CRISPR gRNA sequence
ctttctgggggcctggtgat

SEQ ID NO: 150159 - DNA, 20 bp, Artificial
  CRISPR gRNA sequence
tctgggggcctggtgatggg

SEQ ID NO: 150160 - DNA, 20 bp, Artificial
  CRISPR gRNA sequence
tctatcctttctctataatt

SEQ ID NO: 150161 - DNA, 20 bp, Artificial
  CRISPR gRNA sequence
atcctttctctataattcag

SEQ ID NO: 150162 - DNA, 20 bp, Artificial
  CRISPR gRNA sequence
ctttctctataattcagaag

SEQ ID NO: 150163 - DNA, 20 bp, Artificial
  CRISPR gRNA sequence
ttctctataattcagaagaa

SEQ ID NO: 150164 - DNA, 20 bp, Artificial
  CRISPR gRNA sequence
ataattcagaagaagagcct

SEQ ID NO: 150165 - DNA, 20 bp, Artificial
  CRISPR gRNA sequence
tcagaagaagagccttagcc

SEQ ID NO: 150166 - DNA, 20 bp, Artificial
  CRISPR gRNA sequence
cttagcccagcctcctatat

SEQ ID NO: 150167 - DNA, 20 bp, Artificial
  CRISPR gRNA sequence
tagcccagcctcctatattg

SEQ ID NO: 150168 - DNA, 20 bp, Artificial
  CRISPR gRNA sequence
ctatattggagatgttttca

SEQ ID NO: 150169 - DNA, 20 bp, Artificial
  CRISPR gRNA sequence
ttttcatagctgcccactta

SEQ ID NO: 150170 - DNA, 20 bp, Artificial
  CRISPR gRNA sequence
tttcatagctgcccacttat

SEQ ID NO: 150171 - DNA, 20 bp, Artificial
  CRISPR gRNA sequence
tcatagctgcccacttatag

SEQ ID NO: 150172 - DNA, 20 bp, Artificial
  CRISPR gRNA sequence
catagctgcccacttatagg

SEQ ID NO: 150173 - DNA, 20 bp, Artificial
  CRISPR gRNA sequence
cacttataggaggaatcacc

SEQ ID NO: 150174 - DNA, 20 bp, Artificial
  CRISPR gRNA sequence
tcacctggctaaattctatg

SEQ ID NO: 150175 - DNA, 20 bp, Artificial
  CRISPR gRNA sequence
tatgcagtgtttcaaaatta

SEQ ID NO: 150176 - DNA, 20 bp, Artificial
  CRISPR gRNA sequence
ctatcgctacattgtgaaca

SEQ ID NO: 150177 - DNA, 20 bp, Artificial
  CRISPR gRNA sequence
ataatgttattttaattatc

SEQ ID NO: 150178 - DNA, 20 bp, Artificial
  CRISPR gRNA sequence
aattatccagccattcctcc

SEQ ID NO: 150179 - DNA, 20 bp, Artificial
  CRISPR gRNA sequence
cagccattcctccaagaaat

SEQ ID NO: 150180 - DNA, 20 bp, Artificial
  CRISPR gRNA sequence
attcctttgttccacctcac

SEQ ID NO: 150181 - DNA, 20 bp, Artificial
  CRISPR gRNA sequence
ttcctttgttccacctcact

SEQ ID NO: 150182 - DNA, 20 bp, Artificial
  CRISPR gRNA sequence
tcctttgttccacctcacta

SEQ ID NO: 150183 - DNA, 20 bp, Artificial
  CRISPR gRNA sequence
cctttgttccacctcactag

SEQ ID NO: 150184 - DNA, 20 bp, Artificial
  CRISPR gRNA sequence
tgttccacctcactaggggt

SEQ ID NO: 150185 - DNA, 20 bp, Artificial
  CRISPR gRNA sequence
ccacctcactaggggtaagc

SEQ ID NO: 150186 - DNA, 20 bp, Artificial
  CRISPR gRNA sequence
cacctcactaggggtaagca

SEQ ID NO: 150187 - DNA, 20 bp, Artificial
  CRISPR gRNA sequence
taagcaaggattataaatca

SEQ ID NO: 150188 - DNA, 20 bp, Artificial
  CRISPR gRNA sequence
caaggattataaatcatagc

SEQ ID NO: 150189 - DNA, 20 bp, Artificial
  CRISPR gRNA sequence
aaggattataaatcatagct

SEQ ID NO: 150190 - DNA, 20 bp, Artificial
  CRISPR gRNA sequence
aatcatagctaggaaattta

SEQ ID NO: 150191 - DNA, 20 bp, Artificial
  CRISPR gRNA sequence
agctaggaaatttaaagcaa

SEQ ID NO: 150192 - DNA, 20 bp, Artificial
  CRISPR gRNA sequence
tttaaagcaacggattattt

SEQ ID NO: 150193 - DNA, 20 bp, Artificial
  CRISPR gRNA sequence
cggattatttaagaacacca

SEQ ID NO: 150194 - DNA, 20 bp, Artificial
  CRISPR gRNA sequence
ggattatttaagaacaccat

SEQ ID NO: 150195 - DNA, 20 bp, Artificial
  CRISPR gRNA sequence
tatttaagaacaccatgggc

SEQ ID NO: 150196 - DNA, 20 bp, Artificial
  CRISPR gRNA sequence
atttaagaacaccatgggcc

SEQ ID NO: 150197 - DNA, 20 bp, Artificial
  CRISPR gRNA sequence
acaccatgggccaggcgccg

SEQ ID NO: 150198 - DNA, 20 bp, Artificial
  CRISPR gRNA sequence
gtggctcacgcctgtaatcc

SEQ ID NO: 150199 - DNA, 20 bp, Artificial
  CRISPR gRNA sequence
cgcctgtaatcccagcactt

SEQ ID NO: 150200 - DNA, 20 bp, Artificial
  CRISPR gRNA sequence
gcctgtaatcccagcacttt

SEQ ID NO: 150201 - DNA, 20 bp, Artificial
  CRISPR gRNA sequence
ctgtaatcccagcactttgg

SEQ ID NO: 150202 - DNA, 20 bp, Artificial
  CRISPR gRNA sequence
tgtaatcccagcactttggg

SEQ ID NO: 150203 - DNA, 20 bp, Artificial
  CRISPR gRNA sequence
tcccagcactttgggaggct

SEQ ID NO: 150204 - DNA, 20 bp, Artificial
  CRISPR gRNA sequence
cccagcactttgggaggctg

SEQ ID NO: 150205 - DNA, 20 bp, Artificial
  CRISPR gRNA sequence
agcactttgggaggctgagg

SEQ ID NO: 150206 - DNA, 20 bp, Artificial
  CRISPR gRNA sequence
gcactttgggaggctgaggc

SEQ ID NO: 150207 - DNA, 20 bp, Artificial
  CRISPR gRNA sequence
ctttgggaggctgaggcggg

SEQ ID NO: 150208 - DNA, 20 bp, Artificial
  CRISPR gRNA sequence
ggctgaggcgggcagatcac

SEQ ID NO: 150209 - DNA, 20 bp, Artificial
  CRISPR gRNA sequence
gctgaggcgggcagatcacg

SEQ ID NO: 150210 - DNA, 20 bp, Artificial
  CRISPR gRNA sequence
cgggcagatcacgaggtcat

SEQ ID NO: 150211 - DNA, 20 bp, Artificial
  CRISPR gRNA sequence
gatcacgaggtcataagatc

SEQ ID NO: 150212 - DNA, 20 bp, Artificial
  CRISPR gRNA sequence
gtcataagatcaagaccatc

SEQ ID NO: 150213 - DNA, 20 bp, Artificial
  CRISPR gRNA sequence
tcaagaccatctggccaaca

SEQ ID NO: 150214 - DNA, 20 bp, Artificial
  CRISPR gRNA sequence
tctactaaaaatacaaaaat

SEQ ID NO: 150215 - DNA, 20 bp, Artificial
  CRISPR gRNA sequence
ctaaaaatacaaaaattagc

SEQ ID NO: 150216 - DNA, 20 bp, Artificial
  CRISPR gRNA sequence
taaaaatacaaaaattagct

SEQ ID NO: 150217 - DNA, 20 bp, Artificial
  CRISPR gRNA sequence
atacaaaaattagctgggcg

SEQ ID NO: 150218 - DNA, 20 bp, Artificial
  CRISPR gRNA sequence
caaaaattagctgggcgtgg

SEQ ID NO: 150219 - DNA, 20 bp, Artificial
  CRISPR gRNA sequence
ggcgtggtggcgcacatctg

SEQ ID NO: 150220 - DNA, 20 bp, Artificial
  CRISPR gRNA sequence
gtggcgcacatctgtagtcc

SEQ ID NO: 150221 - DNA, 20 bp, Artificial
  CRISPR gRNA sequence
catctgtagtcccagctact

SEQ ID NO: 150222 - DNA, 20 bp, Artificial
  CRISPR gRNA sequence
atctgtagtcccagctactc

SEQ ID NO: 150223 - DNA, 20 bp, Artificial
  CRISPR gRNA sequence
ctgtagtcccagctactcgg

SEQ ID NO: 150224 - DNA, 20 bp, Artificial
  CRISPR gRNA sequence
tgtagtcccagctactcggg

SEQ ID NO: 150225 - DNA, 20 bp, Artificial
  CRISPR gRNA sequence
tcccagctactcgggaggct

SEQ ID NO: 150226 - DNA, 20 bp, Artificial
  CRISPR gRNA sequence
cccagctactcgggaggctg

SEQ ID NO: 150227 - DNA, 20 bp, Artificial
  CRISPR gRNA sequence
agctactcgggaggctgagg

SEQ ID NO: 150228 - DNA, 20 bp, Artificial
  CRISPR gRNA sequence
gctactcgggaggctgaggc

SEQ ID NO: 150229 - DNA, 20 bp, Artificial
  CRISPR gRNA sequence
tactcgggaggctgaggcag

SEQ ID NO: 150230 - DNA, 20 bp, Artificial
  CRISPR gRNA sequence
gcaggagaatcgcttgaacc

SEQ ID NO: 150231 - DNA, 20 bp, Artificial
  CRISPR gRNA sequence
caggagaatcgcttgaacct

SEQ ID NO: 150232 - DNA, 20 bp, Artificial
  CRISPR gRNA sequence
ggagaatcgcttgaacctgg

SEQ ID NO: 150233 - DNA, 20 bp, Artificial
  CRISPR gRNA sequence
gagaatcgcttgaacctggg

SEQ ID NO: 150234 - DNA, 20 bp, Artificial
  CRISPR gRNA sequence
aatcgcttgaacctgggagg

SEQ ID NO: 150235 - DNA, 20 bp, Artificial
  CRISPR gRNA sequence
tcgcttgaacctgggaggca

SEQ ID NO: 150236 - DNA, 20 bp, Artificial
  CRISPR gRNA sequence
cgcttgaacctgggaggcag

SEQ ID NO: 150237 - DNA, 20 bp, Artificial
  CRISPR gRNA sequence
aacctgggaggcagaggttg

SEQ ID NO: 150238 - DNA, 20 bp, Artificial
  CRISPR gRNA sequence
tgggaggcagaggttgcagt

SEQ ID NO: 150239 - DNA, 20 bp, Artificial
  CRISPR gRNA sequence
ggcagaggttgcagtgagcc

SEQ ID NO: 150240 - DNA, 20 bp, Artificial
  CRISPR gRNA sequence
aagatcgtgccactgcactc

SEQ ID NO: 150241 - DNA, 20 bp, Artificial
  CRISPR gRNA sequence
cgtgccactgcactccagcc

SEQ ID NO: 150242 - DNA, 20 bp, Artificial
  CRISPR gRNA sequence
actgcactccagcctggcga

SEQ ID NO: 150243 - DNA, 20 bp, Artificial
  CRISPR gRNA sequence
tgcactccagcctggcgaca

SEQ ID NO: 150244 - DNA, 20 bp, Artificial
  CRISPR gRNA sequence
ctccagcctggcgacagagc

SEQ ID NO: 150245 - DNA, 20 bp, Artificial
  CRISPR gRNA sequence
aatatcgatctctatgtttc

SEQ ID NO: 150246 - DNA, 20 bp, Artificial
  CRISPR gRNA sequence
cgatctctatgtttcaagat

SEQ ID NO: 150247 - DNA, 20 bp, Artificial
  CRISPR gRNA sequence
tcaagatgagaacccaaatg

SEQ ID NO: 150248 - DNA, 20 bp, Artificial
  CRISPR gRNA sequence
caagatgagaacccaaatgt

SEQ ID NO: 150249 - DNA, 20 bp, Artificial
  CRISPR gRNA sequence
agatgagaacccaaatgtgg

SEQ ID NO: 150250 - DNA, 20 bp, Artificial
  CRISPR gRNA sequence
ctgcctcaatacataccaca

SEQ ID NO: 150251 - DNA, 20 bp, Artificial
  CRISPR gRNA sequence
ccacaaagtatgtatctgca

SEQ ID NO: 150252 - DNA, 20 bp, Artificial
  CRISPR gRNA sequence
aagtatgtatctgcatagct

SEQ ID NO: 150253 - DNA, 20 bp, Artificial
  CRISPR gRNA sequence
agtatgtatctgcatagcta

SEQ ID NO: 150254 - DNA, 20 bp, Artificial
  CRISPR gRNA sequence
tgcatagctaaggaatacca

SEQ ID NO: 150255 - DNA, 20 bp, Artificial
  CRISPR gRNA sequence
attctaaccacatatctatt

SEQ ID NO: 150256 - DNA, 20 bp, Artificial
  CRISPR gRNA sequence
ttcaactacttacctgacct

SEQ ID NO: 150257 - DNA, 20 bp, Artificial
  CRISPR gRNA sequence
ttacctgaccttagtgaatt

SEQ ID NO: 150258 - DNA, 20 bp, Artificial
  CRISPR gRNA sequence
tacctgaccttagtgaattt

SEQ ID NO: 150259 - DNA, 20 bp, Artificial
  CRISPR gRNA sequence
agtgaatttaggattcatta

SEQ ID NO: 150260 - DNA, 20 bp, Artificial
  CRISPR gRNA sequence
aaagacaatttccaaaatac

SEQ ID NO: 150261 - DNA, 20 bp, Artificial
  CRISPR gRNA sequence
gacaatttccaaaatactgg

SEQ ID NO: 150262 - DNA, 20 bp, Artificial
  CRISPR gRNA sequence
gtaccatgctttgttccaaa

SEQ ID NO: 150263 - DNA, 20 bp, Artificial
  CRISPR gRNA sequence
ctattttaacaaacacttta

SEQ ID NO: 150264 - DNA, 20 bp, Artificial
  CRISPR gRNA sequence
tattttaacaaacactttaa

SEQ ID NO: 150265 - DNA, 20 bp, Artificial
  CRISPR gRNA sequence
atgtttgttccctttacgat

SEQ ID NO: 150266 - DNA, 20 bp, Artificial
  CRISPR gRNA sequence
ccctttacgattagcctgtt

SEQ ID NO: 150267 - DNA, 20 bp, Artificial
  CRISPR gRNA sequence
tttacgattagcctgttaag

SEQ ID NO: 150268 - DNA, 20 bp, Artificial
  CRISPR gRNA sequence
tgttaagcagtctataatat

SEQ ID NO: 150269 - DNA, 20 bp, Artificial
  CRISPR gRNA sequence
ttaagcagtctataatatga

SEQ ID NO: 150270 - DNA, 20 bp, Artificial
  CRISPR gRNA sequence
tctataatatgagagttgat

SEQ ID NO: 150271 - DNA, 20 bp, Artificial
  CRISPR gRNA sequence
atgagagttgatgagaactc

SEQ ID NO: 150272 - DNA, 20 bp, Artificial
  CRISPR gRNA sequence
tgagagttgatgagaactct

SEQ ID NO: 150273 - DNA, 20 bp, Artificial
  CRISPR gRNA sequence
agttgatgagaactctggga

SEQ ID NO: 150274 - DNA, 20 bp, Artificial
  CRISPR gRNA sequence
tgggaaagttctgtgccttt

SEQ ID NO: 150275 - DNA, 20 bp, Artificial
  CRISPR gRNA sequence
gggaaagttctgtgcctttc

SEQ ID NO: 150276 - DNA, 20 bp, Artificial
  CRISPR gRNA sequence
ggaaagttctgtgcctttca

SEQ ID NO: 150277 - DNA, 20 bp, Artificial
  CRISPR gRNA sequence
gaaagttctgtgcctttcag

SEQ ID NO: 150278 - DNA, 20 bp, Artificial
  CRISPR gRNA sequence
aagttctgtgcctttcaggg

SEQ ID NO: 150279 - DNA, 20 bp, Artificial
  CRISPR gRNA sequence
ttctgtgcctttcaggggag

SEQ ID NO: 150280 - DNA, 20 bp, Artificial
  CRISPR gRNA sequence
gtgcctttcaggggagaagc

SEQ ID NO: 150281 - DNA, 20 bp, Artificial
  CRISPR gRNA sequence
tttcaggggagaagcaagta

SEQ ID NO: 150282 - DNA, 20 bp, Artificial
  CRISPR gRNA sequence
ggggagaagcaagtatggaa

SEQ ID NO: 150283 - DNA, 20 bp, Artificial
  CRISPR gRNA sequence
ggagaagcaagtatggaaaa

SEQ ID NO: 150284 - DNA, 20 bp, Artificial
  CRISPR gRNA sequence
gaagcaagtatggaaaagag

SEQ ID NO: 150285 - DNA, 20 bp, Artificial
  CRISPR gRNA sequence
aagcaagtatggaaaagaga

SEQ ID NO: 150286 - DNA, 20 bp, Artificial
  CRISPR gRNA sequence
caagtatggaaaagagaagg

SEQ ID NO: 150287 - DNA, 20 bp, Artificial
  CRISPR gRNA sequence
aagtatggaaaagagaaggt

SEQ ID NO: 150288 - DNA, 20 bp, Artificial
  CRISPR gRNA sequence
gtatggaaaagagaaggtag

SEQ ID NO: 150289 - DNA, 20 bp, Artificial
  CRISPR gRNA sequence
tatggaaaagagaaggtagg

SEQ ID NO: 150290 - DNA, 20 bp, Artificial
  CRISPR gRNA sequence
ggaaaagagaaggtaggagg

SEQ ID NO: 150291 - DNA, 20 bp, Artificial
  CRISPR gRNA sequence
gagaaggtaggaggaagaat

SEQ ID NO: 150292 - DNA, 20 bp, Artificial
  CRISPR gRNA sequence
ggaggaagaattagtccccg

SEQ ID NO: 150293 - DNA, 20 bp, Artificial
  CRISPR gRNA sequence
gaagaattagtccccgaaga

SEQ ID NO: 150294 - DNA, 20 bp, Artificial
  CRISPR gRNA sequence
ttagtccccgaagatggaca

SEQ ID NO: 150295 - DNA, 20 bp, Artificial
  CRISPR gRNA sequence
cccgaagatggacacagcta

SEQ ID NO: 150296 - DNA, 20 bp, Artificial
  CRISPR gRNA sequence
tatagactgtttttcatata

SEQ ID NO: 150297 - DNA, 20 bp, Artificial
  CRISPR gRNA sequence
gactgtttttcatatatggt

SEQ ID NO: 150298 - DNA, 20 bp, Artificial
  CRISPR gRNA sequence
gtttttcatatatggtaaga

SEQ ID NO: 150299 - DNA, 20 bp, Artificial
  CRISPR gRNA sequence
tcatatatggtaagaaagtg

SEQ ID NO: 150300 - DNA, 20 bp, Artificial
  CRISPR gRNA sequence
tggtaagaaagtgcagtata

SEQ ID NO: 150301 - DNA, 20 bp, Artificial
  CRISPR gRNA sequence
gtaagaaagtgcagtataaa

SEQ ID NO: 150302 - DNA, 20 bp, Artificial
  CRISPR gRNA sequence
aagtgcagtataaagagcaa

SEQ ID NO: 150303 - DNA, 20 bp, Artificial
  CRISPR gRNA sequence
agagcaaaagcctttgtcac

SEQ ID NO: 150304 - DNA, 20 bp, Artificial
  CRISPR gRNA sequence
gagcaaaagcctttgtcact

SEQ ID NO: 150305 - DNA, 20 bp, Artificial
  CRISPR gRNA sequence
ctattttctcaccctcaaaa

SEQ ID NO: 150306 - DNA, 20 bp, Artificial
  CRISPR gRNA sequence
tattttctcaccctcaaaat

SEQ ID NO: 150307 - DNA, 20 bp, Artificial
  CRISPR gRNA sequence
attttctcaccctcaaaatg

SEQ ID NO: 150308 - DNA, 20 bp, Artificial
  CRISPR gRNA sequence
ttttctcaccctcaaaatgg

SEQ ID NO: 150309 - DNA, 20 bp, Artificial
  CRISPR gRNA sequence
atcgtctgtcctacttacat

SEQ ID NO: 150310 - DNA, 20 bp, Artificial
  CRISPR gRNA sequence
tcgtctgtcctacttacatt

SEQ ID NO: 150311 - DNA, 20 bp, Artificial
  CRISPR gRNA sequence
tctgtcctacttacattagg

SEQ ID NO: 150312 - DNA, 20 bp, Artificial
  CRISPR gRNA sequence
acattaggtagataccaaat

SEQ ID NO: 150313 - DNA, 20 bp, Artificial
  CRISPR gRNA sequence
attaggtagataccaaataa

SEQ ID NO: 150314 - DNA, 20 bp, Artificial
  CRISPR gRNA sequence
tagataccaaataagagaat

SEQ ID NO: 150315 - DNA, 20 bp, Artificial
  CRISPR gRNA sequence
aaatcacttcactaactata

SEQ ID NO: 150316 - DNA, 20 bp, Artificial
  CRISPR gRNA sequence
tacattgcttaaccaccttc

SEQ ID NO: 150317 - DNA, 20 bp, Artificial
  CRISPR gRNA sequence
acattgcttaaccaccttca

SEQ ID NO: 150318 - DNA, 20 bp, Artificial
  CRISPR gRNA sequence
cattgcttaaccaccttcaa

SEQ ID NO: 150319 - DNA, 20 bp, Artificial
  CRISPR gRNA sequence
attgcttaaccaccttcaag

SEQ ID NO: 150320 - DNA, 20 bp, Artificial
  CRISPR gRNA sequence
tgcttaaccaccttcaaggg

SEQ ID NO: 150321 - DNA, 20 bp, Artificial
  CRISPR gRNA sequence
caccttcaaggggagcttca

SEQ ID NO: 150322 - DNA, 20 bp, Artificial
  CRISPR gRNA sequence
accttcaaggggagcttcat

SEQ ID NO: 150323 - DNA, 20 bp, Artificial
  CRISPR gRNA sequence
aggggagcttcatgggcatc

SEQ ID NO: 150324 - DNA, 20 bp, Artificial
  CRISPR gRNA sequence
catctggccaatgaatttcc

SEQ ID NO: 150325 - DNA, 20 bp, Artificial
  CRISPR gRNA sequence
tctggccaatgaatttccaa

SEQ ID NO: 150326 - DNA, 20 bp, Artificial
  CRISPR gRNA sequence
ctggccaatgaatttccaag

SEQ ID NO: 150327 - DNA, 20 bp, Artificial
  CRISPR gRNA sequence
ttccaagaggaaaataatca

SEQ ID NO: 150328 - DNA, 20 bp, Artificial
  CRISPR gRNA sequence
ccaagaggaaaataatcatg

SEQ ID NO: 150329 - DNA, 20 bp, Artificial
  CRISPR gRNA sequence
aggaaaataatcatggagtt

SEQ ID NO: 150330 - DNA, 20 bp, Artificial
  CRISPR gRNA sequence
gagtttagattataaataat

SEQ ID NO: 150331 - DNA, 20 bp, Artificial
  CRISPR gRNA sequence
agtttagattataaataatg

SEQ ID NO: 150332 - DNA, 20 bp, Artificial
  CRISPR gRNA sequence
ttataaataatgaggtaaaa

SEQ ID NO: 150333 - DNA, 20 bp, Artificial
  CRISPR gRNA sequence
aaataatgaggtaaaatggc

SEQ ID NO: 150334 - DNA, 20 bp, Artificial
  CRISPR gRNA sequence
gaaatttaccactatttctc

SEQ ID NO: 150335 - DNA, 20 bp, Artificial
  CRISPR gRNA sequence
accactatttctctagtgaa

SEQ ID NO: 150336 - DNA, 20 bp, Artificial
  CRISPR gRNA sequence
gtttcttattgcctttattt

SEQ ID NO: 150337 - DNA, 20 bp, Artificial
  CRISPR gRNA sequence
tattgcctttattttagatt

SEQ ID NO: 150338 - DNA, 20 bp, Artificial
  CRISPR gRNA sequence
attgcctttattttagattg

SEQ ID NO: 150339 - DNA, 20 bp, Artificial
  CRISPR gRNA sequence
gaggataattacaacatata

SEQ ID NO: 150340 - DNA, 20 bp, Artificial
  CRISPR gRNA sequence
taattacaacatatatagcc

SEQ ID NO: 150341 - DNA, 20 bp, Artificial
  CRISPR gRNA sequence
tatagcctagaaactaaata

SEQ ID NO: 150342 - DNA, 20 bp, Artificial
  CRISPR gRNA sequence
atagcctagaaactaaatat

SEQ ID NO: 150343 - DNA, 20 bp, Artificial
  CRISPR gRNA sequence
aaaaattctgctaaatccta

SEQ ID NO: 150344 - DNA, 20 bp, Artificial
  CRISPR gRNA sequence
ttctgctaaatcctacagat

SEQ ID NO: 150345 - DNA, 20 bp, Artificial
  CRISPR gRNA sequence
tctgctaaatcctacagatg

SEQ ID NO: 150346 - DNA, 20 bp, Artificial
  CRISPR gRNA sequence
ctaaatcctacagatgaggc

SEQ ID NO: 150347 - DNA, 20 bp, Artificial
  CRISPR gRNA sequence
gatgaggctagtctcattcc

SEQ ID NO: 150348 - DNA, 20 bp, Artificial
  CRISPR gRNA sequence
taattgtgtgtgctgctcat

SEQ ID NO: 150349 - DNA, 20 bp, Artificial
  CRISPR gRNA sequence
ttggtgctacaatgatcatg

SEQ ID NO: 150350 - DNA, 20 bp, Artificial
  CRISPR gRNA sequence
tggtgctacaatgatcatgt

SEQ ID NO: 150351 - DNA, 20 bp, Artificial
  CRISPR gRNA sequence
tgggctataaattacttgct

SEQ ID NO: 150352 - DNA, 20 bp, Artificial
  CRISPR gRNA sequence
aattcctacatatgtatttt

SEQ ID NO: 150353 - DNA, 20 bp, Artificial
  CRISPR gRNA sequence
cctacatatgtatttttggt

SEQ ID NO: 150354 - DNA, 20 bp, Artificial
  CRISPR gRNA sequence
tatttttggtcagcttcatg

SEQ ID NO: 150355 - DNA, 20 bp, Artificial
  CRISPR gRNA sequence
atttttggtcagcttcatgc

SEQ ID NO: 150356 - DNA, 20 bp, Artificial
  CRISPR gRNA sequence
catgcaggatgctgccattt

SEQ ID NO: 150357 - DNA, 20 bp, Artificial
  CRISPR gRNA sequence
ctgccatttgagattttaca

SEQ ID NO: 150358 - DNA, 20 bp, Artificial
  CRISPR gRNA sequence
agattttacaaagctaaaat

SEQ ID NO: 150359 - DNA, 20 bp, Artificial
  CRISPR gRNA sequence
tttacaaagctaaaatcagt

SEQ ID NO: 150360 - DNA, 20 bp, Artificial
  CRISPR gRNA sequence
aatcagtaagattatgccca

SEQ ID NO: 150361 - DNA, 20 bp, Artificial
  CRISPR gRNA sequence
gcaactcaaaaaataaaacc

SEQ ID NO: 150362 - DNA, 20 bp, Artificial
  CRISPR gRNA sequence
aacctagtctttgtaccaaa

SEQ ID NO: 150363 - DNA, 20 bp, Artificial
  CRISPR gRNA sequence
cctagtctttgtaccaaatg

SEQ ID NO: 150364 - DNA, 20 bp, Artificial
  CRISPR gRNA sequence
ctttgtaccaaatggagata

SEQ ID NO: 150365 - DNA, 20 bp, Artificial
  CRISPR gRNA sequence
atggtatatgtactaatctc

SEQ ID NO: 150366 - DNA, 20 bp, Artificial
  CRISPR gRNA sequence
tggtatatgtactaatctca

SEQ ID NO: 150367 - DNA, 20 bp, Artificial
  CRISPR gRNA sequence
gaaatatttgtacatcttta

SEQ ID NO: 150368 - DNA, 20 bp, Artificial
  CRISPR gRNA sequence
tatttgtacatctttaaagc

SEQ ID NO: 150369 - DNA, 20 bp, Artificial
  CRISPR gRNA sequence
gtacatctttaaagcaagtg

SEQ ID NO: 150370 - DNA, 20 bp, Artificial
  CRISPR gRNA sequence
tacatctttaaagcaagtga

SEQ ID NO: 150371 - DNA, 20 bp, Artificial
  CRISPR gRNA sequence
ttaaagcaagtgaaggtcac

SEQ ID NO: 150372 - DNA, 20 bp, Artificial
  CRISPR gRNA sequence
agtgaaggtcaccagattct

SEQ ID NO: 150373 - DNA, 20 bp, Artificial
  CRISPR gRNA sequence
gtgaaggtcaccagattcta

SEQ ID NO: 150374 - DNA, 20 bp, Artificial
  CRISPR gRNA sequence
aaggtcaccagattctaagg

SEQ ID NO: 150375 - DNA, 20 bp, Artificial
  CRISPR gRNA sequence
agattctaaggaagtatttc

SEQ ID NO: 150376 - DNA, 20 bp, Artificial
  CRISPR gRNA sequence
tttctagtcttttacttatc

SEQ ID NO: 150377 - DNA, 20 bp, Artificial
  CRISPR gRNA sequence
ttctagtcttttacttatca

SEQ ID NO: 150378 - DNA, 20 bp, Artificial
  CRISPR gRNA sequence
tttacttatcaaggcacaca

SEQ ID NO: 150379 - DNA, 20 bp, Artificial
  CRISPR gRNA sequence
cttatcaaggcacacacaga

SEQ ID NO: 150380 - DNA, 20 bp, Artificial
  CRISPR gRNA sequence
cacacagaaagtgttaatat

SEQ ID NO: 150381 - DNA, 20 bp, Artificial
  CRISPR gRNA sequence
ttttcaaatatttaacctat

SEQ ID NO: 150382 - DNA, 20 bp, Artificial
  CRISPR gRNA sequence
ctgataatgatgccctcatt

SEQ ID NO: 150383 - DNA, 20 bp, Artificial
  CRISPR gRNA sequence
cctcatttagttgaacttgt

SEQ ID NO: 150384 - DNA, 20 bp, Artificial
  CRISPR gRNA sequence
catttagttgaacttgtcag

SEQ ID NO: 150385 - DNA, 20 bp, Artificial
  CRISPR gRNA sequence
agaagaccatgtattacata

SEQ ID NO: 150386 - DNA, 20 bp, Artificial
  CRISPR gRNA sequence
tgtattacatacggtgctcc

SEQ ID NO: 150387 - DNA, 20 bp, Artificial
  CRISPR gRNA sequence
gtattacatacggtgctcca

SEQ ID NO: 150388 - DNA, 20 bp, Artificial
  CRISPR gRNA sequence
tacggtgctccaaggactgc

SEQ ID NO: 150389 - DNA, 20 bp, Artificial
  CRISPR gRNA sequence
acggtgctccaaggactgcg

SEQ ID NO: 150390 - DNA, 20 bp, Artificial
  CRISPR gRNA sequence
gtgctccaaggactgcgagg

SEQ ID NO: 150391 - DNA, 20 bp, Artificial
  CRISPR gRNA sequence
caaggactgcgaggaagatg

SEQ ID NO: 150392 - DNA, 20 bp, Artificial
  CRISPR gRNA sequence
aaggactgcgaggaagatgt

SEQ ID NO: 150393 - DNA, 20 bp, Artificial
  CRISPR gRNA sequence
tttaccttgttgtacacgcc

SEQ ID NO: 150394 - DNA, 20 bp, Artificial
  CRISPR gRNA sequence
ttgttgtacacgcctggatt

SEQ ID NO: 150395 - DNA, 20 bp, Artificial
  CRISPR gRNA sequence
tgttgtacacgcctggatta

SEQ ID NO: 150396 - DNA, 20 bp, Artificial
  CRISPR gRNA sequence
gttgtacacgcctggattaa

SEQ ID NO: 150397 - DNA, 20 bp, Artificial
  CRISPR gRNA sequence
ttgtacacgcctggattaag

SEQ ID NO: 150398 - DNA, 20 bp, Artificial
  CRISPR gRNA sequence
gtacacgcctggattaaggg

SEQ ID NO: 150399 - DNA, 20 bp, Artificial
  CRISPR gRNA sequence
gcctggattaaggggagtta

SEQ ID NO: 150400 - DNA, 20 bp, Artificial
  CRISPR gRNA sequence
ttacagatattctctatttt

SEQ ID NO: 150401 - DNA, 20 bp, Artificial
  CRISPR gRNA sequence
taaactaatactaaaaaacc

SEQ ID NO: 150402 - DNA, 20 bp, Artificial
  CRISPR gRNA sequence
ctaatactaaaaaaccaagc

SEQ ID NO: 150403 - DNA, 20 bp, Artificial
  CRISPR gRNA sequence
aaaccaagcaagtaactttt

SEQ ID NO: 150404 - DNA, 20 bp, Artificial
  CRISPR gRNA sequence
gcaagtaactttttggaata

SEQ ID NO: 150405 - DNA, 20 bp, Artificial
  CRISPR gRNA sequence
aaagaatattaattcttaca

SEQ ID NO: 150406 - DNA, 20 bp, Artificial
  CRISPR gRNA sequence
aagaatattaattcttacat

SEQ ID NO: 150407 - DNA, 20 bp, Artificial
  CRISPR gRNA sequence
ttacatgggaaatgcacact

SEQ ID NO: 150408 - DNA, 20 bp, Artificial
  CRISPR gRNA sequence
ggaaatgcacactcagaaaa

SEQ ID NO: 150409 - DNA, 20 bp, Artificial
  CRISPR gRNA sequence
gaaatgcacactcagaaaac

SEQ ID NO: 150410 - DNA, 20 bp, Artificial
  CRISPR gRNA sequence
aaatgcacactcagaaaaca

SEQ ID NO: 150411 - DNA, 20 bp, Artificial
  CRISPR gRNA sequence
aatgcacactcagaaaacag

SEQ ID NO: 150412 - DNA, 20 bp, Artificial
  CRISPR gRNA sequence
caggggtgtgcaaccaaaaa

SEQ ID NO: 150413 - DNA, 20 bp, Artificial
  CRISPR gRNA sequence
gtgtgcaaccaaaaaaagct

SEQ ID NO: 150414 - DNA, 20 bp, Artificial
  CRISPR gRNA sequence
gtgcaaccaaaaaaagctta

SEQ ID NO: 150415 - DNA, 20 bp, Artificial
  CRISPR gRNA sequence
gcaaccaaaaaaagcttaga

SEQ ID NO: 150416 - DNA, 20 bp, Artificial
  CRISPR gRNA sequence
aagcttagagagcactgacc

SEQ ID NO: 150417 - DNA, 20 bp, Artificial
  CRISPR gRNA sequence
gcttagagagcactgaccta

SEQ ID NO: 150418 - DNA, 20 bp, Artificial
  CRISPR gRNA sequence
cttagagagcactgacctag

SEQ ID NO: 150419 - DNA, 20 bp, Artificial
  CRISPR gRNA sequence
gactctaccatgctcatttc

SEQ ID NO: 150420 - DNA, 20 bp, Artificial
  CRISPR gRNA sequence
atttctggatttctcaactt

SEQ ID NO: 150421 - DNA, 20 bp, Artificial
  CRISPR gRNA sequence
ttctggatttctcaacttta

SEQ ID NO: 150422 - DNA, 20 bp, Artificial
  CRISPR gRNA sequence
ggatttctcaactttagagt

SEQ ID NO: 150423 - DNA, 20 bp, Artificial
  CRISPR gRNA sequence
actttagagtcagacatttt

SEQ ID NO: 150424 - DNA, 20 bp, Artificial
  CRISPR gRNA sequence
ctttagagtcagacattttt

SEQ ID NO: 150425 - DNA, 20 bp, Artificial
  CRISPR gRNA sequence
gggcttccatgtttgacatg

SEQ ID NO: 150426 - DNA, 20 bp, Artificial
  CRISPR gRNA sequence
ccatgtttgacatgtagcac

SEQ ID NO: 150427 - DNA, 20 bp, Artificial
  CRISPR gRNA sequence
attctctcctgtttgtcccc

SEQ ID NO: 150428 - DNA, 20 bp, Artificial
  CRISPR gRNA sequence
ttctctcctgtttgtcccct

SEQ ID NO: 150429 - DNA, 20 bp, Artificial
  CRISPR gRNA sequence
tcctgtttgtcccctaggtt

SEQ ID NO: 150430 - DNA, 20 bp, Artificial
  CRISPR gRNA sequence
ccaattttgatatttctcca

SEQ ID NO: 150431 - DNA, 20 bp, Artificial
  CRISPR gRNA sequence
ttgatatttctccaaagctt

SEQ ID NO: 150432 - DNA, 20 bp, Artificial
  CRISPR gRNA sequence
agcttcagtccttcatgtac

SEQ ID NO: 150433 - DNA, 20 bp, Artificial
  CRISPR gRNA sequence
tccttcatgtacaagctgcc

SEQ ID NO: 150434 - DNA, 20 bp, Artificial
  CRISPR gRNA sequence
tcatgtacaagctgcctggc

SEQ ID NO: 150435 - DNA, 20 bp, Artificial
  CRISPR gRNA sequence
cctggctggacatctacaac

SEQ ID NO: 150436 - DNA, 20 bp, Artificial
  CRISPR gRNA sequence
gctggacatctacaaccaga

SEQ ID NO: 150437 - DNA, 20 bp, Artificial
  CRISPR gRNA sequence
tctacaaccagaaagctacc

SEQ ID NO: 150438 - DNA, 20 bp, Artificial
  CRISPR gRNA sequence
aaatttctgtttctatcctc

SEQ ID NO: 150439 - DNA, 20 bp, Artificial
  CRISPR gRNA sequence
gtttctatcctccagtcacc

SEQ ID NO: 150440 - DNA, 20 bp, Artificial
  CRISPR gRNA sequence
tatcctccagtcacccagac

SEQ ID NO: 150441 - DNA, 20 bp, Artificial
  CRISPR gRNA sequence
ctccagtcacccagactgga

SEQ ID NO: 150442 - DNA, 20 bp, Artificial
  CRISPR gRNA sequence
cccagactggatagaaatct

SEQ ID NO: 150443 - DNA, 20 bp, Artificial
  CRISPR gRNA sequence
ctctgttcctcaattctaat

SEQ ID NO: 150444 - DNA, 20 bp, Artificial
  CRISPR gRNA sequence
taatcagctgctaaattcta

SEQ ID NO: 150445 - DNA, 20 bp, Artificial
  CRISPR gRNA sequence
gctgctaaattctatagtaa

SEQ ID NO: 150446 - DNA, 20 bp, Artificial
  CRISPR gRNA sequence
tctatagtaacagtgtccaa

SEQ ID NO: 150447 - DNA, 20 bp, Artificial
  CRISPR gRNA sequence
atactaccactatctctgtt

SEQ ID NO: 150448 - DNA, 20 bp, Artificial
  CRISPR gRNA sequence
aataaaaacgatgatgatga

SEQ ID NO: 150449 - DNA, 20 bp, Artificial
  CRISPR gRNA sequence
tgatgatagccaatgttcat

SEQ ID NO: 150450 - DNA, 20 bp, Artificial
  CRISPR gRNA sequence
gatgatagccaatgttcatt

SEQ ID NO: 150451 - DNA, 20 bp, Artificial
  CRISPR gRNA sequence
tgatagccaatgttcattag

SEQ ID NO: 150452 - DNA, 20 bp, Artificial
  CRISPR gRNA sequence
tgtgtgccacgtacaattct

SEQ ID NO: 150453 - DNA, 20 bp, Artificial
  CRISPR gRNA sequence
aaacctcctaataatcctat

SEQ ID NO: 150454 - DNA, 20 bp, Artificial
  CRISPR gRNA sequence
aacctcctaataatcctata

SEQ ID NO: 150455 - DNA, 20 bp, Artificial
  CRISPR gRNA sequence
acctcctaataatcctataa

SEQ ID NO: 150456 - DNA, 20 bp, Artificial
  CRISPR gRNA sequence
cctataagggttgtgaacct

SEQ ID NO: 150457 - DNA, 20 bp, Artificial
  CRISPR gRNA sequence
atgtataataaatcatataa

SEQ ID NO: 150458 - DNA, 20 bp, Artificial
  CRISPR gRNA sequence
taataaatcatataaaagtg

SEQ ID NO: 150459 - DNA, 20 bp, Artificial
  CRISPR gRNA sequence
gccacatcactctactaccc

SEQ ID NO: 150460 - DNA, 20 bp, Artificial
  CRISPR gRNA sequence
ctactaccccagattttcaa

SEQ ID NO: 150461 - DNA, 20 bp, Artificial
  CRISPR gRNA sequence
tttcaatggtcaccaacgtc

SEQ ID NO: 150462 - DNA, 20 bp, Artificial
  CRISPR gRNA sequence
caatggtcaccaacgtcaag

SEQ ID NO: 150463 - DNA, 20 bp, Artificial
  CRISPR gRNA sequence
atggtcaccaacgtcaagca

SEQ ID NO: 150464 - DNA, 20 bp, Artificial
  CRISPR gRNA sequence
cagagactgttcaaatttct

SEQ ID NO: 150465 - DNA, 20 bp, Artificial
  CRISPR gRNA sequence
actgttcaaatttcttagcc

SEQ ID NO: 150466 - DNA, 20 bp, Artificial
  CRISPR gRNA sequence
aatttcttagcctagcaaac

SEQ ID NO: 150467 - DNA, 20 bp, Artificial
  CRISPR gRNA sequence
atttcttagcctagcaaaca

SEQ ID NO: 150468 - DNA, 20 bp, Artificial
  CRISPR gRNA sequence
aactcatctccttatgctct

SEQ ID NO: 150469 - DNA, 20 bp, Artificial
  CRISPR gRNA sequence
tcatctccttatgctctaag

SEQ ID NO: 150470 - DNA, 20 bp, Artificial
  CRISPR gRNA sequence
tttactgctctccttaaccc

SEQ ID NO: 150471 - DNA, 20 bp, Artificial
  CRISPR gRNA sequence
tgcttgttgctcccaatgtc

SEQ ID NO: 150472 - DNA, 20 bp, Artificial
  CRISPR gRNA sequence
gcccttgtccctacctccct

SEQ ID NO: 150473 - DNA, 20 bp, Artificial
  CRISPR gRNA sequence
tacctccctgagtctacacc

SEQ ID NO: 150474 - DNA, 20 bp, Artificial
  CRISPR gRNA sequence
tgagtctacacccagttaaa

SEQ ID NO: 150475 - DNA, 20 bp, Artificial
  CRISPR gRNA sequence
aacagcttgccttcattcct

SEQ ID NO: 150476 - DNA, 20 bp, Artificial
  CRISPR gRNA sequence
tttgcttgttctttccatat

SEQ ID NO: 150477 - DNA, 20 bp, Artificial
  CRISPR gRNA sequence
taatacttgataaacatcat

SEQ ID NO: 150478 - DNA, 20 bp, Artificial
  CRISPR gRNA sequence
ttgataaacatcatcagtct

SEQ ID NO: 150479 - DNA, 20 bp, Artificial
  CRISPR gRNA sequence
gataaacatcatcagtctca

SEQ ID NO: 150480 - DNA, 20 bp, Artificial
  CRISPR gRNA sequence
tttatttgtatacattttta

SEQ ID NO: 150481 - DNA, 20 bp, Artificial
  CRISPR gRNA sequence
tttttaaagtctccacaaaa

SEQ ID NO: 150482 - DNA, 20 bp, Artificial
  CRISPR gRNA sequence
acaaaaaagacatgcatgcg

SEQ ID NO: 150483 - DNA, 20 bp, Artificial
  CRISPR gRNA sequence
catgcgtggtgaattgatga

SEQ ID NO: 150484 - DNA, 20 bp, Artificial
  CRISPR gRNA sequence
atgcgtggtgaattgatgaa

SEQ ID NO: 150485 - DNA, 20 bp, Artificial
  CRISPR gRNA sequence
cgtggtgaattgatgaaagg

SEQ ID NO: 150486 - DNA, 20 bp, Artificial
  CRISPR gRNA sequence
ttgatgaaaggaagtgtaaa

SEQ ID NO: 150487 - DNA, 20 bp, Artificial
  CRISPR gRNA sequence
gtgtaaaaagcatccaactt

SEQ ID NO: 150488 - DNA, 20 bp, Artificial
  CRISPR gRNA sequence
caactttagcatttccttga

SEQ ID NO: 150489 - DNA, 20 bp, Artificial
  CRISPR gRNA sequence
tttagcatttccttgaaagt

SEQ ID NO: 150490 - DNA, 20 bp, Artificial
  CRISPR gRNA sequence
ccttgaaagtaagaactata

SEQ ID NO: 150491 - DNA, 20 bp, Artificial
  CRISPR gRNA sequence
aaagtaagaactatatagct

SEQ ID NO: 150492 - DNA, 20 bp, Artificial
  CRISPR gRNA sequence
aagtaagaactatatagctt

SEQ ID NO: 150493 - DNA, 20 bp, Artificial
  CRISPR gRNA sequence
taagaactatatagcttagg

SEQ ID NO: 150494 - DNA, 20 bp, Artificial
  CRISPR gRNA sequence
aactatatagcttaggtaga

SEQ ID NO: 150495 - DNA, 20 bp, Artificial
  CRISPR gRNA sequence
tatatagcttaggtagacag

SEQ ID NO: 150496 - DNA, 20 bp, Artificial
  CRISPR gRNA sequence
gaagaaaatttcattttatc

SEQ ID NO: 150497 - DNA, 20 bp, Artificial
  CRISPR gRNA sequence
ttatctggatattttcaatt

SEQ ID NO: 150498 - DNA, 20 bp, Artificial
  CRISPR gRNA sequence
tctggatattttcaattgag

SEQ ID NO: 150499 - DNA, 20 bp, Artificial
  CRISPR gRNA sequence
ctggatattttcaattgagc

SEQ ID NO: 150500 - DNA, 20 bp, Artificial
  CRISPR gRNA sequence
aattgagcaggtcttccctt

SEQ ID NO: 150501 - DNA, 20 bp, Artificial
  CRISPR gRNA sequence
tttctatgtaattgaaacta

SEQ ID NO: 150502 - DNA, 20 bp, Artificial
  CRISPR gRNA sequence
tgtaattgaaactatggaaa

SEQ ID NO: 150503 - DNA, 20 bp, Artificial
  CRISPR gRNA sequence
actatggaaacagaccaaaa

SEQ ID NO: 150504 - DNA, 20 bp, Artificial
  CRISPR gRNA sequence
atggaaacagaccaaaacgg

SEQ ID NO: 150505 - DNA, 20 bp, Artificial
  CRISPR gRNA sequence
accaaaacggtagtacttcc

SEQ ID NO: 150506 - DNA, 20 bp, Artificial
  CRISPR gRNA sequence
aaaacggtagtacttccaag

SEQ ID NO: 150507 - DNA, 20 bp, Artificial
  CRISPR gRNA sequence
cggtagtacttccaagaaga

SEQ ID NO: 150508 - DNA, 20 bp, Artificial
  CRISPR gRNA sequence
ggtagtacttccaagaagaa

SEQ ID NO: 150509 - DNA, 20 bp, Artificial
  CRISPR gRNA sequence
tccaagaagaaaggataacc

SEQ ID NO: 150510 - DNA, 20 bp, Artificial
  CRISPR gRNA sequence
gaaaggataaccaagtgaat

SEQ ID NO: 150511 - DNA, 20 bp, Artificial
  CRISPR gRNA sequence
attagcactgctatttgctg

SEQ ID NO: 150512 - DNA, 20 bp, Artificial
  CRISPR gRNA sequence
gctatttgctgtagttattt

SEQ ID NO: 150513 - DNA, 20 bp, Artificial
  CRISPR gRNA sequence
tagtcttctttctttgaact

SEQ ID NO: 150514 - DNA, 20 bp, Artificial
  CRISPR gRNA sequence
agtcttctttctttgaacta

SEQ ID NO: 150515 - DNA, 20 bp, Artificial
  CRISPR gRNA sequence
ttctttgaactaaggaacac

SEQ ID NO: 150516 - DNA, 20 bp, Artificial
  CRISPR gRNA sequence
tctttgaactaaggaacaca

SEQ ID NO: 150517 - DNA, 20 bp, Artificial
  CRISPR gRNA sequence
cacaatgttatgccacttta

SEQ ID NO: 150518 - DNA, 20 bp, Artificial
  CRISPR gRNA sequence
ttactatgtttttttttctt

SEQ ID NO: 150519 - DNA, 20 bp, Artificial
  CRISPR gRNA sequence
ctttagttcttcctttatac

SEQ ID NO: 150520 - DNA, 20 bp, Artificial
  CRISPR gRNA sequence
tcgattgcccattttcactg

SEQ ID NO: 150521 - DNA, 20 bp, Artificial
  CRISPR gRNA sequence
cgattgcccattttcactgc

SEQ ID NO: 150522 - DNA, 20 bp, Artificial
  CRISPR gRNA sequence
cccattttcactgcaggtgc

SEQ ID NO: 150523 - DNA, 20 bp, Artificial
  CRISPR gRNA sequence
tgctagactgtaatctaatt

SEQ ID NO: 150524 - DNA, 20 bp, Artificial
  CRISPR gRNA sequence
taatttagaaaaaatactat

SEQ ID NO: 150525 - DNA, 20 bp, Artificial
  CRISPR gRNA sequence
tttagaaaaaatactataag

SEQ ID NO: 150526 - DNA, 20 bp, Artificial
  CRISPR gRNA sequence
tagaaaaaatactataagta

SEQ ID NO: 150527 - DNA, 20 bp, Artificial
  CRISPR gRNA sequence
tataagtagagaaaaacttt

SEQ ID NO: 150528 - DNA, 20 bp, Artificial
  CRISPR gRNA sequence
acttttggtcaattattgaa

SEQ ID NO: 150529 - DNA, 20 bp, Artificial
  CRISPR gRNA sequence
tttggtcaattattgaacag

SEQ ID NO: 150530 - DNA, 20 bp, Artificial
  CRISPR gRNA sequence
ttggtcaattattgaacagc

SEQ ID NO: 150531 - DNA, 20 bp, Artificial
  CRISPR gRNA sequence
tggtcaattattgaacagcg

SEQ ID NO: 150532 - DNA, 20 bp, Artificial
  CRISPR gRNA sequence
aattattgaacagcggggtc

SEQ ID NO: 150533 - DNA, 20 bp, Artificial
  CRISPR gRNA sequence
tgaacagcggggtctagctt

SEQ ID NO: 150534 - DNA, 20 bp, Artificial
  CRISPR gRNA sequence
gaacagcggggtctagcttt

SEQ ID NO: 150535 - DNA, 20 bp, Artificial
  CRISPR gRNA sequence
ggtctagctttgggatccct

SEQ ID NO: 150536 - DNA, 20 bp, Artificial
  CRISPR gRNA sequence
gtctagctttgggatcccta

SEQ ID NO: 150537 - DNA, 20 bp, Artificial
  CRISPR gRNA sequence
tctagctttgggatccctaa

SEQ ID NO: 150538 - DNA, 20 bp, Artificial
  CRISPR gRNA sequence
tagctttgggatccctaagg

SEQ ID NO: 150539 - DNA, 20 bp, Artificial
  CRISPR gRNA sequence
gctttgggatccctaaggga

SEQ ID NO: 150540 - DNA, 20 bp, Artificial
  CRISPR gRNA sequence
gggatccctaagggagagac

SEQ ID NO: 150541 - DNA, 20 bp, Artificial
  CRISPR gRNA sequence
atccctaagggagagacaag

SEQ ID NO: 150542 - DNA, 20 bp, Artificial
  CRISPR gRNA sequence
taagggagagacaagaagat

SEQ ID NO: 150543 - DNA, 20 bp, Artificial
  CRISPR gRNA sequence
agggagagacaagaagataa

SEQ ID NO: 150544 - DNA, 20 bp, Artificial
  CRISPR gRNA sequence
gataagagtgataatacaaa

SEQ ID NO: 150545 - DNA, 20 bp, Artificial
  CRISPR gRNA sequence
tagaatctgaccacgttata

SEQ ID NO: 150546 - DNA, 20 bp, Artificial
  CRISPR gRNA sequence
gaatctgaccacgttataaa

SEQ ID NO: 150547 - DNA, 20 bp, Artificial
  CRISPR gRNA sequence
aatctgaccacgttataaag

SEQ ID NO: 150548 - DNA, 20 bp, Artificial
  CRISPR gRNA sequence
ctgaccacgttataaagagg

SEQ ID NO: 150549 - DNA, 20 bp, Artificial
  CRISPR gRNA sequence
tgaccacgttataaagaggt

SEQ ID NO: 150550 - DNA, 20 bp, Artificial
  CRISPR gRNA sequence
taaagaggtgggcccccata

SEQ ID NO: 150551 - DNA, 20 bp, Artificial
  CRISPR gRNA sequence
aagaggtgggcccccatatg

SEQ ID NO: 150552 - DNA, 20 bp, Artificial
  CRISPR gRNA sequence
agaggtgggcccccatatgg

SEQ ID NO: 150553 - DNA, 20 bp, Artificial
  CRISPR gRNA sequence
ggtgggcccccatatggagg

SEQ ID NO: 150554 - DNA, 20 bp, Artificial
  CRISPR gRNA sequence
gggcccccatatggaggtag

SEQ ID NO: 150555 - DNA, 20 bp, Artificial
  CRISPR gRNA sequence
aggtagcagaacacattaaa

SEQ ID NO: 150556 - DNA, 20 bp, Artificial
  CRISPR gRNA sequence
gaacacattaaaaagaaaac

SEQ ID NO: 150557 - DNA, 20 bp, Artificial
  CRISPR gRNA sequence
acattaaaaagaaaactagc

SEQ ID NO: 150558 - DNA, 20 bp, Artificial
  CRISPR gRNA sequence
cattaaaaagaaaactagcc

SEQ ID NO: 150559 - DNA, 20 bp, Artificial
  CRISPR gRNA sequence
aaaagaaaactagccaggca

SEQ ID NO: 150560 - DNA, 20 bp, Artificial
  CRISPR gRNA sequence
atgctcacacctgtaaatgc

SEQ ID NO: 150561 - DNA, 20 bp, Artificial
  CRISPR gRNA sequence
acctgtaaatgccagtgctt

SEQ ID NO: 150562 - DNA, 20 bp, Artificial
  CRISPR gRNA sequence
cctgtaaatgccagtgcttt

SEQ ID NO: 150563 - DNA, 20 bp, Artificial
  CRISPR gRNA sequence
tgtaaatgccagtgctttgg

SEQ ID NO: 150564 - DNA, 20 bp, Artificial
  CRISPR gRNA sequence
gtaaatgccagtgctttggg

SEQ ID NO: 150565 - DNA, 20 bp, Artificial
  CRISPR gRNA sequence
tgccagtgctttgggaggct

SEQ ID NO: 150566 - DNA, 20 bp, Artificial
  CRISPR gRNA sequence
gccagtgctttgggaggctg

SEQ ID NO: 150567 - DNA, 20 bp, Artificial
  CRISPR gRNA sequence
agtgctttgggaggctgagg

SEQ ID NO: 150568 - DNA, 20 bp, Artificial
  CRISPR gRNA sequence
ctttgggaggctgaggtaga

SEQ ID NO: 150569 - DNA, 20 bp, Artificial
  CRISPR gRNA sequence
ctgaggtagaaagatccttt

SEQ ID NO: 150570 - DNA, 20 bp, Artificial
  CRISPR gRNA sequence
tgaggtagaaagatcctttg

SEQ ID NO: 150571 - DNA, 20 bp, Artificial
  CRISPR gRNA sequence
gtagaaagatcctttgaggc

SEQ ID NO: 150572 - DNA, 20 bp, Artificial
  CRISPR gRNA sequence
tagaaagatcctttgaggcc

SEQ ID NO: 150573 - DNA, 20 bp, Artificial
  CRISPR gRNA sequence
gaaagatcctttgaggccag

SEQ ID NO: 150574 - DNA, 20 bp, Artificial
  CRISPR gRNA sequence
tcctttgaggccaggagttc

SEQ ID NO: 150575 - DNA, 20 bp, Artificial
  CRISPR gRNA sequence
tgaggccaggagttcgagac

SEQ ID NO: 150576 - DNA, 20 bp, Artificial
  CRISPR gRNA sequence
gccaggagttcgagaccagc

SEQ ID NO: 150577 - DNA, 20 bp, Artificial
  CRISPR gRNA sequence
ccaggagttcgagaccagcc

SEQ ID NO: 150578 - DNA, 20 bp, Artificial
  CRISPR gRNA sequence
caggagttcgagaccagcca

SEQ ID NO: 150579 - DNA, 20 bp, Artificial
  CRISPR gRNA sequence
gaccagccagggaaaataat

SEQ ID NO: 150580 - DNA, 20 bp, Artificial
  CRISPR gRNA sequence
ataatgagactccatttcta

SEQ ID NO: 150581 - DNA, 20 bp, Artificial
  CRISPR gRNA sequence
taatgagactccatttctac

SEQ ID NO: 150582 - DNA, 20 bp, Artificial
  CRISPR gRNA sequence
ttctacaggaaaaaaaaaaa

SEQ ID NO: 150583 - DNA, 20 bp, Artificial
  CRISPR gRNA sequence
gttttttgtttttttttctt

SEQ ID NO: 150584 - DNA, 20 bp, Artificial
  CRISPR gRNA sequence
tttgtttttttttcttgaga

SEQ ID NO: 150585 - DNA, 20 bp, Artificial
  CRISPR gRNA sequence
cggaatctcactctgttgcc

SEQ ID NO: 150586 - DNA, 20 bp, Artificial
  CRISPR gRNA sequence
ggaatctcactctgttgccc

SEQ ID NO: 150587 - DNA, 20 bp, Artificial
  CRISPR gRNA sequence
tctcactctgttgcccaggc

SEQ ID NO: 150588 - DNA, 20 bp, Artificial
  CRISPR gRNA sequence
tcactctgttgcccaggctg

SEQ ID NO: 150589 - DNA, 20 bp, Artificial
  CRISPR gRNA sequence
ctgttgcccaggctggagtg

SEQ ID NO: 150590 - DNA, 20 bp, Artificial
  CRISPR gRNA sequence
ttgcccaggctggagtgcag

SEQ ID NO: 150591 - DNA, 20 bp, Artificial
  CRISPR gRNA sequence
ggagtgcagtggcactatca

SEQ ID NO: 150592 - DNA, 20 bp, Artificial
  CRISPR gRNA sequence
catggctcactgcaacctcc

SEQ ID NO: 150593 - DNA, 20 bp, Artificial
  CRISPR gRNA sequence
tcactgcaacctcccagttc

SEQ ID NO: 150594 - DNA, 20 bp, Artificial
  CRISPR gRNA sequence
ttcaagcaattcttgtgcct

SEQ ID NO: 150595 - DNA, 20 bp, Artificial
  CRISPR gRNA sequence
ttgtgcctcagcctcctgta

SEQ ID NO: 150596 - DNA, 20 bp, Artificial
  CRISPR gRNA sequence
gcctcagcctcctgtatagc

SEQ ID NO: 150597 - DNA, 20 bp, Artificial
  CRISPR gRNA sequence
cctcagcctcctgtatagct

SEQ ID NO: 150598 - DNA, 20 bp, Artificial
  CRISPR gRNA sequence
tgtatagctgggactacgcc

SEQ ID NO: 150599 - DNA, 20 bp, Artificial
  CRISPR gRNA sequence
ggactacgcctggctaattt

SEQ ID NO: 150600 - DNA, 20 bp, Artificial
  CRISPR gRNA sequence
ggctaatttcggtgtttttt

SEQ ID NO: 150601 - DNA, 20 bp, Artificial
  CRISPR gRNA sequence
atttcggtgtttttttagta

SEQ ID NO: 150602 - DNA, 20 bp, Artificial
  CRISPR gRNA sequence
tttcggtgtttttttagtaa

SEQ ID NO: 150603 - DNA, 20 bp, Artificial
  CRISPR gRNA sequence
ggtgtttttttagtaaaggc

SEQ ID NO: 150604 - DNA, 20 bp, Artificial
  CRISPR gRNA sequence
gtgtttttttagtaaaggct

SEQ ID NO: 150605 - DNA, 20 bp, Artificial
  CRISPR gRNA sequence
aaggctgggtttcaccatgt

SEQ ID NO: 150606 - DNA, 20 bp, Artificial
  CRISPR gRNA sequence
ctgggtttcaccatgttggc

SEQ ID NO: 150607 - DNA, 20 bp, Artificial
  CRISPR gRNA sequence
tgggtttcaccatgttggcc

SEQ ID NO: 150608 - DNA, 20 bp, Artificial
  CRISPR gRNA sequence
tttcaccatgttggccaggc

SEQ ID NO: 150609 - DNA, 20 bp, Artificial
  CRISPR gRNA sequence
ggtctcaaactcctgacctc

SEQ ID NO: 150610 - DNA, 20 bp, Artificial
  CRISPR gRNA sequence
ctcaagtgatccgcccacct

SEQ ID NO: 150611 - DNA, 20 bp, Artificial
  CRISPR gRNA sequence
ccgcccaccttggcctccca

SEQ ID NO: 150612 - DNA, 20 bp, Artificial
  CRISPR gRNA sequence
accttggcctcccaaagtgc

SEQ ID NO: 150613 - DNA, 20 bp, Artificial
  CRISPR gRNA sequence
ccttggcctcccaaagtgct

SEQ ID NO: 150614 - DNA, 20 bp, Artificial
  CRISPR gRNA sequence
ctcccaaagtgctgggatta

SEQ ID NO: 150615 - DNA, 20 bp, Artificial
  CRISPR gRNA sequence
tcccaaagtgctgggattac

SEQ ID NO: 150616 - DNA, 20 bp, Artificial
  CRISPR gRNA sequence
caggcatgatccaccacacc

SEQ ID NO: 150617 - DNA, 20 bp, Artificial
  CRISPR gRNA sequence
atttatttatttattgtttt

SEQ ID NO: 150618 - DNA, 20 bp, Artificial
  CRISPR gRNA sequence
ttatttattgttttgagaca

SEQ ID NO: 150619 - DNA, 20 bp, Artificial
  CRISPR gRNA sequence
atttattgttttgagacatg

SEQ ID NO: 150620 - DNA, 20 bp, Artificial
  CRISPR gRNA sequence
tggagtctcgatttgttgca

SEQ ID NO: 150621 - DNA, 20 bp, Artificial
  CRISPR gRNA sequence
ggagtctcgatttgttgcac

SEQ ID NO: 150622 - DNA, 20 bp, Artificial
  CRISPR gRNA sequence
tctcgatttgttgcacaggc

SEQ ID NO: 150623 - DNA, 20 bp, Artificial
  CRISPR gRNA sequence
tcgatttgttgcacaggctg

SEQ ID NO: 150624 - DNA, 20 bp, Artificial
  CRISPR gRNA sequence
ttgttgcacaggctggagtg

SEQ ID NO: 150625 - DNA, 20 bp, Artificial
  CRISPR gRNA sequence
ttgcacaggctggagtgcag

SEQ ID NO: 150626 - DNA, 20 bp, Artificial
  CRISPR gRNA sequence
ggagtgcagtggcgccatgt

SEQ ID NO: 150627 - DNA, 20 bp, Artificial
  CRISPR gRNA sequence
gcgccatgtcggctcactgc

SEQ ID NO: 150628 - DNA, 20 bp, Artificial
  CRISPR gRNA sequence
tcactgcaagctccgcctcc

SEQ ID NO: 150629 - DNA, 20 bp, Artificial
  CRISPR gRNA sequence
ttcatgccattctcctgcct

SEQ ID NO: 150630 - DNA, 20 bp, Artificial
  CRISPR gRNA sequence
ttctcctgcctcagcctgcc

SEQ ID NO: 150631 - DNA, 20 bp, Artificial
  CRISPR gRNA sequence
tcctgcctcagcctgccgag

SEQ ID NO: 150632 - DNA, 20 bp, Artificial
  CRISPR gRNA sequence
gcctcagcctgccgagtagc

SEQ ID NO: 150633 - DNA, 20 bp, Artificial
  CRISPR gRNA sequence
cctcagcctgccgagtagct

SEQ ID NO: 150634 - DNA, 20 bp, Artificial
  CRISPR gRNA sequence
ctgccgagtagctgggacta

SEQ ID NO: 150635 - DNA, 20 bp, Artificial
  CRISPR gRNA sequence
tgccgagtagctgggactac

SEQ ID NO: 150636 - DNA, 20 bp, Artificial
  CRISPR gRNA sequence
caggcgcccgccaccacacc

SEQ ID NO: 150637 - DNA, 20 bp, Artificial
  CRISPR gRNA sequence
cggctaattttttgtatttt

SEQ ID NO: 150638 - DNA, 20 bp, Artificial
  CRISPR gRNA sequence
ctaattttttgtatttttag

SEQ ID NO: 150639 - DNA, 20 bp, Artificial
  CRISPR gRNA sequence
aattttttgtatttttagta

SEQ ID NO: 150640 - DNA, 20 bp, Artificial
  CRISPR gRNA sequence
tttgtatttttagtagagat

SEQ ID NO: 150641 - DNA, 20 bp, Artificial
  CRISPR gRNA sequence
ttgtatttttagtagagatg

SEQ ID NO: 150642 - DNA, 20 bp, Artificial
  CRISPR gRNA sequence
gagatgaggtttaaccatgt

SEQ ID NO: 150643 - DNA, 20 bp, Artificial
  CRISPR gRNA sequence
tgaggtttaaccatgttagc

SEQ ID NO: 150644 - DNA, 20 bp, Artificial
  CRISPR gRNA sequence
gaggtttaaccatgttagcc

SEQ ID NO: 150645 - DNA, 20 bp, Artificial
  CRISPR gRNA sequence
tttaaccatgttagccagga

SEQ ID NO: 150646 - DNA, 20 bp, Artificial
  CRISPR gRNA sequence
acctcgtgatctgcctgcct

SEQ ID NO: 150647 - DNA, 20 bp, Artificial
  CRISPR gRNA sequence
ctgcctgcctcggcctccca

SEQ ID NO: 150648 - DNA, 20 bp, Artificial
  CRISPR gRNA sequence
gcctcggcctcccaaagtgc

SEQ ID NO: 150649 - DNA, 20 bp, Artificial
  CRISPR gRNA sequence
cctcggcctcccaaagtgct

SEQ ID NO: 150650 - DNA, 20 bp, Artificial
  CRISPR gRNA sequence
ctcccaaagtgctgggatta

SEQ ID NO: 150651 - DNA, 20 bp, Artificial
  CRISPR gRNA sequence
tcccaaagtgctgggattac

SEQ ID NO: 150652 - DNA, 20 bp, Artificial
  CRISPR gRNA sequence
agtgctgggattacaggcgt

SEQ ID NO: 150653 - DNA, 20 bp, Artificial
  CRISPR gRNA sequence
cctcaaaatttttttttaat

SEQ ID NO: 150654 - DNA, 20 bp, Artificial
  CRISPR gRNA sequence
aaaatttttttttaattagc

SEQ ID NO: 150655 - DNA, 20 bp, Artificial
  CRISPR gRNA sequence
aaatttttttttaattagcc

SEQ ID NO: 150656 - DNA, 20 bp, Artificial
  CRISPR gRNA sequence
tttttttaattagccaggcc

SEQ ID NO: 150657 - DNA, 20 bp, Artificial
  CRISPR gRNA sequence
ttttaattagccaggcctag

SEQ ID NO: 150658 - DNA, 20 bp, Artificial
  CRISPR gRNA sequence
ggcctagtagcgtgcatctg

SEQ ID NO: 150659 - DNA, 20 bp, Artificial
  CRISPR gRNA sequence
catctgtagtcccaattact

SEQ ID NO: 150660 - DNA, 20 bp, Artificial
  CRISPR gRNA sequence
tctgtagtcccaattactcg

SEQ ID NO: 150661 - DNA, 20 bp, Artificial
  CRISPR gRNA sequence
ctgtagtcccaattactcgg

SEQ ID NO: 150662 - DNA, 20 bp, Artificial
  CRISPR gRNA sequence
gtcccaattactcggaggct

SEQ ID NO: 150663 - DNA, 20 bp, Artificial
  CRISPR gRNA sequence
tcccaattactcggaggctg

SEQ ID NO: 150664 - DNA, 20 bp, Artificial
  CRISPR gRNA sequence
caattactcggaggctgagg

SEQ ID NO: 150665 - DNA, 20 bp, Artificial
  CRISPR gRNA sequence
aattactcggaggctgaggt

SEQ ID NO: 150666 - DNA, 20 bp, Artificial
  CRISPR gRNA sequence
ttactcggaggctgaggtgg

SEQ ID NO: 150667 - DNA, 20 bp, Artificial
  CRISPR gRNA sequence
tactcggaggctgaggtggg

SEQ ID NO: 150668 - DNA, 20 bp, Artificial
  CRISPR gRNA sequence
ctgaggtgggaggactgctt

SEQ ID NO: 150669 - DNA, 20 bp, Artificial
  CRISPR gRNA sequence
gtgggaggactgcttgagcc

SEQ ID NO: 150670 - DNA, 20 bp, Artificial
  CRISPR gRNA sequence
tgggaggactgcttgagccc

SEQ ID NO: 150671 - DNA, 20 bp, Artificial
  CRISPR gRNA sequence
ggaggactgcttgagcccag

SEQ ID NO: 150672 - DNA, 20 bp, Artificial
  CRISPR gRNA sequence
ctgcttgagcccaggagttt

SEQ ID NO: 150673 - DNA, 20 bp, Artificial
  CRISPR gRNA sequence
tgcttgagcccaggagttta

SEQ ID NO: 150674 - DNA, 20 bp, Artificial
  CRISPR gRNA sequence
agcccaggagtttaaggttg

SEQ ID NO: 150675 - DNA, 20 bp, Artificial
  CRISPR gRNA sequence
atgattacaccactacactc

SEQ ID NO: 150676 - DNA, 20 bp, Artificial
  CRISPR gRNA sequence
tacaccactacactctagcc

SEQ ID NO: 150677 - DNA, 20 bp, Artificial
  CRISPR gRNA sequence
acaccactacactctagcct

SEQ ID NO: 150678 - DNA, 20 bp, Artificial
  CRISPR gRNA sequence
ctacactctagcctgggtga

SEQ ID NO: 150679 - DNA, 20 bp, Artificial
  CRISPR gRNA sequence
acactctagcctgggtgaca

SEQ ID NO: 150680 - DNA, 20 bp, Artificial
  CRISPR gRNA sequence
tctagcctgggtgacagagc

SEQ ID NO: 150681 - DNA, 20 bp, Artificial
  CRISPR gRNA sequence
aagaccttgtctccaaaaaa

SEQ ID NO: 150682 - DNA, 20 bp, Artificial
  CRISPR gRNA sequence
agaccttgtctccaaaaaaa

SEQ ID NO: 150683 - DNA, 20 bp, Artificial
  CRISPR gRNA sequence
cttgtctccaaaaaaaagga

SEQ ID NO: 150684 - DNA, 20 bp, Artificial
  CRISPR gRNA sequence
aggaaagaaaactaaacttc

SEQ ID NO: 150685 - DNA, 20 bp, Artificial
  CRISPR gRNA sequence
ggaaagaaaactaaacttct

SEQ ID NO: 150686 - DNA, 20 bp, Artificial
  CRISPR gRNA sequence
aactaaacttctgggaaatg

SEQ ID NO: 150687 - DNA, 20 bp, Artificial
  CRISPR gRNA sequence
gacatgaaatatattctatc

SEQ ID NO: 150688 - DNA, 20 bp, Artificial
  CRISPR gRNA sequence
gctatgtctattataatctt

SEQ ID NO: 150689 - DNA, 20 bp, Artificial
  CRISPR gRNA sequence
tgtctattataatcttcagt

SEQ ID NO: 150690 - DNA, 20 bp, Artificial
  CRISPR gRNA sequence
aatcttcagtcagtacactt

SEQ ID NO: 150691 - DNA, 20 bp, Artificial
  CRISPR gRNA sequence
atcttcagtcagtacacttt

SEQ ID NO: 150692 - DNA, 20 bp, Artificial
  CRISPR gRNA sequence
ttacataacttacatcgttc

SEQ ID NO: 150693 - DNA, 20 bp, Artificial
  CRISPR gRNA sequence
tcaagccctcattctttcaa

SEQ ID NO: 150694 - DNA, 20 bp, Artificial
  CRISPR gRNA sequence
aacttttgtctaaatatatg

SEQ ID NO: 150695 - DNA, 20 bp, Artificial
  CRISPR gRNA sequence
acttttgtctaaatatatga

SEQ ID NO: 150696 - DNA, 20 bp, Artificial
  CRISPR gRNA sequence
tatatgaaggtcatcacctt

SEQ ID NO: 150697 - DNA, 20 bp, Artificial
  CRISPR gRNA sequence
cagaaaaattaaaaatgtta

SEQ ID NO: 150698 - DNA, 20 bp, Artificial
  CRISPR gRNA sequence
aaaaatgttaaagtatatca

SEQ ID NO: 150699 - DNA, 20 bp, Artificial
  CRISPR gRNA sequence
aagtatatcatggtctatca

SEQ ID NO: 150700 - DNA, 20 bp, Artificial
  CRISPR gRNA sequence
atggtctatcaaagaatata

SEQ ID NO: 150701 - DNA, 20 bp, Artificial
  CRISPR gRNA sequence
aatactactcaaacatacac

SEQ ID NO: 150702 - DNA, 20 bp, Artificial
  CRISPR gRNA sequence
acataataccactttgctga

SEQ ID NO: 150703 - DNA, 20 bp, Artificial
  CRISPR gRNA sequence
cataataccactttgctgat

SEQ ID NO: 150704 - DNA, 20 bp, Artificial
  CRISPR gRNA sequence
accactttgctgatgggaaa

SEQ ID NO: 150705 - DNA, 20 bp, Artificial
  CRISPR gRNA sequence
tttgctgatgggaaacagta

SEQ ID NO: 150706 - DNA, 20 bp, Artificial
  CRISPR gRNA sequence
ctgatgggaaacagtaaagt

SEQ ID NO: 150707 - DNA, 20 bp, Artificial
  CRISPR gRNA sequence
gggaaacagtaaagtcagca

SEQ ID NO: 150708 - DNA, 20 bp, Artificial
  CRISPR gRNA sequence
acagtaaagtcagcacagtt

SEQ ID NO: 150709 - DNA, 20 bp, Artificial
  CRISPR gRNA sequence
gcacagttaagatattattt

SEQ ID NO: 150710 - DNA, 20 bp, Artificial
  CRISPR gRNA sequence
cacagttaagatattatttt

SEQ ID NO: 150711 - DNA, 20 bp, Artificial
  CRISPR gRNA sequence
ataaacaatgattcctattt

SEQ ID NO: 150712 - DNA, 20 bp, Artificial
  CRISPR gRNA sequence
tcaaatgcttaaaatgaccc

SEQ ID NO: 150713 - DNA, 20 bp, Artificial
  CRISPR gRNA sequence
gaatctttgtttattaaata

SEQ ID NO: 150714 - DNA, 20 bp, Artificial
  CRISPR gRNA sequence
aatctttgtttattaaatac

SEQ ID NO: 150715 - DNA, 20 bp, Artificial
  CRISPR gRNA sequence
tttgtttattaaatacaggt

SEQ ID NO: 150716 - DNA, 20 bp, Artificial
  CRISPR gRNA sequence
attaaatacaggttagcttg

SEQ ID NO: 150717 - DNA, 20 bp, Artificial
  CRISPR gRNA sequence
ttagcttgtggactcacttt

SEQ ID NO: 150718 - DNA, 20 bp, Artificial
  CRISPR gRNA sequence
agcttgtggactcactttaa

SEQ ID NO: 150719 - DNA, 20 bp, Artificial
  CRISPR gRNA sequence
tgtggactcactttaagagc

SEQ ID NO: 150720 - DNA, 20 bp, Artificial
  CRISPR gRNA sequence
gtggactcactttaagagcc

SEQ ID NO: 150721 - DNA, 20 bp, Artificial
  CRISPR gRNA sequence
gagccaggtccaaacttttt

SEQ ID NO: 150722 - DNA, 20 bp, Artificial
  CRISPR gRNA sequence
agccaggtccaaactttttt

SEQ ID NO: 150723 - DNA, 20 bp, Artificial
  CRISPR gRNA sequence
gtccaaacttttttgggaat

SEQ ID NO: 150724 - DNA, 20 bp, Artificial
  CRISPR gRNA sequence
caacaacaaaaaacactaac

SEQ ID NO: 150725 - DNA, 20 bp, Artificial
  CRISPR gRNA sequence
aaaaaacactaactggcttg

SEQ ID NO: 150726 - DNA, 20 bp, Artificial
  CRISPR gRNA sequence
aaaaacactaactggcttgc

SEQ ID NO: 150727 - DNA, 20 bp, Artificial
  CRISPR gRNA sequence
aaattcctcataatgcataa

SEQ ID NO: 150728 - DNA, 20 bp, Artificial
  CRISPR gRNA sequence
cataatgcataaaagtaacc

SEQ ID NO: 150729 - DNA, 20 bp, Artificial
  CRISPR gRNA sequence
ataaaagtaacctggctttc

SEQ ID NO: 150730 - DNA, 20 bp, Artificial
  CRISPR gRNA sequence
tggctttctggaatacctca

SEQ ID NO: 150731 - DNA, 20 bp, Artificial
  CRISPR gRNA sequence
ggctttctggaatacctcac

SEQ ID NO: 150732 - DNA, 20 bp, Artificial
  CRISPR gRNA sequence
acctcacaggtgaacaccat

SEQ ID NO: 150733 - DNA, 20 bp, Artificial
  CRISPR gRNA sequence
ggtgaacaccattagcttcc

SEQ ID NO: 150734 - DNA, 20 bp, Artificial
  CRISPR gRNA sequence
aacaccattagcttcctagc

SEQ ID NO: 150735 - DNA, 20 bp, Artificial
  CRISPR gRNA sequence
ttagcttcctagctggttct

SEQ ID NO: 150736 - DNA, 20 bp, Artificial
  CRISPR gRNA sequence
tggttctcagctttctgaat

SEQ ID NO: 150737 - DNA, 20 bp, Artificial
  CRISPR gRNA sequence
tttctgaataagcaactaac

SEQ ID NO: 150738 - DNA, 20 bp, Artificial
  CRISPR gRNA sequence
gaataagcaactaactggct

SEQ ID NO: 150739 - DNA, 20 bp, Artificial
  CRISPR gRNA sequence
aataagcaactaactggctg

SEQ ID NO: 150740 - DNA, 20 bp, Artificial
  CRISPR gRNA sequence
agcaactaactggctgaggc

SEQ ID NO: 150741 - DNA, 20 bp, Artificial
  CRISPR gRNA sequence
gcaactaactggctgaggca

SEQ ID NO: 150742 - DNA, 20 bp, Artificial
  CRISPR gRNA sequence
tggctgaggcaaggtatctt

SEQ ID NO: 150743 - DNA, 20 bp, Artificial
  CRISPR gRNA sequence
caaggtatcttcagatccca

SEQ ID NO: 150744 - DNA, 20 bp, Artificial
  CRISPR gRNA sequence
aaggtatcttcagatcccaa

SEQ ID NO: 150745 - DNA, 20 bp, Artificial
  CRISPR gRNA sequence
aggtatcttcagatcccaaa

SEQ ID NO: 150746 - DNA, 20 bp, Artificial
  CRISPR gRNA sequence
aagggacactaaatctgctg

SEQ ID NO: 150747 - DNA, 20 bp, Artificial
  CRISPR gRNA sequence
ggacactaaatctgctgcag

SEQ ID NO: 150748 - DNA, 20 bp, Artificial
  CRISPR gRNA sequence
actttctaaccaacacactt

SEQ ID NO: 150749 - DNA, 20 bp, Artificial
  CRISPR gRNA sequence
ctttctaaccaacacacttc

SEQ ID NO: 150750 - DNA, 20 bp, Artificial
  CRISPR gRNA sequence
taaccaacacacttcaggta

SEQ ID NO: 150751 - DNA, 20 bp, Artificial
  CRISPR gRNA sequence
agacttctgaacctcttcca

SEQ ID NO: 150752 - DNA, 20 bp, Artificial
  CRISPR gRNA sequence
ctgttccttctatacccaaa

SEQ ID NO: 150753 - DNA, 20 bp, Artificial
  CRISPR gRNA sequence
tccttctatacccaaacagc

SEQ ID NO: 150754 - DNA, 20 bp, Artificial
  CRISPR gRNA sequence
acccaaacagcaagcctata

SEQ ID NO: 150755 - DNA, 20 bp, Artificial
  CRISPR gRNA sequence
caaacagcaagcctatacag

SEQ ID NO: 150756 - DNA, 20 bp, Artificial
  CRISPR gRNA sequence
gcctatacagaagtcccaaa

SEQ ID NO: 150757 - DNA, 20 bp, Artificial
  CRISPR gRNA sequence
tacagaagtcccaaaaagaa

SEQ ID NO: 150758 - DNA, 20 bp, Artificial
  CRISPR gRNA sequence
aaagaaacatgaaaaataaa

SEQ ID NO: 150759 - DNA, 20 bp, Artificial
  CRISPR gRNA sequence
aataaaaagtgaaaacaacc

SEQ ID NO: 150760 - DNA, 20 bp, Artificial
  CRISPR gRNA sequence
taaaaagtgaaaacaaccta

SEQ ID NO: 150761 - DNA, 20 bp, Artificial
  CRISPR gRNA sequence
aaaaagtgaaaacaacctag

SEQ ID NO: 150762 - DNA, 20 bp, Artificial
  CRISPR gRNA sequence
aaaacaacctagaggaataa

SEQ ID NO: 150763 - DNA, 20 bp, Artificial
  CRISPR gRNA sequence
aaagaaacatgcaacaaatt

SEQ ID NO: 150764 - DNA, 20 bp, Artificial
  CRISPR gRNA sequence
gaaacatgcaacaaattgag

SEQ ID NO: 150765 - DNA, 20 bp, Artificial
  CRISPR gRNA sequence
aaacatgcaacaaattgagt

SEQ ID NO: 150766 - DNA, 20 bp, Artificial
  CRISPR gRNA sequence
acatgcaacaaattgagtgg

SEQ ID NO: 150767 - DNA, 20 bp, Artificial
  CRISPR gRNA sequence
tcaaatctccaaacttgtac

SEQ ID NO: 150768 - DNA, 20 bp, Artificial
  CRISPR gRNA sequence
tgtacaagcctgttcctaaa

SEQ ID NO: 150769 - DNA, 20 bp, Artificial
  CRISPR gRNA sequence
gcctgttcctaaaaagctga

SEQ ID NO: 150770 - DNA, 20 bp, Artificial
  CRISPR gRNA sequence
tcctaaaaagctgaaagact

SEQ ID NO: 150771 - DNA, 20 bp, Artificial
  CRISPR gRNA sequence
aaaagctgaaagacttggat

SEQ ID NO: 150772 - DNA, 20 bp, Artificial
  CRISPR gRNA sequence
aaagctgaaagacttggatt

SEQ ID NO: 150773 - DNA, 20 bp, Artificial
  CRISPR gRNA sequence
aagctgaaagacttggatta

SEQ ID NO: 150774 - DNA, 20 bp, Artificial
  CRISPR gRNA sequence
attagggcacctgaacttac

SEQ ID NO: 150775 - DNA, 20 bp, Artificial
  CRISPR gRNA sequence
ttagggcacctgaacttact

SEQ ID NO: 150776 - DNA, 20 bp, Artificial
  CRISPR gRNA sequence
cctcaatttccccactttac

SEQ ID NO: 150777 - DNA, 20 bp, Artificial
  CRISPR gRNA sequence
caatttccccactttacaag

SEQ ID NO: 150778 - DNA, 20 bp, Artificial
  CRISPR gRNA sequence
aatttccccactttacaaga

SEQ ID NO: 150779 - DNA, 20 bp, Artificial
  CRISPR gRNA sequence
atttccccactttacaagaa

SEQ ID NO: 150780 - DNA, 20 bp, Artificial
  CRISPR gRNA sequence
ccactttacaagaagggaac

SEQ ID NO: 150781 - DNA, 20 bp, Artificial
  CRISPR gRNA sequence
ttacaagaagggaactagac

SEQ ID NO: 150782 - DNA, 20 bp, Artificial
  CRISPR gRNA sequence
gggaactagactagatccct

SEQ ID NO: 150783 - DNA, 20 bp, Artificial
  CRISPR gRNA sequence
gatccctaagtgattcccat

SEQ ID NO: 150784 - DNA, 20 bp, Artificial
  CRISPR gRNA sequence
tgattcccatcagcctaatt

SEQ ID NO: 150785 - DNA, 20 bp, Artificial
  CRISPR gRNA sequence
actctgtatgcatatattat

SEQ ID NO: 150786 - DNA, 20 bp, Artificial
  CRISPR gRNA sequence
atgcatatattatcagtaat

SEQ ID NO: 150787 - DNA, 20 bp, Artificial
  CRISPR gRNA sequence
tgcatatattatcagtaata

SEQ ID NO: 150788 - DNA, 20 bp, Artificial
  CRISPR gRNA sequence
tatattatcagtaataagga

SEQ ID NO: 150789 - DNA, 20 bp, Artificial
  CRISPR gRNA sequence
atattatcagtaataaggat

SEQ ID NO: 150790 - DNA, 20 bp, Artificial
  CRISPR gRNA sequence
caaaaatcattccattcatg

SEQ ID NO: 150791 - DNA, 20 bp, Artificial
  CRISPR gRNA sequence
aatcattccattcatgaaga

SEQ ID NO: 150792 - DNA, 20 bp, Artificial
  CRISPR gRNA sequence
tcaacttttaatacattttt

SEQ ID NO: 150793 - DNA, 20 bp, Artificial
  CRISPR gRNA sequence
caacttttaatacatttttt

SEQ ID NO: 150794 - DNA, 20 bp, Artificial
  CRISPR gRNA sequence
atacattttttgggttactg

SEQ ID NO: 150795 - DNA, 20 bp, Artificial
  CRISPR gRNA sequence
ggttactgaagctcctacaa

SEQ ID NO: 150796 - DNA, 20 bp, Artificial
  CRISPR gRNA sequence
gaagctcctacaaaagtatt

SEQ ID NO: 150797 - DNA, 20 bp, Artificial
  CRISPR gRNA sequence
aaagtatttagcctctttaa

SEQ ID NO: 150798 - DNA, 20 bp, Artificial
  CRISPR gRNA sequence
aagtatttagcctctttaaa

SEQ ID NO: 150799 - DNA, 20 bp, Artificial
  CRISPR gRNA sequence
agtatttagcctctttaaaa

SEQ ID NO: 150800 - DNA, 20 bp, Artificial
  CRISPR gRNA sequence
tatttagcctctttaaaagg

SEQ ID NO: 150801 - DNA, 20 bp, Artificial
  CRISPR gRNA sequence
tcatcttgttttaaaaacaa

SEQ ID NO: 150802 - DNA, 20 bp, Artificial
  CRISPR gRNA sequence
gttttaaaaacaaaagccca

SEQ ID NO: 150803 - DNA, 20 bp, Artificial
  CRISPR gRNA sequence
tttttaaacctacacatccc

SEQ ID NO: 150804 - DNA, 20 bp, Artificial
  CRISPR gRNA sequence
aacctacacatccctggaac

SEQ ID NO: 150805 - DNA, 20 bp, Artificial
  CRISPR gRNA sequence
cctggaactggaattttatt

SEQ ID NO: 150806 - DNA, 20 bp, Artificial
  CRISPR gRNA sequence
aactggaattttatttggta

SEQ ID NO: 150807 - DNA, 20 bp, Artificial
  CRISPR gRNA sequence
ggaattttatttggtaaagt

SEQ ID NO: 150808 - DNA, 20 bp, Artificial
  CRISPR gRNA sequence
aatatgattcttccaatgca

SEQ ID NO: 150809 - DNA, 20 bp, Artificial
  CRISPR gRNA sequence
tgattcttccaatgcacaga

SEQ ID NO: 150810 - DNA, 20 bp, Artificial
  CRISPR gRNA sequence
gattcttccaatgcacagat

SEQ ID NO: 150811 - DNA, 20 bp, Artificial
  CRISPR gRNA sequence
tcttccaatgcacagatagg

SEQ ID NO: 150812 - DNA, 20 bp, Artificial
  CRISPR gRNA sequence
tccaatgcacagataggaag

SEQ ID NO: 150813 - DNA, 20 bp, Artificial
  CRISPR gRNA sequence
aatgctgactgaccatgcct

SEQ ID NO: 150814 - DNA, 20 bp, Artificial
  CRISPR gRNA sequence
tgctgactgaccatgcctga

SEQ ID NO: 150815 - DNA, 20 bp, Artificial
  CRISPR gRNA sequence
gctgactgaccatgcctgag

SEQ ID NO: 150816 - DNA, 20 bp, Artificial
  CRISPR gRNA sequence
gactgaccatgcctgagagg

SEQ ID NO: 150817 - DNA, 20 bp, Artificial
  CRISPR gRNA sequence
cctgagaggaagtgacttaa

SEQ ID NO: 150818 - DNA, 20 bp, Artificial
  CRISPR gRNA sequence
ctgagaggaagtgacttaat

SEQ ID NO: 150819 - DNA, 20 bp, Artificial
  CRISPR gRNA sequence
gaggaagtgacttaatagga

SEQ ID NO: 150820 - DNA, 20 bp, Artificial
  CRISPR gRNA sequence
aggaagtgacttaataggac

SEQ ID NO: 150821 - DNA, 20 bp, Artificial
  CRISPR gRNA sequence
caaaatatcaaccccacccc

SEQ ID NO: 150822 - DNA, 20 bp, Artificial
  CRISPR gRNA sequence
aaaatatcaaccccacccct

SEQ ID NO: 150823 - DNA, 20 bp, Artificial
  CRISPR gRNA sequence
aaatatcaaccccacccctg

SEQ ID NO: 150824 - DNA, 20 bp, Artificial
  CRISPR gRNA sequence
aatatcaaccccacccctgg

SEQ ID NO: 150825 - DNA, 20 bp, Artificial
  CRISPR gRNA sequence
atatcaaccccacccctggg

SEQ ID NO: 150826 - DNA, 20 bp, Artificial
  CRISPR gRNA sequence
tatcaaccccacccctgggg

SEQ ID NO: 150827 - DNA, 20 bp, Artificial
  CRISPR gRNA sequence
cccacccctgggggggaaaa

SEQ ID NO: 150828 - DNA, 20 bp, Artificial
  CRISPR gRNA sequence
ccacccctgggggggaaaaa

SEQ ID NO: 150829 - DNA, 20 bp, Artificial
  CRISPR gRNA sequence
cccctgggggggaaaaaagg

SEQ ID NO: 150830 - DNA, 20 bp, Artificial
  CRISPR gRNA sequence
aaaaaaggaagtcctaaaaa

SEQ ID NO: 150831 - DNA, 20 bp, Artificial
  CRISPR gRNA sequence
gtcctaaaaatagatgacac

SEQ ID NO: 150832 - DNA, 20 bp, Artificial
  CRISPR gRNA sequence
tcctaaaaatagatgacact

SEQ ID NO: 150833 - DNA, 20 bp, Artificial
  CRISPR gRNA sequence
aatagatgacactgggcatg

SEQ ID NO: 150834 - DNA, 20 bp, Artificial
  CRISPR gRNA sequence
atgacactgggcatgcagac

SEQ ID NO: 150835 - DNA, 20 bp, Artificial
  CRISPR gRNA sequence
gggcatgcagactagattaa

SEQ ID NO: 150836 - DNA, 20 bp, Artificial
  CRISPR gRNA sequence
agattaaaagaaacccccat

SEQ ID NO: 150837 - DNA, 20 bp, Artificial
  CRISPR gRNA sequence
tgagtttccaccaattatgt

SEQ ID NO: 150838 - DNA, 20 bp, Artificial
  CRISPR gRNA sequence
tttccaccaattatgttaga

SEQ ID NO: 150839 - DNA, 20 bp, Artificial
  CRISPR gRNA sequence
ttccaccaattatgttagaa

SEQ ID NO: 150840 - DNA, 20 bp, Artificial
  CRISPR gRNA sequence
tatgttagaaaggtatctca

SEQ ID NO: 150841 - DNA, 20 bp, Artificial
  CRISPR gRNA sequence
gttagaaaggtatctcatag

SEQ ID NO: 150842 - DNA, 20 bp, Artificial
  CRISPR gRNA sequence
ttagaaaggtatctcatagt

SEQ ID NO: 150843 - DNA, 20 bp, Artificial
  CRISPR gRNA sequence
caactgtgtgaaatttatgt

SEQ ID NO: 150844 - DNA, 20 bp, Artificial
  CRISPR gRNA sequence
atttatgttagatttctgat

SEQ ID NO: 150845 - DNA, 20 bp, Artificial
  CRISPR gRNA sequence
ttatgttagatttctgatga

SEQ ID NO: 150846 - DNA, 20 bp, Artificial
  CRISPR gRNA sequence
agatcaattattttttttta

SEQ ID NO: 150847 - DNA, 20 bp, Artificial
  CRISPR gRNA sequence
taaagtgttcatcccacaat

SEQ ID NO: 150848 - DNA, 20 bp, Artificial
  CRISPR gRNA sequence
aaagtgttcatcccacaatt

SEQ ID NO: 150849 - DNA, 20 bp, Artificial
  CRISPR gRNA sequence
catcccacaattgggcacaa

SEQ ID NO: 150850 - DNA, 20 bp, Artificial
  CRISPR gRNA sequence
atggctcatgcctgtaatcc

SEQ ID NO: 150851 - DNA, 20 bp, Artificial
  CRISPR gRNA sequence
aatcccagtgcttgtaatcc

SEQ ID NO: 150852 - DNA, 20 bp, Artificial
  CRISPR gRNA sequence
tgcttgtaatcccagcactt

SEQ ID NO: 150853 - DNA, 20 bp, Artificial
  CRISPR gRNA sequence
gcttgtaatcccagcacttt

SEQ ID NO: 150854 - DNA, 20 bp, Artificial
  CRISPR gRNA sequence
ttgtaatcccagcactttgg

SEQ ID NO: 150855 - DNA, 20 bp, Artificial
  CRISPR gRNA sequence
tgtaatcccagcactttggg

SEQ ID NO: 150856 - DNA, 20 bp, Artificial
  CRISPR gRNA sequence
tcccagcactttgggaggcc

SEQ ID NO: 150857 - DNA, 20 bp, Artificial
  CRISPR gRNA sequence
cccagcactttgggaggcca

SEQ ID NO: 150858 - DNA, 20 bp, Artificial
  CRISPR gRNA sequence
agcactttgggaggccaagg

SEQ ID NO: 150859 - DNA, 20 bp, Artificial
  CRISPR gRNA sequence
gcactttgggaggccaaggc

SEQ ID NO: 150860 - DNA, 20 bp, Artificial
  CRISPR gRNA sequence
actttgggaggccaaggcag

SEQ ID NO: 150861 - DNA, 20 bp, Artificial
  CRISPR gRNA sequence
ctttgggaggccaaggcagg

SEQ ID NO: 150862 - DNA, 20 bp, Artificial
  CRISPR gRNA sequence
ccaaggcaggaggatcactt

SEQ ID NO: 150863 - DNA, 20 bp, Artificial
  CRISPR gRNA sequence
gcaggaggatcacttgagtc

SEQ ID NO: 150864 - DNA, 20 bp, Artificial
  CRISPR gRNA sequence
caggaggatcacttgagtcc

SEQ ID NO: 150865 - DNA, 20 bp, Artificial
  CRISPR gRNA sequence
ggaggatcacttgagtccag

SEQ ID NO: 150866 - DNA, 20 bp, Artificial
  CRISPR gRNA sequence
tcacttgagtccaggagttt

SEQ ID NO: 150867 - DNA, 20 bp, Artificial
  CRISPR gRNA sequence
tgagtccaggagtttgagat

SEQ ID NO: 150868 - DNA, 20 bp, Artificial
  CRISPR gRNA sequence
ccaggagtttgagatcagcc

SEQ ID NO: 150869 - DNA, 20 bp, Artificial
  CRISPR gRNA sequence
caggagtttgagatcagcct

SEQ ID NO: 150870 - DNA, 20 bp, Artificial
  CRISPR gRNA sequence
atcagcctgggcaacaaatc

SEQ ID NO: 150871 - DNA, 20 bp, Artificial
  CRISPR gRNA sequence
ataaataaataaaaaaaaat

SEQ ID NO: 150872 - DNA, 20 bp, Artificial
  CRISPR gRNA sequence
ataaataaaaaaaaattagt

SEQ ID NO: 150873 - DNA, 20 bp, Artificial
  CRISPR gRNA sequence
taaataaaaaaaaattagtt

SEQ ID NO: 150874 - DNA, 20 bp, Artificial
  CRISPR gRNA sequence
aaaaaaaaattagttgggca

SEQ ID NO: 150875 - DNA, 20 bp, Artificial
  CRISPR gRNA sequence
aaaaaattagttgggcacgg

SEQ ID NO: 150876 - DNA, 20 bp, Artificial
  CRISPR gRNA sequence
ggcacggtggcacatgcctg

SEQ ID NO: 150877 - DNA, 20 bp, Artificial
  CRISPR gRNA sequence
gtggcacatgcctgtagtcc

SEQ ID NO: 150878 - DNA, 20 bp, Artificial
  CRISPR gRNA sequence
tgcctgtagtcccagctact

SEQ ID NO: 150879 - DNA, 20 bp, Artificial
  CRISPR gRNA sequence
gcctgtagtcccagctactc

SEQ ID NO: 150880 - DNA, 20 bp, Artificial
  CRISPR gRNA sequence
ctgtagtcccagctactcag

SEQ ID NO: 150881 - DNA, 20 bp, Artificial
  CRISPR gRNA sequence
tgtagtcccagctactcagg

SEQ ID NO: 150882 - DNA, 20 bp, Artificial
  CRISPR gRNA sequence
cccagctactcaggaggctg

SEQ ID NO: 150883 - DNA, 20 bp, Artificial
  CRISPR gRNA sequence
agctactcaggaggctgaag

SEQ ID NO: 150884 - DNA, 20 bp, Artificial
  CRISPR gRNA sequence
gctactcaggaggctgaagt

SEQ ID NO: 150885 - DNA, 20 bp, Artificial
  CRISPR gRNA sequence
tactcaggaggctgaagtag

SEQ ID NO: 150886 - DNA, 20 bp, Artificial
  CRISPR gRNA sequence
actcaggaggctgaagtagg

SEQ ID NO: 150887 - DNA, 20 bp, Artificial
  CRISPR gRNA sequence
ctgaagtaggaggattgctt

SEQ ID NO: 150888 - DNA, 20 bp, Artificial
  CRISPR gRNA sequence
gtaggaggattgcttgagcc

SEQ ID NO: 150889 - DNA, 20 bp, Artificial
  CRISPR gRNA sequence
taggaggattgcttgagccc

SEQ ID NO: 150890 - DNA, 20 bp, Artificial
  CRISPR gRNA sequence
ggaggattgcttgagcccag

SEQ ID NO: 150891 - DNA, 20 bp, Artificial
  CRISPR gRNA sequence
gaggattgcttgagcccagg

SEQ ID NO: 150892 - DNA, 20 bp, Artificial
  CRISPR gRNA sequence
gattgcttgagcccaggagg

SEQ ID NO: 150893 - DNA, 20 bp, Artificial
  CRISPR gRNA sequence
ttgcttgagcccaggaggtg

SEQ ID NO: 150894 - DNA, 20 bp, Artificial
  CRISPR gRNA sequence
tgcttgagcccaggaggtgg

SEQ ID NO: 150895 - DNA, 20 bp, Artificial
  CRISPR gRNA sequence
agcccaggaggtggaggctg

SEQ ID NO: 150896 - DNA, 20 bp, Artificial
  CRISPR gRNA sequence
caggaggtggaggctgcagt

SEQ ID NO: 150897 - DNA, 20 bp, Artificial
  CRISPR gRNA sequence
agtgagtcatgatcatgcca

SEQ ID NO: 150898 - DNA, 20 bp, Artificial
  CRISPR gRNA sequence
atgatcatgccacggcactc

SEQ ID NO: 150899 - DNA, 20 bp, Artificial
  CRISPR gRNA sequence
catgccacggcactccagcc

SEQ ID NO: 150900 - DNA, 20 bp, Artificial
  CRISPR gRNA sequence
ggcactccagcctggcacac

SEQ ID NO: 150901 - DNA, 20 bp, Artificial
  CRISPR gRNA sequence
ccagcctggcacaccagcct

SEQ ID NO: 150902 - DNA, 20 bp, Artificial
  CRISPR gRNA sequence
tggcacaccagccttggcaa

SEQ ID NO: 150903 - DNA, 20 bp, Artificial
  CRISPR gRNA sequence
gcacaccagccttggcaaca

SEQ ID NO: 150904 - DNA, 20 bp, Artificial
  CRISPR gRNA sequence
accagccttggcaacagagc

SEQ ID NO: 150905 - DNA, 20 bp, Artificial
  CRISPR gRNA sequence
aaaaaaaaaaaaaaaaaaaa

SEQ ID NO: 150906 - DNA, 20 bp, Artificial
  CRISPR gRNA sequence
aaaaaaaaaaaaaaaaaaaa

SEQ ID NO: 150907 - DNA, 20 bp, Artificial
  CRISPR gRNA sequence
acatttacttgcttactata

SEQ ID NO: 150908 - DNA, 20 bp, Artificial
  CRISPR gRNA sequence
tttacttgcttactatacag

SEQ ID NO: 150909 - DNA, 20 bp, Artificial
  CRISPR gRNA sequence
ttacttgcttactatacagc

SEQ ID NO: 150910 - DNA, 20 bp, Artificial
  CRISPR gRNA sequence
ctcccatgcttgaaaattga

SEQ ID NO: 150911 - DNA, 20 bp, Artificial
  CRISPR gRNA sequence
tcccatgcttgaaaattgac

SEQ ID NO: 150912 - DNA, 20 bp, Artificial
  CRISPR gRNA sequence
aaattgacaggataatcaca

SEQ ID NO: 150913 - DNA, 20 bp, Artificial
  CRISPR gRNA sequence
aaagcaaacaaaaaaaaaaa

SEQ ID NO: 150914 - DNA, 20 bp, Artificial
  CRISPR gRNA sequence
aacaaaaaaaaaaatggttc

SEQ ID NO: 150915 - DNA, 20 bp, Artificial
  CRISPR gRNA sequence
cagtttactttataaatatt

SEQ ID NO: 150916 - DNA, 20 bp, Artificial
  CRISPR gRNA sequence
ctaaatatgtaacctctgct

SEQ ID NO: 150917 - DNA, 20 bp, Artificial
  CRISPR gRNA sequence
tgcaaatctcataatgcaaa

SEQ ID NO: 150918 - DNA, 20 bp, Artificial
  CRISPR gRNA sequence
atctcataatgcaaatggaa

SEQ ID NO: 150919 - DNA, 20 bp, Artificial
  CRISPR gRNA sequence
tctcataatgcaaatggaac

SEQ ID NO: 150920 - DNA, 20 bp, Artificial
  CRISPR gRNA sequence
atgcaaatggaacaggcttc

SEQ ID NO: 150921 - DNA, 20 bp, Artificial
  CRISPR gRNA sequence
aggcttccagattttattct

SEQ ID NO: 150922 - DNA, 20 bp, Artificial
  CRISPR gRNA sequence
gcttccagattttattctga

SEQ ID NO: 150923 - DNA, 20 bp, Artificial
  CRISPR gRNA sequence
cttccagattttattctgag

SEQ ID NO: 150924 - DNA, 20 bp, Artificial
  CRISPR gRNA sequence
gagaggttcctaaatctaac

SEQ ID NO: 150925 - DNA, 20 bp, Artificial
  CRISPR gRNA sequence
gaggttcctaaatctaacaa

SEQ ID NO: 150926 - DNA, 20 bp, Artificial
  CRISPR gRNA sequence
aacaagagttttttaaaaat

SEQ ID NO: 150927 - DNA, 20 bp, Artificial
  CRISPR gRNA sequence
tacccatttcatcctattct

SEQ ID NO: 150928 - DNA, 20 bp, Artificial
  CRISPR gRNA sequence
cccatttcatcctattctga

SEQ ID NO: 150929 - DNA, 20 bp, Artificial
  CRISPR gRNA sequence
ccatttcatcctattctgag

SEQ ID NO: 150930 - DNA, 20 bp, Artificial
  CRISPR gRNA sequence
gaggtccttaaattttgaca

SEQ ID NO: 150931 - DNA, 20 bp, Artificial
  CRISPR gRNA sequence
aggtccttaaattttgacaa

SEQ ID NO: 150932 - DNA, 20 bp, Artificial
  CRISPR gRNA sequence
ggtccttaaattttgacaaa

SEQ ID NO: 150933 - DNA, 20 bp, Artificial
  CRISPR gRNA sequence
gtccttaaattttgacaaag

SEQ ID NO: 150934 - DNA, 20 bp, Artificial
  CRISPR gRNA sequence
aggggttaaaattctttcac

SEQ ID NO: 150935 - DNA, 20 bp, Artificial
  CRISPR gRNA sequence
ggggttaaaattctttcaca

SEQ ID NO: 150936 - DNA, 20 bp, Artificial
  CRISPR gRNA sequence
tctttcacaaggatcttgat

SEQ ID NO: 150937 - DNA, 20 bp, Artificial
  CRISPR gRNA sequence
cacaaggatcttgatgagta

SEQ ID NO: 150938 - DNA, 20 bp, Artificial
  CRISPR gRNA sequence
acaaggatcttgatgagtaa

SEQ ID NO: 150939 - DNA, 20 bp, Artificial
  CRISPR gRNA sequence
gatcttgatgagtaaaggac

SEQ ID NO: 150940 - DNA, 20 bp, Artificial
  CRISPR gRNA sequence
cttgatgagtaaaggactgg

SEQ ID NO: 150941 - DNA, 20 bp, Artificial
  CRISPR gRNA sequence
caacatatgcattaaataaa

SEQ ID NO: 150942 - DNA, 20 bp, Artificial
  CRISPR gRNA sequence
aacatatgcattaaataaat

SEQ ID NO: 150943 - DNA, 20 bp, Artificial
  CRISPR gRNA sequence
acatatgcattaaataaata

SEQ ID NO: 150944 - DNA, 20 bp, Artificial
  CRISPR gRNA sequence
ttaaataaatagggtcatgt

SEQ ID NO: 150945 - DNA, 20 bp, Artificial
  CRISPR gRNA sequence
tagggtcatgtcagcataaa

SEQ ID NO: 150946 - DNA, 20 bp, Artificial
  CRISPR gRNA sequence
agggtcatgtcagcataaat

SEQ ID NO: 150947 - DNA, 20 bp, Artificial
  CRISPR gRNA sequence
tcagcataaataggaatatg

SEQ ID NO: 150948 - DNA, 20 bp, Artificial
  CRISPR gRNA sequence
cagcataaataggaatatgc

SEQ ID NO: 150949 - DNA, 20 bp, Artificial
  CRISPR gRNA sequence
taaataggaatatgcaggtg

SEQ ID NO: 150950 - DNA, 20 bp, Artificial
  CRISPR gRNA sequence
aaataggaatatgcaggtga

SEQ ID NO: 150951 - DNA, 20 bp, Artificial
  CRISPR gRNA sequence
taggaatatgcaggtgaagg

SEQ ID NO: 150952 - DNA, 20 bp, Artificial
  CRISPR gRNA sequence
gcaggtgaaggcagtttaaa

SEQ ID NO: 150953 - DNA, 20 bp, Artificial
  CRISPR gRNA sequence
cagtttaaaaagaaatgtgt

SEQ ID NO: 150954 - DNA, 20 bp, Artificial
  CRISPR gRNA sequence
agtttaaaaagaaatgtgtc

SEQ ID NO: 150955 - DNA, 20 bp, Artificial
  CRISPR gRNA sequence
ttttacaaatattaaaatac

SEQ ID NO: 150956 - DNA, 20 bp, Artificial
  CRISPR gRNA sequence
taaacgtttcatcccccaaa

SEQ ID NO: 150957 - DNA, 20 bp, Artificial
  CRISPR gRNA sequence
gtttcatcccccaaatagtc

SEQ ID NO: 150958 - DNA, 20 bp, Artificial
  CRISPR gRNA sequence
atcccccaaatagtctggat

SEQ ID NO: 150959 - DNA, 20 bp, Artificial
  CRISPR gRNA sequence
tagtaacaactaatattatg

SEQ ID NO: 150960 - DNA, 20 bp, Artificial
  CRISPR gRNA sequence
gtagctcttcacaatttgca

SEQ ID NO: 150961 - DNA, 20 bp, Artificial
  CRISPR gRNA sequence
tgacacacatgatctcattc

SEQ ID NO: 150962 - DNA, 20 bp, Artificial
  CRISPR gRNA sequence
ttcaagactcgccactaaat

SEQ ID NO: 150963 - DNA, 20 bp, Artificial
  CRISPR gRNA sequence
actaaatcagacactatttt

SEQ ID NO: 150964 - DNA, 20 bp, Artificial
  CRISPR gRNA sequence
ctaaatcagacactattttt

SEQ ID NO: 150965 - DNA, 20 bp, Artificial
  CRISPR gRNA sequence
taggttccatttttacatgt

SEQ ID NO: 150966 - DNA, 20 bp, Artificial
  CRISPR gRNA sequence
aggttccatttttacatgtg

SEQ ID NO: 150967 - DNA, 20 bp, Artificial
  CRISPR gRNA sequence
ttccatttttacatgtgagg

SEQ ID NO: 150968 - DNA, 20 bp, Artificial
  CRISPR gRNA sequence
gtgaggaagctaacactaaa

SEQ ID NO: 150969 - DNA, 20 bp, Artificial
  CRISPR gRNA sequence
ctgacttgcccaaacctaca

SEQ ID NO: 150970 - DNA, 20 bp, Artificial
  CRISPR gRNA sequence
cttgcccaaacctacaaagc

SEQ ID NO: 150971 - DNA, 20 bp, Artificial
  CRISPR gRNA sequence
aacctacaaagctggtgata

SEQ ID NO: 150972 - DNA, 20 bp, Artificial
  CRISPR gRNA sequence
acctacaaagctggtgataa

SEQ ID NO: 150973 - DNA, 20 bp, Artificial
  CRISPR gRNA sequence
acaaagctggtgataaaggt

SEQ ID NO: 150974 - DNA, 20 bp, Artificial
  CRISPR gRNA sequence
aagctggtgataaaggtgag

SEQ ID NO: 150975 - DNA, 20 bp, Artificial
  CRISPR gRNA sequence
agctggtgataaaggtgagt

SEQ ID NO: 150976 - DNA, 20 bp, Artificial
  CRISPR gRNA sequence
gctggtgataaaggtgagtg

SEQ ID NO: 150977 - DNA, 20 bp, Artificial
  CRISPR gRNA sequence
aggtgagtggggcttgaaca

SEQ ID NO: 150978 - DNA, 20 bp, Artificial
  CRISPR gRNA sequence
acagatctcttgactttaaa

SEQ ID NO: 150979 - DNA, 20 bp, Artificial
  CRISPR gRNA sequence
gctgcctcaaatactgtgat

SEQ ID NO: 150980 - DNA, 20 bp, Artificial
  CRISPR gRNA sequence
tgcctcaaatactgtgatca

SEQ ID NO: 150981 - DNA, 20 bp, Artificial
  CRISPR gRNA sequence
taaataaatgtccatatctc

SEQ ID NO: 150982 - DNA, 20 bp, Artificial
  CRISPR gRNA sequence
catatctctagaccccatct

SEQ ID NO: 150983 - DNA, 20 bp, Artificial
  CRISPR gRNA sequence
gcctcccccacttacacaca

SEQ ID NO: 150984 - DNA, 20 bp, Artificial
  CRISPR gRNA sequence
cttacacacacagccaccca

SEQ ID NO: 150985 - DNA, 20 bp, Artificial
  CRISPR gRNA sequence
cagccacccatggcctaaat

SEQ ID NO: 150986 - DNA, 20 bp, Artificial
  CRISPR gRNA sequence
gccacccatggcctaaatta

SEQ ID NO: 150987 - DNA, 20 bp, Artificial
  CRISPR gRNA sequence
cccatggcctaaattagagt

SEQ ID NO: 150988 - DNA, 20 bp, Artificial
  CRISPR gRNA sequence
ctaaattagagttagctctc

SEQ ID NO: 150989 - DNA, 20 bp, Artificial
  CRISPR gRNA sequence
aattagagttagctctctag

SEQ ID NO: 150990 - DNA, 20 bp, Artificial
  CRISPR gRNA sequence
attagagttagctctctaga

SEQ ID NO: 150991 - DNA, 20 bp, Artificial
  CRISPR gRNA sequence
tagaaggtctttgctctttc

SEQ ID NO: 150992 - DNA, 20 bp, Artificial
  CRISPR gRNA sequence
aaggtctttgctctttctgg

SEQ ID NO: 150993 - DNA, 20 bp, Artificial
  CRISPR gRNA sequence
ctttgctctttctggaagca

SEQ ID NO: 150994 - DNA, 20 bp, Artificial
  CRISPR gRNA sequence
caaagttttcttcatttgtc

SEQ ID NO: 150995 - DNA, 20 bp, Artificial
  CRISPR gRNA sequence
ttgtctagtaaacatttatc

SEQ ID NO: 150996 - DNA, 20 bp, Artificial
  CRISPR gRNA sequence
agtaaacatttatctggctg

SEQ ID NO: 150997 - DNA, 20 bp, Artificial
  CRISPR gRNA sequence
acatacactaaaaaataact

SEQ ID NO: 150998 - DNA, 20 bp, Artificial
  CRISPR gRNA sequence
aaaaaataacttagtcatca

SEQ ID NO: 150999 - DNA, 20 bp, Artificial
  CRISPR gRNA sequence
aaaaataacttagtcatcaa

SEQ ID NO: 151000 - DNA, 20 bp, Artificial
  CRISPR gRNA sequence
tagtcatcaaaggttttgta

SEQ ID NO: 151001 - DNA, 20 bp, Artificial
  CRISPR gRNA sequence
agtcatcaaaggttttgtac

SEQ ID NO: 151002 - DNA, 20 bp, Artificial
  CRISPR gRNA sequence
catgcccatgtgcatttttc

SEQ ID NO: 151003 - DNA, 20 bp, Artificial
  CRISPR gRNA sequence
atgcccatgtgcatttttcc

SEQ ID NO: 151004 - DNA, 20 bp, Artificial
  CRISPR gRNA sequence
cccatgtgcatttttccagg

SEQ ID NO: 151005 - DNA, 20 bp, Artificial
  CRISPR gRNA sequence
atgtgcatttttccaggtag

SEQ ID NO: 151006 - DNA, 20 bp, Artificial
  CRISPR gRNA sequence
tgtgcatttttccaggtagt

SEQ ID NO: 151007 - DNA, 20 bp, Artificial
  CRISPR gRNA sequence
caggtagtgggtcattctca

SEQ ID NO: 151008 - DNA, 20 bp, Artificial
  CRISPR gRNA sequence
ggtagtgggtcattctcaaa

SEQ ID NO: 151009 - DNA, 20 bp, Artificial
  CRISPR gRNA sequence
tgggtcattctcaaagagaa

SEQ ID NO: 151010 - DNA, 20 bp, Artificial
  CRISPR gRNA sequence
cattctcaaagagaatggtg

SEQ ID NO: 151011 - DNA, 20 bp, Artificial
  CRISPR gRNA sequence
aagagaatggtgaagaacct

SEQ ID NO: 151012 - DNA, 20 bp, Artificial
  CRISPR gRNA sequence
gaatggtgaagaacctcggc

SEQ ID NO: 151013 - DNA, 20 bp, Artificial
  CRISPR gRNA sequence
atggtgaagaacctcggcta

SEQ ID NO: 151014 - DNA, 20 bp, Artificial
  CRISPR gRNA sequence
tggtgaagaacctcggctag

SEQ ID NO: 151015 - DNA, 20 bp, Artificial
  CRISPR gRNA sequence
tgaagaacctcggctagagg

SEQ ID NO: 151016 - DNA, 20 bp, Artificial
  CRISPR gRNA sequence
cctcggctagaggcagtgac

SEQ ID NO: 151017 - DNA, 20 bp, Artificial
  CRISPR gRNA sequence
ctcggctagaggcagtgact

SEQ ID NO: 151018 - DNA, 20 bp, Artificial
  CRISPR gRNA sequence
cagtgactgggcatctttcc

SEQ ID NO: 151019 - DNA, 20 bp, Artificial
  CRISPR gRNA sequence
tgactgggcatctttccaag

SEQ ID NO: 151020 - DNA, 20 bp, Artificial
  CRISPR gRNA sequence
tccaagaagccaaatccaca

SEQ ID NO: 151021 - DNA, 20 bp, Artificial
  CRISPR gRNA sequence
gccaaatccacaaagttctc

SEQ ID NO: 151022 - DNA, 20 bp, Artificial
  CRISPR gRNA sequence
ccacaaagttctcaagttta

SEQ ID NO: 151023 - DNA, 20 bp, Artificial
  CRISPR gRNA sequence
cacttttgcctcccctgctg

SEQ ID NO: 151024 - DNA, 20 bp, Artificial
  CRISPR gRNA sequence
acttttgcctcccctgctgc

SEQ ID NO: 151025 - DNA, 20 bp, Artificial
  CRISPR gRNA sequence
ccctgctgcaggccttctcc

SEQ ID NO: 151026 - DNA, 20 bp, Artificial
  CRISPR gRNA sequence
cctgctgcaggccttctcct

SEQ ID NO: 151027 - DNA, 20 bp, Artificial
  CRISPR gRNA sequence
ctgctgcaggccttctccta

SEQ ID NO: 151028 - DNA, 20 bp, Artificial
  CRISPR gRNA sequence
aggccttctcctagggccaa

SEQ ID NO: 151029 - DNA, 20 bp, Artificial
  CRISPR gRNA sequence
ggccttctcctagggccaac

SEQ ID NO: 151030 - DNA, 20 bp, Artificial
  CRISPR gRNA sequence
gccttctcctagggccaaca

SEQ ID NO: 151031 - DNA, 20 bp, Artificial
  CRISPR gRNA sequence
ctcctagggccaacagggtc

SEQ ID NO: 151032 - DNA, 20 bp, Artificial
  CRISPR gRNA sequence
tagggccaacagggtcaagt

SEQ ID NO: 151033 - DNA, 20 bp, Artificial
  CRISPR gRNA sequence
ttaaaatcatatatataatc

SEQ ID NO: 151034 - DNA, 20 bp, Artificial
  CRISPR gRNA sequence
taacacatacttcttcatct

SEQ ID NO: 151035 - DNA, 20 bp, Artificial
  CRISPR gRNA sequence
aacacatacttcttcatctt

SEQ ID NO: 151036 - DNA, 20 bp, Artificial
  CRISPR gRNA sequence
catcttaggacttaaattcc

SEQ ID NO: 151037 - DNA, 20 bp, Artificial
  CRISPR gRNA sequence
aatgaacattttcttattat

SEQ ID NO: 151038 - DNA, 20 bp, Artificial
  CRISPR gRNA sequence
tactatctatccccttcact

SEQ ID NO: 151039 - DNA, 20 bp, Artificial
  CRISPR gRNA sequence
ccccttcactaagaaccctc

SEQ ID NO: 151040 - DNA, 20 bp, Artificial
  CRISPR gRNA sequence
taagaaccctctagattaca

SEQ ID NO: 151041 - DNA, 20 bp, Artificial
  CRISPR gRNA sequence
gaaccctctagattacaaag

SEQ ID NO: 151042 - DNA, 20 bp, Artificial
  CRISPR gRNA sequence
ctctagattacaaagaagac

SEQ ID NO: 151043 - DNA, 20 bp, Artificial
  CRISPR gRNA sequence
tctagattacaaagaagaca

SEQ ID NO: 151044 - DNA, 20 bp, Artificial
  CRISPR gRNA sequence
agattacaaagaagacaagg

SEQ ID NO: 151045 - DNA, 20 bp, Artificial
  CRISPR gRNA sequence
aagaagacaaggtagcatgc

SEQ ID NO: 151046 - DNA, 20 bp, Artificial
  CRISPR gRNA sequence
agaagacaaggtagcatgca

SEQ ID NO: 151047 - DNA, 20 bp, Artificial
  CRISPR gRNA sequence
gcaaggaattctgaatctgt

SEQ ID NO: 151048 - DNA, 20 bp, Artificial
  CRISPR gRNA sequence
caaggaattctgaatctgtt

SEQ ID NO: 151049 - DNA, 20 bp, Artificial
  CRISPR gRNA sequence
ggaattctgaatctgttagg

SEQ ID NO: 151050 - DNA, 20 bp, Artificial
  CRISPR gRNA sequence
aatctgttaggcagttcact

SEQ ID NO: 151051 - DNA, 20 bp, Artificial
  CRISPR gRNA sequence
tcactcagctatcataccaa

SEQ ID NO: 151052 - DNA, 20 bp, Artificial
  CRISPR gRNA sequence
gctatcataccaaaagaatt

SEQ ID NO: 151053 - DNA, 20 bp, Artificial
  CRISPR gRNA sequence
aagaatttagaattttttgc

SEQ ID NO: 151054 - DNA, 20 bp, Artificial
  CRISPR gRNA sequence
agaatttagaattttttgct

SEQ ID NO: 151055 - DNA, 20 bp, Artificial
  CRISPR gRNA sequence
gaatttagaattttttgctg

SEQ ID NO: 151056 - DNA, 20 bp, Artificial
  CRISPR gRNA sequence
aatttagaattttttgctgg

SEQ ID NO: 151057 - DNA, 20 bp, Artificial
  CRISPR gRNA sequence
atttagaattttttgctggg

SEQ ID NO: 151058 - DNA, 20 bp, Artificial
  CRISPR gRNA sequence
ttagaattttttgctggggg

SEQ ID NO: 151059 - DNA, 20 bp, Artificial
  CRISPR gRNA sequence
tagaattttttgctgggggg

SEQ ID NO: 151060 - DNA, 20 bp, Artificial
  CRISPR gRNA sequence
agaattttttgctgggggga

SEQ ID NO: 151061 - DNA, 20 bp, Artificial
  CRISPR gRNA sequence
attttttgctggggggaggg

SEQ ID NO: 151062 - DNA, 20 bp, Artificial
  CRISPR gRNA sequence
gctggggggagggaagtaaa

SEQ ID NO: 151063 - DNA, 20 bp, Artificial
  CRISPR gRNA sequence
tggggggagggaagtaaaaa

SEQ ID NO: 151064 - DNA, 20 bp, Artificial
  CRISPR gRNA sequence
ggggagggaagtaaaaagag

SEQ ID NO: 151065 - DNA, 20 bp, Artificial
  CRISPR gRNA sequence
gggagggaagtaaaaagagt

SEQ ID NO: 151066 - DNA, 20 bp, Artificial
  CRISPR gRNA sequence
gagggaagtaaaaagagtgg

SEQ ID NO: 151067 - DNA, 20 bp, Artificial
  CRISPR gRNA sequence
gggaagtaaaaagagtggga

SEQ ID NO: 151068 - DNA, 20 bp, Artificial
  CRISPR gRNA sequence
gaagtaaaaagagtgggaga

SEQ ID NO: 151069 - DNA, 20 bp, Artificial
  CRISPR gRNA sequence
agtgggagagagaatgaatg

SEQ ID NO: 151070 - DNA, 20 bp, Artificial
  CRISPR gRNA sequence
taaccactcgacttgaatat

SEQ ID NO: 151071 - DNA, 20 bp, Artificial
  CRISPR gRNA sequence
ccactcgacttgaatatcag

SEQ ID NO: 151072 - DNA, 20 bp, Artificial
  CRISPR gRNA sequence
cgacttgaatatcagaagta

SEQ ID NO: 151073 - DNA, 20 bp, Artificial
  CRISPR gRNA sequence
cagtctcttttcatcttaaa

SEQ ID NO: 151074 - DNA, 20 bp, Artificial
  CRISPR gRNA sequence
gtctcttttcatcttaaata

SEQ ID NO: 151075 - DNA, 20 bp, Artificial
  CRISPR gRNA sequence
tcatcttaaatagagctttt

SEQ ID NO: 151076 - DNA, 20 bp, Artificial
  CRISPR gRNA sequence
ccttcaatctttcaactccc

SEQ ID NO: 151077 - DNA, 20 bp, Artificial
  CRISPR gRNA sequence
tcaatctttcaactccccag

SEQ ID NO: 151078 - DNA, 20 bp, Artificial
  CRISPR gRNA sequence
caactccccagcagtttttc

SEQ ID NO: 151079 - DNA, 20 bp, Artificial
  CRISPR gRNA sequence
aactccccagcagtttttca

SEQ ID NO: 151080 - DNA, 20 bp, Artificial
  CRISPR gRNA sequence
tttttcaaggtcacttttgc

SEQ ID NO: 151081 - DNA, 20 bp, Artificial
  CRISPR gRNA sequence
gtcacttttgcaagcaacga

SEQ ID NO: 151082 - DNA, 20 bp, Artificial
  CRISPR gRNA sequence
cacttttgcaagcaacgaca

SEQ ID NO: 151083 - DNA, 20 bp, Artificial
  CRISPR gRNA sequence
acttttgcaagcaacgacag

SEQ ID NO: 151084 - DNA, 20 bp, Artificial
  CRISPR gRNA sequence
caacgacagaggcctgcatc

SEQ ID NO: 151085 - DNA, 20 bp, Artificial
  CRISPR gRNA sequence
aacgacagaggcctgcatcc

SEQ ID NO: 151086 - DNA, 20 bp, Artificial
  CRISPR gRNA sequence
tgctatatcattacaactcc

SEQ ID NO: 151087 - DNA, 20 bp, Artificial
  CRISPR gRNA sequence
ctatatcattacaactccaa

SEQ ID NO: 151088 - DNA, 20 bp, Artificial
  CRISPR gRNA sequence
gccccgaatctaaatcctat

SEQ ID NO: 151089 - DNA, 20 bp, Artificial
  CRISPR gRNA sequence
ctaaatcctatcagtcctct

SEQ ID NO: 151090 - DNA, 20 bp, Artificial
  CRISPR gRNA sequence
taaatcctatcagtcctcta

SEQ ID NO: 151091 - DNA, 20 bp, Artificial
  CRISPR gRNA sequence
ctctaaggtaaatcctttat

SEQ ID NO: 151092 - DNA, 20 bp, Artificial
  CRISPR gRNA sequence
ctaaggtaaatcctttatta

SEQ ID NO: 151093 - DNA, 20 bp, Artificial
  CRISPR gRNA sequence
taaggtaaatcctttattag

SEQ ID NO: 151094 - DNA, 20 bp, Artificial
  CRISPR gRNA sequence
aaggtaaatcctttattaga

SEQ ID NO: 151095 - DNA, 20 bp, Artificial
  CRISPR gRNA sequence
aggtaaatcctttattagag

SEQ ID NO: 151096 - DNA, 20 bp, Artificial
  CRISPR gRNA sequence
taaatcctttattagagggg

SEQ ID NO: 151097 - DNA, 20 bp, Artificial
  CRISPR gRNA sequence
tcctttattagaggggaagc

SEQ ID NO: 151098 - DNA, 20 bp, Artificial
  CRISPR gRNA sequence
cctttattagaggggaagct

SEQ ID NO: 151099 - DNA, 20 bp, Artificial
  CRISPR gRNA sequence
ctttattagaggggaagcta

SEQ ID NO: 151100 - DNA, 20 bp, Artificial
  CRISPR gRNA sequence
tattagaggggaagctaggg

SEQ ID NO: 151101 - DNA, 20 bp, Artificial
  CRISPR gRNA sequence
attagaggggaagctaggga

SEQ ID NO: 151102 - DNA, 20 bp, Artificial
  CRISPR gRNA sequence
cctcgaaacttctcctctaa

SEQ ID NO: 151103 - DNA, 20 bp, Artificial
  CRISPR gRNA sequence
ctcgaaacttctcctctaat

SEQ ID NO: 151104 - DNA, 20 bp, Artificial
  CRISPR gRNA sequence
tcgaaacttctcctctaata

SEQ ID NO: 151105 - DNA, 20 bp, Artificial
  CRISPR gRNA sequence
gcctgctccttttccgtacc

SEQ ID NO: 151106 - DNA, 20 bp, Artificial
  CRISPR gRNA sequence
ctgctccttttccgtaccca

SEQ ID NO: 151107 - DNA, 20 bp, Artificial
  CRISPR gRNA sequence
cttttccgtacccagagact

SEQ ID NO: 151108 - DNA, 20 bp, Artificial
  CRISPR gRNA sequence
acccagagactaagtgctgc

SEQ ID NO: 151109 - DNA, 20 bp, Artificial
  CRISPR gRNA sequence
gactaagtgctgctggctga

SEQ ID NO: 151110 - DNA, 20 bp, Artificial
  CRISPR gRNA sequence
ctggctgacggctccacact

SEQ ID NO: 151111 - DNA, 20 bp, Artificial
  CRISPR gRNA sequence
gctccacactgagtctgctg

SEQ ID NO: 151112 - DNA, 20 bp, Artificial
  CRISPR gRNA sequence
attccatatttgcaaataaa

SEQ ID NO: 151113 - DNA, 20 bp, Artificial
  CRISPR gRNA sequence
ttgcaaataaaaagaaaaca

SEQ ID NO: 151114 - DNA, 20 bp, Artificial
  CRISPR gRNA sequence
aaagaattgcattttaaaat

SEQ ID NO: 151115 - DNA, 20 bp, Artificial
  CRISPR gRNA sequence
aagaattgcattttaaaatc

SEQ ID NO: 151116 - DNA, 20 bp, Artificial
  CRISPR gRNA sequence
ttttaaaatcaggtgtatta

SEQ ID NO: 151117 - DNA, 20 bp, Artificial
  CRISPR gRNA sequence
atcaggtgtattatagatct

SEQ ID NO: 151118 - DNA, 20 bp, Artificial
  CRISPR gRNA sequence
gtattatagatcttagtatg

SEQ ID NO: 151119 - DNA, 20 bp, Artificial
  CRISPR gRNA sequence
tattatagatcttagtatgt

SEQ ID NO: 151120 - DNA, 20 bp, Artificial
  CRISPR gRNA sequence
gatcttagtatgtgggattg

SEQ ID NO: 151121 - DNA, 20 bp, Artificial
  CRISPR gRNA sequence
ttgaagatttcactgttcat

SEQ ID NO: 151122 - DNA, 20 bp, Artificial
  CRISPR gRNA sequence
atttcactgttcatgagaac

SEQ ID NO: 151123 - DNA, 20 bp, Artificial
  CRISPR gRNA sequence
cactgttcatgagaactggc

SEQ ID NO: 151124 - DNA, 20 bp, Artificial
  CRISPR gRNA sequence
agaactggctggttactgat

SEQ ID NO: 151125 - DNA, 20 bp, Artificial
  CRISPR gRNA sequence
tactgattagcaacctacat

SEQ ID NO: 151126 - DNA, 20 bp, Artificial
  CRISPR gRNA sequence
acattagctttatatccata

SEQ ID NO: 151127 - DNA, 20 bp, Artificial
  CRISPR gRNA sequence
attagctttatatccataaa

SEQ ID NO: 151128 - DNA, 20 bp, Artificial
  CRISPR gRNA sequence
gagaaaaatatatacatatc

SEQ ID NO: 151129 - DNA, 20 bp, Artificial
  CRISPR gRNA sequence
agaaaaatatatacatatca

SEQ ID NO: 151130 - DNA, 20 bp, Artificial
  CRISPR gRNA sequence
gaaaaatatatacatatcaa

SEQ ID NO: 151131 - DNA, 20 bp, Artificial
  CRISPR gRNA sequence
tatatacatatcaagggcaa

SEQ ID NO: 151132 - DNA, 20 bp, Artificial
  CRISPR gRNA sequence
tacatatcaagggcaaaaga

SEQ ID NO: 151133 - DNA, 20 bp, Artificial
  CRISPR gRNA sequence
acatatcaagggcaaaagat

SEQ ID NO: 151134 - DNA, 20 bp, Artificial
  CRISPR gRNA sequence
catatcaagggcaaaagata

SEQ ID NO: 151135 - DNA, 20 bp, Artificial
  CRISPR gRNA sequence
actttcctattcacaaactg

SEQ ID NO: 151136 - DNA, 20 bp, Artificial
  CRISPR gRNA sequence
ctttcctattcacaaactgc

SEQ ID NO: 151137 - DNA, 20 bp, Artificial
  CRISPR gRNA sequence
aggattttaaatatttaata

SEQ ID NO: 151138 - DNA, 20 bp, Artificial
  CRISPR gRNA sequence
aaatatttaatacggaaaaa

SEQ ID NO: 151139 - DNA, 20 bp, Artificial
  CRISPR gRNA sequence
atttaatacggaaaaatgga

SEQ ID NO: 151140 - DNA, 20 bp, Artificial
  CRISPR gRNA sequence
actttgctcacatcatttta

SEQ ID NO: 151141 - DNA, 20 bp, Artificial
  CRISPR gRNA sequence
gacaaaatgtgtgaaatctg

SEQ ID NO: 151142 - DNA, 20 bp, Artificial
  CRISPR gRNA sequence
ttgctcatcactgtcaatat

SEQ ID NO: 151143 - DNA, 20 bp, Artificial
  CRISPR gRNA sequence
catcactgtcaatataagtg

SEQ ID NO: 151144 - DNA, 20 bp, Artificial
  CRISPR gRNA sequence
taagtgaagatatttctaac

SEQ ID NO: 151145 - DNA, 20 bp, Artificial
  CRISPR gRNA sequence
atatttctaaccagcattct

SEQ ID NO: 151146 - DNA, 20 bp, Artificial
  CRISPR gRNA sequence
taaaatgtgcattaaaaaca

SEQ ID NO: 151147 - DNA, 20 bp, Artificial
  CRISPR gRNA sequence
ctacattaactactacttat

SEQ ID NO: 151148 - DNA, 20 bp, Artificial
  CRISPR gRNA sequence
aactactacttattagaatc

SEQ ID NO: 151149 - DNA, 20 bp, Artificial
  CRISPR gRNA sequence
ctactacttattagaatcta

SEQ ID NO: 151150 - DNA, 20 bp, Artificial
  CRISPR gRNA sequence
tactacttattagaatctag

SEQ ID NO: 151151 - DNA, 20 bp, Artificial
  CRISPR gRNA sequence
tacttattagaatctagagg

SEQ ID NO: 151152 - DNA, 20 bp, Artificial
  CRISPR gRNA sequence
attagaatctagaggtagac

SEQ ID NO: 151153 - DNA, 20 bp, Artificial
  CRISPR gRNA sequence
tagaggtagactggtaaatc

SEQ ID NO: 151154 - DNA, 20 bp, Artificial
  CRISPR gRNA sequence
ggtagactggtaaatcaaga

SEQ ID NO: 151155 - DNA, 20 bp, Artificial
  CRISPR gRNA sequence
ctggtaaatcaagaaagtta

SEQ ID NO: 151156 - DNA, 20 bp, Artificial
  CRISPR gRNA sequence
tggtaaatcaagaaagttat

SEQ ID NO: 151157 - DNA, 20 bp, Artificial
  CRISPR gRNA sequence
gttatgggaaaatttcacac

SEQ ID NO: 151158 - DNA, 20 bp, Artificial
  CRISPR gRNA sequence
gaaaatttcacactggcatg

SEQ ID NO: 151159 - DNA, 20 bp, Artificial
  CRISPR gRNA sequence
aaaatttcacactggcatgt

SEQ ID NO: 151160 - DNA, 20 bp, Artificial
  CRISPR gRNA sequence
ggcatgtgggccttcaccat

SEQ ID NO: 151161 - DNA, 20 bp, Artificial
  CRISPR gRNA sequence
gccttcaccattagaacctg

SEQ ID NO: 151162 - DNA, 20 bp, Artificial
  CRISPR gRNA sequence
ttcaccattagaacctgcag

SEQ ID NO: 151163 - DNA, 20 bp, Artificial
  CRISPR gRNA sequence
attttcacacaaatttctaa

SEQ ID NO: 151164 - DNA, 20 bp, Artificial
  CRISPR gRNA sequence
acacaaatttctaacagcaa

SEQ ID NO: 151165 - DNA, 20 bp, Artificial
  CRISPR gRNA sequence
tgcttccatatctgaaaaca

SEQ ID NO: 151166 - DNA, 20 bp, Artificial
  CRISPR gRNA sequence
tgaaaacacagatgtcaaca

SEQ ID NO: 151167 - DNA, 20 bp, Artificial
  CRISPR gRNA sequence
acagatgtcaacaaagtgca

SEQ ID NO: 151168 - DNA, 20 bp, Artificial
  CRISPR gRNA sequence
gtcaacaaagtgcatggaaa

SEQ ID NO: 151169 - DNA, 20 bp, Artificial
  CRISPR gRNA sequence
gaaaaactctcacaacaacc

SEQ ID NO: 151170 - DNA, 20 bp, Artificial
  CRISPR gRNA sequence
caacaacccagcttattccg

SEQ ID NO: 151171 - DNA, 20 bp, Artificial
  CRISPR gRNA sequence
aacaacccagcttattccgt

SEQ ID NO: 151172 - DNA, 20 bp, Artificial
  CRISPR gRNA sequence
acccagcttattccgtagga

SEQ ID NO: 151173 - DNA, 20 bp, Artificial
  CRISPR gRNA sequence
cttattccgtaggaaagctt

SEQ ID NO: 151174 - DNA, 20 bp, Artificial
  CRISPR gRNA sequence
ttattccgtaggaaagcttc

SEQ ID NO: 151175 - DNA, 20 bp, Artificial
  CRISPR gRNA sequence
tattccgtaggaaagcttca

SEQ ID NO: 151176 - DNA, 20 bp, Artificial
  CRISPR gRNA sequence
agcttcagggcacttgaaca

SEQ ID NO: 151177 - DNA, 20 bp, Artificial
  CRISPR gRNA sequence
gcttcagggcacttgaacaa

SEQ ID NO: 151178 - DNA, 20 bp, Artificial
  CRISPR gRNA sequence
ttgaacaaaggaaaattatt

SEQ ID NO: 151179 - DNA, 20 bp, Artificial
  CRISPR gRNA sequence
aaggaaaattatttggaaaa

SEQ ID NO: 151180 - DNA, 20 bp, Artificial
  CRISPR gRNA sequence
aaattatttggaaaacagtt

SEQ ID NO: 151181 - DNA, 20 bp, Artificial
  CRISPR gRNA sequence
agttaagtttacccaatgca

SEQ ID NO: 151182 - DNA, 20 bp, Artificial
  CRISPR gRNA sequence
ttaagtttacccaatgcaaa

SEQ ID NO: 151183 - DNA, 20 bp, Artificial
  CRISPR gRNA sequence
tttacccaatgcaaagagaa

SEQ ID NO: 151184 - DNA, 20 bp, Artificial
  CRISPR gRNA sequence
gtgtgcccctgaaaaatgat

SEQ ID NO: 151185 - DNA, 20 bp, Artificial
  CRISPR gRNA sequence
tgatcttgtcgatacccaac

SEQ ID NO: 151186 - DNA, 20 bp, Artificial
  CRISPR gRNA sequence
gatcttgtcgatacccaact

SEQ ID NO: 151187 - DNA, 20 bp, Artificial
  CRISPR gRNA sequence
ttgtcgatacccaactagga

SEQ ID NO: 151188 - DNA, 20 bp, Artificial
  CRISPR gRNA sequence
cccaactaggaaagaaatcc

SEQ ID NO: 151189 - DNA, 20 bp, Artificial
  CRISPR gRNA sequence
taggaaagaaatcctagttg

SEQ ID NO: 151190 - DNA, 20 bp, Artificial
  CRISPR gRNA sequence
aggaaagaaatcctagttga

SEQ ID NO: 151191 - DNA, 20 bp, Artificial
  CRISPR gRNA sequence
ggacatgcaaaatctaaaca

SEQ ID NO: 151192 - DNA, 20 bp, Artificial
  CRISPR gRNA sequence
atgcaaaatctaaacacagc

SEQ ID NO: 151193 - DNA, 20 bp, Artificial
  CRISPR gRNA sequence
tgcaaaatctaaacacagca

SEQ ID NO: 151194 - DNA, 20 bp, Artificial
  CRISPR gRNA sequence
ctaaacacagcaaggtattc

SEQ ID NO: 151195 - DNA, 20 bp, Artificial
  CRISPR gRNA sequence
taaacacagcaaggtattct

SEQ ID NO: 151196 - DNA, 20 bp, Artificial
  CRISPR gRNA sequence
aggtattctaggtgcaccaa

SEQ ID NO: 151197 - DNA, 20 bp, Artificial
  CRISPR gRNA sequence
ggtattctaggtgcaccaaa

SEQ ID NO: 151198 - DNA, 20 bp, Artificial
  CRISPR gRNA sequence
ggtgcaccaaaaggtatgca

SEQ ID NO: 151199 - DNA, 20 bp, Artificial
  CRISPR gRNA sequence
aaaggtatgcatggaatgta

SEQ ID NO: 151200 - DNA, 20 bp, Artificial
  CRISPR gRNA sequence
ggtatgcatggaatgtaaag

SEQ ID NO: 151201 - DNA, 20 bp, Artificial
  CRISPR gRNA sequence
taaagtggccattttctgaa

SEQ ID NO: 151202 - DNA, 20 bp, Artificial
  CRISPR gRNA sequence
caacttgtctacactctctg

SEQ ID NO: 151203 - DNA, 20 bp, Artificial
  CRISPR gRNA sequence
ctacactctctgaagctaaa

SEQ ID NO: 151204 - DNA, 20 bp, Artificial
  CRISPR gRNA sequence
tatcatttcaacacaaaaca

SEQ ID NO: 151205 - DNA, 20 bp, Artificial
  CRISPR gRNA sequence
aaacaaagaattaaacttac

SEQ ID NO: 151206 - DNA, 20 bp, Artificial
  CRISPR gRNA sequence
aacaaagaattaaacttacc

SEQ ID NO: 151207 - DNA, 20 bp, Artificial
  CRISPR gRNA sequence
aactgcattaattttacatg

SEQ ID NO: 151208 - DNA, 20 bp, Artificial
  CRISPR gRNA sequence
ttatttatacctccaccgac

SEQ ID NO: 151209 - DNA, 20 bp, Artificial
  CRISPR gRNA sequence
tatttatacctccaccgact

SEQ ID NO: 151210 - DNA, 20 bp, Artificial
  CRISPR gRNA sequence
tttatacctccaccgactgg

SEQ ID NO: 151211 - DNA, 20 bp, Artificial
  CRISPR gRNA sequence
tccaccgactgggagaattt

SEQ ID NO: 151212 - DNA, 20 bp, Artificial
  CRISPR gRNA sequence
actcctatccctacccccca

SEQ ID NO: 151213 - DNA, 20 bp, Artificial
  CRISPR gRNA sequence
ctcctatccctaccccccaa

SEQ ID NO: 151214 - DNA, 20 bp, Artificial
  CRISPR gRNA sequence
tatccctaccccccaaagga

SEQ ID NO: 151215 - DNA, 20 bp, Artificial
  CRISPR gRNA sequence
tccctaccccccaaaggacg

SEQ ID NO: 151216 - DNA, 20 bp, Artificial
  CRISPR gRNA sequence
ccctaccccccaaaggacgg

SEQ ID NO: 151217 - DNA, 20 bp, Artificial
  CRISPR gRNA sequence
ccaaaggacggaggaaacaa

SEQ ID NO: 151218 - DNA, 20 bp, Artificial
  CRISPR gRNA sequence
caaaggacggaggaaacaaa

SEQ ID NO: 151219 - DNA, 20 bp, Artificial
  CRISPR gRNA sequence
aggacggaggaaacaaaagg

SEQ ID NO: 151220 - DNA, 20 bp, Artificial
  CRISPR gRNA sequence
acggaggaaacaaaaggcag

SEQ ID NO: 151221 - DNA, 20 bp, Artificial
  CRISPR gRNA sequence
cggaggaaacaaaaggcagc

SEQ ID NO: 151222 - DNA, 20 bp, Artificial
  CRISPR gRNA sequence
gaggaaacaaaaggcagcag

SEQ ID NO: 151223 - DNA, 20 bp, Artificial
  CRISPR gRNA sequence
acaaaaggcagcaggagatg

SEQ ID NO: 151224 - DNA, 20 bp, Artificial
  CRISPR gRNA sequence
agcaggagatgcagaaacat

SEQ ID NO: 151225 - DNA, 20 bp, Artificial
  CRISPR gRNA sequence
gagatgcagaaacatgagtc

SEQ ID NO: 151226 - DNA, 20 bp, Artificial
  CRISPR gRNA sequence
cactccactgaaaacccgaa

SEQ ID NO: 151227 - DNA, 20 bp, Artificial
  CRISPR gRNA sequence
cgccatttttctttgtcttt

SEQ ID NO: 151228 - DNA, 20 bp, Artificial
  CRISPR gRNA sequence
ctttcagctgacccctgcct

SEQ ID NO: 151229 - DNA, 20 bp, Artificial
  CRISPR gRNA sequence
ctgcctcagtgaaaaactcc

SEQ ID NO: 151230 - DNA, 20 bp, Artificial
  CRISPR gRNA sequence
tgcctcagtgaaaaactccg

SEQ ID NO: 151231 - DNA, 20 bp, Artificial
  CRISPR gRNA sequence
aaaactccgaggctccaatg

SEQ ID NO: 151232 - DNA, 20 bp, Artificial
  CRISPR gRNA sequence
gaggctccaatgaagccctg

SEQ ID NO: 151233 - DNA, 20 bp, Artificial
  CRISPR gRNA sequence
gcagcctccttccactttaa

SEQ ID NO: 151234 - DNA, 20 bp, Artificial
  CRISPR gRNA sequence
tccttccactttaacagtca

SEQ ID NO: 151235 - DNA, 20 bp, Artificial
  CRISPR gRNA sequence
ccttccactttaacagtcaa

SEQ ID NO: 151236 - DNA, 20 bp, Artificial
  CRISPR gRNA sequence
acagtcaaaggcattcaatc

SEQ ID NO: 151237 - DNA, 20 bp, Artificial
  CRISPR gRNA sequence
gacaccaaaccttgcctcca

SEQ ID NO: 151238 - DNA, 20 bp, Artificial
  CRISPR gRNA sequence
accaaaccttgcctccacag

SEQ ID NO: 151239 - DNA, 20 bp, Artificial
  CRISPR gRNA sequence
tgcctccacagtggtcccat

SEQ ID NO: 151240 - DNA, 20 bp, Artificial
  CRISPR gRNA sequence
cattggctgaactgctttat

SEQ ID NO: 151241 - DNA, 20 bp, Artificial
  CRISPR gRNA sequence
gctgaactgctttatcggct

SEQ ID NO: 151242 - DNA, 20 bp, Artificial
  CRISPR gRNA sequence
ctttatcggctaagaacaca

SEQ ID NO: 151243 - DNA, 20 bp, Artificial
  CRISPR gRNA sequence
taagaacacaaagccacgat

SEQ ID NO: 151244 - DNA, 20 bp, Artificial
  CRISPR gRNA sequence
gtgtcaaatagcatgctaga

SEQ ID NO: 151245 - DNA, 20 bp, Artificial
  CRISPR gRNA sequence
gcagggcttcattggagcct

SEQ ID NO: 151246 - DNA, 20 bp, Artificial
  CRISPR gRNA sequence
tcggagtttttcactgaggc

SEQ ID NO: 151247 - DNA, 20 bp, Artificial
  CRISPR gRNA sequence
ctgaaagacaaagaaaaatg

SEQ ID NO: 151248 - DNA, 20 bp, Artificial
  CRISPR gRNA sequence
aaatggcgaatagtttgttg

SEQ ID NO: 151249 - DNA, 20 bp, Artificial
  CRISPR gRNA sequence
gggggtgggaggacagctgt

SEQ ID NO: 151250 - DNA, 20 bp, Artificial
  CRISPR gRNA sequence
acagctgttcgggttttcag

SEQ ID NO: 151251 - DNA, 20 bp, Artificial
  CRISPR gRNA sequence
tttgtttcctccgtcctttg

SEQ ID NO: 151252 - DNA, 20 bp, Artificial
  CRISPR gRNA sequence
tcctccgtcctttggggggt

SEQ ID NO: 151253 - DNA, 20 bp, Artificial
  CRISPR gRNA sequence
gtcctttggggggtagggat

SEQ ID NO: 151254 - DNA, 20 bp, Artificial
  CRISPR gRNA sequence
atagaaactgtttagcttca

SEQ ID NO: 151255 - DNA, 20 bp, Artificial
  CRISPR gRNA sequence
tgcataccttttggtgcacc

SEQ ID NO: 151256 - DNA, 20 bp, Artificial
  CRISPR gRNA sequence
gattttgcatgtccttcaac

SEQ ID NO: 151257 - DNA, 20 bp, Artificial
  CRISPR gRNA sequence
aactaggatttctttcctag

SEQ ID NO: 151258 - DNA, 20 bp, Artificial
  CRISPR gRNA sequence
aaaacacttttctctttgca

SEQ ID NO: 151259 - DNA, 20 bp, Artificial
  CRISPR gRNA sequence
agtgccctgaagctttccta

SEQ ID NO: 151260 - DNA, 20 bp, Artificial
  CRISPR gRNA sequence
aagctttcctacggaataag

SEQ ID NO: 151261 - DNA, 20 bp, Artificial
  CRISPR gRNA sequence
ggaataagctgggttgttgt

SEQ ID NO: 151262 - DNA, 20 bp, Artificial
  CRISPR gRNA sequence
ttttaatgcacattttagct

SEQ ID NO: 151263 - DNA, 20 bp, Artificial
  CRISPR gRNA sequence
tatttaaaatcctgcagttt

SEQ ID NO: 151264 - DNA, 20 bp, Artificial
  CRISPR gRNA sequence
agtttgtgaataggaaagtt

SEQ ID NO: 151265 - DNA, 20 bp, Artificial
  CRISPR gRNA sequence
atgtatatatttttctcttt

SEQ ID NO: 151266 - DNA, 20 bp, Artificial
  CRISPR gRNA sequence
tttctttttatttgcaaata

SEQ ID NO: 151267 - DNA, 20 bp, Artificial
  CRISPR gRNA sequence
cagccagcagcacttagtct

SEQ ID NO: 151268 - DNA, 20 bp, Artificial
  CRISPR gRNA sequence
cctattagaggagaagtttc

SEQ ID NO: 151269 - DNA, 20 bp, Artificial
  CRISPR gRNA sequence
ccctagcttcccctctaata

SEQ ID NO: 151270 - DNA, 20 bp, Artificial
  CRISPR gRNA sequence
gatttaccttagaggactga

SEQ ID NO: 151271 - DNA, 20 bp, Artificial
  CRISPR gRNA sequence
ggatttagattcggggctct

SEQ ID NO: 151272 - DNA, 20 bp, Artificial
  CRISPR gRNA sequence
gatatagcaagtcaaagttc

SEQ ID NO: 151273 - DNA, 20 bp, Artificial
  CRISPR gRNA sequence
gtgaccttgaaaaactgctg

SEQ ID NO: 151274 - DNA, 20 bp, Artificial
  CRISPR gRNA sequence
ctgtacttctgatattcaag

SEQ ID NO: 151275 - DNA, 20 bp, Artificial
  CRISPR gRNA sequence
attcaagtcgagtggttagt

SEQ ID NO: 151276 - DNA, 20 bp, Artificial
  CRISPR gRNA sequence
atatgttatagattcagatt

SEQ ID NO: 151277 - DNA, 20 bp, Artificial
  CRISPR gRNA sequence
attcagattaggaattttca

SEQ ID NO: 151278 - DNA, 20 bp, Artificial
  CRISPR gRNA sequence
aaattcttttggtatgatag

SEQ ID NO: 151279 - DNA, 20 bp, Artificial
  CRISPR gRNA sequence
agtgaactgcctaacagatt

SEQ ID NO: 151280 - DNA, 20 bp, Artificial
  CRISPR gRNA sequence
cttgtcttctttgtaatcta

SEQ ID NO: 151281 - DNA, 20 bp, Artificial
  CRISPR gRNA sequence
tctagagggttcttagtgaa

SEQ ID NO: 151282 - DNA, 20 bp, Artificial
  CRISPR gRNA sequence
aaggggatagatagtatttt

SEQ ID NO: 151283 - DNA, 20 bp, Artificial
  CRISPR gRNA sequence
tagatagtattttaggagtt

SEQ ID NO: 151284 - DNA, 20 bp, Artificial
  CRISPR gRNA sequence
ttgtatttgtgaaagttttg

SEQ ID NO: 151285 - DNA, 20 bp, Artificial
  CRISPR gRNA sequence
ttgtgaaagttttggggaat

SEQ ID NO: 151286 - DNA, 20 bp, Artificial
  CRISPR gRNA sequence
aataagaaaatgttcattct

SEQ ID NO: 151287 - DNA, 20 bp, Artificial
  CRISPR gRNA sequence
aagatgaagaagtatgtgtt

SEQ ID NO: 151288 - DNA, 20 bp, Artificial
  CRISPR gRNA sequence
actataaacttgagaacttt

SEQ ID NO: 151289 - DNA, 20 bp, Artificial
  CRISPR gRNA sequence
ggttcttcaccattctcttt

SEQ ID NO: 151290 - DNA, 20 bp, Artificial
  CRISPR gRNA sequence
agctaactctaatttaggcc

SEQ ID NO: 151291 - DNA, 20 bp, Artificial
  CRISPR gRNA sequence
gtaagtgggggaggcttaga

SEQ ID NO: 151292 - DNA, 20 bp, Artificial
  CRISPR gRNA sequence
aaatagtgtctgatttagtg

SEQ ID NO: 151293 - DNA, 20 bp, Artificial
  CRISPR gRNA sequence
gtctgatttagtggcgagtc

SEQ ID NO: 151294 - DNA, 20 bp, Artificial
  CRISPR gRNA sequence
ttactaatccagactatttg

SEQ ID NO: 151295 - DNA, 20 bp, Artificial
  CRISPR gRNA sequence
gtattttaatatttgtaaaa

SEQ ID NO: 151296 - DNA, 20 bp, Artificial
  CRISPR gRNA sequence
actcatcaagatccttgtga

SEQ ID NO: 151297 - DNA, 20 bp, Artificial
  CRISPR gRNA sequence
gtcaaaatttaaggacctct

SEQ ID NO: 151298 - DNA, 20 bp, Artificial
  CRISPR gRNA sequence
aatttaaggacctctcagaa

SEQ ID NO: 151299 - DNA, 20 bp, Artificial
  CRISPR gRNA sequence
acctctcagaataggatgaa

SEQ ID NO: 151300 - DNA, 20 bp, Artificial
  CRISPR gRNA sequence
tgttagatttaggaacctct

SEQ ID NO: 151301 - DNA, 20 bp, Artificial
  CRISPR gRNA sequence
tatagtaagcaagtaaatgt

SEQ ID NO: 151302 - DNA, 20 bp, Artificial
  CRISPR gRNA sequence
ccaaggctggtgtgccaggc

SEQ ID NO: 151303 - DNA, 20 bp, Artificial
  CRISPR gRNA sequence
aatcctcctacttcagcctc

SEQ ID NO: 151304 - DNA, 20 bp, Artificial
  CRISPR gRNA sequence
tttttatttttaaatacaga

SEQ ID NO: 151305 - DNA, 20 bp, Artificial
  CRISPR gRNA sequence
gccttggcctcccaaagtgc

SEQ ID NO: 151306 - DNA, 20 bp, Artificial
  CRISPR gRNA sequence
agtgctgggattacaagcac

SEQ ID NO: 151307 - DNA, 20 bp, Artificial
  CRISPR gRNA sequence
tgagccattgtgcccaattg

SEQ ID NO: 151308 - DNA, 20 bp, Artificial
  CRISPR gRNA sequence
cataattggtggaaactcat

SEQ ID NO: 151309 - DNA, 20 bp, Artificial
  CRISPR gRNA sequence
gacttccttttttccccccc

SEQ ID NO: 151310 - DNA, 20 bp, Artificial
  CRISPR gRNA sequence
ccttttttcccccccagggg

SEQ ID NO: 151311 - DNA, 20 bp, Artificial
  CRISPR gRNA sequence
gcttcctatctgtgcattgg

SEQ ID NO: 151312 - DNA, 20 bp, Artificial
  CRISPR gRNA sequence
ttggaagaatcatattcaga

SEQ ID NO: 151313 - DNA, 20 bp, Artificial
  CRISPR gRNA sequence
ccaaataaaattccagttcc

SEQ ID NO: 151314 - DNA, 20 bp, Artificial
  CRISPR gRNA sequence
agttgaacatggctgtcttc

SEQ ID NO: 151315 - DNA, 20 bp, Artificial
  CRISPR gRNA sequence
aacatggctgtcttcatgaa

SEQ ID NO: 151316 - DNA, 20 bp, Artificial
  CRISPR gRNA sequence
ttactgataatatatgcata

SEQ ID NO: 151317 - DNA, 20 bp, Artificial
  CRISPR gRNA sequence
ataatatatgcatacagagt

SEQ ID NO: 151318 - DNA, 20 bp, Artificial
  CRISPR gRNA sequence
tacatctaaattaggctgat

SEQ ID NO: 151319 - DNA, 20 bp, Artificial
  CRISPR gRNA sequence
taggctgatgggaatcactt

SEQ ID NO: 151320 - DNA, 20 bp, Artificial
  CRISPR gRNA sequence
cttctgtataggcttgctgt

SEQ ID NO: 151321 - DNA, 20 bp, Artificial
  CRISPR gRNA sequence
cagcagatttagtgtccctt

SEQ ID NO: 151322 - DNA, 20 bp, Artificial
  CRISPR gRNA sequence
ggttacttttatgcattatg

SEQ ID NO: 151323 - DNA, 20 bp, Artificial
  CRISPR gRNA sequence
tttatgcattatgaggaatt

SEQ ID NO: 151324 - DNA, 20 bp, Artificial
  CRISPR gRNA sequence
gtttggacctggctcttaaa

SEQ ID NO: 151325 - DNA, 20 bp, Artificial
  CRISPR gRNA sequence
tatttaataaacaaagattc

SEQ ID NO: 151326 - DNA, 20 bp, Artificial
  CRISPR gRNA sequence
gcatttgacaagactaaaat

SEQ ID NO: 151327 - DNA, 20 bp, Artificial
  CRISPR gRNA sequence
gtgtatgtgcttgtgtatgt

SEQ ID NO: 151328 - DNA, 20 bp, Artificial
  CRISPR gRNA sequence
caaaagttatagtccattga

SEQ ID NO: 151329 - DNA, 20 bp, Artificial
  CRISPR gRNA sequence
gaagattataatagacatag

SEQ ID NO: 151330 - DNA, 20 bp, Artificial
  CRISPR gRNA sequence
ttataatagacatagctgga

SEQ ID NO: 151331 - DNA, 20 bp, Artificial
  CRISPR gRNA sequence
tcttgctctgtcacccaggc

SEQ ID NO: 151332 - DNA, 20 bp, Artificial
  CRISPR gRNA sequence
cagtcctcccacctcagcct

SEQ ID NO: 151333 - DNA, 20 bp, Artificial
  CRISPR gRNA sequence
ctaaaaatacaaaaaattag

SEQ ID NO: 151334 - DNA, 20 bp, Artificial
  CRISPR gRNA sequence
tactcggcaggctgaggcag

SEQ ID NO: 151335 - DNA, 20 bp, Artificial
  CRISPR gRNA sequence
ggctgaggcaggagaatggc

SEQ ID NO: 151336 - DNA, 20 bp, Artificial
  CRISPR gRNA sequence
ataaataaataataatttgg

SEQ ID NO: 151337 - DNA, 20 bp, Artificial
  CRISPR gRNA sequence
taataatttggctgggtgtg

SEQ ID NO: 151338 - DNA, 20 bp, Artificial
  CRISPR gRNA sequence
actttgggaggccaaggtgg

SEQ ID NO: 151339 - DNA, 20 bp, Artificial
  CRISPR gRNA sequence
tgggcggatcacttgaggtc

SEQ ID NO: 151340 - DNA, 20 bp, Artificial
  CRISPR gRNA sequence
tatacaggaggctgaggcac

SEQ ID NO: 151341 - DNA, 20 bp, Artificial
  CRISPR gRNA sequence
ctgcactccagcctgggcaa

SEQ ID NO: 151342 - DNA, 20 bp, Artificial
  CRISPR gRNA sequence
ttttttttttcctgtagaaa

SEQ ID NO: 151343 - DNA, 20 bp, Artificial
  CRISPR gRNA sequence
gtctcgaactcctggcctca

SEQ ID NO: 151344 - DNA, 20 bp, Artificial
  CRISPR gRNA sequence
tatcttcttgtctctccctt

SEQ ID NO: 151345 - DNA, 20 bp, Artificial
  CRISPR gRNA sequence
gcagtgaaaatgggcaatcg

SEQ ID NO: 151346 - DNA, 20 bp, Artificial
  CRISPR gRNA sequence
aaatgggcaatcgaaggata

SEQ ID NO: 151347 - DNA, 20 bp, Artificial
  CRISPR gRNA sequence
ctttcaaggaaatgctaaag

SEQ ID NO: 151348 - DNA, 20 bp, Artificial
  CRISPR gRNA sequence
gaaagaacaagcaaaataca

SEQ ID NO: 151349 - DNA, 20 bp, Artificial
  CRISPR gRNA sequence
aggaggggagacgttcgctt

SEQ ID NO: 151350 - DNA, 20 bp, Artificial
  CRISPR gRNA sequence
aatgaaggcaagctgtttaa

SEQ ID NO: 151351 - DNA, 20 bp, Artificial
  CRISPR gRNA sequence
catgattcaaaaagtacatc

SEQ ID NO: 151352 - DNA, 20 bp, Artificial
  CRISPR gRNA sequence
actgcttagagcataaggag

SEQ ID NO: 151353 - DNA, 20 bp, Artificial
  CRISPR gRNA sequence
gagatgagttaaggacagga

SEQ ID NO: 151354 - DNA, 20 bp, Artificial
  CRISPR gRNA sequence
aagaagtatggagaagtaga

SEQ ID NO: 151355 - DNA, 20 bp, Artificial
  CRISPR gRNA sequence
gttggtgaccattgaaaatc

SEQ ID NO: 151356 - DNA, 20 bp, Artificial
  CRISPR gRNA sequence
ccattgaaaatctggggtag

SEQ ID NO: 151357 - DNA, 20 bp, Artificial
  CRISPR gRNA sequence
tcttaggttcacaaccctta

SEQ ID NO: 151358 - DNA, 20 bp, Artificial
  CRISPR gRNA sequence
aggtagtaacataaagggct

SEQ ID NO: 151359 - DNA, 20 bp, Artificial
  CRISPR gRNA sequence
ttttattacatggaggcaat

SEQ ID NO: 151360 - DNA, 20 bp, Artificial
  CRISPR gRNA sequence
actgttggacactgttacta

SEQ ID NO: 151361 - DNA, 20 bp, Artificial
  CRISPR gRNA sequence
tatagaatttagcagctgat

SEQ ID NO: 151362 - DNA, 20 bp, Artificial
  CRISPR gRNA sequence
tactgagatttctatccagt

SEQ ID NO: 151363 - DNA, 20 bp, Artificial
  CRISPR gRNA sequence
ctatccagtctgggtgactg

SEQ ID NO: 151364 - DNA, 20 bp, Artificial
  CRISPR gRNA sequence
tagatttgatttggggcacg

SEQ ID NO: 151365 - DNA, 20 bp, Artificial
  CRISPR gRNA sequence
gggcacgtggaatttcagtt

SEQ ID NO: 151366 - DNA, 20 bp, Artificial
  CRISPR gRNA sequence
caaaattggtaatgtatatt

SEQ ID NO: 151367 - DNA, 20 bp, Artificial
  CRISPR gRNA sequence
ggtaatgtatatttggaatt

SEQ ID NO: 151368 - DNA, 20 bp, Artificial
  CRISPR gRNA sequence
aacctaggggacaaacagga

SEQ ID NO: 151369 - DNA, 20 bp, Artificial
  CRISPR gRNA sequence
aacaggagagaatcaagaaa

SEQ ID NO: 151370 - DNA, 20 bp, Artificial
  CRISPR gRNA sequence
aaatccagaaatgagcatgg

SEQ ID NO: 151371 - DNA, 20 bp, Artificial
  CRISPR gRNA sequence
tggttgcacacccctgtttt

SEQ ID NO: 151372 - DNA, 20 bp, Artificial
  CRISPR gRNA sequence
tgagtgtgcatttcccatgt

SEQ ID NO: 151373 - DNA, 20 bp, Artificial
  CRISPR gRNA sequence
gtattagtttactaaaaata

SEQ ID NO: 151374 - DNA, 20 bp, Artificial
  CRISPR gRNA sequence
aaagactagaaatacttcct

SEQ ID NO: 151375 - DNA, 20 bp, Artificial
  CRISPR gRNA sequence
caaagactaggttttatttt

SEQ ID NO: 151376 - DNA, 20 bp, Artificial
  CRISPR gRNA sequence
ctgaccaaaaatacatatgt

SEQ ID NO: 151377 - DNA, 20 bp, Artificial
  CRISPR gRNA sequence
agcacacacaattaattacc

SEQ ID NO: 151378 - DNA, 20 bp, Artificial
  CRISPR gRNA sequence
aatgagactagcctcatctg

SEQ ID NO: 151379 - DNA, 20 bp, Artificial
  CRISPR gRNA sequence
gcctcatctgtaggatttag

SEQ ID NO: 151380 - DNA, 20 bp, Artificial
  CRISPR gRNA sequence
aaggtggttaagcaatgtaa

SEQ ID NO: 151381 - DNA, 20 bp, Artificial
  CRISPR gRNA sequence
taatagaatgcagtgtttat

SEQ ID NO: 151382 - DNA, 20 bp, Artificial
  CRISPR gRNA sequence
cgattatcatcccccatttt

SEQ ID NO: 151383 - DNA, 20 bp, Artificial
  CRISPR gRNA sequence
tgaaaggcacagaactttcc

SEQ ID NO: 151384 - DNA, 20 bp, Artificial
  CRISPR gRNA sequence
ggaacaaacatacagtcaaa

SEQ ID NO: 151385 - DNA, 20 bp, Artificial
  CRISPR gRNA sequence
tattttggaaattgtcttta

SEQ ID NO: 151386 - DNA, 20 bp, Artificial
  CRISPR gRNA sequence
taaggtcaggtaagtagttg

SEQ ID NO: 151387 - DNA, 20 bp, Artificial
  CRISPR gRNA sequence
tttccaaatagatatgtggt

SEQ ID NO: 151388 - DNA, 20 bp, Artificial
  CRISPR gRNA sequence
tattgaggcagctcccacat

SEQ ID NO: 151389 - DNA, 20 bp, Artificial
  CRISPR gRNA sequence
atagagatcgatatttttag

SEQ ID NO: 151390 - DNA, 20 bp, Artificial
  CRISPR gRNA sequence
gttttgttttgtttttgaga

SEQ ID NO: 151391 - DNA, 20 bp, Artificial
  CRISPR gRNA sequence
gtcttgctctgtcgccaggc

SEQ ID NO: 151392 - DNA, 20 bp, Artificial
  CRISPR gRNA sequence
gattctcctgcctcagcctc

SEQ ID NO: 151393 - DNA, 20 bp, Artificial
  CRISPR gRNA sequence
ttttgtatttttagtagaga

SEQ ID NO: 151394 - DNA, 20 bp, Artificial
  CRISPR gRNA sequence
gcctcagcctcccaaagtgc

SEQ ID NO: 151395 - DNA, 20 bp, Artificial
  CRISPR gRNA sequence
cccctagtgaggtggaacaa

SEQ ID NO: 151396 - DNA, 20 bp, Artificial
  CRISPR gRNA sequence
aaggaattctgatttcttgg

SEQ ID NO: 151397 - DNA, 20 bp, Artificial
  CRISPR gRNA sequence
ctgatttcttggaggaatgg

SEQ ID NO: 151398 - DNA, 20 bp, Artificial
  CRISPR gRNA sequence
tataattttgaaacactgca

SEQ ID NO: 151399 - DNA, 20 bp, Artificial
  CRISPR gRNA sequence
gctgggctaaggctcttctt

SEQ ID NO: 151400 - DNA, 20 bp, Artificial
  CRISPR gRNA sequence
cttcttctgaattatagaga

SEQ ID NO: 151401 - DNA, 20 bp, Artificial
  CRISPR gRNA sequence
tctgaattatagagaaagga

SEQ ID NO: 151402 - DNA, 20 bp, Artificial
  CRISPR gRNA sequence
ctttctactttgaaatgttt

SEQ ID NO: 151403 - DNA, 20 bp, Artificial
  CRISPR gRNA sequence
atctggtatcttgatttttt

SEQ ID NO: 151404 - DNA, 20 bp, Artificial
  CRISPR gRNA sequence
ttttggagtacttttttcag

SEQ ID NO: 151405 - DNA, 20 bp, Artificial
  CRISPR gRNA sequence
acgaaaggtaaaaaggcctg

SEQ ID NO: 151406 - DNA, 20 bp, Artificial
  CRISPR gRNA sequence
taatgaaagagcacagaact

SEQ ID NO: 151407 - DNA, 20 bp, Artificial
  CRISPR gRNA sequence
agaactgagaatcagaagac

SEQ ID NO: 151408 - DNA, 20 bp, Artificial
  CRISPR gRNA sequence
tgtggcatatacttgtcctg

SEQ ID NO: 151409 - DNA, 20 bp, Artificial
  CRISPR gRNA sequence
tgccaagttcctcagtccac

SEQ ID NO: 151410 - DNA, 20 bp, Artificial
  CRISPR gRNA sequence
gtaaagtatgtacaaatgta

SEQ ID NO: 151411 - DNA, 20 bp, Artificial
  CRISPR gRNA sequence
aaaagacactaaacagaggg

SEQ ID NO: 151412 - DNA, 20 bp, Artificial
  CRISPR gRNA sequence
gggaagaattcacagtgtat

SEQ ID NO: 151413 - DNA, 20 bp, Artificial
  CRISPR gRNA sequence
tcacagtgtatctgaatgag

SEQ ID NO: 151414 - DNA, 20 bp, Artificial
  CRISPR gRNA sequence
aatgagcagaatctagacag

SEQ ID NO: 151415 - DNA, 20 bp, Artificial
  CRISPR gRNA sequence
ccactcttgtggctcttcca

SEQ ID NO: 151416 - DNA, 20 bp, Artificial
  CRISPR gRNA sequence
ctgagcacagatacttaaga

SEQ ID NO: 151417 - DNA, 20 bp, Artificial
  CRISPR gRNA sequence
ccatttcaaagaaaagtacc

SEQ ID NO: 151418 - DNA, 20 bp, Artificial
  CRISPR gRNA sequence
aaagtacctagaatgaggcc

SEQ ID NO: 151419 - DNA, 20 bp, Artificial
  CRISPR gRNA sequence
agaatgaggccaaggatact

SEQ ID NO: 151420 - DNA, 20 bp, Artificial
  CRISPR gRNA sequence
actttggcaggccaaagtga

SEQ ID NO: 151421 - DNA, 20 bp, Artificial
  CRISPR gRNA sequence
tgagaggatcacttgagccc

SEQ ID NO: 151422 - DNA, 20 bp, Artificial
  CRISPR gRNA sequence
actcaggaggctgagcaggg

SEQ ID NO: 151423 - DNA, 20 bp, Artificial
  CRISPR gRNA sequence
gttcattcagtagatgtgta

SEQ ID NO: 151424 - DNA, 20 bp, Artificial
  CRISPR gRNA sequence
gtgcaaggcatatttgcctt

SEQ ID NO: 151425 - DNA, 20 bp, Artificial
  CRISPR gRNA sequence
gttacacaagtctgaagcaa

SEQ ID NO: 151426 - DNA, 20 bp, Artificial
  CRISPR gRNA sequence
aatagatttgattgtgtgcc

SEQ ID NO: 151427 - DNA, 20 bp, Artificial
  CRISPR gRNA sequence
aaatttatcatcactgatta

SEQ ID NO: 151428 - DNA, 20 bp, Artificial
  CRISPR gRNA sequence
tgtttccttcatgttcactt

SEQ ID NO: 151429 - DNA, 20 bp, Artificial
  CRISPR gRNA sequence
ttcatgttcacttcaggatg

SEQ ID NO: 151430 - DNA, 20 bp, Artificial
  CRISPR gRNA sequence
gatgttggatatagatggaa

SEQ ID NO: 151431 - DNA, 20 bp, Artificial
  CRISPR gRNA sequence
gctctctttagagctccaaa

SEQ ID NO: 151432 - DNA, 20 bp, Artificial
  CRISPR gRNA sequence
ctccaaacagaatcttttgc

SEQ ID NO: 151433 - DNA, 20 bp, Artificial
  CRISPR gRNA sequence
gcttggatggtggggccagg

SEQ ID NO: 151434 - DNA, 20 bp, Artificial
  CRISPR gRNA sequence
ccaaggagatggtggtggtt

SEQ ID NO: 151435 - DNA, 20 bp, Artificial
  CRISPR gRNA sequence
gtggtggttgtgggtttttt

SEQ ID NO: 151436 - DNA, 20 bp, Artificial
  CRISPR gRNA sequence
tttggggtttttttttgata

SEQ ID NO: 151437 - DNA, 20 bp, Artificial
  CRISPR gRNA sequence
gatcctcctgccccagcctc

SEQ ID NO: 151438 - DNA, 20 bp, Artificial
  CRISPR gRNA sequence
agcccaaggagacatattct

SEQ ID NO: 151439 - DNA, 20 bp, Artificial
  CRISPR gRNA sequence
actttgggaggccaaggtgg

SEQ ID NO: 151440 - DNA, 20 bp, Artificial
  CRISPR gRNA sequence
tacttgggaggctgaggcag

SEQ ID NO: 151441 - DNA, 20 bp, Artificial
  CRISPR gRNA sequence
tcatgctactgcattccagc

SEQ ID NO: 151442 - DNA, 20 bp, Artificial
  CRISPR gRNA sequence
ctgcattccagcctgggtga

SEQ ID NO: 151443 - DNA, 20 bp, Artificial
  CRISPR gRNA sequence
ataaataattaatttaaaaa

SEQ ID NO: 151444 - DNA, 20 bp, Artificial
  CRISPR gRNA sequence
aaaaaagaatttaaatgttt

SEQ ID NO: 151445 - DNA, 20 bp, Artificial
  CRISPR gRNA sequence
tattgatcattgacacaccc

SEQ ID NO: 151446 - DNA, 20 bp, Artificial
  CRISPR gRNA sequence
ggaacgttcccatgttcagc

SEQ ID NO: 151447 - DNA, 20 bp, Artificial
  CRISPR gRNA sequence
tgtgtgtttcagctgctctg

SEQ ID NO: 151448 - DNA, 20 bp, Artificial
  CRISPR gRNA sequence
tctgtgggatgttgctttag

SEQ ID NO: 151449 - DNA, 20 bp, Artificial
  CRISPR gRNA sequence
gtgcccccaactgttcgcag

SEQ ID NO: 151450 - DNA, 20 bp, Artificial
  CRISPR gRNA sequence
cctagagacatgcaaagggg

SEQ ID NO: 151451 - DNA, 20 bp, Artificial
  CRISPR gRNA sequence
ggataaaacagaaaagaaaa

SEQ ID NO: 151452 - DNA, 20 bp, Artificial
  CRISPR gRNA sequence
caagttataataaatcaaga

SEQ ID NO: 151453 - DNA, 20 bp, Artificial
  CRISPR gRNA sequence
ctcaaccttatctgtaaaat

SEQ ID NO: 151454 - DNA, 20 bp, Artificial
  CRISPR gRNA sequence
aatttatcactgagctaagt

SEQ ID NO: 151455 - DNA, 20 bp, Artificial
  CRISPR gRNA sequence
gagctaagtaagggtcaatt

SEQ ID NO: 151456 - DNA, 20 bp, Artificial
  CRISPR gRNA sequence
ggcatctatgaaacattctt

SEQ ID NO: 151457 - DNA, 20 bp, Artificial
  CRISPR gRNA sequence
ctctgctagacacacaaaca

SEQ ID NO: 151458 - DNA, 20 bp, Artificial
  CRISPR gRNA sequence
aactgggcaagaggctgttt

SEQ ID NO: 151459 - DNA, 20 bp, Artificial
  CRISPR gRNA sequence
aagaaaatgatgctttgttt

SEQ ID NO: 151460 - DNA, 20 bp, Artificial
  CRISPR gRNA sequence
ctcatgtcacaattcctttt

SEQ ID NO: 151461 - DNA, 20 bp, Artificial
  CRISPR gRNA sequence
ttactcaccattcttcctac

SEQ ID NO: 151462 - DNA, 20 bp, Artificial
  CRISPR gRNA sequence
tttatttactcgttaggctg

SEQ ID NO: 151463 - DNA, 20 bp, Artificial
  CRISPR gRNA sequence
agatacttctgtggggcaga

SEQ ID NO: 151464 - DNA, 20 bp, Artificial
  CRISPR gRNA sequence
ggcccagcttacttctaatt

SEQ ID NO: 151465 - DNA, 20 bp, Artificial
  CRISPR gRNA sequence
agtttccccatcagtaaatc

SEQ ID NO: 151466 - DNA, 20 bp, Artificial
  CRISPR gRNA sequence
acagtgctttaaaacaagat

SEQ ID NO: 151467 - DNA, 20 bp, Artificial
  CRISPR gRNA sequence
cttttcttttttttttgaga

SEQ ID NO: 151468 - DNA, 20 bp, Artificial
  CRISPR gRNA sequence
tctgctgttcctgctcaggc

SEQ ID NO: 151469 - DNA, 20 bp, Artificial
  CRISPR gRNA sequence
agtcctcccgcctcagcctc

SEQ ID NO: 151470 - DNA, 20 bp, Artificial
  CRISPR gRNA sequence
tttttattttctattgagat

SEQ ID NO: 151471 - DNA, 20 bp, Artificial
  CRISPR gRNA sequence
cccaggctgatctcgagctc

SEQ ID NO: 151472 - DNA, 20 bp, Artificial
  CRISPR gRNA sequence
atcctcccgccttggcctcc

SEQ ID NO: 151473 - DNA, 20 bp, Artificial
  CRISPR gRNA sequence
gccttggcctcccagagtgc

SEQ ID NO: 151474 - DNA, 20 bp, Artificial
  CRISPR gRNA sequence
tgggcagatcacttaaggtc

SEQ ID NO: 151475 - DNA, 20 bp, Artificial
  CRISPR gRNA sequence
ttcaaaaatacaaaaattag

SEQ ID NO: 151476 - DNA, 20 bp, Artificial
  CRISPR gRNA sequence
aaaattagctgggtgtgatg

SEQ ID NO: 151477 - DNA, 20 bp, Artificial
  CRISPR gRNA sequence
tgcttgggaggctgaggtgg

SEQ ID NO: 151478 - DNA, 20 bp, Artificial
  CRISPR gRNA sequence
tcgtgccattgtactccagc

SEQ ID NO: 151479 - DNA, 20 bp, Artificial
  CRISPR gRNA sequence
gaggctccgtctaaaagtaa

SEQ ID NO: 151480 - DNA, 20 bp, Artificial
  CRISPR gRNA sequence
tgaataaataaataaataat

SEQ ID NO: 151481 - DNA, 20 bp, Artificial
  CRISPR gRNA sequence
tagtttttagacccttgctt

SEQ ID NO: 151482 - DNA, 20 bp, Artificial
  CRISPR gRNA sequence
ggtttaagtttgagcattga

SEQ ID NO: 151483 - DNA, 20 bp, Artificial
  CRISPR gRNA sequence
taagtttgagcattgaaagg

SEQ ID NO: 151484 - DNA, 20 bp, Artificial
  CRISPR gRNA sequence
tgagcattgaaaggatgagt

SEQ ID NO: 151485 - DNA, 20 bp, Artificial
  CRISPR gRNA sequence
acgtcaaacttggcattaat

SEQ ID NO: 151486 - DNA, 20 bp, Artificial
  CRISPR gRNA sequence
cagctggtacccagctatgt

SEQ ID NO: 151487 - DNA, 20 bp, Artificial
  CRISPR gRNA sequence
tacccagctatgtaagggtt

SEQ ID NO: 151488 - DNA, 20 bp, Artificial
  CRISPR gRNA sequence
tgactatataaaaaccttag

SEQ ID NO: 151489 - DNA, 20 bp, Artificial
  CRISPR gRNA sequence
caaaccaccagagacccctt

SEQ ID NO: 151490 - DNA, 20 bp, Artificial
  CRISPR gRNA sequence
tgttcagtatacatcattgc

SEQ ID NO: 151491 - DNA, 20 bp, Artificial
  CRISPR gRNA sequence
tcattgctggagtggcttag

SEQ ID NO: 151492 - DNA, 20 bp, Artificial
  CRISPR gRNA sequence
tttagattggttttattttg

SEQ ID NO: 151493 - DNA, 20 bp, Artificial
  CRISPR gRNA sequence
aaagctaacattataataaa

SEQ ID NO: 151494 - DNA, 20 bp, Artificial
  CRISPR gRNA sequence
gtcataaccttttgctgctt

SEQ ID NO: 151495 - DNA, 20 bp, Artificial
  CRISPR gRNA sequence
gatgatggctgctgactgat

SEQ ID NO: 151496 - DNA, 20 bp, Artificial
  CRISPR gRNA sequence
gggtggtagttgctgaagtt

SEQ ID NO: 151497 - DNA, 20 bp, Artificial
  CRISPR gRNA sequence
gtgtgtgtttttttttgaga

SEQ ID NO: 151498 - DNA, 20 bp, Artificial
  CRISPR gRNA sequence
ttcgctcctgttgctcaggc

SEQ ID NO: 151499 - DNA, 20 bp, Artificial
  CRISPR gRNA sequence
gccccagcttcccaagtagc

SEQ ID NO: 151500 - DNA, 20 bp, Artificial
  CRISPR gRNA sequence
ttttgtatttttagtagaga

SEQ ID NO: 151501 - DNA, 20 bp, Artificial
  CRISPR gRNA sequence
acctcagtctcccaaagtgc

SEQ ID NO: 151502 - DNA, 20 bp, Artificial
  CRISPR gRNA sequence
ctccacactgtcacccaggc

SEQ ID NO: 151503 - DNA, 20 bp, Artificial
  CRISPR gRNA sequence
ttttgtattttttgtataga

SEQ ID NO: 151504 - DNA, 20 bp, Artificial
  CRISPR gRNA sequence
gccctagcctcccaaagtgc

SEQ ID NO: 151505 - DNA, 20 bp, Artificial
  CRISPR gRNA sequence
ctgtttgatagcattttacc

SEQ ID NO: 151506 - DNA, 20 bp, Artificial
  CRISPR gRNA sequence
agtagagcttctttcaaaac

SEQ ID NO: 151507 - DNA, 20 bp, Artificial
  CRISPR gRNA sequence
atgttcatagcattttcact

SEQ ID NO: 151508 - DNA, 20 bp, Artificial
  CRISPR gRNA sequence
aacccctcaaaatcatccag

SEQ ID NO: 151509 - DNA, 20 bp, Artificial
  CRISPR gRNA sequence
tcaaaatcatccaggaggat

SEQ ID NO: 151510 - DNA, 20 bp, Artificial
  CRISPR gRNA sequence
ttatattttgacttcctccc

SEQ ID NO: 151511 - DNA, 20 bp, Artificial
  CRISPR gRNA sequence
ttgacttcctcccatgaatt

SEQ ID NO: 151512 - DNA, 20 bp, Artificial
  CRISPR gRNA sequence
tggttggttggtttttgaga

SEQ ID NO: 151513 - DNA, 20 bp, Artificial
  CRISPR gRNA sequence
tcttactctgttgcccagac

SEQ ID NO: 151514 - DNA, 20 bp, Artificial
  CRISPR gRNA sequence
gccttggcctcccaaactgc

SEQ ID NO: 151515 - DNA, 20 bp, Artificial
  CRISPR gRNA sequence
ctgaggcactgtgcctggcc

SEQ ID NO: 151516 - DNA, 20 bp, Artificial
  CRISPR gRNA sequence
tcttgctctgtcgcccaggc

SEQ ID NO: 151517 - DNA, 20 bp, Artificial
  CRISPR gRNA sequence
gcctcagctttccaagtagc

SEQ ID NO: 151518 - DNA, 20 bp, Artificial
  CRISPR gRNA sequence
ttgtatttttttagtagaga

SEQ ID NO: 151519 - DNA, 20 bp, Artificial
  CRISPR gRNA sequence
gcctcggcctcccaaagtgc

SEQ ID NO: 151520 - DNA, 20 bp, Artificial
  CRISPR gRNA sequence
aaagtgctaggattacaggc

SEQ ID NO: 151521 - DNA, 20 bp, Artificial
  CRISPR gRNA sequence
gtcaccgcgcccagcctgcc

SEQ ID NO: 151522 - DNA, 20 bp, Artificial
  CRISPR gRNA sequence
tcttaatggtatttaaaatg

SEQ ID NO: 151523 - DNA, 20 bp, Artificial
  CRISPR gRNA sequence
agtttactcagatctgtctg

SEQ ID NO: 151524 - DNA, 20 bp, Artificial
  CRISPR gRNA sequence
aagtgtttttatttctgaga

SEQ ID NO: 151525 - DNA, 20 bp, Artificial
  CRISPR gRNA sequence
tctcactctgtcacctaggc

SEQ ID NO: 151526 - DNA, 20 bp, Artificial
  CRISPR gRNA sequence
tggagtgcagtggtgtgatc

SEQ ID NO: 151527 - DNA, 20 bp, Artificial
  CRISPR gRNA sequence
cagcctcatgctttggcctc

SEQ ID NO: 151528 - DNA, 20 bp, Artificial
  CRISPR gRNA sequence
ttttgtgtttttagtagaga

SEQ ID NO: 151529 - DNA, 20 bp, Artificial
  CRISPR gRNA sequence
tggggtttcattatgttggc

SEQ ID NO: 151530 - DNA, 20 bp, Artificial
  CRISPR gRNA sequence
gccttggcctcccaaagtgc

SEQ ID NO: 151531 - DNA, 20 bp, Artificial
  CRISPR gRNA sequence
attttcttcaataataagac

SEQ ID NO: 151532 - DNA, 20 bp, Artificial
  CRISPR gRNA sequence
actctttggtccatgggctg

SEQ ID NO: 151533 - DNA, 20 bp, Artificial
  CRISPR gRNA sequence
tttggtccatgggctgcaga

SEQ ID NO: 151534 - DNA, 20 bp, Artificial
  CRISPR gRNA sequence
actttgggaggctgaggcgg

SEQ ID NO: 151535 - DNA, 20 bp, Artificial
  CRISPR gRNA sequence
cgggcggattacttgaaatc

SEQ ID NO: 151536 - DNA, 20 bp, Artificial
  CRISPR gRNA sequence
ctactcgggaggctgggcat

SEQ ID NO: 151537 - DNA, 20 bp, Artificial
  CRISPR gRNA sequence
ctgcactccagcctgggcga

SEQ ID NO: 151538 - DNA, 20 bp, Artificial
  CRISPR gRNA sequence
aaaacaaaacaaaactctga

SEQ ID NO: 151539 - DNA, 20 bp, Artificial
  CRISPR gRNA sequence
ttttgttttgttttttgaga

SEQ ID NO: 151540 - DNA, 20 bp, Artificial
  CRISPR gRNA sequence
tctcgctgtgctacccaggc

SEQ ID NO: 151541 - DNA, 20 bp, Artificial
  CRISPR gRNA sequence
ctcactgcaacctctgcctc

SEQ ID NO: 151542 - DNA, 20 bp, Artificial
  CRISPR gRNA sequence
gattctcctgcctcagcctc

SEQ ID NO: 151543 - DNA, 20 bp, Artificial
  CRISPR gRNA sequence
gcctcagcctcttgagtagc

SEQ ID NO: 151544 - DNA, 20 bp, Artificial
  CRISPR gRNA sequence
ttttgtatttttaatggaga

SEQ ID NO: 151545 - DNA, 20 bp, Artificial
  CRISPR gRNA sequence
gccttggcctcccaaagtgt

SEQ ID NO: 151546 - DNA, 20 bp, Artificial
  CRISPR gRNA sequence
ctcccagcctccatcagttt

SEQ ID NO: 151547 - DNA, 20 bp, Artificial
  CRISPR gRNA sequence
gtgagcagtaatattttcaa

SEQ ID NO: 151548 - DNA, 20 bp, Artificial
  CRISPR gRNA sequence
ctccatttatagagcacagg

SEQ ID NO: 151549 - DNA, 20 bp, Artificial
  CRISPR gRNA sequence
tgtataattcttaagggccc

SEQ ID NO: 151550 - DNA, 20 bp, Artificial
  CRISPR gRNA sequence
cttaagggccctagaatttt

SEQ ID NO: 151551 - DNA, 20 bp, Artificial
  CRISPR gRNA sequence
aattactctagctagatctt

SEQ ID NO: 151552 - DNA, 20 bp, Artificial
  CRISPR gRNA sequence
ctcacctctctcagccttca

SEQ ID NO: 151553 - DNA, 20 bp, Artificial
  CRISPR gRNA sequence
ctctcagccttcatagaatt

SEQ ID NO: 151554 - DNA, 20 bp, Artificial
  CRISPR gRNA sequence
cacattaggctttggcttaa

SEQ ID NO: 151555 - DNA, 20 bp, Artificial
  CRISPR gRNA sequence
tttttctttgcagtcacagc

SEQ ID NO: 151556 - DNA, 20 bp, Artificial
  CRISPR gRNA sequence
tcttttttttttttttgaac

SEQ ID NO: 151557 - DNA, 20 bp, Artificial
  CRISPR gRNA sequence
tcttgcactgtcgcccaggc

SEQ ID NO: 151558 - DNA, 20 bp, Artificial
  CRISPR gRNA sequence
ctgactgcaaccttcgcctc

SEQ ID NO: 151559 - DNA, 20 bp, Artificial
  CRISPR gRNA sequence
gcctcagcttcccaagtagc

SEQ ID NO: 151560 - DNA, 20 bp, Artificial
  CRISPR gRNA sequence
ttttgtatttttggtagaga

SEQ ID NO: 151561 - DNA, 20 bp, Artificial
  CRISPR gRNA sequence
aggggtttcatcatgttggt

SEQ ID NO: 151562 - DNA, 20 bp, Artificial
  CRISPR gRNA sequence
gcctcggcctcccaaagtgc

SEQ ID NO: 151563 - DNA, 20 bp, Artificial
  CRISPR gRNA sequence
catttctagctttcgattga

SEQ ID NO: 151564 - DNA, 20 bp, Artificial
  CRISPR gRNA sequence
tcgattgattgagttagaga

SEQ ID NO: 151565 - DNA, 20 bp, Artificial
  CRISPR gRNA sequence
ttttgttctgtcacccaggc

SEQ ID NO: 151566 - DNA, 20 bp, Artificial
  CRISPR gRNA sequence
gatcctcccacctcagcctt

SEQ ID NO: 151567 - DNA, 20 bp, Artificial
  CRISPR gRNA sequence
ttttttttttggtagagata

SEQ ID NO: 151568 - DNA, 20 bp, Artificial
  CRISPR gRNA sequence
gccaagctggtctcgaactc

SEQ ID NO: 151569 - DNA, 20 bp, Artificial
  CRISPR gRNA sequence
tccttggtgcctcaaagttc

SEQ ID NO: 151570 - DNA, 20 bp, Artificial
  CRISPR gRNA sequence
tgaacgcttagaggccgttg

SEQ ID NO: 151571 - DNA, 20 bp, Artificial
  CRISPR gRNA sequence
gtaatagggaggcccgaggt

SEQ ID NO: 151572 - DNA, 20 bp, Artificial
  CRISPR gRNA sequence
aaacaaggtatagttgtaaa

SEQ ID NO: 151573 - DNA, 20 bp, Artificial
  CRISPR gRNA sequence
tcaaaatgcaagtcacaaaa

SEQ ID NO: 151574 - DNA, 20 bp, Artificial
  CRISPR gRNA sequence
atgttaagttggagatgcac

SEQ ID NO: 151575 - DNA, 20 bp, Artificial
  CRISPR gRNA sequence
cggtttggggaacattaaag

SEQ ID NO: 151576 - DNA, 20 bp, Artificial
  CRISPR gRNA sequence
ttaggtaaaacatgtcttcc

SEQ ID NO: 151577 - DNA, 20 bp, Artificial
  CRISPR gRNA sequence
atggttcaactagtagtaca

SEQ ID NO: 151578 - DNA, 20 bp, Artificial
  CRISPR gRNA sequence
aaaagaaaccagttcctggc

SEQ ID NO: 151579 - DNA, 20 bp, Artificial
  CRISPR gRNA sequence
ggccggggtcactctctgtg

SEQ ID NO: 151580 - DNA, 20 bp, Artificial
  CRISPR gRNA sequence
ctctgctttcttcttgcatc

SEQ ID NO: 151581 - DNA, 20 bp, Artificial
  CRISPR gRNA sequence
cacatctaaattgtctcagc

SEQ ID NO: 151582 - DNA, 20 bp, Artificial
  CRISPR gRNA sequence
taaattgtctcagcctgagt

SEQ ID NO: 151583 - DNA, 20 bp, Artificial
  CRISPR gRNA sequence
agtgagagtgtgccctgtga

SEQ ID NO: 151584 - DNA, 20 bp, Artificial
  CRISPR gRNA sequence
caccttgtgccctgaactgt

SEQ ID NO: 151585 - DNA, 20 bp, Artificial
  CRISPR gRNA sequence
aatcatctgcaaccctgaac

SEQ ID NO: 151586 - DNA, 20 bp, Artificial
  CRISPR gRNA sequence
gcaaccctgaactggaataa

SEQ ID NO: 151587 - DNA, 20 bp, Artificial
  CRISPR gRNA sequence
tcttacttttttttttggga

SEQ ID NO: 151588 - DNA, 20 bp, Artificial
  CRISPR gRNA sequence
agtcttgctgtatcccagta

SEQ ID NO: 151589 - DNA, 20 bp, Artificial
  CRISPR gRNA sequence
ttcactgcaacctccacctc

SEQ ID NO: 151590 - DNA, 20 bp, Artificial
  CRISPR gRNA sequence
gccttagcctcccaagtagc

SEQ ID NO: 151591 - DNA, 20 bp, Artificial
  CRISPR gRNA sequence
ttttgtatttttagtagaga

SEQ ID NO: 151592 - DNA, 20 bp, Artificial
  CRISPR gRNA sequence
ctgcctcagcctcccaaagt

SEQ ID NO: 151593 - DNA, 20 bp, Artificial
  CRISPR gRNA sequence
cttttggcgggggcggggga

SEQ ID NO: 151594 - DNA, 20 bp, Artificial
  CRISPR gRNA sequence
ctcactgcagcctccacctc

SEQ ID NO: 151595 - DNA, 20 bp, Artificial
  CRISPR gRNA sequence
gattcccccgcctcagcctc

SEQ ID NO: 151596 - DNA, 20 bp, Artificial
  CRISPR gRNA sequence
ttttatatttttagtagaga

SEQ ID NO: 151597 - DNA, 20 bp, Artificial
  CRISPR gRNA sequence
tggggtttcaccatgttggc

SEQ ID NO: 151598 - DNA, 20 bp, Artificial
  CRISPR gRNA sequence
cacctcggcctctcaaagtg

SEQ ID NO: 151599 - DNA, 20 bp, Artificial
  CRISPR gRNA sequence
tgtttttgtgaccagaaata

SEQ ID NO: 151600 - DNA, 20 bp, Artificial
  CRISPR gRNA sequence
aattggaagcagcattggtc

SEQ ID NO: 151601 - DNA, 20 bp, Artificial
  CRISPR gRNA sequence
gaagcagcattggtcaagaa

SEQ ID NO: 151602 - DNA, 20 bp, Artificial
  CRISPR gRNA sequence
ttacctcaaagagctgtatt

SEQ ID NO: 151603 - DNA, 20 bp, Artificial
  CRISPR gRNA sequence
gtgggtttaggctactataa

SEQ ID NO: 151604 - DNA, 20 bp, Artificial
  CRISPR gRNA sequence
ctataaaagagtttggtata

SEQ ID NO: 151605 - DNA, 20 bp, Artificial
  CRISPR gRNA sequence
agagaatgaagtacatgcca

SEQ ID NO: 151606 - DNA, 20 bp, Artificial
  CRISPR gRNA sequence
tgaactgaagtctaaaggtc

SEQ ID NO: 151607 - DNA, 20 bp, Artificial
  CRISPR gRNA sequence
taaaaggaacactctgattt

SEQ ID NO: 151608 - DNA, 20 bp, Artificial
  CRISPR gRNA sequence
gaagtttcatttttttcttt

SEQ ID NO: 151609 - DNA, 20 bp, Artificial
  CRISPR gRNA sequence
ttttttctttaagaatgata

SEQ ID NO: 151610 - DNA, 20 bp, Artificial
  CRISPR gRNA sequence
ttaagaatgataaagagtaa

SEQ ID NO: 151611 - DNA, 20 bp, Artificial
  CRISPR gRNA sequence
gataaagagtaactggatat

SEQ ID NO: 151612 - DNA, 20 bp, Artificial
  CRISPR gRNA sequence
tgattttccccttcttgcta

SEQ ID NO: 151613 - DNA, 20 bp, Artificial
  CRISPR gRNA sequence
ctttgaaaagatttacactt

SEQ ID NO: 151614 - DNA, 20 bp, Artificial
  CRISPR gRNA sequence
gctcatttagtctaagcttc

SEQ ID NO: 151615 - DNA, 20 bp, Artificial
  CRISPR gRNA sequence
tcagtcttgcacctcctctt

SEQ ID NO: 151616 - DNA, 20 bp, Artificial
  CRISPR gRNA sequence
attagttatcagactgtgtg

SEQ ID NO: 151617 - DNA, 20 bp, Artificial
  CRISPR gRNA sequence
actgtgtgctggatactgtg

SEQ ID NO: 151618 - DNA, 20 bp, Artificial
  CRISPR gRNA sequence
actgtgagggatccagagag

SEQ ID NO: 151619 - DNA, 20 bp, Artificial
  CRISPR gRNA sequence
accagttccagaaagcagta

SEQ ID NO: 151620 - DNA, 20 bp, Artificial
  CRISPR gRNA sequence
acttcgtggagagatagtaa

SEQ ID NO: 151621 - DNA, 20 bp, Artificial
  CRISPR gRNA sequence
gtggagagatagtaattgag

SEQ ID NO: 151622 - DNA, 20 bp, Artificial
  CRISPR gRNA sequence
tacttgggaggctgtggtag

SEQ ID NO: 151623 - DNA, 20 bp, Artificial
  CRISPR gRNA sequence
agaaaaaaaaaatagagaga

SEQ ID NO: 151624 - DNA, 20 bp, Artificial
  CRISPR gRNA sequence
agagaaagagtagtttaaca

SEQ ID NO: 151625 - DNA, 20 bp, Artificial
  CRISPR gRNA sequence
gtagtttaacatggaatgaa

SEQ ID NO: 151626 - DNA, 20 bp, Artificial
  CRISPR gRNA sequence
acatggaatgaagaggatcc

SEQ ID NO: 151627 - DNA, 20 bp, Artificial
  CRISPR gRNA sequence
ggaatgaagaggatcctgga

SEQ ID NO: 151628 - DNA, 20 bp, Artificial
  CRISPR gRNA sequence
ttattataatttttttgagg

SEQ ID NO: 151629 - DNA, 20 bp, Artificial
  CRISPR gRNA sequence
tctccctctgttgcccaggc

SEQ ID NO: 151630 - DNA, 20 bp, Artificial
  CRISPR gRNA sequence
gatccttctgcctcagcctc

SEQ ID NO: 151631 - DNA, 20 bp, Artificial
  CRISPR gRNA sequence
ttttattcttctttttgaga

SEQ ID NO: 151632 - DNA, 20 bp, Artificial
  CRISPR gRNA sequence
gcctcagcctcccaagtagc

SEQ ID NO: 151633 - DNA, 20 bp, Artificial
  CRISPR gRNA sequence
ttttgtgtttttagtagaaa

SEQ ID NO: 151634 - DNA, 20 bp, Artificial
  CRISPR gRNA sequence
acctcagcctcccaaagtgt

SEQ ID NO: 151635 - DNA, 20 bp, Artificial
  CRISPR gRNA sequence
aaaaatcctttttttagaga

SEQ ID NO: 151636 - DNA, 20 bp, Artificial
  CRISPR gRNA sequence
gattctcctgtctcagcctc

SEQ ID NO: 151637 - DNA, 20 bp, Artificial
  CRISPR gRNA sequence
gtctcagcctccggagttgt

SEQ ID NO: 151638 - DNA, 20 bp, Artificial
  CRISPR gRNA sequence
attatcctagaagatgaacc

SEQ ID NO: 151639 - DNA, 20 bp, Artificial
  CRISPR gRNA sequence
tttatttatttattttgaga

SEQ ID NO: 151640 - DNA, 20 bp, Artificial
  CRISPR gRNA sequence
tcttgctctgtcacccaggc

SEQ ID NO: 151641 - DNA, 20 bp, Artificial
  CRISPR gRNA sequence
ctcactgcaacctccacctc

SEQ ID NO: 151642 - DNA, 20 bp, Artificial
  CRISPR gRNA sequence
agcctccacctccttggttc

SEQ ID NO: 151643 - DNA, 20 bp, Artificial
  CRISPR gRNA sequence
gccttggcctcccaaagtgc

SEQ ID NO: 151644 - DNA, 20 bp, Artificial
  CRISPR gRNA sequence
tatatatataatattaattg

SEQ ID NO: 151645 - DNA, 20 bp, Artificial
  CRISPR gRNA sequence
tgtttttaaagctccatgca

SEQ ID NO: 151646 - DNA, 20 bp, Artificial
  CRISPR gRNA sequence
tttaaagctccatgcaaaga

SEQ ID NO: 151647 - DNA, 20 bp, Artificial
  CRISPR gRNA sequence
tctgctttaggaaaagcctt

SEQ ID NO: 151648 - DNA, 20 bp, Artificial
  CRISPR gRNA sequence
taaaagtactcactttttcc

SEQ ID NO: 151649 - DNA, 20 bp, Artificial
  CRISPR gRNA sequence
tacctttgtctttcgaagtc

SEQ ID NO: 151650 - DNA, 20 bp, Artificial
  CRISPR gRNA sequence
cgaagtcaggaatttataaa

SEQ ID NO: 151651 - DNA, 20 bp, Artificial
  CRISPR gRNA sequence
gaatttataaaaagagtttg

SEQ ID NO: 151652 - DNA, 20 bp, Artificial
  CRISPR gRNA sequence
agagctgtccaaagatggga

SEQ ID NO: 151653 - DNA, 20 bp, Artificial
  CRISPR gRNA sequence
gtaagccagtttcccagaac

SEQ ID NO: 151654 - DNA, 20 bp, Artificial
  CRISPR gRNA sequence
agctggttgaacacttaagg

SEQ ID NO: 151655 - DNA, 20 bp, Artificial
  CRISPR gRNA sequence
acacttaaggtagaatcacc

SEQ ID NO: 151656 - DNA, 20 bp, Artificial
  CRISPR gRNA sequence
aagctgcgagcgtcttatga

SEQ ID NO: 151657 - DNA, 20 bp, Artificial
  CRISPR gRNA sequence
cgtcttatgaaggggtgggc

SEQ ID NO: 151658 - DNA, 20 bp, Artificial
  CRISPR gRNA sequence
ctatgatgcagtaaaatgta

SEQ ID NO: 151659 - DNA, 20 bp, Artificial
  CRISPR gRNA sequence
tatttttcgctttacctatt

SEQ ID NO: 151660 - DNA, 20 bp, Artificial
  CRISPR gRNA sequence
gatggttctagacgtgcttt

SEQ ID NO: 151661 - DNA, 20 bp, Artificial
  CRISPR gRNA sequence
gtacctttgtaatgttttgg

SEQ ID NO: 151662 - DNA, 20 bp, Artificial
  CRISPR gRNA sequence
gggggatatcagaggacagc

SEQ ID NO: 151663 - DNA, 20 bp, Artificial
  CRISPR gRNA sequence
cccatttaaaaaaggttaaa

SEQ ID NO: 151664 - DNA, 20 bp, Artificial
  CRISPR gRNA sequence
gagtcactgtcttcattttc

SEQ ID NO: 151665 - DNA, 20 bp, Artificial
  CRISPR gRNA sequence
gttgttctcagtacatctaa

SEQ ID NO: 151666 - DNA, 20 bp, Artificial
  CRISPR gRNA sequence
gtggtgataaatgaaaatgc

SEQ ID NO: 151667 - DNA, 20 bp, Artificial
  CRISPR gRNA sequence
tcatattgtatcccaggtac

SEQ ID NO: 151668 - DNA, 20 bp, Artificial
  CRISPR gRNA sequence
acccactaatgtcattacac

SEQ ID NO: 151669 - DNA, 20 bp, Artificial
  CRISPR gRNA sequence
tcagagacctgtaaacattt

SEQ ID NO: 151670 - DNA, 20 bp, Artificial
  CRISPR gRNA sequence
agacctgtaaacatttaaga

SEQ ID NO: 151671 - DNA, 20 bp, Artificial
  CRISPR gRNA sequence
acatccccacaggctaaacc

SEQ ID NO: 151672 - DNA, 20 bp, Artificial
  CRISPR gRNA sequence
ttcattccattctgctgtga

SEQ ID NO: 151673 - DNA, 20 bp, Artificial
  CRISPR gRNA sequence
gtgctttgctttcagcccct

SEQ ID NO: 151674 - DNA, 20 bp, Artificial
  CRISPR gRNA sequence
aaccttttcaaataattcct

SEQ ID NO: 151675 - DNA, 20 bp, Artificial
  CRISPR gRNA sequence
ttaagacattacaatacagg

SEQ ID NO: 151676 - DNA, 20 bp, Artificial
  CRISPR gRNA sequence
ggaaatgctcattttcgatt

SEQ ID NO: 151677 - DNA, 20 bp, Artificial
  CRISPR gRNA sequence
cgattttggattttcagatt

SEQ ID NO: 151678 - DNA, 20 bp, Artificial
  CRISPR gRNA sequence
actttgggaggacgaggcag

SEQ ID NO: 151679 - DNA, 20 bp, Artificial
  CRISPR gRNA sequence
caggtggatcatctgaggtc

SEQ ID NO: 151680 - DNA, 20 bp, Artificial
  CRISPR gRNA sequence
tactcaggaggctgaggcag

SEQ ID NO: 151681 - DNA, 20 bp, Artificial
  CRISPR gRNA sequence
tttctggtccccaggcattt

SEQ ID NO: 151682 - DNA, 20 bp, Artificial
  CRISPR gRNA sequence
gcatttcagaatttcagata

SEQ ID NO: 151683 - DNA, 20 bp, Artificial
  CRISPR gRNA sequence
tctacagttatagctgacat

SEQ ID NO: 151684 - DNA, 20 bp, Artificial
  CRISPR gRNA sequence
tactttttttttttttgcga

SEQ ID NO: 151685 - DNA, 20 bp, Artificial
  CRISPR gRNA sequence
tcttgctctgttgcccaggc

SEQ ID NO: 151686 - DNA, 20 bp, Artificial
  CRISPR gRNA sequence
ctcactgcaacctctgcctc

SEQ ID NO: 151687 - DNA, 20 bp, Artificial
  CRISPR gRNA sequence
gattctcctgcctcagcctc

SEQ ID NO: 151688 - DNA, 20 bp, Artificial
  CRISPR gRNA sequence
gcctcagcctcctgagtaac

SEQ ID NO: 151689 - DNA, 20 bp, Artificial
  CRISPR gRNA sequence
ttttgtatttttagtagaga

SEQ ID NO: 151690 - DNA, 20 bp, Artificial
  CRISPR gRNA sequence
atccacctgcctcggcttcc

SEQ ID NO: 151691 - DNA, 20 bp, Artificial
  CRISPR gRNA sequence
gcctcggcttcccagagtgt

SEQ ID NO: 151692 - DNA, 20 bp, Artificial
  CRISPR gRNA sequence
cagatttgtctgagattaga

SEQ ID NO: 151693 - DNA, 20 bp, Artificial
  CRISPR gRNA sequence
catcaggagccccagagaaa

SEQ ID NO: 151694 - DNA, 20 bp, Artificial
  CRISPR gRNA sequence
ttttttttttttttttgaga

SEQ ID NO: 151695 - DNA, 20 bp, Artificial
  CRISPR gRNA sequence
tctcgctctgtcgcccaggc

SEQ ID NO: 151696 - DNA, 20 bp, Artificial
  CRISPR gRNA sequence
cccaggctggagtgcagtgg

SEQ ID NO: 151697 - DNA, 20 bp, Artificial
  CRISPR gRNA sequence
ctcactgcaagctccgcctc

SEQ ID NO: 151698 - DNA, 20 bp, Artificial
  CRISPR gRNA sequence
ttttgtatttttagtagaga

SEQ ID NO: 151699 - DNA, 20 bp, Artificial
  CRISPR gRNA sequence
cggggtttcactgttttagc

SEQ ID NO: 151700 - DNA, 20 bp, Artificial
  CRISPR gRNA sequence
gcctcggcctcccaaagtgc

SEQ ID NO: 151701 - DNA, 20 bp, Artificial
  CRISPR gRNA sequence
gatcctcctggctcaccttc

SEQ ID NO: 151702 - DNA, 20 bp, Artificial
  CRISPR gRNA sequence
ttggcttttatcttttaaga

SEQ ID NO: 151703 - DNA, 20 bp, Artificial
  CRISPR gRNA sequence
tcactggggacttttaatat

SEQ ID NO: 151704 - DNA, 20 bp, Artificial
  CRISPR gRNA sequence
ttgctgaaggctgtggcatg

SEQ ID NO: 151705 - DNA, 20 bp, Artificial
  CRISPR gRNA sequence
gaacttgaaaaagctttgga

SEQ ID NO: 151706 - DNA, 20 bp, Artificial
  CRISPR gRNA sequence
taaaagtccttgattaacat

SEQ ID NO: 151707 - DNA, 20 bp, Artificial
  CRISPR gRNA sequence
taccttatcaaactgaaaga

SEQ ID NO: 151708 - DNA, 20 bp, Artificial
  CRISPR gRNA sequence
tgtcgagatgtccacagaag

SEQ ID NO: 151709 - DNA, 20 bp, Artificial
  CRISPR gRNA sequence
agcctacagtcgttctggcc

SEQ ID NO: 151710 - DNA, 20 bp, Artificial
  CRISPR gRNA sequence
ctcgggtcatggaagaaatc

SEQ ID NO: 151711 - DNA, 20 bp, Artificial
  CRISPR gRNA sequence
ggaatttaacagtggtgagg

SEQ ID NO: 151712 - DNA, 20 bp, Artificial
  CRISPR gRNA sequence
acttttattagaaactttta

SEQ ID NO: 151713 - DNA, 20 bp, Artificial
  CRISPR gRNA sequence
gcatggttcacccctgacct

SEQ ID NO: 151714 - DNA, 20 bp, Artificial
  CRISPR gRNA sequence
gccttccgtgaggtaactgc

SEQ ID NO: 151715 - DNA, 20 bp, Artificial
  CRISPR gRNA sequence
ccataggcgtgtggtgtgca

SEQ ID NO: 151716 - DNA, 20 bp, Artificial
  CRISPR gRNA sequence
tattcaacaacaaatctatt

SEQ ID NO: 151717 - DNA, 20 bp, Artificial
  CRISPR gRNA sequence
gatgccagtagcacccctcc

SEQ ID NO: 151718 - DNA, 20 bp, Artificial
  CRISPR gRNA sequence
cttgttgagaactactgact

SEQ ID NO: 151719 - DNA, 20 bp, Artificial
  CRISPR gRNA sequence
tacaatctagtaattacaac

SEQ ID NO: 151720 - DNA, 20 bp, Artificial
  CRISPR gRNA sequence
aggtatttactaagtactta

SEQ ID NO: 151721 - DNA, 20 bp, Artificial
  CRISPR gRNA sequence
ttactgaatcaggcacagtg

SEQ ID NO: 151722 - DNA, 20 bp, Artificial
  CRISPR gRNA sequence
tagtgcttgattctttctgg

SEQ ID NO: 151723 - DNA, 20 bp, Artificial
  CRISPR gRNA sequence
aagtaaagggaacatttttg

SEQ ID NO: 151724 - DNA, 20 bp, Artificial
  CRISPR gRNA sequence
tttttgttgagtcttaaaat

SEQ ID NO: 151725 - DNA, 20 bp, Artificial
  CRISPR gRNA sequence
gtaagcattcaccagatgtg

SEQ ID NO: 151726 - DNA, 20 bp, Artificial
  CRISPR gRNA sequence
taggggaacatcaagacatt

SEQ ID NO: 151727 - DNA, 20 bp, Artificial
  CRISPR gRNA sequence
gtttagtggaggttgaggga

SEQ ID NO: 151728 - DNA, 20 bp, Artificial
  CRISPR gRNA sequence
aaggagtaagtatgtggtat

SEQ ID NO: 151729 - DNA, 20 bp, Artificial
  CRISPR gRNA sequence
tagtggaaggtgagacaggt

SEQ ID NO: 151730 - DNA, 20 bp, Artificial
  CRISPR gRNA sequence
aaggtgagacaggttagagt

SEQ ID NO: 151731 - DNA, 20 bp, Artificial
  CRISPR gRNA sequence
cagttgtcatgtccttaatg

SEQ ID NO: 151732 - DNA, 20 bp, Artificial
  CRISPR gRNA sequence
gcatcctggcagagcagaca

SEQ ID NO: 151733 - DNA, 20 bp, Artificial
  CRISPR gRNA sequence
cactggattccttcctgatg

SEQ ID NO: 151734 - DNA, 20 bp, Artificial
  CRISPR gRNA sequence
ctaaggctatgctagatact

SEQ ID NO: 151735 - DNA, 20 bp, Artificial
  CRISPR gRNA sequence
acagtaatgaaccagacaga

SEQ ID NO: 151736 - DNA, 20 bp, Artificial
  CRISPR gRNA sequence
gataaatgcccactgacttc

SEQ ID NO: 151737 - DNA, 20 bp, Artificial
  CRISPR gRNA sequence
gataaaaagtaattcatgtt

SEQ ID NO: 151738 - DNA, 20 bp, Artificial
  CRISPR gRNA sequence
ttcatgttttggatatacct

SEQ ID NO: 151739 - DNA, 20 bp, Artificial
  CRISPR gRNA sequence
gggtcatgtttgtttatatg

SEQ ID NO: 151740 - DNA, 20 bp, Artificial
  CRISPR gRNA sequence
ttagcctttctcagactggc

SEQ ID NO: 151741 - DNA, 20 bp, Artificial
  CRISPR gRNA sequence
ttctcagactggcctgggtt

SEQ ID NO: 151742 - DNA, 20 bp, Artificial
  CRISPR gRNA sequence
cagactggcctgggttcaga

SEQ ID NO: 151743 - DNA, 20 bp, Artificial
  CRISPR gRNA sequence
tcagatatgaaagagaaggg

SEQ ID NO: 151744 - DNA, 20 bp, Artificial
  CRISPR gRNA sequence
aaatgaaatgataaagtcaa

SEQ ID NO: 151745 - DNA, 20 bp, Artificial
  CRISPR gRNA sequence
aaatgataaagtcaaaagga

SEQ ID NO: 151746 - DNA, 20 bp, Artificial
  CRISPR gRNA sequence
ggtgttttgttcatatttta

SEQ ID NO: 151747 - DNA, 20 bp, Artificial
  CRISPR gRNA sequence
agcttatcagcttttggtgc

SEQ ID NO: 151748 - DNA, 20 bp, Artificial
  CRISPR gRNA sequence
tggggtcagcttggtgtaaa

SEQ ID NO: 151749 - DNA, 20 bp, Artificial
  CRISPR gRNA sequence
gtgtaaaatgaatgctgtcc

SEQ ID NO: 151750 - DNA, 20 bp, Artificial
  CRISPR gRNA sequence
tgagccgagaggcataaatc

SEQ ID NO: 151751 - DNA, 20 bp, Artificial
  CRISPR gRNA sequence
attgttatggaacttacctt

SEQ ID NO: 151752 - DNA, 20 bp, Artificial
  CRISPR gRNA sequence
cagccaccattctgctttct

SEQ ID NO: 151753 - DNA, 20 bp, Artificial
  CRISPR gRNA sequence
tttttgatacctcatagaag

SEQ ID NO: 151754 - DNA, 20 bp, Artificial
  CRISPR gRNA sequence
cattcagtagcagttgtact

SEQ ID NO: 151755 - DNA, 20 bp, Artificial
  CRISPR gRNA sequence
ctcaacactttactataaaa

SEQ ID NO: 151756 - DNA, 20 bp, Artificial
  CRISPR gRNA sequence
tagtaaatgcattttcaact

SEQ ID NO: 151757 - DNA, 20 bp, Artificial
  CRISPR gRNA sequence
caacttaacaatagctttat

SEQ ID NO: 151758 - DNA, 20 bp, Artificial
  CRISPR gRNA sequence
atgtctgttgaagcatgtga

SEQ ID NO: 151759 - DNA, 20 bp, Artificial
  CRISPR gRNA sequence
ttttttttcctttttggaga

SEQ ID NO: 151760 - DNA, 20 bp, Artificial
  CRISPR gRNA sequence
tctcactctgtcatccaggc

SEQ ID NO: 151761 - DNA, 20 bp, Artificial
  CRISPR gRNA sequence
gatcctcccgcctcagcctc

SEQ ID NO: 151762 - DNA, 20 bp, Artificial
  CRISPR gRNA sequence
tttgtatttttctgtagagg

SEQ ID NO: 151763 - DNA, 20 bp, Artificial
  CRISPR gRNA sequence
acatctgcctcccaaagtgc

SEQ ID NO: 151764 - DNA, 20 bp, Artificial
  CRISPR gRNA sequence
ttttttcttttttaaagaga

SEQ ID NO: 151765 - DNA, 20 bp, Artificial
  CRISPR gRNA sequence
ggtctcactctgttcattgc

SEQ ID NO: 151766 - DNA, 20 bp, Artificial
  CRISPR gRNA sequence
tcattgctggagtgcagtgg

SEQ ID NO: 151767 - DNA, 20 bp, Artificial
  CRISPR gRNA sequence
gccttggccctccaaagcac

SEQ ID NO: 151768 - DNA, 20 bp, Artificial
  CRISPR gRNA sequence
tcctttttttttttttaagg

SEQ ID NO: 151769 - DNA, 20 bp, Artificial
  CRISPR gRNA sequence
gttcatctgttaatggacat

SEQ ID NO: 151770 - DNA, 20 bp, Artificial
  CRISPR gRNA sequence
ggtttcacctcttggctatt

SEQ ID NO: 151771 - DNA, 20 bp, Artificial
  CRISPR gRNA sequence
gaatagtgctgctgtgttac

SEQ ID NO: 151772 - DNA, 20 bp, Artificial
  CRISPR gRNA sequence
tagtctatcagaagttaaaa

SEQ ID NO: 151773 - DNA, 20 bp, Artificial
  CRISPR gRNA sequence
gttaaaagagaattactttg

SEQ ID NO: 151774 - DNA, 20 bp, Artificial
  CRISPR gRNA sequence
tcagttttggttcaagtttt

SEQ ID NO: 151775 - DNA, 20 bp, Artificial
  CRISPR gRNA sequence
aagcaacatcaattccatat

SEQ ID NO: 151776 - DNA, 20 bp, Artificial
  CRISPR gRNA sequence
catcaattccatatttgagt

SEQ ID NO: 151777 - DNA, 20 bp, Artificial
  CRISPR gRNA sequence
agaatgcaatccagtaaagt

SEQ ID NO: 151778 - DNA, 20 bp, Artificial
  CRISPR gRNA sequence
tcttattttcccctcttctc

SEQ ID NO: 151779 - DNA, 20 bp, Artificial
  CRISPR gRNA sequence
caatcataagtaaaacttac

SEQ ID NO: 151780 - DNA, 20 bp, Artificial
  CRISPR gRNA sequence
aaatccaggtggtgttcagc

SEQ ID NO: 151781 - DNA, 20 bp, Artificial
  CRISPR gRNA sequence
atatcaagatgattgtgcac

SEQ ID NO: 151782 - DNA, 20 bp, Artificial
  CRISPR gRNA sequence
aaataacagacttcttcgtg

SEQ ID NO: 151783 - DNA, 20 bp, Artificial
  CRISPR gRNA sequence
ctaactttgtctttatggag

SEQ ID NO: 151784 - DNA, 20 bp, Artificial
  CRISPR gRNA sequence
ggggcaggtgggcaacaatg

SEQ ID NO: 151785 - DNA, 20 bp, Artificial
  CRISPR gRNA sequence
cagccttcacttaactgtaa

SEQ ID NO: 151786 - DNA, 20 bp, Artificial
  CRISPR gRNA sequence
cattcctcagtgcctcctga

SEQ ID NO: 151787 - DNA, 20 bp, Artificial
  CRISPR gRNA sequence
tctgtatgaaccacgtgagg

SEQ ID NO: 151788 - DNA, 20 bp, Artificial
  CRISPR gRNA sequence
agtaggttaggaacggaacc

SEQ ID NO: 151789 - DNA, 20 bp, Artificial
  CRISPR gRNA sequence
cctgggattctgtgtttctt

SEQ ID NO: 151790 - DNA, 20 bp, Artificial
  CRISPR gRNA sequence
gctggtccaaggaccttact

SEQ ID NO: 151791 - DNA, 20 bp, Artificial
  CRISPR gRNA sequence
cagtagtccttaactctcac

SEQ ID NO: 151792 - DNA, 20 bp, Artificial
  CRISPR gRNA sequence
acttggatcatagtcacaag

SEQ ID NO: 151793 - DNA, 20 bp, Artificial
  CRISPR gRNA sequence
agtactctacccactagagc

SEQ ID NO: 151794 - DNA, 20 bp, Artificial
  CRISPR gRNA sequence
cccctgggccacagaccggt

SEQ ID NO: 151795 - DNA, 20 bp, Artificial
  CRISPR gRNA sequence
cagtggcattagattctcaa

SEQ ID NO: 151796 - DNA, 20 bp, Artificial
  CRISPR gRNA sequence
tatcatgaactgcgcatgtg

SEQ ID NO: 151797 - DNA, 20 bp, Artificial
  CRISPR gRNA sequence
ctaggtagcacactccttat

SEQ ID NO: 151798 - DNA, 20 bp, Artificial
  CRISPR gRNA sequence
gaggttggggaccactgtcc

SEQ ID NO: 151799 - DNA, 20 bp, Artificial
  CRISPR gRNA sequence
taacctgcagccccaagatt

SEQ ID NO: 151800 - DNA, 20 bp, Artificial
  CRISPR gRNA sequence
attgagaatcattgatttca

SEQ ID NO: 151801 - DNA, 20 bp, Artificial
  CRISPR gRNA sequence
atcattgatttcaaagggtt

SEQ ID NO: 151802 - DNA, 20 bp, Artificial
  CRISPR gRNA sequence
ggttgagaatcttgacttgc

SEQ ID NO: 151803 - DNA, 20 bp, Artificial
  CRISPR gRNA sequence
tgacttgccagagtgcctga

SEQ ID NO: 151804 - DNA, 20 bp, Artificial
  CRISPR gRNA sequence
tctctttattatttgaaact

SEQ ID NO: 151805 - DNA, 20 bp, Artificial
  CRISPR gRNA sequence
tctttgtctccaaactctca

SEQ ID NO: 151806 - DNA, 20 bp, Artificial
  CRISPR gRNA sequence
tgtctccaaactctcattga

SEQ ID NO: 151807 - DNA, 20 bp, Artificial
  CRISPR gRNA sequence
ctcattgagtgaattcagat

SEQ ID NO: 151808 - DNA, 20 bp, Artificial
  CRISPR gRNA sequence
ttggtagtggtcaggagcat

SEQ ID NO: 151809 - DNA, 20 bp, Artificial
  CRISPR gRNA sequence
tgtgtcagctgttcttccag

SEQ ID NO: 151810 - DNA, 20 bp, Artificial
  CRISPR gRNA sequence
gttgaatcagtatcaggaga

SEQ ID NO: 151811 - DNA, 20 bp, Artificial
  CRISPR gRNA sequence
agtatcaggagaaggagtta

SEQ ID NO: 151812 - DNA, 20 bp, Artificial
  CRISPR gRNA sequence
tagctagtgaagtggggagc

SEQ ID NO: 151813 - DNA, 20 bp, Artificial
  CRISPR gRNA sequence
cttacatgtaactagaaggc

SEQ ID NO: 151814 - DNA, 20 bp, Artificial
  CRISPR gRNA sequence
atgtaactagaaggctagga

SEQ ID NO: 151815 - DNA, 20 bp, Artificial
  CRISPR gRNA sequence
taggataggattatagaaaa

SEQ ID NO: 151816 - DNA, 20 bp, Artificial
  CRISPR gRNA sequence
aaaactgggtgattgtcaac

SEQ ID NO: 151817 - DNA, 20 bp, Artificial
  CRISPR gRNA sequence
acaaagaaaagctttgggaa

SEQ ID NO: 151818 - DNA, 20 bp, Artificial
  CRISPR gRNA sequence
attttacatctctgcaaggc

SEQ ID NO: 151819 - DNA, 20 bp, Artificial
  CRISPR gRNA sequence
gattaaagaagagaaattga

SEQ ID NO: 151820 - DNA, 20 bp, Artificial
  CRISPR gRNA sequence
tagcctgggaggttttccaa

SEQ ID NO: 151821 - DNA, 20 bp, Artificial
  CRISPR gRNA sequence
gaagaccagtggttgatttc

SEQ ID NO: 151822 - DNA, 20 bp, Artificial
  CRISPR gRNA sequence
aaacttttaaaaaaactctt

SEQ ID NO: 151823 - DNA, 20 bp, Artificial
  CRISPR gRNA sequence
ctctgtctttgttgttctgt

SEQ ID NO: 151824 - DNA, 20 bp, Artificial
  CRISPR gRNA sequence
tccttctttgtgtccccgca

SEQ ID NO: 151825 - DNA, 20 bp, Artificial
  CRISPR gRNA sequence
gggatccctcccctccagta

SEQ ID NO: 151826 - DNA, 20 bp, Artificial
  CRISPR gRNA sequence
ctcccctccagtattgggta

SEQ ID NO: 151827 - DNA, 20 bp, Artificial
  CRISPR gRNA sequence
accacaagctcttcaaaggt

SEQ ID NO: 151828 - DNA, 20 bp, Artificial
  CRISPR gRNA sequence
ctttcttttttaaatagtga

SEQ ID NO: 151829 - DNA, 20 bp, Artificial
  CRISPR gRNA sequence
attctcccatctcagccttc

SEQ ID NO: 151830 - DNA, 20 bp, Artificial
  CRISPR gRNA sequence
atctcagccttccagagtgc

SEQ ID NO: 151831 - DNA, 20 bp, Artificial
  CRISPR gRNA sequence
tatcatacatttactattag

SEQ ID NO: 151832 - DNA, 20 bp, Artificial
  CRISPR gRNA sequence
tttactattagttgagttgc

SEQ ID NO: 151833 - DNA, 20 bp, Artificial
  CRISPR gRNA sequence
gaaagagcaaggggaaaaac

SEQ ID NO: 151834 - DNA, 20 bp, Artificial
  CRISPR gRNA sequence
agcaaggggaaaaacaagaa

SEQ ID NO: 151835 - DNA, 20 bp, Artificial
  CRISPR gRNA sequence
cttctaagtctctgttactc

SEQ ID NO: 151836 - DNA, 20 bp, Artificial
  CRISPR gRNA sequence
ctccagggttagttttagta

SEQ ID NO: 151837 - DNA, 20 bp, Artificial
  CRISPR gRNA sequence
ggtgtttgaagtttgtagag

SEQ ID NO: 151838 - DNA, 20 bp, Artificial
  CRISPR gRNA sequence
agtggtagccaagcagcttg

SEQ ID NO: 151839 - DNA, 20 bp, Artificial
  CRISPR gRNA sequence
aggtgagcatattaggttta

SEQ ID NO: 151840 - DNA, 20 bp, Artificial
  CRISPR gRNA sequence
gtcacatttcagaccactta

SEQ ID NO: 151841 - DNA, 20 bp, Artificial
  CRISPR gRNA sequence
ctcaaaattgatttttttcc

SEQ ID NO: 151842 - DNA, 20 bp, Artificial
  CRISPR gRNA sequence
agggcttaagtctcaaatta

SEQ ID NO: 151843 - DNA, 20 bp, Artificial
  CRISPR gRNA sequence
actatcagttgtaaagaact

SEQ ID NO: 151844 - DNA, 20 bp, Artificial
  CRISPR gRNA sequence
cgttgctgttagtttggtca

SEQ ID NO: 151845 - DNA, 20 bp, Artificial
  CRISPR gRNA sequence
agaaagaactggcagtttag

SEQ ID NO: 151846 - DNA, 20 bp, Artificial
  CRISPR gRNA sequence
cctgcatatgttaagtaaag

SEQ ID NO: 151847 - DNA, 20 bp, Artificial
  CRISPR gRNA sequence
cctgaagagagggaccaagc

SEQ ID NO: 151848 - DNA, 20 bp, Artificial
  CRISPR gRNA sequence
tgttcatttcagaaagactt

SEQ ID NO: 151849 - DNA, 20 bp, Artificial
  CRISPR gRNA sequence
gtattaagaagattatgaaa

SEQ ID NO: 151850 - DNA, 20 bp, Artificial
  CRISPR gRNA sequence
aactggatgaagatgtgaag

SEQ ID NO: 151851 - DNA, 20 bp, Artificial
  CRISPR gRNA sequence
tttcttattgaagctaagtg

SEQ ID NO: 151852 - DNA, 20 bp, Artificial
  CRISPR gRNA sequence
tgagcagttttggttactat

SEQ ID NO: 151853 - DNA, 20 bp, Artificial
  CRISPR gRNA sequence
tgttgaaaaaatagttgatg

SEQ ID NO: 151854 - DNA, 20 bp, Artificial
  CRISPR gRNA sequence
tgggtttttttttttttttt

SEQ ID NO: 151855 - DNA, 20 bp, Artificial
  CRISPR gRNA sequence
aattcccatgcctcagactc

SEQ ID NO: 151856 - DNA, 20 bp, Artificial
  CRISPR gRNA sequence
gcctcagactcccgagtagc

SEQ ID NO: 151857 - DNA, 20 bp, Artificial
  CRISPR gRNA sequence
ttttgtattttttgtagaga

SEQ ID NO: 151858 - DNA, 20 bp, Artificial
  CRISPR gRNA sequence
gcctctgcctcccaaagtgc

SEQ ID NO: 151859 - DNA, 20 bp, Artificial
  CRISPR gRNA sequence
ccttttctttctttttgaga

SEQ ID NO: 151860 - DNA, 20 bp, Artificial
  CRISPR gRNA sequence
cttaatttttaatgtttttt

SEQ ID NO: 151861 - DNA, 20 bp, Artificial
  CRISPR gRNA sequence
tgtttttttggagtggggga

SEQ ID NO: 151862 - DNA, 20 bp, Artificial
  CRISPR gRNA sequence
gcctcagcctcccaaagtgc

SEQ ID NO: 151863 - DNA, 20 bp, Artificial
  CRISPR gRNA sequence
ctgttctaaccttttgatct

SEQ ID NO: 151864 - DNA, 20 bp, Artificial
  CRISPR gRNA sequence
gatctatgagtttcttttac

SEQ ID NO: 151865 - DNA, 20 bp, Artificial
  CRISPR gRNA sequence
tacatgaataatacttgtga

SEQ ID NO: 151866 - DNA, 20 bp, Artificial
  CRISPR gRNA sequence
ttggccatttctgtattcct

SEQ ID NO: 151867 - DNA, 20 bp, Artificial
  CRISPR gRNA sequence
cctgtgagatttgatataat

SEQ ID NO: 151868 - DNA, 20 bp, Artificial
  CRISPR gRNA sequence
aagaggttaagtgactcacc

SEQ ID NO: 151869 - DNA, 20 bp, Artificial
  CRISPR gRNA sequence
cctatatgccaagccctggg

SEQ ID NO: 151870 - DNA, 20 bp, Artificial
  CRISPR gRNA sequence
cagtacatgaaaaagcccaa

SEQ ID NO: 151871 - DNA, 20 bp, Artificial
  CRISPR gRNA sequence
cttcctcatattgtttctcc

SEQ ID NO: 151872 - DNA, 20 bp, Artificial
  CRISPR gRNA sequence
tttctttgaaaggctattat

SEQ ID NO: 151873 - DNA, 20 bp, Artificial
  CRISPR gRNA sequence
tacctgctttgttcccactc

SEQ ID NO: 151874 - DNA, 20 bp, Artificial
  CRISPR gRNA sequence
ctcatggatttattttacct

SEQ ID NO: 151875 - DNA, 20 bp, Artificial
  CRISPR gRNA sequence
ttattttaccttggaatctc

SEQ ID NO: 151876 - DNA, 20 bp, Artificial
  CRISPR gRNA sequence
ggcagcccagatttttatca

SEQ ID NO: 151877 - DNA, 20 bp, Artificial
  CRISPR gRNA sequence
acagagttgactcttcgagc

SEQ ID NO: 151878 - DNA, 20 bp, Artificial
  CRISPR gRNA sequence
cagacttagattaggaaaac

SEQ ID NO: 151879 - DNA, 20 bp, Artificial
  CRISPR gRNA sequence
taaacagaggctcaagtgat

SEQ ID NO: 151880 - DNA, 20 bp, Artificial
  CRISPR gRNA sequence
tgttccttgtcagccttcct

SEQ ID NO: 151881 - DNA, 20 bp, Artificial
  CRISPR gRNA sequence
taattttaatttttaaccta

SEQ ID NO: 151882 - DNA, 20 bp, Artificial
  CRISPR gRNA sequence
gatttcccagatacaagaag

SEQ ID NO: 151883 - DNA, 20 bp, Artificial
  CRISPR gRNA sequence
cgggcacttttctaggctct

SEQ ID NO: 151884 - DNA, 20 bp, Artificial
  CRISPR gRNA sequence
ttgtcaatgcgtcataaagt

SEQ ID NO: 151885 - DNA, 20 bp, Artificial
  CRISPR gRNA sequence
tgttgccttgaagttagtct

SEQ ID NO: 151886 - DNA, 20 bp, Artificial
  CRISPR gRNA sequence
agatactgttttacacccac

SEQ ID NO: 151887 - DNA, 20 bp, Artificial
  CRISPR gRNA sequence
taccacagttggtgaggaag

SEQ ID NO: 151888 - DNA, 20 bp, Artificial
  CRISPR gRNA sequence
gaaactcatatattgctggt

SEQ ID NO: 151889 - DNA, 20 bp, Artificial
  CRISPR gRNA sequence
actcaagtgtccatcaatat

SEQ ID NO: 151890 - DNA, 20 bp, Artificial
  CRISPR gRNA sequence
aattctgaggtattgatgaa

SEQ ID NO: 151891 - DNA, 20 bp, Artificial
  CRISPR gRNA sequence
aaaccattgctccatacaac

SEQ ID NO: 151892 - DNA, 20 bp, Artificial
  CRISPR gRNA sequence
ccacctatagtgatagaaat

SEQ ID NO: 151893 - DNA, 20 bp, Artificial
  CRISPR gRNA sequence
ttgtggttgcccagatttag

SEQ ID NO: 151894 - DNA, 20 bp, Artificial
  CRISPR gRNA sequence
agatttaggggagtgtgggg

SEQ ID NO: 151895 - DNA, 20 bp, Artificial
  CRISPR gRNA sequence
tccttttttattttttgaga

SEQ ID NO: 151896 - DNA, 20 bp, Artificial
  CRISPR gRNA sequence
tctcactctgtggcctaggc

SEQ ID NO: 151897 - DNA, 20 bp, Artificial
  CRISPR gRNA sequence
caagcgatcctcctgcctca

SEQ ID NO: 151898 - DNA, 20 bp, Artificial
  CRISPR gRNA sequence
tctatgtttccaaaatactc

SEQ ID NO: 151899 - DNA, 20 bp, Artificial
  CRISPR gRNA sequence
aaatgagccatttagataga

SEQ ID NO: 151900 - DNA, 20 bp, Artificial
  CRISPR gRNA sequence
ctatattgtagtcatcttaa

SEQ ID NO: 151901 - DNA, 20 bp, Artificial
  CRISPR gRNA sequence
atgggccctgcttcagttgg

SEQ ID NO: 151902 - DNA, 20 bp, Artificial
  CRISPR gRNA sequence
ggttggcaagaagggcggac

SEQ ID NO: 151903 - DNA, 20 bp, Artificial
  CRISPR gRNA sequence
atcctctcctgttttgtccg

SEQ ID NO: 151904 - DNA, 20 bp, Artificial
  CRISPR gRNA sequence
accttttaaggtgtggtata

SEQ ID NO: 151905 - DNA, 20 bp, Artificial
  CRISPR gRNA sequence
tgtggtatatagagtttgct

SEQ ID NO: 151906 - DNA, 20 bp, Artificial
  CRISPR gRNA sequence
aaacataagcaaagtttaca

SEQ ID NO: 151907 - DNA, 20 bp, Artificial
  CRISPR gRNA sequence
tcttaactatacataatatg

SEQ ID NO: 151908 - DNA, 20 bp, Artificial
  CRISPR gRNA sequence
tgctgttcatagcacaaact

SEQ ID NO: 151909 - DNA, 20 bp, Artificial
  CRISPR gRNA sequence
atagcacaaactatgaatat

SEQ ID NO: 151910 - DNA, 20 bp, Artificial
  CRISPR gRNA sequence
acaagctatgttttttattt

SEQ ID NO: 151911 - DNA, 20 bp, Artificial
  CRISPR gRNA sequence
atggtttaagtattgcaatt

SEQ ID NO: 151912 - DNA, 20 bp, Artificial
  CRISPR gRNA sequence
gaaaatgttgcaaaaagtta

SEQ ID NO: 151913 - DNA, 20 bp, Artificial
  CRISPR gRNA sequence
gttgcaaaaagttattgaat

SEQ ID NO: 151914 - DNA, 20 bp, Artificial
  CRISPR gRNA sequence
aacctaactttgctaaccca

SEQ ID NO: 151915 - DNA, 20 bp, Artificial
  CRISPR gRNA sequence
taatttgaaaatcgcgggga

SEQ ID NO: 151916 - DNA, 20 bp, Artificial
  CRISPR gRNA sequence
tcgcggggagaggatcaagc

SEQ ID NO: 151917 - DNA, 20 bp, Artificial
  CRISPR gRNA sequence
cagataccccattttacagt

SEQ ID NO: 151918 - DNA, 20 bp, Artificial
  CRISPR gRNA sequence
ggtctgatcatttaaagtat

SEQ ID NO: 151919 - DNA, 20 bp, Artificial
  CRISPR gRNA sequence
aagtcgtcttaccttacttg

SEQ ID NO: 151920 - DNA, 20 bp, Artificial
  CRISPR gRNA sequence
aagcgtcaggtgagctgtga

SEQ ID NO: 151921 - DNA, 20 bp, Artificial
  CRISPR gRNA sequence
tctccttctgttactcattt

SEQ ID NO: 151922 - DNA, 20 bp, Artificial
  CRISPR gRNA sequence
gtctatcagagctcttcatc

SEQ ID NO: 151923 - DNA, 20 bp, Artificial
  CRISPR gRNA sequence
gagctcttcatctgggatag

SEQ ID NO: 151924 - DNA, 20 bp, Artificial
  CRISPR gRNA sequence
tctatgtgcacagtggcatt

SEQ ID NO: 151925 - DNA, 20 bp, Artificial
  CRISPR gRNA sequence
tgtgcacagtggcatttgga

SEQ ID NO: 151926 - DNA, 20 bp, Artificial
  CRISPR gRNA sequence
atagtaccctgactgcacac

SEQ ID NO: 151927 - DNA, 20 bp, Artificial
  CRISPR gRNA sequence
tgcacactagaatcacctgt

SEQ ID NO: 151928 - DNA, 20 bp, Artificial
  CRISPR gRNA sequence
caggctctaacccacatcag

SEQ ID NO: 151929 - DNA, 20 bp, Artificial
  CRISPR gRNA sequence
ctaacccacatcagctgaat

SEQ ID NO: 151930 - DNA, 20 bp, Artificial
  CRISPR gRNA sequence
tcagtaccttttaaaactcc

SEQ ID NO: 151931 - DNA, 20 bp, Artificial
  CRISPR gRNA sequence
ttttgcaagcaatcacaaga

SEQ ID NO: 151932 - DNA, 20 bp, Artificial
  CRISPR gRNA sequence
ctagttgttttttcagcacc

SEQ ID NO: 151933 - DNA, 20 bp, Artificial
  CRISPR gRNA sequence
tgccacttgggaaattgtgg

SEQ ID NO: 151934 - DNA, 20 bp, Artificial
  CRISPR gRNA sequence
tatataaaactttattttta

SEQ ID NO: 151935 - DNA, 20 bp, Artificial
  CRISPR gRNA sequence
ctgaccctgcatgagggcct

SEQ ID NO: 151936 - DNA, 20 bp, Artificial
  CRISPR gRNA sequence
gccctctgtcacctccttac

SEQ ID NO: 151937 - DNA, 20 bp, Artificial
  CRISPR gRNA sequence
ctgtcacctccttactagag

SEQ ID NO: 151938 - DNA, 20 bp, Artificial
  CRISPR gRNA sequence
gtgttcagaggagctttcag

SEQ ID NO: 151939 - DNA, 20 bp, Artificial
  CRISPR gRNA sequence
caggctcaattcctcctctt

SEQ ID NO: 151940 - DNA, 20 bp, Artificial
  CRISPR gRNA sequence
atttatcttccttcagaaca

SEQ ID NO: 151941 - DNA, 20 bp, Artificial
  CRISPR gRNA sequence
tgttttctgtgggctgcctg

SEQ ID NO: 151942 - DNA, 20 bp, Artificial
  CRISPR gRNA sequence
tgaatacactggctggagag

SEQ ID NO: 151943 - DNA, 20 bp, Artificial
  CRISPR gRNA sequence
ctccaaattcctcagtgctt

SEQ ID NO: 151944 - DNA, 20 bp, Artificial
  CRISPR gRNA sequence
ctcagtgcttctgggtctct

SEQ ID NO: 151945 - DNA, 20 bp, Artificial
  CRISPR gRNA sequence
ctgaaacagcttcttgttgc

SEQ ID NO: 151946 - DNA, 20 bp, Artificial
  CRISPR gRNA sequence
agttcactcttgctactaaa

SEQ ID NO: 151947 - DNA, 20 bp, Artificial
  CRISPR gRNA sequence
caacactgtagagatggccc

SEQ ID NO: 151948 - DNA, 20 bp, Artificial
  CRISPR gRNA sequence
agttgagcaagtgccccatt

SEQ ID NO: 151949 - DNA, 20 bp, Artificial
  CRISPR gRNA sequence
aaaggaactagtcagaaata

SEQ ID NO: 151950 - DNA, 20 bp, Artificial
  CRISPR gRNA sequence
ctagtcagaaatactgaatt

SEQ ID NO: 151951 - DNA, 20 bp, Artificial
  CRISPR gRNA sequence
ctgacttctcaaagatactt

SEQ ID NO: 151952 - DNA, 20 bp, Artificial
  CRISPR gRNA sequence
cttctgccccactaaagcta

SEQ ID NO: 151953 - DNA, 20 bp, Artificial
  CRISPR gRNA sequence
gctggcttgacctccattgg

SEQ ID NO: 151954 - DNA, 20 bp, Artificial
  CRISPR gRNA sequence
gcttgacctccattggcaga

SEQ ID NO: 151955 - DNA, 20 bp, Artificial
  CRISPR gRNA sequence
ctagttcataaacagtttaa

SEQ ID NO: 151956 - DNA, 20 bp, Artificial
  CRISPR gRNA sequence
agcttttggcaagagatatt

SEQ ID NO: 151957 - DNA, 20 bp, Artificial
  CRISPR gRNA sequence
gagatattttgggttctgga

SEQ ID NO: 151958 - DNA, 20 bp, Artificial
  CRISPR gRNA sequence
ggttctggaaggggttttta

SEQ ID NO: 151959 - DNA, 20 bp, Artificial
  CRISPR gRNA sequence
atactagatcagctgtagtt

SEQ ID NO: 151960 - DNA, 20 bp, Artificial
  CRISPR gRNA sequence
agagcttttccaagttaggt

SEQ ID NO: 151961 - DNA, 20 bp, Artificial
  CRISPR gRNA sequence
tatttataatgatgataagt

SEQ ID NO: 151962 - DNA, 20 bp, Artificial
  CRISPR gRNA sequence
agacctagatgaaaataaaa

SEQ ID NO: 151963 - DNA, 20 bp, Artificial
  CRISPR gRNA sequence
tgccttagcataatcatatt

SEQ ID NO: 151964 - DNA, 20 bp, Artificial
  CRISPR gRNA sequence
catatattaacttagaaacc

SEQ ID NO: 151965 - DNA, 20 bp, Artificial
  CRISPR gRNA sequence
gttacaggtatctccctaag

SEQ ID NO: 151966 - DNA, 20 bp, Artificial
  CRISPR gRNA sequence
tgcagagacccatgtttctc

SEQ ID NO: 151967 - DNA, 20 bp, Artificial
  CRISPR gRNA sequence
ccccagacatcaggcaaaca

SEQ ID NO: 151968 - DNA, 20 bp, Artificial
  CRISPR gRNA sequence
gcttcctcacactgtggcca

SEQ ID NO: 151969 - DNA, 20 bp, Artificial
  CRISPR gRNA sequence
gagtcttagaggtaccaaaa

SEQ ID NO: 151970 - DNA, 20 bp, Artificial
  CRISPR gRNA sequence
ttttctattggtaacagctg

SEQ ID NO: 151971 - DNA, 20 bp, Artificial
  CRISPR gRNA sequence
gtaacagctgttgggtttaa

SEQ ID NO: 151972 - DNA, 20 bp, Artificial
  CRISPR gRNA sequence
gaatttgtcatatcagcaag

SEQ ID NO: 151973 - DNA, 20 bp, Artificial
  CRISPR gRNA sequence
catcattcatcacgcactta

SEQ ID NO: 151974 - DNA, 20 bp, Artificial
  CRISPR gRNA sequence
agtgcctacctgggaacgcg

SEQ ID NO: 151975 - DNA, 20 bp, Artificial
  CRISPR gRNA sequence
gagggcacctaacatagtgt

SEQ ID NO: 151976 - DNA, 20 bp, Artificial
  CRISPR gRNA sequence
cacctaacatagtgtgggga

SEQ ID NO: 151977 - DNA, 20 bp, Artificial
  CRISPR gRNA sequence
gctttgtaaatgttactttg

SEQ ID NO: 151978 - DNA, 20 bp, Artificial
  CRISPR gRNA sequence
ggggagttggaggcaatcca

SEQ ID NO: 151979 - DNA, 20 bp, Artificial
  CRISPR gRNA sequence
ggaacgtggcaaactttgcc

SEQ ID NO: 151980 - DNA, 20 bp, Artificial
  CRISPR gRNA sequence
actttgccctgaataaggac

SEQ ID NO: 151981 - DNA, 20 bp, Artificial
  CRISPR gRNA sequence
catgtgtcacacaggtcact

SEQ ID NO: 151982 - DNA, 20 bp, Artificial
  CRISPR gRNA sequence
tgagctcaaggtggctggga

SEQ ID NO: 151983 - DNA, 20 bp, Artificial
  CRISPR gRNA sequence
tctccactccgcagatcgga

SEQ ID NO: 151984 - DNA, 20 bp, Artificial
  CRISPR gRNA sequence
agagctgtccatcaggcccc

SEQ ID NO: 151985 - DNA, 20 bp, Artificial
  CRISPR gRNA sequence
aaccagaaccagatgtgaca

SEQ ID NO: 151986 - DNA, 20 bp, Artificial
  CRISPR gRNA sequence
tttcaacaagctgtgaaaag

SEQ ID NO: 151987 - DNA, 20 bp, Artificial
  CRISPR gRNA sequence
agtggtggggctaaaacgag

SEQ ID NO: 151988 - DNA, 20 bp, Artificial
  CRISPR gRNA sequence
aggcctgagaggcatgatgt

SEQ ID NO: 151989 - DNA, 20 bp, Artificial
  CRISPR gRNA sequence
cgtttgcaacttatcatgca

SEQ ID NO: 151990 - DNA, 20 bp, Artificial
  CRISPR gRNA sequence
tgtatgttttgtgaagccta

SEQ ID NO: 151991 - DNA, 20 bp, Artificial
  CRISPR gRNA sequence
atttagcataactggtctct

SEQ ID NO: 151992 - DNA, 20 bp, Artificial
  CRISPR gRNA sequence
gcacatagcctgtttggggg

SEQ ID NO: 151993 - DNA, 20 bp, Artificial
  CRISPR gRNA sequence
gaaattcactgtggcggctg

SEQ ID NO: 151994 - DNA, 20 bp, Artificial
  CRISPR gRNA sequence
ggccaggtctgtgagctgct

SEQ ID NO: 151995 - DNA, 20 bp, Artificial
  CRISPR gRNA sequence
agacagtgccccttaggttt

SEQ ID NO: 151996 - DNA, 20 bp, Artificial
  CRISPR gRNA sequence
agccagatcattatagagca

SEQ ID NO: 151997 - DNA, 20 bp, Artificial
  CRISPR gRNA sequence
ttttccccagattcagctac

SEQ ID NO: 151998 - DNA, 20 bp, Artificial
  CRISPR gRNA sequence
gtactagacagtatgttctc

SEQ ID NO: 151999 - DNA, 20 bp, Artificial
  CRISPR gRNA sequence
aatgtctgaaatgccttatg

SEQ ID NO: 152000 - DNA, 20 bp, Artificial
  CRISPR gRNA sequence
ctgtgtgtctgtgtgagaag

SEQ ID NO: 152001 - DNA, 20 bp, Artificial
  CRISPR gRNA sequence
cagtagcattcatgtttgtt

SEQ ID NO: 152002 - DNA, 20 bp, Artificial
  CRISPR gRNA sequence
agaactctgtactatgagct

SEQ ID NO: 152003 - DNA, 20 bp, Artificial
  CRISPR gRNA sequence
tcaaacactgagcatcctct

SEQ ID NO: 152004 - DNA, 20 bp, Artificial
  CRISPR gRNA sequence
aaagttctgtgctatgtatt

SEQ ID NO: 152005 - DNA, 20 bp, Artificial
  CRISPR gRNA sequence
tatgtattggggatacaagc

SEQ ID NO: 152006 - DNA, 20 bp, Artificial
  CRISPR gRNA sequence
taaaacagtccttattttca

SEQ ID NO: 152007 - DNA, 20 bp, Artificial
  CRISPR gRNA sequence
aaggaattcacaatttagtt

SEQ ID NO: 152008 - DNA, 20 bp, Artificial
  CRISPR gRNA sequence
taaaggttgtaccaccacgt

SEQ ID NO: 152009 - DNA, 20 bp, Artificial
  CRISPR gRNA sequence
ccaccacgtgggaatgtgta

SEQ ID NO: 152010 - DNA, 20 bp, Artificial
  CRISPR gRNA sequence
ggccaatgtgggaggaaccc

SEQ ID NO: 152011 - DNA, 20 bp, Artificial
  CRISPR gRNA sequence
agtttgaggttacagtgagg

SEQ ID NO: 152012 - DNA, 20 bp, Artificial
  CRISPR gRNA sequence
actttgggaggccgaggcag

SEQ ID NO: 152013 - DNA, 20 bp, Artificial
  CRISPR gRNA sequence
ggccccagctacttaagagg

SEQ ID NO: 152014 - DNA, 20 bp, Artificial
  CRISPR gRNA sequence
tacttaagaggctgagttgg

SEQ ID NO: 152015 - DNA, 20 bp, Artificial
  CRISPR gRNA sequence
ttgtgccattgcactccagc

SEQ ID NO: 152016 - DNA, 20 bp, Artificial
  CRISPR gRNA sequence
gtgtgtatgtatgtagggga

SEQ ID NO: 152017 - DNA, 20 bp, Artificial
  CRISPR gRNA sequence
gtatgtatgtaggggagggg

SEQ ID NO: 152018 - DNA, 20 bp, Artificial
  CRISPR gRNA sequence
ggtcagataatgtttctgaa

SEQ ID NO: 152019 - DNA, 20 bp, Artificial
  CRISPR gRNA sequence
atgtttctgaagggaataat

SEQ ID NO: 152020 - DNA, 20 bp, Artificial
  CRISPR gRNA sequence
attaatcaaagaaagtggga

SEQ ID NO: 152021 - DNA, 20 bp, Artificial
  CRISPR gRNA sequence
tcgtatattctaataaggag

SEQ ID NO: 152022 - DNA, 20 bp, Artificial
  CRISPR gRNA sequence
ttgcctagaagaaaaaaaaa

SEQ ID NO: 152023 - DNA, 20 bp, Artificial
  CRISPR gRNA sequence
tctcacttcgtcactcaggc

SEQ ID NO: 152024 - DNA, 20 bp, Artificial
  CRISPR gRNA sequence
ccaggcatgtgccaccacac

SEQ ID NO: 152025 - DNA, 20 bp, Artificial
  CRISPR gRNA sequence
ttttaatttttttgtggaga

SEQ ID NO: 152026 - DNA, 20 bp, Artificial
  CRISPR gRNA sequence
accttggcctcccacagtgg

SEQ ID NO: 152027 - DNA, 20 bp, Artificial
  CRISPR gRNA sequence
actttgggaggccaaagcag

SEQ ID NO: 152028 - DNA, 20 bp, Artificial
  CRISPR gRNA sequence
caggagggtcgcatgggccc

SEQ ID NO: 152029 - DNA, 20 bp, Artificial
  CRISPR gRNA sequence
gtctcaaaaacaaacacaca

SEQ ID NO: 152030 - DNA, 20 bp, Artificial
  CRISPR gRNA sequence
actttgggaggccgaggtgg

SEQ ID NO: 152031 - DNA, 20 bp, Artificial
  CRISPR gRNA sequence
ggtgggcggatcacaaagcc

SEQ ID NO: 152032 - DNA, 20 bp, Artificial
  CRISPR gRNA sequence
acccggggaggctgaggcag

SEQ ID NO: 152033 - DNA, 20 bp, Artificial
  CRISPR gRNA sequence
gaatctcttgaacctgggag

SEQ ID NO: 152034 - DNA, 20 bp, Artificial
  CRISPR gRNA sequence
tcgtgccactgcactccaat

SEQ ID NO: 152035 - DNA, 20 bp, Artificial
  CRISPR gRNA sequence
aaaaaaggtaattatgattt

SEQ ID NO: 152036 - DNA, 20 bp, Artificial
  CRISPR gRNA sequence
atccatataacaaaaatgta

SEQ ID NO: 152037 - DNA, 20 bp, Artificial
  CRISPR gRNA sequence
ccagacactgtgctaggcag

SEQ ID NO: 152038 - DNA, 20 bp, Artificial
  CRISPR gRNA sequence
ccaaaggctttatcccttta

SEQ ID NO: 152039 - DNA, 20 bp, Artificial
  CRISPR gRNA sequence
ctttacagaatgaacttaga

SEQ ID NO: 152040 - DNA, 20 bp, Artificial
  CRISPR gRNA sequence
tggaaatcctctcgggaaaa

SEQ ID NO: 152041 - DNA, 20 bp, Artificial
  CRISPR gRNA sequence
tgggttgatacagtacagtg

SEQ ID NO: 152042 - DNA, 20 bp, Artificial
  CRISPR gRNA sequence
tgcatttctttttagtcagc

SEQ ID NO: 152043 - DNA, 20 bp, Artificial
  CRISPR gRNA sequence
ttggagctgataaggcttgt

SEQ ID NO: 152044 - DNA, 20 bp, Artificial
  CRISPR gRNA sequence
gtttcaccatcctgctgctt

SEQ ID NO: 152045 - DNA, 20 bp, Artificial
  CRISPR gRNA sequence
gtagtgatggctatttcaag

SEQ ID NO: 152046 - DNA, 20 bp, Artificial
  CRISPR gRNA sequence
tgcaaatatccttcgtagga

SEQ ID NO: 152047 - DNA, 20 bp, Artificial
  CRISPR gRNA sequence
agaatacatatgtattaaag

SEQ ID NO: 152048 - DNA, 20 bp, Artificial
  CRISPR gRNA sequence
tgtattaaagcagagttgga

SEQ ID NO: 152049 - DNA, 20 bp, Artificial
  CRISPR gRNA sequence
aaaacttatttctggaggtt

SEQ ID NO: 152050 - DNA, 20 bp, Artificial
  CRISPR gRNA sequence
ttctggaggttgggaatagg

SEQ ID NO: 152051 - DNA, 20 bp, Artificial
  CRISPR gRNA sequence
tgagttgaaaattgtggtac

SEQ ID NO: 152052 - DNA, 20 bp, Artificial
  CRISPR gRNA sequence
aatttctccgtagtaatccc

SEQ ID NO: 152053 - DNA, 20 bp, Artificial
  CRISPR gRNA sequence
catccccttcccttgtaact

SEQ ID NO: 152054 - DNA, 20 bp, Artificial
  CRISPR gRNA sequence
ttttcagtaacctatgcagt

SEQ ID NO: 152055 - DNA, 20 bp, Artificial
  CRISPR gRNA sequence
gcagtcagaattaagaacat

SEQ ID NO: 152056 - DNA, 20 bp, Artificial
  CRISPR gRNA sequence
gttgaagtttatgattcatt

SEQ ID NO: 152057 - DNA, 20 bp, Artificial
  CRISPR gRNA sequence
aaagtgaggagagatagtga

SEQ ID NO: 152058 - DNA, 20 bp, Artificial
  CRISPR gRNA sequence
atagtgatggaattcaagtc

SEQ ID NO: 152059 - DNA, 20 bp, Artificial
  CRISPR gRNA sequence
gatggaattcaagtcaggga

SEQ ID NO: 152060 - DNA, 20 bp, Artificial
  CRISPR gRNA sequence
actaaaggtttgagatttga

SEQ ID NO: 152061 - DNA, 20 bp, Artificial
  CRISPR gRNA sequence
ttgtgtctttaccgtctcaa

SEQ ID NO: 152062 - DNA, 20 bp, Artificial
  CRISPR gRNA sequence
caaccattgtgtgtgagaga

SEQ ID NO: 152063 - DNA, 20 bp, Artificial
  CRISPR gRNA sequence
gattgctatttttagaaagt

SEQ ID NO: 152064 - DNA, 20 bp, Artificial
  CRISPR gRNA sequence
tttcttaaattctattaatt

SEQ ID NO: 152065 - DNA, 20 bp, Artificial
  CRISPR gRNA sequence
aattaggggtagacttagtt

SEQ ID NO: 152066 - DNA, 20 bp, Artificial
  CRISPR gRNA sequence
ctgtgtcttaacagtgccca

SEQ ID NO: 152067 - DNA, 20 bp, Artificial
  CRISPR gRNA sequence
gccatctggccagtgtgggc

SEQ ID NO: 152068 - DNA, 20 bp, Artificial
  CRISPR gRNA sequence
ggcaggaattgctctgcagc

SEQ ID NO: 152069 - DNA, 20 bp, Artificial
  CRISPR gRNA sequence
gaattgctctgcagcttgaa

SEQ ID NO: 152070 - DNA, 20 bp, Artificial
  CRISPR gRNA sequence
ttggtttttctttcgttttg

SEQ ID NO: 152071 - DNA, 20 bp, Artificial
  CRISPR gRNA sequence
tgaccttaggcattcatgga

SEQ ID NO: 152072 - DNA, 20 bp, Artificial
  CRISPR gRNA sequence
agattgtccaggctcagcca

SEQ ID NO: 152073 - DNA, 20 bp, Artificial
  CRISPR gRNA sequence
agggtcaagcccaacaggcc

SEQ ID NO: 152074 - DNA, 20 bp, Artificial
  CRISPR gRNA sequence
gagagatccagcagatcccg

SEQ ID NO: 152075 - DNA, 20 bp, Artificial
  CRISPR gRNA sequence
gattctcctgcctcagcctc

SEQ ID NO: 152076 - DNA, 20 bp, Artificial
  CRISPR gRNA sequence
gcctcagcctcccgagtagc

SEQ ID NO: 152077 - DNA, 20 bp, Artificial
  CRISPR gRNA sequence
ttttgtatttttagtagaga

SEQ ID NO: 152078 - DNA, 20 bp, Artificial
  CRISPR gRNA sequence
gcctcggcctcccaaagtgc

SEQ ID NO: 152079 - DNA, 20 bp, Artificial
  CRISPR gRNA sequence
agtcctgtatttgattagca

SEQ ID NO: 152080 - DNA, 20 bp, Artificial
  CRISPR gRNA sequence
aatacacttgttgcatattc

SEQ ID NO: 152081 - DNA, 20 bp, Artificial
  CRISPR gRNA sequence
gctgcttcctgtgtgccttg

SEQ ID NO: 152082 - DNA, 20 bp, Artificial
  CRISPR gRNA sequence
tgaccccccaaaactggaaa

SEQ ID NO: 152083 - DNA, 20 bp, Artificial
  CRISPR gRNA sequence
aagtatcctgagatcagttt

SEQ ID NO: 152084 - DNA, 20 bp, Artificial
  CRISPR gRNA sequence
caagagaaagcttaggaaag

SEQ ID NO: 152085 - DNA, 20 bp, Artificial
  CRISPR gRNA sequence
tcacgtgtgcttacgatacc

SEQ ID NO: 152086 - DNA, 20 bp, Artificial
  CRISPR gRNA sequence
cctcaaccccaagatttctg

SEQ ID NO: 152087 - DNA, 20 bp, Artificial
  CRISPR gRNA sequence
caggttcatttaagacagag

SEQ ID NO: 152088 - DNA, 20 bp, Artificial
  CRISPR gRNA sequence
ttagcccagaagatttgttg

SEQ ID NO: 152089 - DNA, 20 bp, Artificial
  CRISPR gRNA sequence
ctggctcaggcaccttctgt

SEQ ID NO: 152090 - DNA, 20 bp, Artificial
  CRISPR gRNA sequence
agactctttaggcagctcat

SEQ ID NO: 152091 - DNA, 20 bp, Artificial
  CRISPR gRNA sequence
aattaatgtaaaaaagctat

SEQ ID NO: 152092 - DNA, 20 bp, Artificial
  CRISPR gRNA sequence
ccagacctgtcctgctgtag

SEQ ID NO: 152093 - DNA, 20 bp, Artificial
  CRISPR gRNA sequence
ctgctgtagaggaatgaggg

SEQ ID NO: 152094 - DNA, 20 bp, Artificial
  CRISPR gRNA sequence
tcacagcttttcagtcacat

SEQ ID NO: 152095 - DNA, 20 bp, Artificial
  CRISPR gRNA sequence
ttcatcttgtgatccctggc

SEQ ID NO: 152096 - DNA, 20 bp, Artificial
  CRISPR gRNA sequence
gttgccaggaagctgcatta

SEQ ID NO: 152097 - DNA, 20 bp, Artificial
  CRISPR gRNA sequence
tgcattataggatttaggtg

SEQ ID NO: 152098 - DNA, 20 bp, Artificial
  CRISPR gRNA sequence
tcctttgaaccagattttta

SEQ ID NO: 152099 - DNA, 20 bp, Artificial
  CRISPR gRNA sequence
agatttttaatgggtttaga

SEQ ID NO: 152100 - DNA, 20 bp, Artificial
  CRISPR gRNA sequence
ttgcctcaagtgggcaattc

SEQ ID NO: 152101 - DNA, 20 bp, Artificial
  CRISPR gRNA sequence
tttgattgaacactgcgtgc

SEQ ID NO: 152102 - DNA, 20 bp, Artificial
  CRISPR gRNA sequence
cattagcattttcctcatgg

SEQ ID NO: 152103 - DNA, 20 bp, Artificial
  CRISPR gRNA sequence
cctttcatttcctctaaatt

SEQ ID NO: 152104 - DNA, 20 bp, Artificial
  CRISPR gRNA sequence
atttcctctaaattgagggt

SEQ ID NO: 152105 - DNA, 20 bp, Artificial
  CRISPR gRNA sequence
tacactggagcattaagagc

SEQ ID NO: 152106 - DNA, 20 bp, Artificial
  CRISPR gRNA sequence
gtagctttggtttcccatga

SEQ ID NO: 152107 - DNA, 20 bp, Artificial
  CRISPR gRNA sequence
gcagtgtgagggctatgatg

SEQ ID NO: 152108 - DNA, 20 bp, Artificial
  CRISPR gRNA sequence
ggaatgatggctgtttgctt

SEQ ID NO: 152109 - DNA, 20 bp, Artificial
  CRISPR gRNA sequence
ctttgggatcctggcagatg

SEQ ID NO: 152110 - DNA, 20 bp, Artificial
  CRISPR gRNA sequence
tgctgttctcacctttgtga

SEQ ID NO: 152111 - DNA, 20 bp, Artificial
  CRISPR gRNA sequence
cctttgtgacaggatcttct

SEQ ID NO: 152112 - DNA, 20 bp, Artificial
  CRISPR gRNA sequence
ttttttctgaagtccattca

SEQ ID NO: 152113 - DNA, 20 bp, Artificial
  CRISPR gRNA sequence
cttctgtgctgtgtgacttg

SEQ ID NO: 152114 - DNA, 20 bp, Artificial
  CRISPR gRNA sequence
tgctgtgtgacttgtgggat

SEQ ID NO: 152115 - DNA, 20 bp, Artificial
  CRISPR gRNA sequence
aggcttctttggagggcttg

SEQ ID NO: 152116 - DNA, 20 bp, Artificial
  CRISPR gRNA sequence
tgcccctgccctaggtgcag

SEQ ID NO: 152117 - DNA, 20 bp, Artificial
  CRISPR gRNA sequence
tccttctgcacccaagaggc

SEQ ID NO: 152118 - DNA, 20 bp, Artificial
  CRISPR gRNA sequence
gccctacaatattgatggct

SEQ ID NO: 152119 - DNA, 20 bp, Artificial
  CRISPR gRNA sequence
ggggctgcctccctgggctt

SEQ ID NO: 152120 - DNA, 20 bp, Artificial
  CRISPR gRNA sequence
gcttgggggtgttgagggac

SEQ ID NO: 152121 - DNA, 20 bp, Artificial
  CRISPR gRNA sequence
ggtattacttgcagaagatg

SEQ ID NO: 152122 - DNA, 20 bp, Artificial
  CRISPR gRNA sequence
gtcaaggggaggcattgtta

SEQ ID NO: 152123 - DNA, 20 bp, Artificial
  CRISPR gRNA sequence
tattgacagtggtgacagag

SEQ ID NO: 152124 - DNA, 20 bp, Artificial
  CRISPR gRNA sequence
atctcatttgggaaaatacg

SEQ ID NO: 152125 - DNA, 20 bp, Artificial
  CRISPR gRNA sequence
atgagccaaaagcaaggctt

SEQ ID NO: 152126 - DNA, 20 bp, Artificial
  CRISPR gRNA sequence
tctgagttccatatagtctc

SEQ ID NO: 152127 - DNA, 20 bp, Artificial
  CRISPR gRNA sequence
aacctcataagattcttccc

SEQ ID NO: 152128 - DNA, 20 bp, Artificial
  CRISPR gRNA sequence
tccaaaaaacataacggcat

SEQ ID NO: 152129 - DNA, 20 bp, Artificial
  CRISPR gRNA sequence
tcagtttggggctgggcaca

SEQ ID NO: 152130 - DNA, 20 bp, Artificial
  CRISPR gRNA sequence
gcaggtgatcacatgaggtc

SEQ ID NO: 152131 - DNA, 20 bp, Artificial
  CRISPR gRNA sequence
tacttgggaggctgagacac

SEQ ID NO: 152132 - DNA, 20 bp, Artificial
  CRISPR gRNA sequence
ctgcactccagcctgggcga

SEQ ID NO: 152133 - DNA, 20 bp, Artificial
  CRISPR gRNA sequence
aggtgctcagtaaatgtttg

SEQ ID NO: 152134 - DNA, 20 bp, Artificial
  CRISPR gRNA sequence
taaatgtttgttgaatgaag

SEQ ID NO: 152135 - DNA, 20 bp, Artificial
  CRISPR gRNA sequence
tgtttgttgaatgaagctga

SEQ ID NO: 152136 - DNA, 20 bp, Artificial
  CRISPR gRNA sequence
taaatgaaatctcagctaat

SEQ ID NO: 152137 - DNA, 20 bp, Artificial
  CRISPR gRNA sequence
agttaaccttcttatctatg

SEQ ID NO: 152138 - DNA, 20 bp, Artificial
  CRISPR gRNA sequence
tgtttattctgcaacatttc

SEQ ID NO: 152139 - DNA, 20 bp, Artificial
  CRISPR gRNA sequence
ttcttgttcctcatagcctc

SEQ ID NO: 152140 - DNA, 20 bp, Artificial
  CRISPR gRNA sequence
agcctcatgggtaggcctgc

SEQ ID NO: 152141 - DNA, 20 bp, Artificial
  CRISPR gRNA sequence
gaccaaggccacttgctcgc

SEQ ID NO: 152142 - DNA, 20 bp, Artificial
  CRISPR gRNA sequence
tcatattccagtcagatgat

SEQ ID NO: 152143 - DNA, 20 bp, Artificial
  CRISPR gRNA sequence
agtcagatgatctgggtgat

SEQ ID NO: 152144 - DNA, 20 bp, Artificial
  CRISPR gRNA sequence
tggtttggagcccaccttcc

SEQ ID NO: 152145 - DNA, 20 bp, Artificial
  CRISPR gRNA sequence
ctaccccaaaccatagcacc

SEQ ID NO: 152146 - DNA, 20 bp, Artificial
  CRISPR gRNA sequence
catgtgttctgtttgagcct

SEQ ID NO: 152147 - DNA, 20 bp, Artificial
  CRISPR gRNA sequence
tttgagcctcagagtttgag

SEQ ID NO: 152148 - DNA, 20 bp, Artificial
  CRISPR gRNA sequence
agcctcagagtttgagatga

SEQ ID NO: 152149 - DNA, 20 bp, Artificial
  CRISPR gRNA sequence
tgagatgagtgggtggttga

SEQ ID NO: 152150 - DNA, 20 bp, Artificial
  CRISPR gRNA sequence
agtaggcattcattagagag

SEQ ID NO: 152151 - DNA, 20 bp, Artificial
  CRISPR gRNA sequence
gaactatctattatgtgctc

SEQ ID NO: 152152 - DNA, 20 bp, Artificial
  CRISPR gRNA sequence
gccatcagtgctagattagg

SEQ ID NO: 152153 - DNA, 20 bp, Artificial
  CRISPR gRNA sequence
ttgatctttatgaccctctt

SEQ ID NO: 152154 - DNA, 20 bp, Artificial
  CRISPR gRNA sequence
ctcttttgggtggtgggctg

SEQ ID NO: 152155 - DNA, 20 bp, Artificial
  CRISPR gRNA sequence
ccagttcacagatggacagg

SEQ ID NO: 152156 - DNA, 20 bp, Artificial
  CRISPR gRNA sequence
tacccaacctgggctgggca

SEQ ID NO: 152157 - DNA, 20 bp, Artificial
  CRISPR gRNA sequence
acctgggctgggcagagggt

SEQ ID NO: 152158 - DNA, 20 bp, Artificial
  CRISPR gRNA sequence
gagggtgaggatttgcgggg

SEQ ID NO: 152159 - DNA, 20 bp, Artificial
  CRISPR gRNA sequence
ggcagggtagcaggtagtat

SEQ ID NO: 152160 - DNA, 20 bp, Artificial
  CRISPR gRNA sequence
gtagcaggtagtatctgggt

SEQ ID NO: 152161 - DNA, 20 bp, Artificial
  CRISPR gRNA sequence
tgtcctgtcctctactaaca

SEQ ID NO: 152162 - DNA, 20 bp, Artificial
  CRISPR gRNA sequence
cccaaattgccattttacag

SEQ ID NO: 152163 - DNA, 20 bp, Artificial
  CRISPR gRNA sequence
cacgtgacctcttgagctct

SEQ ID NO: 152164 - DNA, 20 bp, Artificial
  CRISPR gRNA sequence
attttcagtccatgcgagga

SEQ ID NO: 152165 - DNA, 20 bp, Artificial
  CRISPR gRNA sequence
agagaccactgaggacatga

SEQ ID NO: 152166 - DNA, 20 bp, Artificial
  CRISPR gRNA sequence
tgaccttcctaagtggctgt

SEQ ID NO: 152167 - DNA, 20 bp, Artificial
  CRISPR gRNA sequence
ataccaggccacctccttag

SEQ ID NO: 152168 - DNA, 20 bp, Artificial
  CRISPR gRNA sequence
ctgagaaaagaaggagagga

SEQ ID NO: 152169 - DNA, 20 bp, Artificial
  CRISPR gRNA sequence
ccctgccagtgtagattacc

SEQ ID NO: 152170 - DNA, 20 bp, Artificial
  CRISPR gRNA sequence
caagctgctggtacagtggt

SEQ ID NO: 152171 - DNA, 20 bp, Artificial
  CRISPR gRNA sequence
aggaacagcgtgcagcaagc

SEQ ID NO: 152172 - DNA, 20 bp, Artificial
  CRISPR gRNA sequence
cctccttctgacgccttgca

SEQ ID NO: 152173 - DNA, 20 bp, Artificial
  CRISPR gRNA sequence
gagctgcatgcccctctccc

SEQ ID NO: 152174 - DNA, 20 bp, Artificial
  CRISPR gRNA sequence
tttttccatttttttctcta

SEQ ID NO: 152175 - DNA, 20 bp, Artificial
  CRISPR gRNA sequence
ggaatcaatatttcaatatg

SEQ ID NO: 152176 - DNA, 20 bp, Artificial
  CRISPR gRNA sequence
atatttatggcattttcttg

SEQ ID NO: 152177 - DNA, 20 bp, Artificial
  CRISPR gRNA sequence
ttttaggagcaaatctcccc

SEQ ID NO: 152178 - DNA, 20 bp, Artificial
  CRISPR gRNA sequence
cacgttgttctgccctcaga

SEQ ID NO: 152179 - DNA, 20 bp, Artificial
  CRISPR gRNA sequence
ctgccctcagatggaattag

SEQ ID NO: 152180 - DNA, 20 bp, Artificial
  CRISPR gRNA sequence
agacagatttattccctgtg

SEQ ID NO: 152181 - DNA, 20 bp, Artificial
  CRISPR gRNA sequence
agatttattccctgtggaga

SEQ ID NO: 152182 - DNA, 20 bp, Artificial
  CRISPR gRNA sequence
ttattccctgtggagagtgg

SEQ ID NO: 152183 - DNA, 20 bp, Artificial
  CRISPR gRNA sequence
aaatctcattttagataatt

SEQ ID NO: 152184 - DNA, 20 bp, Artificial
  CRISPR gRNA sequence
cattttagataatttagagt

SEQ ID NO: 152185 - DNA, 20 bp, Artificial
  CRISPR gRNA sequence
tttccaagcaaagtggcccc

SEQ ID NO: 152186 - DNA, 20 bp, Artificial
  CRISPR gRNA sequence
acacacaaagtcctagtttc

SEQ ID NO: 152187 - DNA, 20 bp, Artificial
  CRISPR gRNA sequence
ttcctgggtccctgggagaa

SEQ ID NO: 152188 - DNA, 20 bp, Artificial
  CRISPR gRNA sequence
tgggagaaaagagtgtggca

SEQ ID NO: 152189 - DNA, 20 bp, Artificial
  CRISPR gRNA sequence
gaatccacccactctccaca

SEQ ID NO: 152190 - DNA, 20 bp, Artificial
  CRISPR gRNA sequence
aaatctgtctcttaaatgca

SEQ ID NO: 152191 - DNA, 20 bp, Artificial
  CRISPR gRNA sequence
aaagaatgtttccatggcct

SEQ ID NO: 152192 - DNA, 20 bp, Artificial
  CRISPR gRNA sequence
gatgcaaatacacagagctc

SEQ ID NO: 152193 - DNA, 20 bp, Artificial
  CRISPR gRNA sequence
agagctctggggtcagagca

SEQ ID NO: 152194 - DNA, 20 bp, Artificial
  CRISPR gRNA sequence
caagggatggggagaggacc

SEQ ID NO: 152195 - DNA, 20 bp, Artificial
  CRISPR gRNA sequence
agaacaacgtggcaagtctt

SEQ ID NO: 152196 - DNA, 20 bp, Artificial
  CRISPR gRNA sequence
ttgggggtagcagctgttcc

SEQ ID NO: 152197 - DNA, 20 bp, Artificial
  CRISPR gRNA sequence
aatattgcatctttctgctg

SEQ ID NO: 152198 - DNA, 20 bp, Artificial
  CRISPR gRNA sequence
agaatctcggcccccaggca

SEQ ID NO: 152199 - DNA, 20 bp, Artificial
  CRISPR gRNA sequence
gcaggaggcgctgaggtcgg

SEQ ID NO: 152200 - DNA, 20 bp, Artificial
  CRISPR gRNA sequence
gctgtatggcaaaaattgtg

SEQ ID NO: 152201 - DNA, 20 bp, Artificial
  CRISPR gRNA sequence
tcggagggctggttggctga

SEQ ID NO: 152202 - DNA, 20 bp, Artificial
  CRISPR gRNA sequence
cccgcaggcatggtgacttg

SEQ ID NO: 152203 - DNA, 20 bp, Artificial
  CRISPR gRNA sequence
gatctggtagagctgctgcg

SEQ ID NO: 152204 - DNA, 20 bp, Artificial
  CRISPR gRNA sequence
gctgcgaggggtggagagga

SEQ ID NO: 152205 - DNA, 20 bp, Artificial
  CRISPR gRNA sequence
agaggggcatgcagctccct

SEQ ID NO: 152206 - DNA, 20 bp, Artificial
  CRISPR gRNA sequence
ctatgggtctcgagctggtt

SEQ ID NO: 152207 - DNA, 20 bp, Artificial
  CRISPR gRNA sequence
gaggggaagtggagctctgc

SEQ ID NO: 152208 - DNA, 20 bp, Artificial
  CRISPR gRNA sequence
ggcaccagcccggtgtgagg

SEQ ID NO: 152209 - DNA, 20 bp, Artificial
  CRISPR gRNA sequence
gtgggcagggaagaggtgca

SEQ ID NO: 152210 - DNA, 20 bp, Artificial
  CRISPR gRNA sequence
cagggaagaggtgcagggag

SEQ ID NO: 152211 - DNA, 20 bp, Artificial
  CRISPR gRNA sequence
atctacactggcaggggcag

SEQ ID NO: 152212 - DNA, 20 bp, Artificial
  CRISPR gRNA sequence
ccctcctctccttcttttct

SEQ ID NO: 152213 - DNA, 20 bp, Artificial
  CRISPR gRNA sequence
tggctcaggttgaaactaaa

SEQ ID NO: 152214 - DNA, 20 bp, Artificial
  CRISPR gRNA sequence
aggttgaaactaaactgaat

SEQ ID NO: 152215 - DNA, 20 bp, Artificial
  CRISPR gRNA sequence
aactatagccaagacgctcc

SEQ ID NO: 152216 - DNA, 20 bp, Artificial
  CRISPR gRNA sequence
ggtgctggcagaagccagag

SEQ ID NO: 152217 - DNA, 20 bp, Artificial
  CRISPR gRNA sequence
ctcgcatggactgaaaatga

SEQ ID NO: 152218 - DNA, 20 bp, Artificial
  CRISPR gRNA sequence
gacaaggcacttcccatctc

SEQ ID NO: 152219 - DNA, 20 bp, Artificial
  CRISPR gRNA sequence
ccactaagtctataaaacta

SEQ ID NO: 152220 - DNA, 20 bp, Artificial
  CRISPR gRNA sequence
caccctctgcccagcccagg

SEQ ID NO: 152221 - DNA, 20 bp, Artificial
  CRISPR gRNA sequence
cctctgtctgtgtaatctgt

SEQ ID NO: 152222 - DNA, 20 bp, Artificial
  CRISPR gRNA sequence
atctgtaagaatcaagatgg

SEQ ID NO: 152223 - DNA, 20 bp, Artificial
  CRISPR gRNA sequence
tagagttggtatgtcagctg

SEQ ID NO: 152224 - DNA, 20 bp, Artificial
  CRISPR gRNA sequence
caccagcccaccacccaaaa

SEQ ID NO: 152225 - DNA, 20 bp, Artificial
  CRISPR gRNA sequence
aagtgcccagcaggtgctca

SEQ ID NO: 152226 - DNA, 20 bp, Artificial
  CRISPR gRNA sequence
ctagcactgatggctacgtc

SEQ ID NO: 152227 - DNA, 20 bp, Artificial
  CRISPR gRNA sequence
tggcagcacaaagtgacatc

SEQ ID NO: 152228 - DNA, 20 bp, Artificial
  CRISPR gRNA sequence
ttcccacacccatctctcta

SEQ ID NO: 152229 - DNA, 20 bp, Artificial
  CRISPR gRNA sequence
ggaccctaggtgctatggtt

SEQ ID NO: 152230 - DNA, 20 bp, Artificial
  CRISPR gRNA sequence
tggtttggggtagaagtcct

SEQ ID NO: 152231 - DNA, 20 bp, Artificial
  CRISPR gRNA sequence
tatcacccagatcatctgac

SEQ ID NO: 152232 - DNA, 20 bp, Artificial
  CRISPR gRNA sequence
aggagaaaaggggagggacc

SEQ ID NO: 152233 - DNA, 20 bp, Artificial
  CRISPR gRNA sequence
taaaatcttatgtgtggact

SEQ ID NO: 152234 - DNA, 20 bp, Artificial
  CRISPR gRNA sequence
atcttatgtgtggactgtga

SEQ ID NO: 152235 - DNA, 20 bp, Artificial
  CRISPR gRNA sequence
gtcctctgtgtaccatttcc

SEQ ID NO: 152236 - DNA, 20 bp, Artificial
  CRISPR gRNA sequence
ttagtattccagaaatgttg

SEQ ID NO: 152237 - DNA, 20 bp, Artificial
  CRISPR gRNA sequence
gttaactgctctgtggccag

SEQ ID NO: 152238 - DNA, 20 bp, Artificial
  CRISPR gRNA sequence
ttaatttttattttttgaga

SEQ ID NO: 152239 - DNA, 20 bp, Artificial
  CRISPR gRNA sequence
tctcactctgtcgcccaggc

SEQ ID NO: 152240 - DNA, 20 bp, Artificial
  CRISPR gRNA sequence
ctcactgcaacctccacctc

SEQ ID NO: 152241 - DNA, 20 bp, Artificial
  CRISPR gRNA sequence
gtctcagcctcccaagtagc

SEQ ID NO: 152242 - DNA, 20 bp, Artificial
  CRISPR gRNA sequence
cagcctccctcccaaagtgc

SEQ ID NO: 152243 - DNA, 20 bp, Artificial
  CRISPR gRNA sequence
ctcccatgccgttatgtttt

SEQ ID NO: 152244 - DNA, 20 bp, Artificial
  CRISPR gRNA sequence
atgttttttggatcccaggg

SEQ ID NO: 152245 - DNA, 20 bp, Artificial
  CRISPR gRNA sequence
ttaaaaagaggggctggggg

SEQ ID NO: 152246 - DNA, 20 bp, Artificial
  CRISPR gRNA sequence
agaggggctgggggaagggt

SEQ ID NO: 152247 - DNA, 20 bp, Artificial
  CRISPR gRNA sequence
ccgcgtccttaggtaagccg

SEQ ID NO: 152248 - DNA, 20 bp, Artificial
  CRISPR gRNA sequence
cagaaatgcaactgggccag

SEQ ID NO: 152249 - DNA, 20 bp, Artificial
  CRISPR gRNA sequence
ttaaacgatcgctgcttttt

SEQ ID NO: 152250 - DNA, 20 bp, Artificial
  CRISPR gRNA sequence
tttttttgggtctgaggcaa

SEQ ID NO: 152251 - DNA, 20 bp, Artificial
  CRISPR gRNA sequence
gaagggcaatttttctggtt

SEQ ID NO: 152252 - DNA, 20 bp, Artificial
  CRISPR gRNA sequence
ttagggatgcaagaggaggt

SEQ ID NO: 152253 - DNA, 20 bp, Artificial
  CRISPR gRNA sequence
tgccagaacacaacagccac

SEQ ID NO: 152254 - DNA, 20 bp, Artificial
  CRISPR gRNA sequence
tcgaacatttcccaggtctg

SEQ ID NO: 152255 - DNA, 20 bp, Artificial
  CRISPR gRNA sequence
agatggtaagagaaaacact

SEQ ID NO: 152256 - DNA, 20 bp, Artificial
  CRISPR gRNA sequence
ccaattaccacccatgcctc

SEQ ID NO: 152257 - DNA, 20 bp, Artificial
  CRISPR gRNA sequence
cccatgcctcttgggtgcag

SEQ ID NO: 152258 - DNA, 20 bp, Artificial
  CRISPR gRNA sequence
cttgggtgcagaaggatatg

SEQ ID NO: 152259 - DNA, 20 bp, Artificial
  CRISPR gRNA sequence
cagaaggatatggagggtgt

SEQ ID NO: 152260 - DNA, 20 bp, Artificial
  CRISPR gRNA sequence
gggggtggtgcttctggttg

SEQ ID NO: 152261 - DNA, 20 bp, Artificial
  CRISPR gRNA sequence
tgagcattggtggcaagtgt

SEQ ID NO: 152262 - DNA, 20 bp, Artificial
  CRISPR gRNA sequence
tggatctgtccctgcacaac

SEQ ID NO: 152263 - DNA, 20 bp, Artificial
  CRISPR gRNA sequence
cctgatacaggctgggctaa

SEQ ID NO: 152264 - DNA, 20 bp, Artificial
  CRISPR gRNA sequence
gacaaagagaccataagaca

SEQ ID NO: 152265 - DNA, 20 bp, Artificial
  CRISPR gRNA sequence
acaagtcacacagcacagaa

SEQ ID NO: 152266 - DNA, 20 bp, Artificial
  CRISPR gRNA sequence
cacagaagagaatatattcc

SEQ ID NO: 152267 - DNA, 20 bp, Artificial
  CRISPR gRNA sequence
acatgatcacagcttatctt

SEQ ID NO: 152268 - DNA, 20 bp, Artificial
  CRISPR gRNA sequence
atttatctgactgacatcat

SEQ ID NO: 152269 - DNA, 20 bp, Artificial
  CRISPR gRNA sequence
taaagagatccagcatctgc

SEQ ID NO: 152270 - DNA, 20 bp, Artificial
  CRISPR gRNA sequence
ctctgtccccaagagccagg

SEQ ID NO: 152271 - DNA, 20 bp, Artificial
  CRISPR gRNA sequence
ccccaagagccaggctggat

SEQ ID NO: 152272 - DNA, 20 bp, Artificial
  CRISPR gRNA sequence
atgggggtctgtggggcttt

SEQ ID NO: 152273 - DNA, 20 bp, Artificial
  CRISPR gRNA sequence
aaacacctcccaaggggaag

SEQ ID NO: 152274 - DNA, 20 bp, Artificial
  CRISPR gRNA sequence
caaagctacgaaagcgccct

SEQ ID NO: 152275 - DNA, 20 bp, Artificial
  CRISPR gRNA sequence
aagtattagtgttttgagct

SEQ ID NO: 152276 - DNA, 20 bp, Artificial
  CRISPR gRNA sequence
ctcaatttagaggaaatgaa

SEQ ID NO: 152277 - DNA, 20 bp, Artificial
  CRISPR gRNA sequence
atgaaaggggttctgggagc

SEQ ID NO: 152278 - DNA, 20 bp, Artificial
  CRISPR gRNA sequence
atagactaggtctctatctg

SEQ ID NO: 152279 - DNA, 20 bp, Artificial
  CRISPR gRNA sequence
ttccatgaggaaaatgctaa

SEQ ID NO: 152280 - DNA, 20 bp, Artificial
  CRISPR gRNA sequence
ctctgagacttccagcctca

SEQ ID NO: 152281 - DNA, 20 bp, Artificial
  CRISPR gRNA sequence
aagttcacggtagaccattc

SEQ ID NO: 152282 - DNA, 20 bp, Artificial
  CRISPR gRNA sequence
tggttcaaaggagacagggc

SEQ ID NO: 152283 - DNA, 20 bp, Artificial
  CRISPR gRNA sequence
cctgcagtcatttctttcct

SEQ ID NO: 152284 - DNA, 20 bp, Artificial
  CRISPR gRNA sequence
gggaggctgtggtgccaagc

SEQ ID NO: 152285 - DNA, 20 bp, Artificial
  CRISPR gRNA sequence
gactgatggtggctagttcc

SEQ ID NO: 152286 - DNA, 20 bp, Artificial
  CRISPR gRNA sequence
gagtccccagaactccagcc

SEQ ID NO: 152287 - DNA, 20 bp, Artificial
  CRISPR gRNA sequence
aaaaactaaagccttgtccc

SEQ ID NO: 152288 - DNA, 20 bp, Artificial
  CRISPR gRNA sequence
gaaggtatactgacagctac

SEQ ID NO: 152289 - DNA, 20 bp, Artificial
  CRISPR gRNA sequence
aattacagagaaaataagct

SEQ ID NO: 152290 - DNA, 20 bp, Artificial
  CRISPR gRNA sequence
acattccaatgagctgccta

SEQ ID NO: 152291 - DNA, 20 bp, Artificial
  CRISPR gRNA sequence
gagccagtgaagatgaagta

SEQ ID NO: 152292 - DNA, 20 bp, Artificial
  CRISPR gRNA sequence
ggctaaagctctgtgcccca

SEQ ID NO: 152293 - DNA, 20 bp, Artificial
  CRISPR gRNA sequence
gaaccattcaacagaaatct

SEQ ID NO: 152294 - DNA, 20 bp, Artificial
  CRISPR gRNA sequence
gagctcagtcatctgcaatc

SEQ ID NO: 152295 - DNA, 20 bp, Artificial
  CRISPR gRNA sequence
aacaattcctaaactgatct

SEQ ID NO: 152296 - DNA, 20 bp, Artificial
  CRISPR gRNA sequence
aactgatctcaggatacttt

SEQ ID NO: 152297 - DNA, 20 bp, Artificial
  CRISPR gRNA sequence
aagtggttaaccaagtctac

SEQ ID NO: 152298 - DNA, 20 bp, Artificial
  CRISPR gRNA sequence
gacaaaaatggcaaagggca

SEQ ID NO: 152299 - DNA, 20 bp, Artificial
  CRISPR gRNA sequence
tcactcactttccagttttg

SEQ ID NO: 152300 - DNA, 20 bp, Artificial
  CRISPR gRNA sequence
acaaggacacattttacaaa

SEQ ID NO: 152301 - DNA, 20 bp, Artificial
  CRISPR gRNA sequence
gaagcagcagtccacagtaa

SEQ ID NO: 152302 - DNA, 20 bp, Artificial
  CRISPR gRNA sequence
gctccactgggaactgactc

SEQ ID NO: 152303 - DNA, 20 bp, Artificial
  CRISPR gRNA sequence
cagggcctttgggccttggc

SEQ ID NO: 152304 - DNA, 20 bp, Artificial
  CRISPR gRNA sequence
caatgatttccctgcatagg

SEQ ID NO: 152305 - DNA, 20 bp, Artificial
  CRISPR gRNA sequence
actttgggaggccgaggcgg

SEQ ID NO: 152306 - DNA, 20 bp, Artificial
  CRISPR gRNA sequence
cgggcggatcacctgaggtt

SEQ ID NO: 152307 - DNA, 20 bp, Artificial
  CRISPR gRNA sequence
tactcgggaggctgaggcag

SEQ ID NO: 152308 - DNA, 20 bp, Artificial
  CRISPR gRNA sequence
agccactgcacttcatcagt

SEQ ID NO: 152309 - DNA, 20 bp, Artificial
  CRISPR gRNA sequence
ctgtctcctaaaaagaaaaa

SEQ ID NO: 152310 - DNA, 20 bp, Artificial
  CRISPR gRNA sequence
gacctcagggcaggactcac

SEQ ID NO: 152311 - DNA, 20 bp, Artificial
  CRISPR gRNA sequence
gcaggactcaccgggatctg

SEQ ID NO: 152312 - DNA, 20 bp, Artificial
  CRISPR gRNA sequence
cacaggtgtggtctgaaagg

SEQ ID NO: 152313 - DNA, 20 bp, Artificial
  CRISPR gRNA sequence
ggtctgaaaggaagagttat

SEQ ID NO: 152314 - DNA, 20 bp, Artificial
  CRISPR gRNA sequence
aagagttatgagaatgctgc

SEQ ID NO: 152315 - DNA, 20 bp, Artificial
  CRISPR gRNA sequence
gagttcaggctcagagccca

SEQ ID NO: 152316 - DNA, 20 bp, Artificial
  CRISPR gRNA sequence
gctgggagcaaaccctctcc

SEQ ID NO: 152317 - DNA, 20 bp, Artificial
  CRISPR gRNA sequence
tcagtactagtaataaccta

SEQ ID NO: 152318 - DNA, 20 bp, Artificial
  CRISPR gRNA sequence
gtaataacctacagagtcct

SEQ ID NO: 152319 - DNA, 20 bp, Artificial
  CRISPR gRNA sequence
ctcacagtacaaatatttgc

SEQ ID NO: 152320 - DNA, 20 bp, Artificial
  CRISPR gRNA sequence
caaagtcaagtctggggcag

SEQ ID NO: 152321 - DNA, 20 bp, Artificial
  CRISPR gRNA sequence
ggaggggaacattaaatgga

SEQ ID NO: 152322 - DNA, 20 bp, Artificial
  CRISPR gRNA sequence
attaaatggaaagggtcagt

SEQ ID NO: 152323 - DNA, 20 bp, Artificial
  CRISPR gRNA sequence
cagtatgaatttatttagtt

SEQ ID NO: 152324 - DNA, 20 bp, Artificial
  CRISPR gRNA sequence
ctgagagaaaaataaagcac

SEQ ID NO: 152325 - DNA, 20 bp, Artificial
  CRISPR gRNA sequence
ctaagtctacccctaattaa

SEQ ID NO: 152326 - DNA, 20 bp, Artificial
  CRISPR gRNA sequence
gtaaagacacaagctgccaa

SEQ ID NO: 152327 - DNA, 20 bp, Artificial
  CRISPR gRNA sequence
atctggtggtggtagtgatg

SEQ ID NO: 152328 - DNA, 20 bp, Artificial
  CRISPR gRNA sequence
tggtagtgatggggggtggc

SEQ ID NO: 152329 - DNA, 20 bp, Artificial
  CRISPR gRNA sequence
ggggtggcgggggtgtgggc

SEQ ID NO: 152330 - DNA, 20 bp, Artificial
  CRISPR gRNA sequence
ctgtacacccaatccctgac

SEQ ID NO: 152331 - DNA, 20 bp, Artificial
  CRISPR gRNA sequence
catcactatctctcctcact

SEQ ID NO: 152332 - DNA, 20 bp, Artificial
  CRISPR gRNA sequence
agaagactatggaactctca

SEQ ID NO: 152333 - DNA, 20 bp, Artificial
  CRISPR gRNA sequence
catccaaagttacaagggaa

SEQ ID NO: 152334 - DNA, 20 bp, Artificial
  CRISPR gRNA sequence
ggaacgacagatgagattca

SEQ ID NO: 152335 - DNA, 20 bp, Artificial
  CRISPR gRNA sequence
agggccaaaaagaaagacga

SEQ ID NO: 152336 - DNA, 20 bp, Artificial
  CRISPR gRNA sequence
tcaatttatgacagaaaaca

SEQ ID NO: 152337 - DNA, 20 bp, Artificial
  CRISPR gRNA sequence
catatgtattctgtcctacg

SEQ ID NO: 152338 - DNA, 20 bp, Artificial
  CRISPR gRNA sequence
aacttgaaatagccatcact

SEQ ID NO: 152339 - DNA, 20 bp, Artificial
  CRISPR gRNA sequence
acaaggccaccctgaagcag

SEQ ID NO: 152340 - DNA, 20 bp, Artificial
  CRISPR gRNA sequence
cagctccaagctgagcacgt

SEQ ID NO: 152341 - DNA, 20 bp, Artificial
  CRISPR gRNA sequence
tatcaacccaattttcccga

SEQ ID NO: 152342 - DNA, 20 bp, Artificial
  CRISPR gRNA sequence
cacaacagccatgagcttct

SEQ ID NO: 152343 - DNA, 20 bp, Artificial
  CRISPR gRNA sequence
cctctaagttcattctgtaa

SEQ ID NO: 152344 - DNA, 20 bp, Artificial
  CRISPR gRNA sequence
actcaatacatttttgttat

SEQ ID NO: 152345 - DNA, 20 bp, Artificial
  CRISPR gRNA sequence
atggataagtaaaatgagca

SEQ ID NO: 152346 - DNA, 20 bp, Artificial
  CRISPR gRNA sequence
tctcgctctgtcacccagat

SEQ ID NO: 152347 - DNA, 20 bp, Artificial
  CRISPR gRNA sequence
attctcctgcctcagcctcc

SEQ ID NO: 152348 - DNA, 20 bp, Artificial
  CRISPR gRNA sequence
ttttgtatttttagtagaga

SEQ ID NO: 152349 - DNA, 20 bp, Artificial
  CRISPR gRNA sequence
acctcggcctcccaaagtac

SEQ ID NO: 152350 - DNA, 20 bp, Artificial
  CRISPR gRNA sequence
gctttggcctcccaaagtga

SEQ ID NO: 152351 - DNA, 20 bp, Artificial
  CRISPR gRNA sequence
actgtgggaggccaaggtgg

SEQ ID NO: 152352 - DNA, 20 bp, Artificial
  CRISPR gRNA sequence
tgggaggatggcataaagcc

SEQ ID NO: 152353 - DNA, 20 bp, Artificial
  CRISPR gRNA sequence
aggtgtggtggcacatgcct

SEQ ID NO: 152354 - DNA, 20 bp, Artificial
  CRISPR gRNA sequence
ttgtgctactacactccagc

SEQ ID NO: 152355 - DNA, 20 bp, Artificial
  CRISPR gRNA sequence
aggcaaactcagctccttat

SEQ ID NO: 152356 - DNA, 20 bp, Artificial
  CRISPR gRNA sequence
ttagaatatacgaggctgtc

SEQ ID NO: 152357 - DNA, 20 bp, Artificial
  CRISPR gRNA sequence
tttttgttttttttttgaga

SEQ ID NO: 152358 - DNA, 20 bp, Artificial
  CRISPR gRNA sequence
tcttgctctgtcaccctggc

SEQ ID NO: 152359 - DNA, 20 bp, Artificial
  CRISPR gRNA sequence
gcctcggcctcccaaagtgc

SEQ ID NO: 152360 - DNA, 20 bp, Artificial
  CRISPR gRNA sequence
ctcactgtaacctcaaactc

SEQ ID NO: 152361 - DNA, 20 bp, Artificial
  CRISPR gRNA sequence
acattggcctcccaaagtgt

SEQ ID NO: 152362 - DNA, 20 bp, Artificial
  CRISPR gRNA sequence
tttgtatccccaactaaatt

SEQ ID NO: 152363 - DNA, 20 bp, Artificial
  CRISPR gRNA sequence
agcacagaactttaccctca

SEQ ID NO: 152364 - DNA, 20 bp, Artificial
  CRISPR gRNA sequence
cagaggatgctcagtgtttg

SEQ ID NO: 152365 - DNA, 20 bp, Artificial
  CRISPR gRNA sequence
tgaataaataatgattgaca

SEQ ID NO: 152366 - DNA, 20 bp, Artificial
  CRISPR gRNA sequence
aataatgattgacagagaat

SEQ ID NO: 152367 - DNA, 20 bp, Artificial
  CRISPR gRNA sequence
tggattcagagctcatagta

SEQ ID NO: 152368 - DNA, 20 bp, Artificial
  CRISPR gRNA sequence
tcacatgacccccaacaaac

SEQ ID NO: 152369 - DNA, 20 bp, Artificial
  CRISPR gRNA sequence
acactactactggggagaga

SEQ ID NO: 152370 - DNA, 20 bp, Artificial
  CRISPR gRNA sequence
acagagaaatgacggggaga

SEQ ID NO: 152371 - DNA, 20 bp, Artificial
  CRISPR gRNA sequence
agacacacagacagcaggca

SEQ ID NO: 152372 - DNA, 20 bp, Artificial
  CRISPR gRNA sequence
tctaaaatttctgagctaat

SEQ ID NO: 152373 - DNA, 20 bp, Artificial
  CRISPR gRNA sequence
catttgacctttgagaaaaa

SEQ ID NO: 152374 - DNA, 20 bp, Artificial
  CRISPR gRNA sequence
aaaacagggtccagagagat

SEQ ID NO: 152375 - DNA, 20 bp, Artificial
  CRISPR gRNA sequence
gtaacatctcaccccagtag

SEQ ID NO: 152376 - DNA, 20 bp, Artificial
  CRISPR gRNA sequence
acctaaggggcactgtcttg

SEQ ID NO: 152377 - DNA, 20 bp, Artificial
  CRISPR gRNA sequence
gcgatgatgatctgcccagg

SEQ ID NO: 152378 - DNA, 20 bp, Artificial
  CRISPR gRNA sequence
ggccctggacttggacagcg

SEQ ID NO: 152379 - DNA, 20 bp, Artificial
  CRISPR gRNA sequence
tagtactggactggctcggc

SEQ ID NO: 152380 - DNA, 20 bp, Artificial
  CRISPR gRNA sequence
gactggcgcacctcctcctg

SEQ ID NO: 152381 - DNA, 20 bp, Artificial
  CRISPR gRNA sequence
ccaactcagcagccgccaca

SEQ ID NO: 152382 - DNA, 20 bp, Artificial
  CRISPR gRNA sequence
aggctatgtgcagttgcctg

SEQ ID NO: 152383 - DNA, 20 bp, Artificial
  CRISPR gRNA sequence
catttgaagccaaaggaaag

SEQ ID NO: 152384 - DNA, 20 bp, Artificial
  CRISPR gRNA sequence
cttttcctgagctgaaattt

SEQ ID NO: 152385 - DNA, 20 bp, Artificial
  CRISPR gRNA sequence
cctgatggacagctctccgc

SEQ ID NO: 152386 - DNA, 20 bp, Artificial
  CRISPR gRNA sequence
gtcgcattctgtccgatctg

SEQ ID NO: 152387 - DNA, 20 bp, Artificial
  CRISPR gRNA sequence
ctgatgttttccatggcaga

SEQ ID NO: 152388 - DNA, 20 bp, Artificial
  CRISPR gRNA sequence
gccaccttgagctcacagct

SEQ ID NO: 152389 - DNA, 20 bp, Artificial
  CRISPR gRNA sequence
tgagctcacagctgagagtg

SEQ ID NO: 152390 - DNA, 20 bp, Artificial
  CRISPR gRNA sequence
tacagcatggttatagccca

SEQ ID NO: 152391 - DNA, 20 bp, Artificial
  CRISPR gRNA sequence
tggttatagcccacagggtc

SEQ ID NO: 152392 - DNA, 20 bp, Artificial
  CRISPR gRNA sequence
acacagaacggcgtctgatc

SEQ ID NO: 152393 - DNA, 20 bp, Artificial
  CRISPR gRNA sequence
cacagaaccacttgggctgg

SEQ ID NO: 152394 - DNA, 20 bp, Artificial
  CRISPR gRNA sequence
cttagatgtacacagaccct

SEQ ID NO: 152395 - DNA, 20 bp, Artificial
  CRISPR gRNA sequence
aggcactcagtaagtgcgtg

SEQ ID NO: 152396 - DNA, 20 bp, Artificial
  CRISPR gRNA sequence
cagtaagtgcgtgatgaatg

SEQ ID NO: 152397 - DNA, 20 bp, Artificial
  CRISPR gRNA sequence
aagtgcgtgatgaatgatga

SEQ ID NO: 152398 - DNA, 20 bp, Artificial
  CRISPR gRNA sequence
agaggcaggaaagtagttct

SEQ ID NO: 152399 - DNA, 20 bp, Artificial
  CRISPR gRNA sequence
gtgtcccctgtggaacagag

SEQ ID NO: 152400 - DNA, 20 bp, Artificial
  CRISPR gRNA sequence
tttgcctgatgtctgggggc

SEQ ID NO: 152401 - DNA, 20 bp, Artificial
  CRISPR gRNA sequence
agtatctacccctgagaaac

SEQ ID NO: 152402 - DNA, 20 bp, Artificial
  CRISPR gRNA sequence
agggagatacctgtaacatt

SEQ ID NO: 152403 - DNA, 20 bp, Artificial
  CRISPR gRNA sequence
gacctaacttggaaaagctc

SEQ ID NO: 152404 - DNA, 20 bp, Artificial
  CRISPR gRNA sequence
gaaaagctcttgggtaatga

SEQ ID NO: 152405 - DNA, 20 bp, Artificial
  CRISPR gRNA sequence
tgggtaatgagagggtatac

SEQ ID NO: 152406 - DNA, 20 bp, Artificial
  CRISPR gRNA sequence
caactacagctgatctagta

SEQ ID NO: 152407 - DNA, 20 bp, Artificial
  CRISPR gRNA sequence
tagacagtatctaggacact

SEQ ID NO: 152408 - DNA, 20 bp, Artificial
  CRISPR gRNA sequence
cacaactgttctcaaatcac

SEQ ID NO: 152409 - DNA, 20 bp, Artificial
  CRISPR gRNA sequence
attatgcttggtttaaagaa

SEQ ID NO: 152410 - DNA, 20 bp, Artificial
  CRISPR gRNA sequence
gcagaacaatgctttaatga

SEQ ID NO: 152411 - DNA, 20 bp, Artificial
  CRISPR gRNA sequence
ctttaatgactggatcaatc

SEQ ID NO: 152412 - DNA, 20 bp, Artificial
  CRISPR gRNA sequence
ccaactacagggcttgctct

SEQ ID NO: 152413 - DNA, 20 bp, Artificial
  CRISPR gRNA sequence
agtacattcgctttagtagc

SEQ ID NO: 152414 - DNA, 20 bp, Artificial
  CRISPR gRNA sequence
gaactgctgcctccttcaga

SEQ ID NO: 152415 - DNA, 20 bp, Artificial
  CRISPR gRNA sequence
tgctgcctccttcagaaagg

SEQ ID NO: 152416 - DNA, 20 bp, Artificial
  CRISPR gRNA sequence
ttcagaaagggtgggttttg

SEQ ID NO: 152417 - DNA, 20 bp, Artificial
  CRISPR gRNA sequence
gggaaaacttcatgtctaca

SEQ ID NO: 152418 - DNA, 20 bp, Artificial
  CRISPR gRNA sequence
gaggattaaaaatgctatct

SEQ ID NO: 152419 - DNA, 20 bp, Artificial
  CRISPR gRNA sequence
aaggccaggcagcagctgtc

SEQ ID NO: 152420 - DNA, 20 bp, Artificial
  CRISPR gRNA sequence
tagacacactttaaaatcag

SEQ ID NO: 152421 - DNA, 20 bp, Artificial
  CRISPR gRNA sequence
atcagatggatcatagcatt

SEQ ID NO: 152422 - DNA, 20 bp, Artificial
  CRISPR gRNA sequence
cattttgagtctggctaaga

SEQ ID NO: 152423 - DNA, 20 bp, Artificial
  CRISPR gRNA sequence
cgagagacccagaagcactg

SEQ ID NO: 152424 - DNA, 20 bp, Artificial
  CRISPR gRNA sequence
gaggaatttggaggaactga

SEQ ID NO: 152425 - DNA, 20 bp, Artificial
  CRISPR gRNA sequence
caggcagcccacagaaaaca

SEQ ID NO: 152426 - DNA, 20 bp, Artificial
  CRISPR gRNA sequence
aaacaaggagttagcacaat

SEQ ID NO: 152427 - DNA, 20 bp, Artificial
  CRISPR gRNA sequence
tctgaaggaagataaatggc

SEQ ID NO: 152428 - DNA, 20 bp, Artificial
  CRISPR gRNA sequence
agggaaggacccccaagagg

SEQ ID NO: 152429 - DNA, 20 bp, Artificial
  CRISPR gRNA sequence
acaccttacagcttccagtc

SEQ ID NO: 152430 - DNA, 20 bp, Artificial
  CRISPR gRNA sequence
ctaatccaaaggccctcatg

SEQ ID NO: 152431 - DNA, 20 bp, Artificial
  CRISPR gRNA sequence
caaaggccctcatgcagggt

SEQ ID NO: 152432 - DNA, 20 bp, Artificial
  CRISPR gRNA sequence
tcagaattacaaatgttcat

SEQ ID NO: 152433 - DNA, 20 bp, Artificial
  CRISPR gRNA sequence
gactggttattaatacaggc

SEQ ID NO: 152434 - DNA, 20 bp, Artificial
  CRISPR gRNA sequence
ttaatacaggctgggatggg

SEQ ID NO: 152435 - DNA, 20 bp, Artificial
  CRISPR gRNA sequence
gatggggagaatggctgtca

SEQ ID NO: 152436 - DNA, 20 bp, Artificial
  CRISPR gRNA sequence
gtcactgaatgactgcttct

SEQ ID NO: 152437 - DNA, 20 bp, Artificial
  CRISPR gRNA sequence
aatttcccaagtggcaccta

SEQ ID NO: 152438 - DNA, 20 bp, Artificial
  CRISPR gRNA sequence
ctgcacattaaaagcatcca

SEQ ID NO: 152439 - DNA, 20 bp, Artificial
  CRISPR gRNA sequence
gagattctgattcagctgat

SEQ ID NO: 152440 - DNA, 20 bp, Artificial
  CRISPR gRNA sequence
aggtgattctagtgtgcagt

SEQ ID NO: 152441 - DNA, 20 bp, Artificial
  CRISPR gRNA sequence
tctaaaatctataactttct

SEQ ID NO: 152442 - DNA, 20 bp, Artificial
  CRISPR gRNA sequence
gaaataccacttcggaggca

SEQ ID NO: 152443 - DNA, 20 bp, Artificial
  CRISPR gRNA sequence
tgagttaaaagtatccagaa

SEQ ID NO: 152444 - DNA, 20 bp, Artificial
  CRISPR gRNA sequence
gagtaacagaaggagatgtt

SEQ ID NO: 152445 - DNA, 20 bp, Artificial
  CRISPR gRNA sequence
aacagaaggagatgttaaga

SEQ ID NO: 152446 - DNA, 20 bp, Artificial
  CRISPR gRNA sequence
gtctagaaacgagaagcaaa

SEQ ID NO: 152447 - DNA, 20 bp, Artificial
  CRISPR gRNA sequence
atgtaactcacactgtaaaa

SEQ ID NO: 152448 - DNA, 20 bp, Artificial
  CRISPR gRNA sequence
agcaggtttctggtcattct

SEQ ID NO: 152449 - DNA, 20 bp, Artificial
  CRISPR gRNA sequence
ttccctttggttcacaagta

SEQ ID NO: 152450 - DNA, 20 bp, Artificial
  CRISPR gRNA sequence
tttgcaacattttcaagtca

SEQ ID NO: 152451 - DNA, 20 bp, Artificial
  CRISPR gRNA sequence
acaagctatgatttttattt

SEQ ID NO: 152452 - DNA, 20 bp, Artificial
  CRISPR gRNA sequence
taaattgcaatacttaaacc

SEQ ID NO: 152453 - DNA, 20 bp, Artificial
  CRISPR gRNA sequence
atgggtttatcattgcagtt

SEQ ID NO: 152454 - DNA, 20 bp, Artificial
  CRISPR gRNA sequence
aaataaaaaacatagcttgt

SEQ ID NO: 152455 - DNA, 20 bp, Artificial
  CRISPR gRNA sequence
caagagaggtaagagaacac

SEQ ID NO: 152456 - DNA, 20 bp, Artificial
  CRISPR gRNA sequence
aaaccaagacctgctctaat

SEQ ID NO: 152457 - DNA, 20 bp, Artificial
  CRISPR gRNA sequence
aagtgtgatacttcctttct

SEQ ID NO: 152458 - DNA, 20 bp, Artificial
  CRISPR gRNA sequence
tgaaaaaacactgaacgcta

SEQ ID NO: 152459 - DNA, 20 bp, Artificial
  CRISPR gRNA sequence
acttaaaaacagattacttg

SEQ ID NO: 152460 - DNA, 20 bp, Artificial
  CRISPR gRNA sequence
aaaaacagattacttgaagg

SEQ ID NO: 152461 - DNA, 20 bp, Artificial
  CRISPR gRNA sequence
attacttgaaggatggatag

SEQ ID NO: 152462 - DNA, 20 bp, Artificial
  CRISPR gRNA sequence
atagagggataaacagatat

SEQ ID NO: 152463 - DNA, 20 bp, Artificial
  CRISPR gRNA sequence
gcatagtaaaatgtttatgg

SEQ ID NO: 152464 - DNA, 20 bp, Artificial
  CRISPR gRNA sequence
actcatcggacaaaacagga

SEQ ID NO: 152465 - DNA, 20 bp, Artificial
  CRISPR gRNA sequence
ctaaatggctcatttattga

SEQ ID NO: 152466 - DNA, 20 bp, Artificial
  CRISPR gRNA sequence
cagcatataataaaatattc

SEQ ID NO: 152467 - DNA, 20 bp, Artificial
  CRISPR gRNA sequence
ttttaaattccctgaggcag

SEQ ID NO: 152468 - DNA, 20 bp, Artificial
  CRISPR gRNA sequence
gcaggaggatcgcttgagcc

SEQ ID NO: 152469 - DNA, 20 bp, Artificial
  CRISPR gRNA sequence
tacttgggaggctgaggtgg

SEQ ID NO: 152470 - DNA, 20 bp, Artificial
  CRISPR gRNA sequence
ctgcactccagcctaggcca

SEQ ID NO: 152471 - DNA, 20 bp, Artificial
  CRISPR gRNA sequence
cctatctcaaaaaataaaaa

SEQ ID NO: 152472 - DNA, 20 bp, Artificial
  CRISPR gRNA sequence
gtttctttttattgctgagg

SEQ ID NO: 152473 - DNA, 20 bp, Artificial
  CRISPR gRNA sequence
aatccatttcatcaatacct

SEQ ID NO: 152474 - DNA, 20 bp, Artificial
  CRISPR gRNA sequence
attcctatattgatggacac

SEQ ID NO: 152475 - DNA, 20 bp, Artificial
  CRISPR gRNA sequence
tgttaagagcatttttatat

SEQ ID NO: 152476 - DNA, 20 bp, Artificial
  CRISPR gRNA sequence
taagaatggctacagttctt

SEQ ID NO: 152477 - DNA, 20 bp, Artificial
  CRISPR gRNA sequence
gttcttttgggtacaaacct

SEQ ID NO: 152478 - DNA, 20 bp, Artificial
  CRISPR gRNA sequence
caaacctaggaatgaaatgg

SEQ ID NO: 152479 - DNA, 20 bp, Artificial
  CRISPR gRNA sequence
ggaatgaaatggctgggtta

SEQ ID NO: 152480 - DNA, 20 bp, Artificial
  CRISPR gRNA sequence
atggctgggttacagagtag

SEQ ID NO: 152481 - DNA, 20 bp, Artificial
  CRISPR gRNA sequence
tagattctgaccagcaatat

SEQ ID NO: 152482 - DNA, 20 bp, Artificial
  CRISPR gRNA sequence
tttttattttaggtattcta

SEQ ID NO: 152483 - DNA, 20 bp, Artificial
  CRISPR gRNA sequence
atgatgttgcatatcttctc

SEQ ID NO: 152484 - DNA, 20 bp, Artificial
  CRISPR gRNA sequence
tgcctattttattttctaat

SEQ ID NO: 152485 - DNA, 20 bp, Artificial
  CRISPR gRNA sequence
gatcttgaagggagctttaa

SEQ ID NO: 152486 - DNA, 20 bp, Artificial
  CRISPR gRNA sequence
ggagctttaactggatctct

SEQ ID NO: 152487 - DNA, 20 bp, Artificial
  CRISPR gRNA sequence
gacgcattgacaagctgtac

SEQ ID NO: 152488 - DNA, 20 bp, Artificial
  CRISPR gRNA sequence
aatgcaggcttcccacagat

SEQ ID NO: 152489 - DNA, 20 bp, Artificial
  CRISPR gRNA sequence
agaaaagtgcccggcacatt

SEQ ID NO: 152490 - DNA, 20 bp, Artificial
  CRISPR gRNA sequence
gggtgttcagtaagtatttt

SEQ ID NO: 152491 - DNA, 20 bp, Artificial
  CRISPR gRNA sequence
agtaagtatttttagaataa

SEQ ID NO: 152492 - DNA, 20 bp, Artificial
  CRISPR gRNA sequence
taagagccagggcttggcta

SEQ ID NO: 152493 - DNA, 20 bp, Artificial
  CRISPR gRNA sequence
ccagggcttggctatagggt

SEQ ID NO: 152494 - DNA, 20 bp, Artificial
  CRISPR gRNA sequence
ggctatagggtgagggtttc

SEQ ID NO: 152495 - DNA, 20 bp, Artificial
  CRISPR gRNA sequence
ccaagggctctgcatacagt

SEQ ID NO: 152496 - DNA, 20 bp, Artificial
  CRISPR gRNA sequence
gctctgcatacagtatgaat

SEQ ID NO: 152497 - DNA, 20 bp, Artificial
  CRISPR gRNA sequence
gtgagactgatgatacttcc

SEQ ID NO: 152498 - DNA, 20 bp, Artificial
  CRISPR gRNA sequence
gtgagggctcaccaagggaa

SEQ ID NO: 152499 - DNA, 20 bp, Artificial
  CRISPR gRNA sequence
ctaagctgtgaaaaccagga

SEQ ID NO: 152500 - DNA, 20 bp, Artificial
  CRISPR gRNA sequence
taagtctgcaataatacctg

SEQ ID NO: 152501 - DNA, 20 bp, Artificial
  CRISPR gRNA sequence
cggcgcttgttatcttctgt

SEQ ID NO: 152502 - DNA, 20 bp, Artificial
  CRISPR gRNA sequence
tctgtgtgaatccaggctcg

SEQ ID NO: 152503 - DNA, 20 bp, Artificial
  CRISPR gRNA sequence
aaatctgggctgccttggca

SEQ ID NO: 152504 - DNA, 20 bp, Artificial
  CRISPR gRNA sequence
ctggcatgggactatggggc

SEQ ID NO: 152505 - DNA, 20 bp, Artificial
  CRISPR gRNA sequence
ttccaaggtaaaataaatcc

SEQ ID NO: 152506 - DNA, 20 bp, Artificial
  CRISPR gRNA sequence
caaagcaggtaacagggaga

SEQ ID NO: 152507 - DNA, 20 bp, Artificial
  CRISPR gRNA sequence
aatagcctttcaaagaaact

SEQ ID NO: 152508 - DNA, 20 bp, Artificial
  CRISPR gRNA sequence
gccatagagccagtaagtgg

SEQ ID NO: 152509 - DNA, 20 bp, Artificial
  CRISPR gRNA sequence
ggagaaacaatatgaggaag

SEQ ID NO: 152510 - DNA, 20 bp, Artificial
  CRISPR gRNA sequence
gagaatgagcttgaaagcca

SEQ ID NO: 152511 - DNA, 20 bp, Artificial
  CRISPR gRNA sequence
gagcttgaaagccaatggat

SEQ ID NO: 152512 - DNA, 20 bp, Artificial
  CRISPR gRNA sequence
ctttttcatgtactgaaaaa

SEQ ID NO: 152513 - DNA, 20 bp, Artificial
  CRISPR gRNA sequence
ctttggtgaggtagtctgtg

SEQ ID NO: 152514 - DNA, 20 bp, Artificial
  CRISPR gRNA sequence
tacagccacagaaagagctc

SEQ ID NO: 152515 - DNA, 20 bp, Artificial
  CRISPR gRNA sequence
aagaagcagcagatgggaaa

SEQ ID NO: 152516 - DNA, 20 bp, Artificial
  CRISPR gRNA sequence
gggatcttggtcctatcact

SEQ ID NO: 152517 - DNA, 20 bp, Artificial
  CRISPR gRNA sequence
tcttggtcctatcactctgg

SEQ ID NO: 152518 - DNA, 20 bp, Artificial
  CRISPR gRNA sequence
aatacaaaagactattaatt

SEQ ID NO: 152519 - DNA, 20 bp, Artificial
  CRISPR gRNA sequence
aattttgagtggtaaagaga

SEQ ID NO: 152520 - DNA, 20 bp, Artificial
  CRISPR gRNA sequence
tgtaatggagatggactcct

SEQ ID NO: 152521 - DNA, 20 bp, Artificial
  CRISPR gRNA sequence
gatcaaaaggttagaacagg

SEQ ID NO: 152522 - DNA, 20 bp, Artificial
  CRISPR gRNA sequence
atcattatcaaaaatttctt

SEQ ID NO: 152523 - DNA, 20 bp, Artificial
  CRISPR gRNA sequence
ctggaggactgcttgagccc

SEQ ID NO: 152524 - DNA, 20 bp, Artificial
  CRISPR gRNA sequence
ttatgccattgccctccagc

SEQ ID NO: 152525 - DNA, 20 bp, Artificial
  CRISPR gRNA sequence
ttgccctccagcctgggtga

SEQ ID NO: 152526 - DNA, 20 bp, Artificial
  CRISPR gRNA sequence
caggcatatcacctgaggtc

SEQ ID NO: 152527 - DNA, 20 bp, Artificial
  CRISPR gRNA sequence
gcctgtaatcctagctactc

SEQ ID NO: 152528 - DNA, 20 bp, Artificial
  CRISPR gRNA sequence
tactcgggagtctgaggcat

SEQ ID NO: 152529 - DNA, 20 bp, Artificial
  CRISPR gRNA sequence
tcgcaccactgcactgcggc

SEQ ID NO: 152530 - DNA, 20 bp, Artificial
  CRISPR gRNA sequence
ctgcactgcggcctggataa

SEQ ID NO: 152531 - DNA, 20 bp, Artificial
  CRISPR gRNA sequence
ttcaacatctaaaaaatttt

SEQ ID NO: 152532 - DNA, 20 bp, Artificial
  CRISPR gRNA sequence
ttcaataagaaataataaaa

SEQ ID NO: 152533 - DNA, 20 bp, Artificial
  CRISPR gRNA sequence
aagaaataataaaaatgaat

SEQ ID NO: 152534 - DNA, 20 bp, Artificial
  CRISPR gRNA sequence
tcttcttaatacgagccagt

SEQ ID NO: 152535 - DNA, 20 bp, Artificial
  CRISPR gRNA sequence
ttaacatatgcaggtcttca

SEQ ID NO: 152536 - DNA, 20 bp, Artificial
  CRISPR gRNA sequence
aatgggctttagaaaaagct

SEQ ID NO: 152537 - DNA, 20 bp, Artificial
  CRISPR gRNA sequence
taaaatgagatttctgtctc

SEQ ID NO: 152538 - DNA, 20 bp, Artificial
  CRISPR gRNA sequence
ctccaaaatttgtttcaagt

SEQ ID NO: 152539 - DNA, 20 bp, Artificial
  CRISPR gRNA sequence
tttgtttcaagtgggggtag

SEQ ID NO: 152540 - DNA, 20 bp, Artificial
  CRISPR gRNA sequence
ggggtagaggagtatagaaa

SEQ ID NO: 152541 - DNA, 20 bp, Artificial
  CRISPR gRNA sequence
gaggagtatagaaaaaggat

SEQ ID NO: 152542 - DNA, 20 bp, Artificial
  CRISPR gRNA sequence
agtatagaaaaaggatgagg

SEQ ID NO: 152543 - DNA, 20 bp, Artificial
  CRISPR gRNA sequence
ttattttttcttaacaagcc

SEQ ID NO: 152544 - DNA, 20 bp, Artificial
  CRISPR gRNA sequence
gaggaccatataacttcact

SEQ ID NO: 152545 - DNA, 20 bp, Artificial
  CRISPR gRNA sequence
atttaaacacatgcccaatg

SEQ ID NO: 152546 - DNA, 20 bp, Artificial
  CRISPR gRNA sequence
ttctaggaaaaaaatcaatt

SEQ ID NO: 152547 - DNA, 20 bp, Artificial
  CRISPR gRNA sequence
taaacctaatatgctcacct

SEQ ID NO: 152548 - DNA, 20 bp, Artificial
  CRISPR gRNA sequence
ttttatgattatagaaagaa

SEQ ID NO: 152549 - DNA, 20 bp, Artificial
  CRISPR gRNA sequence
atagaaagaagagaatctat

SEQ ID NO: 152550 - DNA, 20 bp, Artificial
  CRISPR gRNA sequence
ccctctactaaaactaaccc

SEQ ID NO: 152551 - DNA, 20 bp, Artificial
  CRISPR gRNA sequence
actctggaaggctgagatgg

SEQ ID NO: 152552 - DNA, 20 bp, Artificial
  CRISPR gRNA sequence
tgggagaatcgcttgaggcc

SEQ ID NO: 152553 - DNA, 20 bp, Artificial
  CRISPR gRNA sequence
cctacccaatactggagggg

SEQ ID NO: 152554 - DNA, 20 bp, Artificial
  CRISPR gRNA sequence
tagcaatgtggggctggagg

SEQ ID NO: 152555 - DNA, 20 bp, Artificial
  CRISPR gRNA sequence
gtggggctggagggagagtg

SEQ ID NO: 152556 - DNA, 20 bp, Artificial
  CRISPR gRNA sequence
attgggaaatgttccacaaa

SEQ ID NO: 152557 - DNA, 20 bp, Artificial
  CRISPR gRNA sequence
ttccacaaaggggatgacat

SEQ ID NO: 152558 - DNA, 20 bp, Artificial
  CRISPR gRNA sequence
tgacatctgaattgtgtcta

SEQ ID NO: 152559 - DNA, 20 bp, Artificial
  CRISPR gRNA sequence
aattgtgtctaagggatgct

SEQ ID NO: 152560 - DNA, 20 bp, Artificial
  CRISPR gRNA sequence
tttgcctgttgaaaaagtat

SEQ ID NO: 152561 - DNA, 20 bp, Artificial
  CRISPR gRNA sequence
ttaagttttagatctactac

SEQ ID NO: 152562 - DNA, 20 bp, Artificial
  CRISPR gRNA sequence
tagaggggaaaagcaggaaa

SEQ ID NO: 152563 - DNA, 20 bp, Artificial
  CRISPR gRNA sequence
gaaaagcaggaaagaggata

SEQ ID NO: 152564 - DNA, 20 bp, Artificial
  CRISPR gRNA sequence
tgggttggggccagatccta

SEQ ID NO: 152565 - DNA, 20 bp, Artificial
  CRISPR gRNA sequence
cactacatagaaatgccaaa

SEQ ID NO: 152566 - DNA, 20 bp, Artificial
  CRISPR gRNA sequence
gaaatgccaaagagaatgct

SEQ ID NO: 152567 - DNA, 20 bp, Artificial
  CRISPR gRNA sequence
gacctctttccccaaattga

SEQ ID NO: 152568 - DNA, 20 bp, Artificial
  CRISPR gRNA sequence
aatcaaaagcaacaaaagtc

SEQ ID NO: 152569 - DNA, 20 bp, Artificial
  CRISPR gRNA sequence
tcaagaagcagtgtgtaaaa

SEQ ID NO: 152570 - DNA, 20 bp, Artificial
  CRISPR gRNA sequence
gtgtgtaaaagtggatcttg

SEQ ID NO: 152571 - DNA, 20 bp, Artificial
  CRISPR gRNA sequence
ctagccttctagttacatgt

SEQ ID NO: 152572 - DNA, 20 bp, Artificial
  CRISPR gRNA sequence
tagattgaggcccacgaaac

SEQ ID NO: 152573 - DNA, 20 bp, Artificial
  CRISPR gRNA sequence
ctagctaccatgtaactgaa

SEQ ID NO: 152574 - DNA, 20 bp, Artificial
  CRISPR gRNA sequence
cactgctcccccctactttt

SEQ ID NO: 152575 - DNA, 20 bp, Artificial
  CRISPR gRNA sequence
atttcaagacaaattcaaat

SEQ ID NO: 152576 - DNA, 20 bp, Artificial
  CRISPR gRNA sequence
caaatctgaattcactcaat

SEQ ID NO: 152577 - DNA, 20 bp, Artificial
  CRISPR gRNA sequence
gggctgcactgaagaacatc

SEQ ID NO: 152578 - DNA, 20 bp, Artificial
  CRISPR gRNA sequence
tcaatcttggggctgcaggt

SEQ ID NO: 152579 - DNA, 20 bp, Artificial
  CRISPR gRNA sequence
agctctctcctggagaccaa

SEQ ID NO: 152580 - DNA, 20 bp, Artificial
  CRISPR gRNA sequence
acaatttttccagagatggg

SEQ ID NO: 152581 - DNA, 20 bp, Artificial
  CRISPR gRNA sequence
gtgggcattagattctcata

SEQ ID NO: 152582 - DNA, 20 bp, Artificial
  CRISPR gRNA sequence
ctcacatgcgcagttcatga

SEQ ID NO: 152583 - DNA, 20 bp, Artificial
  CRISPR gRNA sequence
gatagggttcacattccttt

SEQ ID NO: 152584 - DNA, 20 bp, Artificial
  CRISPR gRNA sequence
cccataccggtctgtggccc

SEQ ID NO: 152585 - DNA, 20 bp, Artificial
  CRISPR gRNA sequence
ggttggggacccctgctcta

SEQ ID NO: 152586 - DNA, 20 bp, Artificial
  CRISPR gRNA sequence
gggacccctgctctagtggg

SEQ ID NO: 152587 - DNA, 20 bp, Artificial
  CRISPR gRNA sequence
cttgtgactatgatccaagt

SEQ ID NO: 152588 - DNA, 20 bp, Artificial
  CRISPR gRNA sequence
ctgggaactcaaaagaaaca

SEQ ID NO: 152589 - DNA, 20 bp, Artificial
  CRISPR gRNA sequence
cacccaatcaggaggcactg

SEQ ID NO: 152590 - DNA, 20 bp, Artificial
  CRISPR gRNA sequence
caattacagttaagtgaagg

SEQ ID NO: 152591 - DNA, 20 bp, Artificial
  CRISPR gRNA sequence
acagttaagtgaaggctgaa

SEQ ID NO: 152592 - DNA, 20 bp, Artificial
  CRISPR gRNA sequence
tgaaggctgaatgggatgta

SEQ ID NO: 152593 - DNA, 20 bp, Artificial
  CRISPR gRNA sequence
tgggatgtaaagagtaagta

SEQ ID NO: 152594 - DNA, 20 bp, Artificial
  CRISPR gRNA sequence
ttcccagagctctgctgtgc

SEQ ID NO: 152595 - DNA, 20 bp, Artificial
  CRISPR gRNA sequence
agctctgctgtgcgggaata

SEQ ID NO: 152596 - DNA, 20 bp, Artificial
  CRISPR gRNA sequence
caatcccagctgaacaccac

SEQ ID NO: 152597 - DNA, 20 bp, Artificial
  CRISPR gRNA sequence
tagacaactacagagctttt

SEQ ID NO: 152598 - DNA, 20 bp, Artificial
  CRISPR gRNA sequence
ccagtctgagatcacatttt

SEQ ID NO: 152599 - DNA, 20 bp, Artificial
  CRISPR gRNA sequence
gattggctagtttaaacata

SEQ ID NO: 152600 - DNA, 20 bp, Artificial
  CRISPR gRNA sequence
aagtctggttttaagtactg

SEQ ID NO: 152601 - DNA, 20 bp, Artificial
  CRISPR gRNA sequence
tcctgagaagaggggaaaat

SEQ ID NO: 152602 - DNA, 20 bp, Artificial
  CRISPR gRNA sequence
aaaaaattaccctgacttta

SEQ ID NO: 152603 - DNA, 20 bp, Artificial
  CRISPR gRNA sequence
attgcattcttactcaaata

SEQ ID NO: 152604 - DNA, 20 bp, Artificial
  CRISPR gRNA sequence
gctttgcactaaacctgaag

SEQ ID NO: 152605 - DNA, 20 bp, Artificial
  CRISPR gRNA sequence
acatagcatggcagaggtct

SEQ ID NO: 152606 - DNA, 20 bp, Artificial
  CRISPR gRNA sequence
ctttcaaaagtacataggag

SEQ ID NO: 152607 - DNA, 20 bp, Artificial
  CRISPR gRNA sequence
taattagtcaccaatacaag

SEQ ID NO: 152608 - DNA, 20 bp, Artificial
  CRISPR gRNA sequence
ccacaaaacttgaaccaaaa

SEQ ID NO: 152609 - DNA, 20 bp, Artificial
  CRISPR gRNA sequence
gtaggttacaaatcaaagcc

SEQ ID NO: 152610 - DNA, 20 bp, Artificial
  CRISPR gRNA sequence
aaatgtccattaacagatga

SEQ ID NO: 152611 - DNA, 20 bp, Artificial
  CRISPR gRNA sequence
aatgtggtatatacatacaa

SEQ ID NO: 152612 - DNA, 20 bp, Artificial
  CRISPR gRNA sequence
ttctgccttaaaaaaaaaaa

SEQ ID NO: 152613 - DNA, 20 bp, Artificial
  CRISPR gRNA sequence
gctttggagggccaaggcaa

SEQ ID NO: 152614 - DNA, 20 bp, Artificial
  CRISPR gRNA sequence
caagaggattgcttgaggcc

SEQ ID NO: 152615 - DNA, 20 bp, Artificial
  CRISPR gRNA sequence
caggtgtggtggtgcacaac

SEQ ID NO: 152616 - DNA, 20 bp, Artificial
  CRISPR gRNA sequence
agtcctagctacttggggga

SEQ ID NO: 152617 - DNA, 20 bp, Artificial
  CRISPR gRNA sequence
tacttgggggactgagtagg

SEQ ID NO: 152618 - DNA, 20 bp, Artificial
  CRISPR gRNA sequence
aggaagggtcccttgagccc

SEQ ID NO: 152619 - DNA, 20 bp, Artificial
  CRISPR gRNA sequence
cactgcactccagcaatgaa

SEQ ID NO: 152620 - DNA, 20 bp, Artificial
  CRISPR gRNA sequence
ctttgggaggcagatgtggg

SEQ ID NO: 152621 - DNA, 20 bp, Artificial
  CRISPR gRNA sequence
cccagaagtttgagaccagc

SEQ ID NO: 152622 - DNA, 20 bp, Artificial
  CRISPR gRNA sequence
cagaaaaatacaaaaattag

SEQ ID NO: 152623 - DNA, 20 bp, Artificial
  CRISPR gRNA sequence
tactcaggaggctgaggcgg

SEQ ID NO: 152624 - DNA, 20 bp, Artificial
  CRISPR gRNA sequence
ttgtaccactacactccagc

SEQ ID NO: 152625 - DNA, 20 bp, Artificial
  CRISPR gRNA sequence
ctacactccagcctggatga

SEQ ID NO: 152626 - DNA, 20 bp, Artificial
  CRISPR gRNA sequence
agatgttgttctacttacaa

SEQ ID NO: 152627 - DNA, 20 bp, Artificial
  CRISPR gRNA sequence
ccctattttatagtaaagtg

SEQ ID NO: 152628 - DNA, 20 bp, Artificial
  CRISPR gRNA sequence
gttgagtatctcataattta

SEQ ID NO: 152629 - DNA, 20 bp, Artificial
  CRISPR gRNA sequence
actagattgaaagcgaaaaa

SEQ ID NO: 152630 - DNA, 20 bp, Artificial
  CRISPR gRNA sequence
gaaagcgaaaaacagaatgg

SEQ ID NO: 152631 - DNA, 20 bp, Artificial
  CRISPR gRNA sequence
gcgaaaaacagaatggttga

SEQ ID NO: 152632 - DNA, 20 bp, Artificial
  CRISPR gRNA sequence
tactcaaagtacaactgcta

SEQ ID NO: 152633 - DNA, 20 bp, Artificial
  CRISPR gRNA sequence
agtggaaaaaaaacattaag

SEQ ID NO: 152634 - DNA, 20 bp, Artificial
  CRISPR gRNA sequence
atagtcaaattcatagaaag

SEQ ID NO: 152635 - DNA, 20 bp, Artificial
  CRISPR gRNA sequence
agcagaatggtggctgttta

SEQ ID NO: 152636 - DNA, 20 bp, Artificial
  CRISPR gRNA sequence
tctgaactgtacatttaaaa

SEQ ID NO: 152637 - DNA, 20 bp, Artificial
  CRISPR gRNA sequence
aagtgctgagcttaaacctc

SEQ ID NO: 152638 - DNA, 20 bp, Artificial
  CRISPR gRNA sequence
atctggccacttgcctgatc

SEQ ID NO: 152639 - DNA, 20 bp, Artificial
  CRISPR gRNA sequence
cccagaggtatatccaaaac

SEQ ID NO: 152640 - DNA, 20 bp, Artificial
  CRISPR gRNA sequence
tgtttattagcctgtctcat

SEQ ID NO: 152641 - DNA, 20 bp, Artificial
  CRISPR gRNA sequence
tggtacataataagtatttg

SEQ ID NO: 152642 - DNA, 20 bp, Artificial
  CRISPR gRNA sequence
acataataagtatttgttga

SEQ ID NO: 152643 - DNA, 20 bp, Artificial
  CRISPR gRNA sequence
aataagtatttgttgagtga

SEQ ID NO: 152644 - DNA, 20 bp, Artificial
  CRISPR gRNA sequence
acattaattctacatcagga

SEQ ID NO: 152645 - DNA, 20 bp, Artificial
  CRISPR gRNA sequence
gaatccagtgtctgctctgc

SEQ ID NO: 152646 - DNA, 20 bp, Artificial
  CRISPR gRNA sequence
gatgctagtatttccagggc

SEQ ID NO: 152647 - DNA, 20 bp, Artificial
  CRISPR gRNA sequence
cacagtaacctccaggcact

SEQ ID NO: 152648 - DNA, 20 bp, Artificial
  CRISPR gRNA sequence
cctcccatccttcacatctg

SEQ ID NO: 152649 - DNA, 20 bp, Artificial
  CRISPR gRNA sequence
tttacttaaactcaaccaga

SEQ ID NO: 152650 - DNA, 20 bp, Artificial
  CRISPR gRNA sequence
cgaggttatatttaattatt

SEQ ID NO: 152651 - DNA, 20 bp, Artificial
  CRISPR gRNA sequence
tgagtcagtagttctcaaca

SEQ ID NO: 152652 - DNA, 20 bp, Artificial
  CRISPR gRNA sequence
ctggttgtcacaactcgggg

SEQ ID NO: 152653 - DNA, 20 bp, Artificial
  CRISPR gRNA sequence
aggggtgctactggcatcta

SEQ ID NO: 152654 - DNA, 20 bp, Artificial
  CRISPR gRNA sequence
gcatctagtgagtagaggct

SEQ ID NO: 152655 - DNA, 20 bp, Artificial
  CRISPR gRNA sequence
taagacggcccctcacaaca

SEQ ID NO: 152656 - DNA, 20 bp, Artificial
  CRISPR gRNA sequence
atatctttttaacacctaga

SEQ ID NO: 152657 - DNA, 20 bp, Artificial
  CRISPR gRNA sequence
gactcacaatagatttgttg

SEQ ID NO: 152658 - DNA, 20 bp, Artificial
  CRISPR gRNA sequence
ctgtttttctgtaagtccta

SEQ ID NO: 152659 - DNA, 20 bp, Artificial
  CRISPR gRNA sequence
cattttcctacccacaggtc

SEQ ID NO: 152660 - DNA, 20 bp, Artificial
  CRISPR gRNA sequence
gaaattaaaaatgctttagt

SEQ ID NO: 152661 - DNA, 20 bp, Artificial
  CRISPR gRNA sequence
ttcctcaccactgttaaatt

SEQ ID NO: 152662 - DNA, 20 bp, Artificial
  CRISPR gRNA sequence
gattaggcatttgtatattt

SEQ ID NO: 152663 - DNA, 20 bp, Artificial
  CRISPR gRNA sequence
gtatatttgtggatgttttt

SEQ ID NO: 152664 - DNA, 20 bp, Artificial
  CRISPR gRNA sequence
gactactgaagacctccaac

SEQ ID NO: 152665 - DNA, 20 bp, Artificial
  CRISPR gRNA sequence
aaggacttttaacttcttat

SEQ ID NO: 152666 - DNA, 20 bp, Artificial
  CRISPR gRNA sequence
tttaacttcttatatgggtg

SEQ ID NO: 152667 - DNA, 20 bp, Artificial
  CRISPR gRNA sequence
tactcaggaaggtgagccag

SEQ ID NO: 152668 - DNA, 20 bp, Artificial
  CRISPR gRNA sequence
caggaggatcacttgggccc

SEQ ID NO: 152669 - DNA, 20 bp, Artificial
  CRISPR gRNA sequence
actttgggaggccgaggcgg

SEQ ID NO: 152670 - DNA, 20 bp, Artificial
  CRISPR gRNA sequence
tacttgggaggctgaggcag

SEQ ID NO: 152671 - DNA, 20 bp, Artificial
  CRISPR gRNA sequence
actctgggaagccgaggcag

SEQ ID NO: 152672 - DNA, 20 bp, Artificial
  CRISPR gRNA sequence
tactcaggaggctgaggcag

SEQ ID NO: 152673 - DNA, 20 bp, Artificial
  CRISPR gRNA sequence
catcgcaaaaaaaaaaaaag

SEQ ID NO: 152674 - DNA, 20 bp, Artificial
  CRISPR gRNA sequence
aaaaaaagtagaattaaaat

SEQ ID NO: 152675 - DNA, 20 bp, Artificial
  CRISPR gRNA sequence
tttgtgacaaaggagggaag

SEQ ID NO: 152676 - DNA, 20 bp, Artificial
  CRISPR gRNA sequence
acaaaggagggaagatgaat

SEQ ID NO: 152677 - DNA, 20 bp, Artificial
  CRISPR gRNA sequence
ataactgtagataacacagg

SEQ ID NO: 152678 - DNA, 20 bp, Artificial
  CRISPR gRNA sequence
gcctggggaccagaaatgtc

SEQ ID NO: 152679 - DNA, 20 bp, Artificial
  CRISPR gRNA sequence
ttttttttttttttttgaga

SEQ ID NO: 152680 - DNA, 20 bp, Artificial
  CRISPR gRNA sequence
ttcgctcttgttgcccagac

SEQ ID NO: 152681 - DNA, 20 bp, Artificial
  CRISPR gRNA sequence
gattctcctgcctcagcctc

SEQ ID NO: 152682 - DNA, 20 bp, Artificial
  CRISPR gRNA sequence
gcctcagcctcctgagtagc

SEQ ID NO: 152683 - DNA, 20 bp, Artificial
  CRISPR gRNA sequence
ttttatatttttagtaaaga

SEQ ID NO: 152684 - DNA, 20 bp, Artificial
  CRISPR gRNA sequence
gcctcgtcctcccaaagtgc

SEQ ID NO: 152685 - DNA, 20 bp, Artificial
  CRISPR gRNA sequence
tttttttttttttttttttt

SEQ ID NO: 152686 - DNA, 20 bp, Artificial
  CRISPR gRNA sequence
atgtcagggctcaaaaagtt

SEQ ID NO: 152687 - DNA, 20 bp, Artificial
  CRISPR gRNA sequence
ggatttcagattttcagatt

SEQ ID NO: 152688 - DNA, 20 bp, Artificial
  CRISPR gRNA sequence
gaacagtttaattaaacaca

SEQ ID NO: 152689 - DNA, 20 bp, Artificial
  CRISPR gRNA sequence
gagaaatttagtgctctcct

SEQ ID NO: 152690 - DNA, 20 bp, Artificial
  CRISPR gRNA sequence
tcctaagaatctctattctg

SEQ ID NO: 152691 - DNA, 20 bp, Artificial
  CRISPR gRNA sequence
aaggtttaacgtgccagtga

SEQ ID NO: 152692 - DNA, 20 bp, Artificial
  CRISPR gRNA sequence
tgttactttccaggctccat

SEQ ID NO: 152693 - DNA, 20 bp, Artificial
  CRISPR gRNA sequence
ggcagaacactctatcacag

SEQ ID NO: 152694 - DNA, 20 bp, Artificial
  CRISPR gRNA sequence
aacactctatcacagcagaa

SEQ ID NO: 152695 - DNA, 20 bp, Artificial
  CRISPR gRNA sequence
caactctaggtttagcctgt

SEQ ID NO: 152696 - DNA, 20 bp, Artificial
  CRISPR gRNA sequence
attctggtgtaatgacatta

SEQ ID NO: 152697 - DNA, 20 bp, Artificial
  CRISPR gRNA sequence
ttagtgggtgatgatgtaat

SEQ ID NO: 152698 - DNA, 20 bp, Artificial
  CRISPR gRNA sequence
tgaacagaaattctagtacc

SEQ ID NO: 152699 - DNA, 20 bp, Artificial
  CRISPR gRNA sequence
cctgggatacaatatgatct

SEQ ID NO: 152700 - DNA, 20 bp, Artificial
  CRISPR gRNA sequence
atgatcttggagtttctgaa

SEQ ID NO: 152701 - DNA, 20 bp, Artificial
  CRISPR gRNA sequence
taattatcaaaaagctttaa

SEQ ID NO: 152702 - DNA, 20 bp, Artificial
  CRISPR gRNA sequence
agaatctaaccttttattgc

SEQ ID NO: 152703 - DNA, 20 bp, Artificial
  CRISPR gRNA sequence
atatctctgtacacttgcta

SEQ ID NO: 152704 - DNA, 20 bp, Artificial
  CRISPR gRNA sequence
ctctgtacacttgctaatgg

SEQ ID NO: 152705 - DNA, 20 bp, Artificial
  CRISPR gRNA sequence
aatggatgggtaggtttagt

SEQ ID NO: 152706 - DNA, 20 bp, Artificial
  CRISPR gRNA sequence
atctgtgtagtcaacagatc

SEQ ID NO: 152707 - DNA, 20 bp, Artificial
  CRISPR gRNA sequence
tcttcaacctctgcccaacc

SEQ ID NO: 152708 - DNA, 20 bp, Artificial
  CRISPR gRNA sequence
ttcttctttacattaggttt

SEQ ID NO: 152709 - DNA, 20 bp, Artificial
  CRISPR gRNA sequence
aatgtaaattcctggaaaaa

SEQ ID NO: 152710 - DNA, 20 bp, Artificial
  CRISPR gRNA sequence
cagcactttgggaggccaag

SEQ ID NO: 152711 - DNA, 20 bp, Artificial
  CRISPR gRNA sequence
actttgggaggccaaggcgg

SEQ ID NO: 152712 - DNA, 20 bp, Artificial
  CRISPR gRNA sequence
cgggtggatcacctgaggtc

SEQ ID NO: 152713 - DNA, 20 bp, Artificial
  CRISPR gRNA sequence
tcatgccactgcactccagc

SEQ ID NO: 152714 - DNA, 20 bp, Artificial
  CRISPR gRNA sequence
acaagcccatggaaaatatt

SEQ ID NO: 152715 - DNA, 20 bp, Artificial
  CRISPR gRNA sequence
aatattctgggttcatcttc

SEQ ID NO: 152716 - DNA, 20 bp, Artificial
  CRISPR gRNA sequence
tcttctaggataataaggga

SEQ ID NO: 152717 - DNA, 20 bp, Artificial
  CRISPR gRNA sequence
tatttaaaagtaagaggagg

SEQ ID NO: 152718 - DNA, 20 bp, Artificial
  CRISPR gRNA sequence
aactccggaggctgagacag

SEQ ID NO: 152719 - DNA, 20 bp, Artificial
  CRISPR gRNA sequence
tgagactctgtctctaaaaa

SEQ ID NO: 152720 - DNA, 20 bp, Artificial
  CRISPR gRNA sequence
cactttgggaggctgaggtg

SEQ ID NO: 152721 - DNA, 20 bp, Artificial
  CRISPR gRNA sequence
gtggaggatcacttgaggtc

SEQ ID NO: 152722 - DNA, 20 bp, Artificial
  CRISPR gRNA sequence
cctgggaagcggaggttgca

SEQ ID NO: 152723 - DNA, 20 bp, Artificial
  CRISPR gRNA sequence
cgagactccatctcaaaaag

SEQ ID NO: 152724 - DNA, 20 bp, Artificial
  CRISPR gRNA sequence
tactcaggaggctgaggcag

SEQ ID NO: 152725 - DNA, 20 bp, Artificial
  CRISPR gRNA sequence
cagaaggatctcctgggccc

SEQ ID NO: 152726 - DNA, 20 bp, Artificial
  CRISPR gRNA sequence
aagaaaaaagagactcattc

SEQ ID NO: 152727 - DNA, 20 bp, Artificial
  CRISPR gRNA sequence
tattttttttttctcaaagc

SEQ ID NO: 152728 - DNA, 20 bp, Artificial
  CRISPR gRNA sequence
tttcgctctgttgcccaggc

SEQ ID NO: 152729 - DNA, 20 bp, Artificial
  CRISPR gRNA sequence
tcctgctatacaagctcctt

SEQ ID NO: 152730 - DNA, 20 bp, Artificial
  CRISPR gRNA sequence
ctatacaagctccttgaggg

SEQ ID NO: 152731 - DNA, 20 bp, Artificial
  CRISPR gRNA sequence
tctgcatatgattcatctct

SEQ ID NO: 152732 - DNA, 20 bp, Artificial
  CRISPR gRNA sequence
gaggaggtgcaagactgatg

SEQ ID NO: 152733 - DNA, 20 bp, Artificial
  CRISPR gRNA sequence
aaaaaaaaaagggggggggg

SEQ ID NO: 152734 - DNA, 20 bp, Artificial
  CRISPR gRNA sequence
cttggccctgacatacttat

SEQ ID NO: 152735 - DNA, 20 bp, Artificial
  CRISPR gRNA sequence
cctgaaactgatttactgaa

SEQ ID NO: 152736 - DNA, 20 bp, Artificial
  CRISPR gRNA sequence
gaaatggatttaaaataaaa

SEQ ID NO: 152737 - DNA, 20 bp, Artificial
  CRISPR gRNA sequence
cagacttgaaggctggaaat

SEQ ID NO: 152738 - DNA, 20 bp, Artificial
  CRISPR gRNA sequence
aacctcttcagaaaagtgac

SEQ ID NO: 152739 - DNA, 20 bp, Artificial
  CRISPR gRNA sequence
agtctgaaatattaatgaca

SEQ ID NO: 152740 - DNA, 20 bp, Artificial
  CRISPR gRNA sequence
atgatttgatcagaccactg

SEQ ID NO: 152741 - DNA, 20 bp, Artificial
  CRISPR gRNA sequence
ttttcaaaacatcccaaaat

SEQ ID NO: 152742 - DNA, 20 bp, Artificial
  CRISPR gRNA sequence
tatgcctgggcatggaacaa

SEQ ID NO: 152743 - DNA, 20 bp, Artificial
  CRISPR gRNA sequence
aaaggctaattgacataaat

SEQ ID NO: 152744 - DNA, 20 bp, Artificial
  CRISPR gRNA sequence
ctaaaaatataaaaaattag

SEQ ID NO: 152745 - DNA, 20 bp, Artificial
  CRISPR gRNA sequence
tactcaggaggctgaggcgg

SEQ ID NO: 152746 - DNA, 20 bp, Artificial
  CRISPR gRNA sequence
ggctgaggcgggggaatcgc

SEQ ID NO: 152747 - DNA, 20 bp, Artificial
  CRISPR gRNA sequence
actttgggaggctgaggcag

SEQ ID NO: 152748 - DNA, 20 bp, Artificial
  CRISPR gRNA sequence
caggaggatcacctgaggtc

SEQ ID NO: 152749 - DNA, 20 bp, Artificial
  CRISPR gRNA sequence
tacttgggaggctaaggcat

SEQ ID NO: 152750 - DNA, 20 bp, Artificial
  CRISPR gRNA sequence
catgccactgcactccatac

SEQ ID NO: 152751 - DNA, 20 bp, Artificial
  CRISPR gRNA sequence
tttatccaattattccagtt

SEQ ID NO: 152752 - DNA, 20 bp, Artificial
  CRISPR gRNA sequence
taacctaacatgcacatatt

SEQ ID NO: 152753 - DNA, 20 bp, Artificial
  CRISPR gRNA sequence
ttcgggatgcaagaagaaag

SEQ ID NO: 152754 - DNA, 20 bp, Artificial
  CRISPR gRNA sequence
caatgctcaaactccacaca

SEQ ID NO: 152755 - DNA, 20 bp, Artificial
  CRISPR gRNA sequence
acttgcagcccttaggcttt

SEQ ID NO: 152756 - DNA, 20 bp, Artificial
  CRISPR gRNA sequence
cagcccttaggctttttggg

SEQ ID NO: 152757 - DNA, 20 bp, Artificial
  CRISPR gRNA sequence
caccaaggagggctgactgc

SEQ ID NO: 152758 - DNA, 20 bp, Artificial
  CRISPR gRNA sequence
agggctgactgcatgaatcc

SEQ ID NO: 152759 - DNA, 20 bp, Artificial
  CRISPR gRNA sequence
tactcagaaggctgaggtgg

SEQ ID NO: 152760 - DNA, 20 bp, Artificial
  CRISPR gRNA sequence
tcatgccaccacactccagc

SEQ ID NO: 152761 - DNA, 20 bp, Artificial
  CRISPR gRNA sequence
cagcactttgggaggccgag

SEQ ID NO: 152762 - DNA, 20 bp, Artificial
  CRISPR gRNA sequence
actttgggaggccgaggcgg

SEQ ID NO: 152763 - DNA, 20 bp, Artificial
  CRISPR gRNA sequence
cgggtggatcacctgaggtc

SEQ ID NO: 152764 - DNA, 20 bp, Artificial
  CRISPR gRNA sequence
tacttgggaagctgaggcag

SEQ ID NO: 152765 - DNA, 20 bp, Artificial
  CRISPR gRNA sequence
ttttatcccgaagatctagc

SEQ ID NO: 152766 - DNA, 20 bp, Artificial
  CRISPR gRNA sequence
caactggctacattaaacaa

SEQ ID NO: 152767 - DNA, 20 bp, Artificial
  CRISPR gRNA sequence
ccaaaaattctagggccctt

SEQ ID NO: 152768 - DNA, 20 bp, Artificial
  CRISPR gRNA sequence
ctctataaatggagcaaagc

SEQ ID NO: 152769 - DNA, 20 bp, Artificial
  CRISPR gRNA sequence
actttgggaggccaaggcgg

SEQ ID NO: 152770 - DNA, 20 bp, Artificial
  CRISPR gRNA sequence
cgggcggataacctgaggtc

SEQ ID NO: 152771 - DNA, 20 bp, Artificial
  CRISPR gRNA sequence
tactcaagaggctgaggcag

SEQ ID NO: 152772 - DNA, 20 bp, Artificial
  CRISPR gRNA sequence
ttgcaccactgcactccagc

SEQ ID NO: 152773 - DNA, 20 bp, Artificial
  CRISPR gRNA sequence
atctgcttgcacaactccat

SEQ ID NO: 152774 - DNA, 20 bp, Artificial
  CRISPR gRNA sequence
tctcactctgtcgcccaggc

SEQ ID NO: 152775 - DNA, 20 bp, Artificial
  CRISPR gRNA sequence
gtcactgcaacctccgcctt

SEQ ID NO: 152776 - DNA, 20 bp, Artificial
  CRISPR gRNA sequence
cgattctcatgcccagcctc

SEQ ID NO: 152777 - DNA, 20 bp, Artificial
  CRISPR gRNA sequence
tgcccagcctcccgagtagc

SEQ ID NO: 152778 - DNA, 20 bp, Artificial
  CRISPR gRNA sequence
ttttgtaattttagtaaaga

SEQ ID NO: 152779 - DNA, 20 bp, Artificial
  CRISPR gRNA sequence
gcctcagcctcccaaagtgt

SEQ ID NO: 152780 - DNA, 20 bp, Artificial
  CRISPR gRNA sequence
attctgcagcccatggacca

SEQ ID NO: 152781 - DNA, 20 bp, Artificial
  CRISPR gRNA sequence
actttgggaggccaaggcag

SEQ ID NO: 152782 - DNA, 20 bp, Artificial
  CRISPR gRNA sequence
cagaaggatcacctgaggtc

SEQ ID NO: 152783 - DNA, 20 bp, Artificial
  CRISPR gRNA sequence
ctgcactccagcctaggtga

SEQ ID NO: 152784 - DNA, 20 bp, Artificial
  CRISPR gRNA sequence
aggacacagctgccatagac

SEQ ID NO: 152785 - DNA, 20 bp, Artificial
  CRISPR gRNA sequence
cagggattcctcagacagat

SEQ ID NO: 152786 - DNA, 20 bp, Artificial
  CRISPR gRNA sequence
taaactgaaaaccttctaga

SEQ ID NO: 152787 - DNA, 20 bp, Artificial
  CRISPR gRNA sequence
tcaccattttaaataccatt

SEQ ID NO: 152788 - DNA, 20 bp, Artificial
  CRISPR gRNA sequence
actttgggaggccgaggcgg

SEQ ID NO: 152789 - DNA, 20 bp, Artificial
  CRISPR gRNA sequence
ggcgggcgaatcacaaggtc

SEQ ID NO: 152790 - DNA, 20 bp, Artificial
  CRISPR gRNA sequence
tacttggaaagctgaggcag

SEQ ID NO: 152791 - DNA, 20 bp, Artificial
  CRISPR gRNA sequence
agctgaggcaggagaatcac

SEQ ID NO: 152792 - DNA, 20 bp, Artificial
  CRISPR gRNA sequence
tgtctcaaaaaaaaaaaaaa

SEQ ID NO: 152793 - DNA, 20 bp, Artificial
  CRISPR gRNA sequence
tacttaggaggctgaggtgg

SEQ ID NO: 152794 - DNA, 20 bp, Artificial
  CRISPR gRNA sequence
ctgcactccagtctgggcaa

SEQ ID NO: 152795 - DNA, 20 bp, Artificial
  CRISPR gRNA sequence
gtcaaaatataaacattaac

SEQ ID NO: 152796 - DNA, 20 bp, Artificial
  CRISPR gRNA sequence
tgaagttgattccaatcctc

SEQ ID NO: 152797 - DNA, 20 bp, Artificial
  CRISPR gRNA sequence
aatcctcctggatgattttg

SEQ ID NO: 152798 - DNA, 20 bp, Artificial
  CRISPR gRNA sequence
aagcggagcctgagatgtga

SEQ ID NO: 152799 - DNA, 20 bp, Artificial
  CRISPR gRNA sequence
tgataaaactttaacagatg

SEQ ID NO: 152800 - DNA, 20 bp, Artificial
  CRISPR gRNA sequence
agtgaaaatgctatgaacat

SEQ ID NO: 152801 - DNA, 20 bp, Artificial
  CRISPR gRNA sequence
cttagttcataaaatagtgg

SEQ ID NO: 152802 - DNA, 20 bp, Artificial
  CRISPR gRNA sequence
gttttgaaagaagctctact

SEQ ID NO: 152803 - DNA, 20 bp, Artificial
  CRISPR gRNA sequence
gagaaatctttcatgaaagg

SEQ ID NO: 152804 - DNA, 20 bp, Artificial
  CRISPR gRNA sequence
actttgggaggctagggcaa

SEQ ID NO: 152805 - DNA, 20 bp, Artificial
  CRISPR gRNA sequence
caagaggatcacttcagccc

SEQ ID NO: 152806 - DNA, 20 bp, Artificial
  CRISPR gRNA sequence
acaaaaaatacaaaaatcag

SEQ ID NO: 152807 - DNA, 20 bp, Artificial
  CRISPR gRNA sequence
tacttgggaggctgaagtag

SEQ ID NO: 152808 - DNA, 20 bp, Artificial
  CRISPR gRNA sequence
tcatgacactgtactccagc

SEQ ID NO: 152809 - DNA, 20 bp, Artificial
  CRISPR gRNA sequence
cagcactttgggagactgag

SEQ ID NO: 152810 - DNA, 20 bp, Artificial
  CRISPR gRNA sequence
actttgggagactgaggtgg

SEQ ID NO: 152811 - DNA, 20 bp, Artificial
  CRISPR gRNA sequence
tgggtggatcacctgaggtc

SEQ ID NO: 152812 - DNA, 20 bp, Artificial
  CRISPR gRNA sequence
tacttgggaagctggggcag

SEQ ID NO: 152813 - DNA, 20 bp, Artificial
  CRISPR gRNA sequence
caaacttcagcaactaccac

SEQ ID NO: 152814 - DNA, 20 bp, Artificial
  CRISPR gRNA sequence
atgggagatacagagaaagg

SEQ ID NO: 152815 - DNA, 20 bp, Artificial
  CRISPR gRNA sequence
aagaatattaataaaaataa

SEQ ID NO: 152816 - DNA, 20 bp, Artificial
  CRISPR gRNA sequence
atattaataaaaataaatgg

SEQ ID NO: 152817 - DNA, 20 bp, Artificial
  CRISPR gRNA sequence
aatggatggatgagggaaag

SEQ ID NO: 152818 - DNA, 20 bp, Artificial
  CRISPR gRNA sequence
atggatgagggaaagggggg

SEQ ID NO: 152819 - DNA, 20 bp, Artificial
  CRISPR gRNA sequence
gtatactgaacacattccaa

SEQ ID NO: 152820 - DNA, 20 bp, Artificial
  CRISPR gRNA sequence
actacttgaagatgcaataa

SEQ ID NO: 152821 - DNA, 20 bp, Artificial
  CRISPR gRNA sequence
cttgaagatgcaataaatga

SEQ ID NO: 152822 - DNA, 20 bp, Artificial
  CRISPR gRNA sequence
cattctaaacccttacatag

SEQ ID NO: 152823 - DNA, 20 bp, Artificial
  CRISPR gRNA sequence
tcatatttactggcaggcta

SEQ ID NO: 152824 - DNA, 20 bp, Artificial
  CRISPR gRNA sequence
agtcttcactactataatac

SEQ ID NO: 152825 - DNA, 20 bp, Artificial
  CRISPR gRNA sequence
ttcactactataatacaaga

SEQ ID NO: 152826 - DNA, 20 bp, Artificial
  CRISPR gRNA sequence
catttgaaaacttttttctg

SEQ ID NO: 152827 - DNA, 20 bp, Artificial
  CRISPR gRNA sequence
tattttgtatgatgaagaaa

SEQ ID NO: 152828 - DNA, 20 bp, Artificial
  CRISPR gRNA sequence
ttagtgaagtattctaaagc

SEQ ID NO: 152829 - DNA, 20 bp, Artificial
  CRISPR gRNA sequence
cctcagtctgtcatccaggc

SEQ ID NO: 152830 - DNA, 20 bp, Artificial
  CRISPR gRNA sequence
ctcactgcaacctccacctc

SEQ ID NO: 152831 - DNA, 20 bp, Artificial
  CRISPR gRNA sequence
acctcagcctcccaagcagc

SEQ ID NO: 152832 - DNA, 20 bp, Artificial
  CRISPR gRNA sequence
atttttgtatttttgaagag

SEQ ID NO: 152833 - DNA, 20 bp, Artificial
  CRISPR gRNA sequence
acctcggcctcccaaaacgc

SEQ ID NO: 152834 - DNA, 20 bp, Artificial
  CRISPR gRNA sequence
tgtctgttcatgctaaacag

SEQ ID NO: 152835 - DNA, 20 bp, Artificial
  CRISPR gRNA sequence
catgctaaacagtagagttg

SEQ ID NO: 152836 - DNA, 20 bp, Artificial
  CRISPR gRNA sequence
actctgggaggccaaggcgg

SEQ ID NO: 152837 - DNA, 20 bp, Artificial
  CRISPR gRNA sequence
ggcgggaggactgcttgagc

SEQ ID NO: 152838 - DNA, 20 bp, Artificial
  CRISPR gRNA sequence
ctctctgaccctccagccta

SEQ ID NO: 152839 - DNA, 20 bp, Artificial
  CRISPR gRNA sequence
agtaaataaatccttgtagg

SEQ ID NO: 152840 - DNA, 20 bp, Artificial
  CRISPR gRNA sequence
aaatccttgtaggaagaatg

SEQ ID NO: 152841 - DNA, 20 bp, Artificial
  CRISPR gRNA sequence
ttcaggcctcaatcccgaaa

SEQ ID NO: 152842 - DNA, 20 bp, Artificial
  CRISPR gRNA sequence
tgacatgagctagagacaga

SEQ ID NO: 152843 - DNA, 20 bp, Artificial
  CRISPR gRNA sequence
aacaaagcatcattttctta

SEQ ID NO: 152844 - DNA, 20 bp, Artificial
  CRISPR gRNA sequence
agggaagaagtgtgattctg

SEQ ID NO: 152845 - DNA, 20 bp, Artificial
  CRISPR gRNA sequence
agatgccaacttacgggctt

SEQ ID NO: 152846 - DNA, 20 bp, Artificial
  CRISPR gRNA sequence
ccaattttacagataaggtt

SEQ ID NO: 152847 - DNA, 20 bp, Artificial
  CRISPR gRNA sequence
tttacagataaggttgaggg

SEQ ID NO: 152848 - DNA, 20 bp, Artificial
  CRISPR gRNA sequence
agatcacaatacaataaatg

SEQ ID NO: 152849 - DNA, 20 bp, Artificial
  CRISPR gRNA sequence
taggcaggttagcagcacct

SEQ ID NO: 152850 - DNA, 20 bp, Artificial
  CRISPR gRNA sequence
aaataaaatgtattggacct

SEQ ID NO: 152851 - DNA, 20 bp, Artificial
  CRISPR gRNA sequence
agacaccaactactggtctg

SEQ ID NO: 152852 - DNA, 20 bp, Artificial
  CRISPR gRNA sequence
gtactagttccaaaaaagca

SEQ ID NO: 152853 - DNA, 20 bp, Artificial
  CRISPR gRNA sequence
aacgttccaaatttaaatcc

SEQ ID NO: 152854 - DNA, 20 bp, Artificial
  CRISPR gRNA sequence
atttatttatatatattttt

SEQ ID NO: 152855 - DNA, 20 bp, Artificial
  CRISPR gRNA sequence
tttatatatattttttggga

SEQ ID NO: 152856 - DNA, 20 bp, Artificial
  CRISPR gRNA sequence
tctcactctgtcacccaggc

SEQ ID NO: 152857 - DNA, 20 bp, Artificial
  CRISPR gRNA sequence
ctcactgcaagcttcgcctc

SEQ ID NO: 152858 - DNA, 20 bp, Artificial
  CRISPR gRNA sequence
ttttgtatttttagtagaga

SEQ ID NO: 152859 - DNA, 20 bp, Artificial
  CRISPR gRNA sequence
cagggtttcaccgtgttagc

SEQ ID NO: 152860 - DNA, 20 bp, Artificial
  CRISPR gRNA sequence
accttggcctcccaaagtgc

SEQ ID NO: 152861 - DNA, 20 bp, Artificial
  CRISPR gRNA sequence
cgcgcccggccttcaattct

SEQ ID NO: 152862 - DNA, 20 bp, Artificial
  CRISPR gRNA sequence
actttgggaagccaaagcag

SEQ ID NO: 152863 - DNA, 20 bp, Artificial
  CRISPR gRNA sequence
caggaggatcgcttgagccc

SEQ ID NO: 152864 - DNA, 20 bp, Artificial
  CRISPR gRNA sequence
tactcaggaggctggggcag

SEQ ID NO: 152865 - DNA, 20 bp, Artificial
  CRISPR gRNA sequence
actgcacttcagcctggcaa

SEQ ID NO: 152866 - DNA, 20 bp, Artificial
  CRISPR gRNA sequence
ccacaaccaccaccatctcc

SEQ ID NO: 152867 - DNA, 20 bp, Artificial
  CRISPR gRNA sequence
acctaagacttccacaagct

SEQ ID NO: 152868 - DNA, 20 bp, Artificial
  CRISPR gRNA sequence
tgcctgttttgtcttgtgaa

SEQ ID NO: 152869 - DNA, 20 bp, Artificial
  CRISPR gRNA sequence
aaggaatcttgtttatgtta

SEQ ID NO: 152870 - DNA, 20 bp, Artificial
  CRISPR gRNA sequence
gttagagggtagaggaaacc

SEQ ID NO: 152871 - DNA, 20 bp, Artificial
  CRISPR gRNA sequence
ggaaacatgttctggaaagt

SEQ ID NO: 152872 - DNA, 20 bp, Artificial
  CRISPR gRNA sequence
ggaatttctcagactatctc

SEQ ID NO: 152873 - DNA, 20 bp, Artificial
  CRISPR gRNA sequence
aaatatgccttgcacatagt

SEQ ID NO: 152874 - DNA, 20 bp, Artificial
  CRISPR gRNA sequence
ggggattcaatacacatcta

SEQ ID NO: 152875 - DNA, 20 bp, Artificial
  CRISPR gRNA sequence
tcttgctctgttgcccacgc

SEQ ID NO: 152876 - DNA, 20 bp, Artificial
  CRISPR gRNA sequence
ctcactgaagcctcaacctc

SEQ ID NO: 152877 - DNA, 20 bp, Artificial
  CRISPR gRNA sequence
atcctcccctgctcagcctc

SEQ ID NO: 152878 - DNA, 20 bp, Artificial
  CRISPR gRNA sequence
tttaaaattttttgtaaaga

SEQ ID NO: 152879 - DNA, 20 bp, Artificial
  CRISPR gRNA sequence
actttggcctgccaaagtgc

SEQ ID NO: 152880 - DNA, 20 bp, Artificial
  CRISPR gRNA sequence
taatccaatggaagagccac

SEQ ID NO: 152881 - DNA, 20 bp, Artificial
  CRISPR gRNA sequence
caatggaagagccacaagag

SEQ ID NO: 152882 - DNA, 20 bp, Artificial
  CRISPR gRNA sequence
ttaatacatctaaaaaccag

SEQ ID NO: 152883 - DNA, 20 bp, Artificial
  CRISPR gRNA sequence
tctgctcattcagatacact

SEQ ID NO: 152884 - DNA, 20 bp, Artificial
  CRISPR gRNA sequence
aggtggactgaggaacttgg

SEQ ID NO: 152885 - DNA, 20 bp, Artificial
  CRISPR gRNA sequence
taaatcttctccttctactt

SEQ ID NO: 152886 - DNA, 20 bp, Artificial
  CRISPR gRNA sequence
ctaaactgcagttgcatcaa

SEQ ID NO: 152887 - DNA, 20 bp, Artificial
  CRISPR gRNA sequence
caaacaaaagtggagataga

SEQ ID NO: 152888 - DNA, 20 bp, Artificial
  CRISPR gRNA sequence
catagctgcccacttatagg

SEQ ID NO: 152889 - DNA, 20 bp, Artificial
  CRISPR gRNA sequence
cagccattcctccaagaaat

SEQ ID NO: 152890 - DNA, 20 bp, Artificial
  CRISPR gRNA sequence
ttcctttgttccacctcact

SEQ ID NO: 152891 - DNA, 20 bp, Artificial
  CRISPR gRNA sequence
ccacctcactaggggtaagc

SEQ ID NO: 152892 - DNA, 20 bp, Artificial
  CRISPR gRNA sequence
tagctaggaaatttaaagca

SEQ ID NO: 152893 - DNA, 20 bp, Artificial
  CRISPR gRNA sequence
tactcgggaggctgaggcag

SEQ ID NO: 152894 - DNA, 20 bp, Artificial
  CRISPR gRNA sequence
agtatgtatctgcatagcta

SEQ ID NO: 152895 - DNA, 20 bp, Artificial
  CRISPR gRNA sequence
tgcatagctaaggaatacca

SEQ ID NO: 152896 - DNA, 20 bp, Artificial
  CRISPR gRNA sequence
caactacttacctgacctta

SEQ ID NO: 152897 - DNA, 20 bp, Artificial
  CRISPR gRNA sequence
ttacctgaccttagtgaatt

SEQ ID NO: 152898 - DNA, 20 bp, Artificial
  CRISPR gRNA sequence
tgttaagcagtctataatat

SEQ ID NO: 152899 - DNA, 20 bp, Artificial
  CRISPR gRNA sequence
ggaaaagagaaggtaggagg

SEQ ID NO: 152900 - DNA, 20 bp, Artificial
  CRISPR gRNA sequence
attttctcaccctcaaaatg

SEQ ID NO: 152901 - DNA, 20 bp, Artificial
  CRISPR gRNA sequence
attaggtagataccaaataa

SEQ ID NO: 152902 - DNA, 20 bp, Artificial
  CRISPR gRNA sequence
ggtagataccaaataagaga

SEQ ID NO: 152903 - DNA, 20 bp, Artificial
  CRISPR gRNA sequence
gcttcatgggcatctggcca

SEQ ID NO: 152904 - DNA, 20 bp, Artificial
  CRISPR gRNA sequence
ttccaagaggaaaataatca

SEQ ID NO: 152905 - DNA, 20 bp, Artificial
  CRISPR gRNA sequence
tattgcctttattttagatt

SEQ ID NO: 152906 - DNA, 20 bp, Artificial
  CRISPR gRNA sequence
tatttttggtcagcttcatg

SEQ ID NO: 152907 - DNA, 20 bp, Artificial
  CRISPR gRNA sequence
ctttaccttgttgtacacgc

SEQ ID NO: 152908 - DNA, 20 bp, Artificial
  CRISPR gRNA sequence
ttgtacacgcctggattaag

SEQ ID NO: 152909 - DNA, 20 bp, Artificial
  CRISPR gRNA sequence
aaaccaagcaagtaactttt

SEQ ID NO: 152910 - DNA, 20 bp, Artificial
  CRISPR gRNA sequence
gcaagtaactttttggaata

SEQ ID NO: 152911 - DNA, 20 bp, Artificial
  CRISPR gRNA sequence
gaaatgcacactcagaaaac

SEQ ID NO: 152912 - DNA, 20 bp, Artificial
  CRISPR gRNA sequence
ggactctaccatgctcattt

SEQ ID NO: 152913 - DNA, 20 bp, Artificial
  CRISPR gRNA sequence
atttctggatttctcaactt

SEQ ID NO: 152914 - DNA, 20 bp, Artificial
  CRISPR gRNA sequence
ctatcctccagtcacccaga

SEQ ID NO: 152915 - DNA, 20 bp, Artificial
  CRISPR gRNA sequence
gatgatagccaatgttcatt

SEQ ID NO: 152916 - DNA, 20 bp, Artificial
  CRISPR gRNA sequence
aaacctcctaataatcctat

SEQ ID NO: 152917 - DNA, 20 bp, Artificial
  CRISPR gRNA sequence
cttaacccaagatgtacttt

SEQ ID NO: 152918 - DNA, 20 bp, Artificial
  CRISPR gRNA sequence
tgcttgttgctcccaatgtc

SEQ ID NO: 152919 - DNA, 20 bp, Artificial
  CRISPR gRNA sequence
atgcccttgtccctacctcc

SEQ ID NO: 152920 - DNA, 20 bp, Artificial
  CRISPR gRNA sequence
aagcgaacgtctcccctcct

SEQ ID NO: 152921 - DNA, 20 bp, Artificial
  CRISPR gRNA sequence
ttgataaacatcatcagtct

SEQ ID NO: 152922 - DNA, 20 bp, Artificial
  CRISPR gRNA sequence
aaaaaagacatgcatgcgtg

SEQ ID NO: 152923 - DNA, 20 bp, Artificial
  CRISPR gRNA sequence
agaagaaaatttcattttat

SEQ ID NO: 152924 - DNA, 20 bp, Artificial
  CRISPR gRNA sequence
cggtagtacttccaagaaga

SEQ ID NO: 152925 - DNA, 20 bp, Artificial
  CRISPR gRNA sequence
caagaagaaaggataaccaa

SEQ ID NO: 152926 - DNA, 20 bp, Artificial
  CRISPR gRNA sequence
ctttagttcttcctttatac

SEQ ID NO: 152927 - DNA, 20 bp, Artificial
  CRISPR gRNA sequence
tttggtcaattattgaacag

SEQ ID NO: 152928 - DNA, 20 bp, Artificial
  CRISPR gRNA sequence
tgaacagcggggtctagctt

SEQ ID NO: 152929 - DNA, 20 bp, Artificial
  CRISPR gRNA sequence
taagggagagacaagaagat

SEQ ID NO: 152930 - DNA, 20 bp, Artificial
  CRISPR gRNA sequence
gataagagtgataatacaaa

SEQ ID NO: 152931 - DNA, 20 bp, Artificial
  CRISPR gRNA sequence
tagaaagatcctttgaggcc

SEQ ID NO: 152932 - DNA, 20 bp, Artificial
  CRISPR gRNA sequence
tttgtttttttttcttgaga

SEQ ID NO: 152933 - DNA, 20 bp, Artificial
  CRISPR gRNA sequence
tctcactctgttgcccaggc

SEQ ID NO: 152934 - DNA, 20 bp, Artificial
  CRISPR gRNA sequence
cggtgtttttttagtaaagg

SEQ ID NO: 152935 - DNA, 20 bp, Artificial
  CRISPR gRNA sequence
accttggcctcccaaagtgc

SEQ ID NO: 152936 - DNA, 20 bp, Artificial
  CRISPR gRNA sequence
ttatttattgttttgagaca

SEQ ID NO: 152937 - DNA, 20 bp, Artificial
  CRISPR gRNA sequence
tctcgatttgttgcacaggc

SEQ ID NO: 152938 - DNA, 20 bp, Artificial
  CRISPR gRNA sequence
ctcactgcaagctccgcctc

SEQ ID NO: 152939 - DNA, 20 bp, Artificial
  CRISPR gRNA sequence
cattctcctgcctcagcctg

SEQ ID NO: 152940 - DNA, 20 bp, Artificial
  CRISPR gRNA sequence
tgaggtttaaccatgttagc

SEQ ID NO: 152941 - DNA, 20 bp, Artificial
  CRISPR gRNA sequence
gcctcggcctcccaaagtgc

SEQ ID NO: 152942 - DNA, 20 bp, Artificial
  CRISPR gRNA sequence
tgggaggactgcttgagccc

SEQ ID NO: 152943 - DNA, 20 bp, Artificial
  CRISPR gRNA sequence
ttacaccactacactctagc

SEQ ID NO: 152944 - DNA, 20 bp, Artificial
  CRISPR gRNA sequence
aagtatatcatggtctatca

SEQ ID NO: 152945 - DNA, 20 bp, Artificial
  CRISPR gRNA sequence
agcacagttaagatattatt

SEQ ID NO: 152946 - DNA, 20 bp, Artificial
  CRISPR gRNA sequence
tcaaatgcttaaaatgaccc

SEQ ID NO: 152947 - DNA, 20 bp, Artificial
  CRISPR gRNA sequence
agccaggtccaaactttttt

SEQ ID NO: 152948 - DNA, 20 bp, Artificial
  CRISPR gRNA sequence
ataaaagtaacctggctttc

SEQ ID NO: 152949 - DNA, 20 bp, Artificial
  CRISPR gRNA sequence
cctagctggttctcagcttt

SEQ ID NO: 152950 - DNA, 20 bp, Artificial
  CRISPR gRNA sequence
aaaaagtgaaaacaacctag

SEQ ID NO: 152951 - DNA, 20 bp, Artificial
  CRISPR gRNA sequence
taaaagaaacatgcaacaaa

SEQ ID NO: 152952 - DNA, 20 bp, Artificial
  CRISPR gRNA sequence
aaacatgcaacaaattgagt

SEQ ID NO: 152953 - DNA, 20 bp, Artificial
  CRISPR gRNA sequence
ttcctaaaaagctgaaagac

SEQ ID NO: 152954 - DNA, 20 bp, Artificial
  CRISPR gRNA sequence
atgcatatattatcagtaat

SEQ ID NO: 152955 - DNA, 20 bp, Artificial
  CRISPR gRNA sequence
ttcaacttttaatacatttt

SEQ ID NO: 152956 - DNA, 20 bp, Artificial
  CRISPR gRNA sequence
aacctacacatccctggaac

SEQ ID NO: 152957 - DNA, 20 bp, Artificial
  CRISPR gRNA sequence
tttgccaaacctcattctgt

SEQ ID NO: 152958 - DNA, 20 bp, Artificial
  CRISPR gRNA sequence
ctagattaaaagaaaccccc

SEQ ID NO: 152959 - DNA, 20 bp, Artificial
  CRISPR gRNA sequence
actttgggaggccaaggcag

SEQ ID NO: 152960 - DNA, 20 bp, Artificial
  CRISPR gRNA sequence
ggccaaggcaggaggatcac

SEQ ID NO: 152961 - DNA, 20 bp, Artificial
  CRISPR gRNA sequence
caggaggatcacttgagtcc

SEQ ID NO: 152962 - DNA, 20 bp, Artificial
  CRISPR gRNA sequence
tactcaggaggctgaagtag

SEQ ID NO: 152963 - DNA, 20 bp, Artificial
  CRISPR gRNA sequence
cccaggaggtggaggctgca

SEQ ID NO: 152964 - DNA, 20 bp, Artificial
  CRISPR gRNA sequence
ctcccatgcttgaaaattga

SEQ ID NO: 152965 - DNA, 20 bp, Artificial
  CRISPR gRNA sequence
gagaggttcctaaatctaac

SEQ ID NO: 152966 - DNA, 20 bp, Artificial
  CRISPR gRNA sequence
aggtccttaaattttgacaa

SEQ ID NO: 152967 - DNA, 20 bp, Artificial
  CRISPR gRNA sequence
aggggttaaaattctttcac

SEQ ID NO: 152968 - DNA, 20 bp, Artificial
  CRISPR gRNA sequence
attctttcacaaggatcttg

SEQ ID NO: 152969 - DNA, 20 bp, Artificial
  CRISPR gRNA sequence
caacatatgcattaaataaa

SEQ ID NO: 152970 - DNA, 20 bp, Artificial
  CRISPR gRNA sequence
agggtcatgtcagcataaat

SEQ ID NO: 152971 - DNA, 20 bp, Artificial
  CRISPR gRNA sequence
cgtttcatcccccaaatagt

SEQ ID NO: 152972 - DNA, 20 bp, Artificial
  CRISPR gRNA sequence
ctacaaagctggtgataaag

SEQ ID NO: 152973 - DNA, 20 bp, Artificial
  CRISPR gRNA sequence
gctgcctcaaatactgtgat

SEQ ID NO: 152974 - DNA, 20 bp, Artificial
  CRISPR gRNA sequence
cagccacccatggcctaaat

SEQ ID NO: 152975 - DNA, 20 bp, Artificial
  CRISPR gRNA sequence
catgtgcatttttccaggta

SEQ ID NO: 152976 - DNA, 20 bp, Artificial
  CRISPR gRNA sequence
ggtagtgggtcattctcaaa

SEQ ID NO: 152977 - DNA, 20 bp, Artificial
  CRISPR gRNA sequence
aggccttctcctagggccaa

SEQ ID NO: 152978 - DNA, 20 bp, Artificial
  CRISPR gRNA sequence
catcttaggacttaaattcc

SEQ ID NO: 152979 - DNA, 20 bp, Artificial
  CRISPR gRNA sequence
agaagacaaggtagcatgca

SEQ ID NO: 152980 - DNA, 20 bp, Artificial
  CRISPR gRNA sequence
aaggtagcatgcaaggaatt

SEQ ID NO: 152981 - DNA, 20 bp, Artificial
  CRISPR gRNA sequence
tcactcagctatcataccaa

SEQ ID NO: 152982 - DNA, 20 bp, Artificial
  CRISPR gRNA sequence
gctatcataccaaaagaatt

SEQ ID NO: 152983 - DNA, 20 bp, Artificial
  CRISPR gRNA sequence
gctggggggagggaagtaaa

SEQ ID NO: 152984 - DNA, 20 bp, Artificial
  CRISPR gRNA sequence
gaagtaaaaagagtgggaga

SEQ ID NO: 152985 - DNA, 20 bp, Artificial
  CRISPR gRNA sequence
taaaaagagtgggagagaga

SEQ ID NO: 152986 - DNA, 20 bp, Artificial
  CRISPR gRNA sequence
attccctgaaaattcctaat

SEQ ID NO: 152987 - DNA, 20 bp, Artificial
  CRISPR gRNA sequence
attcctactaaccactcgac

SEQ ID NO: 152988 - DNA, 20 bp, Artificial
  CRISPR gRNA sequence
tcattacaactccaagagcc

SEQ ID NO: 152989 - DNA, 20 bp, Artificial
  CRISPR gRNA sequence
tgctggctgacggctccaca

SEQ ID NO: 152990 - DNA, 20 bp, Artificial
  CRISPR gRNA sequence
ttgcaaataaaaagaaaaca

SEQ ID NO: 152991 - DNA, 20 bp, Artificial
  CRISPR gRNA sequence
gtattatagatcttagtatg

SEQ ID NO: 152992 - DNA, 20 bp, Artificial
  CRISPR gRNA sequence
tacatatcaagggcaaaaga

SEQ ID NO: 152993 - DNA, 20 bp, Artificial
  CRISPR gRNA sequence
actttcctattcacaaactg

SEQ ID NO: 152994 - DNA, 20 bp, Artificial
  CRISPR gRNA sequence
ctacattaactactacttat

SEQ ID NO: 152995 - DNA, 20 bp, Artificial
  CRISPR gRNA sequence
ggtgcaccaaaaggtatgca

SEQ ID NO: 152996 - DNA, 20 bp, Artificial
  CRISPR gRNA sequence
tatcatttcaacacaaaaca

SEQ ID NO: 152997 - DNA, 20 bp, Artificial
  CRISPR gRNA sequence
tttatacctccaccgactgg

SEQ ID NO: 152998 - DNA, 20 bp, Artificial
  CRISPR gRNA sequence
gcagcaggagatgcagaaac

SEQ ID NO: 152999 - DNA, 20 bp, Artificial
  CRISPR gRNA sequence
gagatgcagaaacatgagtc

SEQ ID NO: 153000 - DNA, 20 bp, Artificial
  CRISPR gRNA sequence
caatgggaccactgtggagg

SEQ ID NO: 153001 - DNA, 20 bp, Artificial
  CRISPR gRNA sequence
ggtttggtgtcaaatagcat

SEQ ID NO: 153002 - DNA, 20 bp, Artificial
  CRISPR gRNA sequence
gttaaagtggaaggaggctg

SEQ ID NO: 153003 - DNA, 20 bp, Artificial
  CRISPR gRNA sequence
gcagggcttcattggagcct

SEQ ID NO: 153004 - DNA, 20 bp, Artificial
  CRISPR gRNA sequence
aaagacaaagaaaaatggcg

SEQ ID NO: 153005 - DNA, 20 bp, Artificial
  CRISPR gRNA sequence
gggggtgggaggacagctgt

SEQ ID NO: 153006 - DNA, 20 bp, Artificial
  CRISPR gRNA sequence
gtggagtggacattccagac

SEQ ID NO: 153007 - DNA, 20 bp, Artificial
  CRISPR gRNA sequence
tttctgcatctcctgctgcc

SEQ ID NO: 153008 - DNA, 20 bp, Artificial
  CRISPR gRNA sequence
taaaattaatgcagttcccg

SEQ ID NO: 153009 - DNA, 20 bp, Artificial
  CRISPR gRNA sequence
agttcccggtaagtttaatt

SEQ ID NO: 153010 - DNA, 20 bp, Artificial
  CRISPR gRNA sequence
ttttgtgttgaaatgataga

SEQ ID NO: 153011 - DNA, 20 bp, Artificial
  CRISPR gRNA sequence
tgttgaaatgatagaaactg

SEQ ID NO: 153012 - DNA, 20 bp, Artificial
  CRISPR gRNA sequence
ggtgcacctagaataccttg

SEQ ID NO: 153013 - DNA, 20 bp, Artificial
  CRISPR gRNA sequence
acctagaataccttgctgtg

SEQ ID NO: 153014 - DNA, 20 bp, Artificial
  CRISPR gRNA sequence
agattttgcatgtccttcaa

SEQ ID NO: 153015 - DNA, 20 bp, Artificial
  CRISPR gRNA sequence
tctttgcattgggtaaactt

SEQ ID NO: 153016 - DNA, 20 bp, Artificial
  CRISPR gRNA sequence
tttcctttgttcaagtgccc

SEQ ID NO: 153017 - DNA, 20 bp, Artificial
  CRISPR gRNA sequence
ggaataagctgggttgttgt

SEQ ID NO: 153018 - DNA, 20 bp, Artificial
  CRISPR gRNA sequence
tccatgcactttgttgacat

SEQ ID NO: 153019 - DNA, 20 bp, Artificial
  CRISPR gRNA sequence
tgttagaaatttgtgtgaaa

SEQ ID NO: 153020 - DNA, 20 bp, Artificial
  CRISPR gRNA sequence
gtgaaattttcccataactt

SEQ ID NO: 153021 - DNA, 20 bp, Artificial
  CRISPR gRNA sequence
tcttgatttaccagtctacc

SEQ ID NO: 153022 - DNA, 20 bp, Artificial
  CRISPR gRNA sequence
gtagttaatgtagtaacaat

SEQ ID NO: 153023 - DNA, 20 bp, Artificial
  CRISPR gRNA sequence
tctttgtttttaatgcacat

SEQ ID NO: 153024 - DNA, 20 bp, Artificial
  CRISPR gRNA sequence
gtgatgagcaaatatttttc

SEQ ID NO: 153025 - DNA, 20 bp, Artificial
  CRISPR gRNA sequence
atttcacacattttgtcagg

SEQ ID NO: 153026 - DNA, 20 bp, Artificial
  CRISPR gRNA sequence
tctttaaaatgatgtgagca

SEQ ID NO: 153027 - DNA, 20 bp, Artificial
  CRISPR gRNA sequence
gtattaaatatttaaaatcc

SEQ ID NO: 153028 - DNA, 20 bp, Artificial
  CRISPR gRNA sequence
catactaagatctataatac

SEQ ID NO: 153029 - DNA, 20 bp, Artificial
  CRISPR gRNA sequence
cctgattttaaaatgcaatt

SEQ ID NO: 153030 - DNA, 20 bp, Artificial
  CRISPR gRNA sequence
ggagcaggccctattagagg

SEQ ID NO: 153031 - DNA, 20 bp, Artificial
  CRISPR gRNA sequence
tagaggagaagtttcgaggg

SEQ ID NO: 153032 - DNA, 20 bp, Artificial
  CRISPR gRNA sequence
gagggtgtcgatttgccttc

SEQ ID NO: 153033 - DNA, 20 bp, Artificial
  CRISPR gRNA sequence
tccctagcttcccctctaat

SEQ ID NO: 153034 - DNA, 20 bp, Artificial
  CRISPR gRNA sequence
ggatttaccttagaggactg

SEQ ID NO: 153035 - DNA, 20 bp, Artificial
  CRISPR gRNA sequence
accttagaggactgatagga

SEQ ID NO: 153036 - DNA, 20 bp, Artificial
  CRISPR gRNA sequence
tcctggatgcaggcctctgt

SEQ ID NO: 153037 - DNA, 20 bp, Artificial
  CRISPR gRNA sequence
tgaaaaactgctggggagtt

SEQ ID NO: 153038 - DNA, 20 bp, Artificial
  CRISPR gRNA sequence
ggagttgaaagattgaagga

SEQ ID NO: 153039 - DNA, 20 bp, Artificial
  CRISPR gRNA sequence
ttgaaagattgaaggacaaa

SEQ ID NO: 153040 - DNA, 20 bp, Artificial
  CRISPR gRNA sequence
tgaaggacaaagtttgttta

SEQ ID NO: 153041 - DNA, 20 bp, Artificial
  CRISPR gRNA sequence
agtggttagtaggaatatgt

SEQ ID NO: 153042 - DNA, 20 bp, Artificial
  CRISPR gRNA sequence
tagtaggaatatgttataga

SEQ ID NO: 153043 - DNA, 20 bp, Artificial
  CRISPR gRNA sequence
gatagctgagtgaactgcct

SEQ ID NO: 153044 - DNA, 20 bp, Artificial
  CRISPR gRNA sequence
ttcagagtagttgtatttgt

SEQ ID NO: 153045 - DNA, 20 bp, Artificial
  CRISPR gRNA sequence
gtgaaagttttggggaatta

SEQ ID NO: 153046 - DNA, 20 bp, Artificial
  CRISPR gRNA sequence
taagatgaagaagtatgtgt

SEQ ID NO: 153047 - DNA, 20 bp, Artificial
  CRISPR gRNA sequence
tacattttaagaggtagtta

SEQ ID NO: 153048 - DNA, 20 bp, Artificial
  CRISPR gRNA sequence
agttattttgatttaaattt

SEQ ID NO: 153049 - DNA, 20 bp, Artificial
  CRISPR gRNA sequence
atttaaatttatttgtttgt

SEQ ID NO: 153050 - DNA, 20 bp, Artificial
  CRISPR gRNA sequence
atttatatgttatcagttgt

SEQ ID NO: 153051 - DNA, 20 bp, Artificial
  CRISPR gRNA sequence
tcagttgttccagattatat

SEQ ID NO: 153052 - DNA, 20 bp, Artificial
  CRISPR gRNA sequence
aactataaacttgagaactt

SEQ ID NO: 153053 - DNA, 20 bp, Artificial
  CRISPR gRNA sequence
aaacttgagaactttgtgga

SEQ ID NO: 153054 - DNA, 20 bp, Artificial
  CRISPR gRNA sequence
atttaacacttcagccagat

SEQ ID NO: 153055 - DNA, 20 bp, Artificial
  CRISPR gRNA sequence
tactagacaaatgaagaaaa

SEQ ID NO: 153056 - DNA, 20 bp, Artificial
  CRISPR gRNA sequence
tggctgtgtgtgtaagtggg

SEQ ID NO: 153057 - DNA, 20 bp, Artificial
  CRISPR gRNA sequence
aagccccactcacctttatc

SEQ ID NO: 153058 - DNA, 20 bp, Artificial
  CRISPR gRNA sequence
tcacctttatcaccagcttt

SEQ ID NO: 153059 - DNA, 20 bp, Artificial
  CRISPR gRNA sequence
gggcaagtcagctatttagt

SEQ ID NO: 153060 - DNA, 20 bp, Artificial
  CRISPR gRNA sequence
aaatggaacctaaaaatagt

SEQ ID NO: 153061 - DNA, 20 bp, Artificial
  CRISPR gRNA sequence
tccagactatttgggggatg

SEQ ID NO: 153062 - DNA, 20 bp, Artificial
  CRISPR gRNA sequence
tttaatatttgtaaaaagga

SEQ ID NO: 153063 - DNA, 20 bp, Artificial
  CRISPR gRNA sequence
agaataggatgaaatgggta

SEQ ID NO: 153064 - DNA, 20 bp, Artificial
  CRISPR gRNA sequence
ctgatttttaaaaaactctt

SEQ ID NO: 153065 - DNA, 20 bp, Artificial
  CRISPR gRNA sequence
aagcctgttccatttgcatt

SEQ ID NO: 153066 - DNA, 20 bp, Artificial
  CRISPR gRNA sequence
aggtaagttgtaatggttgc

SEQ ID NO: 153067 - DNA, 20 bp, Artificial
  CRISPR gRNA sequence
taccaagcagaggttacata

SEQ ID NO: 153068 - DNA, 20 bp, Artificial
  CRISPR gRNA sequence
taaactggaaccattttttt

SEQ ID NO: 153069 - DNA, 20 bp, Artificial
  CRISPR gRNA sequence
ctggaaccattttttttttt

SEQ ID NO: 153070 - DNA, 20 bp, Artificial
  CRISPR gRNA sequence
catttttttttttgtttgct

SEQ ID NO: 153071 - DNA, 20 bp, Artificial
  CRISPR gRNA sequence
gtatagtaagcaagtaaatg

SEQ ID NO: 153072 - DNA, 20 bp, Artificial
  CRISPR gRNA sequence
atttttaaatacagacgggg

SEQ ID NO: 153073 - DNA, 20 bp, Artificial
  CRISPR gRNA sequence
tgccttggcctcccaaagtg

SEQ ID NO: 153074 - DNA, 20 bp, Artificial
  CRISPR gRNA sequence
aagtgctgggattacaagca

SEQ ID NO: 153075 - DNA, 20 bp, Artificial
  CRISPR gRNA sequence
cataattggtggaaactcat

SEQ ID NO: 153076 - DNA, 20 bp, Artificial
  CRISPR gRNA sequence
ggggtggggttgatattttg

SEQ ID NO: 153077 - DNA, 20 bp, Artificial
  CRISPR gRNA sequence
tggggttgatattttgtgat

SEQ ID NO: 153078 - DNA, 20 bp, Artificial
  CRISPR gRNA sequence
catggtcagtcagcattggt

SEQ ID NO: 153079 - DNA, 20 bp, Artificial
  CRISPR gRNA sequence
agaatcatattcagacagaa

SEQ ID NO: 153080 - DNA, 20 bp, Artificial
  CRISPR gRNA sequence
aattccagttccagggatgt

SEQ ID NO: 153081 - DNA, 20 bp, Artificial
  CRISPR gRNA sequence
aaacagcaatcgtggtcact

SEQ ID NO: 153082 - DNA, 20 bp, Artificial
  CRISPR gRNA sequence
caatcgtggtcactttgggc

SEQ ID NO: 153083 - DNA, 20 bp, Artificial
  CRISPR gRNA sequence
aagaggctaaatacttttgt

SEQ ID NO: 153084 - DNA, 20 bp, Artificial
  CRISPR gRNA sequence
catggctgtcttcatgaatg

SEQ ID NO: 153085 - DNA, 20 bp, Artificial
  CRISPR gRNA sequence
ttactgataatatatgcata

SEQ ID NO: 153086 - DNA, 20 bp, Artificial
  CRISPR gRNA sequence
aggtgccctaatccaagtct

SEQ ID NO: 153087 - DNA, 20 bp, Artificial
  CRISPR gRNA sequence
agtctttcagctttttagga

SEQ ID NO: 153088 - DNA, 20 bp, Artificial
  CRISPR gRNA sequence
ctttttaggaacaggcttgt

SEQ ID NO: 153089 - DNA, 20 bp, Artificial
  CRISPR gRNA sequence
ggaacaggcttgtacaagtt

SEQ ID NO: 153090 - DNA, 20 bp, Artificial
  CRISPR gRNA sequence
tgactcccactcaatttgtt

SEQ ID NO: 153091 - DNA, 20 bp, Artificial
  CRISPR gRNA sequence
atgtttcttttattcctcta

SEQ ID NO: 153092 - DNA, 20 bp, Artificial
  CRISPR gRNA sequence
ttgttttcactttttatttt

SEQ ID NO: 153093 - DNA, 20 bp, Artificial
  CRISPR gRNA sequence
tttctttttgggacttctgt

SEQ ID NO: 153094 - DNA, 20 bp, Artificial
  CRISPR gRNA sequence
ttgggacttctgtataggct

SEQ ID NO: 153095 - DNA, 20 bp, Artificial
  CRISPR gRNA sequence
ttggttagaaagtctgctgc

SEQ ID NO: 153096 - DNA, 20 bp, Artificial
  CRISPR gRNA sequence
ataccttgcctcagccagtt

SEQ ID NO: 153097 - DNA, 20 bp, Artificial
  CRISPR gRNA sequence
cacatcacctgcaagccagt

SEQ ID NO: 153098 - DNA, 20 bp, Artificial
  CRISPR gRNA sequence
agccagttagtgttttttgt

SEQ ID NO: 153099 - DNA, 20 bp, Artificial
  CRISPR gRNA sequence
aagaacaagctaattcccaa

SEQ ID NO: 153100 - DNA, 20 bp, Artificial
  CRISPR gRNA sequence
gctaacctgtatttaataaa

SEQ ID NO: 153101 - DNA, 20 bp, Artificial
  CRISPR gRNA sequence
gacaagactaaaataggaat

SEQ ID NO: 153102 - DNA, 20 bp, Artificial
  CRISPR gRNA sequence
tatcttaactgtgctgactt

SEQ ID NO: 153103 - DNA, 20 bp, Artificial
  CRISPR gRNA sequence
caaagtggtattatgtgtgt

SEQ ID NO: 153104 - DNA, 20 bp, Artificial
  CRISPR gRNA sequence
ttatgtgtgtatgtgcttgt

SEQ ID NO: 153105 - DNA, 20 bp, Artificial
  CRISPR gRNA sequence
ttatagtccattgaaagaat

SEQ ID NO: 153106 - DNA, 20 bp, Artificial
  CRISPR gRNA sequence
aagtcctaaagtgtactgac

SEQ ID NO: 153107 - DNA, 20 bp, Artificial
  CRISPR gRNA sequence
atttcatgtctacatttccc

SEQ ID NO: 153108 - DNA, 20 bp, Artificial
  CRISPR gRNA sequence
atgtctacatttcccagaag

SEQ ID NO: 153109 - DNA, 20 bp, Artificial
  CRISPR gRNA sequence
aatggcatgaatccgggagg

SEQ ID NO: 153110 - DNA, 20 bp, Artificial
  CRISPR gRNA sequence
tgggcggatcacttgaggtc

SEQ ID NO: 153111 - DNA, 20 bp, Artificial
  CRISPR gRNA sequence
acaggaggctgaggcacaag

SEQ ID NO: 153112 - DNA, 20 bp, Artificial
  CRISPR gRNA sequence
actccagcctgggcaacaga

SEQ ID NO: 153113 - DNA, 20 bp, Artificial
  CRISPR gRNA sequence
ggtgtgagcatctgtgcctg

SEQ ID NO: 153114 - DNA, 20 bp, Artificial
  CRISPR gRNA sequence
gcccacctctttataacgtg

SEQ ID NO: 153115 - DNA, 20 bp, Artificial
  CRISPR gRNA sequence
ccgctgttcaataattgacc

SEQ ID NO: 153116 - DNA, 20 bp, Artificial
  CRISPR gRNA sequence
acttatagtattttttctaa

SEQ ID NO: 153117 - DNA, 20 bp, Artificial
  CRISPR gRNA sequence
taaagaaaaaaaaacatagt

SEQ ID NO: 153118 - DNA, 20 bp, Artificial
  CRISPR gRNA sequence
tcctttcttcttggaagtac

SEQ ID NO: 153119 - DNA, 20 bp, Artificial
  CRISPR gRNA sequence
ttggaagtactaccgttttg

SEQ ID NO: 153120 - DNA, 20 bp, Artificial
  CRISPR gRNA sequence
ctaccgttttggtctgtttc

SEQ ID NO: 153121 - DNA, 20 bp, Artificial
  CRISPR gRNA sequence
ttcaaggaaatgctaaagtt

SEQ ID NO: 153122 - DNA, 20 bp, Artificial
  CRISPR gRNA sequence
aaattttactctgagactga

SEQ ID NO: 153123 - DNA, 20 bp, Artificial
  CRISPR gRNA sequence
gaattcagaggaggggagac

SEQ ID NO: 153124 - DNA, 20 bp, Artificial
  CRISPR gRNA sequence
ttcgcttaggaatgaaggca

SEQ ID NO: 153125 - DNA, 20 bp, Artificial
  CRISPR gRNA sequence
attgggagcaacaagcaaga

SEQ ID NO: 153126 - DNA, 20 bp, Artificial
  CRISPR gRNA sequence
aaggagagcagtaaatggtc

SEQ ID NO: 153127 - DNA, 20 bp, Artificial
  CRISPR gRNA sequence
aaaagaaagaagtatggaga

SEQ ID NO: 153128 - DNA, 20 bp, Artificial
  CRISPR gRNA sequence
ttgggtcagatgttgaaggg

SEQ ID NO: 153129 - DNA, 20 bp, Artificial
  CRISPR gRNA sequence
ggctaagaaatttgaacagt

SEQ ID NO: 153130 - DNA, 20 bp, Artificial
  CRISPR gRNA sequence
attatgagagctgcactttt

SEQ ID NO: 153131 - DNA, 20 bp, Artificial
  CRISPR gRNA sequence
atcttaggttcacaaccctt

SEQ ID NO: 153132 - DNA, 20 bp, Artificial
  CRISPR gRNA sequence
caacccttataggattatta

SEQ ID NO: 153133 - DNA, 20 bp, Artificial
  CRISPR gRNA sequence
ttaaaataggtagtaacata

SEQ ID NO: 153134 - DNA, 20 bp, Artificial
  CRISPR gRNA sequence
tgaacattggctatcatcat

SEQ ID NO: 153135 - DNA, 20 bp, Artificial
  CRISPR gRNA sequence
ctgttactatagaatttagc

SEQ ID NO: 153136 - DNA, 20 bp, Artificial
  CRISPR gRNA sequence
agaaaaagtgcaaaatgata

SEQ ID NO: 153137 - DNA, 20 bp, Artificial
  CRISPR gRNA sequence
gaaacagaaatttaggaaga

SEQ ID NO: 153138 - DNA, 20 bp, Artificial
  CRISPR gRNA sequence
caagtttggggggaaaagaa

SEQ ID NO: 153139 - DNA, 20 bp, Artificial
  CRISPR gRNA sequence
ttggggggaaaagaagatag

SEQ ID NO: 153140 - DNA, 20 bp, Artificial
  CRISPR gRNA sequence
cacgtggaatttcagttctg

SEQ ID NO: 153141 - DNA, 20 bp, Artificial
  CRISPR gRNA sequence
tggttgtagatgtccagcca

SEQ ID NO: 153142 - DNA, 20 bp, Artificial
  CRISPR gRNA sequence
gcagcttgtacatgaaggac

SEQ ID NO: 153143 - DNA, 20 bp, Artificial
  CRISPR gRNA sequence
atatttggaatttaggatca

SEQ ID NO: 153144 - DNA, 20 bp, Artificial
  CRISPR gRNA sequence
gtcctctaggtcagtgctct

SEQ ID NO: 153145 - DNA, 20 bp, Artificial
  CRISPR gRNA sequence
agctttttttggttgcacac

SEQ ID NO: 153146 - DNA, 20 bp, Artificial
  CRISPR gRNA sequence
attctttattccaaaaagtt

SEQ ID NO: 153147 - DNA, 20 bp, Artificial
  CRISPR gRNA sequence
ttattccaaaaagttacttg

SEQ ID NO: 153148 - DNA, 20 bp, Artificial
  CRISPR gRNA sequence
tacttgcttggttttttagt

SEQ ID NO: 153149 - DNA, 20 bp, Artificial
  CRISPR gRNA sequence
ccaggcgtgtacaacaaggt

SEQ ID NO: 153150 - DNA, 20 bp, Artificial
  CRISPR gRNA sequence
cttagaatctggtgaccttc

SEQ ID NO: 153151 - DNA, 20 bp, Artificial
  CRISPR gRNA sequence
aaagatgtacaaatatttcc

SEQ ID NO: 153152 - DNA, 20 bp, Artificial
  CRISPR gRNA sequence
atctccatttggtacaaaga

SEQ ID NO: 153153 - DNA, 20 bp, Artificial
  CRISPR gRNA sequence
agactaggttttattttttg

SEQ ID NO: 153154 - DNA, 20 bp, Artificial
  CRISPR gRNA sequence
agttgctttgggcataatct

SEQ ID NO: 153155 - DNA, 20 bp, Artificial
  CRISPR gRNA sequence
ttgggcataatcttactgat

SEQ ID NO: 153156 - DNA, 20 bp, Artificial
  CRISPR gRNA sequence
gaatgagactagcctcatct

SEQ ID NO: 153157 - DNA, 20 bp, Artificial
  CRISPR gRNA sequence
tttaatataagacacctata

SEQ ID NO: 153158 - DNA, 20 bp, Artificial
  CRISPR gRNA sequence
cattatttataatctaaact

SEQ ID NO: 153159 - DNA, 20 bp, Artificial
  CRISPR gRNA sequence
ttaagcaatgtaatagaatg

SEQ ID NO: 153160 - DNA, 20 bp, Artificial
  CRISPR gRNA sequence
atagtactttatagttagtg

SEQ ID NO: 153161 - DNA, 20 bp, Artificial
  CRISPR gRNA sequence
ctacctaatgtaagtaggac

SEQ ID NO: 153162 - DNA, 20 bp, Artificial
  CRISPR gRNA sequence
agaaggcagagcctagtgac

SEQ ID NO: 153163 - DNA, 20 bp, Artificial
  CRISPR gRNA sequence
tcctaccttctcttttccat

SEQ ID NO: 153164 - DNA, 20 bp, Artificial
  CRISPR gRNA sequence
tcatcaactctcatattata

SEQ ID NO: 153165 - DNA, 20 bp, Artificial
  CRISPR gRNA sequence
gtcaaattgaattaccttta

SEQ ID NO: 153166 - DNA, 20 bp, Artificial
  CRISPR gRNA sequence
ctaaggtcaggtaagtagtt

SEQ ID NO: 153167 - DNA, 20 bp, Artificial
  CRISPR gRNA sequence
gatatttttagatgaatcat

SEQ ID NO: 153168 - DNA, 20 bp, Artificial
  CRISPR gRNA sequence
agatgaatcatggtggtttt

SEQ ID NO: 153169 - DNA, 20 bp, Artificial
  CRISPR gRNA sequence
aatcatggtggttttttttg

SEQ ID NO: 153170 - DNA, 20 bp, Artificial
  CRISPR gRNA sequence
tggtggttttttttgttttg

SEQ ID NO: 153171 - DNA, 20 bp, Artificial
  CRISPR gRNA sequence
gttttttttgttttgttttg

SEQ ID NO: 153172 - DNA, 20 bp, Artificial
  CRISPR gRNA sequence
ttttgttttgttttgttttg

SEQ ID NO: 153173 - DNA, 20 bp, Artificial
  CRISPR gRNA sequence
aacctctgcctcccaggttc

SEQ ID NO: 153174 - DNA, 20 bp, Artificial
  CRISPR gRNA sequence
ttttgtatttttagtagaga

SEQ ID NO: 153175 - DNA, 20 bp, Artificial
  CRISPR gRNA sequence
cgcctcagcctcccaaagtg

SEQ ID NO: 153176 - DNA, 20 bp, Artificial
  CRISPR gRNA sequence
catggtgttcttaaataatc

SEQ ID NO: 153177 - DNA, 20 bp, Artificial
  CRISPR gRNA sequence
cgttgctttaaatttcctag

SEQ ID NO: 153178 - DNA, 20 bp, Artificial
  CRISPR gRNA sequence
tcctagctatgatttataat

SEQ ID NO: 153179 - DNA, 20 bp, Artificial
  CRISPR gRNA sequence
agtgaggtggaacaaaggaa

SEQ ID NO: 153180 - DNA, 20 bp, Artificial
  CRISPR gRNA sequence
acactgcatagaatttagcc

SEQ ID NO: 153181 - DNA, 20 bp, Artificial
  CRISPR gRNA sequence
ttgatcctttctatctccac

SEQ ID NO: 153182 - DNA, 20 bp, Artificial
  CRISPR gRNA sequence
tcccactcctttgatgcaac

SEQ ID NO: 153183 - DNA, 20 bp, Artificial
  CRISPR gRNA sequence
tttgatgcaactgcagttta

SEQ ID NO: 153184 - DNA, 20 bp, Artificial
  CRISPR gRNA sequence
gtttagcaagcttgaaaacc

SEQ ID NO: 153185 - DNA, 20 bp, Artificial
  CRISPR gRNA sequence
agcttgaaaaccttaagctt

SEQ ID NO: 153186 - DNA, 20 bp, Artificial
  CRISPR gRNA sequence
aaaaccttaagctttcttgt

SEQ ID NO: 153187 - DNA, 20 bp, Artificial
  CRISPR gRNA sequence
tgtttaagctttctactttg

SEQ ID NO: 153188 - DNA, 20 bp, Artificial
  CRISPR gRNA sequence
aaatgtttaagaatctggta

SEQ ID NO: 153189 - DNA, 20 bp, Artificial
  CRISPR gRNA sequence
aacgaaaggtaaaaaggcct

SEQ ID NO: 153190 - DNA, 20 bp, Artificial
  CRISPR gRNA sequence
ctgagaaaagctataggttc

SEQ ID NO: 153191 - DNA, 20 bp, Artificial
  CRISPR gRNA sequence
aagctataggttcttaagtt

SEQ ID NO: 153192 - DNA, 20 bp, Artificial
  CRISPR gRNA sequence
atcaattctaaagtagaagg

SEQ ID NO: 153193 - DNA, 20 bp, Artificial
  CRISPR gRNA sequence
gtatctttatctgtcagatg

SEQ ID NO: 153194 - DNA, 20 bp, Artificial
  CRISPR gRNA sequence
tcagatgtgttgcttatctt

SEQ ID NO: 153195 - DNA, 20 bp, Artificial
  CRISPR gRNA sequence
tgtaaagtatgtacaaatgt

SEQ ID NO: 153196 - DNA, 20 bp, Artificial
  CRISPR gRNA sequence
acagctgtatacatgaagtt

SEQ ID NO: 153197 - DNA, 20 bp, Artificial
  CRISPR gRNA sequence
atacatgaagttaagagatt

SEQ ID NO: 153198 - DNA, 20 bp, Artificial
  CRISPR gRNA sequence
gttaagagatttatggtttg

SEQ ID NO: 153199 - DNA, 20 bp, Artificial
  CRISPR gRNA sequence
atttatggtttggttggctt

SEQ ID NO: 153200 - DNA, 20 bp, Artificial
  CRISPR gRNA sequence
ggaagatttgtctcatttca

SEQ ID NO: 153201 - DNA, 20 bp, Artificial
  CRISPR gRNA sequence
tgacattattataacgccct

SEQ ID NO: 153202 - DNA, 20 bp, Artificial
  CRISPR gRNA sequence
ttcccctgtcccaccacccc

SEQ ID NO: 153203 - DNA, 20 bp, Artificial
  CRISPR gRNA sequence
ctcccatttttcagtggagc

SEQ ID NO: 153204 - DNA, 20 bp, Artificial
  CRISPR gRNA sequence
tctacattttccaaagtaga

SEQ ID NO: 153205 - DNA, 20 bp, Artificial
  CRISPR gRNA sequence
cccactcttgtggctcttcc

SEQ ID NO: 153206 - DNA, 20 bp, Artificial
  CRISPR gRNA sequence
tgagaggatcacttgagccc

SEQ ID NO: 153207 - DNA, 20 bp, Artificial
  CRISPR gRNA sequence
atcacttgaacccaggaggt

SEQ ID NO: 153208 - DNA, 20 bp, Artificial
  CRISPR gRNA sequence
gaggttgaggcttcagtgag

SEQ ID NO: 153209 - DNA, 20 bp, Artificial
  CRISPR gRNA sequence
tttttaagttcttgaggaac

SEQ ID NO: 153210 - DNA, 20 bp, Artificial
  CRISPR gRNA sequence
ttgagggtgtatcagaaaca

SEQ ID NO: 153211 - DNA, 20 bp, Artificial
  CRISPR gRNA sequence
gtgtatcagaaacaaaatga

SEQ ID NO: 153212 - DNA, 20 bp, Artificial
  CRISPR gRNA sequence
aaaataggagcatgaaaaat

SEQ ID NO: 153213 - DNA, 20 bp, Artificial
  CRISPR gRNA sequence
gtgaatatgctaattagaga

SEQ ID NO: 153214 - DNA, 20 bp, Artificial
  CRISPR gRNA sequence
tatgctaattagagaaatag

SEQ ID NO: 153215 - DNA, 20 bp, Artificial
  CRISPR gRNA sequence
agatttgattgtgtgccagg

SEQ ID NO: 153216 - DNA, 20 bp, Artificial
  CRISPR gRNA sequence
ggagaaaaaaaatttatcat

SEQ ID NO: 153217 - DNA, 20 bp, Artificial
  CRISPR gRNA sequence
ctgattagtgaatgtgtaga

SEQ ID NO: 153218 - DNA, 20 bp, Artificial
  CRISPR gRNA sequence
tttacatttgtactgtaaag

SEQ ID NO: 153219 - DNA, 20 bp, Artificial
  CRISPR gRNA sequence
attgcagaagagccttaaac

SEQ ID NO: 153220 - DNA, 20 bp, Artificial
  CRISPR gRNA sequence
agaaattccaactttccaga

SEQ ID NO: 153221 - DNA, 20 bp, Artificial
  CRISPR gRNA sequence
ttagagctccaaacagaatc

SEQ ID NO: 153222 - DNA, 20 bp, Artificial
  CRISPR gRNA sequence
agtggggagctgcctggact

SEQ ID NO: 153223 - DNA, 20 bp, Artificial
  CRISPR gRNA sequence
tcctctaccctctaacataa

SEQ ID NO: 153224 - DNA, 20 bp, Artificial
  CRISPR gRNA sequence
agacaaaacaggcacgtact

SEQ ID NO: 153225 - DNA, 20 bp, Artificial
  CRISPR gRNA sequence
ccaaggagatggtggtggtt

SEQ ID NO: 153226 - DNA, 20 bp, Artificial
  CRISPR gRNA sequence
gtggtggttgtgggtttttt

SEQ ID NO: 153227 - DNA, 20 bp, Artificial
  CRISPR gRNA sequence
tttgtagagacgaggtcttt

SEQ ID NO: 153228 - DNA, 20 bp, Artificial
  CRISPR gRNA sequence
ctcctgggctcaagcgatcc

SEQ ID NO: 153229 - DNA, 20 bp, Artificial
  CRISPR gRNA sequence
ggctcaagcgatcctcctgc

SEQ ID NO: 153230 - DNA, 20 bp, Artificial
  CRISPR gRNA sequence
tgctttggcttcccaaagtg

SEQ ID NO: 153231 - DNA, 20 bp, Artificial
  CRISPR gRNA sequence
aatggtgtggacccgggagg

SEQ ID NO: 153232 - DNA, 20 bp, Artificial
  CRISPR gRNA sequence
attccagcctgggtgacaga

SEQ ID NO: 153233 - DNA, 20 bp, Artificial
  CRISPR gRNA sequence
ttaatttaaaaaaagaattt

SEQ ID NO: 153234 - DNA, 20 bp, Artificial
  CRISPR gRNA sequence
aaaaaaagaatttaaatgtt

SEQ ID NO: 153235 - DNA, 20 bp, Artificial
  CRISPR gRNA sequence
ctattgatcattgacacacc

SEQ ID NO: 153236 - DNA, 20 bp, Artificial
  CRISPR gRNA sequence
aaatttggaacgttcccatg

SEQ ID NO: 153237 - DNA, 20 bp, Artificial
  CRISPR gRNA sequence
tcccatgttcagcttgaatt

SEQ ID NO: 153238 - DNA, 20 bp, Artificial
  CRISPR gRNA sequence
agtacatttgttccaaattt

SEQ ID NO: 153239 - DNA, 20 bp, Artificial
  CRISPR gRNA sequence
gttccaaatttaatagttta

SEQ ID NO: 153240 - DNA, 20 bp, Artificial
  CRISPR gRNA sequence
taaagggcttaaaaattatt

SEQ ID NO: 153241 - DNA, 20 bp, Artificial
  CRISPR gRNA sequence
gtatttccatgcatctgaaa

SEQ ID NO: 153242 - DNA, 20 bp, Artificial
  CRISPR gRNA sequence
gaccagtagttggtgtcttg

SEQ ID NO: 153243 - DNA, 20 bp, Artificial
  CRISPR gRNA sequence
gatgccatctggcatttgta

SEQ ID NO: 153244 - DNA, 20 bp, Artificial
  CRISPR gRNA sequence
attttttgaggccttctaac

SEQ ID NO: 153245 - DNA, 20 bp, Artificial
  CRISPR gRNA sequence
taacatgtgttttaccattt

SEQ ID NO: 153246 - DNA, 20 bp, Artificial
  CRISPR gRNA sequence
gtttcagctgctctgtggga

SEQ ID NO: 153247 - DNA, 20 bp, Artificial
  CRISPR gRNA sequence
atgttgctttagatgaatag

SEQ ID NO: 153248 - DNA, 20 bp, Artificial
  CRISPR gRNA sequence
agagaagtttctaagaagtt

SEQ ID NO: 153249 - DNA, 20 bp, Artificial
  CRISPR gRNA sequence
tatttatttatgtatttacc

SEQ ID NO: 153250 - DNA, 20 bp, Artificial
  CRISPR gRNA sequence
aacagaaaagaaaaaagagt

SEQ ID NO: 153251 - DNA, 20 bp, Artificial
  CRISPR gRNA sequence
aataaatcaagacagaattt

SEQ ID NO: 153252 - DNA, 20 bp, Artificial
  CRISPR gRNA sequence
ctgccagaaactgggcaaga

SEQ ID NO: 153253 - DNA, 20 bp, Artificial
  CRISPR gRNA sequence
gaaggcacccggtaagaaaa

SEQ ID NO: 153254 - DNA, 20 bp, Artificial
  CRISPR gRNA sequence
cacccggtaagaaaatgatg

SEQ ID NO: 153255 - DNA, 20 bp, Artificial
  CRISPR gRNA sequence
gctcatgtcacaattccttt

SEQ ID NO: 153256 - DNA, 20 bp, Artificial
  CRISPR gRNA sequence
gttactcaccattcttccta

SEQ ID NO: 153257 - DNA, 20 bp, Artificial
  CRISPR gRNA sequence
gtggggcagagggggtctgg

SEQ ID NO: 153258 - DNA, 20 bp, Artificial
  CRISPR gRNA sequence
taacagttgtgtgatctagg

SEQ ID NO: 153259 - DNA, 20 bp, Artificial
  CRISPR gRNA sequence
ccagcttctcaacttctagt

SEQ ID NO: 153260 - DNA, 20 bp, Artificial
  CRISPR gRNA sequence
gggataaataaaacacctaa

SEQ ID NO: 153261 - DNA, 20 bp, Artificial
  CRISPR gRNA sequence
tggcgcaatcatggctcact

SEQ ID NO: 153262 - DNA, 20 bp, Artificial
  CRISPR gRNA sequence
ggtgtgggccactacacctg

SEQ ID NO: 153263 - DNA, 20 bp, Artificial
  CRISPR gRNA sequence
cgccttggcctcccagagtg

SEQ ID NO: 153264 - DNA, 20 bp, Artificial
  CRISPR gRNA sequence
tccttaaagggccagatatt

SEQ ID NO: 153265 - DNA, 20 bp, Artificial
  CRISPR gRNA sequence
atattttaggctttgtggct

SEQ ID NO: 153266 - DNA, 20 bp, Artificial
  CRISPR gRNA sequence
ttgttgtaactcttcaactc

SEQ ID NO: 153267 - DNA, 20 bp, Artificial
  CRISPR gRNA sequence
gtggctcacgcctgtaatcc

SEQ ID NO: 153268 - DNA, 20 bp, Artificial
  CRISPR gRNA sequence
tggcgggtgcctataatccc

SEQ ID NO: 153269 - DNA, 20 bp, Artificial
  CRISPR gRNA sequence
ttgggaggctgaggtgggag

SEQ ID NO: 153270 - DNA, 20 bp, Artificial
  CRISPR gRNA sequence
gggttgatgtcttccagtga

SEQ ID NO: 153271 - DNA, 20 bp, Artificial
  CRISPR gRNA sequence
gccagatgtggcctatgagc

SEQ ID NO: 153272 - DNA, 20 bp, Artificial
  CRISPR gRNA sequence
atgagctgtagtttttagac

SEQ ID NO: 153273 - DNA, 20 bp, Artificial
  CRISPR gRNA sequence
ttcatcatacaaaatactga

SEQ ID NO: 153274 - DNA, 20 bp, Artificial
  CRISPR gRNA sequence
attgctgttatatatgcaga

SEQ ID NO: 153275 - DNA, 20 bp, Artificial
  CRISPR gRNA sequence
gttatatatgcagagatggt

SEQ ID NO: 153276 - DNA, 20 bp, Artificial
  CRISPR gRNA sequence
gtgtgaagtaagatgttaca

SEQ ID NO: 153277 - DNA, 20 bp, Artificial
  CRISPR gRNA sequence
tcgttttctattccacagaa

SEQ ID NO: 153278 - DNA, 20 bp, Artificial
  CRISPR gRNA sequence
tcatgccttcccgtcacttt

SEQ ID NO: 153279 - DNA, 20 bp, Artificial
  CRISPR gRNA sequence
caactatattatgatctggc

SEQ ID NO: 153280 - DNA, 20 bp, Artificial
  CRISPR gRNA sequence
ttatgatctggcccctgttt

SEQ ID NO: 153281 - DNA, 20 bp, Artificial
  CRISPR gRNA sequence
gataccaaatagaaaagtat

SEQ ID NO: 153282 - DNA, 20 bp, Artificial
  CRISPR gRNA sequence
gaaggaaaagtggctcttct

SEQ ID NO: 153283 - DNA, 20 bp, Artificial
  CRISPR gRNA sequence
agcctaagtcttttaggaag

SEQ ID NO: 153284 - DNA, 20 bp, Artificial
  CRISPR gRNA sequence
ttccagtaggcactttgaaa

SEQ ID NO: 153285 - DNA, 20 bp, Artificial
  CRISPR gRNA sequence
cagctggtacccagctatgt

SEQ ID NO: 153286 - DNA, 20 bp, Artificial
  CRISPR gRNA sequence
agggtttagaatgtaagtaa

SEQ ID NO: 153287 - DNA, 20 bp, Artificial
  CRISPR gRNA sequence
cactaaacgtagtgcctgaa

SEQ ID NO: 153288 - DNA, 20 bp, Artificial
  CRISPR gRNA sequence
tgactatataaaaaccttag

SEQ ID NO: 153289 - DNA, 20 bp, Artificial
  CRISPR gRNA sequence
tcagtatacatcattgctgg

SEQ ID NO: 153290 - DNA, 20 bp, Artificial
  CRISPR gRNA sequence
tcttttaatttccagaccag

SEQ ID NO: 153291 - DNA, 20 bp, Artificial
  CRISPR gRNA sequence
cttcttgtgaaattgtcaat

SEQ ID NO: 153292 - DNA, 20 bp, Artificial
  CRISPR gRNA sequence
tgtgaaattgtcaattttag

SEQ ID NO: 153293 - DNA, 20 bp, Artificial
  CRISPR gRNA sequence
agagtataagccttcttaag

SEQ ID NO: 153294 - DNA, 20 bp, Artificial
  CRISPR gRNA sequence
ctgagcagtactggtacata

SEQ ID NO: 153295 - DNA, 20 bp, Artificial
  CRISPR gRNA sequence
aaagagagtcacacaaattt

SEQ ID NO: 153296 - DNA, 20 bp, Artificial
  CRISPR gRNA sequence
tttcccagtgcaaatagaag

SEQ ID NO: 153297 - DNA, 20 bp, Artificial
  CRISPR gRNA sequence
aacagcataatgtctaaaaa

SEQ ID NO: 153298 - DNA, 20 bp, Artificial
  CRISPR gRNA sequence
tgcagcaagtcataaccttt

SEQ ID NO: 153299 - DNA, 20 bp, Artificial
  CRISPR gRNA sequence
acttgatgatgatggctgct

SEQ ID NO: 153300 - DNA, 20 bp, Artificial
  CRISPR gRNA sequence
ctgattcgggtggtagttgc

SEQ ID NO: 153301 - DNA, 20 bp, Artificial
  CRISPR gRNA sequence
tggtagttgctgaagtttgg

SEQ ID NO: 153302 - DNA, 20 bp, Artificial
  CRISPR gRNA sequence
ggctttggcaatttctgtgt

SEQ ID NO: 153303 - DNA, 20 bp, Artificial
  CRISPR gRNA sequence
atgtgtttgtgtgtgtgtgt

SEQ ID NO: 153304 - DNA, 20 bp, Artificial
  CRISPR gRNA sequence
gtgtgtgtttttttttgaga

SEQ ID NO: 153305 - DNA, 20 bp, Artificial
  CRISPR gRNA sequence
aacctctgcctcctgggctc

SEQ ID NO: 153306 - DNA, 20 bp, Artificial
  CRISPR gRNA sequence
ggctcaagcgattctgctgc

SEQ ID NO: 153307 - DNA, 20 bp, Artificial
  CRISPR gRNA sequence
tgccccagcttcccaagtag

SEQ ID NO: 153308 - DNA, 20 bp, Artificial
  CRISPR gRNA sequence
ttttgtatttttagtagaga

SEQ ID NO: 153309 - DNA, 20 bp, Artificial
  CRISPR gRNA sequence
ggtttcaccatgttggccag

SEQ ID NO: 153310 - DNA, 20 bp, Artificial
  CRISPR gRNA sequence
cacctcagtctcccaaagtg

SEQ ID NO: 153311 - DNA, 20 bp, Artificial
  CRISPR gRNA sequence
ggcgtgagccaccgcatctg

SEQ ID NO: 153312 - DNA, 20 bp, Artificial
  CRISPR gRNA sequence
gagtacagtgtcatgatctt

SEQ ID NO: 153313 - DNA, 20 bp, Artificial
  CRISPR gRNA sequence
agacacgtgccaccacaccc

SEQ ID NO: 153314 - DNA, 20 bp, Artificial
  CRISPR gRNA sequence
tgccctagcctcccaaagtg

SEQ ID NO: 153315 - DNA, 20 bp, Artificial
  CRISPR gRNA sequence
ttcttaaaataaggcagcag

SEQ ID NO: 153316 - DNA, 20 bp, Artificial
  CRISPR gRNA sequence
aataaggcagcagtgaagtt

SEQ ID NO: 153317 - DNA, 20 bp, Artificial
  CRISPR gRNA sequence
cagttgactcttcctttcat

SEQ ID NO: 153318 - DNA, 20 bp, Artificial
  CRISPR gRNA sequence
ttcatgaaagatttctctgt

SEQ ID NO: 153319 - DNA, 20 bp, Artificial
  CRISPR gRNA sequence
agatttctctgtagctgctt

SEQ ID NO: 153320 - DNA, 20 bp, Artificial
  CRISPR gRNA sequence
tgatagcattttacccagag

SEQ ID NO: 153321 - DNA, 20 bp, Artificial
  CRISPR gRNA sequence
agtagagcttctttcaaaac

SEQ ID NO: 153322 - DNA, 20 bp, Artificial
  CRISPR gRNA sequence
tcctgccactattttatgaa

SEQ ID NO: 153323 - DNA, 20 bp, Artificial
  CRISPR gRNA sequence
agaagcaactcctcatctgt

SEQ ID NO: 153324 - DNA, 20 bp, Artificial
  CRISPR gRNA sequence
tcatctgttaaagttttatc

SEQ ID NO: 153325 - DNA, 20 bp, Artificial
  CRISPR gRNA sequence
caatccagtcacatctcagg

SEQ ID NO: 153326 - DNA, 20 bp, Artificial
  CRISPR gRNA sequence
aaacccctcaaaatcatcca

SEQ ID NO: 153327 - DNA, 20 bp, Artificial
  CRISPR gRNA sequence
aatcaacttcagactcctgt

SEQ ID NO: 153328 - DNA, 20 bp, Artificial
  CRISPR gRNA sequence
acttcctcccatgaattttg

SEQ ID NO: 153329 - DNA, 20 bp, Artificial
  CRISPR gRNA sequence
catgaattttgaatggcttt

SEQ ID NO: 153330 - DNA, 20 bp, Artificial
  CRISPR gRNA sequence
aattttgaatggcttttttt

SEQ ID NO: 153331 - DNA, 20 bp, Artificial
  CRISPR gRNA sequence
ttgaatggctttttttgttt

SEQ ID NO: 153332 - DNA, 20 bp, Artificial
  CRISPR gRNA sequence
tttggttggttggttggttg

SEQ ID NO: 153333 - DNA, 20 bp, Artificial
  CRISPR gRNA sequence
tttttgtattttttgtagag

SEQ ID NO: 153334 - DNA, 20 bp, Artificial
  CRISPR gRNA sequence
ggttttgccatgttgcccag

SEQ ID NO: 153335 - DNA, 20 bp, Artificial
  CRISPR gRNA sequence
gcccaggctggagtgcagtg

SEQ ID NO: 153336 - DNA, 20 bp, Artificial
  CRISPR gRNA sequence
gctcactgcaacctccgcct

SEQ ID NO: 153337 - DNA, 20 bp, Artificial
  CRISPR gRNA sequence
aacctccgcctcccagattc

SEQ ID NO: 153338 - DNA, 20 bp, Artificial
  CRISPR gRNA sequence
gattcaagtgattctcctgc

SEQ ID NO: 153339 - DNA, 20 bp, Artificial
  CRISPR gRNA sequence
tgcctcagctttccaagtag

SEQ ID NO: 153340 - DNA, 20 bp, Artificial
  CRISPR gRNA sequence
ttgtatttttttagtagaga

SEQ ID NO: 153341 - DNA, 20 bp, Artificial
  CRISPR gRNA sequence
ctggtctcaaactcatgacc

SEQ ID NO: 153342 - DNA, 20 bp, Artificial
  CRISPR gRNA sequence
cgcctcggcctcccaaagtg

SEQ ID NO: 153343 - DNA, 20 bp, Artificial
  CRISPR gRNA sequence
aaaatggtgaatcctgtcta

SEQ ID NO: 153344 - DNA, 20 bp, Artificial
  CRISPR gRNA sequence
tgaatcctgtctagaaggtt

SEQ ID NO: 153345 - DNA, 20 bp, Artificial
  CRISPR gRNA sequence
atggcagctgtgtccttatg

SEQ ID NO: 153346 - DNA, 20 bp, Artificial
  CRISPR gRNA sequence
gatctcggatcactgcagcc

SEQ ID NO: 153347 - DNA, 20 bp, Artificial
  CRISPR gRNA sequence
ccaacaagccctgctaattt

SEQ ID NO: 153348 - DNA, 20 bp, Artificial
  CRISPR gRNA sequence
ttttgtgtttttagtagaga

SEQ ID NO: 153349 - DNA, 20 bp, Artificial
  CRISPR gRNA sequence
tgccttggcctcccaaagtg

SEQ ID NO: 153350 - DNA, 20 bp, Artificial
  CRISPR gRNA sequence
tactaatctcggctgggcgc

SEQ ID NO: 153351 - DNA, 20 bp, Artificial
  CRISPR gRNA sequence
cactttgggaggctgaggcg

SEQ ID NO: 153352 - DNA, 20 bp, Artificial
  CRISPR gRNA sequence
cgggcggattacttgaaatc

SEQ ID NO: 153353 - DNA, 20 bp, Artificial
  CRISPR gRNA sequence
ctcgggaggctgggcatgag

SEQ ID NO: 153354 - DNA, 20 bp, Artificial
  CRISPR gRNA sequence
aactctgatggagttgtgca

SEQ ID NO: 153355 - DNA, 20 bp, Artificial
  CRISPR gRNA sequence
atggagttgtgcaagcagat

SEQ ID NO: 153356 - DNA, 20 bp, Artificial
  CRISPR gRNA sequence
tgtgcaagcagattaatgtt

SEQ ID NO: 153357 - DNA, 20 bp, Artificial
  CRISPR gRNA sequence
aagcagattaatgttttttg

SEQ ID NO: 153358 - DNA, 20 bp, Artificial
  CRISPR gRNA sequence
ctcactgcaacctctgcctc

SEQ ID NO: 153359 - DNA, 20 bp, Artificial
  CRISPR gRNA sequence
aacctctgcctcctgggttt

SEQ ID NO: 153360 - DNA, 20 bp, Artificial
  CRISPR gRNA sequence
tgcctcagcctcttgagtag

SEQ ID NO: 153361 - DNA, 20 bp, Artificial
  CRISPR gRNA sequence
ttttgtatttttaatggaga

SEQ ID NO: 153362 - DNA, 20 bp, Artificial
  CRISPR gRNA sequence
cgccttggcctcccaaagtg

SEQ ID NO: 153363 - DNA, 20 bp, Artificial
  CRISPR gRNA sequence
agccactgctcccagcctcc

SEQ ID NO: 153364 - DNA, 20 bp, Artificial
  CRISPR gRNA sequence
ctgagcagtaggtctcaaca

SEQ ID NO: 153365 - DNA, 20 bp, Artificial
  CRISPR gRNA sequence
gtaaacagatgtgctgtcat

SEQ ID NO: 153366 - DNA, 20 bp, Artificial
  CRISPR gRNA sequence
catttatagagcacaggcag

SEQ ID NO: 153367 - DNA, 20 bp, Artificial
  CRISPR gRNA sequence
ttttggaatggtaaatgagc

SEQ ID NO: 153368 - DNA, 20 bp, Artificial
  CRISPR gRNA sequence
ttttgtctgcactgaaattc

SEQ ID NO: 153369 - DNA, 20 bp, Artificial
  CRISPR gRNA sequence
atcttcgggataaaacttgc

SEQ ID NO: 153370 - DNA, 20 bp, Artificial
  CRISPR gRNA sequence
ttatacttttatgttatgga

SEQ ID NO: 153371 - DNA, 20 bp, Artificial
  CRISPR gRNA sequence
ttatgttatggagatggctt

SEQ ID NO: 153372 - DNA, 20 bp, Artificial
  CRISPR gRNA sequence
agttagggcattgctccaca

SEQ ID NO: 153373 - DNA, 20 bp, Artificial
  CRISPR gRNA sequence
ggcattgctccacattaggc

SEQ ID NO: 153374 - DNA, 20 bp, Artificial
  CRISPR gRNA sequence
tggcttaaaggaatgttgtg

SEQ ID NO: 153375 - DNA, 20 bp, Artificial
  CRISPR gRNA sequence
tttcttcatatcagcaataa

SEQ ID NO: 153376 - DNA, 20 bp, Artificial
  CRISPR gRNA sequence
ttcatatcagcaataaagct

SEQ ID NO: 153377 - DNA, 20 bp, Artificial
  CRISPR gRNA sequence
aagaactttttctttgcagt

SEQ ID NO: 153378 - DNA, 20 bp, Artificial
  CRISPR gRNA sequence
tttgcagtcacagcttgggt

SEQ ID NO: 153379 - DNA, 20 bp, Artificial
  CRISPR gRNA sequence
aaccttcgcctcctgggttc

SEQ ID NO: 153380 - DNA, 20 bp, Artificial
  CRISPR gRNA sequence
ggttcaagagattcttctgc

SEQ ID NO: 153381 - DNA, 20 bp, Artificial
  CRISPR gRNA sequence
tgcctcagcttcccaagtag

SEQ ID NO: 153382 - DNA, 20 bp, Artificial
  CRISPR gRNA sequence
ttttgtatttttggtagaga

SEQ ID NO: 153383 - DNA, 20 bp, Artificial
  CRISPR gRNA sequence
cgcctcggcctcccaaagtg

SEQ ID NO: 153384 - DNA, 20 bp, Artificial
  CRISPR gRNA sequence
gccaccgcgcccagccccat

SEQ ID NO: 153385 - DNA, 20 bp, Artificial
  CRISPR gRNA sequence
cagccccatatcagcttttg

SEQ ID NO: 153386 - DNA, 20 bp, Artificial
  CRISPR gRNA sequence
cttttgatgtgctttcctca

SEQ ID NO: 153387 - DNA, 20 bp, Artificial
  CRISPR gRNA sequence
cctcactaagcttaatcatt

SEQ ID NO: 153388 - DNA, 20 bp, Artificial
  CRISPR gRNA sequence
taagcttaatcatttctagc

SEQ ID NO: 153389 - DNA, 20 bp, Artificial
  CRISPR gRNA sequence
cttaatcatttctagctttc

SEQ ID NO: 153390 - DNA, 20 bp, Artificial
  CRISPR gRNA sequence
tcgattgattgagttagaga

SEQ ID NO: 153391 - DNA, 20 bp, Artificial
  CRISPR gRNA sequence
tgccaagctggtctcgaact

SEQ ID NO: 153392 - DNA, 20 bp, Artificial
  CRISPR gRNA sequence
ctccttggtgcctcaaagtt

SEQ ID NO: 153393 - DNA, 20 bp, Artificial
  CRISPR gRNA sequence
gtgagccaccacacctggcc

SEQ ID NO: 153394 - DNA, 20 bp, Artificial
  CRISPR gRNA sequence
gtgagactgttcttttactt

SEQ ID NO: 153395 - DNA, 20 bp, Artificial
  CRISPR gRNA sequence
aaaaagcctaagggctgcaa

SEQ ID NO: 153396 - DNA, 20 bp, Artificial
  CRISPR gRNA sequence
aatgataataccaacattat

SEQ ID NO: 153397 - DNA, 20 bp, Artificial
  CRISPR gRNA sequence
tcagtactgagctaagatat

SEQ ID NO: 153398 - DNA, 20 bp, Artificial
  CRISPR gRNA sequence
tacagagggtcttcagacaa

SEQ ID NO: 153399 - DNA, 20 bp, Artificial
  CRISPR gRNA sequence
gagggtcttcagacaatgtt

SEQ ID NO: 153400 - DNA, 20 bp, Artificial
  CRISPR gRNA sequence
ggccggggtcactctctgtg

SEQ ID NO: 153401 - DNA, 20 bp, Artificial
  CRISPR gRNA sequence
agtttgagcattgtccccac

SEQ ID NO: 153402 - DNA, 20 bp, Artificial
  CRISPR gRNA sequence
gagcattgtccccacgtctg

SEQ ID NO: 153403 - DNA, 20 bp, Artificial
  CRISPR gRNA sequence
gtttggttttttttccagta

SEQ ID NO: 153404 - DNA, 20 bp, Artificial
  CRISPR gRNA sequence
agcctgagtgagagtgtgcc

SEQ ID NO: 153405 - DNA, 20 bp, Artificial
  CRISPR gRNA sequence
gtgccctgtgattgagttgt

SEQ ID NO: 153406 - DNA, 20 bp, Artificial
  CRISPR gRNA sequence
ttgtgccctgaactgttggg

SEQ ID NO: 153407 - DNA, 20 bp, Artificial
  CRISPR gRNA sequence
aacctccacctcctgggttc

SEQ ID NO: 153408 - DNA, 20 bp, Artificial
  CRISPR gRNA sequence
tgccttagcctcccaagtag

SEQ ID NO: 153409 - DNA, 20 bp, Artificial
  CRISPR gRNA sequence
ttttgtatttttagtagaga

SEQ ID NO: 153410 - DNA, 20 bp, Artificial
  CRISPR gRNA sequence
gctcactgcagcctccacct

SEQ ID NO: 153411 - DNA, 20 bp, Artificial
  CRISPR gRNA sequence
agcctccacctcctggattc

SEQ ID NO: 153412 - DNA, 20 bp, Artificial
  CRISPR gRNA sequence
ttttatatttttagtagaga

SEQ ID NO: 153413 - DNA, 20 bp, Artificial
  CRISPR gRNA sequence
cacctcggcctctcaaagtg

SEQ ID NO: 153414 - DNA, 20 bp, Artificial
  CRISPR gRNA sequence
tgtatagttcatacttattt

SEQ ID NO: 153415 - DNA, 20 bp, Artificial
  CRISPR gRNA sequence
aagtgtcttgatctttattt

SEQ ID NO: 153416 - DNA, 20 bp, Artificial
  CRISPR gRNA sequence
atctttatttagaagtttgg

SEQ ID NO: 153417 - DNA, 20 bp, Artificial
  CRISPR gRNA sequence
gtcaattagcctttggtaaa

SEQ ID NO: 153418 - DNA, 20 bp, Artificial
  CRISPR gRNA sequence
ttggtaaaattggttttgtt

SEQ ID NO: 153419 - DNA, 20 bp, Artificial
  CRISPR gRNA sequence
aaaattggttttgttatatg

SEQ ID NO: 153420 - DNA, 20 bp, Artificial
  CRISPR gRNA sequence
gttatatgtttggcttaagt

SEQ ID NO: 153421 - DNA, 20 bp, Artificial
  CRISPR gRNA sequence
gacattaagggaggacttaa

SEQ ID NO: 153422 - DNA, 20 bp, Artificial
  CRISPR gRNA sequence
gaagcagcattggtcaagaa

SEQ ID NO: 153423 - DNA, 20 bp, Artificial
  CRISPR gRNA sequence
agaattgggtttcattttag

SEQ ID NO: 153424 - DNA, 20 bp, Artificial
  CRISPR gRNA sequence
cttggacagttgttgtgatg

SEQ ID NO: 153425 - DNA, 20 bp, Artificial
  CRISPR gRNA sequence
ttatctcccaacaacatcta

SEQ ID NO: 153426 - DNA, 20 bp, Artificial
  CRISPR gRNA sequence
ttacctcaaagagctgtatt

SEQ ID NO: 153427 - DNA, 20 bp, Artificial
  CRISPR gRNA sequence
gtgggtttaggctactataa

SEQ ID NO: 153428 - DNA, 20 bp, Artificial
  CRISPR gRNA sequence
tgaactgaagtctaaaggtc

SEQ ID NO: 153429 - DNA, 20 bp, Artificial
  CRISPR gRNA sequence
aggtcatattgcaataaaac

SEQ ID NO: 153430 - DNA, 20 bp, Artificial
  CRISPR gRNA sequence
tgcccaggcatatcactaag

SEQ ID NO: 153431 - DNA, 20 bp, Artificial
  CRISPR gRNA sequence
catggtacctggttgagagc

SEQ ID NO: 153432 - DNA, 20 bp, Artificial
  CRISPR gRNA sequence
ctggttgagagcaagagctt

SEQ ID NO: 153433 - DNA, 20 bp, Artificial
  CRISPR gRNA sequence
aaacaattttaaaaggaaca

SEQ ID NO: 153434 - DNA, 20 bp, Artificial
  CRISPR gRNA sequence
aaaggaacactctgattttg

SEQ ID NO: 153435 - DNA, 20 bp, Artificial
  CRISPR gRNA sequence
tgggatgttttgaaaacttc

SEQ ID NO: 153436 - DNA, 20 bp, Artificial
  CRISPR gRNA sequence
aactggatataagagtaaca

SEQ ID NO: 153437 - DNA, 20 bp, Artificial
  CRISPR gRNA sequence
gatcaaatcatctcacttct

SEQ ID NO: 153438 - DNA, 20 bp, Artificial
  CRISPR gRNA sequence
ctgaagaggttctgactttg

SEQ ID NO: 153439 - DNA, 20 bp, Artificial
  CRISPR gRNA sequence
tccagccttcaagtctgcct

SEQ ID NO: 153440 - DNA, 20 bp, Artificial
  CRISPR gRNA sequence
tcagcttccagcactgtctt

SEQ ID NO: 153441 - DNA, 20 bp, Artificial
  CRISPR gRNA sequence
ttttaaatccatttcagtaa

SEQ ID NO: 153442 - DNA, 20 bp, Artificial
  CRISPR gRNA sequence
atttcagtaaatcagtttca

SEQ ID NO: 153443 - DNA, 20 bp, Artificial
  CRISPR gRNA sequence
taaatcagtttcaggtagat

SEQ ID NO: 153444 - DNA, 20 bp, Artificial
  CRISPR gRNA sequence
aggtagatttctgattgcag

SEQ ID NO: 153445 - DNA, 20 bp, Artificial
  CRISPR gRNA sequence
agtcctggagctcatttagt

SEQ ID NO: 153446 - DNA, 20 bp, Artificial
  CRISPR gRNA sequence
catttagtctaagcttctgg

SEQ ID NO: 153447 - DNA, 20 bp, Artificial
  CRISPR gRNA sequence
ttccaataagtatgtcaggg

SEQ ID NO: 153448 - DNA, 20 bp, Artificial
  CRISPR gRNA sequence
gtatgtcagggccaagcttt

SEQ ID NO: 153449 - DNA, 20 bp, Artificial
  CRISPR gRNA sequence
atatgcagatcctaccctca

SEQ ID NO: 153450 - DNA, 20 bp, Artificial
  CRISPR gRNA sequence
gtcatacaaggtatcaaata

SEQ ID NO: 153451 - DNA, 20 bp, Artificial
  CRISPR gRNA sequence
ctacttgggaggctgtggta

SEQ ID NO: 153452 - DNA, 20 bp, Artificial
  CRISPR gRNA sequence
ttgggaggctgtggtaggag

SEQ ID NO: 153453 - DNA, 20 bp, Artificial
  CRISPR gRNA sequence
cctgggcaacagagcgaaac

SEQ ID NO: 153454 - DNA, 20 bp, Artificial
  CRISPR gRNA sequence
aaaaaaaaatagagagaaag

SEQ ID NO: 153455 - DNA, 20 bp, Artificial
  CRISPR gRNA sequence
ttatcttgactcactgcaac

SEQ ID NO: 153456 - DNA, 20 bp, Artificial
  CRISPR gRNA sequence
tgcctcagcctcccaagtag

SEQ ID NO: 153457 - DNA, 20 bp, Artificial
  CRISPR gRNA sequence
ccatgctcggctaatgtatt

SEQ ID NO: 153458 - DNA, 20 bp, Artificial
  CRISPR gRNA sequence
ttttgtgtttttagtagaaa

SEQ ID NO: 153459 - DNA, 20 bp, Artificial
  CRISPR gRNA sequence
cacctcagcctcccaaagtg

SEQ ID NO: 153460 - DNA, 20 bp, Artificial
  CRISPR gRNA sequence
ggtctcaaactactggcctg

SEQ ID NO: 153461 - DNA, 20 bp, Artificial
  CRISPR gRNA sequence
tgtctcagcctccggagttg

SEQ ID NO: 153462 - DNA, 20 bp, Artificial
  CRISPR gRNA sequence
atgaacccagaatattttcc

SEQ ID NO: 153463 - DNA, 20 bp, Artificial
  CRISPR gRNA sequence
aattaatgcattaaaataag

SEQ ID NO: 153464 - DNA, 20 bp, Artificial
  CRISPR gRNA sequence
aataagaggtgattaactac

SEQ ID NO: 153465 - DNA, 20 bp, Artificial
  CRISPR gRNA sequence
ctcactgcaacctccacctc

SEQ ID NO: 153466 - DNA, 20 bp, Artificial
  CRISPR gRNA sequence
ttttgcatttttagtagaga

SEQ ID NO: 153467 - DNA, 20 bp, Artificial
  CRISPR gRNA sequence
cgccttggcctcccaaagtg

SEQ ID NO: 153468 - DNA, 20 bp, Artificial
  CRISPR gRNA sequence
gacgtgaaccaccgtgcccg

SEQ ID NO: 153469 - DNA, 20 bp, Artificial
  CRISPR gRNA sequence
tatatataatattaattgtt

SEQ ID NO: 153470 - DNA, 20 bp, Artificial
  CRISPR gRNA sequence
aagctccatgcaaagaatgg

SEQ ID NO: 153471 - DNA, 20 bp, Artificial
  CRISPR gRNA sequence
atctgcaaagatgttagaaa

SEQ ID NO: 153472 - DNA, 20 bp, Artificial
  CRISPR gRNA sequence
aagaacttgtgtccttcaaa

SEQ ID NO: 153473 - DNA, 20 bp, Artificial
  CRISPR gRNA sequence
cgaagtcaggaatttataaa

SEQ ID NO: 153474 - DNA, 20 bp, Artificial
  CRISPR gRNA sequence
aaagaatgtcttaccagtaa

SEQ ID NO: 153475 - DNA, 20 bp, Artificial
  CRISPR gRNA sequence
ggatattattgacttgtatt

SEQ ID NO: 153476 - DNA, 20 bp, Artificial
  CRISPR gRNA sequence
gtatttttcgctttacctat

SEQ ID NO: 153477 - DNA, 20 bp, Artificial
  CRISPR gRNA sequence
tttgggatttcctaatgtag

SEQ ID NO: 153478 - DNA, 20 bp, Artificial
  CRISPR gRNA sequence
ttccaaaaaaatttgataac

SEQ ID NO: 153479 - DNA, 20 bp, Artificial
  CRISPR gRNA sequence
gtatgtggctctgagccagc

SEQ ID NO: 153480 - DNA, 20 bp, Artificial
  CRISPR gRNA sequence
tcatgatctgttgactacac

SEQ ID NO: 153481 - DNA, 20 bp, Artificial
  CRISPR gRNA sequence
gactgcacagatggttctag

SEQ ID NO: 153482 - DNA, 20 bp, Artificial
  CRISPR gRNA sequence
ttttgaattgtgtacctttg

SEQ ID NO: 153483 - DNA, 20 bp, Artificial
  CRISPR gRNA sequence
catctttctcctttgacctt

SEQ ID NO: 153484 - DNA, 20 bp, Artificial
  CRISPR gRNA sequence
ttgaccttagcagtttgcat

SEQ ID NO: 153485 - DNA, 20 bp, Artificial
  CRISPR gRNA sequence
agggacccatgcaataaaag

SEQ ID NO: 153486 - DNA, 20 bp, Artificial
  CRISPR gRNA sequence
aataaaaggttagattcttt

SEQ ID NO: 153487 - DNA, 20 bp, Artificial
  CRISPR gRNA sequence
tattatttccagaaagatat

SEQ ID NO: 153488 - DNA, 20 bp, Artificial
  CRISPR gRNA sequence
atgataaataactaaacttc

SEQ ID NO: 153489 - DNA, 20 bp, Artificial
  CRISPR gRNA sequence
cttacttggttatttaggac

SEQ ID NO: 153490 - DNA, 20 bp, Artificial
  CRISPR gRNA sequence
ttttatctagtcattttcaa

SEQ ID NO: 153491 - DNA, 20 bp, Artificial
  CRISPR gRNA sequence
aggtactagaatttctgttc

SEQ ID NO: 153492 - DNA, 20 bp, Artificial
  CRISPR gRNA sequence
tgtcattacaccagaatgaa

SEQ ID NO: 153493 - DNA, 20 bp, Artificial
  CRISPR gRNA sequence
caccagaatgaaatctgctt

SEQ ID NO: 153494 - DNA, 20 bp, Artificial
  CRISPR gRNA sequence
atctgctttgaggcttgtat

SEQ ID NO: 153495 - DNA, 20 bp, Artificial
  CRISPR gRNA sequence
cacaggctaaacctagagtt

SEQ ID NO: 153496 - DNA, 20 bp, Artificial
  CRISPR gRNA sequence
acaagtctggtcatgtgaca

SEQ ID NO: 153497 - DNA, 20 bp, Artificial
  CRISPR gRNA sequence
ggtcatgtgacaactggctt

SEQ ID NO: 153498 - DNA, 20 bp, Artificial
  CRISPR gRNA sequence
tgtgacaactggctttggtg

SEQ ID NO: 153499 - DNA, 20 bp, Artificial
  CRISPR gRNA sequence
tttcaaataattcctcagaa

SEQ ID NO: 153500 - DNA, 20 bp, Artificial
  CRISPR gRNA sequence
gcactaaatttctccattct

SEQ ID NO: 153501 - DNA, 20 bp, Artificial
  CRISPR gRNA sequence
cattttaatatttgccagat

SEQ ID NO: 153502 - DNA, 20 bp, Artificial
  CRISPR gRNA sequence
cgctcaaaggaaatgctcat

SEQ ID NO: 153503 - DNA, 20 bp, Artificial
  CRISPR gRNA sequence
aggaaatgctcattttcgat

SEQ ID NO: 153504 - DNA, 20 bp, Artificial
  CRISPR gRNA sequence
ctcattttcgattttggatt

SEQ ID NO: 153505 - DNA, 20 bp, Artificial
  CRISPR gRNA sequence
caggtggatcatctgaggtc

SEQ ID NO: 153506 - DNA, 20 bp, Artificial
  CRISPR gRNA sequence
aacctctgcctcctgggttc

SEQ ID NO: 153507 - DNA, 20 bp, Artificial
  CRISPR gRNA sequence
tgcctcagcctcctgagtaa

SEQ ID NO: 153508 - DNA, 20 bp, Artificial
  CRISPR gRNA sequence
ttttgtatttttagtagaga

SEQ ID NO: 153509 - DNA, 20 bp, Artificial
  CRISPR gRNA sequence
acctcaggtgatccacctgc

SEQ ID NO: 153510 - DNA, 20 bp, Artificial
  CRISPR gRNA sequence
ccacctgcctcggcttccca

SEQ ID NO: 153511 - DNA, 20 bp, Artificial
  CRISPR gRNA sequence
tgcctcggcttcccagagtg

SEQ ID NO: 153512 - DNA, 20 bp, Artificial
  CRISPR gRNA sequence
gccaccgcacctggcctctc

SEQ ID NO: 153513 - DNA, 20 bp, Artificial
  CRISPR gRNA sequence
ttcgtttttttaactgtctt

SEQ ID NO: 153514 - DNA, 20 bp, Artificial
  CRISPR gRNA sequence
ccagttgccagtgtgctgtg

SEQ ID NO: 153515 - DNA, 20 bp, Artificial
  CRISPR gRNA sequence
gccagtgtgctgtgttaggc

SEQ ID NO: 153516 - DNA, 20 bp, Artificial
  CRISPR gRNA sequence
aagaactgggcgaactggca

SEQ ID NO: 153517 - DNA, 20 bp, Artificial
  CRISPR gRNA sequence
ctggcaagtagtttcatttc

SEQ ID NO: 153518 - DNA, 20 bp, Artificial
  CRISPR gRNA sequence
aatggcctcatgtcctttga

SEQ ID NO: 153519 - DNA, 20 bp, Artificial
  CRISPR gRNA sequence
gtcctttgagacagatttgt

SEQ ID NO: 153520 - DNA, 20 bp, Artificial
  CRISPR gRNA sequence
ttttgtatttttagtagaga

SEQ ID NO: 153521 - DNA, 20 bp, Artificial
  CRISPR gRNA sequence
ttttagtagagacggggttt

SEQ ID NO: 153522 - DNA, 20 bp, Artificial
  CRISPR gRNA sequence
cgcctcggcctcccaaagtg

SEQ ID NO: 153523 - DNA, 20 bp, Artificial
  CRISPR gRNA sequence
tctctctttttttaagagac

SEQ ID NO: 153524 - DNA, 20 bp, Artificial
  CRISPR gRNA sequence
cacaggcatgcacctttgtg

SEQ ID NO: 153525 - DNA, 20 bp, Artificial
  CRISPR gRNA sequence
gcatgcacctttgtgcccag

SEQ ID NO: 153526 - DNA, 20 bp, Artificial
  CRISPR gRNA sequence
ttggcttttatcttttaaga

SEQ ID NO: 153527 - DNA, 20 bp, Artificial
  CRISPR gRNA sequence
agaagccacagagaacttga

SEQ ID NO: 153528 - DNA, 20 bp, Artificial
  CRISPR gRNA sequence
ccatataagaagttaaaagt

SEQ ID NO: 153529 - DNA, 20 bp, Artificial
  CRISPR gRNA sequence
ttaaaagtccttgattaaca

SEQ ID NO: 153530 - DNA, 20 bp, Artificial
  CRISPR gRNA sequence
tccttgattaacattaggat

SEQ ID NO: 153531 - DNA, 20 bp, Artificial
  CRISPR gRNA sequence
agaaggaaaaactttcctac

SEQ ID NO: 153532 - DNA, 20 bp, Artificial
  CRISPR gRNA sequence
attatataccttatcaaact

SEQ ID NO: 153533 - DNA, 20 bp, Artificial
  CRISPR gRNA sequence
cttatcaaactgaaagattg

SEQ ID NO: 153534 - DNA, 20 bp, Artificial
  CRISPR gRNA sequence
ctggacagaaagtctgactt

SEQ ID NO: 153535 - DNA, 20 bp, Artificial
  CRISPR gRNA sequence
gtttctaatgtgtcttatgt

SEQ ID NO: 153536 - DNA, 20 bp, Artificial
  CRISPR gRNA sequence
ttgtcgagatgtccacagaa

SEQ ID NO: 153537 - DNA, 20 bp, Artificial
  CRISPR gRNA sequence
agtggatactttgacttgga

SEQ ID NO: 153538 - DNA, 20 bp, Artificial
  CRISPR gRNA sequence
gctgtagctcaattttttag

SEQ ID NO: 153539 - DNA, 20 bp, Artificial
  CRISPR gRNA sequence
ttaaaaagatatactttgat

SEQ ID NO: 153540 - DNA, 20 bp, Artificial
  CRISPR gRNA sequence
gggccgtcttatgcataaca

SEQ ID NO: 153541 - DNA, 20 bp, Artificial
  CRISPR gRNA sequence
aaatataacctcggcctgtg

SEQ ID NO: 153542 - DNA, 20 bp, Artificial
  CRISPR gRNA sequence
gtcaaggagcacagaggaca

SEQ ID NO: 153543 - DNA, 20 bp, Artificial
  CRISPR gRNA sequence
aggagcacagaggacatagt

SEQ ID NO: 153544 - DNA, 20 bp, Artificial
  CRISPR gRNA sequence
tagtgcttgattctttctgg

SEQ ID NO: 153545 - DNA, 20 bp, Artificial
  CRISPR gRNA sequence
cagagtgcctggaggttact

SEQ ID NO: 153546 - DNA, 20 bp, Artificial
  CRISPR gRNA sequence
agcatcctggcagagcagac

SEQ ID NO: 153547 - DNA, 20 bp, Artificial
  CRISPR gRNA sequence
tgatgtagaattaatgttgc

SEQ ID NO: 153548 - DNA, 20 bp, Artificial
  CRISPR gRNA sequence
ttaacttctgacgttacaat

SEQ ID NO: 153549 - DNA, 20 bp, Artificial
  CRISPR gRNA sequence
cttcagggataaaaagtaat

SEQ ID NO: 153550 - DNA, 20 bp, Artificial
  CRISPR gRNA sequence
gttttggatatacctctggg

SEQ ID NO: 153551 - DNA, 20 bp, Artificial
  CRISPR gRNA sequence
tggatatacctctgggtcat

SEQ ID NO: 153552 - DNA, 20 bp, Artificial
  CRISPR gRNA sequence
gggtcatgtttgtttatatg

SEQ ID NO: 153553 - DNA, 20 bp, Artificial
  CRISPR gRNA sequence
aagagttttcagcagttgaa

SEQ ID NO: 153554 - DNA, 20 bp, Artificial
  CRISPR gRNA sequence
tcagactggcctgggttcag

SEQ ID NO: 153555 - DNA, 20 bp, Artificial
  CRISPR gRNA sequence
atgataaagtcaaaaggatg

SEQ ID NO: 153556 - DNA, 20 bp, Artificial
  CRISPR gRNA sequence
catattttagggggttaatc

SEQ ID NO: 153557 - DNA, 20 bp, Artificial
  CRISPR gRNA sequence
ttagggggttaatctcatga

SEQ ID NO: 153558 - DNA, 20 bp, Artificial
  CRISPR gRNA sequence
ttaatctcatgattaagctt

SEQ ID NO: 153559 - DNA, 20 bp, Artificial
  CRISPR gRNA sequence
tatcagcttttggtgctggg

SEQ ID NO: 153560 - DNA, 20 bp, Artificial
  CRISPR gRNA sequence
ccaatcgagcaagtctgtgc

SEQ ID NO: 153561 - DNA, 20 bp, Artificial
  CRISPR gRNA sequence
caagtggccagataaactct

SEQ ID NO: 153562 - DNA, 20 bp, Artificial
  CRISPR gRNA sequence
ttaagctcagcacttaactt

SEQ ID NO: 153563 - DNA, 20 bp, Artificial
  CRISPR gRNA sequence
aacttttctgttttgttgga

SEQ ID NO: 153564 - DNA, 20 bp, Artificial
  CRISPR gRNA sequence
cactcaataaacagccacca

SEQ ID NO: 153565 - DNA, 20 bp, Artificial
  CRISPR gRNA sequence
atcgtacagtcccctactta

SEQ ID NO: 153566 - DNA, 20 bp, Artificial
  CRISPR gRNA sequence
ctacttacaatgattcaact

SEQ ID NO: 153567 - DNA, 20 bp, Artificial
  CRISPR gRNA sequence
tttgagtacccattcaacca

SEQ ID NO: 153568 - DNA, 20 bp, Artificial
  CRISPR gRNA sequence
acccattcaaccattctgtt

SEQ ID NO: 153569 - DNA, 20 bp, Artificial
  CRISPR gRNA sequence
ctcaacactttactataaaa

SEQ ID NO: 153570 - DNA, 20 bp, Artificial
  CRISPR gRNA sequence
ctgagcacatttaaggtggg

SEQ ID NO: 153571 - DNA, 20 bp, Artificial
  CRISPR gRNA sequence
aggtgggcgaggcttaacta

SEQ ID NO: 153572 - DNA, 20 bp, Artificial
  CRISPR gRNA sequence
taggatcttttcaacttaac

SEQ ID NO: 153573 - DNA, 20 bp, Artificial
  CRISPR gRNA sequence
cacatctgcctcccaaagtg

SEQ ID NO: 153574 - DNA, 20 bp, Artificial
  CRISPR gRNA sequence
tgtgagccaccatgcgtggc

SEQ ID NO: 153575 - DNA, 20 bp, Artificial
  CRISPR gRNA sequence
ttcattgctggagtgcagtg

SEQ ID NO: 153576 - DNA, 20 bp, Artificial
  CRISPR gRNA sequence
tgccttggccctccaaagca

SEQ ID NO: 153577 - DNA, 20 bp, Artificial
  CRISPR gRNA sequence
tgttgtatgtatataccaca

SEQ ID NO: 153578 - DNA, 20 bp, Artificial
  CRISPR gRNA sequence
atctgttaatggacatttgg

SEQ ID NO: 153579 - DNA, 20 bp, Artificial
  CRISPR gRNA sequence
gcaaatacctcttcaagacc

SEQ ID NO: 153580 - DNA, 20 bp, Artificial
  CRISPR gRNA sequence
tacctcttcaagaccctggg

SEQ ID NO: 153581 - DNA, 20 bp, Artificial
  CRISPR gRNA sequence
gggctttgatttgtaaccta

SEQ ID NO: 153582 - DNA, 20 bp, Artificial
  CRISPR gRNA sequence
atttgtaacctacttggttt

SEQ ID NO: 153583 - DNA, 20 bp, Artificial
  CRISPR gRNA sequence
gtaacctacttggtttacaa

SEQ ID NO: 153584 - DNA, 20 bp, Artificial
  CRISPR gRNA sequence
agttaaaagagaattacttt

SEQ ID NO: 153585 - DNA, 20 bp, Artificial
  CRISPR gRNA sequence
aagagaattactttgaggga

SEQ ID NO: 153586 - DNA, 20 bp, Artificial
  CRISPR gRNA sequence
ttgagggattcagttttggt

SEQ ID NO: 153587 - DNA, 20 bp, Artificial
  CRISPR gRNA sequence
catgctatgtcttttatatc

SEQ ID NO: 153588 - DNA, 20 bp, Artificial
  CRISPR gRNA sequence
tgaacaaattagactccact

SEQ ID NO: 153589 - DNA, 20 bp, Artificial
  CRISPR gRNA sequence
ggagtgcaacacgtgatggc

SEQ ID NO: 153590 - DNA, 20 bp, Artificial
  CRISPR gRNA sequence
gttgacacctcacaatatct

SEQ ID NO: 153591 - DNA, 20 bp, Artificial
  CRISPR gRNA sequence
attaaaaagaaaaaaattcc

SEQ ID NO: 153592 - DNA, 20 bp, Artificial
  CRISPR gRNA sequence
tgatctcagactgggacaca

SEQ ID NO: 153593 - DNA, 20 bp, Artificial
  CRISPR gRNA sequence
ttgtttcaaaaagaagtaat

SEQ ID NO: 153594 - DNA, 20 bp, Artificial
  CRISPR gRNA sequence
aaaagcaatttatctttcat

SEQ ID NO: 153595 - DNA, 20 bp, Artificial
  CRISPR gRNA sequence
tctttcattttagcttgttc

SEQ ID NO: 153596 - DNA, 20 bp, Artificial
  CRISPR gRNA sequence
taaatccaggtggtgttcag

SEQ ID NO: 153597 - DNA, 20 bp, Artificial
  CRISPR gRNA sequence
attagttaaaaaccatatca

SEQ ID NO: 153598 - DNA, 20 bp, Artificial
  CRISPR gRNA sequence
atcaagatgattgtgcacca

SEQ ID NO: 153599 - DNA, 20 bp, Artificial
  CRISPR gRNA sequence
aaataacagacttcttcgtg

SEQ ID NO: 153600 - DNA, 20 bp, Artificial
  CRISPR gRNA sequence
taggtcactttcttttaatt

SEQ ID NO: 153601 - DNA, 20 bp, Artificial
  CRISPR gRNA sequence
tcttttcattcctcagtgcc

SEQ ID NO: 153602 - DNA, 20 bp, Artificial
  CRISPR gRNA sequence
acattacaatcaaatcagat

SEQ ID NO: 153603 - DNA, 20 bp, Artificial
  CRISPR gRNA sequence
tgtgagccctttctgtagag

SEQ ID NO: 153604 - DNA, 20 bp, Artificial
  CRISPR gRNA sequence
ggatcttcttaaaatattga

SEQ ID NO: 153605 - DNA, 20 bp, Artificial
  CRISPR gRNA sequence
tagtaggttaggaacggaac

SEQ ID NO: 153606 - DNA, 20 bp, Artificial
  CRISPR gRNA sequence
taggaacggaacctgggatt

SEQ ID NO: 153607 - DNA, 20 bp, Artificial
  CRISPR gRNA sequence
acttggatcatagtcacaag

SEQ ID NO: 153608 - DNA, 20 bp, Artificial
  CRISPR gRNA sequence
cctgtcagatcagcagtggc

SEQ ID NO: 153609 - DNA, 20 bp, Artificial
  CRISPR gRNA sequence
ggggaccactgtcctagagt

SEQ ID NO: 153610 - DNA, 20 bp, Artificial
  CRISPR gRNA sequence
tccaggagagagctcaggca

SEQ ID NO: 153611 - DNA, 20 bp, Artificial
  CRISPR gRNA sequence
gctcaggcatcttgtttttc

SEQ ID NO: 153612 - DNA, 20 bp, Artificial
  CRISPR gRNA sequence
ttgtttttcaaaagcttttc

SEQ ID NO: 153613 - DNA, 20 bp, Artificial
  CRISPR gRNA sequence
ggtgattctaacctgcagcc

SEQ ID NO: 153614 - DNA, 20 bp, Artificial
  CRISPR gRNA sequence
gcagccccaagattgagaat

SEQ ID NO: 153615 - DNA, 20 bp, Artificial
  CRISPR gRNA sequence
cctgactgggtaggcctgga

SEQ ID NO: 153616 - DNA, 20 bp, Artificial
  CRISPR gRNA sequence
ccaaactctcattgagtgaa

SEQ ID NO: 153617 - DNA, 20 bp, Artificial
  CRISPR gRNA sequence
ttgaatttgtcttgaaatgc

SEQ ID NO: 153618 - DNA, 20 bp, Artificial
  CRISPR gRNA sequence
gtgaagtggggagcatgaat

SEQ ID NO: 153619 - DNA, 20 bp, Artificial
  CRISPR gRNA sequence
aagtttcgtgggcctcaatc

SEQ ID NO: 153620 - DNA, 20 bp, Artificial
  CRISPR gRNA sequence
tagagggcctcccttttcca

SEQ ID NO: 153621 - DNA, 20 bp, Artificial
  CRISPR gRNA sequence
catgtaactagaaggctagg

SEQ ID NO: 153622 - DNA, 20 bp, Artificial
  CRISPR gRNA sequence
ggataggattatagaaaact

SEQ ID NO: 153623 - DNA, 20 bp, Artificial
  CRISPR gRNA sequence
cctcaagatccacttttaca

SEQ ID NO: 153624 - DNA, 20 bp, Artificial
  CRISPR gRNA sequence
cacactgcttcttgagatct

SEQ ID NO: 153625 - DNA, 20 bp, Artificial
  CRISPR gRNA sequence
aggtttcaggaacatgaaaa

SEQ ID NO: 153626 - DNA, 20 bp, Artificial
  CRISPR gRNA sequence
aaaaatagtttgtcacaaag

SEQ ID NO: 153627 - DNA, 20 bp, Artificial
  CRISPR gRNA sequence
cacaaagaaaagctttggga

SEQ ID NO: 153628 - DNA, 20 bp, Artificial
  CRISPR gRNA sequence
ctttgggaaggggattaaag

SEQ ID NO: 153629 - DNA, 20 bp, Artificial
  CRISPR gRNA sequence
atctcttgatccttgacttt

SEQ ID NO: 153630 - DNA, 20 bp, Artificial
  CRISPR gRNA sequence
tgatccttgacttttgttgc

SEQ ID NO: 153631 - DNA, 20 bp, Artificial
  CRISPR gRNA sequence
agaagagaaattgaaggagt

SEQ ID NO: 153632 - DNA, 20 bp, Artificial
  CRISPR gRNA sequence
agaggtcttttttatcaact

SEQ ID NO: 153633 - DNA, 20 bp, Artificial
  CRISPR gRNA sequence
gtgctgtatgtattagcctg

SEQ ID NO: 153634 - DNA, 20 bp, Artificial
  CRISPR gRNA sequence
acacaagaaggaagaccagt

SEQ ID NO: 153635 - DNA, 20 bp, Artificial
  CRISPR gRNA sequence
ggaagaccagtggttgattt

SEQ ID NO: 153636 - DNA, 20 bp, Artificial
  CRISPR gRNA sequence
ccccaacccagtatcctctt

SEQ ID NO: 153637 - DNA, 20 bp, Artificial
  CRISPR gRNA sequence
agatctaaaacttaaatagg

SEQ ID NO: 153638 - DNA, 20 bp, Artificial
  CRISPR gRNA sequence
cctcccctccagtattgggt

SEQ ID NO: 153639 - DNA, 20 bp, Artificial
  CRISPR gRNA sequence
cagtattgggtaggggatta

SEQ ID NO: 153640 - DNA, 20 bp, Artificial
  CRISPR gRNA sequence
ggtctcaaactcctggcctc

SEQ ID NO: 153641 - DNA, 20 bp, Artificial
  CRISPR gRNA sequence
catctcagccttccagagtg

SEQ ID NO: 153642 - DNA, 20 bp, Artificial
  CRISPR gRNA sequence
catacatttactattagttg

SEQ ID NO: 153643 - DNA, 20 bp, Artificial
  CRISPR gRNA sequence
agaatagaatgaacctgcgc

SEQ ID NO: 153644 - DNA, 20 bp, Artificial
  CRISPR gRNA sequence
taagtctctgttactccagg

SEQ ID NO: 153645 - DNA, 20 bp, Artificial
  CRISPR gRNA sequence
aaaaggaaaagatgaaaaat

SEQ ID NO: 153646 - DNA, 20 bp, Artificial
  CRISPR gRNA sequence
aaagatgaaaaattggtgtt

SEQ ID NO: 153647 - DNA, 20 bp, Artificial
  CRISPR gRNA sequence
gtagagcagagtggtagcca

SEQ ID NO: 153648 - DNA, 20 bp, Artificial
  CRISPR gRNA sequence
agtggtagccaagcagcttg

SEQ ID NO: 153649 - DNA, 20 bp, Artificial
  CRISPR gRNA sequence
cttggtgtacattttatcct

SEQ ID NO: 153650 - DNA, 20 bp, Artificial
  CRISPR gRNA sequence
ataggttctgggaagactgt

SEQ ID NO: 153651 - DNA, 20 bp, Artificial
  CRISPR gRNA sequence
tacctttttttgacatatat

SEQ ID NO: 153652 - DNA, 20 bp, Artificial
  CRISPR gRNA sequence
tcttgcaaaagaaagttcac

SEQ ID NO: 153653 - DNA, 20 bp, Artificial
  CRISPR gRNA sequence
caaattcccaggtgagcata

SEQ ID NO: 153654 - DNA, 20 bp, Artificial
  CRISPR gRNA sequence
catttgacacctagtcccag

SEQ ID NO: 153655 - DNA, 20 bp, Artificial
  CRISPR gRNA sequence
cctagtcccagtagagattt

SEQ ID NO: 153656 - DNA, 20 bp, Artificial
  CRISPR gRNA sequence
attgcagctctgaaactcaa

SEQ ID NO: 153657 - DNA, 20 bp, Artificial
  CRISPR gRNA sequence
aattgcatccatcattgggc

SEQ ID NO: 153658 - DNA, 20 bp, Artificial
  CRISPR gRNA sequence
tgggcatgtgtttaaatacc

SEQ ID NO: 153659 - DNA, 20 bp, Artificial
  CRISPR gRNA sequence
agtttcaaaataaaacaaaa

SEQ ID NO: 153660 - DNA, 20 bp, Artificial
  CRISPR gRNA sequence
ttatatggtcctcccccact

SEQ ID NO: 153661 - DNA, 20 bp, Artificial
  CRISPR gRNA sequence
atgagaaaggagctctcctc

SEQ ID NO: 153662 - DNA, 20 bp, Artificial
  CRISPR gRNA sequence
tcaagtgccccggcgttgct

SEQ ID NO: 153663 - DNA, 20 bp, Artificial
  CRISPR gRNA sequence
actgaatggaagaaagaact

SEQ ID NO: 153664 - DNA, 20 bp, Artificial
  CRISPR gRNA sequence
gaaaaaaaaaaaaaaacaga

SEQ ID NO: 153665 - DNA, 20 bp, Artificial
  CRISPR gRNA sequence
aaaacagatattgcttgggg

SEQ ID NO: 153666 - DNA, 20 bp, Artificial
  CRISPR gRNA sequence
gagcactgttagaggccatc

SEQ ID NO: 153667 - DNA, 20 bp, Artificial
  CRISPR gRNA sequence
agtaaagaagaattttgctc

SEQ ID NO: 153668 - DNA, 20 bp, Artificial
  CRISPR gRNA sequence
tctgtaccttctctcccgac

SEQ ID NO: 153669 - DNA, 20 bp, Artificial
  CRISPR gRNA sequence
tgaagagagggaccaagcca

SEQ ID NO: 153670 - DNA, 20 bp, Artificial
  CRISPR gRNA sequence
agagtgtttcctactgcctg

SEQ ID NO: 153671 - DNA, 20 bp, Artificial
  CRISPR gRNA sequence
cctgtcatgctttgccacac

SEQ ID NO: 153672 - DNA, 20 bp, Artificial
  CRISPR gRNA sequence
actcccactggctcgtatta

SEQ ID NO: 153673 - DNA, 20 bp, Artificial
  CRISPR gRNA sequence
ttgctcatttctctagagct

SEQ ID NO: 153674 - DNA, 20 bp, Artificial
  CRISPR gRNA sequence
aacacacaaaaattactgtc

SEQ ID NO: 153675 - DNA, 20 bp, Artificial
  CRISPR gRNA sequence
tgttaagtgagccaaaattg

SEQ ID NO: 153676 - DNA, 20 bp, Artificial
  CRISPR gRNA sequence
tgttgaaaaaatagttgatg

SEQ ID NO: 153677 - DNA, 20 bp, Artificial
  CRISPR gRNA sequence
tgggtttttttttttttttt

SEQ ID NO: 153678 - DNA, 20 bp, Artificial
  CRISPR gRNA sequence
ccaggccgcagtgcagtggt

SEQ ID NO: 153679 - DNA, 20 bp, Artificial
  CRISPR gRNA sequence
tgcctcagactcccgagtag

SEQ ID NO: 153680 - DNA, 20 bp, Artificial
  CRISPR gRNA sequence
ttttgtattttttgtagaga

SEQ ID NO: 153681 - DNA, 20 bp, Artificial
  CRISPR gRNA sequence
tgcctctgcctcccaaagtg

SEQ ID NO: 153682 - DNA, 20 bp, Artificial
  CRISPR gRNA sequence
ctcactgtagccttcacctc

SEQ ID NO: 153683 - DNA, 20 bp, Artificial
  CRISPR gRNA sequence
tacaggcacgtgccatcatg

SEQ ID NO: 153684 - DNA, 20 bp, Artificial
  CRISPR gRNA sequence
atcatgtctggcttaatttt

SEQ ID NO: 153685 - DNA, 20 bp, Artificial
  CRISPR gRNA sequence
agcctcagcctcccaaagtg

SEQ ID NO: 153686 - DNA, 20 bp, Artificial
  CRISPR gRNA sequence
gccatcatcttagcgtctta

SEQ ID NO: 153687 - DNA, 20 bp, Artificial
  CRISPR gRNA sequence
ctgttctaaccttttgatct

SEQ ID NO: 153688 - DNA, 20 bp, Artificial
  CRISPR gRNA sequence
tacatgaataatacttgtga

SEQ ID NO: 153689 - DNA, 20 bp, Artificial
  CRISPR gRNA sequence
atacttgtgagagggtttgc

SEQ ID NO: 153690 - DNA, 20 bp, Artificial
  CRISPR gRNA sequence
ttcttcctcacagtagccct

SEQ ID NO: 153691 - DNA, 20 bp, Artificial
  CRISPR gRNA sequence
ccaagatcccatttcccatc

SEQ ID NO: 153692 - DNA, 20 bp, Artificial
  CRISPR gRNA sequence
cctgcacagactacctcacc

SEQ ID NO: 153693 - DNA, 20 bp, Artificial
  CRISPR gRNA sequence
acctcaccaaaggtttagaa

SEQ ID NO: 153694 - DNA, 20 bp, Artificial
  CRISPR gRNA sequence
gtttagaaccttgtttgacc

SEQ ID NO: 153695 - DNA, 20 bp, Artificial
  CRISPR gRNA sequence
tttgaaatcagacacatcaa

SEQ ID NO: 153696 - DNA, 20 bp, Artificial
  CRISPR gRNA sequence
agacacatcaagaaagttta

SEQ ID NO: 153697 - DNA, 20 bp, Artificial
  CRISPR gRNA sequence
ctgggtacatatattatctc

SEQ ID NO: 153698 - DNA, 20 bp, Artificial
  CRISPR gRNA sequence
ctgcaattttatccaaatcc

SEQ ID NO: 153699 - DNA, 20 bp, Artificial
  CRISPR gRNA sequence
aagctcattctccttcctca

SEQ ID NO: 153700 - DNA, 20 bp, Artificial
  CRISPR gRNA sequence
ccttcctcatattgtttctc

SEQ ID NO: 153701 - DNA, 20 bp, Artificial
  CRISPR gRNA sequence
tcacttcatctctcttgacc

SEQ ID NO: 153702 - DNA, 20 bp, Artificial
  CRISPR gRNA sequence
gagtaagaaaacaccttgca

SEQ ID NO: 153703 - DNA, 20 bp, Artificial
  CRISPR gRNA sequence
aagtattctttctccctgtt

SEQ ID NO: 153704 - DNA, 20 bp, Artificial
  CRISPR gRNA sequence
ttacctgctttgttcccact

SEQ ID NO: 153705 - DNA, 20 bp, Artificial
  CRISPR gRNA sequence
ggcaatgaggcaagagacag

SEQ ID NO: 153706 - DNA, 20 bp, Artificial
  CRISPR gRNA sequence
gactggtttgcatgacttgc

SEQ ID NO: 153707 - DNA, 20 bp, Artificial
  CRISPR gRNA sequence
tgtactctttgccaaggcag

SEQ ID NO: 153708 - DNA, 20 bp, Artificial
  CRISPR gRNA sequence
cacagagttgactcttcgag

SEQ ID NO: 153709 - DNA, 20 bp, Artificial
  CRISPR gRNA sequence
tctacaggtattattgcaga

SEQ ID NO: 153710 - DNA, 20 bp, Artificial
  CRISPR gRNA sequence
tggggtaagcagcagccttt

SEQ ID NO: 153711 - DNA, 20 bp, Artificial
  CRISPR gRNA sequence
ttttcctgcgtggtgttgga

SEQ ID NO: 153712 - DNA, 20 bp, Artificial
  CRISPR gRNA sequence
agattgttctcctttaggac

SEQ ID NO: 153713 - DNA, 20 bp, Artificial
  CRISPR gRNA sequence
agattgttctcctttaggac

SEQ ID NO: 153714 - DNA, 20 bp, Artificial
  CRISPR gRNA sequence
gcagacataccttctagcca

SEQ ID NO: 153715 - DNA, 20 bp, Artificial
  CRISPR gRNA sequence
ataccttctagccatggtga

SEQ ID NO: 153716 - DNA, 20 bp, Artificial
  CRISPR gRNA sequence
aaaatcttaatcaattctct

SEQ ID NO: 153717 - DNA, 20 bp, Artificial
  CRISPR gRNA sequence
atcaattctctcctggtttt

SEQ ID NO: 153718 - DNA, 20 bp, Artificial
  CRISPR gRNA sequence
ctcaagtgataagagtattt

SEQ ID NO: 153719 - DNA, 20 bp, Artificial
  CRISPR gRNA sequence
aacttctggttgggagcctt

SEQ ID NO: 153720 - DNA, 20 bp, Artificial
  CRISPR gRNA sequence
caggaagtatcatcagtctc

SEQ ID NO: 153721 - DNA, 20 bp, Artificial
  CRISPR gRNA sequence
catcagtctcactagcttca

SEQ ID NO: 153722 - DNA, 20 bp, Artificial
  CRISPR gRNA sequence
ccaagccctggctcttagag

SEQ ID NO: 153723 - DNA, 20 bp, Artificial
  CRISPR gRNA sequence
gaaagtaaattattttctct

SEQ ID NO: 153724 - DNA, 20 bp, Artificial
  CRISPR gRNA sequence
acctacaaagtagaaaatgc

SEQ ID NO: 153725 - DNA, 20 bp, Artificial
  CRISPR gRNA sequence
ccgggcacttttctaggctc

SEQ ID NO: 153726 - DNA, 20 bp, Artificial
  CRISPR gRNA sequence
gtgggaagcctgcattctag

SEQ ID NO: 153727 - DNA, 20 bp, Artificial
  CRISPR gRNA sequence
cttgtcaatgcgtcataaag

SEQ ID NO: 153728 - DNA, 20 bp, Artificial
  CRISPR gRNA sequence
atttgtgtacattactatat

SEQ ID NO: 153729 - DNA, 20 bp, Artificial
  CRISPR gRNA sequence
aaagctcccttcaagatcaa

SEQ ID NO: 153730 - DNA, 20 bp, Artificial
  CRISPR gRNA sequence
aataaaaaactgcagtgaga

SEQ ID NO: 153731 - DNA, 20 bp, Artificial
  CRISPR gRNA sequence
gtcagaatctaaagtggtca

SEQ ID NO: 153732 - DNA, 20 bp, Artificial
  CRISPR gRNA sequence
gtaacccagccatttcattc

SEQ ID NO: 153733 - DNA, 20 bp, Artificial
  CRISPR gRNA sequence
tataaaaatgctcttaacaa

SEQ ID NO: 153734 - DNA, 20 bp, Artificial
  CRISPR gRNA sequence
aaattctgaggtattgatga

SEQ ID NO: 153735 - DNA, 20 bp, Artificial
  CRISPR gRNA sequence
agaaatcagagttgtggttg

SEQ ID NO: 153736 - DNA, 20 bp, Artificial
  CRISPR gRNA sequence
tacaggtgcatgccaccata

SEQ ID NO: 153737 - DNA, 20 bp, Artificial
  CRISPR gRNA sequence
gaagaccaacttaagtatat

SEQ ID NO: 153738 - DNA, 20 bp, Artificial
  CRISPR gRNA sequence
aatattttattatatgctgg

SEQ ID NO: 153739 - DNA, 20 bp, Artificial
  CRISPR gRNA sequence
atcaataaatgagccattta

SEQ ID NO: 153740 - DNA, 20 bp, Artificial
  CRISPR gRNA sequence
tctggcaatcttaagatggg

SEQ ID NO: 153741 - DNA, 20 bp, Artificial
  CRISPR gRNA sequence
atgggccctgcttcagttgg

SEQ ID NO: 153742 - DNA, 20 bp, Artificial
  CRISPR gRNA sequence
ggttggcaagaagggcggac

SEQ ID NO: 153743 - DNA, 20 bp, Artificial
  CRISPR gRNA sequence
ggactagagttttgcatttc

SEQ ID NO: 153744 - DNA, 20 bp, Artificial
  CRISPR gRNA sequence
aaaaaaaaatttccatcctc

SEQ ID NO: 153745 - DNA, 20 bp, Artificial
  CRISPR gRNA sequence
accttttaaggtgtggtata

SEQ ID NO: 153746 - DNA, 20 bp, Artificial
  CRISPR gRNA sequence
gtgtggtatatagagtttgc

SEQ ID NO: 153747 - DNA, 20 bp, Artificial
  CRISPR gRNA sequence
tgaaaaatttcaaacataag

SEQ ID NO: 153748 - DNA, 20 bp, Artificial
  CRISPR gRNA sequence
gaatacctgtatacttacaa

SEQ ID NO: 153749 - DNA, 20 bp, Artificial
  CRISPR gRNA sequence
attctaccataaacatttta

SEQ ID NO: 153750 - DNA, 20 bp, Artificial
  CRISPR gRNA sequence
tatgcttattttattctcat

SEQ ID NO: 153751 - DNA, 20 bp, Artificial
  CRISPR gRNA sequence
ctctatccatccttcaagta

SEQ ID NO: 153752 - DNA, 20 bp, Artificial
  CRISPR gRNA sequence
atctgtttttaagtgcattg

SEQ ID NO: 153753 - DNA, 20 bp, Artificial
  CRISPR gRNA sequence
gcatatcattcactagcgtt

SEQ ID NO: 153754 - DNA, 20 bp, Artificial
  CRISPR gRNA sequence
tagcgttcagtgttttttca

SEQ ID NO: 153755 - DNA, 20 bp, Artificial
  CRISPR gRNA sequence
ttttttcatattgtttttcc

SEQ ID NO: 153756 - DNA, 20 bp, Artificial
  CRISPR gRNA sequence
tcttaactatacataatatg

SEQ ID NO: 153757 - DNA, 20 bp, Artificial
  CRISPR gRNA sequence
aaacccccattagagcaggt

SEQ ID NO: 153758 - DNA, 20 bp, Artificial
  CRISPR gRNA sequence
aatatcagaattctcacaag

SEQ ID NO: 153759 - DNA, 20 bp, Artificial
  CRISPR gRNA sequence
cagaactgcaatgataaacc

SEQ ID NO: 153760 - DNA, 20 bp, Artificial
  CRISPR gRNA sequence
tagaattcccaaataaaaat

SEQ ID NO: 153761 - DNA, 20 bp, Artificial
  CRISPR gRNA sequence
tgttgcaaaaagttattgaa

SEQ ID NO: 153762 - DNA, 20 bp, Artificial
  CRISPR gRNA sequence
aaatattatttagggcctta

SEQ ID NO: 153763 - DNA, 20 bp, Artificial
  CRISPR gRNA sequence
aatgaccagaaacctgctaa

SEQ ID NO: 153764 - DNA, 20 bp, Artificial
  CRISPR gRNA sequence
aaacctgctaattgagatta

SEQ ID NO: 153765 - DNA, 20 bp, Artificial
  CRISPR gRNA sequence
ggtctgatcatttaaagtat

SEQ ID NO: 153766 - DNA, 20 bp, Artificial
  CRISPR gRNA sequence
tttaaagtatatgagtttgg

SEQ ID NO: 153767 - DNA, 20 bp, Artificial
  CRISPR gRNA sequence
tcagctgtagacttgcccgt

SEQ ID NO: 153768 - DNA, 20 bp, Artificial
  CRISPR gRNA sequence
tgtagacttgcccgtaggtg

SEQ ID NO: 153769 - DNA, 20 bp, Artificial
  CRISPR gRNA sequence
acttgcccgtaggtgtttag

SEQ ID NO: 153770 - DNA, 20 bp, Artificial
  CRISPR gRNA sequence
gagggtataaagccaagtga

SEQ ID NO: 153771 - DNA, 20 bp, Artificial
  CRISPR gRNA sequence
catggcaattacaaaatttg

SEQ ID NO: 153772 - DNA, 20 bp, Artificial
  CRISPR gRNA sequence
gcaattacaaaatttgatca

SEQ ID NO: 153773 - DNA, 20 bp, Artificial
  CRISPR gRNA sequence
aaagcgtcaggtgagctgtg

SEQ ID NO: 153774 - DNA, 20 bp, Artificial
  CRISPR gRNA sequence
tgcagttgctgctgactgaa

SEQ ID NO: 153775 - DNA, 20 bp, Artificial
  CRISPR gRNA sequence
cacaagtcatttgctattcc

SEQ ID NO: 153776 - DNA, 20 bp, Artificial
  CRISPR gRNA sequence
catttgctattccttttgct

SEQ ID NO: 153777 - DNA, 20 bp, Artificial
  CRISPR gRNA sequence
cttttgcttctcgtttctag

SEQ ID NO: 153778 - DNA, 20 bp, Artificial
  CRISPR gRNA sequence
ggagaatattcccagaaagt

SEQ ID NO: 153779 - DNA, 20 bp, Artificial
  CRISPR gRNA sequence
attcccagaaagttatagat

SEQ ID NO: 153780 - DNA, 20 bp, Artificial
  CRISPR gRNA sequence
tagattttagatttttaaga

SEQ ID NO: 153781 - DNA, 20 bp, Artificial
  CRISPR gRNA sequence
tggcatttggagtgaatgga

SEQ ID NO: 153782 - DNA, 20 bp, Artificial
  CRISPR gRNA sequence
tgcacactagaatcacctgt

SEQ ID NO: 153783 - DNA, 20 bp, Artificial
  CRISPR gRNA sequence
agtaccttttaaaactccct

SEQ ID NO: 153784 - DNA, 20 bp, Artificial
  CRISPR gRNA sequence
ctggatgcttttaatgtgca

SEQ ID NO: 153785 - DNA, 20 bp, Artificial
  CRISPR gRNA sequence
gatttgagaaccaccacttg

SEQ ID NO: 153786 - DNA, 20 bp, Artificial
  CRISPR gRNA sequence
ccctctccaaaggtcacact

SEQ ID NO: 153787 - DNA, 20 bp, Artificial
  CRISPR gRNA sequence
tgggtgcatatagctcttaa

SEQ ID NO: 153788 - DNA, 20 bp, Artificial
  CRISPR gRNA sequence
gacctctgtcctttagagct

SEQ ID NO: 153789 - DNA, 20 bp, Artificial
  CRISPR gRNA sequence
agagctcattgttttaagca

SEQ ID NO: 153790 - DNA, 20 bp, Artificial
  CRISPR gRNA sequence
ttgttttaagcatgcagatt

SEQ ID NO: 153791 - DNA, 20 bp, Artificial
  CRISPR gRNA sequence
aggagcaaagctgtgccttg

SEQ ID NO: 153792 - DNA, 20 bp, Artificial
  CRISPR gRNA sequence
gcaaagctgtgccttgttct

SEQ ID NO: 153793 - DNA, 20 bp, Artificial
  CRISPR gRNA sequence
tctgaccctgcatgagggcc

SEQ ID NO: 153794 - DNA, 20 bp, Artificial
  CRISPR gRNA sequence
ggaagctgtaaggtgttcag

SEQ ID NO: 153795 - DNA, 20 bp, Artificial
  CRISPR gRNA sequence
gttcagaggagctttcagtc

SEQ ID NO: 153796 - DNA, 20 bp, Artificial
  CRISPR gRNA sequence
acggtcgtccccagctacgc

SEQ ID NO: 153797 - DNA, 20 bp, Artificial
  CRISPR gRNA sequence
cgcaccggctttgaaacatt

SEQ ID NO: 153798 - DNA, 20 bp, Artificial
  CRISPR gRNA sequence
cagaacaaagagtatcatac

SEQ ID NO: 153799 - DNA, 20 bp, Artificial
  CRISPR gRNA sequence
acacctgctttccttgttga

SEQ ID NO: 153800 - DNA, 20 bp, Artificial
  CRISPR gRNA sequence
tatcagaagccccctttaaa

SEQ ID NO: 153801 - DNA, 20 bp, Artificial
  CRISPR gRNA sequence
tcactctcattgtgctaact

SEQ ID NO: 153802 - DNA, 20 bp, Artificial
  CRISPR gRNA sequence
gtcagttcctccaaattcct

SEQ ID NO: 153803 - DNA, 20 bp, Artificial
  CRISPR gRNA sequence
gactcaaaatgctatgatcc

SEQ ID NO: 153804 - DNA, 20 bp, Artificial
  CRISPR gRNA sequence
tttaaagtgtgtctagctga

SEQ ID NO: 153805 - DNA, 20 bp, Artificial
  CRISPR gRNA sequence
gtctagctgaaacagcttct

SEQ ID NO: 153806 - DNA, 20 bp, Artificial
  CRISPR gRNA sequence
gctgaaacagcttcttgttg

SEQ ID NO: 153807 - DNA, 20 bp, Artificial
  CRISPR gRNA sequence
ttctttgtaggtgttcgagg

SEQ ID NO: 153808 - DNA, 20 bp, Artificial
  CRISPR gRNA sequence
gctgcctggcctttgaaagg

SEQ ID NO: 153809 - DNA, 20 bp, Artificial
  CRISPR gRNA sequence
tttttaatcctctgtagaca

SEQ ID NO: 153810 - DNA, 20 bp, Artificial
  CRISPR gRNA sequence
tctgtagacatgaagttttc

SEQ ID NO: 153811 - DNA, 20 bp, Artificial
  CRISPR gRNA sequence
ctctggcactgttcgtcagt

SEQ ID NO: 153812 - DNA, 20 bp, Artificial
  CRISPR gRNA sequence
ttcgtcagtctcagcttctg

SEQ ID NO: 153813 - DNA, 20 bp, Artificial
  CRISPR gRNA sequence
aagttgagcaagtgccccat

SEQ ID NO: 153814 - DNA, 20 bp, Artificial
  CRISPR gRNA sequence
ctgacttctcaaagatactt

SEQ ID NO: 153815 - DNA, 20 bp, Artificial
  CRISPR gRNA sequence
ttctcaaagatacttgagag

SEQ ID NO: 153816 - DNA, 20 bp, Artificial
  CRISPR gRNA sequence
ttgttcttcagagaagcaag

SEQ ID NO: 153817 - DNA, 20 bp, Artificial
  CRISPR gRNA sequence
ccaagcataatcatttcctt

SEQ ID NO: 153818 - DNA, 20 bp, Artificial
  CRISPR gRNA sequence
agatatgccttcttccattc

SEQ ID NO: 153819 - DNA, 20 bp, Artificial
  CRISPR gRNA sequence
acacaaacctaggtgcctcc

SEQ ID NO: 153820 - DNA, 20 bp, Artificial
  CRISPR gRNA sequence
tagatactgtctagttcata

SEQ ID NO: 153821 - DNA, 20 bp, Artificial
  CRISPR gRNA sequence
aggagctcttgtcctgctct

SEQ ID NO: 153822 - DNA, 20 bp, Artificial
  CRISPR gRNA sequence
gagatattttgggttctgga

SEQ ID NO: 153823 - DNA, 20 bp, Artificial
  CRISPR gRNA sequence
ggttctggaaggggttttta

SEQ ID NO: 153824 - DNA, 20 bp, Artificial
  CRISPR gRNA sequence
ctggaaggggtttttaaagg

SEQ ID NO: 153825 - DNA, 20 bp, Artificial
  CRISPR gRNA sequence
atgcaggtgtctccctgctg

SEQ ID NO: 153826 - DNA, 20 bp, Artificial
  CRISPR gRNA sequence
tgtataccctctcattaccc

SEQ ID NO: 153827 - DNA, 20 bp, Artificial
  CRISPR gRNA sequence
aagagcttttccaagttagg

SEQ ID NO: 153828 - DNA, 20 bp, Artificial
  CRISPR gRNA sequence
tccaagttaggtctggattt

SEQ ID NO: 153829 - DNA, 20 bp, Artificial
  CRISPR gRNA sequence
taggtctggatttcagtgat

SEQ ID NO: 153830 - DNA, 20 bp, Artificial
  CRISPR gRNA sequence
aagtaccttgaacctacttc

SEQ ID NO: 153831 - DNA, 20 bp, Artificial
  CRISPR gRNA sequence
caatagctttgcaaagagca

SEQ ID NO: 153832 - DNA, 20 bp, Artificial
  CRISPR gRNA sequence
ctttgcaaagagcagttggc

SEQ ID NO: 153833 - DNA, 20 bp, Artificial
  CRISPR gRNA sequence
gctgcaaaaggtatcagtat

SEQ ID NO: 153834 - DNA, 20 bp, Artificial
  CRISPR gRNA sequence
tagctttgccacagccaata

SEQ ID NO: 153835 - DNA, 20 bp, Artificial
  CRISPR gRNA sequence
taaccatgtcatgcagagac

SEQ ID NO: 153836 - DNA, 20 bp, Artificial
  CRISPR gRNA sequence
caggggtagatactggcagt

SEQ ID NO: 153837 - DNA, 20 bp, Artificial
  CRISPR gRNA sequence
tctgttccacaggggacact

SEQ ID NO: 153838 - DNA, 20 bp, Artificial
  CRISPR gRNA sequence
gagtcttagaggtaccaaaa

SEQ ID NO: 153839 - DNA, 20 bp, Artificial
  CRISPR gRNA sequence
ttttctattggtaacagctg

SEQ ID NO: 153840 - DNA, 20 bp, Artificial
  CRISPR gRNA sequence
agaatttgtcatatcagcaa

SEQ ID NO: 153841 - DNA, 20 bp, Artificial
  CRISPR gRNA sequence
tagcagagagcaagagagag

SEQ ID NO: 153842 - DNA, 20 bp, Artificial
  CRISPR gRNA sequence
agagctaggctttgccctca

SEQ ID NO: 153843 - DNA, 20 bp, Artificial
  CRISPR gRNA sequence
agtgtggggatggggtcaat

SEQ ID NO: 153844 - DNA, 20 bp, Artificial
  CRISPR gRNA sequence
ctcagccagcccaagtggtt

SEQ ID NO: 153845 - DNA, 20 bp, Artificial
  CRISPR gRNA sequence
cccaagtggttctgtgtttt

SEQ ID NO: 153846 - DNA, 20 bp, Artificial
  CRISPR gRNA sequence
gctcaaggtggctgggagag

SEQ ID NO: 153847 - DNA, 20 bp, Artificial
  CRISPR gRNA sequence
tgtccatcaggccccctggg

SEQ ID NO: 153848 - DNA, 20 bp, Artificial
  CRISPR gRNA sequence
agacatgccctcagtgacca

SEQ ID NO: 153849 - DNA, 20 bp, Artificial
  CRISPR gRNA sequence
aaatttcagctcaggaaaag

SEQ ID NO: 153850 - DNA, 20 bp, Artificial
  CRISPR gRNA sequence
gagaagagtgctgcctattt

SEQ ID NO: 153851 - DNA, 20 bp, Artificial
  CRISPR gRNA sequence
gggaccaggcctgagaggca

SEQ ID NO: 153852 - DNA, 20 bp, Artificial
  CRISPR gRNA sequence
actgacaagcactgctggtg

SEQ ID NO: 153853 - DNA, 20 bp, Artificial
  CRISPR gRNA sequence
tttagttacggtacttattt

SEQ ID NO: 153854 - DNA, 20 bp, Artificial
  CRISPR gRNA sequence
tttgcaacttatcatgcaat

SEQ ID NO: 153855 - DNA, 20 bp, Artificial
  CRISPR gRNA sequence
tcgtacttcagaaattggct

SEQ ID NO: 153856 - DNA, 20 bp, Artificial
  CRISPR gRNA sequence
agcctataggatctgttatt

SEQ ID NO: 153857 - DNA, 20 bp, Artificial
  CRISPR gRNA sequence
tataggatctgttattttta

SEQ ID NO: 153858 - DNA, 20 bp, Artificial
  CRISPR gRNA sequence
ctctttgaattccactttcc

SEQ ID NO: 153859 - DNA, 20 bp, Artificial
  CRISPR gRNA sequence
tcagcaggcaactgcacata

SEQ ID NO: 153860 - DNA, 20 bp, Artificial
  CRISPR gRNA sequence
atccagcaagacagtgcccc

SEQ ID NO: 153861 - DNA, 20 bp, Artificial
  CRISPR gRNA sequence
cccttaggtttttggatggg

SEQ ID NO: 153862 - DNA, 20 bp, Artificial
  CRISPR gRNA sequence
cagccagatcattatagagc

SEQ ID NO: 153863 - DNA, 20 bp, Artificial
  CRISPR gRNA sequence
tctggaaactggaacttttc

SEQ ID NO: 153864 - DNA, 20 bp, Artificial
  CRISPR gRNA sequence
gttaccctaatctctctgga

SEQ ID NO: 153865 - DNA, 20 bp, Artificial
  CRISPR gRNA sequence
ggaatttgtgcccttaaagg

SEQ ID NO: 153866 - DNA, 20 bp, Artificial
  CRISPR gRNA sequence
agtgttaagagcagtagcat

SEQ ID NO: 153867 - DNA, 20 bp, Artificial
  CRISPR gRNA sequence
ggccaatgtgggaggaaccc

SEQ ID NO: 153868 - DNA, 20 bp, Artificial
  CRISPR gRNA sequence
cactttgggaggccgaggca

SEQ ID NO: 153869 - DNA, 20 bp, Artificial
  CRISPR gRNA sequence
ttgggaggccgaggcaggag

SEQ ID NO: 153870 - DNA, 20 bp, Artificial
  CRISPR gRNA sequence
ttaagaggctgagttgggag

SEQ ID NO: 153871 - DNA, 20 bp, Artificial
  CRISPR gRNA sequence
gaggtcaaggctacagtgag

SEQ ID NO: 153872 - DNA, 20 bp, Artificial
  CRISPR gRNA sequence
atgtgaacgaggtggtcaga

SEQ ID NO: 153873 - DNA, 20 bp, Artificial
  CRISPR gRNA sequence
cagcgtaggggaccatctac

SEQ ID NO: 153874 - DNA, 20 bp, Artificial
  CRISPR gRNA sequence
tcgtatattctaataaggag

SEQ ID NO: 153875 - DNA, 20 bp, Artificial
  CRISPR gRNA sequence
agaaaaaaaaatggagtaga

SEQ ID NO: 153876 - DNA, 20 bp, Artificial
  CRISPR gRNA sequence
aaaaaaatggagtagaggta

SEQ ID NO: 153877 - DNA, 20 bp, Artificial
  CRISPR gRNA sequence
aaatggagtagaggtagatt

SEQ ID NO: 153878 - DNA, 20 bp, Artificial
  CRISPR gRNA sequence
gtagaggtagattgattgat

SEQ ID NO: 153879 - DNA, 20 bp, Artificial
  CRISPR gRNA sequence
ctggagtgtagtagcacaat

SEQ ID NO: 153880 - DNA, 20 bp, Artificial
  CRISPR gRNA sequence
gtagcacaatcatagcttac

SEQ ID NO: 153881 - DNA, 20 bp, Artificial
  CRISPR gRNA sequence
tttgtggagatggggtctca

SEQ ID NO: 153882 - DNA, 20 bp, Artificial
  CRISPR gRNA sequence
tcccaggctggtctcaaact

SEQ ID NO: 153883 - DNA, 20 bp, Artificial
  CRISPR gRNA sequence
gccaccatgcccagttagga

SEQ ID NO: 153884 - DNA, 20 bp, Artificial
  CRISPR gRNA sequence
taggaggtagatttaagtaa

SEQ ID NO: 153885 - DNA, 20 bp, Artificial
  CRISPR gRNA sequence
tcaaaaaaaaaaaaaggtaa

SEQ ID NO: 153886 - DNA, 20 bp, Artificial
  CRISPR gRNA sequence
aaaaaaaggtaattatgatt

SEQ ID NO: 153887 - DNA, 20 bp, Artificial
  CRISPR gRNA sequence
ccatataacaaaaatgtatt

SEQ ID NO: 153888 - DNA, 20 bp, Artificial
  CRISPR gRNA sequence
cctaagggaccttctttggc

SEQ ID NO: 153889 - DNA, 20 bp, Artificial
  CRISPR gRNA sequence
tggtgaaaactttacctgcc

SEQ ID NO: 153890 - DNA, 20 bp, Artificial
  CRISPR gRNA sequence
gggagtctgccaagggcagg

SEQ ID NO: 153891 - DNA, 20 bp, Artificial
  CRISPR gRNA sequence
ctgacagcagggcacaccat

SEQ ID NO: 153892 - DNA, 20 bp, Artificial
  CRISPR gRNA sequence
cacaagccctcattttcctg

SEQ ID NO: 153893 - DNA, 20 bp, Artificial
  CRISPR gRNA sequence
tctctgccaacccagacgtg

SEQ ID NO: 153894 - DNA, 20 bp, Artificial
  CRISPR gRNA sequence
cgtgctcagcttggagctga

SEQ ID NO: 153895 - DNA, 20 bp, Artificial
  CRISPR gRNA sequence
ccttcccagcatttcctggc

SEQ ID NO: 153896 - DNA, 20 bp, Artificial
  CRISPR gRNA sequence
tggctgttgtttcaccatcc

SEQ ID NO: 153897 - DNA, 20 bp, Artificial
  CRISPR gRNA sequence
atattttggtaaaattaatc

SEQ ID NO: 153898 - DNA, 20 bp, Artificial
  CRISPR gRNA sequence
ttgtggtacaagaatggaag

SEQ ID NO: 153899 - DNA, 20 bp, Artificial
  CRISPR gRNA sequence
gtctttctttttggccctcc

SEQ ID NO: 153900 - DNA, 20 bp, Artificial
  CRISPR gRNA sequence
atcagaatagcaacatcggt

SEQ ID NO: 153901 - DNA, 20 bp, Artificial
  CRISPR gRNA sequence
atagcaacatcggttgaagt

SEQ ID NO: 153902 - DNA, 20 bp, Artificial
  CRISPR gRNA sequence
gttccatagtcttcttattg

SEQ ID NO: 153903 - DNA, 20 bp, Artificial
  CRISPR gRNA sequence
gatagtgatggaattcaagt

SEQ ID NO: 153904 - DNA, 20 bp, Artificial
  CRISPR gRNA sequence
tcagggattgggtgtacagg

SEQ ID NO: 153905 - DNA, 20 bp, Artificial
  CRISPR gRNA sequence
taaaagtcacaaacagtact

SEQ ID NO: 153906 - DNA, 20 bp, Artificial
  CRISPR gRNA sequence
tcacaaacagtactaaaggt

SEQ ID NO: 153907 - DNA, 20 bp, Artificial
  CRISPR gRNA sequence
aaagaataattgaccctttt

SEQ ID NO: 153908 - DNA, 20 bp, Artificial
  CRISPR gRNA sequence
tgggcagaaatttcttaaat

SEQ ID NO: 153909 - DNA, 20 bp, Artificial
  CRISPR gRNA sequence
tatttttagaaagttagagt

SEQ ID NO: 153910 - DNA, 20 bp, Artificial
  CRISPR gRNA sequence
aacagtgcccagtgagttag

SEQ ID NO: 153911 - DNA, 20 bp, Artificial
  CRISPR gRNA sequence
agtgtgggcaggaattgctc

SEQ ID NO: 153912 - DNA, 20 bp, Artificial
  CRISPR gRNA sequence
cccgccttggagatgcaccc

SEQ ID NO: 153913 - DNA, 20 bp, Artificial
  CRISPR gRNA sequence
tttctgaagtaaacggtcat

SEQ ID NO: 153914 - DNA, 20 bp, Artificial
  CRISPR gRNA sequence
aagtaaacggtcatggttgc

SEQ ID NO: 153915 - DNA, 20 bp, Artificial
  CRISPR gRNA sequence
aagttgcagcatttggggca

SEQ ID NO: 153916 - DNA, 20 bp, Artificial
  CRISPR gRNA sequence
agcatttggggcacagagat

SEQ ID NO: 153917 - DNA, 20 bp, Artificial
  CRISPR gRNA sequence
actgtgagcctaaaaatatt

SEQ ID NO: 153918 - DNA, 20 bp, Artificial
  CRISPR gRNA sequence
aaaaatatttttggtttttc

SEQ ID NO: 153919 - DNA, 20 bp, Artificial
  CRISPR gRNA sequence
tgaccttaggcattcatgga

SEQ ID NO: 153920 - DNA, 20 bp, Artificial
  CRISPR gRNA sequence
ggttggagaaggtcagcagg

SEQ ID NO: 153921 - DNA, 20 bp, Artificial
  CRISPR gRNA sequence
cactcagactgatgaagtgc

SEQ ID NO: 153922 - DNA, 20 bp, Artificial
  CRISPR gRNA sequence
gtggcttgatctcagctcac

SEQ ID NO: 153923 - DNA, 20 bp, Artificial
  CRISPR gRNA sequence
agcttccgcctcccaggttc

SEQ ID NO: 153924 - DNA, 20 bp, Artificial
  CRISPR gRNA sequence
tgcctcagcctcccgagtag

SEQ ID NO: 153925 - DNA, 20 bp, Artificial
  CRISPR gRNA sequence
aggcacgtgccactatgccc

SEQ ID NO: 153926 - DNA, 20 bp, Artificial
  CRISPR gRNA sequence
ttttgtatttttagtagaga

SEQ ID NO: 153927 - DNA, 20 bp, Artificial
  CRISPR gRNA sequence
cgcctcggcctcccaaagtg

SEQ ID NO: 153928 - DNA, 20 bp, Artificial
  CRISPR gRNA sequence
ttatttatatatatgcgtgt

SEQ ID NO: 153929 - DNA, 20 bp, Artificial
  CRISPR gRNA sequence
ttatatatatgcgtgtgtgt

SEQ ID NO: 153930 - DNA, 20 bp, Artificial
  CRISPR gRNA sequence
tatatgcgtgtgtgtgtttg

SEQ ID NO: 153931 - DNA, 20 bp, Artificial
  CRISPR gRNA sequence
gcccagtgttcctgaccaca

SEQ ID NO: 153932 - DNA, 20 bp, Artificial
  CRISPR gRNA sequence
cctgaccacaacttgcttca

SEQ ID NO: 153933 - DNA, 20 bp, Artificial
  CRISPR gRNA sequence
cttgcttcactgtgtttgtt

SEQ ID NO: 153934 - DNA, 20 bp, Artificial
  CRISPR gRNA sequence
ttaatctaggttcaggttca

SEQ ID NO: 153935 - DNA, 20 bp, Artificial
  CRISPR gRNA sequence
gttcaggttcaccacgattg

SEQ ID NO: 153936 - DNA, 20 bp, Artificial
  CRISPR gRNA sequence
caccacgattgggcggcttc

SEQ ID NO: 153937 - DNA, 20 bp, Artificial
  CRISPR gRNA sequence
gccctgtgaggcagtcctgt

SEQ ID NO: 153938 - DNA, 20 bp, Artificial
  CRISPR gRNA sequence
agcctgcagcaaagtgtatt

SEQ ID NO: 153939 - DNA, 20 bp, Artificial
  CRISPR gRNA sequence
tctattcctttactgtggac

SEQ ID NO: 153940 - DNA, 20 bp, Artificial
  CRISPR gRNA sequence
tgctgcttcctgtgtgcctt

SEQ ID NO: 153941 - DNA, 20 bp, Artificial
  CRISPR gRNA sequence
tgccttgagggatttcattt

SEQ ID NO: 153942 - DNA, 20 bp, Artificial
  CRISPR gRNA sequence
ggatttcatttcttagattt

SEQ ID NO: 153943 - DNA, 20 bp, Artificial
  CRISPR gRNA sequence
aactctaaaagtatcctgag

SEQ ID NO: 153944 - DNA, 20 bp, Artificial
  CRISPR gRNA sequence
aacatagtaataggccaaga

SEQ ID NO: 153945 - DNA, 20 bp, Artificial
  CRISPR gRNA sequence
tctttctctacctctctcac

SEQ ID NO: 153946 - DNA, 20 bp, Artificial
  CRISPR gRNA sequence
ctcacgtgtgcttacgatac

SEQ ID NO: 153947 - DNA, 20 bp, Artificial
  CRISPR gRNA sequence
ttgcagatgactgagctctg

SEQ ID NO: 153948 - DNA, 20 bp, Artificial
  CRISPR gRNA sequence
gactgagctctgccttgctt

SEQ ID NO: 153949 - DNA, 20 bp, Artificial
  CRISPR gRNA sequence
cattgtttcagtcctcaacc

SEQ ID NO: 153950 - DNA, 20 bp, Artificial
  CRISPR gRNA sequence
tactttaactctctggggca

SEQ ID NO: 153951 - DNA, 20 bp, Artificial
  CRISPR gRNA sequence
ggggcacagagctttagccc

SEQ ID NO: 153952 - DNA, 20 bp, Artificial
  CRISPR gRNA sequence
ttggaatgttcctaatagtg

SEQ ID NO: 153953 - DNA, 20 bp, Artificial
  CRISPR gRNA sequence
ttatttccctttcaaaaacc

SEQ ID NO: 153954 - DNA, 20 bp, Artificial
  CRISPR gRNA sequence
tcttaacctaggccaaaaag

SEQ ID NO: 153955 - DNA, 20 bp, Artificial
  CRISPR gRNA sequence
ctaggccaaaaaggaaagct

SEQ ID NO: 153956 - DNA, 20 bp, Artificial
  CRISPR gRNA sequence
agcttcttgctttgttgaag

SEQ ID NO: 153957 - DNA, 20 bp, Artificial
  CRISPR gRNA sequence
ctgcttggaaccatttggct

SEQ ID NO: 153958 - DNA, 20 bp, Artificial
  CRISPR gRNA sequence
tcacagcttttcagtcacat

SEQ ID NO: 153959 - DNA, 20 bp, Artificial
  CRISPR gRNA sequence
accttctcccactcctggga

SEQ ID NO: 153960 - DNA, 20 bp, Artificial
  CRISPR gRNA sequence
tcccactcctgggacaaggc

SEQ ID NO: 153961 - DNA, 20 bp, Artificial
  CRISPR gRNA sequence
ccaccatcagtctctgtaga

SEQ ID NO: 153962 - DNA, 20 bp, Artificial
  CRISPR gRNA sequence
tgttgccaggaagctgcatt

SEQ ID NO: 153963 - DNA, 20 bp, Artificial
  CRISPR gRNA sequence
ataggatttaggtggggaat

SEQ ID NO: 153964 - DNA, 20 bp, Artificial
  CRISPR gRNA sequence
gcttggcaccacagcctccc

SEQ ID NO: 153965 - DNA, 20 bp, Artificial
  CRISPR gRNA sequence
tcttgccctgtctcctttga

SEQ ID NO: 153966 - DNA, 20 bp, Artificial
  CRISPR gRNA sequence
tcctttgaaccagattttta

SEQ ID NO: 153967 - DNA, 20 bp, Artificial
  CRISPR gRNA sequence
tgaaccagatttttaatggg

SEQ ID NO: 153968 - DNA, 20 bp, Artificial
  CRISPR gRNA sequence
ggtctaccgtgaacttgaga

SEQ ID NO: 153969 - DNA, 20 bp, Artificial
  CRISPR gRNA sequence
ctggaagtctcagagaagca

SEQ ID NO: 153970 - DNA, 20 bp, Artificial
  CRISPR gRNA sequence
ttgaacactgcgtgcaggaa

SEQ ID NO: 153971 - DNA, 20 bp, Artificial
  CRISPR gRNA sequence
atacttgcctgttagccaca

SEQ ID NO: 153972 - DNA, 20 bp, Artificial
  CRISPR gRNA sequence
caggctgggcagccagggca

SEQ ID NO: 153973 - DNA, 20 bp, Artificial
  CRISPR gRNA sequence
ggagcattaagagcctgagt

SEQ ID NO: 153974 - DNA, 20 bp, Artificial
  CRISPR gRNA sequence
atgtggtattattgtattat

SEQ ID NO: 153975 - DNA, 20 bp, Artificial
  CRISPR gRNA sequence
gtaagcatgagagactctaa

SEQ ID NO: 153976 - DNA, 20 bp, Artificial
  CRISPR gRNA sequence
agagactctaagggcgcttt

SEQ ID NO: 153977 - DNA, 20 bp, Artificial
  CRISPR gRNA sequence
tctaagggcgctttcgtagc

SEQ ID NO: 153978 - DNA, 20 bp, Artificial
  CRISPR gRNA sequence
gtagctttggtttcccatga

SEQ ID NO: 153979 - DNA, 20 bp, Artificial
  CRISPR gRNA sequence
ccatgatggggttttctatg

SEQ ID NO: 153980 - DNA, 20 bp, Artificial
  CRISPR gRNA sequence
ggggttttctatgaaaggtt

SEQ ID NO: 153981 - DNA, 20 bp, Artificial
  CRISPR gRNA sequence
ttctatgaaaggtttattga

SEQ ID NO: 153982 - DNA, 20 bp, Artificial
  CRISPR gRNA sequence
tgattctgcttccccttggg

SEQ ID NO: 153983 - DNA, 20 bp, Artificial
  CRISPR gRNA sequence
ggacagagatggttaagcag

SEQ ID NO: 153984 - DNA, 20 bp, Artificial
  CRISPR gRNA sequence
gggctatgatgcggaatgat

SEQ ID NO: 153985 - DNA, 20 bp, Artificial
  CRISPR gRNA sequence
tatgatgcggaatgatggct

SEQ ID NO: 153986 - DNA, 20 bp, Artificial
  CRISPR gRNA sequence
cctttgtgacaggatcttct

SEQ ID NO: 153987 - DNA, 20 bp, Artificial
  CRISPR gRNA sequence
tgacttgtgggatgtggatg

SEQ ID NO: 153988 - DNA, 20 bp, Artificial
  CRISPR gRNA sequence
gtgggatgtggatgttctga

SEQ ID NO: 153989 - DNA, 20 bp, Artificial
  CRISPR gRNA sequence
gatgtggatgttctgatttt

SEQ ID NO: 153990 - DNA, 20 bp, Artificial
  CRISPR gRNA sequence
ctgattttgcttgttttgac

SEQ ID NO: 153991 - DNA, 20 bp, Artificial
  CRISPR gRNA sequence
taaaagggacttttttcagg

SEQ ID NO: 153992 - DNA, 20 bp, Artificial
  CRISPR gRNA sequence
tttcagggcaggcttctttg

SEQ ID NO: 153993 - DNA, 20 bp, Artificial
  CRISPR gRNA sequence
aatcaacatctctggtcatg

SEQ ID NO: 153994 - DNA, 20 bp, Artificial
  CRISPR gRNA sequence
tctctggtcatggaaagttt

SEQ ID NO: 153995 - DNA, 20 bp, Artificial
  CRISPR gRNA sequence
gtcatggaaagtttgcctgt

SEQ ID NO: 153996 - DNA, 20 bp, Artificial
  CRISPR gRNA sequence
atgccggccagctgcagtat

SEQ ID NO: 153997 - DNA, 20 bp, Artificial
  CRISPR gRNA sequence
tgtgttggagaccaggagca

SEQ ID NO: 153998 - DNA, 20 bp, Artificial
  CRISPR gRNA sequence
gcatgggtggtaattggaac

SEQ ID NO: 153999 - DNA, 20 bp, Artificial
  CRISPR gRNA sequence
taattggaacattagattca

SEQ ID NO: 154000 - DNA, 20 bp, Artificial
  CRISPR gRNA sequence
gacagatcgcctgatcgtca

SEQ ID NO: 154001 - DNA, 20 bp, Artificial
  CRISPR gRNA sequence
ggcacctcctgtgctctttg

SEQ ID NO: 154002 - DNA, 20 bp, Artificial
  CRISPR gRNA sequence
tgtgctctttggaaagctta

SEQ ID NO: 154003 - DNA, 20 bp, Artificial
  CRISPR gRNA sequence
atggtgagggggctgcctcc

SEQ ID NO: 154004 - DNA, 20 bp, Artificial
  CRISPR gRNA sequence
ggtcaaggggaggcattgtt

SEQ ID NO: 154005 - DNA, 20 bp, Artificial
  CRISPR gRNA sequence
tcagacccaaaaaaagcagc

SEQ ID NO: 154006 - DNA, 20 bp, Artificial
  CRISPR gRNA sequence
tattgacagtggtgacagag

SEQ ID NO: 154007 - DNA, 20 bp, Artificial
  CRISPR gRNA sequence
tacgaggaatgagccaaaag

SEQ ID NO: 154008 - DNA, 20 bp, Artificial
  CRISPR gRNA sequence
tagtctctgggatcattaag

SEQ ID NO: 154009 - DNA, 20 bp, Artificial
  CRISPR gRNA sequence
ggctgtttctgtgcccactc

SEQ ID NO: 154010 - DNA, 20 bp, Artificial
  CRISPR gRNA sequence
ctccccggcttacctaagga

SEQ ID NO: 154011 - DNA, 20 bp, Artificial
  CRISPR gRNA sequence
cagcccctctttttaacctc

SEQ ID NO: 154012 - DNA, 20 bp, Artificial
  CRISPR gRNA sequence
ggagtgggaggaaatgagaa

SEQ ID NO: 154013 - DNA, 20 bp, Artificial
  CRISPR gRNA sequence
agcttcttggttcctcagaa

SEQ ID NO: 154014 - DNA, 20 bp, Artificial
  CRISPR gRNA sequence
gcaggtgatcacatgaggtc

SEQ ID NO: 154015 - DNA, 20 bp, Artificial
  CRISPR gRNA sequence
cagcctggccaacatggcaa

SEQ ID NO: 154016 - DNA, 20 bp, Artificial
  CRISPR gRNA sequence
gaggtggaggttgcagtgag

SEQ ID NO: 154017 - DNA, 20 bp, Artificial
  CRISPR gRNA sequence
aaaaataaaaattaaaaaaa

SEQ ID NO: 154018 - DNA, 20 bp, Artificial
  CRISPR gRNA sequence
atacttagtaggtgctcagt

SEQ ID NO: 154019 - DNA, 20 bp, Artificial
  CRISPR gRNA sequence
tttccatttgtctcaggctc

SEQ ID NO: 154020 - DNA, 20 bp, Artificial
  CRISPR gRNA sequence
ctcatgggtaggcctgcagg

SEQ ID NO: 154021 - DNA, 20 bp, Artificial
  CRISPR gRNA sequence
cttgtcttgcaggctggctg

SEQ ID NO: 154022 - DNA, 20 bp, Artificial
  CRISPR gRNA sequence
atgcacaccgcagtcttctt

SEQ ID NO: 154023 - DNA, 20 bp, Artificial
  CRISPR gRNA sequence
aatccattcacagtccacac

SEQ ID NO: 154024 - DNA, 20 bp, Artificial
  CRISPR gRNA sequence
tctctcggaaaaagtacttc

SEQ ID NO: 154025 - DNA, 20 bp, Artificial
  CRISPR gRNA sequence
ccaaggccacttgctcgcca

SEQ ID NO: 154026 - DNA, 20 bp, Artificial
  CRISPR gRNA sequence
agtcagatgatctgggtgat

SEQ ID NO: 154027 - DNA, 20 bp, Artificial
  CRISPR gRNA sequence
gatgatctgggtgatacggg

SEQ ID NO: 154028 - DNA, 20 bp, Artificial
  CRISPR gRNA sequence
tagcacctagggtccatgtg

SEQ ID NO: 154029 - DNA, 20 bp, Artificial
  CRISPR gRNA sequence
catgtgttctgtttgagcct

SEQ ID NO: 154030 - DNA, 20 bp, Artificial
  CRISPR gRNA sequence
ggaactatctattatgtgct

SEQ ID NO: 154031 - DNA, 20 bp, Artificial
  CRISPR gRNA sequence
ctcttgacgtagccatcagt

SEQ ID NO: 154032 - DNA, 20 bp, Artificial
  CRISPR gRNA sequence
catcagtgctagattaggag

SEQ ID NO: 154033 - DNA, 20 bp, Artificial
  CRISPR gRNA sequence
agtgctagattaggaggggt

SEQ ID NO: 154034 - DNA, 20 bp, Artificial
  CRISPR gRNA sequence
ctagattaggaggggtgctt

SEQ ID NO: 154035 - DNA, 20 bp, Artificial
  CRISPR gRNA sequence
ctgacataccaactctacca

SEQ ID NO: 154036 - DNA, 20 bp, Artificial
  CRISPR gRNA sequence
aactctaccatcttgattct

SEQ ID NO: 154037 - DNA, 20 bp, Artificial
  CRISPR gRNA sequence
aacctgggctgggcagaggg

SEQ ID NO: 154038 - DNA, 20 bp, Artificial
  CRISPR gRNA sequence
ggcagggtagcaggtagtat

SEQ ID NO: 154039 - DNA, 20 bp, Artificial
  CRISPR gRNA sequence
ttaaatcagggcacctatcc

SEQ ID NO: 154040 - DNA, 20 bp, Artificial
  CRISPR gRNA sequence
tgcagagccaggactagaga

SEQ ID NO: 154041 - DNA, 20 bp, Artificial
  CRISPR gRNA sequence
ccaggactagagagcaggtt

SEQ ID NO: 154042 - DNA, 20 bp, Artificial
  CRISPR gRNA sequence
ttttcccctctaagccatga

SEQ ID NO: 154043 - DNA, 20 bp, Artificial
  CRISPR gRNA sequence
gagagaatcttcccttttcc

SEQ ID NO: 154044 - DNA, 20 bp, Artificial
  CRISPR gRNA sequence
agctggcatcaggacccacc

SEQ ID NO: 154045 - DNA, 20 bp, Artificial
  CRISPR gRNA sequence
gcttctgccagcaccacatg

SEQ ID NO: 154046 - DNA, 20 bp, Artificial
  CRISPR gRNA sequence
ttacatgccagggctcccat

SEQ ID NO: 154047 - DNA, 20 bp, Artificial
  CRISPR gRNA sequence
tgccagggctcccatgaggg

SEQ ID NO: 154048 - DNA, 20 bp, Artificial
  CRISPR gRNA sequence
gctcccatgagggcttggct

SEQ ID NO: 154049 - DNA, 20 bp, Artificial
  CRISPR gRNA sequence
ggagcgtcttggctatagtt

SEQ ID NO: 154050 - DNA, 20 bp, Artificial
  CRISPR gRNA sequence
gtccatggagaaaattcaaa

SEQ ID NO: 154051 - DNA, 20 bp, Artificial
  CRISPR gRNA sequence
tggagaaaattcaaattcag

SEQ ID NO: 154052 - DNA, 20 bp, Artificial
  CRISPR gRNA sequence
aatcctactgcccctgccag

SEQ ID NO: 154053 - DNA, 20 bp, Artificial
  CRISPR gRNA sequence
gctgctggtacagtggttcg

SEQ ID NO: 154054 - DNA, 20 bp, Artificial
  CRISPR gRNA sequence
ggtacagtggttcgaattgc

SEQ ID NO: 154055 - DNA, 20 bp, Artificial
  CRISPR gRNA sequence
ctacaccccatgcctggggg

SEQ ID NO: 154056 - DNA, 20 bp, Artificial
  CRISPR gRNA sequence
cagcagaaagatgcaatatt

SEQ ID NO: 154057 - DNA, 20 bp, Artificial
  CRISPR gRNA sequence
ggttgaagaaatatttctcc

SEQ ID NO: 154058 - DNA, 20 bp, Artificial
  CRISPR gRNA sequence
tccttttgtttttctttttt

SEQ ID NO: 154059 - DNA, 20 bp, Artificial
  CRISPR gRNA sequence
ggaattaggtgaatgtgtgt

SEQ ID NO: 154060 - DNA, 20 bp, Artificial
  CRISPR gRNA sequence
aacattctttgcatttaaga

SEQ ID NO: 154061 - DNA, 20 bp, Artificial
  CRISPR gRNA sequence
tttattccctgtggagagtg

SEQ ID NO: 154062 - DNA, 20 bp, Artificial
  CRISPR gRNA sequence
acccaggaaactaggacttt

SEQ ID NO: 154063 - DNA, 20 bp, Artificial
  CRISPR gRNA sequence
cattttagataatttagagt

SEQ ID NO: 154064 - DNA, 20 bp, Artificial
  CRISPR gRNA sequence
tgggggcattcatggggcca

SEQ ID NO: 154065 - DNA, 20 bp, Artificial
  CRISPR gRNA sequence
cttggaaaggttcatttgcc

SEQ ID NO: 154066 - DNA, 20 bp, Artificial
  CRISPR gRNA sequence
cagactctaaattatctaaa

SEQ ID NO: 154067 - DNA, 20 bp, Artificial
  CRISPR gRNA sequence
atgagatttattgcatttca

SEQ ID NO: 154068 - DNA, 20 bp, Artificial
  CRISPR gRNA sequence
gtccatgcaaaggagactag

SEQ ID NO: 154069 - DNA, 20 bp, Artificial
  CRISPR gRNA sequence
gggcagcaaacacacaaagt

SEQ ID NO: 154070 - DNA, 20 bp, Artificial
  CRISPR gRNA sequence
atctgtctcttaaatgcaaa

SEQ ID NO: 154071 - DNA, 20 bp, Artificial
  CRISPR gRNA sequence
agaaataccgtacacccctg

SEQ ID NO: 154072 - DNA, 20 bp, Artificial
  CRISPR gRNA sequence
acacactcaacatattgaaa

SEQ ID NO: 154073 - DNA, 20 bp, Artificial
  CRISPR gRNA sequence
gtgcagggagttgaatttcc

SEQ ID NO: 154074 - DNA, 20 bp, Artificial
  CRISPR gRNA sequence
tctcccgttagctcagagac

SEQ ID NO: 154075 - DNA, 20 bp, Artificial
  CRISPR gRNA sequence
gcaattcgaaccactgtacc

SEQ ID NO: 154076 - DNA, 20 bp, Artificial
  CRISPR gRNA sequence
aatctacactggcaggggca

SEQ ID NO: 154077 - DNA, 20 bp, Artificial
  CRISPR gRNA sequence
aggtcagggctaattgacta

SEQ ID NO: 154078 - DNA, 20 bp, Artificial
  CRISPR gRNA sequence
ccttttgagcagcagagggc

SEQ ID NO: 154079 - DNA, 20 bp, Artificial
  CRISPR gRNA sequence
ggggaaagcagagggaaaag

SEQ ID NO: 154080 - DNA, 20 bp, Artificial
  CRISPR gRNA sequence
ccatgctattaaaacagcat

SEQ ID NO: 154081 - DNA, 20 bp, Artificial
  CRISPR gRNA sequence
ggcacttcccatctccaggg

SEQ ID NO: 154082 - DNA, 20 bp, Artificial
  CRISPR gRNA sequence
tggcaatttgggctacatgt

SEQ ID NO: 154083 - DNA, 20 bp, Artificial
  CRISPR gRNA sequence
ataaaactaaaggataggtg

SEQ ID NO: 154084 - DNA, 20 bp, Artificial
  CRISPR gRNA sequence
tgccctgatttaaataccgt

SEQ ID NO: 154085 - DNA, 20 bp, Artificial
  CRISPR gRNA sequence
aacacatggaccctaggtgc

SEQ ID NO: 154086 - DNA, 20 bp, Artificial
  CRISPR gRNA sequence
aatcttatgtgtggactgtg

SEQ ID NO: 154087 - DNA, 20 bp, Artificial
  CRISPR gRNA sequence
caagaaagggaacaggtatg

SEQ ID NO: 154088 - DNA, 20 bp, Artificial
  CRISPR gRNA sequence
ggttaactgctctgtggcca

SEQ ID NO: 154089 - DNA, 20 bp, Artificial
  CRISPR gRNA sequence
aggattgccattcatattag

SEQ ID NO: 154090 - DNA, 20 bp, Artificial
  CRISPR gRNA sequence
ttttatttacatattattca

SEQ ID NO: 154091 - DNA, 20 bp, Artificial
  CRISPR gRNA sequence
ataattacaacctgttgtta

SEQ ID NO: 154092 - DNA, 20 bp, Artificial
  CRISPR gRNA sequence
attgccttcagctaccactt

SEQ ID NO: 154093 - DNA, 20 bp, Artificial
  CRISPR gRNA sequence
ctccccagcctctcccattt

SEQ ID NO: 154094 - DNA, 20 bp, Artificial
  CRISPR gRNA sequence
aacctccacctcctgggttc

SEQ ID NO: 154095 - DNA, 20 bp, Artificial
  CRISPR gRNA sequence
aattttgtatttttagtgga

SEQ ID NO: 154096 - DNA, 20 bp, Artificial
  CRISPR gRNA sequence
tcagcctccctcccaaagtg

SEQ ID NO: 154097 - DNA, 20 bp, Artificial
  CRISPR gRNA sequence
aactgacttctgaggaacca

SEQ ID NO: 154098 - DNA, 20 bp, Artificial
  CRISPR gRNA sequence
ttcctcccactcccatgccg

SEQ ID NO: 154099 - DNA, 20 bp, Artificial
  CRISPR gRNA sequence
gactatatggaactcagaag

SEQ ID NO: 154100 - DNA, 20 bp, Artificial
  CRISPR gRNA sequence
gggtccagctcttaaacgat

SEQ ID NO: 154101 - DNA, 20 bp, Artificial
  CRISPR gRNA sequence
gaggtaggggtaaaatctaa

SEQ ID NO: 154102 - DNA, 20 bp, Artificial
  CRISPR gRNA sequence
tgccagaacacaacagccac

SEQ ID NO: 154103 - DNA, 20 bp, Artificial
  CRISPR gRNA sequence
ctgatgggtgtgcacacctg

SEQ ID NO: 154104 - DNA, 20 bp, Artificial
  CRISPR gRNA sequence
aggtttctttcaggcacctt

SEQ ID NO: 154105 - DNA, 20 bp, Artificial
  CRISPR gRNA sequence
ggatatggagggtgtggggg

SEQ ID NO: 154106 - DNA, 20 bp, Artificial
  CRISPR gRNA sequence
aaactttccatgaccagaga

SEQ ID NO: 154107 - DNA, 20 bp, Artificial
  CRISPR gRNA sequence
ccagctcttagctacatgat

SEQ ID NO: 154108 - DNA, 20 bp, Artificial
  CRISPR gRNA sequence
cattttggaggcaaaagctg

SEQ ID NO: 154109 - DNA, 20 bp, Artificial
  CRISPR gRNA sequence
ccaggctggatgggggtctg

SEQ ID NO: 154110 - DNA, 20 bp, Artificial
  CRISPR gRNA sequence
taggatctttggtgttcagc

SEQ ID NO: 154111 - DNA, 20 bp, Artificial
  CRISPR gRNA sequence
gaaagcgcccttagagtctc

SEQ ID NO: 154112 - DNA, 20 bp, Artificial
  CRISPR gRNA sequence
gcccttagagtctctcatgc

SEQ ID NO: 154113 - DNA, 20 bp, Artificial
  CRISPR gRNA sequence
ccagtgtaccatgaaagtat

SEQ ID NO: 154114 - DNA, 20 bp, Artificial
  CRISPR gRNA sequence
agcctgcctttgttgcaagg

SEQ ID NO: 154115 - DNA, 20 bp, Artificial
  CRISPR gRNA sequence
ctgcacgcagtgttcaatca

SEQ ID NO: 154116 - DNA, 20 bp, Artificial
  CRISPR gRNA sequence
tccccacctaaatcctataa

SEQ ID NO: 154117 - DNA, 20 bp, Artificial
  CRISPR gRNA sequence
gcttcctggcaacaatgtta

SEQ ID NO: 154118 - DNA, 20 bp, Artificial
  CRISPR gRNA sequence
ggggaggaaggcagctgggc

SEQ ID NO: 154119 - DNA, 20 bp, Artificial
  CRISPR gRNA sequence
agcagctcttcaacaaagca

SEQ ID NO: 154120 - DNA, 20 bp, Artificial
  CRISPR gRNA sequence
aggacaggtctggggaccct

SEQ ID NO: 154121 - DNA, 20 bp, Artificial
  CRISPR gRNA sequence
aattacagagaaaataagct

SEQ ID NO: 154122 - DNA, 20 bp, Artificial
  CRISPR gRNA sequence
ctgggtttttgaaagggaaa

SEQ ID NO: 154123 - DNA, 20 bp, Artificial
  CRISPR gRNA sequence
aaatgaacctgtggtggtgc

SEQ ID NO: 154124 - DNA, 20 bp, Artificial
  CRISPR gRNA sequence
gacatacacactccactttc

SEQ ID NO: 154125 - DNA, 20 bp, Artificial
  CRISPR gRNA sequence
aagtggttaaccaagtctac

SEQ ID NO: 154126 - DNA, 20 bp, Artificial
  CRISPR gRNA sequence
acgtgagtttctatacctgc

SEQ ID NO: 154127 - DNA, 20 bp, Artificial
  CRISPR gRNA sequence
ggcagggaatagaaggactg

SEQ ID NO: 154128 - DNA, 20 bp, Artificial
  CRISPR gRNA sequence
ctgctctgtttcactcactt

SEQ ID NO: 154129 - DNA, 20 bp, Artificial
  CRISPR gRNA sequence
cttggcatgggtagtggtta

SEQ ID NO: 154130 - DNA, 20 bp, Artificial
  CRISPR gRNA sequence
ccaatcgtggtgaacctgaa

SEQ ID NO: 154131 - DNA, 20 bp, Artificial
  CRISPR gRNA sequence
tcgggaggctgaggcaggag

SEQ ID NO: 154132 - DNA, 20 bp, Artificial
  CRISPR gRNA sequence
cctgtctcctaaaaagaaaa

SEQ ID NO: 154133 - DNA, 20 bp, Artificial
  CRISPR gRNA sequence
ccagtgccactctgggcctg

SEQ ID NO: 154134 - DNA, 20 bp, Artificial
  CRISPR gRNA sequence
tgagttcaggctcagagccc

SEQ ID NO: 154135 - DNA, 20 bp, Artificial
  CRISPR gRNA sequence
gtaataacctacagagtcct

SEQ ID NO: 154136 - DNA, 20 bp, Artificial
  CRISPR gRNA sequence
aaaaaatcaaaagcaaccat

SEQ ID NO: 154137 - DNA, 20 bp, Artificial
  CRISPR gRNA sequence
atggctgctctggaccacag

SEQ ID NO: 154138 - DNA, 20 bp, Artificial
  CRISPR gRNA sequence
aactttctaaaaatagcaat

SEQ ID NO: 154139 - DNA, 20 bp, Artificial
  CRISPR gRNA sequence
ctgcccaatgtgtatgactt

SEQ ID NO: 154140 - DNA, 20 bp, Artificial
  CRISPR gRNA sequence
ttcaaatctcaaacctttag

SEQ ID NO: 154141 - DNA, 20 bp, Artificial
  CRISPR gRNA sequence
atgtgttctgggaacgacag

SEQ ID NO: 154142 - DNA, 20 bp, Artificial
  CRISPR gRNA sequence
gggaacgacagatgagattc

SEQ ID NO: 154143 - DNA, 20 bp, Artificial
  CRISPR gRNA sequence
cctattcccaacctccagaa

SEQ ID NO: 154144 - DNA, 20 bp, Artificial
  CRISPR gRNA sequence
ttcaatttatgacagaaaac

SEQ ID NO: 154145 - DNA, 20 bp, Artificial
  CRISPR gRNA sequence
aaaatatgcattctttccaa

SEQ ID NO: 154146 - DNA, 20 bp, Artificial
  CRISPR gRNA sequence
gtatcaacccaattttcccg

SEQ ID NO: 154147 - DNA, 20 bp, Artificial
  CRISPR gRNA sequence
ctaaatcatttcaggaaaat

SEQ ID NO: 154148 - DNA, 20 bp, Artificial
  CRISPR gRNA sequence
gctgtcagggcacaacagcc

SEQ ID NO: 154149 - DNA, 20 bp, Artificial
  CRISPR gRNA sequence
gggataaagcctttggcagg

SEQ ID NO: 154150 - DNA, 20 bp, Artificial
  CRISPR gRNA sequence
gagacagtctcgctctgtca

SEQ ID NO: 154151 - DNA, 20 bp, Artificial
  CRISPR gRNA sequence
ttggagtgcagtggcacgat

SEQ ID NO: 154152 - DNA, 20 bp, Artificial
  CRISPR gRNA sequence
aacatccgcctcccaggttc

SEQ ID NO: 154153 - DNA, 20 bp, Artificial
  CRISPR gRNA sequence
ttttgtatttttagtagaga

SEQ ID NO: 154154 - DNA, 20 bp, Artificial
  CRISPR gRNA sequence
ggccaggctggtcttgaact

SEQ ID NO: 154155 - DNA, 20 bp, Artificial
  CRISPR gRNA sequence
cacctcggcctcccaaagta

SEQ ID NO: 154156 - DNA, 20 bp, Artificial
  CRISPR gRNA sequence
ttacttatttttaattctct

SEQ ID NO: 154157 - DNA, 20 bp, Artificial
  CRISPR gRNA sequence
ttatttttaattctctgtgt

SEQ ID NO: 154158 - DNA, 20 bp, Artificial
  CRISPR gRNA sequence
ctcccgggcccatgcgaccc

SEQ ID NO: 154159 - DNA, 20 bp, Artificial
  CRISPR gRNA sequence
tgctttggcctcccaaagtg

SEQ ID NO: 154160 - DNA, 20 bp, Artificial
  CRISPR gRNA sequence
tgggaggatggcataaagcc

SEQ ID NO: 154161 - DNA, 20 bp, Artificial
  CRISPR gRNA sequence
tcgggaggctgaggcagaag

SEQ ID NO: 154162 - DNA, 20 bp, Artificial
  CRISPR gRNA sequence
cagaaggactgcttgagccc

SEQ ID NO: 154163 - DNA, 20 bp, Artificial
  CRISPR gRNA sequence
tagtttgaagctgcagtaag

SEQ ID NO: 154164 - DNA, 20 bp, Artificial
  CRISPR gRNA sequence
aatatacgaggctgtccagg

SEQ ID NO: 154165 - DNA, 20 bp, Artificial
  CRISPR gRNA sequence
tactttcctacggccccctg

SEQ ID NO: 154166 - DNA, 20 bp, Artificial
  CRISPR gRNA sequence
ataccaccctttcccacttt

SEQ ID NO: 154167 - DNA, 20 bp, Artificial
  CRISPR gRNA sequence
acacacacacatatactttt

SEQ ID NO: 154168 - DNA, 20 bp, Artificial
  CRISPR gRNA sequence
cacattggcctcccaaagtg

SEQ ID NO: 154169 - DNA, 20 bp, Artificial
  CRISPR gRNA sequence
gtgaattccttgaaaataag

SEQ ID NO: 154170 - DNA, 20 bp, Artificial
  CRISPR gRNA sequence
gaaaataaggactgttttat

SEQ ID NO: 154171 - DNA, 20 bp, Artificial
  CRISPR gRNA sequence
ctttaccctcagaggatgct

SEQ ID NO: 154172 - DNA, 20 bp, Artificial
  CRISPR gRNA sequence
ctcagtgtttgatgaataaa

SEQ ID NO: 154173 - DNA, 20 bp, Artificial
  CRISPR gRNA sequence
aaataatgattgacagagaa

SEQ ID NO: 154174 - DNA, 20 bp, Artificial
  CRISPR gRNA sequence
tactggggagagaaagagtc

SEQ ID NO: 154175 - DNA, 20 bp, Artificial
  CRISPR gRNA sequence
tttgagaaaaacagggtcca

SEQ ID NO: 154176 - DNA, 20 bp, Artificial
  CRISPR gRNA sequence
agctgaatctggggaaaagt

SEQ ID NO: 154177 - DNA, 20 bp, Artificial
  CRISPR gRNA sequence
aactaaaaataacagatcct

SEQ ID NO: 154178 - DNA, 20 bp, Artificial
  CRISPR gRNA sequence
aactaaaaaccacacaccag

SEQ ID NO: 154179 - DNA, 20 bp, Artificial
  CRISPR gRNA sequence
tcccaaataggcagcactct

SEQ ID NO: 154180 - DNA, 20 bp, Artificial
  CRISPR gRNA sequence
cagaacaggttaatgggaaa

SEQ ID NO: 154181 - DNA, 20 bp, Artificial
  CRISPR gRNA sequence
agagcactggtaggcaagta

SEQ ID NO: 154182 - DNA, 20 bp, Artificial
  CRISPR gRNA sequence
taggcaagtacccagctttt

SEQ ID NO: 154183 - DNA, 20 bp, Artificial
  CRISPR gRNA sequence
ctccgctggggtactgcctt

SEQ ID NO: 154184 - DNA, 20 bp, Artificial
  CRISPR gRNA sequence
gagactgttccttcttcagc

SEQ ID NO: 154185 - DNA, 20 bp, Artificial
  CRISPR gRNA sequence
agctcacagctgagagtgta

SEQ ID NO: 154186 - DNA, 20 bp, Artificial
  CRISPR gRNA sequence
actcatgtccttattcaggg

SEQ ID NO: 154187 - DNA, 20 bp, Artificial
  CRISPR gRNA sequence
tcttagatgtacacagaccc

SEQ ID NO: 154188 - DNA, 20 bp, Artificial
  CRISPR gRNA sequence
actatgttaggtgccctcaa

SEQ ID NO: 154189 - DNA, 20 bp, Artificial
  CRISPR gRNA sequence
taagtgcgtgatgaatgatg

SEQ ID NO: 154190 - DNA, 20 bp, Artificial
  CRISPR gRNA sequence
gtggaacagagctgagtatc

SEQ ID NO: 154191 - DNA, 20 bp, Artificial
  CRISPR gRNA sequence
ggttacttgacagccatcta

SEQ ID NO: 154192 - DNA, 20 bp, Artificial
  CRISPR gRNA sequence
agggagatacctgtaacatt

SEQ ID NO: 154193 - DNA, 20 bp, Artificial
  CRISPR gRNA sequence
actttttaggttgatatagt

SEQ ID NO: 154194 - DNA, 20 bp, Artificial
  CRISPR gRNA sequence
tagtctgtgcttcagacaca

SEQ ID NO: 154195 - DNA, 20 bp, Artificial
  CRISPR gRNA sequence
acaaatagttttaaccctca

SEQ ID NO: 154196 - DNA, 20 bp, Artificial
  CRISPR gRNA sequence
tatgctaaggcagaaggaaa

SEQ ID NO: 154197 - DNA, 20 bp, Artificial
  CRISPR gRNA sequence
ctgcattttctagccgtgac

SEQ ID NO: 154198 - DNA, 20 bp, Artificial
  CRISPR gRNA sequence
attttctagccgtgacctgt

SEQ ID NO: 154199 - DNA, 20 bp, Artificial
  CRISPR gRNA sequence
caggacaagagctcctccta

SEQ ID NO: 154200 - DNA, 20 bp, Artificial
  CRISPR gRNA sequence
ctgcttactacatcctctta

SEQ ID NO: 154201 - DNA, 20 bp, Artificial
  CRISPR gRNA sequence
tgagaatcaagtggaggcac

SEQ ID NO: 154202 - DNA, 20 bp, Artificial
  CRISPR gRNA sequence
tggaggtcaagccagcaagg

SEQ ID NO: 154203 - DNA, 20 bp, Artificial
  CRISPR gRNA sequence
tcaagccagcaaggaaatga

SEQ ID NO: 154204 - DNA, 20 bp, Artificial
  CRISPR gRNA sequence
ccagcaaggaaatgattatg

SEQ ID NO: 154205 - DNA, 20 bp, Artificial
  CRISPR gRNA sequence
tgggcaggaactttcaactc

SEQ ID NO: 154206 - DNA, 20 bp, Artificial
  CRISPR gRNA sequence
cctaccttcaaataatcttt

SEQ ID NO: 154207 - DNA, 20 bp, Artificial
  CRISPR gRNA sequence
ggttgccccaagtggcagaa

SEQ ID NO: 154208 - DNA, 20 bp, Artificial
  CRISPR gRNA sequence
agcagtggcctccccaacta

SEQ ID NO: 154209 - DNA, 20 bp, Artificial
  CRISPR gRNA sequence
ccctgactggaaaaaagtac

SEQ ID NO: 154210 - DNA, 20 bp, Artificial
  CRISPR gRNA sequence
tgctgcctccttcagaaagg

SEQ ID NO: 154211 - DNA, 20 bp, Artificial
  CRISPR gRNA sequence
aagggtgggttttggagagt

SEQ ID NO: 154212 - DNA, 20 bp, Artificial
  CRISPR gRNA sequence
tgggaaaacttcatgtctac

SEQ ID NO: 154213 - DNA, 20 bp, Artificial
  CRISPR gRNA sequence
atgctatcttagaatttcag

SEQ ID NO: 154214 - DNA, 20 bp, Artificial
  CRISPR gRNA sequence
actaaatccaagcaacaaga

SEQ ID NO: 154215 - DNA, 20 bp, Artificial
  CRISPR gRNA sequence
gcacaatgagagtgagcaag

SEQ ID NO: 154216 - DNA, 20 bp, Artificial
  CRISPR gRNA sequence
tttcatcacagagctcacaa

SEQ ID NO: 154217 - DNA, 20 bp, Artificial
  CRISPR gRNA sequence
gctcacaatcttgttttaaa

SEQ ID NO: 154218 - DNA, 20 bp, Artificial
  CRISPR gRNA sequence
agcctgtgggcacaaacctg

SEQ ID NO: 154219 - DNA, 20 bp, Artificial
  CRISPR gRNA sequence
gaaagctcctctgaacacct

SEQ ID NO: 154220 - DNA, 20 bp, Artificial
  CRISPR gRNA sequence
accttacagcttccagtcaa

SEQ ID NO: 154221 - DNA, 20 bp, Artificial
  CRISPR gRNA sequence
actctagtaaggaggtgaca

SEQ ID NO: 154222 - DNA, 20 bp, Artificial
  CRISPR gRNA sequence
gagaatggctgtcactgaat

SEQ ID NO: 154223 - DNA, 20 bp, Artificial
  CRISPR gRNA sequence
atgaaataattcattaaaaa

SEQ ID NO: 154224 - DNA, 20 bp, Artificial
  CRISPR gRNA sequence
acaaagcaagcagaacaagg

SEQ ID NO: 154225 - DNA, 20 bp, Artificial
  CRISPR gRNA sequence
caaggcacagctttgctcct

SEQ ID NO: 154226 - DNA, 20 bp, Artificial
  CRISPR gRNA sequence
cctagtgaatcatgcaatct

SEQ ID NO: 154227 - DNA, 20 bp, Artificial
  CRISPR gRNA sequence
gcagacgttcatattctttc

SEQ ID NO: 154228 - DNA, 20 bp, Artificial
  CRISPR gRNA sequence
acgttcatattctttcttgt

SEQ ID NO: 154229 - DNA, 20 bp, Artificial
  CRISPR gRNA sequence
ctgcacattaaaagcatcca

SEQ ID NO: 154230 - DNA, 20 bp, Artificial
  CRISPR gRNA sequence
actgatgcctgggctccatc

SEQ ID NO: 154231 - DNA, 20 bp, Artificial
  CRISPR gRNA sequence
gcctgggctccatcatgaga

SEQ ID NO: 154232 - DNA, 20 bp, Artificial
  CRISPR gRNA sequence
gatatttttaaaaccccaac

SEQ ID NO: 154233 - DNA, 20 bp, Artificial
  CRISPR gRNA sequence
tgccactgtgcacatagaga

SEQ ID NO: 154234 - DNA, 20 bp, Artificial
  CRISPR gRNA sequence
acttcctaagataacttgaa

SEQ ID NO: 154235 - DNA, 20 bp, Artificial
  CRISPR gRNA sequence
caatcccttcacagctcacc

SEQ ID NO: 154236 - DNA, 20 bp, Artificial
  CRISPR gRNA sequence
cacagctcacctgacgcttt

SEQ ID NO: 154237 - DNA, 20 bp, Artificial
  CRISPR gRNA sequence
cctggggagaaactagttca

SEQ ID NO: 154238 - DNA, 20 bp, Artificial
  CRISPR gRNA sequence
gagcctccaaccactgctac

SEQ ID NO: 154239 - DNA, 20 bp, Artificial
  CRISPR gRNA sequence
actcctgcttgatcctctcc

SEQ ID NO: 154240 - DNA, 20 bp, Artificial
  CRISPR gRNA sequence
aaacctagtaatctcaatta

SEQ ID NO: 154241 - DNA, 20 bp, Artificial
  CRISPR gRNA sequence
cattctgtgggttagcaaag

SEQ ID NO: 154242 - DNA, 20 bp, Artificial
  CRISPR gRNA sequence
atacactaagttctcacaag

SEQ ID NO: 154243 - DNA, 20 bp, Artificial
  CRISPR gRNA sequence
taaattgcaatacttaaacc

SEQ ID NO: 154244 - DNA, 20 bp, Artificial
  CRISPR gRNA sequence
ctgaattcccaaataaaaaa

SEQ ID NO: 154245 - DNA, 20 bp, Artificial
  CRISPR gRNA sequence
cttgtgagaattctgatatt

SEQ ID NO: 154246 - DNA, 20 bp, Artificial
  CRISPR gRNA sequence
aaaccaagacctgctctaat

SEQ ID NO: 154247 - DNA, 20 bp, Artificial
  CRISPR gRNA sequence
tttctttgaataataaaatt

SEQ ID NO: 154248 - DNA, 20 bp, Artificial
  CRISPR gRNA sequence
acccaacatattatgtatag

SEQ ID NO: 154249 - DNA, 20 bp, Artificial
  CRISPR gRNA sequence
ttaagatttgtgtactttac

SEQ ID NO: 154250 - DNA, 20 bp, Artificial
  CRISPR gRNA sequence
aactttacaatgcacttaaa

SEQ ID NO: 154251 - DNA, 20 bp, Artificial
  CRISPR gRNA sequence
agaataaaataagcatagta

SEQ ID NO: 154252 - DNA, 20 bp, Artificial
  CRISPR gRNA sequence
atacaggtattcactgtaaa

SEQ ID NO: 154253 - DNA, 20 bp, Artificial
  CRISPR gRNA sequence
gtattcactgtaaactttgc

SEQ ID NO: 154254 - DNA, 20 bp, Artificial
  CRISPR gRNA sequence
gtccgcccttcttgccaacc

SEQ ID NO: 154255 - DNA, 20 bp, Artificial
  CRISPR gRNA sequence
caactgaagcagggcccatc

SEQ ID NO: 154256 - DNA, 20 bp, Artificial
  CRISPR gRNA sequence
ttggtcttcctaaaattttt

SEQ ID NO: 154257 - DNA, 20 bp, Artificial
  CRISPR gRNA sequence
taaattccctgaggcaggag

SEQ ID NO: 154258 - DNA, 20 bp, Artificial
  CRISPR gRNA sequence
gcaggaggatcgcttgagcc

SEQ ID NO: 154259 - DNA, 20 bp, Artificial
  CRISPR gRNA sequence
gaggtcgaggctgcaatgag

SEQ ID NO: 154260 - DNA, 20 bp, Artificial
  CRISPR gRNA sequence
ctaaatctgggcaaccacaa

SEQ ID NO: 154261 - DNA, 20 bp, Artificial
  CRISPR gRNA sequence
cttttgttaacatagtatct

SEQ ID NO: 154262 - DNA, 20 bp, Artificial
  CRISPR gRNA sequence
ttatccatgttgtatggagc

SEQ ID NO: 154263 - DNA, 20 bp, Artificial
  CRISPR gRNA sequence
ccatgttgtatggagcaatg

SEQ ID NO: 154264 - DNA, 20 bp, Artificial
  CRISPR gRNA sequence
catttcatcaatacctcaga

SEQ ID NO: 154265 - DNA, 20 bp, Artificial
  CRISPR gRNA sequence
cctatattgatggacacttg

SEQ ID NO: 154266 - DNA, 20 bp, Artificial
  CRISPR gRNA sequence
tgatggacacttgagttgtt

SEQ ID NO: 154267 - DNA, 20 bp, Artificial
  CRISPR gRNA sequence
ctgggttacagagtaggggg

SEQ ID NO: 154268 - DNA, 20 bp, Artificial
  CRISPR gRNA sequence
ttttcaaactgactgaccac

SEQ ID NO: 154269 - DNA, 20 bp, Artificial
  CRISPR gRNA sequence
tagattctgaccagcaatat

SEQ ID NO: 154270 - DNA, 20 bp, Artificial
  CRISPR gRNA sequence
ggtgtaaaacagtatctcac

SEQ ID NO: 154271 - DNA, 20 bp, Artificial
  CRISPR gRNA sequence
atgatgttgcatatcttctc

SEQ ID NO: 154272 - DNA, 20 bp, Artificial
  CRISPR gRNA sequence
ttctcatgggtttattgggc

SEQ ID NO: 154273 - DNA, 20 bp, Artificial
  CRISPR gRNA sequence
ttttttctgaaggtctgtcc

SEQ ID NO: 154274 - DNA, 20 bp, Artificial
  CRISPR gRNA sequence
taatctgaattgatcttgaa

SEQ ID NO: 154275 - DNA, 20 bp, Artificial
  CRISPR gRNA sequence
atttattggagctcagtatt

SEQ ID NO: 154276 - DNA, 20 bp, Artificial
  CRISPR gRNA sequence
agctcagtattttttgcttt

SEQ ID NO: 154277 - DNA, 20 bp, Artificial
  CRISPR gRNA sequence
ttgacaagctgtactagaat

SEQ ID NO: 154278 - DNA, 20 bp, Artificial
  CRISPR gRNA sequence
gaatgcaggcttcccacaga

SEQ ID NO: 154279 - DNA, 20 bp, Artificial
  CRISPR gRNA sequence
aagagaaaataatttacttt

SEQ ID NO: 154280 - DNA, 20 bp, Artificial
  CRISPR gRNA sequence
cattgttaaaatactgccac

SEQ ID NO: 154281 - DNA, 20 bp, Artificial
  CRISPR gRNA sequence
gaaatctttcctctaagagc

SEQ ID NO: 154282 - DNA, 20 bp, Artificial
  CRISPR gRNA sequence
ccagggcttggctatagggt

SEQ ID NO: 154283 - DNA, 20 bp, Artificial
  CRISPR gRNA sequence
tctcaaggctcccaaccaga

SEQ ID NO: 154284 - DNA, 20 bp, Artificial
  CRISPR gRNA sequence
ggctcccaaccagaagttga

SEQ ID NO: 154285 - DNA, 20 bp, Artificial
  CRISPR gRNA sequence
aatactcttatcacttgagc

SEQ ID NO: 154286 - DNA, 20 bp, Artificial
  CRISPR gRNA sequence
agctgtgaaaaccaggagag

SEQ ID NO: 154287 - DNA, 20 bp, Artificial
  CRISPR gRNA sequence
gaaaaccaggagagaattga

SEQ ID NO: 154288 - DNA, 20 bp, Artificial
  CRISPR gRNA sequence
agtggtgatgccaatgacac

SEQ ID NO: 154289 - DNA, 20 bp, Artificial
  CRISPR gRNA sequence
gcaggaaaacaggcaaaggc

SEQ ID NO: 154290 - DNA, 20 bp, Artificial
  CRISPR gRNA sequence
aggcaaaggctgctgcttac

SEQ ID NO: 154291 - DNA, 20 bp, Artificial
  CRISPR gRNA sequence
gcaataatacctgtagagtc

SEQ ID NO: 154292 - DNA, 20 bp, Artificial
  CRISPR gRNA sequence
gctgccttggcaaagagtac

SEQ ID NO: 154293 - DNA, 20 bp, Artificial
  CRISPR gRNA sequence
aaaaatgaggtggtatactc

SEQ ID NO: 154294 - DNA, 20 bp, Artificial
  CRISPR gRNA sequence
catgcgccaaaccttgtgca

SEQ ID NO: 154295 - DNA, 20 bp, Artificial
  CRISPR gRNA sequence
gccatagagccagtaagtgg

SEQ ID NO: 154296 - DNA, 20 bp, Artificial
  CRISPR gRNA sequence
aaacaatatgaggaaggaga

SEQ ID NO: 154297 - DNA, 20 bp, Artificial
  CRISPR gRNA sequence
ggagaatgagcttgaaagcc

SEQ ID NO: 154298 - DNA, 20 bp, Artificial
  CRISPR gRNA sequence
caatggatttggataaaatt

SEQ ID NO: 154299 - DNA, 20 bp, Artificial
  CRISPR gRNA sequence
attgcaggcttcccatcctt

SEQ ID NO: 154300 - DNA, 20 bp, Artificial
  CRISPR gRNA sequence
actgaaaaagaggataacct

SEQ ID NO: 154301 - DNA, 20 bp, Artificial
  CRISPR gRNA sequence
gataatatatgtacccagcc

SEQ ID NO: 154302 - DNA, 20 bp, Artificial
  CRISPR gRNA sequence
catataaactttcttgatgt

SEQ ID NO: 154303 - DNA, 20 bp, Artificial
  CRISPR gRNA sequence
agggaaaattactatcaatt

SEQ ID NO: 154304 - DNA, 20 bp, Artificial
  CRISPR gRNA sequence
ctaagatgatggcactgtcc

SEQ ID NO: 154305 - DNA, 20 bp, Artificial
  CRISPR gRNA sequence
ttgggaggctgaggctggag

SEQ ID NO: 154306 - DNA, 20 bp, Artificial
  CRISPR gRNA sequence
gaggtgaaggctacagtgag

SEQ ID NO: 154307 - DNA, 20 bp, Artificial
  CRISPR gRNA sequence
agacagtaatttttgtgtgt

SEQ ID NO: 154308 - DNA, 20 bp, Artificial
  CRISPR gRNA sequence
gagcaataacctacccatca

SEQ ID NO: 154309 - DNA, 20 bp, Artificial
  CRISPR gRNA sequence
aattcaccttcacatcttca

SEQ ID NO: 154310 - DNA, 20 bp, Artificial
  CRISPR gRNA sequence
tgacaggcagtaggaaacac

SEQ ID NO: 154311 - DNA, 20 bp, Artificial
  CRISPR gRNA sequence
tgcaggtcttcaaagaatta

SEQ ID NO: 154312 - DNA, 20 bp, Artificial
  CRISPR gRNA sequence
aagaattaatgggctttaga

SEQ ID NO: 154313 - DNA, 20 bp, Artificial
  CRISPR gRNA sequence
gaaacacagccccaagcaat

SEQ ID NO: 154314 - DNA, 20 bp, Artificial
  CRISPR gRNA sequence
cgccttctttttttttccaa

SEQ ID NO: 154315 - DNA, 20 bp, Artificial
  CRISPR gRNA sequence
aagtttaccagtctgcaata

SEQ ID NO: 154316 - DNA, 20 bp, Artificial
  CRISPR gRNA sequence
tctgcaatatgcagattaaa

SEQ ID NO: 154317 - DNA, 20 bp, Artificial
  CRISPR gRNA sequence
gcaatggccttgtctccaaa

SEQ ID NO: 154318 - DNA, 20 bp, Artificial
  CRISPR gRNA sequence
ccatataacttcactgtgga

SEQ ID NO: 154319 - DNA, 20 bp, Artificial
  CRISPR gRNA sequence
actgtggatatagtttagga

SEQ ID NO: 154320 - DNA, 20 bp, Artificial
  CRISPR gRNA sequence
aatttgagacttaagccctt

SEQ ID NO: 154321 - DNA, 20 bp, Artificial
  CRISPR gRNA sequence
ttctaggaaaaaaatcaatt

SEQ ID NO: 154322 - DNA, 20 bp, Artificial
  CRISPR gRNA sequence
ctctactgggactaggtgtc

SEQ ID NO: 154323 - DNA, 20 bp, Artificial
  CRISPR gRNA sequence
actgggactaggtgtcaaat

SEQ ID NO: 154324 - DNA, 20 bp, Artificial
  CRISPR gRNA sequence
atggaaggagcatatattat

SEQ ID NO: 154325 - DNA, 20 bp, Artificial
  CRISPR gRNA sequence
cagtcttcccagaacctatt

SEQ ID NO: 154326 - DNA, 20 bp, Artificial
  CRISPR gRNA sequence
ttttccatgcaaacccaaca

SEQ ID NO: 154327 - DNA, 20 bp, Artificial
  CRISPR gRNA sequence
gagtaacagagacttagaag

SEQ ID NO: 154328 - DNA, 20 bp, Artificial
  CRISPR gRNA sequence
gtagcgcaggttcattctat

SEQ ID NO: 154329 - DNA, 20 bp, Artificial
  CRISPR gRNA sequence
tttccccttgctctttcatt

SEQ ID NO: 154330 - DNA, 20 bp, Artificial
  CRISPR gRNA sequence
ctggaaggctgagatgggag

SEQ ID NO: 154331 - DNA, 20 bp, Artificial
  CRISPR gRNA sequence
tgggagaatcgcttgaggcc

SEQ ID NO: 154332 - DNA, 20 bp, Artificial
  CRISPR gRNA sequence
cacatctactcctacctttg

SEQ ID NO: 154333 - DNA, 20 bp, Artificial
  CRISPR gRNA sequence
actcctacctttgaagagct

SEQ ID NO: 154334 - DNA, 20 bp, Artificial
  CRISPR gRNA sequence
tgtggggctggagggagagt

SEQ ID NO: 154335 - DNA, 20 bp, Artificial
  CRISPR gRNA sequence
gacaaaaaatcacagcctat

SEQ ID NO: 154336 - DNA, 20 bp, Artificial
  CRISPR gRNA sequence
tgggttggggccagatccta

SEQ ID NO: 154337 - DNA, 20 bp, Artificial
  CRISPR gRNA sequence
agatcctaaagagttttttt

SEQ ID NO: 154338 - DNA, 20 bp, Artificial
  CRISPR gRNA sequence
tagctctcttgcaagtgtgc

SEQ ID NO: 154339 - DNA, 20 bp, Artificial
  CRISPR gRNA sequence
ctcttgcaagtgtgctcttg

SEQ ID NO: 154340 - DNA, 20 bp, Artificial
  CRISPR gRNA sequence
gcaagtgtgctcttgtttgg

SEQ ID NO: 154341 - DNA, 20 bp, Artificial
  CRISPR gRNA sequence
ataatttgtacaagaacgtt

SEQ ID NO: 154342 - DNA, 20 bp, Artificial
  CRISPR gRNA sequence
aggcagaaatttataataag

SEQ ID NO: 154343 - DNA, 20 bp, Artificial
  CRISPR gRNA sequence
ctctgctttaatccccttcc

SEQ ID NO: 154344 - DNA, 20 bp, Artificial
  CRISPR gRNA sequence
ttcatccctgttgacaatca

SEQ ID NO: 154345 - DNA, 20 bp, Artificial
  CRISPR gRNA sequence
cctagccttctagttacatg

SEQ ID NO: 154346 - DNA, 20 bp, Artificial
  CRISPR gRNA sequence
gttacatgtaaggatttacc

SEQ ID NO: 154347 - DNA, 20 bp, Artificial
  CRISPR gRNA sequence
aagggaggccctctacaatc

SEQ ID NO: 154348 - DNA, 20 bp, Artificial
  CRISPR gRNA sequence
gtagattgaggcccacgaaa

SEQ ID NO: 154349 - DNA, 20 bp, Artificial
  CRISPR gRNA sequence
tccttaactccttctcctga

SEQ ID NO: 154350 - DNA, 20 bp, Artificial
  CRISPR gRNA sequence
ttctatcagtaaggcagaag

SEQ ID NO: 154351 - DNA, 20 bp, Artificial
  CRISPR gRNA sequence
ctaccaaagaactacgttaa

SEQ ID NO: 154352 - DNA, 20 bp, Artificial
  CRISPR gRNA sequence
caaatctgaattcactcaat

SEQ ID NO: 154353 - DNA, 20 bp, Artificial
  CRISPR gRNA sequence
gggctgcactgaagaacatc

SEQ ID NO: 154354 - DNA, 20 bp, Artificial
  CRISPR gRNA sequence
cagtcaggcactctggcaag

SEQ ID NO: 154355 - DNA, 20 bp, Artificial
  CRISPR gRNA sequence
gattctcaaccctttgaaat

SEQ ID NO: 154356 - DNA, 20 bp, Artificial
  CRISPR gRNA sequence
ctgcaggttagaatcacctg

SEQ ID NO: 154357 - DNA, 20 bp, Artificial
  CRISPR gRNA sequence
agtggtccccaacctcagga

SEQ ID NO: 154358 - DNA, 20 bp, Artificial
  CRISPR gRNA sequence
cagagatgggcagggtgggc

SEQ ID NO: 154359 - DNA, 20 bp, Artificial
  CRISPR gRNA sequence
aggaggtggagctcaggcag

SEQ ID NO: 154360 - DNA, 20 bp, Artificial
  CRISPR gRNA sequence
ggtggagctcaggcagtaat

SEQ ID NO: 154361 - DNA, 20 bp, Artificial
  CRISPR gRNA sequence
tagtgggtagagtactggca

SEQ ID NO: 154362 - DNA, 20 bp, Artificial
  CRISPR gRNA sequence
tccaagtgagagttaaggac

SEQ ID NO: 154363 - DNA, 20 bp, Artificial
  CRISPR gRNA sequence
cacgtggttcatacagacaa

SEQ ID NO: 154364 - DNA, 20 bp, Artificial
  CRISPR gRNA sequence
aagggctcacacagcacagg

SEQ ID NO: 154365 - DNA, 20 bp, Artificial
  CRISPR gRNA sequence
accaaccttcatcaccaagt

SEQ ID NO: 154366 - DNA, 20 bp, Artificial
  CRISPR gRNA sequence
aagttcttgtttaaacagtt

SEQ ID NO: 154367 - DNA, 20 bp, Artificial
  CRISPR gRNA sequence
cttgtttaaacagttatctg

SEQ ID NO: 154368 - DNA, 20 bp, Artificial
  CRISPR gRNA sequence
atgtaaagagtaagtagaga

SEQ ID NO: 154369 - DNA, 20 bp, Artificial
  CRISPR gRNA sequence
ctcacctccataaagacaaa

SEQ ID NO: 154370 - DNA, 20 bp, Artificial
  CRISPR gRNA sequence
agctctgctgtgcgggaata

SEQ ID NO: 154371 - DNA, 20 bp, Artificial
  CRISPR gRNA sequence
ctggtgcacaatcatcttga

SEQ ID NO: 154372 - DNA, 20 bp, Artificial
  CRISPR gRNA sequence
tcaatcccagctgaacacca

SEQ ID NO: 154373 - DNA, 20 bp, Artificial
  CRISPR gRNA sequence
cctggatttatagacaacta

SEQ ID NO: 154374 - DNA, 20 bp, Artificial
  CRISPR gRNA sequence
acaagctaaaatgaaagata

SEQ ID NO: 154375 - DNA, 20 bp, Artificial
  CRISPR gRNA sequence
agaccaaaaggacttgaggc

SEQ ID NO: 154376 - DNA, 20 bp, Artificial
  CRISPR gRNA sequence
cacattttatgaatattctc

SEQ ID NO: 154377 - DNA, 20 bp, Artificial
  CRISPR gRNA sequence
aatattctcgtaagttttac

SEQ ID NO: 154378 - DNA, 20 bp, Artificial
  CRISPR gRNA sequence
gtaagttttacttatgattg

SEQ ID NO: 154379 - DNA, 20 bp, Artificial
  CRISPR gRNA sequence
ctctgacacatctgaggaag

SEQ ID NO: 154380 - DNA, 20 bp, Artificial
  CRISPR gRNA sequence
actgttgagttctggaaagg

SEQ ID NO: 154381 - DNA, 20 bp, Artificial
  CRISPR gRNA sequence
aagggacagattaaatgcta

SEQ ID NO: 154382 - DNA, 20 bp, Artificial
  CRISPR gRNA sequence
aaaaaaattaccctgacttt

SEQ ID NO: 154383 - DNA, 20 bp, Artificial
  CRISPR gRNA sequence
ttactcaaatatggaattga

SEQ ID NO: 154384 - DNA, 20 bp, Artificial
  CRISPR gRNA sequence
ttaattagtcaccaatacaa

SEQ ID NO: 154385 - DNA, 20 bp, Artificial
  CRISPR gRNA sequence
aaaatttggtcaacatcatg

SEQ ID NO: 154386 - DNA, 20 bp, Artificial
  CRISPR gRNA sequence
tggtatatacatacaacagg

SEQ ID NO: 154387 - DNA, 20 bp, Artificial
  CRISPR gRNA sequence
atggctcatgtctgtaatcc

SEQ ID NO: 154388 - DNA, 20 bp, Artificial
  CRISPR gRNA sequence
tgctttggagggccaaggca

SEQ ID NO: 154389 - DNA, 20 bp, Artificial
  CRISPR gRNA sequence
ttggagggccaaggcaagag

SEQ ID NO: 154390 - DNA, 20 bp, Artificial
  CRISPR gRNA sequence
agtgagacctccatctctac

SEQ ID NO: 154391 - DNA, 20 bp, Artificial
  CRISPR gRNA sequence
ttgggaggcagatgtgggag

SEQ ID NO: 154392 - DNA, 20 bp, Artificial
  CRISPR gRNA sequence
tgggaggaatgcttgagccc

SEQ ID NO: 154393 - DNA, 20 bp, Artificial
  CRISPR gRNA sequence
tcaggaggctgaggcgggag

SEQ ID NO: 154394 - DNA, 20 bp, Artificial
  CRISPR gRNA sequence
aaaaggaaagacatcctgtc

SEQ ID NO: 154395 - DNA, 20 bp, Artificial
  CRISPR gRNA sequence
tatctcataatttattgaat

SEQ ID NO: 154396 - DNA, 20 bp, Artificial
  CRISPR gRNA sequence
tacaactgctactgaatgca

SEQ ID NO: 154397 - DNA, 20 bp, Artificial
  CRISPR gRNA sequence
ttcatagaaagcagaatggt

SEQ ID NO: 154398 - DNA, 20 bp, Artificial
  CRISPR gRNA sequence
tggtggctgtttattgagtg

SEQ ID NO: 154399 - DNA, 20 bp, Artificial
  CRISPR gRNA sequence
tcaaggtaagttccataaca

SEQ ID NO: 154400 - DNA, 20 bp, Artificial
  CRISPR gRNA sequence
tggataaggggcgaaatttt

SEQ ID NO: 154401 - DNA, 20 bp, Artificial
  CRISPR gRNA sequence
caaaacagaaaagttaagtg

SEQ ID NO: 154402 - DNA, 20 bp, Artificial
  CRISPR gRNA sequence
aagtgctgagcttaaacctc

SEQ ID NO: 154403 - DNA, 20 bp, Artificial
  CRISPR gRNA sequence
tatctggccacttgcctgat

SEQ ID NO: 154404 - DNA, 20 bp, Artificial
  CRISPR gRNA sequence
tcaagctgcggcacagactt

SEQ ID NO: 154405 - DNA, 20 bp, Artificial
  CRISPR gRNA sequence
gaccccagcaccaaaagctg

SEQ ID NO: 154406 - DNA, 20 bp, Artificial
  CRISPR gRNA sequence
aaaagctgataagcttaatc

SEQ ID NO: 154407 - DNA, 20 bp, Artificial
  CRISPR gRNA sequence
cccttctctttcatatctga

SEQ ID NO: 154408 - DNA, 20 bp, Artificial
  CRISPR gRNA sequence
gttatttcatttcattaatt

SEQ ID NO: 154409 - DNA, 20 bp, Artificial
  CRISPR gRNA sequence
tcccatccttcacatctggt

SEQ ID NO: 154410 - DNA, 20 bp, Artificial
  CRISPR gRNA sequence
cctctgtgctccttgacttt

SEQ ID NO: 154411 - DNA, 20 bp, Artificial
  CRISPR gRNA sequence
gcttcaggactcatcactgt

SEQ ID NO: 154412 - DNA, 20 bp, Artificial
  CRISPR gRNA sequence
aaattattctggttgtaatt

SEQ ID NO: 154413 - DNA, 20 bp, Artificial
  CRISPR gRNA sequence
agtcagtagttctcaacaag

SEQ ID NO: 154414 - DNA, 20 bp, Artificial
  CRISPR gRNA sequence
agaaagagttcctgactcac

SEQ ID NO: 154415 - DNA, 20 bp, Artificial
  CRISPR gRNA sequence
tgttgttgaataaattgccc

SEQ ID NO: 154416 - DNA, 20 bp, Artificial
  CRISPR gRNA sequence
ctactgaaggaagatgagat

SEQ ID NO: 154417 - DNA, 20 bp, Artificial
  CRISPR gRNA sequence
gttacctcacggaaggcaaa

SEQ ID NO: 154418 - DNA, 20 bp, Artificial
  CRISPR gRNA sequence
ggtgaaccatgcctctgtaa

SEQ ID NO: 154419 - DNA, 20 bp, Artificial
  CRISPR gRNA sequence
gtaaatgtgcttgaaattaa

SEQ ID NO: 154420 - DNA, 20 bp, Artificial
  CRISPR gRNA sequence
gaaattaaaaatgctttagt

SEQ ID NO: 154421 - DNA, 20 bp, Artificial
  CRISPR gRNA sequence
cagagctctttatactcttt

SEQ ID NO: 154422 - DNA, 20 bp, Artificial
  CRISPR gRNA sequence
actctttaaaagtttctaat

SEQ ID NO: 154423 - DNA, 20 bp, Artificial
  CRISPR gRNA sequence
cttcctcaccactgttaaat

SEQ ID NO: 154424 - DNA, 20 bp, Artificial
  CRISPR gRNA sequence
gacccgaggccagaacgact

SEQ ID NO: 154425 - DNA, 20 bp, Artificial
  CRISPR gRNA sequence
caataaagtcagactttctg

SEQ ID NO: 154426 - DNA, 20 bp, Artificial
  CRISPR gRNA sequence
ttaggcatttgtatatttgt

SEQ ID NO: 154427 - DNA, 20 bp, Artificial
  CRISPR gRNA sequence
tttatgaatctattcaatct

SEQ ID NO: 154428 - DNA, 20 bp, Artificial
  CRISPR gRNA sequence
taaggtatataattacgcta

SEQ ID NO: 154429 - DNA, 20 bp, Artificial
  CRISPR gRNA sequence
catcttaaaaacattggtag

SEQ ID NO: 154430 - DNA, 20 bp, Artificial
  CRISPR gRNA sequence
taggaaagtttttccttcta

SEQ ID NO: 154431 - DNA, 20 bp, Artificial
  CRISPR gRNA sequence
attttcaatgccattctttc

SEQ ID NO: 154432 - DNA, 20 bp, Artificial
  CRISPR gRNA sequence
caaagctttttcaagttctc

SEQ ID NO: 154433 - DNA, 20 bp, Artificial
  CRISPR gRNA sequence
attcttatattaaaagtccc

SEQ ID NO: 154434 - DNA, 20 bp, Artificial
  CRISPR gRNA sequence
aatggcgtgaacccgggagg

SEQ ID NO: 154435 - DNA, 20 bp, Artificial
  CRISPR gRNA sequence
aaaaaaagagagagagcacg

SEQ ID NO: 154436 - DNA, 20 bp, Artificial
  CRISPR gRNA sequence
agagcacgctaagtttcttc

SEQ ID NO: 154437 - DNA, 20 bp, Artificial
  CRISPR gRNA sequence
ttttgttttagacactgtga

SEQ ID NO: 154438 - DNA, 20 bp, Artificial
  CRISPR gRNA sequence
tgtttctctggggctcctga

SEQ ID NO: 154439 - DNA, 20 bp, Artificial
  CRISPR gRNA sequence
aattagccgggcgtggcggc

SEQ ID NO: 154440 - DNA, 20 bp, Artificial
  CRISPR gRNA sequence
tcaggaggctgaggcaggag

SEQ ID NO: 154441 - DNA, 20 bp, Artificial
  CRISPR gRNA sequence
ctagaacctgcaatttagtc

SEQ ID NO: 154442 - DNA, 20 bp, Artificial
  CRISPR gRNA sequence
tgcctggggaccagaaatgt

SEQ ID NO: 154443 - DNA, 20 bp, Artificial
  CRISPR gRNA sequence
ttttttttttttttttgaga

SEQ ID NO: 154444 - DNA, 20 bp, Artificial
  CRISPR gRNA sequence
aacctctgcctcccaggttc

SEQ ID NO: 154445 - DNA, 20 bp, Artificial
  CRISPR gRNA sequence
tgcctcagcctcctgagtag

SEQ ID NO: 154446 - DNA, 20 bp, Artificial
  CRISPR gRNA sequence
ttttatatttttagtaaaga

SEQ ID NO: 154447 - DNA, 20 bp, Artificial
  CRISPR gRNA sequence
tgcctcgtcctcccaaagtg

SEQ ID NO: 154448 - DNA, 20 bp, Artificial
  CRISPR gRNA sequence
tttttttttttttttttgga

SEQ ID NO: 154449 - DNA, 20 bp, Artificial
  CRISPR gRNA sequence
gagcgtcatgtcagggctca

SEQ ID NO: 154450 - DNA, 20 bp, Artificial
  CRISPR gRNA sequence
catgtcagggctcaaaaagt

SEQ ID NO: 154451 - DNA, 20 bp, Artificial
  CRISPR gRNA sequence
gggctcaaaaagtttcggat

SEQ ID NO: 154452 - DNA, 20 bp, Artificial
  CRISPR gRNA sequence
aaagtttcggatttcagatt

SEQ ID NO: 154453 - DNA, 20 bp, Artificial
  CRISPR gRNA sequence
aacctgtattgtaatgtctt

SEQ ID NO: 154454 - DNA, 20 bp, Artificial
  CRISPR gRNA sequence
ggcaaatattaaaatgcaag

SEQ ID NO: 154455 - DNA, 20 bp, Artificial
  CRISPR gRNA sequence
tattctgaggaattatttga

SEQ ID NO: 154456 - DNA, 20 bp, Artificial
  CRISPR gRNA sequence
tggaatgaaagctgacaact

SEQ ID NO: 154457 - DNA, 20 bp, Artificial
  CRISPR gRNA sequence
gggatgtccaattcactctt

SEQ ID NO: 154458 - DNA, 20 bp, Artificial
  CRISPR gRNA sequence
actcttaaatgtttacaggt

SEQ ID NO: 154459 - DNA, 20 bp, Artificial
  CRISPR gRNA sequence
aacaacaatacaagcctcaa

SEQ ID NO: 154460 - DNA, 20 bp, Artificial
  CRISPR gRNA sequence
tgggtgatgatgtaatggga

SEQ ID NO: 154461 - DNA, 20 bp, Artificial
  CRISPR gRNA sequence
cctgggatacaatatgatct

SEQ ID NO: 154462 - DNA, 20 bp, Artificial
  CRISPR gRNA sequence
aaaaaattaaggtaatctag

SEQ ID NO: 154463 - DNA, 20 bp, Artificial
  CRISPR gRNA sequence
tttagttatttatcattatt

SEQ ID NO: 154464 - DNA, 20 bp, Artificial
  CRISPR gRNA sequence
ggaaataataataattatca

SEQ ID NO: 154465 - DNA, 20 bp, Artificial
  CRISPR gRNA sequence
gtacacttgctaatggatgg

SEQ ID NO: 154466 - DNA, 20 bp, Artificial
  CRISPR gRNA sequence
tagttggagtacaaagacct

SEQ ID NO: 154467 - DNA, 20 bp, Artificial
  CRISPR gRNA sequence
cgtctagaaccatctgtgca

SEQ ID NO: 154468 - DNA, 20 bp, Artificial
  CRISPR gRNA sequence
aactgaaaatgtattaaagg

SEQ ID NO: 154469 - DNA, 20 bp, Artificial
  CRISPR gRNA sequence
ccaccccttcataagacgct

SEQ ID NO: 154470 - DNA, 20 bp, Artificial
  CRISPR gRNA sequence
ttcaacctctgcccaacccc

SEQ ID NO: 154471 - DNA, 20 bp, Artificial
  CRISPR gRNA sequence
gattctaccttaagtgttca

SEQ ID NO: 154472 - DNA, 20 bp, Artificial
  CRISPR gRNA sequence
ccccactccagttctgggaa

SEQ ID NO: 154473 - DNA, 20 bp, Artificial
  CRISPR gRNA sequence
tctaactgttcttctttaca

SEQ ID NO: 154474 - DNA, 20 bp, Artificial
  CRISPR gRNA sequence
aggttttagagttatggcct

SEQ ID NO: 154475 - DNA, 20 bp, Artificial
  CRISPR gRNA sequence
ctcaccaggaaaaaagagaa

SEQ ID NO: 154476 - DNA, 20 bp, Artificial
  CRISPR gRNA sequence
aaaagagaaaaaggtttgaa

SEQ ID NO: 154477 - DNA, 20 bp, Artificial
  CRISPR gRNA sequence
aaagtgagtacttttattca

SEQ ID NO: 154478 - DNA, 20 bp, Artificial
  CRISPR gRNA sequence
aagcagatccattctttgca

SEQ ID NO: 154479 - DNA, 20 bp, Artificial
  CRISPR gRNA sequence
taatgcattaattgcaaata

SEQ ID NO: 154480 - DNA, 20 bp, Artificial
  CRISPR gRNA sequence
agtaagaggaggctgggtgt

SEQ ID NO: 154481 - DNA, 20 bp, Artificial
  CRISPR gRNA sequence
caggagaatcacttcaggcc

SEQ ID NO: 154482 - DNA, 20 bp, Artificial
  CRISPR gRNA sequence
gtgagactctgtctctaaaa

SEQ ID NO: 154483 - DNA, 20 bp, Artificial
  CRISPR gRNA sequence
gcctggctaatatagcaaaa

SEQ ID NO: 154484 - DNA, 20 bp, Artificial
  CRISPR gRNA sequence
cattagccgagcatggtggc

SEQ ID NO: 154485 - DNA, 20 bp, Artificial
  CRISPR gRNA sequence
gctacttgggaggctgaggc

SEQ ID NO: 154486 - DNA, 20 bp, Artificial
  CRISPR gRNA sequence
cagaaggatctcctgggccc

SEQ ID NO: 154487 - DNA, 20 bp, Artificial
  CRISPR gRNA sequence
tattttttttttctcaaagc

SEQ ID NO: 154488 - DNA, 20 bp, Artificial
  CRISPR gRNA sequence
tctctccacgaagtattctc

SEQ ID NO: 154489 - DNA, 20 bp, Artificial
  CRISPR gRNA sequence
tccttgagggtaggatctgc

SEQ ID NO: 154490 - DNA, 20 bp, Artificial
  CRISPR gRNA sequence
gggggggggggcgaatcttg

SEQ ID NO: 154491 - DNA, 20 bp, Artificial
  CRISPR gRNA sequence
atggttacacaagctattcc

SEQ ID NO: 154492 - DNA, 20 bp, Artificial
  CRISPR gRNA sequence
gcaatcagaaatctacctga

SEQ ID NO: 154493 - DNA, 20 bp, Artificial
  CRISPR gRNA sequence
acctgaaactgatttactga

SEQ ID NO: 154494 - DNA, 20 bp, Artificial
  CRISPR gRNA sequence
ctcttcagaaaagtgaccag

SEQ ID NO: 154495 - DNA, 20 bp, Artificial
  CRISPR gRNA sequence
gggaaaatcatgcagaagtg

SEQ ID NO: 154496 - DNA, 20 bp, Artificial
  CRISPR gRNA sequence
aaagaaaaaaatgaaacttc

SEQ ID NO: 154497 - DNA, 20 bp, Artificial
  CRISPR gRNA sequence
aatcagagtgttccttttaa

SEQ ID NO: 154498 - DNA, 20 bp, Artificial
  CRISPR gRNA sequence
ctcataaataaaaagaaatc

SEQ ID NO: 154499 - DNA, 20 bp, Artificial
  CRISPR gRNA sequence
aaggttttattgcaatatga

SEQ ID NO: 154500 - DNA, 20 bp, Artificial
  CRISPR gRNA sequence
gaaacccaattcttgaccaa

SEQ ID NO: 154501 - DNA, 20 bp, Artificial
  CRISPR gRNA sequence
tgaactatacatacattgaa

SEQ ID NO: 154502 - DNA, 20 bp, Artificial
  CRISPR gRNA sequence
ggtgggcagatcacgaggtc

SEQ ID NO: 154503 - DNA, 20 bp, Artificial
  CRISPR gRNA sequence
tcaggaggctgaggcggggg

SEQ ID NO: 154504 - DNA, 20 bp, Artificial
  CRISPR gRNA sequence
ttgggaggctaaggcatgag

SEQ ID NO: 154505 - DNA, 20 bp, Artificial
  CRISPR gRNA sequence
ccgtcccaaaaaaaaaagta

SEQ ID NO: 154506 - DNA, 20 bp, Artificial
  CRISPR gRNA sequence
ttattccagttcagggttgc

SEQ ID NO: 154507 - DNA, 20 bp, Artificial
  CRISPR gRNA sequence
gagagtgaccccggccagga

SEQ ID NO: 154508 - DNA, 20 bp, Artificial
  CRISPR gRNA sequence
agttgaaccatcctgggaag

SEQ ID NO: 154509 - DNA, 20 bp, Artificial
  CRISPR gRNA sequence
cccaaaccgacttgcagccc

SEQ ID NO: 154510 - DNA, 20 bp, Artificial
  CRISPR gRNA sequence
acatcctttttacaactata

SEQ ID NO: 154511 - DNA, 20 bp, Artificial
  CRISPR gRNA sequence
ttttattgcatttcacttta

SEQ ID NO: 154512 - DNA, 20 bp, Artificial
  CRISPR gRNA sequence
catgaatccaggagttcgag

SEQ ID NO: 154513 - DNA, 20 bp, Artificial
  CRISPR gRNA sequence
ctcaatcaatcgaaagctag

SEQ ID NO: 154514 - DNA, 20 bp, Artificial
  CRISPR gRNA sequence
caatcgaaagctagaaatga

SEQ ID NO: 154515 - DNA, 20 bp, Artificial
  CRISPR gRNA sequence
aacacacaaataagaaagca

SEQ ID NO: 154516 - DNA, 20 bp, Artificial
  CRISPR gRNA sequence
agctttattgctgatatgaa

SEQ ID NO: 154517 - DNA, 20 bp, Artificial
  CRISPR gRNA sequence
gcagaagaaaagttggttca

SEQ ID NO: 154518 - DNA, 20 bp, Artificial
  CRISPR gRNA sequence
gtgctaatgtagaagctgca

SEQ ID NO: 154519 - DNA, 20 bp, Artificial
  CRISPR gRNA sequence
cctgtgctctataaatggag

SEQ ID NO: 154520 - DNA, 20 bp, Artificial
  CRISPR gRNA sequence
caaagcttggatgacagcac

SEQ ID NO: 154521 - DNA, 20 bp, Artificial
  CRISPR gRNA sequence
gagacctactgctcagaaaa

SEQ ID NO: 154522 - DNA, 20 bp, Artificial
  CRISPR gRNA sequence
tcaagaggctgaggcaggag

SEQ ID NO: 154523 - DNA, 20 bp, Artificial
  CRISPR gRNA sequence
gaggcagaggttgcagtgag

SEQ ID NO: 154524 - DNA, 20 bp, Artificial
  CRISPR gRNA sequence
aaacaaaacaaaaaacatta

SEQ ID NO: 154525 - DNA, 20 bp, Artificial
  CRISPR gRNA sequence
atctgcttgcacaactccat

SEQ ID NO: 154526 - DNA, 20 bp, Artificial
  CRISPR gRNA sequence
cttgcacaactccatcagag

SEQ ID NO: 154527 - DNA, 20 bp, Artificial
  CRISPR gRNA sequence
acaactccatcagagttttg

SEQ ID NO: 154528 - DNA, 20 bp, Artificial
  CRISPR gRNA sequence
aacctccgccttctgggttc

SEQ ID NO: 154529 - DNA, 20 bp, Artificial
  CRISPR gRNA sequence
ttttgtaattttagtaaaga

SEQ ID NO: 154530 - DNA, 20 bp, Artificial
  CRISPR gRNA sequence
tggccagactggtctcaaac

SEQ ID NO: 154531 - DNA, 20 bp, Artificial
  CRISPR gRNA sequence
cgcctcagcctcccaaagtg

SEQ ID NO: 154532 - DNA, 20 bp, Artificial
  CRISPR gRNA sequence
gtgtaaaccatcgcgcccag

SEQ ID NO: 154533 - DNA, 20 bp, Artificial
  CRISPR gRNA sequence
actaaaaacacaaaaattag

SEQ ID NO: 154534 - DNA, 20 bp, Artificial
  CRISPR gRNA sequence
aaggacacagctgccataga

SEQ ID NO: 154535 - DNA, 20 bp, Artificial
  CRISPR gRNA sequence
gtaaactgaaaaccttctag

SEQ ID NO: 154536 - DNA, 20 bp, Artificial
  CRISPR gRNA sequence
ggcgggcgaatcacaaggtc

SEQ ID NO: 154537 - DNA, 20 bp, Artificial
  CRISPR gRNA sequence
tgcctcaggcctgtaattcc

SEQ ID NO: 154538 - DNA, 20 bp, Artificial
  CRISPR gRNA sequence
ttgggaggccaaggcgggag

SEQ ID NO: 154539 - DNA, 20 bp, Artificial
  CRISPR gRNA sequence
aattagctggttgtggtggc

SEQ ID NO: 154540 - DNA, 20 bp, Artificial
  CRISPR gRNA sequence
aaacattaacaggagtctga

SEQ ID NO: 154541 - DNA, 20 bp, Artificial
  CRISPR gRNA sequence
aagttgattccaatcctcct

SEQ ID NO: 154542 - DNA, 20 bp, Artificial
  CRISPR gRNA sequence
aatcctcctggatgattttg

SEQ ID NO: 154543 - DNA, 20 bp, Artificial
  CRISPR gRNA sequence
gaagcggagcctgagatgtg

SEQ ID NO: 154544 - DNA, 20 bp, Artificial
  CRISPR gRNA sequence
taaaactttaacagatgagg

SEQ ID NO: 154545 - DNA, 20 bp, Artificial
  CRISPR gRNA sequence
acttagttcataaaatagtg

SEQ ID NO: 154546 - DNA, 20 bp, Artificial
  CRISPR gRNA sequence
caggatttgagaggacaaac

SEQ ID NO: 154547 - DNA, 20 bp, Artificial
  CRISPR gRNA sequence
caagaggatcacttcagccc

SEQ ID NO: 154548 - DNA, 20 bp, Artificial
  CRISPR gRNA sequence
ttgggaggctgaagtaggag

SEQ ID NO: 154549 - DNA, 20 bp, Artificial
  CRISPR gRNA sequence
ttgggaagctggggcagcag

SEQ ID NO: 154550 - DNA, 20 bp, Artificial
  CRISPR gRNA sequence
gtgactctctttattataat

SEQ ID NO: 154551 - DNA, 20 bp, Artificial
  CRISPR gRNA sequence
ggtatttactgaggttagtt

SEQ ID NO: 154552 - DNA, 20 bp, Artificial
  CRISPR gRNA sequence
gtttcttcatttaaatgagc

SEQ ID NO: 154553 - DNA, 20 bp, Artificial
  CRISPR gRNA sequence
gatggatgagggaaaggggg

SEQ ID NO: 154554 - DNA, 20 bp, Artificial
  CRISPR gRNA sequence
atttatttactaacagacta

SEQ ID NO: 154555 - DNA, 20 bp, Artificial
  CRISPR gRNA sequence
actaacagactatttggttt

SEQ ID NO: 154556 - DNA, 20 bp, Artificial
  CRISPR gRNA sequence
agctaaaaagcatttcttaa

SEQ ID NO: 154557 - DNA, 20 bp, Artificial
  CRISPR gRNA sequence
aagacctacgtctgtgtact

SEQ ID NO: 154558 - DNA, 20 bp, Artificial
  CRISPR gRNA sequence
cacattccaaaggggtctct

SEQ ID NO: 154559 - DNA, 20 bp, Artificial
  CRISPR gRNA sequence
agtctctatttaaactcatc

SEQ ID NO: 154560 - DNA, 20 bp, Artificial
  CRISPR gRNA sequence
caggaaactaagttcaggca

SEQ ID NO: 154561 - DNA, 20 bp, Artificial
  CRISPR gRNA sequence
acatagctctacttccccaa

SEQ ID NO: 154562 - DNA, 20 bp, Artificial
  CRISPR gRNA sequence
ttccccaactctgattaatg

SEQ ID NO: 154563 - DNA, 20 bp, Artificial
  CRISPR gRNA sequence
actctgattaatgccaagtt

SEQ ID NO: 154564 - DNA, 20 bp, Artificial
  CRISPR gRNA sequence
gtatatctgtgttaagagga

SEQ ID NO: 154565 - DNA, 20 bp, Artificial
  CRISPR gRNA sequence
tcaaagtgcctactggaaaa

SEQ ID NO: 154566 - DNA, 20 bp, Artificial
  CRISPR gRNA sequence
aaccatgcttcctaaaagac

SEQ ID NO: 154567 - DNA, 20 bp, Artificial
  CRISPR gRNA sequence
taggccacatctggcctaca

SEQ ID NO: 154568 - DNA, 20 bp, Artificial
  CRISPR gRNA sequence
gcctacagcctgtttttaga

SEQ ID NO: 154569 - DNA, 20 bp, Artificial
  CRISPR gRNA sequence
aacctccacctcccgggttc

SEQ ID NO: 154570 - DNA, 20 bp, Artificial
  CRISPR gRNA sequence
cacctcagcctcccaagcag

SEQ ID NO: 154571 - DNA, 20 bp, Artificial
  CRISPR gRNA sequence
atttttgtatttttgaagag

SEQ ID NO: 154572 - DNA, 20 bp, Artificial
  CRISPR gRNA sequence
cacctcggcctcccaaaacg

SEQ ID NO: 154573 - DNA, 20 bp, Artificial
  CRISPR gRNA sequence
gccaccatgtccagccccta

SEQ ID NO: 154574 - DNA, 20 bp, Artificial
  CRISPR gRNA sequence
tcacgaggctgaggcgggag

SEQ ID NO: 154575 - DNA, 20 bp, Artificial
  CRISPR gRNA sequence
gtggtcaagcctgcagtgag

SEQ ID NO: 154576 - DNA, 20 bp, Artificial
  CRISPR gRNA sequence
aaaaaaaagaaaagaaaaga

SEQ ID NO: 154577 - DNA, 20 bp, Artificial
  CRISPR gRNA sequence
agtttcagataatattctga

SEQ ID NO: 154578 - DNA, 20 bp, Artificial
  CRISPR gRNA sequence
tcttgttttaaagcactgtt

SEQ ID NO: 154579 - DNA, 20 bp, Artificial
  CRISPR gRNA sequence
ctgttaggtgttttatttat

SEQ ID NO: 154580 - DNA, 20 bp, Artificial
  CRISPR gRNA sequence
tgtaggaagaatggtgagta

SEQ ID NO: 154581 - DNA, 20 bp, Artificial
  CRISPR gRNA sequence
attttcttaccgggtgcctt

SEQ ID NO: 154582 - DNA, 20 bp, Artificial
  CRISPR gRNA sequence
gattcacaaacagcctcttg

SEQ ID NO: 154583 - DNA, 20 bp, Artificial
  CRISPR gRNA sequence
gcccagtttctggcagtatc

SEQ ID NO: 154584 - DNA, 20 bp, Artificial
  CRISPR gRNA sequence
gtgtctagcagagggaagaa

SEQ ID NO: 154585 - DNA, 20 bp, Artificial
  CRISPR gRNA sequence
ggaagaagtgtgattctgaa

SEQ ID NO: 154586 - DNA, 20 bp, Artificial
  CRISPR gRNA sequence
tgtttcatagatgccaactt

SEQ ID NO: 154587 - DNA, 20 bp, Artificial
  CRISPR gRNA sequence
gcaaaagctctaaaattctg

SEQ ID NO: 154588 - DNA, 20 bp, Artificial
  CRISPR gRNA sequence
ttgctctttcccactttttg

SEQ ID NO: 154589 - DNA, 20 bp, Artificial
  CRISPR gRNA sequence
agctgtcactcttttttctt

SEQ ID NO: 154590 - DNA, 20 bp, Artificial
  CRISPR gRNA sequence
ttagaaggcctcaaaaaata

SEQ ID NO: 154591 - DNA, 20 bp, Artificial
  CRISPR gRNA sequence
agtaccgagcctaaagacca

SEQ ID NO: 154592 - DNA, 20 bp, Artificial
  CRISPR gRNA sequence
ttctctataatttagactta

SEQ ID NO: 154593 - DNA, 20 bp, Artificial
  CRISPR gRNA sequence
tgacatatttctttaaaaag

SEQ ID NO: 154594 - DNA, 20 bp, Artificial
  CRISPR gRNA sequence
gtcaatgatcaatagctata

SEQ ID NO: 154595 - DNA, 20 bp, Artificial
  CRISPR gRNA sequence
tagcatgatcttggctcact

SEQ ID NO: 154596 - DNA, 20 bp, Artificial
  CRISPR gRNA sequence
ttttgtatttttagtagaga

SEQ ID NO: 154597 - DNA, 20 bp, Artificial
  CRISPR gRNA sequence
caccttggcctcccaaagtg

SEQ ID NO: 154598 - DNA, 20 bp, Artificial
  CRISPR gRNA sequence
ttgggaagccaaagcaggag

SEQ ID NO: 154599 - DNA, 20 bp, Artificial
  CRISPR gRNA sequence
agctgggagactgcaatgag

SEQ ID NO: 154600 - DNA, 20 bp, Artificial
  CRISPR gRNA sequence
tccacaagctaggagtacgt

SEQ ID NO: 154601 - DNA, 20 bp, Artificial
  CRISPR gRNA sequence
gttttgtcttgtgaaaggaa

SEQ ID NO: 154602 - DNA, 20 bp, Artificial
  CRISPR gRNA sequence
cctggccccaccatccaagc

SEQ ID NO: 154603 - DNA, 20 bp, Artificial
  CRISPR gRNA sequence
cccaccatccaagcaaaaga

SEQ ID NO: 154604 - DNA, 20 bp, Artificial
  CRISPR gRNA sequence
actatctcatgggttgaaac

SEQ ID NO: 154605 - DNA, 20 bp, Artificial
  CRISPR gRNA sequence
cttctgcaatagcattgata

SEQ ID NO: 154606 - DNA, 20 bp, Artificial
  CRISPR gRNA sequence
tttctctaattagcatattc

SEQ ID NO: 154607 - DNA, 20 bp, Artificial
  CRISPR gRNA sequence
tttagggggcatattatttt

SEQ ID NO: 154608 - DNA, 20 bp, Artificial
  CRISPR gRNA sequence
tttcatgctcctattttttc

SEQ ID NO: 154609 - DNA, 20 bp, Artificial
  CRISPR gRNA sequence
ttgtaagacaaacataatca

SEQ ID NO: 154610 - DNA, 20 bp, Artificial
  CRISPR gRNA sequence
caaatatgccttgcacatag

SEQ ID NO: 154611 - DNA, 20 bp, Artificial
  CRISPR gRNA sequence
tcctgagtagcggggactac

SEQ ID NO: 154612 - DNA, 20 bp, Artificial
  CRISPR gRNA sequence
cactttggcctgccaaagtg

SEQ ID NO: 154613 - DNA, 20 bp, Artificial
  CRISPR gRNA sequence
catcggctccactgaaaaat

SEQ ID NO: 154614 - DNA, 20 bp, Artificial
  CRISPR gRNA sequence
ggcgttataataatgtcaat

SEQ ID NO: 154615 - DNA, 20 bp, Artificial
  CRISPR gRNA sequence
tgtcaatatgagcttggctg

SEQ ID NO: 154616 - DNA, 20 bp, Artificial
  CRISPR gRNA sequence
tggctgtattgattctgctg

SEQ ID NO: 154617 - DNA, 20 bp, Artificial
  CRISPR gRNA sequence
gatacactgtgaattcttcc

SEQ ID NO: 154618 - DNA, 20 bp, Artificial
  CRISPR gRNA sequence
tccctctgtttagtgtcttt

SEQ ID NO: 154619 - DNA, 20 bp, Artificial
  CRISPR gRNA sequence
ttagtgtcttttattgattt

SEQ ID NO: 154620 - DNA, 20 bp, Artificial
  CRISPR gRNA sequence
acatactttacacttcttaa

SEQ ID NO: 154621 - DNA, 20 bp, Artificial
  CRISPR gRNA sequence
aagtagtttcatgttatttt

SEQ ID NO: 154622 - DNA, 20 bp, Artificial
  CRISPR gRNA sequence
gtgaaattaaaattcatgtc

SEQ ID NO: 154623 - DNA, 20 bp, Artificial
  CRISPR gRNA sequence
aaacacaaaacttaagaacc

SEQ ID NO: 154624 - DNA, 20 bp, Artificial
  CRISPR gRNA sequence
atccaccaggcctttttacc

SEQ ID NO: 154625 - DNA, 20 bp, Artificial
  CRISPR gRNA sequence
tactccaaaaaaatcaagat

SEQ ID NO: 154626 - DNA, 20 bp, Artificial
  CRISPR gRNA sequence
ttcttaaacatttcaaagta

SEQ ID NO: 154627 - DNA, 20 bp, Artificial
  CRISPR gRNA sequence
aaagtagaaagcttaaacaa

SEQ ID NO: 154628 - DNA, 20 bp, Artificial
  CRISPR gRNA sequence
aaagcttaaacaagaaagct

SEQ ID NO: 154629 - DNA, 20 bp, Artificial
  CRISPR gRNA sequence
aacaagaaagcttaaggttt

SEQ ID NO: 154630 - DNA, 20 bp, Artificial
  CRISPR gRNA sequence
agcccagcctcctatattgg

SEQ ID NO: 154631 - DNA, 20 bp, Artificial
  CRISPR gRNA sequence
tcacctggctaaattctatg

SEQ ID NO: 154632 - DNA, 20 bp, Artificial
  CRISPR gRNA sequence
tccacctcactaggggtaag

SEQ ID NO: 154633 - DNA, 20 bp, Artificial
  CRISPR gRNA sequence
atagctaggaaatttaaagc

SEQ ID NO: 154634 - DNA, 20 bp, Artificial
  CRISPR gRNA sequence
tcgggaggctgaggcaggag

SEQ ID NO: 154635 - DNA, 20 bp, Artificial
  CRISPR gRNA sequence
aaacaaaacaaaaaaaacca

SEQ ID NO: 154636 - DNA, 20 bp, Artificial
  CRISPR gRNA sequence
tcatctaaaaatatcgatct

SEQ ID NO: 154637 - DNA, 20 bp, Artificial
  CRISPR gRNA sequence
cttacctgaccttagtgaat

SEQ ID NO: 154638 - DNA, 20 bp, Artificial
  CRISPR gRNA sequence
tcaattgttatctacttgta

SEQ ID NO: 154639 - DNA, 20 bp, Artificial
  CRISPR gRNA sequence
aaaggtaattcaatttgact

SEQ ID NO: 154640 - DNA, 20 bp, Artificial
  CRISPR gRNA sequence
tgactgtatgtttgttccct

SEQ ID NO: 154641 - DNA, 20 bp, Artificial
  CRISPR gRNA sequence
cgaagatggacacagctata

SEQ ID NO: 154642 - DNA, 20 bp, Artificial
  CRISPR gRNA sequence
ataaacactgcattctatta

SEQ ID NO: 154643 - DNA, 20 bp, Artificial
  CRISPR gRNA sequence
attgcttaaccaccttcaag

SEQ ID NO: 154644 - DNA, 20 bp, Artificial
  CRISPR gRNA sequence
ttccaagaggaaaataatca

SEQ ID NO: 154645 - DNA, 20 bp, Artificial
  CRISPR gRNA sequence
agaggaaaataatcatggag

SEQ ID NO: 154646 - DNA, 20 bp, Artificial
  CRISPR gRNA sequence
ttaccactatttctctagtg

SEQ ID NO: 154647 - DNA, 20 bp, Artificial
  CRISPR gRNA sequence
aagtttcttattgcctttat

SEQ ID NO: 154648 - DNA, 20 bp, Artificial
  CRISPR gRNA sequence
ttcctacatatgtatttttg

SEQ ID NO: 154649 - DNA, 20 bp, Artificial
  CRISPR gRNA sequence
ttcatgcaggatgctgccat

SEQ ID NO: 154650 - DNA, 20 bp, Artificial
  CRISPR gRNA sequence
attttacaaagctaaaatca

SEQ ID NO: 154651 - DNA, 20 bp, Artificial
  CRISPR gRNA sequence
ctttaaagcaagtgaaggtc

SEQ ID NO: 154652 - DNA, 20 bp, Artificial
  CRISPR gRNA sequence
cacacacagaaagtgttaat

SEQ ID NO: 154653 - DNA, 20 bp, Artificial
  CRISPR gRNA sequence
cctttaccttgttgtacacg

SEQ ID NO: 154654 - DNA, 20 bp, Artificial
  CRISPR gRNA sequence
aacaggggtgtgcaaccaaa

SEQ ID NO: 154655 - DNA, 20 bp, Artificial
  CRISPR gRNA sequence
aggactctaccatgctcatt

SEQ ID NO: 154656 - DNA, 20 bp, Artificial
  CRISPR gRNA sequence
aactttagagtcagacattt

SEQ ID NO: 154657 - DNA, 20 bp, Artificial
  CRISPR gRNA sequence
agtcagacatttttgggctt

SEQ ID NO: 154658 - DNA, 20 bp, Artificial
  CRISPR gRNA sequence
agtcttctgtcaattctctt

SEQ ID NO: 154659 - DNA, 20 bp, Artificial
  CRISPR gRNA sequence
aattctctttcttgattctc

SEQ ID NO: 154660 - DNA, 20 bp, Artificial
  CRISPR gRNA sequence
taccaattttgatatttctc

SEQ ID NO: 154661 - DNA, 20 bp, Artificial
  CRISPR gRNA sequence
caaacttgctcttcctaaat

SEQ ID NO: 154662 - DNA, 20 bp, Artificial
  CRISPR gRNA sequence
atgccacatcactctactac

SEQ ID NO: 154663 - DNA, 20 bp, Artificial
  CRISPR gRNA sequence
atgtactttttgaatcatga

SEQ ID NO: 154664 - DNA, 20 bp, Artificial
  CRISPR gRNA sequence
cctgagtctacacccagtta

SEQ ID NO: 154665 - DNA, 20 bp, Artificial
  CRISPR gRNA sequence
cctcctctgaattctgtgta

SEQ ID NO: 154666 - DNA, 20 bp, Artificial
  CRISPR gRNA sequence
attttgcttgttctttccat

SEQ ID NO: 154667 - DNA, 20 bp, Artificial
  CRISPR gRNA sequence
ttccttgaaagtaagaacta

SEQ ID NO: 154668 - DNA, 20 bp, Artificial
  CRISPR gRNA sequence
tcaattgagcaggtcttccc

SEQ ID NO: 154669 - DNA, 20 bp, Artificial
  CRISPR gRNA sequence
actttaaagttaaacattta

SEQ ID NO: 154670 - DNA, 20 bp, Artificial
  CRISPR gRNA sequence
atttaccttcattccttatc

SEQ ID NO: 154671 - DNA, 20 bp, Artificial
  CRISPR gRNA sequence
tcaattattgaacagcgggg

SEQ ID NO: 154672 - DNA, 20 bp, Artificial
  CRISPR gRNA sequence
atgctcacacctgtaaatgc

SEQ ID NO: 154673 - DNA, 20 bp, Artificial
  CRISPR gRNA sequence
atttctacaggaaaaaaaaa

SEQ ID NO: 154674 - DNA, 20 bp, Artificial
  CRISPR gRNA sequence
acaggaaaaaaaaaaaaagt

SEQ ID NO: 154675 - DNA, 20 bp, Artificial
  CRISPR gRNA sequence
aaaaaaaaaaagtttttgtt

SEQ ID NO: 154676 - DNA, 20 bp, Artificial
  CRISPR gRNA sequence
ggactacgcctggctaattt

SEQ ID NO: 154677 - DNA, 20 bp, Artificial
  CRISPR gRNA sequence
cggtgtttttttagtaaagg

SEQ ID NO: 154678 - DNA, 20 bp, Artificial
  CRISPR gRNA sequence
caccttggcctcccaaagtg

SEQ ID NO: 154679 - DNA, 20 bp, Artificial
  CRISPR gRNA sequence
tatttatttatttatttatt

SEQ ID NO: 154680 - DNA, 20 bp, Artificial
  CRISPR gRNA sequence
tattgttttgagacatggag

SEQ ID NO: 154681 - DNA, 20 bp, Artificial
  CRISPR gRNA sequence
gctcactgcaagctccgcct

SEQ ID NO: 154682 - DNA, 20 bp, Artificial
  CRISPR gRNA sequence
ttttgtatttttagtagaga

SEQ ID NO: 154683 - DNA, 20 bp, Artificial
  CRISPR gRNA sequence
tgcctcggcctcccaaagtg

SEQ ID NO: 154684 - DNA, 20 bp, Artificial
  CRISPR gRNA sequence
ctcggaggctgaggtgggag

SEQ ID NO: 154685 - DNA, 20 bp, Artificial
  CRISPR gRNA sequence
tgggaggactgcttgagccc

SEQ ID NO: 154686 - DNA, 20 bp, Artificial
  CRISPR gRNA sequence
gagtttaaggttgcagtgat

SEQ ID NO: 154687 - DNA, 20 bp, Artificial
  CRISPR gRNA sequence
ttattttgggtgtctataaa

SEQ ID NO: 154688 - DNA, 20 bp, Artificial
  CRISPR gRNA sequence
attcctattttagtcttgtc

SEQ ID NO: 154689 - DNA, 20 bp, Artificial
  CRISPR gRNA sequence
gcttaaaatgaccctggaat

SEQ ID NO: 154690 - DNA, 20 bp, Artificial
  CRISPR gRNA sequence
tctttgtttattaaatacag

SEQ ID NO: 154691 - DNA, 20 bp, Artificial
  CRISPR gRNA sequence
aggtccaaacttttttggga

SEQ ID NO: 154692 - DNA, 20 bp, Artificial
  CRISPR gRNA sequence
aacaacaacaaaaaacacta

SEQ ID NO: 154693 - DNA, 20 bp, Artificial
  CRISPR gRNA sequence
cactaactggcttgcaggtg

SEQ ID NO: 154694 - DNA, 20 bp, Artificial
  CRISPR gRNA sequence
ctcataatgcataaaagtaa

SEQ ID NO: 154695 - DNA, 20 bp, Artificial
  CRISPR gRNA sequence
atacctcacaggtgaacacc

SEQ ID NO: 154696 - DNA, 20 bp, Artificial
  CRISPR gRNA sequence
cattagcttcctagctggtt

SEQ ID NO: 154697 - DNA, 20 bp, Artificial
  CRISPR gRNA sequence
gttcctaaaaagctgaaaga

SEQ ID NO: 154698 - DNA, 20 bp, Artificial
  CRISPR gRNA sequence
gggaactagactagatccct

SEQ ID NO: 154699 - DNA, 20 bp, Artificial
  CRISPR gRNA sequence
tctttaaaagggagacctca

SEQ ID NO: 154700 - DNA, 20 bp, Artificial
  CRISPR gRNA sequence
aaaacaaaagcccaaagtga

SEQ ID NO: 154701 - DNA, 20 bp, Artificial
  CRISPR gRNA sequence
aagcccaaagtgaccacgat

SEQ ID NO: 154702 - DNA, 20 bp, Artificial
  CRISPR gRNA sequence
ccaaacctcattctgtctga

SEQ ID NO: 154703 - DNA, 20 bp, Artificial
  CRISPR gRNA sequence
agatgacactgggcatgcag

SEQ ID NO: 154704 - DNA, 20 bp, Artificial
  CRISPR gRNA sequence
ctagattaaaagaaaccccc

SEQ ID NO: 154705 - DNA, 20 bp, Artificial
  CRISPR gRNA sequence
atcaactgtgtgaaatttat

SEQ ID NO: 154706 - DNA, 20 bp, Artificial
  CRISPR gRNA sequence
atggctcatgcctgtaatcc

SEQ ID NO: 154707 - DNA, 20 bp, Artificial
  CRISPR gRNA sequence
caggaggatcacttgagtcc

SEQ ID NO: 154708 - DNA, 20 bp, Artificial
  CRISPR gRNA sequence
ctactcaggaggctgaagta

SEQ ID NO: 154709 - DNA, 20 bp, Artificial
  CRISPR gRNA sequence
tcaggaggctgaagtaggag

SEQ ID NO: 154710 - DNA, 20 bp, Artificial
  CRISPR gRNA sequence
aggcattaatcccaacattt

SEQ ID NO: 154711 - DNA, 20 bp, Artificial
  CRISPR gRNA sequence
cagcaggctataattacctc

SEQ ID NO: 154712 - DNA, 20 bp, Artificial
  CRISPR gRNA sequence
caaacaaaaaaaaaaatggt

SEQ ID NO: 154713 - DNA, 20 bp, Artificial
  CRISPR gRNA sequence
atacaaactaaatatgtaac

SEQ ID NO: 154714 - DNA, 20 bp, Artificial
  CRISPR gRNA sequence
aatctcataatgcaaatgga

SEQ ID NO: 154715 - DNA, 20 bp, Artificial
  CRISPR gRNA sequence
taatgcaaatggaacaggct

SEQ ID NO: 154716 - DNA, 20 bp, Artificial
  CRISPR gRNA sequence
gagaggttcctaaatctaac

SEQ ID NO: 154717 - DNA, 20 bp, Artificial
  CRISPR gRNA sequence
aataggaatatgcaggtgaa

SEQ ID NO: 154718 - DNA, 20 bp, Artificial
  CRISPR gRNA sequence
gcagtttaaaaagaaatgtg

SEQ ID NO: 154719 - DNA, 20 bp, Artificial
  CRISPR gRNA sequence
gatgccacacctatcttcat

SEQ ID NO: 154720 - DNA, 20 bp, Artificial
  CRISPR gRNA sequence
acgtttcatcccccaaatag

SEQ ID NO: 154721 - DNA, 20 bp, Artificial
  CRISPR gRNA sequence
aagctggtgataaaggtgag

SEQ ID NO: 154722 - DNA, 20 bp, Artificial
  CRISPR gRNA sequence
gtctttgctctttctggaag

SEQ ID NO: 154723 - DNA, 20 bp, Artificial
  CRISPR gRNA sequence
taaaaaataacttagtcatc

SEQ ID NO: 154724 - DNA, 20 bp, Artificial
  CRISPR gRNA sequence
aagccaaatccacaaagttc

SEQ ID NO: 154725 - DNA, 20 bp, Artificial
  CRISPR gRNA sequence
atccacaaagttctcaagtt

SEQ ID NO: 154726 - DNA, 20 bp, Artificial
  CRISPR gRNA sequence
agggtcaagtcagcacctac

SEQ ID NO: 154727 - DNA, 20 bp, Artificial
  CRISPR gRNA sequence
atccccttcactaagaaccc

SEQ ID NO: 154728 - DNA, 20 bp, Artificial
  CRISPR gRNA sequence
cagtctcttttcatcttaaa

SEQ ID NO: 154729 - DNA, 20 bp, Artificial
  CRISPR gRNA sequence
cttcaatctttcaactcccc

SEQ ID NO: 154730 - DNA, 20 bp, Artificial
  CRISPR gRNA sequence
tgtattatagatcttagtat

SEQ ID NO: 154731 - DNA, 20 bp, Artificial
  CRISPR gRNA sequence
tagatcttagtatgtgggat

SEQ ID NO: 154732 - DNA, 20 bp, Artificial
  CRISPR gRNA sequence
gttcatgagaactggctggt

SEQ ID NO: 154733 - DNA, 20 bp, Artificial
  CRISPR gRNA sequence
gttactgattagcaacctac

SEQ ID NO: 154734 - DNA, 20 bp, Artificial
  CRISPR gRNA sequence
aactttcctattcacaaact

SEQ ID NO: 154735 - DNA, 20 bp, Artificial
  CRISPR gRNA sequence
gctaaaatgtgcattaaaaa

SEQ ID NO: 154736 - DNA, 20 bp, Artificial
  CRISPR gRNA sequence
caaatttctaacagcaacag

SEQ ID NO: 154737 - DNA, 20 bp, Artificial
  CRISPR gRNA sequence
tagaaaaactctcacaacaa

SEQ ID NO: 154738 - DNA, 20 bp, Artificial
  CRISPR gRNA sequence
caacccagcttattccgtag

SEQ ID NO: 154739 - DNA, 20 bp, Artificial
  CRISPR gRNA sequence
gaaaattatttggaaaacag

SEQ ID NO: 154740 - DNA, 20 bp, Artificial
  CRISPR gRNA sequence
tttacccaatgcaaagagaa

SEQ ID NO: 154741 - DNA, 20 bp, Artificial
  CRISPR gRNA sequence
ccaatgcaaagagaaaagtg

SEQ ID NO: 154742 - DNA, 20 bp, Artificial
  CRISPR gRNA sequence
tgcttctgtgtgcccctgaa

SEQ ID NO: 154743 - DNA, 20 bp, Artificial
  CRISPR gRNA sequence
gtctacactctctgaagcta

SEQ ID NO: 154744 - DNA, 20 bp, Artificial
  CRISPR gRNA sequence
cacagtggtcccattggctg

SEQ ID NO: 154745 - DNA, 20 bp, Artificial
  CRISPR gRNA sequence
tatcggctaagaacacaaag

SEQ ID NO: 154746 - DNA, 20 bp, Artificial
  CRISPR gRNA sequence
gcaggggtcagctgaaagac

SEQ ID NO: 154747 - DNA, 20 bp, Artificial
  CRISPR gRNA sequence
ctttgttttgtgttgaaatg

SEQ ID NO: 154748 - DNA, 20 bp, Artificial
  CRISPR gRNA sequence
gtgtagacaagttgcactgt

SEQ ID NO: 154749 - DNA, 20 bp, Artificial
  CRISPR gRNA sequence
atgcataccttttggtgcac

SEQ ID NO: 154750 - DNA, 20 bp, Artificial
  CRISPR gRNA sequence
atcgacaagatcaggtacat

SEQ ID NO: 154751 - DNA, 20 bp, Artificial
  CRISPR gRNA sequence
tggaagcaacactgttgctg

SEQ ID NO: 154752 - DNA, 20 bp, Artificial
  CRISPR gRNA sequence
tttttaatgcacattttagc

SEQ ID NO: 154753 - DNA, 20 bp, Artificial
  CRISPR gRNA sequence
attttagcttagaatgctgg

SEQ ID NO: 154754 - DNA, 20 bp, Artificial
  CRISPR gRNA sequence
gagtgaactgcctaacagat

SEQ ID NO: 154755 - DNA, 20 bp, Artificial
  CRISPR gRNA sequence
tttgtgaaagttttggggaa

SEQ ID NO: 154756 - DNA, 20 bp, Artificial
  CRISPR gRNA sequence
gggaattagaatgcttataa

SEQ ID NO: 154757 - DNA, 20 bp, Artificial
  CRISPR gRNA sequence
aggttcttcaccattctctt

SEQ ID NO: 154758 - DNA, 20 bp, Artificial
  CRISPR gRNA sequence
taaatgtttactagacaaat

SEQ ID NO: 154759 - DNA, 20 bp, Artificial
  CRISPR gRNA sequence
aaatgaagaaaactttgctt

SEQ ID NO: 154760 - DNA, 20 bp, Artificial
  CRISPR gRNA sequence
atgaagataggtgtggcatc

SEQ ID NO: 154761 - DNA, 20 bp, Artificial
  CRISPR gRNA sequence
tactcatcaagatccttgtg

SEQ ID NO: 154762 - DNA, 20 bp, Artificial
  CRISPR gRNA sequence
tgtcaaaatttaaggacctc

SEQ ID NO: 154763 - DNA, 20 bp, Artificial
  CRISPR gRNA sequence
ttgttagatttaggaacctc

SEQ ID NO: 154764 - DNA, 20 bp, Artificial
  CRISPR gRNA sequence
aaaaaataattgatctctca

SEQ ID NO: 154765 - DNA, 20 bp, Artificial
  CRISPR gRNA sequence
tgcttcctatctgtgcattg

SEQ ID NO: 154766 - DNA, 20 bp, Artificial
  CRISPR gRNA sequence
attggaagaatcatattcag

SEQ ID NO: 154767 - DNA, 20 bp, Artificial
  CRISPR gRNA sequence
tgtttgggtatagaaggaac

SEQ ID NO: 154768 - DNA, 20 bp, Artificial
  CRISPR gRNA sequence
ctttacctgaagtgtgttgg

SEQ ID NO: 154769 - DNA, 20 bp, Artificial
  CRISPR gRNA sequence
tcagccagttagttgcttat

SEQ ID NO: 154770 - DNA, 20 bp, Artificial
  CRISPR gRNA sequence
gtgttcacctgtgaggtatt

SEQ ID NO: 154771 - DNA, 20 bp, Artificial
  CRISPR gRNA sequence
acaaaagttatagtccattg

SEQ ID NO: 154772 - DNA, 20 bp, Artificial
  CRISPR gRNA sequence
attataatagacatagctgg

SEQ ID NO: 154773 - DNA, 20 bp, Artificial
  CRISPR gRNA sequence
ctactcggcaggctgaggca

SEQ ID NO: 154774 - DNA, 20 bp, Artificial
  CRISPR gRNA sequence
ctatacaggaggctgaggca

SEQ ID NO: 154775 - DNA, 20 bp, Artificial
  CRISPR gRNA sequence
aacagagtgagattccgtct

SEQ ID NO: 154776 - DNA, 20 bp, Artificial
  CRISPR gRNA sequence
aaactttttttttttttcct

SEQ ID NO: 154777 - DNA, 20 bp, Artificial
  CRISPR gRNA sequence
tccagtataaaggaagaact

SEQ ID NO: 154778 - DNA, 20 bp, Artificial
  CRISPR gRNA sequence
gaccttgtgttccttagttc

SEQ ID NO: 154779 - DNA, 20 bp, Artificial
  CRISPR gRNA sequence
gtttccatagtttcaattac

SEQ ID NO: 154780 - DNA, 20 bp, Artificial
  CRISPR gRNA sequence
ctgatgatgtttatcaagta

SEQ ID NO: 154781 - DNA, 20 bp, Artificial
  CRISPR gRNA sequence
ggaaagaacaagcaaaatac

SEQ ID NO: 154782 - DNA, 20 bp, Artificial
  CRISPR gRNA sequence
aaggacaggaaggagtggta

SEQ ID NO: 154783 - DNA, 20 bp, Artificial
  CRISPR gRNA sequence
aagggccttgtttgctaggc

SEQ ID NO: 154784 - DNA, 20 bp, Artificial
  CRISPR gRNA sequence
taggtagtaacataaagggc

SEQ ID NO: 154785 - DNA, 20 bp, Artificial
  CRISPR gRNA sequence
aacagagatagtggtagtat

SEQ ID NO: 154786 - DNA, 20 bp, Artificial
  CRISPR gRNA sequence
cactgttggacactgttact

SEQ ID NO: 154787 - DNA, 20 bp, Artificial
  CRISPR gRNA sequence
ctatagaatttagcagctga

SEQ ID NO: 154788 - DNA, 20 bp, Artificial
  CRISPR gRNA sequence
gattagaattgaggaacaga

SEQ ID NO: 154789 - DNA, 20 bp, Artificial
  CRISPR gRNA sequence
ccagtctgggtgactggagg

SEQ ID NO: 154790 - DNA, 20 bp, Artificial
  CRISPR gRNA sequence
tgggtgactggaggatagaa

SEQ ID NO: 154791 - DNA, 20 bp, Artificial
  CRISPR gRNA sequence
acatgaaggactgaagcttt

SEQ ID NO: 154792 - DNA, 20 bp, Artificial
  CRISPR gRNA sequence
gaacctaggggacaaacagg

SEQ ID NO: 154793 - DNA, 20 bp, Artificial
  CRISPR gRNA sequence
ggggacaaacaggagagaat

SEQ ID NO: 154794 - DNA, 20 bp, Artificial
  CRISPR gRNA sequence
aaacaggagagaatcaagaa

SEQ ID NO: 154795 - DNA, 20 bp, Artificial
  CRISPR gRNA sequence
aaaatgtctgactctaaagt

SEQ ID NO: 154796 - DNA, 20 bp, Artificial
  CRISPR gRNA sequence
tgactctaaagttgagaaat

SEQ ID NO: 154797 - DNA, 20 bp, Artificial
  CRISPR gRNA sequence
ctgagtgtgcatttcccatg

SEQ ID NO: 154798 - DNA, 20 bp, Artificial
  CRISPR gRNA sequence
agtattagtttactaaaaat

SEQ ID NO: 154799 - DNA, 20 bp, Artificial
  CRISPR gRNA sequence
gtgccttgataagtaaaaga

SEQ ID NO: 154800 - DNA, 20 bp, Artificial
  CRISPR gRNA sequence
aaaagactagaaatacttcc

SEQ ID NO: 154801 - DNA, 20 bp, Artificial
  CRISPR gRNA sequence
agcctcatctgtaggattta

SEQ ID NO: 154802 - DNA, 20 bp, Artificial
  CRISPR gRNA sequence
tcaatctaaaataaaggcaa

SEQ ID NO: 154803 - DNA, 20 bp, Artificial
  CRISPR gRNA sequence
gcaataagaaacttttcact

SEQ ID NO: 154804 - DNA, 20 bp, Artificial
  CRISPR gRNA sequence
gaaggtggttaagcaatgta

SEQ ID NO: 154805 - DNA, 20 bp, Artificial
  CRISPR gRNA sequence
atcatcccccattttgaggg

SEQ ID NO: 154806 - DNA, 20 bp, Artificial
  CRISPR gRNA sequence
ttttccaaatagatatgtgg

SEQ ID NO: 154807 - DNA, 20 bp, Artificial
  CRISPR gRNA sequence
ctataattttgaaacactgc

SEQ ID NO: 154808 - DNA, 20 bp, Artificial
  CRISPR gRNA sequence
aggctcttcttctgaattat

SEQ ID NO: 154809 - DNA, 20 bp, Artificial
  CRISPR gRNA sequence
gacttcccatcaccaggccc

SEQ ID NO: 154810 - DNA, 20 bp, Artificial
  CRISPR gRNA sequence
gctttctactttgaaatgtt

SEQ ID NO: 154811 - DNA, 20 bp, Artificial
  CRISPR gRNA sequence
ggtggatttgtgttccaggc

SEQ ID NO: 154812 - DNA, 20 bp, Artificial
  CRISPR gRNA sequence
ttaatgaaagagcacagaac

SEQ ID NO: 154813 - DNA, 20 bp, Artificial
  CRISPR gRNA sequence
cttatcttatgtgtttatgg

SEQ ID NO: 154814 - DNA, 20 bp, Artificial
  CRISPR gRNA sequence
taaaagacactaaacagagg

SEQ ID NO: 154815 - DNA, 20 bp, Artificial
  CRISPR gRNA sequence
ttcacagtgtatctgaatga

SEQ ID NO: 154816 - DNA, 20 bp, Artificial
  CRISPR gRNA sequence
gaatgagcagaatctagaca

SEQ ID NO: 154817 - DNA, 20 bp, Artificial
  CRISPR gRNA sequence
agaaggaattttcccatttc

SEQ ID NO: 154818 - DNA, 20 bp, Artificial
  CRISPR gRNA sequence
cccatttcaaagaaaagtac

SEQ ID NO: 154819 - DNA, 20 bp, Artificial
  CRISPR gRNA sequence
atatttgccttgagggtgta

SEQ ID NO: 154820 - DNA, 20 bp, Artificial
  CRISPR gRNA sequence
agcaagtgaatatgctaatt

SEQ ID NO: 154821 - DNA, 20 bp, Artificial
  CRISPR gRNA sequence
tgccaggaatggtttcttgg

SEQ ID NO: 154822 - DNA, 20 bp, Artificial
  CRISPR gRNA sequence
tttcaacccatgagatagtc

SEQ ID NO: 154823 - DNA, 20 bp, Artificial
  CRISPR gRNA sequence
agctctctttagagctccaa

SEQ ID NO: 154824 - DNA, 20 bp, Artificial
  CRISPR gRNA sequence
cagcccaaggagacatattc

SEQ ID NO: 154825 - DNA, 20 bp, Artificial
  CRISPR gRNA sequence
ctacttgggaggctgaggca

SEQ ID NO: 154826 - DNA, 20 bp, Artificial
  CRISPR gRNA sequence
aataaataattaatttaaaa

SEQ ID NO: 154827 - DNA, 20 bp, Artificial
  CRISPR gRNA sequence
atgtttttggattagtgtgg

SEQ ID NO: 154828 - DNA, 20 bp, Artificial
  CRISPR gRNA sequence
catctgaaactaggcttttt

SEQ ID NO: 154829 - DNA, 20 bp, Artificial
  CRISPR gRNA sequence
gcaaagtaagtctaaattat

SEQ ID NO: 154830 - DNA, 20 bp, Artificial
  CRISPR gRNA sequence
atgcaaaggggaaggataaa

SEQ ID NO: 154831 - DNA, 20 bp, Artificial
  CRISPR gRNA sequence
aaggggaaggataaaacaga

SEQ ID NO: 154832 - DNA, 20 bp, Artificial
  CRISPR gRNA sequence
gcaagttataataaatcaag

SEQ ID NO: 154833 - DNA, 20 bp, Artificial
  CRISPR gRNA sequence
tggcatctatgaaacattct

SEQ ID NO: 154834 - DNA, 20 bp, Artificial
  CRISPR gRNA sequence
cacacaaacacaggatactg

SEQ ID NO: 154835 - DNA, 20 bp, Artificial
  CRISPR gRNA sequence
gaatctcagaaggcacccgg

SEQ ID NO: 154836 - DNA, 20 bp, Artificial
  CRISPR gRNA sequence
taagaaaatgatgctttgtt

SEQ ID NO: 154837 - DNA, 20 bp, Artificial
  CRISPR gRNA sequence
aacagtgctttaaaacaaga

SEQ ID NO: 154838 - DNA, 20 bp, Artificial
  CRISPR gRNA sequence
ctgcttgggaggctgaggtg

SEQ ID NO: 154839 - DNA, 20 bp, Artificial
  CRISPR gRNA sequence
gtagtttttagacccttgct

SEQ ID NO: 154840 - DNA, 20 bp, Artificial
  CRISPR gRNA sequence
ttgagcattgaaaggatgag

SEQ ID NO: 154841 - DNA, 20 bp, Artificial
  CRISPR gRNA sequence
tacatatcgttttctattcc

SEQ ID NO: 154842 - DNA, 20 bp, Artificial
  CRISPR gRNA sequence
tatattgtactagataccaa

SEQ ID NO: 154843 - DNA, 20 bp, Artificial
  CRISPR gRNA sequence
gtacccagctatgtaagggt

SEQ ID NO: 154844 - DNA, 20 bp, Artificial
  CRISPR gRNA sequence
ttggagagtataagccttct

SEQ ID NO: 154845 - DNA, 20 bp, Artificial
  CRISPR gRNA sequence
aaaccttagctcatttaaat

SEQ ID NO: 154846 - DNA, 20 bp, Artificial
  CRISPR gRNA sequence
tactctttggtccatgggct

SEQ ID NO: 154847 - DNA, 20 bp, Artificial
  CRISPR gRNA sequence
gctactcgggaggctgggca

SEQ ID NO: 154848 - DNA, 20 bp, Artificial
  CRISPR gRNA sequence
ttgtataattcttaagggcc

SEQ ID NO: 154849 - DNA, 20 bp, Artificial
  CRISPR gRNA sequence
cctcacctctctcagccttc

SEQ ID NO: 154850 - DNA, 20 bp, Artificial
  CRISPR gRNA sequence
tgtttgattataatattgat

SEQ ID NO: 154851 - DNA, 20 bp, Artificial
  CRISPR gRNA sequence
ttataatattgatgaagaaa

SEQ ID NO: 154852 - DNA, 20 bp, Artificial
  CRISPR gRNA sequence
gtttggtgatgtttttgtga

SEQ ID NO: 154853 - DNA, 20 bp, Artificial
  CRISPR gRNA sequence
taattggaagcagcattggt

SEQ ID NO: 154854 - DNA, 20 bp, Artificial
  CRISPR gRNA sequence
actataaaagagtttggtat

SEQ ID NO: 154855 - DNA, 20 bp, Artificial
  CRISPR gRNA sequence
aagtctaaaggtcctgagtt

SEQ ID NO: 154856 - DNA, 20 bp, Artificial
  CRISPR gRNA sequence
tgaagtttcatttttttctt

SEQ ID NO: 154857 - DNA, 20 bp, Artificial
  CRISPR gRNA sequence
actttgaaaagatttacact

SEQ ID NO: 154858 - DNA, 20 bp, Artificial
  CRISPR gRNA sequence
tacaaggtaatgtggtgagg

SEQ ID NO: 154859 - DNA, 20 bp, Artificial
  CRISPR gRNA sequence
tcccaagggagggaccagtt

SEQ ID NO: 154860 - DNA, 20 bp, Artificial
  CRISPR gRNA sequence
gaccagttccagaaagcagt

SEQ ID NO: 154861 - DNA, 20 bp, Artificial
  CRISPR gRNA sequence
acagagcgaaaccctggctt

SEQ ID NO: 154862 - DNA, 20 bp, Artificial
  CRISPR gRNA sequence
ctttgagaaaaaaaaaatag

SEQ ID NO: 154863 - DNA, 20 bp, Artificial
  CRISPR gRNA sequence
taatgtattttgtgttttta

SEQ ID NO: 154864 - DNA, 20 bp, Artificial
  CRISPR gRNA sequence
tattatcctagaagatgaac

SEQ ID NO: 154865 - DNA, 20 bp, Artificial
  CRISPR gRNA sequence
gtgtttttaaagctccatgc

SEQ ID NO: 154866 - DNA, 20 bp, Artificial
  CRISPR gRNA sequence
taataatatctgcaaagatg

SEQ ID NO: 154867 - DNA, 20 bp, Artificial
  CRISPR gRNA sequence
tagagctgtccaaagatggg

SEQ ID NO: 154868 - DNA, 20 bp, Artificial
  CRISPR gRNA sequence
aagctggttgaacacttaag

SEQ ID NO: 154869 - DNA, 20 bp, Artificial
  CRISPR gRNA sequence
cccggggttgggcagaggtt

SEQ ID NO: 154870 - DNA, 20 bp, Artificial
  CRISPR gRNA sequence
ggggggatatcagaggacag

SEQ ID NO: 154871 - DNA, 20 bp, Artificial
  CRISPR gRNA sequence
tttgataattattattattt

SEQ ID NO: 154872 - DNA, 20 bp, Artificial
  CRISPR gRNA sequence
ttcattttcatgagtacctt

SEQ ID NO: 154873 - DNA, 20 bp, Artificial
  CRISPR gRNA sequence
acacttccctttaactccct

SEQ ID NO: 154874 - DNA, 20 bp, Artificial
  CRISPR gRNA sequence
atcatattgtatcccaggta

SEQ ID NO: 154875 - DNA, 20 bp, Artificial
  CRISPR gRNA sequence
ctgtttataggcctccacca

SEQ ID NO: 154876 - DNA, 20 bp, Artificial
  CRISPR gRNA sequence
cacccactaatgtcattaca

SEQ ID NO: 154877 - DNA, 20 bp, Artificial
  CRISPR gRNA sequence
aggaaaagggaaggaaaaaa

SEQ ID NO: 154878 - DNA, 20 bp, Artificial
  CRISPR gRNA sequence
ggtgctttgctttcagcccc

SEQ ID NO: 154879 - DNA, 20 bp, Artificial
  CRISPR gRNA sequence
aaaccttttcaaataattcc

SEQ ID NO: 154880 - DNA, 20 bp, Artificial
  CRISPR gRNA sequence
ctactcaggaggctgaggca

SEQ ID NO: 154881 - DNA, 20 bp, Artificial
  CRISPR gRNA sequence
atttctggtccccaggcatt

SEQ ID NO: 154882 - DNA, 20 bp, Artificial
  CRISPR gRNA sequence
taatcatcatcaggagcccc

SEQ ID NO: 154883 - DNA, 20 bp, Artificial
  CRISPR gRNA sequence
tcacagtgtctaaaacaaaa

SEQ ID NO: 154884 - DNA, 20 bp, Artificial
  CRISPR gRNA sequence
atcactggggacttttaata

SEQ ID NO: 154885 - DNA, 20 bp, Artificial
  CRISPR gRNA sequence
agaacttgaaaaagctttgg

SEQ ID NO: 154886 - DNA, 20 bp, Artificial
  CRISPR gRNA sequence
tatacaaatgcctaatctgg

SEQ ID NO: 154887 - DNA, 20 bp, Artificial
  CRISPR gRNA sequence
cgttctggcctcgggtcatg

SEQ ID NO: 154888 - DNA, 20 bp, Artificial
  CRISPR gRNA sequence
cggaatttaacagtggtgag

SEQ ID NO: 154889 - DNA, 20 bp, Artificial
  CRISPR gRNA sequence
ttaacagtggtgaggaagaa

SEQ ID NO: 154890 - DNA, 20 bp, Artificial
  CRISPR gRNA sequence
ggaagaatgagaaactttta

SEQ ID NO: 154891 - DNA, 20 bp, Artificial
  CRISPR gRNA sequence
aggcatatcctttaggactt

SEQ ID NO: 154892 - DNA, 20 bp, Artificial
  CRISPR gRNA sequence
ccctccccgagttgtgacaa

SEQ ID NO: 154893 - DNA, 20 bp, Artificial
  CRISPR gRNA sequence
ccttgttgagaactactgac

SEQ ID NO: 154894 - DNA, 20 bp, Artificial
  CRISPR gRNA sequence
ttacaatctagtaattacaa

SEQ ID NO: 154895 - DNA, 20 bp, Artificial
  CRISPR gRNA sequence
acagttgtcatgtccttaat

SEQ ID NO: 154896 - DNA, 20 bp, Artificial
  CRISPR gRNA sequence
acactggattccttcctgat

SEQ ID NO: 154897 - DNA, 20 bp, Artificial
  CRISPR gRNA sequence
cattgttatggaacttacct

SEQ ID NO: 154898 - DNA, 20 bp, Artificial
  CRISPR gRNA sequence
ttttttccactttacagtgg

SEQ ID NO: 154899 - DNA, 20 bp, Artificial
  CRISPR gRNA sequence
atcctttttttttttttaag

SEQ ID NO: 154900 - DNA, 20 bp, Artificial
  CRISPR gRNA sequence
ttagtctatcagaagttaaa

SEQ ID NO: 154901 - DNA, 20 bp, Artificial
  CRISPR gRNA sequence
ggttcaagttttgtgggtga

SEQ ID NO: 154902 - DNA, 20 bp, Artificial
  CRISPR gRNA sequence
caagttttgtgggtgaagag

SEQ ID NO: 154903 - DNA, 20 bp, Artificial
  CRISPR gRNA sequence
acatcaattccatatttgag

SEQ ID NO: 154904 - DNA, 20 bp, Artificial
  CRISPR gRNA sequence
cacaatatctaacagattaa

SEQ ID NO: 154905 - DNA, 20 bp, Artificial
  CRISPR gRNA sequence
ccaatcataagtaaaactta

SEQ ID NO: 154906 - DNA, 20 bp, Artificial
  CRISPR gRNA sequence
ggcctctttgaaaataggaa

SEQ ID NO: 154907 - DNA, 20 bp, Artificial
  CRISPR gRNA sequence
gcaacaatgctgaatttcga

SEQ ID NO: 154908 - DNA, 20 bp, Artificial
  CRISPR gRNA sequence
tctaggtagcacactcctta

SEQ ID NO: 154909 - DNA, 20 bp, Artificial
  CRISPR gRNA sequence
ctaacctgcagccccaagat

SEQ ID NO: 154910 - DNA, 20 bp, Artificial
  CRISPR gRNA sequence
aatcattgatttcaaagggt

SEQ ID NO: 154911 - DNA, 20 bp, Artificial
  CRISPR gRNA sequence
tttggtagtggtcaggagca

SEQ ID NO: 154912 - DNA, 20 bp, Artificial
  CRISPR gRNA sequence
tagaaggctaggataggatt

SEQ ID NO: 154913 - DNA, 20 bp, Artificial
  CRISPR gRNA sequence
atgaaaaaatagtttgtcac

SEQ ID NO: 154914 - DNA, 20 bp, Artificial
  CRISPR gRNA sequence
ttgttgcttttgattaaaga

SEQ ID NO: 154915 - DNA, 20 bp, Artificial
  CRISPR gRNA sequence
tgaaagagcaaggggaaaaa

SEQ ID NO: 154916 - DNA, 20 bp, Artificial
  CRISPR gRNA sequence
gagcaaggggaaaaacaaga

SEQ ID NO: 154917 - DNA, 20 bp, Artificial
  CRISPR gRNA sequence
gattttctgttggtcttgca

SEQ ID NO: 154918 - DNA, 20 bp, Artificial
  CRISPR gRNA sequence
agtcacatttcagaccactt

SEQ ID NO: 154919 - DNA, 20 bp, Artificial
  CRISPR gRNA sequence
actcaaaattgatttttttc

SEQ ID NO: 154920 - DNA, 20 bp, Artificial
  CRISPR gRNA sequence
ctcccccactccaggcttgt

SEQ ID NO: 154921 - DNA, 20 bp, Artificial
  CRISPR gRNA sequence
caaggccattgctactgtga

SEQ ID NO: 154922 - DNA, 20 bp, Artificial
  CRISPR gRNA sequence
ttgtcaggttagtgcaaatg

SEQ ID NO: 154923 - DNA, 20 bp, Artificial
  CRISPR gRNA sequence
gttagtttggtcactgaatg

SEQ ID NO: 154924 - DNA, 20 bp, Artificial
  CRISPR gRNA sequence
tttagaggaatacccctgag

SEQ ID NO: 154925 - DNA, 20 bp, Artificial
  CRISPR gRNA sequence
acctgcatatgttaagtaaa

SEQ ID NO: 154926 - DNA, 20 bp, Artificial
  CRISPR gRNA sequence
tgcatctcttgttgttcatt

SEQ ID NO: 154927 - DNA, 20 bp, Artificial
  CRISPR gRNA sequence
agtttgttgatctgaactct

SEQ ID NO: 154928 - DNA, 20 bp, Artificial
  CRISPR gRNA sequence
ccatctccattacagatctc

SEQ ID NO: 154929 - DNA, 20 bp, Artificial
  CRISPR gRNA sequence
taatagtcttttgtattttc

SEQ ID NO: 154930 - DNA, 20 bp, Artificial
  CRISPR gRNA sequence
ccctgtgagatttgatataa

SEQ ID NO: 154931 - DNA, 20 bp, Artificial
  CRISPR gRNA sequence
aactttgaaatcagacacat

SEQ ID NO: 154932 - DNA, 20 bp, Artificial
  CRISPR gRNA sequence
ttgaaaggctattataagag

SEQ ID NO: 154933 - DNA, 20 bp, Artificial
  CRISPR gRNA sequence
ctgttttcctgcgtggtgtt

SEQ ID NO: 154934 - DNA, 20 bp, Artificial
  CRISPR gRNA sequence
agagcccttggtcattgact

SEQ ID NO: 154935 - DNA, 20 bp, Artificial
  CRISPR gRNA sequence
cagtattttaacaatgaagc

SEQ ID NO: 154936 - DNA, 20 bp, Artificial
  CRISPR gRNA sequence
tgtttccctttacctacaaa

SEQ ID NO: 154937 - DNA, 20 bp, Artificial
  CRISPR gRNA sequence
cccttcaagatcaattcaga

SEQ ID NO: 154938 - DNA, 20 bp, Artificial
  CRISPR gRNA sequence
caaaacacttggacagacct

SEQ ID NO: 154939 - DNA, 20 bp, Artificial
  CRISPR gRNA sequence
gagatactgttttacaccca

SEQ ID NO: 154940 - DNA, 20 bp, Artificial
  CRISPR gRNA sequence
tgaaactcatatattgctgg

SEQ ID NO: 154941 - DNA, 20 bp, Artificial
  CRISPR gRNA sequence
ggattcctcctcagcaataa

SEQ ID NO: 154942 - DNA, 20 bp, Artificial
  CRISPR gRNA sequence
cattattaccacctatagtg

SEQ ID NO: 154943 - DNA, 20 bp, Artificial
  CRISPR gRNA sequence
atctatgtttccaaaatact

SEQ ID NO: 154944 - DNA, 20 bp, Artificial
  CRISPR gRNA sequence
ggccatcacagatacaaggg

SEQ ID NO: 154945 - DNA, 20 bp, Artificial
  CRISPR gRNA sequence
atcttttaattttattattc

SEQ ID NO: 154946 - DNA, 20 bp, Artificial
  CRISPR gRNA sequence
aaaggaagtatcacacttgg

SEQ ID NO: 154947 - DNA, 20 bp, Artificial
  CRISPR gRNA sequence
catagcacaaactatgaata

SEQ ID NO: 154948 - DNA, 20 bp, Artificial
  CRISPR gRNA sequence
catggtttaagtattgcaat

SEQ ID NO: 154949 - DNA, 20 bp, Artificial
  CRISPR gRNA sequence
aaacctaactttgctaaccc

SEQ ID NO: 154950 - DNA, 20 bp, Artificial
  CRISPR gRNA sequence
tttgctaacccacagaatga

SEQ ID NO: 154951 - DNA, 20 bp, Artificial
  CRISPR gRNA sequence
acaccgctcttctttgttac

SEQ ID NO: 154952 - DNA, 20 bp, Artificial
  CRISPR gRNA sequence
agagctcttcatctgggata

SEQ ID NO: 154953 - DNA, 20 bp, Artificial
  CRISPR gRNA sequence
tctgggataggagaatattc

SEQ ID NO: 154954 - DNA, 20 bp, Artificial
  CRISPR gRNA sequence
agttatagattttagatttt

SEQ ID NO: 154955 - DNA, 20 bp, Artificial
  CRISPR gRNA sequence
tatagtaccctgactgcaca

SEQ ID NO: 154956 - DNA, 20 bp, Artificial
  CRISPR gRNA sequence
tctaacccacatcagctgaa

SEQ ID NO: 154957 - DNA, 20 bp, Artificial
  CRISPR gRNA sequence
agctgttttgcaagcaatca

SEQ ID NO: 154958 - DNA, 20 bp, Artificial
  CRISPR gRNA sequence
gttttgcaagcaatcacaag

SEQ ID NO: 154959 - DNA, 20 bp, Artificial
  CRISPR gRNA sequence
gtgccacttgggaaattgtg

SEQ ID NO: 154960 - DNA, 20 bp, Artificial
  CRISPR gRNA sequence
gcctgtattaataaccagtc

SEQ ID NO: 154961 - DNA, 20 bp, Artificial
  CRISPR gRNA sequence
ctgctgggaaaaggaactag

SEQ ID NO: 154962 - DNA, 20 bp, Artificial
  CRISPR gRNA sequence
tgctggcttgacctccattg

SEQ ID NO: 154963 - DNA, 20 bp, Artificial
  CRISPR gRNA sequence
taaacaatcacaggtcacgg

SEQ ID NO: 154964 - DNA, 20 bp, Artificial
  CRISPR gRNA sequence
aagtcagttcatatattaac

SEQ ID NO: 154965 - DNA, 20 bp, Artificial
  CRISPR gRNA sequence
tcatatattaacttagaaac

SEQ ID NO: 154966 - DNA, 20 bp, Artificial
  CRISPR gRNA sequence
ggtaacagctgttgggttta

SEQ ID NO: 154967 - DNA, 20 bp, Artificial
  CRISPR gRNA sequence
gtctccactccgcagatcgg

SEQ ID NO: 154968 - DNA, 20 bp, Artificial
  CRISPR gRNA sequence
atgggtgattatttcgtact

SEQ ID NO: 154969 - DNA, 20 bp, Artificial
  CRISPR gRNA sequence
tctccaggatccctattagc

SEQ ID NO: 154970 - DNA, 20 bp, Artificial
  CRISPR gRNA sequence
taggggaggggatgagtagc

SEQ ID NO: 154971 - DNA, 20 bp, Artificial
  CRISPR gRNA sequence
gggaacagtggaaattaatc

SEQ ID NO: 154972 - DNA, 20 bp, Artificial
  CRISPR gRNA sequence
cacaggcaaaggctcagagg

SEQ ID NO: 154973 - DNA, 20 bp, Artificial
  CRISPR gRNA sequence
taaggagctgagtttgccta

SEQ ID NO: 154974 - DNA, 20 bp, Artificial
  CRISPR gRNA sequence
tgtctcaaaaacaaacacac

SEQ ID NO: 154975 - DNA, 20 bp, Artificial
  CRISPR gRNA sequence
tacccggggaggctgaggca

SEQ ID NO: 154976 - DNA, 20 bp, Artificial
  CRISPR gRNA sequence
gccaaaggctttatcccttt

SEQ ID NO: 154977 - DNA, 20 bp, Artificial
  CRISPR gRNA sequence
cctcattttcctgaaatgat

SEQ ID NO: 154978 - DNA, 20 bp, Artificial
  CRISPR gRNA sequence
atgcatttctttttagtcag

SEQ ID NO: 154979 - DNA, 20 bp, Artificial
  CRISPR gRNA sequence
gtgcaaatatccttcgtagg

SEQ ID NO: 154980 - DNA, 20 bp, Artificial
  CRISPR gRNA sequence
atgtattaaagcagagttgg

SEQ ID NO: 154981 - DNA, 20 bp, Artificial
  CRISPR gRNA sequence
ctgagttgaaaattgtggta

SEQ ID NO: 154982 - DNA, 20 bp, Artificial
  CRISPR gRNA sequence
aaaattgtggtacaagaatg

SEQ ID NO: 154983 - DNA, 20 bp, Artificial
  CRISPR gRNA sequence
attttcagtaacctatgcag

SEQ ID NO: 154984 - DNA, 20 bp, Artificial
  CRISPR gRNA sequence
tgcagtcagaattaagaaca

SEQ ID NO: 154985 - DNA, 20 bp, Artificial
  CRISPR gRNA sequence
tactaaaggtttgagatttg

SEQ ID NO: 154986 - DNA, 20 bp, Artificial
  CRISPR gRNA sequence
acaaccattgtgtgtgagag

SEQ ID NO: 154987 - DNA, 20 bp, Artificial
  CRISPR gRNA sequence
tgccaagtcatacacattgg

SEQ ID NO: 154988 - DNA, 20 bp, Artificial
  CRISPR gRNA sequence
taaatctgagattgctattt

SEQ ID NO: 154989 - DNA, 20 bp, Artificial
  CRISPR gRNA sequence
ctctcagtgtcttacatgcc

SEQ ID NO: 154990 - DNA, 20 bp, Artificial
  CRISPR gRNA sequence
taaatgaaacgtaggcaggt

SEQ ID NO: 154991 - DNA, 20 bp, Artificial
  CRISPR gRNA sequence
gttaacatagtaataggcca

SEQ ID NO: 154992 - DNA, 20 bp, Artificial
  CRISPR gRNA sequence
tttagcccagaagatttgtt

SEQ ID NO: 154993 - DNA, 20 bp, Artificial
  CRISPR gRNA sequence
ctgcaaagagctcttcccag

SEQ ID NO: 154994 - DNA, 20 bp, Artificial
  CRISPR gRNA sequence
tctcttggcatattctcagg

SEQ ID NO: 154995 - DNA, 20 bp, Artificial
  CRISPR gRNA sequence
ccatcttgttctcaaggggc

SEQ ID NO: 154996 - DNA, 20 bp, Artificial
  CRISPR gRNA sequence
ggaagcctcgaaggtgcctg

SEQ ID NO: 154997 - DNA, 20 bp, Artificial
  CRISPR gRNA sequence
acctcctcttgcatccctaa

SEQ ID NO: 154998 - DNA, 20 bp, Artificial
  CRISPR gRNA sequence
ctacttgggaggctgagaca

SEQ ID NO: 154999 - DNA, 20 bp, Artificial
  CRISPR gRNA sequence
tgggagaggctggggagaag

SEQ ID NO: 155000 - DNA, 20 bp, Artificial
  CRISPR gRNA sequence
ttggtttggagcccaccttc

SEQ ID NO: 155001 - DNA, 20 bp, Artificial
  CRISPR gRNA sequence
cctctactaacagtgagtgg

SEQ ID NO: 155002 - DNA, 20 bp, Artificial
  CRISPR gRNA sequence
cattttcagtccatgcgagg

SEQ ID NO: 155003 - DNA, 20 bp, Artificial
  CRISPR gRNA sequence
acctccttagcagggtccat

SEQ ID NO: 155004 - DNA, 20 bp, Artificial
  CRISPR gRNA sequence
tcaacctgagccagatattc

SEQ ID NO: 155005 - DNA, 20 bp, Artificial
  CRISPR gRNA sequence
ctgggggccgagattctcca

SEQ ID NO: 155006 - DNA, 20 bp, Artificial
  CRISPR gRNA sequence
ttttcttgaagagtgtggtt

SEQ ID NO: 155007 - DNA, 20 bp, Artificial
  CRISPR gRNA sequence
ccccatgaatgcccccagac

SEQ ID NO: 155008 - DNA, 20 bp, Artificial
  CRISPR gRNA sequence
cctagtttcctgggtccctg

SEQ ID NO: 155009 - DNA, 20 bp, Artificial
  CRISPR gRNA sequence
taaatctgtctcttaaatgc

SEQ ID NO: 155010 - DNA, 20 bp, Artificial
  CRISPR gRNA sequence
gtagcagctgttcccagagt

SEQ ID NO: 155011 - DNA, 20 bp, Artificial
  CRISPR gRNA sequence
ggcagtaacaaacaaaaaaa

SEQ ID NO: 155012 - DNA, 20 bp, Artificial
  CRISPR gRNA sequence
aaaaaaaaagaaaaacaaaa

SEQ ID NO: 155013 - DNA, 20 bp, Artificial
  CRISPR gRNA sequence
atttcttcaaccacactctt

SEQ ID NO: 155014 - DNA, 20 bp, Artificial
  CRISPR gRNA sequence
tattgaaatattgattcctt

SEQ ID NO: 155015 - DNA, 20 bp, Artificial
  CRISPR gRNA sequence
aaatattgcatctttctgct

SEQ ID NO: 155016 - DNA, 20 bp, Artificial
  CRISPR gRNA sequence
cccctcctctccttcttttc

SEQ ID NO: 155017 - DNA, 20 bp, Artificial
  CRISPR gRNA sequence
acctctgtctgtgtaatctg

SEQ ID NO: 155018 - DNA, 20 bp, Artificial
  CRISPR gRNA sequence
ttggcagcacaaagtgacat

SEQ ID NO: 155019 - DNA, 20 bp, Artificial
  CRISPR gRNA sequence
ctctgggccaaaggagggga

SEQ ID NO: 155020 - DNA, 20 bp, Artificial
  CRISPR gRNA sequence
gctgggagcagctcggtaaa

SEQ ID NO: 155021 - DNA, 20 bp, Artificial
  CRISPR gRNA sequence
acccatgaggctatgaggaa

SEQ ID NO: 155022 - DNA, 20 bp, Artificial
  CRISPR gRNA sequence
gcccatacaaagttagtatt

SEQ ID NO: 155023 - DNA, 20 bp, Artificial
  CRISPR gRNA sequence
gttagtattccagaaatgtt

SEQ ID NO: 155024 - DNA, 20 bp, Artificial
  CRISPR gRNA sequence
tatgttttttggatcccagg

SEQ ID NO: 155025 - DNA, 20 bp, Artificial
  CRISPR gRNA sequence
aggtaagccggggagtgggc

SEQ ID NO: 155026 - DNA, 20 bp, Artificial
  CRISPR gRNA sequence
cactgtcaatagatacatca

SEQ ID NO: 155027 - DNA, 20 bp, Artificial
  CRISPR gRNA sequence
ctttttttgggtctgaggca

SEQ ID NO: 155028 - DNA, 20 bp, Artificial
  CRISPR gRNA sequence
cccttgagaacaagatggta

SEQ ID NO: 155029 - DNA, 20 bp, Artificial
  CRISPR gRNA sequence
cacaagtcacacagcacaga

SEQ ID NO: 155030 - DNA, 20 bp, Artificial
  CRISPR gRNA sequence
atatattccctgaatggact

SEQ ID NO: 155031 - DNA, 20 bp, Artificial
  CRISPR gRNA sequence
aatttatctgactgacatca

SEQ ID NO: 155032 - DNA, 20 bp, Artificial
  CRISPR gRNA sequence
caaacacctcccaaggggaa

SEQ ID NO: 155033 - DNA, 20 bp, Artificial
  CRISPR gRNA sequence
gcagaatcaataaacctttc

SEQ ID NO: 155034 - DNA, 20 bp, Artificial
  CRISPR gRNA sequence
taggtctctatctgcggggt

SEQ ID NO: 155035 - DNA, 20 bp, Artificial
  CRISPR gRNA sequence
tctctgagacttccagcctc

SEQ ID NO: 155036 - DNA, 20 bp, Artificial
  CRISPR gRNA sequence
cctcacagaatttgaactac

SEQ ID NO: 155037 - DNA, 20 bp, Artificial
  CRISPR gRNA sequence
caagttcacggtagaccatt

SEQ ID NO: 155038 - DNA, 20 bp, Artificial
  CRISPR gRNA sequence
acctgcagtcatttctttcc

SEQ ID NO: 155039 - DNA, 20 bp, Artificial
  CRISPR gRNA sequence
ctagctgggaagagctcttt

SEQ ID NO: 155040 - DNA, 20 bp, Artificial
  CRISPR gRNA sequence
agcttttttacattaattac

SEQ ID NO: 155041 - DNA, 20 bp, Artificial
  CRISPR gRNA sequence
gcaaaaatgagaaccattca

SEQ ID NO: 155042 - DNA, 20 bp, Artificial
  CRISPR gRNA sequence
taagcacacgtgagagaggt

SEQ ID NO: 155043 - DNA, 20 bp, Artificial
  CRISPR gRNA sequence
aataaaaaagccaacaaatc

SEQ ID NO: 155044 - DNA, 20 bp, Artificial
  CRISPR gRNA sequence
acaatgatttccctgcatag

SEQ ID NO: 155045 - DNA, 20 bp, Artificial
  CRISPR gRNA sequence
ctactcgggaggctgaggca

SEQ ID NO: 155046 - DNA, 20 bp, Artificial
  CRISPR gRNA sequence
cagcaagacctgtctcctaa

SEQ ID NO: 155047 - DNA, 20 bp, Artificial
  CRISPR gRNA sequence
tggtctgaaaggaagagtta

SEQ ID NO: 155048 - DNA, 20 bp, Artificial
  CRISPR gRNA sequence
tgaagttactctccaaaacg

SEQ ID NO: 155049 - DNA, 20 bp, Artificial
  CRISPR gRNA sequence
agtgataaggcacatacact

SEQ ID NO: 155050 - DNA, 20 bp, Artificial
  CRISPR gRNA sequence
agcaaccatgaccgtttact

SEQ ID NO: 155051 - DNA, 20 bp, Artificial
  CRISPR gRNA sequence
cttaggcatgtaagacactg

SEQ ID NO: 155052 - DNA, 20 bp, Artificial
  CRISPR gRNA sequence
actaagtctacccctaatta

SEQ ID NO: 155053 - DNA, 20 bp, Artificial
  CRISPR gRNA sequence
tacccctaattaatagaatt

SEQ ID NO: 155054 - DNA, 20 bp, Artificial
  CRISPR gRNA sequence
aaaaatagcaatctcagatt

SEQ ID NO: 155055 - DNA, 20 bp, Artificial
  CRISPR gRNA sequence
gagattcaagggattactac

SEQ ID NO: 155056 - DNA, 20 bp, Artificial
  CRISPR gRNA sequence
ataaactggaggagggccaa

SEQ ID NO: 155057 - DNA, 20 bp, Artificial
  CRISPR gRNA sequence
acatgcagtgggctaggcta

SEQ ID NO: 155058 - DNA, 20 bp, Artificial
  CRISPR gRNA sequence
actcagcctattcccaacct

SEQ ID NO: 155059 - DNA, 20 bp, Artificial
  CRISPR gRNA sequence
aaataagttttcaatttatg

SEQ ID NO: 155060 - DNA, 20 bp, Artificial
  CRISPR gRNA sequence
atgaaattctcgctgactaa

SEQ ID NO: 155061 - DNA, 20 bp, Artificial
  CRISPR gRNA sequence
tatggataagtaaaatgagc

SEQ ID NO: 155062 - DNA, 20 bp, Artificial
  CRISPR gRNA sequence
taggcaaactcagctcctta

SEQ ID NO: 155063 - DNA, 20 bp, Artificial
  CRISPR gRNA sequence
caagactcatattattccct

SEQ ID NO: 155064 - DNA, 20 bp, Artificial
  CRISPR gRNA sequence
atgaataaataatgattgac

SEQ ID NO: 155065 - DNA, 20 bp, Artificial
  CRISPR gRNA sequence
tcttaacactactactgggg

SEQ ID NO: 155066 - DNA, 20 bp, Artificial
  CRISPR gRNA sequence
acttaacacaaatatgggac

SEQ ID NO: 155067 - DNA, 20 bp, Artificial
  CRISPR gRNA sequence
cactttcctcatttgacctt

SEQ ID NO: 155068 - DNA, 20 bp, Artificial
  CRISPR gRNA sequence
agggcaaagtttgccacgtt

SEQ ID NO: 155069 - DNA, 20 bp, Artificial
  CRISPR gRNA sequence
aaacccaacagctgttacca

SEQ ID NO: 155070 - DNA, 20 bp, Artificial
  CRISPR gRNA sequence
ggactgccagtatctacccc

SEQ ID NO: 155071 - DNA, 20 bp, Artificial
  CRISPR gRNA sequence
atactgataccttttgcagc

SEQ ID NO: 155072 - DNA, 20 bp, Artificial
  CRISPR gRNA sequence
ctagacagtatctaggacac

SEQ ID NO: 155073 - DNA, 20 bp, Artificial
  CRISPR gRNA sequence
gaaatgattatgcttggttt

SEQ ID NO: 155074 - DNA, 20 bp, Artificial
  CRISPR gRNA sequence
gctttaatgactggatcaat

SEQ ID NO: 155075 - DNA, 20 bp, Artificial
  CRISPR gRNA sequence
agagtgaactgctgcctcct

SEQ ID NO: 155076 - DNA, 20 bp, Artificial
  CRISPR gRNA sequence
agaggattaaaaatgctatc

SEQ ID NO: 155077 - DNA, 20 bp, Artificial
  CRISPR gRNA sequence
gtgtattcagcaggcagccc

SEQ ID NO: 155078 - DNA, 20 bp, Artificial
  CRISPR gRNA sequence
ggggcttctgatagacaaaa

SEQ ID NO: 155079 - DNA, 20 bp, Artificial
  CRISPR gRNA sequence
tttacagtagcaaagactgc

SEQ ID NO: 155080 - DNA, 20 bp, Artificial
  CRISPR gRNA sequence
ccaaaggccctcatgcaggg

SEQ ID NO: 155081 - DNA, 20 bp, Artificial
  CRISPR gRNA sequence
attaatacaggctgggatgg

SEQ ID NO: 155082 - DNA, 20 bp, Artificial
  CRISPR gRNA sequence
atgaaccacaatatagagga

SEQ ID NO: 155083 - DNA, 20 bp, Artificial
  CRISPR gRNA sequence
aggcactgagttaaaagtat

SEQ ID NO: 155084 - DNA, 20 bp, Artificial
  CRISPR gRNA sequence
tgagtaacagaaggagatgt

SEQ ID NO: 155085 - DNA, 20 bp, Artificial
  CRISPR gRNA sequence
atgttaagaatgaatctggt

SEQ ID NO: 155086 - DNA, 20 bp, Artificial
  CRISPR gRNA sequence
atctcttggaacaatatcga

SEQ ID NO: 155087 - DNA, 20 bp, Artificial
  CRISPR gRNA sequence
ggtgtgaaaaattagcctgg

SEQ ID NO: 155088 - DNA, 20 bp, Artificial
  CRISPR gRNA sequence
ggtgggcaaccatcaacaaa

SEQ ID NO: 155089 - DNA, 20 bp, Artificial
  CRISPR gRNA sequence
caaataaaaaacatagcttg

SEQ ID NO: 155090 - DNA, 20 bp, Artificial
  CRISPR gRNA sequence
gatagagggataaacagata

SEQ ID NO: 155091 - DNA, 20 bp, Artificial
  CRISPR gRNA sequence
agcatagtaaaatgtttatg

SEQ ID NO: 155092 - DNA, 20 bp, Artificial
  CRISPR gRNA sequence
gggaaaatgttaacacacta

SEQ ID NO: 155093 - DNA, 20 bp, Artificial
  CRISPR gRNA sequence
ttgatggaataaaaggggaa

SEQ ID NO: 155094 - DNA, 20 bp, Artificial
  CRISPR gRNA sequence
tcaaaaaataaaaaaggaat

SEQ ID NO: 155095 - DNA, 20 bp, Artificial
  CRISPR gRNA sequence
gaatccatttcatcaatacc

SEQ ID NO: 155096 - DNA, 20 bp, Artificial
  CRISPR gRNA sequence
ttgttaagagcatttttata

SEQ ID NO: 155097 - DNA, 20 bp, Artificial
  CRISPR gRNA sequence
agagtagggggatatgttta

SEQ ID NO: 155098 - DNA, 20 bp, Artificial
  CRISPR gRNA sequence
tgacgcattgacaagctgta

SEQ ID NO: 155099 - DNA, 20 bp, Artificial
  CRISPR gRNA sequence
gtatcgttaatccccagagc

SEQ ID NO: 155100 - DNA, 20 bp, Artificial
  CRISPR gRNA sequence
tgggtgttcagtaagtattt

SEQ ID NO: 155101 - DNA, 20 bp, Artificial
  CRISPR gRNA sequence
gtaggtaaagggaaacaaga

SEQ ID NO: 155102 - DNA, 20 bp, Artificial
  CRISPR gRNA sequence
taaaattaaaaaaaaaagaa

SEQ ID NO: 155103 - DNA, 20 bp, Artificial
  CRISPR gRNA sequence
taaaaaaaaaagaagaagaa

SEQ ID NO: 155104 - DNA, 20 bp, Artificial
  CRISPR gRNA sequence
actaagctgtgaaaaccagg

SEQ ID NO: 155105 - DNA, 20 bp, Artificial
  CRISPR gRNA sequence
aattgattaagatttttggt

SEQ ID NO: 155106 - DNA, 20 bp, Artificial
  CRISPR gRNA sequence
gggaacaaagcaggtaacag

SEQ ID NO: 155107 - DNA, 20 bp, Artificial
  CRISPR gRNA sequence
acaaagcaggtaacagggag

SEQ ID NO: 155108 - DNA, 20 bp, Artificial
  CRISPR gRNA sequence
tactcttataatagcctttc

SEQ ID NO: 155109 - DNA, 20 bp, Artificial
  CRISPR gRNA sequence
gggtttaggttctaatccaa

SEQ ID NO: 155110 - DNA, 20 bp, Artificial
  CRISPR gRNA sequence
aggagaaacaatatgaggaa

SEQ ID NO: 155111 - DNA, 20 bp, Artificial
  CRISPR gRNA sequence
agtctgtgcaggatacagcc

SEQ ID NO: 155112 - DNA, 20 bp, Artificial
  CRISPR gRNA sequence
tctcacagggctactgtgag

SEQ ID NO: 155113 - DNA, 20 bp, Artificial
  CRISPR gRNA sequence
ggagatggactcctaggaat

SEQ ID NO: 155114 - DNA, 20 bp, Artificial
  CRISPR gRNA sequence
tcacaagtattattcatgta

SEQ ID NO: 155115 - DNA, 20 bp, Artificial
  CRISPR gRNA sequence
agatcaaaaggttagaacag

SEQ ID NO: 155116 - DNA, 20 bp, Artificial
  CRISPR gRNA sequence
agagtgagaccctgtctcaa

SEQ ID NO: 155117 - DNA, 20 bp, Artificial
  CRISPR gRNA sequence
tgagaccctgtctcaaaaag

SEQ ID NO: 155118 - DNA, 20 bp, Artificial
  CRISPR gRNA sequence
ttaattaaactttgagctct

SEQ ID NO: 155119 - DNA, 20 bp, Artificial
  CRISPR gRNA sequence
tacccatcacttagcttcaa

SEQ ID NO: 155120 - DNA, 20 bp, Artificial
  CRISPR gRNA sequence
agagaaggtacagatgaaat

SEQ ID NO: 155121 - DNA, 20 bp, Artificial
  CRISPR gRNA sequence
cttaacatatgcaggtcttc

SEQ ID NO: 155122 - DNA, 20 bp, Artificial
  CRISPR gRNA sequence
cttcaaagaattaatgggct

SEQ ID NO: 155123 - DNA, 20 bp, Artificial
  CRISPR gRNA sequence
acatttgcactaacctgaca

SEQ ID NO: 155124 - DNA, 20 bp, Artificial
  CRISPR gRNA sequence
tcaagtgggggtagaggagt

SEQ ID NO: 155125 - DNA, 20 bp, Artificial
  CRISPR gRNA sequence
aactttcttttgcaagacca

SEQ ID NO: 155126 - DNA, 20 bp, Artificial
  CRISPR gRNA sequence
ccagaacctattttatgatt

SEQ ID NO: 155127 - DNA, 20 bp, Artificial
  CRISPR gRNA sequence
attttatgattatagaaaga

SEQ ID NO: 155128 - DNA, 20 bp, Artificial
  CRISPR gRNA sequence
cactctggaaggctgagatg

SEQ ID NO: 155129 - DNA, 20 bp, Artificial
  CRISPR gRNA sequence
agaccccatcactatttaaa

SEQ ID NO: 155130 - DNA, 20 bp, Artificial
  CRISPR gRNA sequence
cccatcactatttaaaaaag

SEQ ID NO: 155131 - DNA, 20 bp, Artificial
  CRISPR gRNA sequence
atttgcctgttgaaaaagta

SEQ ID NO: 155132 - DNA, 20 bp, Artificial
  CRISPR gRNA sequence
gtttttttaaaagtttaatc

SEQ ID NO: 155133 - DNA, 20 bp, Artificial
  CRISPR gRNA sequence
acagaagatgatgacactac

SEQ ID NO: 155134 - DNA, 20 bp, Artificial
  CRISPR gRNA sequence
acactacatagaaatgccaa

SEQ ID NO: 155135 - DNA, 20 bp, Artificial
  CRISPR gRNA sequence
ttgcagagatgtaaaatgag

SEQ ID NO: 155136 - DNA, 20 bp, Artificial
  CRISPR gRNA sequence
ctcaatgagagtttggagac

SEQ ID NO: 155137 - DNA, 20 bp, Artificial
  CRISPR gRNA sequence
tccagagtttcaaataataa

SEQ ID NO: 155138 - DNA, 20 bp, Artificial
  CRISPR gRNA sequence
ctcaatcttggggctgcagg

SEQ ID NO: 155139 - DNA, 20 bp, Artificial
  CRISPR gRNA sequence
tgatagggttcacattcctt

SEQ ID NO: 155140 - DNA, 20 bp, Artificial
  CRISPR gRNA sequence
tggtatcacctgggaactca

SEQ ID NO: 155141 - DNA, 20 bp, Artificial
  CRISPR gRNA sequence
cctgggaactcaaaagaaac

SEQ ID NO: 155142 - DNA, 20 bp, Artificial
  CRISPR gRNA sequence
agtttgagaagcactgctct

SEQ ID NO: 155143 - DNA, 20 bp, Artificial
  CRISPR gRNA sequence
tatctgatttgattgtaatg

SEQ ID NO: 155144 - DNA, 20 bp, Artificial
  CRISPR gRNA sequence
aaagatgaaactgccaatta

SEQ ID NO: 155145 - DNA, 20 bp, Artificial
  CRISPR gRNA sequence
atgggatgtaaagagtaagt

SEQ ID NO: 155146 - DNA, 20 bp, Artificial
  CRISPR gRNA sequence
atagacaactacagagcttt

SEQ ID NO: 155147 - DNA, 20 bp, Artificial
  CRISPR gRNA sequence
cctttcaaaagtacatagga

SEQ ID NO: 155148 - DNA, 20 bp, Artificial
  CRISPR gRNA sequence
tgagaccctgtctctttaaa

SEQ ID NO: 155149 - DNA, 20 bp, Artificial
  CRISPR gRNA sequence
catggtgggaccctgcctct

SEQ ID NO: 155150 - DNA, 20 bp, Artificial
  CRISPR gRNA sequence
ctccaaaaaggaaaaaaaaa

SEQ ID NO: 155151 - DNA, 20 bp, Artificial
  CRISPR gRNA sequence
tactagattgaaagcgaaaa

SEQ ID NO: 155152 - DNA, 20 bp, Artificial
  CRISPR gRNA sequence
tatcaaaaatagtcaaattc

SEQ ID NO: 155153 - DNA, 20 bp, Artificial
  CRISPR gRNA sequence
aatagtcaaattcatagaaa

SEQ ID NO: 155154 - DNA, 20 bp, Artificial
  CRISPR gRNA sequence
aaaaatcaaagtccaacaaa

SEQ ID NO: 155155 - DNA, 20 bp, Artificial
  CRISPR gRNA sequence
actctgaacccaggccagtc

SEQ ID NO: 155156 - DNA, 20 bp, Artificial
  CRISPR gRNA sequence
ttgtttattagcctgtctca

SEQ ID NO: 155157 - DNA, 20 bp, Artificial
  CRISPR gRNA sequence
ttccctttacttaaactcaa

SEQ ID NO: 155158 - DNA, 20 bp, Artificial
  CRISPR gRNA sequence
ctttacttaaactcaaccag

SEQ ID NO: 155159 - DNA, 20 bp, Artificial
  CRISPR gRNA sequence
ataagacggcccctcacaac

SEQ ID NO: 155160 - DNA, 20 bp, Artificial
  CRISPR gRNA sequence
aatgtcaataatgcagctgt

SEQ ID NO: 155161 - DNA, 20 bp, Artificial
  CRISPR gRNA sequence
aaagtatatctttttaacac

SEQ ID NO: 155162 - DNA, 20 bp, Artificial
  CRISPR gRNA sequence
ccaatagtttttaccaagtt

SEQ ID NO: 155163 - DNA, 20 bp, Artificial
  CRISPR gRNA sequence
aaacacatacataagacaca

SEQ ID NO: 155164 - DNA, 20 bp, Artificial
  CRISPR gRNA sequence
agactactgaagacctccaa

SEQ ID NO: 155165 - DNA, 20 bp, Artificial
  CRISPR gRNA sequence
aactagaatatcaaaagttg

SEQ ID NO: 155166 - DNA, 20 bp, Artificial
  CRISPR gRNA sequence
tccccagtgattagtactgt

SEQ ID NO: 155167 - DNA, 20 bp, Artificial
  CRISPR gRNA sequence
ctacttgggaggctgaggca

SEQ ID NO: 155168 - DNA, 20 bp, Artificial
  CRISPR gRNA sequence
ttactcaggaggctgaggca

SEQ ID NO: 155169 - DNA, 20 bp, Artificial
  CRISPR gRNA sequence
ccatcgcaaaaaaaaaaaaa

SEQ ID NO: 155170 - DNA, 20 bp, Artificial
  CRISPR gRNA sequence
agtagaattaaaattaggat

SEQ ID NO: 155171 - DNA, 20 bp, Artificial
  CRISPR gRNA sequence
aattctgaaatgcctgggga

SEQ ID NO: 155172 - DNA, 20 bp, Artificial
  CRISPR gRNA sequence
agaacagtttaattaaacac

SEQ ID NO: 155173 - DNA, 20 bp, Artificial
  CRISPR gRNA sequence
tttaattaaacacaaagaat

SEQ ID NO: 155174 - DNA, 20 bp, Artificial
  CRISPR gRNA sequence
ggagaaatttagtgctctcc

SEQ ID NO: 155175 - DNA, 20 bp, Artificial
  CRISPR gRNA sequence
gggcagaacactctatcaca

SEQ ID NO: 155176 - DNA, 20 bp, Artificial
  CRISPR gRNA sequence
ctaaaggaaatgatgagggg

SEQ ID NO: 155177 - DNA, 20 bp, Artificial
  CRISPR gRNA sequence
ggaggcctataaacagctga

SEQ ID NO: 155178 - DNA, 20 bp, Artificial
  CRISPR gRNA sequence
ataattatcaaaaagcttta

SEQ ID NO: 155179 - DNA, 20 bp, Artificial
  CRISPR gRNA sequence
tgcaaactgctaaggtcaaa

SEQ ID NO: 155180 - DNA, 20 bp, Artificial
  CRISPR gRNA sequence
gttcttctcaccaggaaaaa

SEQ ID NO: 155181 - DNA, 20 bp, Artificial
  CRISPR gRNA sequence
atcttctaggataataaggg

SEQ ID NO: 155182 - DNA, 20 bp, Artificial
  CRISPR gRNA sequence
caactccggaggctgagaca

SEQ ID NO: 155183 - DNA, 20 bp, Artificial
  CRISPR gRNA sequence
gcgagactccatctcaaaaa

SEQ ID NO: 155184 - DNA, 20 bp, Artificial
  CRISPR gRNA sequence
aattataataataaaaaata

SEQ ID NO: 155185 - DNA, 20 bp, Artificial
  CRISPR gRNA sequence
actttaaagcaagactgcaa

SEQ ID NO: 155186 - DNA, 20 bp, Artificial
  CRISPR gRNA sequence
atttaaaataaaaggggatg

SEQ ID NO: 155187 - DNA, 20 bp, Artificial
  CRISPR gRNA sequence
ttttcaaagtcagaacctct

SEQ ID NO: 155188 - DNA, 20 bp, Artificial
  CRISPR gRNA sequence
agttactctttatcattctt

SEQ ID NO: 155189 - DNA, 20 bp, Artificial
  CRISPR gRNA sequence
attatcaacctcataaataa

SEQ ID NO: 155190 - DNA, 20 bp, Artificial
  CRISPR gRNA sequence
gtatgaactatacatacatt

SEQ ID NO: 155191 - DNA, 20 bp, Artificial
  CRISPR gRNA sequence
tacatacattgaagaaagat

SEQ ID NO: 155192 - DNA, 20 bp, Artificial
  CRISPR gRNA sequence
tctgtcccccgcccccgcca

SEQ ID NO: 155193 - DNA, 20 bp, Artificial
  CRISPR gRNA sequence
ccccgcccccgccaaaagaa

SEQ ID NO: 155194 - DNA, 20 bp, Artificial
  CRISPR gRNA sequence
ccccgccaaaagaaaaagaa

SEQ ID NO: 155195 - DNA, 20 bp, Artificial
  CRISPR gRNA sequence
ctacttgggaggctaaggca

SEQ ID NO: 155196 - DNA, 20 bp, Artificial
  CRISPR gRNA sequence
tgcacatattcgggatgcaa

SEQ ID NO: 155197 - DNA, 20 bp, Artificial
  CRISPR gRNA sequence
tatcttagctcagtactgac

SEQ ID NO: 155198 - DNA, 20 bp, Artificial
  CRISPR gRNA sequence
caaaaaaaaaaaaaaaaaaa

SEQ ID NO: 155199 - DNA, 20 bp, Artificial
  CRISPR gRNA sequence
aaaaaaaaaaaaaaaaaaga

SEQ ID NO: 155200 - DNA, 20 bp, Artificial
  CRISPR gRNA sequence
aaaaaaaaaaaaaagaaaag

SEQ ID NO: 155201 - DNA, 20 bp, Artificial
  CRISPR gRNA sequence
ctaactcaatcaatcgaaag

SEQ ID NO: 155202 - DNA, 20 bp, Artificial
  CRISPR gRNA sequence
ctacttgggaagctgaggca

SEQ ID NO: 155203 - DNA, 20 bp, Artificial
  CRISPR gRNA sequence
cttacccaagctgtgactgc

SEQ ID NO: 155204 - DNA, 20 bp, Artificial
  CRISPR gRNA sequence
tcctccagtgaacacacaaa

SEQ ID NO: 155205 - DNA, 20 bp, Artificial
  CRISPR gRNA sequence
aacagctttattgctgatat

SEQ ID NO: 155206 - DNA, 20 bp, Artificial
  CRISPR gRNA sequence
agagaggtgagggggctgca

SEQ ID NO: 155207 - DNA, 20 bp, Artificial
  CRISPR gRNA sequence
gcaactggctacattaaaca

SEQ ID NO: 155208 - DNA, 20 bp, Artificial
  CRISPR gRNA sequence
tccaaaaattctagggccct

SEQ ID NO: 155209 - DNA, 20 bp, Artificial
  CRISPR gRNA sequence
tcactgttgagacctactgc

SEQ ID NO: 155210 - DNA, 20 bp, Artificial
  CRISPR gRNA sequence
ctactcaagaggctgaggca

SEQ ID NO: 155211 - DNA, 20 bp, Artificial
  CRISPR gRNA sequence
aacattcaagtcttattatt

SEQ ID NO: 155212 - DNA, 20 bp, Artificial
  CRISPR gRNA sequence
tgacagagtgagactctgtc

SEQ ID NO: 155213 - DNA, 20 bp, Artificial
  CRISPR gRNA sequence
ttcaccattttaaataccat

SEQ ID NO: 155214 - DNA, 20 bp, Artificial
  CRISPR gRNA sequence
ctacttggaaagctgaggca

SEQ ID NO: 155215 - DNA, 20 bp, Artificial
  CRISPR gRNA sequence
ttgtctcaaaaaaaaaaaaa

SEQ ID NO: 155216 - DNA, 20 bp, Artificial
  CRISPR gRNA sequence
aagaagtaactgtagatgtg

SEQ ID NO: 155217 - DNA, 20 bp, Artificial
  CRISPR gRNA sequence
agttgcttcttatggaaggc

SEQ ID NO: 155218 - DNA, 20 bp, Artificial
  CRISPR gRNA sequence
cagtgaaaatgctatgaaca

SEQ ID NO: 155219 - DNA, 20 bp, Artificial
  CRISPR gRNA sequence
tctgggtaaaatgctatcaa

SEQ ID NO: 155220 - DNA, 20 bp, Artificial
  CRISPR gRNA sequence
tcaaacagaaaagcagctac

SEQ ID NO: 155221 - DNA, 20 bp, Artificial
  CRISPR gRNA sequence
acttcactgctgccttattt

SEQ ID NO: 155222 - DNA, 20 bp, Artificial
  CRISPR gRNA sequence
ctacttgggaagctggggca

SEQ ID NO: 155223 - DNA, 20 bp, Artificial
  CRISPR gRNA sequence
acacacacacaaacacatac

SEQ ID NO: 155224 - DNA, 20 bp, Artificial
  CRISPR gRNA sequence
taaatgatgatgggagatac

SEQ ID NO: 155225 - DNA, 20 bp, Artificial
  CRISPR gRNA sequence
gatgggagatacagagaaag

SEQ ID NO: 155226 - DNA, 20 bp, Artificial
  CRISPR gRNA sequence
taaaattgacaatttcacaa

SEQ ID NO: 155227 - DNA, 20 bp, Artificial
  CRISPR gRNA sequence
tagtcttcactactataata

SEQ ID NO: 155228 - DNA, 20 bp, Artificial
  CRISPR gRNA sequence
aatatagttgtagcacaact

SEQ ID NO: 155229 - DNA, 20 bp, Artificial
  CRISPR gRNA sequence
tgaaaacttttttctgtgga

SEQ ID NO: 155230 - DNA, 20 bp, Artificial
  CRISPR gRNA sequence
ctatcagtattttgtatgat

SEQ ID NO: 155231 - DNA, 20 bp, Artificial
  CRISPR gRNA sequence
atctggcctacagcctgttt

SEQ ID NO: 155232 - DNA, 20 bp, Artificial
  CRISPR gRNA sequence
atagtgagacccccatctca

SEQ ID NO: 155233 - DNA, 20 bp, Artificial
  CRISPR gRNA sequence
aagatcctgtctcaaaaaaa

SEQ ID NO: 155234 - DNA, 20 bp, Artificial
  CRISPR gRNA sequence
cctgtctcaaaaaaaaaaga

SEQ ID NO: 155235 - DNA, 20 bp, Artificial
  CRISPR gRNA sequence
ctcaaaaaaaaaagaaaaga

SEQ ID NO: 155236 - DNA, 20 bp, Artificial
  CRISPR gRNA sequence
gagtaaataaatccttgtag

SEQ ID NO: 155237 - DNA, 20 bp, Artificial
  CRISPR gRNA sequence
aattgtgacatgagctagag

SEQ ID NO: 155238 - DNA, 20 bp, Artificial
  CRISPR gRNA sequence
gagggaagaagtgtgattct

SEQ ID NO: 155239 - DNA, 20 bp, Artificial
  CRISPR gRNA sequence
tgagcaaatctcttaacttc

SEQ ID NO: 155240 - DNA, 20 bp, Artificial
  CRISPR gRNA sequence
atggaaatacatattaaaat

SEQ ID NO: 155241 - DNA, 20 bp, Artificial
  CRISPR gRNA sequence
tgtactagttccaaaaaagc

SEQ ID NO: 155242 - DNA, 20 bp, Artificial
  CRISPR gRNA sequence
ccgcgcccggccttcaattc

SEQ ID NO: 155243 - DNA, 20 bp, Artificial
  CRISPR gRNA sequence
tcaagatcagcctgggaaac

SEQ ID NO: 155244 - DNA, 20 bp, Artificial
  CRISPR gRNA sequence
aaagacctcgtctctacaaa

SEQ ID NO: 155245 - DNA, 20 bp, Artificial
  CRISPR gRNA sequence
tgcctttacagtacaaatgt

SEQ ID NO: 155246 - DNA, 20 bp, Artificial
  CRISPR gRNA sequence
tgataaattttttttctccc

SEQ ID NO: 155247 - DNA, 20 bp, Artificial
  CRISPR gRNA sequence
agagccacaagagtggggtt

SEQ ID NO: 155248 - DNA, 20 bp, Artificial
  CRISPR gRNA sequence
gggtggtgggacaggggaag

SEQ ID NO: 155249 - DNA, 20 bp, Artificial
  CRISPR gRNA sequence
tttaaatgtttaaaagagga

SEQ ID NO: 155250 - DNA, 20 bp, Artificial
  CRISPR gRNA sequence
aatgtttaaaagaggagaag

SEQ ID NO: 155251 - DNA, 20 bp, Artificial
  CRISPR gRNA sequence
caggtggactgaggaacttg

SEQ ID NO: 155252 - DNA, 20 bp, Artificial
  CRISPR gRNA sequence
ttaaatcttctccttctact

SEQ ID NO: 155253 - DNA, 20 bp, Artificial
  CRISPR gRNA sequence
ctactttagaattgataaca

SEQ ID NO: 155254 - DNA, 20 bp, Artificial
  CRISPR gRNA sequence
agattcttaaacatttcaaa

SEQ ID NO: 155255 - DNA, 20 bp, Artificial
  CRISPR gRNA sequence
ttcaaagtagaaagcttaaa

SEQ ID NO: 155256 - DNA, 20 bp, Artificial
  CRISPR gRNA sequence
gctaccaaacaaaagtggag

SEQ ID NO: 155257 - DNA, 20 bp, Artificial
  CRISPR gRNA sequence
taattatccagccattcctc

SEQ ID NO: 155258 - DNA, 20 bp, Artificial
  CRISPR gRNA sequence
ccagccattcctccaagaaa

SEQ ID NO: 155259 - DNA, 20 bp, Artificial
  CRISPR gRNA sequence
ctactcgggaggctgaggca

SEQ ID NO: 155260 - DNA, 20 bp, Artificial
  CRISPR gRNA sequence
ctgcatagctaaggaatacc

SEQ ID NO: 155261 - DNA, 20 bp, Artificial
  CRISPR gRNA sequence
tggaaaagagaaggtaggag

SEQ ID NO: 155262 - DNA, 20 bp, Artificial
  CRISPR gRNA sequence
agactgtttttcatatatgg

SEQ ID NO: 155263 - DNA, 20 bp, Artificial
  CRISPR gRNA sequence
cattaggtagataccaaata

SEQ ID NO: 155264 - DNA, 20 bp, Artificial
  CRISPR gRNA sequence
ataattacaacatatatagc

SEQ ID NO: 155265 - DNA, 20 bp, Artificial
  CRISPR gRNA sequence
ttttacttatcaaggcacac

SEQ ID NO: 155266 - DNA, 20 bp, Artificial
  CRISPR gRNA sequence
agcaagtaactttttggaat

SEQ ID NO: 155267 - DNA, 20 bp, Artificial
  CRISPR gRNA sequence
cttacatgggaaatgcacac

SEQ ID NO: 155268 - DNA, 20 bp, Artificial
  CRISPR gRNA sequence
gcctggctggacatctacaa

SEQ ID NO: 155269 - DNA, 20 bp, Artificial
  CRISPR gRNA sequence
cctccagtcacccagactgg

SEQ ID NO: 155270 - DNA, 20 bp, Artificial
  CRISPR gRNA sequence
ctatatagcttaggtagaca

SEQ ID NO: 155271 - DNA, 20 bp, Artificial
  CRISPR gRNA sequence
caaaacggtagtacttccaa

SEQ ID NO: 155272 - DNA, 20 bp, Artificial
  CRISPR gRNA sequence
gtgctagactgtaatctaat

SEQ ID NO: 155273 - DNA, 20 bp, Artificial
  CRISPR gRNA sequence
ttagaaaaaatactataagt

SEQ ID NO: 155274 - DNA, 20 bp, Artificial
  CRISPR gRNA sequence
agataagagtgataatacaa

SEQ ID NO: 155275 - DNA, 20 bp, Artificial
  CRISPR gRNA sequence
gaggtagcagaacacattaa

SEQ ID NO: 155276 - DNA, 20 bp, Artificial
  CRISPR gRNA sequence
cagtgctttgggaggctgag

SEQ ID NO: 155277 - DNA, 20 bp, Artificial
  CRISPR gRNA sequence
ccttgtctccaaaaaaaagg

SEQ ID NO: 155278 - DNA, 20 bp, Artificial
  CRISPR gRNA sequence
atatatgaaggtcatcacct

SEQ ID NO: 155279 - DNA, 20 bp, Artificial
  CRISPR gRNA sequence
aaagtatatcatggtctatc

SEQ ID NO: 155280 - DNA, 20 bp, Artificial
  CRISPR gRNA sequence
agcctatacagaagtcccaa

SEQ ID NO: 155281 - DNA, 20 bp, Artificial
  CRISPR gRNA sequence
atacagaagtcccaaaaaga

SEQ ID NO: 155282 - DNA, 20 bp, Artificial
  CRISPR gRNA sequence
gaaaacaacctagaggaata

SEQ ID NO: 155283 - DNA, 20 bp, Artificial
  CRISPR gRNA sequence
tgggcatgcagactagatta

SEQ ID NO: 155284 - DNA, 20 bp, Artificial
  CRISPR gRNA sequence
atgagtttccaccaattatg

SEQ ID NO: 155285 - DNA, 20 bp, Artificial
  CRISPR gRNA sequence
tgcaggtgaaggcagtttaa

SEQ ID NO: 155286 - DNA, 20 bp, Artificial
  CRISPR gRNA sequence
aggtagtgggtcattctcaa

SEQ ID NO: 155287 - DNA, 20 bp, Artificial
  CRISPR gRNA sequence
tcatcttaggacttaaattc

SEQ ID NO: 155288 - DNA, 20 bp, Artificial
  CRISPR gRNA sequence
ttcactcagctatcatacca

SEQ ID NO: 155289 - DNA, 20 bp, Artificial
  CRISPR gRNA sequence
agctatcataccaaaagaat

SEQ ID NO: 155290 - DNA, 20 bp, Artificial
  CRISPR gRNA sequence
ggaagtaaaaagagtgggag

SEQ ID NO: 155291 - DNA, 20 bp, Artificial
  CRISPR gRNA sequence
ggctccacactgagtctgct

SEQ ID NO: 155292 - DNA, 20 bp, Artificial
  CRISPR gRNA sequence
cattccatatttgcaaataa

SEQ ID NO: 155293 - DNA, 20 bp, Artificial
  CRISPR gRNA sequence
tttgcaaataaaaagaaaac

SEQ ID NO: 155294 - DNA, 20 bp, Artificial
  CRISPR gRNA sequence
cattagctttatatccataa

SEQ ID NO: 155295 - DNA, 20 bp, Artificial
  CRISPR gRNA sequence
actacattaactactactta

SEQ ID NO: 155296 - DNA, 20 bp, Artificial
  CRISPR gRNA sequence
ctagaggtagactggtaaat

SEQ ID NO: 155297 - DNA, 20 bp, Artificial
  CRISPR gRNA sequence
tgtcaacaaagtgcatggaa

SEQ ID NO: 155298 - DNA, 20 bp, Artificial
  CRISPR gRNA sequence
gttaagtttacccaatgcaa

SEQ ID NO: 155299 - DNA, 20 bp, Artificial
  CRISPR gRNA sequence
cttgtcgatacccaactagg

SEQ ID NO: 155300 - DNA, 20 bp, Artificial
  CRISPR gRNA sequence
ctatcatttcaacacaaaac

SEQ ID NO: 155301 - DNA, 20 bp, Artificial
  CRISPR gRNA sequence
atttatacctccaccgactg

SEQ ID NO: 155302 - DNA, 20 bp, Artificial
  CRISPR gRNA sequence
aacaaaaggcagcaggagat

SEQ ID NO: 155303 - DNA, 20 bp, Artificial
  CRISPR gRNA sequence
ttttcaggggcacacagaag

SEQ ID NO: 155304 - DNA, 20 bp, Artificial
  CRISPR gRNA sequence
tgcttgcaaaagtgaccttg

SEQ ID NO: 155305 - DNA, 20 bp, Artificial
  CRISPR gRNA sequence
cagattatatatatgatttt

SEQ ID NO: 155306 - DNA, 20 bp, Artificial
  CRISPR gRNA sequence
tgcacatgggcatgcctgta

SEQ ID NO: 155307 - DNA, 20 bp, Artificial
  CRISPR gRNA sequence
atgtttactagacaaatgaa

SEQ ID NO: 155308 - DNA, 20 bp, Artificial
  CRISPR gRNA sequence
aatgggtatgctgattttta

SEQ ID NO: 155309 - DNA, 20 bp, Artificial
  CRISPR gRNA sequence
ttccagggatgtgtaggttt

SEQ ID NO: 155310 - DNA, 20 bp, Artificial
  CRISPR gRNA sequence
tcactttgggcttttgtttt

SEQ ID NO: 155311 - DNA, 20 bp, Artificial
  CRISPR gRNA sequence
caaatcgagactccatgtct

SEQ ID NO: 155312 - DNA, 20 bp, Artificial
  CRISPR gRNA sequence
tgaaacccagcctttactaa

SEQ ID NO: 155313 - DNA, 20 bp, Artificial
  CRISPR gRNA sequence
gagattccgtctcaagaaaa

SEQ ID NO: 155314 - DNA, 20 bp, Artificial
  CRISPR gRNA sequence
cgtctcaagaaaaaaaaaca

SEQ ID NO: 155315 - DNA, 20 bp, Artificial
  CRISPR gRNA sequence
aagaaaaaaaaacaaaaaac

SEQ ID NO: 155316 - DNA, 20 bp, Artificial
  CRISPR gRNA sequence
aaaggaagaactaaagaaaa

SEQ ID NO: 155317 - DNA, 20 bp, Artificial
  CRISPR gRNA sequence
tccatagtttcaattacata

SEQ ID NO: 155318 - DNA, 20 bp, Artificial
  CRISPR gRNA sequence
gcactttcttaccatatatg

SEQ ID NO: 155319 - DNA, 20 bp, Artificial
  CRISPR gRNA sequence
tcctataagtgggcagctat

SEQ ID NO: 155320 - DNA, 20 bp, Artificial
  CRISPR gRNA sequence
aactgcagtttagcaagctt

SEQ ID NO: 155321 - DNA, 20 bp, Artificial
  CRISPR gRNA sequence
tttttcaggagagtgatcag

SEQ ID NO: 155322 - DNA, 20 bp, Artificial
  CRISPR gRNA sequence
acaagattcctttcacaaga

SEQ ID NO: 155323 - DNA, 20 bp, Artificial
  CRISPR gRNA sequence
tttttggattagtgtggaga

SEQ ID NO: 155324 - DNA, 20 bp, Artificial
  CRISPR gRNA sequence
agacatgcaaaggggaagga

SEQ ID NO: 155325 - DNA, 20 bp, Artificial
  CRISPR gRNA sequence
cttttcgggattgaggcctg

SEQ ID NO: 155326 - DNA, 20 bp, Artificial
  CRISPR gRNA sequence
atcagtaaatcagggataaa

SEQ ID NO: 155327 - DNA, 20 bp, Artificial
  CRISPR gRNA sequence
taaaacacctaacagtgctt

SEQ ID NO: 155328 - DNA, 20 bp, Artificial
  CRISPR gRNA sequence
cttccagtgaaactgtttct

SEQ ID NO: 155329 - DNA, 20 bp, Artificial
  CRISPR gRNA sequence
agtttcctgcatgactatat

SEQ ID NO: 155330 - DNA, 20 bp, Artificial
  CRISPR gRNA sequence
aggtccatctgtgtaaacat

SEQ ID NO: 155331 - DNA, 20 bp, Artificial
  CRISPR gRNA sequence
acccagagtagagcttcttt

SEQ ID NO: 155332 - DNA, 20 bp, Artificial
  CRISPR gRNA sequence
gcgacagagtgagactgtca

SEQ ID NO: 155333 - DNA, 20 bp, Artificial
  CRISPR gRNA sequence
agagtgagactgtcacaaaa

SEQ ID NO: 155334 - DNA, 20 bp, Artificial
  CRISPR gRNA sequence
gagactgtcacaaaacaaaa

SEQ ID NO: 155335 - DNA, 20 bp, Artificial
  CRISPR gRNA sequence
ctctagctagatcttcggga

SEQ ID NO: 155336 - DNA, 20 bp, Artificial
  CRISPR gRNA sequence
cacaataaagtgaaatgcaa

SEQ ID NO: 155337 - DNA, 20 bp, Artificial
  CRISPR gRNA sequence
gtgagagcattatttttagg

SEQ ID NO: 155338 - DNA, 20 bp, Artificial
  CRISPR gRNA sequence
gaaaccaggtcatattgcaa

SEQ ID NO: 155339 - DNA, 20 bp, Artificial
  CRISPR gRNA sequence
ctctgattttgggatgtttt

SEQ ID NO: 155340 - DNA, 20 bp, Artificial
  CRISPR gRNA sequence
taatatctgcaaagatgtta

SEQ ID NO: 155341 - DNA, 20 bp, Artificial
  CRISPR gRNA sequence
aatcataaaggccataactc

SEQ ID NO: 155342 - DNA, 20 bp, Artificial
  CRISPR gRNA sequence
gtagatgggcttctcaattt

SEQ ID NO: 155343 - DNA, 20 bp, Artificial
  CRISPR gRNA sequence
attttcatgagtaccttgta

SEQ ID NO: 155344 - DNA, 20 bp, Artificial
  CRISPR gRNA sequence
agaaacaggatcacagtgtc

SEQ ID NO: 155345 - DNA, 20 bp, Artificial
  CRISPR gRNA sequence
ggtataagctagatagaagg

SEQ ID NO: 155346 - DNA, 20 bp, Artificial
  CRISPR gRNA sequence
gaaagattgaatagattcat

SEQ ID NO: 155347 - DNA, 20 bp, Artificial
  CRISPR gRNA sequence
aagagctctgggaaattaac

SEQ ID NO: 155348 - DNA, 20 bp, Artificial
  CRISPR gRNA sequence
tgacctgtgggtaggaaaat

SEQ ID NO: 155349 - DNA, 20 bp, Artificial
  CRISPR gRNA sequence
atatcctttaggacttacag

SEQ ID NO: 155350 - DNA, 20 bp, Artificial
  CRISPR gRNA sequence
cgacatttctagaacttggt

SEQ ID NO: 155351 - DNA, 20 bp, Artificial
  CRISPR gRNA sequence
tttttttttagttgtagtaa

SEQ ID NO: 155352 - DNA, 20 bp, Artificial
  CRISPR gRNA sequence
tttccactttacagtggtta

SEQ ID NO: 155353 - DNA, 20 bp, Artificial
  CRISPR gRNA sequence
ttccagaactcaacagtact

SEQ ID NO: 155354 - DNA, 20 bp, Artificial
  CRISPR gRNA sequence
ttaaactagccaatcataag

SEQ ID NO: 155355 - DNA, 20 bp, Artificial
  CRISPR gRNA sequence
agctgggattgaaattagtt

SEQ ID NO: 155356 - DNA, 20 bp, Artificial
  CRISPR gRNA sequence
tgtgcaccagagtgattgtg

SEQ ID NO: 155357 - DNA, 20 bp, Artificial
  CRISPR gRNA sequence
tgaaggttggtggactgtta

SEQ ID NO: 155358 - DNA, 20 bp, Artificial
  CRISPR gRNA sequence
tactttgagtagcagggccg

SEQ ID NO: 155359 - DNA, 20 bp, Artificial
  CRISPR gRNA sequence
agtcacaaggggagttttca

SEQ ID NO: 155360 - DNA, 20 bp, Artificial
  CRISPR gRNA sequence
tctggaaaaattgtcttgca

SEQ ID NO: 155361 - DNA, 20 bp, Artificial
  CRISPR gRNA sequence
aaggctaggataggattata

SEQ ID NO: 155362 - DNA, 20 bp, Artificial
  CRISPR gRNA sequence
gttcttgtacaaattatatt

SEQ ID NO: 155363 - DNA, 20 bp, Artificial
  CRISPR gRNA sequence
ttctgggattaaacttttaa

SEQ ID NO: 155364 - DNA, 20 bp, Artificial
  CRISPR gRNA sequence
ctatactcaggtagtagatc

SEQ ID NO: 155365 - DNA, 20 bp, Artificial
  CRISPR gRNA sequence
gtaaatgaaagagcaagggg

SEQ ID NO: 155366 - DNA, 20 bp, Artificial
  CRISPR gRNA sequence
aaataccagtagtttcaaaa

SEQ ID NO: 155367 - DNA, 20 bp, Artificial
  CRISPR gRNA sequence
tgtgctgacgaaaaaaaaaa

SEQ ID NO: 155368 - DNA, 20 bp, Artificial
  CRISPR gRNA sequence
atctcatttgattgccacaa

SEQ ID NO: 155369 - DNA, 20 bp, Artificial
  CRISPR gRNA sequence
aaaggctattataagagtaa

SEQ ID NO: 155370 - DNA, 20 bp, Artificial
  CRISPR gRNA sequence
ttattgcagacttagattag

SEQ ID NO: 155371 - DNA, 20 bp, Artificial
  CRISPR gRNA sequence
gaagaagagtgtaacaagta

SEQ ID NO: 155372 - DNA, 20 bp, Artificial
  CRISPR gRNA sequence
agattagaaaataaaatagg

SEQ ID NO: 155373 - DNA, 20 bp, Artificial
  CRISPR gRNA sequence
cattagtcatcagggaaata

SEQ ID NO: 155374 - DNA, 20 bp, Artificial
  CRISPR gRNA sequence
caaccttgtttatactacct

SEQ ID NO: 155375 - DNA, 20 bp, Artificial
  CRISPR gRNA sequence
gcccaggcatcagtaccttt

SEQ ID NO: 155376 - DNA, 20 bp, Artificial
  CRISPR gRNA sequence
gttctgcttgctttgttata

SEQ ID NO: 155377 - DNA, 20 bp, Artificial
  CRISPR gRNA sequence
tgtctatcagaagccccctt

SEQ ID NO: 155378 - DNA, 20 bp, Artificial
  CRISPR gRNA sequence
tggcacctcctaaagtcctt

SEQ ID NO: 155379 - DNA, 20 bp, Artificial
  CRISPR gRNA sequence
cctttaaaacgcctactctc

SEQ ID NO: 155380 - DNA, 20 bp, Artificial
  CRISPR gRNA sequence
agcataatcatattgagggt

SEQ ID NO: 155381 - DNA, 20 bp, Artificial
  CRISPR gRNA sequence
tgtttactccttctgccatg

SEQ ID NO: 155382 - DNA, 20 bp, Artificial
  CRISPR gRNA sequence
cccccttgaagtggtggggc

SEQ ID NO: 155383 - DNA, 20 bp, Artificial
  CRISPR gRNA sequence
attggggatacaagcatgaa

SEQ ID NO: 155384 - DNA, 20 bp, Artificial
  CRISPR gRNA sequence
gcaagatcctgtctcaaaaa

SEQ ID NO: 155385 - DNA, 20 bp, Artificial
  CRISPR gRNA sequence
atatggcaagaccttgtctc

SEQ ID NO: 155386 - DNA, 20 bp, Artificial
  CRISPR gRNA sequence
gcttgtgcctctgcagtggt

SEQ ID NO: 155387 - DNA, 20 bp, Artificial
  CRISPR gRNA sequence
tgtgttttctgtcataaatt

SEQ ID NO: 155388 - DNA, 20 bp, Artificial
  CRISPR gRNA sequence
cattggtcattttgaccccc

SEQ ID NO: 155389 - DNA, 20 bp, Artificial
  CRISPR gRNA sequence
ggaaactttatttccctttc

SEQ ID NO: 155390 - DNA, 20 bp, Artificial
  CRISPR gRNA sequence
tcctcttttcatccccagct

SEQ ID NO: 155391 - DNA, 20 bp, Artificial
  CRISPR gRNA sequence
agattcttccctgggatcca

SEQ ID NO: 155392 - DNA, 20 bp, Artificial
  CRISPR gRNA sequence
gaccagcctggccaacatgg

SEQ ID NO: 155393 - DNA, 20 bp, Artificial
  CRISPR gRNA sequence
agtgagtggacagaaattgt

SEQ ID NO: 155394 - DNA, 20 bp, Artificial
  CRISPR gRNA sequence
ttttattttttaaatgcatt

SEQ ID NO: 155395 - DNA, 20 bp, Artificial
  CRISPR gRNA sequence
gtaacaaacaaaaaaaaaag

SEQ ID NO: 155396 - DNA, 20 bp, Artificial
  CRISPR gRNA sequence
gtctcaacagtccatgctat

SEQ ID NO: 155397 - DNA, 20 bp, Artificial
  CRISPR gRNA sequence
tttagttcccactaagtcta

SEQ ID NO: 155398 - DNA, 20 bp, Artificial
  CRISPR gRNA sequence
caaatgtcctcaccatggcc

SEQ ID NO: 155399 - DNA, 20 bp, Artificial
  CRISPR gRNA sequence
tttggctttagttctgttcc

SEQ ID NO: 155400 - DNA, 20 bp, Artificial
  CRISPR gRNA sequence
ttgagaacaagatggtaaga

SEQ ID NO: 155401 - DNA, 20 bp, Artificial
  CRISPR gRNA sequence
agtcccttttaaacagaggt

SEQ ID NO: 155402 - DNA, 20 bp, Artificial
  CRISPR gRNA sequence
ttccctgaatggacttcaga

SEQ ID NO: 155403 - DNA, 20 bp, Artificial
  CRISPR gRNA sequence
gaatcaataaacctttcata

SEQ ID NO: 155404 - DNA, 20 bp, Artificial
  CRISPR gRNA sequence
cagaatttgaactaccgaga

SEQ ID NO: 155405 - DNA, 20 bp, Artificial
  CRISPR gRNA sequence
ggcagctgggcagaagtttg

SEQ ID NO: 155406 - DNA, 20 bp, Artificial
  CRISPR gRNA sequence
cagccagggatcacaagatg

SEQ ID NO: 155407 - DNA, 20 bp, Artificial
  CRISPR gRNA sequence
gaacactgggcatataggtt

SEQ ID NO: 155408 - DNA, 20 bp, Artificial
  CRISPR gRNA sequence
ctgggcatataggttaaaaa

SEQ ID NO: 155409 - DNA, 20 bp, Artificial
  CRISPR gRNA sequence
gcattgctgaagttactctc

SEQ ID NO: 155410 - DNA, 20 bp, Artificial
  CRISPR gRNA sequence
gttactctccaaaacgaaag

SEQ ID NO: 155411 - DNA, 20 bp, Artificial
  CRISPR gRNA sequence
tgcagtgggctaggctaaca

SEQ ID NO: 155412 - DNA, 20 bp, Artificial
  CRISPR gRNA sequence
taagttttcaatttatgaca

SEQ ID NO: 155413 - DNA, 20 bp, Artificial
  CRISPR gRNA sequence
aagtgagaacttatctttaa

SEQ ID NO: 155414 - DNA, 20 bp, Artificial
  CRISPR gRNA sequence
ttcctcatttgacctttgag

SEQ ID NO: 155415 - DNA, 20 bp, Artificial
  CRISPR gRNA sequence
tcatcaagctctgcccatcc

SEQ ID NO: 155416 - DNA, 20 bp, Artificial
  CRISPR gRNA sequence
aacagatcctataggcttca

SEQ ID NO: 155417 - DNA, 20 bp, Artificial
  CRISPR gRNA sequence
ggcaaataagtaccgtaact

SEQ ID NO: 155418 - DNA, 20 bp, Artificial
  CRISPR gRNA sequence
gtgcccctgcctgggacaac

SEQ ID NO: 155419 - DNA, 20 bp, Artificial
  CRISPR gRNA sequence
cctgggacaacaaaaacaat

SEQ ID NO: 155420 - DNA, 20 bp, Artificial
  CRISPR gRNA sequence
atgtctgggggctaggatac

SEQ ID NO: 155421 - DNA, 20 bp, Artificial
  CRISPR gRNA sequence
agacaaaaagcaaacccttt

SEQ ID NO: 155422 - DNA, 20 bp, Artificial
  CRISPR gRNA sequence
ccagccaatttgaagcctgg

SEQ ID NO: 155423 - DNA, 20 bp, Artificial
  CRISPR gRNA sequence
tattcagcaggcagcccaca

SEQ ID NO: 155424 - DNA, 20 bp, Artificial
  CRISPR gRNA sequence
gcttctgatagacaaaagga

SEQ ID NO: 155425 - DNA, 20 bp, Artificial
  CRISPR gRNA sequence
aatcatgcaatctgcatgct

SEQ ID NO: 155426 - DNA, 20 bp, Artificial
  CRISPR gRNA sequence
atatgcacccaaggtgctga

SEQ ID NO: 155427 - DNA, 20 bp, Artificial
  CRISPR gRNA sequence
ttctttcttgtgattgcttg

SEQ ID NO: 155428 - DNA, 20 bp, Artificial
  CRISPR gRNA sequence
agcctgggcgctgatatttt

SEQ ID NO: 155429 - DNA, 20 bp, Artificial
  CRISPR gRNA sequence
aaccacaatatagaggaaga

SEQ ID NO: 155430 - DNA, 20 bp, Artificial
  CRISPR gRNA sequence
cagttctgaattcccaaata

SEQ ID NO: 155431 - DNA, 20 bp, Artificial
  CRISPR gRNA sequence
taaaattaaaagatttttac

SEQ ID NO: 155432 - DNA, 20 bp, Artificial
  CRISPR gRNA sequence
taaagatttaaagcaaaagg

SEQ ID NO: 155433 - DNA, 20 bp, Artificial
  CRISPR gRNA sequence
caaaaggaaaaacaatatga

SEQ ID NO: 155434 - DNA, 20 bp, Artificial
  CRISPR gRNA sequence
gtaaactttacaatgcactt

SEQ ID NO: 155435 - DNA, 20 bp, Artificial
  CRISPR gRNA sequence
ttaaaaggtgactcatcgga

SEQ ID NO: 155436 - DNA, 20 bp, Artificial
  CRISPR gRNA sequence
ggccccaagcctctgaaatg

SEQ ID NO: 155437 - DNA, 20 bp, Artificial
  CRISPR gRNA sequence
tttaggtattctagtgggtg

SEQ ID NO: 155438 - DNA, 20 bp, Artificial
  CRISPR gRNA sequence
attttttgctttttttgctt

SEQ ID NO: 155439 - DNA, 20 bp, Artificial
  CRISPR gRNA sequence
gagttcagtcactaagctgt

SEQ ID NO: 155440 - DNA, 20 bp, Artificial
  CRISPR gRNA sequence
ctttctccaacaccacgcag

SEQ ID NO: 155441 - DNA, 20 bp, Artificial
  CRISPR gRNA sequence
gatcctgtcccccactccaa

SEQ ID NO: 155442 - DNA, 20 bp, Artificial
  CRISPR gRNA sequence
ctgcggcctggataacagag

SEQ ID NO: 155443 - DNA, 20 bp, Artificial
  CRISPR gRNA sequence
aaaactctcaaaaaaaaaaa

SEQ ID NO: 155444 - DNA, 20 bp, Artificial
  CRISPR gRNA sequence
aggatgatccatatagtaac

SEQ ID NO: 155445 - DNA, 20 bp, Artificial
  CRISPR gRNA sequence
gtcaaaaaaaggtattttgg

SEQ ID NO: 155446 - DNA, 20 bp, Artificial
  CRISPR gRNA sequence
attttccatgaaccctctac

SEQ ID NO: 155447 - DNA, 20 bp, Artificial
  CRISPR gRNA sequence
tttgtcagagatagtcacat

SEQ ID NO: 155448 - DNA, 20 bp, Artificial
  CRISPR gRNA sequence
tagggatgatcattcctttg

SEQ ID NO: 155449 - DNA, 20 bp, Artificial
  CRISPR gRNA sequence
aatcacctgaaaagcttttg

SEQ ID NO: 155450 - DNA, 20 bp, Artificial
  CRISPR gRNA sequence
gtactggcatcatgtttttt

SEQ ID NO: 155451 - DNA, 20 bp, Artificial
  CRISPR gRNA sequence
ttcaaagaggcccactgggg

SEQ ID NO: 155452 - DNA, 20 bp, Artificial
  CRISPR gRNA sequence
cttttctttctcttcaccca

SEQ ID NO: 155453 - DNA, 20 bp, Artificial
  CRISPR gRNA sequence
ttcacccacaaaacttgaac

SEQ ID NO: 155454 - DNA, 20 bp, Artificial
  CRISPR gRNA sequence
ccctgtctctttaaaaaaga

SEQ ID NO: 155455 - DNA, 20 bp, Artificial
  CRISPR gRNA sequence
tgaatactagattgaaagcg

SEQ ID NO: 155456 - DNA, 20 bp, Artificial
  CRISPR gRNA sequence
taaccactgtaaagtggaaa

SEQ ID NO: 155457 - DNA, 20 bp, Artificial
  CRISPR gRNA sequence
aaaaaaaaatcaaagtccaa

SEQ ID NO: 155458 - DNA, 20 bp, Artificial
  CRISPR gRNA sequence
ttaaccccctaaaatatgaa

SEQ ID NO: 155459 - DNA, 20 bp, Artificial
  CRISPR gRNA sequence
ctaagccaagttcaactgct

SEQ ID NO: 155460 - DNA, 20 bp, Artificial
  CRISPR gRNA sequence
acatgacccagaggtatatc

SEQ ID NO: 155461 - DNA, 20 bp, Artificial
  CRISPR gRNA sequence
ttaacacagacttacatctt

SEQ ID NO: 155462 - DNA, 20 bp, Artificial
  CRISPR gRNA sequence
gagatcgagaccatcctggc

SEQ ID NO: 155463 - DNA, 20 bp, Artificial
  CRISPR gRNA sequence
gaagccttaaagacagttaa

SEQ ID NO: 155464 - DNA, 20 bp, Artificial
  CRISPR gRNA sequence
tgaggggaaagaaatggaag

SEQ ID NO: 155465 - DNA, 20 bp, Artificial
  CRISPR gRNA sequence
gctgtcctctgatatccccc

SEQ ID NO: 155466 - DNA, 20 bp, Artificial
  CRISPR gRNA sequence
gtagtagtggaagttaggta

SEQ ID NO: 155467 - DNA, 20 bp, Artificial
  CRISPR gRNA sequence
cattctttgcatggagcttt

SEQ ID NO: 155468 - DNA, 20 bp, Artificial
  CRISPR gRNA sequence
gaccagcctggctaatatag

SEQ ID NO: 155469 - DNA, 20 bp, Artificial
  CRISPR gRNA sequence
agcaaaaccctgtttctact

SEQ ID NO: 155470 - DNA, 20 bp, Artificial
  CRISPR gRNA sequence
aatgaaacttcagaagtttt

SEQ ID NO: 155471 - DNA, 20 bp, Artificial
  CRISPR gRNA sequence
atacagctctttgaggtaac

SEQ ID NO: 155472 - DNA, 20 bp, Artificial
  CRISPR gRNA sequence
gttgttgggagataatactt

SEQ ID NO: 155473 - DNA, 20 bp, Artificial
  CRISPR gRNA sequence
aacttaagccaaacatataa

SEQ ID NO: 155474 - DNA, 20 bp, Artificial
  CRISPR gRNA sequence
tattccatatttctggtcac

SEQ ID NO: 155475 - DNA, 20 bp, Artificial
  CRISPR gRNA sequence
gaccagcctggccaacatgg

SEQ ID NO: 155476 - DNA, 20 bp, Artificial
  CRISPR gRNA sequence
agaaagcagagtactggaaa

SEQ ID NO: 155477 - DNA, 20 bp, Artificial
  CRISPR gRNA sequence
ctccagcctgggtgacagaa

SEQ ID NO: 155478 - DNA, 20 bp, Artificial
  CRISPR gRNA sequence
aacaatatacctggtcatcc

SEQ ID NO: 155479 - DNA, 20 bp, Artificial
  CRISPR gRNA sequence
cacagcgagactccgtctca

SEQ ID NO: 155480 - DNA, 20 bp, Artificial
  CRISPR gRNA sequence
cgagactccgtctcaaaaaa

SEQ ID NO: 155481 - DNA, 20 bp, Artificial
  CRISPR gRNA sequence
ccgtctcaaaaaacaaaaca

SEQ ID NO: 155482 - DNA, 20 bp, Artificial
  CRISPR gRNA sequence
aatgaaaccccatctctact

SEQ ID NO: 155483 - DNA, 20 bp, Artificial
  CRISPR gRNA sequence
tgagactctgtctcagaaat

SEQ ID NO: 155484 - DNA, 20 bp, Artificial
  CRISPR gRNA sequence
cagacagatctgagtaaact

SEQ ID NO: 155485 - DNA, 20 bp, Artificial
  CRISPR gRNA sequence
actgctttagctcaggactt

SEQ ID NO: 155486 - DNA, 20 bp, Artificial
  CRISPR gRNA sequence
aaccagcctgggcaacatgg

SEQ ID NO: 155487 - DNA, 20 bp, Artificial
  CRISPR gRNA sequence
acagagtaagaccctgtctc

SEQ ID NO: 155488 - DNA, 20 bp, Artificial
  CRISPR gRNA sequence
ggattgctgcaatctcatga

SEQ ID NO: 155489 - DNA, 20 bp, Artificial
  CRISPR gRNA sequence
gtgtggagagaggaaaaaaa

SEQ ID NO: 155490 - DNA, 20 bp, Artificial
  CRISPR gRNA sequence
agcgaaactccatctcaaaa

SEQ ID NO: 155491 - DNA, 20 bp, Artificial
  CRISPR gRNA sequence
aaggcttatactctccaaaa

SEQ ID NO: 155492 - DNA, 20 bp, Artificial
  CRISPR gRNA sequence
attgacaatttcacaagaag

SEQ ID NO: 155493 - DNA, 20 bp, Artificial
  CRISPR gRNA sequence
gcttttcaaagtgcctactg

SEQ ID NO: 155494 - DNA, 20 bp, Artificial
  CRISPR gRNA sequence
agaagagccacttttccttc

SEQ ID NO: 155495 - DNA, 20 bp, Artificial
  CRISPR gRNA sequence
aaggcatgaacagaacattt

SEQ ID NO: 155496 - DNA, 20 bp, Artificial
  CRISPR gRNA sequence
aaacttttttctgtggaata

SEQ ID NO: 155497 - DNA, 20 bp, Artificial
  CRISPR gRNA sequence
ctctgcatatataacagcaa

SEQ ID NO: 155498 - DNA, 20 bp, Artificial
  CRISPR gRNA sequence
gtattctaaagcaagggtct

SEQ ID NO: 155499 - DNA, 20 bp, Artificial
  CRISPR gRNA sequence
atctgcccacctcggcctcc

SEQ ID NO: 155500 - DNA, 20 bp, Artificial
  CRISPR gRNA sequence
tcaatagaaaataaaaaata

SEQ ID NO: 155501 - DNA, 20 bp, Artificial
  CRISPR gRNA sequence
gcctaagttaagttgtattc

SEQ ID NO: 155502 - DNA, 20 bp, Artificial
  CRISPR gRNA sequence
cagctgaaacacacaaatgg

SEQ ID NO: 155503 - DNA, 20 bp, Artificial
  CRISPR gRNA sequence
ttttctctccacactaatcc

SEQ ID NO: 155504 - DNA, 20 bp, Artificial
  CRISPR gRNA sequence
agtgagaccctgtatcaaaa

SEQ ID NO: 155505 - DNA, 20 bp, Artificial
  CRISPR gRNA sequence
gtatcaaaaaaaaaccccaa

SEQ ID NO: 155506 - DNA, 20 bp, Artificial
  CRISPR gRNA sequence
ccacaagagtggggttggag

SEQ ID NO: 155507 - DNA, 20 bp, Artificial
  CRISPR gRNA sequence
gctggtgacttaatacatct

SEQ ID NO: 155508 - DNA, 20 bp, Artificial
  CRISPR gRNA sequence
aaggcagaaaattgtcaatt

SEQ ID NO: 155509 - DNA, 20 bp, Artificial
  CRISPR gRNA sequence
aaagaggagaagaaagaaag

SEQ ID NO: 155510 - DNA, 20 bp, Artificial
  CRISPR gRNA sequence
ctttagaattgataacaaca

SEQ ID NO: 155511 - DNA, 20 bp, Artificial
  CRISPR gRNA sequence
attgataacaacagaaaaca

SEQ ID NO: 155512 - DNA, 20 bp, Artificial
  CRISPR gRNA sequence
acagagcaagactccgtctc

SEQ ID NO: 155513 - DNA, 20 bp, Artificial
  CRISPR gRNA sequence
gcaagactccgtctcaaaaa

SEQ ID NO: 155514 - DNA, 20 bp, Artificial
  CRISPR gRNA sequence
actccgtctcaaaaacaaaa

SEQ ID NO: 155515 - DNA, 20 bp, Artificial
  CRISPR gRNA sequence
gtctcaaaaacaaaacaaaa

SEQ ID NO: 155516 - DNA, 20 bp, Artificial
  CRISPR gRNA sequence
aaaaacaaaacaaaacaaaa

SEQ ID NO: 155517 - DNA, 20 bp, Artificial
  CRISPR gRNA sequence
acaaaacaaaacaaaacaaa

SEQ ID NO: 155518 - DNA, 20 bp, Artificial
  CRISPR gRNA sequence
gcccaaagcaactcaaaaaa

SEQ ID NO: 155519 - DNA, 20 bp, Artificial
  CRISPR gRNA sequence
tttttagtaaactaatacta

SEQ ID NO: 155520 - DNA, 20 bp, Artificial
  CRISPR gRNA sequence
acatgggaaatgcacactca

SEQ ID NO: 155521 - DNA, 20 bp, Artificial
  CRISPR gRNA sequence
cctcattgcctccatgtaat

SEQ ID NO: 155522 - DNA, 20 bp, Artificial
  CRISPR gRNA sequence
ttgaaactatggaaacagac

SEQ ID NO: 155523 - DNA, 20 bp, Artificial
  CRISPR gRNA sequence
aaaaaatactataagtagag

SEQ ID NO: 155524 - DNA, 20 bp, Artificial
  CRISPR gRNA sequence
gtagcagaacacattaaaaa

SEQ ID NO: 155525 - DNA, 20 bp, Artificial
  CRISPR gRNA sequence
tgtctccaaaaaaaaggaaa

SEQ ID NO: 155526 - DNA, 20 bp, Artificial
  CRISPR gRNA sequence
ttcttgaaatataataacaa

SEQ ID NO: 155527 - DNA, 20 bp, Artificial
  CRISPR gRNA sequence
ataacaaaaaaacaacaaca

SEQ ID NO: 155528 - DNA, 20 bp, Artificial
  CRISPR gRNA sequence
aaacatgaaaaataaaaagt

SEQ ID NO: 155529 - DNA, 20 bp, Artificial
  CRISPR gRNA sequence
gggagacctcatcttgtttt

SEQ ID NO: 155530 - DNA, 20 bp, Artificial
  CRISPR gRNA sequence
ttataagcattctaattccc

SEQ ID NO: 155531 - DNA, 20 bp, Artificial
  CRISPR gRNA sequence
tccatatttgcaaataaaaa

SEQ ID NO: 155532 - DNA, 20 bp, Artificial
  CRISPR gRNA sequence
tctaagctaaaatgtgcatt

SEQ ID NO: 155533 - DNA, 20 bp, Artificial
  CRISPR gRNA sequence
acagtgttgcttccatatct

SEQ ID NO: 155534 - DNA, 20 bp, Artificial
  CRISPR gRNA sequence
aacaaagtgcatggaaatag

SEQ ID NO: 155535 - DNA, 20 bp, Artificial
  CRISPR gRNA sequence
gaacaaaggaaaattatttg

SEQ ID NO: 155536 - DNA, 20 bp, Artificial
  CRISPR gRNA sequence
cagtttctatcatttcaaca

SEQ ID NO: 155537 - DNA, 20 bp, Artificial
  CRISPR gRNA sequence
tctggaatgtccactccact

SEQ ID NO: 155538 - DNA, 20 bp, Artificial
  CRISPR gRNA sequence
agctgacccctgcctcagtg

SEQ ID NO: 155539 - DNA, 20 bp, Artificial
  CRISPR gRNA sequence
tgtgttcttagccgataaag

SEQ ID NO: 155540 - DNA, 20 bp, Artificial
  CRISPR gRNA sequence
gtgttcttagccgataaagc

SEQ ID NO: 155541 - DNA, 20 bp, Artificial
  CRISPR gRNA sequence
tgttcttagccgataaagca

SEQ ID NO: 155542 - DNA, 20 bp, Artificial
  CRISPR gRNA sequence
ttagccgataaagcagttca

SEQ ID NO: 155543 - DNA, 20 bp, Artificial
  CRISPR gRNA sequence
agccgataaagcagttcagc

SEQ ID NO: 155544 - DNA, 20 bp, Artificial
  CRISPR gRNA sequence
gccgataaagcagttcagcc

SEQ ID NO: 155545 - DNA, 20 bp, Artificial
  CRISPR gRNA sequence
agccaatgggaccactgtgg

SEQ ID NO: 155546 - DNA, 20 bp, Artificial
  CRISPR gRNA sequence
tggaggcaaggtttggtgtc

SEQ ID NO: 155547 - DNA, 20 bp, Artificial
  CRISPR gRNA sequence
ggtgtcaaatagcatgctag

SEQ ID NO: 155548 - DNA, 20 bp, Artificial
  CRISPR gRNA sequence
gtgtcaaatagcatgctaga

SEQ ID NO: 155549 - DNA, 20 bp, Artificial
  CRISPR gRNA sequence
gattgaatgcctttgactgt

SEQ ID NO: 155550 - DNA, 20 bp, Artificial
  CRISPR gRNA sequence
aatgcctttgactgttaaag

SEQ ID NO: 155551 - DNA, 20 bp, Artificial
  CRISPR gRNA sequence
tgactgttaaagtggaagga

SEQ ID NO: 155552 - DNA, 20 bp, Artificial
  CRISPR gRNA sequence
gactgttaaagtggaaggag

SEQ ID NO: 155553 - DNA, 20 bp, Artificial
  CRISPR gRNA sequence
actgttaaagtggaaggagg

SEQ ID NO: 155554 - DNA, 20 bp, Artificial
  CRISPR gRNA sequence
ttaaagtggaaggaggctgc

SEQ ID NO: 155555 - DNA, 20 bp, Artificial
  CRISPR gRNA sequence
aagtggaaggaggctgcagg

SEQ ID NO: 155556 - DNA, 20 bp, Artificial
  CRISPR gRNA sequence
cagggcttcattggagcctc

SEQ ID NO: 155557 - DNA, 20 bp, Artificial
  CRISPR gRNA sequence
cattggagcctcggagtttt

SEQ ID NO: 155558 - DNA, 20 bp, Artificial
  CRISPR gRNA sequence
attggagcctcggagttttt

SEQ ID NO: 155559 - DNA, 20 bp, Artificial
  CRISPR gRNA sequence
gagcctcggagtttttcact

SEQ ID NO: 155560 - DNA, 20 bp, Artificial
  CRISPR gRNA sequence
ggagtttttcactgaggcag

SEQ ID NO: 155561 - DNA, 20 bp, Artificial
  CRISPR gRNA sequence
ttcactgaggcaggggtcag

SEQ ID NO: 155562 - DNA, 20 bp, Artificial
  CRISPR gRNA sequence
tcactgaggcaggggtcagc

SEQ ID NO: 155563 - DNA, 20 bp, Artificial
  CRISPR gRNA sequence
cactgaggcaggggtcagct

SEQ ID NO: 155564 - DNA, 20 bp, Artificial
  CRISPR gRNA sequence
actgaggcaggggtcagctg

SEQ ID NO: 155565 - DNA, 20 bp, Artificial
  CRISPR gRNA sequence
aggcaggggtcagctgaaag

SEQ ID NO: 155566 - DNA, 20 bp, Artificial
  CRISPR gRNA sequence
aaagacaaagaaaaatggcg

SEQ ID NO: 155567 - DNA, 20 bp, Artificial
  CRISPR gRNA sequence
gttggggggtgggaggacag

SEQ ID NO: 155568 - DNA, 20 bp, Artificial
  CRISPR gRNA sequence
ttggggggtgggaggacagc

SEQ ID NO: 155569 - DNA, 20 bp, Artificial
  CRISPR gRNA sequence
gggggtgggaggacagctgt

SEQ ID NO: 155570 - DNA, 20 bp, Artificial
  CRISPR gRNA sequence
ttcgggttttcagtggagtg

SEQ ID NO: 155571 - DNA, 20 bp, Artificial
  CRISPR gRNA sequence
gggttttcagtggagtggac

SEQ ID NO: 155572 - DNA, 20 bp, Artificial
  CRISPR gRNA sequence
tcagtggagtggacattcca

SEQ ID NO: 155573 - DNA, 20 bp, Artificial
  CRISPR gRNA sequence
cagtggagtggacattccag

SEQ ID NO: 155574 - DNA, 20 bp, Artificial
  CRISPR gRNA sequence
agtggagtggacattccaga

SEQ ID NO: 155575 - DNA, 20 bp, Artificial
  CRISPR gRNA sequence
cagactcatgtttctgcatc

SEQ ID NO: 155576 - DNA, 20 bp, Artificial
  CRISPR gRNA sequence
atgtttctgcatctcctgct

SEQ ID NO: 155577 - DNA, 20 bp, Artificial
  CRISPR gRNA sequence
ctgcatctcctgctgccttt

SEQ ID NO: 155578 - DNA, 20 bp, Artificial
  CRISPR gRNA sequence
tgcatctcctgctgcctttt

SEQ ID NO: 155579 - DNA, 20 bp, Artificial
  CRISPR gRNA sequence
catctcctgctgccttttgt

SEQ ID NO: 155580 - DNA, 20 bp, Artificial
  CRISPR gRNA sequence
ctgctgccttttgtttcctc

SEQ ID NO: 155581 - DNA, 20 bp, Artificial
  CRISPR gRNA sequence
ctgccttttgtttcctccgt

SEQ ID NO: 155582 - DNA, 20 bp, Artificial
  CRISPR gRNA sequence
ccttttgtttcctccgtcct

SEQ ID NO: 155583 - DNA, 20 bp, Artificial
  CRISPR gRNA sequence
ttgtttcctccgtcctttgg

SEQ ID NO: 155584 - DNA, 20 bp, Artificial
  CRISPR gRNA sequence
tgtttcctccgtcctttggg

SEQ ID NO: 155585 - DNA, 20 bp, Artificial
  CRISPR gRNA sequence
gtttcctccgtcctttgggg

SEQ ID NO: 155586 - DNA, 20 bp, Artificial
  CRISPR gRNA sequence
tttcctccgtcctttggggg

SEQ ID NO: 155587 - DNA, 20 bp, Artificial
  CRISPR gRNA sequence
cctccgtcctttggggggta

SEQ ID NO: 155588 - DNA, 20 bp, Artificial
  CRISPR gRNA sequence
ctccgtcctttggggggtag

SEQ ID NO: 155589 - DNA, 20 bp, Artificial
  CRISPR gRNA sequence
cgtcctttggggggtaggga

SEQ ID NO: 155590 - DNA, 20 bp, Artificial
  CRISPR gRNA sequence
tggggggtagggataggagt

SEQ ID NO: 155591 - DNA, 20 bp, Artificial
  CRISPR gRNA sequence
ggggggtagggataggagtg

SEQ ID NO: 155592 - DNA, 20 bp, Artificial
  CRISPR gRNA sequence
gggggtagggataggagtga

SEQ ID NO: 155593 - DNA, 20 bp, Artificial
  CRISPR gRNA sequence
aaattctcccagtcggtgga

SEQ ID NO: 155594 - DNA, 20 bp, Artificial
  CRISPR gRNA sequence
aattctcccagtcggtggag

SEQ ID NO: 155595 - DNA, 20 bp, Artificial
  CRISPR gRNA sequence
tcccagtcggtggaggtata

SEQ ID NO: 155596 - DNA, 20 bp, Artificial
  CRISPR gRNA sequence
ccagtcggtggaggtataaa

SEQ ID NO: 155597 - DNA, 20 bp, Artificial
  CRISPR gRNA sequence
catgtaaaattaatgcagtt

SEQ ID NO: 155598 - DNA, 20 bp, Artificial
  CRISPR gRNA sequence
atgcagttcccggtaagttt

SEQ ID NO: 155599 - DNA, 20 bp, Artificial
  CRISPR gRNA sequence
ccggtaagtttaattctttg

SEQ ID NO: 155600 - DNA, 20 bp, Artificial
  CRISPR gRNA sequence
aattctttgttttgtgttga

SEQ ID NO: 155601 - DNA, 20 bp, Artificial
  CRISPR gRNA sequence
attctttgttttgtgttgaa

SEQ ID NO: 155602 - DNA, 20 bp, Artificial
  CRISPR gRNA sequence
tttgttttgtgttgaaatga

SEQ ID NO: 155603 - DNA, 20 bp, Artificial
  CRISPR gRNA sequence
tgttttgtgttgaaatgata

SEQ ID NO: 155604 - DNA, 20 bp, Artificial
  CRISPR gRNA sequence
gttttgtgttgaaatgatag

SEQ ID NO: 155605 - DNA, 20 bp, Artificial
  CRISPR gRNA sequence
ttttgtgttgaaatgataga

SEQ ID NO: 155606 - DNA, 20 bp, Artificial
  CRISPR gRNA sequence
tgtgttgaaatgatagaaac

SEQ ID NO: 155607 - DNA, 20 bp, Artificial
  CRISPR gRNA sequence
gtgttgaaatgatagaaact

SEQ ID NO: 155608 - DNA, 20 bp, Artificial
  CRISPR gRNA sequence
tgttgaaatgatagaaactg

SEQ ID NO: 155609 - DNA, 20 bp, Artificial
  CRISPR gRNA sequence
aaatgatagaaactgtttag

SEQ ID NO: 155610 - DNA, 20 bp, Artificial
  CRISPR gRNA sequence
tttagcttcagagagtgtag

SEQ ID NO: 155611 - DNA, 20 bp, Artificial
  CRISPR gRNA sequence
agcttcagagagtgtagaca

SEQ ID NO: 155612 - DNA, 20 bp, Artificial
  CRISPR gRNA sequence
gcttcagagagtgtagacaa

SEQ ID NO: 155613 - DNA, 20 bp, Artificial
  CRISPR gRNA sequence
cagagagtgtagacaagttg

SEQ ID NO: 155614 - DNA, 20 bp, Artificial
  CRISPR gRNA sequence
agagagtgtagacaagttgc

SEQ ID NO: 155615 - DNA, 20 bp, Artificial
  CRISPR gRNA sequence
cactgttcagaaaatggcca

SEQ ID NO: 155616 - DNA, 20 bp, Artificial
  CRISPR gRNA sequence
ttcagaaaatggccacttta

SEQ ID NO: 155617 - DNA, 20 bp, Artificial
  CRISPR gRNA sequence
agaaaatggccactttacat

SEQ ID NO: 155618 - DNA, 20 bp, Artificial
  CRISPR gRNA sequence
tacattccatgcataccttt

SEQ ID NO: 155619 - DNA, 20 bp, Artificial
  CRISPR gRNA sequence
acattccatgcatacctttt

SEQ ID NO: 155620 - DNA, 20 bp, Artificial
  CRISPR gRNA sequence
cattccatgcataccttttg

SEQ ID NO: 155621 - DNA, 20 bp, Artificial
  CRISPR gRNA sequence
catgcataccttttggtgca

SEQ ID NO: 155622 - DNA, 20 bp, Artificial
  CRISPR gRNA sequence
ttggtgcacctagaatacct

SEQ ID NO: 155623 - DNA, 20 bp, Artificial
  CRISPR gRNA sequence
tggtgcacctagaatacctt

SEQ ID NO: 155624 - DNA, 20 bp, Artificial
  CRISPR gRNA sequence
ggtgcacctagaataccttg

SEQ ID NO: 155625 - DNA, 20 bp, Artificial
  CRISPR gRNA sequence
gtgcacctagaataccttgc

SEQ ID NO: 155626 - DNA, 20 bp, Artificial
  CRISPR gRNA sequence
gaataccttgctgtgtttag

SEQ ID NO: 155627 - DNA, 20 bp, Artificial
  CRISPR gRNA sequence
gctgtgtttagattttgcat

SEQ ID NO: 155628 - DNA, 20 bp, Artificial
  CRISPR gRNA sequence
ctgtgtttagattttgcatg

SEQ ID NO: 155629 - DNA, 20 bp, Artificial
  CRISPR gRNA sequence
tgtttagattttgcatgtcc

SEQ ID NO: 155630 - DNA, 20 bp, Artificial
  CRISPR gRNA sequence
agattttgcatgtccttcaa

SEQ ID NO: 155631 - DNA, 20 bp, Artificial
  CRISPR gRNA sequence
gattttgcatgtccttcaac

SEQ ID NO: 155632 - DNA, 20 bp, Artificial
  CRISPR gRNA sequence
tgcatgtccttcaactagga

SEQ ID NO: 155633 - DNA, 20 bp, Artificial
  CRISPR gRNA sequence
gcatgtccttcaactaggat

SEQ ID NO: 155634 - DNA, 20 bp, Artificial
  CRISPR gRNA sequence
catgtccttcaactaggatt

SEQ ID NO: 155635 - DNA, 20 bp, Artificial
  CRISPR gRNA sequence
caactaggatttctttccta

SEQ ID NO: 155636 - DNA, 20 bp, Artificial
  CRISPR gRNA sequence
aactaggatttctttcctag

SEQ ID NO: 155637 - DNA, 20 bp, Artificial
  CRISPR gRNA sequence
ggatttctttcctagttggg

SEQ ID NO: 155638 - DNA, 20 bp, Artificial
  CRISPR gRNA sequence
ctttcctagttgggtatcga

SEQ ID NO: 155639 - DNA, 20 bp, Artificial
  CRISPR gRNA sequence
tttcctagttgggtatcgac

SEQ ID NO: 155640 - DNA, 20 bp, Artificial
  CRISPR gRNA sequence
tcctagttgggtatcgacaa

SEQ ID NO: 155641 - DNA, 20 bp, Artificial
  CRISPR gRNA sequence
cctagttgggtatcgacaag

SEQ ID NO: 155642 - DNA, 20 bp, Artificial
  CRISPR gRNA sequence
ctagttgggtatcgacaaga

SEQ ID NO: 155643 - DNA, 20 bp, Artificial
  CRISPR gRNA sequence
gttgggtatcgacaagatca

SEQ ID NO: 155644 - DNA, 20 bp, Artificial
  CRISPR gRNA sequence
ggtatcgacaagatcaggta

SEQ ID NO: 155645 - DNA, 20 bp, Artificial
  CRISPR gRNA sequence
atcatttttcaggggcacac

SEQ ID NO: 155646 - DNA, 20 bp, Artificial
  CRISPR gRNA sequence
ttcaggggcacacagaagca

SEQ ID NO: 155647 - DNA, 20 bp, Artificial
  CRISPR gRNA sequence
tcaggggcacacagaagcaa

SEQ ID NO: 155648 - DNA, 20 bp, Artificial
  CRISPR gRNA sequence
caggggcacacagaagcaaa

SEQ ID NO: 155649 - DNA, 20 bp, Artificial
  CRISPR gRNA sequence
aggggcacacagaagcaaaa

SEQ ID NO: 155650 - DNA, 20 bp, Artificial
  CRISPR gRNA sequence
ttctctttgcattgggtaaa

SEQ ID NO: 155651 - DNA, 20 bp, Artificial
  CRISPR gRNA sequence
tctctttgcattgggtaaac

SEQ ID NO: 155652 - DNA, 20 bp, Artificial
  CRISPR gRNA sequence
ctctttgcattgggtaaact

SEQ ID NO: 155653 - DNA, 20 bp, Artificial
  CRISPR gRNA sequence
tctttgcattgggtaaactt

SEQ ID NO: 155654 - DNA, 20 bp, Artificial
  CRISPR gRNA sequence
tttgcattgggtaaacttaa

SEQ ID NO: 155655 - DNA, 20 bp, Artificial
  CRISPR gRNA sequence
tgcattgggtaaacttaact

SEQ ID NO: 155656 - DNA, 20 bp, Artificial
  CRISPR gRNA sequence
gcattgggtaaacttaactg

SEQ ID NO: 155657 - DNA, 20 bp, Artificial
  CRISPR gRNA sequence
cattgggtaaacttaactgt

SEQ ID NO: 155658 - DNA, 20 bp, Artificial
  CRISPR gRNA sequence
ggtaaacttaactgttttcc

SEQ ID NO: 155659 - DNA, 20 bp, Artificial
  CRISPR gRNA sequence
aactgttttccaaataattt

SEQ ID NO: 155660 - DNA, 20 bp, Artificial
  CRISPR gRNA sequence
actgttttccaaataatttt

SEQ ID NO: 155661 - DNA, 20 bp, Artificial
  CRISPR gRNA sequence
ttttccaaataattttcctt

SEQ ID NO: 155662 - DNA, 20 bp, Artificial
  CRISPR gRNA sequence
tccaaataattttcctttgt

SEQ ID NO: 155663 - DNA, 20 bp, Artificial
  CRISPR gRNA sequence
ccaaataattttcctttgtt

SEQ ID NO: 155664 - DNA, 20 bp, Artificial
  CRISPR gRNA sequence
caaataattttcctttgttc

SEQ ID NO: 155665 - DNA, 20 bp, Artificial
  CRISPR gRNA sequence
tcctttgttcaagtgccctg

SEQ ID NO: 155666 - DNA, 20 bp, Artificial
  CRISPR gRNA sequence
cctttgttcaagtgccctga

SEQ ID NO: 155667 - DNA, 20 bp, Artificial
  CRISPR gRNA sequence
ctttgttcaagtgccctgaa

SEQ ID NO: 155668 - DNA, 20 bp, Artificial
  CRISPR gRNA sequence
tgttcaagtgccctgaagct

SEQ ID NO: 155669 - DNA, 20 bp, Artificial
  CRISPR gRNA sequence
gttcaagtgccctgaagctt

SEQ ID NO: 155670 - DNA, 20 bp, Artificial
  CRISPR gRNA sequence
ttcaagtgccctgaagcttt

SEQ ID NO: 155671 - DNA, 20 bp, Artificial
  CRISPR gRNA sequence
aagtgccctgaagctttcct

SEQ ID NO: 155672 - DNA, 20 bp, Artificial
  CRISPR gRNA sequence
aagctttcctacggaataag

SEQ ID NO: 155673 - DNA, 20 bp, Artificial
  CRISPR gRNA sequence
tcctacggaataagctgggt

SEQ ID NO: 155674 - DNA, 20 bp, Artificial
  CRISPR gRNA sequence
cctacggaataagctgggtt

SEQ ID NO: 155675 - DNA, 20 bp, Artificial
  CRISPR gRNA sequence
ctacggaataagctgggttg

SEQ ID NO: 155676 - DNA, 20 bp, Artificial
  CRISPR gRNA sequence
cggaataagctgggttgttg

SEQ ID NO: 155677 - DNA, 20 bp, Artificial
  CRISPR gRNA sequence
ggttgttgtgagagtttttc

SEQ ID NO: 155678 - DNA, 20 bp, Artificial
  CRISPR gRNA sequence
ttgtgagagtttttctattt

SEQ ID NO: 155679 - DNA, 20 bp, Artificial
  CRISPR gRNA sequence
tgagagtttttctatttcca

SEQ ID NO: 155680 - DNA, 20 bp, Artificial
  CRISPR gRNA sequence
ttctatttccatgcactttg

SEQ ID NO: 155681 - DNA, 20 bp, Artificial
  CRISPR gRNA sequence
tctatttccatgcactttgt

SEQ ID NO: 155682 - DNA, 20 bp, Artificial
  CRISPR gRNA sequence
ctatttccatgcactttgtt

SEQ ID NO: 155683 - DNA, 20 bp, Artificial
  CRISPR gRNA sequence
tatttccatgcactttgttg

SEQ ID NO: 155684 - DNA, 20 bp, Artificial
  CRISPR gRNA sequence
tttccatgcactttgttgac

SEQ ID NO: 155685 - DNA, 20 bp, Artificial
  CRISPR gRNA sequence
ccatgcactttgttgacatc

SEQ ID NO: 155686 - DNA, 20 bp, Artificial
  CRISPR gRNA sequence
catgcactttgttgacatct

SEQ ID NO: 155687 - DNA, 20 bp, Artificial
  CRISPR gRNA sequence
tgttgacatctgtgttttca

SEQ ID NO: 155688 - DNA, 20 bp, Artificial
  CRISPR gRNA sequence
gttgacatctgtgttttcag

SEQ ID NO: 155689 - DNA, 20 bp, Artificial
  CRISPR gRNA sequence
ttgacatctgtgttttcaga

SEQ ID NO: 155690 - DNA, 20 bp, Artificial
  CRISPR gRNA sequence
acatctgtgttttcagatat

SEQ ID NO: 155691 - DNA, 20 bp, Artificial
  CRISPR gRNA sequence
tgttttcagatatggaagca

SEQ ID NO: 155692 - DNA, 20 bp, Artificial
  CRISPR gRNA sequence
tcagatatggaagcaacact

SEQ ID NO: 155693 - DNA, 20 bp, Artificial
  CRISPR gRNA sequence
cagatatggaagcaacactg

SEQ ID NO: 155694 - DNA, 20 bp, Artificial
  CRISPR gRNA sequence
agatatggaagcaacactgt

SEQ ID NO: 155695 - DNA, 20 bp, Artificial
  CRISPR gRNA sequence
ttgctgttagaaatttgtgt

SEQ ID NO: 155696 - DNA, 20 bp, Artificial
  CRISPR gRNA sequence
ctgttagaaatttgtgtgaa

SEQ ID NO: 155697 - DNA, 20 bp, Artificial
  CRISPR gRNA sequence
ttagaaatttgtgtgaaaat

SEQ ID NO: 155698 - DNA, 20 bp, Artificial
  CRISPR gRNA sequence
gaaatttgtgtgaaaatacg

SEQ ID NO: 155699 - DNA, 20 bp, Artificial
  CRISPR gRNA sequence
gtgtgaaaatacgatttgca

SEQ ID NO: 155700 - DNA, 20 bp, Artificial
  CRISPR gRNA sequence
tgtgaaaatacgatttgcac

SEQ ID NO: 155701 - DNA, 20 bp, Artificial
  CRISPR gRNA sequence
gcactgctgcaggttctaat

SEQ ID NO: 155702 - DNA, 20 bp, Artificial
  CRISPR gRNA sequence
cactgctgcaggttctaatg

SEQ ID NO: 155703 - DNA, 20 bp, Artificial
  CRISPR gRNA sequence
ctgcaggttctaatggtgaa

SEQ ID NO: 155704 - DNA, 20 bp, Artificial
  CRISPR gRNA sequence
caggttctaatggtgaaggc

SEQ ID NO: 155705 - DNA, 20 bp, Artificial
  CRISPR gRNA sequence
taatggtgaaggcccacatg

SEQ ID NO: 155706 - DNA, 20 bp, Artificial
  CRISPR gRNA sequence
atggtgaaggcccacatgcc

SEQ ID NO: 155707 - DNA, 20 bp, Artificial
  CRISPR gRNA sequence
tcccataactttcttgattt

SEQ ID NO: 155708 - DNA, 20 bp, Artificial
  CRISPR gRNA sequence
cccataactttcttgattta

SEQ ID NO: 155709 - DNA, 20 bp, Artificial
  CRISPR gRNA sequence
ccataactttcttgatttac

SEQ ID NO: 155710 - DNA, 20 bp, Artificial
  CRISPR gRNA sequence
tcttgatttaccagtctacc

SEQ ID NO: 155711 - DNA, 20 bp, Artificial
  CRISPR gRNA sequence
cttgatttaccagtctacct

SEQ ID NO: 155712 - DNA, 20 bp, Artificial
  CRISPR gRNA sequence
ttgatttaccagtctacctc

SEQ ID NO: 155713 - DNA, 20 bp, Artificial
  CRISPR gRNA sequence
gatttaccagtctacctcta

SEQ ID NO: 155714 - DNA, 20 bp, Artificial
  CRISPR gRNA sequence
atttaccagtctacctctag

SEQ ID NO: 155715 - DNA, 20 bp, Artificial
  CRISPR gRNA sequence
accagtctacctctagattc

SEQ ID NO: 155716 - DNA, 20 bp, Artificial
  CRISPR gRNA sequence
ccagtctacctctagattct

SEQ ID NO: 155717 - DNA, 20 bp, Artificial
  CRISPR gRNA sequence
cctctagattctaataagta

SEQ ID NO: 155718 - DNA, 20 bp, Artificial
  CRISPR gRNA sequence
tagattctaataagtagtag

SEQ ID NO: 155719 - DNA, 20 bp, Artificial
  CRISPR gRNA sequence
gattctaataagtagtagtt

SEQ ID NO: 155720 - DNA, 20 bp, Artificial
  CRISPR gRNA sequence
taataagtagtagttaatgt

SEQ ID NO: 155721 - DNA, 20 bp, Artificial
  CRISPR gRNA sequence
ataagtagtagttaatgtag

SEQ ID NO: 155722 - DNA, 20 bp, Artificial
  CRISPR gRNA sequence
atgtagtaacaatctttgtt

SEQ ID NO: 155723 - DNA, 20 bp, Artificial
  CRISPR gRNA sequence
tgtttttaatgcacatttta

SEQ ID NO: 155724 - DNA, 20 bp, Artificial
  CRISPR gRNA sequence
gtttttaatgcacattttag

SEQ ID NO: 155725 - DNA, 20 bp, Artificial
  CRISPR gRNA sequence
tttttaatgcacattttagc

SEQ ID NO: 155726 - DNA, 20 bp, Artificial
  CRISPR gRNA sequence
ttaatgcacattttagctta

SEQ ID NO: 155727 - DNA, 20 bp, Artificial
  CRISPR gRNA sequence
taatgcacattttagcttag

SEQ ID NO: 155728 - DNA, 20 bp, Artificial
  CRISPR gRNA sequence
aatgcacattttagcttaga

SEQ ID NO: 155729 - DNA, 20 bp, Artificial
  CRISPR gRNA sequence
atgcacattttagcttagaa

SEQ ID NO: 155730 - DNA, 20 bp, Artificial
  CRISPR gRNA sequence
tagcttagaatgctggttag

SEQ ID NO: 155731 - DNA, 20 bp, Artificial
  CRISPR gRNA sequence
agcttagaatgctggttaga

SEQ ID NO: 155732 - DNA, 20 bp, Artificial
  CRISPR gRNA sequence
gcttagaatgctggttagaa

SEQ ID NO: 155733 - DNA, 20 bp, Artificial
  CRISPR gRNA sequence
agaatgctggttagaaatat

SEQ ID NO: 155734 - DNA, 20 bp, Artificial
  CRISPR gRNA sequence
gaatgctggttagaaatatc

SEQ ID NO: 155735 - DNA, 20 bp, Artificial
  CRISPR gRNA sequence
gttagaaatatcttcactta

SEQ ID NO: 155736 - DNA, 20 bp, Artificial
  CRISPR gRNA sequence
gaaatatcttcacttatatt

SEQ ID NO: 155737 - DNA, 20 bp, Artificial
  CRISPR gRNA sequence
cacttatattgacagtgatg

SEQ ID NO: 155738 - DNA, 20 bp, Artificial
  CRISPR gRNA sequence
acttatattgacagtgatga

SEQ ID NO: 155739 - DNA, 20 bp, Artificial
  CRISPR gRNA sequence
atattgacagtgatgagcaa

SEQ ID NO: 155740 - DNA, 20 bp, Artificial
  CRISPR gRNA sequence
tattgacagtgatgagcaaa

SEQ ID NO: 155741 - DNA, 20 bp, Artificial
  CRISPR gRNA sequence
acagtgatgagcaaatattt

SEQ ID NO: 155742 - DNA, 20 bp, Artificial
  CRISPR gRNA sequence
ttccacagatttcacacatt

SEQ ID NO: 155743 - DNA, 20 bp, Artificial
  CRISPR gRNA sequence
tccacagatttcacacattt

SEQ ID NO: 155744 - DNA, 20 bp, Artificial
  CRISPR gRNA sequence
ccacagatttcacacatttt

SEQ ID NO: 155745 - DNA, 20 bp, Artificial
  CRISPR gRNA sequence
cacagatttcacacattttg

SEQ ID NO: 155746 - DNA, 20 bp, Artificial
  CRISPR gRNA sequence
cacacattttgtcaggtgtt

SEQ ID NO: 155747 - DNA, 20 bp, Artificial
  CRISPR gRNA sequence
acacattttgtcaggtgttg

SEQ ID NO: 155748 - DNA, 20 bp, Artificial
  CRISPR gRNA sequence
tgtcaggtgttgatttagtt

SEQ ID NO: 155749 - DNA, 20 bp, Artificial
  CRISPR gRNA sequence
gtcaggtgttgatttagttc

SEQ ID NO: 155750 - DNA, 20 bp, Artificial
  CRISPR gRNA sequence
tcaggtgttgatttagttct

SEQ ID NO: 155751 - DNA, 20 bp, Artificial
  CRISPR gRNA sequence
atttagttctttaaaatgat

SEQ ID NO: 155752 - DNA, 20 bp, Artificial
  CRISPR gRNA sequence
agttctttaaaatgatgtga

SEQ ID NO: 155753 - DNA, 20 bp, Artificial
  CRISPR gRNA sequence
gttctttaaaatgatgtgag

SEQ ID NO: 155754 - DNA, 20 bp, Artificial
  CRISPR gRNA sequence
tttaaaatgatgtgagcaaa

SEQ ID NO: 155755 - DNA, 20 bp, Artificial
  CRISPR gRNA sequence
taaaatgatgtgagcaaagt

SEQ ID NO: 155756 - DNA, 20 bp, Artificial
  CRISPR gRNA sequence
aaaatgatgtgagcaaagtg

SEQ ID NO: 155757 - DNA, 20 bp, Artificial
  CRISPR gRNA sequence
aaatgatgtgagcaaagtgc

SEQ ID NO: 155758 - DNA, 20 bp, Artificial
  CRISPR gRNA sequence
tccatttttccgtattaaat

SEQ ID NO: 155759 - DNA, 20 bp, Artificial
  CRISPR gRNA sequence
ccatttttccgtattaaata

SEQ ID NO: 155760 - DNA, 20 bp, Artificial
  CRISPR gRNA sequence
catttttccgtattaaatat

SEQ ID NO: 155761 - DNA, 20 bp, Artificial
  CRISPR gRNA sequence
ttccgtattaaatatttaaa

SEQ ID NO: 155762 - DNA, 20 bp, Artificial
  CRISPR gRNA sequence
tccgtattaaatatttaaaa

SEQ ID NO: 155763 - DNA, 20 bp, Artificial
  CRISPR gRNA sequence
ccgtattaaatatttaaaat

SEQ ID NO: 155764 - DNA, 20 bp, Artificial
  CRISPR gRNA sequence
cgtattaaatatttaaaatc

SEQ ID NO: 155765 - DNA, 20 bp, Artificial
  CRISPR gRNA sequence
aatatttaaaatcctgcagt

SEQ ID NO: 155766 - DNA, 20 bp, Artificial
  CRISPR gRNA sequence
aaaatcctgcagtttgtgaa

SEQ ID NO: 155767 - DNA, 20 bp, Artificial
  CRISPR gRNA sequence
aaatcctgcagtttgtgaat

SEQ ID NO: 155768 - DNA, 20 bp, Artificial
  CRISPR gRNA sequence
cagtttgtgaataggaaagt

SEQ ID NO: 155769 - DNA, 20 bp, Artificial
  CRISPR gRNA sequence
gtgaataggaaagttaagag

SEQ ID NO: 155770 - DNA, 20 bp, Artificial
  CRISPR gRNA sequence
tgaataggaaagttaagagt

SEQ ID NO: 155771 - DNA, 20 bp, Artificial
  CRISPR gRNA sequence
agagtataggcaccctatct

SEQ ID NO: 155772 - DNA, 20 bp, Artificial
  CRISPR gRNA sequence
tcttttgcccttgatatgta

SEQ ID NO: 155773 - DNA, 20 bp, Artificial
  CRISPR gRNA sequence
ttgcccttgatatgtatata

SEQ ID NO: 155774 - DNA, 20 bp, Artificial
  CRISPR gRNA sequence
tgcccttgatatgtatatat

SEQ ID NO: 155775 - DNA, 20 bp, Artificial
  CRISPR gRNA sequence
gcccttgatatgtatatatt

SEQ ID NO: 155776 - DNA, 20 bp, Artificial
  CRISPR gRNA sequence
cccttgatatgtatatattt

SEQ ID NO: 155777 - DNA, 20 bp, Artificial
  CRISPR gRNA sequence
gatatgtatatatttttctc

SEQ ID NO: 155778 - DNA, 20 bp, Artificial
  CRISPR gRNA sequence
atatgtatatatttttctct

SEQ ID NO: 155779 - DNA, 20 bp, Artificial
  CRISPR gRNA sequence
ttctctttatggatataaag

SEQ ID NO: 155780 - DNA, 20 bp, Artificial
  CRISPR gRNA sequence
tctctttatggatataaagc

SEQ ID NO: 155781 - DNA, 20 bp, Artificial
  CRISPR gRNA sequence
ctctttatggatataaagct

SEQ ID NO: 155782 - DNA, 20 bp, Artificial
  CRISPR gRNA sequence
tctttatggatataaagcta

SEQ ID NO: 155783 - DNA, 20 bp, Artificial
  CRISPR gRNA sequence
tttatggatataaagctaat

SEQ ID NO: 155784 - DNA, 20 bp, Artificial
  CRISPR gRNA sequence
tatggatataaagctaatgt

SEQ ID NO: 155785 - DNA, 20 bp, Artificial
  CRISPR gRNA sequence
atggatataaagctaatgta

SEQ ID NO: 155786 - DNA, 20 bp, Artificial
  CRISPR gRNA sequence
tggatataaagctaatgtag

SEQ ID NO: 155787 - DNA, 20 bp, Artificial
  CRISPR gRNA sequence
atgtaggttgctaatcagta

SEQ ID NO: 155788 - DNA, 20 bp, Artificial
  CRISPR gRNA sequence
ctaatcagtaaccagccagt

SEQ ID NO: 155789 - DNA, 20 bp, Artificial
  CRISPR gRNA sequence
atcagtaaccagccagttct

SEQ ID NO: 155790 - DNA, 20 bp, Artificial
  CRISPR gRNA sequence
tcatgaacagtgaaatcttc

SEQ ID NO: 155791 - DNA, 20 bp, Artificial
  CRISPR gRNA sequence
atgaacagtgaaatcttcaa

SEQ ID NO: 155792 - DNA, 20 bp, Artificial
  CRISPR gRNA sequence
caatcccacatactaagatc

SEQ ID NO: 155793 - DNA, 20 bp, Artificial
  CRISPR gRNA sequence
aatcccacatactaagatct

SEQ ID NO: 155794 - DNA, 20 bp, Artificial
  CRISPR gRNA sequence
agatctataatacacctgat

SEQ ID NO: 155795 - DNA, 20 bp, Artificial
  CRISPR gRNA sequence
taatacacctgattttaaaa

SEQ ID NO: 155796 - DNA, 20 bp, Artificial
  CRISPR gRNA sequence
attttaaaatgcaattcttt

SEQ ID NO: 155797 - DNA, 20 bp, Artificial
  CRISPR gRNA sequence
taaaatgcaattctttgttt

SEQ ID NO: 155798 - DNA, 20 bp, Artificial
  CRISPR gRNA sequence
aaaatgcaattctttgtttt

SEQ ID NO: 155799 - DNA, 20 bp, Artificial
  CRISPR gRNA sequence
aaatgcaattctttgttttc

SEQ ID NO: 155800 - DNA, 20 bp, Artificial
  CRISPR gRNA sequence
tttgttttctttttatttgc

SEQ ID NO: 155801 - DNA, 20 bp, Artificial
  CRISPR gRNA sequence
tgttttctttttatttgcaa

SEQ ID NO: 155802 - DNA, 20 bp, Artificial
  CRISPR gRNA sequence
gttttctttttatttgcaaa

SEQ ID NO: 155803 - DNA, 20 bp, Artificial
  CRISPR gRNA sequence
ttttctttttatttgcaaat

SEQ ID NO: 155804 - DNA, 20 bp, Artificial
  CRISPR gRNA sequence
tctttttatttgcaaatatg

SEQ ID NO: 155805 - DNA, 20 bp, Artificial
  CRISPR gRNA sequence
ctttttatttgcaaatatgg

SEQ ID NO: 155806 - DNA, 20 bp, Artificial
  CRISPR gRNA sequence
tttttatttgcaaatatgga

SEQ ID NO: 155807 - DNA, 20 bp, Artificial
  CRISPR gRNA sequence
tttatttgcaaatatggaat

SEQ ID NO: 155808 - DNA, 20 bp, Artificial
  CRISPR gRNA sequence
ttatttgcaaatatggaatg

SEQ ID NO: 155809 - DNA, 20 bp, Artificial
  CRISPR gRNA sequence
tatttgcaaatatggaatga

SEQ ID NO: 155810 - DNA, 20 bp, Artificial
  CRISPR gRNA sequence
atttgcaaatatggaatgaa

SEQ ID NO: 155811 - DNA, 20 bp, Artificial
  CRISPR gRNA sequence
tttgcaaatatggaatgaag

SEQ ID NO: 155812 - DNA, 20 bp, Artificial
  CRISPR gRNA sequence
gcaaatatggaatgaaggtc

SEQ ID NO: 155813 - DNA, 20 bp, Artificial
  CRISPR gRNA sequence
caaatatggaatgaaggtca

SEQ ID NO: 155814 - DNA, 20 bp, Artificial
  CRISPR gRNA sequence
gaacatttctgcagcagact

SEQ ID NO: 155815 - DNA, 20 bp, Artificial
  CRISPR gRNA sequence
ctgcagcagactcagtgtgg

SEQ ID NO: 155816 - DNA, 20 bp, Artificial
  CRISPR gRNA sequence
tgcagcagactcagtgtgga

SEQ ID NO: 155817 - DNA, 20 bp, Artificial
  CRISPR gRNA sequence
cagcagactcagtgtggagc

SEQ ID NO: 155818 - DNA, 20 bp, Artificial
  CRISPR gRNA sequence
agtgtggagccgtcagccag

SEQ ID NO: 155819 - DNA, 20 bp, Artificial
  CRISPR gRNA sequence
agtctctgggtacggaaaag

SEQ ID NO: 155820 - DNA, 20 bp, Artificial
  CRISPR gRNA sequence
gtctctgggtacggaaaagg

SEQ ID NO: 155821 - DNA, 20 bp, Artificial
  CRISPR gRNA sequence
tgggtacggaaaaggagcag

SEQ ID NO: 155822 - DNA, 20 bp, Artificial
  CRISPR gRNA sequence
ggtacggaaaaggagcaggc

SEQ ID NO: 155823 - DNA, 20 bp, Artificial
  CRISPR gRNA sequence
ttagaggagaagtttcgagg

SEQ ID NO: 155824 - DNA, 20 bp, Artificial
  CRISPR gRNA sequence
gaggagaagtttcgagggtg

SEQ ID NO: 155825 - DNA, 20 bp, Artificial
  CRISPR gRNA sequence
cgagggtgtcgatttgcctt

SEQ ID NO: 155826 - DNA, 20 bp, Artificial
  CRISPR gRNA sequence
gagggtgtcgatttgccttc

SEQ ID NO: 155827 - DNA, 20 bp, Artificial
  CRISPR gRNA sequence
gccttccctagcttcccctc

SEQ ID NO: 155828 - DNA, 20 bp, Artificial
  CRISPR gRNA sequence
ccttccctagcttcccctct

SEQ ID NO: 155829 - DNA, 20 bp, Artificial
  CRISPR gRNA sequence
ccctagcttcccctctaata

SEQ ID NO: 155830 - DNA, 20 bp, Artificial
  CRISPR gRNA sequence
cctagcttcccctctaataa

SEQ ID NO: 155831 - DNA, 20 bp, Artificial
  CRISPR gRNA sequence
gcttcccctctaataaagga

SEQ ID NO: 155832 - DNA, 20 bp, Artificial
  CRISPR gRNA sequence
cccctctaataaaggattta

SEQ ID NO: 155833 - DNA, 20 bp, Artificial
  CRISPR gRNA sequence
ccctctaataaaggatttac

SEQ ID NO: 155834 - DNA, 20 bp, Artificial
  CRISPR gRNA sequence
taataaaggatttaccttag

SEQ ID NO: 155835 - DNA, 20 bp, Artificial
  CRISPR gRNA sequence
ataaaggatttaccttagag

SEQ ID NO: 155836 - DNA, 20 bp, Artificial
  CRISPR gRNA sequence
accttagaggactgatagga

SEQ ID NO: 155837 - DNA, 20 bp, Artificial
  CRISPR gRNA sequence
ccttagaggactgataggat

SEQ ID NO: 155838 - DNA, 20 bp, Artificial
  CRISPR gRNA sequence
agaggactgataggatttag

SEQ ID NO: 155839 - DNA, 20 bp, Artificial
  CRISPR gRNA sequence
gaggactgataggatttaga

SEQ ID NO: 155840 - DNA, 20 bp, Artificial
  CRISPR gRNA sequence
ataggatttagattcggggc

SEQ ID NO: 155841 - DNA, 20 bp, Artificial
  CRISPR gRNA sequence
agattcggggctcttggagt

SEQ ID NO: 155842 - DNA, 20 bp, Artificial
  CRISPR gRNA sequence
gattcggggctcttggagtt

SEQ ID NO: 155843 - DNA, 20 bp, Artificial
  CRISPR gRNA sequence
ggggctcttggagttgtaat

SEQ ID NO: 155844 - DNA, 20 bp, Artificial
  CRISPR gRNA sequence
ttggagttgtaatgatatag

SEQ ID NO: 155845 - DNA, 20 bp, Artificial
  CRISPR gRNA sequence
ggagttgtaatgatatagca

SEQ ID NO: 155846 - DNA, 20 bp, Artificial
  CRISPR gRNA sequence
gagttgtaatgatatagcaa

SEQ ID NO: 155847 - DNA, 20 bp, Artificial
  CRISPR gRNA sequence
taatgatatagcaagtcaaa

SEQ ID NO: 155848 - DNA, 20 bp, Artificial
  CRISPR gRNA sequence
ctggatgcaggcctctgtcg

SEQ ID NO: 155849 - DNA, 20 bp, Artificial
  CRISPR gRNA sequence
gatgcaggcctctgtcgttg

SEQ ID NO: 155850 - DNA, 20 bp, Artificial
  CRISPR gRNA sequence
tgtcgttgcttgcaaaagtg

SEQ ID NO: 155851 - DNA, 20 bp, Artificial
  CRISPR gRNA sequence
tcgttgcttgcaaaagtgac

SEQ ID NO: 155852 - DNA, 20 bp, Artificial
  CRISPR gRNA sequence
cttgcaaaagtgaccttgaa

SEQ ID NO: 155853 - DNA, 20 bp, Artificial
  CRISPR gRNA sequence
gcaaaagtgaccttgaaaaa

SEQ ID NO: 155854 - DNA, 20 bp, Artificial
  CRISPR gRNA sequence
caaaagtgaccttgaaaaac

SEQ ID NO: 155855 - DNA, 20 bp, Artificial
  CRISPR gRNA sequence
gaaaaactgctggggagttg

SEQ ID NO: 155856 - DNA, 20 bp, Artificial
  CRISPR gRNA sequence
aaaaactgctggggagttga

SEQ ID NO: 155857 - DNA, 20 bp, Artificial
  CRISPR gRNA sequence
ctggggagttgaaagattga

SEQ ID NO: 155858 - DNA, 20 bp, Artificial
  CRISPR gRNA sequence
gggagttgaaagattgaagg

SEQ ID NO: 155859 - DNA, 20 bp, Artificial
  CRISPR gRNA sequence
aaagattgaaggacaaagtt

SEQ ID NO: 155860 - DNA, 20 bp, Artificial
  CRISPR gRNA sequence
aaggacaaagtttgtttata

SEQ ID NO: 155861 - DNA, 20 bp, Artificial
  CRISPR gRNA sequence
gtttatacagatttggactg

SEQ ID NO: 155862 - DNA, 20 bp, Artificial
  CRISPR gRNA sequence
tttatacagatttggactga

SEQ ID NO: 155863 - DNA, 20 bp, Artificial
  CRISPR gRNA sequence
atacagatttggactgaaaa

SEQ ID NO: 155864 - DNA, 20 bp, Artificial
  CRISPR gRNA sequence
tacagatttggactgaaaag

SEQ ID NO: 155865 - DNA, 20 bp, Artificial
  CRISPR gRNA sequence
ggactgaaaagctctattta

SEQ ID NO: 155866 - DNA, 20 bp, Artificial
  CRISPR gRNA sequence
gactgaaaagctctatttaa

SEQ ID NO: 155867 - DNA, 20 bp, Artificial
  CRISPR gRNA sequence
aaaagctctatttaagatga

SEQ ID NO: 155868 - DNA, 20 bp, Artificial
  CRISPR gRNA sequence
tatttaagatgaaaagagac

SEQ ID NO: 155869 - DNA, 20 bp, Artificial
  CRISPR gRNA sequence
tttaagatgaaaagagactg

SEQ ID NO: 155870 - DNA, 20 bp, Artificial
  CRISPR gRNA sequence
aagatgaaaagagactgtac

SEQ ID NO: 155871 - DNA, 20 bp, Artificial
  CRISPR gRNA sequence
agatgaaaagagactgtact

SEQ ID NO: 155872 - DNA, 20 bp, Artificial
  CRISPR gRNA sequence
tacttctgatattcaagtcg

SEQ ID NO: 155873 - DNA, 20 bp, Artificial
  CRISPR gRNA sequence
ctgatattcaagtcgagtgg

SEQ ID NO: 155874 - DNA, 20 bp, Artificial
  CRISPR gRNA sequence
tgatattcaagtcgagtggt

SEQ ID NO: 155875 - DNA, 20 bp, Artificial
  CRISPR gRNA sequence
atattcaagtcgagtggtta

SEQ ID NO: 155876 - DNA, 20 bp, Artificial
  CRISPR gRNA sequence
aagtcgagtggttagtagga

SEQ ID NO: 155877 - DNA, 20 bp, Artificial
  CRISPR gRNA sequence
gtaggaatatgttatagatt

SEQ ID NO: 155878 - DNA, 20 bp, Artificial
  CRISPR gRNA sequence
tagattcagattaggaattt

SEQ ID NO: 155879 - DNA, 20 bp, Artificial
  CRISPR gRNA sequence
agattaggaattttcaggga

SEQ ID NO: 155880 - DNA, 20 bp, Artificial
  CRISPR gRNA sequence
ggaattttcagggaataaga

SEQ ID NO: 155881 - DNA, 20 bp, Artificial
  CRISPR gRNA sequence
tcagggaataagacaatagg

SEQ ID NO: 155882 - DNA, 20 bp, Artificial
  CRISPR gRNA sequence
cagggaataagacaataggg

SEQ ID NO: 155883 - DNA, 20 bp, Artificial
  CRISPR gRNA sequence
agggaataagacaatagggc

SEQ ID NO: 155884 - DNA, 20 bp, Artificial
  CRISPR gRNA sequence
cattcattctctctcccact

SEQ ID NO: 155885 - DNA, 20 bp, Artificial
  CRISPR gRNA sequence
attctctctcccactctttt

SEQ ID NO: 155886 - DNA, 20 bp, Artificial
  CRISPR gRNA sequence
tctctcccactctttttact

SEQ ID NO: 155887 - DNA, 20 bp, Artificial
  CRISPR gRNA sequence
tctcccactctttttacttc

SEQ ID NO: 155888 - DNA, 20 bp, Artificial
  CRISPR gRNA sequence
tcccactctttttacttccc

SEQ ID NO: 155889 - DNA, 20 bp, Artificial
  CRISPR gRNA sequence
ccactctttttacttccctc

SEQ ID NO: 155890 - DNA, 20 bp, Artificial
  CRISPR gRNA sequence
tttttacttccctcccccca

SEQ ID NO: 155891 - DNA, 20 bp, Artificial
  CRISPR gRNA sequence
tttacttccctccccccagc

SEQ ID NO: 155892 - DNA, 20 bp, Artificial
  CRISPR gRNA sequence
ttacttccctccccccagca

SEQ ID NO: 155893 - DNA, 20 bp, Artificial
  CRISPR gRNA sequence
tacttccctccccccagcaa

SEQ ID NO: 155894 - DNA, 20 bp, Artificial
  CRISPR gRNA sequence
acttccctccccccagcaaa

SEQ ID NO: 155895 - DNA, 20 bp, Artificial
  CRISPR gRNA sequence
cttccctccccccagcaaaa

SEQ ID NO: 155896 - DNA, 20 bp, Artificial
  CRISPR gRNA sequence
ccctccccccagcaaaaaat

SEQ ID NO: 155897 - DNA, 20 bp, Artificial
  CRISPR gRNA sequence
cctccccccagcaaaaaatt

SEQ ID NO: 155898 - DNA, 20 bp, Artificial
  CRISPR gRNA sequence
cccccagcaaaaaattctaa

SEQ ID NO: 155899 - DNA, 20 bp, Artificial
  CRISPR gRNA sequence
taaattcttttggtatgata

SEQ ID NO: 155900 - DNA, 20 bp, Artificial
  CRISPR gRNA sequence
aattcttttggtatgatagc

SEQ ID NO: 155901 - DNA, 20 bp, Artificial
  CRISPR gRNA sequence
ttttggtatgatagctgagt

SEQ ID NO: 155902 - DNA, 20 bp, Artificial
  CRISPR gRNA sequence
ttggtatgatagctgagtga

SEQ ID NO: 155903 - DNA, 20 bp, Artificial
  CRISPR gRNA sequence
tggtatgatagctgagtgaa

SEQ ID NO: 155904 - DNA, 20 bp, Artificial
  CRISPR gRNA sequence
ggtatgatagctgagtgaac

SEQ ID NO: 155905 - DNA, 20 bp, Artificial
  CRISPR gRNA sequence
gtatgatagctgagtgaact

SEQ ID NO: 155906 - DNA, 20 bp, Artificial
  CRISPR gRNA sequence
agtgaactgcctaacagatt

SEQ ID NO: 155907 - DNA, 20 bp, Artificial
  CRISPR gRNA sequence
cctaacagattcagaattcc

SEQ ID NO: 155908 - DNA, 20 bp, Artificial
  CRISPR gRNA sequence
acagattcagaattccttgc

SEQ ID NO: 155909 - DNA, 20 bp, Artificial
  CRISPR gRNA sequence
agaattccttgcatgctacc

SEQ ID NO: 155910 - DNA, 20 bp, Artificial
  CRISPR gRNA sequence
cttgcatgctaccttgtctt

SEQ ID NO: 155911 - DNA, 20 bp, Artificial
  CRISPR gRNA sequence
gcatgctaccttgtcttctt

SEQ ID NO: 155912 - DNA, 20 bp, Artificial
  CRISPR gRNA sequence
catgctaccttgtcttcttt

SEQ ID NO: 155913 - DNA, 20 bp, Artificial
  CRISPR gRNA sequence
ccttgtcttctttgtaatct

SEQ ID NO: 155914 - DNA, 20 bp, Artificial
  CRISPR gRNA sequence
gtcttctttgtaatctagag

SEQ ID NO: 155915 - DNA, 20 bp, Artificial
  CRISPR gRNA sequence
tcttctttgtaatctagagg

SEQ ID NO: 155916 - DNA, 20 bp, Artificial
  CRISPR gRNA sequence
ctttgtaatctagagggttc

SEQ ID NO: 155917 - DNA, 20 bp, Artificial
  CRISPR gRNA sequence
tttgtaatctagagggttct

SEQ ID NO: 155918 - DNA, 20 bp, Artificial
  CRISPR gRNA sequence
tgtaatctagagggttctta

SEQ ID NO: 155919 - DNA, 20 bp, Artificial
  CRISPR gRNA sequence
gtaatctagagggttcttag

SEQ ID NO: 155920 - DNA, 20 bp, Artificial
  CRISPR gRNA sequence
taatctagagggttcttagt

SEQ ID NO: 155921 - DNA, 20 bp, Artificial
  CRISPR gRNA sequence
gagggttcttagtgaagggg

SEQ ID NO: 155922 - DNA, 20 bp, Artificial
  CRISPR gRNA sequence
ttagtgaaggggatagatag

SEQ ID NO: 155923 - DNA, 20 bp, Artificial
  CRISPR gRNA sequence
agtgaaggggatagatagta

SEQ ID NO: 155924 - DNA, 20 bp, Artificial
  CRISPR gRNA sequence
gtgaaggggatagatagtat

SEQ ID NO: 155925 - DNA, 20 bp, Artificial
  CRISPR gRNA sequence
taggagttcagagtagttgt

SEQ ID NO: 155926 - DNA, 20 bp, Artificial
  CRISPR gRNA sequence
aggagttcagagtagttgta

SEQ ID NO: 155927 - DNA, 20 bp, Artificial
  CRISPR gRNA sequence
ggagttcagagtagttgtat

SEQ ID NO: 155928 - DNA, 20 bp, Artificial
  CRISPR gRNA sequence
agagtagttgtatttgtgaa

SEQ ID NO: 155929 - DNA, 20 bp, Artificial
  CRISPR gRNA sequence
tatttgtgaaagttttgggg

SEQ ID NO: 155930 - DNA, 20 bp, Artificial
  CRISPR gRNA sequence
gtgaaagttttggggaatta

SEQ ID NO: 155931 - DNA, 20 bp, Artificial
  CRISPR gRNA sequence
tgaaagttttggggaattag

SEQ ID NO: 155932 - DNA, 20 bp, Artificial
  CRISPR gRNA sequence
tggggaattagaatgcttat

SEQ ID NO: 155933 - DNA, 20 bp, Artificial
  CRISPR gRNA sequence
ggggaattagaatgcttata

SEQ ID NO: 155934 - DNA, 20 bp, Artificial
  CRISPR gRNA sequence
gggaattagaatgcttataa

SEQ ID NO: 155935 - DNA, 20 bp, Artificial
  CRISPR gRNA sequence
gaatgcttataataagaaaa

SEQ ID NO: 155936 - DNA, 20 bp, Artificial
  CRISPR gRNA sequence
ataataagaaaatgttcatt

SEQ ID NO: 155937 - DNA, 20 bp, Artificial
  CRISPR gRNA sequence
taataagaaaatgttcattc

SEQ ID NO: 155938 - DNA, 20 bp, Artificial
  CRISPR gRNA sequence
attctgggaatttaagtcct

SEQ ID NO: 155939 - DNA, 20 bp, Artificial
  CRISPR gRNA sequence
tgggaatttaagtcctaaga

SEQ ID NO: 155940 - DNA, 20 bp, Artificial
  CRISPR gRNA sequence
ggaatttaagtcctaagatg

SEQ ID NO: 155941 - DNA, 20 bp, Artificial
  CRISPR gRNA sequence
aagtcctaagatgaagaagt

SEQ ID NO: 155942 - DNA, 20 bp, Artificial
  CRISPR gRNA sequence
agtcctaagatgaagaagta

SEQ ID NO: 155943 - DNA, 20 bp, Artificial
  CRISPR gRNA sequence
agatgaagaagtatgtgtta

SEQ ID NO: 155944 - DNA, 20 bp, Artificial
  CRISPR gRNA sequence
aggattacattttaagaggt

SEQ ID NO: 155945 - DNA, 20 bp, Artificial
  CRISPR gRNA sequence
cattttaagaggtagttatt

SEQ ID NO: 155946 - DNA, 20 bp, Artificial
  CRISPR gRNA sequence
taagaggtagttattttgat

SEQ ID NO: 155947 - DNA, 20 bp, Artificial
  CRISPR gRNA sequence
aagaggtagttattttgatt

SEQ ID NO: 155948 - DNA, 20 bp, Artificial
  CRISPR gRNA sequence
agaggtagttattttgattt

SEQ ID NO: 155949 - DNA, 20 bp, Artificial
  CRISPR gRNA sequence
ttttgatttaaatttatttg

SEQ ID NO: 155950 - DNA, 20 bp, Artificial
  CRISPR gRNA sequence
tgatttaaatttatttgttt

SEQ ID NO: 155951 - DNA, 20 bp, Artificial
  CRISPR gRNA sequence
gatttaaatttatttgtttg

SEQ ID NO: 155952 - DNA, 20 bp, Artificial
  CRISPR gRNA sequence
atttaaatttatttgtttgt

SEQ ID NO: 155953 - DNA, 20 bp, Artificial
  CRISPR gRNA sequence
aaatttatttgtttgtcatt

SEQ ID NO: 155954 - DNA, 20 bp, Artificial
  CRISPR gRNA sequence
aatttatttgtttgtcattg

SEQ ID NO: 155955 - DNA, 20 bp, Artificial
  CRISPR gRNA sequence
atttgtttgtcattgattat

SEQ ID NO: 155956 - DNA, 20 bp, Artificial
  CRISPR gRNA sequence
tttgtttgtcattgattatt

SEQ ID NO: 155957 - DNA, 20 bp, Artificial
  CRISPR gRNA sequence
gtttgtcattgattatttat

SEQ ID NO: 155958 - DNA, 20 bp, Artificial
  CRISPR gRNA sequence
tttgtcattgattatttata

SEQ ID NO: 155959 - DNA, 20 bp, Artificial
  CRISPR gRNA sequence
gtcattgattatttatatgt

SEQ ID NO: 155960 - DNA, 20 bp, Artificial
  CRISPR gRNA sequence
tcattgattatttatatgtt

SEQ ID NO: 155961 - DNA, 20 bp, Artificial
  CRISPR gRNA sequence
attatttatatgttatcagt

SEQ ID NO: 155962 - DNA, 20 bp, Artificial
  CRISPR gRNA sequence
tttatatgttatcagttgtt

SEQ ID NO: 155963 - DNA, 20 bp, Artificial
  CRISPR gRNA sequence
atatgttatcagttgttcca

SEQ ID NO: 155964 - DNA, 20 bp, Artificial
  CRISPR gRNA sequence
tatgttatcagttgttccag

SEQ ID NO: 155965 - DNA, 20 bp, Artificial
  CRISPR gRNA sequence
tcagttgttccagattatat

SEQ ID NO: 155966 - DNA, 20 bp, Artificial
  CRISPR gRNA sequence
ttccagattatatatatgat

SEQ ID NO: 155967 - DNA, 20 bp, Artificial
  CRISPR gRNA sequence
cagattatatatatgatttt

SEQ ID NO: 155968 - DNA, 20 bp, Artificial
  CRISPR gRNA sequence
tatatatgattttaaaaaca

SEQ ID NO: 155969 - DNA, 20 bp, Artificial
  CRISPR gRNA sequence
taaaaacagttgtaggtgct

SEQ ID NO: 155970 - DNA, 20 bp, Artificial
  CRISPR gRNA sequence
aaaaacagttgtaggtgctg

SEQ ID NO: 155971 - DNA, 20 bp, Artificial
  CRISPR gRNA sequence
aaaacagttgtaggtgctga

SEQ ID NO: 155972 - DNA, 20 bp, Artificial
  CRISPR gRNA sequence
taggtgctgacttgaccctg

SEQ ID NO: 155973 - DNA, 20 bp, Artificial
  CRISPR gRNA sequence
acttgaccctgttggcccta

SEQ ID NO: 155974 - DNA, 20 bp, Artificial
  CRISPR gRNA sequence
gaccctgttggccctaggag

SEQ ID NO: 155975 - DNA, 20 bp, Artificial
  CRISPR gRNA sequence
accctgttggccctaggaga

SEQ ID NO: 155976 - DNA, 20 bp, Artificial
  CRISPR gRNA sequence
ttggccctaggagaaggcct

SEQ ID NO: 155977 - DNA, 20 bp, Artificial
  CRISPR gRNA sequence
gccctaggagaaggcctgca

SEQ ID NO: 155978 - DNA, 20 bp, Artificial
  CRISPR gRNA sequence
ggagaaggcctgcagcaggg

SEQ ID NO: 155979 - DNA, 20 bp, Artificial
  CRISPR gRNA sequence
cagcaggggaggcaaaagtg

SEQ ID NO: 155980 - DNA, 20 bp, Artificial
  CRISPR gRNA sequence
taaacttgagaactttgtgg

SEQ ID NO: 155981 - DNA, 20 bp, Artificial
  CRISPR gRNA sequence
gagaactttgtggatttggc

SEQ ID NO: 155982 - DNA, 20 bp, Artificial
  CRISPR gRNA sequence
agaactttgtggatttggct

SEQ ID NO: 155983 - DNA, 20 bp, Artificial
  CRISPR gRNA sequence
tgtggatttggcttcttgga

SEQ ID NO: 155984 - DNA, 20 bp, Artificial
  CRISPR gRNA sequence
gtggatttggcttcttggaa

SEQ ID NO: 155985 - DNA, 20 bp, Artificial
  CRISPR gRNA sequence
tggatttggcttcttggaaa

SEQ ID NO: 155986 - DNA, 20 bp, Artificial
  CRISPR gRNA sequence
ggcttcttggaaagatgccc

SEQ ID NO: 155987 - DNA, 20 bp, Artificial
  CRISPR gRNA sequence
gcttcttggaaagatgccca

SEQ ID NO: 155988 - DNA, 20 bp, Artificial
  CRISPR gRNA sequence
cttggaaagatgcccagtca

SEQ ID NO: 155989 - DNA, 20 bp, Artificial
  CRISPR gRNA sequence
ttggaaagatgcccagtcac

SEQ ID NO: 155990 - DNA, 20 bp, Artificial
  CRISPR gRNA sequence
ggaaagatgcccagtcactg

SEQ ID NO: 155991 - DNA, 20 bp, Artificial
  CRISPR gRNA sequence
gaaagatgcccagtcactgc

SEQ ID NO: 155992 - DNA, 20 bp, Artificial
  CRISPR gRNA sequence
cctctagccgaggttcttca

SEQ ID NO: 155993 - DNA, 20 bp, Artificial
  CRISPR gRNA sequence
tagccgaggttcttcaccat

SEQ ID NO: 155994 - DNA, 20 bp, Artificial
  CRISPR gRNA sequence
gccgaggttcttcaccattc

SEQ ID NO: 155995 - DNA, 20 bp, Artificial
  CRISPR gRNA sequence
ttcaccattctctttgagaa

SEQ ID NO: 155996 - DNA, 20 bp, Artificial
  CRISPR gRNA sequence
caccattctctttgagaatg

SEQ ID NO: 155997 - DNA, 20 bp, Artificial
  CRISPR gRNA sequence
accattctctttgagaatga

SEQ ID NO: 155998 - DNA, 20 bp, Artificial
  CRISPR gRNA sequence
tctttgagaatgacccacta

SEQ ID NO: 155999 - DNA, 20 bp, Artificial
  CRISPR gRNA sequence
tttgagaatgacccactacc

SEQ ID NO: 156000 - DNA, 20 bp, Artificial
  CRISPR gRNA sequence
tgagaatgacccactacctg

SEQ ID NO: 156001 - DNA, 20 bp, Artificial
  CRISPR gRNA sequence
gagaatgacccactacctgg

SEQ ID NO: 156002 - DNA, 20 bp, Artificial
  CRISPR gRNA sequence
agaatgacccactacctgga

SEQ ID NO: 156003 - DNA, 20 bp, Artificial
  CRISPR gRNA sequence
cctggaaaaatgcacatggg

SEQ ID NO: 156004 - DNA, 20 bp, Artificial
  CRISPR gRNA sequence
gaaaaatgcacatgggcatg

SEQ ID NO: 156005 - DNA, 20 bp, Artificial
  CRISPR gRNA sequence
tacaaaacctttgatgacta

SEQ ID NO: 156006 - DNA, 20 bp, Artificial
  CRISPR gRNA sequence
tgatgactaagttatttttt

SEQ ID NO: 156007 - DNA, 20 bp, Artificial
  CRISPR gRNA sequence
gatgactaagttatttttta

SEQ ID NO: 156008 - DNA, 20 bp, Artificial
  CRISPR gRNA sequence
atgactaagttattttttag

SEQ ID NO: 156009 - DNA, 20 bp, Artificial
  CRISPR gRNA sequence
agttattttttagtgtatgt

SEQ ID NO: 156010 - DNA, 20 bp, Artificial
  CRISPR gRNA sequence
ttttttagtgtatgtcaaat

SEQ ID NO: 156011 - DNA, 20 bp, Artificial
  CRISPR gRNA sequence
tttagtgtatgtcaaatggt

SEQ ID NO: 156012 - DNA, 20 bp, Artificial
  CRISPR gRNA sequence
ttagtgtatgtcaaatggta

SEQ ID NO: 156013 - DNA, 20 bp, Artificial
  CRISPR gRNA sequence
tagtgtatgtcaaatggtat

SEQ ID NO: 156014 - DNA, 20 bp, Artificial
  CRISPR gRNA sequence
agtgtatgtcaaatggtatt

SEQ ID NO: 156015 - DNA, 20 bp, Artificial
  CRISPR gRNA sequence
gtgtatgtcaaatggtattt

SEQ ID NO: 156016 - DNA, 20 bp, Artificial
  CRISPR gRNA sequence
aacacttcagccagataaat

SEQ ID NO: 156017 - DNA, 20 bp, Artificial
  CRISPR gRNA sequence
acacttcagccagataaatg

SEQ ID NO: 156018 - DNA, 20 bp, Artificial
  CRISPR gRNA sequence
cagccagataaatgtttact

SEQ ID NO: 156019 - DNA, 20 bp, Artificial
  CRISPR gRNA sequence
agccagataaatgtttacta

SEQ ID NO: 156020 - DNA, 20 bp, Artificial
  CRISPR gRNA sequence
actagacaaatgaagaaaac

SEQ ID NO: 156021 - DNA, 20 bp, Artificial
  CRISPR gRNA sequence
ctagacaaatgaagaaaact

SEQ ID NO: 156022 - DNA, 20 bp, Artificial
  CRISPR gRNA sequence
gacaaatgaagaaaactttg

SEQ ID NO: 156023 - DNA, 20 bp, Artificial
  CRISPR gRNA sequence
tgcttccagaaagagcaaag

SEQ ID NO: 156024 - DNA, 20 bp, Artificial
  CRISPR gRNA sequence
gcttccagaaagagcaaaga

SEQ ID NO: 156025 - DNA, 20 bp, Artificial
  CRISPR gRNA sequence
cttccagaaagagcaaagac

SEQ ID NO: 156026 - DNA, 20 bp, Artificial
  CRISPR gRNA sequence
ccagaaagagcaaagacctt

SEQ ID NO: 156027 - DNA, 20 bp, Artificial
  CRISPR gRNA sequence
cagaaagagcaaagaccttc

SEQ ID NO: 156028 - DNA, 20 bp, Artificial
  CRISPR gRNA sequence
ctagagagctaactctaatt

SEQ ID NO: 156029 - DNA, 20 bp, Artificial
  CRISPR gRNA sequence
tagagagctaactctaattt

SEQ ID NO: 156030 - DNA, 20 bp, Artificial
  CRISPR gRNA sequence
gagagctaactctaatttag

SEQ ID NO: 156031 - DNA, 20 bp, Artificial
  CRISPR gRNA sequence
actctaatttaggccatggg

SEQ ID NO: 156032 - DNA, 20 bp, Artificial
  CRISPR gRNA sequence
taatttaggccatgggtggc

SEQ ID NO: 156033 - DNA, 20 bp, Artificial
  CRISPR gRNA sequence
atttaggccatgggtggctg

SEQ ID NO: 156034 - DNA, 20 bp, Artificial
  CRISPR gRNA sequence
aggccatgggtggctgtgtg

SEQ ID NO: 156035 - DNA, 20 bp, Artificial
  CRISPR gRNA sequence
ggccatgggtggctgtgtgt

SEQ ID NO: 156036 - DNA, 20 bp, Artificial
  CRISPR gRNA sequence
tgtgtgtaagtgggggaggc

SEQ ID NO: 156037 - DNA, 20 bp, Artificial
  CRISPR gRNA sequence
agatggggtctagagatatg

SEQ ID NO: 156038 - DNA, 20 bp, Artificial
  CRISPR gRNA sequence
gatggggtctagagatatgg

SEQ ID NO: 156039 - DNA, 20 bp, Artificial
  CRISPR gRNA sequence
gagatatggacatttattta

SEQ ID NO: 156040 - DNA, 20 bp, Artificial
  CRISPR gRNA sequence
atttactctgatcacagtat

SEQ ID NO: 156041 - DNA, 20 bp, Artificial
  CRISPR gRNA sequence
tttactctgatcacagtatt

SEQ ID NO: 156042 - DNA, 20 bp, Artificial
  CRISPR gRNA sequence
actctgatcacagtatttga

SEQ ID NO: 156043 - DNA, 20 bp, Artificial
  CRISPR gRNA sequence
ctctgatcacagtatttgag

SEQ ID NO: 156044 - DNA, 20 bp, Artificial
  CRISPR gRNA sequence
tgatcacagtatttgaggca

SEQ ID NO: 156045 - DNA, 20 bp, Artificial
  CRISPR gRNA sequence
atcacagtatttgaggcagc

SEQ ID NO: 156046 - DNA, 20 bp, Artificial
  CRISPR gRNA sequence
gaggcagcatggtacagacc

SEQ ID NO: 156047 - DNA, 20 bp, Artificial
  CRISPR gRNA sequence
aggcagcatggtacagacca

SEQ ID NO: 156048 - DNA, 20 bp, Artificial
  CRISPR gRNA sequence
aaagtcaagagatctgtgtt

SEQ ID NO: 156049 - DNA, 20 bp, Artificial
  CRISPR gRNA sequence
aagtcaagagatctgtgttc

SEQ ID NO: 156050 - DNA, 20 bp, Artificial
  CRISPR gRNA sequence
tgttcaagccccactcacct

SEQ ID NO: 156051 - DNA, 20 bp, Artificial
  CRISPR gRNA sequence
aagccccactcacctttatc

SEQ ID NO: 156052 - DNA, 20 bp, Artificial
  CRISPR gRNA sequence
acctttatcaccagctttgt

SEQ ID NO: 156053 - DNA, 20 bp, Artificial
  CRISPR gRNA sequence
tatcaccagctttgtaggtt

SEQ ID NO: 156054 - DNA, 20 bp, Artificial
  CRISPR gRNA sequence
atcaccagctttgtaggttt

SEQ ID NO: 156055 - DNA, 20 bp, Artificial
  CRISPR gRNA sequence
tcaccagctttgtaggtttg

SEQ ID NO: 156056 - DNA, 20 bp, Artificial
  CRISPR gRNA sequence
tgtaggtttgggcaagtcag

SEQ ID NO: 156057 - DNA, 20 bp, Artificial
  CRISPR gRNA sequence
gtaggtttgggcaagtcagc

SEQ ID NO: 156058 - DNA, 20 bp, Artificial
  CRISPR gRNA sequence
taggtttgggcaagtcagct

SEQ ID NO: 156059 - DNA, 20 bp, Artificial
  CRISPR gRNA sequence
gggcaagtcagctatttagt

SEQ ID NO: 156060 - DNA, 20 bp, Artificial
  CRISPR gRNA sequence
ggcaagtcagctatttagtg

SEQ ID NO: 156061 - DNA, 20 bp, Artificial
  CRISPR gRNA sequence
tttagtgttagcttcctcac

SEQ ID NO: 156062 - DNA, 20 bp, Artificial
  CRISPR gRNA sequence
agtgttagcttcctcacatg

SEQ ID NO: 156063 - DNA, 20 bp, Artificial
  CRISPR gRNA sequence
gtgttagcttcctcacatgt

SEQ ID NO: 156064 - DNA, 20 bp, Artificial
  CRISPR gRNA sequence
gcttcctcacatgtaaaaat

SEQ ID NO: 156065 - DNA, 20 bp, Artificial
  CRISPR gRNA sequence
cctcacatgtaaaaatggaa

SEQ ID NO: 156066 - DNA, 20 bp, Artificial
  CRISPR gRNA sequence
ctcacatgtaaaaatggaac

SEQ ID NO: 156067 - DNA, 20 bp, Artificial
  CRISPR gRNA sequence
acatgtaaaaatggaaccta

SEQ ID NO: 156068 - DNA, 20 bp, Artificial
  CRISPR gRNA sequence
aaaatagtgtctgatttagt

SEQ ID NO: 156069 - DNA, 20 bp, Artificial
  CRISPR gRNA sequence
atttagtggcgagtcttgaa

SEQ ID NO: 156070 - DNA, 20 bp, Artificial
  CRISPR gRNA sequence
agtggcgagtcttgaatgag

SEQ ID NO: 156071 - DNA, 20 bp, Artificial
  CRISPR gRNA sequence
gtggcgagtcttgaatgaga

SEQ ID NO: 156072 - DNA, 20 bp, Artificial
  CRISPR gRNA sequence
gaatgagatcatgtgtgtca

SEQ ID NO: 156073 - DNA, 20 bp, Artificial
  CRISPR gRNA sequence
aatgagatcatgtgtgtcaa

SEQ ID NO: 156074 - DNA, 20 bp, Artificial
  CRISPR gRNA sequence
tgcaaattgtgaagagctac

SEQ ID NO: 156075 - DNA, 20 bp, Artificial
  CRISPR gRNA sequence
gcaaattgtgaagagctaca

SEQ ID NO: 156076 - DNA, 20 bp, Artificial
  CRISPR gRNA sequence
caaattgtgaagagctacat

SEQ ID NO: 156077 - DNA, 20 bp, Artificial
  CRISPR gRNA sequence
tgaagagctacataatatta

SEQ ID NO: 156078 - DNA, 20 bp, Artificial
  CRISPR gRNA sequence
cataatattagttgttacta

SEQ ID NO: 156079 - DNA, 20 bp, Artificial
  CRISPR gRNA sequence
gttgttactaatccagacta

SEQ ID NO: 156080 - DNA, 20 bp, Artificial
  CRISPR gRNA sequence
ttactaatccagactatttg

SEQ ID NO: 156081 - DNA, 20 bp, Artificial
  CRISPR gRNA sequence
ctaatccagactatttgggg

SEQ ID NO: 156082 - DNA, 20 bp, Artificial
  CRISPR gRNA sequence
atccagactatttgggggat

SEQ ID NO: 156083 - DNA, 20 bp, Artificial
  CRISPR gRNA sequence
tttgggggatgaaacgttta

SEQ ID NO: 156084 - DNA, 20 bp, Artificial
  CRISPR gRNA sequence
gggggatgaaacgtttatga

SEQ ID NO: 156085 - DNA, 20 bp, Artificial
  CRISPR gRNA sequence
ggggatgaaacgtttatgaa

SEQ ID NO: 156086 - DNA, 20 bp, Artificial
  CRISPR gRNA sequence
atgaagataggtgtggcatc

SEQ ID NO: 156087 - DNA, 20 bp, Artificial
  CRISPR gRNA sequence
tgaagataggtgtggcatca

SEQ ID NO: 156088 - DNA, 20 bp, Artificial
  CRISPR gRNA sequence
taatatttgtaaaaaggagt

SEQ ID NO: 156089 - DNA, 20 bp, Artificial
  CRISPR gRNA sequence
aatatttgtaaaaaggagtt

SEQ ID NO: 156090 - DNA, 20 bp, Artificial
  CRISPR gRNA sequence
atatttgtaaaaaggagtta

SEQ ID NO: 156091 - DNA, 20 bp, Artificial
  CRISPR gRNA sequence
gtaaaaaggagttagtttaa

SEQ ID NO: 156092 - DNA, 20 bp, Artificial
  CRISPR gRNA sequence
taaaaaggagttagtttaaa

SEQ ID NO: 156093 - DNA, 20 bp, Artificial
  CRISPR gRNA sequence
gtttaaacctgacacatttc

SEQ ID NO: 156094 - DNA, 20 bp, Artificial
  CRISPR gRNA sequence
aaacctgacacatttctttt

SEQ ID NO: 156095 - DNA, 20 bp, Artificial
  CRISPR gRNA sequence
aacctgacacatttcttttt

SEQ ID NO: 156096 - DNA, 20 bp, Artificial
  CRISPR gRNA sequence
acacatttctttttaaactg

SEQ ID NO: 156097 - DNA, 20 bp, Artificial
  CRISPR gRNA sequence
ctttttaaactgccttcacc

SEQ ID NO: 156098 - DNA, 20 bp, Artificial
  CRISPR gRNA sequence
tttttaaactgccttcacct

SEQ ID NO: 156099 - DNA, 20 bp, Artificial
  CRISPR gRNA sequence
tttaaactgccttcacctgc

SEQ ID NO: 156100 - DNA, 20 bp, Artificial
  CRISPR gRNA sequence
ttaaactgccttcacctgca

SEQ ID NO: 156101 - DNA, 20 bp, Artificial
  CRISPR gRNA sequence
taaactgccttcacctgcat

SEQ ID NO: 156102 - DNA, 20 bp, Artificial
  CRISPR gRNA sequence
aaactgccttcacctgcata

SEQ ID NO: 156103 - DNA, 20 bp, Artificial
  CRISPR gRNA sequence
aactgccttcacctgcatat

SEQ ID NO: 156104 - DNA, 20 bp, Artificial
  CRISPR gRNA sequence
ccttcacctgcatattccta

SEQ ID NO: 156105 - DNA, 20 bp, Artificial
  CRISPR gRNA sequence
cacctgcatattcctattta

SEQ ID NO: 156106 - DNA, 20 bp, Artificial
  CRISPR gRNA sequence
acctgcatattcctatttat

SEQ ID NO: 156107 - DNA, 20 bp, Artificial
  CRISPR gRNA sequence
catattcctatttatgctga

SEQ ID NO: 156108 - DNA, 20 bp, Artificial
  CRISPR gRNA sequence
ctatttatgctgacatgacc

SEQ ID NO: 156109 - DNA, 20 bp, Artificial
  CRISPR gRNA sequence
tttatgctgacatgacccta

SEQ ID NO: 156110 - DNA, 20 bp, Artificial
  CRISPR gRNA sequence
atgctgacatgaccctattt

SEQ ID NO: 156111 - DNA, 20 bp, Artificial
  CRISPR gRNA sequence
tgctgacatgaccctattta

SEQ ID NO: 156112 - DNA, 20 bp, Artificial
  CRISPR gRNA sequence
acatgaccctatttatttaa

SEQ ID NO: 156113 - DNA, 20 bp, Artificial
  CRISPR gRNA sequence
tttatttaatgcatatgttg

SEQ ID NO: 156114 - DNA, 20 bp, Artificial
  CRISPR gRNA sequence
atttaatgcatatgttgaga

SEQ ID NO: 156115 - DNA, 20 bp, Artificial
  CRISPR gRNA sequence
tttaatgcatatgttgagac

SEQ ID NO: 156116 - DNA, 20 bp, Artificial
  CRISPR gRNA sequence
aatgcatatgttgagaccac

SEQ ID NO: 156117 - DNA, 20 bp, Artificial
  CRISPR gRNA sequence
atgcatatgttgagaccacc

SEQ ID NO: 156118 - DNA, 20 bp, Artificial
  CRISPR gRNA sequence
agaccaccagtcctttactc

SEQ ID NO: 156119 - DNA, 20 bp, Artificial
  CRISPR gRNA sequence
tactcatcaagatccttgtg

SEQ ID NO: 156120 - DNA, 20 bp, Artificial
  CRISPR gRNA sequence
actcatcaagatccttgtga

SEQ ID NO: 156121 - DNA, 20 bp, Artificial
  CRISPR gRNA sequence
ctcatcaagatccttgtgaa

SEQ ID NO: 156122 - DNA, 20 bp, Artificial
  CRISPR gRNA sequence
atcaagatccttgtgaaaga

SEQ ID NO: 156123 - DNA, 20 bp, Artificial
  CRISPR gRNA sequence
gtgaaagaattttaacccct

SEQ ID NO: 156124 - DNA, 20 bp, Artificial
  CRISPR gRNA sequence
tgaaagaattttaacccctt

SEQ ID NO: 156125 - DNA, 20 bp, Artificial
  CRISPR gRNA sequence
taacccctttgtcaaaattt

SEQ ID NO: 156126 - DNA, 20 bp, Artificial
  CRISPR gRNA sequence
aacccctttgtcaaaattta

SEQ ID NO: 156127 - DNA, 20 bp, Artificial
  CRISPR gRNA sequence
acccctttgtcaaaatttaa

SEQ ID NO: 156128 - DNA, 20 bp, Artificial
  CRISPR gRNA sequence
tgtcaaaatttaaggacctc

SEQ ID NO: 156129 - DNA, 20 bp, Artificial
  CRISPR gRNA sequence
gtcaaaatttaaggacctct

SEQ ID NO: 156130 - DNA, 20 bp, Artificial
  CRISPR gRNA sequence
tcaaaatttaaggacctctc

SEQ ID NO: 156131 - DNA, 20 bp, Artificial
  CRISPR gRNA sequence
aaggacctctcagaatagga

SEQ ID NO: 156132 - DNA, 20 bp, Artificial
  CRISPR gRNA sequence
aggacctctcagaataggat

SEQ ID NO: 156133 - DNA, 20 bp, Artificial
  CRISPR gRNA sequence
tcagaataggatgaaatggg

SEQ ID NO: 156134 - DNA, 20 bp, Artificial
  CRISPR gRNA sequence
agaataggatgaaatgggta

SEQ ID NO: 156135 - DNA, 20 bp, Artificial
  CRISPR gRNA sequence
atttttaaaaaactcttgtt

SEQ ID NO: 156136 - DNA, 20 bp, Artificial
  CRISPR gRNA sequence
ttaaaaaactcttgttagat

SEQ ID NO: 156137 - DNA, 20 bp, Artificial
  CRISPR gRNA sequence
taaaaaactcttgttagatt

SEQ ID NO: 156138 - DNA, 20 bp, Artificial
  CRISPR gRNA sequence
aaaaaactcttgttagattt

SEQ ID NO: 156139 - DNA, 20 bp, Artificial
  CRISPR gRNA sequence
aaaaactcttgttagattta

SEQ ID NO: 156140 - DNA, 20 bp, Artificial
  CRISPR gRNA sequence
ttgttagatttaggaacctc

SEQ ID NO: 156141 - DNA, 20 bp, Artificial
  CRISPR gRNA sequence
gttagatttaggaacctctc

SEQ ID NO: 156142 - DNA, 20 bp, Artificial
  CRISPR gRNA sequence
ttagatttaggaacctctca

SEQ ID NO: 156143 - DNA, 20 bp, Artificial
  CRISPR gRNA sequence
gatttaggaacctctcagaa

SEQ ID NO: 156144 - DNA, 20 bp, Artificial
  CRISPR gRNA sequence
aggaacctctcagaataaaa

SEQ ID NO: 156145 - DNA, 20 bp, Artificial
  CRISPR gRNA sequence
ggaacctctcagaataaaat

SEQ ID NO: 156146 - DNA, 20 bp, Artificial
  CRISPR gRNA sequence
tcagaataaaatctggaagc

SEQ ID NO: 156147 - DNA, 20 bp, Artificial
  CRISPR gRNA sequence
agaataaaatctggaagcct

SEQ ID NO: 156148 - DNA, 20 bp, Artificial
  CRISPR gRNA sequence
gaagcctgttccatttgcat

SEQ ID NO: 156149 - DNA, 20 bp, Artificial
  CRISPR gRNA sequence
ttccatttgcattatgagat

SEQ ID NO: 156150 - DNA, 20 bp, Artificial
  CRISPR gRNA sequence
catttgcattatgagatttg

SEQ ID NO: 156151 - DNA, 20 bp, Artificial
  CRISPR gRNA sequence
gcattatgagatttgcatta

SEQ ID NO: 156152 - DNA, 20 bp, Artificial
  CRISPR gRNA sequence
cattatgagatttgcattac

SEQ ID NO: 156153 - DNA, 20 bp, Artificial
  CRISPR gRNA sequence
tgagatttgcattacaatgc

SEQ ID NO: 156154 - DNA, 20 bp, Artificial
  CRISPR gRNA sequence
gcattacaatgcaggtaagt

SEQ ID NO: 156155 - DNA, 20 bp, Artificial
  CRISPR gRNA sequence
cattacaatgcaggtaagtt

SEQ ID NO: 156156 - DNA, 20 bp, Artificial
  CRISPR gRNA sequence
caatgcaggtaagttgtaat

SEQ ID NO: 156157 - DNA, 20 bp, Artificial
  CRISPR gRNA sequence
taatggttgcagatgtttac

SEQ ID NO: 156158 - DNA, 20 bp, Artificial
  CRISPR gRNA sequence
cagatgtttaccaagcagag

SEQ ID NO: 156159 - DNA, 20 bp, Artificial
  CRISPR gRNA sequence
accaagcagaggttacatat

SEQ ID NO: 156160 - DNA, 20 bp, Artificial
  CRISPR gRNA sequence
ccaagcagaggttacatatt

SEQ ID NO: 156161 - DNA, 20 bp, Artificial
  CRISPR gRNA sequence
catatttagtttgtatacca

SEQ ID NO: 156162 - DNA, 20 bp, Artificial
  CRISPR gRNA sequence
agtttgtataccaaatattt

SEQ ID NO: 156163 - DNA, 20 bp, Artificial
  CRISPR gRNA sequence
gtttgtataccaaatattta

SEQ ID NO: 156164 - DNA, 20 bp, Artificial
  CRISPR gRNA sequence
gtataccaaatatttataaa

SEQ ID NO: 156165 - DNA, 20 bp, Artificial
  CRISPR gRNA sequence
tataccaaatatttataaag

SEQ ID NO: 156166 - DNA, 20 bp, Artificial
  CRISPR gRNA sequence
ataaagtaaactggaaccat

SEQ ID NO: 156167 - DNA, 20 bp, Artificial
  CRISPR gRNA sequence
taaagtaaactggaaccatt

SEQ ID NO: 156168 - DNA, 20 bp, Artificial
  CRISPR gRNA sequence
gaaccatttttttttttgtt

SEQ ID NO: 156169 - DNA, 20 bp, Artificial
  CRISPR gRNA sequence
ttttttttgtttgctttgtg

SEQ ID NO: 156170 - DNA, 20 bp, Artificial
  CRISPR gRNA sequence
tttttttgtttgctttgtga

SEQ ID NO: 156171 - DNA, 20 bp, Artificial
  CRISPR gRNA sequence
ttttttgtttgctttgtgat

SEQ ID NO: 156172 - DNA, 20 bp, Artificial
  CRISPR gRNA sequence
tttttgtttgctttgtgatt

SEQ ID NO: 156173 - DNA, 20 bp, Artificial
  CRISPR gRNA sequence
ttttgtttgctttgtgatta

SEQ ID NO: 156174 - DNA, 20 bp, Artificial
  CRISPR gRNA sequence
tttgtttgctttgtgattat

SEQ ID NO: 156175 - DNA, 20 bp, Artificial
  CRISPR gRNA sequence
ttgtttgctttgtgattatc

SEQ ID NO: 156176 - DNA, 20 bp, Artificial
  CRISPR gRNA sequence
tgtttgctttgtgattatcc

SEQ ID NO: 156177 - DNA, 20 bp, Artificial
  CRISPR gRNA sequence
gtttgctttgtgattatcct

SEQ ID NO: 156178 - DNA, 20 bp, Artificial
  CRISPR gRNA sequence
tttgctttgtgattatcctg

SEQ ID NO: 156179 - DNA, 20 bp, Artificial
  CRISPR gRNA sequence
gctttgtgattatcctgtca

SEQ ID NO: 156180 - DNA, 20 bp, Artificial
  CRISPR gRNA sequence
ctttgtgattatcctgtcaa

SEQ ID NO: 156181 - DNA, 20 bp, Artificial
  CRISPR gRNA sequence
tgtgattatcctgtcaattt

SEQ ID NO: 156182 - DNA, 20 bp, Artificial
  CRISPR gRNA sequence
gtgattatcctgtcaatttt

SEQ ID NO: 156183 - DNA, 20 bp, Artificial
  CRISPR gRNA sequence
tgattatcctgtcaattttc

SEQ ID NO: 156184 - DNA, 20 bp, Artificial
  CRISPR gRNA sequence
tcctgtcaattttcaagcat

SEQ ID NO: 156185 - DNA, 20 bp, Artificial
  CRISPR gRNA sequence
tcaattttcaagcatgggag

SEQ ID NO: 156186 - DNA, 20 bp, Artificial
  CRISPR gRNA sequence
tcaagcatgggaggtaatta

SEQ ID NO: 156187 - DNA, 20 bp, Artificial
  CRISPR gRNA sequence
caagcatgggaggtaattat

SEQ ID NO: 156188 - DNA, 20 bp, Artificial
  CRISPR gRNA sequence
aagcatgggaggtaattata

SEQ ID NO: 156189 - DNA, 20 bp, Artificial
  CRISPR gRNA sequence
tagcctgctgtatagtaagc

SEQ ID NO: 156190 - DNA, 20 bp, Artificial
  CRISPR gRNA sequence
ctgtatagtaagcaagtaaa

SEQ ID NO: 156191 - DNA, 20 bp, Artificial
  CRISPR gRNA sequence
tatagtaagcaagtaaatgt

SEQ ID NO: 156192 - DNA, 20 bp, Artificial
  CRISPR gRNA sequence
ggattaatgccttttttttt

SEQ ID NO: 156193 - DNA, 20 bp, Artificial
  CRISPR gRNA sequence
atgccttttttttttttttt

SEQ ID NO: 156194 - DNA, 20 bp, Artificial
  CRISPR gRNA sequence
tttttttttttttttttttt

SEQ ID NO: 156195 - DNA, 20 bp, Artificial
  CRISPR gRNA sequence
tttttttttttttttttttt

SEQ ID NO: 156196 - DNA, 20 bp, Artificial
  CRISPR gRNA sequence
tttttttttttttttttttt

SEQ ID NO: 156197 - DNA, 20 bp, Artificial
  CRISPR gRNA sequence
tttttttttttttttttttg

SEQ ID NO: 156198 - DNA, 20 bp, Artificial
  CRISPR gRNA sequence
ttttttttttttttttttgc

SEQ ID NO: 156199 - DNA, 20 bp, Artificial
  CRISPR gRNA sequence
tttttttttttttttttgca

SEQ ID NO: 156200 - DNA, 20 bp, Artificial
  CRISPR gRNA sequence
ttttttttttttttttgcag

SEQ ID NO: 156201 - DNA, 20 bp, Artificial
  CRISPR gRNA sequence
tttttttttttttttgcaga

SEQ ID NO: 156202 - DNA, 20 bp, Artificial
  CRISPR gRNA sequence
ttttttttttttttgcagac

SEQ ID NO: 156203 - DNA, 20 bp, Artificial
  CRISPR gRNA sequence
tttttttttttttgcagacg

SEQ ID NO: 156204 - DNA, 20 bp, Artificial
  CRISPR gRNA sequence
ttttttttttttgcagacga

SEQ ID NO: 156205 - DNA, 20 bp, Artificial
  CRISPR gRNA sequence
tttttttttttgcagacgag

SEQ ID NO: 156206 - DNA, 20 bp, Artificial
  CRISPR gRNA sequence
ttttttttttgcagacgagg

SEQ ID NO: 156207 - DNA, 20 bp, Artificial
  CRISPR gRNA sequence
tttttttttgcagacgaggt

SEQ ID NO: 156208 - DNA, 20 bp, Artificial
  CRISPR gRNA sequence
ttttttttgcagacgaggtc

SEQ ID NO: 156209 - DNA, 20 bp, Artificial
  CRISPR gRNA sequence
tttttttgcagacgaggtct

SEQ ID NO: 156210 - DNA, 20 bp, Artificial
  CRISPR gRNA sequence
ttttttgcagacgaggtctc

SEQ ID NO: 156211 - DNA, 20 bp, Artificial
  CRISPR gRNA sequence
tttttgcagacgaggtctcg

SEQ ID NO: 156212 - DNA, 20 bp, Artificial
  CRISPR gRNA sequence
ttttgcagacgaggtctcgc

SEQ ID NO: 156213 - DNA, 20 bp, Artificial
  CRISPR gRNA sequence
tttgcagacgaggtctcgct

SEQ ID NO: 156214 - DNA, 20 bp, Artificial
  CRISPR gRNA sequence
ttgcagacgaggtctcgctc

SEQ ID NO: 156215 - DNA, 20 bp, Artificial
  CRISPR gRNA sequence
tgcagacgaggtctcgctct

SEQ ID NO: 156216 - DNA, 20 bp, Artificial
  CRISPR gRNA sequence
gcagacgaggtctcgctctg

SEQ ID NO: 156217 - DNA, 20 bp, Artificial
  CRISPR gRNA sequence
cagacgaggtctcgctctgt

SEQ ID NO: 156218 - DNA, 20 bp, Artificial
  CRISPR gRNA sequence
gctctgttgccaaggctggt

SEQ ID NO: 156219 - DNA, 20 bp, Artificial
  CRISPR gRNA sequence
tgttgccaaggctggtgtgc

SEQ ID NO: 156220 - DNA, 20 bp, Artificial
  CRISPR gRNA sequence
ttgccaaggctggtgtgcca

SEQ ID NO: 156221 - DNA, 20 bp, Artificial
  CRISPR gRNA sequence
ccaaggctggtgtgccaggc

SEQ ID NO: 156222 - DNA, 20 bp, Artificial
  CRISPR gRNA sequence
gtgtgccaggctggagtgcc

SEQ ID NO: 156223 - DNA, 20 bp, Artificial
  CRISPR gRNA sequence
gagtgccgtggcatgatcat

SEQ ID NO: 156224 - DNA, 20 bp, Artificial
  CRISPR gRNA sequence
actgcagcctccacctcctg

SEQ ID NO: 156225 - DNA, 20 bp, Artificial
  CRISPR gRNA sequence
cagcctccacctcctgggct

SEQ ID NO: 156226 - DNA, 20 bp, Artificial
  CRISPR gRNA sequence
cacctcctgggctcaagcaa

SEQ ID NO: 156227 - DNA, 20 bp, Artificial
  CRISPR gRNA sequence
ctgggctcaagcaatcctcc

SEQ ID NO: 156228 - DNA, 20 bp, Artificial
  CRISPR gRNA sequence
ggctcaagcaatcctcctac

SEQ ID NO: 156229 - DNA, 20 bp, Artificial
  CRISPR gRNA sequence
aagcaatcctcctacttcag

SEQ ID NO: 156230 - DNA, 20 bp, Artificial
  CRISPR gRNA sequence
ctacttcagcctcctgagta

SEQ ID NO: 156231 - DNA, 20 bp, Artificial
  CRISPR gRNA sequence
cttcagcctcctgagtagct

SEQ ID NO: 156232 - DNA, 20 bp, Artificial
  CRISPR gRNA sequence
cagcctcctgagtagctggg

SEQ ID NO: 156233 - DNA, 20 bp, Artificial
  CRISPR gRNA sequence
agcctcctgagtagctggga

SEQ ID NO: 156234 - DNA, 20 bp, Artificial
  CRISPR gRNA sequence
ctgagtagctgggactacag

SEQ ID NO: 156235 - DNA, 20 bp, Artificial
  CRISPR gRNA sequence
agtagctgggactacaggca

SEQ ID NO: 156236 - DNA, 20 bp, Artificial
  CRISPR gRNA sequence
ggactacaggcatgtgccac

SEQ ID NO: 156237 - DNA, 20 bp, Artificial
  CRISPR gRNA sequence
caggcatgtgccaccgtgcc

SEQ ID NO: 156238 - DNA, 20 bp, Artificial
  CRISPR gRNA sequence
atttttttttatttatttat

SEQ ID NO: 156239 - DNA, 20 bp, Artificial
  CRISPR gRNA sequence
ttttttatttatttattttt

SEQ ID NO: 156240 - DNA, 20 bp, Artificial
  CRISPR gRNA sequence
tttttatttatttattttta

SEQ ID NO: 156241 - DNA, 20 bp, Artificial
  CRISPR gRNA sequence
ttttatttatttatttttat

SEQ ID NO: 156242 - DNA, 20 bp, Artificial
  CRISPR gRNA sequence
tttatttatttatttttatt

SEQ ID NO: 156243 - DNA, 20 bp, Artificial
  CRISPR gRNA sequence
ttatttatttatttttattt

SEQ ID NO: 156244 - DNA, 20 bp, Artificial
  CRISPR gRNA sequence
tatttatttatttttatttt

SEQ ID NO: 156245 - DNA, 20 bp, Artificial
  CRISPR gRNA sequence
atttatttatttttattttt

SEQ ID NO: 156246 - DNA, 20 bp, Artificial
  CRISPR gRNA sequence
tttatttatttttattttta

SEQ ID NO: 156247 - DNA, 20 bp, Artificial
  CRISPR gRNA sequence
atttatttttatttttattt

SEQ ID NO: 156248 - DNA, 20 bp, Artificial
  CRISPR gRNA sequence
tttatttttatttttatttt

SEQ ID NO: 156249 - DNA, 20 bp, Artificial
  CRISPR gRNA sequence
atttttatttttatttttaa

SEQ ID NO: 156250 - DNA, 20 bp, Artificial
  CRISPR gRNA sequence
tttttatttttatttttaaa

SEQ ID NO: 156251 - DNA, 20 bp, Artificial
  CRISPR gRNA sequence
ttatttttatttttaaatac

SEQ ID NO: 156252 - DNA, 20 bp, Artificial
  CRISPR gRNA sequence
tatttttatttttaaataca

SEQ ID NO: 156253 - DNA, 20 bp, Artificial
  CRISPR gRNA sequence
atttttatttttaaatacag

SEQ ID NO: 156254 - DNA, 20 bp, Artificial
  CRISPR gRNA sequence
tttttatttttaaatacaga

SEQ ID NO: 156255 - DNA, 20 bp, Artificial
  CRISPR gRNA sequence
ttatttttaaatacagacgg

SEQ ID NO: 156256 - DNA, 20 bp, Artificial
  CRISPR gRNA sequence
tatttttaaatacagacggg

SEQ ID NO: 156257 - DNA, 20 bp, Artificial
  CRISPR gRNA sequence
atttttaaatacagacgggg

SEQ ID NO: 156258 - DNA, 20 bp, Artificial
  CRISPR gRNA sequence
tttttaaatacagacggggt

SEQ ID NO: 156259 - DNA, 20 bp, Artificial
  CRISPR gRNA sequence
ttaaatacagacggggtctt

SEQ ID NO: 156260 - DNA, 20 bp, Artificial
  CRISPR gRNA sequence
taaatacagacggggtcttg

SEQ ID NO: 156261 - DNA, 20 bp, Artificial
  CRISPR gRNA sequence
aaatacagacggggtcttga

SEQ ID NO: 156262 - DNA, 20 bp, Artificial
  CRISPR gRNA sequence
aatacagacggggtcttgat

SEQ ID NO: 156263 - DNA, 20 bp, Artificial
  CRISPR gRNA sequence
gatttgttgcccaggctgat

SEQ ID NO: 156264 - DNA, 20 bp, Artificial
  CRISPR gRNA sequence
atttgttgcccaggctgatc

SEQ ID NO: 156265 - DNA, 20 bp, Artificial
  CRISPR gRNA sequence
gttgcccaggctgatctcaa

SEQ ID NO: 156266 - DNA, 20 bp, Artificial
  CRISPR gRNA sequence
ttgcccaggctgatctcaaa

SEQ ID NO: 156267 - DNA, 20 bp, Artificial
  CRISPR gRNA sequence
cccaggctgatctcaaactc

SEQ ID NO: 156268 - DNA, 20 bp, Artificial
  CRISPR gRNA sequence
atctcaaactcctggactca

SEQ ID NO: 156269 - DNA, 20 bp, Artificial
  CRISPR gRNA sequence
aaactcctggactcaagtga

SEQ ID NO: 156270 - DNA, 20 bp, Artificial
  CRISPR gRNA sequence
ctggactcaagtgatcctcc

SEQ ID NO: 156271 - DNA, 20 bp, Artificial
  CRISPR gRNA sequence
gactcaagtgatcctcctgc

SEQ ID NO: 156272 - DNA, 20 bp, Artificial
  CRISPR gRNA sequence
aagtgatcctcctgccttgg

SEQ ID NO: 156273 - DNA, 20 bp, Artificial
  CRISPR gRNA sequence
ctgccttggcctcccaaagt

SEQ ID NO: 156274 - DNA, 20 bp, Artificial
  CRISPR gRNA sequence
ccttggcctcccaaagtgct

SEQ ID NO: 156275 - DNA, 20 bp, Artificial
  CRISPR gRNA sequence
ggcctcccaaagtgctggga

SEQ ID NO: 156276 - DNA, 20 bp, Artificial
  CRISPR gRNA sequence
gcctcccaaagtgctgggat

SEQ ID NO: 156277 - DNA, 20 bp, Artificial
  CRISPR gRNA sequence
ccaaagtgctgggattacaa

SEQ ID NO: 156278 - DNA, 20 bp, Artificial
  CRISPR gRNA sequence
ggattacaagcactgggatt

SEQ ID NO: 156279 - DNA, 20 bp, Artificial
  CRISPR gRNA sequence
caagcactgggattacaggc

SEQ ID NO: 156280 - DNA, 20 bp, Artificial
  CRISPR gRNA sequence
ggattacaggcatgagccat

SEQ ID NO: 156281 - DNA, 20 bp, Artificial
  CRISPR gRNA sequence
caggcatgagccattgtgcc

SEQ ID NO: 156282 - DNA, 20 bp, Artificial
  CRISPR gRNA sequence
tgcccaattgtgggatgaac

SEQ ID NO: 156283 - DNA, 20 bp, Artificial
  CRISPR gRNA sequence
tgggatgaacactttaaaaa

SEQ ID NO: 156284 - DNA, 20 bp, Artificial
  CRISPR gRNA sequence
taaaaaaaaataattgatct

SEQ ID NO: 156285 - DNA, 20 bp, Artificial
  CRISPR gRNA sequence
aaaaaaaaataattgatctc

SEQ ID NO: 156286 - DNA, 20 bp, Artificial
  CRISPR gRNA sequence
aaaaaaaataattgatctct

SEQ ID NO: 156287 - DNA, 20 bp, Artificial
  CRISPR gRNA sequence
atctctcatcagaaatctaa

SEQ ID NO: 156288 - DNA, 20 bp, Artificial
  CRISPR gRNA sequence
tcatcagaaatctaacataa

SEQ ID NO: 156289 - DNA, 20 bp, Artificial
  CRISPR gRNA sequence
atcagaaatctaacataaat

SEQ ID NO: 156290 - DNA, 20 bp, Artificial
  CRISPR gRNA sequence
acataaatttcacacagttg

SEQ ID NO: 156291 - DNA, 20 bp, Artificial
  CRISPR gRNA sequence
cacacagttgatacctacta

SEQ ID NO: 156292 - DNA, 20 bp, Artificial
  CRISPR gRNA sequence
acacagttgatacctactat

SEQ ID NO: 156293 - DNA, 20 bp, Artificial
  CRISPR gRNA sequence
atacctactatgagatacct

SEQ ID NO: 156294 - DNA, 20 bp, Artificial
  CRISPR gRNA sequence
ctatgagatacctttctaac

SEQ ID NO: 156295 - DNA, 20 bp, Artificial
  CRISPR gRNA sequence
tgagatacctttctaacata

SEQ ID NO: 156296 - DNA, 20 bp, Artificial
  CRISPR gRNA sequence
tctaacataattggtggaaa

SEQ ID NO: 156297 - DNA, 20 bp, Artificial
  CRISPR gRNA sequence
ctaacataattggtggaaac

SEQ ID NO: 156298 - DNA, 20 bp, Artificial
  CRISPR gRNA sequence
taacataattggtggaaact

SEQ ID NO: 156299 - DNA, 20 bp, Artificial
  CRISPR gRNA sequence
acataattggtggaaactca

SEQ ID NO: 156300 - DNA, 20 bp, Artificial
  CRISPR gRNA sequence
gtggaaactcatgggggttt

SEQ ID NO: 156301 - DNA, 20 bp, Artificial
  CRISPR gRNA sequence
atgggggtttcttttaatct

SEQ ID NO: 156302 - DNA, 20 bp, Artificial
  CRISPR gRNA sequence
cttttaatctagtctgcatg

SEQ ID NO: 156303 - DNA, 20 bp, Artificial
  CRISPR gRNA sequence
ttttaatctagtctgcatgc

SEQ ID NO: 156304 - DNA, 20 bp, Artificial
  CRISPR gRNA sequence
ttaatctagtctgcatgccc

SEQ ID NO: 156305 - DNA, 20 bp, Artificial
  CRISPR gRNA sequence
taatctagtctgcatgccca

SEQ ID NO: 156306 - DNA, 20 bp, Artificial
  CRISPR gRNA sequence
aatctagtctgcatgcccag

SEQ ID NO: 156307 - DNA, 20 bp, Artificial
  CRISPR gRNA sequence
atctagtctgcatgcccagt

SEQ ID NO: 156308 - DNA, 20 bp, Artificial
  CRISPR gRNA sequence
gtctgcatgcccagtgtcat

SEQ ID NO: 156309 - DNA, 20 bp, Artificial
  CRISPR gRNA sequence
catgcccagtgtcatctatt

SEQ ID NO: 156310 - DNA, 20 bp, Artificial
  CRISPR gRNA sequence
tttttaggacttcctttttt

SEQ ID NO: 156311 - DNA, 20 bp, Artificial
  CRISPR gRNA sequence
ttaggacttccttttttccc

SEQ ID NO: 156312 - DNA, 20 bp, Artificial
  CRISPR gRNA sequence
taggacttccttttttcccc

SEQ ID NO: 156313 - DNA, 20 bp, Artificial
  CRISPR gRNA sequence
aggacttccttttttccccc

SEQ ID NO: 156314 - DNA, 20 bp, Artificial
  CRISPR gRNA sequence
ggacttccttttttcccccc

SEQ ID NO: 156315 - DNA, 20 bp, Artificial
  CRISPR gRNA sequence
ccttttttcccccccagggg

SEQ ID NO: 156316 - DNA, 20 bp, Artificial
  CRISPR gRNA sequence
cttttttcccccccaggggt

SEQ ID NO: 156317 - DNA, 20 bp, Artificial
  CRISPR gRNA sequence
ttttcccccccaggggtggg

SEQ ID NO: 156318 - DNA, 20 bp, Artificial
  CRISPR gRNA sequence
tttcccccccaggggtgggg

SEQ ID NO: 156319 - DNA, 20 bp, Artificial
  CRISPR gRNA sequence
ttcccccccaggggtggggt

SEQ ID NO: 156320 - DNA, 20 bp, Artificial
  CRISPR gRNA sequence
tcccccccaggggtggggtt

SEQ ID NO: 156321 - DNA, 20 bp, Artificial
  CRISPR gRNA sequence
cccccccaggggtggggttg

SEQ ID NO: 156322 - DNA, 20 bp, Artificial
  CRISPR gRNA sequence
ccccccaggggtggggttga

SEQ ID NO: 156323 - DNA, 20 bp, Artificial
  CRISPR gRNA sequence
atattttgtgatgtttgatt

SEQ ID NO: 156324 - DNA, 20 bp, Artificial
  CRISPR gRNA sequence
tgtgatgtttgatttcctgt

SEQ ID NO: 156325 - DNA, 20 bp, Artificial
  CRISPR gRNA sequence
gtgatgtttgatttcctgtc

SEQ ID NO: 156326 - DNA, 20 bp, Artificial
  CRISPR gRNA sequence
tgatgtttgatttcctgtcc

SEQ ID NO: 156327 - DNA, 20 bp, Artificial
  CRISPR gRNA sequence
gatttcctgtcctattaagt

SEQ ID NO: 156328 - DNA, 20 bp, Artificial
  CRISPR gRNA sequence
atttcctgtcctattaagtc

SEQ ID NO: 156329 - DNA, 20 bp, Artificial
  CRISPR gRNA sequence
cctgtcctattaagtcactt

SEQ ID NO: 156330 - DNA, 20 bp, Artificial
  CRISPR gRNA sequence
ctgtcctattaagtcacttc

SEQ ID NO: 156331 - DNA, 20 bp, Artificial
  CRISPR gRNA sequence
tcctattaagtcacttcctc

SEQ ID NO: 156332 - DNA, 20 bp, Artificial
  CRISPR gRNA sequence
ttaagtcacttcctctcagg

SEQ ID NO: 156333 - DNA, 20 bp, Artificial
  CRISPR gRNA sequence
agtcacttcctctcaggcat

SEQ ID NO: 156334 - DNA, 20 bp, Artificial
  CRISPR gRNA sequence
cctctcaggcatggtcagtc

SEQ ID NO: 156335 - DNA, 20 bp, Artificial
  CRISPR gRNA sequence
ctctcaggcatggtcagtca

SEQ ID NO: 156336 - DNA, 20 bp, Artificial
  CRISPR gRNA sequence
tcaggcatggtcagtcagca

SEQ ID NO: 156337 - DNA, 20 bp, Artificial
  CRISPR gRNA sequence
aggcatggtcagtcagcatt

SEQ ID NO: 156338 - DNA, 20 bp, Artificial
  CRISPR gRNA sequence
gtgtctgcttcctatctgtg

SEQ ID NO: 156339 - DNA, 20 bp, Artificial
  CRISPR gRNA sequence
cttcctatctgtgcattgga

SEQ ID NO: 156340 - DNA, 20 bp, Artificial
  CRISPR gRNA sequence
cctatctgtgcattggaaga

SEQ ID NO: 156341 - DNA, 20 bp, Artificial
  CRISPR gRNA sequence
ctatctgtgcattggaagaa

SEQ ID NO: 156342 - DNA, 20 bp, Artificial
  CRISPR gRNA sequence
tctgtgcattggaagaatca

SEQ ID NO: 156343 - DNA, 20 bp, Artificial
  CRISPR gRNA sequence
tgcattggaagaatcatatt

SEQ ID NO: 156344 - DNA, 20 bp, Artificial
  CRISPR gRNA sequence
gaagaatcatattcagacag

SEQ ID NO: 156345 - DNA, 20 bp, Artificial
  CRISPR gRNA sequence
agacagaatgaggtttggca

SEQ ID NO: 156346 - DNA, 20 bp, Artificial
  CRISPR gRNA sequence
ggcaaaattgatactgactt

SEQ ID NO: 156347 - DNA, 20 bp, Artificial
  CRISPR gRNA sequence
gcaaaattgatactgacttt

SEQ ID NO: 156348 - DNA, 20 bp, Artificial
  CRISPR gRNA sequence
atactgactttaccaaataa

SEQ ID NO: 156349 - DNA, 20 bp, Artificial
  CRISPR gRNA sequence
actttaccaaataaaattcc

SEQ ID NO: 156350 - DNA, 20 bp, Artificial
  CRISPR gRNA sequence
taccaaataaaattccagtt

SEQ ID NO: 156351 - DNA, 20 bp, Artificial
  CRISPR gRNA sequence
accaaataaaattccagttc

SEQ ID NO: 156352 - DNA, 20 bp, Artificial
  CRISPR gRNA sequence
ccaaataaaattccagttcc

SEQ ID NO: 156353 - DNA, 20 bp, Artificial
  CRISPR gRNA sequence
cagttccagggatgtgtagg

SEQ ID NO: 156354 - DNA, 20 bp, Artificial
  CRISPR gRNA sequence
cagggatgtgtaggtttaaa

SEQ ID NO: 156355 - DNA, 20 bp, Artificial
  CRISPR gRNA sequence
aaaaacagcaatcgtggtca

SEQ ID NO: 156356 - DNA, 20 bp, Artificial
  CRISPR gRNA sequence
aaaacagcaatcgtggtcac

SEQ ID NO: 156357 - DNA, 20 bp, Artificial
  CRISPR gRNA sequence
tgggcttttgtttttaaaac

SEQ ID NO: 156358 - DNA, 20 bp, Artificial
  CRISPR gRNA sequence
gggcttttgtttttaaaaca

SEQ ID NO: 156359 - DNA, 20 bp, Artificial
  CRISPR gRNA sequence
ggcttttgtttttaaaacaa

SEQ ID NO: 156360 - DNA, 20 bp, Artificial
  CRISPR gRNA sequence
ttgtttttaaaacaagatga

SEQ ID NO: 156361 - DNA, 20 bp, Artificial
  CRISPR gRNA sequence
tgtttttaaaacaagatgag

SEQ ID NO: 156362 - DNA, 20 bp, Artificial
  CRISPR gRNA sequence
gtttttaaaacaagatgagg

SEQ ID NO: 156363 - DNA, 20 bp, Artificial
  CRISPR gRNA sequence
tttttaaaacaagatgaggt

SEQ ID NO: 156364 - DNA, 20 bp, Artificial
  CRISPR gRNA sequence
ttaaaacaagatgaggtctc

SEQ ID NO: 156365 - DNA, 20 bp, Artificial
  CRISPR gRNA sequence
taaaacaagatgaggtctcc

SEQ ID NO: 156366 - DNA, 20 bp, Artificial
  CRISPR gRNA sequence
aaaacaagatgaggtctccc

SEQ ID NO: 156367 - DNA, 20 bp, Artificial
  CRISPR gRNA sequence
aaacaagatgaggtctccct

SEQ ID NO: 156368 - DNA, 20 bp, Artificial
  CRISPR gRNA sequence
ccttttaaagaggctaaata

SEQ ID NO: 156369 - DNA, 20 bp, Artificial
  CRISPR gRNA sequence
ttaaagaggctaaatacttt

SEQ ID NO: 156370 - DNA, 20 bp, Artificial
  CRISPR gRNA sequence
taaagaggctaaatactttt

SEQ ID NO: 156371 - DNA, 20 bp, Artificial
  CRISPR gRNA sequence
aaagaggctaaatacttttg

SEQ ID NO: 156372 - DNA, 20 bp, Artificial
  CRISPR gRNA sequence
aagaggctaaatacttttgt

SEQ ID NO: 156373 - DNA, 20 bp, Artificial
  CRISPR gRNA sequence
aatacttttgtaggagcttc

SEQ ID NO: 156374 - DNA, 20 bp, Artificial
  CRISPR gRNA sequence
ttgtaggagcttcagtaacc

SEQ ID NO: 156375 - DNA, 20 bp, Artificial
  CRISPR gRNA sequence
tgtaggagcttcagtaaccc

SEQ ID NO: 156376 - DNA, 20 bp, Artificial
  CRISPR gRNA sequence
gtaggagcttcagtaaccca

SEQ ID NO: 156377 - DNA, 20 bp, Artificial
  CRISPR gRNA sequence
taggagcttcagtaacccaa

SEQ ID NO: 156378 - DNA, 20 bp, Artificial
  CRISPR gRNA sequence
cagtaacccaaaaaatgtat

SEQ ID NO: 156379 - DNA, 20 bp, Artificial
  CRISPR gRNA sequence
agtaacccaaaaaatgtatt

SEQ ID NO: 156380 - DNA, 20 bp, Artificial
  CRISPR gRNA sequence
aaagttgaacatggctgtct

SEQ ID NO: 156381 - DNA, 20 bp, Artificial
  CRISPR gRNA sequence
aacatggctgtcttcatgaa

SEQ ID NO: 156382 - DNA, 20 bp, Artificial
  CRISPR gRNA sequence
tcttcatgaatggaatgatt

SEQ ID NO: 156383 - DNA, 20 bp, Artificial
  CRISPR gRNA sequence
catgaatggaatgatttttg

SEQ ID NO: 156384 - DNA, 20 bp, Artificial
  CRISPR gRNA sequence
atgaatggaatgatttttgc

SEQ ID NO: 156385 - DNA, 20 bp, Artificial
  CRISPR gRNA sequence
ttgcctatccttattactga

SEQ ID NO: 156386 - DNA, 20 bp, Artificial
  CRISPR gRNA sequence
tgcctatccttattactgat

SEQ ID NO: 156387 - DNA, 20 bp, Artificial
  CRISPR gRNA sequence
gcctatccttattactgata

SEQ ID NO: 156388 - DNA, 20 bp, Artificial
  CRISPR gRNA sequence
cctatccttattactgataa

SEQ ID NO: 156389 - DNA, 20 bp, Artificial
  CRISPR gRNA sequence
tccttattactgataatata

SEQ ID NO: 156390 - DNA, 20 bp, Artificial
  CRISPR gRNA sequence
attactgataatatatgcat

SEQ ID NO: 156391 - DNA, 20 bp, Artificial
  CRISPR gRNA sequence
ttactgataatatatgcata

SEQ ID NO: 156392 - DNA, 20 bp, Artificial
  CRISPR gRNA sequence
ctgataatatatgcatacag

SEQ ID NO: 156393 - DNA, 20 bp, Artificial
  CRISPR gRNA sequence
ataatatatgcatacagagt

SEQ ID NO: 156394 - DNA, 20 bp, Artificial
  CRISPR gRNA sequence
gaatacatctaaattaggct

SEQ ID NO: 156395 - DNA, 20 bp, Artificial
  CRISPR gRNA sequence
aatacatctaaattaggctg

SEQ ID NO: 156396 - DNA, 20 bp, Artificial
  CRISPR gRNA sequence
aattaggctgatgggaatca

SEQ ID NO: 156397 - DNA, 20 bp, Artificial
  CRISPR gRNA sequence
ggctgatgggaatcacttag

SEQ ID NO: 156398 - DNA, 20 bp, Artificial
  CRISPR gRNA sequence
atgggaatcacttagggatc

SEQ ID NO: 156399 - DNA, 20 bp, Artificial
  CRISPR gRNA sequence
agggatctagtctagttccc

SEQ ID NO: 156400 - DNA, 20 bp, Artificial
  CRISPR gRNA sequence
gggatctagtctagttccct

SEQ ID NO: 156401 - DNA, 20 bp, Artificial
  CRISPR gRNA sequence
gtctagttcccttcttgtaa

SEQ ID NO: 156402 - DNA, 20 bp, Artificial
  CRISPR gRNA sequence
gttcccttcttgtaaagtgg

SEQ ID NO: 156403 - DNA, 20 bp, Artificial
  CRISPR gRNA sequence
ccttcttgtaaagtggggaa

SEQ ID NO: 156404 - DNA, 20 bp, Artificial
  CRISPR gRNA sequence
cttgtaaagtggggaaattg

SEQ ID NO: 156405 - DNA, 20 bp, Artificial
  CRISPR gRNA sequence
ttgtaaagtggggaaattga

SEQ ID NO: 156406 - DNA, 20 bp, Artificial
  CRISPR gRNA sequence
gtaaagtggggaaattgagg

SEQ ID NO: 156407 - DNA, 20 bp, Artificial
  CRISPR gRNA sequence
taaagtggggaaattgaggc

SEQ ID NO: 156408 - DNA, 20 bp, Artificial
  CRISPR gRNA sequence
aggcccagtaagttcaggtg

SEQ ID NO: 156409 - DNA, 20 bp, Artificial
  CRISPR gRNA sequence
aggtgccctaatccaagtct

SEQ ID NO: 156410 - DNA, 20 bp, Artificial
  CRISPR gRNA sequence
atccaagtctttcagctttt

SEQ ID NO: 156411 - DNA, 20 bp, Artificial
  CRISPR gRNA sequence
tcagctttttaggaacaggc

SEQ ID NO: 156412 - DNA, 20 bp, Artificial
  CRISPR gRNA sequence
cagctttttaggaacaggct

SEQ ID NO: 156413 - DNA, 20 bp, Artificial
  CRISPR gRNA sequence
agctttttaggaacaggctt

SEQ ID NO: 156414 - DNA, 20 bp, Artificial
  CRISPR gRNA sequence
tttaggaacaggcttgtaca

SEQ ID NO: 156415 - DNA, 20 bp, Artificial
  CRISPR gRNA sequence
ttaggaacaggcttgtacaa

SEQ ID NO: 156416 - DNA, 20 bp, Artificial
  CRISPR gRNA sequence
taggaacaggcttgtacaag

SEQ ID NO: 156417 - DNA, 20 bp, Artificial
  CRISPR gRNA sequence
aggaacaggcttgtacaagt

SEQ ID NO: 156418 - DNA, 20 bp, Artificial
  CRISPR gRNA sequence
ggaacaggcttgtacaagtt

SEQ ID NO: 156419 - DNA, 20 bp, Artificial
  CRISPR gRNA sequence
gtacaagtttggagatttga

SEQ ID NO: 156420 - DNA, 20 bp, Artificial
  CRISPR gRNA sequence
tacaagtttggagatttgac

SEQ ID NO: 156421 - DNA, 20 bp, Artificial
  CRISPR gRNA sequence
ggagatttgactcccactca

SEQ ID NO: 156422 - DNA, 20 bp, Artificial
  CRISPR gRNA sequence
gagatttgactcccactcaa

SEQ ID NO: 156423 - DNA, 20 bp, Artificial
  CRISPR gRNA sequence
gactcccactcaatttgttg

SEQ ID NO: 156424 - DNA, 20 bp, Artificial
  CRISPR gRNA sequence
actcccactcaatttgttgc

SEQ ID NO: 156425 - DNA, 20 bp, Artificial
  CRISPR gRNA sequence
ccactcaatttgttgcatgt

SEQ ID NO: 156426 - DNA, 20 bp, Artificial
  CRISPR gRNA sequence
aatttgttgcatgtttcttt

SEQ ID NO: 156427 - DNA, 20 bp, Artificial
  CRISPR gRNA sequence
gttgcatgtttcttttattc

SEQ ID NO: 156428 - DNA, 20 bp, Artificial
  CRISPR gRNA sequence
ttgcatgtttcttttattcc

SEQ ID NO: 156429 - DNA, 20 bp, Artificial
  CRISPR gRNA sequence
catgtttcttttattcctct

SEQ ID NO: 156430 - DNA, 20 bp, Artificial
  CRISPR gRNA sequence
cttttattcctctaggttgt

SEQ ID NO: 156431 - DNA, 20 bp, Artificial
  CRISPR gRNA sequence
ttttattcctctaggttgtt

SEQ ID NO: 156432 - DNA, 20 bp, Artificial
  CRISPR gRNA sequence
ttattcctctaggttgtttt

SEQ ID NO: 156433 - DNA, 20 bp, Artificial
  CRISPR gRNA sequence
tattcctctaggttgttttc

SEQ ID NO: 156434 - DNA, 20 bp, Artificial
  CRISPR gRNA sequence
attcctctaggttgttttca

SEQ ID NO: 156435 - DNA, 20 bp, Artificial
  CRISPR gRNA sequence
ttcctctaggttgttttcac

SEQ ID NO: 156436 - DNA, 20 bp, Artificial
  CRISPR gRNA sequence
ctctaggttgttttcacttt

SEQ ID NO: 156437 - DNA, 20 bp, Artificial
  CRISPR gRNA sequence
taggttgttttcacttttta

SEQ ID NO: 156438 - DNA, 20 bp, Artificial
  CRISPR gRNA sequence
ggttgttttcactttttatt

SEQ ID NO: 156439 - DNA, 20 bp, Artificial
  CRISPR gRNA sequence
ttttcactttttatttttca

SEQ ID NO: 156440 - DNA, 20 bp, Artificial
  CRISPR gRNA sequence
tcactttttatttttcatgt

SEQ ID NO: 156441 - DNA, 20 bp, Artificial
  CRISPR gRNA sequence
cactttttatttttcatgtt

SEQ ID NO: 156442 - DNA, 20 bp, Artificial
  CRISPR gRNA sequence
actttttatttttcatgttt

SEQ ID NO: 156443 - DNA, 20 bp, Artificial
  CRISPR gRNA sequence
tttatttttcatgtttcttt

SEQ ID NO: 156444 - DNA, 20 bp, Artificial
  CRISPR gRNA sequence
ttatttttcatgtttctttt

SEQ ID NO: 156445 - DNA, 20 bp, Artificial
  CRISPR gRNA sequence
tatttttcatgtttcttttc

SEQ ID NO: 156446 - DNA, 20 bp, Artificial
  CRISPR gRNA sequence
atttttcatgtttcttttct

SEQ ID NO: 156447 - DNA, 20 bp, Artificial
  CRISPR gRNA sequence
tttttcatgtttcttttctt

SEQ ID NO: 156448 - DNA, 20 bp, Artificial
  CRISPR gRNA sequence
ttcatgtttcttttcttttt

SEQ ID NO: 156449 - DNA, 20 bp, Artificial
  CRISPR gRNA sequence
tcatgtttcttttctttttg

SEQ ID NO: 156450 - DNA, 20 bp, Artificial
  CRISPR gRNA sequence
catgtttcttttctttttgg

SEQ ID NO: 156451 - DNA, 20 bp, Artificial
  CRISPR gRNA sequence
atgtttcttttctttttggg

SEQ ID NO: 156452 - DNA, 20 bp, Artificial
  CRISPR gRNA sequence
cttttctttttgggacttct

SEQ ID NO: 156453 - DNA, 20 bp, Artificial
  CRISPR gRNA sequence
ttttctttttgggacttctg

SEQ ID NO: 156454 - DNA, 20 bp, Artificial
  CRISPR gRNA sequence
ttctttttgggacttctgta

SEQ ID NO: 156455 - DNA, 20 bp, Artificial
  CRISPR gRNA sequence
tctttttgggacttctgtat

SEQ ID NO: 156456 - DNA, 20 bp, Artificial
  CRISPR gRNA sequence
ctttttgggacttctgtata

SEQ ID NO: 156457 - DNA, 20 bp, Artificial
  CRISPR gRNA sequence
tttttgggacttctgtatag

SEQ ID NO: 156458 - DNA, 20 bp, Artificial
  CRISPR gRNA sequence
tttgggacttctgtataggc

SEQ ID NO: 156459 - DNA, 20 bp, Artificial
  CRISPR gRNA sequence
ttgggacttctgtataggct

SEQ ID NO: 156460 - DNA, 20 bp, Artificial
  CRISPR gRNA sequence
tgggacttctgtataggctt

SEQ ID NO: 156461 - DNA, 20 bp, Artificial
  CRISPR gRNA sequence
gggacttctgtataggcttg

SEQ ID NO: 156462 - DNA, 20 bp, Artificial
  CRISPR gRNA sequence
ggacttctgtataggcttgc

SEQ ID NO: 156463 - DNA, 20 bp, Artificial
  CRISPR gRNA sequence
ctgtataggcttgctgtttg

SEQ ID NO: 156464 - DNA, 20 bp, Artificial
  CRISPR gRNA sequence
tgtataggcttgctgtttgg

SEQ ID NO: 156465 - DNA, 20 bp, Artificial
  CRISPR gRNA sequence
tataggcttgctgtttgggt

SEQ ID NO: 156466 - DNA, 20 bp, Artificial
  CRISPR gRNA sequence
gctgtttgggtatagaagga

SEQ ID NO: 156467 - DNA, 20 bp, Artificial
  CRISPR gRNA sequence
ctgtttgggtatagaaggaa

SEQ ID NO: 156468 - DNA, 20 bp, Artificial
  CRISPR gRNA sequence
tttgggtatagaaggaacag

SEQ ID NO: 156469 - DNA, 20 bp, Artificial
  CRISPR gRNA sequence
gggtatagaaggaacagaga

SEQ ID NO: 156470 - DNA, 20 bp, Artificial
  CRISPR gRNA sequence
ggtatagaaggaacagagaa

SEQ ID NO: 156471 - DNA, 20 bp, Artificial
  CRISPR gRNA sequence
agaagtctttacctgaagtg

SEQ ID NO: 156472 - DNA, 20 bp, Artificial
  CRISPR gRNA sequence
tacctgaagtgtgttggtta

SEQ ID NO: 156473 - DNA, 20 bp, Artificial
  CRISPR gRNA sequence
acctgaagtgtgttggttag

SEQ ID NO: 156474 - DNA, 20 bp, Artificial
  CRISPR gRNA sequence
cctgaagtgtgttggttaga

SEQ ID NO: 156475 - DNA, 20 bp, Artificial
  CRISPR gRNA sequence
aagtgtgttggttagaaagt

SEQ ID NO: 156476 - DNA, 20 bp, Artificial
  CRISPR gRNA sequence
gttagaaagtctgctgcagc

SEQ ID NO: 156477 - DNA, 20 bp, Artificial
  CRISPR gRNA sequence
gaaagtctgctgcagcagat

SEQ ID NO: 156478 - DNA, 20 bp, Artificial
  CRISPR gRNA sequence
ctgcagcagatttagtgtcc

SEQ ID NO: 156479 - DNA, 20 bp, Artificial
  CRISPR gRNA sequence
cagcagatttagtgtccctt

SEQ ID NO: 156480 - DNA, 20 bp, Artificial
  CRISPR gRNA sequence
agtgtccctttgggatctga

SEQ ID NO: 156481 - DNA, 20 bp, Artificial
  CRISPR gRNA sequence
gtgtccctttgggatctgaa

SEQ ID NO: 156482 - DNA, 20 bp, Artificial
  CRISPR gRNA sequence
tgggatctgaagataccttg

SEQ ID NO: 156483 - DNA, 20 bp, Artificial
  CRISPR gRNA sequence
gggatctgaagataccttgc

SEQ ID NO: 156484 - DNA, 20 bp, Artificial
  CRISPR gRNA sequence
ggatctgaagataccttgcc

SEQ ID NO: 156485 - DNA, 20 bp, Artificial
  CRISPR gRNA sequence
aagataccttgcctcagcca

SEQ ID NO: 156486 - DNA, 20 bp, Artificial
  CRISPR gRNA sequence
gcctcagccagttagttgct

SEQ ID NO: 156487 - DNA, 20 bp, Artificial
  CRISPR gRNA sequence
cctcagccagttagttgctt

SEQ ID NO: 156488 - DNA, 20 bp, Artificial
  CRISPR gRNA sequence
agccagttagttgcttattc

SEQ ID NO: 156489 - DNA, 20 bp, Artificial
  CRISPR gRNA sequence
gttgcttattcagaaagctg

SEQ ID NO: 156490 - DNA, 20 bp, Artificial
  CRISPR gRNA sequence
cttattcagaaagctgagaa

SEQ ID NO: 156491 - DNA, 20 bp, Artificial
  CRISPR gRNA sequence
attcagaaagctgagaacca

SEQ ID NO: 156492 - DNA, 20 bp, Artificial
  CRISPR gRNA sequence
ttcagaaagctgagaaccag

SEQ ID NO: 156493 - DNA, 20 bp, Artificial
  CRISPR gRNA sequence
agaaagctgagaaccagcta

SEQ ID NO: 156494 - DNA, 20 bp, Artificial
  CRISPR gRNA sequence
agaaccagctaggaagctaa

SEQ ID NO: 156495 - DNA, 20 bp, Artificial
  CRISPR gRNA sequence
ggaagctaatggtgttcacc

SEQ ID NO: 156496 - DNA, 20 bp, Artificial
  CRISPR gRNA sequence
atggtgttcacctgtgaggt

SEQ ID NO: 156497 - DNA, 20 bp, Artificial
  CRISPR gRNA sequence
acctgtgaggtattccagaa

SEQ ID NO: 156498 - DNA, 20 bp, Artificial
  CRISPR gRNA sequence
tgaggtattccagaaagcca

SEQ ID NO: 156499 - DNA, 20 bp, Artificial
  CRISPR gRNA sequence
cagaaagccaggttactttt

SEQ ID NO: 156500 - DNA, 20 bp, Artificial
  CRISPR gRNA sequence
cttttatgcattatgaggaa

SEQ ID NO: 156501 - DNA, 20 bp, Artificial
  CRISPR gRNA sequence
ttatgcattatgaggaattt

SEQ ID NO: 156502 - DNA, 20 bp, Artificial
  CRISPR gRNA sequence
tatgcattatgaggaattta

SEQ ID NO: 156503 - DNA, 20 bp, Artificial
  CRISPR gRNA sequence
atgcattatgaggaatttag

SEQ ID NO: 156504 - DNA, 20 bp, Artificial
  CRISPR gRNA sequence
tgcattatgaggaatttagg

SEQ ID NO: 156505 - DNA, 20 bp, Artificial
  CRISPR gRNA sequence
tgaggaatttagggtataca

SEQ ID NO: 156506 - DNA, 20 bp, Artificial
  CRISPR gRNA sequence
agggtatacaaacacatcac

SEQ ID NO: 156507 - DNA, 20 bp, Artificial
  CRISPR gRNA sequence
gggtatacaaacacatcacc

SEQ ID NO: 156508 - DNA, 20 bp, Artificial
  CRISPR gRNA sequence
caagccagttagtgtttttt

SEQ ID NO: 156509 - DNA, 20 bp, Artificial
  CRISPR gRNA sequence
gtgttttttgttgttgtttt

SEQ ID NO: 156510 - DNA, 20 bp, Artificial
  CRISPR gRNA sequence
tttgttgttgtttttttgtt

SEQ ID NO: 156511 - DNA, 20 bp, Artificial
  CRISPR gRNA sequence
ttgttgttgtttttttgtta

SEQ ID NO: 156512 - DNA, 20 bp, Artificial
  CRISPR gRNA sequence
tgttgttgtttttttgttat

SEQ ID NO: 156513 - DNA, 20 bp, Artificial
  CRISPR gRNA sequence
gttgttgtttttttgttatt

SEQ ID NO: 156514 - DNA, 20 bp, Artificial
  CRISPR gRNA sequence
ttgttgtttttttgttatta

SEQ ID NO: 156515 - DNA, 20 bp, Artificial
  CRISPR gRNA sequence
ttgtttttttgttattatat

SEQ ID NO: 156516 - DNA, 20 bp, Artificial
  CRISPR gRNA sequence
tttttttgttattatatttc

SEQ ID NO: 156517 - DNA, 20 bp, Artificial
  CRISPR gRNA sequence
ttttgttattatatttcaag

SEQ ID NO: 156518 - DNA, 20 bp, Artificial
  CRISPR gRNA sequence
tttgttattatatttcaaga

SEQ ID NO: 156519 - DNA, 20 bp, Artificial
  CRISPR gRNA sequence
ttgttattatatttcaagaa

SEQ ID NO: 156520 - DNA, 20 bp, Artificial
  CRISPR gRNA sequence
tgttattatatttcaagaac

SEQ ID NO: 156521 - DNA, 20 bp, Artificial
  CRISPR gRNA sequence
gttattatatttcaagaaca

SEQ ID NO: 156522 - DNA, 20 bp, Artificial
  CRISPR gRNA sequence
ttattatatttcaagaacaa

SEQ ID NO: 156523 - DNA, 20 bp, Artificial
  CRISPR gRNA sequence
ttatatttcaagaacaagct

SEQ ID NO: 156524 - DNA, 20 bp, Artificial
  CRISPR gRNA sequence
tatttcaagaacaagctaat

SEQ ID NO: 156525 - DNA, 20 bp, Artificial
  CRISPR gRNA sequence
caagaacaagctaattccca

SEQ ID NO: 156526 - DNA, 20 bp, Artificial
  CRISPR gRNA sequence
aagaacaagctaattcccaa

SEQ ID NO: 156527 - DNA, 20 bp, Artificial
  CRISPR gRNA sequence
attcccaaaaaagtttggac

SEQ ID NO: 156528 - DNA, 20 bp, Artificial
  CRISPR gRNA sequence
ccaaaaaagtttggacctgg

SEQ ID NO: 156529 - DNA, 20 bp, Artificial
  CRISPR gRNA sequence
ggacctggctcttaaagtga

SEQ ID NO: 156530 - DNA, 20 bp, Artificial
  CRISPR gRNA sequence
gacctggctcttaaagtgag

SEQ ID NO: 156531 - DNA, 20 bp, Artificial
  CRISPR gRNA sequence
gctcttaaagtgagtccaca

SEQ ID NO: 156532 - DNA, 20 bp, Artificial
  CRISPR gRNA sequence
ttaaagtgagtccacaagct

SEQ ID NO: 156533 - DNA, 20 bp, Artificial
  CRISPR gRNA sequence
aaagtgagtccacaagctaa

SEQ ID NO: 156534 - DNA, 20 bp, Artificial
  CRISPR gRNA sequence
aagtgagtccacaagctaac

SEQ ID NO: 156535 - DNA, 20 bp, Artificial
  CRISPR gRNA sequence
acctgtatttaataaacaaa

SEQ ID NO: 156536 - DNA, 20 bp, Artificial
  CRISPR gRNA sequence
tatttaataaacaaagattc

SEQ ID NO: 156537 - DNA, 20 bp, Artificial
  CRISPR gRNA sequence
aataaacaaagattccaggg

SEQ ID NO: 156538 - DNA, 20 bp, Artificial
  CRISPR gRNA sequence
ataaacaaagattccagggt

SEQ ID NO: 156539 - DNA, 20 bp, Artificial
  CRISPR gRNA sequence
cagggtcattttaagcattt

SEQ ID NO: 156540 - DNA, 20 bp, Artificial
  CRISPR gRNA sequence
taagcatttgacaagactaa

SEQ ID NO: 156541 - DNA, 20 bp, Artificial
  CRISPR gRNA sequence
aagcatttgacaagactaaa

SEQ ID NO: 156542 - DNA, 20 bp, Artificial
  CRISPR gRNA sequence
agcatttgacaagactaaaa

SEQ ID NO: 156543 - DNA, 20 bp, Artificial
  CRISPR gRNA sequence
gacaagactaaaataggaat

SEQ ID NO: 156544 - DNA, 20 bp, Artificial
  CRISPR gRNA sequence
acaagactaaaataggaatc

SEQ ID NO: 156545 - DNA, 20 bp, Artificial
  CRISPR gRNA sequence
aaataggaatcattgtttat

SEQ ID NO: 156546 - DNA, 20 bp, Artificial
  CRISPR gRNA sequence
tttatagacacccaaaataa

SEQ ID NO: 156547 - DNA, 20 bp, Artificial
  CRISPR gRNA sequence
atagacacccaaaataatat

SEQ ID NO: 156548 - DNA, 20 bp, Artificial
  CRISPR gRNA sequence
tagacacccaaaataatatc

SEQ ID NO: 156549 - DNA, 20 bp, Artificial
  CRISPR gRNA sequence
aactgtgctgactttactgt

SEQ ID NO: 156550 - DNA, 20 bp, Artificial
  CRISPR gRNA sequence
actgtgctgactttactgtt

SEQ ID NO: 156551 - DNA, 20 bp, Artificial
  CRISPR gRNA sequence
tgctgactttactgtttccc

SEQ ID NO: 156552 - DNA, 20 bp, Artificial
  CRISPR gRNA sequence
actttactgtttcccatcag

SEQ ID NO: 156553 - DNA, 20 bp, Artificial
  CRISPR gRNA sequence
tactgtttcccatcagcaaa

SEQ ID NO: 156554 - DNA, 20 bp, Artificial
  CRISPR gRNA sequence
actgtttcccatcagcaaag

SEQ ID NO: 156555 - DNA, 20 bp, Artificial
  CRISPR gRNA sequence
ctgtttcccatcagcaaagt

SEQ ID NO: 156556 - DNA, 20 bp, Artificial
  CRISPR gRNA sequence
tttcccatcagcaaagtggt

SEQ ID NO: 156557 - DNA, 20 bp, Artificial
  CRISPR gRNA sequence
cccatcagcaaagtggtatt

SEQ ID NO: 156558 - DNA, 20 bp, Artificial
  CRISPR gRNA sequence
ccatcagcaaagtggtatta

SEQ ID NO: 156559 - DNA, 20 bp, Artificial
  CRISPR gRNA sequence
tgtgtgtatgtgcttgtgta

SEQ ID NO: 156560 - DNA, 20 bp, Artificial
  CRISPR gRNA sequence
gtgtatgtttgagtagtatt

SEQ ID NO: 156561 - DNA, 20 bp, Artificial
  CRISPR gRNA sequence
tgtatgtttgagtagtattt

SEQ ID NO: 156562 - DNA, 20 bp, Artificial
  CRISPR gRNA sequence
gagtagtatttgttctttat

SEQ ID NO: 156563 - DNA, 20 bp, Artificial
  CRISPR gRNA sequence
agtagtatttgttctttata

SEQ ID NO: 156564 - DNA, 20 bp, Artificial
  CRISPR gRNA sequence
gttctttatattctttgata

SEQ ID NO: 156565 - DNA, 20 bp, Artificial
  CRISPR gRNA sequence
ttctttatattctttgatag

SEQ ID NO: 156566 - DNA, 20 bp, Artificial
  CRISPR gRNA sequence
tttatattctttgatagacc

SEQ ID NO: 156567 - DNA, 20 bp, Artificial
  CRISPR gRNA sequence
tatattctttgatagaccat

SEQ ID NO: 156568 - DNA, 20 bp, Artificial
  CRISPR gRNA sequence
atattctttgatagaccatg

SEQ ID NO: 156569 - DNA, 20 bp, Artificial
  CRISPR gRNA sequence
tattctttgatagaccatga

SEQ ID NO: 156570 - DNA, 20 bp, Artificial
  CRISPR gRNA sequence
tttgatagaccatgatatac

SEQ ID NO: 156571 - DNA, 20 bp, Artificial
  CRISPR gRNA sequence
tgatagaccatgatatactt

SEQ ID NO: 156572 - DNA, 20 bp, Artificial
  CRISPR gRNA sequence
gatagaccatgatatacttt

SEQ ID NO: 156573 - DNA, 20 bp, Artificial
  CRISPR gRNA sequence
atagaccatgatatacttta

SEQ ID NO: 156574 - DNA, 20 bp, Artificial
  CRISPR gRNA sequence
taacatttttaatttttctg

SEQ ID NO: 156575 - DNA, 20 bp, Artificial
  CRISPR gRNA sequence
aacatttttaatttttctga

SEQ ID NO: 156576 - DNA, 20 bp, Artificial
  CRISPR gRNA sequence
acatttttaatttttctgaa

SEQ ID NO: 156577 - DNA, 20 bp, Artificial
  CRISPR gRNA sequence
ttaatttttctgaaggtgat

SEQ ID NO: 156578 - DNA, 20 bp, Artificial
  CRISPR gRNA sequence
taatttttctgaaggtgatg

SEQ ID NO: 156579 - DNA, 20 bp, Artificial
  CRISPR gRNA sequence
aatttttctgaaggtgatga

SEQ ID NO: 156580 - DNA, 20 bp, Artificial
  CRISPR gRNA sequence
atttttctgaaggtgatgac

SEQ ID NO: 156581 - DNA, 20 bp, Artificial
  CRISPR gRNA sequence
ttctgaaggtgatgaccttc

SEQ ID NO: 156582 - DNA, 20 bp, Artificial
  CRISPR gRNA sequence
tctgaaggtgatgaccttca

SEQ ID NO: 156583 - DNA, 20 bp, Artificial
  CRISPR gRNA sequence
ctgaaggtgatgaccttcat

SEQ ID NO: 156584 - DNA, 20 bp, Artificial
  CRISPR gRNA sequence
tgaaggtgatgaccttcata

SEQ ID NO: 156585 - DNA, 20 bp, Artificial
  CRISPR gRNA sequence
aaggtgatgaccttcatata

SEQ ID NO: 156586 - DNA, 20 bp, Artificial
  CRISPR gRNA sequence
catatatttagacaaaagtt

SEQ ID NO: 156587 - DNA, 20 bp, Artificial
  CRISPR gRNA sequence
atatatttagacaaaagtta

SEQ ID NO: 156588 - DNA, 20 bp, Artificial
  CRISPR gRNA sequence
agacaaaagttatagtccat

SEQ ID NO: 156589 - DNA, 20 bp, Artificial
  CRISPR gRNA sequence
gacaaaagttatagtccatt

SEQ ID NO: 156590 - DNA, 20 bp, Artificial
  CRISPR gRNA sequence
tagtccattgaaagaatgag

SEQ ID NO: 156591 - DNA, 20 bp, Artificial
  CRISPR gRNA sequence
aaagaatgagggcttgaacg

SEQ ID NO: 156592 - DNA, 20 bp, Artificial
  CRISPR gRNA sequence
gaacgatgtaagttatgtaa

SEQ ID NO: 156593 - DNA, 20 bp, Artificial
  CRISPR gRNA sequence
aacgatgtaagttatgtaat

SEQ ID NO: 156594 - DNA, 20 bp, Artificial
  CRISPR gRNA sequence
tgtaatatttaagtcctaaa

SEQ ID NO: 156595 - DNA, 20 bp, Artificial
  CRISPR gRNA sequence
aagtcctaaagtgtactgac

SEQ ID NO: 156596 - DNA, 20 bp, Artificial
  CRISPR gRNA sequence
agtcctaaagtgtactgact

SEQ ID NO: 156597 - DNA, 20 bp, Artificial
  CRISPR gRNA sequence
aagtgtactgactgaagatt

SEQ ID NO: 156598 - DNA, 20 bp, Artificial
  CRISPR gRNA sequence
actgaagattataatagaca

SEQ ID NO: 156599 - DNA, 20 bp, Artificial
  CRISPR gRNA sequence
aagattataatagacatagc

SEQ ID NO: 156600 - DNA, 20 bp, Artificial
  CRISPR gRNA sequence
taatagacatagctggatag

SEQ ID NO: 156601 - DNA, 20 bp, Artificial
  CRISPR gRNA sequence
gatagaatatatttcatgtc

SEQ ID NO: 156602 - DNA, 20 bp, Artificial
  CRISPR gRNA sequence
catgtctacatttcccagaa

SEQ ID NO: 156603 - DNA, 20 bp, Artificial
  CRISPR gRNA sequence
atgtctacatttcccagaag

SEQ ID NO: 156604 - DNA, 20 bp, Artificial
  CRISPR gRNA sequence
catttcccagaagtttagtt

SEQ ID NO: 156605 - DNA, 20 bp, Artificial
  CRISPR gRNA sequence
cccagaagtttagttttctt

SEQ ID NO: 156606 - DNA, 20 bp, Artificial
  CRISPR gRNA sequence
ccagaagtttagttttcttt

SEQ ID NO: 156607 - DNA, 20 bp, Artificial
  CRISPR gRNA sequence
agttttctttcctttttttt

SEQ ID NO: 156608 - DNA, 20 bp, Artificial
  CRISPR gRNA sequence
gttttctttccttttttttg

SEQ ID NO: 156609 - DNA, 20 bp, Artificial
  CRISPR gRNA sequence
tctttccttttttttggaga

SEQ ID NO: 156610 - DNA, 20 bp, Artificial
  CRISPR gRNA sequence
ctttccttttttttggagac

SEQ ID NO: 156611 - DNA, 20 bp, Artificial
  CRISPR gRNA sequence
tttccttttttttggagaca

SEQ ID NO: 156612 - DNA, 20 bp, Artificial
  CRISPR gRNA sequence
tccttttttttggagacaag

SEQ ID NO: 156613 - DNA, 20 bp, Artificial
  CRISPR gRNA sequence
ccttttttttggagacaagg

SEQ ID NO: 156614 - DNA, 20 bp, Artificial
  CRISPR gRNA sequence
cttttttttggagacaaggt

SEQ ID NO: 156615 - DNA, 20 bp, Artificial
  CRISPR gRNA sequence
ttttttggagacaaggtctt

SEQ ID NO: 156616 - DNA, 20 bp, Artificial
  CRISPR gRNA sequence
tttttggagacaaggtcttg

SEQ ID NO: 156617 - DNA, 20 bp, Artificial
  CRISPR gRNA sequence
ttttggagacaaggtcttgc

SEQ ID NO: 156618 - DNA, 20 bp, Artificial
  CRISPR gRNA sequence
tttggagacaaggtcttgct

SEQ ID NO: 156619 - DNA, 20 bp, Artificial
  CRISPR gRNA sequence
ttggagacaaggtcttgctc

SEQ ID NO: 156620 - DNA, 20 bp, Artificial
  CRISPR gRNA sequence
tggagacaaggtcttgctct

SEQ ID NO: 156621 - DNA, 20 bp, Artificial
  CRISPR gRNA sequence
ggagacaaggtcttgctctg

SEQ ID NO: 156622 - DNA, 20 bp, Artificial
  CRISPR gRNA sequence
gagacaaggtcttgctctgt

SEQ ID NO: 156623 - DNA, 20 bp, Artificial
  CRISPR gRNA sequence
gctctgtcacccaggctaga

SEQ ID NO: 156624 - DNA, 20 bp, Artificial
  CRISPR gRNA sequence
ctctgtcacccaggctagag

SEQ ID NO: 156625 - DNA, 20 bp, Artificial
  CRISPR gRNA sequence
tgtcacccaggctagagtgt

SEQ ID NO: 156626 - DNA, 20 bp, Artificial
  CRISPR gRNA sequence
tcacccaggctagagtgtag

SEQ ID NO: 156627 - DNA, 20 bp, Artificial
  CRISPR gRNA sequence
gagtgtagtggtgtaatcat

SEQ ID NO: 156628 - DNA, 20 bp, Artificial
  CRISPR gRNA sequence
caaccttaaactcctgggct

SEQ ID NO: 156629 - DNA, 20 bp, Artificial
  CRISPR gRNA sequence
aaactcctgggctcaagcag

SEQ ID NO: 156630 - DNA, 20 bp, Artificial
  CRISPR gRNA sequence
aactcctgggctcaagcagt

SEQ ID NO: 156631 - DNA, 20 bp, Artificial
  CRISPR gRNA sequence
ctgggctcaagcagtcctcc

SEQ ID NO: 156632 - DNA, 20 bp, Artificial
  CRISPR gRNA sequence
ggctcaagcagtcctcccac

SEQ ID NO: 156633 - DNA, 20 bp, Artificial
  CRISPR gRNA sequence
aagcagtcctcccacctcag

SEQ ID NO: 156634 - DNA, 20 bp, Artificial
  CRISPR gRNA sequence
ccacctcagcctccgagtaa

SEQ ID NO: 156635 - DNA, 20 bp, Artificial
  CRISPR gRNA sequence
agcctccgagtaattgggac

SEQ ID NO: 156636 - DNA, 20 bp, Artificial
  CRISPR gRNA sequence
cgagtaattgggactacaga

SEQ ID NO: 156637 - DNA, 20 bp, Artificial
  CRISPR gRNA sequence
ggactacagatgcacgctac

SEQ ID NO: 156638 - DNA, 20 bp, Artificial
  CRISPR gRNA sequence
cagatgcacgctactaggcc

SEQ ID NO: 156639 - DNA, 20 bp, Artificial
  CRISPR gRNA sequence
ctaggcctggctaattaaaa

SEQ ID NO: 156640 - DNA, 20 bp, Artificial
  CRISPR gRNA sequence
ggcctggctaattaaaaaaa

SEQ ID NO: 156641 - DNA, 20 bp, Artificial
  CRISPR gRNA sequence
gctaattaaaaaaaaatttt

SEQ ID NO: 156642 - DNA, 20 bp, Artificial
  CRISPR gRNA sequence
attaaaaaaaaattttgagg

SEQ ID NO: 156643 - DNA, 20 bp, Artificial
  CRISPR gRNA sequence
aaaaaaaattttgagggcag

SEQ ID NO: 156644 - DNA, 20 bp, Artificial
  CRISPR gRNA sequence
tgagggcagggcgtggtggc

SEQ ID NO: 156645 - DNA, 20 bp, Artificial
  CRISPR gRNA sequence
gagggcagggcgtggtggct

SEQ ID NO: 156646 - DNA, 20 bp, Artificial
  CRISPR gRNA sequence
agggcagggcgtggtggctc

SEQ ID NO: 156647 - DNA, 20 bp, Artificial
  CRISPR gRNA sequence
acgcctgtaatcccagcact

SEQ ID NO: 156648 - DNA, 20 bp, Artificial
  CRISPR gRNA sequence
taatcccagcactttgggag

SEQ ID NO: 156649 - DNA, 20 bp, Artificial
  CRISPR gRNA sequence
tgggaggccgaggcaggcag

SEQ ID NO: 156650 - DNA, 20 bp, Artificial
  CRISPR gRNA sequence
gggaggccgaggcaggcaga

SEQ ID NO: 156651 - DNA, 20 bp, Artificial
  CRISPR gRNA sequence
ggaggccgaggcaggcagat

SEQ ID NO: 156652 - DNA, 20 bp, Artificial
  CRISPR gRNA sequence
gctaacatggttaaacctca

SEQ ID NO: 156653 - DNA, 20 bp, Artificial
  CRISPR gRNA sequence
acatggttaaacctcatctc

SEQ ID NO: 156654 - DNA, 20 bp, Artificial
  CRISPR gRNA sequence
aacctcatctctactaaaaa

SEQ ID NO: 156655 - DNA, 20 bp, Artificial
  CRISPR gRNA sequence
atctctactaaaaatacaaa

SEQ ID NO: 156656 - DNA, 20 bp, Artificial
  CRISPR gRNA sequence
tactaaaaatacaaaaaatt

SEQ ID NO: 156657 - DNA, 20 bp, Artificial
  CRISPR gRNA sequence
ctaaaaatacaaaaaattag

SEQ ID NO: 156658 - DNA, 20 bp, Artificial
  CRISPR gRNA sequence
aaaatacaaaaaattagccg

SEQ ID NO: 156659 - DNA, 20 bp, Artificial
  CRISPR gRNA sequence
gccgggtgtggtggcgggcg

SEQ ID NO: 156660 - DNA, 20 bp, Artificial
  CRISPR gRNA sequence
tagtcccagctactcggcag

SEQ ID NO: 156661 - DNA, 20 bp, Artificial
  CRISPR gRNA sequence
ctcggcaggctgaggcagga

SEQ ID NO: 156662 - DNA, 20 bp, Artificial
  CRISPR gRNA sequence
ggcaggctgaggcaggagaa

SEQ ID NO: 156663 - DNA, 20 bp, Artificial
  CRISPR gRNA sequence
aggcaggagaatggcatgaa

SEQ ID NO: 156664 - DNA, 20 bp, Artificial
  CRISPR gRNA sequence
gcagtgagccgacatggcgc

SEQ ID NO: 156665 - DNA, 20 bp, Artificial
  CRISPR gRNA sequence
cagtgagccgacatggcgcc

SEQ ID NO: 156666 - DNA, 20 bp, Artificial
  CRISPR gRNA sequence
cactccagcctgtgcaacaa

SEQ ID NO: 156667 - DNA, 20 bp, Artificial
  CRISPR gRNA sequence
cagcctgtgcaacaaatcga

SEQ ID NO: 156668 - DNA, 20 bp, Artificial
  CRISPR gRNA sequence
tgcaacaaatcgagactcca

SEQ ID NO: 156669 - DNA, 20 bp, Artificial
  CRISPR gRNA sequence
catgtctcaaaacaataaat

SEQ ID NO: 156670 - DNA, 20 bp, Artificial
  CRISPR gRNA sequence
aaaacaataaataaataaat

SEQ ID NO: 156671 - DNA, 20 bp, Artificial
  CRISPR gRNA sequence
ggctgggtgtggtggatcat

SEQ ID NO: 156672 - DNA, 20 bp, Artificial
  CRISPR gRNA sequence
gctgggtgtggtggatcatg

SEQ ID NO: 156673 - DNA, 20 bp, Artificial
  CRISPR gRNA sequence
ggtgtggtggatcatgcctg

SEQ ID NO: 156674 - DNA, 20 bp, Artificial
  CRISPR gRNA sequence
taatcccagcactttgggag

SEQ ID NO: 156675 - DNA, 20 bp, Artificial
  CRISPR gRNA sequence
tgggaggccaaggtgggcgg

SEQ ID NO: 156676 - DNA, 20 bp, Artificial
  CRISPR gRNA sequence
gggaggccaaggtgggcgga

SEQ ID NO: 156677 - DNA, 20 bp, Artificial
  CRISPR gRNA sequence
ggaggccaaggtgggcggat

SEQ ID NO: 156678 - DNA, 20 bp, Artificial
  CRISPR gRNA sequence
gaggtcaggagtttgagacc

SEQ ID NO: 156679 - DNA, 20 bp, Artificial
  CRISPR gRNA sequence
aggtcaggagtttgagacca

SEQ ID NO: 156680 - DNA, 20 bp, Artificial
  CRISPR gRNA sequence
gagaccagcctggccaacat

SEQ ID NO: 156681 - DNA, 20 bp, Artificial
  CRISPR gRNA sequence
agaccagcctggccaacatg

SEQ ID NO: 156682 - DNA, 20 bp, Artificial
  CRISPR gRNA sequence
gccaacatggtgaaacccag

SEQ ID NO: 156683 - DNA, 20 bp, Artificial
  CRISPR gRNA sequence
tactaaaaaaacaccgaaat

SEQ ID NO: 156684 - DNA, 20 bp, Artificial
  CRISPR gRNA sequence
actaaaaaaacaccgaaatt

SEQ ID NO: 156685 - DNA, 20 bp, Artificial
  CRISPR gRNA sequence
ctaaaaaaacaccgaaatta

SEQ ID NO: 156686 - DNA, 20 bp, Artificial
  CRISPR gRNA sequence
aaaaaacaccgaaattagcc

SEQ ID NO: 156687 - DNA, 20 bp, Artificial
  CRISPR gRNA sequence
gccaggcgtagtcccagcta

SEQ ID NO: 156688 - DNA, 20 bp, Artificial
  CRISPR gRNA sequence
tacaggaggctgaggcacaa

SEQ ID NO: 156689 - DNA, 20 bp, Artificial
  CRISPR gRNA sequence
aggcacaagaattgcttgaa

SEQ ID NO: 156690 - DNA, 20 bp, Artificial
  CRISPR gRNA sequence
cttgaactgggaggttgcag

SEQ ID NO: 156691 - DNA, 20 bp, Artificial
  CRISPR gRNA sequence
gaactgggaggttgcagtga

SEQ ID NO: 156692 - DNA, 20 bp, Artificial
  CRISPR gRNA sequence
aactgggaggttgcagtgag

SEQ ID NO: 156693 - DNA, 20 bp, Artificial
  CRISPR gRNA sequence
ggaggttgcagtgagccatg

SEQ ID NO: 156694 - DNA, 20 bp, Artificial
  CRISPR gRNA sequence
cagtgagccatgatagtgcc

SEQ ID NO: 156695 - DNA, 20 bp, Artificial
  CRISPR gRNA sequence
cactccagcctgggcaacag

SEQ ID NO: 156696 - DNA, 20 bp, Artificial
  CRISPR gRNA sequence
cagcctgggcaacagagtga

SEQ ID NO: 156697 - DNA, 20 bp, Artificial
  CRISPR gRNA sequence
ggcaacagagtgagattccg

SEQ ID NO: 156698 - DNA, 20 bp, Artificial
  CRISPR gRNA sequence
cgtctcaagaaaaaaaaaca

SEQ ID NO: 156699 - DNA, 20 bp, Artificial
  CRISPR gRNA sequence
aagaaaaaaaaacaaaaaac

SEQ ID NO: 156700 - DNA, 20 bp, Artificial
  CRISPR gRNA sequence
tttttttttttcctgtagaa

SEQ ID NO: 156701 - DNA, 20 bp, Artificial
  CRISPR gRNA sequence
ttttttttttcctgtagaaa

SEQ ID NO: 156702 - DNA, 20 bp, Artificial
  CRISPR gRNA sequence
tttttttttcctgtagaaat

SEQ ID NO: 156703 - DNA, 20 bp, Artificial
  CRISPR gRNA sequence
ttttttttcctgtagaaatg

SEQ ID NO: 156704 - DNA, 20 bp, Artificial
  CRISPR gRNA sequence
tttttttcctgtagaaatgg

SEQ ID NO: 156705 - DNA, 20 bp, Artificial
  CRISPR gRNA sequence
ttttttcctgtagaaatgga

SEQ ID NO: 156706 - DNA, 20 bp, Artificial
  CRISPR gRNA sequence
tttttcctgtagaaatggag

SEQ ID NO: 156707 - DNA, 20 bp, Artificial
  CRISPR gRNA sequence
ttttcctgtagaaatggagt

SEQ ID NO: 156708 - DNA, 20 bp, Artificial
  CRISPR gRNA sequence
tttcctgtagaaatggagtc

SEQ ID NO: 156709 - DNA, 20 bp, Artificial
  CRISPR gRNA sequence
ttcctgtagaaatggagtct

SEQ ID NO: 156710 - DNA, 20 bp, Artificial
  CRISPR gRNA sequence
tcctgtagaaatggagtctc

SEQ ID NO: 156711 - DNA, 20 bp, Artificial
  CRISPR gRNA sequence
cctgtagaaatggagtctca

SEQ ID NO: 156712 - DNA, 20 bp, Artificial
  CRISPR gRNA sequence
ctgtagaaatggagtctcat

SEQ ID NO: 156713 - DNA, 20 bp, Artificial
  CRISPR gRNA sequence
tagaaatggagtctcattat

SEQ ID NO: 156714 - DNA, 20 bp, Artificial
  CRISPR gRNA sequence
attattttccctggctggtc

SEQ ID NO: 156715 - DNA, 20 bp, Artificial
  CRISPR gRNA sequence
ttttccctggctggtctcga

SEQ ID NO: 156716 - DNA, 20 bp, Artificial
  CRISPR gRNA sequence
tccctggctggtctcgaact

SEQ ID NO: 156717 - DNA, 20 bp, Artificial
  CRISPR gRNA sequence
ccctggctggtctcgaactc

SEQ ID NO: 156718 - DNA, 20 bp, Artificial
  CRISPR gRNA sequence
cctggctggtctcgaactcc

SEQ ID NO: 156719 - DNA, 20 bp, Artificial
  CRISPR gRNA sequence
gctggtctcgaactcctggc

SEQ ID NO: 156720 - DNA, 20 bp, Artificial
  CRISPR gRNA sequence
gtctcgaactcctggcctca

SEQ ID NO: 156721 - DNA, 20 bp, Artificial
  CRISPR gRNA sequence
gaactcctggcctcaaagga

SEQ ID NO: 156722 - DNA, 20 bp, Artificial
  CRISPR gRNA sequence
ctggcctcaaaggatctttc

SEQ ID NO: 156723 - DNA, 20 bp, Artificial
  CRISPR gRNA sequence
gcctcaaaggatctttctac

SEQ ID NO: 156724 - DNA, 20 bp, Artificial
  CRISPR gRNA sequence
aaaggatctttctacctcag

SEQ ID NO: 156725 - DNA, 20 bp, Artificial
  CRISPR gRNA sequence
tctacctcagcctcccaaag

SEQ ID NO: 156726 - DNA, 20 bp, Artificial
  CRISPR gRNA sequence
ctacctcagcctcccaaagc

SEQ ID NO: 156727 - DNA, 20 bp, Artificial
  CRISPR gRNA sequence
tacctcagcctcccaaagca

SEQ ID NO: 156728 - DNA, 20 bp, Artificial
  CRISPR gRNA sequence
cctcagcctcccaaagcact

SEQ ID NO: 156729 - DNA, 20 bp, Artificial
  CRISPR gRNA sequence
agcctcccaaagcactggca

SEQ ID NO: 156730 - DNA, 20 bp, Artificial
  CRISPR gRNA sequence
ccaaagcactggcatttaca

SEQ ID NO: 156731 - DNA, 20 bp, Artificial
  CRISPR gRNA sequence
gcatttacaggtgtgagcat

SEQ ID NO: 156732 - DNA, 20 bp, Artificial
  CRISPR gRNA sequence
acaggtgtgagcatctgtgc

SEQ ID NO: 156733 - DNA, 20 bp, Artificial
  CRISPR gRNA sequence
caggtgtgagcatctgtgcc

SEQ ID NO: 156734 - DNA, 20 bp, Artificial
  CRISPR gRNA sequence
tgcctggctagttttctttt

SEQ ID NO: 156735 - DNA, 20 bp, Artificial
  CRISPR gRNA sequence
gctagttttctttttaatgt

SEQ ID NO: 156736 - DNA, 20 bp, Artificial
  CRISPR gRNA sequence
gttttctttttaatgtgttc

SEQ ID NO: 156737 - DNA, 20 bp, Artificial
  CRISPR gRNA sequence
tctttttaatgtgttctgct

SEQ ID NO: 156738 - DNA, 20 bp, Artificial
  CRISPR gRNA sequence
ctttttaatgtgttctgcta

SEQ ID NO: 156739 - DNA, 20 bp, Artificial
  CRISPR gRNA sequence
tttttaatgtgttctgctac

SEQ ID NO: 156740 - DNA, 20 bp, Artificial
  CRISPR gRNA sequence
tttaatgtgttctgctacct

SEQ ID NO: 156741 - DNA, 20 bp, Artificial
  CRISPR gRNA sequence
ttaatgtgttctgctacctc

SEQ ID NO: 156742 - DNA, 20 bp, Artificial
  CRISPR gRNA sequence
taatgtgttctgctacctcc

SEQ ID NO: 156743 - DNA, 20 bp, Artificial
  CRISPR gRNA sequence
aatgtgttctgctacctcca

SEQ ID NO: 156744 - DNA, 20 bp, Artificial
  CRISPR gRNA sequence
atgtgttctgctacctccat

SEQ ID NO: 156745 - DNA, 20 bp, Artificial
  CRISPR gRNA sequence
tgctacctccatatgggggc

SEQ ID NO: 156746 - DNA, 20 bp, Artificial
  CRISPR gRNA sequence
ctacctccatatgggggccc

SEQ ID NO: 156747 - DNA, 20 bp, Artificial
  CRISPR gRNA sequence
cctccatatgggggcccacc

SEQ ID NO: 156748 - DNA, 20 bp, Artificial
  CRISPR gRNA sequence
catatgggggcccacctctt

SEQ ID NO: 156749 - DNA, 20 bp, Artificial
  CRISPR gRNA sequence
tttataacgtggtcagattc

SEQ ID NO: 156750 - DNA, 20 bp, Artificial
  CRISPR gRNA sequence
tataacgtggtcagattcta

SEQ ID NO: 156751 - DNA, 20 bp, Artificial
  CRISPR gRNA sequence
ataacgtggtcagattctat

SEQ ID NO: 156752 - DNA, 20 bp, Artificial
  CRISPR gRNA sequence
taacgtggtcagattctatt

SEQ ID NO: 156753 - DNA, 20 bp, Artificial
  CRISPR gRNA sequence
tatttgtattatcactctta

SEQ ID NO: 156754 - DNA, 20 bp, Artificial
  CRISPR gRNA sequence
tttgtattatcactcttatc

SEQ ID NO: 156755 - DNA, 20 bp, Artificial
  CRISPR gRNA sequence
gtattatcactcttatcttc

SEQ ID NO: 156756 - DNA, 20 bp, Artificial
  CRISPR gRNA sequence
tattatcactcttatcttct

SEQ ID NO: 156757 - DNA, 20 bp, Artificial
  CRISPR gRNA sequence
tcactcttatcttcttgtct

SEQ ID NO: 156758 - DNA, 20 bp, Artificial
  CRISPR gRNA sequence
ttatcttcttgtctctccct

SEQ ID NO: 156759 - DNA, 20 bp, Artificial
  CRISPR gRNA sequence
atcttcttgtctctccctta

SEQ ID NO: 156760 - DNA, 20 bp, Artificial
  CRISPR gRNA sequence
tcttcttgtctctcccttag

SEQ ID NO: 156761 - DNA, 20 bp, Artificial
  CRISPR gRNA sequence
cttgtctctcccttagggat

SEQ ID NO: 156762 - DNA, 20 bp, Artificial
  CRISPR gRNA sequence
ttgtctctcccttagggatc

SEQ ID NO: 156763 - DNA, 20 bp, Artificial
  CRISPR gRNA sequence
gtctctcccttagggatccc

SEQ ID NO: 156764 - DNA, 20 bp, Artificial
  CRISPR gRNA sequence
tctctcccttagggatccca

SEQ ID NO: 156765 - DNA, 20 bp, Artificial
  CRISPR gRNA sequence
tcccttagggatcccaaagc

SEQ ID NO: 156766 - DNA, 20 bp, Artificial
  CRISPR gRNA sequence
ccttagggatcccaaagcta

SEQ ID NO: 156767 - DNA, 20 bp, Artificial
  CRISPR gRNA sequence
agggatcccaaagctagacc

SEQ ID NO: 156768 - DNA, 20 bp, Artificial
  CRISPR gRNA sequence
gggatcccaaagctagaccc

SEQ ID NO: 156769 - DNA, 20 bp, Artificial
  CRISPR gRNA sequence
gaccccgctgttcaataatt

SEQ ID NO: 156770 - DNA, 20 bp, Artificial
  CRISPR gRNA sequence
ttcaataattgaccaaaagt

SEQ ID NO: 156771 - DNA, 20 bp, Artificial
  CRISPR gRNA sequence
aataattgaccaaaagtttt

SEQ ID NO: 156772 - DNA, 20 bp, Artificial
  CRISPR gRNA sequence
accaaaagtttttctctact

SEQ ID NO: 156773 - DNA, 20 bp, Artificial
  CRISPR gRNA sequence
ttctctacttatagtatttt

SEQ ID NO: 156774 - DNA, 20 bp, Artificial
  CRISPR gRNA sequence
tctctacttatagtattttt

SEQ ID NO: 156775 - DNA, 20 bp, Artificial
  CRISPR gRNA sequence
ctctacttatagtatttttt

SEQ ID NO: 156776 - DNA, 20 bp, Artificial
  CRISPR gRNA sequence
tctacttatagtattttttc

SEQ ID NO: 156777 - DNA, 20 bp, Artificial
  CRISPR gRNA sequence
tacttatagtattttttcta

SEQ ID NO: 156778 - DNA, 20 bp, Artificial
  CRISPR gRNA sequence
cttatagtattttttctaaa

SEQ ID NO: 156779 - DNA, 20 bp, Artificial
  CRISPR gRNA sequence
atagtattttttctaaatta

SEQ ID NO: 156780 - DNA, 20 bp, Artificial
  CRISPR gRNA sequence
tagtattttttctaaattag

SEQ ID NO: 156781 - DNA, 20 bp, Artificial
  CRISPR gRNA sequence
tttctaaattagattacagt

SEQ ID NO: 156782 - DNA, 20 bp, Artificial
  CRISPR gRNA sequence
ttctaaattagattacagtc

SEQ ID NO: 156783 - DNA, 20 bp, Artificial
  CRISPR gRNA sequence
tctaaattagattacagtct

SEQ ID NO: 156784 - DNA, 20 bp, Artificial
  CRISPR gRNA sequence
ctaaattagattacagtcta

SEQ ID NO: 156785 - DNA, 20 bp, Artificial
  CRISPR gRNA sequence
taaattagattacagtctag

SEQ ID NO: 156786 - DNA, 20 bp, Artificial
  CRISPR gRNA sequence
aattagattacagtctagca

SEQ ID NO: 156787 - DNA, 20 bp, Artificial
  CRISPR gRNA sequence
gattacagtctagcacctgc

SEQ ID NO: 156788 - DNA, 20 bp, Artificial
  CRISPR gRNA sequence
cagtctagcacctgcagtga

SEQ ID NO: 156789 - DNA, 20 bp, Artificial
  CRISPR gRNA sequence
gcacctgcagtgaaaatggg

SEQ ID NO: 156790 - DNA, 20 bp, Artificial
  CRISPR gRNA sequence
cagtgaaaatgggcaatcga

SEQ ID NO: 156791 - DNA, 20 bp, Artificial
  CRISPR gRNA sequence
cagtataaaggaagaactaa

SEQ ID NO: 156792 - DNA, 20 bp, Artificial
  CRISPR gRNA sequence
aagaaaaaaaaacatagtaa

SEQ ID NO: 156793 - DNA, 20 bp, Artificial
  CRISPR gRNA sequence
aactttaaagtggcataaca

SEQ ID NO: 156794 - DNA, 20 bp, Artificial
  CRISPR gRNA sequence
actttaaagtggcataacat

SEQ ID NO: 156795 - DNA, 20 bp, Artificial
  CRISPR gRNA sequence
taaagtggcataacattgtg

SEQ ID NO: 156796 - DNA, 20 bp, Artificial
  CRISPR gRNA sequence
aaagtggcataacattgtga

SEQ ID NO: 156797 - DNA, 20 bp, Artificial
  CRISPR gRNA sequence
aagtggcataacattgtgac

SEQ ID NO: 156798 - DNA, 20 bp, Artificial
  CRISPR gRNA sequence
tgaccttgtgttccttagtt

SEQ ID NO: 156799 - DNA, 20 bp, Artificial
  CRISPR gRNA sequence
gtgttccttagttcaaagaa

SEQ ID NO: 156800 - DNA, 20 bp, Artificial
  CRISPR gRNA sequence
tgttccttagttcaaagaaa

SEQ ID NO: 156801 - DNA, 20 bp, Artificial
  CRISPR gRNA sequence
cttagttcaaagaaagaaga

SEQ ID NO: 156802 - DNA, 20 bp, Artificial
  CRISPR gRNA sequence
agttcaaagaaagaagacta

SEQ ID NO: 156803 - DNA, 20 bp, Artificial
  CRISPR gRNA sequence
gttcaaagaaagaagactaa

SEQ ID NO: 156804 - DNA, 20 bp, Artificial
  CRISPR gRNA sequence
aaagaaagaagactaaaata

SEQ ID NO: 156805 - DNA, 20 bp, Artificial
  CRISPR gRNA sequence
aaataactacagcaaatagc

SEQ ID NO: 156806 - DNA, 20 bp, Artificial
  CRISPR gRNA sequence
cagcaaatagcagtgctaat

SEQ ID NO: 156807 - DNA, 20 bp, Artificial
  CRISPR gRNA sequence
attcacttggttatcctttc

SEQ ID NO: 156808 - DNA, 20 bp, Artificial
  CRISPR gRNA sequence
acttggttatcctttcttct

SEQ ID NO: 156809 - DNA, 20 bp, Artificial
  CRISPR gRNA sequence
ggttatcctttcttcttgga

SEQ ID NO: 156810 - DNA, 20 bp, Artificial
  CRISPR gRNA sequence
gttatcctttcttcttggaa

SEQ ID NO: 156811 - DNA, 20 bp, Artificial
  CRISPR gRNA sequence
tcctttcttcttggaagtac

SEQ ID NO: 156812 - DNA, 20 bp, Artificial
  CRISPR gRNA sequence
tcttcttggaagtactaccg

SEQ ID NO: 156813 - DNA, 20 bp, Artificial
  CRISPR gRNA sequence
cttcttggaagtactaccgt

SEQ ID NO: 156814 - DNA, 20 bp, Artificial
  CRISPR gRNA sequence
ttcttggaagtactaccgtt

SEQ ID NO: 156815 - DNA, 20 bp, Artificial
  CRISPR gRNA sequence
cttggaagtactaccgtttt

SEQ ID NO: 156816 - DNA, 20 bp, Artificial
  CRISPR gRNA sequence
ttggaagtactaccgttttg

SEQ ID NO: 156817 - DNA, 20 bp, Artificial
  CRISPR gRNA sequence
ggaagtactaccgttttggt

SEQ ID NO: 156818 - DNA, 20 bp, Artificial
  CRISPR gRNA sequence
gaagtactaccgttttggtc

SEQ ID NO: 156819 - DNA, 20 bp, Artificial
  CRISPR gRNA sequence
ccgttttggtctgtttccat

SEQ ID NO: 156820 - DNA, 20 bp, Artificial
  CRISPR gRNA sequence
tggtctgtttccatagtttc

SEQ ID NO: 156821 - DNA, 20 bp, Artificial
  CRISPR gRNA sequence
ggtctgtttccatagtttca

SEQ ID NO: 156822 - DNA, 20 bp, Artificial
  CRISPR gRNA sequence
gtctgtttccatagtttcaa

SEQ ID NO: 156823 - DNA, 20 bp, Artificial
  CRISPR gRNA sequence
tttccatagtttcaattaca

SEQ ID NO: 156824 - DNA, 20 bp, Artificial
  CRISPR gRNA sequence
ccatagtttcaattacatag

SEQ ID NO: 156825 - DNA, 20 bp, Artificial
  CRISPR gRNA sequence
catagtttcaattacataga

SEQ ID NO: 156826 - DNA, 20 bp, Artificial
  CRISPR gRNA sequence
caattacatagaaaactaaa

SEQ ID NO: 156827 - DNA, 20 bp, Artificial
  CRISPR gRNA sequence
aattacatagaaaactaaag

SEQ ID NO: 156828 - DNA, 20 bp, Artificial
  CRISPR gRNA sequence
catagaaaactaaagggaag

SEQ ID NO: 156829 - DNA, 20 bp, Artificial
  CRISPR gRNA sequence
aagggaagacctgctcaatt

SEQ ID NO: 156830 - DNA, 20 bp, Artificial
  CRISPR gRNA sequence
ctcaattgaaaatatccaga

SEQ ID NO: 156831 - DNA, 20 bp, Artificial
  CRISPR gRNA sequence
aattgaaaatatccagataa

SEQ ID NO: 156832 - DNA, 20 bp, Artificial
  CRISPR gRNA sequence
aaaatatccagataaaatga

SEQ ID NO: 156833 - DNA, 20 bp, Artificial
  CRISPR gRNA sequence
tcttctgtctacctaagcta

SEQ ID NO: 156834 - DNA, 20 bp, Artificial
  CRISPR gRNA sequence
cttctgtctacctaagctat

SEQ ID NO: 156835 - DNA, 20 bp, Artificial
  CRISPR gRNA sequence
ttctgtctacctaagctata

SEQ ID NO: 156836 - DNA, 20 bp, Artificial
  CRISPR gRNA sequence
ctgtctacctaagctatata

SEQ ID NO: 156837 - DNA, 20 bp, Artificial
  CRISPR gRNA sequence
tgtctacctaagctatatag

SEQ ID NO: 156838 - DNA, 20 bp, Artificial
  CRISPR gRNA sequence
tctacctaagctatatagtt

SEQ ID NO: 156839 - DNA, 20 bp, Artificial
  CRISPR gRNA sequence
cctaagctatatagttctta

SEQ ID NO: 156840 - DNA, 20 bp, Artificial
  CRISPR gRNA sequence
agctatatagttcttacttt

SEQ ID NO: 156841 - DNA, 20 bp, Artificial
  CRISPR gRNA sequence
tatagttcttactttcaagg

SEQ ID NO: 156842 - DNA, 20 bp, Artificial
  CRISPR gRNA sequence
ttactttcaaggaaatgcta

SEQ ID NO: 156843 - DNA, 20 bp, Artificial
  CRISPR gRNA sequence
actttcaaggaaatgctaaa

SEQ ID NO: 156844 - DNA, 20 bp, Artificial
  CRISPR gRNA sequence
ctttcaaggaaatgctaaag

SEQ ID NO: 156845 - DNA, 20 bp, Artificial
  CRISPR gRNA sequence
tcaaggaaatgctaaagttg

SEQ ID NO: 156846 - DNA, 20 bp, Artificial
  CRISPR gRNA sequence
caaggaaatgctaaagttgg

SEQ ID NO: 156847 - DNA, 20 bp, Artificial
  CRISPR gRNA sequence
aaggaaatgctaaagttgga

SEQ ID NO: 156848 - DNA, 20 bp, Artificial
  CRISPR gRNA sequence
aagttggatgctttttacac

SEQ ID NO: 156849 - DNA, 20 bp, Artificial
  CRISPR gRNA sequence
gatgctttttacacttcctt

SEQ ID NO: 156850 - DNA, 20 bp, Artificial
  CRISPR gRNA sequence
tttacacttcctttcatcaa

SEQ ID NO: 156851 - DNA, 20 bp, Artificial
  CRISPR gRNA sequence
ttacacttcctttcatcaat

SEQ ID NO: 156852 - DNA, 20 bp, Artificial
  CRISPR gRNA sequence
tacacttcctttcatcaatt

SEQ ID NO: 156853 - DNA, 20 bp, Artificial
  CRISPR gRNA sequence
acacttcctttcatcaattc

SEQ ID NO: 156854 - DNA, 20 bp, Artificial
  CRISPR gRNA sequence
cacttcctttcatcaattca

SEQ ID NO: 156855 - DNA, 20 bp, Artificial
  CRISPR gRNA sequence
cctttcatcaattcaccacg

SEQ ID NO: 156856 - DNA, 20 bp, Artificial
  CRISPR gRNA sequence
ctttcatcaattcaccacgc

SEQ ID NO: 156857 - DNA, 20 bp, Artificial
  CRISPR gRNA sequence
tcatcaattcaccacgcatg

SEQ ID NO: 156858 - DNA, 20 bp, Artificial
  CRISPR gRNA sequence
catcaattcaccacgcatgc

SEQ ID NO: 156859 - DNA, 20 bp, Artificial
  CRISPR gRNA sequence
atcaattcaccacgcatgca

SEQ ID NO: 156860 - DNA, 20 bp, Artificial
  CRISPR gRNA sequence
accacgcatgcatgtctttt

SEQ ID NO: 156861 - DNA, 20 bp, Artificial
  CRISPR gRNA sequence
ttttgtggagactttaaaaa

SEQ ID NO: 156862 - DNA, 20 bp, Artificial
  CRISPR gRNA sequence
tttgtggagactttaaaaat

SEQ ID NO: 156863 - DNA, 20 bp, Artificial
  CRISPR gRNA sequence
ttgtggagactttaaaaatg

SEQ ID NO: 156864 - DNA, 20 bp, Artificial
  CRISPR gRNA sequence
tgtggagactttaaaaatgt

SEQ ID NO: 156865 - DNA, 20 bp, Artificial
  CRISPR gRNA sequence
gtggagactttaaaaatgta

SEQ ID NO: 156866 - DNA, 20 bp, Artificial
  CRISPR gRNA sequence
tggagactttaaaaatgtat

SEQ ID NO: 156867 - DNA, 20 bp, Artificial
  CRISPR gRNA sequence
taaaaatgtatacaaataaa

SEQ ID NO: 156868 - DNA, 20 bp, Artificial
  CRISPR gRNA sequence
aaaaatgtatacaaataaaa

SEQ ID NO: 156869 - DNA, 20 bp, Artificial
  CRISPR gRNA sequence
aaaatgtatacaaataaaat

SEQ ID NO: 156870 - DNA, 20 bp, Artificial
  CRISPR gRNA sequence
tactctgagactgatgatgt

SEQ ID NO: 156871 - DNA, 20 bp, Artificial
  CRISPR gRNA sequence
actctgagactgatgatgtt

SEQ ID NO: 156872 - DNA, 20 bp, Artificial
  CRISPR gRNA sequence
ctctgagactgatgatgttt

SEQ ID NO: 156873 - DNA, 20 bp, Artificial
  CRISPR gRNA sequence
tgagactgatgatgtttatc

SEQ ID NO: 156874 - DNA, 20 bp, Artificial
  CRISPR gRNA sequence
agactgatgatgtttatcaa

SEQ ID NO: 156875 - DNA, 20 bp, Artificial
  CRISPR gRNA sequence
atgatgtttatcaagtatta

SEQ ID NO: 156876 - DNA, 20 bp, Artificial
  CRISPR gRNA sequence
atcaagtattagaaactgat

SEQ ID NO: 156877 - DNA, 20 bp, Artificial
  CRISPR gRNA sequence
tcaagtattagaaactgata

SEQ ID NO: 156878 - DNA, 20 bp, Artificial
  CRISPR gRNA sequence
gaaactgatatggaaagaac

SEQ ID NO: 156879 - DNA, 20 bp, Artificial
  CRISPR gRNA sequence
atatggaaagaacaagcaaa

SEQ ID NO: 156880 - DNA, 20 bp, Artificial
  CRISPR gRNA sequence
agaggaggggagacgttcgc

SEQ ID NO: 156881 - DNA, 20 bp, Artificial
  CRISPR gRNA sequence
gcttaggaatgaaggcaagc

SEQ ID NO: 156882 - DNA, 20 bp, Artificial
  CRISPR gRNA sequence
aggaatgaaggcaagctgtt

SEQ ID NO: 156883 - DNA, 20 bp, Artificial
  CRISPR gRNA sequence
ggaatgaaggcaagctgttt

SEQ ID NO: 156884 - DNA, 20 bp, Artificial
  CRISPR gRNA sequence
tttaactgggtgtagactca

SEQ ID NO: 156885 - DNA, 20 bp, Artificial
  CRISPR gRNA sequence
aactgggtgtagactcaggg

SEQ ID NO: 156886 - DNA, 20 bp, Artificial
  CRISPR gRNA sequence
actgggtgtagactcaggga

SEQ ID NO: 156887 - DNA, 20 bp, Artificial
  CRISPR gRNA sequence
ggtgtagactcagggaggta

SEQ ID NO: 156888 - DNA, 20 bp, Artificial
  CRISPR gRNA sequence
agggaggtagggacaagggc

SEQ ID NO: 156889 - DNA, 20 bp, Artificial
  CRISPR gRNA sequence
cagacattgggagcaacaag

SEQ ID NO: 156890 - DNA, 20 bp, Artificial
  CRISPR gRNA sequence
ggagcaacaagcaagatcat

SEQ ID NO: 156891 - DNA, 20 bp, Artificial
  CRISPR gRNA sequence
aaaaagtacatcttgggtta

SEQ ID NO: 156892 - DNA, 20 bp, Artificial
  CRISPR gRNA sequence
gggttaaggagagcagtaaa

SEQ ID NO: 156893 - DNA, 20 bp, Artificial
  CRISPR gRNA sequence
ggttaaggagagcagtaaat

SEQ ID NO: 156894 - DNA, 20 bp, Artificial
  CRISPR gRNA sequence
aggagagcagtaaatggtca

SEQ ID NO: 156895 - DNA, 20 bp, Artificial
  CRISPR gRNA sequence
cttagagcataaggagatga

SEQ ID NO: 156896 - DNA, 20 bp, Artificial
  CRISPR gRNA sequence
agagcataaggagatgagtt

SEQ ID NO: 156897 - DNA, 20 bp, Artificial
  CRISPR gRNA sequence
gagcataaggagatgagtta

SEQ ID NO: 156898 - DNA, 20 bp, Artificial
  CRISPR gRNA sequence
aggacaggaaggagtggtaa

SEQ ID NO: 156899 - DNA, 20 bp, Artificial
  CRISPR gRNA sequence
ggtcagatgttgaagggcct

SEQ ID NO: 156900 - DNA, 20 bp, Artificial
  CRISPR gRNA sequence
aagggccttgtttgctaggc

SEQ ID NO: 156901 - DNA, 20 bp, Artificial
  CRISPR gRNA sequence
gtttgctaggctaagaaatt

SEQ ID NO: 156902 - DNA, 20 bp, Artificial
  CRISPR gRNA sequence
tttgctaggctaagaaattt

SEQ ID NO: 156903 - DNA, 20 bp, Artificial
  CRISPR gRNA sequence
gctaggctaagaaatttgaa

SEQ ID NO: 156904 - DNA, 20 bp, Artificial
  CRISPR gRNA sequence
ctaggctaagaaatttgaac

SEQ ID NO: 156905 - DNA, 20 bp, Artificial
  CRISPR gRNA sequence
ggctaagaaatttgaacagt

SEQ ID NO: 156906 - DNA, 20 bp, Artificial
  CRISPR gRNA sequence
agaaatttgaacagtctctg

SEQ ID NO: 156907 - DNA, 20 bp, Artificial
  CRISPR gRNA sequence
gaacagtctctgcttgacgt

SEQ ID NO: 156908 - DNA, 20 bp, Artificial
  CRISPR gRNA sequence
aacagtctctgcttgacgtt

SEQ ID NO: 156909 - DNA, 20 bp, Artificial
  CRISPR gRNA sequence
tgcttgacgttggtgaccat

SEQ ID NO: 156910 - DNA, 20 bp, Artificial
  CRISPR gRNA sequence
cttgacgttggtgaccattg

SEQ ID NO: 156911 - DNA, 20 bp, Artificial
  CRISPR gRNA sequence
gacgttggtgaccattgaaa

SEQ ID NO: 156912 - DNA, 20 bp, Artificial
  CRISPR gRNA sequence
acgttggtgaccattgaaaa

SEQ ID NO: 156913 - DNA, 20 bp, Artificial
  CRISPR gRNA sequence
gtgaccattgaaaatctggg

SEQ ID NO: 156914 - DNA, 20 bp, Artificial
  CRISPR gRNA sequence
aaaatctggggtagtagagt

SEQ ID NO: 156915 - DNA, 20 bp, Artificial
  CRISPR gRNA sequence
gggtagtagagtgatgtggc

SEQ ID NO: 156916 - DNA, 20 bp, Artificial
  CRISPR gRNA sequence
tgagagctgcacttttatat

SEQ ID NO: 156917 - DNA, 20 bp, Artificial
  CRISPR gRNA sequence
cacttttatatgatttatta

SEQ ID NO: 156918 - DNA, 20 bp, Artificial
  CRISPR gRNA sequence
ttatatgatttattatacat

SEQ ID NO: 156919 - DNA, 20 bp, Artificial
  CRISPR gRNA sequence
tatatgatttattatacatc

SEQ ID NO: 156920 - DNA, 20 bp, Artificial
  CRISPR gRNA sequence
atatgatttattatacatct

SEQ ID NO: 156921 - DNA, 20 bp, Artificial
  CRISPR gRNA sequence
tatgatttattatacatctt

SEQ ID NO: 156922 - DNA, 20 bp, Artificial
  CRISPR gRNA sequence
attatacatcttaggttcac

SEQ ID NO: 156923 - DNA, 20 bp, Artificial
  CRISPR gRNA sequence
ttatacatcttaggttcaca

SEQ ID NO: 156924 - DNA, 20 bp, Artificial
  CRISPR gRNA sequence
tacatcttaggttcacaacc

SEQ ID NO: 156925 - DNA, 20 bp, Artificial
  CRISPR gRNA sequence
aggttcacaacccttatagg

SEQ ID NO: 156926 - DNA, 20 bp, Artificial
  CRISPR gRNA sequence
ggttcacaacccttatagga

SEQ ID NO: 156927 - DNA, 20 bp, Artificial
  CRISPR gRNA sequence
acaacccttataggattatt

SEQ ID NO: 156928 - DNA, 20 bp, Artificial
  CRISPR gRNA sequence
ataggattattaggaggttt

SEQ ID NO: 156929 - DNA, 20 bp, Artificial
  CRISPR gRNA sequence
taggattattaggaggttta

SEQ ID NO: 156930 - DNA, 20 bp, Artificial
  CRISPR gRNA sequence
ttaggaggtttaaaataggt

SEQ ID NO: 156931 - DNA, 20 bp, Artificial
  CRISPR gRNA sequence
ggaggtttaaaataggtagt

SEQ ID NO: 156932 - DNA, 20 bp, Artificial
  CRISPR gRNA sequence
aaaataggtagtaacataaa

SEQ ID NO: 156933 - DNA, 20 bp, Artificial
  CRISPR gRNA sequence
aaataggtagtaacataaag

SEQ ID NO: 156934 - DNA, 20 bp, Artificial
  CRISPR gRNA sequence
agaattgtacgtggcacaca

SEQ ID NO: 156935 - DNA, 20 bp, Artificial
  CRISPR gRNA sequence
gaattgtacgtggcacacag

SEQ ID NO: 156936 - DNA, 20 bp, Artificial
  CRISPR gRNA sequence
tacgtggcacacagtaactc

SEQ ID NO: 156937 - DNA, 20 bp, Artificial
  CRISPR gRNA sequence
ctaatgaacattggctatca

SEQ ID NO: 156938 - DNA, 20 bp, Artificial
  CRISPR gRNA sequence
atgaacattggctatcatca

SEQ ID NO: 156939 - DNA, 20 bp, Artificial
  CRISPR gRNA sequence
gctatcatcatcatcgtttt

SEQ ID NO: 156940 - DNA, 20 bp, Artificial
  CRISPR gRNA sequence
tcatcatcatcgtttttatt

SEQ ID NO: 156941 - DNA, 20 bp, Artificial
  CRISPR gRNA sequence
ttattacatggaggcaatga

SEQ ID NO: 156942 - DNA, 20 bp, Artificial
  CRISPR gRNA sequence
tattacatggaggcaatgag

SEQ ID NO: 156943 - DNA, 20 bp, Artificial
  CRISPR gRNA sequence
attacatggaggcaatgagg

SEQ ID NO: 156944 - DNA, 20 bp, Artificial
  CRISPR gRNA sequence
ttacatggaggcaatgaggg

SEQ ID NO: 156945 - DNA, 20 bp, Artificial
  CRISPR gRNA sequence
catggaggcaatgagggtct

SEQ ID NO: 156946 - DNA, 20 bp, Artificial
  CRISPR gRNA sequence
aacagagatagtggtagtat

SEQ ID NO: 156947 - DNA, 20 bp, Artificial
  CRISPR gRNA sequence
ttggacactgttactataga

SEQ ID NO: 156948 - DNA, 20 bp, Artificial
  CRISPR gRNA sequence
gacactgttactatagaatt

SEQ ID NO: 156949 - DNA, 20 bp, Artificial
  CRISPR gRNA sequence
ttactatagaatttagcagc

SEQ ID NO: 156950 - DNA, 20 bp, Artificial
  CRISPR gRNA sequence
ctatagaatttagcagctga

SEQ ID NO: 156951 - DNA, 20 bp, Artificial
  CRISPR gRNA sequence
tagaatttagcagctgatta

SEQ ID NO: 156952 - DNA, 20 bp, Artificial
  CRISPR gRNA sequence
agcagctgattagaattgag

SEQ ID NO: 156953 - DNA, 20 bp, Artificial
  CRISPR gRNA sequence
gcagctgattagaattgagg

SEQ ID NO: 156954 - DNA, 20 bp, Artificial
  CRISPR gRNA sequence
attagaattgaggaacagag

SEQ ID NO: 156955 - DNA, 20 bp, Artificial
  CRISPR gRNA sequence
gaattgaggaacagaggaga

SEQ ID NO: 156956 - DNA, 20 bp, Artificial
  CRISPR gRNA sequence
aggaacagaggagaaaaagt

SEQ ID NO: 156957 - DNA, 20 bp, Artificial
  CRISPR gRNA sequence
agatttctatccagtctggg

SEQ ID NO: 156958 - DNA, 20 bp, Artificial
  CRISPR gRNA sequence
ctatccagtctgggtgactg

SEQ ID NO: 156959 - DNA, 20 bp, Artificial
  CRISPR gRNA sequence
tatccagtctgggtgactgg

SEQ ID NO: 156960 - DNA, 20 bp, Artificial
  CRISPR gRNA sequence
tccagtctgggtgactggag

SEQ ID NO: 156961 - DNA, 20 bp, Artificial
  CRISPR gRNA sequence
ggtgactggaggatagaaac

SEQ ID NO: 156962 - DNA, 20 bp, Artificial
  CRISPR gRNA sequence
gaggatagaaacagaaattt

SEQ ID NO: 156963 - DNA, 20 bp, Artificial
  CRISPR gRNA sequence
aggaagagcaagtttggggg

SEQ ID NO: 156964 - DNA, 20 bp, Artificial
  CRISPR gRNA sequence
ggaagagcaagtttgggggg

SEQ ID NO: 156965 - DNA, 20 bp, Artificial
  CRISPR gRNA sequence
ggggggaaaagaagatagat

SEQ ID NO: 156966 - DNA, 20 bp, Artificial
  CRISPR gRNA sequence
gggggaaaagaagatagatt

SEQ ID NO: 156967 - DNA, 20 bp, Artificial
  CRISPR gRNA sequence
gatttggggcacgtggaatt

SEQ ID NO: 156968 - DNA, 20 bp, Artificial
  CRISPR gRNA sequence
atttggggcacgtggaattt

SEQ ID NO: 156969 - DNA, 20 bp, Artificial
  CRISPR gRNA sequence
ggggcacgtggaatttcagt

SEQ ID NO: 156970 - DNA, 20 bp, Artificial
  CRISPR gRNA sequence
gggcacgtggaatttcagtt

SEQ ID NO: 156971 - DNA, 20 bp, Artificial
  CRISPR gRNA sequence
cagttctgggtagctttctg

SEQ ID NO: 156972 - DNA, 20 bp, Artificial
  CRISPR gRNA sequence
agttctgggtagctttctgg

SEQ ID NO: 156973 - DNA, 20 bp, Artificial
  CRISPR gRNA sequence
tgggtagctttctggttgta

SEQ ID NO: 156974 - DNA, 20 bp, Artificial
  CRISPR gRNA sequence
ggtagctttctggttgtaga

SEQ ID NO: 156975 - DNA, 20 bp, Artificial
  CRISPR gRNA sequence
tctggttgtagatgtccagc

SEQ ID NO: 156976 - DNA, 20 bp, Artificial
  CRISPR gRNA sequence
ctggttgtagatgtccagcc

SEQ ID NO: 156977 - DNA, 20 bp, Artificial
  CRISPR gRNA sequence
tggttgtagatgtccagcca

SEQ ID NO: 156978 - DNA, 20 bp, Artificial
  CRISPR gRNA sequence
gttgtagatgtccagccagg

SEQ ID NO: 156979 - DNA, 20 bp, Artificial
  CRISPR gRNA sequence
tagatgtccagccaggcagc

SEQ ID NO: 156980 - DNA, 20 bp, Artificial
  CRISPR gRNA sequence
gtacatgaaggactgaagct

SEQ ID NO: 156981 - DNA, 20 bp, Artificial
  CRISPR gRNA sequence
tacatgaaggactgaagctt

SEQ ID NO: 156982 - DNA, 20 bp, Artificial
  CRISPR gRNA sequence
aagctttggagaaatatcaa

SEQ ID NO: 156983 - DNA, 20 bp, Artificial
  CRISPR gRNA sequence
tggagaaatatcaaaattgg

SEQ ID NO: 156984 - DNA, 20 bp, Artificial
  CRISPR gRNA sequence
ggagaaatatcaaaattggt

SEQ ID NO: 156985 - DNA, 20 bp, Artificial
  CRISPR gRNA sequence
gagaaatatcaaaattggta

SEQ ID NO: 156986 - DNA, 20 bp, Artificial
  CRISPR gRNA sequence
gtaatgtatatttggaattt

SEQ ID NO: 156987 - DNA, 20 bp, Artificial
  CRISPR gRNA sequence
ggaatttaggatcatagaga

SEQ ID NO: 156988 - DNA, 20 bp, Artificial
  CRISPR gRNA sequence
gaatttaggatcatagagat

SEQ ID NO: 156989 - DNA, 20 bp, Artificial
  CRISPR gRNA sequence
aggatcatagagattatagc

SEQ ID NO: 156990 - DNA, 20 bp, Artificial
  CRISPR gRNA sequence
ggatcatagagattatagct

SEQ ID NO: 156991 - DNA, 20 bp, Artificial
  CRISPR gRNA sequence
tagctgaacctaggggacaa

SEQ ID NO: 156992 - DNA, 20 bp, Artificial
  CRISPR gRNA sequence
aacctaggggacaaacagga

SEQ ID NO: 156993 - DNA, 20 bp, Artificial
  CRISPR gRNA sequence
ggggacaaacaggagagaat

SEQ ID NO: 156994 - DNA, 20 bp, Artificial
  CRISPR gRNA sequence
acagaagactagtgctacat

SEQ ID NO: 156995 - DNA, 20 bp, Artificial
  CRISPR gRNA sequence
gtgctacatgtcaaacatgg

SEQ ID NO: 156996 - DNA, 20 bp, Artificial
  CRISPR gRNA sequence
catgtcaaacatggaagccc

SEQ ID NO: 156997 - DNA, 20 bp, Artificial
  CRISPR gRNA sequence
actctaaagttgagaaatcc

SEQ ID NO: 156998 - DNA, 20 bp, Artificial
  CRISPR gRNA sequence
taaagttgagaaatccagaa

SEQ ID NO: 156999 - DNA, 20 bp, Artificial
  CRISPR gRNA sequence
aagttgagaaatccagaaat

SEQ ID NO: 157000 - DNA, 20 bp, Artificial
  CRISPR gRNA sequence
agaaatccagaaatgagcat

SEQ ID NO: 157001 - DNA, 20 bp, Artificial
  CRISPR gRNA sequence
taggtcagtgctctctaagc

SEQ ID NO: 157002 - DNA, 20 bp, Artificial
  CRISPR gRNA sequence
ggtcagtgctctctaagctt

SEQ ID NO: 157003 - DNA, 20 bp, Artificial
  CRISPR gRNA sequence
tctaagctttttttggttgc

SEQ ID NO: 157004 - DNA, 20 bp, Artificial
  CRISPR gRNA sequence
taagctttttttggttgcac

SEQ ID NO: 157005 - DNA, 20 bp, Artificial
  CRISPR gRNA sequence
agctttttttggttgcacac

SEQ ID NO: 157006 - DNA, 20 bp, Artificial
  CRISPR gRNA sequence
tttttggttgcacacccctg

SEQ ID NO: 157007 - DNA, 20 bp, Artificial
  CRISPR gRNA sequence
ttttggttgcacacccctgt

SEQ ID NO: 157008 - DNA, 20 bp, Artificial
  CRISPR gRNA sequence
tttggttgcacacccctgtt

SEQ ID NO: 157009 - DNA, 20 bp, Artificial
  CRISPR gRNA sequence
ttggttgcacacccctgttt

SEQ ID NO: 157010 - DNA, 20 bp, Artificial
  CRISPR gRNA sequence
tggttgcacacccctgtttt

SEQ ID NO: 157011 - DNA, 20 bp, Artificial
  CRISPR gRNA sequence
ggttgcacacccctgttttc

SEQ ID NO: 157012 - DNA, 20 bp, Artificial
  CRISPR gRNA sequence
gttgcacacccctgttttct

SEQ ID NO: 157013 - DNA, 20 bp, Artificial
  CRISPR gRNA sequence
cacacccctgttttctgagt

SEQ ID NO: 157014 - DNA, 20 bp, Artificial
  CRISPR gRNA sequence
ttttctgagtgtgcatttcc

SEQ ID NO: 157015 - DNA, 20 bp, Artificial
  CRISPR gRNA sequence
tctgagtgtgcatttcccat

SEQ ID NO: 157016 - DNA, 20 bp, Artificial
  CRISPR gRNA sequence
ctgagtgtgcatttcccatg

SEQ ID NO: 157017 - DNA, 20 bp, Artificial
  CRISPR gRNA sequence
tgagtgtgcatttcccatgt

SEQ ID NO: 157018 - DNA, 20 bp, Artificial
  CRISPR gRNA sequence
agtgtgcatttcccatgtaa

SEQ ID NO: 157019 - DNA, 20 bp, Artificial
  CRISPR gRNA sequence
cccatgtaagaattaatatt

SEQ ID NO: 157020 - DNA, 20 bp, Artificial
  CRISPR gRNA sequence
ccatgtaagaattaatattc

SEQ ID NO: 157021 - DNA, 20 bp, Artificial
  CRISPR gRNA sequence
atattctttattccaaaaag

SEQ ID NO: 157022 - DNA, 20 bp, Artificial
  CRISPR gRNA sequence
tttattccaaaaagttactt

SEQ ID NO: 157023 - DNA, 20 bp, Artificial
  CRISPR gRNA sequence
tattccaaaaagttacttgc

SEQ ID NO: 157024 - DNA, 20 bp, Artificial
  CRISPR gRNA sequence
attccaaaaagttacttgct

SEQ ID NO: 157025 - DNA, 20 bp, Artificial
  CRISPR gRNA sequence
ttccaaaaagttacttgctt

SEQ ID NO: 157026 - DNA, 20 bp, Artificial
  CRISPR gRNA sequence
caaaaagttacttgcttggt

SEQ ID NO: 157027 - DNA, 20 bp, Artificial
  CRISPR gRNA sequence
cttgcttggttttttagtat

SEQ ID NO: 157028 - DNA, 20 bp, Artificial
  CRISPR gRNA sequence
gcttggttttttagtattag

SEQ ID NO: 157029 - DNA, 20 bp, Artificial
  CRISPR gRNA sequence
cttggttttttagtattagt

SEQ ID NO: 157030 - DNA, 20 bp, Artificial
  CRISPR gRNA sequence
ggttttttagtattagttta

SEQ ID NO: 157031 - DNA, 20 bp, Artificial
  CRISPR gRNA sequence
gttttttagtattagtttac

SEQ ID NO: 157032 - DNA, 20 bp, Artificial
  CRISPR gRNA sequence
tttagtattagtttactaaa

SEQ ID NO: 157033 - DNA, 20 bp, Artificial
  CRISPR gRNA sequence
ttagtattagtttactaaaa

SEQ ID NO: 157034 - DNA, 20 bp, Artificial
  CRISPR gRNA sequence
tagtattagtttactaaaaa

SEQ ID NO: 157035 - DNA, 20 bp, Artificial
  CRISPR gRNA sequence
agtattagtttactaaaaat

SEQ ID NO: 157036 - DNA, 20 bp, Artificial
  CRISPR gRNA sequence
gtattagtttactaaaaata

SEQ ID NO: 157037 - DNA, 20 bp, Artificial
  CRISPR gRNA sequence
gtttactaaaaatagagaat

SEQ ID NO: 157038 - DNA, 20 bp, Artificial
  CRISPR gRNA sequence
actaaaaatagagaatatct

SEQ ID NO: 157039 - DNA, 20 bp, Artificial
  CRISPR gRNA sequence
ctaaaaatagagaatatctg

SEQ ID NO: 157040 - DNA, 20 bp, Artificial
  CRISPR gRNA sequence
aaaatagagaatatctgtaa

SEQ ID NO: 157041 - DNA, 20 bp, Artificial
  CRISPR gRNA sequence
taactccccttaatccaggc

SEQ ID NO: 157042 - DNA, 20 bp, Artificial
  CRISPR gRNA sequence
cccttaatccaggcgtgtac

SEQ ID NO: 157043 - DNA, 20 bp, Artificial
  CRISPR gRNA sequence
aatccaggcgtgtacaacaa

SEQ ID NO: 157044 - DNA, 20 bp, Artificial
  CRISPR gRNA sequence
atccaggcgtgtacaacaag

SEQ ID NO: 157045 - DNA, 20 bp, Artificial
  CRISPR gRNA sequence
cattgttagcctacatcttc

SEQ ID NO: 157046 - DNA, 20 bp, Artificial
  CRISPR gRNA sequence
attgttagcctacatcttcc

SEQ ID NO: 157047 - DNA, 20 bp, Artificial
  CRISPR gRNA sequence
ttagcctacatcttcctcgc

SEQ ID NO: 157048 - DNA, 20 bp, Artificial
  CRISPR gRNA sequence
gcctacatcttcctcgcagt

SEQ ID NO: 157049 - DNA, 20 bp, Artificial
  CRISPR gRNA sequence
catcttcctcgcagtccttg

SEQ ID NO: 157050 - DNA, 20 bp, Artificial
  CRISPR gRNA sequence
cctcgcagtccttggagcac

SEQ ID NO: 157051 - DNA, 20 bp, Artificial
  CRISPR gRNA sequence
ctcgcagtccttggagcacc

SEQ ID NO: 157052 - DNA, 20 bp, Artificial
  CRISPR gRNA sequence
gcagtccttggagcaccgta

SEQ ID NO: 157053 - DNA, 20 bp, Artificial
  CRISPR gRNA sequence
ggagcaccgtatgtaataca

SEQ ID NO: 157054 - DNA, 20 bp, Artificial
  CRISPR gRNA sequence
gagcaccgtatgtaatacat

SEQ ID NO: 157055 - DNA, 20 bp, Artificial
  CRISPR gRNA sequence
ctgacaagttcaactaaatg

SEQ ID NO: 157056 - DNA, 20 bp, Artificial
  CRISPR gRNA sequence
tgacaagttcaactaaatga

SEQ ID NO: 157057 - DNA, 20 bp, Artificial
  CRISPR gRNA sequence
acaagttcaactaaatgagg

SEQ ID NO: 157058 - DNA, 20 bp, Artificial
  CRISPR gRNA sequence
aactaaatgagggcatcatt

SEQ ID NO: 157059 - DNA, 20 bp, Artificial
  CRISPR gRNA sequence
aatgagggcatcattatcag

SEQ ID NO: 157060 - DNA, 20 bp, Artificial
  CRISPR gRNA sequence
tcagctcataggttaaatat

SEQ ID NO: 157061 - DNA, 20 bp, Artificial
  CRISPR gRNA sequence
ataggttaaatatttgaaaa

SEQ ID NO: 157062 - DNA, 20 bp, Artificial
  CRISPR gRNA sequence
aatatttgaaaagctaatat

SEQ ID NO: 157063 - DNA, 20 bp, Artificial
  CRISPR gRNA sequence
gaaaagctaatattaacact

SEQ ID NO: 157064 - DNA, 20 bp, Artificial
  CRISPR gRNA sequence
aaaagctaatattaacactt

SEQ ID NO: 157065 - DNA, 20 bp, Artificial
  CRISPR gRNA sequence
atattaacactttctgtgtg

SEQ ID NO: 157066 - DNA, 20 bp, Artificial
  CRISPR gRNA sequence
acactttctgtgtgtgcctt

SEQ ID NO: 157067 - DNA, 20 bp, Artificial
  CRISPR gRNA sequence
tctgtgtgtgccttgataag

SEQ ID NO: 157068 - DNA, 20 bp, Artificial
  CRISPR gRNA sequence
ctgtgtgtgccttgataagt

SEQ ID NO: 157069 - DNA, 20 bp, Artificial
  CRISPR gRNA sequence
tgtgtgtgccttgataagta

SEQ ID NO: 157070 - DNA, 20 bp, Artificial
  CRISPR gRNA sequence
tgtgtgccttgataagtaaa

SEQ ID NO: 157071 - DNA, 20 bp, Artificial
  CRISPR gRNA sequence
gataagtaaaagactagaaa

SEQ ID NO: 157072 - DNA, 20 bp, Artificial
  CRISPR gRNA sequence
ataagtaaaagactagaaat

SEQ ID NO: 157073 - DNA, 20 bp, Artificial
  CRISPR gRNA sequence
gaaatacttccttagaatct

SEQ ID NO: 157074 - DNA, 20 bp, Artificial
  CRISPR gRNA sequence
ccttagaatctggtgacctt

SEQ ID NO: 157075 - DNA, 20 bp, Artificial
  CRISPR gRNA sequence
cttagaatctggtgaccttc

SEQ ID NO: 157076 - DNA, 20 bp, Artificial
  CRISPR gRNA sequence
agaatctggtgaccttcact

SEQ ID NO: 157077 - DNA, 20 bp, Artificial
  CRISPR gRNA sequence
gaatctggtgaccttcactt

SEQ ID NO: 157078 - DNA, 20 bp, Artificial
  CRISPR gRNA sequence
gtgaccttcacttgctttaa

SEQ ID NO: 157079 - DNA, 20 bp, Artificial
  CRISPR gRNA sequence
cacttgctttaaagatgtac

SEQ ID NO: 157080 - DNA, 20 bp, Artificial
  CRISPR gRNA sequence
acttgctttaaagatgtaca

SEQ ID NO: 157081 - DNA, 20 bp, Artificial
  CRISPR gRNA sequence
gctttaaagatgtacaaata

SEQ ID NO: 157082 - DNA, 20 bp, Artificial
  CRISPR gRNA sequence
ctttaaagatgtacaaatat

SEQ ID NO: 157083 - DNA, 20 bp, Artificial
  CRISPR gRNA sequence
taaagatgtacaaatatttc

SEQ ID NO: 157084 - DNA, 20 bp, Artificial
  CRISPR gRNA sequence
aaagatgtacaaatatttcc

SEQ ID NO: 157085 - DNA, 20 bp, Artificial
  CRISPR gRNA sequence
aagatgtacaaatatttcct

SEQ ID NO: 157086 - DNA, 20 bp, Artificial
  CRISPR gRNA sequence
ccttgagattagtacatata

SEQ ID NO: 157087 - DNA, 20 bp, Artificial
  CRISPR gRNA sequence
cttgagattagtacatatac

SEQ ID NO: 157088 - DNA, 20 bp, Artificial
  CRISPR gRNA sequence
gagattagtacatataccat

SEQ ID NO: 157089 - DNA, 20 bp, Artificial
  CRISPR gRNA sequence
agattagtacatataccata

SEQ ID NO: 157090 - DNA, 20 bp, Artificial
  CRISPR gRNA sequence
gtacatataccatatctcca

SEQ ID NO: 157091 - DNA, 20 bp, Artificial
  CRISPR gRNA sequence
catttggtacaaagactagg

SEQ ID NO: 157092 - DNA, 20 bp, Artificial
  CRISPR gRNA sequence
ggtacaaagactaggtttta

SEQ ID NO: 157093 - DNA, 20 bp, Artificial
  CRISPR gRNA sequence
gtacaaagactaggttttat

SEQ ID NO: 157094 - DNA, 20 bp, Artificial
  CRISPR gRNA sequence
ggttttattttttgagttgc

SEQ ID NO: 157095 - DNA, 20 bp, Artificial
  CRISPR gRNA sequence
tattttttgagttgctttgg

SEQ ID NO: 157096 - DNA, 20 bp, Artificial
  CRISPR gRNA sequence
attttttgagttgctttggg

SEQ ID NO: 157097 - DNA, 20 bp, Artificial
  CRISPR gRNA sequence
ttttttgagttgctttgggc

SEQ ID NO: 157098 - DNA, 20 bp, Artificial
  CRISPR gRNA sequence
tttgagttgctttgggcata

SEQ ID NO: 157099 - DNA, 20 bp, Artificial
  CRISPR gRNA sequence
ttgagttgctttgggcataa

SEQ ID NO: 157100 - DNA, 20 bp, Artificial
  CRISPR gRNA sequence
tgagttgctttgggcataat

SEQ ID NO: 157101 - DNA, 20 bp, Artificial
  CRISPR gRNA sequence
gagttgctttgggcataatc

SEQ ID NO: 157102 - DNA, 20 bp, Artificial
  CRISPR gRNA sequence
agttgctttgggcataatct

SEQ ID NO: 157103 - DNA, 20 bp, Artificial
  CRISPR gRNA sequence
ctttgggcataatcttactg

SEQ ID NO: 157104 - DNA, 20 bp, Artificial
  CRISPR gRNA sequence
tgggcataatcttactgatt

SEQ ID NO: 157105 - DNA, 20 bp, Artificial
  CRISPR gRNA sequence
gggcataatcttactgattt

SEQ ID NO: 157106 - DNA, 20 bp, Artificial
  CRISPR gRNA sequence
ggcataatcttactgatttt

SEQ ID NO: 157107 - DNA, 20 bp, Artificial
  CRISPR gRNA sequence
actgattttagctttgtaaa

SEQ ID NO: 157108 - DNA, 20 bp, Artificial
  CRISPR gRNA sequence
ctgattttagctttgtaaaa

SEQ ID NO: 157109 - DNA, 20 bp, Artificial
  CRISPR gRNA sequence
attttagctttgtaaaatct

SEQ ID NO: 157110 - DNA, 20 bp, Artificial
  CRISPR gRNA sequence
tagctttgtaaaatctcaaa

SEQ ID NO: 157111 - DNA, 20 bp, Artificial
  CRISPR gRNA sequence
agctttgtaaaatctcaaat

SEQ ID NO: 157112 - DNA, 20 bp, Artificial
  CRISPR gRNA sequence
gctttgtaaaatctcaaatg

SEQ ID NO: 157113 - DNA, 20 bp, Artificial
  CRISPR gRNA sequence
tgtaaaatctcaaatggcag

SEQ ID NO: 157114 - DNA, 20 bp, Artificial
  CRISPR gRNA sequence
gtaaaatctcaaatggcagc

SEQ ID NO: 157115 - DNA, 20 bp, Artificial
  CRISPR gRNA sequence
taaaatctcaaatggcagca

SEQ ID NO: 157116 - DNA, 20 bp, Artificial
  CRISPR gRNA sequence
aaatggcagcatcctgcatg

SEQ ID NO: 157117 - DNA, 20 bp, Artificial
  CRISPR gRNA sequence
catgaagctgaccaaaaata

SEQ ID NO: 157118 - DNA, 20 bp, Artificial
  CRISPR gRNA sequence
accaaaaatacatatgtagg

SEQ ID NO: 157119 - DNA, 20 bp, Artificial
  CRISPR gRNA sequence
ggcagcatttgctgagcaag

SEQ ID NO: 157120 - DNA, 20 bp, Artificial
  CRISPR gRNA sequence
gcagcatttgctgagcaagt

SEQ ID NO: 157121 - DNA, 20 bp, Artificial
  CRISPR gRNA sequence
gctgagcaagtaatttatag

SEQ ID NO: 157122 - DNA, 20 bp, Artificial
  CRISPR gRNA sequence
ctgagcaagtaatttatagc

SEQ ID NO: 157123 - DNA, 20 bp, Artificial
  CRISPR gRNA sequence
agcaagtaatttatagccca

SEQ ID NO: 157124 - DNA, 20 bp, Artificial
  CRISPR gRNA sequence
atagcccacatgatcattgt

SEQ ID NO: 157125 - DNA, 20 bp, Artificial
  CRISPR gRNA sequence
tagcccacatgatcattgta

SEQ ID NO: 157126 - DNA, 20 bp, Artificial
  CRISPR gRNA sequence
tagcaccaatgagcagcaca

SEQ ID NO: 157127 - DNA, 20 bp, Artificial
  CRISPR gRNA sequence
attaccaggaatgagactag

SEQ ID NO: 157128 - DNA, 20 bp, Artificial
  CRISPR gRNA sequence
ccaggaatgagactagcctc

SEQ ID NO: 157129 - DNA, 20 bp, Artificial
  CRISPR gRNA sequence
gcctcatctgtaggatttag

SEQ ID NO: 157130 - DNA, 20 bp, Artificial
  CRISPR gRNA sequence
atctgtaggatttagcagaa

SEQ ID NO: 157131 - DNA, 20 bp, Artificial
  CRISPR gRNA sequence
taggatttagcagaattttt

SEQ ID NO: 157132 - DNA, 20 bp, Artificial
  CRISPR gRNA sequence
agcagaatttttaatataag

SEQ ID NO: 157133 - DNA, 20 bp, Artificial
  CRISPR gRNA sequence
gcagaatttttaatataaga

SEQ ID NO: 157134 - DNA, 20 bp, Artificial
  CRISPR gRNA sequence
ttaatataagacacctatat

SEQ ID NO: 157135 - DNA, 20 bp, Artificial
  CRISPR gRNA sequence
taatataagacacctatatt

SEQ ID NO: 157136 - DNA, 20 bp, Artificial
  CRISPR gRNA sequence
aatataagacacctatattt

SEQ ID NO: 157137 - DNA, 20 bp, Artificial
  CRISPR gRNA sequence
atataagacacctatattta

SEQ ID NO: 157138 - DNA, 20 bp, Artificial
  CRISPR gRNA sequence
tatttagtttctaggctata

SEQ ID NO: 157139 - DNA, 20 bp, Artificial
  CRISPR gRNA sequence
agtttctaggctatatatgt

SEQ ID NO: 157140 - DNA, 20 bp, Artificial
  CRISPR gRNA sequence
gtttctaggctatatatgtt

SEQ ID NO: 157141 - DNA, 20 bp, Artificial
  CRISPR gRNA sequence
ctaggctatatatgttgtaa

SEQ ID NO: 157142 - DNA, 20 bp, Artificial
  CRISPR gRNA sequence
taggctatatatgttgtaat

SEQ ID NO: 157143 - DNA, 20 bp, Artificial
  CRISPR gRNA sequence
ggctatatatgttgtaatta

SEQ ID NO: 157144 - DNA, 20 bp, Artificial
  CRISPR gRNA sequence
tatatgttgtaattatcctc

SEQ ID NO: 157145 - DNA, 20 bp, Artificial
  CRISPR gRNA sequence
taattatcctcaatctaaaa

SEQ ID NO: 157146 - DNA, 20 bp, Artificial
  CRISPR gRNA sequence
tcctcaatctaaaataaagg

SEQ ID NO: 157147 - DNA, 20 bp, Artificial
  CRISPR gRNA sequence
aatctaaaataaaggcaata

SEQ ID NO: 157148 - DNA, 20 bp, Artificial
  CRISPR gRNA sequence
aaataaaggcaataagaaac

SEQ ID NO: 157149 - DNA, 20 bp, Artificial
  CRISPR gRNA sequence
ttcactagagaaatagtggt

SEQ ID NO: 157150 - DNA, 20 bp, Artificial
  CRISPR gRNA sequence
tcactagagaaatagtggta

SEQ ID NO: 157151 - DNA, 20 bp, Artificial
  CRISPR gRNA sequence
cactagagaaatagtggtaa

SEQ ID NO: 157152 - DNA, 20 bp, Artificial
  CRISPR gRNA sequence
actagagaaatagtggtaaa

SEQ ID NO: 157153 - DNA, 20 bp, Artificial
  CRISPR gRNA sequence
gagaaatagtggtaaatttc

SEQ ID NO: 157154 - DNA, 20 bp, Artificial
  CRISPR gRNA sequence
ccagccattttacctcatta

SEQ ID NO: 157155 - DNA, 20 bp, Artificial
  CRISPR gRNA sequence
cagccattttacctcattat

SEQ ID NO: 157156 - DNA, 20 bp, Artificial
  CRISPR gRNA sequence
tacctcattatttataatct

SEQ ID NO: 157157 - DNA, 20 bp, Artificial
  CRISPR gRNA sequence
acctcattatttataatcta

SEQ ID NO: 157158 - DNA, 20 bp, Artificial
  CRISPR gRNA sequence
cctcattatttataatctaa

SEQ ID NO: 157159 - DNA, 20 bp, Artificial
  CRISPR gRNA sequence
attatttataatctaaactc

SEQ ID NO: 157160 - DNA, 20 bp, Artificial
  CRISPR gRNA sequence
tttataatctaaactccatg

SEQ ID NO: 157161 - DNA, 20 bp, Artificial
  CRISPR gRNA sequence
ataatctaaactccatgatt

SEQ ID NO: 157162 - DNA, 20 bp, Artificial
  CRISPR gRNA sequence
taatctaaactccatgatta

SEQ ID NO: 157163 - DNA, 20 bp, Artificial
  CRISPR gRNA sequence
aactccatgattattttcct

SEQ ID NO: 157164 - DNA, 20 bp, Artificial
  CRISPR gRNA sequence
catgattattttcctcttgg

SEQ ID NO: 157165 - DNA, 20 bp, Artificial
  CRISPR gRNA sequence
ttttcctcttggaaattcat

SEQ ID NO: 157166 - DNA, 20 bp, Artificial
  CRISPR gRNA sequence
tcctcttggaaattcattgg

SEQ ID NO: 157167 - DNA, 20 bp, Artificial
  CRISPR gRNA sequence
cctcttggaaattcattggc

SEQ ID NO: 157168 - DNA, 20 bp, Artificial
  CRISPR gRNA sequence
ctcttggaaattcattggcc

SEQ ID NO: 157169 - DNA, 20 bp, Artificial
  CRISPR gRNA sequence
ttggaaattcattggccaga

SEQ ID NO: 157170 - DNA, 20 bp, Artificial
  CRISPR gRNA sequence
ggaaattcattggccagatg

SEQ ID NO: 157171 - DNA, 20 bp, Artificial
  CRISPR gRNA sequence
gaaattcattggccagatgc

SEQ ID NO: 157172 - DNA, 20 bp, Artificial
  CRISPR gRNA sequence
attggccagatgcccatgaa

SEQ ID NO: 157173 - DNA, 20 bp, Artificial
  CRISPR gRNA sequence
gccagatgcccatgaagctc

SEQ ID NO: 157174 - DNA, 20 bp, Artificial
  CRISPR gRNA sequence
cccttgaaggtggttaagca

SEQ ID NO: 157175 - DNA, 20 bp, Artificial
  CRISPR gRNA sequence
gaaggtggttaagcaatgta

SEQ ID NO: 157176 - DNA, 20 bp, Artificial
  CRISPR gRNA sequence
aaggtggttaagcaatgtaa

SEQ ID NO: 157177 - DNA, 20 bp, Artificial
  CRISPR gRNA sequence
agcaatgtaatagaatgcag

SEQ ID NO: 157178 - DNA, 20 bp, Artificial
  CRISPR gRNA sequence
atatgaatagtactttatag

SEQ ID NO: 157179 - DNA, 20 bp, Artificial
  CRISPR gRNA sequence
tatgaatagtactttatagt

SEQ ID NO: 157180 - DNA, 20 bp, Artificial
  CRISPR gRNA sequence
tatagttagtgaagtgattt

SEQ ID NO: 157181 - DNA, 20 bp, Artificial
  CRISPR gRNA sequence
atagttagtgaagtgatttc

SEQ ID NO: 157182 - DNA, 20 bp, Artificial
  CRISPR gRNA sequence
tagttagtgaagtgatttca

SEQ ID NO: 157183 - DNA, 20 bp, Artificial
  CRISPR gRNA sequence
gtgaagtgatttcatactca

SEQ ID NO: 157184 - DNA, 20 bp, Artificial
  CRISPR gRNA sequence
catactcattctcttatttg

SEQ ID NO: 157185 - DNA, 20 bp, Artificial
  CRISPR gRNA sequence
atactcattctcttatttgg

SEQ ID NO: 157186 - DNA, 20 bp, Artificial
  CRISPR gRNA sequence
attctcttatttggtatcta

SEQ ID NO: 157187 - DNA, 20 bp, Artificial
  CRISPR gRNA sequence
tcttatttggtatctaccta

SEQ ID NO: 157188 - DNA, 20 bp, Artificial
  CRISPR gRNA sequence
ttatttggtatctacctaat

SEQ ID NO: 157189 - DNA, 20 bp, Artificial
  CRISPR gRNA sequence
atttggtatctacctaatgt

SEQ ID NO: 157190 - DNA, 20 bp, Artificial
  CRISPR gRNA sequence
tttggtatctacctaatgta

SEQ ID NO: 157191 - DNA, 20 bp, Artificial
  CRISPR gRNA sequence
ggtatctacctaatgtaagt

SEQ ID NO: 157192 - DNA, 20 bp, Artificial
  CRISPR gRNA sequence
gtatctacctaatgtaagta

SEQ ID NO: 157193 - DNA, 20 bp, Artificial
  CRISPR gRNA sequence
cctaatgtaagtaggacaga

SEQ ID NO: 157194 - DNA, 20 bp, Artificial
  CRISPR gRNA sequence
atgtaagtaggacagacgat

SEQ ID NO: 157195 - DNA, 20 bp, Artificial
  CRISPR gRNA sequence
tcatcccccattttgagggt

SEQ ID NO: 157196 - DNA, 20 bp, Artificial
  CRISPR gRNA sequence
tgagggtgagaaaatagaag

SEQ ID NO: 157197 - DNA, 20 bp, Artificial
  CRISPR gRNA sequence
gagggtgagaaaatagaagg

SEQ ID NO: 157198 - DNA, 20 bp, Artificial
  CRISPR gRNA sequence
agggtgagaaaatagaaggc

SEQ ID NO: 157199 - DNA, 20 bp, Artificial
  CRISPR gRNA sequence
gtgacaaaggcttttgctct

SEQ ID NO: 157200 - DNA, 20 bp, Artificial
  CRISPR gRNA sequence
ttgctctttatactgcactt

SEQ ID NO: 157201 - DNA, 20 bp, Artificial
  CRISPR gRNA sequence
tgctctttatactgcacttt

SEQ ID NO: 157202 - DNA, 20 bp, Artificial
  CRISPR gRNA sequence
gctctttatactgcactttc

SEQ ID NO: 157203 - DNA, 20 bp, Artificial
  CRISPR gRNA sequence
ctctttatactgcactttct

SEQ ID NO: 157204 - DNA, 20 bp, Artificial
  CRISPR gRNA sequence
tttatactgcactttcttac

SEQ ID NO: 157205 - DNA, 20 bp, Artificial
  CRISPR gRNA sequence
tatactgcactttcttacca

SEQ ID NO: 157206 - DNA, 20 bp, Artificial
  CRISPR gRNA sequence
atactgcactttcttaccat

SEQ ID NO: 157207 - DNA, 20 bp, Artificial
  CRISPR gRNA sequence
tactgcactttcttaccata

SEQ ID NO: 157208 - DNA, 20 bp, Artificial
  CRISPR gRNA sequence
cactttcttaccatatatga

SEQ ID NO: 157209 - DNA, 20 bp, Artificial
  CRISPR gRNA sequence
tcttaccatatatgaaaaac

SEQ ID NO: 157210 - DNA, 20 bp, Artificial
  CRISPR gRNA sequence
cttaccatatatgaaaaaca

SEQ ID NO: 157211 - DNA, 20 bp, Artificial
  CRISPR gRNA sequence
ttaccatatatgaaaaacag

SEQ ID NO: 157212 - DNA, 20 bp, Artificial
  CRISPR gRNA sequence
accatatatgaaaaacagtc

SEQ ID NO: 157213 - DNA, 20 bp, Artificial
  CRISPR gRNA sequence
ccatatatgaaaaacagtct

SEQ ID NO: 157214 - DNA, 20 bp, Artificial
  CRISPR gRNA sequence
tagctgtgtccatcttcggg

SEQ ID NO: 157215 - DNA, 20 bp, Artificial
  CRISPR gRNA sequence
tgtccatcttcggggactaa

SEQ ID NO: 157216 - DNA, 20 bp, Artificial
  CRISPR gRNA sequence
cggggactaattcttcctcc

SEQ ID NO: 157217 - DNA, 20 bp, Artificial
  CRISPR gRNA sequence
ggggactaattcttcctcct

SEQ ID NO: 157218 - DNA, 20 bp, Artificial
  CRISPR gRNA sequence
attcttcctcctaccttctc

SEQ ID NO: 157219 - DNA, 20 bp, Artificial
  CRISPR gRNA sequence
ttcctcctaccttctctttt

SEQ ID NO: 157220 - DNA, 20 bp, Artificial
  CRISPR gRNA sequence
cctcctaccttctcttttcc

SEQ ID NO: 157221 - DNA, 20 bp, Artificial
  CRISPR gRNA sequence
ctcctaccttctcttttcca

SEQ ID NO: 157222 - DNA, 20 bp, Artificial
  CRISPR gRNA sequence
ctaccttctcttttccatac

SEQ ID NO: 157223 - DNA, 20 bp, Artificial
  CRISPR gRNA sequence
ccttctcttttccatacttg

SEQ ID NO: 157224 - DNA, 20 bp, Artificial
  CRISPR gRNA sequence
ctcttttccatacttgcttc

SEQ ID NO: 157225 - DNA, 20 bp, Artificial
  CRISPR gRNA sequence
tcttttccatacttgcttct

SEQ ID NO: 157226 - DNA, 20 bp, Artificial
  CRISPR gRNA sequence
ttttccatacttgcttctcc

SEQ ID NO: 157227 - DNA, 20 bp, Artificial
  CRISPR gRNA sequence
ttccatacttgcttctcccc

SEQ ID NO: 157228 - DNA, 20 bp, Artificial
  CRISPR gRNA sequence
tccatacttgcttctcccct

SEQ ID NO: 157229 - DNA, 20 bp, Artificial
  CRISPR gRNA sequence
ccatacttgcttctcccctg

SEQ ID NO: 157230 - DNA, 20 bp, Artificial
  CRISPR gRNA sequence
catacttgcttctcccctga

SEQ ID NO: 157231 - DNA, 20 bp, Artificial
  CRISPR gRNA sequence
gcttctcccctgaaaggcac

SEQ ID NO: 157232 - DNA, 20 bp, Artificial
  CRISPR gRNA sequence
cttctcccctgaaaggcaca

SEQ ID NO: 157233 - DNA, 20 bp, Artificial
  CRISPR gRNA sequence
ctcccctgaaaggcacagaa

SEQ ID NO: 157234 - DNA, 20 bp, Artificial
  CRISPR gRNA sequence
tcccctgaaaggcacagaac

SEQ ID NO: 157235 - DNA, 20 bp, Artificial
  CRISPR gRNA sequence
ccctgaaaggcacagaactt

SEQ ID NO: 157236 - DNA, 20 bp, Artificial
  CRISPR gRNA sequence
aaaggcacagaactttccca

SEQ ID NO: 157237 - DNA, 20 bp, Artificial
  CRISPR gRNA sequence
tcccagagttctcatcaact

SEQ ID NO: 157238 - DNA, 20 bp, Artificial
  CRISPR gRNA sequence
cccagagttctcatcaactc

SEQ ID NO: 157239 - DNA, 20 bp, Artificial
  CRISPR gRNA sequence
ccagagttctcatcaactct

SEQ ID NO: 157240 - DNA, 20 bp, Artificial
  CRISPR gRNA sequence
tcatcaactctcatattata

SEQ ID NO: 157241 - DNA, 20 bp, Artificial
  CRISPR gRNA sequence
atcaactctcatattataga

SEQ ID NO: 157242 - DNA, 20 bp, Artificial
  CRISPR gRNA sequence
tcatattatagactgcttaa

SEQ ID NO: 157243 - DNA, 20 bp, Artificial
  CRISPR gRNA sequence
atattatagactgcttaaca

SEQ ID NO: 157244 - DNA, 20 bp, Artificial
  CRISPR gRNA sequence
tagactgcttaacaggctaa

SEQ ID NO: 157245 - DNA, 20 bp, Artificial
  CRISPR gRNA sequence
cttaacaggctaatcgtaaa

SEQ ID NO: 157246 - DNA, 20 bp, Artificial
  CRISPR gRNA sequence
aacaggctaatcgtaaaggg

SEQ ID NO: 157247 - DNA, 20 bp, Artificial
  CRISPR gRNA sequence
acaggctaatcgtaaaggga

SEQ ID NO: 157248 - DNA, 20 bp, Artificial
  CRISPR gRNA sequence
atcgtaaagggaacaaacat

SEQ ID NO: 157249 - DNA, 20 bp, Artificial
  CRISPR gRNA sequence
aattacctttaaagtgtttg

SEQ ID NO: 157250 - DNA, 20 bp, Artificial
  CRISPR gRNA sequence
cctttaaagtgtttgttaaa

SEQ ID NO: 157251 - DNA, 20 bp, Artificial
  CRISPR gRNA sequence
taaagtgtttgttaaaatag

SEQ ID NO: 157252 - DNA, 20 bp, Artificial
  CRISPR gRNA sequence
aaagtgtttgttaaaatagg

SEQ ID NO: 157253 - DNA, 20 bp, Artificial
  CRISPR gRNA sequence
aagtgtttgttaaaataggt

SEQ ID NO: 157254 - DNA, 20 bp, Artificial
  CRISPR gRNA sequence
gttaaaataggtgaacacgg

SEQ ID NO: 157255 - DNA, 20 bp, Artificial
  CRISPR gRNA sequence
ttaaaataggtgaacacggt

SEQ ID NO: 157256 - DNA, 20 bp, Artificial
  CRISPR gRNA sequence
aaataggtgaacacggtcac

SEQ ID NO: 157257 - DNA, 20 bp, Artificial
  CRISPR gRNA sequence
tttggaacaaagcatggtac

SEQ ID NO: 157258 - DNA, 20 bp, Artificial
  CRISPR gRNA sequence
ttggaacaaagcatggtaca

SEQ ID NO: 157259 - DNA, 20 bp, Artificial
  CRISPR gRNA sequence
tggaacaaagcatggtacaa

SEQ ID NO: 157260 - DNA, 20 bp, Artificial
  CRISPR gRNA sequence
ggaacaaagcatggtacaag

SEQ ID NO: 157261 - DNA, 20 bp, Artificial
  CRISPR gRNA sequence
gaacaaagcatggtacaagt

SEQ ID NO: 157262 - DNA, 20 bp, Artificial
  CRISPR gRNA sequence
agcactaccagtattttgga

SEQ ID NO: 157263 - DNA, 20 bp, Artificial
  CRISPR gRNA sequence
ccagtattttggaaattgtc

SEQ ID NO: 157264 - DNA, 20 bp, Artificial
  CRISPR gRNA sequence
tggaaattgtctttaatgaa

SEQ ID NO: 157265 - DNA, 20 bp, Artificial
  CRISPR gRNA sequence
ggaaattgtctttaatgaat

SEQ ID NO: 157266 - DNA, 20 bp, Artificial
  CRISPR gRNA sequence
gaaattgtctttaatgaatc

SEQ ID NO: 157267 - DNA, 20 bp, Artificial
  CRISPR gRNA sequence
tctttaatgaatcctaaatt

SEQ ID NO: 157268 - DNA, 20 bp, Artificial
  CRISPR gRNA sequence
taatgaatcctaaattcact

SEQ ID NO: 157269 - DNA, 20 bp, Artificial
  CRISPR gRNA sequence
aatgaatcctaaattcacta

SEQ ID NO: 157270 - DNA, 20 bp, Artificial
  CRISPR gRNA sequence
atgaatcctaaattcactaa

SEQ ID NO: 157271 - DNA, 20 bp, Artificial
  CRISPR gRNA sequence
aattcactaaggtcaggtaa

SEQ ID NO: 157272 - DNA, 20 bp, Artificial
  CRISPR gRNA sequence
actaaggtcaggtaagtagt

SEQ ID NO: 157273 - DNA, 20 bp, Artificial
  CRISPR gRNA sequence
aggtcaggtaagtagttgaa

SEQ ID NO: 157274 - DNA, 20 bp, Artificial
  CRISPR gRNA sequence
aaggattttttccaaataga

SEQ ID NO: 157275 - DNA, 20 bp, Artificial
  CRISPR gRNA sequence
tttccaaatagatatgtggt

SEQ ID NO: 157276 - DNA, 20 bp, Artificial
  CRISPR gRNA sequence
ttccaaatagatatgtggtt

SEQ ID NO: 157277 - DNA, 20 bp, Artificial
  CRISPR gRNA sequence
tccaaatagatatgtggtta

SEQ ID NO: 157278 - DNA, 20 bp, Artificial
  CRISPR gRNA sequence
ccaaatagatatgtggttag

SEQ ID NO: 157279 - DNA, 20 bp, Artificial
  CRISPR gRNA sequence
caaatagatatgtggttaga

SEQ ID NO: 157280 - DNA, 20 bp, Artificial
  CRISPR gRNA sequence
gaattgtattaggtattcta

SEQ ID NO: 157281 - DNA, 20 bp, Artificial
  CRISPR gRNA sequence
tattaggtattctatggtat

SEQ ID NO: 157282 - DNA, 20 bp, Artificial
  CRISPR gRNA sequence
ggtattctatggtattcctt

SEQ ID NO: 157283 - DNA, 20 bp, Artificial
  CRISPR gRNA sequence
tatggtattccttagctatg

SEQ ID NO: 157284 - DNA, 20 bp, Artificial
  CRISPR gRNA sequence
tggtattccttagctatgca

SEQ ID NO: 157285 - DNA, 20 bp, Artificial
  CRISPR gRNA sequence
cttagctatgcagatacata

SEQ ID NO: 157286 - DNA, 20 bp, Artificial
  CRISPR gRNA sequence
agctatgcagatacatactt

SEQ ID NO: 157287 - DNA, 20 bp, Artificial
  CRISPR gRNA sequence
gctatgcagatacatacttt

SEQ ID NO: 157288 - DNA, 20 bp, Artificial
  CRISPR gRNA sequence
tgcagatacatactttgtgg

SEQ ID NO: 157289 - DNA, 20 bp, Artificial
  CRISPR gRNA sequence
tgtggtatgtattgaggcag

SEQ ID NO: 157290 - DNA, 20 bp, Artificial
  CRISPR gRNA sequence
gtggtatgtattgaggcagc

SEQ ID NO: 157291 - DNA, 20 bp, Artificial
  CRISPR gRNA sequence
tggtatgtattgaggcagct

SEQ ID NO: 157292 - DNA, 20 bp, Artificial
  CRISPR gRNA sequence
aggcagctcccacatttggg

SEQ ID NO: 157293 - DNA, 20 bp, Artificial
  CRISPR gRNA sequence
ccacatttgggttctcatct

SEQ ID NO: 157294 - DNA, 20 bp, Artificial
  CRISPR gRNA sequence
gggttctcatcttgaaacat

SEQ ID NO: 157295 - DNA, 20 bp, Artificial
  CRISPR gRNA sequence
ggttctcatcttgaaacata

SEQ ID NO: 157296 - DNA, 20 bp, Artificial
  CRISPR gRNA sequence
tcatcttgaaacatagagat

SEQ ID NO: 157297 - DNA, 20 bp, Artificial
  CRISPR gRNA sequence
atcttgaaacatagagatcg

SEQ ID NO: 157298 - DNA, 20 bp, Artificial
  CRISPR gRNA sequence
gaaacatagagatcgatatt

SEQ ID NO: 157299 - DNA, 20 bp, Artificial
  CRISPR gRNA sequence
aaacatagagatcgatattt

SEQ ID NO: 157300 - DNA, 20 bp, Artificial
  CRISPR gRNA sequence
ttagatgaatcatggtggtt

SEQ ID NO: 157301 - DNA, 20 bp, Artificial
  CRISPR gRNA sequence
tagatgaatcatggtggttt

SEQ ID NO: 157302 - DNA, 20 bp, Artificial
  CRISPR gRNA sequence
agatgaatcatggtggtttt

SEQ ID NO: 157303 - DNA, 20 bp, Artificial
  CRISPR gRNA sequence
gatgaatcatggtggttttt

SEQ ID NO: 157304 - DNA, 20 bp, Artificial
  CRISPR gRNA sequence
tttttgttttgttttgtttt

SEQ ID NO: 157305 - DNA, 20 bp, Artificial
  CRISPR gRNA sequence
ttttgttttgttttgttttg

SEQ ID NO: 157306 - DNA, 20 bp, Artificial
  CRISPR gRNA sequence
tttgttttgttttgttttgt

SEQ ID NO: 157307 - DNA, 20 bp, Artificial
  CRISPR gRNA sequence
ttgttttgttttgttttgtt

SEQ ID NO: 157308 - DNA, 20 bp, Artificial
  CRISPR gRNA sequence
tgttttgttttgttttgttt

SEQ ID NO: 157309 - DNA, 20 bp, Artificial
  CRISPR gRNA sequence
gttttgttttgttttgtttt

SEQ ID NO: 157310 - DNA, 20 bp, Artificial
  CRISPR gRNA sequence
ttttgttttgttttgttttg

SEQ ID NO: 157311 - DNA, 20 bp, Artificial
  CRISPR gRNA sequence
tgttttgttttgttttgttt

SEQ ID NO: 157312 - DNA, 20 bp, Artificial
  CRISPR gRNA sequence
gttttgttttgttttgtttt

SEQ ID NO: 157313 - DNA, 20 bp, Artificial
  CRISPR gRNA sequence
ttttgttttgttttgttttt

SEQ ID NO: 157314 - DNA, 20 bp, Artificial
  CRISPR gRNA sequence
tgttttgttttgtttttgag

SEQ ID NO: 157315 - DNA, 20 bp, Artificial
  CRISPR gRNA sequence
gttttgttttgtttttgaga

SEQ ID NO: 157316 - DNA, 20 bp, Artificial
  CRISPR gRNA sequence
ttttgttttgtttttgagac

SEQ ID NO: 157317 - DNA, 20 bp, Artificial
  CRISPR gRNA sequence
tgttttgtttttgagacgga

SEQ ID NO: 157318 - DNA, 20 bp, Artificial
  CRISPR gRNA sequence
gttttgtttttgagacggag

SEQ ID NO: 157319 - DNA, 20 bp, Artificial
  CRISPR gRNA sequence
ttttgtttttgagacggagt

SEQ ID NO: 157320 - DNA, 20 bp, Artificial
  CRISPR gRNA sequence
tgtttttgagacggagtctt

SEQ ID NO: 157321 - DNA, 20 bp, Artificial
  CRISPR gRNA sequence
gtttttgagacggagtcttg

SEQ ID NO: 157322 - DNA, 20 bp, Artificial
  CRISPR gRNA sequence
tttttgagacggagtcttgc

SEQ ID NO: 157323 - DNA, 20 bp, Artificial
  CRISPR gRNA sequence
ttgagacggagtcttgctct

SEQ ID NO: 157324 - DNA, 20 bp, Artificial
  CRISPR gRNA sequence
tgagacggagtcttgctctg

SEQ ID NO: 157325 - DNA, 20 bp, Artificial
  CRISPR gRNA sequence
gagacggagtcttgctctgt

SEQ ID NO: 157326 - DNA, 20 bp, Artificial
  CRISPR gRNA sequence
agacggagtcttgctctgtc

SEQ ID NO: 157327 - DNA, 20 bp, Artificial
  CRISPR gRNA sequence
gctctgtcgccaggctggag

SEQ ID NO: 157328 - DNA, 20 bp, Artificial
  CRISPR gRNA sequence
ctctgtcgccaggctggagt

SEQ ID NO: 157329 - DNA, 20 bp, Artificial
  CRISPR gRNA sequence
tgtcgccaggctggagtgca

SEQ ID NO: 157330 - DNA, 20 bp, Artificial
  CRISPR gRNA sequence
tcgccaggctggagtgcagt

SEQ ID NO: 157331 - DNA, 20 bp, Artificial
  CRISPR gRNA sequence
gagtgcagtggcacgatctt

SEQ ID NO: 157332 - DNA, 20 bp, Artificial
  CRISPR gRNA sequence
ggctcactgcaacctctgcc

SEQ ID NO: 157333 - DNA, 20 bp, Artificial
  CRISPR gRNA sequence
gctcactgcaacctctgcct

SEQ ID NO: 157334 - DNA, 20 bp, Artificial
  CRISPR gRNA sequence
actgcaacctctgcctccca

SEQ ID NO: 157335 - DNA, 20 bp, Artificial
  CRISPR gRNA sequence
caacctctgcctcccaggtt

SEQ ID NO: 157336 - DNA, 20 bp, Artificial
  CRISPR gRNA sequence
tgcctcccaggttcaagcga

SEQ ID NO: 157337 - DNA, 20 bp, Artificial
  CRISPR gRNA sequence
cctcccaggttcaagcgatt

SEQ ID NO: 157338 - DNA, 20 bp, Artificial
  CRISPR gRNA sequence
ccaggttcaagcgattctcc

SEQ ID NO: 157339 - DNA, 20 bp, Artificial
  CRISPR gRNA sequence
aagcgattctcctgcctcag

SEQ ID NO: 157340 - DNA, 20 bp, Artificial
  CRISPR gRNA sequence
tcctgcctcagcctcccgag

SEQ ID NO: 157341 - DNA, 20 bp, Artificial
  CRISPR gRNA sequence
ctgcctcagcctcccgagta

SEQ ID NO: 157342 - DNA, 20 bp, Artificial
  CRISPR gRNA sequence
cctcagcctcccgagtagct

SEQ ID NO: 157343 - DNA, 20 bp, Artificial
  CRISPR gRNA sequence
agcctcccgagtagctggga

SEQ ID NO: 157344 - DNA, 20 bp, Artificial
  CRISPR gRNA sequence
ccgagtagctgggactacag

SEQ ID NO: 157345 - DNA, 20 bp, Artificial
  CRISPR gRNA sequence
ggactacagatgtgcgccac

SEQ ID NO: 157346 - DNA, 20 bp, Artificial
  CRISPR gRNA sequence
cagatgtgcgccaccacgcc

SEQ ID NO: 157347 - DNA, 20 bp, Artificial
  CRISPR gRNA sequence
atttttgtatttttagtaga

SEQ ID NO: 157348 - DNA, 20 bp, Artificial
  CRISPR gRNA sequence
ttgtatttttagtagagacg

SEQ ID NO: 157349 - DNA, 20 bp, Artificial
  CRISPR gRNA sequence
tgtatttttagtagagacgg

SEQ ID NO: 157350 - DNA, 20 bp, Artificial
  CRISPR gRNA sequence
gtatttttagtagagacggg

SEQ ID NO: 157351 - DNA, 20 bp, Artificial
  CRISPR gRNA sequence
tatttttagtagagacgggg

SEQ ID NO: 157352 - DNA, 20 bp, Artificial
  CRISPR gRNA sequence
ttagtagagacggggtttca

SEQ ID NO: 157353 - DNA, 20 bp, Artificial
  CRISPR gRNA sequence
tagtagagacggggtttcac

SEQ ID NO: 157354 - DNA, 20 bp, Artificial
  CRISPR gRNA sequence
agtagagacggggtttcacc

SEQ ID NO: 157355 - DNA, 20 bp, Artificial
  CRISPR gRNA sequence
gtagagacggggtttcacca

SEQ ID NO: 157356 - DNA, 20 bp, Artificial
  CRISPR gRNA sequence
caccatgttggccagatggt

SEQ ID NO: 157357 - DNA, 20 bp, Artificial
  CRISPR gRNA sequence
accatgttggccagatggtc

SEQ ID NO: 157358 - DNA, 20 bp, Artificial
  CRISPR gRNA sequence
gccagatggtcttgatctta

SEQ ID NO: 157359 - DNA, 20 bp, Artificial
  CRISPR gRNA sequence
gatcttatgacctcgtgatc

SEQ ID NO: 157360 - DNA, 20 bp, Artificial
  CRISPR gRNA sequence
atcttatgacctcgtgatct

SEQ ID NO: 157361 - DNA, 20 bp, Artificial
  CRISPR gRNA sequence
atgacctcgtgatctgcccg

SEQ ID NO: 157362 - DNA, 20 bp, Artificial
  CRISPR gRNA sequence
tgacctcgtgatctgcccgc

SEQ ID NO: 157363 - DNA, 20 bp, Artificial
  CRISPR gRNA sequence
gtgatctgcccgcctcagcc

SEQ ID NO: 157364 - DNA, 20 bp, Artificial
  CRISPR gRNA sequence
cccgcctcagcctcccaaag

SEQ ID NO: 157365 - DNA, 20 bp, Artificial
  CRISPR gRNA sequence
agcctcccaaagtgctggga

SEQ ID NO: 157366 - DNA, 20 bp, Artificial
  CRISPR gRNA sequence
ccaaagtgctgggattacag

SEQ ID NO: 157367 - DNA, 20 bp, Artificial
  CRISPR gRNA sequence
ggattacaggcgtgagccac

SEQ ID NO: 157368 - DNA, 20 bp, Artificial
  CRISPR gRNA sequence
caggcgtgagccacggcgcc

SEQ ID NO: 157369 - DNA, 20 bp, Artificial
  CRISPR gRNA sequence
gcccatggtgttcttaaata

SEQ ID NO: 157370 - DNA, 20 bp, Artificial
  CRISPR gRNA sequence
ttaaataatccgttgcttta

SEQ ID NO: 157371 - DNA, 20 bp, Artificial
  CRISPR gRNA sequence
aaataatccgttgctttaaa

SEQ ID NO: 157372 - DNA, 20 bp, Artificial
  CRISPR gRNA sequence
aataatccgttgctttaaat

SEQ ID NO: 157373 - DNA, 20 bp, Artificial
  CRISPR gRNA sequence
ctttaaatttcctagctatg

SEQ ID NO: 157374 - DNA, 20 bp, Artificial
  CRISPR gRNA sequence
taaatttcctagctatgatt

SEQ ID NO: 157375 - DNA, 20 bp, Artificial
  CRISPR gRNA sequence
aaatttcctagctatgattt

SEQ ID NO: 157376 - DNA, 20 bp, Artificial
  CRISPR gRNA sequence
aatttcctagctatgattta

SEQ ID NO: 157377 - DNA, 20 bp, Artificial
  CRISPR gRNA sequence
cctagctatgatttataatc

SEQ ID NO: 157378 - DNA, 20 bp, Artificial
  CRISPR gRNA sequence
ctagctatgatttataatcc

SEQ ID NO: 157379 - DNA, 20 bp, Artificial
  CRISPR gRNA sequence
gctatgatttataatccttg

SEQ ID NO: 157380 - DNA, 20 bp, Artificial
  CRISPR gRNA sequence
tgatttataatccttgctta

SEQ ID NO: 157381 - DNA, 20 bp, Artificial
  CRISPR gRNA sequence
ataatccttgcttaccccta

SEQ ID NO: 157382 - DNA, 20 bp, Artificial
  CRISPR gRNA sequence
taatccttgcttacccctag

SEQ ID NO: 157383 - DNA, 20 bp, Artificial
  CRISPR gRNA sequence
gcttacccctagtgaggtgg

SEQ ID NO: 157384 - DNA, 20 bp, Artificial
  CRISPR gRNA sequence
cttacccctagtgaggtgga

SEQ ID NO: 157385 - DNA, 20 bp, Artificial
  CRISPR gRNA sequence
acccctagtgaggtggaaca

SEQ ID NO: 157386 - DNA, 20 bp, Artificial
  CRISPR gRNA sequence
cccctagtgaggtggaacaa

SEQ ID NO: 157387 - DNA, 20 bp, Artificial
  CRISPR gRNA sequence
gtgaggtggaacaaaggaat

SEQ ID NO: 157388 - DNA, 20 bp, Artificial
  CRISPR gRNA sequence
tgatttcttggaggaatggc

SEQ ID NO: 157389 - DNA, 20 bp, Artificial
  CRISPR gRNA sequence
atttcttggaggaatggctg

SEQ ID NO: 157390 - DNA, 20 bp, Artificial
  CRISPR gRNA sequence
cttggaggaatggctggata

SEQ ID NO: 157391 - DNA, 20 bp, Artificial
  CRISPR gRNA sequence
ttggaggaatggctggataa

SEQ ID NO: 157392 - DNA, 20 bp, Artificial
  CRISPR gRNA sequence
ggaggaatggctggataatt

SEQ ID NO: 157393 - DNA, 20 bp, Artificial
  CRISPR gRNA sequence
gaggaatggctggataatta

SEQ ID NO: 157394 - DNA, 20 bp, Artificial
  CRISPR gRNA sequence
gataattaaaataacattat

SEQ ID NO: 157395 - DNA, 20 bp, Artificial
  CRISPR gRNA sequence
aaataacattatcaccatgt

SEQ ID NO: 157396 - DNA, 20 bp, Artificial
  CRISPR gRNA sequence
tcaccatgttcacaatgtag

SEQ ID NO: 157397 - DNA, 20 bp, Artificial
  CRISPR gRNA sequence
acaatgtagcgatagctata

SEQ ID NO: 157398 - DNA, 20 bp, Artificial
  CRISPR gRNA sequence
taattttgaaacactgcata

SEQ ID NO: 157399 - DNA, 20 bp, Artificial
  CRISPR gRNA sequence
tgaaacactgcatagaattt

SEQ ID NO: 157400 - DNA, 20 bp, Artificial
  CRISPR gRNA sequence
gaaacactgcatagaattta

SEQ ID NO: 157401 - DNA, 20 bp, Artificial
  CRISPR gRNA sequence
aaacactgcatagaatttag

SEQ ID NO: 157402 - DNA, 20 bp, Artificial
  CRISPR gRNA sequence
catagaatttagccaggtga

SEQ ID NO: 157403 - DNA, 20 bp, Artificial
  CRISPR gRNA sequence
agccaggtgattcctcctat

SEQ ID NO: 157404 - DNA, 20 bp, Artificial
  CRISPR gRNA sequence
gccaggtgattcctcctata

SEQ ID NO: 157405 - DNA, 20 bp, Artificial
  CRISPR gRNA sequence
ctcctataagtgggcagcta

SEQ ID NO: 157406 - DNA, 20 bp, Artificial
  CRISPR gRNA sequence
ctataagtgggcagctatga

SEQ ID NO: 157407 - DNA, 20 bp, Artificial
  CRISPR gRNA sequence
taagtgggcagctatgaaaa

SEQ ID NO: 157408 - DNA, 20 bp, Artificial
  CRISPR gRNA sequence
tgaaaacatctccaatatag

SEQ ID NO: 157409 - DNA, 20 bp, Artificial
  CRISPR gRNA sequence
caatataggaggctgggcta

SEQ ID NO: 157410 - DNA, 20 bp, Artificial
  CRISPR gRNA sequence
ggctaaggctcttcttctga

SEQ ID NO: 157411 - DNA, 20 bp, Artificial
  CRISPR gRNA sequence
aggctcttcttctgaattat

SEQ ID NO: 157412 - DNA, 20 bp, Artificial
  CRISPR gRNA sequence
ttcttctgaattatagagaa

SEQ ID NO: 157413 - DNA, 20 bp, Artificial
  CRISPR gRNA sequence
cttctgaattatagagaaag

SEQ ID NO: 157414 - DNA, 20 bp, Artificial
  CRISPR gRNA sequence
ttctgaattatagagaaagg

SEQ ID NO: 157415 - DNA, 20 bp, Artificial
  CRISPR gRNA sequence
ctgaattatagagaaaggat

SEQ ID NO: 157416 - DNA, 20 bp, Artificial
  CRISPR gRNA sequence
tgaattatagagaaaggata

SEQ ID NO: 157417 - DNA, 20 bp, Artificial
  CRISPR gRNA sequence
aattatagagaaaggataga

SEQ ID NO: 157418 - DNA, 20 bp, Artificial
  CRISPR gRNA sequence
tagagaaaggatagagtgac

SEQ ID NO: 157419 - DNA, 20 bp, Artificial
  CRISPR gRNA sequence
cccatcaccaggcccccaga

SEQ ID NO: 157420 - DNA, 20 bp, Artificial
  CRISPR gRNA sequence
ccatcaccaggcccccagaa

SEQ ID NO: 157421 - DNA, 20 bp, Artificial
  CRISPR gRNA sequence
gatcctttctatctccactt

SEQ ID NO: 157422 - DNA, 20 bp, Artificial
  CRISPR gRNA sequence
atcctttctatctccacttt

SEQ ID NO: 157423 - DNA, 20 bp, Artificial
  CRISPR gRNA sequence
tctatctccacttttgtttg

SEQ ID NO: 157424 - DNA, 20 bp, Artificial
  CRISPR gRNA sequence
ctatctccacttttgtttgg

SEQ ID NO: 157425 - DNA, 20 bp, Artificial
  CRISPR gRNA sequence
tatctccacttttgtttggt

SEQ ID NO: 157426 - DNA, 20 bp, Artificial
  CRISPR gRNA sequence
tctccacttttgtttggtag

SEQ ID NO: 157427 - DNA, 20 bp, Artificial
  CRISPR gRNA sequence
cacttttgtttggtagctag

SEQ ID NO: 157428 - DNA, 20 bp, Artificial
  CRISPR gRNA sequence
ttgtttggtagctagatggc

SEQ ID NO: 157429 - DNA, 20 bp, Artificial
  CRISPR gRNA sequence
tgtttggtagctagatggcc

SEQ ID NO: 157430 - DNA, 20 bp, Artificial
  CRISPR gRNA sequence
gtttggtagctagatggcct

SEQ ID NO: 157431 - DNA, 20 bp, Artificial
  CRISPR gRNA sequence
tttggtagctagatggccta

SEQ ID NO: 157432 - DNA, 20 bp, Artificial
  CRISPR gRNA sequence
ggtagctagatggcctagtc

SEQ ID NO: 157433 - DNA, 20 bp, Artificial
  CRISPR gRNA sequence
gtagctagatggcctagtcc

SEQ ID NO: 157434 - DNA, 20 bp, Artificial
  CRISPR gRNA sequence
gatggcctagtcccactcct

SEQ ID NO: 157435 - DNA, 20 bp, Artificial
  CRISPR gRNA sequence
gtcccactcctttgatgcaa

SEQ ID NO: 157436 - DNA, 20 bp, Artificial
  CRISPR gRNA sequence
ctttgatgcaactgcagttt

SEQ ID NO: 157437 - DNA, 20 bp, Artificial
  CRISPR gRNA sequence
tgatgcaactgcagtttagc

SEQ ID NO: 157438 - DNA, 20 bp, Artificial
  CRISPR gRNA sequence
gatgcaactgcagtttagca

SEQ ID NO: 157439 - DNA, 20 bp, Artificial
  CRISPR gRNA sequence
atgcaactgcagtttagcaa

SEQ ID NO: 157440 - DNA, 20 bp, Artificial
  CRISPR gRNA sequence
cagtttagcaagcttgaaaa

SEQ ID NO: 157441 - DNA, 20 bp, Artificial
  CRISPR gRNA sequence
agcaagcttgaaaaccttaa

SEQ ID NO: 157442 - DNA, 20 bp, Artificial
  CRISPR gRNA sequence
gcaagcttgaaaaccttaag

SEQ ID NO: 157443 - DNA, 20 bp, Artificial
  CRISPR gRNA sequence
gaaaaccttaagctttcttg

SEQ ID NO: 157444 - DNA, 20 bp, Artificial
  CRISPR gRNA sequence
aaaaccttaagctttcttgt

SEQ ID NO: 157445 - DNA, 20 bp, Artificial
  CRISPR gRNA sequence
aagctttcttgtttaagctt

SEQ ID NO: 157446 - DNA, 20 bp, Artificial
  CRISPR gRNA sequence
agctttcttgtttaagcttt

SEQ ID NO: 157447 - DNA, 20 bp, Artificial
  CRISPR gRNA sequence
tcttgtttaagctttctact

SEQ ID NO: 157448 - DNA, 20 bp, Artificial
  CRISPR gRNA sequence
cttgtttaagctttctactt

SEQ ID NO: 157449 - DNA, 20 bp, Artificial
  CRISPR gRNA sequence
ttgtttaagctttctacttt

SEQ ID NO: 157450 - DNA, 20 bp, Artificial
  CRISPR gRNA sequence
gtttaagctttctactttga

SEQ ID NO: 157451 - DNA, 20 bp, Artificial
  CRISPR gRNA sequence
tttaagctttctactttgaa

SEQ ID NO: 157452 - DNA, 20 bp, Artificial
  CRISPR gRNA sequence
aagctttctactttgaaatg

SEQ ID NO: 157453 - DNA, 20 bp, Artificial
  CRISPR gRNA sequence
agctttctactttgaaatgt

SEQ ID NO: 157454 - DNA, 20 bp, Artificial
  CRISPR gRNA sequence
tctactttgaaatgtttaag

SEQ ID NO: 157455 - DNA, 20 bp, Artificial
  CRISPR gRNA sequence
ctactttgaaatgtttaaga

SEQ ID NO: 157456 - DNA, 20 bp, Artificial
  CRISPR gRNA sequence
tactttgaaatgtttaagaa

SEQ ID NO: 157457 - DNA, 20 bp, Artificial
  CRISPR gRNA sequence
ctttgaaatgtttaagaatc

SEQ ID NO: 157458 - DNA, 20 bp, Artificial
  CRISPR gRNA sequence
tgaaatgtttaagaatctgg

SEQ ID NO: 157459 - DNA, 20 bp, Artificial
  CRISPR gRNA sequence
gaaatgtttaagaatctggt

SEQ ID NO: 157460 - DNA, 20 bp, Artificial
  CRISPR gRNA sequence
aaatgtttaagaatctggta

SEQ ID NO: 157461 - DNA, 20 bp, Artificial
  CRISPR gRNA sequence
aagaatctggtatcttgatt

SEQ ID NO: 157462 - DNA, 20 bp, Artificial
  CRISPR gRNA sequence
agaatctggtatcttgattt

SEQ ID NO: 157463 - DNA, 20 bp, Artificial
  CRISPR gRNA sequence
gtatcttgatttttttggag

SEQ ID NO: 157464 - DNA, 20 bp, Artificial
  CRISPR gRNA sequence
gatttttttggagtactttt

SEQ ID NO: 157465 - DNA, 20 bp, Artificial
  CRISPR gRNA sequence
atttttttggagtacttttt

SEQ ID NO: 157466 - DNA, 20 bp, Artificial
  CRISPR gRNA sequence
ttttggagtacttttttcag

SEQ ID NO: 157467 - DNA, 20 bp, Artificial
  CRISPR gRNA sequence
tttggagtacttttttcagg

SEQ ID NO: 157468 - DNA, 20 bp, Artificial
  CRISPR gRNA sequence
ttggagtacttttttcagga

SEQ ID NO: 157469 - DNA, 20 bp, Artificial
  CRISPR gRNA sequence
tggagtacttttttcaggag

SEQ ID NO: 157470 - DNA, 20 bp, Artificial
  CRISPR gRNA sequence
ggagtacttttttcaggaga

SEQ ID NO: 157471 - DNA, 20 bp, Artificial
  CRISPR gRNA sequence
gagtacttttttcaggagag

SEQ ID NO: 157472 - DNA, 20 bp, Artificial
  CRISPR gRNA sequence
ttttcaggagagtgatcagg

SEQ ID NO: 157473 - DNA, 20 bp, Artificial
  CRISPR gRNA sequence
tttcaggagagtgatcagga

SEQ ID NO: 157474 - DNA, 20 bp, Artificial
  CRISPR gRNA sequence
ttcaggagagtgatcaggaa

SEQ ID NO: 157475 - DNA, 20 bp, Artificial
  CRISPR gRNA sequence
tcaggagagtgatcaggaaa

SEQ ID NO: 157476 - DNA, 20 bp, Artificial
  CRISPR gRNA sequence
caggagagtgatcaggaaaa

SEQ ID NO: 157477 - DNA, 20 bp, Artificial
  CRISPR gRNA sequence
aggagagtgatcaggaaaac

SEQ ID NO: 157478 - DNA, 20 bp, Artificial
  CRISPR gRNA sequence
gtggatttgtgttccaggct

SEQ ID NO: 157479 - DNA, 20 bp, Artificial
  CRISPR gRNA sequence
gtgttccaggctgagaaaag

SEQ ID NO: 157480 - DNA, 20 bp, Artificial
  CRISPR gRNA sequence
tgttccaggctgagaaaagc

SEQ ID NO: 157481 - DNA, 20 bp, Artificial
  CRISPR gRNA sequence
caggctgagaaaagctatag

SEQ ID NO: 157482 - DNA, 20 bp, Artificial
  CRISPR gRNA sequence
agaaaagctataggttctta

SEQ ID NO: 157483 - DNA, 20 bp, Artificial
  CRISPR gRNA sequence
taggttcttaagttttgtgt

SEQ ID NO: 157484 - DNA, 20 bp, Artificial
  CRISPR gRNA sequence
ttaagttttgtgttttctgt

SEQ ID NO: 157485 - DNA, 20 bp, Artificial
  CRISPR gRNA sequence
aagttttgtgttttctgttg

SEQ ID NO: 157486 - DNA, 20 bp, Artificial
  CRISPR gRNA sequence
agttttgtgttttctgttgt

SEQ ID NO: 157487 - DNA, 20 bp, Artificial
  CRISPR gRNA sequence
tgtgttttctgttgttatca

SEQ ID NO: 157488 - DNA, 20 bp, Artificial
  CRISPR gRNA sequence
gtgttttctgttgttatcaa

SEQ ID NO: 157489 - DNA, 20 bp, Artificial
  CRISPR gRNA sequence
tgttttctgttgttatcaat

SEQ ID NO: 157490 - DNA, 20 bp, Artificial
  CRISPR gRNA sequence
tctgttgttatcaattctaa

SEQ ID NO: 157491 - DNA, 20 bp, Artificial
  CRISPR gRNA sequence
ctgttgttatcaattctaaa

SEQ ID NO: 157492 - DNA, 20 bp, Artificial
  CRISPR gRNA sequence
tgttgttatcaattctaaag

SEQ ID NO: 157493 - DNA, 20 bp, Artificial
  CRISPR gRNA sequence
ttgttatcaattctaaagta

SEQ ID NO: 157494 - DNA, 20 bp, Artificial
  CRISPR gRNA sequence
ttatcaattctaaagtagaa

SEQ ID NO: 157495 - DNA, 20 bp, Artificial
  CRISPR gRNA sequence
tcaattctaaagtagaagga

SEQ ID NO: 157496 - DNA, 20 bp, Artificial
  CRISPR gRNA sequence
taaagtagaaggagaagatt

SEQ ID NO: 157497 - DNA, 20 bp, Artificial
  CRISPR gRNA sequence
aagtagaaggagaagattta

SEQ ID NO: 157498 - DNA, 20 bp, Artificial
  CRISPR gRNA sequence
aatgaaagagcacagaactg

SEQ ID NO: 157499 - DNA, 20 bp, Artificial
  CRISPR gRNA sequence
atgaaagagcacagaactga

SEQ ID NO: 157500 - DNA, 20 bp, Artificial
  CRISPR gRNA sequence
agaatcagaagacatgaatt

SEQ ID NO: 157501 - DNA, 20 bp, Artificial
  CRISPR gRNA sequence
taatttcacctgtggcatat

SEQ ID NO: 157502 - DNA, 20 bp, Artificial
  CRISPR gRNA sequence
aatttcacctgtggcatata

SEQ ID NO: 157503 - DNA, 20 bp, Artificial
  CRISPR gRNA sequence
atttcacctgtggcatatac

SEQ ID NO: 157504 - DNA, 20 bp, Artificial
  CRISPR gRNA sequence
cacctgtggcatatacttgt

SEQ ID NO: 157505 - DNA, 20 bp, Artificial
  CRISPR gRNA sequence
acctgtggcatatacttgtc

SEQ ID NO: 157506 - DNA, 20 bp, Artificial
  CRISPR gRNA sequence
tggcatatacttgtcctggt

SEQ ID NO: 157507 - DNA, 20 bp, Artificial
  CRISPR gRNA sequence
gtcctggtgaattctgccaa

SEQ ID NO: 157508 - DNA, 20 bp, Artificial
  CRISPR gRNA sequence
tcctggtgaattctgccaag

SEQ ID NO: 157509 - DNA, 20 bp, Artificial
  CRISPR gRNA sequence
gtgaattctgccaagttcct

SEQ ID NO: 157510 - DNA, 20 bp, Artificial
  CRISPR gRNA sequence
tgccaagttcctcagtccac

SEQ ID NO: 157511 - DNA, 20 bp, Artificial
  CRISPR gRNA sequence
ccaagttcctcagtccacct

SEQ ID NO: 157512 - DNA, 20 bp, Artificial
  CRISPR gRNA sequence
ctcagtccacctggataaag

SEQ ID NO: 157513 - DNA, 20 bp, Artificial
  CRISPR gRNA sequence
agtccacctggataaagtat

SEQ ID NO: 157514 - DNA, 20 bp, Artificial
  CRISPR gRNA sequence
gataaagtatctttatctgt

SEQ ID NO: 157515 - DNA, 20 bp, Artificial
  CRISPR gRNA sequence
tatctgtcagatgtgttgct

SEQ ID NO: 157516 - DNA, 20 bp, Artificial
  CRISPR gRNA sequence
atctgtcagatgtgttgctt

SEQ ID NO: 157517 - DNA, 20 bp, Artificial
  CRISPR gRNA sequence
tctgtcagatgtgttgctta

SEQ ID NO: 157518 - DNA, 20 bp, Artificial
  CRISPR gRNA sequence
tcagatgtgttgcttatctt

SEQ ID NO: 157519 - DNA, 20 bp, Artificial
  CRISPR gRNA sequence
cttatcttatgtgtttatgg

SEQ ID NO: 157520 - DNA, 20 bp, Artificial
  CRISPR gRNA sequence
atcttatgtgtttatggtga

SEQ ID NO: 157521 - DNA, 20 bp, Artificial
  CRISPR gRNA sequence
tcttatgtgtttatggtgag

SEQ ID NO: 157522 - DNA, 20 bp, Artificial
  CRISPR gRNA sequence
atgtgtttatggtgagaaac

SEQ ID NO: 157523 - DNA, 20 bp, Artificial
  CRISPR gRNA sequence
tgtgtttatggtgagaaaca

SEQ ID NO: 157524 - DNA, 20 bp, Artificial
  CRISPR gRNA sequence
atggtgagaaacacataaaa

SEQ ID NO: 157525 - DNA, 20 bp, Artificial
  CRISPR gRNA sequence
tggtgagaaacacataaaat

SEQ ID NO: 157526 - DNA, 20 bp, Artificial
  CRISPR gRNA sequence
ctttaagaagtgtaaagtat

SEQ ID NO: 157527 - DNA, 20 bp, Artificial
  CRISPR gRNA sequence
taagaagtgtaaagtatgta

SEQ ID NO: 157528 - DNA, 20 bp, Artificial
  CRISPR gRNA sequence
aagaagtgtaaagtatgtac

SEQ ID NO: 157529 - DNA, 20 bp, Artificial
  CRISPR gRNA sequence
agaagtgtaaagtatgtaca

SEQ ID NO: 157530 - DNA, 20 bp, Artificial
  CRISPR gRNA sequence
gcataactatctcagtcact

SEQ ID NO: 157531 - DNA, 20 bp, Artificial
  CRISPR gRNA sequence
tctcagtcactttgccctct

SEQ ID NO: 157532 - DNA, 20 bp, Artificial
  CRISPR gRNA sequence
agtcactttgccctctttga

SEQ ID NO: 157533 - DNA, 20 bp, Artificial
  CRISPR gRNA sequence
tgccctctttgaagaggtct

SEQ ID NO: 157534 - DNA, 20 bp, Artificial
  CRISPR gRNA sequence
gccctctttgaagaggtctt

SEQ ID NO: 157535 - DNA, 20 bp, Artificial
  CRISPR gRNA sequence
ccctctttgaagaggtcttt

SEQ ID NO: 157536 - DNA, 20 bp, Artificial
  CRISPR gRNA sequence
tttgaagaggtctttatgtt

SEQ ID NO: 157537 - DNA, 20 bp, Artificial
  CRISPR gRNA sequence
tgaagaggtctttatgttct

SEQ ID NO: 157538 - DNA, 20 bp, Artificial
  CRISPR gRNA sequence
gaagaggtctttatgttctc

SEQ ID NO: 157539 - DNA, 20 bp, Artificial
  CRISPR gRNA sequence
aagaggtctttatgttctca

SEQ ID NO: 157540 - DNA, 20 bp, Artificial
  CRISPR gRNA sequence
tatgttctcagttcctgaca

SEQ ID NO: 157541 - DNA, 20 bp, Artificial
  CRISPR gRNA sequence
atgttctcagttcctgacag

SEQ ID NO: 157542 - DNA, 20 bp, Artificial
  CRISPR gRNA sequence
tgttctcagttcctgacagc

SEQ ID NO: 157543 - DNA, 20 bp, Artificial
  CRISPR gRNA sequence
tcagttcctgacagctgtat

SEQ ID NO: 157544 - DNA, 20 bp, Artificial
  CRISPR gRNA sequence
agttcctgacagctgtatac

SEQ ID NO: 157545 - DNA, 20 bp, Artificial
  CRISPR gRNA sequence
ctgacagctgtatacatgaa

SEQ ID NO: 157546 - DNA, 20 bp, Artificial
  CRISPR gRNA sequence
acagctgtatacatgaagtt

SEQ ID NO: 157547 - DNA, 20 bp, Artificial
  CRISPR gRNA sequence
tatacatgaagttaagagat

SEQ ID NO: 157548 - DNA, 20 bp, Artificial
  CRISPR gRNA sequence
agagatttatggtttggttg

SEQ ID NO: 157549 - DNA, 20 bp, Artificial
  CRISPR gRNA sequence
atggtttggttggcttggaa

SEQ ID NO: 157550 - DNA, 20 bp, Artificial
  CRISPR gRNA sequence
tggtttggttggcttggaag

SEQ ID NO: 157551 - DNA, 20 bp, Artificial
  CRISPR gRNA sequence
ggttggcttggaagatttgt

SEQ ID NO: 157552 - DNA, 20 bp, Artificial
  CRISPR gRNA sequence
gttggcttggaagatttgtc

SEQ ID NO: 157553 - DNA, 20 bp, Artificial
  CRISPR gRNA sequence
gcttggaagatttgtctcat

SEQ ID NO: 157554 - DNA, 20 bp, Artificial
  CRISPR gRNA sequence
ggaagatttgtctcatttca

SEQ ID NO: 157555 - DNA, 20 bp, Artificial
  CRISPR gRNA sequence
gaagatttgtctcatttcat

SEQ ID NO: 157556 - DNA, 20 bp, Artificial
  CRISPR gRNA sequence
gtctcatttcatgtcgtttt

SEQ ID NO: 157557 - DNA, 20 bp, Artificial
  CRISPR gRNA sequence
tctcatttcatgtcgttttc

SEQ ID NO: 157558 - DNA, 20 bp, Artificial
  CRISPR gRNA sequence
atttcatgtcgttttccttt

SEQ ID NO: 157559 - DNA, 20 bp, Artificial
  CRISPR gRNA sequence
catgtcgttttcctttcttt

SEQ ID NO: 157560 - DNA, 20 bp, Artificial
  CRISPR gRNA sequence
atgtcgttttcctttctttc

SEQ ID NO: 157561 - DNA, 20 bp, Artificial
  CRISPR gRNA sequence
tcctttctttcttctcctct

SEQ ID NO: 157562 - DNA, 20 bp, Artificial
  CRISPR gRNA sequence
cctttctttcttctcctctt

SEQ ID NO: 157563 - DNA, 20 bp, Artificial
  CRISPR gRNA sequence
ctttctttcttctcctcttt

SEQ ID NO: 157564 - DNA, 20 bp, Artificial
  CRISPR gRNA sequence
tctttcttctcctcttttaa

SEQ ID NO: 157565 - DNA, 20 bp, Artificial
  CRISPR gRNA sequence
ctttcttctcctcttttaaa

SEQ ID NO: 157566 - DNA, 20 bp, Artificial
  CRISPR gRNA sequence
tttcttctcctcttttaaac

SEQ ID NO: 157567 - DNA, 20 bp, Artificial
  CRISPR gRNA sequence
tcttctcctcttttaaacat

SEQ ID NO: 157568 - DNA, 20 bp, Artificial
  CRISPR gRNA sequence
cttctcctcttttaaacatt

SEQ ID NO: 157569 - DNA, 20 bp, Artificial
  CRISPR gRNA sequence
ttctcctcttttaaacattt

SEQ ID NO: 157570 - DNA, 20 bp, Artificial
  CRISPR gRNA sequence
ctcctcttttaaacatttaa

SEQ ID NO: 157571 - DNA, 20 bp, Artificial
  CRISPR gRNA sequence
tcctcttttaaacatttaaa

SEQ ID NO: 157572 - DNA, 20 bp, Artificial
  CRISPR gRNA sequence
ctcttttaaacatttaaatc

SEQ ID NO: 157573 - DNA, 20 bp, Artificial
  CRISPR gRNA sequence
ttttaaacatttaaatcaat

SEQ ID NO: 157574 - DNA, 20 bp, Artificial
  CRISPR gRNA sequence
ttaaacatttaaatcaataa

SEQ ID NO: 157575 - DNA, 20 bp, Artificial
  CRISPR gRNA sequence
taaacatttaaatcaataaa

SEQ ID NO: 157576 - DNA, 20 bp, Artificial
  CRISPR gRNA sequence
aaacatttaaatcaataaaa

SEQ ID NO: 157577 - DNA, 20 bp, Artificial
  CRISPR gRNA sequence
aacatttaaatcaataaaag

SEQ ID NO: 157578 - DNA, 20 bp, Artificial
  CRISPR gRNA sequence
aaatcaataaaagacactaa

SEQ ID NO: 157579 - DNA, 20 bp, Artificial
  CRISPR gRNA sequence
aatcaataaaagacactaaa

SEQ ID NO: 157580 - DNA, 20 bp, Artificial
  CRISPR gRNA sequence
aacagagggaagaattcaca

SEQ ID NO: 157581 - DNA, 20 bp, Artificial
  CRISPR gRNA sequence
acagtgtatctgaatgagca

SEQ ID NO: 157582 - DNA, 20 bp, Artificial
  CRISPR gRNA sequence
aatgagcagaatctagacag

SEQ ID NO: 157583 - DNA, 20 bp, Artificial
  CRISPR gRNA sequence
gacagcagaatcaatacagc

SEQ ID NO: 157584 - DNA, 20 bp, Artificial
  CRISPR gRNA sequence
atattgacattattataacg

SEQ ID NO: 157585 - DNA, 20 bp, Artificial
  CRISPR gRNA sequence
acattattataacgccctct

SEQ ID NO: 157586 - DNA, 20 bp, Artificial
  CRISPR gRNA sequence
ttataacgccctctaggttt

SEQ ID NO: 157587 - DNA, 20 bp, Artificial
  CRISPR gRNA sequence
taacgccctctaggttttta

SEQ ID NO: 157588 - DNA, 20 bp, Artificial
  CRISPR gRNA sequence
taggtttttaattgacaatt

SEQ ID NO: 157589 - DNA, 20 bp, Artificial
  CRISPR gRNA sequence
ggtttttaattgacaatttt

SEQ ID NO: 157590 - DNA, 20 bp, Artificial
  CRISPR gRNA sequence
ttaattgacaattttctgcc

SEQ ID NO: 157591 - DNA, 20 bp, Artificial
  CRISPR gRNA sequence
taattgacaattttctgcct

SEQ ID NO: 157592 - DNA, 20 bp, Artificial
  CRISPR gRNA sequence
aattgacaattttctgcctt

SEQ ID NO: 157593 - DNA, 20 bp, Artificial
  CRISPR gRNA sequence
attgacaattttctgccttc

SEQ ID NO: 157594 - DNA, 20 bp, Artificial
  CRISPR gRNA sequence
acaattttctgccttcccct

SEQ ID NO: 157595 - DNA, 20 bp, Artificial
  CRISPR gRNA sequence
tctgccttcccctgtcccac

SEQ ID NO: 157596 - DNA, 20 bp, Artificial
  CRISPR gRNA sequence
ctgccttcccctgtcccacc

SEQ ID NO: 157597 - DNA, 20 bp, Artificial
  CRISPR gRNA sequence
tgccttcccctgtcccacca

SEQ ID NO: 157598 - DNA, 20 bp, Artificial
  CRISPR gRNA sequence
ccttcccctgtcccaccacc

SEQ ID NO: 157599 - DNA, 20 bp, Artificial
  CRISPR gRNA sequence
cccctgtcccaccacccccc

SEQ ID NO: 157600 - DNA, 20 bp, Artificial
  CRISPR gRNA sequence
ccctgtcccaccacccccct

SEQ ID NO: 157601 - DNA, 20 bp, Artificial
  CRISPR gRNA sequence
tcccaccacccccctggttt

SEQ ID NO: 157602 - DNA, 20 bp, Artificial
  CRISPR gRNA sequence
gtttttagatgtattaagtc

SEQ ID NO: 157603 - DNA, 20 bp, Artificial
  CRISPR gRNA sequence
ttagatgtattaagtcacca

SEQ ID NO: 157604 - DNA, 20 bp, Artificial
  CRISPR gRNA sequence
tagatgtattaagtcaccag

SEQ ID NO: 157605 - DNA, 20 bp, Artificial
  CRISPR gRNA sequence
agatgtattaagtcaccagc

SEQ ID NO: 157606 - DNA, 20 bp, Artificial
  CRISPR gRNA sequence
gatgtattaagtcaccagca

SEQ ID NO: 157607 - DNA, 20 bp, Artificial
  CRISPR gRNA sequence
agtcaccagcacaatctccc

SEQ ID NO: 157608 - DNA, 20 bp, Artificial
  CRISPR gRNA sequence
ccatttttcagtggagccga

SEQ ID NO: 157609 - DNA, 20 bp, Artificial
  CRISPR gRNA sequence
ttcagtggagccgatgatta

SEQ ID NO: 157610 - DNA, 20 bp, Artificial
  CRISPR gRNA sequence
tcagtggagccgatgattag

SEQ ID NO: 157611 - DNA, 20 bp, Artificial
  CRISPR gRNA sequence
cagtggagccgatgattaga

SEQ ID NO: 157612 - DNA, 20 bp, Artificial
  CRISPR gRNA sequence
agtggagccgatgattagat

SEQ ID NO: 157613 - DNA, 20 bp, Artificial
  CRISPR gRNA sequence
gataattgtctacattttcc

SEQ ID NO: 157614 - DNA, 20 bp, Artificial
  CRISPR gRNA sequence
tctacattttccaaagtaga

SEQ ID NO: 157615 - DNA, 20 bp, Artificial
  CRISPR gRNA sequence
cattttccaaagtagaacaa

SEQ ID NO: 157616 - DNA, 20 bp, Artificial
  CRISPR gRNA sequence
tccaaagtagaacaagtttt

SEQ ID NO: 157617 - DNA, 20 bp, Artificial
  CRISPR gRNA sequence
ccaaagtagaacaagttttt

SEQ ID NO: 157618 - DNA, 20 bp, Artificial
  CRISPR gRNA sequence
caaagtagaacaagtttttc

SEQ ID NO: 157619 - DNA, 20 bp, Artificial
  CRISPR gRNA sequence
ttctccaaccccactcttgt

SEQ ID NO: 157620 - DNA, 20 bp, Artificial
  CRISPR gRNA sequence
tctccaaccccactcttgtg

SEQ ID NO: 157621 - DNA, 20 bp, Artificial
  CRISPR gRNA sequence
ctccaaccccactcttgtgg

SEQ ID NO: 157622 - DNA, 20 bp, Artificial
  CRISPR gRNA sequence
tccaaccccactcttgtggc

SEQ ID NO: 157623 - DNA, 20 bp, Artificial
  CRISPR gRNA sequence
caaccccactcttgtggctc

SEQ ID NO: 157624 - DNA, 20 bp, Artificial
  CRISPR gRNA sequence
ttgtggctcttccattggat

SEQ ID NO: 157625 - DNA, 20 bp, Artificial
  CRISPR gRNA sequence
gtggctcttccattggatta

SEQ ID NO: 157626 - DNA, 20 bp, Artificial
  CRISPR gRNA sequence
tggctcttccattggattac

SEQ ID NO: 157627 - DNA, 20 bp, Artificial
  CRISPR gRNA sequence
ttccattggattactgcaca

SEQ ID NO: 157628 - DNA, 20 bp, Artificial
  CRISPR gRNA sequence
ccattggattactgcacaaa

SEQ ID NO: 157629 - DNA, 20 bp, Artificial
  CRISPR gRNA sequence
cattggattactgcacaaag

SEQ ID NO: 157630 - DNA, 20 bp, Artificial
  CRISPR gRNA sequence
gattactgcacaaaggttac

SEQ ID NO: 157631 - DNA, 20 bp, Artificial
  CRISPR gRNA sequence
ctgcacaaaggttactgcac

SEQ ID NO: 157632 - DNA, 20 bp, Artificial
  CRISPR gRNA sequence
cacaaaggttactgcacaac

SEQ ID NO: 157633 - DNA, 20 bp, Artificial
  CRISPR gRNA sequence
ctgcacaactgagcacagat

SEQ ID NO: 157634 - DNA, 20 bp, Artificial
  CRISPR gRNA sequence
cacaactgagcacagatact

SEQ ID NO: 157635 - DNA, 20 bp, Artificial
  CRISPR gRNA sequence
agcacagatacttaagaagg

SEQ ID NO: 157636 - DNA, 20 bp, Artificial
  CRISPR gRNA sequence
aagaaggaattttcccattt

SEQ ID NO: 157637 - DNA, 20 bp, Artificial
  CRISPR gRNA sequence
agaaggaattttcccatttc

SEQ ID NO: 157638 - DNA, 20 bp, Artificial
  CRISPR gRNA sequence
tcccatttcaaagaaaagta

SEQ ID NO: 157639 - DNA, 20 bp, Artificial
  CRISPR gRNA sequence
cccatttcaaagaaaagtac

SEQ ID NO: 157640 - DNA, 20 bp, Artificial
  CRISPR gRNA sequence
ccatttcaaagaaaagtacc

SEQ ID NO: 157641 - DNA, 20 bp, Artificial
  CRISPR gRNA sequence
caaagaaaagtacctagaat

SEQ ID NO: 157642 - DNA, 20 bp, Artificial
  CRISPR gRNA sequence
aaagaaaagtacctagaatg

SEQ ID NO: 157643 - DNA, 20 bp, Artificial
  CRISPR gRNA sequence
gaatgaggccaaggatactt

SEQ ID NO: 157644 - DNA, 20 bp, Artificial
  CRISPR gRNA sequence
ggggtcttaaaatagttctt

SEQ ID NO: 157645 - DNA, 20 bp, Artificial
  CRISPR gRNA sequence
gggtcttaaaatagttcttg

SEQ ID NO: 157646 - DNA, 20 bp, Artificial
  CRISPR gRNA sequence
aaaatagttcttgtccaggc

SEQ ID NO: 157647 - DNA, 20 bp, Artificial
  CRISPR gRNA sequence
aaatagttcttgtccaggca

SEQ ID NO: 157648 - DNA, 20 bp, Artificial
  CRISPR gRNA sequence
ttgtccaggcatggtggctc

SEQ ID NO: 157649 - DNA, 20 bp, Artificial
  CRISPR gRNA sequence
gtccaggcatggtggctcac

SEQ ID NO: 157650 - DNA, 20 bp, Artificial
  CRISPR gRNA sequence
tccaggcatggtggctcaca

SEQ ID NO: 157651 - DNA, 20 bp, Artificial
  CRISPR gRNA sequence
acatctgtaatcccagcact

SEQ ID NO: 157652 - DNA, 20 bp, Artificial
  CRISPR gRNA sequence
taatcccagcactttggcag

SEQ ID NO: 157653 - DNA, 20 bp, Artificial
  CRISPR gRNA sequence
tggcaggccaaagtgagagg

SEQ ID NO: 157654 - DNA, 20 bp, Artificial
  CRISPR gRNA sequence
ggcaggccaaagtgagagga

SEQ ID NO: 157655 - DNA, 20 bp, Artificial
  CRISPR gRNA sequence
gcaggccaaagtgagaggat

SEQ ID NO: 157656 - DNA, 20 bp, Artificial
  CRISPR gRNA sequence
gagcccaggagtttgagacc

SEQ ID NO: 157657 - DNA, 20 bp, Artificial
  CRISPR gRNA sequence
agcccaggagtttgagacca

SEQ ID NO: 157658 - DNA, 20 bp, Artificial
  CRISPR gRNA sequence
gagaccagcctgggcaagat

SEQ ID NO: 157659 - DNA, 20 bp, Artificial
  CRISPR gRNA sequence
agaccagcctgggcaagata

SEQ ID NO: 157660 - DNA, 20 bp, Artificial
  CRISPR gRNA sequence
ggcaagatagcaagaccctg

SEQ ID NO: 157661 - DNA, 20 bp, Artificial
  CRISPR gRNA sequence
tctttacaaaaaattttaaa

SEQ ID NO: 157662 - DNA, 20 bp, Artificial
  CRISPR gRNA sequence
tacaaaaaattttaaaaatt

SEQ ID NO: 157663 - DNA, 20 bp, Artificial
  CRISPR gRNA sequence
acaaaaaattttaaaaatta

SEQ ID NO: 157664 - DNA, 20 bp, Artificial
  CRISPR gRNA sequence
caaaaaattttaaaaattag

SEQ ID NO: 157665 - DNA, 20 bp, Artificial
  CRISPR gRNA sequence
taaaaattagccaggtatgg

SEQ ID NO: 157666 - DNA, 20 bp, Artificial
  CRISPR gRNA sequence
aaaaattagccaggtatggt

SEQ ID NO: 157667 - DNA, 20 bp, Artificial
  CRISPR gRNA sequence
aaaattagccaggtatggtg

SEQ ID NO: 157668 - DNA, 20 bp, Artificial
  CRISPR gRNA sequence
gccaggtatggtggcaagca

SEQ ID NO: 157669 - DNA, 20 bp, Artificial
  CRISPR gRNA sequence
tagtccccgctactcaggag

SEQ ID NO: 157670 - DNA, 20 bp, Artificial
  CRISPR gRNA sequence
ctcaggaggctgagcagggg

SEQ ID NO: 157671 - DNA, 20 bp, Artificial
  CRISPR gRNA sequence
aggaggctgagcaggggagg

SEQ ID NO: 157672 - DNA, 20 bp, Artificial
  CRISPR gRNA sequence
agcaggggaggatcacttga

SEQ ID NO: 157673 - DNA, 20 bp, Artificial
  CRISPR gRNA sequence
gaacccaggaggttgaggct

SEQ ID NO: 157674 - DNA, 20 bp, Artificial
  CRISPR gRNA sequence
aacccaggaggttgaggctt

SEQ ID NO: 157675 - DNA, 20 bp, Artificial
  CRISPR gRNA sequence
aggcttcagtgagccatgat

SEQ ID NO: 157676 - DNA, 20 bp, Artificial
  CRISPR gRNA sequence
cagtgagccatgattacgcc

SEQ ID NO: 157677 - DNA, 20 bp, Artificial
  CRISPR gRNA sequence
agtgagccatgattacgcca

SEQ ID NO: 157678 - DNA, 20 bp, Artificial
  CRISPR gRNA sequence
cgccactgcactccagcgtg

SEQ ID NO: 157679 - DNA, 20 bp, Artificial
  CRISPR gRNA sequence
cactccagcgtgggcaacag

SEQ ID NO: 157680 - DNA, 20 bp, Artificial
  CRISPR gRNA sequence
cagcgtgggcaacagagcaa

SEQ ID NO: 157681 - DNA, 20 bp, Artificial
  CRISPR gRNA sequence
ttatttaaaaaaaatttttt

SEQ ID NO: 157682 - DNA, 20 bp, Artificial
  CRISPR gRNA sequence
tttaaaaaaaattttttttt

SEQ ID NO: 157683 - DNA, 20 bp, Artificial
  CRISPR gRNA sequence
aaaaaaaatttttttttaag

SEQ ID NO: 157684 - DNA, 20 bp, Artificial
  CRISPR gRNA sequence
aaaaaaatttttttttaagt

SEQ ID NO: 157685 - DNA, 20 bp, Artificial
  CRISPR gRNA sequence
ttttttaagttcttgaggaa

SEQ ID NO: 157686 - DNA, 20 bp, Artificial
  CRISPR gRNA sequence
tttttaagttcttgaggaac

SEQ ID NO: 157687 - DNA, 20 bp, Artificial
  CRISPR gRNA sequence
ttttaagttcttgaggaacc

SEQ ID NO: 157688 - DNA, 20 bp, Artificial
  CRISPR gRNA sequence
tttaagttcttgaggaacct

SEQ ID NO: 157689 - DNA, 20 bp, Artificial
  CRISPR gRNA sequence
ttaagttcttgaggaacctg

SEQ ID NO: 157690 - DNA, 20 bp, Artificial
  CRISPR gRNA sequence
taagttcttgaggaacctgt

SEQ ID NO: 157691 - DNA, 20 bp, Artificial
  CRISPR gRNA sequence
aagttcttgaggaacctgtg

SEQ ID NO: 157692 - DNA, 20 bp, Artificial
  CRISPR gRNA sequence
agttcttgaggaacctgtgt

SEQ ID NO: 157693 - DNA, 20 bp, Artificial
  CRISPR gRNA sequence
ttgaggaacctgtgtttgtt

SEQ ID NO: 157694 - DNA, 20 bp, Artificial
  CRISPR gRNA sequence
gaggaacctgtgtttgttca

SEQ ID NO: 157695 - DNA, 20 bp, Artificial
  CRISPR gRNA sequence
aggaacctgtgtttgttcat

SEQ ID NO: 157696 - DNA, 20 bp, Artificial
  CRISPR gRNA sequence
tgtttgttcattcagtagat

SEQ ID NO: 157697 - DNA, 20 bp, Artificial
  CRISPR gRNA sequence
gttcattcagtagatgtgta

SEQ ID NO: 157698 - DNA, 20 bp, Artificial
  CRISPR gRNA sequence
ttcattcagtagatgtgtat

SEQ ID NO: 157699 - DNA, 20 bp, Artificial
  CRISPR gRNA sequence
attcagtagatgtgtattga

SEQ ID NO: 157700 - DNA, 20 bp, Artificial
  CRISPR gRNA sequence
agtagatgtgtattgaatcc

SEQ ID NO: 157701 - DNA, 20 bp, Artificial
  CRISPR gRNA sequence
aatccccactatgtgcaagg

SEQ ID NO: 157702 - DNA, 20 bp, Artificial
  CRISPR gRNA sequence
tgtgcaaggcatatttgcct

SEQ ID NO: 157703 - DNA, 20 bp, Artificial
  CRISPR gRNA sequence
gccttgagggtgtatcagaa

SEQ ID NO: 157704 - DNA, 20 bp, Artificial
  CRISPR gRNA sequence
ccttgagggtgtatcagaaa

SEQ ID NO: 157705 - DNA, 20 bp, Artificial
  CRISPR gRNA sequence
gagggtgtatcagaaacaaa

SEQ ID NO: 157706 - DNA, 20 bp, Artificial
  CRISPR gRNA sequence
agggtgtatcagaaacaaaa

SEQ ID NO: 157707 - DNA, 20 bp, Artificial
  CRISPR gRNA sequence
tgtttgtcttacaaacgggg

SEQ ID NO: 157708 - DNA, 20 bp, Artificial
  CRISPR gRNA sequence
gtcttacaaacgggggaaaa

SEQ ID NO: 157709 - DNA, 20 bp, Artificial
  CRISPR gRNA sequence
tcttacaaacgggggaaaaa

SEQ ID NO: 157710 - DNA, 20 bp, Artificial
  CRISPR gRNA sequence
acaaacgggggaaaaaatag

SEQ ID NO: 157711 - DNA, 20 bp, Artificial
  CRISPR gRNA sequence
caaacgggggaaaaaatagg

SEQ ID NO: 157712 - DNA, 20 bp, Artificial
  CRISPR gRNA sequence
aagcttaaaaaataatatgc

SEQ ID NO: 157713 - DNA, 20 bp, Artificial
  CRISPR gRNA sequence
agcttaaaaaataatatgcc

SEQ ID NO: 157714 - DNA, 20 bp, Artificial
  CRISPR gRNA sequence
aaaaaataatatgcccccta

SEQ ID NO: 157715 - DNA, 20 bp, Artificial
  CRISPR gRNA sequence
aaaaataatatgccccctaa

SEQ ID NO: 157716 - DNA, 20 bp, Artificial
  CRISPR gRNA sequence
aaaaaagagaacatgttaca

SEQ ID NO: 157717 - DNA, 20 bp, Artificial
  CRISPR gRNA sequence
cacaagtctgaagcaagtga

SEQ ID NO: 157718 - DNA, 20 bp, Artificial
  CRISPR gRNA sequence
aagcaagtgaatatgctaat

SEQ ID NO: 157719 - DNA, 20 bp, Artificial
  CRISPR gRNA sequence
attagagaaatagatttgat

SEQ ID NO: 157720 - DNA, 20 bp, Artificial
  CRISPR gRNA sequence
gagaaatagatttgattgtg

SEQ ID NO: 157721 - DNA, 20 bp, Artificial
  CRISPR gRNA sequence
gattgtgtgccaggaatggt

SEQ ID NO: 157722 - DNA, 20 bp, Artificial
  CRISPR gRNA sequence
attgtgtgccaggaatggtt

SEQ ID NO: 157723 - DNA, 20 bp, Artificial
  CRISPR gRNA sequence
tgtgccaggaatggtttctt

SEQ ID NO: 157724 - DNA, 20 bp, Artificial
  CRISPR gRNA sequence
cttggggagaaaaaaaattt

SEQ ID NO: 157725 - DNA, 20 bp, Artificial
  CRISPR gRNA sequence
ttggggagaaaaaaaattta

SEQ ID NO: 157726 - DNA, 20 bp, Artificial
  CRISPR gRNA sequence
ggggagaaaaaaaatttatc

SEQ ID NO: 157727 - DNA, 20 bp, Artificial
  CRISPR gRNA sequence
gggagaaaaaaaatttatca

SEQ ID NO: 157728 - DNA, 20 bp, Artificial
  CRISPR gRNA sequence
atcatcactgattagtgaat

SEQ ID NO: 157729 - DNA, 20 bp, Artificial
  CRISPR gRNA sequence
tcatcactgattagtgaatg

SEQ ID NO: 157730 - DNA, 20 bp, Artificial
  CRISPR gRNA sequence
attagtgaatgtgtagacag

SEQ ID NO: 157731 - DNA, 20 bp, Artificial
  CRISPR gRNA sequence
gtgaatgtgtagacagtgtt

SEQ ID NO: 157732 - DNA, 20 bp, Artificial
  CRISPR gRNA sequence
aatttctttacatttgtact

SEQ ID NO: 157733 - DNA, 20 bp, Artificial
  CRISPR gRNA sequence
atttctttacatttgtactg

SEQ ID NO: 157734 - DNA, 20 bp, Artificial
  CRISPR gRNA sequence
ctttacatttgtactgtaaa

SEQ ID NO: 157735 - DNA, 20 bp, Artificial
  CRISPR gRNA sequence
tttacatttgtactgtaaag

SEQ ID NO: 157736 - DNA, 20 bp, Artificial
  CRISPR gRNA sequence
tacatttgtactgtaaaggc

SEQ ID NO: 157737 - DNA, 20 bp, Artificial
  CRISPR gRNA sequence
acatttgtactgtaaaggca

SEQ ID NO: 157738 - DNA, 20 bp, Artificial
  CRISPR gRNA sequence
catttgtactgtaaaggcaa

SEQ ID NO: 157739 - DNA, 20 bp, Artificial
  CRISPR gRNA sequence
gtactgtaaaggcaagcttc

SEQ ID NO: 157740 - DNA, 20 bp, Artificial
  CRISPR gRNA sequence
tactgtaaaggcaagcttct

SEQ ID NO: 157741 - DNA, 20 bp, Artificial
  CRISPR gRNA sequence
taaaggcaagcttcttatca

SEQ ID NO: 157742 - DNA, 20 bp, Artificial
  CRISPR gRNA sequence
cttatcaatgctattgcaga

SEQ ID NO: 157743 - DNA, 20 bp, Artificial
  CRISPR gRNA sequence
ttatcaatgctattgcagaa

SEQ ID NO: 157744 - DNA, 20 bp, Artificial
  CRISPR gRNA sequence
atcaatgctattgcagaaga

SEQ ID NO: 157745 - DNA, 20 bp, Artificial
  CRISPR gRNA sequence
tcaatgctattgcagaagag

SEQ ID NO: 157746 - DNA, 20 bp, Artificial
  CRISPR gRNA sequence
ttgcagaagagccttaaaca

SEQ ID NO: 157747 - DNA, 20 bp, Artificial
  CRISPR gRNA sequence
cagaagagccttaaacattg

SEQ ID NO: 157748 - DNA, 20 bp, Artificial
  CRISPR gRNA sequence
aaacattggtttcaacccat

SEQ ID NO: 157749 - DNA, 20 bp, Artificial
  CRISPR gRNA sequence
aacattggtttcaacccatg

SEQ ID NO: 157750 - DNA, 20 bp, Artificial
  CRISPR gRNA sequence
gtttcaacccatgagatagt

SEQ ID NO: 157751 - DNA, 20 bp, Artificial
  CRISPR gRNA sequence
caacccatgagatagtctga

SEQ ID NO: 157752 - DNA, 20 bp, Artificial
  CRISPR gRNA sequence
aacccatgagatagtctgag

SEQ ID NO: 157753 - DNA, 20 bp, Artificial
  CRISPR gRNA sequence
agaaattccaactttccaga

SEQ ID NO: 157754 - DNA, 20 bp, Artificial
  CRISPR gRNA sequence
caactttccagaacatgttt

SEQ ID NO: 157755 - DNA, 20 bp, Artificial
  CRISPR gRNA sequence
tccagaacatgtttccttca

SEQ ID NO: 157756 - DNA, 20 bp, Artificial
  CRISPR gRNA sequence
ccagaacatgtttccttcat

SEQ ID NO: 157757 - DNA, 20 bp, Artificial
  CRISPR gRNA sequence
cagaacatgtttccttcatg

SEQ ID NO: 157758 - DNA, 20 bp, Artificial
  CRISPR gRNA sequence
ccttcatgttcacttcagga

SEQ ID NO: 157759 - DNA, 20 bp, Artificial
  CRISPR gRNA sequence
cttcatgttcacttcaggat

SEQ ID NO: 157760 - DNA, 20 bp, Artificial
  CRISPR gRNA sequence
catgttcacttcaggatgtt

SEQ ID NO: 157761 - DNA, 20 bp, Artificial
  CRISPR gRNA sequence
atgttcacttcaggatgttg

SEQ ID NO: 157762 - DNA, 20 bp, Artificial
  CRISPR gRNA sequence
acttcaggatgttggatata

SEQ ID NO: 157763 - DNA, 20 bp, Artificial
  CRISPR gRNA sequence
caggatgttggatatagatg

SEQ ID NO: 157764 - DNA, 20 bp, Artificial
  CRISPR gRNA sequence
aggatgttggatatagatgg

SEQ ID NO: 157765 - DNA, 20 bp, Artificial
  CRISPR gRNA sequence
gatatagatggaagtgggtg

SEQ ID NO: 157766 - DNA, 20 bp, Artificial
  CRISPR gRNA sequence
tctttagagctccaaacaga

SEQ ID NO: 157767 - DNA, 20 bp, Artificial
  CRISPR gRNA sequence
tttagagctccaaacagaat

SEQ ID NO: 157768 - DNA, 20 bp, Artificial
  CRISPR gRNA sequence
tagagctccaaacagaatct

SEQ ID NO: 157769 - DNA, 20 bp, Artificial
  CRISPR gRNA sequence
agagctccaaacagaatctt

SEQ ID NO: 157770 - DNA, 20 bp, Artificial
  CRISPR gRNA sequence
gagctccaaacagaatcttt

SEQ ID NO: 157771 - DNA, 20 bp, Artificial
  CRISPR gRNA sequence
caaacagaatcttttgcttg

SEQ ID NO: 157772 - DNA, 20 bp, Artificial
  CRISPR gRNA sequence
ttgcttggatggtggggcca

SEQ ID NO: 157773 - DNA, 20 bp, Artificial
  CRISPR gRNA sequence
tgcttggatggtggggccag

SEQ ID NO: 157774 - DNA, 20 bp, Artificial
  CRISPR gRNA sequence
gcttggatggtggggccagg

SEQ ID NO: 157775 - DNA, 20 bp, Artificial
  CRISPR gRNA sequence
cttggatggtggggccaggt

SEQ ID NO: 157776 - DNA, 20 bp, Artificial
  CRISPR gRNA sequence
ggatggtggggccaggttga

SEQ ID NO: 157777 - DNA, 20 bp, Artificial
  CRISPR gRNA sequence
gatggtggggccaggttgag

SEQ ID NO: 157778 - DNA, 20 bp, Artificial
  CRISPR gRNA sequence
agtggggagctgcctggact

SEQ ID NO: 157779 - DNA, 20 bp, Artificial
  CRISPR gRNA sequence
cctggactccaggtttcctc

SEQ ID NO: 157780 - DNA, 20 bp, Artificial
  CRISPR gRNA sequence
gactccaggtttcctctacc

SEQ ID NO: 157781 - DNA, 20 bp, Artificial
  CRISPR gRNA sequence
caggtttcctctaccctcta

SEQ ID NO: 157782 - DNA, 20 bp, Artificial
  CRISPR gRNA sequence
cctctaccctctaacataaa

SEQ ID NO: 157783 - DNA, 20 bp, Artificial
  CRISPR gRNA sequence
ctctaccctctaacataaac

SEQ ID NO: 157784 - DNA, 20 bp, Artificial
  CRISPR gRNA sequence
taccctctaacataaacaag

SEQ ID NO: 157785 - DNA, 20 bp, Artificial
  CRISPR gRNA sequence
ccctctaacataaacaagat

SEQ ID NO: 157786 - DNA, 20 bp, Artificial
  CRISPR gRNA sequence
taacataaacaagattcctt

SEQ ID NO: 157787 - DNA, 20 bp, Artificial
  CRISPR gRNA sequence
acataaacaagattcctttc

SEQ ID NO: 157788 - DNA, 20 bp, Artificial
  CRISPR gRNA sequence
ctttcacaagacaaaacagg

SEQ ID NO: 157789 - DNA, 20 bp, Artificial
  CRISPR gRNA sequence
tcacaagacaaaacaggcac

SEQ ID NO: 157790 - DNA, 20 bp, Artificial
  CRISPR gRNA sequence
cacaagacaaaacaggcacg

SEQ ID NO: 157791 - DNA, 20 bp, Artificial
  CRISPR gRNA sequence
acaagacaaaacaggcacgt

SEQ ID NO: 157792 - DNA, 20 bp, Artificial
  CRISPR gRNA sequence
ctagcttgtggaagtcttag

SEQ ID NO: 157793 - DNA, 20 bp, Artificial
  CRISPR gRNA sequence
gcttgtggaagtcttaggta

SEQ ID NO: 157794 - DNA, 20 bp, Artificial
  CRISPR gRNA sequence
gtggaagtcttaggtatcca

SEQ ID NO: 157795 - DNA, 20 bp, Artificial
  CRISPR gRNA sequence
tggaagtcttaggtatccaa

SEQ ID NO: 157796 - DNA, 20 bp, Artificial
  CRISPR gRNA sequence
aggtatccaaggagatggtg

SEQ ID NO: 157797 - DNA, 20 bp, Artificial
  CRISPR gRNA sequence
ggtatccaaggagatggtgg

SEQ ID NO: 157798 - DNA, 20 bp, Artificial
  CRISPR gRNA sequence
tgggtttttttggggttttt

SEQ ID NO: 157799 - DNA, 20 bp, Artificial
  CRISPR gRNA sequence
ttttggggtttttttttgat

SEQ ID NO: 157800 - DNA, 20 bp, Artificial
  CRISPR gRNA sequence
tttggggtttttttttgata

SEQ ID NO: 157801 - DNA, 20 bp, Artificial
  CRISPR gRNA sequence
ttggggtttttttttgatac

SEQ ID NO: 157802 - DNA, 20 bp, Artificial
  CRISPR gRNA sequence
tggggtttttttttgataca

SEQ ID NO: 157803 - DNA, 20 bp, Artificial
  CRISPR gRNA sequence
ggggtttttttttgatacag

SEQ ID NO: 157804 - DNA, 20 bp, Artificial
  CRISPR gRNA sequence
gggtttttttttgatacagg

SEQ ID NO: 157805 - DNA, 20 bp, Artificial
  CRISPR gRNA sequence
ttttttgatacagggtctca

SEQ ID NO: 157806 - DNA, 20 bp, Artificial
  CRISPR gRNA sequence
tttttgatacagggtctcac

SEQ ID NO: 157807 - DNA, 20 bp, Artificial
  CRISPR gRNA sequence
ttttgatacagggtctcact

SEQ ID NO: 157808 - DNA, 20 bp, Artificial
  CRISPR gRNA sequence
tttgatacagggtctcactc

SEQ ID NO: 157809 - DNA, 20 bp, Artificial
  CRISPR gRNA sequence
ttgatacagggtctcactct

SEQ ID NO: 157810 - DNA, 20 bp, Artificial
  CRISPR gRNA sequence
tgatacagggtctcactctg

SEQ ID NO: 157811 - DNA, 20 bp, Artificial
  CRISPR gRNA sequence
gatacagggtctcactctgt

SEQ ID NO: 157812 - DNA, 20 bp, Artificial
  CRISPR gRNA sequence
atacagggtctcactctgtt

SEQ ID NO: 157813 - DNA, 20 bp, Artificial
  CRISPR gRNA sequence
actctgttgccaggctgaag

SEQ ID NO: 157814 - DNA, 20 bp, Artificial
  CRISPR gRNA sequence
tgttgccaggctgaagtgca

SEQ ID NO: 157815 - DNA, 20 bp, Artificial
  CRISPR gRNA sequence
ttgccaggctgaagtgcagt

SEQ ID NO: 157816 - DNA, 20 bp, Artificial
  CRISPR gRNA sequence
ccaggctgaagtgcagtagt

SEQ ID NO: 157817 - DNA, 20 bp, Artificial
  CRISPR gRNA sequence
aagtgcagtagtgcaatcat

SEQ ID NO: 157818 - DNA, 20 bp, Artificial
  CRISPR gRNA sequence
attgcagtctcccagctcct

SEQ ID NO: 157819 - DNA, 20 bp, Artificial
  CRISPR gRNA sequence
cagtctcccagctcctcggc

SEQ ID NO: 157820 - DNA, 20 bp, Artificial
  CRISPR gRNA sequence
ccagctcctcggctcaagtg

SEQ ID NO: 157821 - DNA, 20 bp, Artificial
  CRISPR gRNA sequence
ctcggctcaagtgatcctcc

SEQ ID NO: 157822 - DNA, 20 bp, Artificial
  CRISPR gRNA sequence
ggctcaagtgatcctcctgc

SEQ ID NO: 157823 - DNA, 20 bp, Artificial
  CRISPR gRNA sequence
aagtgatcctcctgccccag

SEQ ID NO: 157824 - DNA, 20 bp, Artificial
  CRISPR gRNA sequence
ctgccccagcctcctgagta

SEQ ID NO: 157825 - DNA, 20 bp, Artificial
  CRISPR gRNA sequence
ccccagcctcctgagtagcg

SEQ ID NO: 157826 - DNA, 20 bp, Artificial
  CRISPR gRNA sequence
ctgagtagcgggagctacag

SEQ ID NO: 157827 - DNA, 20 bp, Artificial
  CRISPR gRNA sequence
agtagcgggagctacaggtg

SEQ ID NO: 157828 - DNA, 20 bp, Artificial
  CRISPR gRNA sequence
caggtgcgtgccaccacaca

SEQ ID NO: 157829 - DNA, 20 bp, Artificial
  CRISPR gRNA sequence
atttttttttcttttttgta

SEQ ID NO: 157830 - DNA, 20 bp, Artificial
  CRISPR gRNA sequence
ttttttcttttttgtagaga

SEQ ID NO: 157831 - DNA, 20 bp, Artificial
  CRISPR gRNA sequence
tttttcttttttgtagagac

SEQ ID NO: 157832 - DNA, 20 bp, Artificial
  CRISPR gRNA sequence
ttttcttttttgtagagacg

SEQ ID NO: 157833 - DNA, 20 bp, Artificial
  CRISPR gRNA sequence
tttcttttttgtagagacga

SEQ ID NO: 157834 - DNA, 20 bp, Artificial
  CRISPR gRNA sequence
ttcttttttgtagagacgag

SEQ ID NO: 157835 - DNA, 20 bp, Artificial
  CRISPR gRNA sequence
tcttttttgtagagacgagg

SEQ ID NO: 157836 - DNA, 20 bp, Artificial
  CRISPR gRNA sequence
cttttttgtagagacgaggt

SEQ ID NO: 157837 - DNA, 20 bp, Artificial
  CRISPR gRNA sequence
ttttttgtagagacgaggtc

SEQ ID NO: 157838 - DNA, 20 bp, Artificial
  CRISPR gRNA sequence
ttttgtagagacgaggtctt

SEQ ID NO: 157839 - DNA, 20 bp, Artificial
  CRISPR gRNA sequence
tttgtagagacgaggtcttt

SEQ ID NO: 157840 - DNA, 20 bp, Artificial
  CRISPR gRNA sequence
ttgtagagacgaggtctttc

SEQ ID NO: 157841 - DNA, 20 bp, Artificial
  CRISPR gRNA sequence
tgtagagacgaggtctttct

SEQ ID NO: 157842 - DNA, 20 bp, Artificial
  CRISPR gRNA sequence
gtagagacgaggtctttcta

SEQ ID NO: 157843 - DNA, 20 bp, Artificial
  CRISPR gRNA sequence
tagagacgaggtctttctat

SEQ ID NO: 157844 - DNA, 20 bp, Artificial
  CRISPR gRNA sequence
tctatgtttcccaggctgat

SEQ ID NO: 157845 - DNA, 20 bp, Artificial
  CRISPR gRNA sequence
ctatgtttcccaggctgatc

SEQ ID NO: 157846 - DNA, 20 bp, Artificial
  CRISPR gRNA sequence
tatgtttcccaggctgatct

SEQ ID NO: 157847 - DNA, 20 bp, Artificial
  CRISPR gRNA sequence
tgtttcccaggctgatcttg

SEQ ID NO: 157848 - DNA, 20 bp, Artificial
  CRISPR gRNA sequence
cccaggctgatcttgaactc

SEQ ID NO: 157849 - DNA, 20 bp, Artificial
  CRISPR gRNA sequence
ccaggctgatcttgaactcc

SEQ ID NO: 157850 - DNA, 20 bp, Artificial
  CRISPR gRNA sequence
atcttgaactcctgggctca

SEQ ID NO: 157851 - DNA, 20 bp, Artificial
  CRISPR gRNA sequence
gaactcctgggctcaagcga

SEQ ID NO: 157852 - DNA, 20 bp, Artificial
  CRISPR gRNA sequence
aactcctgggctcaagcgat

SEQ ID NO: 157853 - DNA, 20 bp, Artificial
  CRISPR gRNA sequence
ctgggctcaagcgatcctcc

SEQ ID NO: 157854 - DNA, 20 bp, Artificial
  CRISPR gRNA sequence
ggctcaagcgatcctcctgc

SEQ ID NO: 157855 - DNA, 20 bp, Artificial
  CRISPR gRNA sequence
aagcgatcctcctgctttgg

SEQ ID NO: 157856 - DNA, 20 bp, Artificial
  CRISPR gRNA sequence
ctgctttggcttcccaaagt

SEQ ID NO: 157857 - DNA, 20 bp, Artificial
  CRISPR gRNA sequence
ctttggcttcccaaagtgct

SEQ ID NO: 157858 - DNA, 20 bp, Artificial
  CRISPR gRNA sequence
tggcttcccaaagtgctgag

SEQ ID NO: 157859 - DNA, 20 bp, Artificial
  CRISPR gRNA sequence
ggcttcccaaagtgctgaga

SEQ ID NO: 157860 - DNA, 20 bp, Artificial
  CRISPR gRNA sequence
gcttcccaaagtgctgagat

SEQ ID NO: 157861 - DNA, 20 bp, Artificial
  CRISPR gRNA sequence
cccaaagtgctgagattaca

SEQ ID NO: 157862 - DNA, 20 bp, Artificial
  CRISPR gRNA sequence
ccaaagtgctgagattacag

SEQ ID NO: 157863 - DNA, 20 bp, Artificial
  CRISPR gRNA sequence
agattacaggcatgagccac

SEQ ID NO: 157864 - DNA, 20 bp, Artificial
  CRISPR gRNA sequence
caggcatgagccaccgttcc

SEQ ID NO: 157865 - DNA, 20 bp, Artificial
  CRISPR gRNA sequence
ccagcccaaggagacatatt

SEQ ID NO: 157866 - DNA, 20 bp, Artificial
  CRISPR gRNA sequence
taagaattgaaggccgggcg

SEQ ID NO: 157867 - DNA, 20 bp, Artificial
  CRISPR gRNA sequence
agaattgaaggccgggcgcg

SEQ ID NO: 157868 - DNA, 20 bp, Artificial
  CRISPR gRNA sequence
aaggccgggcgcggtggctc

SEQ ID NO: 157869 - DNA, 20 bp, Artificial
  CRISPR gRNA sequence
atgcctgtaatcccagcact

SEQ ID NO: 157870 - DNA, 20 bp, Artificial
  CRISPR gRNA sequence
taatcccagcactttgggag

SEQ ID NO: 157871 - DNA, 20 bp, Artificial
  CRISPR gRNA sequence
tgggaggccaaggtgggcgg

SEQ ID NO: 157872 - DNA, 20 bp, Artificial
  CRISPR gRNA sequence
gggaggccaaggtgggcgga

SEQ ID NO: 157873 - DNA, 20 bp, Artificial
  CRISPR gRNA sequence
ggaggccaaggtgggcggat

SEQ ID NO: 157874 - DNA, 20 bp, Artificial
  CRISPR gRNA sequence
gctaacacggtgaaaccctg

SEQ ID NO: 157875 - DNA, 20 bp, Artificial
  CRISPR gRNA sequence
acacggtgaaaccctgtctc

SEQ ID NO: 157876 - DNA, 20 bp, Artificial
  CRISPR gRNA sequence
tctctactaaaaatacaaaa

SEQ ID NO: 157877 - DNA, 20 bp, Artificial
  CRISPR gRNA sequence
tactaaaaatacaaaaaagt

SEQ ID NO: 157878 - DNA, 20 bp, Artificial
  CRISPR gRNA sequence
ctaaaaatacaaaaaagtta

SEQ ID NO: 157879 - DNA, 20 bp, Artificial
  CRISPR gRNA sequence
aaaatacaaaaaagttagcc

SEQ ID NO: 157880 - DNA, 20 bp, Artificial
  CRISPR gRNA sequence
gccaggcgtggtggtgggca

SEQ ID NO: 157881 - DNA, 20 bp, Artificial
  CRISPR gRNA sequence
tggtcccagctacttgggag

SEQ ID NO: 157882 - DNA, 20 bp, Artificial
  CRISPR gRNA sequence
cttgggaggctgaggcagga

SEQ ID NO: 157883 - DNA, 20 bp, Artificial
  CRISPR gRNA sequence
gggaggctgaggcaggagaa

SEQ ID NO: 157884 - DNA, 20 bp, Artificial
  CRISPR gRNA sequence
ggaggctgaggcaggagaat

SEQ ID NO: 157885 - DNA, 20 bp, Artificial
  CRISPR gRNA sequence
aggcaggagaatggtgtgga

SEQ ID NO: 157886 - DNA, 20 bp, Artificial
  CRISPR gRNA sequence
gcagtgagccaagatcatgc

SEQ ID NO: 157887 - DNA, 20 bp, Artificial
  CRISPR gRNA sequence
cagtgagccaagatcatgct

SEQ ID NO: 157888 - DNA, 20 bp, Artificial
  CRISPR gRNA sequence
ctgcattccagcctgggtga

SEQ ID NO: 157889 - DNA, 20 bp, Artificial
  CRISPR gRNA sequence
cattccagcctgggtgacag

SEQ ID NO: 157890 - DNA, 20 bp, Artificial
  CRISPR gRNA sequence
cagcctgggtgacagagtga

SEQ ID NO: 157891 - DNA, 20 bp, Artificial
  CRISPR gRNA sequence
ggtgacagagtgagattcca

SEQ ID NO: 157892 - DNA, 20 bp, Artificial
  CRISPR gRNA sequence
catcccaaaaaatatatata

SEQ ID NO: 157893 - DNA, 20 bp, Artificial
  CRISPR gRNA sequence
atttaaaaaaagaatttaaa

SEQ ID NO: 157894 - DNA, 20 bp, Artificial
  CRISPR gRNA sequence
aaaaaaagaatttaaatgtt

SEQ ID NO: 157895 - DNA, 20 bp, Artificial
  CRISPR gRNA sequence
aaaaaagaatttaaatgttt

SEQ ID NO: 157896 - DNA, 20 bp, Artificial
  CRISPR gRNA sequence
aaatgtttttggattagtgt

SEQ ID NO: 157897 - DNA, 20 bp, Artificial
  CRISPR gRNA sequence
aatgtttttggattagtgtg

SEQ ID NO: 157898 - DNA, 20 bp, Artificial
  CRISPR gRNA sequence
ttggattagtgtggagagaa

SEQ ID NO: 157899 - DNA, 20 bp, Artificial
  CRISPR gRNA sequence
tggattagtgtggagagaaa

SEQ ID NO: 157900 - DNA, 20 bp, Artificial
  CRISPR gRNA sequence
ggattagtgtggagagaaaa

SEQ ID NO: 157901 - DNA, 20 bp, Artificial
  CRISPR gRNA sequence
gattagtgtggagagaaaac

SEQ ID NO: 157902 - DNA, 20 bp, Artificial
  CRISPR gRNA sequence
gtgtggagagaaaacctagt

SEQ ID NO: 157903 - DNA, 20 bp, Artificial
  CRISPR gRNA sequence
gtatagctattgatcattga

SEQ ID NO: 157904 - DNA, 20 bp, Artificial
  CRISPR gRNA sequence
ttgatcattgacacacccaa

SEQ ID NO: 157905 - DNA, 20 bp, Artificial
  CRISPR gRNA sequence
atcattgacacacccaagga

SEQ ID NO: 157906 - DNA, 20 bp, Artificial
  CRISPR gRNA sequence
acacacccaaggatttaaat

SEQ ID NO: 157907 - DNA, 20 bp, Artificial
  CRISPR gRNA sequence
aaatttggaacgttcccatg

SEQ ID NO: 157908 - DNA, 20 bp, Artificial
  CRISPR gRNA sequence
aatttggaacgttcccatgt

SEQ ID NO: 157909 - DNA, 20 bp, Artificial
  CRISPR gRNA sequence
ggaacgttcccatgttcagc

SEQ ID NO: 157910 - DNA, 20 bp, Artificial
  CRISPR gRNA sequence
gaacgttcccatgttcagct

SEQ ID NO: 157911 - DNA, 20 bp, Artificial
  CRISPR gRNA sequence
ccatgttcagcttgaattct

SEQ ID NO: 157912 - DNA, 20 bp, Artificial
  CRISPR gRNA sequence
agcttgaattctttgctttt

SEQ ID NO: 157913 - DNA, 20 bp, Artificial
  CRISPR gRNA sequence
gaattctttgcttttttgga

SEQ ID NO: 157914 - DNA, 20 bp, Artificial
  CRISPR gRNA sequence
aattctttgcttttttggaa

SEQ ID NO: 157915 - DNA, 20 bp, Artificial
  CRISPR gRNA sequence
tttgcttttttggaactagt

SEQ ID NO: 157916 - DNA, 20 bp, Artificial
  CRISPR gRNA sequence
tgcttttttggaactagtac

SEQ ID NO: 157917 - DNA, 20 bp, Artificial
  CRISPR gRNA sequence
gcttttttggaactagtaca

SEQ ID NO: 157918 - DNA, 20 bp, Artificial
  CRISPR gRNA sequence
cttttttggaactagtacat

SEQ ID NO: 157919 - DNA, 20 bp, Artificial
  CRISPR gRNA sequence
ttttggaactagtacatttg

SEQ ID NO: 157920 - DNA, 20 bp, Artificial
  CRISPR gRNA sequence
tttggaactagtacatttgt

SEQ ID NO: 157921 - DNA, 20 bp, Artificial
  CRISPR gRNA sequence
ttggaactagtacatttgtt

SEQ ID NO: 157922 - DNA, 20 bp, Artificial
  CRISPR gRNA sequence
tggaactagtacatttgttc

SEQ ID NO: 157923 - DNA, 20 bp, Artificial
  CRISPR gRNA sequence
ggaactagtacatttgttcc

SEQ ID NO: 157924 - DNA, 20 bp, Artificial
  CRISPR gRNA sequence
gaactagtacatttgttcca

SEQ ID NO: 157925 - DNA, 20 bp, Artificial
  CRISPR gRNA sequence
gtacatttgttccaaattta

SEQ ID NO: 157926 - DNA, 20 bp, Artificial
  CRISPR gRNA sequence
gttccaaatttaatagttta

SEQ ID NO: 157927 - DNA, 20 bp, Artificial
  CRISPR gRNA sequence
ttccaaatttaatagtttaa

SEQ ID NO: 157928 - DNA, 20 bp, Artificial
  CRISPR gRNA sequence
caaatttaatagtttaaagg

SEQ ID NO: 157929 - DNA, 20 bp, Artificial
  CRISPR gRNA sequence
aatagtttaaagggcttaaa

SEQ ID NO: 157930 - DNA, 20 bp, Artificial
  CRISPR gRNA sequence
atagtttaaagggcttaaaa

SEQ ID NO: 157931 - DNA, 20 bp, Artificial
  CRISPR gRNA sequence
aaagggcttaaaaattattt

SEQ ID NO: 157932 - DNA, 20 bp, Artificial
  CRISPR gRNA sequence
aagggcttaaaaattatttc

SEQ ID NO: 157933 - DNA, 20 bp, Artificial
  CRISPR gRNA sequence
aaaaattatttcatgtttat

SEQ ID NO: 157934 - DNA, 20 bp, Artificial
  CRISPR gRNA sequence
aaaattatttcatgtttata

SEQ ID NO: 157935 - DNA, 20 bp, Artificial
  CRISPR gRNA sequence
tttcatgtttataaaagaga

SEQ ID NO: 157936 - DNA, 20 bp, Artificial
  CRISPR gRNA sequence
catgtttataaaagagatag

SEQ ID NO: 157937 - DNA, 20 bp, Artificial
  CRISPR gRNA sequence
atgtttataaaagagatagg

SEQ ID NO: 157938 - DNA, 20 bp, Artificial
  CRISPR gRNA sequence
ataaaagagataggagaaca

SEQ ID NO: 157939 - DNA, 20 bp, Artificial
  CRISPR gRNA sequence
taaaagagataggagaacat

SEQ ID NO: 157940 - DNA, 20 bp, Artificial
  CRISPR gRNA sequence
tctctattttaatatgtatt

SEQ ID NO: 157941 - DNA, 20 bp, Artificial
  CRISPR gRNA sequence
ctctattttaatatgtattt

SEQ ID NO: 157942 - DNA, 20 bp, Artificial
  CRISPR gRNA sequence
tctattttaatatgtatttc

SEQ ID NO: 157943 - DNA, 20 bp, Artificial
  CRISPR gRNA sequence
tattttaatatgtatttcca

SEQ ID NO: 157944 - DNA, 20 bp, Artificial
  CRISPR gRNA sequence
ttttaatatgtatttccatg

SEQ ID NO: 157945 - DNA, 20 bp, Artificial
  CRISPR gRNA sequence
taatatgtatttccatgcat

SEQ ID NO: 157946 - DNA, 20 bp, Artificial
  CRISPR gRNA sequence
aatatgtatttccatgcatc

SEQ ID NO: 157947 - DNA, 20 bp, Artificial
  CRISPR gRNA sequence
atatgtatttccatgcatct

SEQ ID NO: 157948 - DNA, 20 bp, Artificial
  CRISPR gRNA sequence
ccatgcatctgaaactaggc

SEQ ID NO: 157949 - DNA, 20 bp, Artificial
  CRISPR gRNA sequence
catgcatctgaaactaggct

SEQ ID NO: 157950 - DNA, 20 bp, Artificial
  CRISPR gRNA sequence
aaactaggctttttaaagaa

SEQ ID NO: 157951 - DNA, 20 bp, Artificial
  CRISPR gRNA sequence
ggctttttaaagaaatatgt

SEQ ID NO: 157952 - DNA, 20 bp, Artificial
  CRISPR gRNA sequence
tttaaagaaatatgtcaaaa

SEQ ID NO: 157953 - DNA, 20 bp, Artificial
  CRISPR gRNA sequence
ttaaagaaatatgtcaaaag

SEQ ID NO: 157954 - DNA, 20 bp, Artificial
  CRISPR gRNA sequence
taaagaaatatgtcaaaagc

SEQ ID NO: 157955 - DNA, 20 bp, Artificial
  CRISPR gRNA sequence
aaagaaatatgtcaaaagca

SEQ ID NO: 157956 - DNA, 20 bp, Artificial
  CRISPR gRNA sequence
aagaaatatgtcaaaagcaa

SEQ ID NO: 157957 - DNA, 20 bp, Artificial
  CRISPR gRNA sequence
aattatagagaaaaagaagc

SEQ ID NO: 157958 - DNA, 20 bp, Artificial
  CRISPR gRNA sequence
tagagaaaaagaagctagtt

SEQ ID NO: 157959 - DNA, 20 bp, Artificial
  CRISPR gRNA sequence
gttggtctttaggctcggta

SEQ ID NO: 157960 - DNA, 20 bp, Artificial
  CRISPR gRNA sequence
gtctttaggctcggtactgt

SEQ ID NO: 157961 - DNA, 20 bp, Artificial
  CRISPR gRNA sequence
taggctcggtactgtatctg

SEQ ID NO: 157962 - DNA, 20 bp, Artificial
  CRISPR gRNA sequence
aggctcggtactgtatctgg

SEQ ID NO: 157963 - DNA, 20 bp, Artificial
  CRISPR gRNA sequence
ggctcggtactgtatctggg

SEQ ID NO: 157964 - DNA, 20 bp, Artificial
  CRISPR gRNA sequence
ggtactgtatctgggactct

SEQ ID NO: 157965 - DNA, 20 bp, Artificial
  CRISPR gRNA sequence
tatctgggactcttcagacc

SEQ ID NO: 157966 - DNA, 20 bp, Artificial
  CRISPR gRNA sequence
ggactcttcagaccagtagt

SEQ ID NO: 157967 - DNA, 20 bp, Artificial
  CRISPR gRNA sequence
ttcagaccagtagttggtgt

SEQ ID NO: 157968 - DNA, 20 bp, Artificial
  CRISPR gRNA sequence
cagaccagtagttggtgtct

SEQ ID NO: 157969 - DNA, 20 bp, Artificial
  CRISPR gRNA sequence
agaccagtagttggtgtctt

SEQ ID NO: 157970 - DNA, 20 bp, Artificial
  CRISPR gRNA sequence
gtgtcttgtctagcttcagg

SEQ ID NO: 157971 - DNA, 20 bp, Artificial
  CRISPR gRNA sequence
gtctagcttcaggcagccat

SEQ ID NO: 157972 - DNA, 20 bp, Artificial
  CRISPR gRNA sequence
tctagcttcaggcagccatg

SEQ ID NO: 157973 - DNA, 20 bp, Artificial
  CRISPR gRNA sequence
gcttcaggcagccatgatga

SEQ ID NO: 157974 - DNA, 20 bp, Artificial
  CRISPR gRNA sequence
caggcagccatgatgatatg

SEQ ID NO: 157975 - DNA, 20 bp, Artificial
  CRISPR gRNA sequence
aggcagccatgatgatatga

SEQ ID NO: 157976 - DNA, 20 bp, Artificial
  CRISPR gRNA sequence
gcatttgtatgaagcttgct

SEQ ID NO: 157977 - DNA, 20 bp, Artificial
  CRISPR gRNA sequence
gtatgaagcttgctattttt

SEQ ID NO: 157978 - DNA, 20 bp, Artificial
  CRISPR gRNA sequence
tatgaagcttgctatttttt

SEQ ID NO: 157979 - DNA, 20 bp, Artificial
  CRISPR gRNA sequence
gctattttttgaggccttct

SEQ ID NO: 157980 - DNA, 20 bp, Artificial
  CRISPR gRNA sequence
ctattttttgaggccttcta

SEQ ID NO: 157981 - DNA, 20 bp, Artificial
  CRISPR gRNA sequence
ttttttgaggccttctaaca

SEQ ID NO: 157982 - DNA, 20 bp, Artificial
  CRISPR gRNA sequence
tttgaggccttctaacatgt

SEQ ID NO: 157983 - DNA, 20 bp, Artificial
  CRISPR gRNA sequence
ttgaggccttctaacatgtg

SEQ ID NO: 157984 - DNA, 20 bp, Artificial
  CRISPR gRNA sequence
tgaggccttctaacatgtgt

SEQ ID NO: 157985 - DNA, 20 bp, Artificial
  CRISPR gRNA sequence
gaggccttctaacatgtgtt

SEQ ID NO: 157986 - DNA, 20 bp, Artificial
  CRISPR gRNA sequence
aggccttctaacatgtgttt

SEQ ID NO: 157987 - DNA, 20 bp, Artificial
  CRISPR gRNA sequence
ctaacatgtgttttaccatt

SEQ ID NO: 157988 - DNA, 20 bp, Artificial
  CRISPR gRNA sequence
taacatgtgttttaccattt

SEQ ID NO: 157989 - DNA, 20 bp, Artificial
  CRISPR gRNA sequence
acatgtgttttaccatttgt

SEQ ID NO: 157990 - DNA, 20 bp, Artificial
  CRISPR gRNA sequence
taccatttgtgtgtttcagc

SEQ ID NO: 157991 - DNA, 20 bp, Artificial
  CRISPR gRNA sequence
accatttgtgtgtttcagct

SEQ ID NO: 157992 - DNA, 20 bp, Artificial
  CRISPR gRNA sequence
ccatttgtgtgtttcagctg

SEQ ID NO: 157993 - DNA, 20 bp, Artificial
  CRISPR gRNA sequence
gtgtgtttcagctgctctgt

SEQ ID NO: 157994 - DNA, 20 bp, Artificial
  CRISPR gRNA sequence
tgtgtttcagctgctctgtg

SEQ ID NO: 157995 - DNA, 20 bp, Artificial
  CRISPR gRNA sequence
cagctgctctgtgggatgtt

SEQ ID NO: 157996 - DNA, 20 bp, Artificial
  CRISPR gRNA sequence
agctgctctgtgggatgttg

SEQ ID NO: 157997 - DNA, 20 bp, Artificial
  CRISPR gRNA sequence
ctctgtgggatgttgcttta

SEQ ID NO: 157998 - DNA, 20 bp, Artificial
  CRISPR gRNA sequence
tgtgggatgttgctttagat

SEQ ID NO: 157999 - DNA, 20 bp, Artificial
  CRISPR gRNA sequence
tgggatgttgctttagatga

SEQ ID NO: 158000 - DNA, 20 bp, Artificial
  CRISPR gRNA sequence
ctttagatgaatagagaagt

SEQ ID NO: 158001 - DNA, 20 bp, Artificial
  CRISPR gRNA sequence
tagatgaatagagaagtttc

SEQ ID NO: 158002 - DNA, 20 bp, Artificial
  CRISPR gRNA sequence
agatgaatagagaagtttct

SEQ ID NO: 158003 - DNA, 20 bp, Artificial
  CRISPR gRNA sequence
gatgaatagagaagtttcta

SEQ ID NO: 158004 - DNA, 20 bp, Artificial
  CRISPR gRNA sequence
ctaagaagttaagagatttg

SEQ ID NO: 158005 - DNA, 20 bp, Artificial
  CRISPR gRNA sequence
taagaagttaagagatttgc

SEQ ID NO: 158006 - DNA, 20 bp, Artificial
  CRISPR gRNA sequence
agaagttaagagatttgctc

SEQ ID NO: 158007 - DNA, 20 bp, Artificial
  CRISPR gRNA sequence
agagatttgctcaagatcac

SEQ ID NO: 158008 - DNA, 20 bp, Artificial
  CRISPR gRNA sequence
gctcaagatcacagttcgcc

SEQ ID NO: 158009 - DNA, 20 bp, Artificial
  CRISPR gRNA sequence
ctcaagatcacagttcgcca

SEQ ID NO: 158010 - DNA, 20 bp, Artificial
  CRISPR gRNA sequence
aagatcacagttcgccagag

SEQ ID NO: 158011 - DNA, 20 bp, Artificial
  CRISPR gRNA sequence
gccagagagctaagaacccc

SEQ ID NO: 158012 - DNA, 20 bp, Artificial
  CRISPR gRNA sequence
agaacccccaggtccaatac

SEQ ID NO: 158013 - DNA, 20 bp, Artificial
  CRISPR gRNA sequence
tatttatttatgtatttacc

SEQ ID NO: 158014 - DNA, 20 bp, Artificial
  CRISPR gRNA sequence
atttatttatgtatttacct

SEQ ID NO: 158015 - DNA, 20 bp, Artificial
  CRISPR gRNA sequence
tttatttatgtatttacctc

SEQ ID NO: 158016 - DNA, 20 bp, Artificial
  CRISPR gRNA sequence
atttatgtatttacctcgtg

SEQ ID NO: 158017 - DNA, 20 bp, Artificial
  CRISPR gRNA sequence
tttatgtatttacctcgtgc

SEQ ID NO: 158018 - DNA, 20 bp, Artificial
  CRISPR gRNA sequence
atgtatttacctcgtgcttt

SEQ ID NO: 158019 - DNA, 20 bp, Artificial
  CRISPR gRNA sequence
tgtatttacctcgtgcttta

SEQ ID NO: 158020 - DNA, 20 bp, Artificial
  CRISPR gRNA sequence
acctcgtgctttagtgcccc

SEQ ID NO: 158021 - DNA, 20 bp, Artificial
  CRISPR gRNA sequence
cctcgtgctttagtgccccc

SEQ ID NO: 158022 - DNA, 20 bp, Artificial
  CRISPR gRNA sequence
gtgctttagtgcccccaact

SEQ ID NO: 158023 - DNA, 20 bp, Artificial
  CRISPR gRNA sequence
tagtgcccccaactgttcgc

SEQ ID NO: 158024 - DNA, 20 bp, Artificial
  CRISPR gRNA sequence
agtgcccccaactgttcgca

SEQ ID NO: 158025 - DNA, 20 bp, Artificial
  CRISPR gRNA sequence
gtgcccccaactgttcgcag

SEQ ID NO: 158026 - DNA, 20 bp, Artificial
  CRISPR gRNA sequence
ttcgcagctgagtattcata

SEQ ID NO: 158027 - DNA, 20 bp, Artificial
  CRISPR gRNA sequence
gcagctgagtattcataggt

SEQ ID NO: 158028 - DNA, 20 bp, Artificial
  CRISPR gRNA sequence
agtattcataggtgctgcta

SEQ ID NO: 158029 - DNA, 20 bp, Artificial
  CRISPR gRNA sequence
ataggtgctgctaacctgcc

SEQ ID NO: 158030 - DNA, 20 bp, Artificial
  CRISPR gRNA sequence
ctaacctgcctagagacatg

SEQ ID NO: 158031 - DNA, 20 bp, Artificial
  CRISPR gRNA sequence
acctgcctagagacatgcaa

SEQ ID NO: 158032 - DNA, 20 bp, Artificial
  CRISPR gRNA sequence
cctagagacatgcaaagggg

SEQ ID NO: 158033 - DNA, 20 bp, Artificial
  CRISPR gRNA sequence
gagacatgcaaaggggaagg

SEQ ID NO: 158034 - DNA, 20 bp, Artificial
  CRISPR gRNA sequence
aaacagtgcaaaaagtggga

SEQ ID NO: 158035 - DNA, 20 bp, Artificial
  CRISPR gRNA sequence
aacagtgcaaaaagtgggaa

SEQ ID NO: 158036 - DNA, 20 bp, Artificial
  CRISPR gRNA sequence
taataaatcaagacagaatt

SEQ ID NO: 158037 - DNA, 20 bp, Artificial
  CRISPR gRNA sequence
tagagcttttgcattttgac

SEQ ID NO: 158038 - DNA, 20 bp, Artificial
  CRISPR gRNA sequence
agagcttttgcattttgact

SEQ ID NO: 158039 - DNA, 20 bp, Artificial
  CRISPR gRNA sequence
gagcttttgcattttgactc

SEQ ID NO: 158040 - DNA, 20 bp, Artificial
  CRISPR gRNA sequence
ttgcattttgactcatcatt

SEQ ID NO: 158041 - DNA, 20 bp, Artificial
  CRISPR gRNA sequence
tgcattttgactcatcattt

SEQ ID NO: 158042 - DNA, 20 bp, Artificial
  CRISPR gRNA sequence
gcattttgactcatcattta

SEQ ID NO: 158043 - DNA, 20 bp, Artificial
  CRISPR gRNA sequence
cattttgactcatcatttat

SEQ ID NO: 158044 - DNA, 20 bp, Artificial
  CRISPR gRNA sequence
tgactcatcatttattgtat

SEQ ID NO: 158045 - DNA, 20 bp, Artificial
  CRISPR gRNA sequence
gactcatcatttattgtatt

SEQ ID NO: 158046 - DNA, 20 bp, Artificial
  CRISPR gRNA sequence
actcatcatttattgtattg

SEQ ID NO: 158047 - DNA, 20 bp, Artificial
  CRISPR gRNA sequence
atcatttattgtattgtgat

SEQ ID NO: 158048 - DNA, 20 bp, Artificial
  CRISPR gRNA sequence
attgtattgtgatcttgagc

SEQ ID NO: 158049 - DNA, 20 bp, Artificial
  CRISPR gRNA sequence
ttgtattgtgatcttgagca

SEQ ID NO: 158050 - DNA, 20 bp, Artificial
  CRISPR gRNA sequence
tattgtgatcttgagcaagt

SEQ ID NO: 158051 - DNA, 20 bp, Artificial
  CRISPR gRNA sequence
tgatcttgagcaagtaattt

SEQ ID NO: 158052 - DNA, 20 bp, Artificial
  CRISPR gRNA sequence
gagcaagtaatttgatattc

SEQ ID NO: 158053 - DNA, 20 bp, Artificial
  CRISPR gRNA sequence
agcaagtaatttgatattca

SEQ ID NO: 158054 - DNA, 20 bp, Artificial
  CRISPR gRNA sequence
gatattcaaccctcaacctt

SEQ ID NO: 158055 - DNA, 20 bp, Artificial
  CRISPR gRNA sequence
atattcaaccctcaacctta

SEQ ID NO: 158056 - DNA, 20 bp, Artificial
  CRISPR gRNA sequence
aaccctcaaccttatctgta

SEQ ID NO: 158057 - DNA, 20 bp, Artificial
  CRISPR gRNA sequence
aaccttatctgtaaaattgg

SEQ ID NO: 158058 - DNA, 20 bp, Artificial
  CRISPR gRNA sequence
atctgtaaaattggaataat

SEQ ID NO: 158059 - DNA, 20 bp, Artificial
  CRISPR gRNA sequence
tctgtaaaattggaataata

SEQ ID NO: 158060 - DNA, 20 bp, Artificial
  CRISPR gRNA sequence
taaaattggaataatattgg

SEQ ID NO: 158061 - DNA, 20 bp, Artificial
  CRISPR gRNA sequence
gaataatattggtaaattta

SEQ ID NO: 158062 - DNA, 20 bp, Artificial
  CRISPR gRNA sequence
gtaaatttatcactgagcta

SEQ ID NO: 158063 - DNA, 20 bp, Artificial
  CRISPR gRNA sequence
atcactgagctaagtaaggg

SEQ ID NO: 158064 - DNA, 20 bp, Artificial
  CRISPR gRNA sequence
tcactgagctaagtaagggt

SEQ ID NO: 158065 - DNA, 20 bp, Artificial
  CRISPR gRNA sequence
agctaagtaagggtcaattg

SEQ ID NO: 158066 - DNA, 20 bp, Artificial
  CRISPR gRNA sequence
agtaagggtcaattgaggat

SEQ ID NO: 158067 - DNA, 20 bp, Artificial
  CRISPR gRNA sequence
aggatgatgtatgtggcatg

SEQ ID NO: 158068 - DNA, 20 bp, Artificial
  CRISPR gRNA sequence
tatgaactctgaagcccgta

SEQ ID NO: 158069 - DNA, 20 bp, Artificial
  CRISPR gRNA sequence
atgaactctgaagcccgtaa

SEQ ID NO: 158070 - DNA, 20 bp, Artificial
  CRISPR gRNA sequence
tgaactctgaagcccgtaag

SEQ ID NO: 158071 - DNA, 20 bp, Artificial
  CRISPR gRNA sequence
tgaagcccgtaagttggcat

SEQ ID NO: 158072 - DNA, 20 bp, Artificial
  CRISPR gRNA sequence
aagcccgtaagttggcatct

SEQ ID NO: 158073 - DNA, 20 bp, Artificial
  CRISPR gRNA sequence
gcatctatgaaacattcttc

SEQ ID NO: 158074 - DNA, 20 bp, Artificial
  CRISPR gRNA sequence
tgaaacattcttcagaatca

SEQ ID NO: 158075 - DNA, 20 bp, Artificial
  CRISPR gRNA sequence
ttcagaatcacacttcttcc

SEQ ID NO: 158076 - DNA, 20 bp, Artificial
  CRISPR gRNA sequence
cagaatcacacttcttccct

SEQ ID NO: 158077 - DNA, 20 bp, Artificial
  CRISPR gRNA sequence
agaatcacacttcttccctc

SEQ ID NO: 158078 - DNA, 20 bp, Artificial
  CRISPR gRNA sequence
cttccctctgctagacacac

SEQ ID NO: 158079 - DNA, 20 bp, Artificial
  CRISPR gRNA sequence
ttccctctgctagacacaca

SEQ ID NO: 158080 - DNA, 20 bp, Artificial
  CRISPR gRNA sequence
ccctctgctagacacacaaa

SEQ ID NO: 158081 - DNA, 20 bp, Artificial
  CRISPR gRNA sequence
cctctgctagacacacaaac

SEQ ID NO: 158082 - DNA, 20 bp, Artificial
  CRISPR gRNA sequence
tgctagacacacaaacacag

SEQ ID NO: 158083 - DNA, 20 bp, Artificial
  CRISPR gRNA sequence
ctagacacacaaacacagga

SEQ ID NO: 158084 - DNA, 20 bp, Artificial
  CRISPR gRNA sequence
gacacacaaacacaggatac

SEQ ID NO: 158085 - DNA, 20 bp, Artificial
  CRISPR gRNA sequence
ccagaaactgggcaagaggc

SEQ ID NO: 158086 - DNA, 20 bp, Artificial
  CRISPR gRNA sequence
ggcaagaggctgtttgtgaa

SEQ ID NO: 158087 - DNA, 20 bp, Artificial
  CRISPR gRNA sequence
tttgtgaatctcagaaggca

SEQ ID NO: 158088 - DNA, 20 bp, Artificial
  CRISPR gRNA sequence
gtgaatctcagaaggcaccc

SEQ ID NO: 158089 - DNA, 20 bp, Artificial
  CRISPR gRNA sequence
tgaatctcagaaggcacccg

SEQ ID NO: 158090 - DNA, 20 bp, Artificial
  CRISPR gRNA sequence
agaaggcacccggtaagaaa

SEQ ID NO: 158091 - DNA, 20 bp, Artificial
  CRISPR gRNA sequence
tgttttagaatacaacttaa

SEQ ID NO: 158092 - DNA, 20 bp, Artificial
  CRISPR gRNA sequence
gttttagaatacaacttaac

SEQ ID NO: 158093 - DNA, 20 bp, Artificial
  CRISPR gRNA sequence
ttttagaatacaacttaact

SEQ ID NO: 158094 - DNA, 20 bp, Artificial
  CRISPR gRNA sequence
tagaatacaacttaacttag

SEQ ID NO: 158095 - DNA, 20 bp, Artificial
  CRISPR gRNA sequence
agaatacaacttaacttagg

SEQ ID NO: 158096 - DNA, 20 bp, Artificial
  CRISPR gRNA sequence
gaatacaacttaacttaggc

SEQ ID NO: 158097 - DNA, 20 bp, Artificial
  CRISPR gRNA sequence
aacttaggctacaggcactc

SEQ ID NO: 158098 - DNA, 20 bp, Artificial
  CRISPR gRNA sequence
acttaggctacaggcactct

SEQ ID NO: 158099 - DNA, 20 bp, Artificial
  CRISPR gRNA sequence
aggctacaggcactctttct

SEQ ID NO: 158100 - DNA, 20 bp, Artificial
  CRISPR gRNA sequence
ggctacaggcactctttctg

SEQ ID NO: 158101 - DNA, 20 bp, Artificial
  CRISPR gRNA sequence
caggcactctttctgtctct

SEQ ID NO: 158102 - DNA, 20 bp, Artificial
  CRISPR gRNA sequence
tttctgtctctagctcatgt

SEQ ID NO: 158103 - DNA, 20 bp, Artificial
  CRISPR gRNA sequence
tctgtctctagctcatgtca

SEQ ID NO: 158104 - DNA, 20 bp, Artificial
  CRISPR gRNA sequence
ctgtctctagctcatgtcac

SEQ ID NO: 158105 - DNA, 20 bp, Artificial
  CRISPR gRNA sequence
tgtctctagctcatgtcaca

SEQ ID NO: 158106 - DNA, 20 bp, Artificial
  CRISPR gRNA sequence
tctctagctcatgtcacaat

SEQ ID NO: 158107 - DNA, 20 bp, Artificial
  CRISPR gRNA sequence
tagctcatgtcacaattcct

SEQ ID NO: 158108 - DNA, 20 bp, Artificial
  CRISPR gRNA sequence
gctcatgtcacaattccttt

SEQ ID NO: 158109 - DNA, 20 bp, Artificial
  CRISPR gRNA sequence
atgtcacaattccttttcgg

SEQ ID NO: 158110 - DNA, 20 bp, Artificial
  CRISPR gRNA sequence
cttttcgggattgaggcctg

SEQ ID NO: 158111 - DNA, 20 bp, Artificial
  CRISPR gRNA sequence
ttcgggattgaggcctgaaa

SEQ ID NO: 158112 - DNA, 20 bp, Artificial
  CRISPR gRNA sequence
tcgggattgaggcctgaaaa

SEQ ID NO: 158113 - DNA, 20 bp, Artificial
  CRISPR gRNA sequence
cgggattgaggcctgaaaaa

SEQ ID NO: 158114 - DNA, 20 bp, Artificial
  CRISPR gRNA sequence
gggattgaggcctgaaaaac

SEQ ID NO: 158115 - DNA, 20 bp, Artificial
  CRISPR gRNA sequence
aggcctgaaaaaccagttac

SEQ ID NO: 158116 - DNA, 20 bp, Artificial
  CRISPR gRNA sequence
aaaaaccagttactcaccat

SEQ ID NO: 158117 - DNA, 20 bp, Artificial
  CRISPR gRNA sequence
ctcaccattcttcctacaag

SEQ ID NO: 158118 - DNA, 20 bp, Artificial
  CRISPR gRNA sequence
accattcttcctacaaggat

SEQ ID NO: 158119 - DNA, 20 bp, Artificial
  CRISPR gRNA sequence
ttcctacaaggatttattta

SEQ ID NO: 158120 - DNA, 20 bp, Artificial
  CRISPR gRNA sequence
cctacaaggatttatttact

SEQ ID NO: 158121 - DNA, 20 bp, Artificial
  CRISPR gRNA sequence
ctacaaggatttatttactc

SEQ ID NO: 158122 - DNA, 20 bp, Artificial
  CRISPR gRNA sequence
caaggatttatttactcgtt

SEQ ID NO: 158123 - DNA, 20 bp, Artificial
  CRISPR gRNA sequence
atttactcgttaggctggag

SEQ ID NO: 158124 - DNA, 20 bp, Artificial
  CRISPR gRNA sequence
tttactcgttaggctggagg

SEQ ID NO: 158125 - DNA, 20 bp, Artificial
  CRISPR gRNA sequence
actcgttaggctggagggtc

SEQ ID NO: 158126 - DNA, 20 bp, Artificial
  CRISPR gRNA sequence
ctcgttaggctggagggtca

SEQ ID NO: 158127 - DNA, 20 bp, Artificial
  CRISPR gRNA sequence
gttaggctggagggtcagag

SEQ ID NO: 158128 - DNA, 20 bp, Artificial
  CRISPR gRNA sequence
ggctggagggtcagagagac

SEQ ID NO: 158129 - DNA, 20 bp, Artificial
  CRISPR gRNA sequence
gagggtcagagagactaaca

SEQ ID NO: 158130 - DNA, 20 bp, Artificial
  CRISPR gRNA sequence
acagatacttctgtggggca

SEQ ID NO: 158131 - DNA, 20 bp, Artificial
  CRISPR gRNA sequence
ctgtggggcagagggggtct

SEQ ID NO: 158132 - DNA, 20 bp, Artificial
  CRISPR gRNA sequence
tgtggggcagagggggtctg

SEQ ID NO: 158133 - DNA, 20 bp, Artificial
  CRISPR gRNA sequence
tggggcagagggggtctggc

SEQ ID NO: 158134 - DNA, 20 bp, Artificial
  CRISPR gRNA sequence
gcccagcttacttctaattg

SEQ ID NO: 158135 - DNA, 20 bp, Artificial
  CRISPR gRNA sequence
acttctaattgaggatgaac

SEQ ID NO: 158136 - DNA, 20 bp, Artificial
  CRISPR gRNA sequence
cttctaattgaggatgaaca

SEQ ID NO: 158137 - DNA, 20 bp, Artificial
  CRISPR gRNA sequence
ctaattgaggatgaacaggt

SEQ ID NO: 158138 - DNA, 20 bp, Artificial
  CRISPR gRNA sequence
taattgaggatgaacaggtg

SEQ ID NO: 158139 - DNA, 20 bp, Artificial
  CRISPR gRNA sequence
attgaggatgaacaggtgag

SEQ ID NO: 158140 - DNA, 20 bp, Artificial
  CRISPR gRNA sequence
aggatgaacaggtgagggag

SEQ ID NO: 158141 - DNA, 20 bp, Artificial
  CRISPR gRNA sequence
agtaacagttgtgtgatcta

SEQ ID NO: 158142 - DNA, 20 bp, Artificial
  CRISPR gRNA sequence
tgtgatctaggaccagcttc

SEQ ID NO: 158143 - DNA, 20 bp, Artificial
  CRISPR gRNA sequence
ggaccagcttctcaacttct

SEQ ID NO: 158144 - DNA, 20 bp, Artificial
  CRISPR gRNA sequence
ctcaacttctagtgtcagtt

SEQ ID NO: 158145 - DNA, 20 bp, Artificial
  CRISPR gRNA sequence
tcaacttctagtgtcagttt

SEQ ID NO: 158146 - DNA, 20 bp, Artificial
  CRISPR gRNA sequence
aacttctagtgtcagtttcc

SEQ ID NO: 158147 - DNA, 20 bp, Artificial
  CRISPR gRNA sequence
ctagtgtcagtttccccatc

SEQ ID NO: 158148 - DNA, 20 bp, Artificial
  CRISPR gRNA sequence
tagtgtcagtttccccatca

SEQ ID NO: 158149 - DNA, 20 bp, Artificial
  CRISPR gRNA sequence
gtgtcagtttccccatcagt

SEQ ID NO: 158150 - DNA, 20 bp, Artificial
  CRISPR gRNA sequence
ccccatcagtaaatcaggga

SEQ ID NO: 158151 - DNA, 20 bp, Artificial
  CRISPR gRNA sequence
cccatcagtaaatcagggat

SEQ ID NO: 158152 - DNA, 20 bp, Artificial
  CRISPR gRNA sequence
acagtgctttaaaacaagat

SEQ ID NO: 158153 - DNA, 20 bp, Artificial
  CRISPR gRNA sequence
taaaacaagatcagaatatt

SEQ ID NO: 158154 - DNA, 20 bp, Artificial
  CRISPR gRNA sequence
aaaacaagatcagaatatta

SEQ ID NO: 158155 - DNA, 20 bp, Artificial
  CRISPR gRNA sequence
aaacaagatcagaatattat

SEQ ID NO: 158156 - DNA, 20 bp, Artificial
  CRISPR gRNA sequence
tctgaaactttttcttttct

SEQ ID NO: 158157 - DNA, 20 bp, Artificial
  CRISPR gRNA sequence
aaactttttcttttcttttc

SEQ ID NO: 158158 - DNA, 20 bp, Artificial
  CRISPR gRNA sequence
tttcttttcttttctttttt

SEQ ID NO: 158159 - DNA, 20 bp, Artificial
  CRISPR gRNA sequence
ttcttttcttttcttttttt

SEQ ID NO: 158160 - DNA, 20 bp, Artificial
  CRISPR gRNA sequence
tcttttcttttctttttttt

SEQ ID NO: 158161 - DNA, 20 bp, Artificial
  CRISPR gRNA sequence
cttttcttttcttttttttt

SEQ ID NO: 158162 - DNA, 20 bp, Artificial
  CRISPR gRNA sequence
ttttcttttctttttttttt

SEQ ID NO: 158163 - DNA, 20 bp, Artificial
  CRISPR gRNA sequence
ttcttttcttttttttttga

SEQ ID NO: 158164 - DNA, 20 bp, Artificial
  CRISPR gRNA sequence
tcttttcttttttttttgag

SEQ ID NO: 158165 - DNA, 20 bp, Artificial
  CRISPR gRNA sequence
cttttcttttttttttgaga

SEQ ID NO: 158166 - DNA, 20 bp, Artificial
  CRISPR gRNA sequence
ttttcttttttttttgagac

SEQ ID NO: 158167 - DNA, 20 bp, Artificial
  CRISPR gRNA sequence
ttcttttttttttgagacag

SEQ ID NO: 158168 - DNA, 20 bp, Artificial
  CRISPR gRNA sequence
tcttttttttttgagacagg

SEQ ID NO: 158169 - DNA, 20 bp, Artificial
  CRISPR gRNA sequence
cttttttttttgagacagga

SEQ ID NO: 158170 - DNA, 20 bp, Artificial
  CRISPR gRNA sequence
ttttttttttgagacaggat

SEQ ID NO: 158171 - DNA, 20 bp, Artificial
  CRISPR gRNA sequence
ttttttttgagacaggatct

SEQ ID NO: 158172 - DNA, 20 bp, Artificial
  CRISPR gRNA sequence
tttttttgagacaggatctt

SEQ ID NO: 158173 - DNA, 20 bp, Artificial
  CRISPR gRNA sequence
ttttttgagacaggatcttg

SEQ ID NO: 158174 - DNA, 20 bp, Artificial
  CRISPR gRNA sequence
tttttgagacaggatcttgc

SEQ ID NO: 158175 - DNA, 20 bp, Artificial
  CRISPR gRNA sequence
ttttgagacaggatcttgct

SEQ ID NO: 158176 - DNA, 20 bp, Artificial
  CRISPR gRNA sequence
tttgagacaggatcttgctc

SEQ ID NO: 158177 - DNA, 20 bp, Artificial
  CRISPR gRNA sequence
ttgagacaggatcttgctct

SEQ ID NO: 158178 - DNA, 20 bp, Artificial
  CRISPR gRNA sequence
tgagacaggatcttgctctg

SEQ ID NO: 158179 - DNA, 20 bp, Artificial
  CRISPR gRNA sequence
gagacaggatcttgctctgc

SEQ ID NO: 158180 - DNA, 20 bp, Artificial
  CRISPR gRNA sequence
agacaggatcttgctctgct

SEQ ID NO: 158181 - DNA, 20 bp, Artificial
  CRISPR gRNA sequence
gctctgctgttcctgctcag

SEQ ID NO: 158182 - DNA, 20 bp, Artificial
  CRISPR gRNA sequence
ctctgctgttcctgctcagg

SEQ ID NO: 158183 - DNA, 20 bp, Artificial
  CRISPR gRNA sequence
tgctgttcctgctcaggctg

SEQ ID NO: 158184 - DNA, 20 bp, Artificial
  CRISPR gRNA sequence
ctgttcctgctcaggctgga

SEQ ID NO: 158185 - DNA, 20 bp, Artificial
  CRISPR gRNA sequence
ttcctgctcaggctggagtg

SEQ ID NO: 158186 - DNA, 20 bp, Artificial
  CRISPR gRNA sequence
ctgctcaggctggagtgcag

SEQ ID NO: 158187 - DNA, 20 bp, Artificial
  CRISPR gRNA sequence
ctcaggctggagtgcagtgg

SEQ ID NO: 158188 - DNA, 20 bp, Artificial
  CRISPR gRNA sequence
aggctggagtgcagtggcgc

SEQ ID NO: 158189 - DNA, 20 bp, Artificial
  CRISPR gRNA sequence
gagtgcagtggcgcaatcat

SEQ ID NO: 158190 - DNA, 20 bp, Artificial
  CRISPR gRNA sequence
actgcaggcttgaccaccca

SEQ ID NO: 158191 - DNA, 20 bp, Artificial
  CRISPR gRNA sequence
caggcttgaccacccaggct

SEQ ID NO: 158192 - DNA, 20 bp, Artificial
  CRISPR gRNA sequence
gaccacccaggctcaagcag

SEQ ID NO: 158193 - DNA, 20 bp, Artificial
  CRISPR gRNA sequence
accacccaggctcaagcagt

SEQ ID NO: 158194 - DNA, 20 bp, Artificial
  CRISPR gRNA sequence
aagcagtcctcccgcctcag

SEQ ID NO: 158195 - DNA, 20 bp, Artificial
  CRISPR gRNA sequence
ccgcctcagcctcgtgagta

SEQ ID NO: 158196 - DNA, 20 bp, Artificial
  CRISPR gRNA sequence
agcctcgtgagtagctggga

SEQ ID NO: 158197 - DNA, 20 bp, Artificial
  CRISPR gRNA sequence
gtgagtagctgggactacag

SEQ ID NO: 158198 - DNA, 20 bp, Artificial
  CRISPR gRNA sequence
ggactacaggtgtgggccac

SEQ ID NO: 158199 - DNA, 20 bp, Artificial
  CRISPR gRNA sequence
caggtgtgggccactacacc

SEQ ID NO: 158200 - DNA, 20 bp, Artificial
  CRISPR gRNA sequence
cacctggctagttttttatt

SEQ ID NO: 158201 - DNA, 20 bp, Artificial
  CRISPR gRNA sequence
gctagttttttattttttat

SEQ ID NO: 158202 - DNA, 20 bp, Artificial
  CRISPR gRNA sequence
gttttttattttttattttc

SEQ ID NO: 158203 - DNA, 20 bp, Artificial
  CRISPR gRNA sequence
tttattttttattttctatt

SEQ ID NO: 158204 - DNA, 20 bp, Artificial
  CRISPR gRNA sequence
ttattttttattttctattg

SEQ ID NO: 158205 - DNA, 20 bp, Artificial
  CRISPR gRNA sequence
tattttttattttctattga

SEQ ID NO: 158206 - DNA, 20 bp, Artificial
  CRISPR gRNA sequence
attttttattttctattgag

SEQ ID NO: 158207 - DNA, 20 bp, Artificial
  CRISPR gRNA sequence
ttttttattttctattgaga

SEQ ID NO: 158208 - DNA, 20 bp, Artificial
  CRISPR gRNA sequence
tttattttctattgagatgg

SEQ ID NO: 158209 - DNA, 20 bp, Artificial
  CRISPR gRNA sequence
ttattttctattgagatggg

SEQ ID NO: 158210 - DNA, 20 bp, Artificial
  CRISPR gRNA sequence
tattttctattgagatgggg

SEQ ID NO: 158211 - DNA, 20 bp, Artificial
  CRISPR gRNA sequence
attttctattgagatggggg

SEQ ID NO: 158212 - DNA, 20 bp, Artificial
  CRISPR gRNA sequence
ttttctattgagatgggggt

SEQ ID NO: 158213 - DNA, 20 bp, Artificial
  CRISPR gRNA sequence
tctattgagatgggggtctc

SEQ ID NO: 158214 - DNA, 20 bp, Artificial
  CRISPR gRNA sequence
ctattgagatgggggtctca

SEQ ID NO: 158215 - DNA, 20 bp, Artificial
  CRISPR gRNA sequence
tattgagatgggggtctcac

SEQ ID NO: 158216 - DNA, 20 bp, Artificial
  CRISPR gRNA sequence
ttgagatgggggtctcacta

SEQ ID NO: 158217 - DNA, 20 bp, Artificial
  CRISPR gRNA sequence
agatgggggtctcactatgt

SEQ ID NO: 158218 - DNA, 20 bp, Artificial
  CRISPR gRNA sequence
actatgttgcccaggctgat

SEQ ID NO: 158219 - DNA, 20 bp, Artificial
  CRISPR gRNA sequence
tgttgcccaggctgatctcg

SEQ ID NO: 158220 - DNA, 20 bp, Artificial
  CRISPR gRNA sequence
cccaggctgatctcgagctc

SEQ ID NO: 158221 - DNA, 20 bp, Artificial
  CRISPR gRNA sequence
atctcgagctcttgggttca

SEQ ID NO: 158222 - DNA, 20 bp, Artificial
  CRISPR gRNA sequence
gagctcttgggttcaagtga

SEQ ID NO: 158223 - DNA, 20 bp, Artificial
  CRISPR gRNA sequence
ttgggttcaagtgatcctcc

SEQ ID NO: 158224 - DNA, 20 bp, Artificial
  CRISPR gRNA sequence
gggttcaagtgatcctcccg

SEQ ID NO: 158225 - DNA, 20 bp, Artificial
  CRISPR gRNA sequence
ggttcaagtgatcctcccgc

SEQ ID NO: 158226 - DNA, 20 bp, Artificial
  CRISPR gRNA sequence
aagtgatcctcccgccttgg

SEQ ID NO: 158227 - DNA, 20 bp, Artificial
  CRISPR gRNA sequence
ccgccttggcctcccagagt

SEQ ID NO: 158228 - DNA, 20 bp, Artificial
  CRISPR gRNA sequence
ggcctcccagagtgctagga

SEQ ID NO: 158229 - DNA, 20 bp, Artificial
  CRISPR gRNA sequence
gcctcccagagtgctaggat

SEQ ID NO: 158230 - DNA, 20 bp, Artificial
  CRISPR gRNA sequence
ccagagtgctaggattagag

SEQ ID NO: 158231 - DNA, 20 bp, Artificial
  CRISPR gRNA sequence
ggattagaggcatgagctac

SEQ ID NO: 158232 - DNA, 20 bp, Artificial
  CRISPR gRNA sequence
gaggcatgagctaccatgcc

SEQ ID NO: 158233 - DNA, 20 bp, Artificial
  CRISPR gRNA sequence
ccatgcctggctgaaccttt

SEQ ID NO: 158234 - DNA, 20 bp, Artificial
  CRISPR gRNA sequence
gctgaacctttttccttaaa

SEQ ID NO: 158235 - DNA, 20 bp, Artificial
  CRISPR gRNA sequence
aacctttttccttaaagggc

SEQ ID NO: 158236 - DNA, 20 bp, Artificial
  CRISPR gRNA sequence
tttccttaaagggccagata

SEQ ID NO: 158237 - DNA, 20 bp, Artificial
  CRISPR gRNA sequence
ttccttaaagggccagatat

SEQ ID NO: 158238 - DNA, 20 bp, Artificial
  CRISPR gRNA sequence
tccttaaagggccagatatt

SEQ ID NO: 158239 - DNA, 20 bp, Artificial
  CRISPR gRNA sequence
ccttaaagggccagatattt

SEQ ID NO: 158240 - DNA, 20 bp, Artificial
  CRISPR gRNA sequence
cttaaagggccagatatttt

SEQ ID NO: 158241 - DNA, 20 bp, Artificial
  CRISPR gRNA sequence
aaagggccagatattttagg

SEQ ID NO: 158242 - DNA, 20 bp, Artificial
  CRISPR gRNA sequence
aagggccagatattttaggc

SEQ ID NO: 158243 - DNA, 20 bp, Artificial
  CRISPR gRNA sequence
taggctttgtggctgtatga

SEQ ID NO: 158244 - DNA, 20 bp, Artificial
  CRISPR gRNA sequence
aggctttgtggctgtatgat

SEQ ID NO: 158245 - DNA, 20 bp, Artificial
  CRISPR gRNA sequence
ggctttgtggctgtatgatt

SEQ ID NO: 158246 - DNA, 20 bp, Artificial
  CRISPR gRNA sequence
tgtggctgtatgatttttgt

SEQ ID NO: 158247 - DNA, 20 bp, Artificial
  CRISPR gRNA sequence
gtggctgtatgatttttgtt

SEQ ID NO: 158248 - DNA, 20 bp, Artificial
  CRISPR gRNA sequence
tggctgtatgatttttgttg

SEQ ID NO: 158249 - DNA, 20 bp, Artificial
  CRISPR gRNA sequence
tatgatttttgttgtaactc

SEQ ID NO: 158250 - DNA, 20 bp, Artificial
  CRISPR gRNA sequence
ttgttgtaactcttcaactc

SEQ ID NO: 158251 - DNA, 20 bp, Artificial
  CRISPR gRNA sequence
tgttgtaactcttcaactct

SEQ ID NO: 158252 - DNA, 20 bp, Artificial
  CRISPR gRNA sequence
gttgtaactcttcaactcta

SEQ ID NO: 158253 - DNA, 20 bp, Artificial
  CRISPR gRNA sequence
ttgtaactcttcaactctac

SEQ ID NO: 158254 - DNA, 20 bp, Artificial
  CRISPR gRNA sequence
taactcttcaactctactgt

SEQ ID NO: 158255 - DNA, 20 bp, Artificial
  CRISPR gRNA sequence
ttcaactctactgtttagca

SEQ ID NO: 158256 - DNA, 20 bp, Artificial
  CRISPR gRNA sequence
caactctactgtttagcatg

SEQ ID NO: 158257 - DNA, 20 bp, Artificial
  CRISPR gRNA sequence
aactctactgtttagcatga

SEQ ID NO: 158258 - DNA, 20 bp, Artificial
  CRISPR gRNA sequence
tactgtttagcatgaacaga

SEQ ID NO: 158259 - DNA, 20 bp, Artificial
  CRISPR gRNA sequence
ctgtttagcatgaacagaca

SEQ ID NO: 158260 - DNA, 20 bp, Artificial
  CRISPR gRNA sequence
tttagcatgaacagacaata

SEQ ID NO: 158261 - DNA, 20 bp, Artificial
  CRISPR gRNA sequence
agcatgaacagacaatataa

SEQ ID NO: 158262 - DNA, 20 bp, Artificial
  CRISPR gRNA sequence
gcatgaacagacaatataaa

SEQ ID NO: 158263 - DNA, 20 bp, Artificial
  CRISPR gRNA sequence
attaggggctggacatggtg

SEQ ID NO: 158264 - DNA, 20 bp, Artificial
  CRISPR gRNA sequence
ggggctggacatggtggctc

SEQ ID NO: 158265 - DNA, 20 bp, Artificial
  CRISPR gRNA sequence
gacatggtggctcacgcctg

SEQ ID NO: 158266 - DNA, 20 bp, Artificial
  CRISPR gRNA sequence
acgcctgtaatcccagcgtt

SEQ ID NO: 158267 - DNA, 20 bp, Artificial
  CRISPR gRNA sequence
taatcccagcgttttgggag

SEQ ID NO: 158268 - DNA, 20 bp, Artificial
  CRISPR gRNA sequence
tgggaggccgaggtgggcag

SEQ ID NO: 158269 - DNA, 20 bp, Artificial
  CRISPR gRNA sequence
gggaggccgaggtgggcaga

SEQ ID NO: 158270 - DNA, 20 bp, Artificial
  CRISPR gRNA sequence
ggaggccgaggtgggcagat

SEQ ID NO: 158271 - DNA, 20 bp, Artificial
  CRISPR gRNA sequence
aaggtcaggagttcaagacc

SEQ ID NO: 158272 - DNA, 20 bp, Artificial
  CRISPR gRNA sequence
aggtcaggagttcaagacca

SEQ ID NO: 158273 - DNA, 20 bp, Artificial
  CRISPR gRNA sequence
aagaccaacctggtcaacat

SEQ ID NO: 158274 - DNA, 20 bp, Artificial
  CRISPR gRNA sequence
gtcaacatggtgaaacccgt

SEQ ID NO: 158275 - DNA, 20 bp, Artificial
  CRISPR gRNA sequence
ttcaaaaatacaaaaattag

SEQ ID NO: 158276 - DNA, 20 bp, Artificial
  CRISPR gRNA sequence
caaaaatacaaaaattagct

SEQ ID NO: 158277 - DNA, 20 bp, Artificial
  CRISPR gRNA sequence
aaaaatacaaaaattagctg

SEQ ID NO: 158278 - DNA, 20 bp, Artificial
  CRISPR gRNA sequence
gctgggtgtgatggcgggtg

SEQ ID NO: 158279 - DNA, 20 bp, Artificial
  CRISPR gRNA sequence
ggtgtgatggcgggtgccta

SEQ ID NO: 158280 - DNA, 20 bp, Artificial
  CRISPR gRNA sequence
taatcccagctgcttgggag

SEQ ID NO: 158281 - DNA, 20 bp, Artificial
  CRISPR gRNA sequence
cttgggaggctgaggtggga

SEQ ID NO: 158282 - DNA, 20 bp, Artificial
  CRISPR gRNA sequence
gggaggctgaggtgggagaa

SEQ ID NO: 158283 - DNA, 20 bp, Artificial
  CRISPR gRNA sequence
ggaggctgaggtgggagaat

SEQ ID NO: 158284 - DNA, 20 bp, Artificial
  CRISPR gRNA sequence
aggtgggagaatcgcttgaa

SEQ ID NO: 158285 - DNA, 20 bp, Artificial
  CRISPR gRNA sequence
gaacccgggaggtggaggtt

SEQ ID NO: 158286 - DNA, 20 bp, Artificial
  CRISPR gRNA sequence
aacccgggaggtggaggttg

SEQ ID NO: 158287 - DNA, 20 bp, Artificial
  CRISPR gRNA sequence
cagtgagccgagatcgtgcc

SEQ ID NO: 158288 - DNA, 20 bp, Artificial
  CRISPR gRNA sequence
tactccagcctggatgacag

SEQ ID NO: 158289 - DNA, 20 bp, Artificial
  CRISPR gRNA sequence
cagcctggatgacagactga

SEQ ID NO: 158290 - DNA, 20 bp, Artificial
  CRISPR gRNA sequence
gatgacagactgaggctccg

SEQ ID NO: 158291 - DNA, 20 bp, Artificial
  CRISPR gRNA sequence
aggctccgtctaaaagtaaa

SEQ ID NO: 158292 - DNA, 20 bp, Artificial
  CRISPR gRNA sequence
cgtctaaaagtaaatgaata

SEQ ID NO: 158293 - DNA, 20 bp, Artificial
  CRISPR gRNA sequence
aaagtaaatgaataaataaa

SEQ ID NO: 158294 - DNA, 20 bp, Artificial
  CRISPR gRNA sequence
gggttgatgtcttccagtga

SEQ ID NO: 158295 - DNA, 20 bp, Artificial
  CRISPR gRNA sequence
atgtcttccagtgaaactgt

SEQ ID NO: 158296 - DNA, 20 bp, Artificial
  CRISPR gRNA sequence
ccagtgaaactgtttctaaa

SEQ ID NO: 158297 - DNA, 20 bp, Artificial
  CRISPR gRNA sequence
cagtgaaactgtttctaaaa

SEQ ID NO: 158298 - DNA, 20 bp, Artificial
  CRISPR gRNA sequence
tttctaaaaacaggctgtag

SEQ ID NO: 158299 - DNA, 20 bp, Artificial
  CRISPR gRNA sequence
ctaaaaacaggctgtaggcc

SEQ ID NO: 158300 - DNA, 20 bp, Artificial
  CRISPR gRNA sequence
taaaaacaggctgtaggcca

SEQ ID NO: 158301 - DNA, 20 bp, Artificial
  CRISPR gRNA sequence
aaaacaggctgtaggccaga

SEQ ID NO: 158302 - DNA, 20 bp, Artificial
  CRISPR gRNA sequence
taggccagatgtggcctatg

SEQ ID NO: 158303 - DNA, 20 bp, Artificial
  CRISPR gRNA sequence
tgagctgtagtttttagacc

SEQ ID NO: 158304 - DNA, 20 bp, Artificial
  CRISPR gRNA sequence
tagtttttagacccttgctt

SEQ ID NO: 158305 - DNA, 20 bp, Artificial
  CRISPR gRNA sequence
ttagacccttgctttagaat

SEQ ID NO: 158306 - DNA, 20 bp, Artificial
  CRISPR gRNA sequence
tagacccttgctttagaata

SEQ ID NO: 158307 - DNA, 20 bp, Artificial
  CRISPR gRNA sequence
agacccttgctttagaatac

SEQ ID NO: 158308 - DNA, 20 bp, Artificial
  CRISPR gRNA sequence
gacccttgctttagaatact

SEQ ID NO: 158309 - DNA, 20 bp, Artificial
  CRISPR gRNA sequence
gctttagaatacttcactaa

SEQ ID NO: 158310 - DNA, 20 bp, Artificial
  CRISPR gRNA sequence
ctttagaatacttcactaaa

SEQ ID NO: 158311 - DNA, 20 bp, Artificial
  CRISPR gRNA sequence
tagaatacttcactaaatac

SEQ ID NO: 158312 - DNA, 20 bp, Artificial
  CRISPR gRNA sequence
agaatacttcactaaatact

SEQ ID NO: 158313 - DNA, 20 bp, Artificial
  CRISPR gRNA sequence
gaatacttcactaaatactt

SEQ ID NO: 158314 - DNA, 20 bp, Artificial
  CRISPR gRNA sequence
cactaaatacttgatccttt

SEQ ID NO: 158315 - DNA, 20 bp, Artificial
  CRISPR gRNA sequence
actaaatacttgatcctttt

SEQ ID NO: 158316 - DNA, 20 bp, Artificial
  CRISPR gRNA sequence
aatacttgatcctttttctt

SEQ ID NO: 158317 - DNA, 20 bp, Artificial
  CRISPR gRNA sequence
gatcctttttcttcatcata

SEQ ID NO: 158318 - DNA, 20 bp, Artificial
  CRISPR gRNA sequence
atcctttttcttcatcatac

SEQ ID NO: 158319 - DNA, 20 bp, Artificial
  CRISPR gRNA sequence
tttcttcatcatacaaaata

SEQ ID NO: 158320 - DNA, 20 bp, Artificial
  CRISPR gRNA sequence
ttcttcatcatacaaaatac

SEQ ID NO: 158321 - DNA, 20 bp, Artificial
  CRISPR gRNA sequence
tcttcatcatacaaaatact

SEQ ID NO: 158322 - DNA, 20 bp, Artificial
  CRISPR gRNA sequence
cttcatcatacaaaatactg

SEQ ID NO: 158323 - DNA, 20 bp, Artificial
  CRISPR gRNA sequence
ttcatcatacaaaatactga

SEQ ID NO: 158324 - DNA, 20 bp, Artificial
  CRISPR gRNA sequence
catcatacaaaatactgata

SEQ ID NO: 158325 - DNA, 20 bp, Artificial
  CRISPR gRNA sequence
atcatacaaaatactgatag

SEQ ID NO: 158326 - DNA, 20 bp, Artificial
  CRISPR gRNA sequence
atagtgttttattgctgtta

SEQ ID NO: 158327 - DNA, 20 bp, Artificial
  CRISPR gRNA sequence
tattgctgttatatatgcag

SEQ ID NO: 158328 - DNA, 20 bp, Artificial
  CRISPR gRNA sequence
attgctgttatatatgcaga

SEQ ID NO: 158329 - DNA, 20 bp, Artificial
  CRISPR gRNA sequence
ttgctgttatatatgcagag

SEQ ID NO: 158330 - DNA, 20 bp, Artificial
  CRISPR gRNA sequence
ctgttatatatgcagagatg

SEQ ID NO: 158331 - DNA, 20 bp, Artificial
  CRISPR gRNA sequence
ttatatatgcagagatggtt

SEQ ID NO: 158332 - DNA, 20 bp, Artificial
  CRISPR gRNA sequence
tatatgcagagatggtttaa

SEQ ID NO: 158333 - DNA, 20 bp, Artificial
  CRISPR gRNA sequence
aagtttgagcattgaaagga

SEQ ID NO: 158334 - DNA, 20 bp, Artificial
  CRISPR gRNA sequence
agtttgagcattgaaaggat

SEQ ID NO: 158335 - DNA, 20 bp, Artificial
  CRISPR gRNA sequence
gagcattgaaaggatgagta

SEQ ID NO: 158336 - DNA, 20 bp, Artificial
  CRISPR gRNA sequence
agcattgaaaggatgagtaa

SEQ ID NO: 158337 - DNA, 20 bp, Artificial
  CRISPR gRNA sequence
aaaggatgagtaagaatgtg

SEQ ID NO: 158338 - DNA, 20 bp, Artificial
  CRISPR gRNA sequence
catatcgttttctattccac

SEQ ID NO: 158339 - DNA, 20 bp, Artificial
  CRISPR gRNA sequence
tctattccacagaaaaaagt

SEQ ID NO: 158340 - DNA, 20 bp, Artificial
  CRISPR gRNA sequence
ctattccacagaaaaaagtt

SEQ ID NO: 158341 - DNA, 20 bp, Artificial
  CRISPR gRNA sequence
tattccacagaaaaaagttt

SEQ ID NO: 158342 - DNA, 20 bp, Artificial
  CRISPR gRNA sequence
ttccacagaaaaaagttttc

SEQ ID NO: 158343 - DNA, 20 bp, Artificial
  CRISPR gRNA sequence
cacagaaaaaagttttcaaa

SEQ ID NO: 158344 - DNA, 20 bp, Artificial
  CRISPR gRNA sequence
tcaaatgttctgttcatgcc

SEQ ID NO: 158345 - DNA, 20 bp, Artificial
  CRISPR gRNA sequence
caaatgttctgttcatgcct

SEQ ID NO: 158346 - DNA, 20 bp, Artificial
  CRISPR gRNA sequence
aaatgttctgttcatgcctt

SEQ ID NO: 158347 - DNA, 20 bp, Artificial
  CRISPR gRNA sequence
tgttcatgccttcccgtcac

SEQ ID NO: 158348 - DNA, 20 bp, Artificial
  CRISPR gRNA sequence
ttcatgccttcccgtcactt

SEQ ID NO: 158349 - DNA, 20 bp, Artificial
  CRISPR gRNA sequence
atgccttcccgtcactttca

SEQ ID NO: 158350 - DNA, 20 bp, Artificial
  CRISPR gRNA sequence
cccgtcactttcattgttta

SEQ ID NO: 158351 - DNA, 20 bp, Artificial
  CRISPR gRNA sequence
ccgtcactttcattgtttat

SEQ ID NO: 158352 - DNA, 20 bp, Artificial
  CRISPR gRNA sequence
tcattgtttataccagttgc

SEQ ID NO: 158353 - DNA, 20 bp, Artificial
  CRISPR gRNA sequence
cattgtttataccagttgct

SEQ ID NO: 158354 - DNA, 20 bp, Artificial
  CRISPR gRNA sequence
attgtttataccagttgctg

SEQ ID NO: 158355 - DNA, 20 bp, Artificial
  CRISPR gRNA sequence
tttataccagttgctgtgcc

SEQ ID NO: 158356 - DNA, 20 bp, Artificial
  CRISPR gRNA sequence
ataccagttgctgtgccttc

SEQ ID NO: 158357 - DNA, 20 bp, Artificial
  CRISPR gRNA sequence
taccagttgctgtgccttca

SEQ ID NO: 158358 - DNA, 20 bp, Artificial
  CRISPR gRNA sequence
ctgtgccttcatttttctct

SEQ ID NO: 158359 - DNA, 20 bp, Artificial
  CRISPR gRNA sequence
tgccttcatttttctctagt

SEQ ID NO: 158360 - DNA, 20 bp, Artificial
  CRISPR gRNA sequence
catttttctctagttgtgct

SEQ ID NO: 158361 - DNA, 20 bp, Artificial
  CRISPR gRNA sequence
atttttctctagttgtgcta

SEQ ID NO: 158362 - DNA, 20 bp, Artificial
  CRISPR gRNA sequence
ttctctagttgtgctacaac

SEQ ID NO: 158363 - DNA, 20 bp, Artificial
  CRISPR gRNA sequence
tctctagttgtgctacaact

SEQ ID NO: 158364 - DNA, 20 bp, Artificial
  CRISPR gRNA sequence
ctctagttgtgctacaacta

SEQ ID NO: 158365 - DNA, 20 bp, Artificial
  CRISPR gRNA sequence
tctagttgtgctacaactat

SEQ ID NO: 158366 - DNA, 20 bp, Artificial
  CRISPR gRNA sequence
tagttgtgctacaactatat

SEQ ID NO: 158367 - DNA, 20 bp, Artificial
  CRISPR gRNA sequence
gttgtgctacaactatatta

SEQ ID NO: 158368 - DNA, 20 bp, Artificial
  CRISPR gRNA sequence
tgctacaactatattatgat

SEQ ID NO: 158369 - DNA, 20 bp, Artificial
  CRISPR gRNA sequence
caactatattatgatctggc

SEQ ID NO: 158370 - DNA, 20 bp, Artificial
  CRISPR gRNA sequence
tattatgatctggcccctgt

SEQ ID NO: 158371 - DNA, 20 bp, Artificial
  CRISPR gRNA sequence
tgatctggcccctgtttcaa

SEQ ID NO: 158372 - DNA, 20 bp, Artificial
  CRISPR gRNA sequence
gcccctgtttcaaagattat

SEQ ID NO: 158373 - DNA, 20 bp, Artificial
  CRISPR gRNA sequence
tttcaaagattatattgtac

SEQ ID NO: 158374 - DNA, 20 bp, Artificial
  CRISPR gRNA sequence
caaagattatattgtactag

SEQ ID NO: 158375 - DNA, 20 bp, Artificial
  CRISPR gRNA sequence
aaagattatattgtactaga

SEQ ID NO: 158376 - DNA, 20 bp, Artificial
  CRISPR gRNA sequence
tattgtactagataccaaat

SEQ ID NO: 158377 - DNA, 20 bp, Artificial
  CRISPR gRNA sequence
tactagataccaaatagaaa

SEQ ID NO: 158378 - DNA, 20 bp, Artificial
  CRISPR gRNA sequence
gataccaaatagaaaagtat

SEQ ID NO: 158379 - DNA, 20 bp, Artificial
  CRISPR gRNA sequence
ttgtttttgaaggaaaagtg

SEQ ID NO: 158380 - DNA, 20 bp, Artificial
  CRISPR gRNA sequence
tgtttttgaaggaaaagtgg

SEQ ID NO: 158381 - DNA, 20 bp, Artificial
  CRISPR gRNA sequence
gtttttgaaggaaaagtggc

SEQ ID NO: 158382 - DNA, 20 bp, Artificial
  CRISPR gRNA sequence
tttttgaaggaaaagtggct

SEQ ID NO: 158383 - DNA, 20 bp, Artificial
  CRISPR gRNA sequence
ttgaaggaaaagtggctctt

SEQ ID NO: 158384 - DNA, 20 bp, Artificial
  CRISPR gRNA sequence
tgaaggaaaagtggctcttc

SEQ ID NO: 158385 - DNA, 20 bp, Artificial
  CRISPR gRNA sequence
gaaggaaaagtggctcttct

SEQ ID NO: 158386 - DNA, 20 bp, Artificial
  CRISPR gRNA sequence
aaggaaaagtggctcttctg

SEQ ID NO: 158387 - DNA, 20 bp, Artificial
  CRISPR gRNA sequence
ttctgccagtttgaaaatgt

SEQ ID NO: 158388 - DNA, 20 bp, Artificial
  CRISPR gRNA sequence
ctgccagtttgaaaatgtgt

SEQ ID NO: 158389 - DNA, 20 bp, Artificial
  CRISPR gRNA sequence
tgccagtttgaaaatgtgtc

SEQ ID NO: 158390 - DNA, 20 bp, Artificial
  CRISPR gRNA sequence
ccagtttgaaaatgtgtcct

SEQ ID NO: 158391 - DNA, 20 bp, Artificial
  CRISPR gRNA sequence
gaaaatgtgtccttgtgtac

SEQ ID NO: 158392 - DNA, 20 bp, Artificial
  CRISPR gRNA sequence
aaaatgtgtccttgtgtaca

SEQ ID NO: 158393 - DNA, 20 bp, Artificial
  CRISPR gRNA sequence
gtgtacagatctttaaggag

SEQ ID NO: 158394 - DNA, 20 bp, Artificial
  CRISPR gRNA sequence
tgtacagatctttaaggaga

SEQ ID NO: 158395 - DNA, 20 bp, Artificial
  CRISPR gRNA sequence
taaggagagcagtgtgcagc

SEQ ID NO: 158396 - DNA, 20 bp, Artificial
  CRISPR gRNA sequence
aaggagagcagtgtgcagcc

SEQ ID NO: 158397 - DNA, 20 bp, Artificial
  CRISPR gRNA sequence
aggagagcagtgtgcagcca

SEQ ID NO: 158398 - DNA, 20 bp, Artificial
  CRISPR gRNA sequence
ctaagcctaagtcttttagg

SEQ ID NO: 158399 - DNA, 20 bp, Artificial
  CRISPR gRNA sequence
taagcctaagtcttttagga

SEQ ID NO: 158400 - DNA, 20 bp, Artificial
  CRISPR gRNA sequence
agcctaagtcttttaggaag

SEQ ID NO: 158401 - DNA, 20 bp, Artificial
  CRISPR gRNA sequence
agtcttttaggaagcatggt

SEQ ID NO: 158402 - DNA, 20 bp, Artificial
  CRISPR gRNA sequence
ttaggaagcatggttttcca

SEQ ID NO: 158403 - DNA, 20 bp, Artificial
  CRISPR gRNA sequence
taggaagcatggttttccag

SEQ ID NO: 158404 - DNA, 20 bp, Artificial
  CRISPR gRNA sequence
aggaagcatggttttccagt

SEQ ID NO: 158405 - DNA, 20 bp, Artificial
  CRISPR gRNA sequence
ggaagcatggttttccagta

SEQ ID NO: 158406 - DNA, 20 bp, Artificial
  CRISPR gRNA sequence
tccagtaggcactttgaaaa

SEQ ID NO: 158407 - DNA, 20 bp, Artificial
  CRISPR gRNA sequence
ccagtaggcactttgaaaag

SEQ ID NO: 158408 - DNA, 20 bp, Artificial
  CRISPR gRNA sequence
cagtaggcactttgaaaagc

SEQ ID NO: 158409 - DNA, 20 bp, Artificial
  CRISPR gRNA sequence
tgaaaagcggcttcctctta

SEQ ID NO: 158410 - DNA, 20 bp, Artificial
  CRISPR gRNA sequence
gaaaagcggcttcctcttaa

SEQ ID NO: 158411 - DNA, 20 bp, Artificial
  CRISPR gRNA sequence
aaaagcggcttcctcttaac

SEQ ID NO: 158412 - DNA, 20 bp, Artificial
  CRISPR gRNA sequence
cctcttaacacagatatacc

SEQ ID NO: 158413 - DNA, 20 bp, Artificial
  CRISPR gRNA sequence
ctcttaacacagatatacct

SEQ ID NO: 158414 - DNA, 20 bp, Artificial
  CRISPR gRNA sequence
ttaacacagatataccttca

SEQ ID NO: 158415 - DNA, 20 bp, Artificial
  CRISPR gRNA sequence
aacacagatataccttcaaa

SEQ ID NO: 158416 - DNA, 20 bp, Artificial
  CRISPR gRNA sequence
acacagatataccttcaaac

SEQ ID NO: 158417 - DNA, 20 bp, Artificial
  CRISPR gRNA sequence
caaacgtcaaacttggcatt

SEQ ID NO: 158418 - DNA, 20 bp, Artificial
  CRISPR gRNA sequence
aaacgtcaaacttggcatta

SEQ ID NO: 158419 - DNA, 20 bp, Artificial
  CRISPR gRNA sequence
ggcattaatcagagttgggg

SEQ ID NO: 158420 - DNA, 20 bp, Artificial
  CRISPR gRNA sequence
gcattaatcagagttgggga

SEQ ID NO: 158421 - DNA, 20 bp, Artificial
  CRISPR gRNA sequence
atcagagttggggaagtaga

SEQ ID NO: 158422 - DNA, 20 bp, Artificial
  CRISPR gRNA sequence
gggaagtagagctatgttat

SEQ ID NO: 158423 - DNA, 20 bp, Artificial
  CRISPR gRNA sequence
tgttattcattcttgtatta

SEQ ID NO: 158424 - DNA, 20 bp, Artificial
  CRISPR gRNA sequence
ttcattcttgtattatagta

SEQ ID NO: 158425 - DNA, 20 bp, Artificial
  CRISPR gRNA sequence
attcttgtattatagtagtg

SEQ ID NO: 158426 - DNA, 20 bp, Artificial
  CRISPR gRNA sequence
ttgtattatagtagtgaaga

SEQ ID NO: 158427 - DNA, 20 bp, Artificial
  CRISPR gRNA sequence
gtattatagtagtgaagact

SEQ ID NO: 158428 - DNA, 20 bp, Artificial
  CRISPR gRNA sequence
tattatagtagtgaagacta

SEQ ID NO: 158429 - DNA, 20 bp, Artificial
  CRISPR gRNA sequence
tagtagtgaagactattcag

SEQ ID NO: 158430 - DNA, 20 bp, Artificial
  CRISPR gRNA sequence
ttcagtagcctgccagtaaa

SEQ ID NO: 158431 - DNA, 20 bp, Artificial
  CRISPR gRNA sequence
agtagcctgccagtaaatat

SEQ ID NO: 158432 - DNA, 20 bp, Artificial
  CRISPR gRNA sequence
ccagtaaatatgaccagctg

SEQ ID NO: 158433 - DNA, 20 bp, Artificial
  CRISPR gRNA sequence
gtacccagctatgtaagggt

SEQ ID NO: 158434 - DNA, 20 bp, Artificial
  CRISPR gRNA sequence
tgtaagggtttagaatgtaa

SEQ ID NO: 158435 - DNA, 20 bp, Artificial
  CRISPR gRNA sequence
agaatgtaagtaataaggtt

SEQ ID NO: 158436 - DNA, 20 bp, Artificial
  CRISPR gRNA sequence
gaatgtaagtaataaggttt

SEQ ID NO: 158437 - DNA, 20 bp, Artificial
  CRISPR gRNA sequence
caggcactaaacgtagtgcc

SEQ ID NO: 158438 - DNA, 20 bp, Artificial
  CRISPR gRNA sequence
aggcactaaacgtagtgcct

SEQ ID NO: 158439 - DNA, 20 bp, Artificial
  CRISPR gRNA sequence
aacgtagtgcctgaacttag

SEQ ID NO: 158440 - DNA, 20 bp, Artificial
  CRISPR gRNA sequence
aacttagtttcctgcatgac

SEQ ID NO: 158441 - DNA, 20 bp, Artificial
  CRISPR gRNA sequence
agtttcctgcatgactatat

SEQ ID NO: 158442 - DNA, 20 bp, Artificial
  CRISPR gRNA sequence
gtttcctgcatgactatata

SEQ ID NO: 158443 - DNA, 20 bp, Artificial
  CRISPR gRNA sequence
cctgcatgactatataaaaa

SEQ ID NO: 158444 - DNA, 20 bp, Artificial
  CRISPR gRNA sequence
ctgcatgactatataaaaac

SEQ ID NO: 158445 - DNA, 20 bp, Artificial
  CRISPR gRNA sequence
catgactatataaaaacctt

SEQ ID NO: 158446 - DNA, 20 bp, Artificial
  CRISPR gRNA sequence
tataaaaaccttagatgagt

SEQ ID NO: 158447 - DNA, 20 bp, Artificial
  CRISPR gRNA sequence
agatgagtttaaatagagac

SEQ ID NO: 158448 - DNA, 20 bp, Artificial
  CRISPR gRNA sequence
gatgagtttaaatagagact

SEQ ID NO: 158449 - DNA, 20 bp, Artificial
  CRISPR gRNA sequence
aaatagagactattgaacct

SEQ ID NO: 158450 - DNA, 20 bp, Artificial
  CRISPR gRNA sequence
aatagagactattgaacctt

SEQ ID NO: 158451 - DNA, 20 bp, Artificial
  CRISPR gRNA sequence
ttgaaccttctcttctctct

SEQ ID NO: 158452 - DNA, 20 bp, Artificial
  CRISPR gRNA sequence
aaccttctcttctctctagt

SEQ ID NO: 158453 - DNA, 20 bp, Artificial
  CRISPR gRNA sequence
ctcttctctctagtcacttt

SEQ ID NO: 158454 - DNA, 20 bp, Artificial
  CRISPR gRNA sequence
tcttctctctagtcactttg

SEQ ID NO: 158455 - DNA, 20 bp, Artificial
  CRISPR gRNA sequence
ttctctctagtcactttgcc

SEQ ID NO: 158456 - DNA, 20 bp, Artificial
  CRISPR gRNA sequence
ctctctagtcactttgcctt

SEQ ID NO: 158457 - DNA, 20 bp, Artificial
  CRISPR gRNA sequence
tctctagtcactttgccttc

SEQ ID NO: 158458 - DNA, 20 bp, Artificial
  CRISPR gRNA sequence
tctagtcactttgccttccc

SEQ ID NO: 158459 - DNA, 20 bp, Artificial
  CRISPR gRNA sequence
tagtcactttgccttccctt

SEQ ID NO: 158460 - DNA, 20 bp, Artificial
  CRISPR gRNA sequence
gtcactttgccttcccttgt

SEQ ID NO: 158461 - DNA, 20 bp, Artificial
  CRISPR gRNA sequence
tgccttcccttgtattcatt

SEQ ID NO: 158462 - DNA, 20 bp, Artificial
  CRISPR gRNA sequence
gccttcccttgtattcattc

SEQ ID NO: 158463 - DNA, 20 bp, Artificial
  CRISPR gRNA sequence
ccttcccttgtattcattca

SEQ ID NO: 158464 - DNA, 20 bp, Artificial
  CRISPR gRNA sequence
cccttgtattcattcattta

SEQ ID NO: 158465 - DNA, 20 bp, Artificial
  CRISPR gRNA sequence
ccttgtattcattcatttat

SEQ ID NO: 158466 - DNA, 20 bp, Artificial
  CRISPR gRNA sequence
gtattcattcatttattgca

SEQ ID NO: 158467 - DNA, 20 bp, Artificial
  CRISPR gRNA sequence
tattcattcatttattgcat

SEQ ID NO: 158468 - DNA, 20 bp, Artificial
  CRISPR gRNA sequence
attcatttattgcatcttca

SEQ ID NO: 158469 - DNA, 20 bp, Artificial
  CRISPR gRNA sequence
atttattgcatcttcaagta

SEQ ID NO: 158470 - DNA, 20 bp, Artificial
  CRISPR gRNA sequence
attgcatcttcaagtagtga

SEQ ID NO: 158471 - DNA, 20 bp, Artificial
  CRISPR gRNA sequence
ttgcatcttcaagtagtgaa

SEQ ID NO: 158472 - DNA, 20 bp, Artificial
  CRISPR gRNA sequence
catcttcaagtagtgaagtg

SEQ ID NO: 158473 - DNA, 20 bp, Artificial
  CRISPR gRNA sequence
caagtagtgaagtgtaggac

SEQ ID NO: 158474 - DNA, 20 bp, Artificial
  CRISPR gRNA sequence
aagtagtgaagtgtaggact

SEQ ID NO: 158475 - DNA, 20 bp, Artificial
  CRISPR gRNA sequence
ccccaccaaaccaccagaga

SEQ ID NO: 158476 - DNA, 20 bp, Artificial
  CRISPR gRNA sequence
cccaccaaaccaccagagac

SEQ ID NO: 158477 - DNA, 20 bp, Artificial
  CRISPR gRNA sequence
tggaatgtgttcagtataca

SEQ ID NO: 158478 - DNA, 20 bp, Artificial
  CRISPR gRNA sequence
ggaatgtgttcagtatacat

SEQ ID NO: 158479 - DNA, 20 bp, Artificial
  CRISPR gRNA sequence
gaatgtgttcagtatacatc

SEQ ID NO: 158480 - DNA, 20 bp, Artificial
  CRISPR gRNA sequence
agtatacatcattgctggag

SEQ ID NO: 158481 - DNA, 20 bp, Artificial
  CRISPR gRNA sequence
ctggagtggcttagtagagt

SEQ ID NO: 158482 - DNA, 20 bp, Artificial
  CRISPR gRNA sequence
gagtggcttagtagagtgac

SEQ ID NO: 158483 - DNA, 20 bp, Artificial
  CRISPR gRNA sequence
agtagagtgactggcccagg

SEQ ID NO: 158484 - DNA, 20 bp, Artificial
  CRISPR gRNA sequence
gtagagtgactggcccaggg

SEQ ID NO: 158485 - DNA, 20 bp, Artificial
  CRISPR gRNA sequence
gcccagggccaccagctagt

SEQ ID NO: 158486 - DNA, 20 bp, Artificial
  CRISPR gRNA sequence
gtaggcagcaagcgtccagt

SEQ ID NO: 158487 - DNA, 20 bp, Artificial
  CRISPR gRNA sequence
ttaatttccagaccagtgct

SEQ ID NO: 158488 - DNA, 20 bp, Artificial
  CRISPR gRNA sequence
taatttccagaccagtgctg

SEQ ID NO: 158489 - DNA, 20 bp, Artificial
  CRISPR gRNA sequence
aatttccagaccagtgctgt

SEQ ID NO: 158490 - DNA, 20 bp, Artificial
  CRISPR gRNA sequence
atttccagaccagtgctgtt

SEQ ID NO: 158491 - DNA, 20 bp, Artificial
  CRISPR gRNA sequence
ccagaccagtgctgtttttc

SEQ ID NO: 158492 - DNA, 20 bp, Artificial
  CRISPR gRNA sequence
cagaccagtgctgtttttct

SEQ ID NO: 158493 - DNA, 20 bp, Artificial
  CRISPR gRNA sequence
tttttcttcttgtgaaattg

SEQ ID NO: 158494 - DNA, 20 bp, Artificial
  CRISPR gRNA sequence
ttcttcttgtgaaattgtca

SEQ ID NO: 158495 - DNA, 20 bp, Artificial
  CRISPR gRNA sequence
tcttcttgtgaaattgtcaa

SEQ ID NO: 158496 - DNA, 20 bp, Artificial
  CRISPR gRNA sequence
cttcttgtgaaattgtcaat

SEQ ID NO: 158497 - DNA, 20 bp, Artificial
  CRISPR gRNA sequence
ttcttgtgaaattgtcaatt

SEQ ID NO: 158498 - DNA, 20 bp, Artificial
  CRISPR gRNA sequence
cttgtgaaattgtcaatttt

SEQ ID NO: 158499 - DNA, 20 bp, Artificial
  CRISPR gRNA sequence
ttgtgaaattgtcaatttta

SEQ ID NO: 158500 - DNA, 20 bp, Artificial
  CRISPR gRNA sequence
gtgaaattgtcaattttaga

SEQ ID NO: 158501 - DNA, 20 bp, Artificial
  CRISPR gRNA sequence
tgaaattgtcaattttagat

SEQ ID NO: 158502 - DNA, 20 bp, Artificial
  CRISPR gRNA sequence
tcaattttagattggtttta

SEQ ID NO: 158503 - DNA, 20 bp, Artificial
  CRISPR gRNA sequence
tagattggttttattttgga

SEQ ID NO: 158504 - DNA, 20 bp, Artificial
  CRISPR gRNA sequence
agattggttttattttggag

SEQ ID NO: 158505 - DNA, 20 bp, Artificial
  CRISPR gRNA sequence
gattggttttattttggaga

SEQ ID NO: 158506 - DNA, 20 bp, Artificial
  CRISPR gRNA sequence
gttttattttggagagtata

SEQ ID NO: 158507 - DNA, 20 bp, Artificial
  CRISPR gRNA sequence
tattttggagagtataagcc

SEQ ID NO: 158508 - DNA, 20 bp, Artificial
  CRISPR gRNA sequence
attttggagagtataagcct

SEQ ID NO: 158509 - DNA, 20 bp, Artificial
  CRISPR gRNA sequence
ttttggagagtataagcctt

SEQ ID NO: 158510 - DNA, 20 bp, Artificial
  CRISPR gRNA sequence
tggagagtataagccttctt

SEQ ID NO: 158511 - DNA, 20 bp, Artificial
  CRISPR gRNA sequence
ggagagtataagccttctta

SEQ ID NO: 158512 - DNA, 20 bp, Artificial
  CRISPR gRNA sequence
gagagtataagccttcttaa

SEQ ID NO: 158513 - DNA, 20 bp, Artificial
  CRISPR gRNA sequence
cttaagaaatgctttttagc

SEQ ID NO: 158514 - DNA, 20 bp, Artificial
  CRISPR gRNA sequence
ttaagaaatgctttttagct

SEQ ID NO: 158515 - DNA, 20 bp, Artificial
  CRISPR gRNA sequence
aagaaatgctttttagctgt

SEQ ID NO: 158516 - DNA, 20 bp, Artificial
  CRISPR gRNA sequence
agaaatgctttttagctgtt

SEQ ID NO: 158517 - DNA, 20 bp, Artificial
  CRISPR gRNA sequence
tttagctgttgtgatcgata

SEQ ID NO: 158518 - DNA, 20 bp, Artificial
  CRISPR gRNA sequence
ttagctgttgtgatcgataa

SEQ ID NO: 158519 - DNA, 20 bp, Artificial
  CRISPR gRNA sequence
tagctgttgtgatcgataat

SEQ ID NO: 158520 - DNA, 20 bp, Artificial
  CRISPR gRNA sequence
agctgttgtgatcgataata

SEQ ID NO: 158521 - DNA, 20 bp, Artificial
  CRISPR gRNA sequence
gctgttgtgatcgataatag

SEQ ID NO: 158522 - DNA, 20 bp, Artificial
  CRISPR gRNA sequence
ttgtgatcgataatagcata

SEQ ID NO: 158523 - DNA, 20 bp, Artificial
  CRISPR gRNA sequence
tgatcgataatagcataagt

SEQ ID NO: 158524 - DNA, 20 bp, Artificial
  CRISPR gRNA sequence
aggtccatctgtgtaaacat

SEQ ID NO: 158525 - DNA, 20 bp, Artificial
  CRISPR gRNA sequence
tgtaaacataaaaaccaaat

SEQ ID NO: 158526 - DNA, 20 bp, Artificial
  CRISPR gRNA sequence
ttagtaaataaatcctaccc

SEQ ID NO: 158527 - DNA, 20 bp, Artificial
  CRISPR gRNA sequence
gtaaataaatcctacccccc

SEQ ID NO: 158528 - DNA, 20 bp, Artificial
  CRISPR gRNA sequence
cccccctttccctcatccat

SEQ ID NO: 158529 - DNA, 20 bp, Artificial
  CRISPR gRNA sequence
tccctcatccatccatttat

SEQ ID NO: 158530 - DNA, 20 bp, Artificial
  CRISPR gRNA sequence
ccctcatccatccatttatt

SEQ ID NO: 158531 - DNA, 20 bp, Artificial
  CRISPR gRNA sequence
cctcatccatccatttattt

SEQ ID NO: 158532 - DNA, 20 bp, Artificial
  CRISPR gRNA sequence
atccatccatttatttttat

SEQ ID NO: 158533 - DNA, 20 bp, Artificial
  CRISPR gRNA sequence
atttttattaatattcttcc

SEQ ID NO: 158534 - DNA, 20 bp, Artificial
  CRISPR gRNA sequence
tttttattaatattcttcct

SEQ ID NO: 158535 - DNA, 20 bp, Artificial
  CRISPR gRNA sequence
ttattaatattcttcctttc

SEQ ID NO: 158536 - DNA, 20 bp, Artificial
  CRISPR gRNA sequence
tattaatattcttcctttct

SEQ ID NO: 158537 - DNA, 20 bp, Artificial
  CRISPR gRNA sequence
attaatattcttcctttctc

SEQ ID NO: 158538 - DNA, 20 bp, Artificial
  CRISPR gRNA sequence
ttaatattcttcctttctct

SEQ ID NO: 158539 - DNA, 20 bp, Artificial
  CRISPR gRNA sequence
atattcttcctttctctgta

SEQ ID NO: 158540 - DNA, 20 bp, Artificial
  CRISPR gRNA sequence
ttcctttctctgtatctccc

SEQ ID NO: 158541 - DNA, 20 bp, Artificial
  CRISPR gRNA sequence
cctttctctgtatctcccat

SEQ ID NO: 158542 - DNA, 20 bp, Artificial
  CRISPR gRNA sequence
ctttctctgtatctcccatc

SEQ ID NO: 158543 - DNA, 20 bp, Artificial
  CRISPR gRNA sequence
tctctgtatctcccatcatc

SEQ ID NO: 158544 - DNA, 20 bp, Artificial
  CRISPR gRNA sequence
ctctgtatctcccatcatca

SEQ ID NO: 158545 - DNA, 20 bp, Artificial
  CRISPR gRNA sequence
tctgtatctcccatcatcat

SEQ ID NO: 158546 - DNA, 20 bp, Artificial
  CRISPR gRNA sequence
tgtatctcccatcatcattt

SEQ ID NO: 158547 - DNA, 20 bp, Artificial
  CRISPR gRNA sequence
tatctcccatcatcatttaa

SEQ ID NO: 158548 - DNA, 20 bp, Artificial
  CRISPR gRNA sequence
ccatcatcatttaaaatata

SEQ ID NO: 158549 - DNA, 20 bp, Artificial
  CRISPR gRNA sequence
aaaatataacatcttacaaa

SEQ ID NO: 158550 - DNA, 20 bp, Artificial
  CRISPR gRNA sequence
aaatataacatcttacaaac

SEQ ID NO: 158551 - DNA, 20 bp, Artificial
  CRISPR gRNA sequence
acaaaccttagctcatttaa

SEQ ID NO: 158552 - DNA, 20 bp, Artificial
  CRISPR gRNA sequence
caaaccttagctcatttaaa

SEQ ID NO: 158553 - DNA, 20 bp, Artificial
  CRISPR gRNA sequence
agctcatttaaatgaagaaa

SEQ ID NO: 158554 - DNA, 20 bp, Artificial
  CRISPR gRNA sequence
gctcatttaaatgaagaaac

SEQ ID NO: 158555 - DNA, 20 bp, Artificial
  CRISPR gRNA sequence
atttaaatgaagaaacctag

SEQ ID NO: 158556 - DNA, 20 bp, Artificial
  CRISPR gRNA sequence
aaatgaagaaacctagaact

SEQ ID NO: 158557 - DNA, 20 bp, Artificial
  CRISPR gRNA sequence
aatgaagaaacctagaacta

SEQ ID NO: 158558 - DNA, 20 bp, Artificial
  CRISPR gRNA sequence
gaactaacctcagtaaatac

SEQ ID NO: 158559 - DNA, 20 bp, Artificial
  CRISPR gRNA sequence
acctcagtaaatacctgagc

SEQ ID NO: 158560 - DNA, 20 bp, Artificial
  CRISPR gRNA sequence
agtaaatacctgagcagtac

SEQ ID NO: 158561 - DNA, 20 bp, Artificial
  CRISPR gRNA sequence
agcagtactggtacataaaa

SEQ ID NO: 158562 - DNA, 20 bp, Artificial
  CRISPR gRNA sequence
gtacataaaatgcttgtgat

SEQ ID NO: 158563 - DNA, 20 bp, Artificial
  CRISPR gRNA sequence
gtgatagtgctgccactagg

SEQ ID NO: 158564 - DNA, 20 bp, Artificial
  CRISPR gRNA sequence
tgatagtgctgccactaggg

SEQ ID NO: 158565 - DNA, 20 bp, Artificial
  CRISPR gRNA sequence
ccactagggcaaaatacaat

SEQ ID NO: 158566 - DNA, 20 bp, Artificial
  CRISPR gRNA sequence
gggcaaaatacaataaagct

SEQ ID NO: 158567 - DNA, 20 bp, Artificial
  CRISPR gRNA sequence
acattataataaagagagtc

SEQ ID NO: 158568 - DNA, 20 bp, Artificial
  CRISPR gRNA sequence
taataaagagagtcacacaa

SEQ ID NO: 158569 - DNA, 20 bp, Artificial
  CRISPR gRNA sequence
gttggtttcccagtgcaaat

SEQ ID NO: 158570 - DNA, 20 bp, Artificial
  CRISPR gRNA sequence
ttggtttcccagtgcaaata

SEQ ID NO: 158571 - DNA, 20 bp, Artificial
  CRISPR gRNA sequence
gtttcccagtgcaaatagaa

SEQ ID NO: 158572 - DNA, 20 bp, Artificial
  CRISPR gRNA sequence
cccagtgcaaatagaagtta

SEQ ID NO: 158573 - DNA, 20 bp, Artificial
  CRISPR gRNA sequence
ccagtgcaaatagaagttat

SEQ ID NO: 158574 - DNA, 20 bp, Artificial
  CRISPR gRNA sequence
tgtttatattatagtgtagc

SEQ ID NO: 158575 - DNA, 20 bp, Artificial
  CRISPR gRNA sequence
atattatagtgtagcctatt

SEQ ID NO: 158576 - DNA, 20 bp, Artificial
  CRISPR gRNA sequence
tattatagtgtagcctatta

SEQ ID NO: 158577 - DNA, 20 bp, Artificial
  CRISPR gRNA sequence
tagtgtagcctattaagtgt

SEQ ID NO: 158578 - DNA, 20 bp, Artificial
  CRISPR gRNA sequence
ttaagtgtgcaacagcataa

SEQ ID NO: 158579 - DNA, 20 bp, Artificial
  CRISPR gRNA sequence
agtgtgcaacagcataatgt

SEQ ID NO: 158580 - DNA, 20 bp, Artificial
  CRISPR gRNA sequence
aaaaatgtgcttattttaat

SEQ ID NO: 158581 - DNA, 20 bp, Artificial
  CRISPR gRNA sequence
attttaattttaaaatacct

SEQ ID NO: 158582 - DNA, 20 bp, Artificial
  CRISPR gRNA sequence
ttttaattttaaaatacctt

SEQ ID NO: 158583 - DNA, 20 bp, Artificial
  CRISPR gRNA sequence
taattttaaaataccttatt

SEQ ID NO: 158584 - DNA, 20 bp, Artificial
  CRISPR gRNA sequence
aattttaaaataccttattg

SEQ ID NO: 158585 - DNA, 20 bp, Artificial
  CRISPR gRNA sequence
attttaaaataccttattgg

SEQ ID NO: 158586 - DNA, 20 bp, Artificial
  CRISPR gRNA sequence
taaaataccttattggtaaa

SEQ ID NO: 158587 - DNA, 20 bp, Artificial
  CRISPR gRNA sequence
aaaataccttattggtaaaa

SEQ ID NO: 158588 - DNA, 20 bp, Artificial
  CRISPR gRNA sequence
aaataccttattggtaaaaa

SEQ ID NO: 158589 - DNA, 20 bp, Artificial
  CRISPR gRNA sequence
attggtaaaaatgcaaatta

SEQ ID NO: 158590 - DNA, 20 bp, Artificial
  CRISPR gRNA sequence
ttggtaaaaatgcaaattat

SEQ ID NO: 158591 - DNA, 20 bp, Artificial
  CRISPR gRNA sequence
gtaaaaatgcaaattatcat

SEQ ID NO: 158592 - DNA, 20 bp, Artificial
  CRISPR gRNA sequence
tcatctgaacttgcagcaag

SEQ ID NO: 158593 - DNA, 20 bp, Artificial
  CRISPR gRNA sequence
aacttgcagcaagtcataac

SEQ ID NO: 158594 - DNA, 20 bp, Artificial
  CRISPR gRNA sequence
gcagcaagtcataacctttt

SEQ ID NO: 158595 - DNA, 20 bp, Artificial
  CRISPR gRNA sequence
cagcaagtcataaccttttg

SEQ ID NO: 158596 - DNA, 20 bp, Artificial
  CRISPR gRNA sequence
ttgctgcttgagggtcttga

SEQ ID NO: 158597 - DNA, 20 bp, Artificial
  CRISPR gRNA sequence
tgctgcttgagggtcttgac

SEQ ID NO: 158598 - DNA, 20 bp, Artificial
  CRISPR gRNA sequence
gctgcttgagggtcttgact

SEQ ID NO: 158599 - DNA, 20 bp, Artificial
  CRISPR gRNA sequence
ctgcttgagggtcttgactt

SEQ ID NO: 158600 - DNA, 20 bp, Artificial
  CRISPR gRNA sequence
cttgagggtcttgacttgat

SEQ ID NO: 158601 - DNA, 20 bp, Artificial
  CRISPR gRNA sequence
gagggtcttgacttgatgat

SEQ ID NO: 158602 - DNA, 20 bp, Artificial
  CRISPR gRNA sequence
agggtcttgacttgatgatg

SEQ ID NO: 158603 - DNA, 20 bp, Artificial
  CRISPR gRNA sequence
gacttgatgatgatggctgc

SEQ ID NO: 158604 - DNA, 20 bp, Artificial
  CRISPR gRNA sequence
acttgatgatgatggctgct

SEQ ID NO: 158605 - DNA, 20 bp, Artificial
  CRISPR gRNA sequence
gatgatgatggctgctgact

SEQ ID NO: 158606 - DNA, 20 bp, Artificial
  CRISPR gRNA sequence
atgatgatggctgctgactg

SEQ ID NO: 158607 - DNA, 20 bp, Artificial
  CRISPR gRNA sequence
ctgactgattcgggtggtag

SEQ ID NO: 158608 - DNA, 20 bp, Artificial
  CRISPR gRNA sequence
actgattcgggtggtagttg

SEQ ID NO: 158609 - DNA, 20 bp, Artificial
  CRISPR gRNA sequence
attcgggtggtagttgctga

SEQ ID NO: 158610 - DNA, 20 bp, Artificial
  CRISPR gRNA sequence
gggtggtagttgctgaagtt

SEQ ID NO: 158611 - DNA, 20 bp, Artificial
  CRISPR gRNA sequence
ctgaagtttggggtggcttt

SEQ ID NO: 158612 - DNA, 20 bp, Artificial
  CRISPR gRNA sequence
aagtttggggtggctttggc

SEQ ID NO: 158613 - DNA, 20 bp, Artificial
  CRISPR gRNA sequence
ggggtggctttggcaatttc

SEQ ID NO: 158614 - DNA, 20 bp, Artificial
  CRISPR gRNA sequence
gggtggctttggcaatttct

SEQ ID NO: 158615 - DNA, 20 bp, Artificial
  CRISPR gRNA sequence
tggcaatttctgtgtatgtg

SEQ ID NO: 158616 - DNA, 20 bp, Artificial
  CRISPR gRNA sequence
ggcaatttctgtgtatgtgt

SEQ ID NO: 158617 - DNA, 20 bp, Artificial
  CRISPR gRNA sequence
gcaatttctgtgtatgtgtt

SEQ ID NO: 158618 - DNA, 20 bp, Artificial
  CRISPR gRNA sequence
ctgtgtatgtgtttgtgtgt

SEQ ID NO: 158619 - DNA, 20 bp, Artificial
  CRISPR gRNA sequence
tgtgtatgtgtttgtgtgtg

SEQ ID NO: 158620 - DNA, 20 bp, Artificial
  CRISPR gRNA sequence
tgtatgtgtttgtgtgtgtg

SEQ ID NO: 158621 - DNA, 20 bp, Artificial
  CRISPR gRNA sequence
gtgtgtgtgtgtgtgtgttt

SEQ ID NO: 158622 - DNA, 20 bp, Artificial
  CRISPR gRNA sequence
tgtgtgtgtgtgtgtgtttt

SEQ ID NO: 158623 - DNA, 20 bp, Artificial
  CRISPR gRNA sequence
ttttttgagatggagtttcg

SEQ ID NO: 158624 - DNA, 20 bp, Artificial
  CRISPR gRNA sequence
tttttgagatggagtttcgc

SEQ ID NO: 158625 - DNA, 20 bp, Artificial
  CRISPR gRNA sequence
ttttgagatggagtttcgct

SEQ ID NO: 158626 - DNA, 20 bp, Artificial
  CRISPR gRNA sequence
tttgagatggagtttcgctc

SEQ ID NO: 158627 - DNA, 20 bp, Artificial
  CRISPR gRNA sequence
ttgagatggagtttcgctcc

SEQ ID NO: 158628 - DNA, 20 bp, Artificial
  CRISPR gRNA sequence
tgagatggagtttcgctcct

SEQ ID NO: 158629 - DNA, 20 bp, Artificial
  CRISPR gRNA sequence
gagatggagtttcgctcctg

SEQ ID NO: 158630 - DNA, 20 bp, Artificial
  CRISPR gRNA sequence
agatggagtttcgctcctgt

SEQ ID NO: 158631 - DNA, 20 bp, Artificial
  CRISPR gRNA sequence
cgctcctgttgctcaggctg

SEQ ID NO: 158632 - DNA, 20 bp, Artificial
  CRISPR gRNA sequence
gctcctgttgctcaggctgg

SEQ ID NO: 158633 - DNA, 20 bp, Artificial
  CRISPR gRNA sequence
ctgttgctcaggctggagtg

SEQ ID NO: 158634 - DNA, 20 bp, Artificial
  CRISPR gRNA sequence
ttgctcaggctggagtgcag

SEQ ID NO: 158635 - DNA, 20 bp, Artificial
  CRISPR gRNA sequence
ctcaggctggagtgcagtgg

SEQ ID NO: 158636 - DNA, 20 bp, Artificial
  CRISPR gRNA sequence
aggctggagtgcagtggcgc

SEQ ID NO: 158637 - DNA, 20 bp, Artificial
  CRISPR gRNA sequence
gagtgcagtggcgccatctc

SEQ ID NO: 158638 - DNA, 20 bp, Artificial
  CRISPR gRNA sequence
agctcactgcaacctctgcc

SEQ ID NO: 158639 - DNA, 20 bp, Artificial
  CRISPR gRNA sequence
actgcaacctctgcctcctg

SEQ ID NO: 158640 - DNA, 20 bp, Artificial
  CRISPR gRNA sequence
caacctctgcctcctgggct

SEQ ID NO: 158641 - DNA, 20 bp, Artificial
  CRISPR gRNA sequence
tgcctcctgggctcaagcga

SEQ ID NO: 158642 - DNA, 20 bp, Artificial
  CRISPR gRNA sequence
cctcctgggctcaagcgatt

SEQ ID NO: 158643 - DNA, 20 bp, Artificial
  CRISPR gRNA sequence
ctgggctcaagcgattctgc

SEQ ID NO: 158644 - DNA, 20 bp, Artificial
  CRISPR gRNA sequence
ggctcaagcgattctgctgc

SEQ ID NO: 158645 - DNA, 20 bp, Artificial
  CRISPR gRNA sequence
aagcgattctgctgccccag

SEQ ID NO: 158646 - DNA, 20 bp, Artificial
  CRISPR gRNA sequence
tgctgccccagcttcccaag

SEQ ID NO: 158647 - DNA, 20 bp, Artificial
  CRISPR gRNA sequence
ctgccccagcttcccaagta

SEQ ID NO: 158648 - DNA, 20 bp, Artificial
  CRISPR gRNA sequence
ccccagcttcccaagtagct

SEQ ID NO: 158649 - DNA, 20 bp, Artificial
  CRISPR gRNA sequence
cccaagtagctgggattgca

SEQ ID NO: 158650 - DNA, 20 bp, Artificial
  CRISPR gRNA sequence
ccaagtagctgggattgcag

SEQ ID NO: 158651 - DNA, 20 bp, Artificial
  CRISPR gRNA sequence
ggattgcaggcccgcaccac

SEQ ID NO: 158652 - DNA, 20 bp, Artificial
  CRISPR gRNA sequence
caggcccgcaccaccatgcc

SEQ ID NO: 158653 - DNA, 20 bp, Artificial
  CRISPR gRNA sequence
atttttgtatttttagtaga

SEQ ID NO: 158654 - DNA, 20 bp, Artificial
  CRISPR gRNA sequence
ttgtatttttagtagagacg

SEQ ID NO: 158655 - DNA, 20 bp, Artificial
  CRISPR gRNA sequence
tgtatttttagtagagacgg

SEQ ID NO: 158656 - DNA, 20 bp, Artificial
  CRISPR gRNA sequence
gtatttttagtagagacggg

SEQ ID NO: 158657 - DNA, 20 bp, Artificial
  CRISPR gRNA sequence
tatttttagtagagacgggg

SEQ ID NO: 158658 - DNA, 20 bp, Artificial
  CRISPR gRNA sequence
ttagtagagacggggtttca

SEQ ID NO: 158659 - DNA, 20 bp, Artificial
  CRISPR gRNA sequence
tagtagagacggggtttcac

SEQ ID NO: 158660 - DNA, 20 bp, Artificial
  CRISPR gRNA sequence
agtagagacggggtttcacc

SEQ ID NO: 158661 - DNA, 20 bp, Artificial
  CRISPR gRNA sequence
gtagagacggggtttcacca

SEQ ID NO: 158662 - DNA, 20 bp, Artificial
  CRISPR gRNA sequence
caccatgttggccaggctgg

SEQ ID NO: 158663 - DNA, 20 bp, Artificial
  CRISPR gRNA sequence
accatgttggccaggctggt

SEQ ID NO: 158664 - DNA, 20 bp, Artificial
  CRISPR gRNA sequence
gccaggctggtttcgaactc

SEQ ID NO: 158665 - DNA, 20 bp, Artificial
  CRISPR gRNA sequence
gtttcgaactcctgacctca

SEQ ID NO: 158666 - DNA, 20 bp, Artificial
  CRISPR gRNA sequence
cgaactcctgacctcaggtg

SEQ ID NO: 158667 - DNA, 20 bp, Artificial
  CRISPR gRNA sequence
gaactcctgacctcaggtga

SEQ ID NO: 158668 - DNA, 20 bp, Artificial
  CRISPR gRNA sequence
ctgacctcaggtgatccacc

SEQ ID NO: 158669 - DNA, 20 bp, Artificial
  CRISPR gRNA sequence
acctcaggtgatccacccac

SEQ ID NO: 158670 - DNA, 20 bp, Artificial
  CRISPR gRNA sequence
aggtgatccacccacctcag

SEQ ID NO: 158671 - DNA, 20 bp, Artificial
  CRISPR gRNA sequence
agtctcccaaagtgctggga

SEQ ID NO: 158672 - DNA, 20 bp, Artificial
  CRISPR gRNA sequence
ccaaagtgctgggattacag

SEQ ID NO: 158673 - DNA, 20 bp, Artificial
  CRISPR gRNA sequence
ggattacaggcgtgagccac

SEQ ID NO: 158674 - DNA, 20 bp, Artificial
  CRISPR gRNA sequence
caggcgtgagccaccgcatc

SEQ ID NO: 158675 - DNA, 20 bp, Artificial
  CRISPR gRNA sequence
gcctgttttttttttttcct

SEQ ID NO: 158676 - DNA, 20 bp, Artificial
  CRISPR gRNA sequence
ttttttttttttcctctctc

SEQ ID NO: 158677 - DNA, 20 bp, Artificial
  CRISPR gRNA sequence
tttttttttcctctctccac

SEQ ID NO: 158678 - DNA, 20 bp, Artificial
  CRISPR gRNA sequence
ttttttttcctctctccaca

SEQ ID NO: 158679 - DNA, 20 bp, Artificial
  CRISPR gRNA sequence
tttttttcctctctccacac

SEQ ID NO: 158680 - DNA, 20 bp, Artificial
  CRISPR gRNA sequence
ttttttcctctctccacact

SEQ ID NO: 158681 - DNA, 20 bp, Artificial
  CRISPR gRNA sequence
tttttcctctctccacactg

SEQ ID NO: 158682 - DNA, 20 bp, Artificial
  CRISPR gRNA sequence
ttttcctctctccacactgt

SEQ ID NO: 158683 - DNA, 20 bp, Artificial
  CRISPR gRNA sequence
tttcctctctccacactgtc

SEQ ID NO: 158684 - DNA, 20 bp, Artificial
  CRISPR gRNA sequence
ttcctctctccacactgtca

SEQ ID NO: 158685 - DNA, 20 bp, Artificial
  CRISPR gRNA sequence
tcctctctccacactgtcac

SEQ ID NO: 158686 - DNA, 20 bp, Artificial
  CRISPR gRNA sequence
cctctctccacactgtcacc

SEQ ID NO: 158687 - DNA, 20 bp, Artificial
  CRISPR gRNA sequence
ctctctccacactgtcaccc

SEQ ID NO: 158688 - DNA, 20 bp, Artificial
  CRISPR gRNA sequence
tctccacactgtcacccagg

SEQ ID NO: 158689 - DNA, 20 bp, Artificial
  CRISPR gRNA sequence
tccacactgtcacccaggct

SEQ ID NO: 158690 - DNA, 20 bp, Artificial
  CRISPR gRNA sequence
cacactgtcacccaggctgg

SEQ ID NO: 158691 - DNA, 20 bp, Artificial
  CRISPR gRNA sequence
tcacccaggctggagtacag

SEQ ID NO: 158692 - DNA, 20 bp, Artificial
  CRISPR gRNA sequence
gagtacagtgtcatgatctt

SEQ ID NO: 158693 - DNA, 20 bp, Artificial
  CRISPR gRNA sequence
ggctgattgcaacctctgcc

SEQ ID NO: 158694 - DNA, 20 bp, Artificial
  CRISPR gRNA sequence
gctgattgcaacctctgcct

SEQ ID NO: 158695 - DNA, 20 bp, Artificial
  CRISPR gRNA sequence
attgcaacctctgccttcca

SEQ ID NO: 158696 - DNA, 20 bp, Artificial
  CRISPR gRNA sequence
caacctctgccttccaggtt

SEQ ID NO: 158697 - DNA, 20 bp, Artificial
  CRISPR gRNA sequence
tgccttccaggttcaagcca

SEQ ID NO: 158698 - DNA, 20 bp, Artificial
  CRISPR gRNA sequence
ccttccaggttcaagccatc

SEQ ID NO: 158699 - DNA, 20 bp, Artificial
  CRISPR gRNA sequence
ccaggttcaagccatcctcc

SEQ ID NO: 158700 - DNA, 20 bp, Artificial
  CRISPR gRNA sequence
caggttcaagccatcctcct

SEQ ID NO: 158701 - DNA, 20 bp, Artificial
  CRISPR gRNA sequence
aagccatcctcctacttcag

SEQ ID NO: 158702 - DNA, 20 bp, Artificial
  CRISPR gRNA sequence
ctacttcagcctcccaagta

SEQ ID NO: 158703 - DNA, 20 bp, Artificial
  CRISPR gRNA sequence
cttcagcctcccaagtagct

SEQ ID NO: 158704 - DNA, 20 bp, Artificial
  CRISPR gRNA sequence
cagcctcccaagtagctggg

SEQ ID NO: 158705 - DNA, 20 bp, Artificial
  CRISPR gRNA sequence
agcctcccaagtagctggga

SEQ ID NO: 158706 - DNA, 20 bp, Artificial
  CRISPR gRNA sequence
ccaagtagctgggactacag

SEQ ID NO: 158707 - DNA, 20 bp, Artificial
  CRISPR gRNA sequence
ggactacagacacgtgccac

SEQ ID NO: 158708 - DNA, 20 bp, Artificial
  CRISPR gRNA sequence
cagacacgtgccaccacacc

SEQ ID NO: 158709 - DNA, 20 bp, Artificial
  CRISPR gRNA sequence
atttttgtattttttgtata

SEQ ID NO: 158710 - DNA, 20 bp, Artificial
  CRISPR gRNA sequence
ttgtattttttgtatagaca

SEQ ID NO: 158711 - DNA, 20 bp, Artificial
  CRISPR gRNA sequence
tgtattttttgtatagacag

SEQ ID NO: 158712 - DNA, 20 bp, Artificial
  CRISPR gRNA sequence
gtattttttgtatagacagg

SEQ ID NO: 158713 - DNA, 20 bp, Artificial
  CRISPR gRNA sequence
tattttttgtatagacaggg

SEQ ID NO: 158714 - DNA, 20 bp, Artificial
  CRISPR gRNA sequence
tttgtatagacagggtctcc

SEQ ID NO: 158715 - DNA, 20 bp, Artificial
  CRISPR gRNA sequence
ttgtatagacagggtctcct

SEQ ID NO: 158716 - DNA, 20 bp, Artificial
  CRISPR gRNA sequence
tgtatagacagggtctcctg

SEQ ID NO: 158717 - DNA, 20 bp, Artificial
  CRISPR gRNA sequence
gtatagacagggtctcctgt

SEQ ID NO: 158718 - DNA, 20 bp, Artificial
  CRISPR gRNA sequence
tatagacagggtctcctgtg

SEQ ID NO: 158719 - DNA, 20 bp, Artificial
  CRISPR gRNA sequence
ctgtgttgcccagactgatc

SEQ ID NO: 158720 - DNA, 20 bp, Artificial
  CRISPR gRNA sequence
tgttgcccagactgatcttg

SEQ ID NO: 158721 - DNA, 20 bp, Artificial
  CRISPR gRNA sequence
cccagactgatcttgatgtc

SEQ ID NO: 158722 - DNA, 20 bp, Artificial
  CRISPR gRNA sequence
atcttgatgtctcaaactcc

SEQ ID NO: 158723 - DNA, 20 bp, Artificial
  CRISPR gRNA sequence
gatgtctcaaactcctgggc

SEQ ID NO: 158724 - DNA, 20 bp, Artificial
  CRISPR gRNA sequence
atgtctcaaactcctgggct

SEQ ID NO: 158725 - DNA, 20 bp, Artificial
  CRISPR gRNA sequence
aaactcctgggctgaagtga

SEQ ID NO: 158726 - DNA, 20 bp, Artificial
  CRISPR gRNA sequence
ctgggctgaagtgatcctct

SEQ ID NO: 158727 - DNA, 20 bp, Artificial
  CRISPR gRNA sequence
ggctgaagtgatcctcttgc

SEQ ID NO: 158728 - DNA, 20 bp, Artificial
  CRISPR gRNA sequence
aagtgatcctcttgccctag

SEQ ID NO: 158729 - DNA, 20 bp, Artificial
  CRISPR gRNA sequence
ttgccctagcctcccaaagt

SEQ ID NO: 158730 - DNA, 20 bp, Artificial
  CRISPR gRNA sequence
gccctagcctcccaaagtgc

SEQ ID NO: 158731 - DNA, 20 bp, Artificial
  CRISPR gRNA sequence
ccctagcctcccaaagtgct

SEQ ID NO: 158732 - DNA, 20 bp, Artificial
  CRISPR gRNA sequence
gcctcccaaagtgctgggat

SEQ ID NO: 158733 - DNA, 20 bp, Artificial
  CRISPR gRNA sequence
ccaaagtgctgggattactg

SEQ ID NO: 158734 - DNA, 20 bp, Artificial
  CRISPR gRNA sequence
ggattactggcgtgagccac

SEQ ID NO: 158735 - DNA, 20 bp, Artificial
  CRISPR gRNA sequence
ctggcgtgagccactgtgcc

SEQ ID NO: 158736 - DNA, 20 bp, Artificial
  CRISPR gRNA sequence
gcgtgagccactgtgcctgg

SEQ ID NO: 158737 - DNA, 20 bp, Artificial
  CRISPR gRNA sequence
tgcctggctggcaatttctt

SEQ ID NO: 158738 - DNA, 20 bp, Artificial
  CRISPR gRNA sequence
gctggcaatttcttaaaata

SEQ ID NO: 158739 - DNA, 20 bp, Artificial
  CRISPR gRNA sequence
gcaatttcttaaaataaggc

SEQ ID NO: 158740 - DNA, 20 bp, Artificial
  CRISPR gRNA sequence
cttaaaataaggcagcagtg

SEQ ID NO: 158741 - DNA, 20 bp, Artificial
  CRISPR gRNA sequence
ttaaaataaggcagcagtga

SEQ ID NO: 158742 - DNA, 20 bp, Artificial
  CRISPR gRNA sequence
aaaataaggcagcagtgaag

SEQ ID NO: 158743 - DNA, 20 bp, Artificial
  CRISPR gRNA sequence
aaataaggcagcagtgaagt

SEQ ID NO: 158744 - DNA, 20 bp, Artificial
  CRISPR gRNA sequence
gttgcttcagttgactcttc

SEQ ID NO: 158745 - DNA, 20 bp, Artificial
  CRISPR gRNA sequence
ttgcttcagttgactcttcc

SEQ ID NO: 158746 - DNA, 20 bp, Artificial
  CRISPR gRNA sequence
cttcagttgactcttccttt

SEQ ID NO: 158747 - DNA, 20 bp, Artificial
  CRISPR gRNA sequence
cagttgactcttcctttcat

SEQ ID NO: 158748 - DNA, 20 bp, Artificial
  CRISPR gRNA sequence
agttgactcttcctttcatg

SEQ ID NO: 158749 - DNA, 20 bp, Artificial
  CRISPR gRNA sequence
actcttcctttcatgaaaga

SEQ ID NO: 158750 - DNA, 20 bp, Artificial
  CRISPR gRNA sequence
ttcctttcatgaaagatttc

SEQ ID NO: 158751 - DNA, 20 bp, Artificial
  CRISPR gRNA sequence
cctttcatgaaagatttctc

SEQ ID NO: 158752 - DNA, 20 bp, Artificial
  CRISPR gRNA sequence
ctttcatgaaagatttctct

SEQ ID NO: 158753 - DNA, 20 bp, Artificial
  CRISPR gRNA sequence
tcatgaaagatttctctgta

SEQ ID NO: 158754 - DNA, 20 bp, Artificial
  CRISPR gRNA sequence
catgaaagatttctctgtag

SEQ ID NO: 158755 - DNA, 20 bp, Artificial
  CRISPR gRNA sequence
atgaaagatttctctgtagc

SEQ ID NO: 158756 - DNA, 20 bp, Artificial
  CRISPR gRNA sequence
ctctgtagctgcttttctgt

SEQ ID NO: 158757 - DNA, 20 bp, Artificial
  CRISPR gRNA sequence
tctgtagctgcttttctgtt

SEQ ID NO: 158758 - DNA, 20 bp, Artificial
  CRISPR gRNA sequence
tgtagctgcttttctgtttg

SEQ ID NO: 158759 - DNA, 20 bp, Artificial
  CRISPR gRNA sequence
tagctgcttttctgtttgat

SEQ ID NO: 158760 - DNA, 20 bp, Artificial
  CRISPR gRNA sequence
cttttctgtttgatagcatt

SEQ ID NO: 158761 - DNA, 20 bp, Artificial
  CRISPR gRNA sequence
ttctgtttgatagcatttta

SEQ ID NO: 158762 - DNA, 20 bp, Artificial
  CRISPR gRNA sequence
tctgtttgatagcattttac

SEQ ID NO: 158763 - DNA, 20 bp, Artificial
  CRISPR gRNA sequence
ctgtttgatagcattttacc

SEQ ID NO: 158764 - DNA, 20 bp, Artificial
  CRISPR gRNA sequence
tgtttgatagcattttaccc

SEQ ID NO: 158765 - DNA, 20 bp, Artificial
  CRISPR gRNA sequence
tttgatagcattttacccag

SEQ ID NO: 158766 - DNA, 20 bp, Artificial
  CRISPR gRNA sequence
gatagcattttacccagagt

SEQ ID NO: 158767 - DNA, 20 bp, Artificial
  CRISPR gRNA sequence
atagcattttacccagagta

SEQ ID NO: 158768 - DNA, 20 bp, Artificial
  CRISPR gRNA sequence
tacccagagtagagcttctt

SEQ ID NO: 158769 - DNA, 20 bp, Artificial
  CRISPR gRNA sequence
acccagagtagagcttcttt

SEQ ID NO: 158770 - DNA, 20 bp, Artificial
  CRISPR gRNA sequence
cccagagtagagcttctttc

SEQ ID NO: 158771 - DNA, 20 bp, Artificial
  CRISPR gRNA sequence
ctttcaaaactggagtttgt

SEQ ID NO: 158772 - DNA, 20 bp, Artificial
  CRISPR gRNA sequence
tttcaaaactggagtttgtc

SEQ ID NO: 158773 - DNA, 20 bp, Artificial
  CRISPR gRNA sequence
tcaaaactggagtttgtcct

SEQ ID NO: 158774 - DNA, 20 bp, Artificial
  CRISPR gRNA sequence
caaaactggagtttgtcctc

SEQ ID NO: 158775 - DNA, 20 bp, Artificial
  CRISPR gRNA sequence
aaaactggagtttgtcctct

SEQ ID NO: 158776 - DNA, 20 bp, Artificial
  CRISPR gRNA sequence
gagtttgtcctctcaaatcc

SEQ ID NO: 158777 - DNA, 20 bp, Artificial
  CRISPR gRNA sequence
gtcctctcaaatcctgccac

SEQ ID NO: 158778 - DNA, 20 bp, Artificial
  CRISPR gRNA sequence
tcctctcaaatcctgccact

SEQ ID NO: 158779 - DNA, 20 bp, Artificial
  CRISPR gRNA sequence
tcaaatcctgccactatttt

SEQ ID NO: 158780 - DNA, 20 bp, Artificial
  CRISPR gRNA sequence
aaatcctgccactattttat

SEQ ID NO: 158781 - DNA, 20 bp, Artificial
  CRISPR gRNA sequence
ccactattttatgaactaag

SEQ ID NO: 158782 - DNA, 20 bp, Artificial
  CRISPR gRNA sequence
ttttatgaactaagtttata

SEQ ID NO: 158783 - DNA, 20 bp, Artificial
  CRISPR gRNA sequence
tatgaactaagtttatataa

SEQ ID NO: 158784 - DNA, 20 bp, Artificial
  CRISPR gRNA sequence
atgaactaagtttatataat

SEQ ID NO: 158785 - DNA, 20 bp, Artificial
  CRISPR gRNA sequence
tgaactaagtttatataata

SEQ ID NO: 158786 - DNA, 20 bp, Artificial
  CRISPR gRNA sequence
agtttatataatattctaat

SEQ ID NO: 158787 - DNA, 20 bp, Artificial
  CRISPR gRNA sequence
atataatattctaatgttca

SEQ ID NO: 158788 - DNA, 20 bp, Artificial
  CRISPR gRNA sequence
tataatattctaatgttcat

SEQ ID NO: 158789 - DNA, 20 bp, Artificial
  CRISPR gRNA sequence
taatgttcatagcattttca

SEQ ID NO: 158790 - DNA, 20 bp, Artificial
  CRISPR gRNA sequence
atgttcatagcattttcact

SEQ ID NO: 158791 - DNA, 20 bp, Artificial
  CRISPR gRNA sequence
atagcattttcactgggagt

SEQ ID NO: 158792 - DNA, 20 bp, Artificial
  CRISPR gRNA sequence
tcactgggagtaggttccat

SEQ ID NO: 158793 - DNA, 20 bp, Artificial
  CRISPR gRNA sequence
cactgggagtaggttccatt

SEQ ID NO: 158794 - DNA, 20 bp, Artificial
  CRISPR gRNA sequence
actgggagtaggttccattt

SEQ ID NO: 158795 - DNA, 20 bp, Artificial
  CRISPR gRNA sequence
ggagtaggttccatttcaag

SEQ ID NO: 158796 - DNA, 20 bp, Artificial
  CRISPR gRNA sequence
catttcaaggaacgactttc

SEQ ID NO: 158797 - DNA, 20 bp, Artificial
  CRISPR gRNA sequence
caaggaacgactttctttgc

SEQ ID NO: 158798 - DNA, 20 bp, Artificial
  CRISPR gRNA sequence
aaggaacgactttctttgcc

SEQ ID NO: 158799 - DNA, 20 bp, Artificial
  CRISPR gRNA sequence
tctttgccttccataagaag

SEQ ID NO: 158800 - DNA, 20 bp, Artificial
  CRISPR gRNA sequence
ctttgccttccataagaagc

SEQ ID NO: 158801 - DNA, 20 bp, Artificial
  CRISPR gRNA sequence
tttgccttccataagaagca

SEQ ID NO: 158802 - DNA, 20 bp, Artificial
  CRISPR gRNA sequence
tgccttccataagaagcaac

SEQ ID NO: 158803 - DNA, 20 bp, Artificial
  CRISPR gRNA sequence
gccttccataagaagcaact

SEQ ID NO: 158804 - DNA, 20 bp, Artificial
  CRISPR gRNA sequence
ccttccataagaagcaactc

SEQ ID NO: 158805 - DNA, 20 bp, Artificial
  CRISPR gRNA sequence
ccataagaagcaactcctca

SEQ ID NO: 158806 - DNA, 20 bp, Artificial
  CRISPR gRNA sequence
cataagaagcaactcctcat

SEQ ID NO: 158807 - DNA, 20 bp, Artificial
  CRISPR gRNA sequence
ctcatctgttaaagttttat

SEQ ID NO: 158808 - DNA, 20 bp, Artificial
  CRISPR gRNA sequence
atctgttaaagttttatcat

SEQ ID NO: 158809 - DNA, 20 bp, Artificial
  CRISPR gRNA sequence
ttaaagttttatcatgagat

SEQ ID NO: 158810 - DNA, 20 bp, Artificial
  CRISPR gRNA sequence
aagttttatcatgagattgc

SEQ ID NO: 158811 - DNA, 20 bp, Artificial
  CRISPR gRNA sequence
tatcatgagattgcagcaat

SEQ ID NO: 158812 - DNA, 20 bp, Artificial
  CRISPR gRNA sequence
atcatgagattgcagcaatc

SEQ ID NO: 158813 - DNA, 20 bp, Artificial
  CRISPR gRNA sequence
tcatgagattgcagcaatcc

SEQ ID NO: 158814 - DNA, 20 bp, Artificial
  CRISPR gRNA sequence
cagcaatccagtcacatctc

SEQ ID NO: 158815 - DNA, 20 bp, Artificial
  CRISPR gRNA sequence
aggctccgcttctaattaca

SEQ ID NO: 158816 - DNA, 20 bp, Artificial
  CRISPR gRNA sequence
cgcttctaattacagttctc

SEQ ID NO: 158817 - DNA, 20 bp, Artificial
  CRISPR gRNA sequence
ctaattacagttctcttgct

SEQ ID NO: 158818 - DNA, 20 bp, Artificial
  CRISPR gRNA sequence
taattacagttctcttgcta

SEQ ID NO: 158819 - DNA, 20 bp, Artificial
  CRISPR gRNA sequence
attacagttctcttgctatt

SEQ ID NO: 158820 - DNA, 20 bp, Artificial
  CRISPR gRNA sequence
cagttctcttgctatttcta

SEQ ID NO: 158821 - DNA, 20 bp, Artificial
  CRISPR gRNA sequence
tcttgctatttctaccacat

SEQ ID NO: 158822 - DNA, 20 bp, Artificial
  CRISPR gRNA sequence
ttgctatttctaccacatct

SEQ ID NO: 158823 - DNA, 20 bp, Artificial
  CRISPR gRNA sequence
gctatttctaccacatctac

SEQ ID NO: 158824 - DNA, 20 bp, Artificial
  CRISPR gRNA sequence
ctatttctaccacatctaca

SEQ ID NO: 158825 - DNA, 20 bp, Artificial
  CRISPR gRNA sequence
tttctaccacatctacagtt

SEQ ID NO: 158826 - DNA, 20 bp, Artificial
  CRISPR gRNA sequence
ctaccacatctacagttact

SEQ ID NO: 158827 - DNA, 20 bp, Artificial
  CRISPR gRNA sequence
taccacatctacagttactt

SEQ ID NO: 158828 - DNA, 20 bp, Artificial
  CRISPR gRNA sequence
ccacatctacagttacttct

SEQ ID NO: 158829 - DNA, 20 bp, Artificial
  CRISPR gRNA sequence
cagttacttcttccactgaa

SEQ ID NO: 158830 - DNA, 20 bp, Artificial
  CRISPR gRNA sequence
cttcttccactgaagtctca

SEQ ID NO: 158831 - DNA, 20 bp, Artificial
  CRISPR gRNA sequence
cttccactgaagtctcaaac

SEQ ID NO: 158832 - DNA, 20 bp, Artificial
  CRISPR gRNA sequence
ttccactgaagtctcaaacc

SEQ ID NO: 158833 - DNA, 20 bp, Artificial
  CRISPR gRNA sequence
ccactgaagtctcaaacccc

SEQ ID NO: 158834 - DNA, 20 bp, Artificial
  CRISPR gRNA sequence
cactgaagtctcaaacccct

SEQ ID NO: 158835 - DNA, 20 bp, Artificial
  CRISPR gRNA sequence
aagtctcaaacccctcaaaa

SEQ ID NO: 158836 - DNA, 20 bp, Artificial
  CRISPR gRNA sequence
aaacccctcaaaatcatcca

SEQ ID NO: 158837 - DNA, 20 bp, Artificial
  CRISPR gRNA sequence
aaaatcatccaggaggattg

SEQ ID NO: 158838 - DNA, 20 bp, Artificial
  CRISPR gRNA sequence
gaatcaacttcagactcctg

SEQ ID NO: 158839 - DNA, 20 bp, Artificial
  CRISPR gRNA sequence
cagactcctgttaatgttta

SEQ ID NO: 158840 - DNA, 20 bp, Artificial
  CRISPR gRNA sequence
agactcctgttaatgtttat

SEQ ID NO: 158841 - DNA, 20 bp, Artificial
  CRISPR gRNA sequence
ctgttaatgtttatattttg

SEQ ID NO: 158842 - DNA, 20 bp, Artificial
  CRISPR gRNA sequence
ttaatgtttatattttgact

SEQ ID NO: 158843 - DNA, 20 bp, Artificial
  CRISPR gRNA sequence
atgtttatattttgacttcc

SEQ ID NO: 158844 - DNA, 20 bp, Artificial
  CRISPR gRNA sequence
atattttgacttcctcccat

SEQ ID NO: 158845 - DNA, 20 bp, Artificial
  CRISPR gRNA sequence
tattttgacttcctcccatg

SEQ ID NO: 158846 - DNA, 20 bp, Artificial
  CRISPR gRNA sequence
tgacttcctcccatgaattt

SEQ ID NO: 158847 - DNA, 20 bp, Artificial
  CRISPR gRNA sequence
gacttcctcccatgaatttt

SEQ ID NO: 158848 - DNA, 20 bp, Artificial
  CRISPR gRNA sequence
acttcctcccatgaattttg

SEQ ID NO: 158849 - DNA, 20 bp, Artificial
  CRISPR gRNA sequence
cctcccatgaattttgaatg

SEQ ID NO: 158850 - DNA, 20 bp, Artificial
  CRISPR gRNA sequence
ctcccatgaattttgaatgg

SEQ ID NO: 158851 - DNA, 20 bp, Artificial
  CRISPR gRNA sequence
ccatgaattttgaatggctt

SEQ ID NO: 158852 - DNA, 20 bp, Artificial
  CRISPR gRNA sequence
tgaatggctttttttgtttg

SEQ ID NO: 158853 - DNA, 20 bp, Artificial
  CRISPR gRNA sequence
gaatggctttttttgtttgt

SEQ ID NO: 158854 - DNA, 20 bp, Artificial
  CRISPR gRNA sequence
aatggctttttttgtttgtt

SEQ ID NO: 158855 - DNA, 20 bp, Artificial
  CRISPR gRNA sequence
tttttgtttgtttgtttggt

SEQ ID NO: 158856 - DNA, 20 bp, Artificial
  CRISPR gRNA sequence
ttttgtttgtttgtttggtt

SEQ ID NO: 158857 - DNA, 20 bp, Artificial
  CRISPR gRNA sequence
tttgtttgtttgtttggttg

SEQ ID NO: 158858 - DNA, 20 bp, Artificial
  CRISPR gRNA sequence
ttgtttgtttgtttggttgg

SEQ ID NO: 158859 - DNA, 20 bp, Artificial
  CRISPR gRNA sequence
tgtttgtttgtttggttggt

SEQ ID NO: 158860 - DNA, 20 bp, Artificial
  CRISPR gRNA sequence
gtttgtttgtttggttggtt

SEQ ID NO: 158861 - DNA, 20 bp, Artificial
  CRISPR gRNA sequence
tttgtttgtttggttggttg

SEQ ID NO: 158862 - DNA, 20 bp, Artificial
  CRISPR gRNA sequence
gtttgtttggttggttggtt

SEQ ID NO: 158863 - DNA, 20 bp, Artificial
  CRISPR gRNA sequence
tttgtttggttggttggttg

SEQ ID NO: 158864 - DNA, 20 bp, Artificial
  CRISPR gRNA sequence
gtttggttggttggttggtt

SEQ ID NO: 158865 - DNA, 20 bp, Artificial
  CRISPR gRNA sequence
tttggttggttggttggttg

SEQ ID NO: 158866 - DNA, 20 bp, Artificial
  CRISPR gRNA sequence
ggttggttggttggttggtt

SEQ ID NO: 158867 - DNA, 20 bp, Artificial
  CRISPR gRNA sequence
gttggttggttggttggttg

SEQ ID NO: 158868 - DNA, 20 bp, Artificial
  CRISPR gRNA sequence
gttggttggttggttggttt

SEQ ID NO: 158869 - DNA, 20 bp, Artificial
  CRISPR gRNA sequence
gttggttggttggtttttga

SEQ ID NO: 158870 - DNA, 20 bp, Artificial
  CRISPR gRNA sequence
gttggttggtttttgagaca

SEQ ID NO: 158871 - DNA, 20 bp, Artificial
  CRISPR gRNA sequence
gttggtttttgagacagggt

SEQ ID NO: 158872 - DNA, 20 bp, Artificial
  CRISPR gRNA sequence
gtttttgagacagggtctta

SEQ ID NO: 158873 - DNA, 20 bp, Artificial
  CRISPR gRNA sequence
ttgagacagggtcttactct

SEQ ID NO: 158874 - DNA, 20 bp, Artificial
  CRISPR gRNA sequence
tgagacagggtcttactctg

SEQ ID NO: 158875 - DNA, 20 bp, Artificial
  CRISPR gRNA sequence
gagacagggtcttactctgt

SEQ ID NO: 158876 - DNA, 20 bp, Artificial
  CRISPR gRNA sequence
agacagggtcttactctgtt

SEQ ID NO: 158877 - DNA, 20 bp, Artificial
  CRISPR gRNA sequence
actctgttgcccagactgga

SEQ ID NO: 158878 - DNA, 20 bp, Artificial
  CRISPR gRNA sequence
ctctgttgcccagactggag

SEQ ID NO: 158879 - DNA, 20 bp, Artificial
  CRISPR gRNA sequence
tgttgcccagactggagtgc

SEQ ID NO: 158880 - DNA, 20 bp, Artificial
  CRISPR gRNA sequence
ttgcccagactggagtgcag

SEQ ID NO: 158881 - DNA, 20 bp, Artificial
  CRISPR gRNA sequence
cccagactggagtgcagtag

SEQ ID NO: 158882 - DNA, 20 bp, Artificial
  CRISPR gRNA sequence
gagtgcagtagcaagatctt

SEQ ID NO: 158883 - DNA, 20 bp, Artificial
  CRISPR gRNA sequence
ggctcactgcagccctgatc

SEQ ID NO: 158884 - DNA, 20 bp, Artificial
  CRISPR gRNA sequence
gctcactgcagccctgatct

SEQ ID NO: 158885 - DNA, 20 bp, Artificial
  CRISPR gRNA sequence
actgcagccctgatctccca

SEQ ID NO: 158886 - DNA, 20 bp, Artificial
  CRISPR gRNA sequence
cagccctgatctcccaggct

SEQ ID NO: 158887 - DNA, 20 bp, Artificial
  CRISPR gRNA sequence
atctcccaggctcaagtgat

SEQ ID NO: 158888 - DNA, 20 bp, Artificial
  CRISPR gRNA sequence
ccaggctcaagtgatcctcc

SEQ ID NO: 158889 - DNA, 20 bp, Artificial
  CRISPR gRNA sequence
aagtgatcctcccacctcag

SEQ ID NO: 158890 - DNA, 20 bp, Artificial
  CRISPR gRNA sequence
ccacctcagcctcctaagta

SEQ ID NO: 158891 - DNA, 20 bp, Artificial
  CRISPR gRNA sequence
agcctcctaagtagttggga

SEQ ID NO: 158892 - DNA, 20 bp, Artificial
  CRISPR gRNA sequence
ctaagtagttgggacaataa

SEQ ID NO: 158893 - DNA, 20 bp, Artificial
  CRISPR gRNA sequence
agtagttgggacaataagca

SEQ ID NO: 158894 - DNA, 20 bp, Artificial
  CRISPR gRNA sequence
ggacaataagcatgtgccac

SEQ ID NO: 158895 - DNA, 20 bp, Artificial
  CRISPR gRNA sequence
atttttgtattttttgtaga

SEQ ID NO: 158896 - DNA, 20 bp, Artificial
  CRISPR gRNA sequence
ttgtattttttgtagagaca

SEQ ID NO: 158897 - DNA, 20 bp, Artificial
  CRISPR gRNA sequence
tgtattttttgtagagacag

SEQ ID NO: 158898 - DNA, 20 bp, Artificial
  CRISPR gRNA sequence
gtattttttgtagagacagg

SEQ ID NO: 158899 - DNA, 20 bp, Artificial
  CRISPR gRNA sequence
tattttttgtagagacaggt

SEQ ID NO: 158900 - DNA, 20 bp, Artificial
  CRISPR gRNA sequence
tttgtagagacaggttttgc

SEQ ID NO: 158901 - DNA, 20 bp, Artificial
  CRISPR gRNA sequence
ttgtagagacaggttttgcc

SEQ ID NO: 158902 - DNA, 20 bp, Artificial
  CRISPR gRNA sequence
tgtagagacaggttttgcca

SEQ ID NO: 158903 - DNA, 20 bp, Artificial
  CRISPR gRNA sequence
gtagagacaggttttgccat

SEQ ID NO: 158904 - DNA, 20 bp, Artificial
  CRISPR gRNA sequence
tagagacaggttttgccatg

SEQ ID NO: 158905 - DNA, 20 bp, Artificial
  CRISPR gRNA sequence
tgccatgttgcccaggctgg

SEQ ID NO: 158906 - DNA, 20 bp, Artificial
  CRISPR gRNA sequence
gccatgttgcccaggctggt

SEQ ID NO: 158907 - DNA, 20 bp, Artificial
  CRISPR gRNA sequence
ccatgttgcccaggctggtt

SEQ ID NO: 158908 - DNA, 20 bp, Artificial
  CRISPR gRNA sequence
cccaggctggttttgaagtc

SEQ ID NO: 158909 - DNA, 20 bp, Artificial
  CRISPR gRNA sequence
gttttgaagtcctgagctaa

SEQ ID NO: 158910 - DNA, 20 bp, Artificial
  CRISPR gRNA sequence
tgaagtcctgagctaaagca

SEQ ID NO: 158911 - DNA, 20 bp, Artificial
  CRISPR gRNA sequence
gaagtcctgagctaaagcag

SEQ ID NO: 158912 - DNA, 20 bp, Artificial
  CRISPR gRNA sequence
aagtcctgagctaaagcagt

SEQ ID NO: 158913 - DNA, 20 bp, Artificial
  CRISPR gRNA sequence
agctaaagcagtcctcccgc

SEQ ID NO: 158914 - DNA, 20 bp, Artificial
  CRISPR gRNA sequence
aagcagtcctcccgccttgg

SEQ ID NO: 158915 - DNA, 20 bp, Artificial
  CRISPR gRNA sequence
ccgccttggcctcccaaact

SEQ ID NO: 158916 - DNA, 20 bp, Artificial
  CRISPR gRNA sequence
ggcctcccaaactgctggaa

SEQ ID NO: 158917 - DNA, 20 bp, Artificial
  CRISPR gRNA sequence
gcctcccaaactgctggaat

SEQ ID NO: 158918 - DNA, 20 bp, Artificial
  CRISPR gRNA sequence
ccaaactgctggaattacag

SEQ ID NO: 158919 - DNA, 20 bp, Artificial
  CRISPR gRNA sequence
ctggaattacaggcctgagg

SEQ ID NO: 158920 - DNA, 20 bp, Artificial
  CRISPR gRNA sequence
gaattacaggcctgaggcac

SEQ ID NO: 158921 - DNA, 20 bp, Artificial
  CRISPR gRNA sequence
caggcctgaggcactgtgcc

SEQ ID NO: 158922 - DNA, 20 bp, Artificial
  CRISPR gRNA sequence
aggcactgtgcctggccatg

SEQ ID NO: 158923 - DNA, 20 bp, Artificial
  CRISPR gRNA sequence
tgcctggccatgaatattct

SEQ ID NO: 158924 - DNA, 20 bp, Artificial
  CRISPR gRNA sequence
gccatgaatattcttttttt

SEQ ID NO: 158925 - DNA, 20 bp, Artificial
  CRISPR gRNA sequence
ttttttttttttttttgaga

SEQ ID NO: 158926 - DNA, 20 bp, Artificial
  CRISPR gRNA sequence
ttttttttttttttgagaca

SEQ ID NO: 158927 - DNA, 20 bp, Artificial
  CRISPR gRNA sequence
tttttttttttttgagacaa

SEQ ID NO: 158928 - DNA, 20 bp, Artificial
  CRISPR gRNA sequence
ttttttttttttgagacaaa

SEQ ID NO: 158929 - DNA, 20 bp, Artificial
  CRISPR gRNA sequence
tttttttttttgagacaaag

SEQ ID NO: 158930 - DNA, 20 bp, Artificial
  CRISPR gRNA sequence
ttttttttttgagacaaagt

SEQ ID NO: 158931 - DNA, 20 bp, Artificial
  CRISPR gRNA sequence
tttttttttgagacaaagtc

SEQ ID NO: 158932 - DNA, 20 bp, Artificial
  CRISPR gRNA sequence
ttttttttgagacaaagtct

SEQ ID NO: 158933 - DNA, 20 bp, Artificial
  CRISPR gRNA sequence
tttttttgagacaaagtctt

SEQ ID NO: 158934 - DNA, 20 bp, Artificial
  CRISPR gRNA sequence
ttttttgagacaaagtcttg

SEQ ID NO: 158935 - DNA, 20 bp, Artificial
  CRISPR gRNA sequence
tttttgagacaaagtcttgc

SEQ ID NO: 158936 - DNA, 20 bp, Artificial
  CRISPR gRNA sequence
ttttgagacaaagtcttgct

SEQ ID NO: 158937 - DNA, 20 bp, Artificial
  CRISPR gRNA sequence
tttgagacaaagtcttgctc

SEQ ID NO: 158938 - DNA, 20 bp, Artificial
  CRISPR gRNA sequence
ttgagacaaagtcttgctct

SEQ ID NO: 158939 - DNA, 20 bp, Artificial
  CRISPR gRNA sequence
tgagacaaagtcttgctctg

SEQ ID NO: 158940 - DNA, 20 bp, Artificial
  CRISPR gRNA sequence
gagacaaagtcttgctctgt

SEQ ID NO: 158941 - DNA, 20 bp, Artificial
  CRISPR gRNA sequence
agacaaagtcttgctctgtc

SEQ ID NO: 158942 - DNA, 20 bp, Artificial
  CRISPR gRNA sequence
gctctgtcgcccaggctgga

SEQ ID NO: 158943 - DNA, 20 bp, Artificial
  CRISPR gRNA sequence
ctctgtcgcccaggctggag

SEQ ID NO: 158944 - DNA, 20 bp, Artificial
  CRISPR gRNA sequence
tgtcgcccaggctggagtgc

SEQ ID NO: 158945 - DNA, 20 bp, Artificial
  CRISPR gRNA sequence
tcgcccaggctggagtgcag

SEQ ID NO: 158946 - DNA, 20 bp, Artificial
  CRISPR gRNA sequence
gagtgcagtggcacgatttc

SEQ ID NO: 158947 - DNA, 20 bp, Artificial
  CRISPR gRNA sequence
cggctcactgcaacctccgc

SEQ ID NO: 158948 - DNA, 20 bp, Artificial
  CRISPR gRNA sequence
ggctcactgcaacctccgcc

SEQ ID NO: 158949 - DNA, 20 bp, Artificial
  CRISPR gRNA sequence
actgcaacctccgcctccca

SEQ ID NO: 158950 - DNA, 20 bp, Artificial
  CRISPR gRNA sequence
caacctccgcctcccagatt

SEQ ID NO: 158951 - DNA, 20 bp, Artificial
  CRISPR gRNA sequence
cgcctcccagattcaagtga

SEQ ID NO: 158952 - DNA, 20 bp, Artificial
  CRISPR gRNA sequence
ccagattcaagtgattctcc

SEQ ID NO: 158953 - DNA, 20 bp, Artificial
  CRISPR gRNA sequence
aagtgattctcctgcctcag

SEQ ID NO: 158954 - DNA, 20 bp, Artificial
  CRISPR gRNA sequence
tcctgcctcagctttccaag

SEQ ID NO: 158955 - DNA, 20 bp, Artificial
  CRISPR gRNA sequence
ctgcctcagctttccaagta

SEQ ID NO: 158956 - DNA, 20 bp, Artificial
  CRISPR gRNA sequence
cctcagctttccaagtagct

SEQ ID NO: 158957 - DNA, 20 bp, Artificial
  CRISPR gRNA sequence
agctttccaagtagctggga

SEQ ID NO: 158958 - DNA, 20 bp, Artificial
  CRISPR gRNA sequence
tccaagtagctgggatttca

SEQ ID NO: 158959 - DNA, 20 bp, Artificial
  CRISPR gRNA sequence
ccaagtagctgggatttcag

SEQ ID NO: 158960 - DNA, 20 bp, Artificial
  CRISPR gRNA sequence
caagtagctgggatttcagg

SEQ ID NO: 158961 - DNA, 20 bp, Artificial
  CRISPR gRNA sequence
ggatttcaggcccacaccac

SEQ ID NO: 158962 - DNA, 20 bp, Artificial
  CRISPR gRNA sequence
caggcccacaccaccatgcc

SEQ ID NO: 158963 - DNA, 20 bp, Artificial
  CRISPR gRNA sequence
aggcccacaccaccatgccc

SEQ ID NO: 158964 - DNA, 20 bp, Artificial
  CRISPR gRNA sequence
atttttgtatttttttagta

SEQ ID NO: 158965 - DNA, 20 bp, Artificial
  CRISPR gRNA sequence
ttgtatttttttagtagaga

SEQ ID NO: 158966 - DNA, 20 bp, Artificial
  CRISPR gRNA sequence
tgtatttttttagtagagac

SEQ ID NO: 158967 - DNA, 20 bp, Artificial
  CRISPR gRNA sequence
gtatttttttagtagagaca

SEQ ID NO: 158968 - DNA, 20 bp, Artificial
  CRISPR gRNA sequence
tatttttttagtagagacag

SEQ ID NO: 158969 - DNA, 20 bp, Artificial
  CRISPR gRNA sequence
ttttagtagagacagggttt

SEQ ID NO: 158970 - DNA, 20 bp, Artificial
  CRISPR gRNA sequence
tttagtagagacagggtttc

SEQ ID NO: 158971 - DNA, 20 bp, Artificial
  CRISPR gRNA sequence
ttagtagagacagggtttca

SEQ ID NO: 158972 - DNA, 20 bp, Artificial
  CRISPR gRNA sequence
tagtagagacagggtttcac

SEQ ID NO: 158973 - DNA, 20 bp, Artificial
  CRISPR gRNA sequence
agtagagacagggtttcacc

SEQ ID NO: 158974 - DNA, 20 bp, Artificial
  CRISPR gRNA sequence
gtagagacagggtttcacca

SEQ ID NO: 158975 - DNA, 20 bp, Artificial
  CRISPR gRNA sequence
caccatgttggcccggctgg

SEQ ID NO: 158976 - DNA, 20 bp, Artificial
  CRISPR gRNA sequence
accatgttggcccggctggt

SEQ ID NO: 158977 - DNA, 20 bp, Artificial
  CRISPR gRNA sequence
gcccggctggtctcaaactc

SEQ ID NO: 158978 - DNA, 20 bp, Artificial
  CRISPR gRNA sequence
gtctcaaactcatgaccttg

SEQ ID NO: 158979 - DNA, 20 bp, Artificial
  CRISPR gRNA sequence
aaactcatgaccttgtgatt

SEQ ID NO: 158980 - DNA, 20 bp, Artificial
  CRISPR gRNA sequence
atgaccttgtgattcgcccg

SEQ ID NO: 158981 - DNA, 20 bp, Artificial
  CRISPR gRNA sequence
gtgattcgcccgcctcggcc

SEQ ID NO: 158982 - DNA, 20 bp, Artificial
  CRISPR gRNA sequence
tgattcgcccgcctcggcct

SEQ ID NO: 158983 - DNA, 20 bp, Artificial
  CRISPR gRNA sequence
gcccgcctcggcctcccaaa

SEQ ID NO: 158984 - DNA, 20 bp, Artificial
  CRISPR gRNA sequence
ggcctcccaaagtgctagga

SEQ ID NO: 158985 - DNA, 20 bp, Artificial
  CRISPR gRNA sequence
ccaaagtgctaggattacag

SEQ ID NO: 158986 - DNA, 20 bp, Artificial
  CRISPR gRNA sequence
ggattacaggcatgagtcac

SEQ ID NO: 158987 - DNA, 20 bp, Artificial
  CRISPR gRNA sequence
caggcatgagtcaccgcgcc

SEQ ID NO: 158988 - DNA, 20 bp, Artificial
  CRISPR gRNA sequence
ccatgaatattcttaatggt

SEQ ID NO: 158989 - DNA, 20 bp, Artificial
  CRISPR gRNA sequence
ttaatggtatttaaaatggt

SEQ ID NO: 158990 - DNA, 20 bp, Artificial
  CRISPR gRNA sequence
aatggtatttaaaatggtga

SEQ ID NO: 158991 - DNA, 20 bp, Artificial
  CRISPR gRNA sequence
atggtatttaaaatggtgaa

SEQ ID NO: 158992 - DNA, 20 bp, Artificial
  CRISPR gRNA sequence
aaaatggtgaatcctgtcta

SEQ ID NO: 158993 - DNA, 20 bp, Artificial
  CRISPR gRNA sequence
aaatggtgaatcctgtctag

SEQ ID NO: 158994 - DNA, 20 bp, Artificial
  CRISPR gRNA sequence
tctagaaggttttcagttta

SEQ ID NO: 158995 - DNA, 20 bp, Artificial
  CRISPR gRNA sequence
gaaggttttcagtttactca

SEQ ID NO: 158996 - DNA, 20 bp, Artificial
  CRISPR gRNA sequence
tcagtttactcagatctgtc

SEQ ID NO: 158997 - DNA, 20 bp, Artificial
  CRISPR gRNA sequence
cagtttactcagatctgtct

SEQ ID NO: 158998 - DNA, 20 bp, Artificial
  CRISPR gRNA sequence
agtttactcagatctgtctg

SEQ ID NO: 158999 - DNA, 20 bp, Artificial
  CRISPR gRNA sequence
actcagatctgtctgaggaa

SEQ ID NO: 159000 - DNA, 20 bp, Artificial
  CRISPR gRNA sequence
ctcagatctgtctgaggaat

SEQ ID NO: 159001 - DNA, 20 bp, Artificial
  CRISPR gRNA sequence
agatctgtctgaggaatccc

SEQ ID NO: 159002 - DNA, 20 bp, Artificial
  CRISPR gRNA sequence
tctgaggaatccctgtctat

SEQ ID NO: 159003 - DNA, 20 bp, Artificial
  CRISPR gRNA sequence
aggaatccctgtctatggca

SEQ ID NO: 159004 - DNA, 20 bp, Artificial
  CRISPR gRNA sequence
tctatggcagctgtgtcctt

SEQ ID NO: 159005 - DNA, 20 bp, Artificial
  CRISPR gRNA sequence
tggcagctgtgtccttatga

SEQ ID NO: 159006 - DNA, 20 bp, Artificial
  CRISPR gRNA sequence
tgtccttatgaagtgttttt

SEQ ID NO: 159007 - DNA, 20 bp, Artificial
  CRISPR gRNA sequence
atgaagtgtttttatttctg

SEQ ID NO: 159008 - DNA, 20 bp, Artificial
  CRISPR gRNA sequence
tgaagtgtttttatttctga

SEQ ID NO: 159009 - DNA, 20 bp, Artificial
  CRISPR gRNA sequence
ttatttctgagacagagtct

SEQ ID NO: 159010 - DNA, 20 bp, Artificial
  CRISPR gRNA sequence
tatttctgagacagagtctc

SEQ ID NO: 159011 - DNA, 20 bp, Artificial
  CRISPR gRNA sequence
atttctgagacagagtctca

SEQ ID NO: 159012 - DNA, 20 bp, Artificial
  CRISPR gRNA sequence
tttctgagacagagtctcac

SEQ ID NO: 159013 - DNA, 20 bp, Artificial
  CRISPR gRNA sequence
ctgagacagagtctcactct

SEQ ID NO: 159014 - DNA, 20 bp, Artificial
  CRISPR gRNA sequence
tgagacagagtctcactctg

SEQ ID NO: 159015 - DNA, 20 bp, Artificial
  CRISPR gRNA sequence
agacagagtctcactctgtc

SEQ ID NO: 159016 - DNA, 20 bp, Artificial
  CRISPR gRNA sequence
actctgtcacctaggctgga

SEQ ID NO: 159017 - DNA, 20 bp, Artificial
  CRISPR gRNA sequence
tgtcacctaggctggagtgc

SEQ ID NO: 159018 - DNA, 20 bp, Artificial
  CRISPR gRNA sequence
tcacctaggctggagtgcag

SEQ ID NO: 159019 - DNA, 20 bp, Artificial
  CRISPR gRNA sequence
ggctggagtgcagtggtgtg

SEQ ID NO: 159020 - DNA, 20 bp, Artificial
  CRISPR gRNA sequence
gagtgcagtggtgtgatctc

SEQ ID NO: 159021 - DNA, 20 bp, Artificial
  CRISPR gRNA sequence
ggatcactgcagcctcatgc

SEQ ID NO: 159022 - DNA, 20 bp, Artificial
  CRISPR gRNA sequence
cagcctcatgctttggcctc

SEQ ID NO: 159023 - DNA, 20 bp, Artificial
  CRISPR gRNA sequence
atgctttggcctctagagta

SEQ ID NO: 159024 - DNA, 20 bp, Artificial
  CRISPR gRNA sequence
tggcctctagagtagctggg

SEQ ID NO: 159025 - DNA, 20 bp, Artificial
  CRISPR gRNA sequence
ggcctctagagtagctggga

SEQ ID NO: 159026 - DNA, 20 bp, Artificial
  CRISPR gRNA sequence
gcctctagagtagctgggac

SEQ ID NO: 159027 - DNA, 20 bp, Artificial
  CRISPR gRNA sequence
tagagtagctgggactacag

SEQ ID NO: 159028 - DNA, 20 bp, Artificial
  CRISPR gRNA sequence
gagtagctgggactacaggc

SEQ ID NO: 159029 - DNA, 20 bp, Artificial
  CRISPR gRNA sequence
ggactacaggcgtgcaccaa

SEQ ID NO: 159030 - DNA, 20 bp, Artificial
  CRISPR gRNA sequence
caggcgtgcaccaacaagcc

SEQ ID NO: 159031 - DNA, 20 bp, Artificial
  CRISPR gRNA sequence
ctaatttttgtgtttttagt

SEQ ID NO: 159032 - DNA, 20 bp, Artificial
  CRISPR gRNA sequence
atttttgtgtttttagtaga

SEQ ID NO: 159033 - DNA, 20 bp, Artificial
  CRISPR gRNA sequence
ttgtgtttttagtagagatg

SEQ ID NO: 159034 - DNA, 20 bp, Artificial
  CRISPR gRNA sequence
tgtgtttttagtagagatgg

SEQ ID NO: 159035 - DNA, 20 bp, Artificial
  CRISPR gRNA sequence
gtgtttttagtagagatggg

SEQ ID NO: 159036 - DNA, 20 bp, Artificial
  CRISPR gRNA sequence
tgtttttagtagagatgggg

SEQ ID NO: 159037 - DNA, 20 bp, Artificial
  CRISPR gRNA sequence
ttagtagagatggggtttca

SEQ ID NO: 159038 - DNA, 20 bp, Artificial
  CRISPR gRNA sequence
tagtagagatggggtttcat

SEQ ID NO: 159039 - DNA, 20 bp, Artificial
  CRISPR gRNA sequence
agtagagatggggtttcatt

SEQ ID NO: 159040 - DNA, 20 bp, Artificial
  CRISPR gRNA sequence
gtagagatggggtttcatta

SEQ ID NO: 159041 - DNA, 20 bp, Artificial
  CRISPR gRNA sequence
cattatgttggccaggatgg

SEQ ID NO: 159042 - DNA, 20 bp, Artificial
  CRISPR gRNA sequence
attatgttggccaggatggt

SEQ ID NO: 159043 - DNA, 20 bp, Artificial
  CRISPR gRNA sequence
tgttggccaggatggtctcg

SEQ ID NO: 159044 - DNA, 20 bp, Artificial
  CRISPR gRNA sequence
gccaggatggtctcgaactc

SEQ ID NO: 159045 - DNA, 20 bp, Artificial
  CRISPR gRNA sequence
gaactcctgacctcaggtga

SEQ ID NO: 159046 - DNA, 20 bp, Artificial
  CRISPR gRNA sequence
ctgacctcaggtgatccttc

SEQ ID NO: 159047 - DNA, 20 bp, Artificial
  CRISPR gRNA sequence
acctcaggtgatccttctgc

SEQ ID NO: 159048 - DNA, 20 bp, Artificial
  CRISPR gRNA sequence
aggtgatccttctgccttgg

SEQ ID NO: 159049 - DNA, 20 bp, Artificial
  CRISPR gRNA sequence
ctgccttggcctcccaaagt

SEQ ID NO: 159050 - DNA, 20 bp, Artificial
  CRISPR gRNA sequence
tgccttggcctcccaaagtg

SEQ ID NO: 159051 - DNA, 20 bp, Artificial
  CRISPR gRNA sequence
ccttggcctcccaaagtgct

SEQ ID NO: 159052 - DNA, 20 bp, Artificial
  CRISPR gRNA sequence
ggcctcccaaagtgctggga

SEQ ID NO: 159053 - DNA, 20 bp, Artificial
  CRISPR gRNA sequence
gcctcccaaagtgctgggat

SEQ ID NO: 159054 - DNA, 20 bp, Artificial
  CRISPR gRNA sequence
ccaaagtgctgggattatag

SEQ ID NO: 159055 - DNA, 20 bp, Artificial
  CRISPR gRNA sequence
ggattataggcatgagccac

SEQ ID NO: 159056 - DNA, 20 bp, Artificial
  CRISPR gRNA sequence
taggcatgagccactgtgcc

SEQ ID NO: 159057 - DNA, 20 bp, Artificial
  CRISPR gRNA sequence
tgcccggccatgtattttct

SEQ ID NO: 159058 - DNA, 20 bp, Artificial
  CRISPR gRNA sequence
tcttcaataataagacttga

SEQ ID NO: 159059 - DNA, 20 bp, Artificial
  CRISPR gRNA sequence
cttcaataataagacttgaa

SEQ ID NO: 159060 - DNA, 20 bp, Artificial
  CRISPR gRNA sequence
ttcaataataagacttgaat

SEQ ID NO: 159061 - DNA, 20 bp, Artificial
  CRISPR gRNA sequence
caataataagacttgaatgt

SEQ ID NO: 159062 - DNA, 20 bp, Artificial
  CRISPR gRNA sequence
aataataagacttgaatgtt

SEQ ID NO: 159063 - DNA, 20 bp, Artificial
  CRISPR gRNA sequence
gaatgttgaaattactcttt

SEQ ID NO: 159064 - DNA, 20 bp, Artificial
  CRISPR gRNA sequence
aatgttgaaattactctttg

SEQ ID NO: 159065 - DNA, 20 bp, Artificial
  CRISPR gRNA sequence
aaattactctttggtccatg

SEQ ID NO: 159066 - DNA, 20 bp, Artificial
  CRISPR gRNA sequence
ctctttggtccatgggctgc

SEQ ID NO: 159067 - DNA, 20 bp, Artificial
  CRISPR gRNA sequence
tttggtccatgggctgcaga

SEQ ID NO: 159068 - DNA, 20 bp, Artificial
  CRISPR gRNA sequence
tggtccatgggctgcagaat

SEQ ID NO: 159069 - DNA, 20 bp, Artificial
  CRISPR gRNA sequence
ggtccatgggctgcagaatg

SEQ ID NO: 159070 - DNA, 20 bp, Artificial
  CRISPR gRNA sequence
gtccatgggctgcagaatgg

SEQ ID NO: 159071 - DNA, 20 bp, Artificial
  CRISPR gRNA sequence
cagaatggatattgtgttag

SEQ ID NO: 159072 - DNA, 20 bp, Artificial
  CRISPR gRNA sequence
tgttagcaggtgttaaaata

SEQ ID NO: 159073 - DNA, 20 bp, Artificial
  CRISPR gRNA sequence
gcaggtgttaaaatactaat

SEQ ID NO: 159074 - DNA, 20 bp, Artificial
  CRISPR gRNA sequence
aaatactaatctcggctggg

SEQ ID NO: 159075 - DNA, 20 bp, Artificial
  CRISPR gRNA sequence
atctcggctgggcgcgatgg

SEQ ID NO: 159076 - DNA, 20 bp, Artificial
  CRISPR gRNA sequence
ggctgggcgcgatggtttac

SEQ ID NO: 159077 - DNA, 20 bp, Artificial
  CRISPR gRNA sequence
ggcgcgatggtttacacctg

SEQ ID NO: 159078 - DNA, 20 bp, Artificial
  CRISPR gRNA sequence
acacctgtaatcccaacact

SEQ ID NO: 159079 - DNA, 20 bp, Artificial
  CRISPR gRNA sequence
cacctgtaatcccaacactt

SEQ ID NO: 159080 - DNA, 20 bp, Artificial
  CRISPR gRNA sequence
taatcccaacactttgggag

SEQ ID NO: 159081 - DNA, 20 bp, Artificial
  CRISPR gRNA sequence
tgggaggctgaggcgggcgg

SEQ ID NO: 159082 - DNA, 20 bp, Artificial
  CRISPR gRNA sequence
gggaggctgaggcgggcgga

SEQ ID NO: 159083 - DNA, 20 bp, Artificial
  CRISPR gRNA sequence
ggaggctgaggcgggcggat

SEQ ID NO: 159084 - DNA, 20 bp, Artificial
  CRISPR gRNA sequence
aggcgggcggattacttgaa

SEQ ID NO: 159085 - DNA, 20 bp, Artificial
  CRISPR gRNA sequence
cttgaaatcaagagtttgag

SEQ ID NO: 159086 - DNA, 20 bp, Artificial
  CRISPR gRNA sequence
gaaatcaagagtttgagacc

SEQ ID NO: 159087 - DNA, 20 bp, Artificial
  CRISPR gRNA sequence
aaatcaagagtttgagacca

SEQ ID NO: 159088 - DNA, 20 bp, Artificial
  CRISPR gRNA sequence
gagaccagtctggccaacgt

SEQ ID NO: 159089 - DNA, 20 bp, Artificial
  CRISPR gRNA sequence
agaccagtctggccaacgtg

SEQ ID NO: 159090 - DNA, 20 bp, Artificial
  CRISPR gRNA sequence
gccaacgtggcgaaaccctg

SEQ ID NO: 159091 - DNA, 20 bp, Artificial
  CRISPR gRNA sequence
tctttactaaaattacaaaa

SEQ ID NO: 159092 - DNA, 20 bp, Artificial
  CRISPR gRNA sequence
tactaaaattacaaaaatta

SEQ ID NO: 159093 - DNA, 20 bp, Artificial
  CRISPR gRNA sequence
actaaaattacaaaaattag

SEQ ID NO: 159094 - DNA, 20 bp, Artificial
  CRISPR gRNA sequence
ctaaaattacaaaaattagc

SEQ ID NO: 159095 - DNA, 20 bp, Artificial
  CRISPR gRNA sequence
aaattacaaaaattagctgg

SEQ ID NO: 159096 - DNA, 20 bp, Artificial
  CRISPR gRNA sequence
caaaaattagctgggcgtgg

SEQ ID NO: 159097 - DNA, 20 bp, Artificial
  CRISPR gRNA sequence
gctgggcgtggtggcgcatg

SEQ ID NO: 159098 - DNA, 20 bp, Artificial
  CRISPR gRNA sequence
ggcgtggtggcgcatgcctg

SEQ ID NO: 159099 - DNA, 20 bp, Artificial
  CRISPR gRNA sequence
ccatcccagctactcgggag

SEQ ID NO: 159100 - DNA, 20 bp, Artificial
  CRISPR gRNA sequence
ctcgggaggctgggcatgag

SEQ ID NO: 159101 - DNA, 20 bp, Artificial
  CRISPR gRNA sequence
gggaggctgggcatgagaat

SEQ ID NO: 159102 - DNA, 20 bp, Artificial
  CRISPR gRNA sequence
ggcatgagaatcgcttgaac

SEQ ID NO: 159103 - DNA, 20 bp, Artificial
  CRISPR gRNA sequence
gaacccagaaggcggaggtt

SEQ ID NO: 159104 - DNA, 20 bp, Artificial
  CRISPR gRNA sequence
aacccagaaggcggaggttg

SEQ ID NO: 159105 - DNA, 20 bp, Artificial
  CRISPR gRNA sequence
cagtgacctgagatggcacc

SEQ ID NO: 159106 - DNA, 20 bp, Artificial
  CRISPR gRNA sequence
agatggcaccactgcactcc

SEQ ID NO: 159107 - DNA, 20 bp, Artificial
  CRISPR gRNA sequence
cactccagcctgggcgacag

SEQ ID NO: 159108 - DNA, 20 bp, Artificial
  CRISPR gRNA sequence
cagcctgggcgacagagtga

SEQ ID NO: 159109 - DNA, 20 bp, Artificial
  CRISPR gRNA sequence
ggcgacagagtgagactgtc

SEQ ID NO: 159110 - DNA, 20 bp, Artificial
  CRISPR gRNA sequence
tcacaaaacaaaacaaaact

SEQ ID NO: 159111 - DNA, 20 bp, Artificial
  CRISPR gRNA sequence
tgatggagttgtgcaagcag

SEQ ID NO: 159112 - DNA, 20 bp, Artificial
  CRISPR gRNA sequence
atggagttgtgcaagcagat

SEQ ID NO: 159113 - DNA, 20 bp, Artificial
  CRISPR gRNA sequence
tgcaagcagattaatgtttt

SEQ ID NO: 159114 - DNA, 20 bp, Artificial
  CRISPR gRNA sequence
atgttttttgttttgttttt

SEQ ID NO: 159115 - DNA, 20 bp, Artificial
  CRISPR gRNA sequence
tttgttttgttttttgagac

SEQ ID NO: 159116 - DNA, 20 bp, Artificial
  CRISPR gRNA sequence
ttgttttgttttttgagacg

SEQ ID NO: 159117 - DNA, 20 bp, Artificial
  CRISPR gRNA sequence
tgttttgttttttgagacgg

SEQ ID NO: 159118 - DNA, 20 bp, Artificial
  CRISPR gRNA sequence
gttttgttttttgagacgga

SEQ ID NO: 159119 - DNA, 20 bp, Artificial
  CRISPR gRNA sequence
ttttgttttttgagacggag

SEQ ID NO: 159120 - DNA, 20 bp, Artificial
  CRISPR gRNA sequence
tgttttttgagacggagtct

SEQ ID NO: 159121 - DNA, 20 bp, Artificial
  CRISPR gRNA sequence
gttttttgagacggagtctc

SEQ ID NO: 159122 - DNA, 20 bp, Artificial
  CRISPR gRNA sequence
ttttttgagacggagtctcg

SEQ ID NO: 159123 - DNA, 20 bp, Artificial
  CRISPR gRNA sequence
tttgagacggagtctcgctg

SEQ ID NO: 159124 - DNA, 20 bp, Artificial
  CRISPR gRNA sequence
ttgagacggagtctcgctgt

SEQ ID NO: 159125 - DNA, 20 bp, Artificial
  CRISPR gRNA sequence
tgagacggagtctcgctgtg

SEQ ID NO: 159126 - DNA, 20 bp, Artificial
  CRISPR gRNA sequence
gagacggagtctcgctgtgc

SEQ ID NO: 159127 - DNA, 20 bp, Artificial
  CRISPR gRNA sequence
agacggagtctcgctgtgct

SEQ ID NO: 159128 - DNA, 20 bp, Artificial
  CRISPR gRNA sequence
gctgtgctacccaggctgga

SEQ ID NO: 159129 - DNA, 20 bp, Artificial
  CRISPR gRNA sequence
tgctacccaggctggagtgc

SEQ ID NO: 159130 - DNA, 20 bp, Artificial
  CRISPR gRNA sequence
cccaggctggagtgcagtgg

SEQ ID NO: 159131 - DNA, 20 bp, Artificial
  CRISPR gRNA sequence
gagtgcagtggtgcaatctt

SEQ ID NO: 159132 - DNA, 20 bp, Artificial
  CRISPR gRNA sequence
ggctcactgcaacctctgcc

SEQ ID NO: 159133 - DNA, 20 bp, Artificial
  CRISPR gRNA sequence
gctcactgcaacctctgcct

SEQ ID NO: 159134 - DNA, 20 bp, Artificial
  CRISPR gRNA sequence
actgcaacctctgcctcctg

SEQ ID NO: 159135 - DNA, 20 bp, Artificial
  CRISPR gRNA sequence
caacctctgcctcctgggtt

SEQ ID NO: 159136 - DNA, 20 bp, Artificial
  CRISPR gRNA sequence
tgcctcctgggtttaagcga

SEQ ID NO: 159137 - DNA, 20 bp, Artificial
  CRISPR gRNA sequence
cctcctgggtttaagcgatt

SEQ ID NO: 159138 - DNA, 20 bp, Artificial
  CRISPR gRNA sequence
ctgggtttaagcgattctcc

SEQ ID NO: 159139 - DNA, 20 bp, Artificial
  CRISPR gRNA sequence
ggtttaagcgattctcctgc

SEQ ID NO: 159140 - DNA, 20 bp, Artificial
  CRISPR gRNA sequence
aagcgattctcctgcctcag

SEQ ID NO: 159141 - DNA, 20 bp, Artificial
  CRISPR gRNA sequence
agcgattctcctgcctcagc

SEQ ID NO: 159142 - DNA, 20 bp, Artificial
  CRISPR gRNA sequence
tcctgcctcagcctcttgag

SEQ ID NO: 159143 - DNA, 20 bp, Artificial
  CRISPR gRNA sequence
ctgcctcagcctcttgagta

SEQ ID NO: 159144 - DNA, 20 bp, Artificial
  CRISPR gRNA sequence
cctcagcctcttgagtagct

SEQ ID NO: 159145 - DNA, 20 bp, Artificial
  CRISPR gRNA sequence
agcctcttgagtagctggga

SEQ ID NO: 159146 - DNA, 20 bp, Artificial
  CRISPR gRNA sequence
ttgagtagctgggattacag

SEQ ID NO: 159147 - DNA, 20 bp, Artificial
  CRISPR gRNA sequence
gagtagctgggattacaggt

SEQ ID NO: 159148 - DNA, 20 bp, Artificial
  CRISPR gRNA sequence
agtagctgggattacaggtg

SEQ ID NO: 159149 - DNA, 20 bp, Artificial
  CRISPR gRNA sequence
ggattacaggtgcccgccac

SEQ ID NO: 159150 - DNA, 20 bp, Artificial
  CRISPR gRNA sequence
caggtgcccgccaccacgcc

SEQ ID NO: 159151 - DNA, 20 bp, Artificial
  CRISPR gRNA sequence
atttttgtatttttaatgga

SEQ ID NO: 159152 - DNA, 20 bp, Artificial
  CRISPR gRNA sequence
ttgtatttttaatggagact

SEQ ID NO: 159153 - DNA, 20 bp, Artificial
  CRISPR gRNA sequence
tgtatttttaatggagactg

SEQ ID NO: 159154 - DNA, 20 bp, Artificial
  CRISPR gRNA sequence
gtatttttaatggagactgg

SEQ ID NO: 159155 - DNA, 20 bp, Artificial
  CRISPR gRNA sequence
tatttttaatggagactggg

SEQ ID NO: 159156 - DNA, 20 bp, Artificial
  CRISPR gRNA sequence
ttaatggagactgggtttca

SEQ ID NO: 159157 - DNA, 20 bp, Artificial
  CRISPR gRNA sequence
taatggagactgggtttcac

SEQ ID NO: 159158 - DNA, 20 bp, Artificial
  CRISPR gRNA sequence
aatggagactgggtttcact

SEQ ID NO: 159159 - DNA, 20 bp, Artificial
  CRISPR gRNA sequence
atggagactgggtttcacta

SEQ ID NO: 159160 - DNA, 20 bp, Artificial
  CRISPR gRNA sequence
ggtttcactatgttggccag

SEQ ID NO: 159161 - DNA, 20 bp, Artificial
  CRISPR gRNA sequence
cactatgttggccaggctgg

SEQ ID NO: 159162 - DNA, 20 bp, Artificial
  CRISPR gRNA sequence
actatgttggccaggctggt

SEQ ID NO: 159163 - DNA, 20 bp, Artificial
  CRISPR gRNA sequence
tgttggccaggctggtctcg

SEQ ID NO: 159164 - DNA, 20 bp, Artificial
  CRISPR gRNA sequence
gccaggctggtctcgaactc

SEQ ID NO: 159165 - DNA, 20 bp, Artificial
  CRISPR gRNA sequence
gtctcgaactcctgacctca

SEQ ID NO: 159166 - DNA, 20 bp, Artificial
  CRISPR gRNA sequence
gaactcctgacctcaggtta

SEQ ID NO: 159167 - DNA, 20 bp, Artificial
  CRISPR gRNA sequence
ctgacctcaggttatccgcc

SEQ ID NO: 159168 - DNA, 20 bp, Artificial
  CRISPR gRNA sequence
acctcaggttatccgcccgc

SEQ ID NO: 159169 - DNA, 20 bp, Artificial
  CRISPR gRNA sequence
aggttatccgcccgccttgg

SEQ ID NO: 159170 - DNA, 20 bp, Artificial
  CRISPR gRNA sequence
tccgcccgccttggcctccc

SEQ ID NO: 159171 - DNA, 20 bp, Artificial
  CRISPR gRNA sequence
ggcctcccaaagtgttggga

SEQ ID NO: 159172 - DNA, 20 bp, Artificial
  CRISPR gRNA sequence
gcctcccaaagtgttgggat

SEQ ID NO: 159173 - DNA, 20 bp, Artificial
  CRISPR gRNA sequence
ccaaagtgttgggattacag

SEQ ID NO: 159174 - DNA, 20 bp, Artificial
  CRISPR gRNA sequence
ggattacaggcgtgagccac

SEQ ID NO: 159175 - DNA, 20 bp, Artificial
  CRISPR gRNA sequence
caggcgtgagccactgctcc

SEQ ID NO: 159176 - DNA, 20 bp, Artificial
  CRISPR gRNA sequence
ctcccagcctccatcagttt

SEQ ID NO: 159177 - DNA, 20 bp, Artificial
  CRISPR gRNA sequence
ccagcctccatcagtttttg

SEQ ID NO: 159178 - DNA, 20 bp, Artificial
  CRISPR gRNA sequence
catcagtttttggatgacca

SEQ ID NO: 159179 - DNA, 20 bp, Artificial
  CRISPR gRNA sequence
ttggatgaccaggtatattg

SEQ ID NO: 159180 - DNA, 20 bp, Artificial
  CRISPR gRNA sequence
tggatgaccaggtatattgt

SEQ ID NO: 159181 - DNA, 20 bp, Artificial
  CRISPR gRNA sequence
ggatgaccaggtatattgtt

SEQ ID NO: 159182 - DNA, 20 bp, Artificial
  CRISPR gRNA sequence
gatgaccaggtatattgtta

SEQ ID NO: 159183 - DNA, 20 bp, Artificial
  CRISPR gRNA sequence
ttagtgagcagtaatatttt

SEQ ID NO: 159184 - DNA, 20 bp, Artificial
  CRISPR gRNA sequence
gtgagcagtaatattttcaa

SEQ ID NO: 159185 - DNA, 20 bp, Artificial
  CRISPR gRNA sequence
tcaaaggaatcttttttttc

SEQ ID NO: 159186 - DNA, 20 bp, Artificial
  CRISPR gRNA sequence
caaaggaatcttttttttct

SEQ ID NO: 159187 - DNA, 20 bp, Artificial
  CRISPR gRNA sequence
aaaggaatcttttttttctg

SEQ ID NO: 159188 - DNA, 20 bp, Artificial
  CRISPR gRNA sequence
ttttttctgagcagtaggtc

SEQ ID NO: 159189 - DNA, 20 bp, Artificial
  CRISPR gRNA sequence
tttttctgagcagtaggtct

SEQ ID NO: 159190 - DNA, 20 bp, Artificial
  CRISPR gRNA sequence
ttttctgagcagtaggtctc

SEQ ID NO: 159191 - DNA, 20 bp, Artificial
  CRISPR gRNA sequence
tttctgagcagtaggtctca

SEQ ID NO: 159192 - DNA, 20 bp, Artificial
  CRISPR gRNA sequence
ttctgagcagtaggtctcaa

SEQ ID NO: 159193 - DNA, 20 bp, Artificial
  CRISPR gRNA sequence
tctgagcagtaggtctcaac

SEQ ID NO: 159194 - DNA, 20 bp, Artificial
  CRISPR gRNA sequence
ctgagcagtaggtctcaaca

SEQ ID NO: 159195 - DNA, 20 bp, Artificial
  CRISPR gRNA sequence
tgagcagtaggtctcaacag

SEQ ID NO: 159196 - DNA, 20 bp, Artificial
  CRISPR gRNA sequence
agcagtaggtctcaacagtg

SEQ ID NO: 159197 - DNA, 20 bp, Artificial
  CRISPR gRNA sequence
aacagtgagcttaaatagtc

SEQ ID NO: 159198 - DNA, 20 bp, Artificial
  CRISPR gRNA sequence
aaatagtcaaccacgctgta

SEQ ID NO: 159199 - DNA, 20 bp, Artificial
  CRISPR gRNA sequence
aatagtcaaccacgctgtaa

SEQ ID NO: 159200 - DNA, 20 bp, Artificial
  CRISPR gRNA sequence
taaacagatgtgctgtcatc

SEQ ID NO: 159201 - DNA, 20 bp, Artificial
  CRISPR gRNA sequence
tcatccaagctttgctccat

SEQ ID NO: 159202 - DNA, 20 bp, Artificial
  CRISPR gRNA sequence
tgctccatttatagagcaca

SEQ ID NO: 159203 - DNA, 20 bp, Artificial
  CRISPR gRNA sequence
gctccatttatagagcacag

SEQ ID NO: 159204 - DNA, 20 bp, Artificial
  CRISPR gRNA sequence
ctccatttatagagcacagg

SEQ ID NO: 159205 - DNA, 20 bp, Artificial
  CRISPR gRNA sequence
catttatagagcacaggcag

SEQ ID NO: 159206 - DNA, 20 bp, Artificial
  CRISPR gRNA sequence
atagagcacaggcagagtag

SEQ ID NO: 159207 - DNA, 20 bp, Artificial
  CRISPR gRNA sequence
tagagcacaggcagagtaga

SEQ ID NO: 159208 - DNA, 20 bp, Artificial
  CRISPR gRNA sequence
tgtataattcttaagggccc

SEQ ID NO: 159209 - DNA, 20 bp, Artificial
  CRISPR gRNA sequence
gtataattcttaagggccct

SEQ ID NO: 159210 - DNA, 20 bp, Artificial
  CRISPR gRNA sequence
tataattcttaagggcccta

SEQ ID NO: 159211 - DNA, 20 bp, Artificial
  CRISPR gRNA sequence
ttaagggccctagaattttt

SEQ ID NO: 159212 - DNA, 20 bp, Artificial
  CRISPR gRNA sequence
aagggccctagaatttttgg

SEQ ID NO: 159213 - DNA, 20 bp, Artificial
  CRISPR gRNA sequence
agggccctagaatttttgga

SEQ ID NO: 159214 - DNA, 20 bp, Artificial
  CRISPR gRNA sequence
gaatttttggaatggtaaat

SEQ ID NO: 159215 - DNA, 20 bp, Artificial
  CRISPR gRNA sequence
ttggaatggtaaatgagcat

SEQ ID NO: 159216 - DNA, 20 bp, Artificial
  CRISPR gRNA sequence
tggaatggtaaatgagcatc

SEQ ID NO: 159217 - DNA, 20 bp, Artificial
  CRISPR gRNA sequence
ggaatggtaaatgagcatcg

SEQ ID NO: 159218 - DNA, 20 bp, Artificial
  CRISPR gRNA sequence
gaatggtaaatgagcatcgg

SEQ ID NO: 159219 - DNA, 20 bp, Artificial
  CRISPR gRNA sequence
ccacaggcattgacttcttt

SEQ ID NO: 159220 - DNA, 20 bp, Artificial
  CRISPR gRNA sequence
cacaggcattgacttctttg

SEQ ID NO: 159221 - DNA, 20 bp, Artificial
  CRISPR gRNA sequence
acttctttgtagctatgaaa

SEQ ID NO: 159222 - DNA, 20 bp, Artificial
  CRISPR gRNA sequence
ctttgtagctatgaaagtcc

SEQ ID NO: 159223 - DNA, 20 bp, Artificial
  CRISPR gRNA sequence
tttgtagctatgaaagtcct

SEQ ID NO: 159224 - DNA, 20 bp, Artificial
  CRISPR gRNA sequence
tgtagctatgaaagtccttg

SEQ ID NO: 159225 - DNA, 20 bp, Artificial
  CRISPR gRNA sequence
gtagctatgaaagtccttga

SEQ ID NO: 159226 - DNA, 20 bp, Artificial
  CRISPR gRNA sequence
tagctatgaaagtccttgat

SEQ ID NO: 159227 - DNA, 20 bp, Artificial
  CRISPR gRNA sequence
tgaaagtccttgatggcatc

SEQ ID NO: 159228 - DNA, 20 bp, Artificial
  CRISPR gRNA sequence
gatggcatcttcttccagta

SEQ ID NO: 159229 - DNA, 20 bp, Artificial
  CRISPR gRNA sequence
atggcatcttcttccagtaa

SEQ ID NO: 159230 - DNA, 20 bp, Artificial
  CRISPR gRNA sequence
cttccagtaaaagtccattt

SEQ ID NO: 159231 - DNA, 20 bp, Artificial
  CRISPR gRNA sequence
ttccagtaaaagtccatttt

SEQ ID NO: 159232 - DNA, 20 bp, Artificial
  CRISPR gRNA sequence
ccagtaaaagtccattttgt

SEQ ID NO: 159233 - DNA, 20 bp, Artificial
  CRISPR gRNA sequence
cagtaaaagtccattttgtc

SEQ ID NO: 159234 - DNA, 20 bp, Artificial
  CRISPR gRNA sequence
tgtctgcactgaaattctgt

SEQ ID NO: 159235 - DNA, 20 bp, Artificial
  CRISPR gRNA sequence
gtctgcactgaaattctgtt

SEQ ID NO: 159236 - DNA, 20 bp, Artificial
  CRISPR gRNA sequence
tctgcactgaaattctgttg

SEQ ID NO: 159237 - DNA, 20 bp, Artificial
  CRISPR gRNA sequence
cactgaaattctgttgttta

SEQ ID NO: 159238 - DNA, 20 bp, Artificial
  CRISPR gRNA sequence
aaattctgttgtttaatgta

SEQ ID NO: 159239 - DNA, 20 bp, Artificial
  CRISPR gRNA sequence
tgttgtttaatgtagccagt

SEQ ID NO: 159240 - DNA, 20 bp, Artificial
  CRISPR gRNA sequence
ttgtttaatgtagccagttg

SEQ ID NO: 159241 - DNA, 20 bp, Artificial
  CRISPR gRNA sequence
tttaatgtagccagttgcat

SEQ ID NO: 159242 - DNA, 20 bp, Artificial
  CRISPR gRNA sequence
aatgtagccagttgcatcaa

SEQ ID NO: 159243 - DNA, 20 bp, Artificial
  CRISPR gRNA sequence
atgtagccagttgcatcaat

SEQ ID NO: 159244 - DNA, 20 bp, Artificial
  CRISPR gRNA sequence
catcaattactctagctaga

SEQ ID NO: 159245 - DNA, 20 bp, Artificial
  CRISPR gRNA sequence
ctctagctagatcttcggga

SEQ ID NO: 159246 - DNA, 20 bp, Artificial
  CRISPR gRNA sequence
tagctagatcttcgggataa

SEQ ID NO: 159247 - DNA, 20 bp, Artificial
  CRISPR gRNA sequence
gctagatcttcgggataaaa

SEQ ID NO: 159248 - DNA, 20 bp, Artificial
  CRISPR gRNA sequence
gatcttcgggataaaacttg

SEQ ID NO: 159249 - DNA, 20 bp, Artificial
  CRISPR gRNA sequence
cgggataaaacttgctgcag

SEQ ID NO: 159250 - DNA, 20 bp, Artificial
  CRISPR gRNA sequence
gggataaaacttgctgcagc

SEQ ID NO: 159251 - DNA, 20 bp, Artificial
  CRISPR gRNA sequence
gctgcagcttctacattagc

SEQ ID NO: 159252 - DNA, 20 bp, Artificial
  CRISPR gRNA sequence
ctgcagcttctacattagca

SEQ ID NO: 159253 - DNA, 20 bp, Artificial
  CRISPR gRNA sequence
cagcttctacattagcactt

SEQ ID NO: 159254 - DNA, 20 bp, Artificial
  CRISPR gRNA sequence
ctacattagcacttgctact

SEQ ID NO: 159255 - DNA, 20 bp, Artificial
  CRISPR gRNA sequence
tacattagcacttgctactt

SEQ ID NO: 159256 - DNA, 20 bp, Artificial
  CRISPR gRNA sequence
cattagcacttgctacttca

SEQ ID NO: 159257 - DNA, 20 bp, Artificial
  CRISPR gRNA sequence
gcacttgctacttcacctta

SEQ ID NO: 159258 - DNA, 20 bp, Artificial
  CRISPR gRNA sequence
gctacttcaccttatacttt

SEQ ID NO: 159259 - DNA, 20 bp, Artificial
  CRISPR gRNA sequence
ctacttcaccttatactttt

SEQ ID NO: 159260 - DNA, 20 bp, Artificial
  CRISPR gRNA sequence
cttcaccttatacttttatg

SEQ ID NO: 159261 - DNA, 20 bp, Artificial
  CRISPR gRNA sequence
caccttatacttttatgtta

SEQ ID NO: 159262 - DNA, 20 bp, Artificial
  CRISPR gRNA sequence
accttatacttttatgttat

SEQ ID NO: 159263 - DNA, 20 bp, Artificial
  CRISPR gRNA sequence
atacttttatgttatggaga

SEQ ID NO: 159264 - DNA, 20 bp, Artificial
  CRISPR gRNA sequence
tacttttatgttatggagat

SEQ ID NO: 159265 - DNA, 20 bp, Artificial
  CRISPR gRNA sequence
ttatgttatggagatggctt

SEQ ID NO: 159266 - DNA, 20 bp, Artificial
  CRISPR gRNA sequence
tatgttatggagatggcttc

SEQ ID NO: 159267 - DNA, 20 bp, Artificial
  CRISPR gRNA sequence
atgttatggagatggcttct

SEQ ID NO: 159268 - DNA, 20 bp, Artificial
  CRISPR gRNA sequence
tgttatggagatggcttctt

SEQ ID NO: 159269 - DNA, 20 bp, Artificial
  CRISPR gRNA sequence
tggagatggcttctttgctt

SEQ ID NO: 159270 - DNA, 20 bp, Artificial
  CRISPR gRNA sequence
ctttgcttaaacctcatgaa

SEQ ID NO: 159271 - DNA, 20 bp, Artificial
  CRISPR gRNA sequence
tttgcttaaacctcatgaac

SEQ ID NO: 159272 - DNA, 20 bp, Artificial
  CRISPR gRNA sequence
tgcttaaacctcatgaacca

SEQ ID NO: 159273 - DNA, 20 bp, Artificial
  CRISPR gRNA sequence
gcttaaacctcatgaaccaa

SEQ ID NO: 159274 - DNA, 20 bp, Artificial
  CRISPR gRNA sequence
cttaaacctcatgaaccaac

SEQ ID NO: 159275 - DNA, 20 bp, Artificial
  CRISPR gRNA sequence
aaacctcatgaaccaacttt

SEQ ID NO: 159276 - DNA, 20 bp, Artificial
  CRISPR gRNA sequence
aacctcatgaaccaactttt

SEQ ID NO: 159277 - DNA, 20 bp, Artificial
  CRISPR gRNA sequence
atgaaccaacttttcttctg

SEQ ID NO: 159278 - DNA, 20 bp, Artificial
  CRISPR gRNA sequence
ttcttctgcagccccctcac

SEQ ID NO: 159279 - DNA, 20 bp, Artificial
  CRISPR gRNA sequence
tcttctgcagccccctcacc

SEQ ID NO: 159280 - DNA, 20 bp, Artificial
  CRISPR gRNA sequence
cttctgcagccccctcacct

SEQ ID NO: 159281 - DNA, 20 bp, Artificial
  CRISPR gRNA sequence
ttctgcagccccctcacctc

SEQ ID NO: 159282 - DNA, 20 bp, Artificial
  CRISPR gRNA sequence
ctgcagccccctcacctctc

SEQ ID NO: 159283 - DNA, 20 bp, Artificial
  CRISPR gRNA sequence
tgcagccccctcacctctct

SEQ ID NO: 159284 - DNA, 20 bp, Artificial
  CRISPR gRNA sequence
cagccccctcacctctctca

SEQ ID NO: 159285 - DNA, 20 bp, Artificial
  CRISPR gRNA sequence
acctctctcagccttcatag

SEQ ID NO: 159286 - DNA, 20 bp, Artificial
  CRISPR gRNA sequence
tctcagccttcatagaattg

SEQ ID NO: 159287 - DNA, 20 bp, Artificial
  CRISPR gRNA sequence
tcagccttcatagaattgag

SEQ ID NO: 159288 - DNA, 20 bp, Artificial
  CRISPR gRNA sequence
agccttcatagaattgagag

SEQ ID NO: 159289 - DNA, 20 bp, Artificial
  CRISPR gRNA sequence
catagaattgagagttaggg

SEQ ID NO: 159290 - DNA, 20 bp, Artificial
  CRISPR gRNA sequence
atagaattgagagttagggc

SEQ ID NO: 159291 - DNA, 20 bp, Artificial
  CRISPR gRNA sequence
agagttagggcattgctcca

SEQ ID NO: 159292 - DNA, 20 bp, Artificial
  CRISPR gRNA sequence
gggcattgctccacattagg

SEQ ID NO: 159293 - DNA, 20 bp, Artificial
  CRISPR gRNA sequence
ctccacattaggctttggct

SEQ ID NO: 159294 - DNA, 20 bp, Artificial
  CRISPR gRNA sequence
cacattaggctttggcttaa

SEQ ID NO: 159295 - DNA, 20 bp, Artificial
  CRISPR gRNA sequence
ggctttggcttaaaggaatg

SEQ ID NO: 159296 - DNA, 20 bp, Artificial
  CRISPR gRNA sequence
tggcttaaaggaatgttgtg

SEQ ID NO: 159297 - DNA, 20 bp, Artificial
  CRISPR gRNA sequence
ggcttaaaggaatgttgtgg

SEQ ID NO: 159298 - DNA, 20 bp, Artificial
  CRISPR gRNA sequence
gcttaaaggaatgttgtggt

SEQ ID NO: 159299 - DNA, 20 bp, Artificial
  CRISPR gRNA sequence
aaaggaatgttgtggttggt

SEQ ID NO: 159300 - DNA, 20 bp, Artificial
  CRISPR gRNA sequence
aaggaatgttgtggttggtt

SEQ ID NO: 159301 - DNA, 20 bp, Artificial
  CRISPR gRNA sequence
tggttggtttgatcttctgt

SEQ ID NO: 159302 - DNA, 20 bp, Artificial
  CRISPR gRNA sequence
gtttgatcttctgtctagac

SEQ ID NO: 159303 - DNA, 20 bp, Artificial
  CRISPR gRNA sequence
gatcttctgtctagaccact

SEQ ID NO: 159304 - DNA, 20 bp, Artificial
  CRISPR gRNA sequence
atcttctgtctagaccactg

SEQ ID NO: 159305 - DNA, 20 bp, Artificial
  CRISPR gRNA sequence
ctgtctagaccactgaaact

SEQ ID NO: 159306 - DNA, 20 bp, Artificial
  CRISPR gRNA sequence
tgtctagaccactgaaactt

SEQ ID NO: 159307 - DNA, 20 bp, Artificial
  CRISPR gRNA sequence
tctagaccactgaaactttc

SEQ ID NO: 159308 - DNA, 20 bp, Artificial
  CRISPR gRNA sequence
gaccactgaaactttcttca

SEQ ID NO: 159309 - DNA, 20 bp, Artificial
  CRISPR gRNA sequence
aaactttcttcatatcagca

SEQ ID NO: 159310 - DNA, 20 bp, Artificial
  CRISPR gRNA sequence
tcttcatatcagcaataaag

SEQ ID NO: 159311 - DNA, 20 bp, Artificial
  CRISPR gRNA sequence
cttcatatcagcaataaagc

SEQ ID NO: 159312 - DNA, 20 bp, Artificial
  CRISPR gRNA sequence
ttcatatcagcaataaagct

SEQ ID NO: 159313 - DNA, 20 bp, Artificial
  CRISPR gRNA sequence
catatcagcaataaagctgt

SEQ ID NO: 159314 - DNA, 20 bp, Artificial
  CRISPR gRNA sequence
atatcagcaataaagctgtt

SEQ ID NO: 159315 - DNA, 20 bp, Artificial
  CRISPR gRNA sequence
tttgctttcttatttgtgtg

SEQ ID NO: 159316 - DNA, 20 bp, Artificial
  CRISPR gRNA sequence
gctttcttatttgtgtgttc

SEQ ID NO: 159317 - DNA, 20 bp, Artificial
  CRISPR gRNA sequence
ctttcttatttgtgtgttca

SEQ ID NO: 159318 - DNA, 20 bp, Artificial
  CRISPR gRNA sequence
tcttatttgtgtgttcactg

SEQ ID NO: 159319 - DNA, 20 bp, Artificial
  CRISPR gRNA sequence
cttatttgtgtgttcactgg

SEQ ID NO: 159320 - DNA, 20 bp, Artificial
  CRISPR gRNA sequence
ttatttgtgtgttcactgga

SEQ ID NO: 159321 - DNA, 20 bp, Artificial
  CRISPR gRNA sequence
atttgtgtgttcactggagg

SEQ ID NO: 159322 - DNA, 20 bp, Artificial
  CRISPR gRNA sequence
tttgtgtgttcactggagga

SEQ ID NO: 159323 - DNA, 20 bp, Artificial
  CRISPR gRNA sequence
gtgtgttcactggaggagca

SEQ ID NO: 159324 - DNA, 20 bp, Artificial
  CRISPR gRNA sequence
tgtgttcactggaggagcac

SEQ ID NO: 159325 - DNA, 20 bp, Artificial
  CRISPR gRNA sequence
actggaggagcacttttaat

SEQ ID NO: 159326 - DNA, 20 bp, Artificial
  CRISPR gRNA sequence
gaggagcacttttaatttcc

SEQ ID NO: 159327 - DNA, 20 bp, Artificial
  CRISPR gRNA sequence
ttaatttccttcaagaactt

SEQ ID NO: 159328 - DNA, 20 bp, Artificial
  CRISPR gRNA sequence
taatttccttcaagaacttt

SEQ ID NO: 159329 - DNA, 20 bp, Artificial
  CRISPR gRNA sequence
aatttccttcaagaactttt

SEQ ID NO: 159330 - DNA, 20 bp, Artificial
  CRISPR gRNA sequence
atttccttcaagaacttttt

SEQ ID NO: 159331 - DNA, 20 bp, Artificial
  CRISPR gRNA sequence
ccttcaagaactttttcttt

SEQ ID NO: 159332 - DNA, 20 bp, Artificial
  CRISPR gRNA sequence
cttcaagaactttttctttg

SEQ ID NO: 159333 - DNA, 20 bp, Artificial
  CRISPR gRNA sequence
caagaactttttctttgcag

SEQ ID NO: 159334 - DNA, 20 bp, Artificial
  CRISPR gRNA sequence
aagaactttttctttgcagt

SEQ ID NO: 159335 - DNA, 20 bp, Artificial
  CRISPR gRNA sequence
tttctttgcagtcacagctt

SEQ ID NO: 159336 - DNA, 20 bp, Artificial
  CRISPR gRNA sequence
ttctttgcagtcacagcttg

SEQ ID NO: 159337 - DNA, 20 bp, Artificial
  CRISPR gRNA sequence
tctttgcagtcacagcttgg

SEQ ID NO: 159338 - DNA, 20 bp, Artificial
  CRISPR gRNA sequence
ctttgcagtcacagcttggg

SEQ ID NO: 159339 - DNA, 20 bp, Artificial
  CRISPR gRNA sequence
tttgcagtcacagcttgggt

SEQ ID NO: 159340 - DNA, 20 bp, Artificial
  CRISPR gRNA sequence
tgcagtcacagcttgggtaa

SEQ ID NO: 159341 - DNA, 20 bp, Artificial
  CRISPR gRNA sequence
gcagtcacagcttgggtaag

SEQ ID NO: 159342 - DNA, 20 bp, Artificial
  CRISPR gRNA sequence
cagtcacagcttgggtaagt

SEQ ID NO: 159343 - DNA, 20 bp, Artificial
  CRISPR gRNA sequence
gggtaagtgtttggtgcaag

SEQ ID NO: 159344 - DNA, 20 bp, Artificial
  CRISPR gRNA sequence
ggtaagtgtttggtgcaaga

SEQ ID NO: 159345 - DNA, 20 bp, Artificial
  CRISPR gRNA sequence
ggtgcaagaggcctagctct

SEQ ID NO: 159346 - DNA, 20 bp, Artificial
  CRISPR gRNA sequence
gtgcaagaggcctagctctt

SEQ ID NO: 159347 - DNA, 20 bp, Artificial
  CRISPR gRNA sequence
gctcttggtccatctcagct

SEQ ID NO: 159348 - DNA, 20 bp, Artificial
  CRISPR gRNA sequence
ttggtccatctcagctcttt

SEQ ID NO: 159349 - DNA, 20 bp, Artificial
  CRISPR gRNA sequence
ggtccatctcagctcttttt

SEQ ID NO: 159350 - DNA, 20 bp, Artificial
  CRISPR gRNA sequence
gtccatctcagctctttttt

SEQ ID NO: 159351 - DNA, 20 bp, Artificial
  CRISPR gRNA sequence
agctcttttttttttttttg

SEQ ID NO: 159352 - DNA, 20 bp, Artificial
  CRISPR gRNA sequence
ttttttttttttttgaaccg

SEQ ID NO: 159353 - DNA, 20 bp, Artificial
  CRISPR gRNA sequence
ttttttttttttgaaccgga

SEQ ID NO: 159354 - DNA, 20 bp, Artificial
  CRISPR gRNA sequence
tttttttttttgaaccggag

SEQ ID NO: 159355 - DNA, 20 bp, Artificial
  CRISPR gRNA sequence
ttttttttttgaaccggagt

SEQ ID NO: 159356 - DNA, 20 bp, Artificial
  CRISPR gRNA sequence
tttttttttgaaccggagtc

SEQ ID NO: 159357 - DNA, 20 bp, Artificial
  CRISPR gRNA sequence
ttttttttgaaccggagtct

SEQ ID NO: 159358 - DNA, 20 bp, Artificial
  CRISPR gRNA sequence
tttttttgaaccggagtctt

SEQ ID NO: 159359 - DNA, 20 bp, Artificial
  CRISPR gRNA sequence
ttttttgaaccggagtcttg

SEQ ID NO: 159360 - DNA, 20 bp, Artificial
  CRISPR gRNA sequence
tttttgaaccggagtcttgc

SEQ ID NO: 159361 - DNA, 20 bp, Artificial
  CRISPR gRNA sequence
ttttgaaccggagtcttgca

SEQ ID NO: 159362 - DNA, 20 bp, Artificial
  CRISPR gRNA sequence
tttgaaccggagtcttgcac

SEQ ID NO: 159363 - DNA, 20 bp, Artificial
  CRISPR gRNA sequence
ttgaaccggagtcttgcact

SEQ ID NO: 159364 - DNA, 20 bp, Artificial
  CRISPR gRNA sequence
tgaaccggagtcttgcactg

SEQ ID NO: 159365 - DNA, 20 bp, Artificial
  CRISPR gRNA sequence
gaaccggagtcttgcactgt

SEQ ID NO: 159366 - DNA, 20 bp, Artificial
  CRISPR gRNA sequence
aaccggagtcttgcactgtc

SEQ ID NO: 159367 - DNA, 20 bp, Artificial
  CRISPR gRNA sequence
gcactgtcgcccaggctgga

SEQ ID NO: 159368 - DNA, 20 bp, Artificial
  CRISPR gRNA sequence
cactgtcgcccaggctggag

SEQ ID NO: 159369 - DNA, 20 bp, Artificial
  CRISPR gRNA sequence
tcgcccaggctggagtgcaa

SEQ ID NO: 159370 - DNA, 20 bp, Artificial
  CRISPR gRNA sequence
gagtgcaatggtacgatctc

SEQ ID NO: 159371 - DNA, 20 bp, Artificial
  CRISPR gRNA sequence
agctgactgcaaccttcgcc

SEQ ID NO: 159372 - DNA, 20 bp, Artificial
  CRISPR gRNA sequence
actgcaaccttcgcctcctg

SEQ ID NO: 159373 - DNA, 20 bp, Artificial
  CRISPR gRNA sequence
caaccttcgcctcctgggtt

SEQ ID NO: 159374 - DNA, 20 bp, Artificial
  CRISPR gRNA sequence
cgcctcctgggttcaagaga

SEQ ID NO: 159375 - DNA, 20 bp, Artificial
  CRISPR gRNA sequence
gcctcctgggttcaagagat

SEQ ID NO: 159376 - DNA, 20 bp, Artificial
  CRISPR gRNA sequence
ctgggttcaagagattcttc

SEQ ID NO: 159377 - DNA, 20 bp, Artificial
  CRISPR gRNA sequence
ggttcaagagattcttctgc

SEQ ID NO: 159378 - DNA, 20 bp, Artificial
  CRISPR gRNA sequence
aagagattcttctgcctcag

SEQ ID NO: 159379 - DNA, 20 bp, Artificial
  CRISPR gRNA sequence
ttctgcctcagcttcccaag

SEQ ID NO: 159380 - DNA, 20 bp, Artificial
  CRISPR gRNA sequence
ctgcctcagcttcccaagta

SEQ ID NO: 159381 - DNA, 20 bp, Artificial
  CRISPR gRNA sequence
tgcctcagcttcccaagtag

SEQ ID NO: 159382 - DNA, 20 bp, Artificial
  CRISPR gRNA sequence
cctcagcttcccaagtagct

SEQ ID NO: 159383 - DNA, 20 bp, Artificial
  CRISPR gRNA sequence
agcttcccaagtagctggga

SEQ ID NO: 159384 - DNA, 20 bp, Artificial
  CRISPR gRNA sequence
cccaagtagctgggattaca

SEQ ID NO: 159385 - DNA, 20 bp, Artificial
  CRISPR gRNA sequence
ccaagtagctgggattacag

SEQ ID NO: 159386 - DNA, 20 bp, Artificial
  CRISPR gRNA sequence
ggattacaggcgcccactac

SEQ ID NO: 159387 - DNA, 20 bp, Artificial
  CRISPR gRNA sequence
caggcgcccactaccatgcc

SEQ ID NO: 159388 - DNA, 20 bp, Artificial
  CRISPR gRNA sequence
ccatgcctggctaatttttg

SEQ ID NO: 159389 - DNA, 20 bp, Artificial
  CRISPR gRNA sequence
gctaatttttgtatttttgg

SEQ ID NO: 159390 - DNA, 20 bp, Artificial
  CRISPR gRNA sequence
atttttgtatttttggtaga

SEQ ID NO: 159391 - DNA, 20 bp, Artificial
  CRISPR gRNA sequence
ttgtatttttggtagagaag

SEQ ID NO: 159392 - DNA, 20 bp, Artificial
  CRISPR gRNA sequence
tgtatttttggtagagaagg

SEQ ID NO: 159393 - DNA, 20 bp, Artificial
  CRISPR gRNA sequence
gtatttttggtagagaaggg

SEQ ID NO: 159394 - DNA, 20 bp, Artificial
  CRISPR gRNA sequence
tatttttggtagagaagggg

SEQ ID NO: 159395 - DNA, 20 bp, Artificial
  CRISPR gRNA sequence
ttggtagagaaggggtttca

SEQ ID NO: 159396 - DNA, 20 bp, Artificial
  CRISPR gRNA sequence
tggtagagaaggggtttcat

SEQ ID NO: 159397 - DNA, 20 bp, Artificial
  CRISPR gRNA sequence
ggtagagaaggggtttcatc

SEQ ID NO: 159398 - DNA, 20 bp, Artificial
  CRISPR gRNA sequence
gtagagaaggggtttcatca

SEQ ID NO: 159399 - DNA, 20 bp, Artificial
  CRISPR gRNA sequence
catcatgttggtcagggtgg

SEQ ID NO: 159400 - DNA, 20 bp, Artificial
  CRISPR gRNA sequence
atcatgttggtcagggtggt

SEQ ID NO: 159401 - DNA, 20 bp, Artificial
  CRISPR gRNA sequence
gtcagggtggtcttgaactc

SEQ ID NO: 159402 - DNA, 20 bp, Artificial
  CRISPR gRNA sequence
gaactcctgacctcaggtga

SEQ ID NO: 159403 - DNA, 20 bp, Artificial
  CRISPR gRNA sequence
aactcctgacctcaggtgat

SEQ ID NO: 159404 - DNA, 20 bp, Artificial
  CRISPR gRNA sequence
ctgacctcaggtgatccacc

SEQ ID NO: 159405 - DNA, 20 bp, Artificial
  CRISPR gRNA sequence
acctcaggtgatccacccgc

SEQ ID NO: 159406 - DNA, 20 bp, Artificial
  CRISPR gRNA sequence
aggtgatccacccgcctcgg

SEQ ID NO: 159407 - DNA, 20 bp, Artificial
  CRISPR gRNA sequence
ggcctcccaaagtgctggga

SEQ ID NO: 159408 - DNA, 20 bp, Artificial
  CRISPR gRNA sequence
ccaaagtgctgggattacag

SEQ ID NO: 159409 - DNA, 20 bp, Artificial
  CRISPR gRNA sequence
ggattacaggcatgagccac

SEQ ID NO: 159410 - DNA, 20 bp, Artificial
  CRISPR gRNA sequence
caggcatgagccaccgcgcc

SEQ ID NO: 159411 - DNA, 20 bp, Artificial
  CRISPR gRNA sequence
ttgatgtgctttcctcacta

SEQ ID NO: 159412 - DNA, 20 bp, Artificial
  CRISPR gRNA sequence
tgatgtgctttcctcactaa

SEQ ID NO: 159413 - DNA, 20 bp, Artificial
  CRISPR gRNA sequence
gatgtgctttcctcactaag

SEQ ID NO: 159414 - DNA, 20 bp, Artificial
  CRISPR gRNA sequence
atgtgctttcctcactaagc

SEQ ID NO: 159415 - DNA, 20 bp, Artificial
  CRISPR gRNA sequence
tcctcactaagcttaatcat

SEQ ID NO: 159416 - DNA, 20 bp, Artificial
  CRISPR gRNA sequence
cctcactaagcttaatcatt

SEQ ID NO: 159417 - DNA, 20 bp, Artificial
  CRISPR gRNA sequence
ctcactaagcttaatcattt

SEQ ID NO: 159418 - DNA, 20 bp, Artificial
  CRISPR gRNA sequence
actaagcttaatcatttcta

SEQ ID NO: 159419 - DNA, 20 bp, Artificial
  CRISPR gRNA sequence
agcttaatcatttctagctt

SEQ ID NO: 159420 - DNA, 20 bp, Artificial
  CRISPR gRNA sequence
aatcatttctagctttcgat

SEQ ID NO: 159421 - DNA, 20 bp, Artificial
  CRISPR gRNA sequence
atcatttctagctttcgatt

SEQ ID NO: 159422 - DNA, 20 bp, Artificial
  CRISPR gRNA sequence
ctagctttcgattgattgag

SEQ ID NO: 159423 - DNA, 20 bp, Artificial
  CRISPR gRNA sequence
tagctttcgattgattgagt

SEQ ID NO: 159424 - DNA, 20 bp, Artificial
  CRISPR gRNA sequence
gctttcgattgattgagtta

SEQ ID NO: 159425 - DNA, 20 bp, Artificial
  CRISPR gRNA sequence
tcgattgattgagttagaga

SEQ ID NO: 159426 - DNA, 20 bp, Artificial
  CRISPR gRNA sequence
cgattgattgagttagagac

SEQ ID NO: 159427 - DNA, 20 bp, Artificial
  CRISPR gRNA sequence
gattgattgagttagagaca

SEQ ID NO: 159428 - DNA, 20 bp, Artificial
  CRISPR gRNA sequence
attgagttagagacagagtt

SEQ ID NO: 159429 - DNA, 20 bp, Artificial
  CRISPR gRNA sequence
agttagagacagagttttgt

SEQ ID NO: 159430 - DNA, 20 bp, Artificial
  CRISPR gRNA sequence
gagacagagttttgttctgt

SEQ ID NO: 159431 - DNA, 20 bp, Artificial
  CRISPR gRNA sequence
tgttctgtcacccaggctgg

SEQ ID NO: 159432 - DNA, 20 bp, Artificial
  CRISPR gRNA sequence
gttctgtcacccaggctgga

SEQ ID NO: 159433 - DNA, 20 bp, Artificial
  CRISPR gRNA sequence
ttctgtcacccaggctggag

SEQ ID NO: 159434 - DNA, 20 bp, Artificial
  CRISPR gRNA sequence
tgtcacccaggctggagtgt

SEQ ID NO: 159435 - DNA, 20 bp, Artificial
  CRISPR gRNA sequence
tcacccaggctggagtgtgg

SEQ ID NO: 159436 - DNA, 20 bp, Artificial
  CRISPR gRNA sequence
gagtgtggtggcatgatcat

SEQ ID NO: 159437 - DNA, 20 bp, Artificial
  CRISPR gRNA sequence
actgctgcccaagtgatcct

SEQ ID NO: 159438 - DNA, 20 bp, Artificial
  CRISPR gRNA sequence
ctgcccaagtgatcctccca

SEQ ID NO: 159439 - DNA, 20 bp, Artificial
  CRISPR gRNA sequence
cccaagtgatcctcccacct

SEQ ID NO: 159440 - DNA, 20 bp, Artificial
  CRISPR gRNA sequence
ccacctcagccttctgagta

SEQ ID NO: 159441 - DNA, 20 bp, Artificial
  CRISPR gRNA sequence
agccttctgagtagctagga

SEQ ID NO: 159442 - DNA, 20 bp, Artificial
  CRISPR gRNA sequence
ctgagtagctaggaccacag

SEQ ID NO: 159443 - DNA, 20 bp, Artificial
  CRISPR gRNA sequence
tgagtagctaggaccacagg

SEQ ID NO: 159444 - DNA, 20 bp, Artificial
  CRISPR gRNA sequence
agtagctaggaccacaggtg

SEQ ID NO: 159445 - DNA, 20 bp, Artificial
  CRISPR gRNA sequence
ggaccacaggtgcatgccat

SEQ ID NO: 159446 - DNA, 20 bp, Artificial
  CRISPR gRNA sequence
gctaatttttctttcttttc

SEQ ID NO: 159447 - DNA, 20 bp, Artificial
  CRISPR gRNA sequence
atttttctttcttttctttt

SEQ ID NO: 159448 - DNA, 20 bp, Artificial
  CRISPR gRNA sequence
ttctttcttttctttttttt

SEQ ID NO: 159449 - DNA, 20 bp, Artificial
  CRISPR gRNA sequence
tctttcttttcttttttttt

SEQ ID NO: 159450 - DNA, 20 bp, Artificial
  CRISPR gRNA sequence
ctttcttttctttttttttt

SEQ ID NO: 159451 - DNA, 20 bp, Artificial
  CRISPR gRNA sequence
tttcttttcttttttttttt

SEQ ID NO: 159452 - DNA, 20 bp, Artificial
  CRISPR gRNA sequence
tcttttcttttttttttttt

SEQ ID NO: 159453 - DNA, 20 bp, Artificial
  CRISPR gRNA sequence
cttttctttttttttttttt

SEQ ID NO: 159454 - DNA, 20 bp, Artificial
  CRISPR gRNA sequence
ttttcttttttttttttttt

SEQ ID NO: 159455 - DNA, 20 bp, Artificial
  CRISPR gRNA sequence
ttcttttttttttttttttt

SEQ ID NO: 159456 - DNA, 20 bp, Artificial
  CRISPR gRNA sequence
tctttttttttttttttttt

SEQ ID NO: 159457 - DNA, 20 bp, Artificial
  CRISPR gRNA sequence
cttttttttttttttttttt

SEQ ID NO: 159458 - DNA, 20 bp, Artificial
  CRISPR gRNA sequence
tttttttttttttttttttt

SEQ ID NO: 159459 - DNA, 20 bp, Artificial
  CRISPR gRNA sequence
tttttttttttttttttttt

SEQ ID NO: 159460 - DNA, 20 bp, Artificial
  CRISPR gRNA sequence
tttttttttttttttttttg

SEQ ID NO: 159461 - DNA, 20 bp, Artificial
  CRISPR gRNA sequence
ttttttttttttttttttgg

SEQ ID NO: 159462 - DNA, 20 bp, Artificial
  CRISPR gRNA sequence
tttttttttttttttttggt

SEQ ID NO: 159463 - DNA, 20 bp, Artificial
  CRISPR gRNA sequence
ttttttttttttttttggta

SEQ ID NO: 159464 - DNA, 20 bp, Artificial
  CRISPR gRNA sequence
tttttttttttttttggtag

SEQ ID NO: 159465 - DNA, 20 bp, Artificial
  CRISPR gRNA sequence
ttttttttttttttggtaga

SEQ ID NO: 159466 - DNA, 20 bp, Artificial
  CRISPR gRNA sequence
tttttttttttttggtagag

SEQ ID NO: 159467 - DNA, 20 bp, Artificial
  CRISPR gRNA sequence
ttttttttttttggtagaga

SEQ ID NO: 159468 - DNA, 20 bp, Artificial
  CRISPR gRNA sequence
tttttttttttggtagagat

SEQ ID NO: 159469 - DNA, 20 bp, Artificial
  CRISPR gRNA sequence
ttttttttttggtagagata

SEQ ID NO: 159470 - DNA, 20 bp, Artificial
  CRISPR gRNA sequence
tttttttttggtagagatag

SEQ ID NO: 159471 - DNA, 20 bp, Artificial
  CRISPR gRNA sequence
ttttttttggtagagatagg

SEQ ID NO: 159472 - DNA, 20 bp, Artificial
  CRISPR gRNA sequence
tttttttggtagagataggg

SEQ ID NO: 159473 - DNA, 20 bp, Artificial
  CRISPR gRNA sequence
ttttttggtagagatagggg

SEQ ID NO: 159474 - DNA, 20 bp, Artificial
  CRISPR gRNA sequence
tttttggtagagataggggg

SEQ ID NO: 159475 - DNA, 20 bp, Artificial
  CRISPR gRNA sequence
ttttggtagagatagggggt

SEQ ID NO: 159476 - DNA, 20 bp, Artificial
  CRISPR gRNA sequence
tttggtagagatagggggtg

SEQ ID NO: 159477 - DNA, 20 bp, Artificial
  CRISPR gRNA sequence
ttggtagagatagggggtgt

SEQ ID NO: 159478 - DNA, 20 bp, Artificial
  CRISPR gRNA sequence
tggtagagatagggggtgtc

SEQ ID NO: 159479 - DNA, 20 bp, Artificial
  CRISPR gRNA sequence
ggtagagatagggggtgtct

SEQ ID NO: 159480 - DNA, 20 bp, Artificial
  CRISPR gRNA sequence
gtagagatagggggtgtctc

SEQ ID NO: 159481 - DNA, 20 bp, Artificial
  CRISPR gRNA sequence
tctgtgttgccaagctggtc

SEQ ID NO: 159482 - DNA, 20 bp, Artificial
  CRISPR gRNA sequence
tgtgttgccaagctggtctc

SEQ ID NO: 159483 - DNA, 20 bp, Artificial
  CRISPR gRNA sequence
tgttgccaagctggtctcga

SEQ ID NO: 159484 - DNA, 20 bp, Artificial
  CRISPR gRNA sequence
ccaagctggtctcgaactcc

SEQ ID NO: 159485 - DNA, 20 bp, Artificial
  CRISPR gRNA sequence
gtctcgaactcctggattca

SEQ ID NO: 159486 - DNA, 20 bp, Artificial
  CRISPR gRNA sequence
gaactcctggattcatgcag

SEQ ID NO: 159487 - DNA, 20 bp, Artificial
  CRISPR gRNA sequence
ctggattcatgcagtcagcc

SEQ ID NO: 159488 - DNA, 20 bp, Artificial
  CRISPR gRNA sequence
gattcatgcagtcagccctc

SEQ ID NO: 159489 - DNA, 20 bp, Artificial
  CRISPR gRNA sequence
atgcagtcagccctccttgg

SEQ ID NO: 159490 - DNA, 20 bp, Artificial
  CRISPR gRNA sequence
cttggtgcctcaaagttctg

SEQ ID NO: 159491 - DNA, 20 bp, Artificial
  CRISPR gRNA sequence
ggtgcctcaaagttctggga

SEQ ID NO: 159492 - DNA, 20 bp, Artificial
  CRISPR gRNA sequence
gtgcctcaaagttctgggat

SEQ ID NO: 159493 - DNA, 20 bp, Artificial
  CRISPR gRNA sequence
aaagttctgggattacaggc

SEQ ID NO: 159494 - DNA, 20 bp, Artificial
  CRISPR gRNA sequence
tgggattacaggcgtgagcc

SEQ ID NO: 159495 - DNA, 20 bp, Artificial
  CRISPR gRNA sequence
ggattacaggcgtgagccac

SEQ ID NO: 159496 - DNA, 20 bp, Artificial
  CRISPR gRNA sequence
caggcgtgagccaccacacc

SEQ ID NO: 159497 - DNA, 20 bp, Artificial
  CRISPR gRNA sequence
gcctttagcttttaagtgaa

SEQ ID NO: 159498 - DNA, 20 bp, Artificial
  CRISPR gRNA sequence
tagcttttaagtgaaagatg

SEQ ID NO: 159499 - DNA, 20 bp, Artificial
  CRISPR gRNA sequence
agcttttaagtgaaagatgt

SEQ ID NO: 159500 - DNA, 20 bp, Artificial
  CRISPR gRNA sequence
gcttttaagtgaaagatgtg

SEQ ID NO: 159501 - DNA, 20 bp, Artificial
  CRISPR gRNA sequence
ttaagtgaaagatgtgagac

SEQ ID NO: 159502 - DNA, 20 bp, Artificial
  CRISPR gRNA sequence
taagtgaaagatgtgagact

SEQ ID NO: 159503 - DNA, 20 bp, Artificial
  CRISPR gRNA sequence
aagtgaaagatgtgagactg

SEQ ID NO: 159504 - DNA, 20 bp, Artificial
  CRISPR gRNA sequence
agtgaaagatgtgagactgt

SEQ ID NO: 159505 - DNA, 20 bp, Artificial
  CRISPR gRNA sequence
ttcttttacttgaacgctta

SEQ ID NO: 159506 - DNA, 20 bp, Artificial
  CRISPR gRNA sequence
ttttacttgaacgcttagag

SEQ ID NO: 159507 - DNA, 20 bp, Artificial
  CRISPR gRNA sequence
ttacttgaacgcttagaggc

SEQ ID NO: 159508 - DNA, 20 bp, Artificial
  CRISPR gRNA sequence
tacttgaacgcttagaggcc

SEQ ID NO: 159509 - DNA, 20 bp, Artificial
  CRISPR gRNA sequence
acttgaacgcttagaggccg

SEQ ID NO: 159510 - DNA, 20 bp, Artificial
  CRISPR gRNA sequence
cttgaacgcttagaggccgt

SEQ ID NO: 159511 - DNA, 20 bp, Artificial
  CRISPR gRNA sequence
gaacgcttagaggccgttgt

SEQ ID NO: 159512 - DNA, 20 bp, Artificial
  CRISPR gRNA sequence
aacgcttagaggccgttgta

SEQ ID NO: 159513 - DNA, 20 bp, Artificial
  CRISPR gRNA sequence
agaggccgttgtagggttat

SEQ ID NO: 159514 - DNA, 20 bp, Artificial
  CRISPR gRNA sequence
gaggccgttgtagggttatt

SEQ ID NO: 159515 - DNA, 20 bp, Artificial
  CRISPR gRNA sequence
tagggttattaagtggcgta

SEQ ID NO: 159516 - DNA, 20 bp, Artificial
  CRISPR gRNA sequence
ttaagtggcgtaatttcagt

SEQ ID NO: 159517 - DNA, 20 bp, Artificial
  CRISPR gRNA sequence
agtggcgtaatttcagtatt

SEQ ID NO: 159518 - DNA, 20 bp, Artificial
  CRISPR gRNA sequence
cagtattgctgtgtctcagg

SEQ ID NO: 159519 - DNA, 20 bp, Artificial
  CRISPR gRNA sequence
agtattgctgtgtctcaggt

SEQ ID NO: 159520 - DNA, 20 bp, Artificial
  CRISPR gRNA sequence
ctgtgtctcaggtaataggg

SEQ ID NO: 159521 - DNA, 20 bp, Artificial
  CRISPR gRNA sequence
tgtctcaggtaatagggagg

SEQ ID NO: 159522 - DNA, 20 bp, Artificial
  CRISPR gRNA sequence
aggtaatagggaggcccgag

SEQ ID NO: 159523 - DNA, 20 bp, Artificial
  CRISPR gRNA sequence
gtagagcagtatctgtgaag

SEQ ID NO: 159524 - DNA, 20 bp, Artificial
  CRISPR gRNA sequence
tgaagcacaataaagtgaaa

SEQ ID NO: 159525 - DNA, 20 bp, Artificial
  CRISPR gRNA sequence
taaaaaggatgtcacctcat

SEQ ID NO: 159526 - DNA, 20 bp, Artificial
  CRISPR gRNA sequence
atgacagaggaagatatgat

SEQ ID NO: 159527 - DNA, 20 bp, Artificial
  CRISPR gRNA sequence
gatcatagagagatacttgt

SEQ ID NO: 159528 - DNA, 20 bp, Artificial
  CRISPR gRNA sequence
atcatagagagatacttgtt

SEQ ID NO: 159529 - DNA, 20 bp, Artificial
  CRISPR gRNA sequence
gttgacatgttaagttggag

SEQ ID NO: 159530 - DNA, 20 bp, Artificial
  CRISPR gRNA sequence
ttgacatgttaagttggaga

SEQ ID NO: 159531 - DNA, 20 bp, Artificial
  CRISPR gRNA sequence
acatgttaagttggagatgc

SEQ ID NO: 159532 - DNA, 20 bp, Artificial
  CRISPR gRNA sequence
agttggagatgcacaggaat

SEQ ID NO: 159533 - DNA, 20 bp, Artificial
  CRISPR gRNA sequence
gagatgcacaggaatggttg

SEQ ID NO: 159534 - DNA, 20 bp, Artificial
  CRISPR gRNA sequence
ggaactcaacccaaaaagcc

SEQ ID NO: 159535 - DNA, 20 bp, Artificial
  CRISPR gRNA sequence
aacccaaaaagcctaagggc

SEQ ID NO: 159536 - DNA, 20 bp, Artificial
  CRISPR gRNA sequence
agggctgcaagtcggtttgg

SEQ ID NO: 159537 - DNA, 20 bp, Artificial
  CRISPR gRNA sequence
caagtcggtttggggaacat

SEQ ID NO: 159538 - DNA, 20 bp, Artificial
  CRISPR gRNA sequence
ggggaacattaaaggggaat

SEQ ID NO: 159539 - DNA, 20 bp, Artificial
  CRISPR gRNA sequence
gggaacattaaaggggaatg

SEQ ID NO: 159540 - DNA, 20 bp, Artificial
  CRISPR gRNA sequence
aaggggaatgataataccaa

SEQ ID NO: 159541 - DNA, 20 bp, Artificial
  CRISPR gRNA sequence
tatttgtttcttagtcagta

SEQ ID NO: 159542 - DNA, 20 bp, Artificial
  CRISPR gRNA sequence
gtttcttagtcagtactgag

SEQ ID NO: 159543 - DNA, 20 bp, Artificial
  CRISPR gRNA sequence
tttcttagtcagtactgagc

SEQ ID NO: 159544 - DNA, 20 bp, Artificial
  CRISPR gRNA sequence
cttagtcagtactgagctaa

SEQ ID NO: 159545 - DNA, 20 bp, Artificial
  CRISPR gRNA sequence
ttagtcagtactgagctaag

SEQ ID NO: 159546 - DNA, 20 bp, Artificial
  CRISPR gRNA sequence
agtcagtactgagctaagat

SEQ ID NO: 159547 - DNA, 20 bp, Artificial
  CRISPR gRNA sequence
gtcagtactgagctaagata

SEQ ID NO: 159548 - DNA, 20 bp, Artificial
  CRISPR gRNA sequence
agctaagatatatttgtttg

SEQ ID NO: 159549 - DNA, 20 bp, Artificial
  CRISPR gRNA sequence
agatatatttgtttgcattt

SEQ ID NO: 159550 - DNA, 20 bp, Artificial
  CRISPR gRNA sequence
gtttgcatttgacagtgaga

SEQ ID NO: 159551 - DNA, 20 bp, Artificial
  CRISPR gRNA sequence
tttgcatttgacagtgagag

SEQ ID NO: 159552 - DNA, 20 bp, Artificial
  CRISPR gRNA sequence
gcatttgacagtgagagcat

SEQ ID NO: 159553 - DNA, 20 bp, Artificial
  CRISPR gRNA sequence
catttgacagtgagagcatt

SEQ ID NO: 159554 - DNA, 20 bp, Artificial
  CRISPR gRNA sequence
gacagtgagagcattatttt

SEQ ID NO: 159555 - DNA, 20 bp, Artificial
  CRISPR gRNA sequence
acagtgagagcattattttt

SEQ ID NO: 159556 - DNA, 20 bp, Artificial
  CRISPR gRNA sequence
tttttaggtaaaacatgtct

SEQ ID NO: 159557 - DNA, 20 bp, Artificial
  CRISPR gRNA sequence
ttaggtaaaacatgtcttcc

SEQ ID NO: 159558 - DNA, 20 bp, Artificial
  CRISPR gRNA sequence
taggtaaaacatgtcttccc

SEQ ID NO: 159559 - DNA, 20 bp, Artificial
  CRISPR gRNA sequence
aggtaaaacatgtcttccca

SEQ ID NO: 159560 - DNA, 20 bp, Artificial
  CRISPR gRNA sequence
ggtaaaacatgtcttcccag

SEQ ID NO: 159561 - DNA, 20 bp, Artificial
  CRISPR gRNA sequence
cccaggatggttcaactagt

SEQ ID NO: 159562 - DNA, 20 bp, Artificial
  CRISPR gRNA sequence
ccaggatggttcaactagta

SEQ ID NO: 159563 - DNA, 20 bp, Artificial
  CRISPR gRNA sequence
aactagtagtacagagggtc

SEQ ID NO: 159564 - DNA, 20 bp, Artificial
  CRISPR gRNA sequence
gtagtacagagggtcttcag

SEQ ID NO: 159565 - DNA, 20 bp, Artificial
  CRISPR gRNA sequence
cagacaatgttgtttgatta

SEQ ID NO: 159566 - DNA, 20 bp, Artificial
  CRISPR gRNA sequence
agacaatgttgtttgattat

SEQ ID NO: 159567 - DNA, 20 bp, Artificial
  CRISPR gRNA sequence
tttgattataatattgatga

SEQ ID NO: 159568 - DNA, 20 bp, Artificial
  CRISPR gRNA sequence
gattataatattgatgaaga

SEQ ID NO: 159569 - DNA, 20 bp, Artificial
  CRISPR gRNA sequence
attataatattgatgaagaa

SEQ ID NO: 159570 - DNA, 20 bp, Artificial
  CRISPR gRNA sequence
taatattgatgaagaaaaaa

SEQ ID NO: 159571 - DNA, 20 bp, Artificial
  CRISPR gRNA sequence
atgaagaaaaaagaaaccag

SEQ ID NO: 159572 - DNA, 20 bp, Artificial
  CRISPR gRNA sequence
ctggccggggtcactctctg

SEQ ID NO: 159573 - DNA, 20 bp, Artificial
  CRISPR gRNA sequence
gccggggtcactctctgtgt

SEQ ID NO: 159574 - DNA, 20 bp, Artificial
  CRISPR gRNA sequence
tctgtgtggagtttgagcat

SEQ ID NO: 159575 - DNA, 20 bp, Artificial
  CRISPR gRNA sequence
tgtgtggagtttgagcattg

SEQ ID NO: 159576 - DNA, 20 bp, Artificial
  CRISPR gRNA sequence
tgtggagtttgagcattgtc

SEQ ID NO: 159577 - DNA, 20 bp, Artificial
  CRISPR gRNA sequence
gagcattgtccccacgtctg

SEQ ID NO: 159578 - DNA, 20 bp, Artificial
  CRISPR gRNA sequence
agcattgtccccacgtctgt

SEQ ID NO: 159579 - DNA, 20 bp, Artificial
  CRISPR gRNA sequence
tccccacgtctgtttggttt

SEQ ID NO: 159580 - DNA, 20 bp, Artificial
  CRISPR gRNA sequence
tttggttttttttccagtac

SEQ ID NO: 159581 - DNA, 20 bp, Artificial
  CRISPR gRNA sequence
ggttttttttccagtactct

SEQ ID NO: 159582 - DNA, 20 bp, Artificial
  CRISPR gRNA sequence
gttttttttccagtactctg

SEQ ID NO: 159583 - DNA, 20 bp, Artificial
  CRISPR gRNA sequence
tttttccagtactctgcttt

SEQ ID NO: 159584 - DNA, 20 bp, Artificial
  CRISPR gRNA sequence
ttttccagtactctgctttc

SEQ ID NO: 159585 - DNA, 20 bp, Artificial
  CRISPR gRNA sequence
tttccagtactctgctttct

SEQ ID NO: 159586 - DNA, 20 bp, Artificial
  CRISPR gRNA sequence
ttccagtactctgctttctt

SEQ ID NO: 159587 - DNA, 20 bp, Artificial
  CRISPR gRNA sequence
tccagtactctgctttcttc

SEQ ID NO: 159588 - DNA, 20 bp, Artificial
  CRISPR gRNA sequence
ccagtactctgctttcttct

SEQ ID NO: 159589 - DNA, 20 bp, Artificial
  CRISPR gRNA sequence
cagtactctgctttcttctt

SEQ ID NO: 159590 - DNA, 20 bp, Artificial
  CRISPR gRNA sequence
tgctttcttcttgcatcccg

SEQ ID NO: 159591 - DNA, 20 bp, Artificial
  CRISPR gRNA sequence
ctttcttcttgcatcccgaa

SEQ ID NO: 159592 - DNA, 20 bp, Artificial
  CRISPR gRNA sequence
tcttcttgcatcccgaatat

SEQ ID NO: 159593 - DNA, 20 bp, Artificial
  CRISPR gRNA sequence
cttcttgcatcccgaatatg

SEQ ID NO: 159594 - DNA, 20 bp, Artificial
  CRISPR gRNA sequence
ttcttgcatcccgaatatgt

SEQ ID NO: 159595 - DNA, 20 bp, Artificial
  CRISPR gRNA sequence
cttgcatcccgaatatgtgc

SEQ ID NO: 159596 - DNA, 20 bp, Artificial
  CRISPR gRNA sequence
ttgcatcccgaatatgtgca

SEQ ID NO: 159597 - DNA, 20 bp, Artificial
  CRISPR gRNA sequence
gcatcccgaatatgtgcatg

SEQ ID NO: 159598 - DNA, 20 bp, Artificial
  CRISPR gRNA sequence
catcccgaatatgtgcatgt

SEQ ID NO: 159599 - DNA, 20 bp, Artificial
  CRISPR gRNA sequence
ggttaattggcacatctaaa

SEQ ID NO: 159600 - DNA, 20 bp, Artificial
  CRISPR gRNA sequence
attggcacatctaaattgtc

SEQ ID NO: 159601 - DNA, 20 bp, Artificial
  CRISPR gRNA sequence
gcacatctaaattgtctcag

SEQ ID NO: 159602 - DNA, 20 bp, Artificial
  CRISPR gRNA sequence
aattgtctcagcctgagtga

SEQ ID NO: 159603 - DNA, 20 bp, Artificial
  CRISPR gRNA sequence
tctcagcctgagtgagagtg

SEQ ID NO: 159604 - DNA, 20 bp, Artificial
  CRISPR gRNA sequence
agcctgagtgagagtgtgcc

SEQ ID NO: 159605 - DNA, 20 bp, Artificial
  CRISPR gRNA sequence
agtgagagtgtgccctgtga

SEQ ID NO: 159606 - DNA, 20 bp, Artificial
  CRISPR gRNA sequence
tgattgagttgtccaggctt

SEQ ID NO: 159607 - DNA, 20 bp, Artificial
  CRISPR gRNA sequence
agttgtccaggcttggttcc

SEQ ID NO: 159608 - DNA, 20 bp, Artificial
  CRISPR gRNA sequence
tccaggcttggttcccacct

SEQ ID NO: 159609 - DNA, 20 bp, Artificial
  CRISPR gRNA sequence
ggttcccaccttgtgccctg

SEQ ID NO: 159610 - DNA, 20 bp, Artificial
  CRISPR gRNA sequence
gttcccaccttgtgccctga

SEQ ID NO: 159611 - DNA, 20 bp, Artificial
  CRISPR gRNA sequence
ccaccttgtgccctgaactg

SEQ ID NO: 159612 - DNA, 20 bp, Artificial
  CRISPR gRNA sequence
gtgccctgaactgttgggat

SEQ ID NO: 159613 - DNA, 20 bp, Artificial
  CRISPR gRNA sequence
tgccctgaactgttgggata

SEQ ID NO: 159614 - DNA, 20 bp, Artificial
  CRISPR gRNA sequence
aactgttgggataggcttca

SEQ ID NO: 159615 - DNA, 20 bp, Artificial
  CRISPR gRNA sequence
ttgggataggcttcaatcat

SEQ ID NO: 159616 - DNA, 20 bp, Artificial
  CRISPR gRNA sequence
ggataggcttcaatcatctg

SEQ ID NO: 159617 - DNA, 20 bp, Artificial
  CRISPR gRNA sequence
caatcatctgcaaccctgaa

SEQ ID NO: 159618 - DNA, 20 bp, Artificial
  CRISPR gRNA sequence
aatcatctgcaaccctgaac

SEQ ID NO: 159619 - DNA, 20 bp, Artificial
  CRISPR gRNA sequence
caaccctgaactggaataat

SEQ ID NO: 159620 - DNA, 20 bp, Artificial
  CRISPR gRNA sequence
aactggaataattggataaa

SEQ ID NO: 159621 - DNA, 20 bp, Artificial
  CRISPR gRNA sequence
gaataattggataaataatc

SEQ ID NO: 159622 - DNA, 20 bp, Artificial
  CRISPR gRNA sequence
gataaataatcatcttactt

SEQ ID NO: 159623 - DNA, 20 bp, Artificial
  CRISPR gRNA sequence
acttttttttttgggacgga

SEQ ID NO: 159624 - DNA, 20 bp, Artificial
  CRISPR gRNA sequence
cttttttttttgggacggag

SEQ ID NO: 159625 - DNA, 20 bp, Artificial
  CRISPR gRNA sequence
ttttttttgggacggagtct

SEQ ID NO: 159626 - DNA, 20 bp, Artificial
  CRISPR gRNA sequence
tttttttgggacggagtctt

SEQ ID NO: 159627 - DNA, 20 bp, Artificial
  CRISPR gRNA sequence
ttttttgggacggagtcttg

SEQ ID NO: 159628 - DNA, 20 bp, Artificial
  CRISPR gRNA sequence
tttttgggacggagtcttgc

SEQ ID NO: 159629 - DNA, 20 bp, Artificial
  CRISPR gRNA sequence
ttttgggacggagtcttgct

SEQ ID NO: 159630 - DNA, 20 bp, Artificial
  CRISPR gRNA sequence
tttgggacggagtcttgctg

SEQ ID NO: 159631 - DNA, 20 bp, Artificial
  CRISPR gRNA sequence
ttgggacggagtcttgctgt

SEQ ID NO: 159632 - DNA, 20 bp, Artificial
  CRISPR gRNA sequence
tgggacggagtcttgctgta

SEQ ID NO: 159633 - DNA, 20 bp, Artificial
  CRISPR gRNA sequence
gggacggagtcttgctgtat

SEQ ID NO: 159634 - DNA, 20 bp, Artificial
  CRISPR gRNA sequence
ggacggagtcttgctgtatc

SEQ ID NO: 159635 - DNA, 20 bp, Artificial
  CRISPR gRNA sequence
gctgtatcccagtatggagt

SEQ ID NO: 159636 - DNA, 20 bp, Artificial
  CRISPR gRNA sequence
ctgtatcccagtatggagtg

SEQ ID NO: 159637 - DNA, 20 bp, Artificial
  CRISPR gRNA sequence
tatcccagtatggagtgcag

SEQ ID NO: 159638 - DNA, 20 bp, Artificial
  CRISPR gRNA sequence
ggttcactgcaacctccacc

SEQ ID NO: 159639 - DNA, 20 bp, Artificial
  CRISPR gRNA sequence
gttcactgcaacctccacct

SEQ ID NO: 159640 - DNA, 20 bp, Artificial
  CRISPR gRNA sequence
actgcaacctccacctcctg

SEQ ID NO: 159641 - DNA, 20 bp, Artificial
  CRISPR gRNA sequence
caacctccacctcctgggtt

SEQ ID NO: 159642 - DNA, 20 bp, Artificial
  CRISPR gRNA sequence
cacctcctgggttcaagcga

SEQ ID NO: 159643 - DNA, 20 bp, Artificial
  CRISPR gRNA sequence
ctgggttcaagcgattctca

SEQ ID NO: 159644 - DNA, 20 bp, Artificial
  CRISPR gRNA sequence
ggttcaagcgattctcatgc

SEQ ID NO: 159645 - DNA, 20 bp, Artificial
  CRISPR gRNA sequence
aagcgattctcatgccttag

SEQ ID NO: 159646 - DNA, 20 bp, Artificial
  CRISPR gRNA sequence
tcatgccttagcctcccaag

SEQ ID NO: 159647 - DNA, 20 bp, Artificial
  CRISPR gRNA sequence
atgccttagcctcccaagta

SEQ ID NO: 159648 - DNA, 20 bp, Artificial
  CRISPR gRNA sequence
agcctcccaagtagctggga

SEQ ID NO: 159649 - DNA, 20 bp, Artificial
  CRISPR gRNA sequence
gcctcccaagtagctgggat

SEQ ID NO: 159650 - DNA, 20 bp, Artificial
  CRISPR gRNA sequence
ccaagtagctgggattacag

SEQ ID NO: 159651 - DNA, 20 bp, Artificial
  CRISPR gRNA sequence
ggattacaggcgcctgccac

SEQ ID NO: 159652 - DNA, 20 bp, Artificial
  CRISPR gRNA sequence
caggcgcctgccaccatgcc

SEQ ID NO: 159653 - DNA, 20 bp, Artificial
  CRISPR gRNA sequence
ccaccatgcctggctaattt

SEQ ID NO: 159654 - DNA, 20 bp, Artificial
  CRISPR gRNA sequence
gctaatttttgtatttttag

SEQ ID NO: 159655 - DNA, 20 bp, Artificial
  CRISPR gRNA sequence
atttttgtatttttagtaga

SEQ ID NO: 159656 - DNA, 20 bp, Artificial
  CRISPR gRNA sequence
ttgtatttttagtagagaca

SEQ ID NO: 159657 - DNA, 20 bp, Artificial
  CRISPR gRNA sequence
tgtatttttagtagagacag

SEQ ID NO: 159658 - DNA, 20 bp, Artificial
  CRISPR gRNA sequence
gtatttttagtagagacagg

SEQ ID NO: 159659 - DNA, 20 bp, Artificial
  CRISPR gRNA sequence
tatttttagtagagacaggg

SEQ ID NO: 159660 - DNA, 20 bp, Artificial
  CRISPR gRNA sequence
ttagtagagacagggtttta

SEQ ID NO: 159661 - DNA, 20 bp, Artificial
  CRISPR gRNA sequence
tagtagagacagggttttac

SEQ ID NO: 159662 - DNA, 20 bp, Artificial
  CRISPR gRNA sequence
agtagagacagggttttacc

SEQ ID NO: 159663 - DNA, 20 bp, Artificial
  CRISPR gRNA sequence
gtagagacagggttttacca

SEQ ID NO: 159664 - DNA, 20 bp, Artificial
  CRISPR gRNA sequence
taccatgttggccaggctgg

SEQ ID NO: 159665 - DNA, 20 bp, Artificial
  CRISPR gRNA sequence
accatgttggccaggctggt

SEQ ID NO: 159666 - DNA, 20 bp, Artificial
  CRISPR gRNA sequence
ccatgttggccaggctggtc

SEQ ID NO: 159667 - DNA, 20 bp, Artificial
  CRISPR gRNA sequence
gccaggctggtcttgaactc

SEQ ID NO: 159668 - DNA, 20 bp, Artificial
  CRISPR gRNA sequence
gtcttgaactcctgacctca

SEQ ID NO: 159669 - DNA, 20 bp, Artificial
  CRISPR gRNA sequence
gaactcctgacctcaggtga

SEQ ID NO: 159670 - DNA, 20 bp, Artificial
  CRISPR gRNA sequence
aactcctgacctcaggtgat

SEQ ID NO: 159671 - DNA, 20 bp, Artificial
  CRISPR gRNA sequence
ctgacctcaggtgatcctcc

SEQ ID NO: 159672 - DNA, 20 bp, Artificial
  CRISPR gRNA sequence
acctcaggtgatcctcctgc

SEQ ID NO: 159673 - DNA, 20 bp, Artificial
  CRISPR gRNA sequence
aggtgatcctcctgcctcag

SEQ ID NO: 159674 - DNA, 20 bp, Artificial
  CRISPR gRNA sequence
ctgcctcagcctcccaaagt

SEQ ID NO: 159675 - DNA, 20 bp, Artificial
  CRISPR gRNA sequence
cctcagcctcccaaagttgg

SEQ ID NO: 159676 - DNA, 20 bp, Artificial
  CRISPR gRNA sequence
agcctcccaaagttggggtt

SEQ ID NO: 159677 - DNA, 20 bp, Artificial
  CRISPR gRNA sequence
ccaaagttggggttacaggt

SEQ ID NO: 159678 - DNA, 20 bp, Artificial
  CRISPR gRNA sequence
gggttacaggtgtgagccac

SEQ ID NO: 159679 - DNA, 20 bp, Artificial
  CRISPR gRNA sequence
caggtgtgagccaccgcacc

SEQ ID NO: 159680 - DNA, 20 bp, Artificial
  CRISPR gRNA sequence
gcctttctttttctttttct

SEQ ID NO: 159681 - DNA, 20 bp, Artificial
  CRISPR gRNA sequence
tctttttctttttcttttgg

SEQ ID NO: 159682 - DNA, 20 bp, Artificial
  CRISPR gRNA sequence
ctttttctttttcttttggc

SEQ ID NO: 159683 - DNA, 20 bp, Artificial
  CRISPR gRNA sequence
tttttctttttcttttggcg

SEQ ID NO: 159684 - DNA, 20 bp, Artificial
  CRISPR gRNA sequence
tttctttttcttttggcggg

SEQ ID NO: 159685 - DNA, 20 bp, Artificial
  CRISPR gRNA sequence
ttctttttcttttggcgggg

SEQ ID NO: 159686 - DNA, 20 bp, Artificial
  CRISPR gRNA sequence
tctttttcttttggcggggg

SEQ ID NO: 159687 - DNA, 20 bp, Artificial
  CRISPR gRNA sequence
ctttttcttttggcgggggc

SEQ ID NO: 159688 - DNA, 20 bp, Artificial
  CRISPR gRNA sequence
tttttcttttggcgggggcg

SEQ ID NO: 159689 - DNA, 20 bp, Artificial
  CRISPR gRNA sequence
tttcttttggcgggggcggg

SEQ ID NO: 159690 - DNA, 20 bp, Artificial
  CRISPR gRNA sequence
ttcttttggcgggggcgggg

SEQ ID NO: 159691 - DNA, 20 bp, Artificial
  CRISPR gRNA sequence
tcttttggcgggggcggggg

SEQ ID NO: 159692 - DNA, 20 bp, Artificial
  CRISPR gRNA sequence
cttttggcgggggcggggga

SEQ ID NO: 159693 - DNA, 20 bp, Artificial
  CRISPR gRNA sequence
ttttggcgggggcgggggac

SEQ ID NO: 159694 - DNA, 20 bp, Artificial
  CRISPR gRNA sequence
ttggcgggggcgggggacag

SEQ ID NO: 159695 - DNA, 20 bp, Artificial
  CRISPR gRNA sequence
tggcgggggcgggggacaga

SEQ ID NO: 159696 - DNA, 20 bp, Artificial
  CRISPR gRNA sequence
ggcgggggcgggggacagag

SEQ ID NO: 159697 - DNA, 20 bp, Artificial
  CRISPR gRNA sequence
gcgggggcgggggacagagt

SEQ ID NO: 159698 - DNA, 20 bp, Artificial
  CRISPR gRNA sequence
gctctgttgccaggctctag

SEQ ID NO: 159699 - DNA, 20 bp, Artificial
  CRISPR gRNA sequence
ctctgttgccaggctctagt

SEQ ID NO: 159700 - DNA, 20 bp, Artificial
  CRISPR gRNA sequence
tgttgccaggctctagtgca

SEQ ID NO: 159701 - DNA, 20 bp, Artificial
  CRISPR gRNA sequence
ttgccaggctctagtgcagt

SEQ ID NO: 159702 - DNA, 20 bp, Artificial
  CRISPR gRNA sequence
ccaggctctagtgcagtggc

SEQ ID NO: 159703 - DNA, 20 bp, Artificial
  CRISPR gRNA sequence
tagtgcagtggcgcgacctc

SEQ ID NO: 159704 - DNA, 20 bp, Artificial
  CRISPR gRNA sequence
gtgcagtggcgcgacctcag

SEQ ID NO: 159705 - DNA, 20 bp, Artificial
  CRISPR gRNA sequence
agctcactgcagcctccacc

SEQ ID NO: 159706 - DNA, 20 bp, Artificial
  CRISPR gRNA sequence
actgcagcctccacctcctg

SEQ ID NO: 159707 - DNA, 20 bp, Artificial
  CRISPR gRNA sequence
cagcctccacctcctggatt

SEQ ID NO: 159708 - DNA, 20 bp, Artificial
  CRISPR gRNA sequence
cacctcctggattcaagcga

SEQ ID NO: 159709 - DNA, 20 bp, Artificial
  CRISPR gRNA sequence
ctggattcaagcgattcccc

SEQ ID NO: 159710 - DNA, 20 bp, Artificial
  CRISPR gRNA sequence
gattcaagcgattcccccgc

SEQ ID NO: 159711 - DNA, 20 bp, Artificial
  CRISPR gRNA sequence
aagcgattcccccgcctcag

SEQ ID NO: 159712 - DNA, 20 bp, Artificial
  CRISPR gRNA sequence
ccccgcctcagcctcctgag

SEQ ID NO: 159713 - DNA, 20 bp, Artificial
  CRISPR gRNA sequence
agcctcctgagtagctggga

SEQ ID NO: 159714 - DNA, 20 bp, Artificial
  CRISPR gRNA sequence
ctgagtagctgggactacag

SEQ ID NO: 159715 - DNA, 20 bp, Artificial
  CRISPR gRNA sequence
agtagctgggactacaggtg

SEQ ID NO: 159716 - DNA, 20 bp, Artificial
  CRISPR gRNA sequence
ggactacaggtgtacgccac

SEQ ID NO: 159717 - DNA, 20 bp, Artificial
  CRISPR gRNA sequence
caggtgtacgccaccacacc

SEQ ID NO: 159718 - DNA, 20 bp, Artificial
  CRISPR gRNA sequence
attttttatatttttagtag

SEQ ID NO: 159719 - DNA, 20 bp, Artificial
  CRISPR gRNA sequence
tttatatttttagtagagat

SEQ ID NO: 159720 - DNA, 20 bp, Artificial
  CRISPR gRNA sequence
ttatatttttagtagagatg

SEQ ID NO: 159721 - DNA, 20 bp, Artificial
  CRISPR gRNA sequence
tatatttttagtagagatgg

SEQ ID NO: 159722 - DNA, 20 bp, Artificial
  CRISPR gRNA sequence
atatttttagtagagatggg

SEQ ID NO: 159723 - DNA, 20 bp, Artificial
  CRISPR gRNA sequence
tatttttagtagagatgggg

SEQ ID NO: 159724 - DNA, 20 bp, Artificial
  CRISPR gRNA sequence
ttagtagagatggggtttca

SEQ ID NO: 159725 - DNA, 20 bp, Artificial
  CRISPR gRNA sequence
tagtagagatggggtttcac

SEQ ID NO: 159726 - DNA, 20 bp, Artificial
  CRISPR gRNA sequence
agtagagatggggtttcacc

SEQ ID NO: 159727 - DNA, 20 bp, Artificial
  CRISPR gRNA sequence
gtagagatggggtttcacca

SEQ ID NO: 159728 - DNA, 20 bp, Artificial
  CRISPR gRNA sequence
caccatgttggccaggatgg

SEQ ID NO: 159729 - DNA, 20 bp, Artificial
  CRISPR gRNA sequence
accatgttggccaggatggt

SEQ ID NO: 159730 - DNA, 20 bp, Artificial
  CRISPR gRNA sequence
gccaggatggtctcaatctc

SEQ ID NO: 159731 - DNA, 20 bp, Artificial
  CRISPR gRNA sequence
aatctcctgacctcgtgatc

SEQ ID NO: 159732 - DNA, 20 bp, Artificial
  CRISPR gRNA sequence
ctgacctcgtgatctgccca

SEQ ID NO: 159733 - DNA, 20 bp, Artificial
  CRISPR gRNA sequence
acctcgtgatctgcccacct

SEQ ID NO: 159734 - DNA, 20 bp, Artificial
  CRISPR gRNA sequence
gtgatctgcccacctcggcc

SEQ ID NO: 159735 - DNA, 20 bp, Artificial
  CRISPR gRNA sequence
cccacctcggcctctcaaag

SEQ ID NO: 159736 - DNA, 20 bp, Artificial
  CRISPR gRNA sequence
ggcctctcaaagtgctgggt

SEQ ID NO: 159737 - DNA, 20 bp, Artificial
  CRISPR gRNA sequence
tcaaagtgctgggtttacag

SEQ ID NO: 159738 - DNA, 20 bp, Artificial
  CRISPR gRNA sequence
aaagtgctgggtttacaggc

SEQ ID NO: 159739 - DNA, 20 bp, Artificial
  CRISPR gRNA sequence
ggtttacaggcgtgagccac

SEQ ID NO: 159740 - DNA, 20 bp, Artificial
  CRISPR gRNA sequence
acaggcgtgagccaccgcgc

SEQ ID NO: 159741 - DNA, 20 bp, Artificial
  CRISPR gRNA sequence
caggcgtgagccaccgcgcc

SEQ ID NO: 159742 - DNA, 20 bp, Artificial
  CRISPR gRNA sequence
gccccggcctttatttttct

SEQ ID NO: 159743 - DNA, 20 bp, Artificial
  CRISPR gRNA sequence
tatttttcttaatctttctt

SEQ ID NO: 159744 - DNA, 20 bp, Artificial
  CRISPR gRNA sequence
atttttcttaatctttcttc

SEQ ID NO: 159745 - DNA, 20 bp, Artificial
  CRISPR gRNA sequence
tttttcttaatctttcttca

SEQ ID NO: 159746 - DNA, 20 bp, Artificial
  CRISPR gRNA sequence
ttcttaatctttcttcaatg

SEQ ID NO: 159747 - DNA, 20 bp, Artificial
  CRISPR gRNA sequence
tcttaatctttcttcaatgt

SEQ ID NO: 159748 - DNA, 20 bp, Artificial
  CRISPR gRNA sequence
cttaatctttcttcaatgta

SEQ ID NO: 159749 - DNA, 20 bp, Artificial
  CRISPR gRNA sequence
ttaatctttcttcaatgtat

SEQ ID NO: 159750 - DNA, 20 bp, Artificial
  CRISPR gRNA sequence
aatctttcttcaatgtatgt

SEQ ID NO: 159751 - DNA, 20 bp, Artificial
  CRISPR gRNA sequence
atctttcttcaatgtatgta

SEQ ID NO: 159752 - DNA, 20 bp, Artificial
  CRISPR gRNA sequence
tcttcaatgtatgtatagtt

SEQ ID NO: 159753 - DNA, 20 bp, Artificial
  CRISPR gRNA sequence
cttcaatgtatgtatagttc

SEQ ID NO: 159754 - DNA, 20 bp, Artificial
  CRISPR gRNA sequence
ttcaatgtatgtatagttca

SEQ ID NO: 159755 - DNA, 20 bp, Artificial
  CRISPR gRNA sequence
caatgtatgtatagttcata

SEQ ID NO: 159756 - DNA, 20 bp, Artificial
  CRISPR gRNA sequence
aatgtatgtatagttcatac

SEQ ID NO: 159757 - DNA, 20 bp, Artificial
  CRISPR gRNA sequence
atacttatttcagtgtttaa

SEQ ID NO: 159758 - DNA, 20 bp, Artificial
  CRISPR gRNA sequence
atttcagtgtttaatattag

SEQ ID NO: 159759 - DNA, 20 bp, Artificial
  CRISPR gRNA sequence
tttcagtgtttaatattaga

SEQ ID NO: 159760 - DNA, 20 bp, Artificial
  CRISPR gRNA sequence
cagtgtttaatattagaagt

SEQ ID NO: 159761 - DNA, 20 bp, Artificial
  CRISPR gRNA sequence
agtgtttaatattagaagtg

SEQ ID NO: 159762 - DNA, 20 bp, Artificial
  CRISPR gRNA sequence
aatattagaagtgtcttgat

SEQ ID NO: 159763 - DNA, 20 bp, Artificial
  CRISPR gRNA sequence
atattagaagtgtcttgatc

SEQ ID NO: 159764 - DNA, 20 bp, Artificial
  CRISPR gRNA sequence
gaagtgtcttgatctttatt

SEQ ID NO: 159765 - DNA, 20 bp, Artificial
  CRISPR gRNA sequence
gatctttatttagaagtttg

SEQ ID NO: 159766 - DNA, 20 bp, Artificial
  CRISPR gRNA sequence
atctttatttagaagtttgg

SEQ ID NO: 159767 - DNA, 20 bp, Artificial
  CRISPR gRNA sequence
tatttagaagtttggtgatg

SEQ ID NO: 159768 - DNA, 20 bp, Artificial
  CRISPR gRNA sequence
atttagaagtttggtgatgt

SEQ ID NO: 159769 - DNA, 20 bp, Artificial
  CRISPR gRNA sequence
tttagaagtttggtgatgtt

SEQ ID NO: 159770 - DNA, 20 bp, Artificial
  CRISPR gRNA sequence
agaagtttggtgatgttttt

SEQ ID NO: 159771 - DNA, 20 bp, Artificial
  CRISPR gRNA sequence
gaagtttggtgatgtttttg

SEQ ID NO: 159772 - DNA, 20 bp, Artificial
  CRISPR gRNA sequence
ggtgatgtttttgtgaccag

SEQ ID NO: 159773 - DNA, 20 bp, Artificial
  CRISPR gRNA sequence
gtgatgtttttgtgaccaga

SEQ ID NO: 159774 - DNA, 20 bp, Artificial
  CRISPR gRNA sequence
ttgtgaccagaaatatggaa

SEQ ID NO: 159775 - DNA, 20 bp, Artificial
  CRISPR gRNA sequence
tgtgaccagaaatatggaat

SEQ ID NO: 159776 - DNA, 20 bp, Artificial
  CRISPR gRNA sequence
gtgaccagaaatatggaata

SEQ ID NO: 159777 - DNA, 20 bp, Artificial
  CRISPR gRNA sequence
tgaccagaaatatggaatag

SEQ ID NO: 159778 - DNA, 20 bp, Artificial
  CRISPR gRNA sequence
actcttatttatgtcaatta

SEQ ID NO: 159779 - DNA, 20 bp, Artificial
  CRISPR gRNA sequence
ttatttatgtcaattagcct

SEQ ID NO: 159780 - DNA, 20 bp, Artificial
  CRISPR gRNA sequence
atttatgtcaattagccttt

SEQ ID NO: 159781 - DNA, 20 bp, Artificial
  CRISPR gRNA sequence
tttatgtcaattagcctttg

SEQ ID NO: 159782 - DNA, 20 bp, Artificial
  CRISPR gRNA sequence
atgtcaattagcctttggta

SEQ ID NO: 159783 - DNA, 20 bp, Artificial
  CRISPR gRNA sequence
tgtcaattagcctttggtaa

SEQ ID NO: 159784 - DNA, 20 bp, Artificial
  CRISPR gRNA sequence
gcctttggtaaaattggttt

SEQ ID NO: 159785 - DNA, 20 bp, Artificial
  CRISPR gRNA sequence
tggtaaaattggttttgtta

SEQ ID NO: 159786 - DNA, 20 bp, Artificial
  CRISPR gRNA sequence
ggtaaaattggttttgttat

SEQ ID NO: 159787 - DNA, 20 bp, Artificial
  CRISPR gRNA sequence
gtaaaattggttttgttata

SEQ ID NO: 159788 - DNA, 20 bp, Artificial
  CRISPR gRNA sequence
gttttgttatatgtttggct

SEQ ID NO: 159789 - DNA, 20 bp, Artificial
  CRISPR gRNA sequence
tgttatatgtttggcttaag

SEQ ID NO: 159790 - DNA, 20 bp, Artificial
  CRISPR gRNA sequence
gttatatgtttggcttaagt

SEQ ID NO: 159791 - DNA, 20 bp, Artificial
  CRISPR gRNA sequence
ttatatgtttggcttaagtt

SEQ ID NO: 159792 - DNA, 20 bp, Artificial
  CRISPR gRNA sequence
tatgtttggcttaagttgcg

SEQ ID NO: 159793 - DNA, 20 bp, Artificial
  CRISPR gRNA sequence
ggcttaagttgcggtttcca

SEQ ID NO: 159794 - DNA, 20 bp, Artificial
  CRISPR gRNA sequence
gcttaagttgcggtttccaa

SEQ ID NO: 159795 - DNA, 20 bp, Artificial
  CRISPR gRNA sequence
aagttgcggtttccaagagc

SEQ ID NO: 159796 - DNA, 20 bp, Artificial
  CRISPR gRNA sequence
agttgcggtttccaagagcc

SEQ ID NO: 159797 - DNA, 20 bp, Artificial
  CRISPR gRNA sequence
cggtttccaagagcctatcg

SEQ ID NO: 159798 - DNA, 20 bp, Artificial
  CRISPR gRNA sequence
ccaagagcctatcgaagaca

SEQ ID NO: 159799 - DNA, 20 bp, Artificial
  CRISPR gRNA sequence
caagagcctatcgaagacat

SEQ ID NO: 159800 - DNA, 20 bp, Artificial
  CRISPR gRNA sequence
tcgaagacattaagggagga

SEQ ID NO: 159801 - DNA, 20 bp, Artificial
  CRISPR gRNA sequence
agggaggacttaactttgct

SEQ ID NO: 159802 - DNA, 20 bp, Artificial
  CRISPR gRNA sequence
aactttgctttaattggaag

SEQ ID NO: 159803 - DNA, 20 bp, Artificial
  CRISPR gRNA sequence
actttgctttaattggaagc

SEQ ID NO: 159804 - DNA, 20 bp, Artificial
  CRISPR gRNA sequence
tgctttaattggaagcagca

SEQ ID NO: 159805 - DNA, 20 bp, Artificial
  CRISPR gRNA sequence
gctttaattggaagcagcat

SEQ ID NO: 159806 - DNA, 20 bp, Artificial
  CRISPR gRNA sequence
ctttaattggaagcagcatt

SEQ ID NO: 159807 - DNA, 20 bp, Artificial
  CRISPR gRNA sequence
taattggaagcagcattggt

SEQ ID NO: 159808 - DNA, 20 bp, Artificial
  CRISPR gRNA sequence
aattggaagcagcattggtc

SEQ ID NO: 159809 - DNA, 20 bp, Artificial
  CRISPR gRNA sequence
attggaagcagcattggtca

SEQ ID NO: 159810 - DNA, 20 bp, Artificial
  CRISPR gRNA sequence
gaagcagcattggtcaagaa

SEQ ID NO: 159811 - DNA, 20 bp, Artificial
  CRISPR gRNA sequence
gtcaagaattgggtttcatt

SEQ ID NO: 159812 - DNA, 20 bp, Artificial
  CRISPR gRNA sequence
ggtttcattttagcggagct

SEQ ID NO: 159813 - DNA, 20 bp, Artificial
  CRISPR gRNA sequence
cattttagcggagcttcctg

SEQ ID NO: 159814 - DNA, 20 bp, Artificial
  CRISPR gRNA sequence
attttagcggagcttcctgt

SEQ ID NO: 159815 - DNA, 20 bp, Artificial
  CRISPR gRNA sequence
tagcggagcttcctgtggtc

SEQ ID NO: 159816 - DNA, 20 bp, Artificial
  CRISPR gRNA sequence
agcggagcttcctgtggtct

SEQ ID NO: 159817 - DNA, 20 bp, Artificial
  CRISPR gRNA sequence
gcggagcttcctgtggtctt

SEQ ID NO: 159818 - DNA, 20 bp, Artificial
  CRISPR gRNA sequence
cctgtggtctttttcccttg

SEQ ID NO: 159819 - DNA, 20 bp, Artificial
  CRISPR gRNA sequence
ctgtggtctttttcccttgg

SEQ ID NO: 159820 - DNA, 20 bp, Artificial
  CRISPR gRNA sequence
tggtctttttcccttggaca

SEQ ID NO: 159821 - DNA, 20 bp, Artificial
  CRISPR gRNA sequence
tttcccttggacagttgttg

SEQ ID NO: 159822 - DNA, 20 bp, Artificial
  CRISPR gRNA sequence
ttcccttggacagttgttgt

SEQ ID NO: 159823 - DNA, 20 bp, Artificial
  CRISPR gRNA sequence
tcccttggacagttgttgtg

SEQ ID NO: 159824 - DNA, 20 bp, Artificial
  CRISPR gRNA sequence
cccttggacagttgttgtga

SEQ ID NO: 159825 - DNA, 20 bp, Artificial
  CRISPR gRNA sequence
ccttggacagttgttgtgat

SEQ ID NO: 159826 - DNA, 20 bp, Artificial
  CRISPR gRNA sequence
ggacagttgttgtgatgtta

SEQ ID NO: 159827 - DNA, 20 bp, Artificial
  CRISPR gRNA sequence
gacagttgttgtgatgttag

SEQ ID NO: 159828 - DNA, 20 bp, Artificial
  CRISPR gRNA sequence
ttgtgatgttaggtttttaa

SEQ ID NO: 159829 - DNA, 20 bp, Artificial
  CRISPR gRNA sequence
tgatgttaggtttttaagta

SEQ ID NO: 159830 - DNA, 20 bp, Artificial
  CRISPR gRNA sequence
ggtttttaagtattatctcc

SEQ ID NO: 159831 - DNA, 20 bp, Artificial
  CRISPR gRNA sequence
ttaagtattatctcccaaca

SEQ ID NO: 159832 - DNA, 20 bp, Artificial
  CRISPR gRNA sequence
taagtattatctcccaacaa

SEQ ID NO: 159833 - DNA, 20 bp, Artificial
  CRISPR gRNA sequence
aagtattatctcccaacaac

SEQ ID NO: 159834 - DNA, 20 bp, Artificial
  CRISPR gRNA sequence
agtattatctcccaacaaca

SEQ ID NO: 159835 - DNA, 20 bp, Artificial
  CRISPR gRNA sequence
tctcccaacaacatctattt

SEQ ID NO: 159836 - DNA, 20 bp, Artificial
  CRISPR gRNA sequence
ccaacaacatctatttagtt

SEQ ID NO: 159837 - DNA, 20 bp, Artificial
  CRISPR gRNA sequence
tttagttttagttacctcaa

SEQ ID NO: 159838 - DNA, 20 bp, Artificial
  CRISPR gRNA sequence
agttttagttacctcaaaga

SEQ ID NO: 159839 - DNA, 20 bp, Artificial
  CRISPR gRNA sequence
gttttagttacctcaaagag

SEQ ID NO: 159840 - DNA, 20 bp, Artificial
  CRISPR gRNA sequence
tagttacctcaaagagctgt

SEQ ID NO: 159841 - DNA, 20 bp, Artificial
  CRISPR gRNA sequence
agttacctcaaagagctgta

SEQ ID NO: 159842 - DNA, 20 bp, Artificial
  CRISPR gRNA sequence
gttacctcaaagagctgtat

SEQ ID NO: 159843 - DNA, 20 bp, Artificial
  CRISPR gRNA sequence
cctcaaagagctgtattgtg

SEQ ID NO: 159844 - DNA, 20 bp, Artificial
  CRISPR gRNA sequence
aaagagctgtattgtgggtt

SEQ ID NO: 159845 - DNA, 20 bp, Artificial
  CRISPR gRNA sequence
tattgtgggtttaggctact

SEQ ID NO: 159846 - DNA, 20 bp, Artificial
  CRISPR gRNA sequence
tgggtttaggctactataaa

SEQ ID NO: 159847 - DNA, 20 bp, Artificial
  CRISPR gRNA sequence
aggctactataaaagagttt

SEQ ID NO: 159848 - DNA, 20 bp, Artificial
  CRISPR gRNA sequence
ggctactataaaagagtttg

SEQ ID NO: 159849 - DNA, 20 bp, Artificial
  CRISPR gRNA sequence
ctataaaagagtttggtata

SEQ ID NO: 159850 - DNA, 20 bp, Artificial
  CRISPR gRNA sequence
taaaagagtttggtatagag

SEQ ID NO: 159851 - DNA, 20 bp, Artificial
  CRISPR gRNA sequence
ggtatagagaatgaagtaca

SEQ ID NO: 159852 - DNA, 20 bp, Artificial
  CRISPR gRNA sequence
gtatagagaatgaagtacat

SEQ ID NO: 159853 - DNA, 20 bp, Artificial
  CRISPR gRNA sequence
aactgaagtctaaaggtcct

SEQ ID NO: 159854 - DNA, 20 bp, Artificial
  CRISPR gRNA sequence
aagtctaaaggtcctgagtt

SEQ ID NO: 159855 - DNA, 20 bp, Artificial
  CRISPR gRNA sequence
aaggtcctgagtttcagaaa

SEQ ID NO: 159856 - DNA, 20 bp, Artificial
  CRISPR gRNA sequence
agtttcagaaaccaggtcat

SEQ ID NO: 159857 - DNA, 20 bp, Artificial
  CRISPR gRNA sequence
cagaaaccaggtcatattgc

SEQ ID NO: 159858 - DNA, 20 bp, Artificial
  CRISPR gRNA sequence
agaaaccaggtcatattgca

SEQ ID NO: 159859 - DNA, 20 bp, Artificial
  CRISPR gRNA sequence
caataaaaccttagatttct

SEQ ID NO: 159860 - DNA, 20 bp, Artificial
  CRISPR gRNA sequence
agatttctttttatttatga

SEQ ID NO: 159861 - DNA, 20 bp, Artificial
  CRISPR gRNA sequence
gatttctttttatttatgag

SEQ ID NO: 159862 - DNA, 20 bp, Artificial
  CRISPR gRNA sequence
ctttttatttatgaggttga

SEQ ID NO: 159863 - DNA, 20 bp, Artificial
  CRISPR gRNA sequence
tttttatttatgaggttgat

SEQ ID NO: 159864 - DNA, 20 bp, Artificial
  CRISPR gRNA sequence
tttatttatgaggttgataa

SEQ ID NO: 159865 - DNA, 20 bp, Artificial
  CRISPR gRNA sequence
ttatttatgaggttgataat

SEQ ID NO: 159866 - DNA, 20 bp, Artificial
  CRISPR gRNA sequence
tatttatgaggttgataatt

SEQ ID NO: 159867 - DNA, 20 bp, Artificial
  CRISPR gRNA sequence
atttatgaggttgataattt

SEQ ID NO: 159868 - DNA, 20 bp, Artificial
  CRISPR gRNA sequence
tttatgaggttgataatttt

SEQ ID NO: 159869 - DNA, 20 bp, Artificial
  CRISPR gRNA sequence
atgaggttgataattttgat

SEQ ID NO: 159870 - DNA, 20 bp, Artificial
  CRISPR gRNA sequence
tgaggttgataattttgata

SEQ ID NO: 159871 - DNA, 20 bp, Artificial
  CRISPR gRNA sequence
ataattttgatacatcctgt

SEQ ID NO: 159872 - DNA, 20 bp, Artificial
  CRISPR gRNA sequence
tgatacatcctgttgttcca

SEQ ID NO: 159873 - DNA, 20 bp, Artificial
  CRISPR gRNA sequence
gatacatcctgttgttccat

SEQ ID NO: 159874 - DNA, 20 bp, Artificial
  CRISPR gRNA sequence
atacatcctgttgttccatg

SEQ ID NO: 159875 - DNA, 20 bp, Artificial
  CRISPR gRNA sequence
ttgttccatgcccaggcata

SEQ ID NO: 159876 - DNA, 20 bp, Artificial
  CRISPR gRNA sequence
ttccatgcccaggcatatca

SEQ ID NO: 159877 - DNA, 20 bp, Artificial
  CRISPR gRNA sequence
catgcccaggcatatcacta

SEQ ID NO: 159878 - DNA, 20 bp, Artificial
  CRISPR gRNA sequence
agagaagatttggcaggcat

SEQ ID NO: 159879 - DNA, 20 bp, Artificial
  CRISPR gRNA sequence
ggcaggcatggtacctggtt

SEQ ID NO: 159880 - DNA, 20 bp, Artificial
  CRISPR gRNA sequence
gcaggcatggtacctggttg

SEQ ID NO: 159881 - DNA, 20 bp, Artificial
  CRISPR gRNA sequence
gttgagagcaagagcttgaa

SEQ ID NO: 159882 - DNA, 20 bp, Artificial
  CRISPR gRNA sequence
agagcaagagcttgaaagat

SEQ ID NO: 159883 - DNA, 20 bp, Artificial
  CRISPR gRNA sequence
gaaagatttccaaacaattt

SEQ ID NO: 159884 - DNA, 20 bp, Artificial
  CRISPR gRNA sequence
aaagatttccaaacaatttt

SEQ ID NO: 159885 - DNA, 20 bp, Artificial
  CRISPR gRNA sequence
ccaaacaattttaaaaggaa

SEQ ID NO: 159886 - DNA, 20 bp, Artificial
  CRISPR gRNA sequence
caaacaattttaaaaggaac

SEQ ID NO: 159887 - DNA, 20 bp, Artificial
  CRISPR gRNA sequence
taaaaggaacactctgattt

SEQ ID NO: 159888 - DNA, 20 bp, Artificial
  CRISPR gRNA sequence
aaaaggaacactctgatttt

SEQ ID NO: 159889 - DNA, 20 bp, Artificial
  CRISPR gRNA sequence
aaaggaacactctgattttg

SEQ ID NO: 159890 - DNA, 20 bp, Artificial
  CRISPR gRNA sequence
tgattttgggatgttttgaa

SEQ ID NO: 159891 - DNA, 20 bp, Artificial
  CRISPR gRNA sequence
attttgggatgttttgaaaa

SEQ ID NO: 159892 - DNA, 20 bp, Artificial
  CRISPR gRNA sequence
tgggatgttttgaaaacttc

SEQ ID NO: 159893 - DNA, 20 bp, Artificial
  CRISPR gRNA sequence
gggatgttttgaaaacttct

SEQ ID NO: 159894 - DNA, 20 bp, Artificial
  CRISPR gRNA sequence
ggatgttttgaaaacttctg

SEQ ID NO: 159895 - DNA, 20 bp, Artificial
  CRISPR gRNA sequence
tgaaaacttctgaagtttca

SEQ ID NO: 159896 - DNA, 20 bp, Artificial
  CRISPR gRNA sequence
gaaaacttctgaagtttcat

SEQ ID NO: 159897 - DNA, 20 bp, Artificial
  CRISPR gRNA sequence
aaaacttctgaagtttcatt

SEQ ID NO: 159898 - DNA, 20 bp, Artificial
  CRISPR gRNA sequence
ctgaagtttcatttttttct

SEQ ID NO: 159899 - DNA, 20 bp, Artificial
  CRISPR gRNA sequence
tgaagtttcatttttttctt

SEQ ID NO: 159900 - DNA, 20 bp, Artificial
  CRISPR gRNA sequence
aagtttcatttttttcttta

SEQ ID NO: 159901 - DNA, 20 bp, Artificial
  CRISPR gRNA sequence
catttttttctttaagaatg

SEQ ID NO: 159902 - DNA, 20 bp, Artificial
  CRISPR gRNA sequence
atttttttctttaagaatga

SEQ ID NO: 159903 - DNA, 20 bp, Artificial
  CRISPR gRNA sequence
ttttctttaagaatgataaa

SEQ ID NO: 159904 - DNA, 20 bp, Artificial
  CRISPR gRNA sequence
tttctttaagaatgataaag

SEQ ID NO: 159905 - DNA, 20 bp, Artificial
  CRISPR gRNA sequence
ttctttaagaatgataaaga

SEQ ID NO: 159906 - DNA, 20 bp, Artificial
  CRISPR gRNA sequence
tctttaagaatgataaagag

SEQ ID NO: 159907 - DNA, 20 bp, Artificial
  CRISPR gRNA sequence
ctttaagaatgataaagagt

SEQ ID NO: 159908 - DNA, 20 bp, Artificial
  CRISPR gRNA sequence
tttaagaatgataaagagta

SEQ ID NO: 159909 - DNA, 20 bp, Artificial
  CRISPR gRNA sequence
taagaatgataaagagtaac

SEQ ID NO: 159910 - DNA, 20 bp, Artificial
  CRISPR gRNA sequence
aagaatgataaagagtaact

SEQ ID NO: 159911 - DNA, 20 bp, Artificial
  CRISPR gRNA sequence
agaatgataaagagtaactg

SEQ ID NO: 159912 - DNA, 20 bp, Artificial
  CRISPR gRNA sequence
gatataagagtaacagctag

SEQ ID NO: 159913 - DNA, 20 bp, Artificial
  CRISPR gRNA sequence
gattgcccactcatcagtgg

SEQ ID NO: 159914 - DNA, 20 bp, Artificial
  CRISPR gRNA sequence
cccactcatcagtggtctga

SEQ ID NO: 159915 - DNA, 20 bp, Artificial
  CRISPR gRNA sequence
atcagtggtctgatcaaatc

SEQ ID NO: 159916 - DNA, 20 bp, Artificial
  CRISPR gRNA sequence
atcaaatcatctcacttctg

SEQ ID NO: 159917 - DNA, 20 bp, Artificial
  CRISPR gRNA sequence
acttctgcatgattttcccc

SEQ ID NO: 159918 - DNA, 20 bp, Artificial
  CRISPR gRNA sequence
ctgcatgattttccccttct

SEQ ID NO: 159919 - DNA, 20 bp, Artificial
  CRISPR gRNA sequence
tgcatgattttccccttctt

SEQ ID NO: 159920 - DNA, 20 bp, Artificial
  CRISPR gRNA sequence
catgattttccccttcttgc

SEQ ID NO: 159921 - DNA, 20 bp, Artificial
  CRISPR gRNA sequence
tccccttcttgctaatggat

SEQ ID NO: 159922 - DNA, 20 bp, Artificial
  CRISPR gRNA sequence
ccccttcttgctaatggatg

SEQ ID NO: 159923 - DNA, 20 bp, Artificial
  CRISPR gRNA sequence
cccttcttgctaatggatgg

SEQ ID NO: 159924 - DNA, 20 bp, Artificial
  CRISPR gRNA sequence
cttgctaatggatggccagg

SEQ ID NO: 159925 - DNA, 20 bp, Artificial
  CRISPR gRNA sequence
ttgctaatggatggccaggc

SEQ ID NO: 159926 - DNA, 20 bp, Artificial
  CRISPR gRNA sequence
gctaatggatggccaggcag

SEQ ID NO: 159927 - DNA, 20 bp, Artificial
  CRISPR gRNA sequence
ctaatggatggccaggcaga

SEQ ID NO: 159928 - DNA, 20 bp, Artificial
  CRISPR gRNA sequence
atggatggccaggcagaggt

SEQ ID NO: 159929 - DNA, 20 bp, Artificial
  CRISPR gRNA sequence
atcttcctcctacttaccca

SEQ ID NO: 159930 - DNA, 20 bp, Artificial
  CRISPR gRNA sequence
tcttcctcctacttacccat

SEQ ID NO: 159931 - DNA, 20 bp, Artificial
  CRISPR gRNA sequence
cctcctacttacccattgtc

SEQ ID NO: 159932 - DNA, 20 bp, Artificial
  CRISPR gRNA sequence
ctcctacttacccattgtca

SEQ ID NO: 159933 - DNA, 20 bp, Artificial
  CRISPR gRNA sequence
ctacttacccattgtcatta

SEQ ID NO: 159934 - DNA, 20 bp, Artificial
  CRISPR gRNA sequence
cttacccattgtcattaata

SEQ ID NO: 159935 - DNA, 20 bp, Artificial
  CRISPR gRNA sequence
acccattgtcattaatattt

SEQ ID NO: 159936 - DNA, 20 bp, Artificial
  CRISPR gRNA sequence
cccattgtcattaatatttc

SEQ ID NO: 159937 - DNA, 20 bp, Artificial
  CRISPR gRNA sequence
tcattaatatttcagacttt

SEQ ID NO: 159938 - DNA, 20 bp, Artificial
  CRISPR gRNA sequence
atatttcagactttgctaat

SEQ ID NO: 159939 - DNA, 20 bp, Artificial
  CRISPR gRNA sequence
cagactttgctaatctatcc

SEQ ID NO: 159940 - DNA, 20 bp, Artificial
  CRISPR gRNA sequence
agactttgctaatctatcct

SEQ ID NO: 159941 - DNA, 20 bp, Artificial
  CRISPR gRNA sequence
tgctaatctatcctggtcac

SEQ ID NO: 159942 - DNA, 20 bp, Artificial
  CRISPR gRNA sequence
gctaatctatcctggtcact

SEQ ID NO: 159943 - DNA, 20 bp, Artificial
  CRISPR gRNA sequence
ctaatctatcctggtcactt

SEQ ID NO: 159944 - DNA, 20 bp, Artificial
  CRISPR gRNA sequence
atctatcctggtcacttttc

SEQ ID NO: 159945 - DNA, 20 bp, Artificial
  CRISPR gRNA sequence
tcctggtcacttttctgaag

SEQ ID NO: 159946 - DNA, 20 bp, Artificial
  CRISPR gRNA sequence
gtcacttttctgaagaggtt

SEQ ID NO: 159947 - DNA, 20 bp, Artificial
  CRISPR gRNA sequence
ttctgaagaggttctgactt

SEQ ID NO: 159948 - DNA, 20 bp, Artificial
  CRISPR gRNA sequence
tctgaagaggttctgacttt

SEQ ID NO: 159949 - DNA, 20 bp, Artificial
  CRISPR gRNA sequence
ctgaagaggttctgactttg

SEQ ID NO: 159950 - DNA, 20 bp, Artificial
  CRISPR gRNA sequence
tgaagaggttctgactttga

SEQ ID NO: 159951 - DNA, 20 bp, Artificial
  CRISPR gRNA sequence
aagaggttctgactttgaaa

SEQ ID NO: 159952 - DNA, 20 bp, Artificial
  CRISPR gRNA sequence
tgactttgaaaagatttaca

SEQ ID NO: 159953 - DNA, 20 bp, Artificial
  CRISPR gRNA sequence
actttgaaaagatttacact

SEQ ID NO: 159954 - DNA, 20 bp, Artificial
  CRISPR gRNA sequence
tgaaaagatttacacttgag

SEQ ID NO: 159955 - DNA, 20 bp, Artificial
  CRISPR gRNA sequence
gaaaagatttacacttgaga

SEQ ID NO: 159956 - DNA, 20 bp, Artificial
  CRISPR gRNA sequence
aaaagatttacacttgagaa

SEQ ID NO: 159957 - DNA, 20 bp, Artificial
  CRISPR gRNA sequence
acacttgagaatggtatgca

SEQ ID NO: 159958 - DNA, 20 bp, Artificial
  CRISPR gRNA sequence
cacttgagaatggtatgcat

SEQ ID NO: 159959 - DNA, 20 bp, Artificial
  CRISPR gRNA sequence
gagaatggtatgcatccaca

SEQ ID NO: 159960 - DNA, 20 bp, Artificial
  CRISPR gRNA sequence
agaatggtatgcatccacat

SEQ ID NO: 159961 - DNA, 20 bp, Artificial
  CRISPR gRNA sequence
ccagccttcaagtctgcctt

SEQ ID NO: 159962 - DNA, 20 bp, Artificial
  CRISPR gRNA sequence
cagccttcaagtctgccttt

SEQ ID NO: 159963 - DNA, 20 bp, Artificial
  CRISPR gRNA sequence
caagtctgcctttcagcttc

SEQ ID NO: 159964 - DNA, 20 bp, Artificial
  CRISPR gRNA sequence
aagtctgcctttcagcttcc

SEQ ID NO: 159965 - DNA, 20 bp, Artificial
  CRISPR gRNA sequence
cctttcagcttccagcactg

SEQ ID NO: 159966 - DNA, 20 bp, Artificial
  CRISPR gRNA sequence
tcagcttccagcactgtctt

SEQ ID NO: 159967 - DNA, 20 bp, Artificial
  CRISPR gRNA sequence
cagcttccagcactgtctta

SEQ ID NO: 159968 - DNA, 20 bp, Artificial
  CRISPR gRNA sequence
agcttccagcactgtcttag

SEQ ID NO: 159969 - DNA, 20 bp, Artificial
  CRISPR gRNA sequence
ccagcactgtcttagatgtt

SEQ ID NO: 159970 - DNA, 20 bp, Artificial
  CRISPR gRNA sequence
cagcactgtcttagatgttt

SEQ ID NO: 159971 - DNA, 20 bp, Artificial
  CRISPR gRNA sequence
tcttagatgtttgtgtgtgt

SEQ ID NO: 159972 - DNA, 20 bp, Artificial
  CRISPR gRNA sequence
agatgtttgtgtgtgtgtgt

SEQ ID NO: 159973 - DNA, 20 bp, Artificial
  CRISPR gRNA sequence
gatgtttgtgtgtgtgtgtc

SEQ ID NO: 159974 - DNA, 20 bp, Artificial
  CRISPR gRNA sequence
gtgtgtgtgtgtcctttctg

SEQ ID NO: 159975 - DNA, 20 bp, Artificial
  CRISPR gRNA sequence
tgtgtgtgtgtcctttctgt

SEQ ID NO: 159976 - DNA, 20 bp, Artificial
  CRISPR gRNA sequence
tctgtcatccccttttattt

SEQ ID NO: 159977 - DNA, 20 bp, Artificial
  CRISPR gRNA sequence
ctgtcatccccttttatttt

SEQ ID NO: 159978 - DNA, 20 bp, Artificial
  CRISPR gRNA sequence
tgtcatccccttttatttta

SEQ ID NO: 159979 - DNA, 20 bp, Artificial
  CRISPR gRNA sequence
tcatccccttttattttaaa

SEQ ID NO: 159980 - DNA, 20 bp, Artificial
  CRISPR gRNA sequence
ttattttaaatccatttcag

SEQ ID NO: 159981 - DNA, 20 bp, Artificial
  CRISPR gRNA sequence
tattttaaatccatttcagt

SEQ ID NO: 159982 - DNA, 20 bp, Artificial
  CRISPR gRNA sequence
attttaaatccatttcagta

SEQ ID NO: 159983 - DNA, 20 bp, Artificial
  CRISPR gRNA sequence
ttttaaatccatttcagtaa

SEQ ID NO: 159984 - DNA, 20 bp, Artificial
  CRISPR gRNA sequence
taaatccatttcagtaaatc

SEQ ID NO: 159985 - DNA, 20 bp, Artificial
  CRISPR gRNA sequence
aaatccatttcagtaaatca

SEQ ID NO: 159986 - DNA, 20 bp, Artificial
  CRISPR gRNA sequence
aatccatttcagtaaatcag

SEQ ID NO: 159987 - DNA, 20 bp, Artificial
  CRISPR gRNA sequence
cagtaaatcagtttcaggta

SEQ ID NO: 159988 - DNA, 20 bp, Artificial
  CRISPR gRNA sequence
agtaaatcagtttcaggtag

SEQ ID NO: 159989 - DNA, 20 bp, Artificial
  CRISPR gRNA sequence
caggtagatttctgattgca

SEQ ID NO: 159990 - DNA, 20 bp, Artificial
  CRISPR gRNA sequence
aggtagatttctgattgcag

SEQ ID NO: 159991 - DNA, 20 bp, Artificial
  CRISPR gRNA sequence
ctgattgcagtcttgcttta

SEQ ID NO: 159992 - DNA, 20 bp, Artificial
  CRISPR gRNA sequence
tgattgcagtcttgctttaa

SEQ ID NO: 159993 - DNA, 20 bp, Artificial
  CRISPR gRNA sequence
attgcagtcttgctttaaag

SEQ ID NO: 159994 - DNA, 20 bp, Artificial
  CRISPR gRNA sequence
cagtcttgctttaaagtcct

SEQ ID NO: 159995 - DNA, 20 bp, Artificial
  CRISPR gRNA sequence
gctttaaagtcctggagctc

SEQ ID NO: 159996 - DNA, 20 bp, Artificial
  CRISPR gRNA sequence
ctttaaagtcctggagctca

SEQ ID NO: 159997 - DNA, 20 bp, Artificial
  CRISPR gRNA sequence
taaagtcctggagctcattt

SEQ ID NO: 159998 - DNA, 20 bp, Artificial
  CRISPR gRNA sequence
aaagtcctggagctcattta

SEQ ID NO: 159999 - DNA, 20 bp, Artificial
  CRISPR gRNA sequence
aagtcctggagctcatttag

SEQ ID NO: 160000 - DNA, 20 bp, Artificial
  CRISPR gRNA sequence
gagctcatttagtctaagct

SEQ ID NO: 160001 - DNA, 20 bp, Artificial
  CRISPR gRNA sequence
atttagtctaagcttctgga

SEQ ID NO: 160002 - DNA, 20 bp, Artificial
  CRISPR gRNA sequence
agtctaagcttctggaatag

SEQ ID NO: 160003 - DNA, 20 bp, Artificial
  CRISPR gRNA sequence
gtctaagcttctggaatagc

SEQ ID NO: 160004 - DNA, 20 bp, Artificial
  CRISPR gRNA sequence
agcttctggaatagcttgtg

SEQ ID NO: 160005 - DNA, 20 bp, Artificial
  CRISPR gRNA sequence
ctggaatagcttgtgtaacc

SEQ ID NO: 160006 - DNA, 20 bp, Artificial
  CRISPR gRNA sequence
tggaatagcttgtgtaacca

SEQ ID NO: 160007 - DNA, 20 bp, Artificial
  CRISPR gRNA sequence
gaatagcttgtgtaaccatt

SEQ ID NO: 160008 - DNA, 20 bp, Artificial
  CRISPR gRNA sequence
gtgtaaccatttcctttggt

SEQ ID NO: 160009 - DNA, 20 bp, Artificial
  CRISPR gRNA sequence
tgtaaccatttcctttggtt

SEQ ID NO: 160010 - DNA, 20 bp, Artificial
  CRISPR gRNA sequence
cctttggttaggcaattcca

SEQ ID NO: 160011 - DNA, 20 bp, Artificial
  CRISPR gRNA sequence
ctttggttaggcaattccaa

SEQ ID NO: 160012 - DNA, 20 bp, Artificial
  CRISPR gRNA sequence
tggttaggcaattccaataa

SEQ ID NO: 160013 - DNA, 20 bp, Artificial
  CRISPR gRNA sequence
ggttaggcaattccaataag

SEQ ID NO: 160014 - DNA, 20 bp, Artificial
  CRISPR gRNA sequence
gttaggcaattccaataagt

SEQ ID NO: 160015 - DNA, 20 bp, Artificial
  CRISPR gRNA sequence
ggcaattccaataagtatgt

SEQ ID NO: 160016 - DNA, 20 bp, Artificial
  CRISPR gRNA sequence
caataagtatgtcagggcca

SEQ ID NO: 160017 - DNA, 20 bp, Artificial
  CRISPR gRNA sequence
tccaagattcgccccccccc

SEQ ID NO: 160018 - DNA, 20 bp, Artificial
  CRISPR gRNA sequence
ccaagattcgcccccccccc

SEQ ID NO: 160019 - DNA, 20 bp, Artificial
  CRISPR gRNA sequence
caagattcgccccccccccc

SEQ ID NO: 160020 - DNA, 20 bp, Artificial
  CRISPR gRNA sequence
gccccccccccctttttttt

SEQ ID NO: 160021 - DNA, 20 bp, Artificial
  CRISPR gRNA sequence
ttttttttttcctgaaaggc

SEQ ID NO: 160022 - DNA, 20 bp, Artificial
  CRISPR gRNA sequence
tttttttttcctgaaaggcc

SEQ ID NO: 160023 - DNA, 20 bp, Artificial
  CRISPR gRNA sequence
ttttttttcctgaaaggcca

SEQ ID NO: 160024 - DNA, 20 bp, Artificial
  CRISPR gRNA sequence
tttttttcctgaaaggccat

SEQ ID NO: 160025 - DNA, 20 bp, Artificial
  CRISPR gRNA sequence
ttttttcctgaaaggccata

SEQ ID NO: 160026 - DNA, 20 bp, Artificial
  CRISPR gRNA sequence
tttttcctgaaaggccatac

SEQ ID NO: 160027 - DNA, 20 bp, Artificial
  CRISPR gRNA sequence
ttttcctgaaaggccatacc

SEQ ID NO: 160028 - DNA, 20 bp, Artificial
  CRISPR gRNA sequence
tttcctgaaaggccataccc

SEQ ID NO: 160029 - DNA, 20 bp, Artificial
  CRISPR gRNA sequence
ttcctgaaaggccataccca

SEQ ID NO: 160030 - DNA, 20 bp, Artificial
  CRISPR gRNA sequence
tcctgaaaggccatacccag

SEQ ID NO: 160031 - DNA, 20 bp, Artificial
  CRISPR gRNA sequence
cctgaaaggccatacccagc

SEQ ID NO: 160032 - DNA, 20 bp, Artificial
  CRISPR gRNA sequence
ctgaaaggccatacccagca

SEQ ID NO: 160033 - DNA, 20 bp, Artificial
  CRISPR gRNA sequence
aaaggccatacccagcatca

SEQ ID NO: 160034 - DNA, 20 bp, Artificial
  CRISPR gRNA sequence
gcacctcctcttaggggtaa

SEQ ID NO: 160035 - DNA, 20 bp, Artificial
  CRISPR gRNA sequence
cacctcctcttaggggtaat

SEQ ID NO: 160036 - DNA, 20 bp, Artificial
  CRISPR gRNA sequence
ctcttaggggtaattagtta

SEQ ID NO: 160037 - DNA, 20 bp, Artificial
  CRISPR gRNA sequence
ttaggggtaattagttatca

SEQ ID NO: 160038 - DNA, 20 bp, Artificial
  CRISPR gRNA sequence
aggggtaattagttatcaga

SEQ ID NO: 160039 - DNA, 20 bp, Artificial
  CRISPR gRNA sequence
ggggtaattagttatcagac

SEQ ID NO: 160040 - DNA, 20 bp, Artificial
  CRISPR gRNA sequence
gttatcagactgtgtgctgg

SEQ ID NO: 160041 - DNA, 20 bp, Artificial
  CRISPR gRNA sequence
tcagactgtgtgctggatac

SEQ ID NO: 160042 - DNA, 20 bp, Artificial
  CRISPR gRNA sequence
tgtgctggatactgtgaggg

SEQ ID NO: 160043 - DNA, 20 bp, Artificial
  CRISPR gRNA sequence
gatactgtgagggatccaga

SEQ ID NO: 160044 - DNA, 20 bp, Artificial
  CRISPR gRNA sequence
tgagggatccagagagatga

SEQ ID NO: 160045 - DNA, 20 bp, Artificial
  CRISPR gRNA sequence
ccctcaaggagcttgtatag

SEQ ID NO: 160046 - DNA, 20 bp, Artificial
  CRISPR gRNA sequence
aaggagcttgtatagcagga

SEQ ID NO: 160047 - DNA, 20 bp, Artificial
  CRISPR gRNA sequence
gtatagcaggaggggaaata

SEQ ID NO: 160048 - DNA, 20 bp, Artificial
  CRISPR gRNA sequence
tatagcaggaggggaaataa

SEQ ID NO: 160049 - DNA, 20 bp, Artificial
  CRISPR gRNA sequence
atgtgtatgtcatacaaggt

SEQ ID NO: 160050 - DNA, 20 bp, Artificial
  CRISPR gRNA sequence
tacaaggtaatgtggtgagg

SEQ ID NO: 160051 - DNA, 20 bp, Artificial
  CRISPR gRNA sequence
cttaatgctcccaagggagg

SEQ ID NO: 160052 - DNA, 20 bp, Artificial
  CRISPR gRNA sequence
aatgctcccaagggagggac

SEQ ID NO: 160053 - DNA, 20 bp, Artificial
  CRISPR gRNA sequence
atgctcccaagggagggacc

SEQ ID NO: 160054 - DNA, 20 bp, Artificial
  CRISPR gRNA sequence
ccaagggagggaccagttcc

SEQ ID NO: 160055 - DNA, 20 bp, Artificial
  CRISPR gRNA sequence
cagaaagcagtagagaatac

SEQ ID NO: 160056 - DNA, 20 bp, Artificial
  CRISPR gRNA sequence
cgtggagagatagtaattga

SEQ ID NO: 160057 - DNA, 20 bp, Artificial
  CRISPR gRNA sequence
gtggagagatagtaattgag

SEQ ID NO: 160058 - DNA, 20 bp, Artificial
  CRISPR gRNA sequence
agttgagtgcctgtagtccc

SEQ ID NO: 160059 - DNA, 20 bp, Artificial
  CRISPR gRNA sequence
agtgcctgtagtcccagcta

SEQ ID NO: 160060 - DNA, 20 bp, Artificial
  CRISPR gRNA sequence
tagtcccagctacttgggag

SEQ ID NO: 160061 - DNA, 20 bp, Artificial
  CRISPR gRNA sequence
cttgggaggctgtggtagga

SEQ ID NO: 160062 - DNA, 20 bp, Artificial
  CRISPR gRNA sequence
gggaggctgtggtaggagga

SEQ ID NO: 160063 - DNA, 20 bp, Artificial
  CRISPR gRNA sequence
ggaggctgtggtaggaggat

SEQ ID NO: 160064 - DNA, 20 bp, Artificial
  CRISPR gRNA sequence
tggtaggaggattgcttgag

SEQ ID NO: 160065 - DNA, 20 bp, Artificial
  CRISPR gRNA sequence
cttgagcccaggaggtagag

SEQ ID NO: 160066 - DNA, 20 bp, Artificial
  CRISPR gRNA sequence
gagcccaggaggtagaggct

SEQ ID NO: 160067 - DNA, 20 bp, Artificial
  CRISPR gRNA sequence
agcccaggaggtagaggctg

SEQ ID NO: 160068 - DNA, 20 bp, Artificial
  CRISPR gRNA sequence
cagtgagccaagatcacacc

SEQ ID NO: 160069 - DNA, 20 bp, Artificial
  CRISPR gRNA sequence
cactccagcctgggcaacag

SEQ ID NO: 160070 - DNA, 20 bp, Artificial
  CRISPR gRNA sequence
cagcctgggcaacagagcga

SEQ ID NO: 160071 - DNA, 20 bp, Artificial
  CRISPR gRNA sequence
ggcaacagagcgaaaccctg

SEQ ID NO: 160072 - DNA, 20 bp, Artificial
  CRISPR gRNA sequence
gctttgagaaaaaaaaaata

SEQ ID NO: 160073 - DNA, 20 bp, Artificial
  CRISPR gRNA sequence
tgagaaaaaaaaaatagaga

SEQ ID NO: 160074 - DNA, 20 bp, Artificial
  CRISPR gRNA sequence
gagaaaaaaaaaatagagag

SEQ ID NO: 160075 - DNA, 20 bp, Artificial
  CRISPR gRNA sequence
agaaaaaaaaaatagagaga

SEQ ID NO: 160076 - DNA, 20 bp, Artificial
  CRISPR gRNA sequence
aacatggaatgaagaggatc

SEQ ID NO: 160077 - DNA, 20 bp, Artificial
  CRISPR gRNA sequence
acatggaatgaagaggatcc

SEQ ID NO: 160078 - DNA, 20 bp, Artificial
  CRISPR gRNA sequence
gaatgagtctcttttttctt

SEQ ID NO: 160079 - DNA, 20 bp, Artificial
  CRISPR gRNA sequence
ttttttcttgtattttttat

SEQ ID NO: 160080 - DNA, 20 bp, Artificial
  CRISPR gRNA sequence
ttttcttgtattttttatta

SEQ ID NO: 160081 - DNA, 20 bp, Artificial
  CRISPR gRNA sequence
tttcttgtattttttattat

SEQ ID NO: 160082 - DNA, 20 bp, Artificial
  CRISPR gRNA sequence
ttcttgtattttttattatt

SEQ ID NO: 160083 - DNA, 20 bp, Artificial
  CRISPR gRNA sequence
tcttgtattttttattatta

SEQ ID NO: 160084 - DNA, 20 bp, Artificial
  CRISPR gRNA sequence
cttgtattttttattattat

SEQ ID NO: 160085 - DNA, 20 bp, Artificial
  CRISPR gRNA sequence
ttgtattttttattattata

SEQ ID NO: 160086 - DNA, 20 bp, Artificial
  CRISPR gRNA sequence
gtattttttattattataat

SEQ ID NO: 160087 - DNA, 20 bp, Artificial
  CRISPR gRNA sequence
tattttttattattataatt

SEQ ID NO: 160088 - DNA, 20 bp, Artificial
  CRISPR gRNA sequence
tttattattataattttttt

SEQ ID NO: 160089 - DNA, 20 bp, Artificial
  CRISPR gRNA sequence
ttattattataatttttttg

SEQ ID NO: 160090 - DNA, 20 bp, Artificial
  CRISPR gRNA sequence
tattattataatttttttga

SEQ ID NO: 160091 - DNA, 20 bp, Artificial
  CRISPR gRNA sequence
attattataatttttttgag

SEQ ID NO: 160092 - DNA, 20 bp, Artificial
  CRISPR gRNA sequence
ttattataatttttttgagg

SEQ ID NO: 160093 - DNA, 20 bp, Artificial
  CRISPR gRNA sequence
ttataatttttttgaggcag

SEQ ID NO: 160094 - DNA, 20 bp, Artificial
  CRISPR gRNA sequence
taatttttttgaggcagggt

SEQ ID NO: 160095 - DNA, 20 bp, Artificial
  CRISPR gRNA sequence
ttttgaggcagggtctccct

SEQ ID NO: 160096 - DNA, 20 bp, Artificial
  CRISPR gRNA sequence
tttgaggcagggtctccctc

SEQ ID NO: 160097 - DNA, 20 bp, Artificial
  CRISPR gRNA sequence
ttgaggcagggtctccctct

SEQ ID NO: 160098 - DNA, 20 bp, Artificial
  CRISPR gRNA sequence
tgaggcagggtctccctctg

SEQ ID NO: 160099 - DNA, 20 bp, Artificial
  CRISPR gRNA sequence
gaggcagggtctccctctgt

SEQ ID NO: 160100 - DNA, 20 bp, Artificial
  CRISPR gRNA sequence
aggcagggtctccctctgtt

SEQ ID NO: 160101 - DNA, 20 bp, Artificial
  CRISPR gRNA sequence
cctctgttgcccaggctgga

SEQ ID NO: 160102 - DNA, 20 bp, Artificial
  CRISPR gRNA sequence
tgttgcccaggctggagtgc

SEQ ID NO: 160103 - DNA, 20 bp, Artificial
  CRISPR gRNA sequence
ttgcccaggctggagtgcag

SEQ ID NO: 160104 - DNA, 20 bp, Artificial
  CRISPR gRNA sequence
cccaggctggagtgcagtgg

SEQ ID NO: 160105 - DNA, 20 bp, Artificial
  CRISPR gRNA sequence
gagtgcagtggtgtgatcat

SEQ ID NO: 160106 - DNA, 20 bp, Artificial
  CRISPR gRNA sequence
actgtagcctcaaactcctg

SEQ ID NO: 160107 - DNA, 20 bp, Artificial
  CRISPR gRNA sequence
tagcctcaaactcctgggcc

SEQ ID NO: 160108 - DNA, 20 bp, Artificial
  CRISPR gRNA sequence
aaactcctgggcccaggaga

SEQ ID NO: 160109 - DNA, 20 bp, Artificial
  CRISPR gRNA sequence
ctgggcccaggagatccttc

SEQ ID NO: 160110 - DNA, 20 bp, Artificial
  CRISPR gRNA sequence
ggcccaggagatccttctgc

SEQ ID NO: 160111 - DNA, 20 bp, Artificial
  CRISPR gRNA sequence
ctgcctcagcctcctgagta

SEQ ID NO: 160112 - DNA, 20 bp, Artificial
  CRISPR gRNA sequence
tgcctcagcctcctgagtag

SEQ ID NO: 160113 - DNA, 20 bp, Artificial
  CRISPR gRNA sequence
cctcagcctcctgagtagct

SEQ ID NO: 160114 - DNA, 20 bp, Artificial
  CRISPR gRNA sequence
agcctcctgagtagctaaga

SEQ ID NO: 160115 - DNA, 20 bp, Artificial
  CRISPR gRNA sequence
ctgagtagctaagacttaca

SEQ ID NO: 160116 - DNA, 20 bp, Artificial
  CRISPR gRNA sequence
agtagctaagacttacacgt

SEQ ID NO: 160117 - DNA, 20 bp, Artificial
  CRISPR gRNA sequence
agacttacacgtgtgtgcca

SEQ ID NO: 160118 - DNA, 20 bp, Artificial
  CRISPR gRNA sequence
acacgtgtgtgccacaatgc

SEQ ID NO: 160119 - DNA, 20 bp, Artificial
  CRISPR gRNA sequence
cacgtgtgtgccacaatgcc

SEQ ID NO: 160120 - DNA, 20 bp, Artificial
  CRISPR gRNA sequence
tttaaaaattttttttttat

SEQ ID NO: 160121 - DNA, 20 bp, Artificial
  CRISPR gRNA sequence
aaaaattttttttttattct

SEQ ID NO: 160122 - DNA, 20 bp, Artificial
  CRISPR gRNA sequence
aaaattttttttttattctt

SEQ ID NO: 160123 - DNA, 20 bp, Artificial
  CRISPR gRNA sequence
tttttttattcttctttttg

SEQ ID NO: 160124 - DNA, 20 bp, Artificial
  CRISPR gRNA sequence
ttttttattcttctttttga

SEQ ID NO: 160125 - DNA, 20 bp, Artificial
  CRISPR gRNA sequence
tttttattcttctttttgag

SEQ ID NO: 160126 - DNA, 20 bp, Artificial
  CRISPR gRNA sequence
ttttattcttctttttgaga

SEQ ID NO: 160127 - DNA, 20 bp, Artificial
  CRISPR gRNA sequence
tttattcttctttttgagat

SEQ ID NO: 160128 - DNA, 20 bp, Artificial
  CRISPR gRNA sequence
ttattcttctttttgagatg

SEQ ID NO: 160129 - DNA, 20 bp, Artificial
  CRISPR gRNA sequence
tattcttctttttgagatgg

SEQ ID NO: 160130 - DNA, 20 bp, Artificial
  CRISPR gRNA sequence
attcttctttttgagatgga

SEQ ID NO: 160131 - DNA, 20 bp, Artificial
  CRISPR gRNA sequence
ttcttctttttgagatggag

SEQ ID NO: 160132 - DNA, 20 bp, Artificial
  CRISPR gRNA sequence
ttctttttgagatggagtct

SEQ ID NO: 160133 - DNA, 20 bp, Artificial
  CRISPR gRNA sequence
ctttttgagatggagtctcg

SEQ ID NO: 160134 - DNA, 20 bp, Artificial
  CRISPR gRNA sequence
tttttgagatggagtctcgc

SEQ ID NO: 160135 - DNA, 20 bp, Artificial
  CRISPR gRNA sequence
tttgagatggagtctcgctc

SEQ ID NO: 160136 - DNA, 20 bp, Artificial
  CRISPR gRNA sequence
ttgagatggagtctcgctct

SEQ ID NO: 160137 - DNA, 20 bp, Artificial
  CRISPR gRNA sequence
tgagatggagtctcgctctg

SEQ ID NO: 160138 - DNA, 20 bp, Artificial
  CRISPR gRNA sequence
gagatggagtctcgctctgt

SEQ ID NO: 160139 - DNA, 20 bp, Artificial
  CRISPR gRNA sequence
agatggagtctcgctctgtc

SEQ ID NO: 160140 - DNA, 20 bp, Artificial
  CRISPR gRNA sequence
gctctgtcgcccaggctgtt

SEQ ID NO: 160141 - DNA, 20 bp, Artificial
  CRISPR gRNA sequence
tgtcgcccaggctgttgtgc

SEQ ID NO: 160142 - DNA, 20 bp, Artificial
  CRISPR gRNA sequence
tcgcccaggctgttgtgcag

SEQ ID NO: 160143 - DNA, 20 bp, Artificial
  CRISPR gRNA sequence
ttgtgcagtggcattatctt

SEQ ID NO: 160144 - DNA, 20 bp, Artificial
  CRISPR gRNA sequence
tgcagtggcattatcttgac

SEQ ID NO: 160145 - DNA, 20 bp, Artificial
  CRISPR gRNA sequence
tcttgactcactgcaacctc

SEQ ID NO: 160146 - DNA, 20 bp, Artificial
  CRISPR gRNA sequence
gactcactgcaacctccgct

SEQ ID NO: 160147 - DNA, 20 bp, Artificial
  CRISPR gRNA sequence
actcactgcaacctccgctt

SEQ ID NO: 160148 - DNA, 20 bp, Artificial
  CRISPR gRNA sequence
actgcaacctccgcttccca

SEQ ID NO: 160149 - DNA, 20 bp, Artificial
  CRISPR gRNA sequence
caacctccgcttcccaggtt

SEQ ID NO: 160150 - DNA, 20 bp, Artificial
  CRISPR gRNA sequence
cgcttcccaggttccagtga

SEQ ID NO: 160151 - DNA, 20 bp, Artificial
  CRISPR gRNA sequence
cccaggttccagtgaaactg

SEQ ID NO: 160152 - DNA, 20 bp, Artificial
  CRISPR gRNA sequence
ccaggttccagtgaaactgt

SEQ ID NO: 160153 - DNA, 20 bp, Artificial
  CRISPR gRNA sequence
cagtgaaactgttgcctcag

SEQ ID NO: 160154 - DNA, 20 bp, Artificial
  CRISPR gRNA sequence
ttgcctcagcctcccaagta

SEQ ID NO: 160155 - DNA, 20 bp, Artificial
  CRISPR gRNA sequence
cctcagcctcccaagtagct

SEQ ID NO: 160156 - DNA, 20 bp, Artificial
  CRISPR gRNA sequence
agcctcccaagtagctggga

SEQ ID NO: 160157 - DNA, 20 bp, Artificial
  CRISPR gRNA sequence
ccaagtagctgggattataa

SEQ ID NO: 160158 - DNA, 20 bp, Artificial
  CRISPR gRNA sequence
ggattataagcatgtgccac

SEQ ID NO: 160159 - DNA, 20 bp, Artificial
  CRISPR gRNA sequence
taagcatgtgccaccatgct

SEQ ID NO: 160160 - DNA, 20 bp, Artificial
  CRISPR gRNA sequence
ggctaatgtattttgtgttt

SEQ ID NO: 160161 - DNA, 20 bp, Artificial
  CRISPR gRNA sequence
atgtattttgtgtttttagt

SEQ ID NO: 160162 - DNA, 20 bp, Artificial
  CRISPR gRNA sequence
tgtgtttttagtagaaacag

SEQ ID NO: 160163 - DNA, 20 bp, Artificial
  CRISPR gRNA sequence
gtgtttttagtagaaacagg

SEQ ID NO: 160164 - DNA, 20 bp, Artificial
  CRISPR gRNA sequence
tgtttttagtagaaacaggg

SEQ ID NO: 160165 - DNA, 20 bp, Artificial
  CRISPR gRNA sequence
ttagtagaaacagggttttg

SEQ ID NO: 160166 - DNA, 20 bp, Artificial
  CRISPR gRNA sequence
tagtagaaacagggttttgc

SEQ ID NO: 160167 - DNA, 20 bp, Artificial
  CRISPR gRNA sequence
agtagaaacagggttttgct

SEQ ID NO: 160168 - DNA, 20 bp, Artificial
  CRISPR gRNA sequence
gtagaaacagggttttgcta

SEQ ID NO: 160169 - DNA, 20 bp, Artificial
  CRISPR gRNA sequence
tgctatattagccaggctgg

SEQ ID NO: 160170 - DNA, 20 bp, Artificial
  CRISPR gRNA sequence
gctatattagccaggctggt

SEQ ID NO: 160171 - DNA, 20 bp, Artificial
  CRISPR gRNA sequence
ctatattagccaggctggtc

SEQ ID NO: 160172 - DNA, 20 bp, Artificial
  CRISPR gRNA sequence
tattagccaggctggtcttg

SEQ ID NO: 160173 - DNA, 20 bp, Artificial
  CRISPR gRNA sequence
gccaggctggtcttgaactc

SEQ ID NO: 160174 - DNA, 20 bp, Artificial
  CRISPR gRNA sequence
gtcttgaactcctgacctca

SEQ ID NO: 160175 - DNA, 20 bp, Artificial
  CRISPR gRNA sequence
gaactcctgacctcaagtga

SEQ ID NO: 160176 - DNA, 20 bp, Artificial
  CRISPR gRNA sequence
aactcctgacctcaagtgat

SEQ ID NO: 160177 - DNA, 20 bp, Artificial
  CRISPR gRNA sequence
ctgacctcaagtgatcctcc

SEQ ID NO: 160178 - DNA, 20 bp, Artificial
  CRISPR gRNA sequence
acctcaagtgatcctccacc

SEQ ID NO: 160179 - DNA, 20 bp, Artificial
  CRISPR gRNA sequence
aagtgatcctccacctcagc

SEQ ID NO: 160180 - DNA, 20 bp, Artificial
  CRISPR gRNA sequence
cacctcagcctcccaaagtg

SEQ ID NO: 160181 - DNA, 20 bp, Artificial
  CRISPR gRNA sequence
agcctcccaaagtgttggga

SEQ ID NO: 160182 - DNA, 20 bp, Artificial
  CRISPR gRNA sequence
ccaaagtgttgggattacag

SEQ ID NO: 160183 - DNA, 20 bp, Artificial
  CRISPR gRNA sequence
ggattacaggtgtgagccac

SEQ ID NO: 160184 - DNA, 20 bp, Artificial
  CRISPR gRNA sequence
caggtgtgagccacagcccc

SEQ ID NO: 160185 - DNA, 20 bp, Artificial
  CRISPR gRNA sequence
gccttaaaaaatcctttttt

SEQ ID NO: 160186 - DNA, 20 bp, Artificial
  CRISPR gRNA sequence
aaaaaatcctttttttagag

SEQ ID NO: 160187 - DNA, 20 bp, Artificial
  CRISPR gRNA sequence
aaaaatcctttttttagaga

SEQ ID NO: 160188 - DNA, 20 bp, Artificial
  CRISPR gRNA sequence
tttttagagacagagtctca

SEQ ID NO: 160189 - DNA, 20 bp, Artificial
  CRISPR gRNA sequence
ttttagagacagagtctcac

SEQ ID NO: 160190 - DNA, 20 bp, Artificial
  CRISPR gRNA sequence
tttagagacagagtctcact

SEQ ID NO: 160191 - DNA, 20 bp, Artificial
  CRISPR gRNA sequence
ttagagacagagtctcactg

SEQ ID NO: 160192 - DNA, 20 bp, Artificial
  CRISPR gRNA sequence
tagagacagagtctcactgt

SEQ ID NO: 160193 - DNA, 20 bp, Artificial
  CRISPR gRNA sequence
agagacagagtctcactgtg

SEQ ID NO: 160194 - DNA, 20 bp, Artificial
  CRISPR gRNA sequence
gagacagagtctcactgtgt

SEQ ID NO: 160195 - DNA, 20 bp, Artificial
  CRISPR gRNA sequence
actgtgttgccaaggctggt

SEQ ID NO: 160196 - DNA, 20 bp, Artificial
  CRISPR gRNA sequence
tgttgccaaggctggtctca

SEQ ID NO: 160197 - DNA, 20 bp, Artificial
  CRISPR gRNA sequence
ccaaggctggtctcaaacta

SEQ ID NO: 160198 - DNA, 20 bp, Artificial
  CRISPR gRNA sequence
gtctcaaactactggcctga

SEQ ID NO: 160199 - DNA, 20 bp, Artificial
  CRISPR gRNA sequence
aaactactggcctgaagtga

SEQ ID NO: 160200 - DNA, 20 bp, Artificial
  CRISPR gRNA sequence
ctggcctgaagtgattctcc

SEQ ID NO: 160201 - DNA, 20 bp, Artificial
  CRISPR gRNA sequence
gcctgaagtgattctcctgt

SEQ ID NO: 160202 - DNA, 20 bp, Artificial
  CRISPR gRNA sequence
aagtgattctcctgtctcag

SEQ ID NO: 160203 - DNA, 20 bp, Artificial
  CRISPR gRNA sequence
tcctgtctcagcctccggag

SEQ ID NO: 160204 - DNA, 20 bp, Artificial
  CRISPR gRNA sequence
ctgtctcagcctccggagtt

SEQ ID NO: 160205 - DNA, 20 bp, Artificial
  CRISPR gRNA sequence
tctcagcctccggagttgtt

SEQ ID NO: 160206 - DNA, 20 bp, Artificial
  CRISPR gRNA sequence
agcctccggagttgttggga

SEQ ID NO: 160207 - DNA, 20 bp, Artificial
  CRISPR gRNA sequence
cggagttgttgggattacag

SEQ ID NO: 160208 - DNA, 20 bp, Artificial
  CRISPR gRNA sequence
ttgggattacagacataagc

SEQ ID NO: 160209 - DNA, 20 bp, Artificial
  CRISPR gRNA sequence
ggattacagacataagccac

SEQ ID NO: 160210 - DNA, 20 bp, Artificial
  CRISPR gRNA sequence
cagacataagccacaacacc

SEQ ID NO: 160211 - DNA, 20 bp, Artificial
  CRISPR gRNA sequence
ctcttacttttaaatacatt

SEQ ID NO: 160212 - DNA, 20 bp, Artificial
  CRISPR gRNA sequence
ttacttttaaatacattctt

SEQ ID NO: 160213 - DNA, 20 bp, Artificial
  CRISPR gRNA sequence
acttttaaatacattctttc

SEQ ID NO: 160214 - DNA, 20 bp, Artificial
  CRISPR gRNA sequence
cttttaaatacattctttcc

SEQ ID NO: 160215 - DNA, 20 bp, Artificial
  CRISPR gRNA sequence
ttaaatacattctttccctt

SEQ ID NO: 160216 - DNA, 20 bp, Artificial
  CRISPR gRNA sequence
taaatacattctttccctta

SEQ ID NO: 160217 - DNA, 20 bp, Artificial
  CRISPR gRNA sequence
aaatacattctttcccttat

SEQ ID NO: 160218 - DNA, 20 bp, Artificial
  CRISPR gRNA sequence
aatacattctttcccttatt

SEQ ID NO: 160219 - DNA, 20 bp, Artificial
  CRISPR gRNA sequence
tttcccttattatcctagaa

SEQ ID NO: 160220 - DNA, 20 bp, Artificial
  CRISPR gRNA sequence
tcccttattatcctagaaga

SEQ ID NO: 160221 - DNA, 20 bp, Artificial
  CRISPR gRNA sequence
cccttattatcctagaagat

SEQ ID NO: 160222 - DNA, 20 bp, Artificial
  CRISPR gRNA sequence
ccttattatcctagaagatg

SEQ ID NO: 160223 - DNA, 20 bp, Artificial
  CRISPR gRNA sequence
attatcctagaagatgaacc

SEQ ID NO: 160224 - DNA, 20 bp, Artificial
  CRISPR gRNA sequence
ttatcctagaagatgaaccc

SEQ ID NO: 160225 - DNA, 20 bp, Artificial
  CRISPR gRNA sequence
tcctagaagatgaacccaga

SEQ ID NO: 160226 - DNA, 20 bp, Artificial
  CRISPR gRNA sequence
gaagatgaacccagaatatt

SEQ ID NO: 160227 - DNA, 20 bp, Artificial
  CRISPR gRNA sequence
tccatgggcttgtagatgtt

SEQ ID NO: 160228 - DNA, 20 bp, Artificial
  CRISPR gRNA sequence
ccatgggcttgtagatgttg

SEQ ID NO: 160229 - DNA, 20 bp, Artificial
  CRISPR gRNA sequence
catgggcttgtagatgttgt

SEQ ID NO: 160230 - DNA, 20 bp, Artificial
  CRISPR gRNA sequence
gtagatgttgtaaatggact

SEQ ID NO: 160231 - DNA, 20 bp, Artificial
  CRISPR gRNA sequence
tagatgttgtaaatggacta

SEQ ID NO: 160232 - DNA, 20 bp, Artificial
  CRISPR gRNA sequence
taaatggactacttctgtag

SEQ ID NO: 160233 - DNA, 20 bp, Artificial
  CRISPR gRNA sequence
cttctgtagcaaaatcaatt

SEQ ID NO: 160234 - DNA, 20 bp, Artificial
  CRISPR gRNA sequence
ctgtagcaaaatcaatttat

SEQ ID NO: 160235 - DNA, 20 bp, Artificial
  CRISPR gRNA sequence
tgtagcaaaatcaatttatt

SEQ ID NO: 160236 - DNA, 20 bp, Artificial
  CRISPR gRNA sequence
tagcaaaatcaatttatttg

SEQ ID NO: 160237 - DNA, 20 bp, Artificial
  CRISPR gRNA sequence
atttgcaattaatgcattaa

SEQ ID NO: 160238 - DNA, 20 bp, Artificial
  CRISPR gRNA sequence
tttgcaattaatgcattaaa

SEQ ID NO: 160239 - DNA, 20 bp, Artificial
  CRISPR gRNA sequence
gcaattaatgcattaaaata

SEQ ID NO: 160240 - DNA, 20 bp, Artificial
  CRISPR gRNA sequence
caattaatgcattaaaataa

SEQ ID NO: 160241 - DNA, 20 bp, Artificial
  CRISPR gRNA sequence
atgcattaaaataagaggtg

SEQ ID NO: 160242 - DNA, 20 bp, Artificial
  CRISPR gRNA sequence
aaataagaggtgattaacta

SEQ ID NO: 160243 - DNA, 20 bp, Artificial
  CRISPR gRNA sequence
actacggttgctttatttat

SEQ ID NO: 160244 - DNA, 20 bp, Artificial
  CRISPR gRNA sequence
cggttgctttatttatttat

SEQ ID NO: 160245 - DNA, 20 bp, Artificial
  CRISPR gRNA sequence
ctttatttatttatttattt

SEQ ID NO: 160246 - DNA, 20 bp, Artificial
  CRISPR gRNA sequence
tatttatttatttatttatt

SEQ ID NO: 160247 - DNA, 20 bp, Artificial
  CRISPR gRNA sequence
atttatttatttatttattt

SEQ ID NO: 160248 - DNA, 20 bp, Artificial
  CRISPR gRNA sequence
tttatttatttatttattta

SEQ ID NO: 160249 - DNA, 20 bp, Artificial
  CRISPR gRNA sequence
atttatttatttatttattt

SEQ ID NO: 160250 - DNA, 20 bp, Artificial
  CRISPR gRNA sequence
tttatttatttatttattta

SEQ ID NO: 160251 - DNA, 20 bp, Artificial
  CRISPR gRNA sequence
atttatttatttatttattt

SEQ ID NO: 160252 - DNA, 20 bp, Artificial
  CRISPR gRNA sequence
tttatttatttatttattta

SEQ ID NO: 160253 - DNA, 20 bp, Artificial
  CRISPR gRNA sequence
atttatttatttatttattt

SEQ ID NO: 160254 - DNA, 20 bp, Artificial
  CRISPR gRNA sequence
tttatttatttatttattta

SEQ ID NO: 160255 - DNA, 20 bp, Artificial
  CRISPR gRNA sequence
atttatttatttatttattt

SEQ ID NO: 160256 - DNA, 20 bp, Artificial
  CRISPR gRNA sequence
tttatttatttatttatttt

SEQ ID NO: 160257 - DNA, 20 bp, Artificial
  CRISPR gRNA sequence
atttatttatttattttgag

SEQ ID NO: 160258 - DNA, 20 bp, Artificial
  CRISPR gRNA sequence
tttatttatttattttgaga

SEQ ID NO: 160259 - DNA, 20 bp, Artificial
  CRISPR gRNA sequence
atttatttattttgagatgg

SEQ ID NO: 160260 - DNA, 20 bp, Artificial
  CRISPR gRNA sequence
tttatttattttgagatgga

SEQ ID NO: 160261 - DNA, 20 bp, Artificial
  CRISPR gRNA sequence
atttattttgagatggagtc

SEQ ID NO: 160262 - DNA, 20 bp, Artificial
  CRISPR gRNA sequence
tttattttgagatggagtct

SEQ ID NO: 160263 - DNA, 20 bp, Artificial
  CRISPR gRNA sequence
attttgagatggagtcttgc

SEQ ID NO: 160264 - DNA, 20 bp, Artificial
  CRISPR gRNA sequence
ttttgagatggagtcttgct

SEQ ID NO: 160265 - DNA, 20 bp, Artificial
  CRISPR gRNA sequence
tgagatggagtcttgctctg

SEQ ID NO: 160266 - DNA, 20 bp, Artificial
  CRISPR gRNA sequence
gagatggagtcttgctctgt

SEQ ID NO: 160267 - DNA, 20 bp, Artificial
  CRISPR gRNA sequence
agatggagtcttgctctgtc

SEQ ID NO: 160268 - DNA, 20 bp, Artificial
  CRISPR gRNA sequence
gctctgtcacccaggctgga

SEQ ID NO: 160269 - DNA, 20 bp, Artificial
  CRISPR gRNA sequence
ctctgtcacccaggctggag

SEQ ID NO: 160270 - DNA, 20 bp, Artificial
  CRISPR gRNA sequence
tgtcacccaggctggagtgc

SEQ ID NO: 160271 - DNA, 20 bp, Artificial
  CRISPR gRNA sequence
tcacccaggctggagtgcag

SEQ ID NO: 160272 - DNA, 20 bp, Artificial
  CRISPR gRNA sequence
gagtgcagtggcatgacctc

SEQ ID NO: 160273 - DNA, 20 bp, Artificial
  CRISPR gRNA sequence
ggctcactgcaacctccacc

SEQ ID NO: 160274 - DNA, 20 bp, Artificial
  CRISPR gRNA sequence
actgcaacctccacctcctg

SEQ ID NO: 160275 - DNA, 20 bp, Artificial
  CRISPR gRNA sequence
caacctccacctcctgggtt

SEQ ID NO: 160276 - DNA, 20 bp, Artificial
  CRISPR gRNA sequence
cacctcctgggtttgcagcc

SEQ ID NO: 160277 - DNA, 20 bp, Artificial
  CRISPR gRNA sequence
ctgggtttgcagcctccacc

SEQ ID NO: 160278 - DNA, 20 bp, Artificial
  CRISPR gRNA sequence
ggtttgcagcctccacctcc

SEQ ID NO: 160279 - DNA, 20 bp, Artificial
  CRISPR gRNA sequence
gcagcctccacctccttggt

SEQ ID NO: 160280 - DNA, 20 bp, Artificial
  CRISPR gRNA sequence
cagcctccacctccttggtt

SEQ ID NO: 160281 - DNA, 20 bp, Artificial
  CRISPR gRNA sequence
cacctccttggttcccgagt

SEQ ID NO: 160282 - DNA, 20 bp, Artificial
  CRISPR gRNA sequence
cttggttcccgagtagctgg

SEQ ID NO: 160283 - DNA, 20 bp, Artificial
  CRISPR gRNA sequence
ggttcccgagtagctgggac

SEQ ID NO: 160284 - DNA, 20 bp, Artificial
  CRISPR gRNA sequence
gttcccgagtagctgggact

SEQ ID NO: 160285 - DNA, 20 bp, Artificial
  CRISPR gRNA sequence
ccgagtagctgggactacag

SEQ ID NO: 160286 - DNA, 20 bp, Artificial
  CRISPR gRNA sequence
ggactacaggcatgtgccac

SEQ ID NO: 160287 - DNA, 20 bp, Artificial
  CRISPR gRNA sequence
caggcatgtgccaccacagc

SEQ ID NO: 160288 - DNA, 20 bp, Artificial
  CRISPR gRNA sequence
atttttgcatttttagtaga

SEQ ID NO: 160289 - DNA, 20 bp, Artificial
  CRISPR gRNA sequence
ttgcatttttagtagagatg

SEQ ID NO: 160290 - DNA, 20 bp, Artificial
  CRISPR gRNA sequence
tgcatttttagtagagatga

SEQ ID NO: 160291 - DNA, 20 bp, Artificial
  CRISPR gRNA sequence
gcatttttagtagagatgag

SEQ ID NO: 160292 - DNA, 20 bp, Artificial
  CRISPR gRNA sequence
catttttagtagagatgagg

SEQ ID NO: 160293 - DNA, 20 bp, Artificial
  CRISPR gRNA sequence
ttagtagagatgaggtttca

SEQ ID NO: 160294 - DNA, 20 bp, Artificial
  CRISPR gRNA sequence
tagtagagatgaggtttcac

SEQ ID NO: 160295 - DNA, 20 bp, Artificial
  CRISPR gRNA sequence
agtagagatgaggtttcacc

SEQ ID NO: 160296 - DNA, 20 bp, Artificial
  CRISPR gRNA sequence
gtagagatgaggtttcacca

SEQ ID NO: 160297 - DNA, 20 bp, Artificial
  CRISPR gRNA sequence
caccatgttggccaggctgg

SEQ ID NO: 160298 - DNA, 20 bp, Artificial
  CRISPR gRNA sequence
accatgttggccaggctggt

SEQ ID NO: 160299 - DNA, 20 bp, Artificial
  CRISPR gRNA sequence
gccaggctggtctcgaactc

SEQ ID NO: 160300 - DNA, 20 bp, Artificial
  CRISPR gRNA sequence
gtctcgaactcctgacctca

SEQ ID NO: 160301 - DNA, 20 bp, Artificial
  CRISPR gRNA sequence
gaactcctgacctcaggtga

SEQ ID NO: 160302 - DNA, 20 bp, Artificial
  CRISPR gRNA sequence
ctgacctcaggtgatccacc

SEQ ID NO: 160303 - DNA, 20 bp, Artificial
  CRISPR gRNA sequence
acctcaggtgatccacccgc

SEQ ID NO: 160304 - DNA, 20 bp, Artificial
  CRISPR gRNA sequence
aggtgatccacccgccttgg

SEQ ID NO: 160305 - DNA, 20 bp, Artificial
  CRISPR gRNA sequence
ggcctcccaaagtgctggga

SEQ ID NO: 160306 - DNA, 20 bp, Artificial
  CRISPR gRNA sequence
gcctcccaaagtgctgggat

SEQ ID NO: 160307 - DNA, 20 bp, Artificial
  CRISPR gRNA sequence
ccaaagtgctgggattacag

SEQ ID NO: 160308 - DNA, 20 bp, Artificial
  CRISPR gRNA sequence
ggattacagacgtgaaccac

SEQ ID NO: 160309 - DNA, 20 bp, Artificial
  CRISPR gRNA sequence
cagacgtgaaccaccgtgcc

SEQ ID NO: 160310 - DNA, 20 bp, Artificial
  CRISPR gRNA sequence
ctttatatatataatattaa

SEQ ID NO: 160311 - DNA, 20 bp, Artificial
  CRISPR gRNA sequence
tatatatataatattaattg

SEQ ID NO: 160312 - DNA, 20 bp, Artificial
  CRISPR gRNA sequence
atatatataatattaattgt

SEQ ID NO: 160313 - DNA, 20 bp, Artificial
  CRISPR gRNA sequence
tatatataatattaattgtt

SEQ ID NO: 160314 - DNA, 20 bp, Artificial
  CRISPR gRNA sequence
attgttgggtgtttttaaag

SEQ ID NO: 160315 - DNA, 20 bp, Artificial
  CRISPR gRNA sequence
ttgggtgtttttaaagctcc

SEQ ID NO: 160316 - DNA, 20 bp, Artificial
  CRISPR gRNA sequence
ggtgtttttaaagctccatg

SEQ ID NO: 160317 - DNA, 20 bp, Artificial
  CRISPR gRNA sequence
ttaaagctccatgcaaagaa

SEQ ID NO: 160318 - DNA, 20 bp, Artificial
  CRISPR gRNA sequence
taaagctccatgcaaagaat

SEQ ID NO: 160319 - DNA, 20 bp, Artificial
  CRISPR gRNA sequence
aaagctccatgcaaagaatg

SEQ ID NO: 160320 - DNA, 20 bp, Artificial
  CRISPR gRNA sequence
aagctccatgcaaagaatgg

SEQ ID NO: 160321 - DNA, 20 bp, Artificial
  CRISPR gRNA sequence
catgcaaagaatggatctgc

SEQ ID NO: 160322 - DNA, 20 bp, Artificial
  CRISPR gRNA sequence
ctttaggaaaagccttttga

SEQ ID NO: 160323 - DNA, 20 bp, Artificial
  CRISPR gRNA sequence
taggaaaagccttttgaata

SEQ ID NO: 160324 - DNA, 20 bp, Artificial
  CRISPR gRNA sequence
aggaaaagccttttgaataa

SEQ ID NO: 160325 - DNA, 20 bp, Artificial
  CRISPR gRNA sequence
ggaaaagccttttgaataaa

SEQ ID NO: 160326 - DNA, 20 bp, Artificial
  CRISPR gRNA sequence
ttgaataaaagtactcactt

SEQ ID NO: 160327 - DNA, 20 bp, Artificial
  CRISPR gRNA sequence
tgaataaaagtactcacttt

SEQ ID NO: 160328 - DNA, 20 bp, Artificial
  CRISPR gRNA sequence
gaataaaagtactcactttt

SEQ ID NO: 160329 - DNA, 20 bp, Artificial
  CRISPR gRNA sequence
aataaaagtactcacttttt

SEQ ID NO: 160330 - DNA, 20 bp, Artificial
  CRISPR gRNA sequence
actttttccaggaatttaca

SEQ ID NO: 160331 - DNA, 20 bp, Artificial
  CRISPR gRNA sequence
tttccaggaatttacattaa

SEQ ID NO: 160332 - DNA, 20 bp, Artificial
  CRISPR gRNA sequence
ttccaggaatttacattaac

SEQ ID NO: 160333 - DNA, 20 bp, Artificial
  CRISPR gRNA sequence
tccaggaatttacattaaca

SEQ ID NO: 160334 - DNA, 20 bp, Artificial
  CRISPR gRNA sequence
ccaggaatttacattaacaa

SEQ ID NO: 160335 - DNA, 20 bp, Artificial
  CRISPR gRNA sequence
caggaatttacattaacaat

SEQ ID NO: 160336 - DNA, 20 bp, Artificial
  CRISPR gRNA sequence
acattaacaatttatgttct

SEQ ID NO: 160337 - DNA, 20 bp, Artificial
  CRISPR gRNA sequence
cattaacaatttatgttctt

SEQ ID NO: 160338 - DNA, 20 bp, Artificial
  CRISPR gRNA sequence
acaatttatgttcttctaag

SEQ ID NO: 160339 - DNA, 20 bp, Artificial
  CRISPR gRNA sequence
atgttcttctaagagacatt

SEQ ID NO: 160340 - DNA, 20 bp, Artificial
  CRISPR gRNA sequence
tgttcttctaagagacatta

SEQ ID NO: 160341 - DNA, 20 bp, Artificial
  CRISPR gRNA sequence
ttctaagagacattactaat

SEQ ID NO: 160342 - DNA, 20 bp, Artificial
  CRISPR gRNA sequence
ctaagagacattactaataa

SEQ ID NO: 160343 - DNA, 20 bp, Artificial
  CRISPR gRNA sequence
taagagacattactaataat

SEQ ID NO: 160344 - DNA, 20 bp, Artificial
  CRISPR gRNA sequence
agagacattactaataatat

SEQ ID NO: 160345 - DNA, 20 bp, Artificial
  CRISPR gRNA sequence
ctaataatatctgcaaagat

SEQ ID NO: 160346 - DNA, 20 bp, Artificial
  CRISPR gRNA sequence
ataatatctgcaaagatgtt

SEQ ID NO: 160347 - DNA, 20 bp, Artificial
  CRISPR gRNA sequence
caaagatgttagaaaacatg

SEQ ID NO: 160348 - DNA, 20 bp, Artificial
  CRISPR gRNA sequence
gaaaacatgcttcaaacctt

SEQ ID NO: 160349 - DNA, 20 bp, Artificial
  CRISPR gRNA sequence
caaacctttttctctttttt

SEQ ID NO: 160350 - DNA, 20 bp, Artificial
  CRISPR gRNA sequence
aaacctttttctcttttttc

SEQ ID NO: 160351 - DNA, 20 bp, Artificial
  CRISPR gRNA sequence
tttctcttttttcctggtga

SEQ ID NO: 160352 - DNA, 20 bp, Artificial
  CRISPR gRNA sequence
ttctcttttttcctggtgag

SEQ ID NO: 160353 - DNA, 20 bp, Artificial
  CRISPR gRNA sequence
tctcttttttcctggtgaga

SEQ ID NO: 160354 - DNA, 20 bp, Artificial
  CRISPR gRNA sequence
ctcttttttcctggtgagaa

SEQ ID NO: 160355 - DNA, 20 bp, Artificial
  CRISPR gRNA sequence
tcttttttcctggtgagaag

SEQ ID NO: 160356 - DNA, 20 bp, Artificial
  CRISPR gRNA sequence
ttttttcctggtgagaagaa

SEQ ID NO: 160357 - DNA, 20 bp, Artificial
  CRISPR gRNA sequence
ttttcctggtgagaagaact

SEQ ID NO: 160358 - DNA, 20 bp, Artificial
  CRISPR gRNA sequence
tttcctggtgagaagaactt

SEQ ID NO: 160359 - DNA, 20 bp, Artificial
  CRISPR gRNA sequence
ttcctggtgagaagaacttg

SEQ ID NO: 160360 - DNA, 20 bp, Artificial
  CRISPR gRNA sequence
tcctggtgagaagaacttgt

SEQ ID NO: 160361 - DNA, 20 bp, Artificial
  CRISPR gRNA sequence
cctggtgagaagaacttgtg

SEQ ID NO: 160362 - DNA, 20 bp, Artificial
  CRISPR gRNA sequence
ctggtgagaagaacttgtgt

SEQ ID NO: 160363 - DNA, 20 bp, Artificial
  CRISPR gRNA sequence
gtgagaagaacttgtgtcct

SEQ ID NO: 160364 - DNA, 20 bp, Artificial
  CRISPR gRNA sequence
gtgtccttcaaaagaagatt

SEQ ID NO: 160365 - DNA, 20 bp, Artificial
  CRISPR gRNA sequence
tgtccttcaaaagaagatta

SEQ ID NO: 160366 - DNA, 20 bp, Artificial
  CRISPR gRNA sequence
caaaagaagattacctttgt

SEQ ID NO: 160367 - DNA, 20 bp, Artificial
  CRISPR gRNA sequence
aaaagaagattacctttgtc

SEQ ID NO: 160368 - DNA, 20 bp, Artificial
  CRISPR gRNA sequence
cctttgtctttcgaagtcag

SEQ ID NO: 160369 - DNA, 20 bp, Artificial
  CRISPR gRNA sequence
tgtctttcgaagtcaggaat

SEQ ID NO: 160370 - DNA, 20 bp, Artificial
  CRISPR gRNA sequence
gtctttcgaagtcaggaatt

SEQ ID NO: 160371 - DNA, 20 bp, Artificial
  CRISPR gRNA sequence
tctttcgaagtcaggaattt

SEQ ID NO: 160372 - DNA, 20 bp, Artificial
  CRISPR gRNA sequence
tcgaagtcaggaatttataa

SEQ ID NO: 160373 - DNA, 20 bp, Artificial
  CRISPR gRNA sequence
cgaagtcaggaatttataaa

SEQ ID NO: 160374 - DNA, 20 bp, Artificial
  CRISPR gRNA sequence
gaagtcaggaatttataaaa

SEQ ID NO: 160375 - DNA, 20 bp, Artificial
  CRISPR gRNA sequence
ataaaaagagtttgctggat

SEQ ID NO: 160376 - DNA, 20 bp, Artificial
  CRISPR gRNA sequence
taaaaagagtttgctggatg

SEQ ID NO: 160377 - DNA, 20 bp, Artificial
  CRISPR gRNA sequence
gctggatggaaaaatcataa

SEQ ID NO: 160378 - DNA, 20 bp, Artificial
  CRISPR gRNA sequence
ctggatggaaaaatcataaa

SEQ ID NO: 160379 - DNA, 20 bp, Artificial
  CRISPR gRNA sequence
gatggaaaaatcataaaggc

SEQ ID NO: 160380 - DNA, 20 bp, Artificial
  CRISPR gRNA sequence
taaaacctaatgtaaagaag

SEQ ID NO: 160381 - DNA, 20 bp, Artificial
  CRISPR gRNA sequence
aaacctaatgtaaagaagaa

SEQ ID NO: 160382 - DNA, 20 bp, Artificial
  CRISPR gRNA sequence
atgtaaagaagaacagttag

SEQ ID NO: 160383 - DNA, 20 bp, Artificial
  CRISPR gRNA sequence
gagctgtccaaagatgggaa

SEQ ID NO: 160384 - DNA, 20 bp, Artificial
  CRISPR gRNA sequence
tccaaagatgggaaagaatg

SEQ ID NO: 160385 - DNA, 20 bp, Artificial
  CRISPR gRNA sequence
accagtaagccagtttccca

SEQ ID NO: 160386 - DNA, 20 bp, Artificial
  CRISPR gRNA sequence
ccagtaagccagtttcccag

SEQ ID NO: 160387 - DNA, 20 bp, Artificial
  CRISPR gRNA sequence
cccagaactggagtgggggg

SEQ ID NO: 160388 - DNA, 20 bp, Artificial
  CRISPR gRNA sequence
ccagaactggagtggggggg

SEQ ID NO: 160389 - DNA, 20 bp, Artificial
  CRISPR gRNA sequence
gagtgggggggccctcaaat

SEQ ID NO: 160390 - DNA, 20 bp, Artificial
  CRISPR gRNA sequence
aaatgtaagctggttgaaca

SEQ ID NO: 160391 - DNA, 20 bp, Artificial
  CRISPR gRNA sequence
gttgaacacttaaggtagaa

SEQ ID NO: 160392 - DNA, 20 bp, Artificial
  CRISPR gRNA sequence
aacacttaaggtagaatcac

SEQ ID NO: 160393 - DNA, 20 bp, Artificial
  CRISPR gRNA sequence
aaggtagaatcacccggggt

SEQ ID NO: 160394 - DNA, 20 bp, Artificial
  CRISPR gRNA sequence
aggtagaatcacccggggtt

SEQ ID NO: 160395 - DNA, 20 bp, Artificial
  CRISPR gRNA sequence
ggcagaggttgaagaaaagc

SEQ ID NO: 160396 - DNA, 20 bp, Artificial
  CRISPR gRNA sequence
aagaaaagctgcgagcgtct

SEQ ID NO: 160397 - DNA, 20 bp, Artificial
  CRISPR gRNA sequence
cgagcgtcttatgaaggggt

SEQ ID NO: 160398 - DNA, 20 bp, Artificial
  CRISPR gRNA sequence
atgaaggggtgggcctgagt

SEQ ID NO: 160399 - DNA, 20 bp, Artificial
  CRISPR gRNA sequence
tgaaggggtgggcctgagtg

SEQ ID NO: 160400 - DNA, 20 bp, Artificial
  CRISPR gRNA sequence
agtgtctccttatgtctttt

SEQ ID NO: 160401 - DNA, 20 bp, Artificial
  CRISPR gRNA sequence
cttatgtctttttttttttt

SEQ ID NO: 160402 - DNA, 20 bp, Artificial
  CRISPR gRNA sequence
atgtcttttttttttttttt

SEQ ID NO: 160403 - DNA, 20 bp, Artificial
  CRISPR gRNA sequence
tgtctttttttttttttttc

SEQ ID NO: 160404 - DNA, 20 bp, Artificial
  CRISPR gRNA sequence
tttttttttttttcagtcct

SEQ ID NO: 160405 - DNA, 20 bp, Artificial
  CRISPR gRNA sequence
ttttttttttttcagtcctg

SEQ ID NO: 160406 - DNA, 20 bp, Artificial
  CRISPR gRNA sequence
tttttttttttcagtcctga

SEQ ID NO: 160407 - DNA, 20 bp, Artificial
  CRISPR gRNA sequence
ttttttttttcagtcctgaa

SEQ ID NO: 160408 - DNA, 20 bp, Artificial
  CRISPR gRNA sequence
tttttttttcagtcctgaac

SEQ ID NO: 160409 - DNA, 20 bp, Artificial
  CRISPR gRNA sequence
ttttttttcagtcctgaact

SEQ ID NO: 160410 - DNA, 20 bp, Artificial
  CRISPR gRNA sequence
tttttttcagtcctgaactt

SEQ ID NO: 160411 - DNA, 20 bp, Artificial
  CRISPR gRNA sequence
ttttttcagtcctgaacttc

SEQ ID NO: 160412 - DNA, 20 bp, Artificial
  CRISPR gRNA sequence
tttttcagtcctgaacttct

SEQ ID NO: 160413 - DNA, 20 bp, Artificial
  CRISPR gRNA sequence
ttttcagtcctgaacttcta

SEQ ID NO: 160414 - DNA, 20 bp, Artificial
  CRISPR gRNA sequence
tttcagtcctgaacttctat

SEQ ID NO: 160415 - DNA, 20 bp, Artificial
  CRISPR gRNA sequence
ttcagtcctgaacttctatg

SEQ ID NO: 160416 - DNA, 20 bp, Artificial
  CRISPR gRNA sequence
tcagtcctgaacttctatga

SEQ ID NO: 160417 - DNA, 20 bp, Artificial
  CRISPR gRNA sequence
cagtcctgaacttctatgat

SEQ ID NO: 160418 - DNA, 20 bp, Artificial
  CRISPR gRNA sequence
agtcctgaacttctatgatg

SEQ ID NO: 160419 - DNA, 20 bp, Artificial
  CRISPR gRNA sequence
aacttctatgatgcagtaaa

SEQ ID NO: 160420 - DNA, 20 bp, Artificial
  CRISPR gRNA sequence
ctatgatgcagtaaaatgta

SEQ ID NO: 160421 - DNA, 20 bp, Artificial
  CRISPR gRNA sequence
tatgatgcagtaaaatgtaa

SEQ ID NO: 160422 - DNA, 20 bp, Artificial
  CRISPR gRNA sequence
tgatgcagtaaaatgtaaag

SEQ ID NO: 160423 - DNA, 20 bp, Artificial
  CRISPR gRNA sequence
ttgacttgtatttttcgctt

SEQ ID NO: 160424 - DNA, 20 bp, Artificial
  CRISPR gRNA sequence
acttgtatttttcgctttac

SEQ ID NO: 160425 - DNA, 20 bp, Artificial
  CRISPR gRNA sequence
gtatttttcgctttacctat

SEQ ID NO: 160426 - DNA, 20 bp, Artificial
  CRISPR gRNA sequence
tatttttcgctttacctatt

SEQ ID NO: 160427 - DNA, 20 bp, Artificial
  CRISPR gRNA sequence
ttcgctttacctatttggga

SEQ ID NO: 160428 - DNA, 20 bp, Artificial
  CRISPR gRNA sequence
tcgctttacctatttgggat

SEQ ID NO: 160429 - DNA, 20 bp, Artificial
  CRISPR gRNA sequence
cgctttacctatttgggatt

SEQ ID NO: 160430 - DNA, 20 bp, Artificial
  CRISPR gRNA sequence
gctttacctatttgggattt

SEQ ID NO: 160431 - DNA, 20 bp, Artificial
  CRISPR gRNA sequence
tacctatttgggatttccta

SEQ ID NO: 160432 - DNA, 20 bp, Artificial
  CRISPR gRNA sequence
acctatttgggatttcctaa

SEQ ID NO: 160433 - DNA, 20 bp, Artificial
  CRISPR gRNA sequence
cctatttgggatttcctaat

SEQ ID NO: 160434 - DNA, 20 bp, Artificial
  CRISPR gRNA sequence
tttgggatttcctaatgtag

SEQ ID NO: 160435 - DNA, 20 bp, Artificial
  CRISPR gRNA sequence
gggatttcctaatgtagatg

SEQ ID NO: 160436 - DNA, 20 bp, Artificial
  CRISPR gRNA sequence
ggatttcctaatgtagatgg

SEQ ID NO: 160437 - DNA, 20 bp, Artificial
  CRISPR gRNA sequence
cctaatgtagatgggcttct

SEQ ID NO: 160438 - DNA, 20 bp, Artificial
  CRISPR gRNA sequence
ctaatgtagatgggcttctc

SEQ ID NO: 160439 - DNA, 20 bp, Artificial
  CRISPR gRNA sequence
atgtagatgggcttctcaat

SEQ ID NO: 160440 - DNA, 20 bp, Artificial
  CRISPR gRNA sequence
ctcaattttaaaacttaacc

SEQ ID NO: 160441 - DNA, 20 bp, Artificial
  CRISPR gRNA sequence
tcaattttaaaacttaacct

SEQ ID NO: 160442 - DNA, 20 bp, Artificial
  CRISPR gRNA sequence
aattttaaaacttaaccttt

SEQ ID NO: 160443 - DNA, 20 bp, Artificial
  CRISPR gRNA sequence
taaaacttaacctttaatac

SEQ ID NO: 160444 - DNA, 20 bp, Artificial
  CRISPR gRNA sequence
aaaacttaacctttaataca

SEQ ID NO: 160445 - DNA, 20 bp, Artificial
  CRISPR gRNA sequence
aaacttaacctttaatacat

SEQ ID NO: 160446 - DNA, 20 bp, Artificial
  CRISPR gRNA sequence
aacctttaatacattttcag

SEQ ID NO: 160447 - DNA, 20 bp, Artificial
  CRISPR gRNA sequence
acctttaatacattttcagt

SEQ ID NO: 160448 - DNA, 20 bp, Artificial
  CRISPR gRNA sequence
taatacattttcagttccaa

SEQ ID NO: 160449 - DNA, 20 bp, Artificial
  CRISPR gRNA sequence
aatacattttcagttccaaa

SEQ ID NO: 160450 - DNA, 20 bp, Artificial
  CRISPR gRNA sequence
atacattttcagttccaaaa

SEQ ID NO: 160451 - DNA, 20 bp, Artificial
  CRISPR gRNA sequence
tcagttccaaaaaaatttga

SEQ ID NO: 160452 - DNA, 20 bp, Artificial
  CRISPR gRNA sequence
cagttccaaaaaaatttgat

SEQ ID NO: 160453 - DNA, 20 bp, Artificial
  CRISPR gRNA sequence
agttccaaaaaaatttgata

SEQ ID NO: 160454 - DNA, 20 bp, Artificial
  CRISPR gRNA sequence
caaaaaaatttgataacttc

SEQ ID NO: 160455 - DNA, 20 bp, Artificial
  CRISPR gRNA sequence
gataacttctgttttgtacc

SEQ ID NO: 160456 - DNA, 20 bp, Artificial
  CRISPR gRNA sequence
ataacttctgttttgtacct

SEQ ID NO: 160457 - DNA, 20 bp, Artificial
  CRISPR gRNA sequence
ctgttttgtacctaacttcc

SEQ ID NO: 160458 - DNA, 20 bp, Artificial
  CRISPR gRNA sequence
tgttttgtacctaacttcca

SEQ ID NO: 160459 - DNA, 20 bp, Artificial
  CRISPR gRNA sequence
ttttgtacctaacttccact

SEQ ID NO: 160460 - DNA, 20 bp, Artificial
  CRISPR gRNA sequence
tgtacctaacttccactact

SEQ ID NO: 160461 - DNA, 20 bp, Artificial
  CRISPR gRNA sequence
gtacctaacttccactacta

SEQ ID NO: 160462 - DNA, 20 bp, Artificial
  CRISPR gRNA sequence
tacctaacttccactactac

SEQ ID NO: 160463 - DNA, 20 bp, Artificial
  CRISPR gRNA sequence
acttccactactacagtatg

SEQ ID NO: 160464 - DNA, 20 bp, Artificial
  CRISPR gRNA sequence
ccactactacagtatgtggc

SEQ ID NO: 160465 - DNA, 20 bp, Artificial
  CRISPR gRNA sequence
cactactacagtatgtggct

SEQ ID NO: 160466 - DNA, 20 bp, Artificial
  CRISPR gRNA sequence
ctacagtatgtggctctgag

SEQ ID NO: 160467 - DNA, 20 bp, Artificial
  CRISPR gRNA sequence
cagtatgtggctctgagcca

SEQ ID NO: 160468 - DNA, 20 bp, Artificial
  CRISPR gRNA sequence
tgagccagccaaagattcat

SEQ ID NO: 160469 - DNA, 20 bp, Artificial
  CRISPR gRNA sequence
agccagccaaagattcatga

SEQ ID NO: 160470 - DNA, 20 bp, Artificial
  CRISPR gRNA sequence
atgatctgttgactacacag

SEQ ID NO: 160471 - DNA, 20 bp, Artificial
  CRISPR gRNA sequence
ttgactacacagatgtttgc

SEQ ID NO: 160472 - DNA, 20 bp, Artificial
  CRISPR gRNA sequence
actacacagatgtttgcggg

SEQ ID NO: 160473 - DNA, 20 bp, Artificial
  CRISPR gRNA sequence
cacagatgtttgcgggctga

SEQ ID NO: 160474 - DNA, 20 bp, Artificial
  CRISPR gRNA sequence
gcgggctgatcatgcctgca

SEQ ID NO: 160475 - DNA, 20 bp, Artificial
  CRISPR gRNA sequence
cgggctgatcatgcctgcac

SEQ ID NO: 160476 - DNA, 20 bp, Artificial
  CRISPR gRNA sequence
atcatgcctgcacatctgta

SEQ ID NO: 160477 - DNA, 20 bp, Artificial
  CRISPR gRNA sequence
cacatctgtagttgggacag

SEQ ID NO: 160478 - DNA, 20 bp, Artificial
  CRISPR gRNA sequence
tagttgggacagttcaaaat

SEQ ID NO: 160479 - DNA, 20 bp, Artificial
  CRISPR gRNA sequence
ggacagttcaaaatttaaaa

SEQ ID NO: 160480 - DNA, 20 bp, Artificial
  CRISPR gRNA sequence
aaaatttaaaagcagactgc

SEQ ID NO: 160481 - DNA, 20 bp, Artificial
  CRISPR gRNA sequence
aaaagcagactgcacagatg

SEQ ID NO: 160482 - DNA, 20 bp, Artificial
  CRISPR gRNA sequence
aaagcagactgcacagatgg

SEQ ID NO: 160483 - DNA, 20 bp, Artificial
  CRISPR gRNA sequence
cacagatggttctagacgtg

SEQ ID NO: 160484 - DNA, 20 bp, Artificial
  CRISPR gRNA sequence
tagacgtgctttttgaattg

SEQ ID NO: 160485 - DNA, 20 bp, Artificial
  CRISPR gRNA sequence
gacgtgctttttgaattgtg

SEQ ID NO: 160486 - DNA, 20 bp, Artificial
  CRISPR gRNA sequence
tttgaattgtgtacctttgt

SEQ ID NO: 160487 - DNA, 20 bp, Artificial
  CRISPR gRNA sequence
ttgaattgtgtacctttgta

SEQ ID NO: 160488 - DNA, 20 bp, Artificial
  CRISPR gRNA sequence
tgaattgtgtacctttgtaa

SEQ ID NO: 160489 - DNA, 20 bp, Artificial
  CRISPR gRNA sequence
gaattgtgtacctttgtaat

SEQ ID NO: 160490 - DNA, 20 bp, Artificial
  CRISPR gRNA sequence
aattgtgtacctttgtaatg

SEQ ID NO: 160491 - DNA, 20 bp, Artificial
  CRISPR gRNA sequence
tgtacctttgtaatgttttg

SEQ ID NO: 160492 - DNA, 20 bp, Artificial
  CRISPR gRNA sequence
tgtaatgttttggggggata

SEQ ID NO: 160493 - DNA, 20 bp, Artificial
  CRISPR gRNA sequence
gtaatgttttggggggatat

SEQ ID NO: 160494 - DNA, 20 bp, Artificial
  CRISPR gRNA sequence
taatgttttggggggatatc

SEQ ID NO: 160495 - DNA, 20 bp, Artificial
  CRISPR gRNA sequence
tggggggatatcagaggaca

SEQ ID NO: 160496 - DNA, 20 bp, Artificial
  CRISPR gRNA sequence
ggggggatatcagaggacag

SEQ ID NO: 160497 - DNA, 20 bp, Artificial
  CRISPR gRNA sequence
gggggatatcagaggacagc

SEQ ID NO: 160498 - DNA, 20 bp, Artificial
  CRISPR gRNA sequence
gttaccagacttttaaatcg

SEQ ID NO: 160499 - DNA, 20 bp, Artificial
  CRISPR gRNA sequence
ttaccagacttttaaatcgt

SEQ ID NO: 160500 - DNA, 20 bp, Artificial
  CRISPR gRNA sequence
ccagacttttaaatcgtaca

SEQ ID NO: 160501 - DNA, 20 bp, Artificial
  CRISPR gRNA sequence
ttaaatcgtacaggtctttg

SEQ ID NO: 160502 - DNA, 20 bp, Artificial
  CRISPR gRNA sequence
taaatcgtacaggtctttgt

SEQ ID NO: 160503 - DNA, 20 bp, Artificial
  CRISPR gRNA sequence
aaatcgtacaggtctttgta

SEQ ID NO: 160504 - DNA, 20 bp, Artificial
  CRISPR gRNA sequence
aatcgtacaggtctttgtac

SEQ ID NO: 160505 - DNA, 20 bp, Artificial
  CRISPR gRNA sequence
tgtactccaactaaacctac

SEQ ID NO: 160506 - DNA, 20 bp, Artificial
  CRISPR gRNA sequence
gtactccaactaaacctacc

SEQ ID NO: 160507 - DNA, 20 bp, Artificial
  CRISPR gRNA sequence
tactccaactaaacctaccc

SEQ ID NO: 160508 - DNA, 20 bp, Artificial
  CRISPR gRNA sequence
caactaaacctacccatcca

SEQ ID NO: 160509 - DNA, 20 bp, Artificial
  CRISPR gRNA sequence
aacctacccatccattagca

SEQ ID NO: 160510 - DNA, 20 bp, Artificial
  CRISPR gRNA sequence
cccatccattagcaagtgta

SEQ ID NO: 160511 - DNA, 20 bp, Artificial
  CRISPR gRNA sequence
gcaagtgtacagagatatcg

SEQ ID NO: 160512 - DNA, 20 bp, Artificial
  CRISPR gRNA sequence
gcaattgtgcatctttctcc

SEQ ID NO: 160513 - DNA, 20 bp, Artificial
  CRISPR gRNA sequence
tgcatctttctcctttgacc

SEQ ID NO: 160514 - DNA, 20 bp, Artificial
  CRISPR gRNA sequence
tctcctttgaccttagcagt

SEQ ID NO: 160515 - DNA, 20 bp, Artificial
  CRISPR gRNA sequence
ctcctttgaccttagcagtt

SEQ ID NO: 160516 - DNA, 20 bp, Artificial
  CRISPR gRNA sequence
tcctttgaccttagcagttt

SEQ ID NO: 160517 - DNA, 20 bp, Artificial
  CRISPR gRNA sequence
ctttgaccttagcagtttgc

SEQ ID NO: 160518 - DNA, 20 bp, Artificial
  CRISPR gRNA sequence
tgaccttagcagtttgcatg

SEQ ID NO: 160519 - DNA, 20 bp, Artificial
  CRISPR gRNA sequence
gaccttagcagtttgcatgg

SEQ ID NO: 160520 - DNA, 20 bp, Artificial
  CRISPR gRNA sequence
accttagcagtttgcatggc

SEQ ID NO: 160521 - DNA, 20 bp, Artificial
  CRISPR gRNA sequence
agcagtttgcatggcagatt

SEQ ID NO: 160522 - DNA, 20 bp, Artificial
  CRISPR gRNA sequence
gcagtttgcatggcagattg

SEQ ID NO: 160523 - DNA, 20 bp, Artificial
  CRISPR gRNA sequence
gcatggcagattgtgccaag

SEQ ID NO: 160524 - DNA, 20 bp, Artificial
  CRISPR gRNA sequence
catggcagattgtgccaaga

SEQ ID NO: 160525 - DNA, 20 bp, Artificial
  CRISPR gRNA sequence
tgccaagatgaggcctgtcc

SEQ ID NO: 160526 - DNA, 20 bp, Artificial
  CRISPR gRNA sequence
tccagggacccatgcaataa

SEQ ID NO: 160527 - DNA, 20 bp, Artificial
  CRISPR gRNA sequence
gattcttttaaagctttttg

SEQ ID NO: 160528 - DNA, 20 bp, Artificial
  CRISPR gRNA sequence
ttttaaagctttttgataat

SEQ ID NO: 160529 - DNA, 20 bp, Artificial
  CRISPR gRNA sequence
ttaaagctttttgataatta

SEQ ID NO: 160530 - DNA, 20 bp, Artificial
  CRISPR gRNA sequence
taaagctttttgataattat

SEQ ID NO: 160531 - DNA, 20 bp, Artificial
  CRISPR gRNA sequence
aaagctttttgataattatt

SEQ ID NO: 160532 - DNA, 20 bp, Artificial
  CRISPR gRNA sequence
aagctttttgataattatta

SEQ ID NO: 160533 - DNA, 20 bp, Artificial
  CRISPR gRNA sequence
tttgataattattattattt

SEQ ID NO: 160534 - DNA, 20 bp, Artificial
  CRISPR gRNA sequence
ttgataattattattatttc

SEQ ID NO: 160535 - DNA, 20 bp, Artificial
  CRISPR gRNA sequence
tgataattattattatttcc

SEQ ID NO: 160536 - DNA, 20 bp, Artificial
  CRISPR gRNA sequence
gataattattattatttcca

SEQ ID NO: 160537 - DNA, 20 bp, Artificial
  CRISPR gRNA sequence
ataattattattatttccag

SEQ ID NO: 160538 - DNA, 20 bp, Artificial
  CRISPR gRNA sequence
ttattatttccagaaagata

SEQ ID NO: 160539 - DNA, 20 bp, Artificial
  CRISPR gRNA sequence
ttatttccagaaagatattt

SEQ ID NO: 160540 - DNA, 20 bp, Artificial
  CRISPR gRNA sequence
tttccagaaagatatttttg

SEQ ID NO: 160541 - DNA, 20 bp, Artificial
  CRISPR gRNA sequence
ccagaaagatatttttgttt

SEQ ID NO: 160542 - DNA, 20 bp, Artificial
  CRISPR gRNA sequence
cagaaagatatttttgtttg

SEQ ID NO: 160543 - DNA, 20 bp, Artificial
  CRISPR gRNA sequence
ttgtttgccccatttaaaaa

SEQ ID NO: 160544 - DNA, 20 bp, Artificial
  CRISPR gRNA sequence
tgtttgccccatttaaaaaa

SEQ ID NO: 160545 - DNA, 20 bp, Artificial
  CRISPR gRNA sequence
gtttgccccatttaaaaaag

SEQ ID NO: 160546 - DNA, 20 bp, Artificial
  CRISPR gRNA sequence
tttgccccatttaaaaaagg

SEQ ID NO: 160547 - DNA, 20 bp, Artificial
  CRISPR gRNA sequence
gccccatttaaaaaaggtta

SEQ ID NO: 160548 - DNA, 20 bp, Artificial
  CRISPR gRNA sequence
ccccatttaaaaaaggttaa

SEQ ID NO: 160549 - DNA, 20 bp, Artificial
  CRISPR gRNA sequence
aaaaaaggttaaattgagtc

SEQ ID NO: 160550 - DNA, 20 bp, Artificial
  CRISPR gRNA sequence
aaaaaggttaaattgagtca

SEQ ID NO: 160551 - DNA, 20 bp, Artificial
  CRISPR gRNA sequence
aattgagtcactgtcttcat

SEQ ID NO: 160552 - DNA, 20 bp, Artificial
  CRISPR gRNA sequence
agtcactgtcttcattttca

SEQ ID NO: 160553 - DNA, 20 bp, Artificial
  CRISPR gRNA sequence
tcttcattttcatgagtacc

SEQ ID NO: 160554 - DNA, 20 bp, Artificial
  CRISPR gRNA sequence
cattttcatgagtaccttgt

SEQ ID NO: 160555 - DNA, 20 bp, Artificial
  CRISPR gRNA sequence
attttcatgagtaccttgta

SEQ ID NO: 160556 - DNA, 20 bp, Artificial
  CRISPR gRNA sequence
tcatgagtaccttgtagaaa

SEQ ID NO: 160557 - DNA, 20 bp, Artificial
  CRISPR gRNA sequence
catgagtaccttgtagaaaa

SEQ ID NO: 160558 - DNA, 20 bp, Artificial
  CRISPR gRNA sequence
atgagtaccttgtagaaaac

SEQ ID NO: 160559 - DNA, 20 bp, Artificial
  CRISPR gRNA sequence
gtagaaaactattaataatg

SEQ ID NO: 160560 - DNA, 20 bp, Artificial
  CRISPR gRNA sequence
tagaaaactattaataatga

SEQ ID NO: 160561 - DNA, 20 bp, Artificial
  CRISPR gRNA sequence
ttaataatgataaataacta

SEQ ID NO: 160562 - DNA, 20 bp, Artificial
  CRISPR gRNA sequence
ataatgataaataactaaac

SEQ ID NO: 160563 - DNA, 20 bp, Artificial
  CRISPR gRNA sequence
aacttctctagattacctta

SEQ ID NO: 160564 - DNA, 20 bp, Artificial
  CRISPR gRNA sequence
ctctagattaccttaatttt

SEQ ID NO: 160565 - DNA, 20 bp, Artificial
  CRISPR gRNA sequence
tctagattaccttaattttt

SEQ ID NO: 160566 - DNA, 20 bp, Artificial
  CRISPR gRNA sequence
tagattaccttaattttttt

SEQ ID NO: 160567 - DNA, 20 bp, Artificial
  CRISPR gRNA sequence
gattaccttaatttttttgt

SEQ ID NO: 160568 - DNA, 20 bp, Artificial
  CRISPR gRNA sequence
ccttaatttttttgttgttg

SEQ ID NO: 160569 - DNA, 20 bp, Artificial
  CRISPR gRNA sequence
aatttttttgttgttgttct

SEQ ID NO: 160570 - DNA, 20 bp, Artificial
  CRISPR gRNA sequence
atttttttgttgttgttctc

SEQ ID NO: 160571 - DNA, 20 bp, Artificial
  CRISPR gRNA sequence
ttttgttgttgttctcagta

SEQ ID NO: 160572 - DNA, 20 bp, Artificial
  CRISPR gRNA sequence
tttgttgttgttctcagtac

SEQ ID NO: 160573 - DNA, 20 bp, Artificial
  CRISPR gRNA sequence
ttgttgttgttctcagtaca

SEQ ID NO: 160574 - DNA, 20 bp, Artificial
  CRISPR gRNA sequence
tgttgttgttctcagtacat

SEQ ID NO: 160575 - DNA, 20 bp, Artificial
  CRISPR gRNA sequence
gttgttgttctcagtacatc

SEQ ID NO: 160576 - DNA, 20 bp, Artificial
  CRISPR gRNA sequence
ttgttgttctcagtacatct

SEQ ID NO: 160577 - DNA, 20 bp, Artificial
  CRISPR gRNA sequence
ttgttctcagtacatctaag

SEQ ID NO: 160578 - DNA, 20 bp, Artificial
  CRISPR gRNA sequence
ttctcagtacatctaagaga

SEQ ID NO: 160579 - DNA, 20 bp, Artificial
  CRISPR gRNA sequence
tcagtacatctaagagagta

SEQ ID NO: 160580 - DNA, 20 bp, Artificial
  CRISPR gRNA sequence
agtacatctaagagagtagc

SEQ ID NO: 160581 - DNA, 20 bp, Artificial
  CRISPR gRNA sequence
agagagtagcatataggcca

SEQ ID NO: 160582 - DNA, 20 bp, Artificial
  CRISPR gRNA sequence
acttggttatttaggactta

SEQ ID NO: 160583 - DNA, 20 bp, Artificial
  CRISPR gRNA sequence
cttggttatttaggacttaa

SEQ ID NO: 160584 - DNA, 20 bp, Artificial
  CRISPR gRNA sequence
ggttatttaggacttaagat

SEQ ID NO: 160585 - DNA, 20 bp, Artificial
  CRISPR gRNA sequence
gttatttaggacttaagatt

SEQ ID NO: 160586 - DNA, 20 bp, Artificial
  CRISPR gRNA sequence
tttaggacttaagattttat

SEQ ID NO: 160587 - DNA, 20 bp, Artificial
  CRISPR gRNA sequence
aggacttaagattttatcta

SEQ ID NO: 160588 - DNA, 20 bp, Artificial
  CRISPR gRNA sequence
ggacttaagattttatctag

SEQ ID NO: 160589 - DNA, 20 bp, Artificial
  CRISPR gRNA sequence
aagattttatctagtcattt

SEQ ID NO: 160590 - DNA, 20 bp, Artificial
  CRISPR gRNA sequence
agattttatctagtcatttt

SEQ ID NO: 160591 - DNA, 20 bp, Artificial
  CRISPR gRNA sequence
tatctagtcattttcaactg

SEQ ID NO: 160592 - DNA, 20 bp, Artificial
  CRISPR gRNA sequence
atctagtcattttcaactgt

SEQ ID NO: 160593 - DNA, 20 bp, Artificial
  CRISPR gRNA sequence
tctagtcattttcaactgtg

SEQ ID NO: 160594 - DNA, 20 bp, Artificial
  CRISPR gRNA sequence
gtcattttcaactgtgattg

SEQ ID NO: 160595 - DNA, 20 bp, Artificial
  CRISPR gRNA sequence
tcaactgtgattgaacactt

SEQ ID NO: 160596 - DNA, 20 bp, Artificial
  CRISPR gRNA sequence
caactgtgattgaacacttc

SEQ ID NO: 160597 - DNA, 20 bp, Artificial
  CRISPR gRNA sequence
aactgtgattgaacacttcc

SEQ ID NO: 160598 - DNA, 20 bp, Artificial
  CRISPR gRNA sequence
tgattgaacacttcccttta

SEQ ID NO: 160599 - DNA, 20 bp, Artificial
  CRISPR gRNA sequence
aacacttccctttaactccc

SEQ ID NO: 160600 - DNA, 20 bp, Artificial
  CRISPR gRNA sequence
ccctttaactcccttcagaa

SEQ ID NO: 160601 - DNA, 20 bp, Artificial
  CRISPR gRNA sequence
cctttaactcccttcagaaa

SEQ ID NO: 160602 - DNA, 20 bp, Artificial
  CRISPR gRNA sequence
taactcccttcagaaactcc

SEQ ID NO: 160603 - DNA, 20 bp, Artificial
  CRISPR gRNA sequence
aactcccttcagaaactcca

SEQ ID NO: 160604 - DNA, 20 bp, Artificial
  CRISPR gRNA sequence
actcccttcagaaactccaa

SEQ ID NO: 160605 - DNA, 20 bp, Artificial
  CRISPR gRNA sequence
ccttcagaaactccaagatc

SEQ ID NO: 160606 - DNA, 20 bp, Artificial
  CRISPR gRNA sequence
cagaaactccaagatcatat

SEQ ID NO: 160607 - DNA, 20 bp, Artificial
  CRISPR gRNA sequence
agaaactccaagatcatatt

SEQ ID NO: 160608 - DNA, 20 bp, Artificial
  CRISPR gRNA sequence
caagatcatattgtatccca

SEQ ID NO: 160609 - DNA, 20 bp, Artificial
  CRISPR gRNA sequence
tatcccaggtactagaattt

SEQ ID NO: 160610 - DNA, 20 bp, Artificial
  CRISPR gRNA sequence
gaatttctgttcagctgttt

SEQ ID NO: 160611 - DNA, 20 bp, Artificial
  CRISPR gRNA sequence
ctgttcagctgtttataggc

SEQ ID NO: 160612 - DNA, 20 bp, Artificial
  CRISPR gRNA sequence
tgttcagctgtttataggcc

SEQ ID NO: 160613 - DNA, 20 bp, Artificial
  CRISPR gRNA sequence
ttcagctgtttataggcctc

SEQ ID NO: 160614 - DNA, 20 bp, Artificial
  CRISPR gRNA sequence
agctgtttataggcctccac

SEQ ID NO: 160615 - DNA, 20 bp, Artificial
  CRISPR gRNA sequence
tttataggcctccaccacaa

SEQ ID NO: 160616 - DNA, 20 bp, Artificial
  CRISPR gRNA sequence
ataggcctccaccacaagaa

SEQ ID NO: 160617 - DNA, 20 bp, Artificial
  CRISPR gRNA sequence
taggcctccaccacaagaaa

SEQ ID NO: 160618 - DNA, 20 bp, Artificial
  CRISPR gRNA sequence
caccacaagaaattggctcc

SEQ ID NO: 160619 - DNA, 20 bp, Artificial
  CRISPR gRNA sequence
gctccaaacctattcccatt

SEQ ID NO: 160620 - DNA, 20 bp, Artificial
  CRISPR gRNA sequence
caaacctattcccattacat

SEQ ID NO: 160621 - DNA, 20 bp, Artificial
  CRISPR gRNA sequence
ttcccattacatcatcaccc

SEQ ID NO: 160622 - DNA, 20 bp, Artificial
  CRISPR gRNA sequence
ccattacatcatcacccact

SEQ ID NO: 160623 - DNA, 20 bp, Artificial
  CRISPR gRNA sequence
catcatcacccactaatgtc

SEQ ID NO: 160624 - DNA, 20 bp, Artificial
  CRISPR gRNA sequence
atgtcattacaccagaatga

SEQ ID NO: 160625 - DNA, 20 bp, Artificial
  CRISPR gRNA sequence
caccagaatgaaatctgctt

SEQ ID NO: 160626 - DNA, 20 bp, Artificial
  CRISPR gRNA sequence
ctttgaggcttgtattgttg

SEQ ID NO: 160627 - DNA, 20 bp, Artificial
  CRISPR gRNA sequence
tgaggcttgtattgttgttt

SEQ ID NO: 160628 - DNA, 20 bp, Artificial
  CRISPR gRNA sequence
gaggcttgtattgttgtttt

SEQ ID NO: 160629 - DNA, 20 bp, Artificial
  CRISPR gRNA sequence
aggcttgtattgttgttttc

SEQ ID NO: 160630 - DNA, 20 bp, Artificial
  CRISPR gRNA sequence
gtattgttgttttccttcca

SEQ ID NO: 160631 - DNA, 20 bp, Artificial
  CRISPR gRNA sequence
tattgttgttttccttccat

SEQ ID NO: 160632 - DNA, 20 bp, Artificial
  CRISPR gRNA sequence
ttgttttccttccatttctt

SEQ ID NO: 160633 - DNA, 20 bp, Artificial
  CRISPR gRNA sequence
ttttccttccatttctttcc

SEQ ID NO: 160634 - DNA, 20 bp, Artificial
  CRISPR gRNA sequence
tccttccatttctttcccct

SEQ ID NO: 160635 - DNA, 20 bp, Artificial
  CRISPR gRNA sequence
ccttccatttctttcccctc

SEQ ID NO: 160636 - DNA, 20 bp, Artificial
  CRISPR gRNA sequence
cttccatttctttcccctca

SEQ ID NO: 160637 - DNA, 20 bp, Artificial
  CRISPR gRNA sequence
ccatttctttcccctcatca

SEQ ID NO: 160638 - DNA, 20 bp, Artificial
  CRISPR gRNA sequence
catttctttcccctcatcat

SEQ ID NO: 160639 - DNA, 20 bp, Artificial
  CRISPR gRNA sequence
ctttcccctcatcatttcct

SEQ ID NO: 160640 - DNA, 20 bp, Artificial
  CRISPR gRNA sequence
tttcccctcatcatttcctt

SEQ ID NO: 160641 - DNA, 20 bp, Artificial
  CRISPR gRNA sequence
tcccctcatcatttccttta

SEQ ID NO: 160642 - DNA, 20 bp, Artificial
  CRISPR gRNA sequence
cccctcatcatttcctttag

SEQ ID NO: 160643 - DNA, 20 bp, Artificial
  CRISPR gRNA sequence
ccctcatcatttcctttaga

SEQ ID NO: 160644 - DNA, 20 bp, Artificial
  CRISPR gRNA sequence
atcatttcctttagaaggaa

SEQ ID NO: 160645 - DNA, 20 bp, Artificial
  CRISPR gRNA sequence
cctttagaaggaaaagggaa

SEQ ID NO: 160646 - DNA, 20 bp, Artificial
  CRISPR gRNA sequence
ctttagaaggaaaagggaag

SEQ ID NO: 160647 - DNA, 20 bp, Artificial
  CRISPR gRNA sequence
tagaaggaaaagggaaggaa

SEQ ID NO: 160648 - DNA, 20 bp, Artificial
  CRISPR gRNA sequence
agaaggaaaagggaaggaaa

SEQ ID NO: 160649 - DNA, 20 bp, Artificial
  CRISPR gRNA sequence
gaaggaaaagggaaggaaaa

SEQ ID NO: 160650 - DNA, 20 bp, Artificial
  CRISPR gRNA sequence
taaacatttaagagtgaatt

SEQ ID NO: 160651 - DNA, 20 bp, Artificial
  CRISPR gRNA sequence
aagagtgaattggacatccc

SEQ ID NO: 160652 - DNA, 20 bp, Artificial
  CRISPR gRNA sequence
agagtgaattggacatcccc

SEQ ID NO: 160653 - DNA, 20 bp, Artificial
  CRISPR gRNA sequence
gacatccccacaggctaaac

SEQ ID NO: 160654 - DNA, 20 bp, Artificial
  CRISPR gRNA sequence
aacctagagttgtcagcttt

SEQ ID NO: 160655 - DNA, 20 bp, Artificial
  CRISPR gRNA sequence
gagttgtcagctttcattcc

SEQ ID NO: 160656 - DNA, 20 bp, Artificial
  CRISPR gRNA sequence
tcagctttcattccattctg

SEQ ID NO: 160657 - DNA, 20 bp, Artificial
  CRISPR gRNA sequence
tcattccattctgctgtgat

SEQ ID NO: 160658 - DNA, 20 bp, Artificial
  CRISPR gRNA sequence
cattccattctgctgtgata

SEQ ID NO: 160659 - DNA, 20 bp, Artificial
  CRISPR gRNA sequence
attccattctgctgtgatag

SEQ ID NO: 160660 - DNA, 20 bp, Artificial
  CRISPR gRNA sequence
cattctgctgtgatagagtg

SEQ ID NO: 160661 - DNA, 20 bp, Artificial
  CRISPR gRNA sequence
tgctgtgatagagtgttctg

SEQ ID NO: 160662 - DNA, 20 bp, Artificial
  CRISPR gRNA sequence
ctgtgatagagtgttctgcc

SEQ ID NO: 160663 - DNA, 20 bp, Artificial
  CRISPR gRNA sequence
tgatagagtgttctgcccag

SEQ ID NO: 160664 - DNA, 20 bp, Artificial
  CRISPR gRNA sequence
tgcccagtatgtatccacat

SEQ ID NO: 160665 - DNA, 20 bp, Artificial
  CRISPR gRNA sequence
cccagtatgtatccacatgg

SEQ ID NO: 160666 - DNA, 20 bp, Artificial
  CRISPR gRNA sequence
gaaagtaacaagtctggtca

SEQ ID NO: 160667 - DNA, 20 bp, Artificial
  CRISPR gRNA sequence
gtcatgtgacaactggcttt

SEQ ID NO: 160668 - DNA, 20 bp, Artificial
  CRISPR gRNA sequence
gctttggtgctttgctttca

SEQ ID NO: 160669 - DNA, 20 bp, Artificial
  CRISPR gRNA sequence
tggtgctttgctttcagccc

SEQ ID NO: 160670 - DNA, 20 bp, Artificial
  CRISPR gRNA sequence
ggtgctttgctttcagcccc

SEQ ID NO: 160671 - DNA, 20 bp, Artificial
  CRISPR gRNA sequence
gtgctttgctttcagcccct

SEQ ID NO: 160672 - DNA, 20 bp, Artificial
  CRISPR gRNA sequence
tgctttcagcccctcagaat

SEQ ID NO: 160673 - DNA, 20 bp, Artificial
  CRISPR gRNA sequence
gctttcagcccctcagaatt

SEQ ID NO: 160674 - DNA, 20 bp, Artificial
  CRISPR gRNA sequence
ctttcagcccctcagaatta

SEQ ID NO: 160675 - DNA, 20 bp, Artificial
  CRISPR gRNA sequence
tcagcccctcagaattagtt

SEQ ID NO: 160676 - DNA, 20 bp, Artificial
  CRISPR gRNA sequence
cagcccctcagaattagttc

SEQ ID NO: 160677 - DNA, 20 bp, Artificial
  CRISPR gRNA sequence
agcccctcagaattagttcc

SEQ ID NO: 160678 - DNA, 20 bp, Artificial
  CRISPR gRNA sequence
agaattagttcctaatggct

SEQ ID NO: 160679 - DNA, 20 bp, Artificial
  CRISPR gRNA sequence
gttcctaatggctcacatag

SEQ ID NO: 160680 - DNA, 20 bp, Artificial
  CRISPR gRNA sequence
ctaatggctcacatagctcc

SEQ ID NO: 160681 - DNA, 20 bp, Artificial
  CRISPR gRNA sequence
atggctcacatagctccctg

SEQ ID NO: 160682 - DNA, 20 bp, Artificial
  CRISPR gRNA sequence
acatagctccctgccagcat

SEQ ID NO: 160683 - DNA, 20 bp, Artificial
  CRISPR gRNA sequence
cctgccagcatcccgtcact

SEQ ID NO: 160684 - DNA, 20 bp, Artificial
  CRISPR gRNA sequence
ccagcatcccgtcactggca

SEQ ID NO: 160685 - DNA, 20 bp, Artificial
  CRISPR gRNA sequence
gcacgttaaaccttttcaaa

SEQ ID NO: 160686 - DNA, 20 bp, Artificial
  CRISPR gRNA sequence
aaccttttcaaataattcct

SEQ ID NO: 160687 - DNA, 20 bp, Artificial
  CRISPR gRNA sequence
ttcaaataattcctcagaat

SEQ ID NO: 160688 - DNA, 20 bp, Artificial
  CRISPR gRNA sequence
tcaaataattcctcagaata

SEQ ID NO: 160689 - DNA, 20 bp, Artificial
  CRISPR gRNA sequence
caaataattcctcagaatag

SEQ ID NO: 160690 - DNA, 20 bp, Artificial
  CRISPR gRNA sequence
aaataattcctcagaataga

SEQ ID NO: 160691 - DNA, 20 bp, Artificial
  CRISPR gRNA sequence
ctcagaatagagattcttag

SEQ ID NO: 160692 - DNA, 20 bp, Artificial
  CRISPR gRNA sequence
agaatagagattcttaggag

SEQ ID NO: 160693 - DNA, 20 bp, Artificial
  CRISPR gRNA sequence
ttaggagagcactaaatttc

SEQ ID NO: 160694 - DNA, 20 bp, Artificial
  CRISPR gRNA sequence
aggagagcactaaatttctc

SEQ ID NO: 160695 - DNA, 20 bp, Artificial
  CRISPR gRNA sequence
ggagagcactaaatttctcc

SEQ ID NO: 160696 - DNA, 20 bp, Artificial
  CRISPR gRNA sequence
aatttctccattctttgtgt

SEQ ID NO: 160697 - DNA, 20 bp, Artificial
  CRISPR gRNA sequence
ctccattctttgtgtttaat

SEQ ID NO: 160698 - DNA, 20 bp, Artificial
  CRISPR gRNA sequence
tccattctttgtgtttaatt

SEQ ID NO: 160699 - DNA, 20 bp, Artificial
  CRISPR gRNA sequence
cattctttgtgtttaattaa

SEQ ID NO: 160700 - DNA, 20 bp, Artificial
  CRISPR gRNA sequence
tttgtgtttaattaaactgt

SEQ ID NO: 160701 - DNA, 20 bp, Artificial
  CRISPR gRNA sequence
tgtgtttaattaaactgttc

SEQ ID NO: 160702 - DNA, 20 bp, Artificial
  CRISPR gRNA sequence
gtgtttaattaaactgttct

SEQ ID NO: 160703 - DNA, 20 bp, Artificial
  CRISPR gRNA sequence
tgtttaattaaactgttctt

SEQ ID NO: 160704 - DNA, 20 bp, Artificial
  CRISPR gRNA sequence
aattaaactgttcttgcatt

SEQ ID NO: 160705 - DNA, 20 bp, Artificial
  CRISPR gRNA sequence
attaaactgttcttgcattt

SEQ ID NO: 160706 - DNA, 20 bp, Artificial
  CRISPR gRNA sequence
aactgttcttgcattttaat

SEQ ID NO: 160707 - DNA, 20 bp, Artificial
  CRISPR gRNA sequence
ttcttgcattttaatatttg

SEQ ID NO: 160708 - DNA, 20 bp, Artificial
  CRISPR gRNA sequence
ttgcattttaatatttgcca

SEQ ID NO: 160709 - DNA, 20 bp, Artificial
  CRISPR gRNA sequence
gcattttaatatttgccaga

SEQ ID NO: 160710 - DNA, 20 bp, Artificial
  CRISPR gRNA sequence
cattttaatatttgccagat

SEQ ID NO: 160711 - DNA, 20 bp, Artificial
  CRISPR gRNA sequence
taatatttgccagataagcg

SEQ ID NO: 160712 - DNA, 20 bp, Artificial
  CRISPR gRNA sequence
aatatttgccagataagcgc

SEQ ID NO: 160713 - DNA, 20 bp, Artificial
  CRISPR gRNA sequence
atatttgccagataagcgct

SEQ ID NO: 160714 - DNA, 20 bp, Artificial
  CRISPR gRNA sequence
gccagataagcgcttaagac

SEQ ID NO: 160715 - DNA, 20 bp, Artificial
  CRISPR gRNA sequence
ccagataagcgcttaagaca

SEQ ID NO: 160716 - DNA, 20 bp, Artificial
  CRISPR gRNA sequence
aagacattacaatacaggtt

SEQ ID NO: 160717 - DNA, 20 bp, Artificial
  CRISPR gRNA sequence
agacattacaatacaggttg

SEQ ID NO: 160718 - DNA, 20 bp, Artificial
  CRISPR gRNA sequence
caatacaggttgagtatcct

SEQ ID NO: 160719 - DNA, 20 bp, Artificial
  CRISPR gRNA sequence
agtatccttaatctgaaaat

SEQ ID NO: 160720 - DNA, 20 bp, Artificial
  CRISPR gRNA sequence
aatctgaaaatctgaaatcc

SEQ ID NO: 160721 - DNA, 20 bp, Artificial
  CRISPR gRNA sequence
atctgaaaatctgaaatccg

SEQ ID NO: 160722 - DNA, 20 bp, Artificial
  CRISPR gRNA sequence
aaaatctgaaatccgaaact

SEQ ID NO: 160723 - DNA, 20 bp, Artificial
  CRISPR gRNA sequence
aaatccgaaactttttgagc

SEQ ID NO: 160724 - DNA, 20 bp, Artificial
  CRISPR gRNA sequence
tttgagccctgacatgacgc

SEQ ID NO: 160725 - DNA, 20 bp, Artificial
  CRISPR gRNA sequence
ttgagccctgacatgacgct

SEQ ID NO: 160726 - DNA, 20 bp, Artificial
  CRISPR gRNA sequence
tgagccctgacatgacgctc

SEQ ID NO: 160727 - DNA, 20 bp, Artificial
  CRISPR gRNA sequence
gagccctgacatgacgctca

SEQ ID NO: 160728 - DNA, 20 bp, Artificial
  CRISPR gRNA sequence
agccctgacatgacgctcaa

SEQ ID NO: 160729 - DNA, 20 bp, Artificial
  CRISPR gRNA sequence
acatgacgctcaaaggaaat

SEQ ID NO: 160730 - DNA, 20 bp, Artificial
  CRISPR gRNA sequence
aaaggaaatgctcattttcg

SEQ ID NO: 160731 - DNA, 20 bp, Artificial
  CRISPR gRNA sequence
attttcgattttggattttc

SEQ ID NO: 160732 - DNA, 20 bp, Artificial
  CRISPR gRNA sequence
tcgattttggattttcagat

SEQ ID NO: 160733 - DNA, 20 bp, Artificial
  CRISPR gRNA sequence
cgattttggattttcagatt

SEQ ID NO: 160734 - DNA, 20 bp, Artificial
  CRISPR gRNA sequence
gattttggattttcagattt

SEQ ID NO: 160735 - DNA, 20 bp, Artificial
  CRISPR gRNA sequence
tggattttcagatttgggat

SEQ ID NO: 160736 - DNA, 20 bp, Artificial
  CRISPR gRNA sequence
ggattttcagatttgggatg

SEQ ID NO: 160737 - DNA, 20 bp, Artificial
  CRISPR gRNA sequence
gattttcagatttgggatgc

SEQ ID NO: 160738 - DNA, 20 bp, Artificial
  CRISPR gRNA sequence
tcagatttgggatgctcaac

SEQ ID NO: 160739 - DNA, 20 bp, Artificial
  CRISPR gRNA sequence
cagatttgggatgctcaacc

SEQ ID NO: 160740 - DNA, 20 bp, Artificial
  CRISPR gRNA sequence
agatttgggatgctcaacca

SEQ ID NO: 160741 - DNA, 20 bp, Artificial
  CRISPR gRNA sequence
gggatgctcaaccagtaagt

SEQ ID NO: 160742 - DNA, 20 bp, Artificial
  CRISPR gRNA sequence
ggatgctcaaccagtaagta

SEQ ID NO: 160743 - DNA, 20 bp, Artificial
  CRISPR gRNA sequence
aaccagtaagtataatgcaa

SEQ ID NO: 160744 - DNA, 20 bp, Artificial
  CRISPR gRNA sequence
attccaaaaaaaaaaaaaaa

SEQ ID NO: 160745 - DNA, 20 bp, Artificial
  CRISPR gRNA sequence
ttccaaaaaaaaaaaaaaaa

SEQ ID NO: 160746 - DNA, 20 bp, Artificial
  CRISPR gRNA sequence
caaaaaaaaaaaaaaaaaaa

SEQ ID NO: 160747 - DNA, 20 bp, Artificial
  CRISPR gRNA sequence
ggcgcggtggctcacgcctg

SEQ ID NO: 160748 - DNA, 20 bp, Artificial
  CRISPR gRNA sequence
acgcctgtaatcccagcact

SEQ ID NO: 160749 - DNA, 20 bp, Artificial
  CRISPR gRNA sequence
taatcccagcactttgggag

SEQ ID NO: 160750 - DNA, 20 bp, Artificial
  CRISPR gRNA sequence
tgggaggacgaggcaggtgg

SEQ ID NO: 160751 - DNA, 20 bp, Artificial
  CRISPR gRNA sequence
gggaggacgaggcaggtgga

SEQ ID NO: 160752 - DNA, 20 bp, Artificial
  CRISPR gRNA sequence
ggaggacgaggcaggtggat

SEQ ID NO: 160753 - DNA, 20 bp, Artificial
  CRISPR gRNA sequence
aggtcaggagtttgaggcag

SEQ ID NO: 160754 - DNA, 20 bp, Artificial
  CRISPR gRNA sequence
gaggcagcctggccaacatg

SEQ ID NO: 160755 - DNA, 20 bp, Artificial
  CRISPR gRNA sequence
aggcagcctggccaacatgg

SEQ ID NO: 160756 - DNA, 20 bp, Artificial
  CRISPR gRNA sequence
gccaacatggcgaaacccca

SEQ ID NO: 160757 - DNA, 20 bp, Artificial
  CRISPR gRNA sequence
tactaaaaatataaaaaatt

SEQ ID NO: 160758 - DNA, 20 bp, Artificial
  CRISPR gRNA sequence
actaaaaatataaaaaatta

SEQ ID NO: 160759 - DNA, 20 bp, Artificial
  CRISPR gRNA sequence
ctaaaaatataaaaaattag

SEQ ID NO: 160760 - DNA, 20 bp, Artificial
  CRISPR gRNA sequence
aaaatataaaaaattagcta

SEQ ID NO: 160761 - DNA, 20 bp, Artificial
  CRISPR gRNA sequence
gctaggcgtggtggcagatg

SEQ ID NO: 160762 - DNA, 20 bp, Artificial
  CRISPR gRNA sequence
ggcgtggtggcagatgcctg

SEQ ID NO: 160763 - DNA, 20 bp, Artificial
  CRISPR gRNA sequence
taatcccagctactcaggag

SEQ ID NO: 160764 - DNA, 20 bp, Artificial
  CRISPR gRNA sequence
ctcaggaggctgaggcagga

SEQ ID NO: 160765 - DNA, 20 bp, Artificial
  CRISPR gRNA sequence
aggaggctgaggcaggagaa

SEQ ID NO: 160766 - DNA, 20 bp, Artificial
  CRISPR gRNA sequence
aggcaggagaatcacatgaa

SEQ ID NO: 160767 - DNA, 20 bp, Artificial
  CRISPR gRNA sequence
ggaggcagaggttgcagtga

SEQ ID NO: 160768 - DNA, 20 bp, Artificial
  CRISPR gRNA sequence
cagtgagctgaaattgcacc

SEQ ID NO: 160769 - DNA, 20 bp, Artificial
  CRISPR gRNA sequence
aaattgcaccactgcactcc

SEQ ID NO: 160770 - DNA, 20 bp, Artificial
  CRISPR gRNA sequence
caccactgcactccagtctg

SEQ ID NO: 160771 - DNA, 20 bp, Artificial
  CRISPR gRNA sequence
cactccagtctgggcaacaa

SEQ ID NO: 160772 - DNA, 20 bp, Artificial
  CRISPR gRNA sequence
cagtctgggcaacaagagcg

SEQ ID NO: 160773 - DNA, 20 bp, Artificial
  CRISPR gRNA sequence
ggcaacaagagcgaaactct

SEQ ID NO: 160774 - DNA, 20 bp, Artificial
  CRISPR gRNA sequence
tgtctcaaaaaaaaaaaaaa

SEQ ID NO: 160775 - DNA, 20 bp, Artificial
  CRISPR gRNA sequence
tctcaaaaaaaaaaaaaaaa

SEQ ID NO: 160776 - DNA, 20 bp, Artificial
  CRISPR gRNA sequence
aaaaaaaaaaaaaaaaaaaa

SEQ ID NO: 160777 - DNA, 20 bp, Artificial
  CRISPR gRNA sequence
ctggtccccaggcatttcag

SEQ ID NO: 160778 - DNA, 20 bp, Artificial
  CRISPR gRNA sequence
tggtccccaggcatttcaga

SEQ ID NO: 160779 - DNA, 20 bp, Artificial
  CRISPR gRNA sequence
gtccccaggcatttcagaat

SEQ ID NO: 160780 - DNA, 20 bp, Artificial
  CRISPR gRNA sequence
cagaatttcagataagggat

SEQ ID NO: 160781 - DNA, 20 bp, Artificial
  CRISPR gRNA sequence
agaatttcagataagggata

SEQ ID NO: 160782 - DNA, 20 bp, Artificial
  CRISPR gRNA sequence
cagataagggatactcaacc

SEQ ID NO: 160783 - DNA, 20 bp, Artificial
  CRISPR gRNA sequence
agataagggatactcaacct

SEQ ID NO: 160784 - DNA, 20 bp, Artificial
  CRISPR gRNA sequence
aacctgtgttatctacagtt

SEQ ID NO: 160785 - DNA, 20 bp, Artificial
  CRISPR gRNA sequence
tgttatctacagttatagct

SEQ ID NO: 160786 - DNA, 20 bp, Artificial
  CRISPR gRNA sequence
tctacagttatagctgacat

SEQ ID NO: 160787 - DNA, 20 bp, Artificial
  CRISPR gRNA sequence
cagttatagctgacatgagg

SEQ ID NO: 160788 - DNA, 20 bp, Artificial
  CRISPR gRNA sequence
tagctgacatgaggatcctt

SEQ ID NO: 160789 - DNA, 20 bp, Artificial
  CRISPR gRNA sequence
acatgaggatccttattcat

SEQ ID NO: 160790 - DNA, 20 bp, Artificial
  CRISPR gRNA sequence
attcatcttccctcctttgt

SEQ ID NO: 160791 - DNA, 20 bp, Artificial
  CRISPR gRNA sequence
ttcatcttccctcctttgtc

SEQ ID NO: 160792 - DNA, 20 bp, Artificial
  CRISPR gRNA sequence
atcttccctcctttgtcaca

SEQ ID NO: 160793 - DNA, 20 bp, Artificial
  CRISPR gRNA sequence
ccctcctttgtcacaaagca

SEQ ID NO: 160794 - DNA, 20 bp, Artificial
  CRISPR gRNA sequence
cctcctttgtcacaaagcag

SEQ ID NO: 160795 - DNA, 20 bp, Artificial
  CRISPR gRNA sequence
ctttgtcacaaagcagttga

SEQ ID NO: 160796 - DNA, 20 bp, Artificial
  CRISPR gRNA sequence
tgtcacaaagcagttgacta

SEQ ID NO: 160797 - DNA, 20 bp, Artificial
  CRISPR gRNA sequence
gtcacaaagcagttgactaa

SEQ ID NO: 160798 - DNA, 20 bp, Artificial
  CRISPR gRNA sequence
tcacaaagcagttgactaaa

SEQ ID NO: 160799 - DNA, 20 bp, Artificial
  CRISPR gRNA sequence
actaaattgcaggttctagc

SEQ ID NO: 160800 - DNA, 20 bp, Artificial
  CRISPR gRNA sequence
aattgcaggttctagccctc

SEQ ID NO: 160801 - DNA, 20 bp, Artificial
  CRISPR gRNA sequence
caggttctagccctctttct

SEQ ID NO: 160802 - DNA, 20 bp, Artificial
  CRISPR gRNA sequence
tagccctctttctctatcct

SEQ ID NO: 160803 - DNA, 20 bp, Artificial
  CRISPR gRNA sequence
gccctctttctctatcctaa

SEQ ID NO: 160804 - DNA, 20 bp, Artificial
  CRISPR gRNA sequence
tttctctatcctaattttaa

SEQ ID NO: 160805 - DNA, 20 bp, Artificial
  CRISPR gRNA sequence
tctctatcctaattttaatt

SEQ ID NO: 160806 - DNA, 20 bp, Artificial
  CRISPR gRNA sequence
ctctatcctaattttaattc

SEQ ID NO: 160807 - DNA, 20 bp, Artificial
  CRISPR gRNA sequence
tctatcctaattttaattct

SEQ ID NO: 160808 - DNA, 20 bp, Artificial
  CRISPR gRNA sequence
tatcctaattttaattctac

SEQ ID NO: 160809 - DNA, 20 bp, Artificial
  CRISPR gRNA sequence
tcctaattttaattctactt

SEQ ID NO: 160810 - DNA, 20 bp, Artificial
  CRISPR gRNA sequence
attttaattctacttttttt

SEQ ID NO: 160811 - DNA, 20 bp, Artificial
  CRISPR gRNA sequence
taattctacttttttttttt

SEQ ID NO: 160812 - DNA, 20 bp, Artificial
  CRISPR gRNA sequence
aattctactttttttttttt

SEQ ID NO: 160813 - DNA, 20 bp, Artificial
  CRISPR gRNA sequence
attctacttttttttttttt

SEQ ID NO: 160814 - DNA, 20 bp, Artificial
  CRISPR gRNA sequence
tactttttttttttttgcga

SEQ ID NO: 160815 - DNA, 20 bp, Artificial
  CRISPR gRNA sequence
ctttttttttttttgcgatg

SEQ ID NO: 160816 - DNA, 20 bp, Artificial
  CRISPR gRNA sequence
tttttttttttgcgatggag

SEQ ID NO: 160817 - DNA, 20 bp, Artificial
  CRISPR gRNA sequence
ttttttttttgcgatggagt

SEQ ID NO: 160818 - DNA, 20 bp, Artificial
  CRISPR gRNA sequence
tttttttttgcgatggagtc

SEQ ID NO: 160819 - DNA, 20 bp, Artificial
  CRISPR gRNA sequence
ttttttttgcgatggagtct

SEQ ID NO: 160820 - DNA, 20 bp, Artificial
  CRISPR gRNA sequence
tttttttgcgatggagtctt

SEQ ID NO: 160821 - DNA, 20 bp, Artificial
  CRISPR gRNA sequence
ttttttgcgatggagtcttg

SEQ ID NO: 160822 - DNA, 20 bp, Artificial
  CRISPR gRNA sequence
tttttgcgatggagtcttgc

SEQ ID NO: 160823 - DNA, 20 bp, Artificial
  CRISPR gRNA sequence
ttttgcgatggagtcttgct

SEQ ID NO: 160824 - DNA, 20 bp, Artificial
  CRISPR gRNA sequence
tttgcgatggagtcttgctc

SEQ ID NO: 160825 - DNA, 20 bp, Artificial
  CRISPR gRNA sequence
ttgcgatggagtcttgctct

SEQ ID NO: 160826 - DNA, 20 bp, Artificial
  CRISPR gRNA sequence
tgcgatggagtcttgctctg

SEQ ID NO: 160827 - DNA, 20 bp, Artificial
  CRISPR gRNA sequence
gcgatggagtcttgctctgt

SEQ ID NO: 160828 - DNA, 20 bp, Artificial
  CRISPR gRNA sequence
cgatggagtcttgctctgtt

SEQ ID NO: 160829 - DNA, 20 bp, Artificial
  CRISPR gRNA sequence
gctctgttgcccaggctgga

SEQ ID NO: 160830 - DNA, 20 bp, Artificial
  CRISPR gRNA sequence
ctctgttgcccaggctggag

SEQ ID NO: 160831 - DNA, 20 bp, Artificial
  CRISPR gRNA sequence
tgttgcccaggctggagtgc

SEQ ID NO: 160832 - DNA, 20 bp, Artificial
  CRISPR gRNA sequence
ttgcccaggctggagtgcaa

SEQ ID NO: 160833 - DNA, 20 bp, Artificial
  CRISPR gRNA sequence
cccaggctggagtgcaatgg

SEQ ID NO: 160834 - DNA, 20 bp, Artificial
  CRISPR gRNA sequence
gagtgcaatggcgtgatctt

SEQ ID NO: 160835 - DNA, 20 bp, Artificial
  CRISPR gRNA sequence
ggctcactgcaacctctgcc

SEQ ID NO: 160836 - DNA, 20 bp, Artificial
  CRISPR gRNA sequence
gctcactgcaacctctgcct

SEQ ID NO: 160837 - DNA, 20 bp, Artificial
  CRISPR gRNA sequence
actgcaacctctgcctcctg

SEQ ID NO: 160838 - DNA, 20 bp, Artificial
  CRISPR gRNA sequence
caacctctgcctcctgggtt

SEQ ID NO: 160839 - DNA, 20 bp, Artificial
  CRISPR gRNA sequence
tgcctcctgggttcaagcga

SEQ ID NO: 160840 - DNA, 20 bp, Artificial
  CRISPR gRNA sequence
cctcctgggttcaagcgatt

SEQ ID NO: 160841 - DNA, 20 bp, Artificial
  CRISPR gRNA sequence
ctgggttcaagcgattctcc

SEQ ID NO: 160842 - DNA, 20 bp, Artificial
  CRISPR gRNA sequence
ggttcaagcgattctcctgc

SEQ ID NO: 160843 - DNA, 20 bp, Artificial
  CRISPR gRNA sequence
aagcgattctcctgcctcag

SEQ ID NO: 160844 - DNA, 20 bp, Artificial
  CRISPR gRNA sequence
tcctgcctcagcctcctgag

SEQ ID NO: 160845 - DNA, 20 bp, Artificial
  CRISPR gRNA sequence
ctgcctcagcctcctgagta

SEQ ID NO: 160846 - DNA, 20 bp, Artificial
  CRISPR gRNA sequence
cctcagcctcctgagtaact

SEQ ID NO: 160847 - DNA, 20 bp, Artificial
  CRISPR gRNA sequence
agcctcctgagtaactggga

SEQ ID NO: 160848 - DNA, 20 bp, Artificial
  CRISPR gRNA sequence
ctgagtaactgggattacaa

SEQ ID NO: 160849 - DNA, 20 bp, Artificial
  CRISPR gRNA sequence
agtaactgggattacaagcg

SEQ ID NO: 160850 - DNA, 20 bp, Artificial
  CRISPR gRNA sequence
ggattacaagcgtctgccgc

SEQ ID NO: 160851 - DNA, 20 bp, Artificial
  CRISPR gRNA sequence
caagcgtctgccgccacgcc

SEQ ID NO: 160852 - DNA, 20 bp, Artificial
  CRISPR gRNA sequence
ccgccacgcccggctaattt

SEQ ID NO: 160853 - DNA, 20 bp, Artificial
  CRISPR gRNA sequence
atttttgtatttttagtaga

SEQ ID NO: 160854 - DNA, 20 bp, Artificial
  CRISPR gRNA sequence
ttgtatttttagtagagatg

SEQ ID NO: 160855 - DNA, 20 bp, Artificial
  CRISPR gRNA sequence
tgtatttttagtagagatgg

SEQ ID NO: 160856 - DNA, 20 bp, Artificial
  CRISPR gRNA sequence
gtatttttagtagagatggg

SEQ ID NO: 160857 - DNA, 20 bp, Artificial
  CRISPR gRNA sequence
tatttttagtagagatgggg

SEQ ID NO: 160858 - DNA, 20 bp, Artificial
  CRISPR gRNA sequence
ttagtagagatggggtttca

SEQ ID NO: 160859 - DNA, 20 bp, Artificial
  CRISPR gRNA sequence
tagtagagatggggtttcac

SEQ ID NO: 160860 - DNA, 20 bp, Artificial
  CRISPR gRNA sequence
agtagagatggggtttcacc

SEQ ID NO: 160861 - DNA, 20 bp, Artificial
  CRISPR gRNA sequence
gtagagatggggtttcacca

SEQ ID NO: 160862 - DNA, 20 bp, Artificial
  CRISPR gRNA sequence
caccatgttgcccaggctgg

SEQ ID NO: 160863 - DNA, 20 bp, Artificial
  CRISPR gRNA sequence
accatgttgcccaggctggt

SEQ ID NO: 160864 - DNA, 20 bp, Artificial
  CRISPR gRNA sequence
cccaggctggtctcgaactt

SEQ ID NO: 160865 - DNA, 20 bp, Artificial
  CRISPR gRNA sequence
gtctcgaacttttgacctca

SEQ ID NO: 160866 - DNA, 20 bp, Artificial
  CRISPR gRNA sequence
gaacttttgacctcaggtga

SEQ ID NO: 160867 - DNA, 20 bp, Artificial
  CRISPR gRNA sequence
ttgacctcaggtgatccacc

SEQ ID NO: 160868 - DNA, 20 bp, Artificial
  CRISPR gRNA sequence
tgacctcaggtgatccacct

SEQ ID NO: 160869 - DNA, 20 bp, Artificial
  CRISPR gRNA sequence
gacctcaggtgatccacctg

SEQ ID NO: 160870 - DNA, 20 bp, Artificial
  CRISPR gRNA sequence
acctcaggtgatccacctgc

SEQ ID NO: 160871 - DNA, 20 bp, Artificial
  CRISPR gRNA sequence
aggtgatccacctgcctcgg

SEQ ID NO: 160872 - DNA, 20 bp, Artificial
  CRISPR gRNA sequence
cctcggcttcccagagtgtt

SEQ ID NO: 160873 - DNA, 20 bp, Artificial
  CRISPR gRNA sequence
ggcttcccagagtgtttgga

SEQ ID NO: 160874 - DNA, 20 bp, Artificial
  CRISPR gRNA sequence
cccagagtgtttggattaca

SEQ ID NO: 160875 - DNA, 20 bp, Artificial
  CRISPR gRNA sequence
ccagagtgtttggattacag

SEQ ID NO: 160876 - DNA, 20 bp, Artificial
  CRISPR gRNA sequence
ggattacaggcatgagccac

SEQ ID NO: 160877 - DNA, 20 bp, Artificial
  CRISPR gRNA sequence
gattacaggcatgagccacc

SEQ ID NO: 160878 - DNA, 20 bp, Artificial
  CRISPR gRNA sequence
caggcatgagccaccgcacc

SEQ ID NO: 160879 - DNA, 20 bp, Artificial
  CRISPR gRNA sequence
gcctctccttcgttttttta

SEQ ID NO: 160880 - DNA, 20 bp, Artificial
  CRISPR gRNA sequence
tccttcgtttttttaactgt

SEQ ID NO: 160881 - DNA, 20 bp, Artificial
  CRISPR gRNA sequence
cttcgtttttttaactgtct

SEQ ID NO: 160882 - DNA, 20 bp, Artificial
  CRISPR gRNA sequence
cgtttttttaactgtcttta

SEQ ID NO: 160883 - DNA, 20 bp, Artificial
  CRISPR gRNA sequence
gtttttttaactgtctttaa

SEQ ID NO: 160884 - DNA, 20 bp, Artificial
  CRISPR gRNA sequence
ttttaactgtctttaaggct

SEQ ID NO: 160885 - DNA, 20 bp, Artificial
  CRISPR gRNA sequence
tttaactgtctttaaggctt

SEQ ID NO: 160886 - DNA, 20 bp, Artificial
  CRISPR gRNA sequence
ttaactgtctttaaggcttc

SEQ ID NO: 160887 - DNA, 20 bp, Artificial
  CRISPR gRNA sequence
taactgtctttaaggcttcc

SEQ ID NO: 160888 - DNA, 20 bp, Artificial
  CRISPR gRNA sequence
aactgtctttaaggcttcca

SEQ ID NO: 160889 - DNA, 20 bp, Artificial
  CRISPR gRNA sequence
actgtctttaaggcttccag

SEQ ID NO: 160890 - DNA, 20 bp, Artificial
  CRISPR gRNA sequence
tctttaaggcttccagttgc

SEQ ID NO: 160891 - DNA, 20 bp, Artificial
  CRISPR gRNA sequence
taaggcttccagttgccagt

SEQ ID NO: 160892 - DNA, 20 bp, Artificial
  CRISPR gRNA sequence
aaggcttccagttgccagtg

SEQ ID NO: 160893 - DNA, 20 bp, Artificial
  CRISPR gRNA sequence
aggcttccagttgccagtgt

SEQ ID NO: 160894 - DNA, 20 bp, Artificial
  CRISPR gRNA sequence
ccagttgccagtgtgctgtg

SEQ ID NO: 160895 - DNA, 20 bp, Artificial
  CRISPR gRNA sequence
cagttgccagtgtgctgtgt

SEQ ID NO: 160896 - DNA, 20 bp, Artificial
  CRISPR gRNA sequence
ccagtgtgctgtgttaggct

SEQ ID NO: 160897 - DNA, 20 bp, Artificial
  CRISPR gRNA sequence
tgttaggcttgtgtttaata

SEQ ID NO: 160898 - DNA, 20 bp, Artificial
  CRISPR gRNA sequence
ggcttgtgtttaataacatg

SEQ ID NO: 160899 - DNA, 20 bp, Artificial
  CRISPR gRNA sequence
gtgtttaataacatggttaa

SEQ ID NO: 160900 - DNA, 20 bp, Artificial
  CRISPR gRNA sequence
tgtttaataacatggttaag

SEQ ID NO: 160901 - DNA, 20 bp, Artificial
  CRISPR gRNA sequence
aataacatggttaaggttag

SEQ ID NO: 160902 - DNA, 20 bp, Artificial
  CRISPR gRNA sequence
ataacatggttaaggttagg

SEQ ID NO: 160903 - DNA, 20 bp, Artificial
  CRISPR gRNA sequence
aggttaggaaagaactgggc

SEQ ID NO: 160904 - DNA, 20 bp, Artificial
  CRISPR gRNA sequence
ggaaagaactgggcgaactg

SEQ ID NO: 160905 - DNA, 20 bp, Artificial
  CRISPR gRNA sequence
ggcgaactggcaagtagttt

SEQ ID NO: 160906 - DNA, 20 bp, Artificial
  CRISPR gRNA sequence
gcaagtagtttcatttcagg

SEQ ID NO: 160907 - DNA, 20 bp, Artificial
  CRISPR gRNA sequence
catttcaggggcttcatgtt

SEQ ID NO: 160908 - DNA, 20 bp, Artificial
  CRISPR gRNA sequence
atttcaggggcttcatgtta

SEQ ID NO: 160909 - DNA, 20 bp, Artificial
  CRISPR gRNA sequence
caggggcttcatgttaccta

SEQ ID NO: 160910 - DNA, 20 bp, Artificial
  CRISPR gRNA sequence
aggggcttcatgttacctac

SEQ ID NO: 160911 - DNA, 20 bp, Artificial
  CRISPR gRNA sequence
catgttacctacacagttaa

SEQ ID NO: 160912 - DNA, 20 bp, Artificial
  CRISPR gRNA sequence
atgttacctacacagttaat

SEQ ID NO: 160913 - DNA, 20 bp, Artificial
  CRISPR gRNA sequence
cctacacagttaatggcctc

SEQ ID NO: 160914 - DNA, 20 bp, Artificial
  CRISPR gRNA sequence
cacagttaatggcctcatgt

SEQ ID NO: 160915 - DNA, 20 bp, Artificial
  CRISPR gRNA sequence
atggcctcatgtcctttgag

SEQ ID NO: 160916 - DNA, 20 bp, Artificial
  CRISPR gRNA sequence
atgtcctttgagacagattt

SEQ ID NO: 160917 - DNA, 20 bp, Artificial
  CRISPR gRNA sequence
tgagacagatttgtctgaga

SEQ ID NO: 160918 - DNA, 20 bp, Artificial
  CRISPR gRNA sequence
gagacagatttgtctgagat

SEQ ID NO: 160919 - DNA, 20 bp, Artificial
  CRISPR gRNA sequence
agacagatttgtctgagatt

SEQ ID NO: 160920 - DNA, 20 bp, Artificial
  CRISPR gRNA sequence
gtctgagattagaaggaata

SEQ ID NO: 160921 - DNA, 20 bp, Artificial
  CRISPR gRNA sequence
tctgagattagaaggaataa

SEQ ID NO: 160922 - DNA, 20 bp, Artificial
  CRISPR gRNA sequence
agattagaaggaataatcat

SEQ ID NO: 160923 - DNA, 20 bp, Artificial
  CRISPR gRNA sequence
gaaggaataatcatcatcag

SEQ ID NO: 160924 - DNA, 20 bp, Artificial
  CRISPR gRNA sequence
aaacaaaagaagaaacttag

SEQ ID NO: 160925 - DNA, 20 bp, Artificial
  CRISPR gRNA sequence
agcgtgctctctctcttttt

SEQ ID NO: 160926 - DNA, 20 bp, Artificial
  CRISPR gRNA sequence
gcgtgctctctctctttttt

SEQ ID NO: 160927 - DNA, 20 bp, Artificial
  CRISPR gRNA sequence
tctctctttttttttttttt

SEQ ID NO: 160928 - DNA, 20 bp, Artificial
  CRISPR gRNA sequence
tctctttttttttttttttt

SEQ ID NO: 160929 - DNA, 20 bp, Artificial
  CRISPR gRNA sequence
tctttttttttttttttttt

SEQ ID NO: 160930 - DNA, 20 bp, Artificial
  CRISPR gRNA sequence
tttttttttttttttttttg

SEQ ID NO: 160931 - DNA, 20 bp, Artificial
  CRISPR gRNA sequence
tttttttttttttttttgag

SEQ ID NO: 160932 - DNA, 20 bp, Artificial
  CRISPR gRNA sequence
ttttttttttttttttgaga

SEQ ID NO: 160933 - DNA, 20 bp, Artificial
  CRISPR gRNA sequence
tttttttttttttttgagac

SEQ ID NO: 160934 - DNA, 20 bp, Artificial
  CRISPR gRNA sequence
ttttttttttttttgagacg

SEQ ID NO: 160935 - DNA, 20 bp, Artificial
  CRISPR gRNA sequence
tttttttttttttgagacgg

SEQ ID NO: 160936 - DNA, 20 bp, Artificial
  CRISPR gRNA sequence
ttttttttttttgagacgga

SEQ ID NO: 160937 - DNA, 20 bp, Artificial
  CRISPR gRNA sequence
tttttttttttgagacggag

SEQ ID NO: 160938 - DNA, 20 bp, Artificial
  CRISPR gRNA sequence
ttttttttttgagacggagt

SEQ ID NO: 160939 - DNA, 20 bp, Artificial
  CRISPR gRNA sequence
tttttttttgagacggagtc

SEQ ID NO: 160940 - DNA, 20 bp, Artificial
  CRISPR gRNA sequence
ttttttttgagacggagtct

SEQ ID NO: 160941 - DNA, 20 bp, Artificial
  CRISPR gRNA sequence
tttttttgagacggagtctc

SEQ ID NO: 160942 - DNA, 20 bp, Artificial
  CRISPR gRNA sequence
ttttttgagacggagtctcg

SEQ ID NO: 160943 - DNA, 20 bp, Artificial
  CRISPR gRNA sequence
tttttgagacggagtctcgc

SEQ ID NO: 160944 - DNA, 20 bp, Artificial
  CRISPR gRNA sequence
ttttgagacggagtctcgct

SEQ ID NO: 160945 - DNA, 20 bp, Artificial
  CRISPR gRNA sequence
tttgagacggagtctcgctc

SEQ ID NO: 160946 - DNA, 20 bp, Artificial
  CRISPR gRNA sequence
ttgagacggagtctcgctct

SEQ ID NO: 160947 - DNA, 20 bp, Artificial
  CRISPR gRNA sequence
tgagacggagtctcgctctg

SEQ ID NO: 160948 - DNA, 20 bp, Artificial
  CRISPR gRNA sequence
gagacggagtctcgctctgt

SEQ ID NO: 160949 - DNA, 20 bp, Artificial
  CRISPR gRNA sequence
agacggagtctcgctctgtc

SEQ ID NO: 160950 - DNA, 20 bp, Artificial
  CRISPR gRNA sequence
gctctgtcgcccaggctgga

SEQ ID NO: 160951 - DNA, 20 bp, Artificial
  CRISPR gRNA sequence
tgtcgcccaggctggagtgc

SEQ ID NO: 160952 - DNA, 20 bp, Artificial
  CRISPR gRNA sequence
tcgcccaggctggagtgcag

SEQ ID NO: 160953 - DNA, 20 bp, Artificial
  CRISPR gRNA sequence
gagtgcagtggcgggatctc

SEQ ID NO: 160954 - DNA, 20 bp, Artificial
  CRISPR gRNA sequence
ggctcactgcaagctccgcc

SEQ ID NO: 160955 - DNA, 20 bp, Artificial
  CRISPR gRNA sequence
actgcaagctccgcctcccg

SEQ ID NO: 160956 - DNA, 20 bp, Artificial
  CRISPR gRNA sequence
caagctccgcctcccgggtt

SEQ ID NO: 160957 - DNA, 20 bp, Artificial
  CRISPR gRNA sequence
cgcctcccgggttcacgcca

SEQ ID NO: 160958 - DNA, 20 bp, Artificial
  CRISPR gRNA sequence
ccgggttcacgccattctcc

SEQ ID NO: 160959 - DNA, 20 bp, Artificial
  CRISPR gRNA sequence
acgccattctcctgcctcag

SEQ ID NO: 160960 - DNA, 20 bp, Artificial
  CRISPR gRNA sequence
tcctgcctcagcctcccaag

SEQ ID NO: 160961 - DNA, 20 bp, Artificial
  CRISPR gRNA sequence
ctgcctcagcctcccaagta

SEQ ID NO: 160962 - DNA, 20 bp, Artificial
  CRISPR gRNA sequence
cctcagcctcccaagtagct

SEQ ID NO: 160963 - DNA, 20 bp, Artificial
  CRISPR gRNA sequence
agcctcccaagtagctggga

SEQ ID NO: 160964 - DNA, 20 bp, Artificial
  CRISPR gRNA sequence
ccaagtagctgggactacag

SEQ ID NO: 160965 - DNA, 20 bp, Artificial
  CRISPR gRNA sequence
ggactacaggcgcccgccac

SEQ ID NO: 160966 - DNA, 20 bp, Artificial
  CRISPR gRNA sequence
caggcgcccgccactacgcc

SEQ ID NO: 160967 - DNA, 20 bp, Artificial
  CRISPR gRNA sequence
cgcccggctaattttttgta

SEQ ID NO: 160968 - DNA, 20 bp, Artificial
  CRISPR gRNA sequence
attttttgtatttttagtag

SEQ ID NO: 160969 - DNA, 20 bp, Artificial
  CRISPR gRNA sequence
tttgtatttttagtagagac

SEQ ID NO: 160970 - DNA, 20 bp, Artificial
  CRISPR gRNA sequence
ttgtatttttagtagagacg

SEQ ID NO: 160971 - DNA, 20 bp, Artificial
  CRISPR gRNA sequence
tgtatttttagtagagacgg

SEQ ID NO: 160972 - DNA, 20 bp, Artificial
  CRISPR gRNA sequence
gtatttttagtagagacggg

SEQ ID NO: 160973 - DNA, 20 bp, Artificial
  CRISPR gRNA sequence
tatttttagtagagacgggg

SEQ ID NO: 160974 - DNA, 20 bp, Artificial
  CRISPR gRNA sequence
ttagtagagacggggtttca

SEQ ID NO: 160975 - DNA, 20 bp, Artificial
  CRISPR gRNA sequence
tagtagagacggggtttcac

SEQ ID NO: 160976 - DNA, 20 bp, Artificial
  CRISPR gRNA sequence
agtagagacggggtttcact

SEQ ID NO: 160977 - DNA, 20 bp, Artificial
  CRISPR gRNA sequence
gtagagacggggtttcactg

SEQ ID NO: 160978 - DNA, 20 bp, Artificial
  CRISPR gRNA sequence
cactgttttagccaggatgg

SEQ ID NO: 160979 - DNA, 20 bp, Artificial
  CRISPR gRNA sequence
actgttttagccaggatggt

SEQ ID NO: 160980 - DNA, 20 bp, Artificial
  CRISPR gRNA sequence
ttttagccaggatggtctcg

SEQ ID NO: 160981 - DNA, 20 bp, Artificial
  CRISPR gRNA sequence
tagccaggatggtctcgatc

SEQ ID NO: 160982 - DNA, 20 bp, Artificial
  CRISPR gRNA sequence
agccaggatggtctcgatct

SEQ ID NO: 160983 - DNA, 20 bp, Artificial
  CRISPR gRNA sequence
gccaggatggtctcgatctc

SEQ ID NO: 160984 - DNA, 20 bp, Artificial
  CRISPR gRNA sequence
gatctcctgaccttgtgatc

SEQ ID NO: 160985 - DNA, 20 bp, Artificial
  CRISPR gRNA sequence
ctgaccttgtgatccgcccg

SEQ ID NO: 160986 - DNA, 20 bp, Artificial
  CRISPR gRNA sequence
accttgtgatccgcccgcct

SEQ ID NO: 160987 - DNA, 20 bp, Artificial
  CRISPR gRNA sequence
gtgatccgcccgcctcggcc

SEQ ID NO: 160988 - DNA, 20 bp, Artificial
  CRISPR gRNA sequence
tgatccgcccgcctcggcct

SEQ ID NO: 160989 - DNA, 20 bp, Artificial
  CRISPR gRNA sequence
ggcctcccaaagtgctggga

SEQ ID NO: 160990 - DNA, 20 bp, Artificial
  CRISPR gRNA sequence
ccaaagtgctgggattacag

SEQ ID NO: 160991 - DNA, 20 bp, Artificial
  CRISPR gRNA sequence
ggattacaggcgtgagccac

SEQ ID NO: 160992 - DNA, 20 bp, Artificial
  CRISPR gRNA sequence
caggcgtgagccaccgcgcc

SEQ ID NO: 160993 - DNA, 20 bp, Artificial
  CRISPR gRNA sequence
tctctttttttaagagacag

SEQ ID NO: 160994 - DNA, 20 bp, Artificial
  CRISPR gRNA sequence
tctttttttaagagacagac

SEQ ID NO: 160995 - DNA, 20 bp, Artificial
  CRISPR gRNA sequence
tttttttaagagacagacgc

SEQ ID NO: 160996 - DNA, 20 bp, Artificial
  CRISPR gRNA sequence
tttttaagagacagacgctt

SEQ ID NO: 160997 - DNA, 20 bp, Artificial
  CRISPR gRNA sequence
ttttaagagacagacgcttg

SEQ ID NO: 160998 - DNA, 20 bp, Artificial
  CRISPR gRNA sequence
tttaagagacagacgcttgc

SEQ ID NO: 160999 - DNA, 20 bp, Artificial
  CRISPR gRNA sequence
ttaagagacagacgcttgct

SEQ ID NO: 161000 - DNA, 20 bp, Artificial
  CRISPR gRNA sequence
taagagacagacgcttgcta

SEQ ID NO: 161001 - DNA, 20 bp, Artificial
  CRISPR gRNA sequence
aagagacagacgcttgctat

SEQ ID NO: 161002 - DNA, 20 bp, Artificial
  CRISPR gRNA sequence
agagacagacgcttgctatg

SEQ ID NO: 161003 - DNA, 20 bp, Artificial
  CRISPR gRNA sequence
gctatgttgcccaggctgtc

SEQ ID NO: 161004 - DNA, 20 bp, Artificial
  CRISPR gRNA sequence
ctatgttgcccaggctgtct

SEQ ID NO: 161005 - DNA, 20 bp, Artificial
  CRISPR gRNA sequence
tgttgcccaggctgtcttga

SEQ ID NO: 161006 - DNA, 20 bp, Artificial
  CRISPR gRNA sequence
cccaggctgtcttgaactct

SEQ ID NO: 161007 - DNA, 20 bp, Artificial
  CRISPR gRNA sequence
tcttgaactcttgggcccaa

SEQ ID NO: 161008 - DNA, 20 bp, Artificial
  CRISPR gRNA sequence
gaactcttgggcccaagtga

SEQ ID NO: 161009 - DNA, 20 bp, Artificial
  CRISPR gRNA sequence
aactcttgggcccaagtgat

SEQ ID NO: 161010 - DNA, 20 bp, Artificial
  CRISPR gRNA sequence
ttgggcccaagtgatcctcc

SEQ ID NO: 161011 - DNA, 20 bp, Artificial
  CRISPR gRNA sequence
gggcccaagtgatcctcctg

SEQ ID NO: 161012 - DNA, 20 bp, Artificial
  CRISPR gRNA sequence
ggcccaagtgatcctcctgg

SEQ ID NO: 161013 - DNA, 20 bp, Artificial
  CRISPR gRNA sequence
ctggctcaccttcctgagta

SEQ ID NO: 161014 - DNA, 20 bp, Artificial
  CRISPR gRNA sequence
gctcaccttcctgagtagct

SEQ ID NO: 161015 - DNA, 20 bp, Artificial
  CRISPR gRNA sequence
accttcctgagtagctggaa

SEQ ID NO: 161016 - DNA, 20 bp, Artificial
  CRISPR gRNA sequence
cctgagtagctggaaccaca

SEQ ID NO: 161017 - DNA, 20 bp, Artificial
  CRISPR gRNA sequence
ctgagtagctggaaccacag

SEQ ID NO: 161018 - DNA, 20 bp, Artificial
  CRISPR gRNA sequence
agtagctggaaccacaggca

SEQ ID NO: 161019 - DNA, 20 bp, Artificial
  CRISPR gRNA sequence
gaaccacaggcatgcacctt

SEQ ID NO: 161020 - DNA, 20 bp, Artificial
  CRISPR gRNA sequence
tgtgcccagcttggctttta

SEQ ID NO: 161021 - DNA, 20 bp, Artificial
  CRISPR gRNA sequence
gtgcccagcttggcttttat

SEQ ID NO: 161022 - DNA, 20 bp, Artificial
  CRISPR gRNA sequence
tgcccagcttggcttttatc

SEQ ID NO: 161023 - DNA, 20 bp, Artificial
  CRISPR gRNA sequence
ggcttttatcttttaagact

SEQ ID NO: 161024 - DNA, 20 bp, Artificial
  CRISPR gRNA sequence
gcttttatcttttaagactg

SEQ ID NO: 161025 - DNA, 20 bp, Artificial
  CRISPR gRNA sequence
ttatcttttaagactgggtt

SEQ ID NO: 161026 - DNA, 20 bp, Artificial
  CRISPR gRNA sequence
tatcttttaagactgggttt

SEQ ID NO: 161027 - DNA, 20 bp, Artificial
  CRISPR gRNA sequence
atcttttaagactgggttta

SEQ ID NO: 161028 - DNA, 20 bp, Artificial
  CRISPR gRNA sequence
tcttttaagactgggtttac

SEQ ID NO: 161029 - DNA, 20 bp, Artificial
  CRISPR gRNA sequence
ttaagactgggtttacattt

SEQ ID NO: 161030 - DNA, 20 bp, Artificial
  CRISPR gRNA sequence
taagactgggtttacatttc

SEQ ID NO: 161031 - DNA, 20 bp, Artificial
  CRISPR gRNA sequence
aagactgggtttacatttct

SEQ ID NO: 161032 - DNA, 20 bp, Artificial
  CRISPR gRNA sequence
agactgggtttacatttctg

SEQ ID NO: 161033 - DNA, 20 bp, Artificial
  CRISPR gRNA sequence
ggtttacatttctgtacagt

SEQ ID NO: 161034 - DNA, 20 bp, Artificial
  CRISPR gRNA sequence
acatttctgtacagtactaa

SEQ ID NO: 161035 - DNA, 20 bp, Artificial
  CRISPR gRNA sequence
catttctgtacagtactaat

SEQ ID NO: 161036 - DNA, 20 bp, Artificial
  CRISPR gRNA sequence
ctgtacagtactaatcactg

SEQ ID NO: 161037 - DNA, 20 bp, Artificial
  CRISPR gRNA sequence
tgtacagtactaatcactgg

SEQ ID NO: 161038 - DNA, 20 bp, Artificial
  CRISPR gRNA sequence
tacagtactaatcactgggg

SEQ ID NO: 161039 - DNA, 20 bp, Artificial
  CRISPR gRNA sequence
atcactggggacttttaata

SEQ ID NO: 161040 - DNA, 20 bp, Artificial
  CRISPR gRNA sequence
gggacttttaatataagaat

SEQ ID NO: 161041 - DNA, 20 bp, Artificial
  CRISPR gRNA sequence
ttaatataagaatttgctga

SEQ ID NO: 161042 - DNA, 20 bp, Artificial
  CRISPR gRNA sequence
taatataagaatttgctgaa

SEQ ID NO: 161043 - DNA, 20 bp, Artificial
  CRISPR gRNA sequence
aatataagaatttgctgaag

SEQ ID NO: 161044 - DNA, 20 bp, Artificial
  CRISPR gRNA sequence
atataagaatttgctgaagg

SEQ ID NO: 161045 - DNA, 20 bp, Artificial
  CRISPR gRNA sequence
gctgaaggctgtggcatgga

SEQ ID NO: 161046 - DNA, 20 bp, Artificial
  CRISPR gRNA sequence
ctgaaggctgtggcatggag

SEQ ID NO: 161047 - DNA, 20 bp, Artificial
  CRISPR gRNA sequence
aaggctgtggcatggaggat

SEQ ID NO: 161048 - DNA, 20 bp, Artificial
  CRISPR gRNA sequence
tggcatggaggatgagaagc

SEQ ID NO: 161049 - DNA, 20 bp, Artificial
  CRISPR gRNA sequence
gaaaaagctttggaaagaat

SEQ ID NO: 161050 - DNA, 20 bp, Artificial
  CRISPR gRNA sequence
aaaaagctttggaaagaatg

SEQ ID NO: 161051 - DNA, 20 bp, Artificial
  CRISPR gRNA sequence
tggaaagaatggcattgaaa

SEQ ID NO: 161052 - DNA, 20 bp, Artificial
  CRISPR gRNA sequence
ggaaagaatggcattgaaaa

SEQ ID NO: 161053 - DNA, 20 bp, Artificial
  CRISPR gRNA sequence
gaaagaatggcattgaaaat

SEQ ID NO: 161054 - DNA, 20 bp, Artificial
  CRISPR gRNA sequence
aaaattatgggctagactag

SEQ ID NO: 161055 - DNA, 20 bp, Artificial
  CRISPR gRNA sequence
tgggctagactagggcaaca

SEQ ID NO: 161056 - DNA, 20 bp, Artificial
  CRISPR gRNA sequence
gactagggcaacaaagtact

SEQ ID NO: 161057 - DNA, 20 bp, Artificial
  CRISPR gRNA sequence
gggcaacaaagtactttcct

SEQ ID NO: 161058 - DNA, 20 bp, Artificial
  CRISPR gRNA sequence
tcctcaccccacacccatat

SEQ ID NO: 161059 - DNA, 20 bp, Artificial
  CRISPR gRNA sequence
cctcaccccacacccatata

SEQ ID NO: 161060 - DNA, 20 bp, Artificial
  CRISPR gRNA sequence
ctcaccccacacccatataa

SEQ ID NO: 161061 - DNA, 20 bp, Artificial
  CRISPR gRNA sequence
accccacacccatataagaa

SEQ ID NO: 161062 - DNA, 20 bp, Artificial
  CRISPR gRNA sequence
aaagtccttgattaacatta

SEQ ID NO: 161063 - DNA, 20 bp, Artificial
  CRISPR gRNA sequence
gattaacattaggatttcag

SEQ ID NO: 161064 - DNA, 20 bp, Artificial
  CRISPR gRNA sequence
attaacattaggatttcagc

SEQ ID NO: 161065 - DNA, 20 bp, Artificial
  CRISPR gRNA sequence
acattaggatttcagcttac

SEQ ID NO: 161066 - DNA, 20 bp, Artificial
  CRISPR gRNA sequence
ggatttcagcttacatttct

SEQ ID NO: 161067 - DNA, 20 bp, Artificial
  CRISPR gRNA sequence
cagcttacatttctagcaac

SEQ ID NO: 161068 - DNA, 20 bp, Artificial
  CRISPR gRNA sequence
agcttacatttctagcaact

SEQ ID NO: 161069 - DNA, 20 bp, Artificial
  CRISPR gRNA sequence
acatttctagcaacttttga

SEQ ID NO: 161070 - DNA, 20 bp, Artificial
  CRISPR gRNA sequence
catttctagcaacttttgat

SEQ ID NO: 161071 - DNA, 20 bp, Artificial
  CRISPR gRNA sequence
ctagcaacttttgatattct

SEQ ID NO: 161072 - DNA, 20 bp, Artificial
  CRISPR gRNA sequence
tagcaacttttgatattcta

SEQ ID NO: 161073 - DNA, 20 bp, Artificial
  CRISPR gRNA sequence
gcaacttttgatattctagt

SEQ ID NO: 161074 - DNA, 20 bp, Artificial
  CRISPR gRNA sequence
ttgatattctagttggaggt

SEQ ID NO: 161075 - DNA, 20 bp, Artificial
  CRISPR gRNA sequence
tgatattctagttggaggtc

SEQ ID NO: 161076 - DNA, 20 bp, Artificial
  CRISPR gRNA sequence
gatattctagttggaggtct

SEQ ID NO: 161077 - DNA, 20 bp, Artificial
  CRISPR gRNA sequence
atattctagttggaggtctt

SEQ ID NO: 161078 - DNA, 20 bp, Artificial
  CRISPR gRNA sequence
tagttggaggtcttcagtag

SEQ ID NO: 161079 - DNA, 20 bp, Artificial
  CRISPR gRNA sequence
gttggaggtcttcagtagtc

SEQ ID NO: 161080 - DNA, 20 bp, Artificial
  CRISPR gRNA sequence
gaggtcttcagtagtctcta

SEQ ID NO: 161081 - DNA, 20 bp, Artificial
  CRISPR gRNA sequence
cagtagtctctatggtataa

SEQ ID NO: 161082 - DNA, 20 bp, Artificial
  CRISPR gRNA sequence
agtagtctctatggtataag

SEQ ID NO: 161083 - DNA, 20 bp, Artificial
  CRISPR gRNA sequence
tatggtataagctagataga

SEQ ID NO: 161084 - DNA, 20 bp, Artificial
  CRISPR gRNA sequence
tggtataagctagatagaag

SEQ ID NO: 161085 - DNA, 20 bp, Artificial
  CRISPR gRNA sequence
gatagaaggaaaaactttcc

SEQ ID NO: 161086 - DNA, 20 bp, Artificial
  CRISPR gRNA sequence
tcctaccaatgtttttaaga

SEQ ID NO: 161087 - DNA, 20 bp, Artificial
  CRISPR gRNA sequence
cctaccaatgtttttaagat

SEQ ID NO: 161088 - DNA, 20 bp, Artificial
  CRISPR gRNA sequence
ctaccaatgtttttaagatg

SEQ ID NO: 161089 - DNA, 20 bp, Artificial
  CRISPR gRNA sequence
ccaatgtttttaagatgtaa

SEQ ID NO: 161090 - DNA, 20 bp, Artificial
  CRISPR gRNA sequence
ttaagatgtaagtctgtgtt

SEQ ID NO: 161091 - DNA, 20 bp, Artificial
  CRISPR gRNA sequence
taagatgtaagtctgtgtta

SEQ ID NO: 161092 - DNA, 20 bp, Artificial
  CRISPR gRNA sequence
aagatgtaagtctgtgttaa

SEQ ID NO: 161093 - DNA, 20 bp, Artificial
  CRISPR gRNA sequence
agatgtaagtctgtgttaaa

SEQ ID NO: 161094 - DNA, 20 bp, Artificial
  CRISPR gRNA sequence
tgttaaaatctttttagcgt

SEQ ID NO: 161095 - DNA, 20 bp, Artificial
  CRISPR gRNA sequence
aaatctttttagcgtaatta

SEQ ID NO: 161096 - DNA, 20 bp, Artificial
  CRISPR gRNA sequence
tttagcgtaattatatacct

SEQ ID NO: 161097 - DNA, 20 bp, Artificial
  CRISPR gRNA sequence
ttagcgtaattatatacctt

SEQ ID NO: 161098 - DNA, 20 bp, Artificial
  CRISPR gRNA sequence
tagcgtaattatatacctta

SEQ ID NO: 161099 - DNA, 20 bp, Artificial
  CRISPR gRNA sequence
agcgtaattatataccttat

SEQ ID NO: 161100 - DNA, 20 bp, Artificial
  CRISPR gRNA sequence
gcgtaattatataccttatc

SEQ ID NO: 161101 - DNA, 20 bp, Artificial
  CRISPR gRNA sequence
tataccttatcaaactgaaa

SEQ ID NO: 161102 - DNA, 20 bp, Artificial
  CRISPR gRNA sequence
atcaaactgaaagattgaat

SEQ ID NO: 161103 - DNA, 20 bp, Artificial
  CRISPR gRNA sequence
tcaaactgaaagattgaata

SEQ ID NO: 161104 - DNA, 20 bp, Artificial
  CRISPR gRNA sequence
aaagattgaatagattcata

SEQ ID NO: 161105 - DNA, 20 bp, Artificial
  CRISPR gRNA sequence
aatagattcataaaaacatc

SEQ ID NO: 161106 - DNA, 20 bp, Artificial
  CRISPR gRNA sequence
ataaaaacatccacaaatat

SEQ ID NO: 161107 - DNA, 20 bp, Artificial
  CRISPR gRNA sequence
atctggacagaaagtctgac

SEQ ID NO: 161108 - DNA, 20 bp, Artificial
  CRISPR gRNA sequence
gacagaaagtctgactttat

SEQ ID NO: 161109 - DNA, 20 bp, Artificial
  CRISPR gRNA sequence
actttattgtttctaatgtg

SEQ ID NO: 161110 - DNA, 20 bp, Artificial
  CRISPR gRNA sequence
tattgtttctaatgtgtctt

SEQ ID NO: 161111 - DNA, 20 bp, Artificial
  CRISPR gRNA sequence
attgtttctaatgtgtctta

SEQ ID NO: 161112 - DNA, 20 bp, Artificial
  CRISPR gRNA sequence
ttgtttctaatgtgtcttat

SEQ ID NO: 161113 - DNA, 20 bp, Artificial
  CRISPR gRNA sequence
tttctaatgtgtcttatgta

SEQ ID NO: 161114 - DNA, 20 bp, Artificial
  CRISPR gRNA sequence
ctaatgtgtcttatgtatgt

SEQ ID NO: 161115 - DNA, 20 bp, Artificial
  CRISPR gRNA sequence
taatgtgtcttatgtatgtg

SEQ ID NO: 161116 - DNA, 20 bp, Artificial
  CRISPR gRNA sequence
atgtgtcttatgtatgtgtt

SEQ ID NO: 161117 - DNA, 20 bp, Artificial
  CRISPR gRNA sequence
atgtatgtgtttattttcag

SEQ ID NO: 161118 - DNA, 20 bp, Artificial
  CRISPR gRNA sequence
tgtatgtgtttattttcagt

SEQ ID NO: 161119 - DNA, 20 bp, Artificial
  CRISPR gRNA sequence
attttcagttgtcgagatgt

SEQ ID NO: 161120 - DNA, 20 bp, Artificial
  CRISPR gRNA sequence
ttttcagttgtcgagatgtc

SEQ ID NO: 161121 - DNA, 20 bp, Artificial
  CRISPR gRNA sequence
tcagttgtcgagatgtccac

SEQ ID NO: 161122 - DNA, 20 bp, Artificial
  CRISPR gRNA sequence
cagttgtcgagatgtccaca

SEQ ID NO: 161123 - DNA, 20 bp, Artificial
  CRISPR gRNA sequence
agttgtcgagatgtccacag

SEQ ID NO: 161124 - DNA, 20 bp, Artificial
  CRISPR gRNA sequence
tcgagatgtccacagaagga

SEQ ID NO: 161125 - DNA, 20 bp, Artificial
  CRISPR gRNA sequence
ggtggtactagcagcagtga

SEQ ID NO: 161126 - DNA, 20 bp, Artificial
  CRISPR gRNA sequence
gtggtactagcagcagtgat

SEQ ID NO: 161127 - DNA, 20 bp, Artificial
  CRISPR gRNA sequence
gcagcagtgatgcccagcaa

SEQ ID NO: 161128 - DNA, 20 bp, Artificial
  CRISPR gRNA sequence
cagtcgttctggcctcgggt

SEQ ID NO: 161129 - DNA, 20 bp, Artificial
  CRISPR gRNA sequence
tggcctcgggtcatggaaga

SEQ ID NO: 161130 - DNA, 20 bp, Artificial
  CRISPR gRNA sequence
gcctcgggtcatggaagaaa

SEQ ID NO: 161131 - DNA, 20 bp, Artificial
  CRISPR gRNA sequence
gggtcatggaagaaatccgg

SEQ ID NO: 161132 - DNA, 20 bp, Artificial
  CRISPR gRNA sequence
aacagtggtgaggaagaatg

SEQ ID NO: 161133 - DNA, 20 bp, Artificial
  CRISPR gRNA sequence
acagtggtgaggaagaatga

SEQ ID NO: 161134 - DNA, 20 bp, Artificial
  CRISPR gRNA sequence
ttattagaaacttttaaaga

SEQ ID NO: 161135 - DNA, 20 bp, Artificial
  CRISPR gRNA sequence
tattagaaacttttaaagag

SEQ ID NO: 161136 - DNA, 20 bp, Artificial
  CRISPR gRNA sequence
attagaaacttttaaagagt

SEQ ID NO: 161137 - DNA, 20 bp, Artificial
  CRISPR gRNA sequence
ttagaaacttttaaagagta

SEQ ID NO: 161138 - DNA, 20 bp, Artificial
  CRISPR gRNA sequence
gaaacttttaaagagtataa

SEQ ID NO: 161139 - DNA, 20 bp, Artificial
  CRISPR gRNA sequence
ttaaagagtataaagagctc

SEQ ID NO: 161140 - DNA, 20 bp, Artificial
  CRISPR gRNA sequence
taaagagtataaagagctct

SEQ ID NO: 161141 - DNA, 20 bp, Artificial
  CRISPR gRNA sequence
aaagagtataaagagctctg

SEQ ID NO: 161142 - DNA, 20 bp, Artificial
  CRISPR gRNA sequence
aagagtataaagagctctgg

SEQ ID NO: 161143 - DNA, 20 bp, Artificial
  CRISPR gRNA sequence
tgggaaattaaccaaaactc

SEQ ID NO: 161144 - DNA, 20 bp, Artificial
  CRISPR gRNA sequence
ggaaattaaccaaaactcag

SEQ ID NO: 161145 - DNA, 20 bp, Artificial
  CRISPR gRNA sequence
accaaaactcagactaaagc

SEQ ID NO: 161146 - DNA, 20 bp, Artificial
  CRISPR gRNA sequence
agactaaagcatttttaatt

SEQ ID NO: 161147 - DNA, 20 bp, Artificial
  CRISPR gRNA sequence
aagcatttttaatttcaagc

SEQ ID NO: 161148 - DNA, 20 bp, Artificial
  CRISPR gRNA sequence
ttaatttcaagcacatttac

SEQ ID NO: 161149 - DNA, 20 bp, Artificial
  CRISPR gRNA sequence
taatttcaagcacatttaca

SEQ ID NO: 161150 - DNA, 20 bp, Artificial
  CRISPR gRNA sequence
aatttcaagcacatttacag

SEQ ID NO: 161151 - DNA, 20 bp, Artificial
  CRISPR gRNA sequence
atttcaagcacatttacaga

SEQ ID NO: 161152 - DNA, 20 bp, Artificial
  CRISPR gRNA sequence
caagcacatttacagaggca

SEQ ID NO: 161153 - DNA, 20 bp, Artificial
  CRISPR gRNA sequence
aagcacatttacagaggcat

SEQ ID NO: 161154 - DNA, 20 bp, Artificial
  CRISPR gRNA sequence
acagaggcatggttcacccc

SEQ ID NO: 161155 - DNA, 20 bp, Artificial
  CRISPR gRNA sequence
cagaggcatggttcacccct

SEQ ID NO: 161156 - DNA, 20 bp, Artificial
  CRISPR gRNA sequence
acccctgacctgtgggtagg

SEQ ID NO: 161157 - DNA, 20 bp, Artificial
  CRISPR gRNA sequence
acctgtgggtaggaaaatga

SEQ ID NO: 161158 - DNA, 20 bp, Artificial
  CRISPR gRNA sequence
tgggtaggaaaatgaaaaca

SEQ ID NO: 161159 - DNA, 20 bp, Artificial
  CRISPR gRNA sequence
gccttccgtgaggtaactgc

SEQ ID NO: 161160 - DNA, 20 bp, Artificial
  CRISPR gRNA sequence
ccttccgtgaggtaactgca

SEQ ID NO: 161161 - DNA, 20 bp, Artificial
  CRISPR gRNA sequence
ccgtgaggtaactgcaagag

SEQ ID NO: 161162 - DNA, 20 bp, Artificial
  CRISPR gRNA sequence
cgtgaggtaactgcaagagt

SEQ ID NO: 161163 - DNA, 20 bp, Artificial
  CRISPR gRNA sequence
caagagtcttttatatctca

SEQ ID NO: 161164 - DNA, 20 bp, Artificial
  CRISPR gRNA sequence
ttatatctcagtgttcttcc

SEQ ID NO: 161165 - DNA, 20 bp, Artificial
  CRISPR gRNA sequence
tatatctcagtgttcttcca

SEQ ID NO: 161166 - DNA, 20 bp, Artificial
  CRISPR gRNA sequence
atatctcagtgttcttccat

SEQ ID NO: 161167 - DNA, 20 bp, Artificial
  CRISPR gRNA sequence
tatctcagtgttcttccata

SEQ ID NO: 161168 - DNA, 20 bp, Artificial
  CRISPR gRNA sequence
agtgttcttccataggcgtg

SEQ ID NO: 161169 - DNA, 20 bp, Artificial
  CRISPR gRNA sequence
ttccataggcgtgtggtgtg

SEQ ID NO: 161170 - DNA, 20 bp, Artificial
  CRISPR gRNA sequence
ccataggcgtgtggtgtgca

SEQ ID NO: 161171 - DNA, 20 bp, Artificial
  CRISPR gRNA sequence
cataggcgtgtggtgtgcag

SEQ ID NO: 161172 - DNA, 20 bp, Artificial
  CRISPR gRNA sequence
tgacttggaggtagtttaat

SEQ ID NO: 161173 - DNA, 20 bp, Artificial
  CRISPR gRNA sequence
gacttggaggtagtttaatg

SEQ ID NO: 161174 - DNA, 20 bp, Artificial
  CRISPR gRNA sequence
acttggaggtagtttaatgt

SEQ ID NO: 161175 - DNA, 20 bp, Artificial
  CRISPR gRNA sequence
ggaggtagtttaatgtgagg

SEQ ID NO: 161176 - DNA, 20 bp, Artificial
  CRISPR gRNA sequence
gaggtagtttaatgtgaggc

SEQ ID NO: 161177 - DNA, 20 bp, Artificial
  CRISPR gRNA sequence
aatgtgaggcatatccttta

SEQ ID NO: 161178 - DNA, 20 bp, Artificial
  CRISPR gRNA sequence
atgtgaggcatatcctttag

SEQ ID NO: 161179 - DNA, 20 bp, Artificial
  CRISPR gRNA sequence
taggacttacagaaaaacag

SEQ ID NO: 161180 - DNA, 20 bp, Artificial
  CRISPR gRNA sequence
aggacttacagaaaaacaga

SEQ ID NO: 161181 - DNA, 20 bp, Artificial
  CRISPR gRNA sequence
ggacttacagaaaaacagag

SEQ ID NO: 161182 - DNA, 20 bp, Artificial
  CRISPR gRNA sequence
acagaaaaacagagatctca

SEQ ID NO: 161183 - DNA, 20 bp, Artificial
  CRISPR gRNA sequence
cagaaaaacagagatctcat

SEQ ID NO: 161184 - DNA, 20 bp, Artificial
  CRISPR gRNA sequence
atcttccttcagtagctgta

SEQ ID NO: 161185 - DNA, 20 bp, Artificial
  CRISPR gRNA sequence
ccttcagtagctgtagctca

SEQ ID NO: 161186 - DNA, 20 bp, Artificial
  CRISPR gRNA sequence
cttcagtagctgtagctcaa

SEQ ID NO: 161187 - DNA, 20 bp, Artificial
  CRISPR gRNA sequence
cagtagctgtagctcaattt

SEQ ID NO: 161188 - DNA, 20 bp, Artificial
  CRISPR gRNA sequence
agtagctgtagctcaatttt

SEQ ID NO: 161189 - DNA, 20 bp, Artificial
  CRISPR gRNA sequence
tagctcaattttttaggcct

SEQ ID NO: 161190 - DNA, 20 bp, Artificial
  CRISPR gRNA sequence
aattttttaggcctgattta

SEQ ID NO: 161191 - DNA, 20 bp, Artificial
  CRISPR gRNA sequence
tttaggcctgatttagtggc

SEQ ID NO: 161192 - DNA, 20 bp, Artificial
  CRISPR gRNA sequence
ttaggcctgatttagtggcc

SEQ ID NO: 161193 - DNA, 20 bp, Artificial
  CRISPR gRNA sequence
taggcctgatttagtggccc

SEQ ID NO: 161194 - DNA, 20 bp, Artificial
  CRISPR gRNA sequence
aggcctgatttagtggccct

SEQ ID NO: 161195 - DNA, 20 bp, Artificial
  CRISPR gRNA sequence
ggcctgatttagtggcccta

SEQ ID NO: 161196 - DNA, 20 bp, Artificial
  CRISPR gRNA sequence
atttagtggccctacgacat

SEQ ID NO: 161197 - DNA, 20 bp, Artificial
  CRISPR gRNA sequence
agtggccctacgacatttct

SEQ ID NO: 161198 - DNA, 20 bp, Artificial
  CRISPR gRNA sequence
gtggccctacgacatttcta

SEQ ID NO: 161199 - DNA, 20 bp, Artificial
  CRISPR gRNA sequence
cgacatttctagaacttggt

SEQ ID NO: 161200 - DNA, 20 bp, Artificial
  CRISPR gRNA sequence
ctagaacttggtaaaaacta

SEQ ID NO: 161201 - DNA, 20 bp, Artificial
  CRISPR gRNA sequence
tagaacttggtaaaaactat

SEQ ID NO: 161202 - DNA, 20 bp, Artificial
  CRISPR gRNA sequence
gaacttggtaaaaactattg

SEQ ID NO: 161203 - DNA, 20 bp, Artificial
  CRISPR gRNA sequence
ggtaaaaactattgggcaat

SEQ ID NO: 161204 - DNA, 20 bp, Artificial
  CRISPR gRNA sequence
gtaaaaactattgggcaatt

SEQ ID NO: 161205 - DNA, 20 bp, Artificial
  CRISPR gRNA sequence
ttgggcaatttattcaacaa

SEQ ID NO: 161206 - DNA, 20 bp, Artificial
  CRISPR gRNA sequence
ggcaatttattcaacaacaa

SEQ ID NO: 161207 - DNA, 20 bp, Artificial
  CRISPR gRNA sequence
attcaacaacaaatctattg

SEQ ID NO: 161208 - DNA, 20 bp, Artificial
  CRISPR gRNA sequence
ttcaacaacaaatctattgt

SEQ ID NO: 161209 - DNA, 20 bp, Artificial
  CRISPR gRNA sequence
aacaacaaatctattgtgag

SEQ ID NO: 161210 - DNA, 20 bp, Artificial
  CRISPR gRNA sequence
ttgtgagtcaggaactcttt

SEQ ID NO: 161211 - DNA, 20 bp, Artificial
  CRISPR gRNA sequence
tgagtcaggaactctttcta

SEQ ID NO: 161212 - DNA, 20 bp, Artificial
  CRISPR gRNA sequence
tttctaggtgttaaaaagat

SEQ ID NO: 161213 - DNA, 20 bp, Artificial
  CRISPR gRNA sequence
tctaggtgttaaaaagatat

SEQ ID NO: 161214 - DNA, 20 bp, Artificial
  CRISPR gRNA sequence
ctaggtgttaaaaagatata

SEQ ID NO: 161215 - DNA, 20 bp, Artificial
  CRISPR gRNA sequence
taggtgttaaaaagatatac

SEQ ID NO: 161216 - DNA, 20 bp, Artificial
  CRISPR gRNA sequence
ggtgttaaaaagatatactt

SEQ ID NO: 161217 - DNA, 20 bp, Artificial
  CRISPR gRNA sequence
aaaagatatactttgatcgc

SEQ ID NO: 161218 - DNA, 20 bp, Artificial
  CRISPR gRNA sequence
tgatcgcagtttctcaacag

SEQ ID NO: 161219 - DNA, 20 bp, Artificial
  CRISPR gRNA sequence
gatcgcagtttctcaacagc

SEQ ID NO: 161220 - DNA, 20 bp, Artificial
  CRISPR gRNA sequence
atcgcagtttctcaacagct

SEQ ID NO: 161221 - DNA, 20 bp, Artificial
  CRISPR gRNA sequence
ctcaacagctgcattattga

SEQ ID NO: 161222 - DNA, 20 bp, Artificial
  CRISPR gRNA sequence
tcaacagctgcattattgac

SEQ ID NO: 161223 - DNA, 20 bp, Artificial
  CRISPR gRNA sequence
aacagctgcattattgacat

SEQ ID NO: 161224 - DNA, 20 bp, Artificial
  CRISPR gRNA sequence
cattattgacattttgggcc

SEQ ID NO: 161225 - DNA, 20 bp, Artificial
  CRISPR gRNA sequence
ttgacattttgggccagata

SEQ ID NO: 161226 - DNA, 20 bp, Artificial
  CRISPR gRNA sequence
acattttgggccagataatt

SEQ ID NO: 161227 - DNA, 20 bp, Artificial
  CRISPR gRNA sequence
tgggccagataattctttgt

SEQ ID NO: 161228 - DNA, 20 bp, Artificial
  CRISPR gRNA sequence
gggccagataattctttgtt

SEQ ID NO: 161229 - DNA, 20 bp, Artificial
  CRISPR gRNA sequence
ggccagataattctttgttg

SEQ ID NO: 161230 - DNA, 20 bp, Artificial
  CRISPR gRNA sequence
tttgttgtgaggggccgtct

SEQ ID NO: 161231 - DNA, 20 bp, Artificial
  CRISPR gRNA sequence
tgttgtgaggggccgtctta

SEQ ID NO: 161232 - DNA, 20 bp, Artificial
  CRISPR gRNA sequence
gttgtgaggggccgtcttat

SEQ ID NO: 161233 - DNA, 20 bp, Artificial
  CRISPR gRNA sequence
ttgtgaggggccgtcttatg

SEQ ID NO: 161234 - DNA, 20 bp, Artificial
  CRISPR gRNA sequence
tgaggggccgtcttatgcat

SEQ ID NO: 161235 - DNA, 20 bp, Artificial
  CRISPR gRNA sequence
atgcataacagcatgtttag

SEQ ID NO: 161236 - DNA, 20 bp, Artificial
  CRISPR gRNA sequence
tgcataacagcatgtttagc

SEQ ID NO: 161237 - DNA, 20 bp, Artificial
  CRISPR gRNA sequence
agcagcacccctagcctcta

SEQ ID NO: 161238 - DNA, 20 bp, Artificial
  CRISPR gRNA sequence
gcagcacccctagcctctac

SEQ ID NO: 161239 - DNA, 20 bp, Artificial
  CRISPR gRNA sequence
gcctctactcactagatgcc

SEQ ID NO: 161240 - DNA, 20 bp, Artificial
  CRISPR gRNA sequence
tactcactagatgccagtag

SEQ ID NO: 161241 - DNA, 20 bp, Artificial
  CRISPR gRNA sequence
ctcactagatgccagtagca

SEQ ID NO: 161242 - DNA, 20 bp, Artificial
  CRISPR gRNA sequence
actagatgccagtagcaccc

SEQ ID NO: 161243 - DNA, 20 bp, Artificial
  CRISPR gRNA sequence
gatgccagtagcacccctcc

SEQ ID NO: 161244 - DNA, 20 bp, Artificial
  CRISPR gRNA sequence
cccgagttgtgacaaccaga

SEQ ID NO: 161245 - DNA, 20 bp, Artificial
  CRISPR gRNA sequence
tgacaaccagaaaatgtctc

SEQ ID NO: 161246 - DNA, 20 bp, Artificial
  CRISPR gRNA sequence
cagacattggcaaatgtccc

SEQ ID NO: 161247 - DNA, 20 bp, Artificial
  CRISPR gRNA sequence
gcaaatgtccccatgggcaa

SEQ ID NO: 161248 - DNA, 20 bp, Artificial
  CRISPR gRNA sequence
gttgagaactactgactcag

SEQ ID NO: 161249 - DNA, 20 bp, Artificial
  CRISPR gRNA sequence
ttgagaactactgactcaga

SEQ ID NO: 161250 - DNA, 20 bp, Artificial
  CRISPR gRNA sequence
agaactactgactcagaata

SEQ ID NO: 161251 - DNA, 20 bp, Artificial
  CRISPR gRNA sequence
ctgactcagaataattaaat

SEQ ID NO: 161252 - DNA, 20 bp, Artificial
  CRISPR gRNA sequence
actcagaataattaaatata

SEQ ID NO: 161253 - DNA, 20 bp, Artificial
  CRISPR gRNA sequence
agaataattaaatataacct

SEQ ID NO: 161254 - DNA, 20 bp, Artificial
  CRISPR gRNA sequence
aatataacctcggcctgtga

SEQ ID NO: 161255 - DNA, 20 bp, Artificial
  CRISPR gRNA sequence
ggcctgtgaggagcttacaa

SEQ ID NO: 161256 - DNA, 20 bp, Artificial
  CRISPR gRNA sequence
tgaggagcttacaatctagt

SEQ ID NO: 161257 - DNA, 20 bp, Artificial
  CRISPR gRNA sequence
acaatctagtaattacaacc

SEQ ID NO: 161258 - DNA, 20 bp, Artificial
  CRISPR gRNA sequence
caatctagtaattacaacca

SEQ ID NO: 161259 - DNA, 20 bp, Artificial
  CRISPR gRNA sequence
gtaattacaaccagaataat

SEQ ID NO: 161260 - DNA, 20 bp, Artificial
  CRISPR gRNA sequence
caaccagaataatttagtca

SEQ ID NO: 161261 - DNA, 20 bp, Artificial
  CRISPR gRNA sequence
agtcagtaggtatttactaa

SEQ ID NO: 161262 - DNA, 20 bp, Artificial
  CRISPR gRNA sequence
gtcagtaggtatttactaag

SEQ ID NO: 161263 - DNA, 20 bp, Artificial
  CRISPR gRNA sequence
actaagtacttactgaatca

SEQ ID NO: 161264 - DNA, 20 bp, Artificial
  CRISPR gRNA sequence
ctaagtacttactgaatcag

SEQ ID NO: 161265 - DNA, 20 bp, Artificial
  CRISPR gRNA sequence
agtacttactgaatcaggca

SEQ ID NO: 161266 - DNA, 20 bp, Artificial
  CRISPR gRNA sequence
actgaatcaggcacagtgat

SEQ ID NO: 161267 - DNA, 20 bp, Artificial
  CRISPR gRNA sequence
ctgaatcaggcacagtgatg

SEQ ID NO: 161268 - DNA, 20 bp, Artificial
  CRISPR gRNA sequence
aatcaggcacagtgatgagt

SEQ ID NO: 161269 - DNA, 20 bp, Artificial
  CRISPR gRNA sequence
aagcagtaaaagtcaaggag

SEQ ID NO: 161270 - DNA, 20 bp, Artificial
  CRISPR gRNA sequence
gattctttctggttgagttt

SEQ ID NO: 161271 - DNA, 20 bp, Artificial
  CRISPR gRNA sequence
attctttctggttgagttta

SEQ ID NO: 161272 - DNA, 20 bp, Artificial
  CRISPR gRNA sequence
tttctggttgagtttaagta

SEQ ID NO: 161273 - DNA, 20 bp, Artificial
  CRISPR gRNA sequence
tctggttgagtttaagtaaa

SEQ ID NO: 161274 - DNA, 20 bp, Artificial
  CRISPR gRNA sequence
ctggttgagtttaagtaaag

SEQ ID NO: 161275 - DNA, 20 bp, Artificial
  CRISPR gRNA sequence
tggttgagtttaagtaaagg

SEQ ID NO: 161276 - DNA, 20 bp, Artificial
  CRISPR gRNA sequence
gttgagtttaagtaaaggga

SEQ ID NO: 161277 - DNA, 20 bp, Artificial
  CRISPR gRNA sequence
agtttaagtaaagggaacat

SEQ ID NO: 161278 - DNA, 20 bp, Artificial
  CRISPR gRNA sequence
aagtaaagggaacatttttg

SEQ ID NO: 161279 - DNA, 20 bp, Artificial
  CRISPR gRNA sequence
agtaaagggaacatttttgt

SEQ ID NO: 161280 - DNA, 20 bp, Artificial
  CRISPR gRNA sequence
ttgttgagtcttaaaatatg

SEQ ID NO: 161281 - DNA, 20 bp, Artificial
  CRISPR gRNA sequence
tgttgagtcttaaaatatga

SEQ ID NO: 161282 - DNA, 20 bp, Artificial
  CRISPR gRNA sequence
gttgagtcttaaaatatgag

SEQ ID NO: 161283 - DNA, 20 bp, Artificial
  CRISPR gRNA sequence
ttgagtcttaaaatatgagt

SEQ ID NO: 161284 - DNA, 20 bp, Artificial
  CRISPR gRNA sequence
agtcttaaaatatgagtaag

SEQ ID NO: 161285 - DNA, 20 bp, Artificial
  CRISPR gRNA sequence
aaaatatgagtaagcattca

SEQ ID NO: 161286 - DNA, 20 bp, Artificial
  CRISPR gRNA sequence
aaatatgagtaagcattcac

SEQ ID NO: 161287 - DNA, 20 bp, Artificial
  CRISPR gRNA sequence
accagatgtgaaggatggga

SEQ ID NO: 161288 - DNA, 20 bp, Artificial
  CRISPR gRNA sequence
gtagttaggggaacatcaag

SEQ ID NO: 161289 - DNA, 20 bp, Artificial
  CRISPR gRNA sequence
tagttaggggaacatcaaga

SEQ ID NO: 161290 - DNA, 20 bp, Artificial
  CRISPR gRNA sequence
ggggaacatcaagacattca

SEQ ID NO: 161291 - DNA, 20 bp, Artificial
  CRISPR gRNA sequence
agagtgcctggaggttactg

SEQ ID NO: 161292 - DNA, 20 bp, Artificial
  CRISPR gRNA sequence
gaggttactgtgtgtttagt

SEQ ID NO: 161293 - DNA, 20 bp, Artificial
  CRISPR gRNA sequence
ctgtgtgtttagtggaggtt

SEQ ID NO: 161294 - DNA, 20 bp, Artificial
  CRISPR gRNA sequence
tgtgtttagtggaggttgag

SEQ ID NO: 161295 - DNA, 20 bp, Artificial
  CRISPR gRNA sequence
agtggaggttgagggaagga

SEQ ID NO: 161296 - DNA, 20 bp, Artificial
  CRISPR gRNA sequence
gtggaggttgagggaaggag

SEQ ID NO: 161297 - DNA, 20 bp, Artificial
  CRISPR gRNA sequence
agggaaggagtaagtatgtg

SEQ ID NO: 161298 - DNA, 20 bp, Artificial
  CRISPR gRNA sequence
gagttggaatattttcataa

SEQ ID NO: 161299 - DNA, 20 bp, Artificial
  CRISPR gRNA sequence
gaatattttcataatacagt

SEQ ID NO: 161300 - DNA, 20 bp, Artificial
  CRISPR gRNA sequence
tcataatacagttgtcatgt

SEQ ID NO: 161301 - DNA, 20 bp, Artificial
  CRISPR gRNA sequence
cataatacagttgtcatgtc

SEQ ID NO: 161302 - DNA, 20 bp, Artificial
  CRISPR gRNA sequence
ataatacagttgtcatgtcc

SEQ ID NO: 161303 - DNA, 20 bp, Artificial
  CRISPR gRNA sequence
tcatgtccttaatgaagaat

SEQ ID NO: 161304 - DNA, 20 bp, Artificial
  CRISPR gRNA sequence
aatgaagaatgttcattaag

SEQ ID NO: 161305 - DNA, 20 bp, Artificial
  CRISPR gRNA sequence
atgaagaatgttcattaagg

SEQ ID NO: 161306 - DNA, 20 bp, Artificial
  CRISPR gRNA sequence
attaaggtgtcattttagca

SEQ ID NO: 161307 - DNA, 20 bp, Artificial
  CRISPR gRNA sequence
aggtgtcattttagcacata

SEQ ID NO: 161308 - DNA, 20 bp, Artificial
  CRISPR gRNA sequence
tagcacatactaaaggagct

SEQ ID NO: 161309 - DNA, 20 bp, Artificial
  CRISPR gRNA sequence
agcacatactaaaggagctc

SEQ ID NO: 161310 - DNA, 20 bp, Artificial
  CRISPR gRNA sequence
gcacatactaaaggagctcc

SEQ ID NO: 161311 - DNA, 20 bp, Artificial
  CRISPR gRNA sequence
aaggagctccccatgttggc

SEQ ID NO: 161312 - DNA, 20 bp, Artificial
  CRISPR gRNA sequence
cccatgttggctgtgtcatt

SEQ ID NO: 161313 - DNA, 20 bp, Artificial
  CRISPR gRNA sequence
gctgtgtcattcctgccctg

SEQ ID NO: 161314 - DNA, 20 bp, Artificial
  CRISPR gRNA sequence
tgtcattcctgccctggaaa

SEQ ID NO: 161315 - DNA, 20 bp, Artificial
  CRISPR gRNA sequence
ctgccctggaaatactagca

SEQ ID NO: 161316 - DNA, 20 bp, Artificial
  CRISPR gRNA sequence
ccctggaaatactagcatcc

SEQ ID NO: 161317 - DNA, 20 bp, Artificial
  CRISPR gRNA sequence
gaaatactagcatcctggca

SEQ ID NO: 161318 - DNA, 20 bp, Artificial
  CRISPR gRNA sequence
gcatcctggcagagcagaca

SEQ ID NO: 161319 - DNA, 20 bp, Artificial
  CRISPR gRNA sequence
gcagagcagacactggattc

SEQ ID NO: 161320 - DNA, 20 bp, Artificial
  CRISPR gRNA sequence
gattccttcctgatgtagaa

SEQ ID NO: 161321 - DNA, 20 bp, Artificial
  CRISPR gRNA sequence
cttcctgatgtagaattaat

SEQ ID NO: 161322 - DNA, 20 bp, Artificial
  CRISPR gRNA sequence
cctgatgtagaattaatgtt

SEQ ID NO: 161323 - DNA, 20 bp, Artificial
  CRISPR gRNA sequence
ctgatgtagaattaatgttg

SEQ ID NO: 161324 - DNA, 20 bp, Artificial
  CRISPR gRNA sequence
atgtagaattaatgttgcaa

SEQ ID NO: 161325 - DNA, 20 bp, Artificial
  CRISPR gRNA sequence
atgttgcaattgcttaaggt

SEQ ID NO: 161326 - DNA, 20 bp, Artificial
  CRISPR gRNA sequence
caattgcttaaggttagtga

SEQ ID NO: 161327 - DNA, 20 bp, Artificial
  CRISPR gRNA sequence
cttaaggttagtgaccttta

SEQ ID NO: 161328 - DNA, 20 bp, Artificial
  CRISPR gRNA sequence
aaggttagtgacctttaact

SEQ ID NO: 161329 - DNA, 20 bp, Artificial
  CRISPR gRNA sequence
aggttagtgacctttaactt

SEQ ID NO: 161330 - DNA, 20 bp, Artificial
  CRISPR gRNA sequence
gtgacctttaacttctgacg

SEQ ID NO: 161331 - DNA, 20 bp, Artificial
  CRISPR gRNA sequence
taacttctgacgttacaatg

SEQ ID NO: 161332 - DNA, 20 bp, Artificial
  CRISPR gRNA sequence
aacttctgacgttacaatgt

SEQ ID NO: 161333 - DNA, 20 bp, Artificial
  CRISPR gRNA sequence
acttctgacgttacaatgtc

SEQ ID NO: 161334 - DNA, 20 bp, Artificial
  CRISPR gRNA sequence
ctgacgttacaatgtcagtt

SEQ ID NO: 161335 - DNA, 20 bp, Artificial
  CRISPR gRNA sequence
tgacgttacaatgtcagttt

SEQ ID NO: 161336 - DNA, 20 bp, Artificial
  CRISPR gRNA sequence
acgttacaatgtcagtttat

SEQ ID NO: 161337 - DNA, 20 bp, Artificial
  CRISPR gRNA sequence
caatgtcagtttattcattc

SEQ ID NO: 161338 - DNA, 20 bp, Artificial
  CRISPR gRNA sequence
attcattcactcaacaaata

SEQ ID NO: 161339 - DNA, 20 bp, Artificial
  CRISPR gRNA sequence
ttcattcactcaacaaatac

SEQ ID NO: 161340 - DNA, 20 bp, Artificial
  CRISPR gRNA sequence
attcactcaacaaatactta

SEQ ID NO: 161341 - DNA, 20 bp, Artificial
  CRISPR gRNA sequence
actcaacaaatacttattat

SEQ ID NO: 161342 - DNA, 20 bp, Artificial
  CRISPR gRNA sequence
aacaaatacttattatgtac

SEQ ID NO: 161343 - DNA, 20 bp, Artificial
  CRISPR gRNA sequence
attatgtaccaactaaggct

SEQ ID NO: 161344 - DNA, 20 bp, Artificial
  CRISPR gRNA sequence
ttatgtaccaactaaggcta

SEQ ID NO: 161345 - DNA, 20 bp, Artificial
  CRISPR gRNA sequence
tgtaccaactaaggctatgc

SEQ ID NO: 161346 - DNA, 20 bp, Artificial
  CRISPR gRNA sequence
aggctatgctagatactgtg

SEQ ID NO: 161347 - DNA, 20 bp, Artificial
  CRISPR gRNA sequence
tgctagatactgtggataca

SEQ ID NO: 161348 - DNA, 20 bp, Artificial
  CRISPR gRNA sequence
gatactgtggatacagtaat

SEQ ID NO: 161349 - DNA, 20 bp, Artificial
  CRISPR gRNA sequence
tggatacagtaatgaaccag

SEQ ID NO: 161350 - DNA, 20 bp, Artificial
  CRISPR gRNA sequence
cgctcatggaacatatattc

SEQ ID NO: 161351 - DNA, 20 bp, Artificial
  CRISPR gRNA sequence
atggaacatatattctgatg

SEQ ID NO: 161352 - DNA, 20 bp, Artificial
  CRISPR gRNA sequence
tgatgagacaggctaataaa

SEQ ID NO: 161353 - DNA, 20 bp, Artificial
  CRISPR gRNA sequence
atgagacaggctaataaaca

SEQ ID NO: 161354 - DNA, 20 bp, Artificial
  CRISPR gRNA sequence
ataaacaagtaattaatgaa

SEQ ID NO: 161355 - DNA, 20 bp, Artificial
  CRISPR gRNA sequence
atgaaatgaaataacttatt

SEQ ID NO: 161356 - DNA, 20 bp, Artificial
  CRISPR gRNA sequence
attatgataaatgcccactg

SEQ ID NO: 161357 - DNA, 20 bp, Artificial
  CRISPR gRNA sequence
ttatgataaatgcccactga

SEQ ID NO: 161358 - DNA, 20 bp, Artificial
  CRISPR gRNA sequence
tgataaatgcccactgactt

SEQ ID NO: 161359 - DNA, 20 bp, Artificial
  CRISPR gRNA sequence
acttcagggataaaaagtaa

SEQ ID NO: 161360 - DNA, 20 bp, Artificial
  CRISPR gRNA sequence
cagggataaaaagtaattca

SEQ ID NO: 161361 - DNA, 20 bp, Artificial
  CRISPR gRNA sequence
agggataaaaagtaattcat

SEQ ID NO: 161362 - DNA, 20 bp, Artificial
  CRISPR gRNA sequence
atgttttggatatacctctg

SEQ ID NO: 161363 - DNA, 20 bp, Artificial
  CRISPR gRNA sequence
tggatatacctctgggtcat

SEQ ID NO: 161364 - DNA, 20 bp, Artificial
  CRISPR gRNA sequence
ggatatacctctgggtcatg

SEQ ID NO: 161365 - DNA, 20 bp, Artificial
  CRISPR gRNA sequence
gatatacctctgggtcatgt

SEQ ID NO: 161366 - DNA, 20 bp, Artificial
  CRISPR gRNA sequence
tgggtcatgtttgtttatat

SEQ ID NO: 161367 - DNA, 20 bp, Artificial
  CRISPR gRNA sequence
ggtcatgtttgtttatatga

SEQ ID NO: 161368 - DNA, 20 bp, Artificial
  CRISPR gRNA sequence
gtttatatgaagagttttca

SEQ ID NO: 161369 - DNA, 20 bp, Artificial
  CRISPR gRNA sequence
tttatatgaagagttttcag

SEQ ID NO: 161370 - DNA, 20 bp, Artificial
  CRISPR gRNA sequence
atatgaagagttttcagcag

SEQ ID NO: 161371 - DNA, 20 bp, Artificial
  CRISPR gRNA sequence
tatgaagagttttcagcagt

SEQ ID NO: 161372 - DNA, 20 bp, Artificial
  CRISPR gRNA sequence
tcagcagttgaacttggctt

SEQ ID NO: 161373 - DNA, 20 bp, Artificial
  CRISPR gRNA sequence
cagcagttgaacttggctta

SEQ ID NO: 161374 - DNA, 20 bp, Artificial
  CRISPR gRNA sequence
agcagttgaacttggcttag

SEQ ID NO: 161375 - DNA, 20 bp, Artificial
  CRISPR gRNA sequence
aacttggcttagcctttctc

SEQ ID NO: 161376 - DNA, 20 bp, Artificial
  CRISPR gRNA sequence
ggcttagcctttctcagact

SEQ ID NO: 161377 - DNA, 20 bp, Artificial
  CRISPR gRNA sequence
gcttagcctttctcagactg

SEQ ID NO: 161378 - DNA, 20 bp, Artificial
  CRISPR gRNA sequence
agcctttctcagactggcct

SEQ ID NO: 161379 - DNA, 20 bp, Artificial
  CRISPR gRNA sequence
gcctttctcagactggcctg

SEQ ID NO: 161380 - DNA, 20 bp, Artificial
  CRISPR gRNA sequence
tctcagactggcctgggttc

SEQ ID NO: 161381 - DNA, 20 bp, Artificial
  CRISPR gRNA sequence
ctcagactggcctgggttca

SEQ ID NO: 161382 - DNA, 20 bp, Artificial
  CRISPR gRNA sequence
tcagactggcctgggttcag

SEQ ID NO: 161383 - DNA, 20 bp, Artificial
  CRISPR gRNA sequence
agactggcctgggttcagag

SEQ ID NO: 161384 - DNA, 20 bp, Artificial
  CRISPR gRNA sequence
gcctgggttcagagtggatt

SEQ ID NO: 161385 - DNA, 20 bp, Artificial
  CRISPR gRNA sequence
ggttcagagtggatttccac

SEQ ID NO: 161386 - DNA, 20 bp, Artificial
  CRISPR gRNA sequence
agagtggatttccactgaaa

SEQ ID NO: 161387 - DNA, 20 bp, Artificial
  CRISPR gRNA sequence
ccactgaaaagtcattgttc

SEQ ID NO: 161388 - DNA, 20 bp, Artificial
  CRISPR gRNA sequence
cactgaaaagtcattgttcc

SEQ ID NO: 161389 - DNA, 20 bp, Artificial
  CRISPR gRNA sequence
aaaagtcattgttcctcttc

SEQ ID NO: 161390 - DNA, 20 bp, Artificial
  CRISPR gRNA sequence
ttcctcttctgcagtctaag

SEQ ID NO: 161391 - DNA, 20 bp, Artificial
  CRISPR gRNA sequence
ctcttctgcagtctaaggta

SEQ ID NO: 161392 - DNA, 20 bp, Artificial
  CRISPR gRNA sequence
ttctgcagtctaaggtagta

SEQ ID NO: 161393 - DNA, 20 bp, Artificial
  CRISPR gRNA sequence
ctgcagtctaaggtagtagt

SEQ ID NO: 161394 - DNA, 20 bp, Artificial
  CRISPR gRNA sequence
tgcagtctaaggtagtagtt

SEQ ID NO: 161395 - DNA, 20 bp, Artificial
  CRISPR gRNA sequence
cagtctaaggtagtagttat

SEQ ID NO: 161396 - DNA, 20 bp, Artificial
  CRISPR gRNA sequence
aggtagtagttatctaaact

SEQ ID NO: 161397 - DNA, 20 bp, Artificial
  CRISPR gRNA sequence
tctaaactgtctcagatatg

SEQ ID NO: 161398 - DNA, 20 bp, Artificial
  CRISPR gRNA sequence
aactgtctcagatatgaaag

SEQ ID NO: 161399 - DNA, 20 bp, Artificial
  CRISPR gRNA sequence
tctcagatatgaaagagaag

SEQ ID NO: 161400 - DNA, 20 bp, Artificial
  CRISPR gRNA sequence
agatatgaaagagaagggag

SEQ ID NO: 161401 - DNA, 20 bp, Artificial
  CRISPR gRNA sequence
tgttcatattttagggggtt

SEQ ID NO: 161402 - DNA, 20 bp, Artificial
  CRISPR gRNA sequence
gttcatattttagggggtta

SEQ ID NO: 161403 - DNA, 20 bp, Artificial
  CRISPR gRNA sequence
ttcatattttagggggttaa

SEQ ID NO: 161404 - DNA, 20 bp, Artificial
  CRISPR gRNA sequence
atattttagggggttaatct

SEQ ID NO: 161405 - DNA, 20 bp, Artificial
  CRISPR gRNA sequence
tagggggttaatctcatgat

SEQ ID NO: 161406 - DNA, 20 bp, Artificial
  CRISPR gRNA sequence
agggggttaatctcatgatt

SEQ ID NO: 161407 - DNA, 20 bp, Artificial
  CRISPR gRNA sequence
gggggttaatctcatgatta

SEQ ID NO: 161408 - DNA, 20 bp, Artificial
  CRISPR gRNA sequence
atctcatgattaagcttatc

SEQ ID NO: 161409 - DNA, 20 bp, Artificial
  CRISPR gRNA sequence
atgattaagcttatcagctt

SEQ ID NO: 161410 - DNA, 20 bp, Artificial
  CRISPR gRNA sequence
agcttatcagcttttggtgc

SEQ ID NO: 161411 - DNA, 20 bp, Artificial
  CRISPR gRNA sequence
atcagcttttggtgctgggg

SEQ ID NO: 161412 - DNA, 20 bp, Artificial
  CRISPR gRNA sequence
tcagcttttggtgctggggt

SEQ ID NO: 161413 - DNA, 20 bp, Artificial
  CRISPR gRNA sequence
ttggtgctggggtcagcttg

SEQ ID NO: 161414 - DNA, 20 bp, Artificial
  CRISPR gRNA sequence
tggtgctggggtcagcttgg

SEQ ID NO: 161415 - DNA, 20 bp, Artificial
  CRISPR gRNA sequence
ggtgctggggtcagcttggt

SEQ ID NO: 161416 - DNA, 20 bp, Artificial
  CRISPR gRNA sequence
gtgctggggtcagcttggtg

SEQ ID NO: 161417 - DNA, 20 bp, Artificial
  CRISPR gRNA sequence
gggtcagcttggtgtaaaat

SEQ ID NO: 161418 - DNA, 20 bp, Artificial
  CRISPR gRNA sequence
ggtgtaaaatgaatgctgtc

SEQ ID NO: 161419 - DNA, 20 bp, Artificial
  CRISPR gRNA sequence
gtgtaaaatgaatgctgtcc

SEQ ID NO: 161420 - DNA, 20 bp, Artificial
  CRISPR gRNA sequence
tcctggggtgtggtgggact

SEQ ID NO: 161421 - DNA, 20 bp, Artificial
  CRISPR gRNA sequence
gggtgtggtgggactaggcc

SEQ ID NO: 161422 - DNA, 20 bp, Artificial
  CRISPR gRNA sequence
ggccaatcgagcaagtctgt

SEQ ID NO: 161423 - DNA, 20 bp, Artificial
  CRISPR gRNA sequence
tgccgcagcttgagccgaga

SEQ ID NO: 161424 - DNA, 20 bp, Artificial
  CRISPR gRNA sequence
gagccgagaggcataaatcc

SEQ ID NO: 161425 - DNA, 20 bp, Artificial
  CRISPR gRNA sequence
agccgagaggcataaatcca

SEQ ID NO: 161426 - DNA, 20 bp, Artificial
  CRISPR gRNA sequence
tggaggtttaagctcagcac

SEQ ID NO: 161427 - DNA, 20 bp, Artificial
  CRISPR gRNA sequence
gaggtttaagctcagcactt

SEQ ID NO: 161428 - DNA, 20 bp, Artificial
  CRISPR gRNA sequence
aagctcagcacttaactttt

SEQ ID NO: 161429 - DNA, 20 bp, Artificial
  CRISPR gRNA sequence
agctcagcacttaacttttc

SEQ ID NO: 161430 - DNA, 20 bp, Artificial
  CRISPR gRNA sequence
agcacttaacttttctgttt

SEQ ID NO: 161431 - DNA, 20 bp, Artificial
  CRISPR gRNA sequence
aacttttctgttttgttgga

SEQ ID NO: 161432 - DNA, 20 bp, Artificial
  CRISPR gRNA sequence
acttttctgttttgttggac

SEQ ID NO: 161433 - DNA, 20 bp, Artificial
  CRISPR gRNA sequence
ttctgttttgttggactttg

SEQ ID NO: 161434 - DNA, 20 bp, Artificial
  CRISPR gRNA sequence
tctgttttgttggactttga

SEQ ID NO: 161435 - DNA, 20 bp, Artificial
  CRISPR gRNA sequence
ctgttttgttggactttgat

SEQ ID NO: 161436 - DNA, 20 bp, Artificial
  CRISPR gRNA sequence
tgttttgttggactttgatt

SEQ ID NO: 161437 - DNA, 20 bp, Artificial
  CRISPR gRNA sequence
ttttgttggactttgatttt

SEQ ID NO: 161438 - DNA, 20 bp, Artificial
  CRISPR gRNA sequence
tgttggactttgattttttt

SEQ ID NO: 161439 - DNA, 20 bp, Artificial
  CRISPR gRNA sequence
gttggactttgatttttttt

SEQ ID NO: 161440 - DNA, 20 bp, Artificial
  CRISPR gRNA sequence
ttggactttgattttttttt

SEQ ID NO: 161441 - DNA, 20 bp, Artificial
  CRISPR gRNA sequence
gactttgatttttttttttt

SEQ ID NO: 161442 - DNA, 20 bp, Artificial
  CRISPR gRNA sequence
tgatttttttttttttttag

SEQ ID NO: 161443 - DNA, 20 bp, Artificial
  CRISPR gRNA sequence
gatttttttttttttttagt

SEQ ID NO: 161444 - DNA, 20 bp, Artificial
  CRISPR gRNA sequence
atttttttttttttttagtt

SEQ ID NO: 161445 - DNA, 20 bp, Artificial
  CRISPR gRNA sequence
ttttttttttttagttgtag

SEQ ID NO: 161446 - DNA, 20 bp, Artificial
  CRISPR gRNA sequence
tttttttttttagttgtagt

SEQ ID NO: 161447 - DNA, 20 bp, Artificial
  CRISPR gRNA sequence
ttttttttttagttgtagta

SEQ ID NO: 161448 - DNA, 20 bp, Artificial
  CRISPR gRNA sequence
tttttttttagttgtagtaa

SEQ ID NO: 161449 - DNA, 20 bp, Artificial
  CRISPR gRNA sequence
ttttttttagttgtagtaaa

SEQ ID NO: 161450 - DNA, 20 bp, Artificial
  CRISPR gRNA sequence
tttttttagttgtagtaaaa

SEQ ID NO: 161451 - DNA, 20 bp, Artificial
  CRISPR gRNA sequence
ttttttagttgtagtaaaaa

SEQ ID NO: 161452 - DNA, 20 bp, Artificial
  CRISPR gRNA sequence
tttttagttgtagtaaaaaa

SEQ ID NO: 161453 - DNA, 20 bp, Artificial
  CRISPR gRNA sequence
ttttagttgtagtaaaaaaa

SEQ ID NO: 161454 - DNA, 20 bp, Artificial
  CRISPR gRNA sequence
tttagttgtagtaaaaaaac

SEQ ID NO: 161455 - DNA, 20 bp, Artificial
  CRISPR gRNA sequence
ttagttgtagtaaaaaaaca

SEQ ID NO: 161456 - DNA, 20 bp, Artificial
  CRISPR gRNA sequence
tagttgtagtaaaaaaacac

SEQ ID NO: 161457 - DNA, 20 bp, Artificial
  CRISPR gRNA sequence
agttgtagtaaaaaaacaca

SEQ ID NO: 161458 - DNA, 20 bp, Artificial
  CRISPR gRNA sequence
gttgtagtaaaaaaacacat

SEQ ID NO: 161459 - DNA, 20 bp, Artificial
  CRISPR gRNA sequence
tagtaaaaaaacacataaaa

SEQ ID NO: 161460 - DNA, 20 bp, Artificial
  CRISPR gRNA sequence
cgccccttatccatttttaa

SEQ ID NO: 161461 - DNA, 20 bp, Artificial
  CRISPR gRNA sequence
gccccttatccatttttaaa

SEQ ID NO: 161462 - DNA, 20 bp, Artificial
  CRISPR gRNA sequence
atccatttttaaatgtacag

SEQ ID NO: 161463 - DNA, 20 bp, Artificial
  CRISPR gRNA sequence
tccatttttaaatgtacagt

SEQ ID NO: 161464 - DNA, 20 bp, Artificial
  CRISPR gRNA sequence
ttaaatgtacagttcagaag

SEQ ID NO: 161465 - DNA, 20 bp, Artificial
  CRISPR gRNA sequence
taaatgtacagttcagaagt

SEQ ID NO: 161466 - DNA, 20 bp, Artificial
  CRISPR gRNA sequence
aaatgtacagttcagaagtg

SEQ ID NO: 161467 - DNA, 20 bp, Artificial
  CRISPR gRNA sequence
aatgtacagttcagaagtgt

SEQ ID NO: 161468 - DNA, 20 bp, Artificial
  CRISPR gRNA sequence
agaagtgttaagtataatca

SEQ ID NO: 161469 - DNA, 20 bp, Artificial
  CRISPR gRNA sequence
agtataatcacattgttatg

SEQ ID NO: 161470 - DNA, 20 bp, Artificial
  CRISPR gRNA sequence
ttatggaacttaccttgaga

SEQ ID NO: 161471 - DNA, 20 bp, Artificial
  CRISPR gRNA sequence
tggaacttaccttgagaatt

SEQ ID NO: 161472 - DNA, 20 bp, Artificial
  CRISPR gRNA sequence
accttgagaattttttcata

SEQ ID NO: 161473 - DNA, 20 bp, Artificial
  CRISPR gRNA sequence
ccttgagaattttttcatat

SEQ ID NO: 161474 - DNA, 20 bp, Artificial
  CRISPR gRNA sequence
gagaattttttcatattgca

SEQ ID NO: 161475 - DNA, 20 bp, Artificial
  CRISPR gRNA sequence
agaattttttcatattgcag

SEQ ID NO: 161476 - DNA, 20 bp, Artificial
  CRISPR gRNA sequence
tttcatattgcagtactgaa

SEQ ID NO: 161477 - DNA, 20 bp, Artificial
  CRISPR gRNA sequence
ttcatattgcagtactgaaa

SEQ ID NO: 161478 - DNA, 20 bp, Artificial
  CRISPR gRNA sequence
tcatattgcagtactgaaac

SEQ ID NO: 161479 - DNA, 20 bp, Artificial
  CRISPR gRNA sequence
catattgcagtactgaaact

SEQ ID NO: 161480 - DNA, 20 bp, Artificial
  CRISPR gRNA sequence
atattgcagtactgaaactg

SEQ ID NO: 161481 - DNA, 20 bp, Artificial
  CRISPR gRNA sequence
cagtactgaaactgtgcact

SEQ ID NO: 161482 - DNA, 20 bp, Artificial
  CRISPR gRNA sequence
aaactgtgcactcaataaac

SEQ ID NO: 161483 - DNA, 20 bp, Artificial
  CRISPR gRNA sequence
tgcactcaataaacagccac

SEQ ID NO: 161484 - DNA, 20 bp, Artificial
  CRISPR gRNA sequence
aataaacagccaccattctg

SEQ ID NO: 161485 - DNA, 20 bp, Artificial
  CRISPR gRNA sequence
tgctttctatgaatttgact

SEQ ID NO: 161486 - DNA, 20 bp, Artificial
  CRISPR gRNA sequence
ctttctatgaatttgactat

SEQ ID NO: 161487 - DNA, 20 bp, Artificial
  CRISPR gRNA sequence
tctatgaatttgactatttt

SEQ ID NO: 161488 - DNA, 20 bp, Artificial
  CRISPR gRNA sequence
ctatgaatttgactattttt

SEQ ID NO: 161489 - DNA, 20 bp, Artificial
  CRISPR gRNA sequence
tatgaatttgactatttttg

SEQ ID NO: 161490 - DNA, 20 bp, Artificial
  CRISPR gRNA sequence
tgaatttgactatttttgat

SEQ ID NO: 161491 - DNA, 20 bp, Artificial
  CRISPR gRNA sequence
gactatttttgatacctcat

SEQ ID NO: 161492 - DNA, 20 bp, Artificial
  CRISPR gRNA sequence
actatttttgatacctcata

SEQ ID NO: 161493 - DNA, 20 bp, Artificial
  CRISPR gRNA sequence
tttttgatacctcatagaag

SEQ ID NO: 161494 - DNA, 20 bp, Artificial
  CRISPR gRNA sequence
ttgatacctcatagaagtgg

SEQ ID NO: 161495 - DNA, 20 bp, Artificial
  CRISPR gRNA sequence
tgatacctcatagaagtggg

SEQ ID NO: 161496 - DNA, 20 bp, Artificial
  CRISPR gRNA sequence
gatacctcatagaagtggga

SEQ ID NO: 161497 - DNA, 20 bp, Artificial
  CRISPR gRNA sequence
atacctcatagaagtgggat

SEQ ID NO: 161498 - DNA, 20 bp, Artificial
  CRISPR gRNA sequence
atagaagtgggatcatatcg

SEQ ID NO: 161499 - DNA, 20 bp, Artificial
  CRISPR gRNA sequence
cttacaatgattcaacttaa

SEQ ID NO: 161500 - DNA, 20 bp, Artificial
  CRISPR gRNA sequence
acaatgattcaacttaatgt

SEQ ID NO: 161501 - DNA, 20 bp, Artificial
  CRISPR gRNA sequence
caatgattcaacttaatgtt

SEQ ID NO: 161502 - DNA, 20 bp, Artificial
  CRISPR gRNA sequence
aacttaatgttttttttcca

SEQ ID NO: 161503 - DNA, 20 bp, Artificial
  CRISPR gRNA sequence
aatgttttttttccacttta

SEQ ID NO: 161504 - DNA, 20 bp, Artificial
  CRISPR gRNA sequence
atgttttttttccactttac

SEQ ID NO: 161505 - DNA, 20 bp, Artificial
  CRISPR gRNA sequence
tttttccactttacagtggt

SEQ ID NO: 161506 - DNA, 20 bp, Artificial
  CRISPR gRNA sequence
ttttccactttacagtggtt

SEQ ID NO: 161507 - DNA, 20 bp, Artificial
  CRISPR gRNA sequence
tttccactttacagtggtta

SEQ ID NO: 161508 - DNA, 20 bp, Artificial
  CRISPR gRNA sequence
ttccactttacagtggttag

SEQ ID NO: 161509 - DNA, 20 bp, Artificial
  CRISPR gRNA sequence
tccactttacagtggttaga

SEQ ID NO: 161510 - DNA, 20 bp, Artificial
  CRISPR gRNA sequence
ccactttacagtggttagaa

SEQ ID NO: 161511 - DNA, 20 bp, Artificial
  CRISPR gRNA sequence
cactttacagtggttagaaa

SEQ ID NO: 161512 - DNA, 20 bp, Artificial
  CRISPR gRNA sequence
tacagtggttagaaaacgat

SEQ ID NO: 161513 - DNA, 20 bp, Artificial
  CRISPR gRNA sequence
acagtggttagaaaacgatg

SEQ ID NO: 161514 - DNA, 20 bp, Artificial
  CRISPR gRNA sequence
cagtggttagaaaacgatgt

SEQ ID NO: 161515 - DNA, 20 bp, Artificial
  CRISPR gRNA sequence
gaaaacgatgtgcattcagt

SEQ ID NO: 161516 - DNA, 20 bp, Artificial
  CRISPR gRNA sequence
agtagcagttgtactttgag

SEQ ID NO: 161517 - DNA, 20 bp, Artificial
  CRISPR gRNA sequence
tactttgagtacccattcaa

SEQ ID NO: 161518 - DNA, 20 bp, Artificial
  CRISPR gRNA sequence
tgagtacccattcaaccatt

SEQ ID NO: 161519 - DNA, 20 bp, Artificial
  CRISPR gRNA sequence
gagtacccattcaaccattc

SEQ ID NO: 161520 - DNA, 20 bp, Artificial
  CRISPR gRNA sequence
agtacccattcaaccattct

SEQ ID NO: 161521 - DNA, 20 bp, Artificial
  CRISPR gRNA sequence
aaccattctgtttttcgctt

SEQ ID NO: 161522 - DNA, 20 bp, Artificial
  CRISPR gRNA sequence
tgtttttcgctttcaatcta

SEQ ID NO: 161523 - DNA, 20 bp, Artificial
  CRISPR gRNA sequence
tttttcgctttcaatctagt

SEQ ID NO: 161524 - DNA, 20 bp, Artificial
  CRISPR gRNA sequence
ttcgctttcaatctagtatt

SEQ ID NO: 161525 - DNA, 20 bp, Artificial
  CRISPR gRNA sequence
tcgctttcaatctagtattc

SEQ ID NO: 161526 - DNA, 20 bp, Artificial
  CRISPR gRNA sequence
cgctttcaatctagtattca

SEQ ID NO: 161527 - DNA, 20 bp, Artificial
  CRISPR gRNA sequence
gctttcaatctagtattcaa

SEQ ID NO: 161528 - DNA, 20 bp, Artificial
  CRISPR gRNA sequence
tcaatctagtattcaataaa

SEQ ID NO: 161529 - DNA, 20 bp, Artificial
  CRISPR gRNA sequence
caatctagtattcaataaat

SEQ ID NO: 161530 - DNA, 20 bp, Artificial
  CRISPR gRNA sequence
aatctagtattcaataaatt

SEQ ID NO: 161531 - DNA, 20 bp, Artificial
  CRISPR gRNA sequence
gtattcaataaattatgaga

SEQ ID NO: 161532 - DNA, 20 bp, Artificial
  CRISPR gRNA sequence
aataaattatgagatactca

SEQ ID NO: 161533 - DNA, 20 bp, Artificial
  CRISPR gRNA sequence
tgagatactcaacactttac

SEQ ID NO: 161534 - DNA, 20 bp, Artificial
  CRISPR gRNA sequence
aacactttactataaaatag

SEQ ID NO: 161535 - DNA, 20 bp, Artificial
  CRISPR gRNA sequence
tactataaaatagggtttgt

SEQ ID NO: 161536 - DNA, 20 bp, Artificial
  CRISPR gRNA sequence
actataaaatagggtttgtg

SEQ ID NO: 161537 - DNA, 20 bp, Artificial
  CRISPR gRNA sequence
ctataaaatagggtttgtgt

SEQ ID NO: 161538 - DNA, 20 bp, Artificial
  CRISPR gRNA sequence
taaaatagggtttgtgttat

SEQ ID NO: 161539 - DNA, 20 bp, Artificial
  CRISPR gRNA sequence
gtgttatattattttgccca

SEQ ID NO: 161540 - DNA, 20 bp, Artificial
  CRISPR gRNA sequence
tgttatattattttgcccaa

SEQ ID NO: 161541 - DNA, 20 bp, Artificial
  CRISPR gRNA sequence
tattattttgcccaacttta

SEQ ID NO: 161542 - DNA, 20 bp, Artificial
  CRISPR gRNA sequence
ttttgcccaactttaggcta

SEQ ID NO: 161543 - DNA, 20 bp, Artificial
  CRISPR gRNA sequence
tgcccaactttaggctaatg

SEQ ID NO: 161544 - DNA, 20 bp, Artificial
  CRISPR gRNA sequence
gcccaactttaggctaatgt

SEQ ID NO: 161545 - DNA, 20 bp, Artificial
  CRISPR gRNA sequence
cccaactttaggctaatgta

SEQ ID NO: 161546 - DNA, 20 bp, Artificial
  CRISPR gRNA sequence
taggctaatgtaagtgttct

SEQ ID NO: 161547 - DNA, 20 bp, Artificial
  CRISPR gRNA sequence
aggctaatgtaagtgttctg

SEQ ID NO: 161548 - DNA, 20 bp, Artificial
  CRISPR gRNA sequence
ggctaatgtaagtgttctga

SEQ ID NO: 161549 - DNA, 20 bp, Artificial
  CRISPR gRNA sequence
atgtaagtgttctgagcaca

SEQ ID NO: 161550 - DNA, 20 bp, Artificial
  CRISPR gRNA sequence
tgagcacatttaaggtgggc

SEQ ID NO: 161551 - DNA, 20 bp, Artificial
  CRISPR gRNA sequence
agcacatttaaggtgggcga

SEQ ID NO: 161552 - DNA, 20 bp, Artificial
  CRISPR gRNA sequence
aaggtgggcgaggcttaact

SEQ ID NO: 161553 - DNA, 20 bp, Artificial
  CRISPR gRNA sequence
aggtgggcgaggcttaacta

SEQ ID NO: 161554 - DNA, 20 bp, Artificial
  CRISPR gRNA sequence
aactatgatgtttgataggc

SEQ ID NO: 161555 - DNA, 20 bp, Artificial
  CRISPR gRNA sequence
actatgatgtttgataggct

SEQ ID NO: 161556 - DNA, 20 bp, Artificial
  CRISPR gRNA sequence
tgatgtttgataggctaggt

SEQ ID NO: 161557 - DNA, 20 bp, Artificial
  CRISPR gRNA sequence
gataggctaggtgtagtaaa

SEQ ID NO: 161558 - DNA, 20 bp, Artificial
  CRISPR gRNA sequence
ataggctaggtgtagtaaat

SEQ ID NO: 161559 - DNA, 20 bp, Artificial
  CRISPR gRNA sequence
ggtgtagtaaatgcattttc

SEQ ID NO: 161560 - DNA, 20 bp, Artificial
  CRISPR gRNA sequence
tcaacttaggatcttttcaa

SEQ ID NO: 161561 - DNA, 20 bp, Artificial
  CRISPR gRNA sequence
caacttaggatcttttcaac

SEQ ID NO: 161562 - DNA, 20 bp, Artificial
  CRISPR gRNA sequence
aacttaggatcttttcaact

SEQ ID NO: 161563 - DNA, 20 bp, Artificial
  CRISPR gRNA sequence
aggatcttttcaacttaaca

SEQ ID NO: 161564 - DNA, 20 bp, Artificial
  CRISPR gRNA sequence
ggatcttttcaacttaacaa

SEQ ID NO: 161565 - DNA, 20 bp, Artificial
  CRISPR gRNA sequence
ttcaacttaacaatagcttt

SEQ ID NO: 161566 - DNA, 20 bp, Artificial
  CRISPR gRNA sequence
tcaacttaacaatagcttta

SEQ ID NO: 161567 - DNA, 20 bp, Artificial
  CRISPR gRNA sequence
caacttaacaatagctttat

SEQ ID NO: 161568 - DNA, 20 bp, Artificial
  CRISPR gRNA sequence
aacttaacaatagctttatc

SEQ ID NO: 161569 - DNA, 20 bp, Artificial
  CRISPR gRNA sequence
aacaatagctttatcaggat

SEQ ID NO: 161570 - DNA, 20 bp, Artificial
  CRISPR gRNA sequence
acaatagctttatcaggatg

SEQ ID NO: 161571 - DNA, 20 bp, Artificial
  CRISPR gRNA sequence
tatcaggatgtaaccccatt

SEQ ID NO: 161572 - DNA, 20 bp, Artificial
  CRISPR gRNA sequence
atcaggatgtaaccccattg

SEQ ID NO: 161573 - DNA, 20 bp, Artificial
  CRISPR gRNA sequence
tcaggatgtaaccccattgt

SEQ ID NO: 161574 - DNA, 20 bp, Artificial
  CRISPR gRNA sequence
taagtagaacaacatctgta

SEQ ID NO: 161575 - DNA, 20 bp, Artificial
  CRISPR gRNA sequence
tatttgtctttttgtcttat

SEQ ID NO: 161576 - DNA, 20 bp, Artificial
  CRISPR gRNA sequence
gtctttttgtcttatcttat

SEQ ID NO: 161577 - DNA, 20 bp, Artificial
  CRISPR gRNA sequence
tctttttgtcttatcttatt

SEQ ID NO: 161578 - DNA, 20 bp, Artificial
  CRISPR gRNA sequence
tttgtcttatcttatttcac

SEQ ID NO: 161579 - DNA, 20 bp, Artificial
  CRISPR gRNA sequence
ttgtcttatcttatttcact

SEQ ID NO: 161580 - DNA, 20 bp, Artificial
  CRISPR gRNA sequence
tgtcttatcttatttcactt

SEQ ID NO: 161581 - DNA, 20 bp, Artificial
  CRISPR gRNA sequence
gtcttatcttatttcactta

SEQ ID NO: 161582 - DNA, 20 bp, Artificial
  CRISPR gRNA sequence
tcttatcttatttcacttag

SEQ ID NO: 161583 - DNA, 20 bp, Artificial
  CRISPR gRNA sequence
atcttatttcacttagcatg

SEQ ID NO: 161584 - DNA, 20 bp, Artificial
  CRISPR gRNA sequence
tcttatttcacttagcatgt

SEQ ID NO: 161585 - DNA, 20 bp, Artificial
  CRISPR gRNA sequence
atttcacttagcatgtctgt

SEQ ID NO: 161586 - DNA, 20 bp, Artificial
  CRISPR gRNA sequence
tttcacttagcatgtctgtt

SEQ ID NO: 161587 - DNA, 20 bp, Artificial
  CRISPR gRNA sequence
cacttagcatgtctgttgaa

SEQ ID NO: 161588 - DNA, 20 bp, Artificial
  CRISPR gRNA sequence
acttagcatgtctgttgaag

SEQ ID NO: 161589 - DNA, 20 bp, Artificial
  CRISPR gRNA sequence
agcatgtctgttgaagcatg

SEQ ID NO: 161590 - DNA, 20 bp, Artificial
  CRISPR gRNA sequence
gcatgtctgttgaagcatgt

SEQ ID NO: 161591 - DNA, 20 bp, Artificial
  CRISPR gRNA sequence
ttgaagcatgtgacaggatg

SEQ ID NO: 161592 - DNA, 20 bp, Artificial
  CRISPR gRNA sequence
aagcatgtgacaggatgtct

SEQ ID NO: 161593 - DNA, 20 bp, Artificial
  CRISPR gRNA sequence
tccttttttatcttttttct

SEQ ID NO: 161594 - DNA, 20 bp, Artificial
  CRISPR gRNA sequence
ccttttttatcttttttctt

SEQ ID NO: 161595 - DNA, 20 bp, Artificial
  CRISPR gRNA sequence
cttttttatcttttttcttt

SEQ ID NO: 161596 - DNA, 20 bp, Artificial
  CRISPR gRNA sequence
ttttatcttttttctttttt

SEQ ID NO: 161597 - DNA, 20 bp, Artificial
  CRISPR gRNA sequence
tttatcttttttcttttttt

SEQ ID NO: 161598 - DNA, 20 bp, Artificial
  CRISPR gRNA sequence
ttatcttttttctttttttt

SEQ ID NO: 161599 - DNA, 20 bp, Artificial
  CRISPR gRNA sequence
tatcttttttcttttttttt

SEQ ID NO: 161600 - DNA, 20 bp, Artificial
  CRISPR gRNA sequence
atcttttttctttttttttt

SEQ ID NO: 161601 - DNA, 20 bp, Artificial
  CRISPR gRNA sequence
tcttttttcttttttttttt

SEQ ID NO: 161602 - DNA, 20 bp, Artificial
  CRISPR gRNA sequence
ttttcttttttttttttcct

SEQ ID NO: 161603 - DNA, 20 bp, Artificial
  CRISPR gRNA sequence
tttcttttttttttttcctt

SEQ ID NO: 161604 - DNA, 20 bp, Artificial
  CRISPR gRNA sequence
ttcttttttttttttccttt

SEQ ID NO: 161605 - DNA, 20 bp, Artificial
  CRISPR gRNA sequence
tcttttttttttttcctttt

SEQ ID NO: 161606 - DNA, 20 bp, Artificial
  CRISPR gRNA sequence
cttttttttttttccttttt

SEQ ID NO: 161607 - DNA, 20 bp, Artificial
  CRISPR gRNA sequence
ttttttttttttcctttttg

SEQ ID NO: 161608 - DNA, 20 bp, Artificial
  CRISPR gRNA sequence
ttttttttttcctttttgga

SEQ ID NO: 161609 - DNA, 20 bp, Artificial
  CRISPR gRNA sequence
tttttttttcctttttggag

SEQ ID NO: 161610 - DNA, 20 bp, Artificial
  CRISPR gRNA sequence
ttttttttcctttttggaga

SEQ ID NO: 161611 - DNA, 20 bp, Artificial
  CRISPR gRNA sequence
tttttttcctttttggagac

SEQ ID NO: 161612 - DNA, 20 bp, Artificial
  CRISPR gRNA sequence
ttttttcctttttggagaca

SEQ ID NO: 161613 - DNA, 20 bp, Artificial
  CRISPR gRNA sequence
tttttcctttttggagacag

SEQ ID NO: 161614 - DNA, 20 bp, Artificial
  CRISPR gRNA sequence
ttttcctttttggagacagg

SEQ ID NO: 161615 - DNA, 20 bp, Artificial
  CRISPR gRNA sequence
tttcctttttggagacaggg

SEQ ID NO: 161616 - DNA, 20 bp, Artificial
  CRISPR gRNA sequence
ttcctttttggagacagggt

SEQ ID NO: 161617 - DNA, 20 bp, Artificial
  CRISPR gRNA sequence
tcctttttggagacagggtc

SEQ ID NO: 161618 - DNA, 20 bp, Artificial
  CRISPR gRNA sequence
cctttttggagacagggtct

SEQ ID NO: 161619 - DNA, 20 bp, Artificial
  CRISPR gRNA sequence
ctttttggagacagggtctc

SEQ ID NO: 161620 - DNA, 20 bp, Artificial
  CRISPR gRNA sequence
tttggagacagggtctcact

SEQ ID NO: 161621 - DNA, 20 bp, Artificial
  CRISPR gRNA sequence
ttggagacagggtctcactc

SEQ ID NO: 161622 - DNA, 20 bp, Artificial
  CRISPR gRNA sequence
tggagacagggtctcactct

SEQ ID NO: 161623 - DNA, 20 bp, Artificial
  CRISPR gRNA sequence
ggagacagggtctcactctg

SEQ ID NO: 161624 - DNA, 20 bp, Artificial
  CRISPR gRNA sequence
gagacagggtctcactctgt

SEQ ID NO: 161625 - DNA, 20 bp, Artificial
  CRISPR gRNA sequence
actctgtcatccaggctgga

SEQ ID NO: 161626 - DNA, 20 bp, Artificial
  CRISPR gRNA sequence
tgtcatccaggctggagtgt

SEQ ID NO: 161627 - DNA, 20 bp, Artificial
  CRISPR gRNA sequence
tcatccaggctggagtgtag

SEQ ID NO: 161628 - DNA, 20 bp, Artificial
  CRISPR gRNA sequence
gagtgtagtggtacaattat

SEQ ID NO: 161629 - DNA, 20 bp, Artificial
  CRISPR gRNA sequence
tggctcactgcagcctcgac

SEQ ID NO: 161630 - DNA, 20 bp, Artificial
  CRISPR gRNA sequence
actgcagcctcgacctctca

SEQ ID NO: 161631 - DNA, 20 bp, Artificial
  CRISPR gRNA sequence
cagcctcgacctctcaggct

SEQ ID NO: 161632 - DNA, 20 bp, Artificial
  CRISPR gRNA sequence
gacctctcaggctcaagcga

SEQ ID NO: 161633 - DNA, 20 bp, Artificial
  CRISPR gRNA sequence
tcaggctcaagcgatcctcc

SEQ ID NO: 161634 - DNA, 20 bp, Artificial
  CRISPR gRNA sequence
aggctcaagcgatcctcccg

SEQ ID NO: 161635 - DNA, 20 bp, Artificial
  CRISPR gRNA sequence
aagcgatcctcccgcctcag

SEQ ID NO: 161636 - DNA, 20 bp, Artificial
  CRISPR gRNA sequence
ccgcctcagcctcctgagta

SEQ ID NO: 161637 - DNA, 20 bp, Artificial
  CRISPR gRNA sequence
agcctcctgagtagctgaga

SEQ ID NO: 161638 - DNA, 20 bp, Artificial
  CRISPR gRNA sequence
ctgagtagctgagactacag

SEQ ID NO: 161639 - DNA, 20 bp, Artificial
  CRISPR gRNA sequence
agtagctgagactacaggtg

SEQ ID NO: 161640 - DNA, 20 bp, Artificial
  CRISPR gRNA sequence
agactacaggtgcacgccac

SEQ ID NO: 161641 - DNA, 20 bp, Artificial
  CRISPR gRNA sequence
caggtgcacgccaccacacc

SEQ ID NO: 161642 - DNA, 20 bp, Artificial
  CRISPR gRNA sequence
atttttgtatttttctgtag

SEQ ID NO: 161643 - DNA, 20 bp, Artificial
  CRISPR gRNA sequence
ttgtatttttctgtagaggc

SEQ ID NO: 161644 - DNA, 20 bp, Artificial
  CRISPR gRNA sequence
tgtatttttctgtagaggca

SEQ ID NO: 161645 - DNA, 20 bp, Artificial
  CRISPR gRNA sequence
gtatttttctgtagaggcag

SEQ ID NO: 161646 - DNA, 20 bp, Artificial
  CRISPR gRNA sequence
tatttttctgtagaggcagg

SEQ ID NO: 161647 - DNA, 20 bp, Artificial
  CRISPR gRNA sequence
ttctgtagaggcagggtccc

SEQ ID NO: 161648 - DNA, 20 bp, Artificial
  CRISPR gRNA sequence
tctgtagaggcagggtccca

SEQ ID NO: 161649 - DNA, 20 bp, Artificial
  CRISPR gRNA sequence
ctgtagaggcagggtcccac

SEQ ID NO: 161650 - DNA, 20 bp, Artificial
  CRISPR gRNA sequence
tgtagaggcagggtcccacc

SEQ ID NO: 161651 - DNA, 20 bp, Artificial
  CRISPR gRNA sequence
tagaggcagggtcccaccat

SEQ ID NO: 161652 - DNA, 20 bp, Artificial
  CRISPR gRNA sequence
ccctggctggtctcaaactt

SEQ ID NO: 161653 - DNA, 20 bp, Artificial
  CRISPR gRNA sequence
gctggtctcaaacttctggg

SEQ ID NO: 161654 - DNA, 20 bp, Artificial
  CRISPR gRNA sequence
gtctcaaacttctgggctca

SEQ ID NO: 161655 - DNA, 20 bp, Artificial
  CRISPR gRNA sequence
aaacttctgggctcaagcat

SEQ ID NO: 161656 - DNA, 20 bp, Artificial
  CRISPR gRNA sequence
ctgggctcaagcattcctcc

SEQ ID NO: 161657 - DNA, 20 bp, Artificial
  CRISPR gRNA sequence
tgggctcaagcattcctccc

SEQ ID NO: 161658 - DNA, 20 bp, Artificial
  CRISPR gRNA sequence
ggctcaagcattcctcccac

SEQ ID NO: 161659 - DNA, 20 bp, Artificial
  CRISPR gRNA sequence
aagcattcctcccacatctg

SEQ ID NO: 161660 - DNA, 20 bp, Artificial
  CRISPR gRNA sequence
ctcccacatctgcctcccaa

SEQ ID NO: 161661 - DNA, 20 bp, Artificial
  CRISPR gRNA sequence
ccacatctgcctcccaaagt

SEQ ID NO: 161662 - DNA, 20 bp, Artificial
  CRISPR gRNA sequence
cctcccaaagtgctgggatt

SEQ ID NO: 161663 - DNA, 20 bp, Artificial
  CRISPR gRNA sequence
ccaaagtgctgggattatag

SEQ ID NO: 161664 - DNA, 20 bp, Artificial
  CRISPR gRNA sequence
ggattataggtgtgagccac

SEQ ID NO: 161665 - DNA, 20 bp, Artificial
  CRISPR gRNA sequence
taggtgtgagccaccatgcg

SEQ ID NO: 161666 - DNA, 20 bp, Artificial
  CRISPR gRNA sequence
tgttttttcttttttaaaga

SEQ ID NO: 161667 - DNA, 20 bp, Artificial
  CRISPR gRNA sequence
gttttttcttttttaaagag

SEQ ID NO: 161668 - DNA, 20 bp, Artificial
  CRISPR gRNA sequence
ttttttcttttttaaagaga

SEQ ID NO: 161669 - DNA, 20 bp, Artificial
  CRISPR gRNA sequence
tttcttttttaaagagacag

SEQ ID NO: 161670 - DNA, 20 bp, Artificial
  CRISPR gRNA sequence
ttcttttttaaagagacagg

SEQ ID NO: 161671 - DNA, 20 bp, Artificial
  CRISPR gRNA sequence
tcttttttaaagagacaggg

SEQ ID NO: 161672 - DNA, 20 bp, Artificial
  CRISPR gRNA sequence
cttttttaaagagacagggt

SEQ ID NO: 161673 - DNA, 20 bp, Artificial
  CRISPR gRNA sequence
ttttttaaagagacagggtc

SEQ ID NO: 161674 - DNA, 20 bp, Artificial
  CRISPR gRNA sequence
ttttaaagagacagggtctc

SEQ ID NO: 161675 - DNA, 20 bp, Artificial
  CRISPR gRNA sequence
tttaaagagacagggtctca

SEQ ID NO: 161676 - DNA, 20 bp, Artificial
  CRISPR gRNA sequence
ttaaagagacagggtctcac

SEQ ID NO: 161677 - DNA, 20 bp, Artificial
  CRISPR gRNA sequence
taaagagacagggtctcact

SEQ ID NO: 161678 - DNA, 20 bp, Artificial
  CRISPR gRNA sequence
aaagagacagggtctcactc

SEQ ID NO: 161679 - DNA, 20 bp, Artificial
  CRISPR gRNA sequence
aagagacagggtctcactct

SEQ ID NO: 161680 - DNA, 20 bp, Artificial
  CRISPR gRNA sequence
actctgttcattgctggagt

SEQ ID NO: 161681 - DNA, 20 bp, Artificial
  CRISPR gRNA sequence
tgttcattgctggagtgcag

SEQ ID NO: 161682 - DNA, 20 bp, Artificial
  CRISPR gRNA sequence
ttcattgctggagtgcagtg

SEQ ID NO: 161683 - DNA, 20 bp, Artificial
  CRISPR gRNA sequence
attgctggagtgcagtggca

SEQ ID NO: 161684 - DNA, 20 bp, Artificial
  CRISPR gRNA sequence
ctggagtgcagtggcaggat

SEQ ID NO: 161685 - DNA, 20 bp, Artificial
  CRISPR gRNA sequence
gagtgcagtggcaggattat

SEQ ID NO: 161686 - DNA, 20 bp, Artificial
  CRISPR gRNA sequence
tagctcactgtagccttgaa

SEQ ID NO: 161687 - DNA, 20 bp, Artificial
  CRISPR gRNA sequence
actgtagccttgaactcttg

SEQ ID NO: 161688 - DNA, 20 bp, Artificial
  CRISPR gRNA sequence
tagccttgaactcttgggct

SEQ ID NO: 161689 - DNA, 20 bp, Artificial
  CRISPR gRNA sequence
gaactcttgggctcaaggga

SEQ ID NO: 161690 - DNA, 20 bp, Artificial
  CRISPR gRNA sequence
aactcttgggctcaagggac

SEQ ID NO: 161691 - DNA, 20 bp, Artificial
  CRISPR gRNA sequence
ttgggctcaagggacccttc

SEQ ID NO: 161692 - DNA, 20 bp, Artificial
  CRISPR gRNA sequence
gggctcaagggacccttcct

SEQ ID NO: 161693 - DNA, 20 bp, Artificial
  CRISPR gRNA sequence
ggctcaagggacccttccta

SEQ ID NO: 161694 - DNA, 20 bp, Artificial
  CRISPR gRNA sequence
aagggacccttcctactcag

SEQ ID NO: 161695 - DNA, 20 bp, Artificial
  CRISPR gRNA sequence
cctactcagtcccccaagta

SEQ ID NO: 161696 - DNA, 20 bp, Artificial
  CRISPR gRNA sequence
ctactcagtcccccaagtag

SEQ ID NO: 161697 - DNA, 20 bp, Artificial
  CRISPR gRNA sequence
ctcagtcccccaagtagcta

SEQ ID NO: 161698 - DNA, 20 bp, Artificial
  CRISPR gRNA sequence
agtcccccaagtagctagga

SEQ ID NO: 161699 - DNA, 20 bp, Artificial
  CRISPR gRNA sequence
ggactctagttgtgcaccac

SEQ ID NO: 161700 - DNA, 20 bp, Artificial
  CRISPR gRNA sequence
tagttgtgcaccaccacacc

SEQ ID NO: 161701 - DNA, 20 bp, Artificial
  CRISPR gRNA sequence
gttgtgcaccaccacacctg

SEQ ID NO: 161702 - DNA, 20 bp, Artificial
  CRISPR gRNA sequence
tgcaccaccacacctggcta

SEQ ID NO: 161703 - DNA, 20 bp, Artificial
  CRISPR gRNA sequence
gctaattaaaaaaaaaaaat

SEQ ID NO: 161704 - DNA, 20 bp, Artificial
  CRISPR gRNA sequence
attaaaaaaaaaaaatctta

SEQ ID NO: 161705 - DNA, 20 bp, Artificial
  CRISPR gRNA sequence
aaaaaaaaaaatcttatgta

SEQ ID NO: 161706 - DNA, 20 bp, Artificial
  CRISPR gRNA sequence
atgtagagatggaggtctca

SEQ ID NO: 161707 - DNA, 20 bp, Artificial
  CRISPR gRNA sequence
tgtagagatggaggtctcac

SEQ ID NO: 161708 - DNA, 20 bp, Artificial
  CRISPR gRNA sequence
actatgttgcctaggctggt

SEQ ID NO: 161709 - DNA, 20 bp, Artificial
  CRISPR gRNA sequence
tgttgcctaggctggtctca

SEQ ID NO: 161710 - DNA, 20 bp, Artificial
  CRISPR gRNA sequence
cctaggctggtctcaaattc

SEQ ID NO: 161711 - DNA, 20 bp, Artificial
  CRISPR gRNA sequence
ggctggtctcaaattcctgg

SEQ ID NO: 161712 - DNA, 20 bp, Artificial
  CRISPR gRNA sequence
gtctcaaattcctggcctca

SEQ ID NO: 161713 - DNA, 20 bp, Artificial
  CRISPR gRNA sequence
aaattcctggcctcaagcaa

SEQ ID NO: 161714 - DNA, 20 bp, Artificial
  CRISPR gRNA sequence
ctggcctcaagcaatcctct

SEQ ID NO: 161715 - DNA, 20 bp, Artificial
  CRISPR gRNA sequence
gcctcaagcaatcctcttgc

SEQ ID NO: 161716 - DNA, 20 bp, Artificial
  CRISPR gRNA sequence
aagcaatcctcttgccttgg

SEQ ID NO: 161717 - DNA, 20 bp, Artificial
  CRISPR gRNA sequence
ttgccttggccctccaaagc

SEQ ID NO: 161718 - DNA, 20 bp, Artificial
  CRISPR gRNA sequence
gccttggccctccaaagcac

SEQ ID NO: 161719 - DNA, 20 bp, Artificial
  CRISPR gRNA sequence
ccttggccctccaaagcact

SEQ ID NO: 161720 - DNA, 20 bp, Artificial
  CRISPR gRNA sequence
ggccctccaaagcactggga

SEQ ID NO: 161721 - DNA, 20 bp, Artificial
  CRISPR gRNA sequence
gccctccaaagcactgggat

SEQ ID NO: 161722 - DNA, 20 bp, Artificial
  CRISPR gRNA sequence
caaagcactgggattacaga

SEQ ID NO: 161723 - DNA, 20 bp, Artificial
  CRISPR gRNA sequence
ggattacagacatgagccat

SEQ ID NO: 161724 - DNA, 20 bp, Artificial
  CRISPR gRNA sequence
cagacatgagccatcatgtc

SEQ ID NO: 161725 - DNA, 20 bp, Artificial
  CRISPR gRNA sequence
gcctatcctttttttttttt

SEQ ID NO: 161726 - DNA, 20 bp, Artificial
  CRISPR gRNA sequence
tcctttttttttttttaagg

SEQ ID NO: 161727 - DNA, 20 bp, Artificial
  CRISPR gRNA sequence
tttttttttttaaggcagaa

SEQ ID NO: 161728 - DNA, 20 bp, Artificial
  CRISPR gRNA sequence
ttttttttttaaggcagaat

SEQ ID NO: 161729 - DNA, 20 bp, Artificial
  CRISPR gRNA sequence
tttttttttaaggcagaatc

SEQ ID NO: 161730 - DNA, 20 bp, Artificial
  CRISPR gRNA sequence
ttttttttaaggcagaatca

SEQ ID NO: 161731 - DNA, 20 bp, Artificial
  CRISPR gRNA sequence
tttttttaaggcagaatcat

SEQ ID NO: 161732 - DNA, 20 bp, Artificial
  CRISPR gRNA sequence
ttttttaaggcagaatcata

SEQ ID NO: 161733 - DNA, 20 bp, Artificial
  CRISPR gRNA sequence
tttttaaggcagaatcatac

SEQ ID NO: 161734 - DNA, 20 bp, Artificial
  CRISPR gRNA sequence
ttttaaggcagaatcatacc

SEQ ID NO: 161735 - DNA, 20 bp, Artificial
  CRISPR gRNA sequence
tttaaggcagaatcataccc

SEQ ID NO: 161736 - DNA, 20 bp, Artificial
  CRISPR gRNA sequence
ttaaggcagaatcataccct

SEQ ID NO: 161737 - DNA, 20 bp, Artificial
  CRISPR gRNA sequence
taaggcagaatcataccctg

SEQ ID NO: 161738 - DNA, 20 bp, Artificial
  CRISPR gRNA sequence
aaggcagaatcataccctgt

SEQ ID NO: 161739 - DNA, 20 bp, Artificial
  CRISPR gRNA sequence
aggcagaatcataccctgtt

SEQ ID NO: 161740 - DNA, 20 bp, Artificial
  CRISPR gRNA sequence
ttgtatgtatataccacatt

SEQ ID NO: 161741 - DNA, 20 bp, Artificial
  CRISPR gRNA sequence
tatgtatataccacattttg

SEQ ID NO: 161742 - DNA, 20 bp, Artificial
  CRISPR gRNA sequence
tgtttatccgttcatctgtt

SEQ ID NO: 161743 - DNA, 20 bp, Artificial
  CRISPR gRNA sequence
gtttatccgttcatctgtta

SEQ ID NO: 161744 - DNA, 20 bp, Artificial
  CRISPR gRNA sequence
tttatccgttcatctgttaa

SEQ ID NO: 161745 - DNA, 20 bp, Artificial
  CRISPR gRNA sequence
atccgttcatctgttaatgg

SEQ ID NO: 161746 - DNA, 20 bp, Artificial
  CRISPR gRNA sequence
tccgttcatctgttaatgga

SEQ ID NO: 161747 - DNA, 20 bp, Artificial
  CRISPR gRNA sequence
atctgttaatggacatttgg

SEQ ID NO: 161748 - DNA, 20 bp, Artificial
  CRISPR gRNA sequence
ttaatggacatttgggttgg

SEQ ID NO: 161749 - DNA, 20 bp, Artificial
  CRISPR gRNA sequence
atggacatttgggttggttt

SEQ ID NO: 161750 - DNA, 20 bp, Artificial
  CRISPR gRNA sequence
gggttggtttcacctcttgg

SEQ ID NO: 161751 - DNA, 20 bp, Artificial
  CRISPR gRNA sequence
ggttggtttcacctcttggc

SEQ ID NO: 161752 - DNA, 20 bp, Artificial
  CRISPR gRNA sequence
gtttcacctcttggctattg

SEQ ID NO: 161753 - DNA, 20 bp, Artificial
  CRISPR gRNA sequence
cacctcttggctattgtgaa

SEQ ID NO: 161754 - DNA, 20 bp, Artificial
  CRISPR gRNA sequence
acctcttggctattgtgaat

SEQ ID NO: 161755 - DNA, 20 bp, Artificial
  CRISPR gRNA sequence
ttggctattgtgaatagtgc

SEQ ID NO: 161756 - DNA, 20 bp, Artificial
  CRISPR gRNA sequence
ggctattgtgaatagtgctg

SEQ ID NO: 161757 - DNA, 20 bp, Artificial
  CRISPR gRNA sequence
gctattgtgaatagtgctgc

SEQ ID NO: 161758 - DNA, 20 bp, Artificial
  CRISPR gRNA sequence
ttgtgaatagtgctgctgtg

SEQ ID NO: 161759 - DNA, 20 bp, Artificial
  CRISPR gRNA sequence
tgaatagtgctgctgtgtta

SEQ ID NO: 161760 - DNA, 20 bp, Artificial
  CRISPR gRNA sequence
ctgtgttacatgagtgtgca

SEQ ID NO: 161761 - DNA, 20 bp, Artificial
  CRISPR gRNA sequence
tgttacatgagtgtgcaaat

SEQ ID NO: 161762 - DNA, 20 bp, Artificial
  CRISPR gRNA sequence
catgagtgtgcaaatacctc

SEQ ID NO: 161763 - DNA, 20 bp, Artificial
  CRISPR gRNA sequence
ttcaagaccctgggctttga

SEQ ID NO: 161764 - DNA, 20 bp, Artificial
  CRISPR gRNA sequence
caagaccctgggctttgatt

SEQ ID NO: 161765 - DNA, 20 bp, Artificial
  CRISPR gRNA sequence
aagaccctgggctttgattt

SEQ ID NO: 161766 - DNA, 20 bp, Artificial
  CRISPR gRNA sequence
ggctttgatttgtaacctac

SEQ ID NO: 161767 - DNA, 20 bp, Artificial
  CRISPR gRNA sequence
tgatttgtaacctacttggt

SEQ ID NO: 161768 - DNA, 20 bp, Artificial
  CRISPR gRNA sequence
gatttgtaacctacttggtt

SEQ ID NO: 161769 - DNA, 20 bp, Artificial
  CRISPR gRNA sequence
atttgtaacctacttggttt

SEQ ID NO: 161770 - DNA, 20 bp, Artificial
  CRISPR gRNA sequence
gtaacctacttggtttacaa

SEQ ID NO: 161771 - DNA, 20 bp, Artificial
  CRISPR gRNA sequence
taacctacttggtttacaag

SEQ ID NO: 161772 - DNA, 20 bp, Artificial
  CRISPR gRNA sequence
cttggtttacaagtttgatt

SEQ ID NO: 161773 - DNA, 20 bp, Artificial
  CRISPR gRNA sequence
ggtttacaagtttgattgcc

SEQ ID NO: 161774 - DNA, 20 bp, Artificial
  CRISPR gRNA sequence
gtttacaagtttgattgcca

SEQ ID NO: 161775 - DNA, 20 bp, Artificial
  CRISPR gRNA sequence
acaagtttgattgccaacaa

SEQ ID NO: 161776 - DNA, 20 bp, Artificial
  CRISPR gRNA sequence
caagtttgattgccaacaaa

SEQ ID NO: 161777 - DNA, 20 bp, Artificial
  CRISPR gRNA sequence
gattgccaacaaagctgatc

SEQ ID NO: 161778 - DNA, 20 bp, Artificial
  CRISPR gRNA sequence
attgccaacaaagctgatca

SEQ ID NO: 161779 - DNA, 20 bp, Artificial
  CRISPR gRNA sequence
ccaacaaagctgatcatgat

SEQ ID NO: 161780 - DNA, 20 bp, Artificial
  CRISPR gRNA sequence
atcatgatgttgaccaaatt

SEQ ID NO: 161781 - DNA, 20 bp, Artificial
  CRISPR gRNA sequence
accaaattttagtacctaga

SEQ ID NO: 161782 - DNA, 20 bp, Artificial
  CRISPR gRNA sequence
tagtacctagacttagtcta

SEQ ID NO: 161783 - DNA, 20 bp, Artificial
  CRISPR gRNA sequence
agtacctagacttagtctat

SEQ ID NO: 161784 - DNA, 20 bp, Artificial
  CRISPR gRNA sequence
gtacctagacttagtctatc

SEQ ID NO: 161785 - DNA, 20 bp, Artificial
  CRISPR gRNA sequence
gacttagtctatcagaagtt

SEQ ID NO: 161786 - DNA, 20 bp, Artificial
  CRISPR gRNA sequence
agtctatcagaagttaaaag

SEQ ID NO: 161787 - DNA, 20 bp, Artificial
  CRISPR gRNA sequence
gtctatcagaagttaaaaga

SEQ ID NO: 161788 - DNA, 20 bp, Artificial
  CRISPR gRNA sequence
tcagaagttaaaagagaatt

SEQ ID NO: 161789 - DNA, 20 bp, Artificial
  CRISPR gRNA sequence
aaagagaattactttgaggg

SEQ ID NO: 161790 - DNA, 20 bp, Artificial
  CRISPR gRNA sequence
ctttgagggattcagttttg

SEQ ID NO: 161791 - DNA, 20 bp, Artificial
  CRISPR gRNA sequence
tgagggattcagttttggtt

SEQ ID NO: 161792 - DNA, 20 bp, Artificial
  CRISPR gRNA sequence
gagggattcagttttggttc

SEQ ID NO: 161793 - DNA, 20 bp, Artificial
  CRISPR gRNA sequence
agggattcagttttggttca

SEQ ID NO: 161794 - DNA, 20 bp, Artificial
  CRISPR gRNA sequence
agttttggttcaagttttgt

SEQ ID NO: 161795 - DNA, 20 bp, Artificial
  CRISPR gRNA sequence
tggttcaagttttgtgggtg

SEQ ID NO: 161796 - DNA, 20 bp, Artificial
  CRISPR gRNA sequence
ggttcaagttttgtgggtga

SEQ ID NO: 161797 - DNA, 20 bp, Artificial
  CRISPR gRNA sequence
gttcaagttttgtgggtgaa

SEQ ID NO: 161798 - DNA, 20 bp, Artificial
  CRISPR gRNA sequence
aagttttgtgggtgaagaga

SEQ ID NO: 161799 - DNA, 20 bp, Artificial
  CRISPR gRNA sequence
tgtgggtgaagagaaagaaa

SEQ ID NO: 161800 - DNA, 20 bp, Artificial
  CRISPR gRNA sequence
gtgggtgaagagaaagaaaa

SEQ ID NO: 161801 - DNA, 20 bp, Artificial
  CRISPR gRNA sequence
tgggtgaagagaaagaaaag

SEQ ID NO: 161802 - DNA, 20 bp, Artificial
  CRISPR gRNA sequence
tctttaatccttcttgtatt

SEQ ID NO: 161803 - DNA, 20 bp, Artificial
  CRISPR gRNA sequence
taatccttcttgtattggtg

SEQ ID NO: 161804 - DNA, 20 bp, Artificial
  CRISPR gRNA sequence
aatccttcttgtattggtga

SEQ ID NO: 161805 - DNA, 20 bp, Artificial
  CRISPR gRNA sequence
atccttcttgtattggtgac

SEQ ID NO: 161806 - DNA, 20 bp, Artificial
  CRISPR gRNA sequence
cttgtattggtgactaatta

SEQ ID NO: 161807 - DNA, 20 bp, Artificial
  CRISPR gRNA sequence
ttgtattggtgactaattaa

SEQ ID NO: 161808 - DNA, 20 bp, Artificial
  CRISPR gRNA sequence
gtattggtgactaattaaaa

SEQ ID NO: 161809 - DNA, 20 bp, Artificial
  CRISPR gRNA sequence
tattggtgactaattaaaat

SEQ ID NO: 161810 - DNA, 20 bp, Artificial
  CRISPR gRNA sequence
gtgactaattaaaattctcc

SEQ ID NO: 161811 - DNA, 20 bp, Artificial
  CRISPR gRNA sequence
attaaaattctcctcctatg

SEQ ID NO: 161812 - DNA, 20 bp, Artificial
  CRISPR gRNA sequence
aaattctcctcctatgtact

SEQ ID NO: 161813 - DNA, 20 bp, Artificial
  CRISPR gRNA sequence
tcctcctatgtacttttgaa

SEQ ID NO: 161814 - DNA, 20 bp, Artificial
  CRISPR gRNA sequence
ctcctatgtacttttgaaag

SEQ ID NO: 161815 - DNA, 20 bp, Artificial
  CRISPR gRNA sequence
ctatgtacttttgaaaggga

SEQ ID NO: 161816 - DNA, 20 bp, Artificial
  CRISPR gRNA sequence
tgtacttttgaaagggactc

SEQ ID NO: 161817 - DNA, 20 bp, Artificial
  CRISPR gRNA sequence
ttgaaagggactcctagacc

SEQ ID NO: 161818 - DNA, 20 bp, Artificial
  CRISPR gRNA sequence
tgaaagggactcctagacct

SEQ ID NO: 161819 - DNA, 20 bp, Artificial
  CRISPR gRNA sequence
gaaagggactcctagacctc

SEQ ID NO: 161820 - DNA, 20 bp, Artificial
  CRISPR gRNA sequence
aaagggactcctagacctct

SEQ ID NO: 161821 - DNA, 20 bp, Artificial
  CRISPR gRNA sequence
ctagacctctgccatgctat

SEQ ID NO: 161822 - DNA, 20 bp, Artificial
  CRISPR gRNA sequence
gacctctgccatgctatgtc

SEQ ID NO: 161823 - DNA, 20 bp, Artificial
  CRISPR gRNA sequence
tgccatgctatgtcttttat

SEQ ID NO: 161824 - DNA, 20 bp, Artificial
  CRISPR gRNA sequence
ccatgctatgtcttttatat

SEQ ID NO: 161825 - DNA, 20 bp, Artificial
  CRISPR gRNA sequence
tgtcttttatatcaggtgct

SEQ ID NO: 161826 - DNA, 20 bp, Artificial
  CRISPR gRNA sequence
ttatatcaggtgcttagaac

SEQ ID NO: 161827 - DNA, 20 bp, Artificial
  CRISPR gRNA sequence
tatatcaggtgcttagaaca

SEQ ID NO: 161828 - DNA, 20 bp, Artificial
  CRISPR gRNA sequence
atatcaggtgcttagaacaa

SEQ ID NO: 161829 - DNA, 20 bp, Artificial
  CRISPR gRNA sequence
tatcaggtgcttagaacaat

SEQ ID NO: 161830 - DNA, 20 bp, Artificial
  CRISPR gRNA sequence
agaacaatgtctggcatgta

SEQ ID NO: 161831 - DNA, 20 bp, Artificial
  CRISPR gRNA sequence
gaacaatgtctggcatgtag

SEQ ID NO: 161832 - DNA, 20 bp, Artificial
  CRISPR gRNA sequence
gcatgtagtaggtgcacaat

SEQ ID NO: 161833 - DNA, 20 bp, Artificial
  CRISPR gRNA sequence
gaacaaattagactccactt

SEQ ID NO: 161834 - DNA, 20 bp, Artificial
  CRISPR gRNA sequence
aacaaattagactccacttc

SEQ ID NO: 161835 - DNA, 20 bp, Artificial
  CRISPR gRNA sequence
gactccacttcaggtttagt

SEQ ID NO: 161836 - DNA, 20 bp, Artificial
  CRISPR gRNA sequence
cacttcaggtttagtgcaaa

SEQ ID NO: 161837 - DNA, 20 bp, Artificial
  CRISPR gRNA sequence
caggtttagtgcaaagcaac

SEQ ID NO: 161838 - DNA, 20 bp, Artificial
  CRISPR gRNA sequence
aggtttagtgcaaagcaaca

SEQ ID NO: 161839 - DNA, 20 bp, Artificial
  CRISPR gRNA sequence
agtgcaaagcaacatcaatt

SEQ ID NO: 161840 - DNA, 20 bp, Artificial
  CRISPR gRNA sequence
gtgcaaagcaacatcaattc

SEQ ID NO: 161841 - DNA, 20 bp, Artificial
  CRISPR gRNA sequence
catatttgagtaagaatgca

SEQ ID NO: 161842 - DNA, 20 bp, Artificial
  CRISPR gRNA sequence
gagtaagaatgcaatccagt

SEQ ID NO: 161843 - DNA, 20 bp, Artificial
  CRISPR gRNA sequence
agtaagaatgcaatccagta

SEQ ID NO: 161844 - DNA, 20 bp, Artificial
  CRISPR gRNA sequence
ttttcccttgtgtgactctt

SEQ ID NO: 161845 - DNA, 20 bp, Artificial
  CRISPR gRNA sequence
tttcccttgtgtgactctta

SEQ ID NO: 161846 - DNA, 20 bp, Artificial
  CRISPR gRNA sequence
ttcccttgtgtgactcttat

SEQ ID NO: 161847 - DNA, 20 bp, Artificial
  CRISPR gRNA sequence
tcccttgtgtgactcttatt

SEQ ID NO: 161848 - DNA, 20 bp, Artificial
  CRISPR gRNA sequence
cccttgtgtgactcttattt

SEQ ID NO: 161849 - DNA, 20 bp, Artificial
  CRISPR gRNA sequence
ccttgtgtgactcttatttt

SEQ ID NO: 161850 - DNA, 20 bp, Artificial
  CRISPR gRNA sequence
gtgtgactcttattttcccc

SEQ ID NO: 161851 - DNA, 20 bp, Artificial
  CRISPR gRNA sequence
tgtgactcttattttcccct

SEQ ID NO: 161852 - DNA, 20 bp, Artificial
  CRISPR gRNA sequence
ttattttcccctcttctcag

SEQ ID NO: 161853 - DNA, 20 bp, Artificial
  CRISPR gRNA sequence
attttcccctcttctcagga

SEQ ID NO: 161854 - DNA, 20 bp, Artificial
  CRISPR gRNA sequence
ttttcccctcttctcaggag

SEQ ID NO: 161855 - DNA, 20 bp, Artificial
  CRISPR gRNA sequence
tcccctcttctcaggagtgc

SEQ ID NO: 161856 - DNA, 20 bp, Artificial
  CRISPR gRNA sequence
cccctcttctcaggagtgca

SEQ ID NO: 161857 - DNA, 20 bp, Artificial
  CRISPR gRNA sequence
ccctcttctcaggagtgcaa

SEQ ID NO: 161858 - DNA, 20 bp, Artificial
  CRISPR gRNA sequence
ttctcaggagtgcaacacgt

SEQ ID NO: 161859 - DNA, 20 bp, Artificial
  CRISPR gRNA sequence
ctcaggagtgcaacacgtga

SEQ ID NO: 161860 - DNA, 20 bp, Artificial
  CRISPR gRNA sequence
tcaggagtgcaacacgtgat

SEQ ID NO: 161861 - DNA, 20 bp, Artificial
  CRISPR gRNA sequence
aggagtgcaacacgtgatgg

SEQ ID NO: 161862 - DNA, 20 bp, Artificial
  CRISPR gRNA sequence
cttctctgactgcgctgctg

SEQ ID NO: 161863 - DNA, 20 bp, Artificial
  CRISPR gRNA sequence
ctctgactgcgctgctgcct

SEQ ID NO: 161864 - DNA, 20 bp, Artificial
  CRISPR gRNA sequence
tctgactgcgctgctgcctg

SEQ ID NO: 161865 - DNA, 20 bp, Artificial
  CRISPR gRNA sequence
tgactgcgctgctgcctgtg

SEQ ID NO: 161866 - DNA, 20 bp, Artificial
  CRISPR gRNA sequence
actgcgctgctgcctgtgta

SEQ ID NO: 161867 - DNA, 20 bp, Artificial
  CRISPR gRNA sequence
cgctgctgcctgtgtaacat

SEQ ID NO: 161868 - DNA, 20 bp, Artificial
  CRISPR gRNA sequence
ctgcctgtgtaacatgacca

SEQ ID NO: 161869 - DNA, 20 bp, Artificial
  CRISPR gRNA sequence
cctgtgtaacatgaccaaac

SEQ ID NO: 161870 - DNA, 20 bp, Artificial
  CRISPR gRNA sequence
tgtaacatgaccaaacattt

SEQ ID NO: 161871 - DNA, 20 bp, Artificial
  CRISPR gRNA sequence
tagcatttaatctgtccctt

SEQ ID NO: 161872 - DNA, 20 bp, Artificial
  CRISPR gRNA sequence
agcatttaatctgtcccttt

SEQ ID NO: 161873 - DNA, 20 bp, Artificial
  CRISPR gRNA sequence
gcatttaatctgtccctttc

SEQ ID NO: 161874 - DNA, 20 bp, Artificial
  CRISPR gRNA sequence
aatctgtccctttccagaac

SEQ ID NO: 161875 - DNA, 20 bp, Artificial
  CRISPR gRNA sequence
atctgtccctttccagaact

SEQ ID NO: 161876 - DNA, 20 bp, Artificial
  CRISPR gRNA sequence
tccctttccagaactcaaca

SEQ ID NO: 161877 - DNA, 20 bp, Artificial
  CRISPR gRNA sequence
tccagaactcaacagtactt

SEQ ID NO: 161878 - DNA, 20 bp, Artificial
  CRISPR gRNA sequence
ccagaactcaacagtactta

SEQ ID NO: 161879 - DNA, 20 bp, Artificial
  CRISPR gRNA sequence
cagaactcaacagtacttaa

SEQ ID NO: 161880 - DNA, 20 bp, Artificial
  CRISPR gRNA sequence
aacagtacttaaaaccagac

SEQ ID NO: 161881 - DNA, 20 bp, Artificial
  CRISPR gRNA sequence
aaaaccagacttcctcagat

SEQ ID NO: 161882 - DNA, 20 bp, Artificial
  CRISPR gRNA sequence
aaaccagacttcctcagatg

SEQ ID NO: 161883 - DNA, 20 bp, Artificial
  CRISPR gRNA sequence
cctcagatgtgtcagagcct

SEQ ID NO: 161884 - DNA, 20 bp, Artificial
  CRISPR gRNA sequence
ctcagatgtgtcagagcctc

SEQ ID NO: 161885 - DNA, 20 bp, Artificial
  CRISPR gRNA sequence
agatgtgtcagagcctctta

SEQ ID NO: 161886 - DNA, 20 bp, Artificial
  CRISPR gRNA sequence
ttaggttgacacctcacaat

SEQ ID NO: 161887 - DNA, 20 bp, Artificial
  CRISPR gRNA sequence
aggttgacacctcacaatat

SEQ ID NO: 161888 - DNA, 20 bp, Artificial
  CRISPR gRNA sequence
ggttgacacctcacaatatc

SEQ ID NO: 161889 - DNA, 20 bp, Artificial
  CRISPR gRNA sequence
acacctcacaatatctaaca

SEQ ID NO: 161890 - DNA, 20 bp, Artificial
  CRISPR gRNA sequence
acaatatctaacagattaaa

SEQ ID NO: 161891 - DNA, 20 bp, Artificial
  CRISPR gRNA sequence
acagattaaaaagaaaaaaa

SEQ ID NO: 161892 - DNA, 20 bp, Artificial
  CRISPR gRNA sequence
aaaagaaaaaaattccttat

SEQ ID NO: 161893 - DNA, 20 bp, Artificial
  CRISPR gRNA sequence
cttatgtttaaactagccaa

SEQ ID NO: 161894 - DNA, 20 bp, Artificial
  CRISPR gRNA sequence
atgtttaaactagccaatca

SEQ ID NO: 161895 - DNA, 20 bp, Artificial
  CRISPR gRNA sequence
tgtttaaactagccaatcat

SEQ ID NO: 161896 - DNA, 20 bp, Artificial
  CRISPR gRNA sequence
aaactagccaatcataagta

SEQ ID NO: 161897 - DNA, 20 bp, Artificial
  CRISPR gRNA sequence
aactagccaatcataagtaa

SEQ ID NO: 161898 - DNA, 20 bp, Artificial
  CRISPR gRNA sequence
gccaatcataagtaaaactt

SEQ ID NO: 161899 - DNA, 20 bp, Artificial
  CRISPR gRNA sequence
acgagaatattcataaaatg

SEQ ID NO: 161900 - DNA, 20 bp, Artificial
  CRISPR gRNA sequence
cgagaatattcataaaatgt

SEQ ID NO: 161901 - DNA, 20 bp, Artificial
  CRISPR gRNA sequence
ataaaatgtgatctcagact

SEQ ID NO: 161902 - DNA, 20 bp, Artificial
  CRISPR gRNA sequence
agactgggacacaatttgtt

SEQ ID NO: 161903 - DNA, 20 bp, Artificial
  CRISPR gRNA sequence
ggacacaatttgtttcaaaa

SEQ ID NO: 161904 - DNA, 20 bp, Artificial
  CRISPR gRNA sequence
gtttcaaaaagaagtaattg

SEQ ID NO: 161905 - DNA, 20 bp, Artificial
  CRISPR gRNA sequence
tttcaaaaagaagtaattga

SEQ ID NO: 161906 - DNA, 20 bp, Artificial
  CRISPR gRNA sequence
caaaaagaagtaattgaagt

SEQ ID NO: 161907 - DNA, 20 bp, Artificial
  CRISPR gRNA sequence
aaaaagaagtaattgaagtt

SEQ ID NO: 161908 - DNA, 20 bp, Artificial
  CRISPR gRNA sequence
aagtttgctagatgatatat

SEQ ID NO: 161909 - DNA, 20 bp, Artificial
  CRISPR gRNA sequence
gctagatgatatatttcatg

SEQ ID NO: 161910 - DNA, 20 bp, Artificial
  CRISPR gRNA sequence
ctagatgatatatttcatga

SEQ ID NO: 161911 - DNA, 20 bp, Artificial
  CRISPR gRNA sequence
gatgatatatttcatgatgt

SEQ ID NO: 161912 - DNA, 20 bp, Artificial
  CRISPR gRNA sequence
catgatgtgttggaaacact

SEQ ID NO: 161913 - DNA, 20 bp, Artificial
  CRISPR gRNA sequence
atgatgtgttggaaacactg

SEQ ID NO: 161914 - DNA, 20 bp, Artificial
  CRISPR gRNA sequence
gaaacactggcctcaagtcc

SEQ ID NO: 161915 - DNA, 20 bp, Artificial
  CRISPR gRNA sequence
gcctcaagtccttttggtct

SEQ ID NO: 161916 - DNA, 20 bp, Artificial
  CRISPR gRNA sequence
aagtccttttggtctgcgtc

SEQ ID NO: 161917 - DNA, 20 bp, Artificial
  CRISPR gRNA sequence
ttggtctgcgtcctgtaaaa

SEQ ID NO: 161918 - DNA, 20 bp, Artificial
  CRISPR gRNA sequence
tggtctgcgtcctgtaaaag

SEQ ID NO: 161919 - DNA, 20 bp, Artificial
  CRISPR gRNA sequence
ggtctgcgtcctgtaaaagc

SEQ ID NO: 161920 - DNA, 20 bp, Artificial
  CRISPR gRNA sequence
gtctgcgtcctgtaaaagca

SEQ ID NO: 161921 - DNA, 20 bp, Artificial
  CRISPR gRNA sequence
cgtcctgtaaaagcaattta

SEQ ID NO: 161922 - DNA, 20 bp, Artificial
  CRISPR gRNA sequence
taaaagcaatttatctttca

SEQ ID NO: 161923 - DNA, 20 bp, Artificial
  CRISPR gRNA sequence
atctttcattttagcttgtt

SEQ ID NO: 161924 - DNA, 20 bp, Artificial
  CRISPR gRNA sequence
tctttcattttagcttgttc

SEQ ID NO: 161925 - DNA, 20 bp, Artificial
  CRISPR gRNA sequence
tcattttagcttgttctcat

SEQ ID NO: 161926 - DNA, 20 bp, Artificial
  CRISPR gRNA sequence
cattttagcttgttctcatg

SEQ ID NO: 161927 - DNA, 20 bp, Artificial
  CRISPR gRNA sequence
attttagcttgttctcatga

SEQ ID NO: 161928 - DNA, 20 bp, Artificial
  CRISPR gRNA sequence
tagcttgttctcatgattct

SEQ ID NO: 161929 - DNA, 20 bp, Artificial
  CRISPR gRNA sequence
agcttgttctcatgattctt

SEQ ID NO: 161930 - DNA, 20 bp, Artificial
  CRISPR gRNA sequence
gcttgttctcatgattctta

SEQ ID NO: 161931 - DNA, 20 bp, Artificial
  CRISPR gRNA sequence
gttctcatgattcttaaaag

SEQ ID NO: 161932 - DNA, 20 bp, Artificial
  CRISPR gRNA sequence
ttctcatgattcttaaaagc

SEQ ID NO: 161933 - DNA, 20 bp, Artificial
  CRISPR gRNA sequence
tcatgattcttaaaagctct

SEQ ID NO: 161934 - DNA, 20 bp, Artificial
  CRISPR gRNA sequence
atgattcttaaaagctctgt

SEQ ID NO: 161935 - DNA, 20 bp, Artificial
  CRISPR gRNA sequence
ttaaaagctctgtagttgtc

SEQ ID NO: 161936 - DNA, 20 bp, Artificial
  CRISPR gRNA sequence
aaaagctctgtagttgtcta

SEQ ID NO: 161937 - DNA, 20 bp, Artificial
  CRISPR gRNA sequence
aaagctctgtagttgtctat

SEQ ID NO: 161938 - DNA, 20 bp, Artificial
  CRISPR gRNA sequence
tgtagttgtctataaatcca

SEQ ID NO: 161939 - DNA, 20 bp, Artificial
  CRISPR gRNA sequence
tagttgtctataaatccagg

SEQ ID NO: 161940 - DNA, 20 bp, Artificial
  CRISPR gRNA sequence
tctataaatccaggtggtgt

SEQ ID NO: 161941 - DNA, 20 bp, Artificial
  CRISPR gRNA sequence
taaatccaggtggtgttcag

SEQ ID NO: 161942 - DNA, 20 bp, Artificial
  CRISPR gRNA sequence
agctgggattgaaattagtt

SEQ ID NO: 161943 - DNA, 20 bp, Artificial
  CRISPR gRNA sequence
ggattgaaattagttaaaaa

SEQ ID NO: 161944 - DNA, 20 bp, Artificial
  CRISPR gRNA sequence
aaattagttaaaaaccatat

SEQ ID NO: 161945 - DNA, 20 bp, Artificial
  CRISPR gRNA sequence
gttaaaaaccatatcaagat

SEQ ID NO: 161946 - DNA, 20 bp, Artificial
  CRISPR gRNA sequence
aaaaccatatcaagatgatt

SEQ ID NO: 161947 - DNA, 20 bp, Artificial
  CRISPR gRNA sequence
tgcaccagagtgattgtgta

SEQ ID NO: 161948 - DNA, 20 bp, Artificial
  CRISPR gRNA sequence
tgtaaaaccctatattcccg

SEQ ID NO: 161949 - DNA, 20 bp, Artificial
  CRISPR gRNA sequence
tattcccgcacagcagagct

SEQ ID NO: 161950 - DNA, 20 bp, Artificial
  CRISPR gRNA sequence
ccgcacagcagagctctggg

SEQ ID NO: 161951 - DNA, 20 bp, Artificial
  CRISPR gRNA sequence
tgggaacagcaaataacaga

SEQ ID NO: 161952 - DNA, 20 bp, Artificial
  CRISPR gRNA sequence
ggaacagcaaataacagact

SEQ ID NO: 161953 - DNA, 20 bp, Artificial
  CRISPR gRNA sequence
cttcgtgttgagttttgccc

SEQ ID NO: 161954 - DNA, 20 bp, Artificial
  CRISPR gRNA sequence
ttcgtgttgagttttgcccc

SEQ ID NO: 161955 - DNA, 20 bp, Artificial
  CRISPR gRNA sequence
cgtgttgagttttgccccag

SEQ ID NO: 161956 - DNA, 20 bp, Artificial
  CRISPR gRNA sequence
gtgttgagttttgccccagt

SEQ ID NO: 161957 - DNA, 20 bp, Artificial
  CRISPR gRNA sequence
agttttgccccagtgggcct

SEQ ID NO: 161958 - DNA, 20 bp, Artificial
  CRISPR gRNA sequence
tgccccagtgggcctctttg

SEQ ID NO: 161959 - DNA, 20 bp, Artificial
  CRISPR gRNA sequence
gccccagtgggcctctttga

SEQ ID NO: 161960 - DNA, 20 bp, Artificial
  CRISPR gRNA sequence
ccccagtgggcctctttgaa

SEQ ID NO: 161961 - DNA, 20 bp, Artificial
  CRISPR gRNA sequence
tttgaaaataggaaagagaa

SEQ ID NO: 161962 - DNA, 20 bp, Artificial
  CRISPR gRNA sequence
tgaaaataggaaagagaaag

SEQ ID NO: 161963 - DNA, 20 bp, Artificial
  CRISPR gRNA sequence
gaaaataggaaagagaaagc

SEQ ID NO: 161964 - DNA, 20 bp, Artificial
  CRISPR gRNA sequence
aaaataggaaagagaaagct

SEQ ID NO: 161965 - DNA, 20 bp, Artificial
  CRISPR gRNA sequence
actttgtctttatggaggtg

SEQ ID NO: 161966 - DNA, 20 bp, Artificial
  CRISPR gRNA sequence
tgtctttatggaggtgagtt

SEQ ID NO: 161967 - DNA, 20 bp, Artificial
  CRISPR gRNA sequence
gtctttatggaggtgagttg

SEQ ID NO: 161968 - DNA, 20 bp, Artificial
  CRISPR gRNA sequence
tctttatggaggtgagttgg

SEQ ID NO: 161969 - DNA, 20 bp, Artificial
  CRISPR gRNA sequence
tatggaggtgagttgggggc

SEQ ID NO: 161970 - DNA, 20 bp, Artificial
  CRISPR gRNA sequence
atggaggtgagttgggggca

SEQ ID NO: 161971 - DNA, 20 bp, Artificial
  CRISPR gRNA sequence
tggaggtgagttgggggcag

SEQ ID NO: 161972 - DNA, 20 bp, Artificial
  CRISPR gRNA sequence
ggggcaggtgggcaacaatg

SEQ ID NO: 161973 - DNA, 20 bp, Artificial
  CRISPR gRNA sequence
aatttcgaaaagaaaaatct

SEQ ID NO: 161974 - DNA, 20 bp, Artificial
  CRISPR gRNA sequence
cgaaaagaaaaatctaattc

SEQ ID NO: 161975 - DNA, 20 bp, Artificial
  CRISPR gRNA sequence
gaaaagaaaaatctaattct

SEQ ID NO: 161976 - DNA, 20 bp, Artificial
  CRISPR gRNA sequence
attctctacttactctttac

SEQ ID NO: 161977 - DNA, 20 bp, Artificial
  CRISPR gRNA sequence
tctacttactctttacatcc

SEQ ID NO: 161978 - DNA, 20 bp, Artificial
  CRISPR gRNA sequence
tacttactctttacatccca

SEQ ID NO: 161979 - DNA, 20 bp, Artificial
  CRISPR gRNA sequence
cttactctttacatcccatt

SEQ ID NO: 161980 - DNA, 20 bp, Artificial
  CRISPR gRNA sequence
actctttacatcccattcag

SEQ ID NO: 161981 - DNA, 20 bp, Artificial
  CRISPR gRNA sequence
ctctttacatcccattcagc

SEQ ID NO: 161982 - DNA, 20 bp, Artificial
  CRISPR gRNA sequence
tttacatcccattcagcctt

SEQ ID NO: 161983 - DNA, 20 bp, Artificial
  CRISPR gRNA sequence
tacatcccattcagccttca

SEQ ID NO: 161984 - DNA, 20 bp, Artificial
  CRISPR gRNA sequence
acatcccattcagccttcac

SEQ ID NO: 161985 - DNA, 20 bp, Artificial
  CRISPR gRNA sequence
catcccattcagccttcact

SEQ ID NO: 161986 - DNA, 20 bp, Artificial
  CRISPR gRNA sequence
agccttcacttaactgtaat

SEQ ID NO: 161987 - DNA, 20 bp, Artificial
  CRISPR gRNA sequence
cacttaactgtaattgagtg

SEQ ID NO: 161988 - DNA, 20 bp, Artificial
  CRISPR gRNA sequence
acttaactgtaattgagtgc

SEQ ID NO: 161989 - DNA, 20 bp, Artificial
  CRISPR gRNA sequence
aactgtaattgagtgcctag

SEQ ID NO: 161990 - DNA, 20 bp, Artificial
  CRISPR gRNA sequence
actgtaattgagtgcctagg

SEQ ID NO: 161991 - DNA, 20 bp, Artificial
  CRISPR gRNA sequence
taattgagtgcctaggtcac

SEQ ID NO: 161992 - DNA, 20 bp, Artificial
  CRISPR gRNA sequence
agtgcctaggtcactttctt

SEQ ID NO: 161993 - DNA, 20 bp, Artificial
  CRISPR gRNA sequence
ggtcactttcttttaattgg

SEQ ID NO: 161994 - DNA, 20 bp, Artificial
  CRISPR gRNA sequence
tcttttaattggcagtttca

SEQ ID NO: 161995 - DNA, 20 bp, Artificial
  CRISPR gRNA sequence
cttttaattggcagtttcat

SEQ ID NO: 161996 - DNA, 20 bp, Artificial
  CRISPR gRNA sequence
ttttaattggcagtttcatc

SEQ ID NO: 161997 - DNA, 20 bp, Artificial
  CRISPR gRNA sequence
ttaattggcagtttcatctt

SEQ ID NO: 161998 - DNA, 20 bp, Artificial
  CRISPR gRNA sequence
taattggcagtttcatcttt

SEQ ID NO: 161999 - DNA, 20 bp, Artificial
  CRISPR gRNA sequence
aattggcagtttcatctttt

SEQ ID NO: 162000 - DNA, 20 bp, Artificial
  CRISPR gRNA sequence
attggcagtttcatcttttc

SEQ ID NO: 162001 - DNA, 20 bp, Artificial
  CRISPR gRNA sequence
gcagtttcatcttttcattc

SEQ ID NO: 162002 - DNA, 20 bp, Artificial
  CRISPR gRNA sequence
catcttttcattcctcagtg

SEQ ID NO: 162003 - DNA, 20 bp, Artificial
  CRISPR gRNA sequence
atcttttcattcctcagtgc

SEQ ID NO: 162004 - DNA, 20 bp, Artificial
  CRISPR gRNA sequence
ttcattcctcagtgcctcct

SEQ ID NO: 162005 - DNA, 20 bp, Artificial
  CRISPR gRNA sequence
tcattcctcagtgcctcctg

SEQ ID NO: 162006 - DNA, 20 bp, Artificial
  CRISPR gRNA sequence
cattcctcagtgcctcctga

SEQ ID NO: 162007 - DNA, 20 bp, Artificial
  CRISPR gRNA sequence
attcctcagtgcctcctgat

SEQ ID NO: 162008 - DNA, 20 bp, Artificial
  CRISPR gRNA sequence
ctcagtgcctcctgattggg

SEQ ID NO: 162009 - DNA, 20 bp, Artificial
  CRISPR gRNA sequence
agtgcctcctgattgggtga

SEQ ID NO: 162010 - DNA, 20 bp, Artificial
  CRISPR gRNA sequence
ctgattgggtgatgacattt

SEQ ID NO: 162011 - DNA, 20 bp, Artificial
  CRISPR gRNA sequence
attgggtgatgacatttcta

SEQ ID NO: 162012 - DNA, 20 bp, Artificial
  CRISPR gRNA sequence
ggtgatgacatttctaacat

SEQ ID NO: 162013 - DNA, 20 bp, Artificial
  CRISPR gRNA sequence
ctaacattacaatcaaatca

SEQ ID NO: 162014 - DNA, 20 bp, Artificial
  CRISPR gRNA sequence
taacattacaatcaaatcag

SEQ ID NO: 162015 - DNA, 20 bp, Artificial
  CRISPR gRNA sequence
acattacaatcaaatcagat

SEQ ID NO: 162016 - DNA, 20 bp, Artificial
  CRISPR gRNA sequence
caatcaaatcagataactgt

SEQ ID NO: 162017 - DNA, 20 bp, Artificial
  CRISPR gRNA sequence
tttaaacaagaacttggtga

SEQ ID NO: 162018 - DNA, 20 bp, Artificial
  CRISPR gRNA sequence
aaacaagaacttggtgatga

SEQ ID NO: 162019 - DNA, 20 bp, Artificial
  CRISPR gRNA sequence
aacaagaacttggtgatgaa

SEQ ID NO: 162020 - DNA, 20 bp, Artificial
  CRISPR gRNA sequence
ggtgatgaaggttggtggac

SEQ ID NO: 162021 - DNA, 20 bp, Artificial
  CRISPR gRNA sequence
gtgatgaaggttggtggact

SEQ ID NO: 162022 - DNA, 20 bp, Artificial
  CRISPR gRNA sequence
gtggactgttacaaaacagg

SEQ ID NO: 162023 - DNA, 20 bp, Artificial
  CRISPR gRNA sequence
ttacaaaacaggtcctgtgc

SEQ ID NO: 162024 - DNA, 20 bp, Artificial
  CRISPR gRNA sequence
caaaacaggtcctgtgctgt

SEQ ID NO: 162025 - DNA, 20 bp, Artificial
  CRISPR gRNA sequence
tgctgtgtgagccctttctg

SEQ ID NO: 162026 - DNA, 20 bp, Artificial
  CRISPR gRNA sequence
tgtgagccctttctgtagag

SEQ ID NO: 162027 - DNA, 20 bp, Artificial
  CRISPR gRNA sequence
tctgtagagcagtgcttctc

SEQ ID NO: 162028 - DNA, 20 bp, Artificial
  CRISPR gRNA sequence
ctgtagagcagtgcttctca

SEQ ID NO: 162029 - DNA, 20 bp, Artificial
  CRISPR gRNA sequence
tgtagagcagtgcttctcaa

SEQ ID NO: 162030 - DNA, 20 bp, Artificial
  CRISPR gRNA sequence
tagagcagtgcttctcaaac

SEQ ID NO: 162031 - DNA, 20 bp, Artificial
  CRISPR gRNA sequence
ctcaaactttattgtctgta

SEQ ID NO: 162032 - DNA, 20 bp, Artificial
  CRISPR gRNA sequence
tcaaactttattgtctgtat

SEQ ID NO: 162033 - DNA, 20 bp, Artificial
  CRISPR gRNA sequence
aaactttattgtctgtatga

SEQ ID NO: 162034 - DNA, 20 bp, Artificial
  CRISPR gRNA sequence
tattgtctgtatgaaccacg

SEQ ID NO: 162035 - DNA, 20 bp, Artificial
  CRISPR gRNA sequence
attgtctgtatgaaccacgt

SEQ ID NO: 162036 - DNA, 20 bp, Artificial
  CRISPR gRNA sequence
ttgtctgtatgaaccacgtg

SEQ ID NO: 162037 - DNA, 20 bp, Artificial
  CRISPR gRNA sequence
tctgtatgaaccacgtgagg

SEQ ID NO: 162038 - DNA, 20 bp, Artificial
  CRISPR gRNA sequence
tatgaaccacgtgagggagg

SEQ ID NO: 162039 - DNA, 20 bp, Artificial
  CRISPR gRNA sequence
cttaaaatattgatgctgat

SEQ ID NO: 162040 - DNA, 20 bp, Artificial
  CRISPR gRNA sequence
ttaaaatattgatgctgatt

SEQ ID NO: 162041 - DNA, 20 bp, Artificial
  CRISPR gRNA sequence
aaaatattgatgctgattta

SEQ ID NO: 162042 - DNA, 20 bp, Artificial
  CRISPR gRNA sequence
aaatattgatgctgatttag

SEQ ID NO: 162043 - DNA, 20 bp, Artificial
  CRISPR gRNA sequence
atgctgatttagtaggttag

SEQ ID NO: 162044 - DNA, 20 bp, Artificial
  CRISPR gRNA sequence
atttagtaggttaggaacgg

SEQ ID NO: 162045 - DNA, 20 bp, Artificial
  CRISPR gRNA sequence
agtaggttaggaacggaacc

SEQ ID NO: 162046 - DNA, 20 bp, Artificial
  CRISPR gRNA sequence
gtaggttaggaacggaacct

SEQ ID NO: 162047 - DNA, 20 bp, Artificial
  CRISPR gRNA sequence
ggaacggaacctgggattct

SEQ ID NO: 162048 - DNA, 20 bp, Artificial
  CRISPR gRNA sequence
ggattctgtgtttcttttga

SEQ ID NO: 162049 - DNA, 20 bp, Artificial
  CRISPR gRNA sequence
tgtgtttcttttgagttccc

SEQ ID NO: 162050 - DNA, 20 bp, Artificial
  CRISPR gRNA sequence
tgtttcttttgagttcccag

SEQ ID NO: 162051 - DNA, 20 bp, Artificial
  CRISPR gRNA sequence
cttttgagttcccaggtgat

SEQ ID NO: 162052 - DNA, 20 bp, Artificial
  CRISPR gRNA sequence
ttttgagttcccaggtgata

SEQ ID NO: 162053 - DNA, 20 bp, Artificial
  CRISPR gRNA sequence
ttgagttcccaggtgatacc

SEQ ID NO: 162054 - DNA, 20 bp, Artificial
  CRISPR gRNA sequence
tgagttcccaggtgatacca

SEQ ID NO: 162055 - DNA, 20 bp, Artificial
  CRISPR gRNA sequence
gagttcccaggtgataccat

SEQ ID NO: 162056 - DNA, 20 bp, Artificial
  CRISPR gRNA sequence
agttcccaggtgataccatt

SEQ ID NO: 162057 - DNA, 20 bp, Artificial
  CRISPR gRNA sequence
ccaggtgataccattgctgg

SEQ ID NO: 162058 - DNA, 20 bp, Artificial
  CRISPR gRNA sequence
ctggtccaaggaccttactt

SEQ ID NO: 162059 - DNA, 20 bp, Artificial
  CRISPR gRNA sequence
gtccaaggaccttactttga

SEQ ID NO: 162060 - DNA, 20 bp, Artificial
  CRISPR gRNA sequence
actttgagtagcagggccgt

SEQ ID NO: 162061 - DNA, 20 bp, Artificial
  CRISPR gRNA sequence
ctttgagtagcagggccgta

SEQ ID NO: 162062 - DNA, 20 bp, Artificial
  CRISPR gRNA sequence
tgagtagcagggccgtaaaa

SEQ ID NO: 162063 - DNA, 20 bp, Artificial
  CRISPR gRNA sequence
gagtagcagggccgtaaaac

SEQ ID NO: 162064 - DNA, 20 bp, Artificial
  CRISPR gRNA sequence
agtagcagggccgtaaaaca

SEQ ID NO: 162065 - DNA, 20 bp, Artificial
  CRISPR gRNA sequence
aactctcacttggatcatag

SEQ ID NO: 162066 - DNA, 20 bp, Artificial
  CRISPR gRNA sequence
actctcacttggatcatagt

SEQ ID NO: 162067 - DNA, 20 bp, Artificial
  CRISPR gRNA sequence
tcacttggatcatagtcaca

SEQ ID NO: 162068 - DNA, 20 bp, Artificial
  CRISPR gRNA sequence
acttggatcatagtcacaag

SEQ ID NO: 162069 - DNA, 20 bp, Artificial
  CRISPR gRNA sequence
ggatcatagtcacaagggga

SEQ ID NO: 162070 - DNA, 20 bp, Artificial
  CRISPR gRNA sequence
gatcatagtcacaaggggag

SEQ ID NO: 162071 - DNA, 20 bp, Artificial
  CRISPR gRNA sequence
tcaaaaaacatgatgccagt

SEQ ID NO: 162072 - DNA, 20 bp, Artificial
  CRISPR gRNA sequence
caaaaaacatgatgccagta

SEQ ID NO: 162073 - DNA, 20 bp, Artificial
  CRISPR gRNA sequence
aaaaaacatgatgccagtac

SEQ ID NO: 162074 - DNA, 20 bp, Artificial
  CRISPR gRNA sequence
tacccactagagcaggggtc

SEQ ID NO: 162075 - DNA, 20 bp, Artificial
  CRISPR gRNA sequence
cccactagagcaggggtccc

SEQ ID NO: 162076 - DNA, 20 bp, Artificial
  CRISPR gRNA sequence
gagcaggggtccccaacccc

SEQ ID NO: 162077 - DNA, 20 bp, Artificial
  CRISPR gRNA sequence
ggccacagaccggtatgggt

SEQ ID NO: 162078 - DNA, 20 bp, Artificial
  CRISPR gRNA sequence
ttaggaacctaggaactggg

SEQ ID NO: 162079 - DNA, 20 bp, Artificial
  CRISPR gRNA sequence
ggaacctaggaactgggctg

SEQ ID NO: 162080 - DNA, 20 bp, Artificial
  CRISPR gRNA sequence
ggaactgggctgcacagcag

SEQ ID NO: 162081 - DNA, 20 bp, Artificial
  CRISPR gRNA sequence
ggctgcacagcaggaggtga

SEQ ID NO: 162082 - DNA, 20 bp, Artificial
  CRISPR gRNA sequence
cacagcaggaggtgagcagc

SEQ ID NO: 162083 - DNA, 20 bp, Artificial
  CRISPR gRNA sequence
ctgcctgagctccacctcct

SEQ ID NO: 162084 - DNA, 20 bp, Artificial
  CRISPR gRNA sequence
cctgagctccacctcctgtc

SEQ ID NO: 162085 - DNA, 20 bp, Artificial
  CRISPR gRNA sequence
agctccacctcctgtcagat

SEQ ID NO: 162086 - DNA, 20 bp, Artificial
  CRISPR gRNA sequence
cacctcctgtcagatcagca

SEQ ID NO: 162087 - DNA, 20 bp, Artificial
  CRISPR gRNA sequence
ctgtcagatcagcagtggca

SEQ ID NO: 162088 - DNA, 20 bp, Artificial
  CRISPR gRNA sequence
tcagatcagcagtggcatta

SEQ ID NO: 162089 - DNA, 20 bp, Artificial
  CRISPR gRNA sequence
gattctcaaaggaatgtgaa

SEQ ID NO: 162090 - DNA, 20 bp, Artificial
  CRISPR gRNA sequence
tcaaaggaatgtgaacccta

SEQ ID NO: 162091 - DNA, 20 bp, Artificial
  CRISPR gRNA sequence
aaaggaatgtgaaccctatc

SEQ ID NO: 162092 - DNA, 20 bp, Artificial
  CRISPR gRNA sequence
tcatgaactgcgcatgtgag

SEQ ID NO: 162093 - DNA, 20 bp, Artificial
  CRISPR gRNA sequence
cgcatgtgagggatctaggt

SEQ ID NO: 162094 - DNA, 20 bp, Artificial
  CRISPR gRNA sequence
ggtagcacactccttatgag

SEQ ID NO: 162095 - DNA, 20 bp, Artificial
  CRISPR gRNA sequence
cttatgagaatctaatgccc

SEQ ID NO: 162096 - DNA, 20 bp, Artificial
  CRISPR gRNA sequence
atgagaatctaatgcccacc

SEQ ID NO: 162097 - DNA, 20 bp, Artificial
  CRISPR gRNA sequence
tgagaatctaatgcccaccc

SEQ ID NO: 162098 - DNA, 20 bp, Artificial
  CRISPR gRNA sequence
atgcccaccctgcccatctc

SEQ ID NO: 162099 - DNA, 20 bp, Artificial
  CRISPR gRNA sequence
cccatctctggaaaaattgt

SEQ ID NO: 162100 - DNA, 20 bp, Artificial
  CRISPR gRNA sequence
tggaaaaattgtcttgcaca

SEQ ID NO: 162101 - DNA, 20 bp, Artificial
  CRISPR gRNA sequence
gaaaaattgtcttgcacaaa

SEQ ID NO: 162102 - DNA, 20 bp, Artificial
  CRISPR gRNA sequence
tcttgcacaaaactggttcc

SEQ ID NO: 162103 - DNA, 20 bp, Artificial
  CRISPR gRNA sequence
gcacaaaactggttcctgag

SEQ ID NO: 162104 - DNA, 20 bp, Artificial
  CRISPR gRNA sequence
cacaaaactggttcctgagg

SEQ ID NO: 162105 - DNA, 20 bp, Artificial
  CRISPR gRNA sequence
gttcctgaggttggggacca

SEQ ID NO: 162106 - DNA, 20 bp, Artificial
  CRISPR gRNA sequence
ctgaggttggggaccactgt

SEQ ID NO: 162107 - DNA, 20 bp, Artificial
  CRISPR gRNA sequence
aggttggggaccactgtcct

SEQ ID NO: 162108 - DNA, 20 bp, Artificial
  CRISPR gRNA sequence
gggaccactgtcctagagtt

SEQ ID NO: 162109 - DNA, 20 bp, Artificial
  CRISPR gRNA sequence
tcctagagttcctgattcag

SEQ ID NO: 162110 - DNA, 20 bp, Artificial
  CRISPR gRNA sequence
gagttcctgattcagttggt

SEQ ID NO: 162111 - DNA, 20 bp, Artificial
  CRISPR gRNA sequence
ctgattcagttggtctccag

SEQ ID NO: 162112 - DNA, 20 bp, Artificial
  CRISPR gRNA sequence
attcagttggtctccaggag

SEQ ID NO: 162113 - DNA, 20 bp, Artificial
  CRISPR gRNA sequence
agttggtctccaggagagag

SEQ ID NO: 162114 - DNA, 20 bp, Artificial
  CRISPR gRNA sequence
gtctccaggagagagctcag

SEQ ID NO: 162115 - DNA, 20 bp, Artificial
  CRISPR gRNA sequence
caggagagagctcaggcatc

SEQ ID NO: 162116 - DNA, 20 bp, Artificial
  CRISPR gRNA sequence
aggcatcttgtttttcaaaa

SEQ ID NO: 162117 - DNA, 20 bp, Artificial
  CRISPR gRNA sequence
gtttttcaaaagcttttcag

SEQ ID NO: 162118 - DNA, 20 bp, Artificial
  CRISPR gRNA sequence
tttttcaaaagcttttcagg

SEQ ID NO: 162119 - DNA, 20 bp, Artificial
  CRISPR gRNA sequence
ttcaaaagcttttcaggtga

SEQ ID NO: 162120 - DNA, 20 bp, Artificial
  CRISPR gRNA sequence
tcaaaagcttttcaggtgat

SEQ ID NO: 162121 - DNA, 20 bp, Artificial
  CRISPR gRNA sequence
caaaagcttttcaggtgatt

SEQ ID NO: 162122 - DNA, 20 bp, Artificial
  CRISPR gRNA sequence
aaaagcttttcaggtgattc

SEQ ID NO: 162123 - DNA, 20 bp, Artificial
  CRISPR gRNA sequence
ttcaggtgattctaacctgc

SEQ ID NO: 162124 - DNA, 20 bp, Artificial
  CRISPR gRNA sequence
tcaggtgattctaacctgca

SEQ ID NO: 162125 - DNA, 20 bp, Artificial
  CRISPR gRNA sequence
caggtgattctaacctgcag

SEQ ID NO: 162126 - DNA, 20 bp, Artificial
  CRISPR gRNA sequence
aggtgattctaacctgcagc

SEQ ID NO: 162127 - DNA, 20 bp, Artificial
  CRISPR gRNA sequence
taacctgcagccccaagatt

SEQ ID NO: 162128 - DNA, 20 bp, Artificial
  CRISPR gRNA sequence
acctgcagccccaagattga

SEQ ID NO: 162129 - DNA, 20 bp, Artificial
  CRISPR gRNA sequence
cagccccaagattgagaatc

SEQ ID NO: 162130 - DNA, 20 bp, Artificial
  CRISPR gRNA sequence
agaatcattgatttcaaagg

SEQ ID NO: 162131 - DNA, 20 bp, Artificial
  CRISPR gRNA sequence
atttcaaagggttgagaatc

SEQ ID NO: 162132 - DNA, 20 bp, Artificial
  CRISPR gRNA sequence
caaagggttgagaatcttga

SEQ ID NO: 162133 - DNA, 20 bp, Artificial
  CRISPR gRNA sequence
aaagggttgagaatcttgac

SEQ ID NO: 162134 - DNA, 20 bp, Artificial
  CRISPR gRNA sequence
agaatcttgacttgccagag

SEQ ID NO: 162135 - DNA, 20 bp, Artificial
  CRISPR gRNA sequence
gacttgccagagtgcctgac

SEQ ID NO: 162136 - DNA, 20 bp, Artificial
  CRISPR gRNA sequence
acttgccagagtgcctgact

SEQ ID NO: 162137 - DNA, 20 bp, Artificial
  CRISPR gRNA sequence
gccagagtgcctgactgggt

SEQ ID NO: 162138 - DNA, 20 bp, Artificial
  CRISPR gRNA sequence
ccagagtgcctgactgggta

SEQ ID NO: 162139 - DNA, 20 bp, Artificial
  CRISPR gRNA sequence
actgggtaggcctggaaaag

SEQ ID NO: 162140 - DNA, 20 bp, Artificial
  CRISPR gRNA sequence
ggtaggcctggaaaaggttt

SEQ ID NO: 162141 - DNA, 20 bp, Artificial
  CRISPR gRNA sequence
gaaaaggtttctctttatta

SEQ ID NO: 162142 - DNA, 20 bp, Artificial
  CRISPR gRNA sequence
ctctttattatttgaaactc

SEQ ID NO: 162143 - DNA, 20 bp, Artificial
  CRISPR gRNA sequence
tctttattatttgaaactct

SEQ ID NO: 162144 - DNA, 20 bp, Artificial
  CRISPR gRNA sequence
tttattatttgaaactctgg

SEQ ID NO: 162145 - DNA, 20 bp, Artificial
  CRISPR gRNA sequence
tattatttgaaactctggat

SEQ ID NO: 162146 - DNA, 20 bp, Artificial
  CRISPR gRNA sequence
attatttgaaactctggatg

SEQ ID NO: 162147 - DNA, 20 bp, Artificial
  CRISPR gRNA sequence
ttatttgaaactctggatgt

SEQ ID NO: 162148 - DNA, 20 bp, Artificial
  CRISPR gRNA sequence
tttgaaactctggatgttct

SEQ ID NO: 162149 - DNA, 20 bp, Artificial
  CRISPR gRNA sequence
gaaactctggatgttcttca

SEQ ID NO: 162150 - DNA, 20 bp, Artificial
  CRISPR gRNA sequence
aaactctggatgttcttcag

SEQ ID NO: 162151 - DNA, 20 bp, Artificial
  CRISPR gRNA sequence
tggatgttcttcagtgcagc

SEQ ID NO: 162152 - DNA, 20 bp, Artificial
  CRISPR gRNA sequence
gatgttcttcagtgcagccc

SEQ ID NO: 162153 - DNA, 20 bp, Artificial
  CRISPR gRNA sequence
ttcagtgcagcccaagatct

SEQ ID NO: 162154 - DNA, 20 bp, Artificial
  CRISPR gRNA sequence
cagtgcagcccaagatctgt

SEQ ID NO: 162155 - DNA, 20 bp, Artificial
  CRISPR gRNA sequence
agtgcagcccaagatctgtt

SEQ ID NO: 162156 - DNA, 20 bp, Artificial
  CRISPR gRNA sequence
ttgacttttctttgtctcca

SEQ ID NO: 162157 - DNA, 20 bp, Artificial
  CRISPR gRNA sequence
acttttctttgtctccaaac

SEQ ID NO: 162158 - DNA, 20 bp, Artificial
  CRISPR gRNA sequence
ttctttgtctccaaactctc

SEQ ID NO: 162159 - DNA, 20 bp, Artificial
  CRISPR gRNA sequence
tctttgtctccaaactctca

SEQ ID NO: 162160 - DNA, 20 bp, Artificial
  CRISPR gRNA sequence
ctttgtctccaaactctcat

SEQ ID NO: 162161 - DNA, 20 bp, Artificial
  CRISPR gRNA sequence
tttgtctccaaactctcatt

SEQ ID NO: 162162 - DNA, 20 bp, Artificial
  CRISPR gRNA sequence
tgtctccaaactctcattga

SEQ ID NO: 162163 - DNA, 20 bp, Artificial
  CRISPR gRNA sequence
gtctccaaactctcattgag

SEQ ID NO: 162164 - DNA, 20 bp, Artificial
  CRISPR gRNA sequence
tctccaaactctcattgagt

SEQ ID NO: 162165 - DNA, 20 bp, Artificial
  CRISPR gRNA sequence
caaactctcattgagtgaat

SEQ ID NO: 162166 - DNA, 20 bp, Artificial
  CRISPR gRNA sequence
tcattgagtgaattcagatt

SEQ ID NO: 162167 - DNA, 20 bp, Artificial
  CRISPR gRNA sequence
attgagtgaattcagatttg

SEQ ID NO: 162168 - DNA, 20 bp, Artificial
  CRISPR gRNA sequence
agtgaattcagatttgaatt

SEQ ID NO: 162169 - DNA, 20 bp, Artificial
  CRISPR gRNA sequence
agatttgaatttgtcttgaa

SEQ ID NO: 162170 - DNA, 20 bp, Artificial
  CRISPR gRNA sequence
gaatttgtcttgaaatgcag

SEQ ID NO: 162171 - DNA, 20 bp, Artificial
  CRISPR gRNA sequence
aatttgtcttgaaatgcagc

SEQ ID NO: 162172 - DNA, 20 bp, Artificial
  CRISPR gRNA sequence
gtcttgaaatgcagcagttt

SEQ ID NO: 162173 - DNA, 20 bp, Artificial
  CRISPR gRNA sequence
tcttgaaatgcagcagtttc

SEQ ID NO: 162174 - DNA, 20 bp, Artificial
  CRISPR gRNA sequence
gaaatgcagcagtttcagat

SEQ ID NO: 162175 - DNA, 20 bp, Artificial
  CRISPR gRNA sequence
aaatgcagcagtttcagatg

SEQ ID NO: 162176 - DNA, 20 bp, Artificial
  CRISPR gRNA sequence
cagatggaagcatttttaac

SEQ ID NO: 162177 - DNA, 20 bp, Artificial
  CRISPR gRNA sequence
agatggaagcatttttaacg

SEQ ID NO: 162178 - DNA, 20 bp, Artificial
  CRISPR gRNA sequence
ttaacgtagttctttggtag

SEQ ID NO: 162179 - DNA, 20 bp, Artificial
  CRISPR gRNA sequence
taacgtagttctttggtagt

SEQ ID NO: 162180 - DNA, 20 bp, Artificial
  CRISPR gRNA sequence
aacgtagttctttggtagtg

SEQ ID NO: 162181 - DNA, 20 bp, Artificial
  CRISPR gRNA sequence
acgtagttctttggtagtgg

SEQ ID NO: 162182 - DNA, 20 bp, Artificial
  CRISPR gRNA sequence
tttggtagtggtcaggagca

SEQ ID NO: 162183 - DNA, 20 bp, Artificial
  CRISPR gRNA sequence
tggtagtggtcaggagcatg

SEQ ID NO: 162184 - DNA, 20 bp, Artificial
  CRISPR gRNA sequence
ggtagtggtcaggagcatga

SEQ ID NO: 162185 - DNA, 20 bp, Artificial
  CRISPR gRNA sequence
gtagtggtcaggagcatgag

SEQ ID NO: 162186 - DNA, 20 bp, Artificial
  CRISPR gRNA sequence
tgagagataatctgctcttc

SEQ ID NO: 162187 - DNA, 20 bp, Artificial
  CRISPR gRNA sequence
agagataatctgctcttctg

SEQ ID NO: 162188 - DNA, 20 bp, Artificial
  CRISPR gRNA sequence
ctcttctgccttactgatag

SEQ ID NO: 162189 - DNA, 20 bp, Artificial
  CRISPR gRNA sequence
ttctgccttactgatagaac

SEQ ID NO: 162190 - DNA, 20 bp, Artificial
  CRISPR gRNA sequence
ctgccttactgatagaactc

SEQ ID NO: 162191 - DNA, 20 bp, Artificial
  CRISPR gRNA sequence
tgccttactgatagaactcc

SEQ ID NO: 162192 - DNA, 20 bp, Artificial
  CRISPR gRNA sequence
ccttactgatagaactccca

SEQ ID NO: 162193 - DNA, 20 bp, Artificial
  CRISPR gRNA sequence
actgatagaactcccaaaag

SEQ ID NO: 162194 - DNA, 20 bp, Artificial
  CRISPR gRNA sequence
ctgatagaactcccaaaagt

SEQ ID NO: 162195 - DNA, 20 bp, Artificial
  CRISPR gRNA sequence
atagaactcccaaaagtagg

SEQ ID NO: 162196 - DNA, 20 bp, Artificial
  CRISPR gRNA sequence
ccaaaagtaggggggagcag

SEQ ID NO: 162197 - DNA, 20 bp, Artificial
  CRISPR gRNA sequence
ttcttccagttgaatcagta

SEQ ID NO: 162198 - DNA, 20 bp, Artificial
  CRISPR gRNA sequence
ttccagttgaatcagtatca

SEQ ID NO: 162199 - DNA, 20 bp, Artificial
  CRISPR gRNA sequence
ccagttgaatcagtatcagg

SEQ ID NO: 162200 - DNA, 20 bp, Artificial
  CRISPR gRNA sequence
cagttgaatcagtatcagga

SEQ ID NO: 162201 - DNA, 20 bp, Artificial
  CRISPR gRNA sequence
aatcagtatcaggagaagga

SEQ ID NO: 162202 - DNA, 20 bp, Artificial
  CRISPR gRNA sequence
aggagttaaatgttactcac

SEQ ID NO: 162203 - DNA, 20 bp, Artificial
  CRISPR gRNA sequence
aatgttactcacttcagtta

SEQ ID NO: 162204 - DNA, 20 bp, Artificial
  CRISPR gRNA sequence
ctcacttcagttacatggta

SEQ ID NO: 162205 - DNA, 20 bp, Artificial
  CRISPR gRNA sequence
acttcagttacatggtagct

SEQ ID NO: 162206 - DNA, 20 bp, Artificial
  CRISPR gRNA sequence
cagttacatggtagctagtg

SEQ ID NO: 162207 - DNA, 20 bp, Artificial
  CRISPR gRNA sequence
agttacatggtagctagtga

SEQ ID NO: 162208 - DNA, 20 bp, Artificial
  CRISPR gRNA sequence
catggtagctagtgaagtgg

SEQ ID NO: 162209 - DNA, 20 bp, Artificial
  CRISPR gRNA sequence
gtgaagtggggagcatgaat

SEQ ID NO: 162210 - DNA, 20 bp, Artificial
  CRISPR gRNA sequence
cgtgggcctcaatctactga

SEQ ID NO: 162211 - DNA, 20 bp, Artificial
  CRISPR gRNA sequence
gtgggcctcaatctactgat

SEQ ID NO: 162212 - DNA, 20 bp, Artificial
  CRISPR gRNA sequence
aatctactgattgtagaggg

SEQ ID NO: 162213 - DNA, 20 bp, Artificial
  CRISPR gRNA sequence
ctgattgtagagggcctccc

SEQ ID NO: 162214 - DNA, 20 bp, Artificial
  CRISPR gRNA sequence
attgtagagggcctcccttt

SEQ ID NO: 162215 - DNA, 20 bp, Artificial
  CRISPR gRNA sequence
tagagggcctcccttttcca

SEQ ID NO: 162216 - DNA, 20 bp, Artificial
  CRISPR gRNA sequence
ccttttccaacaagcttatg

SEQ ID NO: 162217 - DNA, 20 bp, Artificial
  CRISPR gRNA sequence
ttccaacaagcttatggtaa

SEQ ID NO: 162218 - DNA, 20 bp, Artificial
  CRISPR gRNA sequence
tccaacaagcttatggtaaa

SEQ ID NO: 162219 - DNA, 20 bp, Artificial
  CRISPR gRNA sequence
ccaacaagcttatggtaaat

SEQ ID NO: 162220 - DNA, 20 bp, Artificial
  CRISPR gRNA sequence
caacaagcttatggtaaatc

SEQ ID NO: 162221 - DNA, 20 bp, Artificial
  CRISPR gRNA sequence
atggtaaatccttacatgta

SEQ ID NO: 162222 - DNA, 20 bp, Artificial
  CRISPR gRNA sequence
tggtaaatccttacatgtaa

SEQ ID NO: 162223 - DNA, 20 bp, Artificial
  CRISPR gRNA sequence
acatgtaactagaaggctag

SEQ ID NO: 162224 - DNA, 20 bp, Artificial
  CRISPR gRNA sequence
catgtaactagaaggctagg

SEQ ID NO: 162225 - DNA, 20 bp, Artificial
  CRISPR gRNA sequence
gaaggctaggataggattat

SEQ ID NO: 162226 - DNA, 20 bp, Artificial
  CRISPR gRNA sequence
ggataggattatagaaaact

SEQ ID NO: 162227 - DNA, 20 bp, Artificial
  CRISPR gRNA sequence
tagaaaactgggtgattgtc

SEQ ID NO: 162228 - DNA, 20 bp, Artificial
  CRISPR gRNA sequence
ggtgattgtcaacagggatg

SEQ ID NO: 162229 - DNA, 20 bp, Artificial
  CRISPR gRNA sequence
tcaacagggatgaaccatac

SEQ ID NO: 162230 - DNA, 20 bp, Artificial
  CRISPR gRNA sequence
aagatccacttttacacact

SEQ ID NO: 162231 - DNA, 20 bp, Artificial
  CRISPR gRNA sequence
ttacacactgcttcttgaga

SEQ ID NO: 162232 - DNA, 20 bp, Artificial
  CRISPR gRNA sequence
tacacactgcttcttgagat

SEQ ID NO: 162233 - DNA, 20 bp, Artificial
  CRISPR gRNA sequence
acacactgcttcttgagatc

SEQ ID NO: 162234 - DNA, 20 bp, Artificial
  CRISPR gRNA sequence
cacactgcttcttgagatct

SEQ ID NO: 162235 - DNA, 20 bp, Artificial
  CRISPR gRNA sequence
cttcttgagatctcaaggtt

SEQ ID NO: 162236 - DNA, 20 bp, Artificial
  CRISPR gRNA sequence
cttgagatctcaaggtttca

SEQ ID NO: 162237 - DNA, 20 bp, Artificial
  CRISPR gRNA sequence
ttgagatctcaaggtttcag

SEQ ID NO: 162238 - DNA, 20 bp, Artificial
  CRISPR gRNA sequence
gagatctcaaggtttcagga

SEQ ID NO: 162239 - DNA, 20 bp, Artificial
  CRISPR gRNA sequence
agatctcaaggtttcaggaa

SEQ ID NO: 162240 - DNA, 20 bp, Artificial
  CRISPR gRNA sequence
aaggtttcaggaacatgaaa

SEQ ID NO: 162241 - DNA, 20 bp, Artificial
  CRISPR gRNA sequence
caggaacatgaaaaaatagt

SEQ ID NO: 162242 - DNA, 20 bp, Artificial
  CRISPR gRNA sequence
aggaacatgaaaaaatagtt

SEQ ID NO: 162243 - DNA, 20 bp, Artificial
  CRISPR gRNA sequence
gtcacaaagaaaagctttgg

SEQ ID NO: 162244 - DNA, 20 bp, Artificial
  CRISPR gRNA sequence
tcacaaagaaaagctttggg

SEQ ID NO: 162245 - DNA, 20 bp, Artificial
  CRISPR gRNA sequence
tgggaaggggattaaagcag

SEQ ID NO: 162246 - DNA, 20 bp, Artificial
  CRISPR gRNA sequence
gggaaggggattaaagcaga

SEQ ID NO: 162247 - DNA, 20 bp, Artificial
  CRISPR gRNA sequence
ggaaggggattaaagcagag

SEQ ID NO: 162248 - DNA, 20 bp, Artificial
  CRISPR gRNA sequence
aagcagagcttattataaat

SEQ ID NO: 162249 - DNA, 20 bp, Artificial
  CRISPR gRNA sequence
attataaatttctgcctcat

SEQ ID NO: 162250 - DNA, 20 bp, Artificial
  CRISPR gRNA sequence
ttataaatttctgcctcatt

SEQ ID NO: 162251 - DNA, 20 bp, Artificial
  CRISPR gRNA sequence
taaatttctgcctcatttta

SEQ ID NO: 162252 - DNA, 20 bp, Artificial
  CRISPR gRNA sequence
ctgcctcattttacatctct

SEQ ID NO: 162253 - DNA, 20 bp, Artificial
  CRISPR gRNA sequence
tgcctcattttacatctctg

SEQ ID NO: 162254 - DNA, 20 bp, Artificial
  CRISPR gRNA sequence
cctcattttacatctctgca

SEQ ID NO: 162255 - DNA, 20 bp, Artificial
  CRISPR gRNA sequence
attttacatctctgcaaggc

SEQ ID NO: 162256 - DNA, 20 bp, Artificial
  CRISPR gRNA sequence
tacatctctgcaaggcggga

SEQ ID NO: 162257 - DNA, 20 bp, Artificial
  CRISPR gRNA sequence
acatctctgcaaggcgggaa

SEQ ID NO: 162258 - DNA, 20 bp, Artificial
  CRISPR gRNA sequence
catctctgcaaggcgggaat

SEQ ID NO: 162259 - DNA, 20 bp, Artificial
  CRISPR gRNA sequence
tgcaaggcgggaatgatctc

SEQ ID NO: 162260 - DNA, 20 bp, Artificial
  CRISPR gRNA sequence
caaggcgggaatgatctctt

SEQ ID NO: 162261 - DNA, 20 bp, Artificial
  CRISPR gRNA sequence
ttgatccttgacttttgttg

SEQ ID NO: 162262 - DNA, 20 bp, Artificial
  CRISPR gRNA sequence
gatccttgacttttgttgct

SEQ ID NO: 162263 - DNA, 20 bp, Artificial
  CRISPR gRNA sequence
atccttgacttttgttgctt

SEQ ID NO: 162264 - DNA, 20 bp, Artificial
  CRISPR gRNA sequence
gacttttgttgcttttgatt

SEQ ID NO: 162265 - DNA, 20 bp, Artificial
  CRISPR gRNA sequence
acttttgttgcttttgatta

SEQ ID NO: 162266 - DNA, 20 bp, Artificial
  CRISPR gRNA sequence
ttgttgcttttgattaaaga

SEQ ID NO: 162267 - DNA, 20 bp, Artificial
  CRISPR gRNA sequence
tgttgcttttgattaaagaa

SEQ ID NO: 162268 - DNA, 20 bp, Artificial
  CRISPR gRNA sequence
gttgcttttgattaaagaag

SEQ ID NO: 162269 - DNA, 20 bp, Artificial
  CRISPR gRNA sequence
ttgcttttgattaaagaaga

SEQ ID NO: 162270 - DNA, 20 bp, Artificial
  CRISPR gRNA sequence
cttttgattaaagaagagaa

SEQ ID NO: 162271 - DNA, 20 bp, Artificial
  CRISPR gRNA sequence
ttgattaaagaagagaaatt

SEQ ID NO: 162272 - DNA, 20 bp, Artificial
  CRISPR gRNA sequence
tgattaaagaagagaaattg

SEQ ID NO: 162273 - DNA, 20 bp, Artificial
  CRISPR gRNA sequence
gattaaagaagagaaattga

SEQ ID NO: 162274 - DNA, 20 bp, Artificial
  CRISPR gRNA sequence
attaaagaagagaaattgaa

SEQ ID NO: 162275 - DNA, 20 bp, Artificial
  CRISPR gRNA sequence
aagaagagaaattgaaggag

SEQ ID NO: 162276 - DNA, 20 bp, Artificial
  CRISPR gRNA sequence
aaggagtaatagtttactct

SEQ ID NO: 162277 - DNA, 20 bp, Artificial
  CRISPR gRNA sequence
actctttcaatttggggaaa

SEQ ID NO: 162278 - DNA, 20 bp, Artificial
  CRISPR gRNA sequence
ctctttcaatttggggaaag

SEQ ID NO: 162279 - DNA, 20 bp, Artificial
  CRISPR gRNA sequence
tttcaatttggggaaagagg

SEQ ID NO: 162280 - DNA, 20 bp, Artificial
  CRISPR gRNA sequence
tcaatttggggaaagaggtc

SEQ ID NO: 162281 - DNA, 20 bp, Artificial
  CRISPR gRNA sequence
caatttggggaaagaggtct

SEQ ID NO: 162282 - DNA, 20 bp, Artificial
  CRISPR gRNA sequence
aatttggggaaagaggtctt

SEQ ID NO: 162283 - DNA, 20 bp, Artificial
  CRISPR gRNA sequence
ggggaaagaggtctttttta

SEQ ID NO: 162284 - DNA, 20 bp, Artificial
  CRISPR gRNA sequence
gggaaagaggtcttttttat

SEQ ID NO: 162285 - DNA, 20 bp, Artificial
  CRISPR gRNA sequence
ttttatcaactttgggcttt

SEQ ID NO: 162286 - DNA, 20 bp, Artificial
  CRISPR gRNA sequence
tttatcaactttgggcttta

SEQ ID NO: 162287 - DNA, 20 bp, Artificial
  CRISPR gRNA sequence
ttatcaactttgggctttag

SEQ ID NO: 162288 - DNA, 20 bp, Artificial
  CRISPR gRNA sequence
tatcaactttgggctttagt

SEQ ID NO: 162289 - DNA, 20 bp, Artificial
  CRISPR gRNA sequence
atcaactttgggctttagtt

SEQ ID NO: 162290 - DNA, 20 bp, Artificial
  CRISPR gRNA sequence
tcaactttgggctttagtta

SEQ ID NO: 162291 - DNA, 20 bp, Artificial
  CRISPR gRNA sequence
tgggctttagttaagtaatc

SEQ ID NO: 162292 - DNA, 20 bp, Artificial
  CRISPR gRNA sequence
gggctttagttaagtaatca

SEQ ID NO: 162293 - DNA, 20 bp, Artificial
  CRISPR gRNA sequence
ggctttagttaagtaatcat

SEQ ID NO: 162294 - DNA, 20 bp, Artificial
  CRISPR gRNA sequence
tagttaagtaatcatggaac

SEQ ID NO: 162295 - DNA, 20 bp, Artificial
  CRISPR gRNA sequence
agttaagtaatcatggaacg

SEQ ID NO: 162296 - DNA, 20 bp, Artificial
  CRISPR gRNA sequence
gttaagtaatcatggaacgt

SEQ ID NO: 162297 - DNA, 20 bp, Artificial
  CRISPR gRNA sequence
agtaatcatggaacgttctt

SEQ ID NO: 162298 - DNA, 20 bp, Artificial
  CRISPR gRNA sequence
ttgtacaaattatatttaaa

SEQ ID NO: 162299 - DNA, 20 bp, Artificial
  CRISPR gRNA sequence
gtacaaattatatttaaaac

SEQ ID NO: 162300 - DNA, 20 bp, Artificial
  CRISPR gRNA sequence
tacaaattatatttaaaacc

SEQ ID NO: 162301 - DNA, 20 bp, Artificial
  CRISPR gRNA sequence
tatttaaaaccaagccaaac

SEQ ID NO: 162302 - DNA, 20 bp, Artificial
  CRISPR gRNA sequence
aaaaccaagccaaacaagag

SEQ ID NO: 162303 - DNA, 20 bp, Artificial
  CRISPR gRNA sequence
aaaccaagccaaacaagagc

SEQ ID NO: 162304 - DNA, 20 bp, Artificial
  CRISPR gRNA sequence
gcaagagagctaaatgtatg

SEQ ID NO: 162305 - DNA, 20 bp, Artificial
  CRISPR gRNA sequence
caagagagctaaatgtatga

SEQ ID NO: 162306 - DNA, 20 bp, Artificial
  CRISPR gRNA sequence
aatgtatgatcatcttgtgc

SEQ ID NO: 162307 - DNA, 20 bp, Artificial
  CRISPR gRNA sequence
gtgctgtatgtattagcctg

SEQ ID NO: 162308 - DNA, 20 bp, Artificial
  CRISPR gRNA sequence
tgctgtatgtattagcctgg

SEQ ID NO: 162309 - DNA, 20 bp, Artificial
  CRISPR gRNA sequence
tatgtattagcctgggaggt

SEQ ID NO: 162310 - DNA, 20 bp, Artificial
  CRISPR gRNA sequence
gcctgggaggttttccaaag

SEQ ID NO: 162311 - DNA, 20 bp, Artificial
  CRISPR gRNA sequence
ggaggttttccaaaggaatg

SEQ ID NO: 162312 - DNA, 20 bp, Artificial
  CRISPR gRNA sequence
tccaaaggaatgatcatccc

SEQ ID NO: 162313 - DNA, 20 bp, Artificial
  CRISPR gRNA sequence
ccaaaggaatgatcatccct

SEQ ID NO: 162314 - DNA, 20 bp, Artificial
  CRISPR gRNA sequence
caaaggaatgatcatcccta

SEQ ID NO: 162315 - DNA, 20 bp, Artificial
  CRISPR gRNA sequence
gcattctctttggcatttct

SEQ ID NO: 162316 - DNA, 20 bp, Artificial
  CRISPR gRNA sequence
tctttggcatttctatgtag

SEQ ID NO: 162317 - DNA, 20 bp, Artificial
  CRISPR gRNA sequence
tttggcatttctatgtagtg

SEQ ID NO: 162318 - DNA, 20 bp, Artificial
  CRISPR gRNA sequence
tggcatttctatgtagtgtc

SEQ ID NO: 162319 - DNA, 20 bp, Artificial
  CRISPR gRNA sequence
ggcatttctatgtagtgtca

SEQ ID NO: 162320 - DNA, 20 bp, Artificial
  CRISPR gRNA sequence
gcatttctatgtagtgtcat

SEQ ID NO: 162321 - DNA, 20 bp, Artificial
  CRISPR gRNA sequence
ctatgtagtgtcatcatctt

SEQ ID NO: 162322 - DNA, 20 bp, Artificial
  CRISPR gRNA sequence
tatgtagtgtcatcatcttc

SEQ ID NO: 162323 - DNA, 20 bp, Artificial
  CRISPR gRNA sequence
tgtagtgtcatcatcttctg

SEQ ID NO: 162324 - DNA, 20 bp, Artificial
  CRISPR gRNA sequence
ctgtgatatgccacacaaga

SEQ ID NO: 162325 - DNA, 20 bp, Artificial
  CRISPR gRNA sequence
tgtgatatgccacacaagaa

SEQ ID NO: 162326 - DNA, 20 bp, Artificial
  CRISPR gRNA sequence
tgatatgccacacaagaagg

SEQ ID NO: 162327 - DNA, 20 bp, Artificial
  CRISPR gRNA sequence
atttctgggattaaactttt

SEQ ID NO: 162328 - DNA, 20 bp, Artificial
  CRISPR gRNA sequence
ctgggattaaacttttaaaa

SEQ ID NO: 162329 - DNA, 20 bp, Artificial
  CRISPR gRNA sequence
tgggattaaacttttaaaaa

SEQ ID NO: 162330 - DNA, 20 bp, Artificial
  CRISPR gRNA sequence
ggattaaacttttaaaaaaa

SEQ ID NO: 162331 - DNA, 20 bp, Artificial
  CRISPR gRNA sequence
aacttttaaaaaaactcttt

SEQ ID NO: 162332 - DNA, 20 bp, Artificial
  CRISPR gRNA sequence
ttaaaaaaactctttaggat

SEQ ID NO: 162333 - DNA, 20 bp, Artificial
  CRISPR gRNA sequence
taaaaaaactctttaggatc

SEQ ID NO: 162334 - DNA, 20 bp, Artificial
  CRISPR gRNA sequence
aaaaaaactctttaggatct

SEQ ID NO: 162335 - DNA, 20 bp, Artificial
  CRISPR gRNA sequence
aaaaaactctttaggatctg

SEQ ID NO: 162336 - DNA, 20 bp, Artificial
  CRISPR gRNA sequence
tttaggatctggccccaacc

SEQ ID NO: 162337 - DNA, 20 bp, Artificial
  CRISPR gRNA sequence
taggatctggccccaaccca

SEQ ID NO: 162338 - DNA, 20 bp, Artificial
  CRISPR gRNA sequence
aggatctggccccaacccag

SEQ ID NO: 162339 - DNA, 20 bp, Artificial
  CRISPR gRNA sequence
ggatctggccccaacccagt

SEQ ID NO: 162340 - DNA, 20 bp, Artificial
  CRISPR gRNA sequence
gccccaacccagtatcctct

SEQ ID NO: 162341 - DNA, 20 bp, Artificial
  CRISPR gRNA sequence
tttcctgcttttcccctcta

SEQ ID NO: 162342 - DNA, 20 bp, Artificial
  CRISPR gRNA sequence
tcctgcttttcccctctata

SEQ ID NO: 162343 - DNA, 20 bp, Artificial
  CRISPR gRNA sequence
cctgcttttcccctctatac

SEQ ID NO: 162344 - DNA, 20 bp, Artificial
  CRISPR gRNA sequence
ctgcttttcccctctatact

SEQ ID NO: 162345 - DNA, 20 bp, Artificial
  CRISPR gRNA sequence
cttttcccctctatactcag

SEQ ID NO: 162346 - DNA, 20 bp, Artificial
  CRISPR gRNA sequence
ttcccctctatactcaggta

SEQ ID NO: 162347 - DNA, 20 bp, Artificial
  CRISPR gRNA sequence
tcccctctatactcaggtag

SEQ ID NO: 162348 - DNA, 20 bp, Artificial
  CRISPR gRNA sequence
cccctctatactcaggtagt

SEQ ID NO: 162349 - DNA, 20 bp, Artificial
  CRISPR gRNA sequence
ccctctatactcaggtagta

SEQ ID NO: 162350 - DNA, 20 bp, Artificial
  CRISPR gRNA sequence
tatactcaggtagtagatct

SEQ ID NO: 162351 - DNA, 20 bp, Artificial
  CRISPR gRNA sequence
tactcaggtagtagatctaa

SEQ ID NO: 162352 - DNA, 20 bp, Artificial
  CRISPR gRNA sequence
aggtagtagatctaaaactt

SEQ ID NO: 162353 - DNA, 20 bp, Artificial
  CRISPR gRNA sequence
aaacttaaataggctgtgat

SEQ ID NO: 162354 - DNA, 20 bp, Artificial
  CRISPR gRNA sequence
aaataggctgtgattttttg

SEQ ID NO: 162355 - DNA, 20 bp, Artificial
  CRISPR gRNA sequence
aataggctgtgattttttgt

SEQ ID NO: 162356 - DNA, 20 bp, Artificial
  CRISPR gRNA sequence
tgattttttgtctctctctc

SEQ ID NO: 162357 - DNA, 20 bp, Artificial
  CRISPR gRNA sequence
tttgtctctctctctgtctt

SEQ ID NO: 162358 - DNA, 20 bp, Artificial
  CRISPR gRNA sequence
ttgtctctctctctgtcttt

SEQ ID NO: 162359 - DNA, 20 bp, Artificial
  CRISPR gRNA sequence
tgtctctctctctgtctttg

SEQ ID NO: 162360 - DNA, 20 bp, Artificial
  CRISPR gRNA sequence
gtctctctctctgtctttgt

SEQ ID NO: 162361 - DNA, 20 bp, Artificial
  CRISPR gRNA sequence
tctctctctctgtctttgtt

SEQ ID NO: 162362 - DNA, 20 bp, Artificial
  CRISPR gRNA sequence
tctctctgtctttgttgttc

SEQ ID NO: 162363 - DNA, 20 bp, Artificial
  CRISPR gRNA sequence
tctctgtctttgttgttctg

SEQ ID NO: 162364 - DNA, 20 bp, Artificial
  CRISPR gRNA sequence
tctgtctttgttgttctgtc

SEQ ID NO: 162365 - DNA, 20 bp, Artificial
  CRISPR gRNA sequence
tgtctttgttgttctgtctg

SEQ ID NO: 162366 - DNA, 20 bp, Artificial
  CRISPR gRNA sequence
tctttgttgttctgtctgaa

SEQ ID NO: 162367 - DNA, 20 bp, Artificial
  CRISPR gRNA sequence
tgttgttctgtctgaataac

SEQ ID NO: 162368 - DNA, 20 bp, Artificial
  CRISPR gRNA sequence
gttgttctgtctgaataaca

SEQ ID NO: 162369 - DNA, 20 bp, Artificial
  CRISPR gRNA sequence
ttgttctgtctgaataacat

SEQ ID NO: 162370 - DNA, 20 bp, Artificial
  CRISPR gRNA sequence
ttctgtctgaataacattct

SEQ ID NO: 162371 - DNA, 20 bp, Artificial
  CRISPR gRNA sequence
tgtctgaataacattctcat

SEQ ID NO: 162372 - DNA, 20 bp, Artificial
  CRISPR gRNA sequence
tctgaataacattctcatac

SEQ ID NO: 162373 - DNA, 20 bp, Artificial
  CRISPR gRNA sequence
aataacattctcatactttt

SEQ ID NO: 162374 - DNA, 20 bp, Artificial
  CRISPR gRNA sequence
tcatactttttcaacaggca

SEQ ID NO: 162375 - DNA, 20 bp, Artificial
  CRISPR gRNA sequence
atactttttcaacaggcaaa

SEQ ID NO: 162376 - DNA, 20 bp, Artificial
  CRISPR gRNA sequence
tttcaacaggcaaattccca

SEQ ID NO: 162377 - DNA, 20 bp, Artificial
  CRISPR gRNA sequence
ttcaacaggcaaattcccag

SEQ ID NO: 162378 - DNA, 20 bp, Artificial
  CRISPR gRNA sequence
tcaacaggcaaattcccagc

SEQ ID NO: 162379 - DNA, 20 bp, Artificial
  CRISPR gRNA sequence
caacaggcaaattcccagca

SEQ ID NO: 162380 - DNA, 20 bp, Artificial
  CRISPR gRNA sequence
aacaggcaaattcccagcat

SEQ ID NO: 162381 - DNA, 20 bp, Artificial
  CRISPR gRNA sequence
ccagcatcccttagacacaa

SEQ ID NO: 162382 - DNA, 20 bp, Artificial
  CRISPR gRNA sequence
agacacaattcagatgtcat

SEQ ID NO: 162383 - DNA, 20 bp, Artificial
  CRISPR gRNA sequence
gacacaattcagatgtcatc

SEQ ID NO: 162384 - DNA, 20 bp, Artificial
  CRISPR gRNA sequence
agatgtcatcccctttgtgg

SEQ ID NO: 162385 - DNA, 20 bp, Artificial
  CRISPR gRNA sequence
tgtggaacatttcccaatcc

SEQ ID NO: 162386 - DNA, 20 bp, Artificial
  CRISPR gRNA sequence
gtggaacatttcccaatccc

SEQ ID NO: 162387 - DNA, 20 bp, Artificial
  CRISPR gRNA sequence
tggaacatttcccaatccct

SEQ ID NO: 162388 - DNA, 20 bp, Artificial
  CRISPR gRNA sequence
cccaatccctcactctccct

SEQ ID NO: 162389 - DNA, 20 bp, Artificial
  CRISPR gRNA sequence
ccaatccctcactctccctc

SEQ ID NO: 162390 - DNA, 20 bp, Artificial
  CRISPR gRNA sequence
actctccctccagccccaca

SEQ ID NO: 162391 - DNA, 20 bp, Artificial
  CRISPR gRNA sequence
tccctccagccccacattgc

SEQ ID NO: 162392 - DNA, 20 bp, Artificial
  CRISPR gRNA sequence
cctccagccccacattgcta

SEQ ID NO: 162393 - DNA, 20 bp, Artificial
  CRISPR gRNA sequence
cagccccacattgctagctg

SEQ ID NO: 162394 - DNA, 20 bp, Artificial
  CRISPR gRNA sequence
ctagctgtccctagcaatat

SEQ ID NO: 162395 - DNA, 20 bp, Artificial
  CRISPR gRNA sequence
gctgtccctagcaatatgtc

SEQ ID NO: 162396 - DNA, 20 bp, Artificial
  CRISPR gRNA sequence
tccctagcaatatgtccttc

SEQ ID NO: 162397 - DNA, 20 bp, Artificial
  CRISPR gRNA sequence
gcaatatgtccttctttgtg

SEQ ID NO: 162398 - DNA, 20 bp, Artificial
  CRISPR gRNA sequence
ctttgtgtccccgcagggga

SEQ ID NO: 162399 - DNA, 20 bp, Artificial
  CRISPR gRNA sequence
tttgtgtccccgcaggggat

SEQ ID NO: 162400 - DNA, 20 bp, Artificial
  CRISPR gRNA sequence
tgtgtccccgcaggggatcc

SEQ ID NO: 162401 - DNA, 20 bp, Artificial
  CRISPR gRNA sequence
gtgtccccgcaggggatccc

SEQ ID NO: 162402 - DNA, 20 bp, Artificial
  CRISPR gRNA sequence
tgtccccgcaggggatccct

SEQ ID NO: 162403 - DNA, 20 bp, Artificial
  CRISPR gRNA sequence
ccctccagtattgggtaggg

SEQ ID NO: 162404 - DNA, 20 bp, Artificial
  CRISPR gRNA sequence
cagtattgggtaggggatta

SEQ ID NO: 162405 - DNA, 20 bp, Artificial
  CRISPR gRNA sequence
ggtaggggattataatgttt

SEQ ID NO: 162406 - DNA, 20 bp, Artificial
  CRISPR gRNA sequence
taatgtttttatgtgactat

SEQ ID NO: 162407 - DNA, 20 bp, Artificial
  CRISPR gRNA sequence
ttatgtgactatctctgaca

SEQ ID NO: 162408 - DNA, 20 bp, Artificial
  CRISPR gRNA sequence
tatgtgactatctctgacaa

SEQ ID NO: 162409 - DNA, 20 bp, Artificial
  CRISPR gRNA sequence
atgtgactatctctgacaaa

SEQ ID NO: 162410 - DNA, 20 bp, Artificial
  CRISPR gRNA sequence
tgtgactatctctgacaaac

SEQ ID NO: 162411 - DNA, 20 bp, Artificial
  CRISPR gRNA sequence
tctctgacaaaccacaagct

SEQ ID NO: 162412 - DNA, 20 bp, Artificial
  CRISPR gRNA sequence
tgacaaaccacaagctcttc

SEQ ID NO: 162413 - DNA, 20 bp, Artificial
  CRISPR gRNA sequence
acaaaccacaagctcttcaa

SEQ ID NO: 162414 - DNA, 20 bp, Artificial
  CRISPR gRNA sequence
ttcaaaggtaggagtagatg

SEQ ID NO: 162415 - DNA, 20 bp, Artificial
  CRISPR gRNA sequence
caaaggtaggagtagatgtg

SEQ ID NO: 162416 - DNA, 20 bp, Artificial
  CRISPR gRNA sequence
aaaggtaggagtagatgtgt

SEQ ID NO: 162417 - DNA, 20 bp, Artificial
  CRISPR gRNA sequence
tttttctttcttttttaaat

SEQ ID NO: 162418 - DNA, 20 bp, Artificial
  CRISPR gRNA sequence
ttttctttcttttttaaata

SEQ ID NO: 162419 - DNA, 20 bp, Artificial
  CRISPR gRNA sequence
tttctttcttttttaaatag

SEQ ID NO: 162420 - DNA, 20 bp, Artificial
  CRISPR gRNA sequence
ttctttcttttttaaatagt

SEQ ID NO: 162421 - DNA, 20 bp, Artificial
  CRISPR gRNA sequence
tctttcttttttaaatagtg

SEQ ID NO: 162422 - DNA, 20 bp, Artificial
  CRISPR gRNA sequence
ctttcttttttaaatagtga

SEQ ID NO: 162423 - DNA, 20 bp, Artificial
  CRISPR gRNA sequence
tttcttttttaaatagtgat

SEQ ID NO: 162424 - DNA, 20 bp, Artificial
  CRISPR gRNA sequence
tcttttttaaatagtgatgg

SEQ ID NO: 162425 - DNA, 20 bp, Artificial
  CRISPR gRNA sequence
cttttttaaatagtgatggg

SEQ ID NO: 162426 - DNA, 20 bp, Artificial
  CRISPR gRNA sequence
ttttttaaatagtgatgggg

SEQ ID NO: 162427 - DNA, 20 bp, Artificial
  CRISPR gRNA sequence
ttttaaatagtgatggggtc

SEQ ID NO: 162428 - DNA, 20 bp, Artificial
  CRISPR gRNA sequence
tttaaatagtgatggggtct

SEQ ID NO: 162429 - DNA, 20 bp, Artificial
  CRISPR gRNA sequence
ttaaatagtgatggggtctc

SEQ ID NO: 162430 - DNA, 20 bp, Artificial
  CRISPR gRNA sequence
taaatagtgatggggtctca

SEQ ID NO: 162431 - DNA, 20 bp, Artificial
  CRISPR gRNA sequence
aaatagtgatggggtctcac

SEQ ID NO: 162432 - DNA, 20 bp, Artificial
  CRISPR gRNA sequence
aatagtgatggggtctcact

SEQ ID NO: 162433 - DNA, 20 bp, Artificial
  CRISPR gRNA sequence
actatgttgaccagactggt

SEQ ID NO: 162434 - DNA, 20 bp, Artificial
  CRISPR gRNA sequence
tgttgaccagactggtctca

SEQ ID NO: 162435 - DNA, 20 bp, Artificial
  CRISPR gRNA sequence
accagactggtctcaaactc

SEQ ID NO: 162436 - DNA, 20 bp, Artificial
  CRISPR gRNA sequence
gtctcaaactcctggcctca

SEQ ID NO: 162437 - DNA, 20 bp, Artificial
  CRISPR gRNA sequence
aaactcctggcctcaagcga

SEQ ID NO: 162438 - DNA, 20 bp, Artificial
  CRISPR gRNA sequence
ctggcctcaagcgattctcc

SEQ ID NO: 162439 - DNA, 20 bp, Artificial
  CRISPR gRNA sequence
gcctcaagcgattctcccat

SEQ ID NO: 162440 - DNA, 20 bp, Artificial
  CRISPR gRNA sequence
aagcgattctcccatctcag

SEQ ID NO: 162441 - DNA, 20 bp, Artificial
  CRISPR gRNA sequence
tcccatctcagccttccaga

SEQ ID NO: 162442 - DNA, 20 bp, Artificial
  CRISPR gRNA sequence
ccatctcagccttccagagt

SEQ ID NO: 162443 - DNA, 20 bp, Artificial
  CRISPR gRNA sequence
agccttccagagtgctggga

SEQ ID NO: 162444 - DNA, 20 bp, Artificial
  CRISPR gRNA sequence
ccagagtgctgggattacag

SEQ ID NO: 162445 - DNA, 20 bp, Artificial
  CRISPR gRNA sequence
cagagtgctgggattacagg

SEQ ID NO: 162446 - DNA, 20 bp, Artificial
  CRISPR gRNA sequence
ggattacaggcatgagccac

SEQ ID NO: 162447 - DNA, 20 bp, Artificial
  CRISPR gRNA sequence
caggcatgagccaccatgcc

SEQ ID NO: 162448 - DNA, 20 bp, Artificial
  CRISPR gRNA sequence
gcctacatgtgtattttttg

SEQ ID NO: 162449 - DNA, 20 bp, Artificial
  CRISPR gRNA sequence
catgtgtattttttgcatag

SEQ ID NO: 162450 - DNA, 20 bp, Artificial
  CRISPR gRNA sequence
tttgcatagtagtaggtatc

SEQ ID NO: 162451 - DNA, 20 bp, Artificial
  CRISPR gRNA sequence
ttgcatagtagtaggtatca

SEQ ID NO: 162452 - DNA, 20 bp, Artificial
  CRISPR gRNA sequence
tgcatagtagtaggtatcat

SEQ ID NO: 162453 - DNA, 20 bp, Artificial
  CRISPR gRNA sequence
gcatagtagtaggtatcata

SEQ ID NO: 162454 - DNA, 20 bp, Artificial
  CRISPR gRNA sequence
catagtagtaggtatcatac

SEQ ID NO: 162455 - DNA, 20 bp, Artificial
  CRISPR gRNA sequence
actattagttgagttgcttg

SEQ ID NO: 162456 - DNA, 20 bp, Artificial
  CRISPR gRNA sequence
ctattagttgagttgcttga

SEQ ID NO: 162457 - DNA, 20 bp, Artificial
  CRISPR gRNA sequence
ttagttgagttgcttgaatc

SEQ ID NO: 162458 - DNA, 20 bp, Artificial
  CRISPR gRNA sequence
gttgagttgcttgaatcagt

SEQ ID NO: 162459 - DNA, 20 bp, Artificial
  CRISPR gRNA sequence
agttgcttgaatcagtaaat

SEQ ID NO: 162460 - DNA, 20 bp, Artificial
  CRISPR gRNA sequence
cttgaatcagtaaatgaaag

SEQ ID NO: 162461 - DNA, 20 bp, Artificial
  CRISPR gRNA sequence
gaatcagtaaatgaaagagc

SEQ ID NO: 162462 - DNA, 20 bp, Artificial
  CRISPR gRNA sequence
aatcagtaaatgaaagagca

SEQ ID NO: 162463 - DNA, 20 bp, Artificial
  CRISPR gRNA sequence
cgctactgtttccttttgtt

SEQ ID NO: 162464 - DNA, 20 bp, Artificial
  CRISPR gRNA sequence
ctgtttccttttgttgaaat

SEQ ID NO: 162465 - DNA, 20 bp, Artificial
  CRISPR gRNA sequence
tttccttttgttgaaatttt

SEQ ID NO: 162466 - DNA, 20 bp, Artificial
  CRISPR gRNA sequence
ccttttgttgaaattttaat

SEQ ID NO: 162467 - DNA, 20 bp, Artificial
  CRISPR gRNA sequence
cttttgttgaaattttaata

SEQ ID NO: 162468 - DNA, 20 bp, Artificial
  CRISPR gRNA sequence
ttgttgaaattttaataaac

SEQ ID NO: 162469 - DNA, 20 bp, Artificial
  CRISPR gRNA sequence
tgttgaaattttaataaact

SEQ ID NO: 162470 - DNA, 20 bp, Artificial
  CRISPR gRNA sequence
gttgaaattttaataaactg

SEQ ID NO: 162471 - DNA, 20 bp, Artificial
  CRISPR gRNA sequence
ttgaaattttaataaactga

SEQ ID NO: 162472 - DNA, 20 bp, Artificial
  CRISPR gRNA sequence
aaattttaataaactgaact

SEQ ID NO: 162473 - DNA, 20 bp, Artificial
  CRISPR gRNA sequence
taataaactgaacttctaag

SEQ ID NO: 162474 - DNA, 20 bp, Artificial
  CRISPR gRNA sequence
aataaactgaacttctaagt

SEQ ID NO: 162475 - DNA, 20 bp, Artificial
  CRISPR gRNA sequence
ataaactgaacttctaagtc

SEQ ID NO: 162476 - DNA, 20 bp, Artificial
  CRISPR gRNA sequence
aacttctaagtctctgttac

SEQ ID NO: 162477 - DNA, 20 bp, Artificial
  CRISPR gRNA sequence
ctaagtctctgttactccag

SEQ ID NO: 162478 - DNA, 20 bp, Artificial
  CRISPR gRNA sequence
taagtctctgttactccagg

SEQ ID NO: 162479 - DNA, 20 bp, Artificial
  CRISPR gRNA sequence
agtctctgttactccagggt

SEQ ID NO: 162480 - DNA, 20 bp, Artificial
  CRISPR gRNA sequence
tgttactccagggttagttt

SEQ ID NO: 162481 - DNA, 20 bp, Artificial
  CRISPR gRNA sequence
ttactccagggttagtttta

SEQ ID NO: 162482 - DNA, 20 bp, Artificial
  CRISPR gRNA sequence
ctccagggttagttttagta

SEQ ID NO: 162483 - DNA, 20 bp, Artificial
  CRISPR gRNA sequence
cagggttagttttagtagag

SEQ ID NO: 162484 - DNA, 20 bp, Artificial
  CRISPR gRNA sequence
gttttagtagagggttcatg

SEQ ID NO: 162485 - DNA, 20 bp, Artificial
  CRISPR gRNA sequence
tagtagagggttcatggaaa

SEQ ID NO: 162486 - DNA, 20 bp, Artificial
  CRISPR gRNA sequence
agtagagggttcatggaaaa

SEQ ID NO: 162487 - DNA, 20 bp, Artificial
  CRISPR gRNA sequence
gtagagggttcatggaaaat

SEQ ID NO: 162488 - DNA, 20 bp, Artificial
  CRISPR gRNA sequence
atggaaaatgttgataccta

SEQ ID NO: 162489 - DNA, 20 bp, Artificial
  CRISPR gRNA sequence
atacctaatttggaaaagga

SEQ ID NO: 162490 - DNA, 20 bp, Artificial
  CRISPR gRNA sequence
atttggaaaaggaaaagatg

SEQ ID NO: 162491 - DNA, 20 bp, Artificial
  CRISPR gRNA sequence
ggaaaaggaaaagatgaaaa

SEQ ID NO: 162492 - DNA, 20 bp, Artificial
  CRISPR gRNA sequence
gaaaaggaaaagatgaaaaa

SEQ ID NO: 162493 - DNA, 20 bp, Artificial
  CRISPR gRNA sequence
gtgtttgaagtttgtagagc

SEQ ID NO: 162494 - DNA, 20 bp, Artificial
  CRISPR gRNA sequence
gaagtttgtagagcagagtg

SEQ ID NO: 162495 - DNA, 20 bp, Artificial
  CRISPR gRNA sequence
aagtttgtagagcagagtgg

SEQ ID NO: 162496 - DNA, 20 bp, Artificial
  CRISPR gRNA sequence
gtagagcagagtggtagcca

SEQ ID NO: 162497 - DNA, 20 bp, Artificial
  CRISPR gRNA sequence
tagagcagagtggtagccaa

SEQ ID NO: 162498 - DNA, 20 bp, Artificial
  CRISPR gRNA sequence
gttgggtttgcatggaaaaa

SEQ ID NO: 162499 - DNA, 20 bp, Artificial
  CRISPR gRNA sequence
ttgggtttgcatggaaaaat

SEQ ID NO: 162500 - DNA, 20 bp, Artificial
  CRISPR gRNA sequence
ggtttgcatggaaaaattag

SEQ ID NO: 162501 - DNA, 20 bp, Artificial
  CRISPR gRNA sequence
gcatggaaaaattagatgtc

SEQ ID NO: 162502 - DNA, 20 bp, Artificial
  CRISPR gRNA sequence
catggaaaaattagatgtct

SEQ ID NO: 162503 - DNA, 20 bp, Artificial
  CRISPR gRNA sequence
gatgtcttggtgtacatttt

SEQ ID NO: 162504 - DNA, 20 bp, Artificial
  CRISPR gRNA sequence
ggtgtacattttatcctaat

SEQ ID NO: 162505 - DNA, 20 bp, Artificial
  CRISPR gRNA sequence
gtgtacattttatcctaata

SEQ ID NO: 162506 - DNA, 20 bp, Artificial
  CRISPR gRNA sequence
tatcctaatagattctcttc

SEQ ID NO: 162507 - DNA, 20 bp, Artificial
  CRISPR gRNA sequence
atcctaatagattctcttct

SEQ ID NO: 162508 - DNA, 20 bp, Artificial
  CRISPR gRNA sequence
tcctaatagattctcttctt

SEQ ID NO: 162509 - DNA, 20 bp, Artificial
  CRISPR gRNA sequence
atagattctcttctttctat

SEQ ID NO: 162510 - DNA, 20 bp, Artificial
  CRISPR gRNA sequence
tcttctttctataatcataa

SEQ ID NO: 162511 - DNA, 20 bp, Artificial
  CRISPR gRNA sequence
ttctttctataatcataaaa

SEQ ID NO: 162512 - DNA, 20 bp, Artificial
  CRISPR gRNA sequence
ctttctataatcataaaata

SEQ ID NO: 162513 - DNA, 20 bp, Artificial
  CRISPR gRNA sequence
tttctataatcataaaatag

SEQ ID NO: 162514 - DNA, 20 bp, Artificial
  CRISPR gRNA sequence
tctataatcataaaataggt

SEQ ID NO: 162515 - DNA, 20 bp, Artificial
  CRISPR gRNA sequence
ctataatcataaaataggtt

SEQ ID NO: 162516 - DNA, 20 bp, Artificial
  CRISPR gRNA sequence
tataatcataaaataggttc

SEQ ID NO: 162517 - DNA, 20 bp, Artificial
  CRISPR gRNA sequence
taatcataaaataggttctg

SEQ ID NO: 162518 - DNA, 20 bp, Artificial
  CRISPR gRNA sequence
tgggaagactgttgatgttt

SEQ ID NO: 162519 - DNA, 20 bp, Artificial
  CRISPR gRNA sequence
ggaagactgttgatgttttt

SEQ ID NO: 162520 - DNA, 20 bp, Artificial
  CRISPR gRNA sequence
ttgatgtttttccaaaatac

SEQ ID NO: 162521 - DNA, 20 bp, Artificial
  CRISPR gRNA sequence
atgtttttccaaaatacctt

SEQ ID NO: 162522 - DNA, 20 bp, Artificial
  CRISPR gRNA sequence
ttccaaaatacctttttttg

SEQ ID NO: 162523 - DNA, 20 bp, Artificial
  CRISPR gRNA sequence
tccaaaatacctttttttga

SEQ ID NO: 162524 - DNA, 20 bp, Artificial
  CRISPR gRNA sequence
ccaaaatacctttttttgac

SEQ ID NO: 162525 - DNA, 20 bp, Artificial
  CRISPR gRNA sequence
caaaatacctttttttgaca

SEQ ID NO: 162526 - DNA, 20 bp, Artificial
  CRISPR gRNA sequence
tttttgacatatatttgaga

SEQ ID NO: 162527 - DNA, 20 bp, Artificial
  CRISPR gRNA sequence
ttttgacatatatttgagat

SEQ ID NO: 162528 - DNA, 20 bp, Artificial
  CRISPR gRNA sequence
tttgacatatatttgagatt

SEQ ID NO: 162529 - DNA, 20 bp, Artificial
  CRISPR gRNA sequence
ttgacatatatttgagattt

SEQ ID NO: 162530 - DNA, 20 bp, Artificial
  CRISPR gRNA sequence
tgacatatatttgagatttt

SEQ ID NO: 162531 - DNA, 20 bp, Artificial
  CRISPR gRNA sequence
gacatatatttgagattttc

SEQ ID NO: 162532 - DNA, 20 bp, Artificial
  CRISPR gRNA sequence
acatatatttgagattttct

SEQ ID NO: 162533 - DNA, 20 bp, Artificial
  CRISPR gRNA sequence
gagattttctgttggtcttg

SEQ ID NO: 162534 - DNA, 20 bp, Artificial
  CRISPR gRNA sequence
agattttctgttggtcttgc

SEQ ID NO: 162535 - DNA, 20 bp, Artificial
  CRISPR gRNA sequence
tctgttggtcttgcaaaaga

SEQ ID NO: 162536 - DNA, 20 bp, Artificial
  CRISPR gRNA sequence
ctgttggtcttgcaaaagaa

SEQ ID NO: 162537 - DNA, 20 bp, Artificial
  CRISPR gRNA sequence
tgttggtcttgcaaaagaaa

SEQ ID NO: 162538 - DNA, 20 bp, Artificial
  CRISPR gRNA sequence
ttggtcttgcaaaagaaagt

SEQ ID NO: 162539 - DNA, 20 bp, Artificial
  CRISPR gRNA sequence
gtcttgcaaaagaaagttca

SEQ ID NO: 162540 - DNA, 20 bp, Artificial
  CRISPR gRNA sequence
gcaaaagaaagttcacttat

SEQ ID NO: 162541 - DNA, 20 bp, Artificial
  CRISPR gRNA sequence
caaaagaaagttcacttatg

SEQ ID NO: 162542 - DNA, 20 bp, Artificial
  CRISPR gRNA sequence
acttatgcttgttaattaca

SEQ ID NO: 162543 - DNA, 20 bp, Artificial
  CRISPR gRNA sequence
atgcttgttaattacatcaa

SEQ ID NO: 162544 - DNA, 20 bp, Artificial
  CRISPR gRNA sequence
tgcttgttaattacatcaaa

SEQ ID NO: 162545 - DNA, 20 bp, Artificial
  CRISPR gRNA sequence
gttaattacatcaaatctga

SEQ ID NO: 162546 - DNA, 20 bp, Artificial
  CRISPR gRNA sequence
ttaattacatcaaatctgaa

SEQ ID NO: 162547 - DNA, 20 bp, Artificial
  CRISPR gRNA sequence
attacatcaaatctgaaata

SEQ ID NO: 162548 - DNA, 20 bp, Artificial
  CRISPR gRNA sequence
catcaaatctgaaataatat

SEQ ID NO: 162549 - DNA, 20 bp, Artificial
  CRISPR gRNA sequence
aaataatatatgctccttcc

SEQ ID NO: 162550 - DNA, 20 bp, Artificial
  CRISPR gRNA sequence
cttccataatgtgatgatgc

SEQ ID NO: 162551 - DNA, 20 bp, Artificial
  CRISPR gRNA sequence
ccataatgtgatgatgcaaa

SEQ ID NO: 162552 - DNA, 20 bp, Artificial
  CRISPR gRNA sequence
cataatgtgatgatgcaaat

SEQ ID NO: 162553 - DNA, 20 bp, Artificial
  CRISPR gRNA sequence
ccaggtgagcatattaggtt

SEQ ID NO: 162554 - DNA, 20 bp, Artificial
  CRISPR gRNA sequence
ggtttagtgagtcacatttc

SEQ ID NO: 162555 - DNA, 20 bp, Artificial
  CRISPR gRNA sequence
agtgagtcacatttcagacc

SEQ ID NO: 162556 - DNA, 20 bp, Artificial
  CRISPR gRNA sequence
gtgagtcacatttcagacca

SEQ ID NO: 162557 - DNA, 20 bp, Artificial
  CRISPR gRNA sequence
cagaccacttatagaatcaa

SEQ ID NO: 162558 - DNA, 20 bp, Artificial
  CRISPR gRNA sequence
agaccacttatagaatcaat

SEQ ID NO: 162559 - DNA, 20 bp, Artificial
  CRISPR gRNA sequence
atagaatcaatcatttgaca

SEQ ID NO: 162560 - DNA, 20 bp, Artificial
  CRISPR gRNA sequence
tagaatcaatcatttgacac

SEQ ID NO: 162561 - DNA, 20 bp, Artificial
  CRISPR gRNA sequence
gacacctagtcccagtagag

SEQ ID NO: 162562 - DNA, 20 bp, Artificial
  CRISPR gRNA sequence
acacctagtcccagtagaga

SEQ ID NO: 162563 - DNA, 20 bp, Artificial
  CRISPR gRNA sequence
gtcccagtagagattttgct

SEQ ID NO: 162564 - DNA, 20 bp, Artificial
  CRISPR gRNA sequence
tgctgattttagctaatatc

SEQ ID NO: 162565 - DNA, 20 bp, Artificial
  CRISPR gRNA sequence
gctgattttagctaatatct

SEQ ID NO: 162566 - DNA, 20 bp, Artificial
  CRISPR gRNA sequence
ctgattttagctaatatctg

SEQ ID NO: 162567 - DNA, 20 bp, Artificial
  CRISPR gRNA sequence
attttagctaatatctgcct

SEQ ID NO: 162568 - DNA, 20 bp, Artificial
  CRISPR gRNA sequence
tagctaatatctgcctttgc

SEQ ID NO: 162569 - DNA, 20 bp, Artificial
  CRISPR gRNA sequence
agctaatatctgcctttgca

SEQ ID NO: 162570 - DNA, 20 bp, Artificial
  CRISPR gRNA sequence
gctaatatctgcctttgcac

SEQ ID NO: 162571 - DNA, 20 bp, Artificial
  CRISPR gRNA sequence
atatctgcctttgcaccttc

SEQ ID NO: 162572 - DNA, 20 bp, Artificial
  CRISPR gRNA sequence
cctttgcaccttcctcttca

SEQ ID NO: 162573 - DNA, 20 bp, Artificial
  CRISPR gRNA sequence
tgcaccttcctcttcattgc

SEQ ID NO: 162574 - DNA, 20 bp, Artificial
  CRISPR gRNA sequence
gcaccttcctcttcattgca

SEQ ID NO: 162575 - DNA, 20 bp, Artificial
  CRISPR gRNA sequence
caccttcctcttcattgcag

SEQ ID NO: 162576 - DNA, 20 bp, Artificial
  CRISPR gRNA sequence
cctcttcattgcagctctga

SEQ ID NO: 162577 - DNA, 20 bp, Artificial
  CRISPR gRNA sequence
ctcttcattgcagctctgaa

SEQ ID NO: 162578 - DNA, 20 bp, Artificial
  CRISPR gRNA sequence
ttcattgcagctctgaaact

SEQ ID NO: 162579 - DNA, 20 bp, Artificial
  CRISPR gRNA sequence
cattgcagctctgaaactca

SEQ ID NO: 162580 - DNA, 20 bp, Artificial
  CRISPR gRNA sequence
attgcagctctgaaactcaa

SEQ ID NO: 162581 - DNA, 20 bp, Artificial
  CRISPR gRNA sequence
cagctctgaaactcaaaatt

SEQ ID NO: 162582 - DNA, 20 bp, Artificial
  CRISPR gRNA sequence
tgaaactcaaaattgatttt

SEQ ID NO: 162583 - DNA, 20 bp, Artificial
  CRISPR gRNA sequence
aaactcaaaattgatttttt

SEQ ID NO: 162584 - DNA, 20 bp, Artificial
  CRISPR gRNA sequence
aaaattgatttttttcctag

SEQ ID NO: 162585 - DNA, 20 bp, Artificial
  CRISPR gRNA sequence
atttttttcctagaattgca

SEQ ID NO: 162586 - DNA, 20 bp, Artificial
  CRISPR gRNA sequence
ttttcctagaattgcatcca

SEQ ID NO: 162587 - DNA, 20 bp, Artificial
  CRISPR gRNA sequence
tttcctagaattgcatccat

SEQ ID NO: 162588 - DNA, 20 bp, Artificial
  CRISPR gRNA sequence
ttcctagaattgcatccatc

SEQ ID NO: 162589 - DNA, 20 bp, Artificial
  CRISPR gRNA sequence
tcctagaattgcatccatca

SEQ ID NO: 162590 - DNA, 20 bp, Artificial
  CRISPR gRNA sequence
cctagaattgcatccatcat

SEQ ID NO: 162591 - DNA, 20 bp, Artificial
  CRISPR gRNA sequence
ctagaattgcatccatcatt

SEQ ID NO: 162592 - DNA, 20 bp, Artificial
  CRISPR gRNA sequence
gaattgcatccatcattggg

SEQ ID NO: 162593 - DNA, 20 bp, Artificial
  CRISPR gRNA sequence
catccatcattgggcatgtg

SEQ ID NO: 162594 - DNA, 20 bp, Artificial
  CRISPR gRNA sequence
ggcatgtgtttaaataccag

SEQ ID NO: 162595 - DNA, 20 bp, Artificial
  CRISPR gRNA sequence
aaataccagtagtttcaaaa

SEQ ID NO: 162596 - DNA, 20 bp, Artificial
  CRISPR gRNA sequence
aataccagtagtttcaaaat

SEQ ID NO: 162597 - DNA, 20 bp, Artificial
  CRISPR gRNA sequence
caaaataaaacaaaaaaggg

SEQ ID NO: 162598 - DNA, 20 bp, Artificial
  CRISPR gRNA sequence
aaaataaaacaaaaaagggc

SEQ ID NO: 162599 - DNA, 20 bp, Artificial
  CRISPR gRNA sequence
aagtctcaaattattgagta

SEQ ID NO: 162600 - DNA, 20 bp, Artificial
  CRISPR gRNA sequence
agtctcaaattattgagtag

SEQ ID NO: 162601 - DNA, 20 bp, Artificial
  CRISPR gRNA sequence
aaattattgagtagtgctga

SEQ ID NO: 162602 - DNA, 20 bp, Artificial
  CRISPR gRNA sequence
ttgagtagtgctgatcaaaa

SEQ ID NO: 162603 - DNA, 20 bp, Artificial
  CRISPR gRNA sequence
agtagtgctgatcaaaaaag

SEQ ID NO: 162604 - DNA, 20 bp, Artificial
  CRISPR gRNA sequence
atcaaaaaagccctttccta

SEQ ID NO: 162605 - DNA, 20 bp, Artificial
  CRISPR gRNA sequence
tcctaaactatatccacagt

SEQ ID NO: 162606 - DNA, 20 bp, Artificial
  CRISPR gRNA sequence
cctaaactatatccacagtg

SEQ ID NO: 162607 - DNA, 20 bp, Artificial
  CRISPR gRNA sequence
ctaaactatatccacagtga

SEQ ID NO: 162608 - DNA, 20 bp, Artificial
  CRISPR gRNA sequence
aactatatccacagtgaagt

SEQ ID NO: 162609 - DNA, 20 bp, Artificial
  CRISPR gRNA sequence
tatccacagtgaagttatat

SEQ ID NO: 162610 - DNA, 20 bp, Artificial
  CRISPR gRNA sequence
tatggtcctcccccactcca

SEQ ID NO: 162611 - DNA, 20 bp, Artificial
  CRISPR gRNA sequence
ccccactccaggcttgttaa

SEQ ID NO: 162612 - DNA, 20 bp, Artificial
  CRISPR gRNA sequence
caggcttgttaagaaaaaat

SEQ ID NO: 162613 - DNA, 20 bp, Artificial
  CRISPR gRNA sequence
gttaagaaaaaataacacag

SEQ ID NO: 162614 - DNA, 20 bp, Artificial
  CRISPR gRNA sequence
ttaagaaaaaataacacagc

SEQ ID NO: 162615 - DNA, 20 bp, Artificial
  CRISPR gRNA sequence
agaaaaaataacacagctgt

SEQ ID NO: 162616 - DNA, 20 bp, Artificial
  CRISPR gRNA sequence
ttcctaaaaggcagctgaca

SEQ ID NO: 162617 - DNA, 20 bp, Artificial
  CRISPR gRNA sequence
ctaaaaggcagctgacaaat

SEQ ID NO: 162618 - DNA, 20 bp, Artificial
  CRISPR gRNA sequence
aaaggcagctgacaaattca

SEQ ID NO: 162619 - DNA, 20 bp, Artificial
  CRISPR gRNA sequence
acaaattcaccctcatcctt

SEQ ID NO: 162620 - DNA, 20 bp, Artificial
  CRISPR gRNA sequence
accctcatcctttttctata

SEQ ID NO: 162621 - DNA, 20 bp, Artificial
  CRISPR gRNA sequence
atcctttttctatactcctc

SEQ ID NO: 162622 - DNA, 20 bp, Artificial
  CRISPR gRNA sequence
tttctatactcctctacccc

SEQ ID NO: 162623 - DNA, 20 bp, Artificial
  CRISPR gRNA sequence
ttctatactcctctaccccc

SEQ ID NO: 162624 - DNA, 20 bp, Artificial
  CRISPR gRNA sequence
tctatactcctctaccccca

SEQ ID NO: 162625 - DNA, 20 bp, Artificial
  CRISPR gRNA sequence
ctatactcctctacccccac

SEQ ID NO: 162626 - DNA, 20 bp, Artificial
  CRISPR gRNA sequence
tatactcctctacccccact

SEQ ID NO: 162627 - DNA, 20 bp, Artificial
  CRISPR gRNA sequence
tactcctctacccccacttg

SEQ ID NO: 162628 - DNA, 20 bp, Artificial
  CRISPR gRNA sequence
ctctacccccacttgaaaca

SEQ ID NO: 162629 - DNA, 20 bp, Artificial
  CRISPR gRNA sequence
tacccccacttgaaacaaat

SEQ ID NO: 162630 - DNA, 20 bp, Artificial
  CRISPR gRNA sequence
cccccacttgaaacaaattt

SEQ ID NO: 162631 - DNA, 20 bp, Artificial
  CRISPR gRNA sequence
gaaacaaattttggagacaa

SEQ ID NO: 162632 - DNA, 20 bp, Artificial
  CRISPR gRNA sequence
aaacaaattttggagacaag

SEQ ID NO: 162633 - DNA, 20 bp, Artificial
  CRISPR gRNA sequence
tggagacaaggccattgcta

SEQ ID NO: 162634 - DNA, 20 bp, Artificial
  CRISPR gRNA sequence
ggagacaaggccattgctac

SEQ ID NO: 162635 - DNA, 20 bp, Artificial
  CRISPR gRNA sequence
gagacaaggccattgctact

SEQ ID NO: 162636 - DNA, 20 bp, Artificial
  CRISPR gRNA sequence
ctactgtgatgagaaaggag

SEQ ID NO: 162637 - DNA, 20 bp, Artificial
  CRISPR gRNA sequence
ctgtgatgagaaaggagctc

SEQ ID NO: 162638 - DNA, 20 bp, Artificial
  CRISPR gRNA sequence
tgatgagaaaggagctctcc

SEQ ID NO: 162639 - DNA, 20 bp, Artificial
  CRISPR gRNA sequence
tcctccccagtttctgttgt

SEQ ID NO: 162640 - DNA, 20 bp, Artificial
  CRISPR gRNA sequence
ctccccagtttctgttgtca

SEQ ID NO: 162641 - DNA, 20 bp, Artificial
  CRISPR gRNA sequence
cccagtttctgttgtcaggt

SEQ ID NO: 162642 - DNA, 20 bp, Artificial
  CRISPR gRNA sequence
ctgttgtcaggttagtgcaa

SEQ ID NO: 162643 - DNA, 20 bp, Artificial
  CRISPR gRNA sequence
tgttgtcaggttagtgcaaa

SEQ ID NO: 162644 - DNA, 20 bp, Artificial
  CRISPR gRNA sequence
ttgtcaggttagtgcaaatg

SEQ ID NO: 162645 - DNA, 20 bp, Artificial
  CRISPR gRNA sequence
tcaggttagtgcaaatgtca

SEQ ID NO: 162646 - DNA, 20 bp, Artificial
  CRISPR gRNA sequence
gtgcaaatgtcagaaatggc

SEQ ID NO: 162647 - DNA, 20 bp, Artificial
  CRISPR gRNA sequence
tcagttgtaaagaactgtgg

SEQ ID NO: 162648 - DNA, 20 bp, Artificial
  CRISPR gRNA sequence
taaagaactgtggatcactg

SEQ ID NO: 162649 - DNA, 20 bp, Artificial
  CRISPR gRNA sequence
tggatcactgtggtcaagtg

SEQ ID NO: 162650 - DNA, 20 bp, Artificial
  CRISPR gRNA sequence
tggtcaagtgccccggcgtt

SEQ ID NO: 162651 - DNA, 20 bp, Artificial
  CRISPR gRNA sequence
ctgttagtttggtcactgaa

SEQ ID NO: 162652 - DNA, 20 bp, Artificial
  CRISPR gRNA sequence
ttagtttggtcactgaatgg

SEQ ID NO: 162653 - DNA, 20 bp, Artificial
  CRISPR gRNA sequence
gtttggtcactgaatggaag

SEQ ID NO: 162654 - DNA, 20 bp, Artificial
  CRISPR gRNA sequence
ggtcactgaatggaagaaag

SEQ ID NO: 162655 - DNA, 20 bp, Artificial
  CRISPR gRNA sequence
gtcactgaatggaagaaaga

SEQ ID NO: 162656 - DNA, 20 bp, Artificial
  CRISPR gRNA sequence
aatggaagaaagaactggca

SEQ ID NO: 162657 - DNA, 20 bp, Artificial
  CRISPR gRNA sequence
gcagtttagaggaatacccc

SEQ ID NO: 162658 - DNA, 20 bp, Artificial
  CRISPR gRNA sequence
agaggaatacccctgagaca

SEQ ID NO: 162659 - DNA, 20 bp, Artificial
  CRISPR gRNA sequence
gaggaatacccctgagacag

SEQ ID NO: 162660 - DNA, 20 bp, Artificial
  CRISPR gRNA sequence
agacagaaatctcattttaa

SEQ ID NO: 162661 - DNA, 20 bp, Artificial
  CRISPR gRNA sequence
attttaatctgcatattgca

SEQ ID NO: 162662 - DNA, 20 bp, Artificial
  CRISPR gRNA sequence
taatctgcatattgcagact

SEQ ID NO: 162663 - DNA, 20 bp, Artificial
  CRISPR gRNA sequence
aatctgcatattgcagactg

SEQ ID NO: 162664 - DNA, 20 bp, Artificial
  CRISPR gRNA sequence
atctgcatattgcagactgg

SEQ ID NO: 162665 - DNA, 20 bp, Artificial
  CRISPR gRNA sequence
catattgcagactggtaaac

SEQ ID NO: 162666 - DNA, 20 bp, Artificial
  CRISPR gRNA sequence
cagactggtaaacttacttg

SEQ ID NO: 162667 - DNA, 20 bp, Artificial
  CRISPR gRNA sequence
gtaaacttacttggaaaaaa

SEQ ID NO: 162668 - DNA, 20 bp, Artificial
  CRISPR gRNA sequence
acttggaaaaaaaaagaagg

SEQ ID NO: 162669 - DNA, 20 bp, Artificial
  CRISPR gRNA sequence
cttggaaaaaaaaagaaggc

SEQ ID NO: 162670 - DNA, 20 bp, Artificial
  CRISPR gRNA sequence
ggaaaaaaaaagaaggcgct

SEQ ID NO: 162671 - DNA, 20 bp, Artificial
  CRISPR gRNA sequence
gaaaaaaaaagaaggcgctc

SEQ ID NO: 162672 - DNA, 20 bp, Artificial
  CRISPR gRNA sequence
ataatgtccctctatgttgt

SEQ ID NO: 162673 - DNA, 20 bp, Artificial
  CRISPR gRNA sequence
tatgttgtgctgacgaaaaa

SEQ ID NO: 162674 - DNA, 20 bp, Artificial
  CRISPR gRNA sequence
tgttgtgctgacgaaaaaaa

SEQ ID NO: 162675 - DNA, 20 bp, Artificial
  CRISPR gRNA sequence
tgctgacgaaaaaaaaaaaa

SEQ ID NO: 162676 - DNA, 20 bp, Artificial
  CRISPR gRNA sequence
acgaaaaaaaaaaaaaaaca

SEQ ID NO: 162677 - DNA, 20 bp, Artificial
  CRISPR gRNA sequence
cttggggctgtgtttcatga

SEQ ID NO: 162678 - DNA, 20 bp, Artificial
  CRISPR gRNA sequence
ggggctgtgtttcatgagag

SEQ ID NO: 162679 - DNA, 20 bp, Artificial
  CRISPR gRNA sequence
gggctgtgtttcatgagagc

SEQ ID NO: 162680 - DNA, 20 bp, Artificial
  CRISPR gRNA sequence
tgtttcatgagagcactgtt

SEQ ID NO: 162681 - DNA, 20 bp, Artificial
  CRISPR gRNA sequence
catgagagcactgttagagg

SEQ ID NO: 162682 - DNA, 20 bp, Artificial
  CRISPR gRNA sequence
atgagagcactgttagaggc

SEQ ID NO: 162683 - DNA, 20 bp, Artificial
  CRISPR gRNA sequence
ttagaggccatcctaagctt

SEQ ID NO: 162684 - DNA, 20 bp, Artificial
  CRISPR gRNA sequence
gaggccatcctaagcttttt

SEQ ID NO: 162685 - DNA, 20 bp, Artificial
  CRISPR gRNA sequence
agctttttctaaagcccatt

SEQ ID NO: 162686 - DNA, 20 bp, Artificial
  CRISPR gRNA sequence
tttctaaagcccattaattc

SEQ ID NO: 162687 - DNA, 20 bp, Artificial
  CRISPR gRNA sequence
ttctaaagcccattaattct

SEQ ID NO: 162688 - DNA, 20 bp, Artificial
  CRISPR gRNA sequence
tctaaagcccattaattctt

SEQ ID NO: 162689 - DNA, 20 bp, Artificial
  CRISPR gRNA sequence
ctaaagcccattaattcttt

SEQ ID NO: 162690 - DNA, 20 bp, Artificial
  CRISPR gRNA sequence
taaagcccattaattctttg

SEQ ID NO: 162691 - DNA, 20 bp, Artificial
  CRISPR gRNA sequence
aagcccattaattctttgaa

SEQ ID NO: 162692 - DNA, 20 bp, Artificial
  CRISPR gRNA sequence
attctttgaagacctgcata

SEQ ID NO: 162693 - DNA, 20 bp, Artificial
  CRISPR gRNA sequence
tttgaagacctgcatatgtt

SEQ ID NO: 162694 - DNA, 20 bp, Artificial
  CRISPR gRNA sequence
tgaagacctgcatatgttaa

SEQ ID NO: 162695 - DNA, 20 bp, Artificial
  CRISPR gRNA sequence
gaagacctgcatatgttaag

SEQ ID NO: 162696 - DNA, 20 bp, Artificial
  CRISPR gRNA sequence
aagacctgcatatgttaagt

SEQ ID NO: 162697 - DNA, 20 bp, Artificial
  CRISPR gRNA sequence
catatgttaagtaaagaaga

SEQ ID NO: 162698 - DNA, 20 bp, Artificial
  CRISPR gRNA sequence
agtaaagaagaattttgctc

SEQ ID NO: 162699 - DNA, 20 bp, Artificial
  CRISPR gRNA sequence
tgctctggagcttgtatttt

SEQ ID NO: 162700 - DNA, 20 bp, Artificial
  CRISPR gRNA sequence
gctctggagcttgtattttc

SEQ ID NO: 162701 - DNA, 20 bp, Artificial
  CRISPR gRNA sequence
ctctggagcttgtattttct

SEQ ID NO: 162702 - DNA, 20 bp, Artificial
  CRISPR gRNA sequence
tggagcttgtattttcttca

SEQ ID NO: 162703 - DNA, 20 bp, Artificial
  CRISPR gRNA sequence
gagcttgtattttcttcatt

SEQ ID NO: 162704 - DNA, 20 bp, Artificial
  CRISPR gRNA sequence
gtattttcttcatttcatct

SEQ ID NO: 162705 - DNA, 20 bp, Artificial
  CRISPR gRNA sequence
tattttcttcatttcatctg

SEQ ID NO: 162706 - DNA, 20 bp, Artificial
  CRISPR gRNA sequence
tcttcatttcatctgtacct

SEQ ID NO: 162707 - DNA, 20 bp, Artificial
  CRISPR gRNA sequence
cttcatttcatctgtacctt

SEQ ID NO: 162708 - DNA, 20 bp, Artificial
  CRISPR gRNA sequence
ttcatttcatctgtaccttc

SEQ ID NO: 162709 - DNA, 20 bp, Artificial
  CRISPR gRNA sequence
catttcatctgtaccttctc

SEQ ID NO: 162710 - DNA, 20 bp, Artificial
  CRISPR gRNA sequence
atttcatctgtaccttctct

SEQ ID NO: 162711 - DNA, 20 bp, Artificial
  CRISPR gRNA sequence
catctgtaccttctctcccg

SEQ ID NO: 162712 - DNA, 20 bp, Artificial
  CRISPR gRNA sequence
atctgtaccttctctcccga

SEQ ID NO: 162713 - DNA, 20 bp, Artificial
  CRISPR gRNA sequence
taccttctctcccgacatac

SEQ ID NO: 162714 - DNA, 20 bp, Artificial
  CRISPR gRNA sequence
ctctcccgacatacgcttcc

SEQ ID NO: 162715 - DNA, 20 bp, Artificial
  CRISPR gRNA sequence
tctcccgacatacgcttcct

SEQ ID NO: 162716 - DNA, 20 bp, Artificial
  CRISPR gRNA sequence
tcccgacatacgcttcctga

SEQ ID NO: 162717 - DNA, 20 bp, Artificial
  CRISPR gRNA sequence
ccgacatacgcttcctgaag

SEQ ID NO: 162718 - DNA, 20 bp, Artificial
  CRISPR gRNA sequence
cctgaagagagggaccaagc

SEQ ID NO: 162719 - DNA, 20 bp, Artificial
  CRISPR gRNA sequence
ctgaagagagggaccaagcc

SEQ ID NO: 162720 - DNA, 20 bp, Artificial
  CRISPR gRNA sequence
aagagagggaccaagccaga

SEQ ID NO: 162721 - DNA, 20 bp, Artificial
  CRISPR gRNA sequence
cctactgcctgtcatgcttt

SEQ ID NO: 162722 - DNA, 20 bp, Artificial
  CRISPR gRNA sequence
ctactgcctgtcatgctttg

SEQ ID NO: 162723 - DNA, 20 bp, Artificial
  CRISPR gRNA sequence
ctgcctgtcatgctttgcca

SEQ ID NO: 162724 - DNA, 20 bp, Artificial
  CRISPR gRNA sequence
cctgtcatgctttgccacac

SEQ ID NO: 162725 - DNA, 20 bp, Artificial
  CRISPR gRNA sequence
tcatgctttgccacactgtt

SEQ ID NO: 162726 - DNA, 20 bp, Artificial
  CRISPR gRNA sequence
tgccacactgttgattgtcc

SEQ ID NO: 162727 - DNA, 20 bp, Artificial
  CRISPR gRNA sequence
gccacactgttgattgtccc

SEQ ID NO: 162728 - DNA, 20 bp, Artificial
  CRISPR gRNA sequence
ccacactgttgattgtcccc

SEQ ID NO: 162729 - DNA, 20 bp, Artificial
  CRISPR gRNA sequence
ttgattgtccccaccattta

SEQ ID NO: 162730 - DNA, 20 bp, Artificial
  CRISPR gRNA sequence
attgtccccaccatttatgc

SEQ ID NO: 162731 - DNA, 20 bp, Artificial
  CRISPR gRNA sequence
tccccaccatttatgcatct

SEQ ID NO: 162732 - DNA, 20 bp, Artificial
  CRISPR gRNA sequence
atgcatctcttgttgttcat

SEQ ID NO: 162733 - DNA, 20 bp, Artificial
  CRISPR gRNA sequence
tgcatctcttgttgttcatt

SEQ ID NO: 162734 - DNA, 20 bp, Artificial
  CRISPR gRNA sequence
ttgttgttcatttcagaaag

SEQ ID NO: 162735 - DNA, 20 bp, Artificial
  CRISPR gRNA sequence
gttgttcatttcagaaagac

SEQ ID NO: 162736 - DNA, 20 bp, Artificial
  CRISPR gRNA sequence
ttgttcatttcagaaagact

SEQ ID NO: 162737 - DNA, 20 bp, Artificial
  CRISPR gRNA sequence
ttcatttcagaaagacttcc

SEQ ID NO: 162738 - DNA, 20 bp, Artificial
  CRISPR gRNA sequence
atttcagaaagacttccgag

SEQ ID NO: 162739 - DNA, 20 bp, Artificial
  CRISPR gRNA sequence
cagaaagacttccgagtgca

SEQ ID NO: 162740 - DNA, 20 bp, Artificial
  CRISPR gRNA sequence
agaaagacttccgagtgcag

SEQ ID NO: 162741 - DNA, 20 bp, Artificial
  CRISPR gRNA sequence
ccgagtgcaggaactcccac

SEQ ID NO: 162742 - DNA, 20 bp, Artificial
  CRISPR gRNA sequence
cgagtgcaggaactcccact

SEQ ID NO: 162743 - DNA, 20 bp, Artificial
  CRISPR gRNA sequence
ccactggctcgtattaagaa

SEQ ID NO: 162744 - DNA, 20 bp, Artificial
  CRISPR gRNA sequence
gctcgtattaagaagattat

SEQ ID NO: 162745 - DNA, 20 bp, Artificial
  CRISPR gRNA sequence
gtattaagaagattatgaaa

SEQ ID NO: 162746 - DNA, 20 bp, Artificial
  CRISPR gRNA sequence
agaagattatgaaactggat

SEQ ID NO: 162747 - DNA, 20 bp, Artificial
  CRISPR gRNA sequence
tgaaactggatgaagatgtg

SEQ ID NO: 162748 - DNA, 20 bp, Artificial
  CRISPR gRNA sequence
gatgaagatgtgaaggtgaa

SEQ ID NO: 162749 - DNA, 20 bp, Artificial
  CRISPR gRNA sequence
acattcatttttattatttc

SEQ ID NO: 162750 - DNA, 20 bp, Artificial
  CRISPR gRNA sequence
atttttattatttcttattg

SEQ ID NO: 162751 - DNA, 20 bp, Artificial
  CRISPR gRNA sequence
ttattatttcttattgaagc

SEQ ID NO: 162752 - DNA, 20 bp, Artificial
  CRISPR gRNA sequence
tattatttcttattgaagct

SEQ ID NO: 162753 - DNA, 20 bp, Artificial
  CRISPR gRNA sequence
attatttcttattgaagcta

SEQ ID NO: 162754 - DNA, 20 bp, Artificial
  CRISPR gRNA sequence
ttatttcttattgaagctaa

SEQ ID NO: 162755 - DNA, 20 bp, Artificial
  CRISPR gRNA sequence
tttcttattgaagctaagtg

SEQ ID NO: 162756 - DNA, 20 bp, Artificial
  CRISPR gRNA sequence
cttattgaagctaagtgatg

SEQ ID NO: 162757 - DNA, 20 bp, Artificial
  CRISPR gRNA sequence
ttattgaagctaagtgatgg

SEQ ID NO: 162758 - DNA, 20 bp, Artificial
  CRISPR gRNA sequence
attgaagctaagtgatgggt

SEQ ID NO: 162759 - DNA, 20 bp, Artificial
  CRISPR gRNA sequence
ttgaagctaagtgatgggta

SEQ ID NO: 162760 - DNA, 20 bp, Artificial
  CRISPR gRNA sequence
aagctaagtgatgggtaggt

SEQ ID NO: 162761 - DNA, 20 bp, Artificial
  CRISPR gRNA sequence
agtgatgggtaggttattgc

SEQ ID NO: 162762 - DNA, 20 bp, Artificial
  CRISPR gRNA sequence
ttgctcatttctctagagct

SEQ ID NO: 162763 - DNA, 20 bp, Artificial
  CRISPR gRNA sequence
ctcatttctctagagctcaa

SEQ ID NO: 162764 - DNA, 20 bp, Artificial
  CRISPR gRNA sequence
atttctctagagctcaaagt

SEQ ID NO: 162765 - DNA, 20 bp, Artificial
  CRISPR gRNA sequence
ctctagagctcaaagtttaa

SEQ ID NO: 162766 - DNA, 20 bp, Artificial
  CRISPR gRNA sequence
tctagagctcaaagtttaat

SEQ ID NO: 162767 - DNA, 20 bp, Artificial
  CRISPR gRNA sequence
tagagctcaaagtttaatta

SEQ ID NO: 162768 - DNA, 20 bp, Artificial
  CRISPR gRNA sequence
gagctcaaagtttaattaaa

SEQ ID NO: 162769 - DNA, 20 bp, Artificial
  CRISPR gRNA sequence
aaagtttaattaaacaagaa

SEQ ID NO: 162770 - DNA, 20 bp, Artificial
  CRISPR gRNA sequence
aattaaacaagaacacacaa

SEQ ID NO: 162771 - DNA, 20 bp, Artificial
  CRISPR gRNA sequence
attaaacaagaacacacaaa

SEQ ID NO: 162772 - DNA, 20 bp, Artificial
  CRISPR gRNA sequence
aacaagaacacacaaaaatt

SEQ ID NO: 162773 - DNA, 20 bp, Artificial
  CRISPR gRNA sequence
ctgtctgttgctttgttatt

SEQ ID NO: 162774 - DNA, 20 bp, Artificial
  CRISPR gRNA sequence
tctgttgctttgttatttgg

SEQ ID NO: 162775 - DNA, 20 bp, Artificial
  CRISPR gRNA sequence
ttgctttgttatttggttcc

SEQ ID NO: 162776 - DNA, 20 bp, Artificial
  CRISPR gRNA sequence
ctttgttatttggttcctgt

SEQ ID NO: 162777 - DNA, 20 bp, Artificial
  CRISPR gRNA sequence
tgttatttggttcctgtgca

SEQ ID NO: 162778 - DNA, 20 bp, Artificial
  CRISPR gRNA sequence
gttatttggttcctgtgcaa

SEQ ID NO: 162779 - DNA, 20 bp, Artificial
  CRISPR gRNA sequence
ttatttggttcctgtgcaaa

SEQ ID NO: 162780 - DNA, 20 bp, Artificial
  CRISPR gRNA sequence
tttggttcctgtgcaaaatt

SEQ ID NO: 162781 - DNA, 20 bp, Artificial
  CRISPR gRNA sequence
ggttcctgtgcaaaattgtt

SEQ ID NO: 162782 - DNA, 20 bp, Artificial
  CRISPR gRNA sequence
gttcctgtgcaaaattgtta

SEQ ID NO: 162783 - DNA, 20 bp, Artificial
  CRISPR gRNA sequence
ctgtgcaaaattgttaagtg

SEQ ID NO: 162784 - DNA, 20 bp, Artificial
  CRISPR gRNA sequence
tgcaaaattgttaagtgagc

SEQ ID NO: 162785 - DNA, 20 bp, Artificial
  CRISPR gRNA sequence
ttaagtgagccaaaattgag

SEQ ID NO: 162786 - DNA, 20 bp, Artificial
  CRISPR gRNA sequence
agtgagccaaaattgagcag

SEQ ID NO: 162787 - DNA, 20 bp, Artificial
  CRISPR gRNA sequence
agcagttttggttactatat

SEQ ID NO: 162788 - DNA, 20 bp, Artificial
  CRISPR gRNA sequence
tggttactatatggatcatc

SEQ ID NO: 162789 - DNA, 20 bp, Artificial
  CRISPR gRNA sequence
ggttactatatggatcatcc

SEQ ID NO: 162790 - DNA, 20 bp, Artificial
  CRISPR gRNA sequence
gttactatatggatcatcct

SEQ ID NO: 162791 - DNA, 20 bp, Artificial
  CRISPR gRNA sequence
ctatatggatcatcctgaaa

SEQ ID NO: 162792 - DNA, 20 bp, Artificial
  CRISPR gRNA sequence
tatggatcatcctgaaaatt

SEQ ID NO: 162793 - DNA, 20 bp, Artificial
  CRISPR gRNA sequence
aaaattttttagatgttgaa

SEQ ID NO: 162794 - DNA, 20 bp, Artificial
  CRISPR gRNA sequence
tttagatgttgaaaaaatag

SEQ ID NO: 162795 - DNA, 20 bp, Artificial
  CRISPR gRNA sequence
ttagatgttgaaaaaatagt

SEQ ID NO: 162796 - DNA, 20 bp, Artificial
  CRISPR gRNA sequence
tagatgttgaaaaaatagtt

SEQ ID NO: 162797 - DNA, 20 bp, Artificial
  CRISPR gRNA sequence
agatgttgaaaaaatagttg

SEQ ID NO: 162798 - DNA, 20 bp, Artificial
  CRISPR gRNA sequence
gatgttgaaaaaatagttga

SEQ ID NO: 162799 - DNA, 20 bp, Artificial
  CRISPR gRNA sequence
aaaaaatagttgatgttggg

SEQ ID NO: 162800 - DNA, 20 bp, Artificial
  CRISPR gRNA sequence
atgttgggtttttttttttt

SEQ ID NO: 162801 - DNA, 20 bp, Artificial
  CRISPR gRNA sequence
ggttttttttttttttttga

SEQ ID NO: 162802 - DNA, 20 bp, Artificial
  CRISPR gRNA sequence
tttttttttttttgagagtt

SEQ ID NO: 162803 - DNA, 20 bp, Artificial
  CRISPR gRNA sequence
ttttttttttttgagagttt

SEQ ID NO: 162804 - DNA, 20 bp, Artificial
  CRISPR gRNA sequence
tttttttttttgagagtttt

SEQ ID NO: 162805 - DNA, 20 bp, Artificial
  CRISPR gRNA sequence
ttttttttttgagagtttta

SEQ ID NO: 162806 - DNA, 20 bp, Artificial
  CRISPR gRNA sequence
tttttttttgagagttttac

SEQ ID NO: 162807 - DNA, 20 bp, Artificial
  CRISPR gRNA sequence
ttttttttgagagttttact

SEQ ID NO: 162808 - DNA, 20 bp, Artificial
  CRISPR gRNA sequence
tttttttgagagttttactc

SEQ ID NO: 162809 - DNA, 20 bp, Artificial
  CRISPR gRNA sequence
ttttttgagagttttactct

SEQ ID NO: 162810 - DNA, 20 bp, Artificial
  CRISPR gRNA sequence
tttttgagagttttactctg

SEQ ID NO: 162811 - DNA, 20 bp, Artificial
  CRISPR gRNA sequence
ttttgagagttttactctgt

SEQ ID NO: 162812 - DNA, 20 bp, Artificial
  CRISPR gRNA sequence
tttgagagttttactctgtt

SEQ ID NO: 162813 - DNA, 20 bp, Artificial
  CRISPR gRNA sequence
ttgagagttttactctgtta

SEQ ID NO: 162814 - DNA, 20 bp, Artificial
  CRISPR gRNA sequence
tgagagttttactctgttat

SEQ ID NO: 162815 - DNA, 20 bp, Artificial
  CRISPR gRNA sequence
gagagttttactctgttatc

SEQ ID NO: 162816 - DNA, 20 bp, Artificial
  CRISPR gRNA sequence
agagttttactctgttatcc

SEQ ID NO: 162817 - DNA, 20 bp, Artificial
  CRISPR gRNA sequence
tactctgttatccaggccgc

SEQ ID NO: 162818 - DNA, 20 bp, Artificial
  CRISPR gRNA sequence
actctgttatccaggccgca

SEQ ID NO: 162819 - DNA, 20 bp, Artificial
  CRISPR gRNA sequence
ctctgttatccaggccgcag

SEQ ID NO: 162820 - DNA, 20 bp, Artificial
  CRISPR gRNA sequence
tgttatccaggccgcagtgc

SEQ ID NO: 162821 - DNA, 20 bp, Artificial
  CRISPR gRNA sequence
ttatccaggccgcagtgcag

SEQ ID NO: 162822 - DNA, 20 bp, Artificial
  CRISPR gRNA sequence
tccaggccgcagtgcagtgg

SEQ ID NO: 162823 - DNA, 20 bp, Artificial
  CRISPR gRNA sequence
agctcactgcaacctctgcc

SEQ ID NO: 162824 - DNA, 20 bp, Artificial
  CRISPR gRNA sequence
gctcactgcaacctctgcct

SEQ ID NO: 162825 - DNA, 20 bp, Artificial
  CRISPR gRNA sequence
actgcaacctctgcctccca

SEQ ID NO: 162826 - DNA, 20 bp, Artificial
  CRISPR gRNA sequence
caacctctgcctcccaggtt

SEQ ID NO: 162827 - DNA, 20 bp, Artificial
  CRISPR gRNA sequence
tgcctcccaggttcaggcaa

SEQ ID NO: 162828 - DNA, 20 bp, Artificial
  CRISPR gRNA sequence
cctcccaggttcaggcaatt

SEQ ID NO: 162829 - DNA, 20 bp, Artificial
  CRISPR gRNA sequence
ccaggttcaggcaattccca

SEQ ID NO: 162830 - DNA, 20 bp, Artificial
  CRISPR gRNA sequence
aggcaattcccatgcctcag

SEQ ID NO: 162831 - DNA, 20 bp, Artificial
  CRISPR gRNA sequence
ccatgcctcagactcccgag

SEQ ID NO: 162832 - DNA, 20 bp, Artificial
  CRISPR gRNA sequence
agactcccgagtagctagga

SEQ ID NO: 162833 - DNA, 20 bp, Artificial
  CRISPR gRNA sequence
ccgagtagctaggattacag

SEQ ID NO: 162834 - DNA, 20 bp, Artificial
  CRISPR gRNA sequence
ggattacaggcgcccgccac

SEQ ID NO: 162835 - DNA, 20 bp, Artificial
  CRISPR gRNA sequence
caggcgcccgccaccacacc

SEQ ID NO: 162836 - DNA, 20 bp, Artificial
  CRISPR gRNA sequence
gctaatttttgtattttttg

SEQ ID NO: 162837 - DNA, 20 bp, Artificial
  CRISPR gRNA sequence
atttttgtattttttgtaga

SEQ ID NO: 162838 - DNA, 20 bp, Artificial
  CRISPR gRNA sequence
ttgtattttttgtagagaca

SEQ ID NO: 162839 - DNA, 20 bp, Artificial
  CRISPR gRNA sequence
tgtattttttgtagagacag

SEQ ID NO: 162840 - DNA, 20 bp, Artificial
  CRISPR gRNA sequence
gtattttttgtagagacagg

SEQ ID NO: 162841 - DNA, 20 bp, Artificial
  CRISPR gRNA sequence
tattttttgtagagacaggg

SEQ ID NO: 162842 - DNA, 20 bp, Artificial
  CRISPR gRNA sequence
tttgtagagacagggtttca

SEQ ID NO: 162843 - DNA, 20 bp, Artificial
  CRISPR gRNA sequence
ttgtagagacagggtttcac

SEQ ID NO: 162844 - DNA, 20 bp, Artificial
  CRISPR gRNA sequence
tgtagagacagggtttcacc

SEQ ID NO: 162845 - DNA, 20 bp, Artificial
  CRISPR gRNA sequence
gtagagacagggtttcacca

SEQ ID NO: 162846 - DNA, 20 bp, Artificial
  CRISPR gRNA sequence
tagagacagggtttcaccat

SEQ ID NO: 162847 - DNA, 20 bp, Artificial
  CRISPR gRNA sequence
caccatgttggccaggctgg

SEQ ID NO: 162848 - DNA, 20 bp, Artificial
  CRISPR gRNA sequence
accatgttggccaggctggt

SEQ ID NO: 162849 - DNA, 20 bp, Artificial
  CRISPR gRNA sequence
gccaggctggtcttgaactc

SEQ ID NO: 162850 - DNA, 20 bp, Artificial
  CRISPR gRNA sequence
gtcttgaactcccgacctca

SEQ ID NO: 162851 - DNA, 20 bp, Artificial
  CRISPR gRNA sequence
gaactcccgacctcaggtga

SEQ ID NO: 162852 - DNA, 20 bp, Artificial
  CRISPR gRNA sequence
aactcccgacctcaggtgat

SEQ ID NO: 162853 - DNA, 20 bp, Artificial
  CRISPR gRNA sequence
ccgacctcaggtgatatgcc

SEQ ID NO: 162854 - DNA, 20 bp, Artificial
  CRISPR gRNA sequence
aggtgatatgcctgcctctg

SEQ ID NO: 162855 - DNA, 20 bp, Artificial
  CRISPR gRNA sequence
cctctgcctcccaaagtgct

SEQ ID NO: 162856 - DNA, 20 bp, Artificial
  CRISPR gRNA sequence
tgcctcccaaagtgctggga

SEQ ID NO: 162857 - DNA, 20 bp, Artificial
  CRISPR gRNA sequence
cctcccaaagtgctgggatt

SEQ ID NO: 162858 - DNA, 20 bp, Artificial
  CRISPR gRNA sequence
ccaaagtgctgggattacag

SEQ ID NO: 162859 - DNA, 20 bp, Artificial
  CRISPR gRNA sequence
ggattacaggtgtgagccac

SEQ ID NO: 162860 - DNA, 20 bp, Artificial
  CRISPR gRNA sequence
caggtgtgagccaccgcatc

SEQ ID NO: 162861 - DNA, 20 bp, Artificial
  CRISPR gRNA sequence
gccttttctttctttttgag

SEQ ID NO: 162862 - DNA, 20 bp, Artificial
  CRISPR gRNA sequence
ttctttctttttgagacagg

SEQ ID NO: 162863 - DNA, 20 bp, Artificial
  CRISPR gRNA sequence
tctttctttttgagacaggg

SEQ ID NO: 162864 - DNA, 20 bp, Artificial
  CRISPR gRNA sequence
ctttctttttgagacagggt

SEQ ID NO: 162865 - DNA, 20 bp, Artificial
  CRISPR gRNA sequence
tttctttttgagacagggtc

SEQ ID NO: 162866 - DNA, 20 bp, Artificial
  CRISPR gRNA sequence
tctttttgagacagggtctc

SEQ ID NO: 162867 - DNA, 20 bp, Artificial
  CRISPR gRNA sequence
ctttttgagacagggtctca

SEQ ID NO: 162868 - DNA, 20 bp, Artificial
  CRISPR gRNA sequence
tttttgagacagggtctcac

SEQ ID NO: 162869 - DNA, 20 bp, Artificial
  CRISPR gRNA sequence
tttgagacagggtctcactc

SEQ ID NO: 162870 - DNA, 20 bp, Artificial
  CRISPR gRNA sequence
ttgagacagggtctcactct

SEQ ID NO: 162871 - DNA, 20 bp, Artificial
  CRISPR gRNA sequence
tgagacagggtctcactctg

SEQ ID NO: 162872 - DNA, 20 bp, Artificial
  CRISPR gRNA sequence
gagacagggtctcactctgt

SEQ ID NO: 162873 - DNA, 20 bp, Artificial
  CRISPR gRNA sequence
agacagggtctcactctgtc

SEQ ID NO: 162874 - DNA, 20 bp, Artificial
  CRISPR gRNA sequence
actctgtcacccaggctgga

SEQ ID NO: 162875 - DNA, 20 bp, Artificial
  CRISPR gRNA sequence
tgtcacccaggctggagggc

SEQ ID NO: 162876 - DNA, 20 bp, Artificial
  CRISPR gRNA sequence
tcacccaggctggagggcaa

SEQ ID NO: 162877 - DNA, 20 bp, Artificial
  CRISPR gRNA sequence
gagggcaatggcataatcac

SEQ ID NO: 162878 - DNA, 20 bp, Artificial
  CRISPR gRNA sequence
actgtagccttcacctccca

SEQ ID NO: 162879 - DNA, 20 bp, Artificial
  CRISPR gRNA sequence
tagccttcacctcccaggct

SEQ ID NO: 162880 - DNA, 20 bp, Artificial
  CRISPR gRNA sequence
cacctcccaggcttaagtga

SEQ ID NO: 162881 - DNA, 20 bp, Artificial
  CRISPR gRNA sequence
acctcccaggcttaagtgat

SEQ ID NO: 162882 - DNA, 20 bp, Artificial
  CRISPR gRNA sequence
ccaggcttaagtgatcttcc

SEQ ID NO: 162883 - DNA, 20 bp, Artificial
  CRISPR gRNA sequence
aagtgatcttcccacctcag

SEQ ID NO: 162884 - DNA, 20 bp, Artificial
  CRISPR gRNA sequence
agtgatcttcccacctcagc

SEQ ID NO: 162885 - DNA, 20 bp, Artificial
  CRISPR gRNA sequence
cccacctcagcctcccaagt

SEQ ID NO: 162886 - DNA, 20 bp, Artificial
  CRISPR gRNA sequence
ccacctcagcctcccaagta

SEQ ID NO: 162887 - DNA, 20 bp, Artificial
  CRISPR gRNA sequence
agcctcccaagtagctggga

SEQ ID NO: 162888 - DNA, 20 bp, Artificial
  CRISPR gRNA sequence
ccaagtagctgggactacag

SEQ ID NO: 162889 - DNA, 20 bp, Artificial
  CRISPR gRNA sequence
ggactacaggcacgtgccat

SEQ ID NO: 162890 - DNA, 20 bp, Artificial
  CRISPR gRNA sequence
caggcacgtgccatcatgtc

SEQ ID NO: 162891 - DNA, 20 bp, Artificial
  CRISPR gRNA sequence
gcttaatttttaatgttttt

SEQ ID NO: 162892 - DNA, 20 bp, Artificial
  CRISPR gRNA sequence
aatttttaatgtttttttgg

SEQ ID NO: 162893 - DNA, 20 bp, Artificial
  CRISPR gRNA sequence
atttttaatgtttttttgga

SEQ ID NO: 162894 - DNA, 20 bp, Artificial
  CRISPR gRNA sequence
ttaatgtttttttggagtgg

SEQ ID NO: 162895 - DNA, 20 bp, Artificial
  CRISPR gRNA sequence
taatgtttttttggagtggg

SEQ ID NO: 162896 - DNA, 20 bp, Artificial
  CRISPR gRNA sequence
aatgtttttttggagtgggg

SEQ ID NO: 162897 - DNA, 20 bp, Artificial
  CRISPR gRNA sequence
atgtttttttggagtggggg

SEQ ID NO: 162898 - DNA, 20 bp, Artificial
  CRISPR gRNA sequence
ttttggagtgggggacagga

SEQ ID NO: 162899 - DNA, 20 bp, Artificial
  CRISPR gRNA sequence
tttggagtgggggacaggat

SEQ ID NO: 162900 - DNA, 20 bp, Artificial
  CRISPR gRNA sequence
ttggagtgggggacaggatc

SEQ ID NO: 162901 - DNA, 20 bp, Artificial
  CRISPR gRNA sequence
tggagtgggggacaggatct

SEQ ID NO: 162902 - DNA, 20 bp, Artificial
  CRISPR gRNA sequence
ggagtgggggacaggatctc

SEQ ID NO: 162903 - DNA, 20 bp, Artificial
  CRISPR gRNA sequence
gagtgggggacaggatctca

SEQ ID NO: 162904 - DNA, 20 bp, Artificial
  CRISPR gRNA sequence
accatgttgtccaggctagt

SEQ ID NO: 162905 - DNA, 20 bp, Artificial
  CRISPR gRNA sequence
tccaggctagtcacgaactc

SEQ ID NO: 162906 - DNA, 20 bp, Artificial
  CRISPR gRNA sequence
gtcacgaactcctgggctca

SEQ ID NO: 162907 - DNA, 20 bp, Artificial
  CRISPR gRNA sequence
ctgggctcaagcagtcctcc

SEQ ID NO: 162908 - DNA, 20 bp, Artificial
  CRISPR gRNA sequence
ggctcaagcagtcctccagc

SEQ ID NO: 162909 - DNA, 20 bp, Artificial
  CRISPR gRNA sequence
aagcagtcctccagcctcag

SEQ ID NO: 162910 - DNA, 20 bp, Artificial
  CRISPR gRNA sequence
cagcctcagcctcccaaagt

SEQ ID NO: 162911 - DNA, 20 bp, Artificial
  CRISPR gRNA sequence
agcctcccaaagtgctagga

SEQ ID NO: 162912 - DNA, 20 bp, Artificial
  CRISPR gRNA sequence
ccaaagtgctaggattaggc

SEQ ID NO: 162913 - DNA, 20 bp, Artificial
  CRISPR gRNA sequence
ggattaggcatgagccacca

SEQ ID NO: 162914 - DNA, 20 bp, Artificial
  CRISPR gRNA sequence
ggcatgagccaccatgccca

SEQ ID NO: 162915 - DNA, 20 bp, Artificial
  CRISPR gRNA sequence
gtatctcacagttctgttca

SEQ ID NO: 162916 - DNA, 20 bp, Artificial
  CRISPR gRNA sequence
acagttctgttcacagtgta

SEQ ID NO: 162917 - DNA, 20 bp, Artificial
  CRISPR gRNA sequence
tgttcacagtgtagtatata

SEQ ID NO: 162918 - DNA, 20 bp, Artificial
  CRISPR gRNA sequence
ttcacagtgtagtatataca

SEQ ID NO: 162919 - DNA, 20 bp, Artificial
  CRISPR gRNA sequence
acagtgtagtatatacatgt

SEQ ID NO: 162920 - DNA, 20 bp, Artificial
  CRISPR gRNA sequence
agcgtcttacatagtttgtt

SEQ ID NO: 162921 - DNA, 20 bp, Artificial
  CRISPR gRNA sequence
gcgtcttacatagtttgttg

SEQ ID NO: 162922 - DNA, 20 bp, Artificial
  CRISPR gRNA sequence
acatagtttgttgatctgaa

SEQ ID NO: 162923 - DNA, 20 bp, Artificial
  CRISPR gRNA sequence
catagtttgttgatctgaac

SEQ ID NO: 162924 - DNA, 20 bp, Artificial
  CRISPR gRNA sequence
gttgatctgaactcttaaga

SEQ ID NO: 162925 - DNA, 20 bp, Artificial
  CRISPR gRNA sequence
ttgatctgaactcttaagaa

SEQ ID NO: 162926 - DNA, 20 bp, Artificial
  CRISPR gRNA sequence
atctgaactcttaagaaatt

SEQ ID NO: 162927 - DNA, 20 bp, Artificial
  CRISPR gRNA sequence
aactcttaagaaatttttga

SEQ ID NO: 162928 - DNA, 20 bp, Artificial
  CRISPR gRNA sequence
ttaagaaatttttgataatg

SEQ ID NO: 162929 - DNA, 20 bp, Artificial
  CRISPR gRNA sequence
aagaaatttttgataatgat

SEQ ID NO: 162930 - DNA, 20 bp, Artificial
  CRISPR gRNA sequence
agaaatttttgataatgata

SEQ ID NO: 162931 - DNA, 20 bp, Artificial
  CRISPR gRNA sequence
ttgataatgatattctacct

SEQ ID NO: 162932 - DNA, 20 bp, Artificial
  CRISPR gRNA sequence
tgataatgatattctacctg

SEQ ID NO: 162933 - DNA, 20 bp, Artificial
  CRISPR gRNA sequence
gataatgatattctacctgt

SEQ ID NO: 162934 - DNA, 20 bp, Artificial
  CRISPR gRNA sequence
ataatgatattctacctgtt

SEQ ID NO: 162935 - DNA, 20 bp, Artificial
  CRISPR gRNA sequence
tacctgttctaaccttttga

SEQ ID NO: 162936 - DNA, 20 bp, Artificial
  CRISPR gRNA sequence
cctgttctaaccttttgatc

SEQ ID NO: 162937 - DNA, 20 bp, Artificial
  CRISPR gRNA sequence
ttctaaccttttgatctatg

SEQ ID NO: 162938 - DNA, 20 bp, Artificial
  CRISPR gRNA sequence
taaccttttgatctatgagt

SEQ ID NO: 162939 - DNA, 20 bp, Artificial
  CRISPR gRNA sequence
accttttgatctatgagttt

SEQ ID NO: 162940 - DNA, 20 bp, Artificial
  CRISPR gRNA sequence
ttgatctatgagtttctttt

SEQ ID NO: 162941 - DNA, 20 bp, Artificial
  CRISPR gRNA sequence
tgatctatgagtttctttta

SEQ ID NO: 162942 - DNA, 20 bp, Artificial
  CRISPR gRNA sequence
gatctatgagtttcttttac

SEQ ID NO: 162943 - DNA, 20 bp, Artificial
  CRISPR gRNA sequence
atctatgagtttcttttaca

SEQ ID NO: 162944 - DNA, 20 bp, Artificial
  CRISPR gRNA sequence
tgagtttcttttacatgaat

SEQ ID NO: 162945 - DNA, 20 bp, Artificial
  CRISPR gRNA sequence
cttttacatgaataatactt

SEQ ID NO: 162946 - DNA, 20 bp, Artificial
  CRISPR gRNA sequence
ttttacatgaataatacttg

SEQ ID NO: 162947 - DNA, 20 bp, Artificial
  CRISPR gRNA sequence
ttacatgaataatacttgtg

SEQ ID NO: 162948 - DNA, 20 bp, Artificial
  CRISPR gRNA sequence
tacatgaataatacttgtga

SEQ ID NO: 162949 - DNA, 20 bp, Artificial
  CRISPR gRNA sequence
acatgaataatacttgtgag

SEQ ID NO: 162950 - DNA, 20 bp, Artificial
  CRISPR gRNA sequence
catgaataatacttgtgaga

SEQ ID NO: 162951 - DNA, 20 bp, Artificial
  CRISPR gRNA sequence
gtgagagggtttgcgtgggc

SEQ ID NO: 162952 - DNA, 20 bp, Artificial
  CRISPR gRNA sequence
tgagagggtttgcgtgggct

SEQ ID NO: 162953 - DNA, 20 bp, Artificial
  CRISPR gRNA sequence
gcgtgggcttggccatttct

SEQ ID NO: 162954 - DNA, 20 bp, Artificial
  CRISPR gRNA sequence
cgtgggcttggccatttctg

SEQ ID NO: 162955 - DNA, 20 bp, Artificial
  CRISPR gRNA sequence
ggccatttctgtattcctag

SEQ ID NO: 162956 - DNA, 20 bp, Artificial
  CRISPR gRNA sequence
gccatttctgtattcctagg

SEQ ID NO: 162957 - DNA, 20 bp, Artificial
  CRISPR gRNA sequence
ctgtattcctaggagtccat

SEQ ID NO: 162958 - DNA, 20 bp, Artificial
  CRISPR gRNA sequence
tgtattcctaggagtccatc

SEQ ID NO: 162959 - DNA, 20 bp, Artificial
  CRISPR gRNA sequence
tattcctaggagtccatctc

SEQ ID NO: 162960 - DNA, 20 bp, Artificial
  CRISPR gRNA sequence
ctaggagtccatctccatta

SEQ ID NO: 162961 - DNA, 20 bp, Artificial
  CRISPR gRNA sequence
ggagtccatctccattacag

SEQ ID NO: 162962 - DNA, 20 bp, Artificial
  CRISPR gRNA sequence
cattacagatctcagagaaa

SEQ ID NO: 162963 - DNA, 20 bp, Artificial
  CRISPR gRNA sequence
cagatctcagagaaagagga

SEQ ID NO: 162964 - DNA, 20 bp, Artificial
  CRISPR gRNA sequence
agagaaagaggaactctgtc

SEQ ID NO: 162965 - DNA, 20 bp, Artificial
  CRISPR gRNA sequence
tgtctctttaccactcaaaa

SEQ ID NO: 162966 - DNA, 20 bp, Artificial
  CRISPR gRNA sequence
tctctttaccactcaaaatt

SEQ ID NO: 162967 - DNA, 20 bp, Artificial
  CRISPR gRNA sequence
tttaccactcaaaattaata

SEQ ID NO: 162968 - DNA, 20 bp, Artificial
  CRISPR gRNA sequence
taccactcaaaattaatagt

SEQ ID NO: 162969 - DNA, 20 bp, Artificial
  CRISPR gRNA sequence
accactcaaaattaatagtc

SEQ ID NO: 162970 - DNA, 20 bp, Artificial
  CRISPR gRNA sequence
ccactcaaaattaatagtct

SEQ ID NO: 162971 - DNA, 20 bp, Artificial
  CRISPR gRNA sequence
aaaattaatagtcttttgta

SEQ ID NO: 162972 - DNA, 20 bp, Artificial
  CRISPR gRNA sequence
atagtcttttgtattttcac

SEQ ID NO: 162973 - DNA, 20 bp, Artificial
  CRISPR gRNA sequence
ttgtattttcacagaaagct

SEQ ID NO: 162974 - DNA, 20 bp, Artificial
  CRISPR gRNA sequence
tgtattttcacagaaagcta

SEQ ID NO: 162975 - DNA, 20 bp, Artificial
  CRISPR gRNA sequence
gtattttcacagaaagctaa

SEQ ID NO: 162976 - DNA, 20 bp, Artificial
  CRISPR gRNA sequence
tattttcacagaaagctaac

SEQ ID NO: 162977 - DNA, 20 bp, Artificial
  CRISPR gRNA sequence
tcacagaaagctaacaattg

SEQ ID NO: 162978 - DNA, 20 bp, Artificial
  CRISPR gRNA sequence
cacagaaagctaacaattga

SEQ ID NO: 162979 - DNA, 20 bp, Artificial
  CRISPR gRNA sequence
acagaaagctaacaattgat

SEQ ID NO: 162980 - DNA, 20 bp, Artificial
  CRISPR gRNA sequence
acaattgatagtaattttcc

SEQ ID NO: 162981 - DNA, 20 bp, Artificial
  CRISPR gRNA sequence
atagtaattttcccttttat

SEQ ID NO: 162982 - DNA, 20 bp, Artificial
  CRISPR gRNA sequence
tcccttttattagctccttt

SEQ ID NO: 162983 - DNA, 20 bp, Artificial
  CRISPR gRNA sequence
cccttttattagctcctttc

SEQ ID NO: 162984 - DNA, 20 bp, Artificial
  CRISPR gRNA sequence
ccttttattagctcctttct

SEQ ID NO: 162985 - DNA, 20 bp, Artificial
  CRISPR gRNA sequence
ttattagctcctttcttcct

SEQ ID NO: 162986 - DNA, 20 bp, Artificial
  CRISPR gRNA sequence
tattagctcctttcttcctc

SEQ ID NO: 162987 - DNA, 20 bp, Artificial
  CRISPR gRNA sequence
attagctcctttcttcctca

SEQ ID NO: 162988 - DNA, 20 bp, Artificial
  CRISPR gRNA sequence
ttagctcctttcttcctcac

SEQ ID NO: 162989 - DNA, 20 bp, Artificial
  CRISPR gRNA sequence
gctcctttcttcctcacagt

SEQ ID NO: 162990 - DNA, 20 bp, Artificial
  CRISPR gRNA sequence
ctttcttcctcacagtagcc

SEQ ID NO: 162991 - DNA, 20 bp, Artificial
  CRISPR gRNA sequence
tcttcctcacagtagccctg

SEQ ID NO: 162992 - DNA, 20 bp, Artificial
  CRISPR gRNA sequence
cttcctcacagtagccctgt

SEQ ID NO: 162993 - DNA, 20 bp, Artificial
  CRISPR gRNA sequence
ttcctcacagtagccctgtg

SEQ ID NO: 162994 - DNA, 20 bp, Artificial
  CRISPR gRNA sequence
cctcacagtagccctgtgag

SEQ ID NO: 162995 - DNA, 20 bp, Artificial
  CRISPR gRNA sequence
ctcacagtagccctgtgaga

SEQ ID NO: 162996 - DNA, 20 bp, Artificial
  CRISPR gRNA sequence
acagtagccctgtgagattt

SEQ ID NO: 162997 - DNA, 20 bp, Artificial
  CRISPR gRNA sequence
tgagatttgatataataaga

SEQ ID NO: 162998 - DNA, 20 bp, Artificial
  CRISPR gRNA sequence
gatataataagaattatcag

SEQ ID NO: 162999 - DNA, 20 bp, Artificial
  CRISPR gRNA sequence
atataataagaattatcagt

SEQ ID NO: 163000 - DNA, 20 bp, Artificial
  CRISPR gRNA sequence
tcagttccattttacagaca

SEQ ID NO: 163001 - DNA, 20 bp, Artificial
  CRISPR gRNA sequence
cattttacagacaatggaaa

SEQ ID NO: 163002 - DNA, 20 bp, Artificial
  CRISPR gRNA sequence
tacagacaatggaaatagac

SEQ ID NO: 163003 - DNA, 20 bp, Artificial
  CRISPR gRNA sequence
acagacaatggaaatagaca

SEQ ID NO: 163004 - DNA, 20 bp, Artificial
  CRISPR gRNA sequence
cagacaatggaaatagacac

SEQ ID NO: 163005 - DNA, 20 bp, Artificial
  CRISPR gRNA sequence
agtgactcacccagagtgat

SEQ ID NO: 163006 - DNA, 20 bp, Artificial
  CRISPR gRNA sequence
acccagagtgataggaccaa

SEQ ID NO: 163007 - DNA, 20 bp, Artificial
  CRISPR gRNA sequence
cccatctgctgcttctttaa

SEQ ID NO: 163008 - DNA, 20 bp, Artificial
  CRISPR gRNA sequence
ccatctgctgcttctttaac

SEQ ID NO: 163009 - DNA, 20 bp, Artificial
  CRISPR gRNA sequence
ctgcttctttaactccagag

SEQ ID NO: 163010 - DNA, 20 bp, Artificial
  CRISPR gRNA sequence
cttctttaactccagagctc

SEQ ID NO: 163011 - DNA, 20 bp, Artificial
  CRISPR gRNA sequence
ctttaactccagagctcttt

SEQ ID NO: 163012 - DNA, 20 bp, Artificial
  CRISPR gRNA sequence
tttaactccagagctctttc

SEQ ID NO: 163013 - DNA, 20 bp, Artificial
  CRISPR gRNA sequence
taactccagagctctttctg

SEQ ID NO: 163014 - DNA, 20 bp, Artificial
  CRISPR gRNA sequence
aactccagagctctttctgt

SEQ ID NO: 163015 - DNA, 20 bp, Artificial
  CRISPR gRNA sequence
actccagagctctttctgtg

SEQ ID NO: 163016 - DNA, 20 bp, Artificial
  CRISPR gRNA sequence
cagagctctttctgtggctg

SEQ ID NO: 163017 - DNA, 20 bp, Artificial
  CRISPR gRNA sequence
tttctgtggctgtatcctgc

SEQ ID NO: 163018 - DNA, 20 bp, Artificial
  CRISPR gRNA sequence
tctgtggctgtatcctgcac

SEQ ID NO: 163019 - DNA, 20 bp, Artificial
  CRISPR gRNA sequence
ctgtggctgtatcctgcaca

SEQ ID NO: 163020 - DNA, 20 bp, Artificial
  CRISPR gRNA sequence
tgtggctgtatcctgcacag

SEQ ID NO: 163021 - DNA, 20 bp, Artificial
  CRISPR gRNA sequence
tggctgtatcctgcacagac

SEQ ID NO: 163022 - DNA, 20 bp, Artificial
  CRISPR gRNA sequence
tatcctgcacagactacctc

SEQ ID NO: 163023 - DNA, 20 bp, Artificial
  CRISPR gRNA sequence
cacagactacctcaccaaag

SEQ ID NO: 163024 - DNA, 20 bp, Artificial
  CRISPR gRNA sequence
cctcaccaaaggtttagaac

SEQ ID NO: 163025 - DNA, 20 bp, Artificial
  CRISPR gRNA sequence
accaaaggtttagaaccttg

SEQ ID NO: 163026 - DNA, 20 bp, Artificial
  CRISPR gRNA sequence
agaaccttgtttgaccaaga

SEQ ID NO: 163027 - DNA, 20 bp, Artificial
  CRISPR gRNA sequence
gaaccttgtttgaccaagag

SEQ ID NO: 163028 - DNA, 20 bp, Artificial
  CRISPR gRNA sequence
gtttgaccaagagcttcaac

SEQ ID NO: 163029 - DNA, 20 bp, Artificial
  CRISPR gRNA sequence
tttgaccaagagcttcaact

SEQ ID NO: 163030 - DNA, 20 bp, Artificial
  CRISPR gRNA sequence
gaccaagagcttcaactttg

SEQ ID NO: 163031 - DNA, 20 bp, Artificial
  CRISPR gRNA sequence
accaagagcttcaactttga

SEQ ID NO: 163032 - DNA, 20 bp, Artificial
  CRISPR gRNA sequence
caactttgaaatcagacaca

SEQ ID NO: 163033 - DNA, 20 bp, Artificial
  CRISPR gRNA sequence
aactttgaaatcagacacat

SEQ ID NO: 163034 - DNA, 20 bp, Artificial
  CRISPR gRNA sequence
tgaaatcagacacatcaaga

SEQ ID NO: 163035 - DNA, 20 bp, Artificial
  CRISPR gRNA sequence
gaaatcagacacatcaagaa

SEQ ID NO: 163036 - DNA, 20 bp, Artificial
  CRISPR gRNA sequence
aaatcagacacatcaagaaa

SEQ ID NO: 163037 - DNA, 20 bp, Artificial
  CRISPR gRNA sequence
atatggcttgagcatttcct

SEQ ID NO: 163038 - DNA, 20 bp, Artificial
  CRISPR gRNA sequence
tatggcttgagcatttccta

SEQ ID NO: 163039 - DNA, 20 bp, Artificial
  CRISPR gRNA sequence
gagcatttcctatatgccaa

SEQ ID NO: 163040 - DNA, 20 bp, Artificial
  CRISPR gRNA sequence
agcatttcctatatgccaag

SEQ ID NO: 163041 - DNA, 20 bp, Artificial
  CRISPR gRNA sequence
cctatatgccaagccctggg

SEQ ID NO: 163042 - DNA, 20 bp, Artificial
  CRISPR gRNA sequence
ctatatgccaagccctgggc

SEQ ID NO: 163043 - DNA, 20 bp, Artificial
  CRISPR gRNA sequence
tatgccaagccctgggctgg

SEQ ID NO: 163044 - DNA, 20 bp, Artificial
  CRISPR gRNA sequence
ggctgggtacatatattatc

SEQ ID NO: 163045 - DNA, 20 bp, Artificial
  CRISPR gRNA sequence
ggtacatatattatctcatt

SEQ ID NO: 163046 - DNA, 20 bp, Artificial
  CRISPR gRNA sequence
tctcatttgattgccacaat

SEQ ID NO: 163047 - DNA, 20 bp, Artificial
  CRISPR gRNA sequence
atttgattgccacaataaaa

SEQ ID NO: 163048 - DNA, 20 bp, Artificial
  CRISPR gRNA sequence
gattgccacaataaaactga

SEQ ID NO: 163049 - DNA, 20 bp, Artificial
  CRISPR gRNA sequence
attgccacaataaaactgaa

SEQ ID NO: 163050 - DNA, 20 bp, Artificial
  CRISPR gRNA sequence
ccacaataaaactgaaaggt

SEQ ID NO: 163051 - DNA, 20 bp, Artificial
  CRISPR gRNA sequence
aaaggttatcctctttttca

SEQ ID NO: 163052 - DNA, 20 bp, Artificial
  CRISPR gRNA sequence
tcctctttttcagtacatga

SEQ ID NO: 163053 - DNA, 20 bp, Artificial
  CRISPR gRNA sequence
tttttcagtacatgaaaaag

SEQ ID NO: 163054 - DNA, 20 bp, Artificial
  CRISPR gRNA sequence
tttcagtacatgaaaaagcc

SEQ ID NO: 163055 - DNA, 20 bp, Artificial
  CRISPR gRNA sequence
ttcagtacatgaaaaagccc

SEQ ID NO: 163056 - DNA, 20 bp, Artificial
  CRISPR gRNA sequence
tcagtacatgaaaaagccca

SEQ ID NO: 163057 - DNA, 20 bp, Artificial
  CRISPR gRNA sequence
cagtacatgaaaaagcccaa

SEQ ID NO: 163058 - DNA, 20 bp, Artificial
  CRISPR gRNA sequence
agtacatgaaaaagcccaaa

SEQ ID NO: 163059 - DNA, 20 bp, Artificial
  CRISPR gRNA sequence
caattttatccaaatccatt

SEQ ID NO: 163060 - DNA, 20 bp, Artificial
  CRISPR gRNA sequence
tatccaaatccattggcttt

SEQ ID NO: 163061 - DNA, 20 bp, Artificial
  CRISPR gRNA sequence
atccaaatccattggctttc

SEQ ID NO: 163062 - DNA, 20 bp, Artificial
  CRISPR gRNA sequence
tccaaatccattggctttca

SEQ ID NO: 163063 - DNA, 20 bp, Artificial
  CRISPR gRNA sequence
gctttcaagctcattctcct

SEQ ID NO: 163064 - DNA, 20 bp, Artificial
  CRISPR gRNA sequence
tcaagctcattctccttcct

SEQ ID NO: 163065 - DNA, 20 bp, Artificial
  CRISPR gRNA sequence
caagctcattctccttcctc

SEQ ID NO: 163066 - DNA, 20 bp, Artificial
  CRISPR gRNA sequence
aagctcattctccttcctca

SEQ ID NO: 163067 - DNA, 20 bp, Artificial
  CRISPR gRNA sequence
attctccttcctcatattgt

SEQ ID NO: 163068 - DNA, 20 bp, Artificial
  CRISPR gRNA sequence
tccttcctcatattgtttct

SEQ ID NO: 163069 - DNA, 20 bp, Artificial
  CRISPR gRNA sequence
cttcctcatattgtttctcc

SEQ ID NO: 163070 - DNA, 20 bp, Artificial
  CRISPR gRNA sequence
cctcatattgtttctccttg

SEQ ID NO: 163071 - DNA, 20 bp, Artificial
  CRISPR gRNA sequence
ctcatattgtttctccttgg

SEQ ID NO: 163072 - DNA, 20 bp, Artificial
  CRISPR gRNA sequence
atattgtttctccttggatt

SEQ ID NO: 163073 - DNA, 20 bp, Artificial
  CRISPR gRNA sequence
tttctccttggattagaacc

SEQ ID NO: 163074 - DNA, 20 bp, Artificial
  CRISPR gRNA sequence
ctccttggattagaacctaa

SEQ ID NO: 163075 - DNA, 20 bp, Artificial
  CRISPR gRNA sequence
tccttggattagaacctaaa

SEQ ID NO: 163076 - DNA, 20 bp, Artificial
  CRISPR gRNA sequence
cttggattagaacctaaacc

SEQ ID NO: 163077 - DNA, 20 bp, Artificial
  CRISPR gRNA sequence
ggattagaacctaaaccctg

SEQ ID NO: 163078 - DNA, 20 bp, Artificial
  CRISPR gRNA sequence
gattagaacctaaaccctgc

SEQ ID NO: 163079 - DNA, 20 bp, Artificial
  CRISPR gRNA sequence
gaacctaaaccctgccactt

SEQ ID NO: 163080 - DNA, 20 bp, Artificial
  CRISPR gRNA sequence
aaccctgccacttactggct

SEQ ID NO: 163081 - DNA, 20 bp, Artificial
  CRISPR gRNA sequence
ccacttactggctctatggc

SEQ ID NO: 163082 - DNA, 20 bp, Artificial
  CRISPR gRNA sequence
actggctctatggctgtggg

SEQ ID NO: 163083 - DNA, 20 bp, Artificial
  CRISPR gRNA sequence
ctggctctatggctgtgggc

SEQ ID NO: 163084 - DNA, 20 bp, Artificial
  CRISPR gRNA sequence
gctctatggctgtgggcaag

SEQ ID NO: 163085 - DNA, 20 bp, Artificial
  CRISPR gRNA sequence
tatggctgtgggcaagtcac

SEQ ID NO: 163086 - DNA, 20 bp, Artificial
  CRISPR gRNA sequence
tggctgtgggcaagtcactt

SEQ ID NO: 163087 - DNA, 20 bp, Artificial
  CRISPR gRNA sequence
tgggcaagtcacttcatctc

SEQ ID NO: 163088 - DNA, 20 bp, Artificial
  CRISPR gRNA sequence
catctctcttgacccctagt

SEQ ID NO: 163089 - DNA, 20 bp, Artificial
  CRISPR gRNA sequence
atctctcttgacccctagtt

SEQ ID NO: 163090 - DNA, 20 bp, Artificial
  CRISPR gRNA sequence
tcttgacccctagtttcttt

SEQ ID NO: 163091 - DNA, 20 bp, Artificial
  CRISPR gRNA sequence
ttgacccctagtttctttga

SEQ ID NO: 163092 - DNA, 20 bp, Artificial
  CRISPR gRNA sequence
gacccctagtttctttgaaa

SEQ ID NO: 163093 - DNA, 20 bp, Artificial
  CRISPR gRNA sequence
acccctagtttctttgaaag

SEQ ID NO: 163094 - DNA, 20 bp, Artificial
  CRISPR gRNA sequence
gtttctttgaaaggctatta

SEQ ID NO: 163095 - DNA, 20 bp, Artificial
  CRISPR gRNA sequence
ctttgaaaggctattataag

SEQ ID NO: 163096 - DNA, 20 bp, Artificial
  CRISPR gRNA sequence
tttgaaaggctattataaga

SEQ ID NO: 163097 - DNA, 20 bp, Artificial
  CRISPR gRNA sequence
tgaaaggctattataagagt

SEQ ID NO: 163098 - DNA, 20 bp, Artificial
  CRISPR gRNA sequence
gaaaggctattataagagta

SEQ ID NO: 163099 - DNA, 20 bp, Artificial
  CRISPR gRNA sequence
aaaggctattataagagtaa

SEQ ID NO: 163100 - DNA, 20 bp, Artificial
  CRISPR gRNA sequence
ttataagagtaagaaaacac

SEQ ID NO: 163101 - DNA, 20 bp, Artificial
  CRISPR gRNA sequence
taagagtaagaaaacacctt

SEQ ID NO: 163102 - DNA, 20 bp, Artificial
  CRISPR gRNA sequence
gcacaaggtttggcgcatgg

SEQ ID NO: 163103 - DNA, 20 bp, Artificial
  CRISPR gRNA sequence
cacaaggtttggcgcatggt

SEQ ID NO: 163104 - DNA, 20 bp, Artificial
  CRISPR gRNA sequence
ggcgcatggtatgtgctaga

SEQ ID NO: 163105 - DNA, 20 bp, Artificial
  CRISPR gRNA sequence
gcgcatggtatgtgctagat

SEQ ID NO: 163106 - DNA, 20 bp, Artificial
  CRISPR gRNA sequence
gataagtattctttctccct

SEQ ID NO: 163107 - DNA, 20 bp, Artificial
  CRISPR gRNA sequence
tttctccctgttacctgctt

SEQ ID NO: 163108 - DNA, 20 bp, Artificial
  CRISPR gRNA sequence
tctccctgttacctgctttg

SEQ ID NO: 163109 - DNA, 20 bp, Artificial
  CRISPR gRNA sequence
ctccctgttacctgctttgt

SEQ ID NO: 163110 - DNA, 20 bp, Artificial
  CRISPR gRNA sequence
tccctgttacctgctttgtt

SEQ ID NO: 163111 - DNA, 20 bp, Artificial
  CRISPR gRNA sequence
cctgttacctgctttgttcc

SEQ ID NO: 163112 - DNA, 20 bp, Artificial
  CRISPR gRNA sequence
ttacctgctttgttcccact

SEQ ID NO: 163113 - DNA, 20 bp, Artificial
  CRISPR gRNA sequence
cctgctttgttcccactcat

SEQ ID NO: 163114 - DNA, 20 bp, Artificial
  CRISPR gRNA sequence
ctttgttcccactcatggat

SEQ ID NO: 163115 - DNA, 20 bp, Artificial
  CRISPR gRNA sequence
tgttcccactcatggattta

SEQ ID NO: 163116 - DNA, 20 bp, Artificial
  CRISPR gRNA sequence
gttcccactcatggatttat

SEQ ID NO: 163117 - DNA, 20 bp, Artificial
  CRISPR gRNA sequence
ttcccactcatggatttatt

SEQ ID NO: 163118 - DNA, 20 bp, Artificial
  CRISPR gRNA sequence
ccactcatggatttatttta

SEQ ID NO: 163119 - DNA, 20 bp, Artificial
  CRISPR gRNA sequence
atggatttattttaccttgg

SEQ ID NO: 163120 - DNA, 20 bp, Artificial
  CRISPR gRNA sequence
attttaccttggaatctctt

SEQ ID NO: 163121 - DNA, 20 bp, Artificial
  CRISPR gRNA sequence
ttttaccttggaatctcttg

SEQ ID NO: 163122 - DNA, 20 bp, Artificial
  CRISPR gRNA sequence
taccttggaatctcttgagt

SEQ ID NO: 163123 - DNA, 20 bp, Artificial
  CRISPR gRNA sequence
accttggaatctcttgagta

SEQ ID NO: 163124 - DNA, 20 bp, Artificial
  CRISPR gRNA sequence
ccttggaatctcttgagtat

SEQ ID NO: 163125 - DNA, 20 bp, Artificial
  CRISPR gRNA sequence
ggaatctcttgagtatacca

SEQ ID NO: 163126 - DNA, 20 bp, Artificial
  CRISPR gRNA sequence
gaatctcttgagtataccac

SEQ ID NO: 163127 - DNA, 20 bp, Artificial
  CRISPR gRNA sequence
ttgagtataccacctcattt

SEQ ID NO: 163128 - DNA, 20 bp, Artificial
  CRISPR gRNA sequence
gagtataccacctcattttt

SEQ ID NO: 163129 - DNA, 20 bp, Artificial
  CRISPR gRNA sequence
agtataccacctcatttttt

SEQ ID NO: 163130 - DNA, 20 bp, Artificial
  CRISPR gRNA sequence
attttttgacccttgcccca

SEQ ID NO: 163131 - DNA, 20 bp, Artificial
  CRISPR gRNA sequence
tttgacccttgccccatagt

SEQ ID NO: 163132 - DNA, 20 bp, Artificial
  CRISPR gRNA sequence
ttgacccttgccccatagtc

SEQ ID NO: 163133 - DNA, 20 bp, Artificial
  CRISPR gRNA sequence
tgacccttgccccatagtcc

SEQ ID NO: 163134 - DNA, 20 bp, Artificial
  CRISPR gRNA sequence
gacccttgccccatagtccc

SEQ ID NO: 163135 - DNA, 20 bp, Artificial
  CRISPR gRNA sequence
acccttgccccatagtccca

SEQ ID NO: 163136 - DNA, 20 bp, Artificial
  CRISPR gRNA sequence
gccccatagtcccatgccag

SEQ ID NO: 163137 - DNA, 20 bp, Artificial
  CRISPR gRNA sequence
ccccatagtcccatgccagg

SEQ ID NO: 163138 - DNA, 20 bp, Artificial
  CRISPR gRNA sequence
gtttgcatgacttgctggtg

SEQ ID NO: 163139 - DNA, 20 bp, Artificial
  CRISPR gRNA sequence
gcatgacttgctggtgattg

SEQ ID NO: 163140 - DNA, 20 bp, Artificial
  CRISPR gRNA sequence
catgacttgctggtgattga

SEQ ID NO: 163141 - DNA, 20 bp, Artificial
  CRISPR gRNA sequence
gctggtgattgacagggagg

SEQ ID NO: 163142 - DNA, 20 bp, Artificial
  CRISPR gRNA sequence
ctggtgattgacagggaggg

SEQ ID NO: 163143 - DNA, 20 bp, Artificial
  CRISPR gRNA sequence
gtgattgacagggagggcct

SEQ ID NO: 163144 - DNA, 20 bp, Artificial
  CRISPR gRNA sequence
acagggagggcctgtgtctg

SEQ ID NO: 163145 - DNA, 20 bp, Artificial
  CRISPR gRNA sequence
tgtctgttacagatgatcag

SEQ ID NO: 163146 - DNA, 20 bp, Artificial
  CRISPR gRNA sequence
ttacagatgatcagtgcaga

SEQ ID NO: 163147 - DNA, 20 bp, Artificial
  CRISPR gRNA sequence
cagatgatcagtgcagaagc

SEQ ID NO: 163148 - DNA, 20 bp, Artificial
  CRISPR gRNA sequence
tactctttgccaaggcagcc

SEQ ID NO: 163149 - DNA, 20 bp, Artificial
  CRISPR gRNA sequence
tttgccaaggcagcccagat

SEQ ID NO: 163150 - DNA, 20 bp, Artificial
  CRISPR gRNA sequence
tgccaaggcagcccagattt

SEQ ID NO: 163151 - DNA, 20 bp, Artificial
  CRISPR gRNA sequence
gccaaggcagcccagatttt

SEQ ID NO: 163152 - DNA, 20 bp, Artificial
  CRISPR gRNA sequence
ccaaggcagcccagattttt

SEQ ID NO: 163153 - DNA, 20 bp, Artificial
  CRISPR gRNA sequence
ttatcacagagttgactctt

SEQ ID NO: 163154 - DNA, 20 bp, Artificial
  CRISPR gRNA sequence
tatcacagagttgactcttc

SEQ ID NO: 163155 - DNA, 20 bp, Artificial
  CRISPR gRNA sequence
atcacagagttgactcttcg

SEQ ID NO: 163156 - DNA, 20 bp, Artificial
  CRISPR gRNA sequence
tcacagagttgactcttcga

SEQ ID NO: 163157 - DNA, 20 bp, Artificial
  CRISPR gRNA sequence
actcttcgagcctggattca

SEQ ID NO: 163158 - DNA, 20 bp, Artificial
  CRISPR gRNA sequence
ttcgagcctggattcacaca

SEQ ID NO: 163159 - DNA, 20 bp, Artificial
  CRISPR gRNA sequence
cgagcctggattcacacaga

SEQ ID NO: 163160 - DNA, 20 bp, Artificial
  CRISPR gRNA sequence
gagcctggattcacacagaa

SEQ ID NO: 163161 - DNA, 20 bp, Artificial
  CRISPR gRNA sequence
gattcacacagaagataaca

SEQ ID NO: 163162 - DNA, 20 bp, Artificial
  CRISPR gRNA sequence
acacagaagataacaagcgc

SEQ ID NO: 163163 - DNA, 20 bp, Artificial
  CRISPR gRNA sequence
tacaggtattattgcagact

SEQ ID NO: 163164 - DNA, 20 bp, Artificial
  CRISPR gRNA sequence
caggtattattgcagactta

SEQ ID NO: 163165 - DNA, 20 bp, Artificial
  CRISPR gRNA sequence
ttgcagacttagattaggaa

SEQ ID NO: 163166 - DNA, 20 bp, Artificial
  CRISPR gRNA sequence
cagacttagattaggaaaac

SEQ ID NO: 163167 - DNA, 20 bp, Artificial
  CRISPR gRNA sequence
agattaggaaaactggggta

SEQ ID NO: 163168 - DNA, 20 bp, Artificial
  CRISPR gRNA sequence
gattaggaaaactggggtaa

SEQ ID NO: 163169 - DNA, 20 bp, Artificial
  CRISPR gRNA sequence
ggaaaactggggtaagcagc

SEQ ID NO: 163170 - DNA, 20 bp, Artificial
  CRISPR gRNA sequence
gggtaagcagcagcctttgc

SEQ ID NO: 163171 - DNA, 20 bp, Artificial
  CRISPR gRNA sequence
tgcctgttttcctgcgtggt

SEQ ID NO: 163172 - DNA, 20 bp, Artificial
  CRISPR gRNA sequence
gcctgttttcctgcgtggtg

SEQ ID NO: 163173 - DNA, 20 bp, Artificial
  CRISPR gRNA sequence
cctgttttcctgcgtggtgt

SEQ ID NO: 163174 - DNA, 20 bp, Artificial
  CRISPR gRNA sequence
ttttcctgcgtggtgttgga

SEQ ID NO: 163175 - DNA, 20 bp, Artificial
  CRISPR gRNA sequence
tcctgcgtggtgttggagaa

SEQ ID NO: 163176 - DNA, 20 bp, Artificial
  CRISPR gRNA sequence
cctgcgtggtgttggagaaa

SEQ ID NO: 163177 - DNA, 20 bp, Artificial
  CRISPR gRNA sequence
ctgcgtggtgttggagaaag

SEQ ID NO: 163178 - DNA, 20 bp, Artificial
  CRISPR gRNA sequence
cgtggtgttggagaaagatt

SEQ ID NO: 163179 - DNA, 20 bp, Artificial
  CRISPR gRNA sequence
gagaaagattgttctccttt

SEQ ID NO: 163180 - DNA, 20 bp, Artificial
  CRISPR gRNA sequence
ttctcctttaggaccaaaga

SEQ ID NO: 163181 - DNA, 20 bp, Artificial
  CRISPR gRNA sequence
tcctttaggaccaaagattg

SEQ ID NO: 163182 - DNA, 20 bp, Artificial
  CRISPR gRNA sequence
ctttaggaccaaagattgtt

SEQ ID NO: 163183 - DNA, 20 bp, Artificial
  CRISPR gRNA sequence
taggaccaaagattgttctc

SEQ ID NO: 163184 - DNA, 20 bp, Artificial
  CRISPR gRNA sequence
aggaccaaagattgttctcc

SEQ ID NO: 163185 - DNA, 20 bp, Artificial
  CRISPR gRNA sequence
ggaccaaagattgttctcct

SEQ ID NO: 163186 - DNA, 20 bp, Artificial
  CRISPR gRNA sequence
ttctcctttaggaccaaaga

SEQ ID NO: 163187 - DNA, 20 bp, Artificial
  CRISPR gRNA sequence
tcctttaggaccaaagattg

SEQ ID NO: 163188 - DNA, 20 bp, Artificial
  CRISPR gRNA sequence
ctttaggaccaaagattgtt

SEQ ID NO: 163189 - DNA, 20 bp, Artificial
  CRISPR gRNA sequence
taggaccaaagattgttctc

SEQ ID NO: 163190 - DNA, 20 bp, Artificial
  CRISPR gRNA sequence
aggaccaaagattgttctcc

SEQ ID NO: 163191 - DNA, 20 bp, Artificial
  CRISPR gRNA sequence
ggaccaaagattgttctcct

SEQ ID NO: 163192 - DNA, 20 bp, Artificial
  CRISPR gRNA sequence
ttctcctttaggcctctatc

SEQ ID NO: 163193 - DNA, 20 bp, Artificial
  CRISPR gRNA sequence
tcctttaggcctctatcaag

SEQ ID NO: 163194 - DNA, 20 bp, Artificial
  CRISPR gRNA sequence
ctttaggcctctatcaagct

SEQ ID NO: 163195 - DNA, 20 bp, Artificial
  CRISPR gRNA sequence
taggcctctatcaagctgac

SEQ ID NO: 163196 - DNA, 20 bp, Artificial
  CRISPR gRNA sequence
aggcctctatcaagctgacg

SEQ ID NO: 163197 - DNA, 20 bp, Artificial
  CRISPR gRNA sequence
ggcctctatcaagctgacgt

SEQ ID NO: 163198 - DNA, 20 bp, Artificial
  CRISPR gRNA sequence
tatcaagctgacgtgtcatt

SEQ ID NO: 163199 - DNA, 20 bp, Artificial
  CRISPR gRNA sequence
tcaagctgacgtgtcattgg

SEQ ID NO: 163200 - DNA, 20 bp, Artificial
  CRISPR gRNA sequence
acgtgtcattggcatcacca

SEQ ID NO: 163201 - DNA, 20 bp, Artificial
  CRISPR gRNA sequence
gcatcaccactgttgggagg

SEQ ID NO: 163202 - DNA, 20 bp, Artificial
  CRISPR gRNA sequence
ttgggaggcagacatacctt

SEQ ID NO: 163203 - DNA, 20 bp, Artificial
  CRISPR gRNA sequence
ggaggcagacataccttcta

SEQ ID NO: 163204 - DNA, 20 bp, Artificial
  CRISPR gRNA sequence
ctagccatggtgattgtgtt

SEQ ID NO: 163205 - DNA, 20 bp, Artificial
  CRISPR gRNA sequence
tagccatggtgattgtgttt

SEQ ID NO: 163206 - DNA, 20 bp, Artificial
  CRISPR gRNA sequence
gccatggtgattgtgtttct

SEQ ID NO: 163207 - DNA, 20 bp, Artificial
  CRISPR gRNA sequence
tgtttctccaccaaaaatct

SEQ ID NO: 163208 - DNA, 20 bp, Artificial
  CRISPR gRNA sequence
ctccaccaaaaatcttaatc

SEQ ID NO: 163209 - DNA, 20 bp, Artificial
  CRISPR gRNA sequence
tccaccaaaaatcttaatca

SEQ ID NO: 163210 - DNA, 20 bp, Artificial
  CRISPR gRNA sequence
caccaaaaatcttaatcaat

SEQ ID NO: 163211 - DNA, 20 bp, Artificial
  CRISPR gRNA sequence
aatcaattctctcctggttt

SEQ ID NO: 163212 - DNA, 20 bp, Artificial
  CRISPR gRNA sequence
atcaattctctcctggtttt

SEQ ID NO: 163213 - DNA, 20 bp, Artificial
  CRISPR gRNA sequence
tctcctggttttcacagctt

SEQ ID NO: 163214 - DNA, 20 bp, Artificial
  CRISPR gRNA sequence
tcctggttttcacagcttag

SEQ ID NO: 163215 - DNA, 20 bp, Artificial
  CRISPR gRNA sequence
ctggttttcacagcttagtg

SEQ ID NO: 163216 - DNA, 20 bp, Artificial
  CRISPR gRNA sequence
gttttcacagcttagtgact

SEQ ID NO: 163217 - DNA, 20 bp, Artificial
  CRISPR gRNA sequence
tcacagcttagtgactgaac

SEQ ID NO: 163218 - DNA, 20 bp, Artificial
  CRISPR gRNA sequence
cacagcttagtgactgaact

SEQ ID NO: 163219 - DNA, 20 bp, Artificial
  CRISPR gRNA sequence
acagcttagtgactgaactc

SEQ ID NO: 163220 - DNA, 20 bp, Artificial
  CRISPR gRNA sequence
agtgactgaactcttttccc

SEQ ID NO: 163221 - DNA, 20 bp, Artificial
  CRISPR gRNA sequence
gtgactgaactcttttccct

SEQ ID NO: 163222 - DNA, 20 bp, Artificial
  CRISPR gRNA sequence
aactcttttcccttggtgag

SEQ ID NO: 163223 - DNA, 20 bp, Artificial
  CRISPR gRNA sequence
ttttcccttggtgagccctc

SEQ ID NO: 163224 - DNA, 20 bp, Artificial
  CRISPR gRNA sequence
ttcccttggtgagccctcac

SEQ ID NO: 163225 - DNA, 20 bp, Artificial
  CRISPR gRNA sequence
tcccttggtgagccctcact

SEQ ID NO: 163226 - DNA, 20 bp, Artificial
  CRISPR gRNA sequence
cccttggtgagccctcacta

SEQ ID NO: 163227 - DNA, 20 bp, Artificial
  CRISPR gRNA sequence
ccttggtgagccctcactat

SEQ ID NO: 163228 - DNA, 20 bp, Artificial
  CRISPR gRNA sequence
ggtgagccctcactataaac

SEQ ID NO: 163229 - DNA, 20 bp, Artificial
  CRISPR gRNA sequence
gtgagccctcactataaaca

SEQ ID NO: 163230 - DNA, 20 bp, Artificial
  CRISPR gRNA sequence
actataaacagaggctcaag

SEQ ID NO: 163231 - DNA, 20 bp, Artificial
  CRISPR gRNA sequence
taaacagaggctcaagtgat

SEQ ID NO: 163232 - DNA, 20 bp, Artificial
  CRISPR gRNA sequence
aagtgataagagtatttacc

SEQ ID NO: 163233 - DNA, 20 bp, Artificial
  CRISPR gRNA sequence
acctgtttccaaacgtaatc

SEQ ID NO: 163234 - DNA, 20 bp, Artificial
  CRISPR gRNA sequence
cctgtttccaaacgtaatca

SEQ ID NO: 163235 - DNA, 20 bp, Artificial
  CRISPR gRNA sequence
tttccaaacgtaatcaactt

SEQ ID NO: 163236 - DNA, 20 bp, Artificial
  CRISPR gRNA sequence
ccaaacgtaatcaacttctg

SEQ ID NO: 163237 - DNA, 20 bp, Artificial
  CRISPR gRNA sequence
caaacgtaatcaacttctgg

SEQ ID NO: 163238 - DNA, 20 bp, Artificial
  CRISPR gRNA sequence
ctggttgggagccttgagag

SEQ ID NO: 163239 - DNA, 20 bp, Artificial
  CRISPR gRNA sequence
tggttgggagccttgagaga

SEQ ID NO: 163240 - DNA, 20 bp, Artificial
  CRISPR gRNA sequence
gttgggagccttgagagatt

SEQ ID NO: 163241 - DNA, 20 bp, Artificial
  CRISPR gRNA sequence
ggagccttgagagattccag

SEQ ID NO: 163242 - DNA, 20 bp, Artificial
  CRISPR gRNA sequence
gagagattccaggaagtatc

SEQ ID NO: 163243 - DNA, 20 bp, Artificial
  CRISPR gRNA sequence
agagattccaggaagtatca

SEQ ID NO: 163244 - DNA, 20 bp, Artificial
  CRISPR gRNA sequence
caggaagtatcatcagtctc

SEQ ID NO: 163245 - DNA, 20 bp, Artificial
  CRISPR gRNA sequence
actagcttcattaggctttt

SEQ ID NO: 163246 - DNA, 20 bp, Artificial
  CRISPR gRNA sequence
gcttcattaggctttttgtt

SEQ ID NO: 163247 - DNA, 20 bp, Artificial
  CRISPR gRNA sequence
cattaggctttttgttcctt

SEQ ID NO: 163248 - DNA, 20 bp, Artificial
  CRISPR gRNA sequence
attaggctttttgttccttg

SEQ ID NO: 163249 - DNA, 20 bp, Artificial
  CRISPR gRNA sequence
ggctttttgttccttgtcag

SEQ ID NO: 163250 - DNA, 20 bp, Artificial
  CRISPR gRNA sequence
tttgttccttgtcagccttc

SEQ ID NO: 163251 - DNA, 20 bp, Artificial
  CRISPR gRNA sequence
ttgttccttgtcagccttcc

SEQ ID NO: 163252 - DNA, 20 bp, Artificial
  CRISPR gRNA sequence
tgttccttgtcagccttcct

SEQ ID NO: 163253 - DNA, 20 bp, Artificial
  CRISPR gRNA sequence
gttccttgtcagccttcctg

SEQ ID NO: 163254 - DNA, 20 bp, Artificial
  CRISPR gRNA sequence
ttccttgtcagccttcctgg

SEQ ID NO: 163255 - DNA, 20 bp, Artificial
  CRISPR gRNA sequence
cttgtcagccttcctgggag

SEQ ID NO: 163256 - DNA, 20 bp, Artificial
  CRISPR gRNA sequence
gtcagccttcctgggagtcc

SEQ ID NO: 163257 - DNA, 20 bp, Artificial
  CRISPR gRNA sequence
tcagccttcctgggagtcct

SEQ ID NO: 163258 - DNA, 20 bp, Artificial
  CRISPR gRNA sequence
cctgggagtccttttctttt

SEQ ID NO: 163259 - DNA, 20 bp, Artificial
  CRISPR gRNA sequence
ctgggagtccttttcttttt

SEQ ID NO: 163260 - DNA, 20 bp, Artificial
  CRISPR gRNA sequence
ggagtccttttctttttctt

SEQ ID NO: 163261 - DNA, 20 bp, Artificial
  CRISPR gRNA sequence
ttctttttcttcttcttttt

SEQ ID NO: 163262 - DNA, 20 bp, Artificial
  CRISPR gRNA sequence
tctttttcttcttctttttt

SEQ ID NO: 163263 - DNA, 20 bp, Artificial
  CRISPR gRNA sequence
ctttttcttcttcttttttt

SEQ ID NO: 163264 - DNA, 20 bp, Artificial
  CRISPR gRNA sequence
tttttcttcttctttttttt

SEQ ID NO: 163265 - DNA, 20 bp, Artificial
  CRISPR gRNA sequence
tttcttcttctttttttttt

SEQ ID NO: 163266 - DNA, 20 bp, Artificial
  CRISPR gRNA sequence
ttcttcttctttttttttta

SEQ ID NO: 163267 - DNA, 20 bp, Artificial
  CRISPR gRNA sequence
tcttcttcttttttttttaa

SEQ ID NO: 163268 - DNA, 20 bp, Artificial
  CRISPR gRNA sequence
cttcttcttttttttttaat

SEQ ID NO: 163269 - DNA, 20 bp, Artificial
  CRISPR gRNA sequence
ttcttcttttttttttaatt

SEQ ID NO: 163270 - DNA, 20 bp, Artificial
  CRISPR gRNA sequence
cttcttttttttttaatttt

SEQ ID NO: 163271 - DNA, 20 bp, Artificial
  CRISPR gRNA sequence
ttcttttttttttaatttta

SEQ ID NO: 163272 - DNA, 20 bp, Artificial
  CRISPR gRNA sequence
cttttttttttaattttaat

SEQ ID NO: 163273 - DNA, 20 bp, Artificial
  CRISPR gRNA sequence
ttttttttttaattttaatt

SEQ ID NO: 163274 - DNA, 20 bp, Artificial
  CRISPR gRNA sequence
ttttttttaattttaatttt

SEQ ID NO: 163275 - DNA, 20 bp, Artificial
  CRISPR gRNA sequence
tttttttaattttaattttt

SEQ ID NO: 163276 - DNA, 20 bp, Artificial
  CRISPR gRNA sequence
ttttttaattttaattttta

SEQ ID NO: 163277 - DNA, 20 bp, Artificial
  CRISPR gRNA sequence
tttttaattttaatttttaa

SEQ ID NO: 163278 - DNA, 20 bp, Artificial
  CRISPR gRNA sequence
ttttaattttaatttttaac

SEQ ID NO: 163279 - DNA, 20 bp, Artificial
  CRISPR gRNA sequence
tttaattttaatttttaacc

SEQ ID NO: 163280 - DNA, 20 bp, Artificial
  CRISPR gRNA sequence
ttaattttaatttttaacct

SEQ ID NO: 163281 - DNA, 20 bp, Artificial
  CRISPR gRNA sequence
taattttaatttttaaccta

SEQ ID NO: 163282 - DNA, 20 bp, Artificial
  CRISPR gRNA sequence
aattttaatttttaacctag

SEQ ID NO: 163283 - DNA, 20 bp, Artificial
  CRISPR gRNA sequence
attttaatttttaacctagc

SEQ ID NO: 163284 - DNA, 20 bp, Artificial
  CRISPR gRNA sequence
taatttttaacctagcgaat

SEQ ID NO: 163285 - DNA, 20 bp, Artificial
  CRISPR gRNA sequence
aatttttaacctagcgaatt

SEQ ID NO: 163286 - DNA, 20 bp, Artificial
  CRISPR gRNA sequence
atttttaacctagcgaattc

SEQ ID NO: 163287 - DNA, 20 bp, Artificial
  CRISPR gRNA sequence
ttaacctagcgaattcacat

SEQ ID NO: 163288 - DNA, 20 bp, Artificial
  CRISPR gRNA sequence
taacctagcgaattcacatt

SEQ ID NO: 163289 - DNA, 20 bp, Artificial
  CRISPR gRNA sequence
aacctagcgaattcacattc

SEQ ID NO: 163290 - DNA, 20 bp, Artificial
  CRISPR gRNA sequence
acctagcgaattcacattca

SEQ ID NO: 163291 - DNA, 20 bp, Artificial
  CRISPR gRNA sequence
gcgaattcacattcatactg

SEQ ID NO: 163292 - DNA, 20 bp, Artificial
  CRISPR gRNA sequence
acattcatactgtatgcaga

SEQ ID NO: 163293 - DNA, 20 bp, Artificial
  CRISPR gRNA sequence
atactgtatgcagagccctt

SEQ ID NO: 163294 - DNA, 20 bp, Artificial
  CRISPR gRNA sequence
tatgcagagcccttggtcat

SEQ ID NO: 163295 - DNA, 20 bp, Artificial
  CRISPR gRNA sequence
ggtcattgactctagaaacc

SEQ ID NO: 163296 - DNA, 20 bp, Artificial
  CRISPR gRNA sequence
gtcattgactctagaaaccc

SEQ ID NO: 163297 - DNA, 20 bp, Artificial
  CRISPR gRNA sequence
actctagaaaccctcaccct

SEQ ID NO: 163298 - DNA, 20 bp, Artificial
  CRISPR gRNA sequence
tagaaaccctcaccctatag

SEQ ID NO: 163299 - DNA, 20 bp, Artificial
  CRISPR gRNA sequence
gaaaccctcaccctatagcc

SEQ ID NO: 163300 - DNA, 20 bp, Artificial
  CRISPR gRNA sequence
accctatagccaagccctgg

SEQ ID NO: 163301 - DNA, 20 bp, Artificial
  CRISPR gRNA sequence
tagccaagccctggctctta

SEQ ID NO: 163302 - DNA, 20 bp, Artificial
  CRISPR gRNA sequence
gctcttagaggaaagatttc

SEQ ID NO: 163303 - DNA, 20 bp, Artificial
  CRISPR gRNA sequence
ttagaggaaagatttcccag

SEQ ID NO: 163304 - DNA, 20 bp, Artificial
  CRISPR gRNA sequence
agaggaaagatttcccagat

SEQ ID NO: 163305 - DNA, 20 bp, Artificial
  CRISPR gRNA sequence
gaggaaagatttcccagata

SEQ ID NO: 163306 - DNA, 20 bp, Artificial
  CRISPR gRNA sequence
cccagatacaagaagaagag

SEQ ID NO: 163307 - DNA, 20 bp, Artificial
  CRISPR gRNA sequence
ccagatacaagaagaagagt

SEQ ID NO: 163308 - DNA, 20 bp, Artificial
  CRISPR gRNA sequence
taacaatgaagccaagaaag

SEQ ID NO: 163309 - DNA, 20 bp, Artificial
  CRISPR gRNA sequence
aacaatgaagccaagaaagt

SEQ ID NO: 163310 - DNA, 20 bp, Artificial
  CRISPR gRNA sequence
acaatgaagccaagaaagta

SEQ ID NO: 163311 - DNA, 20 bp, Artificial
  CRISPR gRNA sequence
ttttctcttcttgtttccct

SEQ ID NO: 163312 - DNA, 20 bp, Artificial
  CRISPR gRNA sequence
tctcttcttgtttcccttta

SEQ ID NO: 163313 - DNA, 20 bp, Artificial
  CRISPR gRNA sequence
ctcttcttgtttccctttac

SEQ ID NO: 163314 - DNA, 20 bp, Artificial
  CRISPR gRNA sequence
tcttcttgtttccctttacc

SEQ ID NO: 163315 - DNA, 20 bp, Artificial
  CRISPR gRNA sequence
ttcttgtttccctttaccta

SEQ ID NO: 163316 - DNA, 20 bp, Artificial
  CRISPR gRNA sequence
cttgtttccctttacctaca

SEQ ID NO: 163317 - DNA, 20 bp, Artificial
  CRISPR gRNA sequence
ttgtttccctttacctacaa

SEQ ID NO: 163318 - DNA, 20 bp, Artificial
  CRISPR gRNA sequence
gtttccctttacctacaaag

SEQ ID NO: 163319 - DNA, 20 bp, Artificial
  CRISPR gRNA sequence
tttccctttacctacaaagt

SEQ ID NO: 163320 - DNA, 20 bp, Artificial
  CRISPR gRNA sequence
ccctttacctacaaagtaga

SEQ ID NO: 163321 - DNA, 20 bp, Artificial
  CRISPR gRNA sequence
cctttacctacaaagtagaa

SEQ ID NO: 163322 - DNA, 20 bp, Artificial
  CRISPR gRNA sequence
tacctacaaagtagaaaatg

SEQ ID NO: 163323 - DNA, 20 bp, Artificial
  CRISPR gRNA sequence
acctacaaagtagaaaatgc

SEQ ID NO: 163324 - DNA, 20 bp, Artificial
  CRISPR gRNA sequence
cctacaaagtagaaaatgca

SEQ ID NO: 163325 - DNA, 20 bp, Artificial
  CRISPR gRNA sequence
caaagtagaaaatgcatgtg

SEQ ID NO: 163326 - DNA, 20 bp, Artificial
  CRISPR gRNA sequence
attcatttattctaaaaata

SEQ ID NO: 163327 - DNA, 20 bp, Artificial
  CRISPR gRNA sequence
ttcatttattctaaaaatac

SEQ ID NO: 163328 - DNA, 20 bp, Artificial
  CRISPR gRNA sequence
atttattctaaaaatactta

SEQ ID NO: 163329 - DNA, 20 bp, Artificial
  CRISPR gRNA sequence
attctaaaaatacttactga

SEQ ID NO: 163330 - DNA, 20 bp, Artificial
  CRISPR gRNA sequence
ttctaaaaatacttactgaa

SEQ ID NO: 163331 - DNA, 20 bp, Artificial
  CRISPR gRNA sequence
taaaaatacttactgaacac

SEQ ID NO: 163332 - DNA, 20 bp, Artificial
  CRISPR gRNA sequence
aaaatacttactgaacaccc

SEQ ID NO: 163333 - DNA, 20 bp, Artificial
  CRISPR gRNA sequence
actgaacacccacaatgtgc

SEQ ID NO: 163334 - DNA, 20 bp, Artificial
  CRISPR gRNA sequence
ctgaacacccacaatgtgcc

SEQ ID NO: 163335 - DNA, 20 bp, Artificial
  CRISPR gRNA sequence
aacacccacaatgtgccggg

SEQ ID NO: 163336 - DNA, 20 bp, Artificial
  CRISPR gRNA sequence
ttctaggctctggggattaa

SEQ ID NO: 163337 - DNA, 20 bp, Artificial
  CRISPR gRNA sequence
tctaggctctggggattaac

SEQ ID NO: 163338 - DNA, 20 bp, Artificial
  CRISPR gRNA sequence
ctaggctctggggattaacg

SEQ ID NO: 163339 - DNA, 20 bp, Artificial
  CRISPR gRNA sequence
taggctctggggattaacga

SEQ ID NO: 163340 - DNA, 20 bp, Artificial
  CRISPR gRNA sequence
ggctctggggattaacgata

SEQ ID NO: 163341 - DNA, 20 bp, Artificial
  CRISPR gRNA sequence
tggggattaacgatacacac

SEQ ID NO: 163342 - DNA, 20 bp, Artificial
  CRISPR gRNA sequence
gggattaacgatacacacaa

SEQ ID NO: 163343 - DNA, 20 bp, Artificial
  CRISPR gRNA sequence
acgatacacacaacagacaa

SEQ ID NO: 163344 - DNA, 20 bp, Artificial
  CRISPR gRNA sequence
atctgtgggaagcctgcatt

SEQ ID NO: 163345 - DNA, 20 bp, Artificial
  CRISPR gRNA sequence
tctgtgggaagcctgcattc

SEQ ID NO: 163346 - DNA, 20 bp, Artificial
  CRISPR gRNA sequence
tgggaagcctgcattctagt

SEQ ID NO: 163347 - DNA, 20 bp, Artificial
  CRISPR gRNA sequence
cattctagtacagcttgtca

SEQ ID NO: 163348 - DNA, 20 bp, Artificial
  CRISPR gRNA sequence
tagtacagcttgtcaatgcg

SEQ ID NO: 163349 - DNA, 20 bp, Artificial
  CRISPR gRNA sequence
gtacagcttgtcaatgcgtc

SEQ ID NO: 163350 - DNA, 20 bp, Artificial
  CRISPR gRNA sequence
gtcaatgcgtcataaagtta

SEQ ID NO: 163351 - DNA, 20 bp, Artificial
  CRISPR gRNA sequence
tcaatgcgtcataaagttag

SEQ ID NO: 163352 - DNA, 20 bp, Artificial
  CRISPR gRNA sequence
ggatttgtgtacattactat

SEQ ID NO: 163353 - DNA, 20 bp, Artificial
  CRISPR gRNA sequence
gtgtacattactatatgaaa

SEQ ID NO: 163354 - DNA, 20 bp, Artificial
  CRISPR gRNA sequence
tgtacattactatatgaaag

SEQ ID NO: 163355 - DNA, 20 bp, Artificial
  CRISPR gRNA sequence
ctatatgaaagttttaaagc

SEQ ID NO: 163356 - DNA, 20 bp, Artificial
  CRISPR gRNA sequence
tatgaaagttttaaagcaaa

SEQ ID NO: 163357 - DNA, 20 bp, Artificial
  CRISPR gRNA sequence
taaagcaaaaaaagcaaaaa

SEQ ID NO: 163358 - DNA, 20 bp, Artificial
  CRISPR gRNA sequence
aaagcaaaaaaagcaaaaaa

SEQ ID NO: 163359 - DNA, 20 bp, Artificial
  CRISPR gRNA sequence
aagcaaaaaaagcaaaaaat

SEQ ID NO: 163360 - DNA, 20 bp, Artificial
  CRISPR gRNA sequence
agctccaataaatgatatgc

SEQ ID NO: 163361 - DNA, 20 bp, Artificial
  CRISPR gRNA sequence
caataaatgatatgcatgtt

SEQ ID NO: 163362 - DNA, 20 bp, Artificial
  CRISPR gRNA sequence
aagtcacaaaatttatgttg

SEQ ID NO: 163363 - DNA, 20 bp, Artificial
  CRISPR gRNA sequence
atgttgccttgaagttagtc

SEQ ID NO: 163364 - DNA, 20 bp, Artificial
  CRISPR gRNA sequence
tgttgccttgaagttagtct

SEQ ID NO: 163365 - DNA, 20 bp, Artificial
  CRISPR gRNA sequence
ccttgaagttagtctgtgga

SEQ ID NO: 163366 - DNA, 20 bp, Artificial
  CRISPR gRNA sequence
gaagttagtctgtggatcca

SEQ ID NO: 163367 - DNA, 20 bp, Artificial
  CRISPR gRNA sequence
aagttagtctgtggatccag

SEQ ID NO: 163368 - DNA, 20 bp, Artificial
  CRISPR gRNA sequence
gtctgtggatccagagagat

SEQ ID NO: 163369 - DNA, 20 bp, Artificial
  CRISPR gRNA sequence
tggatccagagagatccagt

SEQ ID NO: 163370 - DNA, 20 bp, Artificial
  CRISPR gRNA sequence
aagctcccttcaagatcaat

SEQ ID NO: 163371 - DNA, 20 bp, Artificial
  CRISPR gRNA sequence
ccttcaagatcaattcagat

SEQ ID NO: 163372 - DNA, 20 bp, Artificial
  CRISPR gRNA sequence
caagatcaattcagattaga

SEQ ID NO: 163373 - DNA, 20 bp, Artificial
  CRISPR gRNA sequence
aagatcaattcagattagaa

SEQ ID NO: 163374 - DNA, 20 bp, Artificial
  CRISPR gRNA sequence
agattagaaaataaaatagg

SEQ ID NO: 163375 - DNA, 20 bp, Artificial
  CRISPR gRNA sequence
gaaaataaaataggcaaaac

SEQ ID NO: 163376 - DNA, 20 bp, Artificial
  CRISPR gRNA sequence
ggacagaccttcagaaaaaa

SEQ ID NO: 163377 - DNA, 20 bp, Artificial
  CRISPR gRNA sequence
gacagaccttcagaaaaaaa

SEQ ID NO: 163378 - DNA, 20 bp, Artificial
  CRISPR gRNA sequence
cagaaaaaaagataaacaaa

SEQ ID NO: 163379 - DNA, 20 bp, Artificial
  CRISPR gRNA sequence
agaaaaaaagataaacaaat

SEQ ID NO: 163380 - DNA, 20 bp, Artificial
  CRISPR gRNA sequence
gtcatcagggaaataaaaaa

SEQ ID NO: 163381 - DNA, 20 bp, Artificial
  CRISPR gRNA sequence
cagtgagatactgttttaca

SEQ ID NO: 163382 - DNA, 20 bp, Artificial
  CRISPR gRNA sequence
ttttacacccactagaatac

SEQ ID NO: 163383 - DNA, 20 bp, Artificial
  CRISPR gRNA sequence
tacacccactagaataccta

SEQ ID NO: 163384 - DNA, 20 bp, Artificial
  CRISPR gRNA sequence
acacccactagaatacctaa

SEQ ID NO: 163385 - DNA, 20 bp, Artificial
  CRISPR gRNA sequence
cacccactagaatacctaaa

SEQ ID NO: 163386 - DNA, 20 bp, Artificial
  CRISPR gRNA sequence
gaatacctaaaataaaaaag

SEQ ID NO: 163387 - DNA, 20 bp, Artificial
  CRISPR gRNA sequence
aaataaaaaagactgacaat

SEQ ID NO: 163388 - DNA, 20 bp, Artificial
  CRISPR gRNA sequence
acaataccacagttggtgag

SEQ ID NO: 163389 - DNA, 20 bp, Artificial
  CRISPR gRNA sequence
gtgaggaagtggagtgtctg

SEQ ID NO: 163390 - DNA, 20 bp, Artificial
  CRISPR gRNA sequence
aaactcatatattgctggtc

SEQ ID NO: 163391 - DNA, 20 bp, Artificial
  CRISPR gRNA sequence
atatattgctggtcagaatc

SEQ ID NO: 163392 - DNA, 20 bp, Artificial
  CRISPR gRNA sequence
ctggtcagaatctaaagtgg

SEQ ID NO: 163393 - DNA, 20 bp, Artificial
  CRISPR gRNA sequence
gtcagaatctaaagtggtca

SEQ ID NO: 163394 - DNA, 20 bp, Artificial
  CRISPR gRNA sequence
aagtggtcagtcagtttgaa

SEQ ID NO: 163395 - DNA, 20 bp, Artificial
  CRISPR gRNA sequence
gaaaaaatattagacatttt

SEQ ID NO: 163396 - DNA, 20 bp, Artificial
  CRISPR gRNA sequence
aaaaaatattagacattttc

SEQ ID NO: 163397 - DNA, 20 bp, Artificial
  CRISPR gRNA sequence
gacattttctgataaacata

SEQ ID NO: 163398 - DNA, 20 bp, Artificial
  CRISPR gRNA sequence
tctgataaacatatccccct

SEQ ID NO: 163399 - DNA, 20 bp, Artificial
  CRISPR gRNA sequence
ctgataaacatatcccccta

SEQ ID NO: 163400 - DNA, 20 bp, Artificial
  CRISPR gRNA sequence
tgataaacatatccccctac

SEQ ID NO: 163401 - DNA, 20 bp, Artificial
  CRISPR gRNA sequence
ataaacatatccccctactc

SEQ ID NO: 163402 - DNA, 20 bp, Artificial
  CRISPR gRNA sequence
ctctgtaacccagccatttc

SEQ ID NO: 163403 - DNA, 20 bp, Artificial
  CRISPR gRNA sequence
tgtaacccagccatttcatt

SEQ ID NO: 163404 - DNA, 20 bp, Artificial
  CRISPR gRNA sequence
taacccagccatttcattcc

SEQ ID NO: 163405 - DNA, 20 bp, Artificial
  CRISPR gRNA sequence
cattcctaggtttgtaccca

SEQ ID NO: 163406 - DNA, 20 bp, Artificial
  CRISPR gRNA sequence
attcctaggtttgtacccaa

SEQ ID NO: 163407 - DNA, 20 bp, Artificial
  CRISPR gRNA sequence
ctaggtttgtacccaaaaga

SEQ ID NO: 163408 - DNA, 20 bp, Artificial
  CRISPR gRNA sequence
ggtttgtacccaaaagaact

SEQ ID NO: 163409 - DNA, 20 bp, Artificial
  CRISPR gRNA sequence
gtacccaaaagaactgtagc

SEQ ID NO: 163410 - DNA, 20 bp, Artificial
  CRISPR gRNA sequence
tacccaaaagaactgtagcc

SEQ ID NO: 163411 - DNA, 20 bp, Artificial
  CRISPR gRNA sequence
tagccattcttatataaaaa

SEQ ID NO: 163412 - DNA, 20 bp, Artificial
  CRISPR gRNA sequence
ttatataaaaatgctcttaa

SEQ ID NO: 163413 - DNA, 20 bp, Artificial
  CRISPR gRNA sequence
atataaaaatgctcttaaca

SEQ ID NO: 163414 - DNA, 20 bp, Artificial
  CRISPR gRNA sequence
tataaaaatgctcttaacaa

SEQ ID NO: 163415 - DNA, 20 bp, Artificial
  CRISPR gRNA sequence
ttaacaaccttgtttatact

SEQ ID NO: 163416 - DNA, 20 bp, Artificial
  CRISPR gRNA sequence
aacaaccttgtttatactac

SEQ ID NO: 163417 - DNA, 20 bp, Artificial
  CRISPR gRNA sequence
acaaccttgtttatactacc

SEQ ID NO: 163418 - DNA, 20 bp, Artificial
  CRISPR gRNA sequence
gtttatactacctcaaaact

SEQ ID NO: 163419 - DNA, 20 bp, Artificial
  CRISPR gRNA sequence
tttatactacctcaaaactg

SEQ ID NO: 163420 - DNA, 20 bp, Artificial
  CRISPR gRNA sequence
atactacctcaaaactggaa

SEQ ID NO: 163421 - DNA, 20 bp, Artificial
  CRISPR gRNA sequence
tactacctcaaaactggaaa

SEQ ID NO: 163422 - DNA, 20 bp, Artificial
  CRISPR gRNA sequence
cctcaaaactggaaacaact

SEQ ID NO: 163423 - DNA, 20 bp, Artificial
  CRISPR gRNA sequence
aaaactggaaacaactcaag

SEQ ID NO: 163424 - DNA, 20 bp, Artificial
  CRISPR gRNA sequence
gaaacaactcaagtgtccat

SEQ ID NO: 163425 - DNA, 20 bp, Artificial
  CRISPR gRNA sequence
aagtgtccatcaatatagga

SEQ ID NO: 163426 - DNA, 20 bp, Artificial
  CRISPR gRNA sequence
tgaggtattgatgaaatgga

SEQ ID NO: 163427 - DNA, 20 bp, Artificial
  CRISPR gRNA sequence
aggtattgatgaaatggatt

SEQ ID NO: 163428 - DNA, 20 bp, Artificial
  CRISPR gRNA sequence
atgaaatggattcctcctca

SEQ ID NO: 163429 - DNA, 20 bp, Artificial
  CRISPR gRNA sequence
ctcctcagcaataaaaagaa

SEQ ID NO: 163430 - DNA, 20 bp, Artificial
  CRISPR gRNA sequence
ctcagcaataaaaagaaaca

SEQ ID NO: 163431 - DNA, 20 bp, Artificial
  CRISPR gRNA sequence
agcaataaaaagaaacaaac

SEQ ID NO: 163432 - DNA, 20 bp, Artificial
  CRISPR gRNA sequence
ctccatacaacatggataaa

SEQ ID NO: 163433 - DNA, 20 bp, Artificial
  CRISPR gRNA sequence
catacaacatggataaatct

SEQ ID NO: 163434 - DNA, 20 bp, Artificial
  CRISPR gRNA sequence
aaagatactatgttaacaaa

SEQ ID NO: 163435 - DNA, 20 bp, Artificial
  CRISPR gRNA sequence
tgttaacaaaaggaaccaga

SEQ ID NO: 163436 - DNA, 20 bp, Artificial
  CRISPR gRNA sequence
acaaaaggaaccagagggaa

SEQ ID NO: 163437 - DNA, 20 bp, Artificial
  CRISPR gRNA sequence
catagtgcatgatacaatgc

SEQ ID NO: 163438 - DNA, 20 bp, Artificial
  CRISPR gRNA sequence
ttaccacctatagtgataga

SEQ ID NO: 163439 - DNA, 20 bp, Artificial
  CRISPR gRNA sequence
ccacctatagtgatagaaat

SEQ ID NO: 163440 - DNA, 20 bp, Artificial
  CRISPR gRNA sequence
tagtgatagaaatcagagtt

SEQ ID NO: 163441 - DNA, 20 bp, Artificial
  CRISPR gRNA sequence
tggttgcccagatttagggg

SEQ ID NO: 163442 - DNA, 20 bp, Artificial
  CRISPR gRNA sequence
cccagatttaggggagtgtg

SEQ ID NO: 163443 - DNA, 20 bp, Artificial
  CRISPR gRNA sequence
aggggagtgtggggaaggat

SEQ ID NO: 163444 - DNA, 20 bp, Artificial
  CRISPR gRNA sequence
ggggagtgtggggaaggata

SEQ ID NO: 163445 - DNA, 20 bp, Artificial
  CRISPR gRNA sequence
actggaaagggctagaagga

SEQ ID NO: 163446 - DNA, 20 bp, Artificial
  CRISPR gRNA sequence
gaaagggctagaaggaactt

SEQ ID NO: 163447 - DNA, 20 bp, Artificial
  CRISPR gRNA sequence
gaaggaactttctatattcc

SEQ ID NO: 163448 - DNA, 20 bp, Artificial
  CRISPR gRNA sequence
tctatattccttttttattt

SEQ ID NO: 163449 - DNA, 20 bp, Artificial
  CRISPR gRNA sequence
ctatattccttttttatttt

SEQ ID NO: 163450 - DNA, 20 bp, Artificial
  CRISPR gRNA sequence
tatattccttttttattttt

SEQ ID NO: 163451 - DNA, 20 bp, Artificial
  CRISPR gRNA sequence
tattccttttttattttttg

SEQ ID NO: 163452 - DNA, 20 bp, Artificial
  CRISPR gRNA sequence
cttttttattttttgagata

SEQ ID NO: 163453 - DNA, 20 bp, Artificial
  CRISPR gRNA sequence
ttttattttttgagataggg

SEQ ID NO: 163454 - DNA, 20 bp, Artificial
  CRISPR gRNA sequence
tttattttttgagatagggt

SEQ ID NO: 163455 - DNA, 20 bp, Artificial
  CRISPR gRNA sequence
ttattttttgagatagggtc

SEQ ID NO: 163456 - DNA, 20 bp, Artificial
  CRISPR gRNA sequence
tattttttgagatagggtct

SEQ ID NO: 163457 - DNA, 20 bp, Artificial
  CRISPR gRNA sequence
attttttgagatagggtctc

SEQ ID NO: 163458 - DNA, 20 bp, Artificial
  CRISPR gRNA sequence
ttttttgagatagggtctca

SEQ ID NO: 163459 - DNA, 20 bp, Artificial
  CRISPR gRNA sequence
tttgagatagggtctcactc

SEQ ID NO: 163460 - DNA, 20 bp, Artificial
  CRISPR gRNA sequence
ttgagatagggtctcactct

SEQ ID NO: 163461 - DNA, 20 bp, Artificial
  CRISPR gRNA sequence
tgagatagggtctcactctg

SEQ ID NO: 163462 - DNA, 20 bp, Artificial
  CRISPR gRNA sequence
gagatagggtctcactctgt

SEQ ID NO: 163463 - DNA, 20 bp, Artificial
  CRISPR gRNA sequence
agatagggtctcactctgtg

SEQ ID NO: 163464 - DNA, 20 bp, Artificial
  CRISPR gRNA sequence
actctgtggcctaggctgga

SEQ ID NO: 163465 - DNA, 20 bp, Artificial
  CRISPR gRNA sequence
tgtggcctaggctggagtgc

SEQ ID NO: 163466 - DNA, 20 bp, Artificial
  CRISPR gRNA sequence
tggcctaggctggagtgcag

SEQ ID NO: 163467 - DNA, 20 bp, Artificial
  CRISPR gRNA sequence
ggctggagtgcagtggcgca

SEQ ID NO: 163468 - DNA, 20 bp, Artificial
  CRISPR gRNA sequence
gagtgcagtggcgcaatcac

SEQ ID NO: 163469 - DNA, 20 bp, Artificial
  CRISPR gRNA sequence
attgcagcctcgacctcctg

SEQ ID NO: 163470 - DNA, 20 bp, Artificial
  CRISPR gRNA sequence
cagcctcgacctcctgggct

SEQ ID NO: 163471 - DNA, 20 bp, Artificial
  CRISPR gRNA sequence
gacctcctgggctcaagtga

SEQ ID NO: 163472 - DNA, 20 bp, Artificial
  CRISPR gRNA sequence
ctgggctcaagtgatcctcc

SEQ ID NO: 163473 - DNA, 20 bp, Artificial
  CRISPR gRNA sequence
ggctcaagtgatcctcccac

SEQ ID NO: 163474 - DNA, 20 bp, Artificial
  CRISPR gRNA sequence
aagtgatcctcccacctcag

SEQ ID NO: 163475 - DNA, 20 bp, Artificial
  CRISPR gRNA sequence
ccacctcagcctcccaagta

SEQ ID NO: 163476 - DNA, 20 bp, Artificial
  CRISPR gRNA sequence
agcctcccaagtagctgaga

SEQ ID NO: 163477 - DNA, 20 bp, Artificial
  CRISPR gRNA sequence
ccaagtagctgagactacag

SEQ ID NO: 163478 - DNA, 20 bp, Artificial
  CRISPR gRNA sequence
agactacaggtgcatgccac

SEQ ID NO: 163479 - DNA, 20 bp, Artificial
  CRISPR gRNA sequence
caggtgcatgccaccatatc

SEQ ID NO: 163480 - DNA, 20 bp, Artificial
  CRISPR gRNA sequence
gcttaaaatttttgttgttg

SEQ ID NO: 163481 - DNA, 20 bp, Artificial
  CRISPR gRNA sequence
aaaatttttgttgttgttgt

SEQ ID NO: 163482 - DNA, 20 bp, Artificial
  CRISPR gRNA sequence
aaatttttgttgttgttgtt

SEQ ID NO: 163483 - DNA, 20 bp, Artificial
  CRISPR gRNA sequence
ttgttgttgttgttgtagag

SEQ ID NO: 163484 - DNA, 20 bp, Artificial
  CRISPR gRNA sequence
tgttgttgttgttgtagaga

SEQ ID NO: 163485 - DNA, 20 bp, Artificial
  CRISPR gRNA sequence
gttgttgttgttgtagagat

SEQ ID NO: 163486 - DNA, 20 bp, Artificial
  CRISPR gRNA sequence
ttgttgttgttgtagagatg

SEQ ID NO: 163487 - DNA, 20 bp, Artificial
  CRISPR gRNA sequence
ttgttgttgtagagatgagg

SEQ ID NO: 163488 - DNA, 20 bp, Artificial
  CRISPR gRNA sequence
ttgttgtagagatgaggcct

SEQ ID NO: 163489 - DNA, 20 bp, Artificial
  CRISPR gRNA sequence
ttgtagagatgaggccttac

SEQ ID NO: 163490 - DNA, 20 bp, Artificial
  CRISPR gRNA sequence
tagagatgaggccttactat

SEQ ID NO: 163491 - DNA, 20 bp, Artificial
  CRISPR gRNA sequence
actatgttgcccagagctgg

SEQ ID NO: 163492 - DNA, 20 bp, Artificial
  CRISPR gRNA sequence
ctatgttgcccagagctggt

SEQ ID NO: 163493 - DNA, 20 bp, Artificial
  CRISPR gRNA sequence
tgttgcccagagctggtctt

SEQ ID NO: 163494 - DNA, 20 bp, Artificial
  CRISPR gRNA sequence
cccagagctggtcttgaaac

SEQ ID NO: 163495 - DNA, 20 bp, Artificial
  CRISPR gRNA sequence
gtcttgaaactcctggctca

SEQ ID NO: 163496 - DNA, 20 bp, Artificial
  CRISPR gRNA sequence
gaaactcctggctcaagcga

SEQ ID NO: 163497 - DNA, 20 bp, Artificial
  CRISPR gRNA sequence
aaactcctggctcaagcgat

SEQ ID NO: 163498 - DNA, 20 bp, Artificial
  CRISPR gRNA sequence
ctggctcaagcgatcctcct

SEQ ID NO: 163499 - DNA, 20 bp, Artificial
  CRISPR gRNA sequence
gctcaagcgatcctcctgcc

SEQ ID NO: 163500 - DNA, 20 bp, Artificial
  CRISPR gRNA sequence
aagcgatcctcctgcctcag

SEQ ID NO: 163501 - DNA, 20 bp, Artificial
  CRISPR gRNA sequence
ctgcctcagggaatttaaaa

SEQ ID NO: 163502 - DNA, 20 bp, Artificial
  CRISPR gRNA sequence
cctcagggaatttaaaaagc

SEQ ID NO: 163503 - DNA, 20 bp, Artificial
  CRISPR gRNA sequence
agggaatttaaaaagcaaat

SEQ ID NO: 163504 - DNA, 20 bp, Artificial
  CRISPR gRNA sequence
aaaaagcaaataaaaatttt

SEQ ID NO: 163505 - DNA, 20 bp, Artificial
  CRISPR gRNA sequence
aaaagcaaataaaaatttta

SEQ ID NO: 163506 - DNA, 20 bp, Artificial
  CRISPR gRNA sequence
taggaagaccaacttaagta

SEQ ID NO: 163507 - DNA, 20 bp, Artificial
  CRISPR gRNA sequence
aggaagaccaacttaagtat

SEQ ID NO: 163508 - DNA, 20 bp, Artificial
  CRISPR gRNA sequence
ggaagaccaacttaagtata

SEQ ID NO: 163509 - DNA, 20 bp, Artificial
  CRISPR gRNA sequence
aagtatatctatgtttccaa

SEQ ID NO: 163510 - DNA, 20 bp, Artificial
  CRISPR gRNA sequence
agtatatctatgtttccaaa

SEQ ID NO: 163511 - DNA, 20 bp, Artificial
  CRISPR gRNA sequence
tgtttccaaaatactctaga

SEQ ID NO: 163512 - DNA, 20 bp, Artificial
  CRISPR gRNA sequence
ccaaaatactctagaatatt

SEQ ID NO: 163513 - DNA, 20 bp, Artificial
  CRISPR gRNA sequence
caaaatactctagaatattt

SEQ ID NO: 163514 - DNA, 20 bp, Artificial
  CRISPR gRNA sequence
tagaatattttattatatgc

SEQ ID NO: 163515 - DNA, 20 bp, Artificial
  CRISPR gRNA sequence
gaatattttattatatgctg

SEQ ID NO: 163516 - DNA, 20 bp, Artificial
  CRISPR gRNA sequence
tattatatgctggagatgtt

SEQ ID NO: 163517 - DNA, 20 bp, Artificial
  CRISPR gRNA sequence
attatatgctggagatgttt

SEQ ID NO: 163518 - DNA, 20 bp, Artificial
  CRISPR gRNA sequence
ttatatgctggagatgttta

SEQ ID NO: 163519 - DNA, 20 bp, Artificial
  CRISPR gRNA sequence
tatgctggagatgtttatta

SEQ ID NO: 163520 - DNA, 20 bp, Artificial
  CRISPR gRNA sequence
gagatgtttattatttttct

SEQ ID NO: 163521 - DNA, 20 bp, Artificial
  CRISPR gRNA sequence
attatttttctttttcccct

SEQ ID NO: 163522 - DNA, 20 bp, Artificial
  CRISPR gRNA sequence
ttatttttctttttcccctt

SEQ ID NO: 163523 - DNA, 20 bp, Artificial
  CRISPR gRNA sequence
tttttctttttcccctttta

SEQ ID NO: 163524 - DNA, 20 bp, Artificial
  CRISPR gRNA sequence
ttctttttccccttttattc

SEQ ID NO: 163525 - DNA, 20 bp, Artificial
  CRISPR gRNA sequence
tctttttccccttttattcc

SEQ ID NO: 163526 - DNA, 20 bp, Artificial
  CRISPR gRNA sequence
ctttttccccttttattcca

SEQ ID NO: 163527 - DNA, 20 bp, Artificial
  CRISPR gRNA sequence
tttttccccttttattccat

SEQ ID NO: 163528 - DNA, 20 bp, Artificial
  CRISPR gRNA sequence
tttccccttttattccatca

SEQ ID NO: 163529 - DNA, 20 bp, Artificial
  CRISPR gRNA sequence
ttccccttttattccatcaa

SEQ ID NO: 163530 - DNA, 20 bp, Artificial
  CRISPR gRNA sequence
tccccttttattccatcaat

SEQ ID NO: 163531 - DNA, 20 bp, Artificial
  CRISPR gRNA sequence
ccccttttattccatcaata

SEQ ID NO: 163532 - DNA, 20 bp, Artificial
  CRISPR gRNA sequence
cccttttattccatcaataa

SEQ ID NO: 163533 - DNA, 20 bp, Artificial
  CRISPR gRNA sequence
ttattccatcaataaatgag

SEQ ID NO: 163534 - DNA, 20 bp, Artificial
  CRISPR gRNA sequence
tattccatcaataaatgagc

SEQ ID NO: 163535 - DNA, 20 bp, Artificial
  CRISPR gRNA sequence
attccatcaataaatgagcc

SEQ ID NO: 163536 - DNA, 20 bp, Artificial
  CRISPR gRNA sequence
ttccatcaataaatgagcca

SEQ ID NO: 163537 - DNA, 20 bp, Artificial
  CRISPR gRNA sequence
catcaataaatgagccattt

SEQ ID NO: 163538 - DNA, 20 bp, Artificial
  CRISPR gRNA sequence
agatagattgagtagatgac

SEQ ID NO: 163539 - DNA, 20 bp, Artificial
  CRISPR gRNA sequence
gatagattgagtagatgaca

SEQ ID NO: 163540 - DNA, 20 bp, Artificial
  CRISPR gRNA sequence
agtagatgacatcaaaaaat

SEQ ID NO: 163541 - DNA, 20 bp, Artificial
  CRISPR gRNA sequence
tattgtagtcatcttaaatg

SEQ ID NO: 163542 - DNA, 20 bp, Artificial
  CRISPR gRNA sequence
tagtcatcttaaatgagttc

SEQ ID NO: 163543 - DNA, 20 bp, Artificial
  CRISPR gRNA sequence
aaatgagttctggcaatctt

SEQ ID NO: 163544 - DNA, 20 bp, Artificial
  CRISPR gRNA sequence
aatgagttctggcaatctta

SEQ ID NO: 163545 - DNA, 20 bp, Artificial
  CRISPR gRNA sequence
tggcaatcttaagatgggcc

SEQ ID NO: 163546 - DNA, 20 bp, Artificial
  CRISPR gRNA sequence
gcaatcttaagatgggccct

SEQ ID NO: 163547 - DNA, 20 bp, Artificial
  CRISPR gRNA sequence
aagatgggccctgcttcagt

SEQ ID NO: 163548 - DNA, 20 bp, Artificial
  CRISPR gRNA sequence
agatgggccctgcttcagtt

SEQ ID NO: 163549 - DNA, 20 bp, Artificial
  CRISPR gRNA sequence
cttcagttgggagggtttat

SEQ ID NO: 163550 - DNA, 20 bp, Artificial
  CRISPR gRNA sequence
cagttgggagggtttatcgt

SEQ ID NO: 163551 - DNA, 20 bp, Artificial
  CRISPR gRNA sequence
agttgggagggtttatcgtc

SEQ ID NO: 163552 - DNA, 20 bp, Artificial
  CRISPR gRNA sequence
ggagggtttatcgtcaagct

SEQ ID NO: 163553 - DNA, 20 bp, Artificial
  CRISPR gRNA sequence
atcgtcaagctcgtggttgg

SEQ ID NO: 163554 - DNA, 20 bp, Artificial
  CRISPR gRNA sequence
tcgtcaagctcgtggttggc

SEQ ID NO: 163555 - DNA, 20 bp, Artificial
  CRISPR gRNA sequence
gtggttggcaagaagggcgg

SEQ ID NO: 163556 - DNA, 20 bp, Artificial
  CRISPR gRNA sequence
gcaagaagggcggactagag

SEQ ID NO: 163557 - DNA, 20 bp, Artificial
  CRISPR gRNA sequence
gagttttgcatttcagaggc

SEQ ID NO: 163558 - DNA, 20 bp, Artificial
  CRISPR gRNA sequence
tgcatttcagaggcttgggg

SEQ ID NO: 163559 - DNA, 20 bp, Artificial
  CRISPR gRNA sequence
gcatttcagaggcttggggc

SEQ ID NO: 163560 - DNA, 20 bp, Artificial
  CRISPR gRNA sequence
catttcagaggcttggggcc

SEQ ID NO: 163561 - DNA, 20 bp, Artificial
  CRISPR gRNA sequence
cagaggcttggggccatcac

SEQ ID NO: 163562 - DNA, 20 bp, Artificial
  CRISPR gRNA sequence
agaggcttggggccatcaca

SEQ ID NO: 163563 - DNA, 20 bp, Artificial
  CRISPR gRNA sequence
ggggccatcacagatacaag

SEQ ID NO: 163564 - DNA, 20 bp, Artificial
  CRISPR gRNA sequence
gggccatcacagatacaagg

SEQ ID NO: 163565 - DNA, 20 bp, Artificial
  CRISPR gRNA sequence
ccatcctctcctgttttgtc

SEQ ID NO: 163566 - DNA, 20 bp, Artificial
  CRISPR gRNA sequence
catcctctcctgttttgtcc

SEQ ID NO: 163567 - DNA, 20 bp, Artificial
  CRISPR gRNA sequence
tcctgttttgtccgatgagt

SEQ ID NO: 163568 - DNA, 20 bp, Artificial
  CRISPR gRNA sequence
ctgttttgtccgatgagtca

SEQ ID NO: 163569 - DNA, 20 bp, Artificial
  CRISPR gRNA sequence
ttttgtccgatgagtcacct

SEQ ID NO: 163570 - DNA, 20 bp, Artificial
  CRISPR gRNA sequence
tgtccgatgagtcacctttt

SEQ ID NO: 163571 - DNA, 20 bp, Artificial
  CRISPR gRNA sequence
gtccgatgagtcacctttta

SEQ ID NO: 163572 - DNA, 20 bp, Artificial
  CRISPR gRNA sequence
tccgatgagtcaccttttaa

SEQ ID NO: 163573 - DNA, 20 bp, Artificial
  CRISPR gRNA sequence
ttaaggtgtggtatatagag

SEQ ID NO: 163574 - DNA, 20 bp, Artificial
  CRISPR gRNA sequence
taaggtgtggtatatagagt

SEQ ID NO: 163575 - DNA, 20 bp, Artificial
  CRISPR gRNA sequence
aaggtgtggtatatagagtt

SEQ ID NO: 163576 - DNA, 20 bp, Artificial
  CRISPR gRNA sequence
aggtgtggtatatagagttt

SEQ ID NO: 163577 - DNA, 20 bp, Artificial
  CRISPR gRNA sequence
gctaaggatttctgttagtg

SEQ ID NO: 163578 - DNA, 20 bp, Artificial
  CRISPR gRNA sequence
ctaaggatttctgttagtgt

SEQ ID NO: 163579 - DNA, 20 bp, Artificial
  CRISPR gRNA sequence
aggatttctgttagtgtgtt

SEQ ID NO: 163580 - DNA, 20 bp, Artificial
  CRISPR gRNA sequence
ctgttagtgtgttaacattt

SEQ ID NO: 163581 - DNA, 20 bp, Artificial
  CRISPR gRNA sequence
tgttagtgtgttaacatttt

SEQ ID NO: 163582 - DNA, 20 bp, Artificial
  CRISPR gRNA sequence
ttagtgtgttaacattttcc

SEQ ID NO: 163583 - DNA, 20 bp, Artificial
  CRISPR gRNA sequence
gtgtgttaacattttcccca

SEQ ID NO: 163584 - DNA, 20 bp, Artificial
  CRISPR gRNA sequence
acattttccccagcatttta

SEQ ID NO: 163585 - DNA, 20 bp, Artificial
  CRISPR gRNA sequence
tccccagcattttattatga

SEQ ID NO: 163586 - DNA, 20 bp, Artificial
  CRISPR gRNA sequence
ccccagcattttattatgaa

SEQ ID NO: 163587 - DNA, 20 bp, Artificial
  CRISPR gRNA sequence
cccagcattttattatgaaa

SEQ ID NO: 163588 - DNA, 20 bp, Artificial
  CRISPR gRNA sequence
tattatgaaaaatttcaaac

SEQ ID NO: 163589 - DNA, 20 bp, Artificial
  CRISPR gRNA sequence
attatgaaaaatttcaaaca

SEQ ID NO: 163590 - DNA, 20 bp, Artificial
  CRISPR gRNA sequence
ttatgaaaaatttcaaacat

SEQ ID NO: 163591 - DNA, 20 bp, Artificial
  CRISPR gRNA sequence
tgaaaaatttcaaacataag

SEQ ID NO: 163592 - DNA, 20 bp, Artificial
  CRISPR gRNA sequence
caaacataagcaaagtttac

SEQ ID NO: 163593 - DNA, 20 bp, Artificial
  CRISPR gRNA sequence
aaacataagcaaagtttaca

SEQ ID NO: 163594 - DNA, 20 bp, Artificial
  CRISPR gRNA sequence
acagtgaatacctgtatact

SEQ ID NO: 163595 - DNA, 20 bp, Artificial
  CRISPR gRNA sequence
cagtgaatacctgtatactt

SEQ ID NO: 163596 - DNA, 20 bp, Artificial
  CRISPR gRNA sequence
tatacttacaacctagattc

SEQ ID NO: 163597 - DNA, 20 bp, Artificial
  CRISPR gRNA sequence
acaacctagattctaccata

SEQ ID NO: 163598 - DNA, 20 bp, Artificial
  CRISPR gRNA sequence
caacctagattctaccataa

SEQ ID NO: 163599 - DNA, 20 bp, Artificial
  CRISPR gRNA sequence
gattctaccataaacatttt

SEQ ID NO: 163600 - DNA, 20 bp, Artificial
  CRISPR gRNA sequence
taccataaacattttactat

SEQ ID NO: 163601 - DNA, 20 bp, Artificial
  CRISPR gRNA sequence
ccataaacattttactatgc

SEQ ID NO: 163602 - DNA, 20 bp, Artificial
  CRISPR gRNA sequence
tactatgcttattttattct

SEQ ID NO: 163603 - DNA, 20 bp, Artificial
  CRISPR gRNA sequence
actatgcttattttattctc

SEQ ID NO: 163604 - DNA, 20 bp, Artificial
  CRISPR gRNA sequence
ctatgcttattttattctca

SEQ ID NO: 163605 - DNA, 20 bp, Artificial
  CRISPR gRNA sequence
tgcttattttattctcatat

SEQ ID NO: 163606 - DNA, 20 bp, Artificial
  CRISPR gRNA sequence
attttattctcatatctgtt

SEQ ID NO: 163607 - DNA, 20 bp, Artificial
  CRISPR gRNA sequence
ttttattctcatatctgttt

SEQ ID NO: 163608 - DNA, 20 bp, Artificial
  CRISPR gRNA sequence
tattctcatatctgtttatc

SEQ ID NO: 163609 - DNA, 20 bp, Artificial
  CRISPR gRNA sequence
attctcatatctgtttatcc

SEQ ID NO: 163610 - DNA, 20 bp, Artificial
  CRISPR gRNA sequence
ttctcatatctgtttatccc

SEQ ID NO: 163611 - DNA, 20 bp, Artificial
  CRISPR gRNA sequence
tcatatctgtttatccctct

SEQ ID NO: 163612 - DNA, 20 bp, Artificial
  CRISPR gRNA sequence
atatctgtttatccctctat

SEQ ID NO: 163613 - DNA, 20 bp, Artificial
  CRISPR gRNA sequence
tttatccctctatccatcct

SEQ ID NO: 163614 - DNA, 20 bp, Artificial
  CRISPR gRNA sequence
atccctctatccatccttca

SEQ ID NO: 163615 - DNA, 20 bp, Artificial
  CRISPR gRNA sequence
tccctctatccatccttcaa

SEQ ID NO: 163616 - DNA, 20 bp, Artificial
  CRISPR gRNA sequence
tatccatccttcaagtaatc

SEQ ID NO: 163617 - DNA, 20 bp, Artificial
  CRISPR gRNA sequence
tccatccttcaagtaatctg

SEQ ID NO: 163618 - DNA, 20 bp, Artificial
  CRISPR gRNA sequence
caagtaatctgtttttaagt

SEQ ID NO: 163619 - DNA, 20 bp, Artificial
  CRISPR gRNA sequence
aagtaatctgtttttaagtg

SEQ ID NO: 163620 - DNA, 20 bp, Artificial
  CRISPR gRNA sequence
tttttaagtgcattgtaaag

SEQ ID NO: 163621 - DNA, 20 bp, Artificial
  CRISPR gRNA sequence
ttaagtgcattgtaaagttt

SEQ ID NO: 163622 - DNA, 20 bp, Artificial
  CRISPR gRNA sequence
taagtgcattgtaaagttta

SEQ ID NO: 163623 - DNA, 20 bp, Artificial
  CRISPR gRNA sequence
aagtgcattgtaaagtttac

SEQ ID NO: 163624 - DNA, 20 bp, Artificial
  CRISPR gRNA sequence
agtgcattgtaaagtttact

SEQ ID NO: 163625 - DNA, 20 bp, Artificial
  CRISPR gRNA sequence
taaagtttactttgcccaaa

SEQ ID NO: 163626 - DNA, 20 bp, Artificial
  CRISPR gRNA sequence
actttgcccaaatactttaa

SEQ ID NO: 163627 - DNA, 20 bp, Artificial
  CRISPR gRNA sequence
ctttgcccaaatactttaac

SEQ ID NO: 163628 - DNA, 20 bp, Artificial
  CRISPR gRNA sequence
tgcccaaatactttaacatg

SEQ ID NO: 163629 - DNA, 20 bp, Artificial
  CRISPR gRNA sequence
gcccaaatactttaacatgc

SEQ ID NO: 163630 - DNA, 20 bp, Artificial
  CRISPR gRNA sequence
cccaaatactttaacatgca

SEQ ID NO: 163631 - DNA, 20 bp, Artificial
  CRISPR gRNA sequence
taacatgcatatcattcact

SEQ ID NO: 163632 - DNA, 20 bp, Artificial
  CRISPR gRNA sequence
aacatgcatatcattcacta

SEQ ID NO: 163633 - DNA, 20 bp, Artificial
  CRISPR gRNA sequence
acatgcatatcattcactag

SEQ ID NO: 163634 - DNA, 20 bp, Artificial
  CRISPR gRNA sequence
actagcgttcagtgtttttt

SEQ ID NO: 163635 - DNA, 20 bp, Artificial
  CRISPR gRNA sequence
gcgttcagtgttttttcata

SEQ ID NO: 163636 - DNA, 20 bp, Artificial
  CRISPR gRNA sequence
agtgttttttcatattgttt

SEQ ID NO: 163637 - DNA, 20 bp, Artificial
  CRISPR gRNA sequence
tttcatattgtttttccttt

SEQ ID NO: 163638 - DNA, 20 bp, Artificial
  CRISPR gRNA sequence
ttcatattgtttttcctttt

SEQ ID NO: 163639 - DNA, 20 bp, Artificial
  CRISPR gRNA sequence
tcatattgtttttccttttg

SEQ ID NO: 163640 - DNA, 20 bp, Artificial
  CRISPR gRNA sequence
catattgtttttccttttgc

SEQ ID NO: 163641 - DNA, 20 bp, Artificial
  CRISPR gRNA sequence
atattgtttttccttttgct

SEQ ID NO: 163642 - DNA, 20 bp, Artificial
  CRISPR gRNA sequence
tttttccttttgctttaaat

SEQ ID NO: 163643 - DNA, 20 bp, Artificial
  CRISPR gRNA sequence
ttccttttgctttaaatctt

SEQ ID NO: 163644 - DNA, 20 bp, Artificial
  CRISPR gRNA sequence
tccttttgctttaaatcttt

SEQ ID NO: 163645 - DNA, 20 bp, Artificial
  CRISPR gRNA sequence
ccttttgctttaaatcttta

SEQ ID NO: 163646 - DNA, 20 bp, Artificial
  CRISPR gRNA sequence
cttttgctttaaatctttag

SEQ ID NO: 163647 - DNA, 20 bp, Artificial
  CRISPR gRNA sequence
ttgctttaaatctttagtaa

SEQ ID NO: 163648 - DNA, 20 bp, Artificial
  CRISPR gRNA sequence
tgctttaaatctttagtaaa

SEQ ID NO: 163649 - DNA, 20 bp, Artificial
  CRISPR gRNA sequence
gctttaaatctttagtaaag

SEQ ID NO: 163650 - DNA, 20 bp, Artificial
  CRISPR gRNA sequence
ctttaaatctttagtaaagt

SEQ ID NO: 163651 - DNA, 20 bp, Artificial
  CRISPR gRNA sequence
taaatctttagtaaagtaca

SEQ ID NO: 163652 - DNA, 20 bp, Artificial
  CRISPR gRNA sequence
aaatctttagtaaagtacac

SEQ ID NO: 163653 - DNA, 20 bp, Artificial
  CRISPR gRNA sequence
aatctttagtaaagtacaca

SEQ ID NO: 163654 - DNA, 20 bp, Artificial
  CRISPR gRNA sequence
tagtaaagtacacaaatctt

SEQ ID NO: 163655 - DNA, 20 bp, Artificial
  CRISPR gRNA sequence
agtaaagtacacaaatctta

SEQ ID NO: 163656 - DNA, 20 bp, Artificial
  CRISPR gRNA sequence
gtaaagtacacaaatcttaa

SEQ ID NO: 163657 - DNA, 20 bp, Artificial
  CRISPR gRNA sequence
aactatacataatatgttgg

SEQ ID NO: 163658 - DNA, 20 bp, Artificial
  CRISPR gRNA sequence
actatacataatatgttggg

SEQ ID NO: 163659 - DNA, 20 bp, Artificial
  CRISPR gRNA sequence
tacataatatgttgggtttt

SEQ ID NO: 163660 - DNA, 20 bp, Artificial
  CRISPR gRNA sequence
ggttttagtaaaaatctttt

SEQ ID NO: 163661 - DNA, 20 bp, Artificial
  CRISPR gRNA sequence
tagtaaaaatcttttaattt

SEQ ID NO: 163662 - DNA, 20 bp, Artificial
  CRISPR gRNA sequence
agtaaaaatcttttaatttt

SEQ ID NO: 163663 - DNA, 20 bp, Artificial
  CRISPR gRNA sequence
gtaaaaatcttttaatttta

SEQ ID NO: 163664 - DNA, 20 bp, Artificial
  CRISPR gRNA sequence
ttaattttattattcaaaga

SEQ ID NO: 163665 - DNA, 20 bp, Artificial
  CRISPR gRNA sequence
taattttattattcaaagaa

SEQ ID NO: 163666 - DNA, 20 bp, Artificial
  CRISPR gRNA sequence
aattttattattcaaagaaa

SEQ ID NO: 163667 - DNA, 20 bp, Artificial
  CRISPR gRNA sequence
attttattattcaaagaaag

SEQ ID NO: 163668 - DNA, 20 bp, Artificial
  CRISPR gRNA sequence
tattattcaaagaaaggaag

SEQ ID NO: 163669 - DNA, 20 bp, Artificial
  CRISPR gRNA sequence
attattcaaagaaaggaagt

SEQ ID NO: 163670 - DNA, 20 bp, Artificial
  CRISPR gRNA sequence
ttattcaaagaaaggaagta

SEQ ID NO: 163671 - DNA, 20 bp, Artificial
  CRISPR gRNA sequence
ttcaaagaaaggaagtatca

SEQ ID NO: 163672 - DNA, 20 bp, Artificial
  CRISPR gRNA sequence
aaagaaaggaagtatcacac

SEQ ID NO: 163673 - DNA, 20 bp, Artificial
  CRISPR gRNA sequence
ggagagaaacccccattaga

SEQ ID NO: 163674 - DNA, 20 bp, Artificial
  CRISPR gRNA sequence
gagagaaacccccattagag

SEQ ID NO: 163675 - DNA, 20 bp, Artificial
  CRISPR gRNA sequence
gagcaggtcttggtttcagt

SEQ ID NO: 163676 - DNA, 20 bp, Artificial
  CRISPR gRNA sequence
ggtttcagtatcattagcct

SEQ ID NO: 163677 - DNA, 20 bp, Artificial
  CRISPR gRNA sequence
gtttcagtatcattagcctt

SEQ ID NO: 163678 - DNA, 20 bp, Artificial
  CRISPR gRNA sequence
cagtatcattagccttctga

SEQ ID NO: 163679 - DNA, 20 bp, Artificial
  CRISPR gRNA sequence
agtatcattagccttctgac

SEQ ID NO: 163680 - DNA, 20 bp, Artificial
  CRISPR gRNA sequence
gccttctgactcctgtgttc

SEQ ID NO: 163681 - DNA, 20 bp, Artificial
  CRISPR gRNA sequence
ctgactcctgtgttctctta

SEQ ID NO: 163682 - DNA, 20 bp, Artificial
  CRISPR gRNA sequence
tgactcctgtgttctcttac

SEQ ID NO: 163683 - DNA, 20 bp, Artificial
  CRISPR gRNA sequence
actcctgtgttctcttacct

SEQ ID NO: 163684 - DNA, 20 bp, Artificial
  CRISPR gRNA sequence
ctgtgttctcttacctctct

SEQ ID NO: 163685 - DNA, 20 bp, Artificial
  CRISPR gRNA sequence
tgttctcttacctctcttgc

SEQ ID NO: 163686 - DNA, 20 bp, Artificial
  CRISPR gRNA sequence
tcttacctctcttgctgctg

SEQ ID NO: 163687 - DNA, 20 bp, Artificial
  CRISPR gRNA sequence
ttacctctcttgctgctgtt

SEQ ID NO: 163688 - DNA, 20 bp, Artificial
  CRISPR gRNA sequence
acctctcttgctgctgttca

SEQ ID NO: 163689 - DNA, 20 bp, Artificial
  CRISPR gRNA sequence
cctctcttgctgctgttcat

SEQ ID NO: 163690 - DNA, 20 bp, Artificial
  CRISPR gRNA sequence
tcttgctgctgttcatagca

SEQ ID NO: 163691 - DNA, 20 bp, Artificial
  CRISPR gRNA sequence
ttgctgctgttcatagcaca

SEQ ID NO: 163692 - DNA, 20 bp, Artificial
  CRISPR gRNA sequence
gctgctgttcatagcacaaa

SEQ ID NO: 163693 - DNA, 20 bp, Artificial
  CRISPR gRNA sequence
ctgctgttcatagcacaaac

SEQ ID NO: 163694 - DNA, 20 bp, Artificial
  CRISPR gRNA sequence
ctgttcatagcacaaactat

SEQ ID NO: 163695 - DNA, 20 bp, Artificial
  CRISPR gRNA sequence
ttcatagcacaaactatgaa

SEQ ID NO: 163696 - DNA, 20 bp, Artificial
  CRISPR gRNA sequence
atagcacaaactatgaatat

SEQ ID NO: 163697 - DNA, 20 bp, Artificial
  CRISPR gRNA sequence
tgaatatcagaattctcaca

SEQ ID NO: 163698 - DNA, 20 bp, Artificial
  CRISPR gRNA sequence
tcacaagctatgttttttat

SEQ ID NO: 163699 - DNA, 20 bp, Artificial
  CRISPR gRNA sequence
acaagctatgttttttattt

SEQ ID NO: 163700 - DNA, 20 bp, Artificial
  CRISPR gRNA sequence
tgttttttatttgggaattc

SEQ ID NO: 163701 - DNA, 20 bp, Artificial
  CRISPR gRNA sequence
tttatttgggaattcagaac

SEQ ID NO: 163702 - DNA, 20 bp, Artificial
  CRISPR gRNA sequence
ttatttgggaattcagaact

SEQ ID NO: 163703 - DNA, 20 bp, Artificial
  CRISPR gRNA sequence
tatttgggaattcagaactg

SEQ ID NO: 163704 - DNA, 20 bp, Artificial
  CRISPR gRNA sequence
atttgggaattcagaactgc

SEQ ID NO: 163705 - DNA, 20 bp, Artificial
  CRISPR gRNA sequence
tttgggaattcagaactgca

SEQ ID NO: 163706 - DNA, 20 bp, Artificial
  CRISPR gRNA sequence
gggaattcagaactgcaatg

SEQ ID NO: 163707 - DNA, 20 bp, Artificial
  CRISPR gRNA sequence
ggaattcagaactgcaatga

SEQ ID NO: 163708 - DNA, 20 bp, Artificial
  CRISPR gRNA sequence
agaactgcaatgataaaccc

SEQ ID NO: 163709 - DNA, 20 bp, Artificial
  CRISPR gRNA sequence
caatgataaacccatggttt

SEQ ID NO: 163710 - DNA, 20 bp, Artificial
  CRISPR gRNA sequence
aagtattgcaatttagaatt

SEQ ID NO: 163711 - DNA, 20 bp, Artificial
  CRISPR gRNA sequence
agtattgcaatttagaattc

SEQ ID NO: 163712 - DNA, 20 bp, Artificial
  CRISPR gRNA sequence
caatttagaattcccaaata

SEQ ID NO: 163713 - DNA, 20 bp, Artificial
  CRISPR gRNA sequence
agaattcccaaataaaaatc

SEQ ID NO: 163714 - DNA, 20 bp, Artificial
  CRISPR gRNA sequence
gaattcccaaataaaaatca

SEQ ID NO: 163715 - DNA, 20 bp, Artificial
  CRISPR gRNA sequence
ccaaataaaaatcatagctt

SEQ ID NO: 163716 - DNA, 20 bp, Artificial
  CRISPR gRNA sequence
gtgagaacttagtgtatata

SEQ ID NO: 163717 - DNA, 20 bp, Artificial
  CRISPR gRNA sequence
tgagaacttagtgtatatag

SEQ ID NO: 163718 - DNA, 20 bp, Artificial
  CRISPR gRNA sequence
agtgtatatagatccagtga

SEQ ID NO: 163719 - DNA, 20 bp, Artificial
  CRISPR gRNA sequence
gtgtatatagatccagtgac

SEQ ID NO: 163720 - DNA, 20 bp, Artificial
  CRISPR gRNA sequence
gaaaatgttgcaaaaagtta

SEQ ID NO: 163721 - DNA, 20 bp, Artificial
  CRISPR gRNA sequence
aaaatgttgcaaaaagttat

SEQ ID NO: 163722 - DNA, 20 bp, Artificial
  CRISPR gRNA sequence
caaaaagttattgaattagg

SEQ ID NO: 163723 - DNA, 20 bp, Artificial
  CRISPR gRNA sequence
ttgaattaggattttaccta

SEQ ID NO: 163724 - DNA, 20 bp, Artificial
  CRISPR gRNA sequence
aattaggattttacctaatt

SEQ ID NO: 163725 - DNA, 20 bp, Artificial
  CRISPR gRNA sequence
ggattttacctaattcaata

SEQ ID NO: 163726 - DNA, 20 bp, Artificial
  CRISPR gRNA sequence
tacctaattcaatacttgtg

SEQ ID NO: 163727 - DNA, 20 bp, Artificial
  CRISPR gRNA sequence
acctaattcaatacttgtga

SEQ ID NO: 163728 - DNA, 20 bp, Artificial
  CRISPR gRNA sequence
cctaattcaatacttgtgaa

SEQ ID NO: 163729 - DNA, 20 bp, Artificial
  CRISPR gRNA sequence
attcaatacttgtgaaccaa

SEQ ID NO: 163730 - DNA, 20 bp, Artificial
  CRISPR gRNA sequence
aatacttgtgaaccaaaggg

SEQ ID NO: 163731 - DNA, 20 bp, Artificial
  CRISPR gRNA sequence
gtgaaccaaagggaaaatat

SEQ ID NO: 163732 - DNA, 20 bp, Artificial
  CRISPR gRNA sequence
tgaaccaaagggaaaatatt

SEQ ID NO: 163733 - DNA, 20 bp, Artificial
  CRISPR gRNA sequence
tttagggccttaaaaagatt

SEQ ID NO: 163734 - DNA, 20 bp, Artificial
  CRISPR gRNA sequence
agggccttaaaaagattata

SEQ ID NO: 163735 - DNA, 20 bp, Artificial
  CRISPR gRNA sequence
gggccttaaaaagattataa

SEQ ID NO: 163736 - DNA, 20 bp, Artificial
  CRISPR gRNA sequence
aaaaagattataaacctaac

SEQ ID NO: 163737 - DNA, 20 bp, Artificial
  CRISPR gRNA sequence
aaaagattataaacctaact

SEQ ID NO: 163738 - DNA, 20 bp, Artificial
  CRISPR gRNA sequence
taaacctaactttgctaacc

SEQ ID NO: 163739 - DNA, 20 bp, Artificial
  CRISPR gRNA sequence
actttgctaacccacagaat

SEQ ID NO: 163740 - DNA, 20 bp, Artificial
  CRISPR gRNA sequence
tgctaacccacagaatgacc

SEQ ID NO: 163741 - DNA, 20 bp, Artificial
  CRISPR gRNA sequence
gctaacccacagaatgacca

SEQ ID NO: 163742 - DNA, 20 bp, Artificial
  CRISPR gRNA sequence
ctaacccacagaatgaccag

SEQ ID NO: 163743 - DNA, 20 bp, Artificial
  CRISPR gRNA sequence
acccacagaatgaccagaaa

SEQ ID NO: 163744 - DNA, 20 bp, Artificial
  CRISPR gRNA sequence
ctaattgagattactaggtt

SEQ ID NO: 163745 - DNA, 20 bp, Artificial
  CRISPR gRNA sequence
attgagattactaggtttgt

SEQ ID NO: 163746 - DNA, 20 bp, Artificial
  CRISPR gRNA sequence
agattactaggtttgtaatt

SEQ ID NO: 163747 - DNA, 20 bp, Artificial
  CRISPR gRNA sequence
ctaggtttgtaatttgaaaa

SEQ ID NO: 163748 - DNA, 20 bp, Artificial
  CRISPR gRNA sequence
ggtttgtaatttgaaaatcg

SEQ ID NO: 163749 - DNA, 20 bp, Artificial
  CRISPR gRNA sequence
gtaatttgaaaatcgcgggg

SEQ ID NO: 163750 - DNA, 20 bp, Artificial
  CRISPR gRNA sequence
taatttgaaaatcgcgggga

SEQ ID NO: 163751 - DNA, 20 bp, Artificial
  CRISPR gRNA sequence
gaaaatcgcggggagaggat

SEQ ID NO: 163752 - DNA, 20 bp, Artificial
  CRISPR gRNA sequence
aaaatcgcggggagaggatc

SEQ ID NO: 163753 - DNA, 20 bp, Artificial
  CRISPR gRNA sequence
gaggctcagataccccattt

SEQ ID NO: 163754 - DNA, 20 bp, Artificial
  CRISPR gRNA sequence
agataccccattttacagtg

SEQ ID NO: 163755 - DNA, 20 bp, Artificial
  CRISPR gRNA sequence
tacagtgtgagttacatgta

SEQ ID NO: 163756 - DNA, 20 bp, Artificial
  CRISPR gRNA sequence
acagtgtgagttacatgtat

SEQ ID NO: 163757 - DNA, 20 bp, Artificial
  CRISPR gRNA sequence
cagtgtgagttacatgtatc

SEQ ID NO: 163758 - DNA, 20 bp, Artificial
  CRISPR gRNA sequence
catgtatctctttctttttt

SEQ ID NO: 163759 - DNA, 20 bp, Artificial
  CRISPR gRNA sequence
tttcttttttgttgatggtt

SEQ ID NO: 163760 - DNA, 20 bp, Artificial
  CRISPR gRNA sequence
tcttttttgttgatggttgc

SEQ ID NO: 163761 - DNA, 20 bp, Artificial
  CRISPR gRNA sequence
cttttttgttgatggttgcc

SEQ ID NO: 163762 - DNA, 20 bp, Artificial
  CRISPR gRNA sequence
ttttttgttgatggttgccc

SEQ ID NO: 163763 - DNA, 20 bp, Artificial
  CRISPR gRNA sequence
ttttgttgatggttgcccac

SEQ ID NO: 163764 - DNA, 20 bp, Artificial
  CRISPR gRNA sequence
tttgttgatggttgcccacc

SEQ ID NO: 163765 - DNA, 20 bp, Artificial
  CRISPR gRNA sequence
ttgttgatggttgcccacca

SEQ ID NO: 163766 - DNA, 20 bp, Artificial
  CRISPR gRNA sequence
tgttgatggttgcccaccag

SEQ ID NO: 163767 - DNA, 20 bp, Artificial
  CRISPR gRNA sequence
gttgatggttgcccaccagg

SEQ ID NO: 163768 - DNA, 20 bp, Artificial
  CRISPR gRNA sequence
ttgatggttgcccaccaggt

SEQ ID NO: 163769 - DNA, 20 bp, Artificial
  CRISPR gRNA sequence
atggttgcccaccaggtctg

SEQ ID NO: 163770 - DNA, 20 bp, Artificial
  CRISPR gRNA sequence
cccaccaggtctgatcattt

SEQ ID NO: 163771 - DNA, 20 bp, Artificial
  CRISPR gRNA sequence
atcatttaaagtatatgagt

SEQ ID NO: 163772 - DNA, 20 bp, Artificial
  CRISPR gRNA sequence
aaagtatatgagtttggctg

SEQ ID NO: 163773 - DNA, 20 bp, Artificial
  CRISPR gRNA sequence
aagtatatgagtttggctgt

SEQ ID NO: 163774 - DNA, 20 bp, Artificial
  CRISPR gRNA sequence
ggctgtgcttatttcagctg

SEQ ID NO: 163775 - DNA, 20 bp, Artificial
  CRISPR gRNA sequence
gctgtgcttatttcagctgt

SEQ ID NO: 163776 - DNA, 20 bp, Artificial
  CRISPR gRNA sequence
tgcttatttcagctgtagac

SEQ ID NO: 163777 - DNA, 20 bp, Artificial
  CRISPR gRNA sequence
atttcagctgtagacttgcc

SEQ ID NO: 163778 - DNA, 20 bp, Artificial
  CRISPR gRNA sequence
tttcagctgtagacttgccc

SEQ ID NO: 163779 - DNA, 20 bp, Artificial
  CRISPR gRNA sequence
cagctgtagacttgcccgta

SEQ ID NO: 163780 - DNA, 20 bp, Artificial
  CRISPR gRNA sequence
agctgtagacttgcccgtag

SEQ ID NO: 163781 - DNA, 20 bp, Artificial
  CRISPR gRNA sequence
tagacttgcccgtaggtgtt

SEQ ID NO: 163782 - DNA, 20 bp, Artificial
  CRISPR gRNA sequence
gcccgtaggtgtttagtttg

SEQ ID NO: 163783 - DNA, 20 bp, Artificial
  CRISPR gRNA sequence
cccgtaggtgtttagtttgg

SEQ ID NO: 163784 - DNA, 20 bp, Artificial
  CRISPR gRNA sequence
agtttggcttaaaagtcgtc

SEQ ID NO: 163785 - DNA, 20 bp, Artificial
  CRISPR gRNA sequence
gtttggcttaaaagtcgtct

SEQ ID NO: 163786 - DNA, 20 bp, Artificial
  CRISPR gRNA sequence
ggcttaaaagtcgtcttacc

SEQ ID NO: 163787 - DNA, 20 bp, Artificial
  CRISPR gRNA sequence
gcttaaaagtcgtcttacct

SEQ ID NO: 163788 - DNA, 20 bp, Artificial
  CRISPR gRNA sequence
aaaagtcgtcttaccttact

SEQ ID NO: 163789 - DNA, 20 bp, Artificial
  CRISPR gRNA sequence
aaagtcgtcttaccttactt

SEQ ID NO: 163790 - DNA, 20 bp, Artificial
  CRISPR gRNA sequence
accttacttggagggtataa

SEQ ID NO: 163791 - DNA, 20 bp, Artificial
  CRISPR gRNA sequence
ccttacttggagggtataaa

SEQ ID NO: 163792 - DNA, 20 bp, Artificial
  CRISPR gRNA sequence
acttggagggtataaagcca

SEQ ID NO: 163793 - DNA, 20 bp, Artificial
  CRISPR gRNA sequence
cttggagggtataaagccaa

SEQ ID NO: 163794 - DNA, 20 bp, Artificial
  CRISPR gRNA sequence
ggagggtataaagccaagtg

SEQ ID NO: 163795 - DNA, 20 bp, Artificial
  CRISPR gRNA sequence
gagggtataaagccaagtga

SEQ ID NO: 163796 - DNA, 20 bp, Artificial
  CRISPR gRNA sequence
gtttctccccaggctaattt

SEQ ID NO: 163797 - DNA, 20 bp, Artificial
  CRISPR gRNA sequence
ctccccaggctaatttttca

SEQ ID NO: 163798 - DNA, 20 bp, Artificial
  CRISPR gRNA sequence
tccccaggctaatttttcac

SEQ ID NO: 163799 - DNA, 20 bp, Artificial
  CRISPR gRNA sequence
cccaggctaatttttcacac

SEQ ID NO: 163800 - DNA, 20 bp, Artificial
  CRISPR gRNA sequence
atttttcacaccgctcttct

SEQ ID NO: 163801 - DNA, 20 bp, Artificial
  CRISPR gRNA sequence
ttcacaccgctcttctttgt

SEQ ID NO: 163802 - DNA, 20 bp, Artificial
  CRISPR gRNA sequence
tcacaccgctcttctttgtt

SEQ ID NO: 163803 - DNA, 20 bp, Artificial
  CRISPR gRNA sequence
cacaccgctcttctttgtta

SEQ ID NO: 163804 - DNA, 20 bp, Artificial
  CRISPR gRNA sequence
acaccgctcttctttgttac

SEQ ID NO: 163805 - DNA, 20 bp, Artificial
  CRISPR gRNA sequence
ttctttgttacagagaaatg

SEQ ID NO: 163806 - DNA, 20 bp, Artificial
  CRISPR gRNA sequence
ctttgttacagagaaatgat

SEQ ID NO: 163807 - DNA, 20 bp, Artificial
  CRISPR gRNA sequence
tttgttacagagaaatgata

SEQ ID NO: 163808 - DNA, 20 bp, Artificial
  CRISPR gRNA sequence
tgttacagagaaatgatatc

SEQ ID NO: 163809 - DNA, 20 bp, Artificial
  CRISPR gRNA sequence
gttacagagaaatgatatcg

SEQ ID NO: 163810 - DNA, 20 bp, Artificial
  CRISPR gRNA sequence
ttacagagaaatgatatcgc

SEQ ID NO: 163811 - DNA, 20 bp, Artificial
  CRISPR gRNA sequence
cagagaaatgatatcgccat

SEQ ID NO: 163812 - DNA, 20 bp, Artificial
  CRISPR gRNA sequence
caaaatttgatcagtttgat

SEQ ID NO: 163813 - DNA, 20 bp, Artificial
  CRISPR gRNA sequence
gatcagtttgattttctcat

SEQ ID NO: 163814 - DNA, 20 bp, Artificial
  CRISPR gRNA sequence
atcagtttgattttctcatc

SEQ ID NO: 163815 - DNA, 20 bp, Artificial
  CRISPR gRNA sequence
gattttctcatcgatattgt

SEQ ID NO: 163816 - DNA, 20 bp, Artificial
  CRISPR gRNA sequence
attttctcatcgatattgtt

SEQ ID NO: 163817 - DNA, 20 bp, Artificial
  CRISPR gRNA sequence
tctcatcgatattgttccaa

SEQ ID NO: 163818 - DNA, 20 bp, Artificial
  CRISPR gRNA sequence
ctcatcgatattgttccaag

SEQ ID NO: 163819 - DNA, 20 bp, Artificial
  CRISPR gRNA sequence
tcatcgatattgttccaaga

SEQ ID NO: 163820 - DNA, 20 bp, Artificial
  CRISPR gRNA sequence
atcgatattgttccaagaga

SEQ ID NO: 163821 - DNA, 20 bp, Artificial
  CRISPR gRNA sequence
ttccaagagatgaactgaaa

SEQ ID NO: 163822 - DNA, 20 bp, Artificial
  CRISPR gRNA sequence
caagagatgaactgaaacct

SEQ ID NO: 163823 - DNA, 20 bp, Artificial
  CRISPR gRNA sequence
aaacctccaaagcgtcaggt

SEQ ID NO: 163824 - DNA, 20 bp, Artificial
  CRISPR gRNA sequence
caaagcgtcaggtgagctgt

SEQ ID NO: 163825 - DNA, 20 bp, Artificial
  CRISPR gRNA sequence
tgaagggattgcagttgctg

SEQ ID NO: 163826 - DNA, 20 bp, Artificial
  CRISPR gRNA sequence
cagttgctgctgactgaaga

SEQ ID NO: 163827 - DNA, 20 bp, Artificial
  CRISPR gRNA sequence
ctgctgactgaagagcgctt

SEQ ID NO: 163828 - DNA, 20 bp, Artificial
  CRISPR gRNA sequence
ctgactgaagagcgctttgt

SEQ ID NO: 163829 - DNA, 20 bp, Artificial
  CRISPR gRNA sequence
actgaagagcgctttgtata

SEQ ID NO: 163830 - DNA, 20 bp, Artificial
  CRISPR gRNA sequence
aagagcgctttgtatactgg

SEQ ID NO: 163831 - DNA, 20 bp, Artificial
  CRISPR gRNA sequence
tgtatactggtgtcagatac

SEQ ID NO: 163832 - DNA, 20 bp, Artificial
  CRISPR gRNA sequence
gtatactggtgtcagatacg

SEQ ID NO: 163833 - DNA, 20 bp, Artificial
  CRISPR gRNA sequence
tatactggtgtcagatacgc

SEQ ID NO: 163834 - DNA, 20 bp, Artificial
  CRISPR gRNA sequence
gtgtcagatacgctccttct

SEQ ID NO: 163835 - DNA, 20 bp, Artificial
  CRISPR gRNA sequence
cttctctctcagcacaagtc

SEQ ID NO: 163836 - DNA, 20 bp, Artificial
  CRISPR gRNA sequence
ctctctcagcacaagtcatt

SEQ ID NO: 163837 - DNA, 20 bp, Artificial
  CRISPR gRNA sequence
tctctcagcacaagtcattt

SEQ ID NO: 163838 - DNA, 20 bp, Artificial
  CRISPR gRNA sequence
tctcagcacaagtcatttgc

SEQ ID NO: 163839 - DNA, 20 bp, Artificial
  CRISPR gRNA sequence
tcagcacaagtcatttgcta

SEQ ID NO: 163840 - DNA, 20 bp, Artificial
  CRISPR gRNA sequence
agcacaagtcatttgctatt

SEQ ID NO: 163841 - DNA, 20 bp, Artificial
  CRISPR gRNA sequence
gctattccttttgcttctcg

SEQ ID NO: 163842 - DNA, 20 bp, Artificial
  CRISPR gRNA sequence
ctattccttttgcttctcgt

SEQ ID NO: 163843 - DNA, 20 bp, Artificial
  CRISPR gRNA sequence
ttccttttgcttctcgtttc

SEQ ID NO: 163844 - DNA, 20 bp, Artificial
  CRISPR gRNA sequence
cttttgcttctcgtttctag

SEQ ID NO: 163845 - DNA, 20 bp, Artificial
  CRISPR gRNA sequence
ttgcttctcgtttctagacc

SEQ ID NO: 163846 - DNA, 20 bp, Artificial
  CRISPR gRNA sequence
tgcttctcgtttctagacca

SEQ ID NO: 163847 - DNA, 20 bp, Artificial
  CRISPR gRNA sequence
gcttctcgtttctagaccag

SEQ ID NO: 163848 - DNA, 20 bp, Artificial
  CRISPR gRNA sequence
cttctcgtttctagaccaga

SEQ ID NO: 163849 - DNA, 20 bp, Artificial
  CRISPR gRNA sequence
ctcgtttctagaccagattc

SEQ ID NO: 163850 - DNA, 20 bp, Artificial
  CRISPR gRNA sequence
tcgtttctagaccagattca

SEQ ID NO: 163851 - DNA, 20 bp, Artificial
  CRISPR gRNA sequence
gtttctagaccagattcatt

SEQ ID NO: 163852 - DNA, 20 bp, Artificial
  CRISPR gRNA sequence
ctagaccagattcattctta

SEQ ID NO: 163853 - DNA, 20 bp, Artificial
  CRISPR gRNA sequence
tagaccagattcattcttaa

SEQ ID NO: 163854 - DNA, 20 bp, Artificial
  CRISPR gRNA sequence
gaccagattcattcttaaca

SEQ ID NO: 163855 - DNA, 20 bp, Artificial
  CRISPR gRNA sequence
attcttaacatctccttctg

SEQ ID NO: 163856 - DNA, 20 bp, Artificial
  CRISPR gRNA sequence
ttaacatctccttctgttac

SEQ ID NO: 163857 - DNA, 20 bp, Artificial
  CRISPR gRNA sequence
aacatctccttctgttactc

SEQ ID NO: 163858 - DNA, 20 bp, Artificial
  CRISPR gRNA sequence
acatctccttctgttactca

SEQ ID NO: 163859 - DNA, 20 bp, Artificial
  CRISPR gRNA sequence
cttctgttactcatttctgg

SEQ ID NO: 163860 - DNA, 20 bp, Artificial
  CRISPR gRNA sequence
ctgttactcatttctggata

SEQ ID NO: 163861 - DNA, 20 bp, Artificial
  CRISPR gRNA sequence
tgttactcatttctggatac

SEQ ID NO: 163862 - DNA, 20 bp, Artificial
  CRISPR gRNA sequence
ttactcatttctggatactt

SEQ ID NO: 163863 - DNA, 20 bp, Artificial
  CRISPR gRNA sequence
ctcatttctggatactttta

SEQ ID NO: 163864 - DNA, 20 bp, Artificial
  CRISPR gRNA sequence
atttctggatacttttaact

SEQ ID NO: 163865 - DNA, 20 bp, Artificial
  CRISPR gRNA sequence
ctggatacttttaactcagt

SEQ ID NO: 163866 - DNA, 20 bp, Artificial
  CRISPR gRNA sequence
tggatacttttaactcagtg

SEQ ID NO: 163867 - DNA, 20 bp, Artificial
  CRISPR gRNA sequence
gatacttttaactcagtgcc

SEQ ID NO: 163868 - DNA, 20 bp, Artificial
  CRISPR gRNA sequence
ttaactcagtgcctccgaag

SEQ ID NO: 163869 - DNA, 20 bp, Artificial
  CRISPR gRNA sequence
taactcagtgcctccgaagt

SEQ ID NO: 163870 - DNA, 20 bp, Artificial
  CRISPR gRNA sequence
aactcagtgcctccgaagtg

SEQ ID NO: 163871 - DNA, 20 bp, Artificial
  CRISPR gRNA sequence
actcagtgcctccgaagtgg

SEQ ID NO: 163872 - DNA, 20 bp, Artificial
  CRISPR gRNA sequence
agtgcctccgaagtggtatt

SEQ ID NO: 163873 - DNA, 20 bp, Artificial
  CRISPR gRNA sequence
cgaagtggtatttcagtgaa

SEQ ID NO: 163874 - DNA, 20 bp, Artificial
  CRISPR gRNA sequence
cagtgaaaatagacaaaatg

SEQ ID NO: 163875 - DNA, 20 bp, Artificial
  CRISPR gRNA sequence
agtgaaaatagacaaaatga

SEQ ID NO: 163876 - DNA, 20 bp, Artificial
  CRISPR gRNA sequence
tagttacaaatggtaaagtt

SEQ ID NO: 163877 - DNA, 20 bp, Artificial
  CRISPR gRNA sequence
agttacaaatggtaaagtta

SEQ ID NO: 163878 - DNA, 20 bp, Artificial
  CRISPR gRNA sequence
gttacaaatggtaaagttaa

SEQ ID NO: 163879 - DNA, 20 bp, Artificial
  CRISPR gRNA sequence
caaatggtaaagttaagctc

SEQ ID NO: 163880 - DNA, 20 bp, Artificial
  CRISPR gRNA sequence
agctcatttcaagttatctt

SEQ ID NO: 163881 - DNA, 20 bp, Artificial
  CRISPR gRNA sequence
atttcaagttatcttaggaa

SEQ ID NO: 163882 - DNA, 20 bp, Artificial
  CRISPR gRNA sequence
caagttatcttaggaagtct

SEQ ID NO: 163883 - DNA, 20 bp, Artificial
  CRISPR gRNA sequence
aagttatcttaggaagtcta

SEQ ID NO: 163884 - DNA, 20 bp, Artificial
  CRISPR gRNA sequence
tcttaggaagtctatcagag

SEQ ID NO: 163885 - DNA, 20 bp, Artificial
  CRISPR gRNA sequence
aggaagtctatcagagctct

SEQ ID NO: 163886 - DNA, 20 bp, Artificial
  CRISPR gRNA sequence
ggaagtctatcagagctctt

SEQ ID NO: 163887 - DNA, 20 bp, Artificial
  CRISPR gRNA sequence
tcagagctcttcatctggga

SEQ ID NO: 163888 - DNA, 20 bp, Artificial
  CRISPR gRNA sequence
ttcatctgggataggagaat

SEQ ID NO: 163889 - DNA, 20 bp, Artificial
  CRISPR gRNA sequence
catctgggataggagaatat

SEQ ID NO: 163890 - DNA, 20 bp, Artificial
  CRISPR gRNA sequence
atctgggataggagaatatt

SEQ ID NO: 163891 - DNA, 20 bp, Artificial
  CRISPR gRNA sequence
ggataggagaatattcccag

SEQ ID NO: 163892 - DNA, 20 bp, Artificial
  CRISPR gRNA sequence
ccagaaagttatagatttta

SEQ ID NO: 163893 - DNA, 20 bp, Artificial
  CRISPR gRNA sequence
tagattttagatttttaaga

SEQ ID NO: 163894 - DNA, 20 bp, Artificial
  CRISPR gRNA sequence
tagatttttaagaaacagct

SEQ ID NO: 163895 - DNA, 20 bp, Artificial
  CRISPR gRNA sequence
agatttttaagaaacagctt

SEQ ID NO: 163896 - DNA, 20 bp, Artificial
  CRISPR gRNA sequence
gatttttaagaaacagcttc

SEQ ID NO: 163897 - DNA, 20 bp, Artificial
  CRISPR gRNA sequence
ttaagaaacagcttctctat

SEQ ID NO: 163898 - DNA, 20 bp, Artificial
  CRISPR gRNA sequence
taagaaacagcttctctatg

SEQ ID NO: 163899 - DNA, 20 bp, Artificial
  CRISPR gRNA sequence
aagaaacagcttctctatgt

SEQ ID NO: 163900 - DNA, 20 bp, Artificial
  CRISPR gRNA sequence
agaaacagcttctctatgtg

SEQ ID NO: 163901 - DNA, 20 bp, Artificial
  CRISPR gRNA sequence
ctctatgtgcacagtggcat

SEQ ID NO: 163902 - DNA, 20 bp, Artificial
  CRISPR gRNA sequence
tctatgtgcacagtggcatt

SEQ ID NO: 163903 - DNA, 20 bp, Artificial
  CRISPR gRNA sequence
tatgtgcacagtggcatttg

SEQ ID NO: 163904 - DNA, 20 bp, Artificial
  CRISPR gRNA sequence
tgtgcacagtggcatttgga

SEQ ID NO: 163905 - DNA, 20 bp, Artificial
  CRISPR gRNA sequence
ggagtgaatggactatgttt

SEQ ID NO: 163906 - DNA, 20 bp, Artificial
  CRISPR gRNA sequence
gagtgaatggactatgtttt

SEQ ID NO: 163907 - DNA, 20 bp, Artificial
  CRISPR gRNA sequence
tgttttctcttcctctatat

SEQ ID NO: 163908 - DNA, 20 bp, Artificial
  CRISPR gRNA sequence
tctcttcctctatattgtgg

SEQ ID NO: 163909 - DNA, 20 bp, Artificial
  CRISPR gRNA sequence
ctcttcctctatattgtggt

SEQ ID NO: 163910 - DNA, 20 bp, Artificial
  CRISPR gRNA sequence
tcttcctctatattgtggtt

SEQ ID NO: 163911 - DNA, 20 bp, Artificial
  CRISPR gRNA sequence
ttcctctatattgtggttca

SEQ ID NO: 163912 - DNA, 20 bp, Artificial
  CRISPR gRNA sequence
cctctatattgtggttcatt

SEQ ID NO: 163913 - DNA, 20 bp, Artificial
  CRISPR gRNA sequence
ctctatattgtggttcatta

SEQ ID NO: 163914 - DNA, 20 bp, Artificial
  CRISPR gRNA sequence
tatattgtggttcattatat

SEQ ID NO: 163915 - DNA, 20 bp, Artificial
  CRISPR gRNA sequence
tattgtggttcattatatct

SEQ ID NO: 163916 - DNA, 20 bp, Artificial
  CRISPR gRNA sequence
tggttcattatatctttata

SEQ ID NO: 163917 - DNA, 20 bp, Artificial
  CRISPR gRNA sequence
attatatctttatatagtac

SEQ ID NO: 163918 - DNA, 20 bp, Artificial
  CRISPR gRNA sequence
tatctttatatagtaccctg

SEQ ID NO: 163919 - DNA, 20 bp, Artificial
  CRISPR gRNA sequence
tatatagtaccctgactgca

SEQ ID NO: 163920 - DNA, 20 bp, Artificial
  CRISPR gRNA sequence
atatagtaccctgactgcac

SEQ ID NO: 163921 - DNA, 20 bp, Artificial
  CRISPR gRNA sequence
tatagtaccctgactgcaca

SEQ ID NO: 163922 - DNA, 20 bp, Artificial
  CRISPR gRNA sequence
actgcacactagaatcacct

SEQ ID NO: 163923 - DNA, 20 bp, Artificial
  CRISPR gRNA sequence
cacactagaatcacctgttg

SEQ ID NO: 163924 - DNA, 20 bp, Artificial
  CRISPR gRNA sequence
gaatcacctgttggggtttt

SEQ ID NO: 163925 - DNA, 20 bp, Artificial
  CRISPR gRNA sequence
ttggggttttaaaaatatca

SEQ ID NO: 163926 - DNA, 20 bp, Artificial
  CRISPR gRNA sequence
gggttttaaaaatatcagcg

SEQ ID NO: 163927 - DNA, 20 bp, Artificial
  CRISPR gRNA sequence
taaaaatatcagcgcccagg

SEQ ID NO: 163928 - DNA, 20 bp, Artificial
  CRISPR gRNA sequence
aaaaatatcagcgcccaggc

SEQ ID NO: 163929 - DNA, 20 bp, Artificial
  CRISPR gRNA sequence
aaaatatcagcgcccaggct

SEQ ID NO: 163930 - DNA, 20 bp, Artificial
  CRISPR gRNA sequence
taacccacatcagctgaatc

SEQ ID NO: 163931 - DNA, 20 bp, Artificial
  CRISPR gRNA sequence
acccacatcagctgaatcag

SEQ ID NO: 163932 - DNA, 20 bp, Artificial
  CRISPR gRNA sequence
aatcagaatctcatgatgga

SEQ ID NO: 163933 - DNA, 20 bp, Artificial
  CRISPR gRNA sequence
atgatggagcccaggcatca

SEQ ID NO: 163934 - DNA, 20 bp, Artificial
  CRISPR gRNA sequence
ttaaaactccctggatgctt

SEQ ID NO: 163935 - DNA, 20 bp, Artificial
  CRISPR gRNA sequence
taaaactccctggatgcttt

SEQ ID NO: 163936 - DNA, 20 bp, Artificial
  CRISPR gRNA sequence
aaaactccctggatgctttt

SEQ ID NO: 163937 - DNA, 20 bp, Artificial
  CRISPR gRNA sequence
aaactccctggatgctttta

SEQ ID NO: 163938 - DNA, 20 bp, Artificial
  CRISPR gRNA sequence
cctggatgcttttaatgtgc

SEQ ID NO: 163939 - DNA, 20 bp, Artificial
  CRISPR gRNA sequence
gatgcttttaatgtgcagtc

SEQ ID NO: 163940 - DNA, 20 bp, Artificial
  CRISPR gRNA sequence
ttaatgtgcagtcagatttg

SEQ ID NO: 163941 - DNA, 20 bp, Artificial
  CRISPR gRNA sequence
taatgtgcagtcagatttga

SEQ ID NO: 163942 - DNA, 20 bp, Artificial
  CRISPR gRNA sequence
aatgtgcagtcagatttgag

SEQ ID NO: 163943 - DNA, 20 bp, Artificial
  CRISPR gRNA sequence
atgtgcagtcagatttgaga

SEQ ID NO: 163944 - DNA, 20 bp, Artificial
  CRISPR gRNA sequence
gagaaccaccacttgagctg

SEQ ID NO: 163945 - DNA, 20 bp, Artificial
  CRISPR gRNA sequence
agaaccaccacttgagctgt

SEQ ID NO: 163946 - DNA, 20 bp, Artificial
  CRISPR gRNA sequence
gagctgttttgcaagcaatc

SEQ ID NO: 163947 - DNA, 20 bp, Artificial
  CRISPR gRNA sequence
agctgttttgcaagcaatca

SEQ ID NO: 163948 - DNA, 20 bp, Artificial
  CRISPR gRNA sequence
ttttgcaagcaatcacaaga

SEQ ID NO: 163949 - DNA, 20 bp, Artificial
  CRISPR gRNA sequence
tgcaagcaatcacaagaaag

SEQ ID NO: 163950 - DNA, 20 bp, Artificial
  CRISPR gRNA sequence
gcaagcaatcacaagaaaga

SEQ ID NO: 163951 - DNA, 20 bp, Artificial
  CRISPR gRNA sequence
caagcaatcacaagaaagaa

SEQ ID NO: 163952 - DNA, 20 bp, Artificial
  CRISPR gRNA sequence
ccttcccgtctcttctgcct

SEQ ID NO: 163953 - DNA, 20 bp, Artificial
  CRISPR gRNA sequence
cccgtctcttctgcctgccc

SEQ ID NO: 163954 - DNA, 20 bp, Artificial
  CRISPR gRNA sequence
ccgtctcttctgcctgcccc

SEQ ID NO: 163955 - DNA, 20 bp, Artificial
  CRISPR gRNA sequence
ttctgcctgcccctctccaa

SEQ ID NO: 163956 - DNA, 20 bp, Artificial
  CRISPR gRNA sequence
ctgcctgcccctctccaaag

SEQ ID NO: 163957 - DNA, 20 bp, Artificial
  CRISPR gRNA sequence
tgcctgcccctctccaaagg

SEQ ID NO: 163958 - DNA, 20 bp, Artificial
  CRISPR gRNA sequence
cctgcccctctccaaaggtc

SEQ ID NO: 163959 - DNA, 20 bp, Artificial
  CRISPR gRNA sequence
cccctctccaaaggtcacac

SEQ ID NO: 163960 - DNA, 20 bp, Artificial
  CRISPR gRNA sequence
tccaaaggtcacactagttg

SEQ ID NO: 163961 - DNA, 20 bp, Artificial
  CRISPR gRNA sequence
caaaggtcacactagttgtt

SEQ ID NO: 163962 - DNA, 20 bp, Artificial
  CRISPR gRNA sequence
gttgttttttcagcaccttg

SEQ ID NO: 163963 - DNA, 20 bp, Artificial
  CRISPR gRNA sequence
ttttttcagcaccttgggtg

SEQ ID NO: 163964 - DNA, 20 bp, Artificial
  CRISPR gRNA sequence
tttcagcaccttgggtgcat

SEQ ID NO: 163965 - DNA, 20 bp, Artificial
  CRISPR gRNA sequence
ttcagcaccttgggtgcata

SEQ ID NO: 163966 - DNA, 20 bp, Artificial
  CRISPR gRNA sequence
tcagcaccttgggtgcatat

SEQ ID NO: 163967 - DNA, 20 bp, Artificial
  CRISPR gRNA sequence
cagcaccttgggtgcatata

SEQ ID NO: 163968 - DNA, 20 bp, Artificial
  CRISPR gRNA sequence
agcaccttgggtgcatatag

SEQ ID NO: 163969 - DNA, 20 bp, Artificial
  CRISPR gRNA sequence
gggtgcatatagctcttaat

SEQ ID NO: 163970 - DNA, 20 bp, Artificial
  CRISPR gRNA sequence
ggtgcatatagctcttaatt

SEQ ID NO: 163971 - DNA, 20 bp, Artificial
  CRISPR gRNA sequence
ttaattgtgattgtaataga

SEQ ID NO: 163972 - DNA, 20 bp, Artificial
  CRISPR gRNA sequence
aattgtgattgtaatagacc

SEQ ID NO: 163973 - DNA, 20 bp, Artificial
  CRISPR gRNA sequence
attgtgattgtaatagacct

SEQ ID NO: 163974 - DNA, 20 bp, Artificial
  CRISPR gRNA sequence
tgattgtaatagacctctgt

SEQ ID NO: 163975 - DNA, 20 bp, Artificial
  CRISPR gRNA sequence
taatagacctctgtccttta

SEQ ID NO: 163976 - DNA, 20 bp, Artificial
  CRISPR gRNA sequence
tgtcctttagagctcattgt

SEQ ID NO: 163977 - DNA, 20 bp, Artificial
  CRISPR gRNA sequence
tcctttagagctcattgttt

SEQ ID NO: 163978 - DNA, 20 bp, Artificial
  CRISPR gRNA sequence
tagagctcattgttttaagc

SEQ ID NO: 163979 - DNA, 20 bp, Artificial
  CRISPR gRNA sequence
agagctcattgttttaagca

SEQ ID NO: 163980 - DNA, 20 bp, Artificial
  CRISPR gRNA sequence
gagctcattgttttaagcat

SEQ ID NO: 163981 - DNA, 20 bp, Artificial
  CRISPR gRNA sequence
attgttttaagcatgcagat

SEQ ID NO: 163982 - DNA, 20 bp, Artificial
  CRISPR gRNA sequence
ttttaagcatgcagattgca

SEQ ID NO: 163983 - DNA, 20 bp, Artificial
  CRISPR gRNA sequence
taagcatgcagattgcatga

SEQ ID NO: 163984 - DNA, 20 bp, Artificial
  CRISPR gRNA sequence
aagcatgcagattgcatgat

SEQ ID NO: 163985 - DNA, 20 bp, Artificial
  CRISPR gRNA sequence
agcatgcagattgcatgatt

SEQ ID NO: 163986 - DNA, 20 bp, Artificial
  CRISPR gRNA sequence
catgattcactaggtgccac

SEQ ID NO: 163987 - DNA, 20 bp, Artificial
  CRISPR gRNA sequence
actaggtgccacttgggaaa

SEQ ID NO: 163988 - DNA, 20 bp, Artificial
  CRISPR gRNA sequence
ggtgccacttgggaaattgt

SEQ ID NO: 163989 - DNA, 20 bp, Artificial
  CRISPR gRNA sequence
gggaaattgtggcagaatct

SEQ ID NO: 163990 - DNA, 20 bp, Artificial
  CRISPR gRNA sequence
ggaaattgtggcagaatctc

SEQ ID NO: 163991 - DNA, 20 bp, Artificial
  CRISPR gRNA sequence
tggcagaatctcacaggagc

SEQ ID NO: 163992 - DNA, 20 bp, Artificial
  CRISPR gRNA sequence
acaggagcaaagctgtgcct

SEQ ID NO: 163993 - DNA, 20 bp, Artificial
  CRISPR gRNA sequence
tgccttgttctgcttgcttt

SEQ ID NO: 163994 - DNA, 20 bp, Artificial
  CRISPR gRNA sequence
gttctgcttgctttgttata

SEQ ID NO: 163995 - DNA, 20 bp, Artificial
  CRISPR gRNA sequence
ttctgcttgctttgttatat

SEQ ID NO: 163996 - DNA, 20 bp, Artificial
  CRISPR gRNA sequence
tgcttgctttgttatataaa

SEQ ID NO: 163997 - DNA, 20 bp, Artificial
  CRISPR gRNA sequence
cttgctttgttatataaaac

SEQ ID NO: 163998 - DNA, 20 bp, Artificial
  CRISPR gRNA sequence
gctttgttatataaaacttt

SEQ ID NO: 163999 - DNA, 20 bp, Artificial
  CRISPR gRNA sequence
ctttgttatataaaacttta

SEQ ID NO: 164000 - DNA, 20 bp, Artificial
  CRISPR gRNA sequence
tgttatataaaactttattt

SEQ ID NO: 164001 - DNA, 20 bp, Artificial
  CRISPR gRNA sequence
gttatataaaactttatttt

SEQ ID NO: 164002 - DNA, 20 bp, Artificial
  CRISPR gRNA sequence
ttatataaaactttattttt

SEQ ID NO: 164003 - DNA, 20 bp, Artificial
  CRISPR gRNA sequence
tataaaactttatttttaat

SEQ ID NO: 164004 - DNA, 20 bp, Artificial
  CRISPR gRNA sequence
tatttttaatgaattatttc

SEQ ID NO: 164005 - DNA, 20 bp, Artificial
  CRISPR gRNA sequence
atttttaatgaattatttca

SEQ ID NO: 164006 - DNA, 20 bp, Artificial
  CRISPR gRNA sequence
tttttaatgaattatttcat

SEQ ID NO: 164007 - DNA, 20 bp, Artificial
  CRISPR gRNA sequence
ttaatgaattatttcatagt

SEQ ID NO: 164008 - DNA, 20 bp, Artificial
  CRISPR gRNA sequence
taatgaattatttcatagta

SEQ ID NO: 164009 - DNA, 20 bp, Artificial
  CRISPR gRNA sequence
aatgaattatttcatagtat

SEQ ID NO: 164010 - DNA, 20 bp, Artificial
  CRISPR gRNA sequence
atgaattatttcatagtata

SEQ ID NO: 164011 - DNA, 20 bp, Artificial
  CRISPR gRNA sequence
tttcatagtatattatcctt

SEQ ID NO: 164012 - DNA, 20 bp, Artificial
  CRISPR gRNA sequence
catagtatattatccttaga

SEQ ID NO: 164013 - DNA, 20 bp, Artificial
  CRISPR gRNA sequence
atagtatattatccttagaa

SEQ ID NO: 164014 - DNA, 20 bp, Artificial
  CRISPR gRNA sequence
tccttagaagcagtcattca

SEQ ID NO: 164015 - DNA, 20 bp, Artificial
  CRISPR gRNA sequence
agaagcagtcattcagtgac

SEQ ID NO: 164016 - DNA, 20 bp, Artificial
  CRISPR gRNA sequence
gaagcagtcattcagtgaca

SEQ ID NO: 164017 - DNA, 20 bp, Artificial
  CRISPR gRNA sequence
agtgacagccattctcccca

SEQ ID NO: 164018 - DNA, 20 bp, Artificial
  CRISPR gRNA sequence
tccccatcccagcctgtatt

SEQ ID NO: 164019 - DNA, 20 bp, Artificial
  CRISPR gRNA sequence
cccatcccagcctgtattaa

SEQ ID NO: 164020 - DNA, 20 bp, Artificial
  CRISPR gRNA sequence
tattaataaccagtcagaga

SEQ ID NO: 164021 - DNA, 20 bp, Artificial
  CRISPR gRNA sequence
ataaccagtcagagaaagtc

SEQ ID NO: 164022 - DNA, 20 bp, Artificial
  CRISPR gRNA sequence
ggagaagtgggcatcctaat

SEQ ID NO: 164023 - DNA, 20 bp, Artificial
  CRISPR gRNA sequence
atgaacatttgtaattctga

SEQ ID NO: 164024 - DNA, 20 bp, Artificial
  CRISPR gRNA sequence
gtaattctgaccctgcatga

SEQ ID NO: 164025 - DNA, 20 bp, Artificial
  CRISPR gRNA sequence
taattctgaccctgcatgag

SEQ ID NO: 164026 - DNA, 20 bp, Artificial
  CRISPR gRNA sequence
tgaccctgcatgagggcctt

SEQ ID NO: 164027 - DNA, 20 bp, Artificial
  CRISPR gRNA sequence
accctgcatgagggcctttg

SEQ ID NO: 164028 - DNA, 20 bp, Artificial
  CRISPR gRNA sequence
catgagggcctttggattag

SEQ ID NO: 164029 - DNA, 20 bp, Artificial
  CRISPR gRNA sequence
tggattagcaagccctctgt

SEQ ID NO: 164030 - DNA, 20 bp, Artificial
  CRISPR gRNA sequence
ggattagcaagccctctgtc

SEQ ID NO: 164031 - DNA, 20 bp, Artificial
  CRISPR gRNA sequence
gattagcaagccctctgtca

SEQ ID NO: 164032 - DNA, 20 bp, Artificial
  CRISPR gRNA sequence
gcaagccctctgtcacctcc

SEQ ID NO: 164033 - DNA, 20 bp, Artificial
  CRISPR gRNA sequence
tgtcacctccttactagagt

SEQ ID NO: 164034 - DNA, 20 bp, Artificial
  CRISPR gRNA sequence
tcacctccttactagagtag

SEQ ID NO: 164035 - DNA, 20 bp, Artificial
  CRISPR gRNA sequence
cttactagagtagggtgtgc

SEQ ID NO: 164036 - DNA, 20 bp, Artificial
  CRISPR gRNA sequence
actagagtagggtgtgcctc

SEQ ID NO: 164037 - DNA, 20 bp, Artificial
  CRISPR gRNA sequence
ctagagtagggtgtgcctca

SEQ ID NO: 164038 - DNA, 20 bp, Artificial
  CRISPR gRNA sequence
gagtagggtgtgcctcactg

SEQ ID NO: 164039 - DNA, 20 bp, Artificial
  CRISPR gRNA sequence
actgcgtctccgttctttct

SEQ ID NO: 164040 - DNA, 20 bp, Artificial
  CRISPR gRNA sequence
cgtctccgttctttctgggc

SEQ ID NO: 164041 - DNA, 20 bp, Artificial
  CRISPR gRNA sequence
cgttctttctgggcagtctt

SEQ ID NO: 164042 - DNA, 20 bp, Artificial
  CRISPR gRNA sequence
tttctgggcagtctttgcta
